United States Patent 7,250,496 (BIOINFORMATICALLY DETECTABLE GROUP OF NOVEL REGULATORY GENES AND USES THEREOF) - sequence listing, part 28

SEQ ID NO: 1195129 - RNA, 21 nt, Human
ugacucucaaacaaaggccag

SEQ ID NO: 1195130 - RNA, 20 nt, Human
ugaggcaggcacccaggauu

SEQ ID NO: 1195131 - RNA, 26 nt, Human
ugaugccaggaaauaucuuggagaag

SEQ ID NO: 1195132 - RNA, 18 nt, Human
uggaagcucagggaaaac

SEQ ID NO: 1195133 - RNA, 20 nt, Human
uggccaaaccauccaugggc

SEQ ID NO: 1195134 - RNA, 23 nt, Human
uggcugacucucaaacaaaggcu

SEQ ID NO: 1195135 - RNA, 20 nt, Human
ugggcaaagagcccaugagg

SEQ ID NO: 1195136 - RNA, 26 nt, Human
ugucaugagucuucagaagcuugaga

SEQ ID NO: 1195137 - RNA, 20 nt, Human
uguggcaaaguggccaaacc

SEQ ID NO: 1195138 - RNA, 24 nt, Human
uguuguagaccaaauugaccaacg

SEQ ID NO: 1195139 - RNA, 18 nt, Human
uguuuuccucaaugcugg

SEQ ID NO: 1195140 - RNA, 25 nt, Human
aaaaagaacaucuuuuacuaacaga

SEQ ID NO: 1195141 - RNA, 18 nt, Human
aaacacaguuucaggauc

SEQ ID NO: 1195142 - RNA, 21 nt, Human
aaacacaguuucaggaucuac

SEQ ID NO: 1195143 - RNA, 28 nt, Human
aacacaguuucaggaucuacagccaccu

SEQ ID NO: 1195144 - RNA, 18 nt, Human
aggagacuucagcaauau

SEQ ID NO: 1195145 - RNA, 18 nt, Human
auccuuuucucuccucaa

SEQ ID NO: 1195146 - RNA, 22 nt, Human
ccucuggaaggccaguugauuc

SEQ ID NO: 1195147 - RNA, 24 nt, Human
cgguaacauaugccaggagacuuc

SEQ ID NO: 1195148 - RNA, 20 nt, Human
cuuagccucuggaaggccag

SEQ ID NO: 1195149 - RNA, 21 nt, Human
gggaaaaagaacaucuuuuac

SEQ ID NO: 1195150 - RNA, 20 nt, Human
uacaucagugugagcugcug

SEQ ID NO: 1195151 - RNA, 19 nt, Human
ugggaaaaagaacaucuuu

SEQ ID NO: 1195152 - RNA, 19 nt, Human
ugggaauacaaaauaacca

SEQ ID NO: 1195153 - RNA, 25 nt, Human
aaaaagaacaucuuuuacuaacaga

SEQ ID NO: 1195154 - RNA, 18 nt, Human
agccagccacagcgugcc

SEQ ID NO: 1195155 - RNA, 18 nt, Human
aggagacuucagcaauau

SEQ ID NO: 1195156 - RNA, 21 nt, Human
agggggaugggaggaagggaa

SEQ ID NO: 1195157 - RNA, 18 nt, Human
auccuuuucucuccucaa

SEQ ID NO: 1195158 - RNA, 18 nt, Human
cacaaaauggcagugaag

SEQ ID NO: 1195159 - RNA, 19 nt, Human
caccugggagugaugugca

SEQ ID NO: 1195160 - RNA, 22 nt, Human
ccucuggaaggcuauuugauuc

SEQ ID NO: 1195161 - RNA, 20 nt, Human
ccuugcuggaggagagacgg

SEQ ID NO: 1195162 - RNA, 22 nt, Human
cggcggcaccucacaaaauggc

SEQ ID NO: 1195163 - RNA, 21 nt, Human
cucacaaaauggcagugaagu

SEQ ID NO: 1195164 - RNA, 23 nt, Human
cuuucuagaaaccugcccucugg

SEQ ID NO: 1195165 - RNA, 21 nt, Human
gggaaaaagaacaucuuuuac

SEQ ID NO: 1195166 - RNA, 18 nt, Human
ggggaugggaggaaggga

SEQ ID NO: 1195167 - RNA, 21 nt, Human
uaacauaugccaggagacuuc

SEQ ID NO: 1195168 - RNA, 22 nt, Human
ucccguuuggcccaagggggau

SEQ ID NO: 1195169 - RNA, 19 nt, Human
ucuagaaaccugcccucug

SEQ ID NO: 1195170 - RNA, 19 nt, Human
ugaaguuguggcgccuccc

SEQ ID NO: 1195171 - RNA, 22 nt, Human
uggcagugaaguuguggcgccu

SEQ ID NO: 1195172 - RNA, 19 nt, Human
ugggaaaaagaacaucuuu

SEQ ID NO: 1195173 - RNA, 19 nt, Human
ugggaauacaaaauaacca

SEQ ID NO: 1195174 - RNA, 18 nt, Human
aaauacaccucucucaca

SEQ ID NO: 1195175 - RNA, 20 nt, Human
aagacuggggaggggugugg

SEQ ID NO: 1195176 - RNA, 20 nt, Human
aaggcgccguacgagccucg

SEQ ID NO: 1195177 - RNA, 21 nt, Human
aaguuccagggccagaggugc

SEQ ID NO: 1195178 - RNA, 21 nt, Human
accccugggccccucucuccc

SEQ ID NO: 1195179 - RNA, 20 nt, Human
accgcagccggggccagggc

SEQ ID NO: 1195180 - RNA, 22 nt, Human
acgcugccucugcccaggcaag

SEQ ID NO: 1195181 - RNA, 19 nt, Human
agcccgauggcaggggccc

SEQ ID NO: 1195182 - RNA, 22 nt, Human
agccgccccgccuccgcccccc

SEQ ID NO: 1195183 - RNA, 23 nt, Human
aggcaacaggucggccgagccca

SEQ ID NO: 1195184 - RNA, 18 nt, Human
aggcaaguuccagggcca

SEQ ID NO: 1195185 - RNA, 24 nt, Human
aggcccuucacgcugccucugccc

SEQ ID NO: 1195186 - RNA, 18 nt, Human
agggccgccgcagccgcc

SEQ ID NO: 1195187 - RNA, 24 nt, Human
augucaagggcaaauccaccccuc

SEQ ID NO: 1195188 - RNA, 24 nt, Human
caaauccaccccucccugaagccu

SEQ ID NO: 1195189 - RNA, 19 nt, Human
cacgcugccucugcccagg

SEQ ID NO: 1195190 - RNA, 22 nt, Human
cacugggcacccccaccccugu

SEQ ID NO: 1195191 - RNA, 22 nt, Human
cacuucccccucccuccuccca

SEQ ID NO: 1195192 - RNA, 21 nt, Human
cagacagagccgccgacgccu

SEQ ID NO: 1195193 - RNA, 22 nt, Human
cagccgcaccgccaggccagac

SEQ ID NO: 1195194 - RNA, 23 nt, Human
cagccggggccagggcugggccg

SEQ ID NO: 1195195 - RNA, 22 nt, Human
cagcugagcgcgacagccgcac

SEQ ID NO: 1195196 - RNA, 18 nt, Human
caggccccgccgaccgac

SEQ ID NO: 1195197 - RNA, 19 nt, Human
ccacuucccccucccuccu

SEQ ID NO: 1195198 - RNA, 22 nt, Human
ccagacagggccgccgcagccg

SEQ ID NO: 1195199 - RNA, 26 nt, Human
ccagagccgcggccgccccgcccccg

SEQ ID NO: 1195200 - RNA, 18 nt, Human
ccaggccagacagggccg

SEQ ID NO: 1195201 - RNA, 22 nt, Human
cccaagccaggacucgaucacu

SEQ ID NO: 1195202 - RNA, 20 nt, Human
cccaaggccgagcggggcuc

SEQ ID NO: 1195203 - RNA, 22 nt, Human
ccccaggagcccuaugcucccc

SEQ ID NO: 1195204 - RNA, 25 nt, Human
ccccaggagcccuaugcuccccucu

SEQ ID NO: 1195205 - RNA, 27 nt, Human
cccccgggcugagaccgcagccggggc

SEQ ID NO: 1195206 - RNA, 18 nt, Human
ccccgcgcaggccccgcc

SEQ ID NO: 1195207 - RNA, 22 nt, Human
ccccgcgcaggccccgccgacc

SEQ ID NO: 1195208 - RNA, 19 nt, Human
ccccucccuccucccacca

SEQ ID NO: 1195209 - RNA, 21 nt, Human
ccccucucucccuuggugccc

SEQ ID NO: 1195210 - RNA, 22 nt, Human
cccgcgcaggccccgccgaccg

SEQ ID NO: 1195211 - RNA, 21 nt, Human
cccgggcugagaccgcagccg

SEQ ID NO: 1195212 - RNA, 20 nt, Human
cccucuccacuucccccucc

SEQ ID NO: 1195213 - RNA, 18 nt, Human
ccgcaccgccaggccaga

SEQ ID NO: 1195214 - RNA, 20 nt, Human
ccgcagccggggccagggcu

SEQ ID NO: 1195215 - RNA, 18 nt, Human
ccgccccgccuccgcccc

SEQ ID NO: 1195216 - RNA, 19 nt, Human
ccgccgccgccgccggcgc

SEQ ID NO: 1195217 - RNA, 20 nt, Human
ccgccgcggcccagcuuucc

SEQ ID NO: 1195218 - RNA, 22 nt, Human
ccgccgcggcccagcuuuccuu

SEQ ID NO: 1195219 - RNA, 21 nt, Human
ccucuacuaggaaggcccuuc

SEQ ID NO: 1195220 - RNA, 20 nt, Human
cgacugacccgcucgagcgc

SEQ ID NO: 1195221 - RNA, 23 nt, Human
cgcagcugagcgcgacagccgca

SEQ ID NO: 1195222 - RNA, 21 nt, Human
cgcccagagccgcggccgccc

SEQ ID NO: 1195223 - RNA, 21 nt, Human
cgccuccgccccccgccgcgg

SEQ ID NO: 1195224 - RNA, 24 nt, Human
cgccuccgccccccgccgcggccc

SEQ ID NO: 1195225 - RNA, 22 nt, Human
cggcgcucacucgauccgcacc

SEQ ID NO: 1195226 - RNA, 22 nt, Human
cuaucugcaugucaagggcaaa

SEQ ID NO: 1195227 - RNA, 28 nt, Human
cucacagugcugcuagcagauuucaguu

SEQ ID NO: 1195228 - RNA, 19 nt, Human
cucagaccuuccuucccaa

SEQ ID NO: 1195229 - RNA, 18 nt, Human
cuccgggccuggaaaguc

SEQ ID NO: 1195230 - RNA, 21 nt, Human
cuccuaucugcaugucaaggg

SEQ ID NO: 1195231 - RNA, 21 nt, Human
cugagaccgcagccggggcca

SEQ ID NO: 1195232 - RNA, 19 nt, Human
cuggggagggguguggggg

SEQ ID NO: 1195233 - RNA, 19 nt, Human
cuucccccucccuccuccc

SEQ ID NO: 1195234 - RNA, 20 nt, Human
cuucccccucccuccuccca

SEQ ID NO: 1195235 - RNA, 19 nt, Human
cuucccggcuccccucugg

SEQ ID NO: 1195236 - RNA, 22 nt, Human
cuucugguuucccccucuuugg

SEQ ID NO: 1195237 - RNA, 25 nt, Human
gaagacuggggaggggugugggggc

SEQ ID NO: 1195238 - RNA, 27 nt, Human
gaaggugagcagcgugcgcgugagccc

SEQ ID NO: 1195239 - RNA, 19 nt, Human
gagccgccccgccuccgcc

SEQ ID NO: 1195240 - RNA, 18 nt, Human
gcaacaggucggccgagc

SEQ ID NO: 1195241 - RNA, 18 nt, Human
gccagaggugccccuggg

SEQ ID NO: 1195242 - RNA, 21 nt, Human
gcccagagccgcggccgcccc

SEQ ID NO: 1195243 - RNA, 24 nt, Human
gccccaggagcccuaugcuccccu

SEQ ID NO: 1195244 - RNA, 18 nt, Human
gccccgccuccgcccccc

SEQ ID NO: 1195245 - RNA, 21 nt, Human
gcccgggccccgcgcaggccc

SEQ ID NO: 1195246 - RNA, 28 nt, Human
gccgggccuucgccgccgccgccgccgg

SEQ ID NO: 1195247 - RNA, 24 nt, Human
gccucaguuuccucugucauuagg

SEQ ID NO: 1195248 - RNA, 20 nt, Human
gccuggaaagucaagucgcc

SEQ ID NO: 1195249 - RNA, 22 nt, Human
gcgacagccgcaccgccaggcc

SEQ ID NO: 1195250 - RNA, 20 nt, Human
gcgauccagggcccccgggc

SEQ ID NO: 1195251 - RNA, 19 nt, Human
gcucaggcggccgcugccu

SEQ ID NO: 1195252 - RNA, 23 nt, Human
ggccagacagggccgccgcagcc

SEQ ID NO: 1195253 - RNA, 19 nt, Human
ggccugcaggcccaggggc

SEQ ID NO: 1195254 - RNA, 22 nt, Human
gggcacccccaccccugugagg

SEQ ID NO: 1195255 - RNA, 19 nt, Human
gggcugggccgucgugccc

SEQ ID NO: 1195256 - RNA, 20 nt, Human
ggggcgggcggggacacggg

SEQ ID NO: 1195257 - RNA, 19 nt, Human
gucccuucccggcuccccu

SEQ ID NO: 1195258 - RNA, 22 nt, Human
guuccagggccagaggugcccc

SEQ ID NO: 1195259 - RNA, 19 nt, Human
uagaaguaggggaaguuca

SEQ ID NO: 1195260 - RNA, 20 nt, Human
ucacugggcacccccacccc

SEQ ID NO: 1195261 - RNA, 19 nt, Human
ucagccgggccuucgccgc

SEQ ID NO: 1195262 - RNA, 23 nt, Human
uccacuucccccucccuccuccc

SEQ ID NO: 1195263 - RNA, 19 nt, Human
ucccaccaugccaggucuu

SEQ ID NO: 1195264 - RNA, 20 nt, Human
ucccagggaacucagaccuu

SEQ ID NO: 1195265 - RNA, 21 nt, Human
ucccagggaacucagaccuuc

SEQ ID NO: 1195266 - RNA, 23 nt, Human
ucccuaccccugggccccucucu

SEQ ID NO: 1195267 - RNA, 19 nt, Human
uccuagauucccuaccccu

SEQ ID NO: 1195268 - RNA, 20 nt, Human
ucgccgccgccgccgccggg

SEQ ID NO: 1195269 - RNA, 21 nt, Human
ucucacagugcugcuagcaga

SEQ ID NO: 1195270 - RNA, 22 nt, Human
ucuccacuucccccucccuccu

SEQ ID NO: 1195271 - RNA, 20 nt, Human
ugaagccucaguuuccucug

SEQ ID NO: 1195272 - RNA, 18 nt, Human
ugacccgcucgagcgcga

SEQ ID NO: 1195273 - RNA, 21 nt, Human
ugagccuuuguccaugcugug

SEQ ID NO: 1195274 - RNA, 22 nt, Human
ugcagacagagccgccgacgcc

SEQ ID NO: 1195275 - RNA, 19 nt, Human
ugccaaugccuuucugcuc

SEQ ID NO: 1195276 - RNA, 22 nt, Human
ugccaaugccuuucugcuccgg

SEQ ID NO: 1195277 - RNA, 25 nt, Human
ugccucggccccaccuccacgaucc

SEQ ID NO: 1195278 - RNA, 21 nt, Human
uggcaaggccagagaaggggc

SEQ ID NO: 1195279 - RNA, 26 nt, Human
ugggcacccccaccccugugagccuu

SEQ ID NO: 1195280 - RNA, 21 nt, Human
uggggaggggugugggggccu

SEQ ID NO: 1195281 - RNA, 19 nt, Human
ugucaagggcaaauccacc

SEQ ID NO: 1195282 - RNA, 21 nt, Human
agagggaccuuauucaggcuu

SEQ ID NO: 1195283 - RNA, 19 nt, Human
agauggcuucaggaagaca

SEQ ID NO: 1195284 - RNA, 19 nt, Human
aggaagacagcacagaaga

SEQ ID NO: 1195285 - RNA, 23 nt, Human
cagaagagggaccuuauucaggc

SEQ ID NO: 1195286 - RNA, 22 nt, Human
cagaaggaagccaggcauggug

SEQ ID NO: 1195287 - RNA, 20 nt, Human
caggaagacagcacagaaga

SEQ ID NO: 1195288 - RNA, 23 nt, Human
cuccacagauggcuucaggaaga

SEQ ID NO: 1195289 - RNA, 18 nt, Human
cuuggugcugaaccaauc

SEQ ID NO: 1195290 - RNA, 21 nt, Human
ucaggcuugaaccagaaggaa

SEQ ID NO: 1195291 - RNA, 18 nt, Human
aaaaagcuccugagagaa

SEQ ID NO: 1195292 - RNA, 20 nt, Human
aaaaaucuucugugcugcaa

SEQ ID NO: 1195293 - RNA, 24 nt, Human
aaaguguugggauuacagguguga

SEQ ID NO: 1195294 - RNA, 18 nt, Human
aaccauagcagaaaaacc

SEQ ID NO: 1195295 - RNA, 22 nt, Human
aaccauagcagaaaaaccucag

SEQ ID NO: 1195296 - RNA, 25 nt, Human
aagaagccaaaguacuacuaaggca

SEQ ID NO: 1195297 - RNA, 19 nt, Human
aaggacacagaaaaaagua

SEQ ID NO: 1195298 - RNA, 27 nt, Human
aaggacacagaaaaaaguuggagaccc

SEQ ID NO: 1195299 - RNA, 19 nt, Human
aaggcacuacuaccaucag

SEQ ID NO: 1195300 - RNA, 21 nt, Human
aaguguugggauuacaggugu

SEQ ID NO: 1195301 - RNA, 26 nt, Human
aaguguugggauuacaggugugagcc

SEQ ID NO: 1195302 - RNA, 19 nt, Human
acaggguuucacuaugcug

SEQ ID NO: 1195303 - RNA, 20 nt, Human
acaggguuucacuaugcugg

SEQ ID NO: 1195304 - RNA, 24 nt, Human
acaggguuucacuaugcuggccag

SEQ ID NO: 1195305 - RNA, 24 nt, Human
acuaugcuggccaggcuggucuug

SEQ ID NO: 1195306 - RNA, 22 nt, Human
agaguacugaauacaaggugca

SEQ ID NO: 1195307 - RNA, 20 nt, Human
agcagaaaaaccucaguuga

SEQ ID NO: 1195308 - RNA, 19 nt, Human
agugaagacaggguuucac

SEQ ID NO: 1195309 - RNA, 19 nt, Human
auagagaccuaaguguuuc

SEQ ID NO: 1195310 - RNA, 24 nt, Human
auguugcaguauucccuugggaac

SEQ ID NO: 1195311 - RNA, 24 nt, Human
caaaguguugggauuacaggugug

SEQ ID NO: 1195312 - RNA, 28 nt, Human
caagcaaaaggcacuacuaaucaacggg

SEQ ID NO: 1195313 - RNA, 19 nt, Human
caccgcauacagucaaagg

SEQ ID NO: 1195314 - RNA, 21 nt, Human
cacuaugcuggccaggcuggu

SEQ ID NO: 1195315 - RNA, 24 nt, Human
cacuaugcuggccaggcuggucuu

SEQ ID NO: 1195316 - RNA, 23 nt, Human
cacuccaaggacacagaaaaaag

SEQ ID NO: 1195317 - RNA, 24 nt, Human
caggguuucacuaugcuggccagg

SEQ ID NO: 1195318 - RNA, 19 nt, Human
cagguaaaugguucagaac

SEQ ID NO: 1195319 - RNA, 18 nt, Human
caucacagagcucuuuug

SEQ ID NO: 1195320 - RNA, 21 nt, Human
ccaaaguguugggauuacagg

SEQ ID NO: 1195321 - RNA, 21 nt, Human
ccaaaguguugggauuacagg

SEQ ID NO: 1195322 - RNA, 24 nt, Human
ccaaaguguugggauuacaggugu

SEQ ID NO: 1195323 - RNA, 23 nt, Human
ccacaauuaagcaauucugauuu

SEQ ID NO: 1195324 - RNA, 26 nt, Human
ccacacuccaaggacacagaaaaaag

SEQ ID NO: 1195325 - RNA, 21 nt, Human
ccacgaaucccacccacacuc

SEQ ID NO: 1195326 - RNA, 26 nt, Human
ccucaguugacaaaaaaaaaaaaaaa

SEQ ID NO: 1195327 - RNA, 22 nt, Human
cgaccucagcaucccaaagugu

SEQ ID NO: 1195328 - RNA, 24 nt, Human
cgcacuaauaccaucaagaacucc

SEQ ID NO: 1195329 - RNA, 21 nt, Human
cgccgaccucagcaucccaaa

SEQ ID NO: 1195330 - RNA, 24 nt, Human
cuaaaaacuaaguacaauaagcac

SEQ ID NO: 1195331 - RNA, 24 nt, Human
cuggucccuaucaucuugucaagg

SEQ ID NO: 1195332 - RNA, 25 nt, Human
gaacaaauguacagugcuggucccu

SEQ ID NO: 1195333 - RNA, 22 nt, Human
gaacugcugacccugugauccg

SEQ ID NO: 1195334 - RNA, 23 nt, Human
gacccugugauccgccgaccuca

SEQ ID NO: 1195335 - RNA, 24 nt, Human
gacccugugauccgccgaccucag

SEQ ID NO: 1195336 - RNA, 18 nt, Human
gaguacugaauacaaggu

SEQ ID NO: 1195337 - RNA, 18 nt, Human
gauuacaggugugagcca

SEQ ID NO: 1195338 - RNA, 21 nt, Human
gauuacaggugugagccacca

SEQ ID NO: 1195339 - RNA, 24 nt, Human
gauuacaggugugagccaccaugc

SEQ ID NO: 1195340 - RNA, 23 nt, Human
gcacuaauaccaucaagaacucc

SEQ ID NO: 1195341 - RNA, 18 nt, Human
gccaaaucauucuuuucc

SEQ ID NO: 1195342 - RNA, 23 nt, Human
gccacaauuaagcaauucugauu

SEQ ID NO: 1195343 - RNA, 22 nt, Human
gcucuuuuggcuacauguacca

SEQ ID NO: 1195344 - RNA, 24 nt, Human
ggauuacaggugugagccaccaug

SEQ ID NO: 1195345 - RNA, 23 nt, Human
gguaaacucucaucuaaaauuuu

SEQ ID NO: 1195346 - RNA, 20 nt, Human
ggucuugaacugcugacccu

SEQ ID NO: 1195347 - RNA, 26 nt, Human
gugaagacaggguuucacuaugcugg

SEQ ID NO: 1195348 - RNA, 21 nt, Human
uaauuaaguggcuacuaauau

SEQ ID NO: 1195349 - RNA, 24 nt, Human
uacaggugugagccaccaugccca

SEQ ID NO: 1195350 - RNA, 24 nt, Human
uagugaagacaggguuucacuaug

SEQ ID NO: 1195351 - RNA, 19 nt, Human
uauauaacccagucuauca

SEQ ID NO: 1195352 - RNA, 24 nt, Human
uaugcuggccaggcuggucuugaa

SEQ ID NO: 1195353 - RNA, 18 nt, Human
ucaguugacaaaaaaaaa

SEQ ID NO: 1195354 - RNA, 24 nt, Human
ucaguugacaaaaaaaaaaaaaaa

SEQ ID NO: 1195355 - RNA, 26 nt, Human
ucaguugacaaaaaaaaaaaaaaaaa

SEQ ID NO: 1195356 - RNA, 18 nt, Human
uccaaggacacagaaaaa

SEQ ID NO: 1195357 - RNA, 24 nt, Human
uccacgaaucccacccacacucca

SEQ ID NO: 1195358 - RNA, 23 nt, Human
ucccaaaguguugggauuacagg

SEQ ID NO: 1195359 - RNA, 21 nt, Human
ucccucaugcauaaaauccaa

SEQ ID NO: 1195360 - RNA, 19 nt, Human
ucugugcugcaacaugagg

SEQ ID NO: 1195361 - RNA, 19 nt, Human
ucuucugugcugcaacaug

SEQ ID NO: 1195362 - RNA, 24 nt, Human
ugaaaauaauuaaguggcuacuaa

SEQ ID NO: 1195363 - RNA, 22 nt, Human
ugaccaaagauuaccuuucuca

SEQ ID NO: 1195364 - RNA, 23 nt, Human
ugaccaaagauuaccuuucucaa

SEQ ID NO: 1195365 - RNA, 20 nt, Human
ugaccaagggcugugccugc

SEQ ID NO: 1195366 - RNA, 18 nt, Human
ugcacuggccaauccagc

SEQ ID NO: 1195367 - RNA, 18 nt, Human
ugcuggccaggcuggucu

SEQ ID NO: 1195368 - RNA, 24 nt, Human
uggccaggcuggucuugaacugcu

SEQ ID NO: 1195369 - RNA, 18 nt, Human
ugggauuacaggugugag

SEQ ID NO: 1195370 - RNA, 22 nt, Human
ugggauuacaggugugagccac

SEQ ID NO: 1195371 - RNA, 23 nt, Human
ugggauuacaggugugagccacc

SEQ ID NO: 1195372 - RNA, 24 nt, Human
ugggauuacaggugugagccacca

SEQ ID NO: 1195373 - RNA, 25 nt, Human
ugggauuacaggugugagccaccau

SEQ ID NO: 1195374 - RNA, 22 nt, Human
ugguaaacucucaucuaaaauu

SEQ ID NO: 1195375 - RNA, 22 nt, Human
uguauccacgaaucccacccac

SEQ ID NO: 1195376 - RNA, 21 nt, Human
ugucaaggcauucucaucacc

SEQ ID NO: 1195377 - RNA, 24 nt, Human
ugucaaggcauucucaucaccuuu

SEQ ID NO: 1195378 - RNA, 18 nt, Human
uuaaaauaagccaaauca

SEQ ID NO: 1195379 - RNA, 21 nt, Human
uuagugaagacaggguuucac

SEQ ID NO: 1195380 - RNA, 24 nt, Human
uuagugaagacaggguuucacuau

SEQ ID NO: 1195381 - RNA, 23 nt, Human
uucagaaccauagcagaaaaacc

SEQ ID NO: 1195382 - RNA, 21 nt, Human
uugggauuacaggugugagcc

SEQ ID NO: 1195383 - RNA, 22 nt, Human
uuucacaaauacauguauuagg

SEQ ID NO: 1195384 - RNA, 21 nt, Human
uuucacuaugcuggccaggcu

SEQ ID NO: 1195385 - RNA, 18 nt, Human
aaauuaacaagguggcuc

SEQ ID NO: 1195386 - RNA, 20 nt, Human
aacacggugaaguccccauc

SEQ ID NO: 1195387 - RNA, 21 nt, Human
aacacggugaaguccccaucu

SEQ ID NO: 1195388 - RNA, 22 nt, Human
aacacggugaaguccccaucuc

SEQ ID NO: 1195389 - RNA, 23 nt, Human
aaccucaacuuuggcuggacaug

SEQ ID NO: 1195390 - RNA, 19 nt, Human
aagcauauuaugugauaac

SEQ ID NO: 1195391 - RNA, 23 nt, Human
aagguacagaauacuucagaaag

SEQ ID NO: 1195392 - RNA, 20 nt, Human
aauugcuugaacccaggagg

SEQ ID NO: 1195393 - RNA, 24 nt, Human
aauugcuugaacccaggaggcaga

SEQ ID NO: 1195394 - RNA, 21 nt, Human
acacggugaaguccccaucuc

SEQ ID NO: 1195395 - RNA, 19 nt, Human
acagaaaagacauguuaug

SEQ ID NO: 1195396 - RNA, 22 nt, Human
acaggagaauugcuugaaccca

SEQ ID NO: 1195397 - RNA, 24 nt, Human
acccaggaggcagagguugcagug

SEQ ID NO: 1195398 - RNA, 24 nt, Human
acuugaggucaggaguucaagacc

SEQ ID NO: 1195399 - RNA, 23 nt, Human
agacaggagaauugcuugaaccc

SEQ ID NO: 1195400 - RNA, 24 nt, Human
agacaggagaauugcuugaaccca

SEQ ID NO: 1195401 - RNA, 24 nt, Human
agagguugcagugagccgagaucg

SEQ ID NO: 1195402 - RNA, 23 nt, Human
agccaggugugguggcaugcgcc

SEQ ID NO: 1195403 - RNA, 24 nt, Human
agccuggccaacacggugaagucc

SEQ ID NO: 1195404 - RNA, 19 nt, Human
aggauacuuggcacagaaa

SEQ ID NO: 1195405 - RNA, 21 nt, Human
aggcagagguugcagugagcc

SEQ ID NO: 1195406 - RNA, 24 nt, Human
aggcagagguugcagugagccgag

SEQ ID NO: 1195407 - RNA, 22 nt, Human
aggcaggcacaucacuugaggu

SEQ ID NO: 1195408 - RNA, 26 nt, Human
aggcaggcacaucacuugaggucagg

SEQ ID NO: 1195409 - RNA, 21 nt, Human
aggccgaggcaggcacaucac

SEQ ID NO: 1195410 - RNA, 24 nt, Human
aggcugagacaggagaauugcuug

SEQ ID NO: 1195411 - RNA, 24 nt, Human
aggugugguggcaugcgccuguaa

SEQ ID NO: 1195412 - RNA, 21 nt, Human
aucacuugaggucaggaguuc

SEQ ID NO: 1195413 - RNA, 23 nt, Human
aucacuugaggucaggaguucaa

SEQ ID NO: 1195414 - RNA, 24 nt, Human
aucacuugaggucaggaguucaag

SEQ ID NO: 1195415 - RNA, 26 nt, Human
caaucaguuuccuaaucuuaagguuu

SEQ ID NO: 1195416 - RNA, 24 nt, Human
cacaucacuugaggucaggaguuc

SEQ ID NO: 1195417 - RNA, 23 nt, Human
cacgccuguaaucccagcauuuu

SEQ ID NO: 1195418 - RNA, 23 nt, Human
cacuugaggucaggaguucaaga

SEQ ID NO: 1195419 - RNA, 23 nt, Human
cagaaaagacauguuauggggcg

SEQ ID NO: 1195420 - RNA, 20 nt, Human
cagaauacuucagaaaguaa

SEQ ID NO: 1195421 - RNA, 24 nt, Human
cagcauuuucggaggccgaggcag

SEQ ID NO: 1195422 - RNA, 24 nt, Human
caucacuugaggucaggaguucaa

SEQ ID NO: 1195423 - RNA, 23 nt, Human
ccuggccaacacggugaaguccc

SEQ ID NO: 1195424 - RNA, 25 nt, Human
ccuggccaacacggugaagucccca

SEQ ID NO: 1195425 - RNA, 20 nt, Human
ccuguaaucccagcuacucg

SEQ ID NO: 1195426 - RNA, 22 nt, Human
ccuguaaucccagcuacucgag

SEQ ID NO: 1195427 - RNA, 24 nt, Human
cgccuguaaucccagcauuuucgg

SEQ ID NO: 1195428 - RNA, 23 nt, Human
cgccuguaaucccagcuacucga

SEQ ID NO: 1195429 - RNA, 21 nt, Human
cucacgccuguaaucccagca

SEQ ID NO: 1195430 - RNA, 25 nt, Human
cucacgccuguaaucccagcauuuu

SEQ ID NO: 1195431 - RNA, 24 nt, Human
cuggccaacacggugaagucccca

SEQ ID NO: 1195432 - RNA, 25 nt, Human
gacacugacacuaggagaggauacu

SEQ ID NO: 1195433 - RNA, 23 nt, Human
gacaugguggcucacgccuguaa

SEQ ID NO: 1195434 - RNA, 23 nt, Human
gagaauugcuugaacccaggagg

SEQ ID NO: 1195435 - RNA, 25 nt, Human
gagaggcugagacaggagaauugcu

SEQ ID NO: 1195436 - RNA, 25 nt, Human
gaggcaggcacaucacuugagguca

SEQ ID NO: 1195437 - RNA, 25 nt, Human
gccaacacggugaaguccccaucuc

SEQ ID NO: 1195438 - RNA, 22 nt, Human
ggaggcagagguugcagugagc

SEQ ID NO: 1195439 - RNA, 21 nt, Human
ggcaugcgccuguaaucccag

SEQ ID NO: 1195440 - RNA, 21 nt, Human
ggcucacgccuguaaucccag

SEQ ID NO: 1195441 - RNA, 21 nt, Human
ggcuggacaugguggcucacg

SEQ ID NO: 1195442 - RNA, 22 nt, Human
ggugcuaaaggucuuauaaacu

SEQ ID NO: 1195443 - RNA, 24 nt, Human
gguggcaugcgccuguaaucccag

SEQ ID NO: 1195444 - RNA, 24 nt, Human
gguggcucacgccuguaaucccag

SEQ ID NO: 1195445 - RNA, 21 nt, Human
gguggcucaucuucuauagug

SEQ ID NO: 1195446 - RNA, 21 nt, Human
guugcagugagccgagaucgc

SEQ ID NO: 1195447 - RNA, 25 nt, Human
uaaaccucaacuuuggcuggacaug

SEQ ID NO: 1195448 - RNA, 24 nt, Human
uaaauauaauuugagacacugaca

SEQ ID NO: 1195449 - RNA, 19 nt, Human
uaggagaggauacuuggca

SEQ ID NO: 1195450 - RNA, 20 nt, Human
uauuuuauuuccuggugcua

SEQ ID NO: 1195451 - RNA, 24 nt, Human
ucaauccccaccuccauuaacacc

SEQ ID NO: 1195452 - RNA, 21 nt, Human
ucacgccuguaaucccagcau

SEQ ID NO: 1195453 - RNA, 18 nt, Human
ucagagcaaauauuccaa

SEQ ID NO: 1195454 - RNA, 21 nt, Human
uccuggugcuaaaggucuuau

SEQ ID NO: 1195455 - RNA, 24 nt, Human
ucggaggccgaggcaggcacauca

SEQ ID NO: 1195456 - RNA, 21 nt, Human
ucuauaguguugauacaaagu

SEQ ID NO: 1195457 - RNA, 23 nt, Human
ucucuacuaaaaauauaaaaacu

SEQ ID NO: 1195458 - RNA, 24 nt, Human
ugagacaggagaauugcuugaacc

SEQ ID NO: 1195459 - RNA, 25 nt, Human
ugagacaggagaauugcuugaaccc

SEQ ID NO: 1195460 - RNA, 20 nt, Human
ugauacaaagucagcaaacu

SEQ ID NO: 1195461 - RNA, 21 nt, Human
uggcaugcgccuguaauccca

SEQ ID NO: 1195462 - RNA, 22 nt, Human
uggcucacgccuguaaucccag

SEQ ID NO: 1195463 - RNA, 24 nt, Human
uggcucacgccuguaaucccagca

SEQ ID NO: 1195464 - RNA, 24 nt, Human
ugggaagcagguaguuaaauacaa

SEQ ID NO: 1195465 - RNA, 24 nt, Human
ugguggcaugcgccuguaauccca

SEQ ID NO: 1195466 - RNA, 24 nt, Human
ugguggcucacgccuguaauccca

SEQ ID NO: 1195467 - RNA, 23 nt, Human
uguguguacacacacauauuuua

SEQ ID NO: 1195468 - RNA, 20 nt, Human
uguguguguacacacacaua

SEQ ID NO: 1195469 - RNA, 18 nt, Human
uugcagugagccgagauc

SEQ ID NO: 1195470 - RNA, 19 nt, Human
uugcagugagccgagaucg

SEQ ID NO: 1195471 - RNA, 20 nt, Human
uugcagugagccgagaucgc

SEQ ID NO: 1195472 - RNA, 24 nt, Human
uugcuugaacccaggaggcagagg

SEQ ID NO: 1195473 - RNA, 18 nt, Human
uuggcuggacaugguggc

SEQ ID NO: 1195474 - RNA, 18 nt, Human
uuuggcuggacauggugg

SEQ ID NO: 1195475 - RNA, 22 nt, Human
uuuucggaggccgaggcaggca

SEQ ID NO: 1195476 - RNA, 21 nt, Human
aacuucuuucagcauugcacu

SEQ ID NO: 1195477 - RNA, 21 nt, Human
acaggcaagggcaagaucaug

SEQ ID NO: 1195478 - RNA, 25 nt, Human
agaaaaaaaauccaaaaugauuagu

SEQ ID NO: 1195479 - RNA, 18 nt, Human
aggcaagggcaagaucau

SEQ ID NO: 1195480 - RNA, 19 nt, Human
agguuuuucuuccuuguua

SEQ ID NO: 1195481 - RNA, 22 nt, Human
aucacuuuccucacuugacggu

SEQ ID NO: 1195482 - RNA, 22 nt, Human
auggcuuucuggaguucaccau

SEQ ID NO: 1195483 - RNA, 18 nt, Human
caaagcaccccagcucuc

SEQ ID NO: 1195484 - RNA, 18 nt, Human
caauggcuuucuggaguu

SEQ ID NO: 1195485 - RNA, 21 nt, Human
caauuucuagaucacuuuccu

SEQ ID NO: 1195486 - RNA, 20 nt, Human
cagcuugauggcaucuguga

SEQ ID NO: 1195487 - RNA, 26 nt, Human
cauuuucgucucccauuucuugagga

SEQ ID NO: 1195488 - RNA, 20 nt, Human
cccaguggccuagaagucug

SEQ ID NO: 1195489 - RNA, 20 nt, Human
ccgccauuucuaaggcugag

SEQ ID NO: 1195490 - RNA, 23 nt, Human
ccuccauuaucuccgcauuuucg

SEQ ID NO: 1195491 - RNA, 21 nt, Human
cuagaagucugugugcuuucc

SEQ ID NO: 1195492 - RNA, 20 nt, Human
cuuuaagucuuccuccaccu

SEQ ID NO: 1195493 - RNA, 23 nt, Human
gccuuauccaucaucuccuccau

SEQ ID NO: 1195494 - RNA, 29 nt, Human
gggagagggguagggauuaucuucaaagg

SEQ ID NO: 1195495 - RNA, 18 nt, Human
guugaacuucuuucagca

SEQ ID NO: 1195496 - RNA, 25 nt, Human
uaacagacccuuuaaauuuguuuua

SEQ ID NO: 1195497 - RNA, 18 nt, Human
uaacuuuuauuucacuca

SEQ ID NO: 1195498 - RNA, 22 nt, Human
uaagaauuaacagacccuuuaa

SEQ ID NO: 1195499 - RNA, 20 nt, Human
uaagcaucuucccugcccaa

SEQ ID NO: 1195500 - RNA, 24 nt, Human
uaauaacuuuuauuucacucaaau

SEQ ID NO: 1195501 - RNA, 20 nt, Human
uagaagucugugugcuuucc

SEQ ID NO: 1195502 - RNA, 19 nt, Human
uauaagaauuaacagaccc

SEQ ID NO: 1195503 - RNA, 24 nt, Human
ucaauuucuagaucacuuuccuca

SEQ ID NO: 1195504 - RNA, 22 nt, Human
uccaauuuacaggcaagggcaa

SEQ ID NO: 1195505 - RNA, 18 nt, Human
uccuccaccuucuuacua

SEQ ID NO: 1195506 - RNA, 21 nt, Human
ucuaaggcugagcugaaucag

SEQ ID NO: 1195507 - RNA, 23 nt, Human
ucucggauggcaguauuuggcuu

SEQ ID NO: 1195508 - RNA, 22 nt, Human
ucucucgcucuucacuuuuuca

SEQ ID NO: 1195509 - RNA, 21 nt, Human
ucuuccuccaccuucuuacua

SEQ ID NO: 1195510 - RNA, 25 nt, Human
ugaaugaauacccuaauggcaaacc

SEQ ID NO: 1195511 - RNA, 23 nt, Human
ugagaaggacagcgguacauugg

SEQ ID NO: 1195512 - RNA, 24 nt, Human
ugaggagcaugagugucugguuca

SEQ ID NO: 1195513 - RNA, 21 nt, Human
ugaucuagguugcuuuuccuu

SEQ ID NO: 1195514 - RNA, 23 nt, Human
ugccuuauccaucaucuccucca

SEQ ID NO: 1195515 - RNA, 23 nt, Human
uggaguucaccaucauuuagggc

SEQ ID NO: 1195516 - RNA, 19 nt, Human
uggcugacaauuuacugau

SEQ ID NO: 1195517 - RNA, 21 nt, Human
ugucacagucucggauggcag

SEQ ID NO: 1195518 - RNA, 18 nt, Human
uucaaagaaaaaaaaucc

SEQ ID NO: 1195519 - RNA, 22 nt, Human
uucccaguggccuagaagucug

SEQ ID NO: 1195520 - RNA, 23 nt, Human
uucccaguggccuagaagucugu

SEQ ID NO: 1195521 - RNA, 25 nt, Human
uucuuccuuguuauuuucuucugau

SEQ ID NO: 1195522 - RNA, 20 nt, Human
uugcuuuuccuucagcaagg

SEQ ID NO: 1195523 - RNA, 18 nt, Human
uuuaaaaaguguuuaaag

SEQ ID NO: 1195524 - RNA, 22 nt, Human
uuuagggcuucgauagcagcca

SEQ ID NO: 1195525 - RNA, 23 nt, Human
uuucuggaguucaccaucauuua

SEQ ID NO: 1195526 - RNA, 20 nt, Human
ccgccauuucuaaggcugag

SEQ ID NO: 1195527 - RNA, 22 nt, Human
ccugugugcuuucccccgccau

SEQ ID NO: 1195528 - RNA, 21 nt, Human
ucuaaggcugagcugaaucag

SEQ ID NO: 1195529 - RNA, 23 nt, Human
ucucggauggcaguauuuggcuu

SEQ ID NO: 1195530 - RNA, 22 nt, Human
ucucucgcucuucacuuuuuca

SEQ ID NO: 1195531 - RNA, 20 nt, Human
ucugugccugugugcuuucc

SEQ ID NO: 1195532 - RNA, 18 nt, Human
ugccugugugcuuucccc

SEQ ID NO: 1195533 - RNA, 19 nt, Human
uggcugacaauuuacugau

SEQ ID NO: 1195534 - RNA, 21 nt, Human
ugucacagucucggauggcag

SEQ ID NO: 1195535 - RNA, 23 nt, Human
uugacgaagacacuggcccucuu

SEQ ID NO: 1195536 - RNA, 22 nt, Human
cacugccaaaugcucuucugcc

SEQ ID NO: 1195537 - RNA, 19 nt, Human
cagucccugccuucucugu

SEQ ID NO: 1195538 - RNA, 21 nt, Human
ucuucauagcagucccugccu

SEQ ID NO: 1195539 - RNA, 24 nt, Human
uucauagcagucccugccuucucu

SEQ ID NO: 1195540 - RNA, 24 nt, Human
uucucuguagucaucaucccugcg

SEQ ID NO: 1195541 - RNA, 20 nt, Human
cuccaaaaacuucugagccu

SEQ ID NO: 1195542 - RNA, 21 nt, Human
cugcucaccaagacucaguug

SEQ ID NO: 1195543 - RNA, 24 nt, Human
gagcaauuucaaacacuaagcuga

SEQ ID NO: 1195544 - RNA, 28 nt, Human
gagcaggcccucuuuaauccagaaguuu

SEQ ID NO: 1195545 - RNA, 18 nt, Human
gcaggcccucuuuaaucc

SEQ ID NO: 1195546 - RNA, 18 nt, Human
ggacucuauugaaacggg

SEQ ID NO: 1195547 - RNA, 21 nt, Human
gucccucacggcuccaaaaac

SEQ ID NO: 1195548 - RNA, 20 nt, Human
gugguccacuuucuuuaauu

SEQ ID NO: 1195549 - RNA, 18 nt, Human
guuugggaagcguagauu

SEQ ID NO: 1195550 - RNA, 23 nt, Human
uaccagauacauugcaguuuucu

SEQ ID NO: 1195551 - RNA, 20 nt, Human
uauguggugguccacuuucu

SEQ ID NO: 1195552 - RNA, 23 nt, Human
uauuucaguucagagcaauuuca

SEQ ID NO: 1195553 - RNA, 19 nt, Human
ucaaagcuuuauuaccgac

SEQ ID NO: 1195554 - RNA, 18 nt, Human
ucagaacuaacagguaua

SEQ ID NO: 1195555 - RNA, 27 nt, Human
ugagaacaucuuugaaugagcaggccc

SEQ ID NO: 1195556 - RNA, 28 nt, Human
ugagcaggcccucuuuaauccagaaguu

SEQ ID NO: 1195557 - RNA, 25 nt, Human
ugagccuuggucaaauuacuuugug

SEQ ID NO: 1195558 - RNA, 23 nt, Human
ugaucauaugauuuuuguuuuug

SEQ ID NO: 1195559 - RNA, 22 nt, Human
ugcugugucccucacggcucca

SEQ ID NO: 1195560 - RNA, 23 nt, Human
uggaugucuuucauugcagcauu

SEQ ID NO: 1195561 - RNA, 22 nt, Human
uggcaggcucugccccuuuuca

SEQ ID NO: 1195562 - RNA, 19 nt, Human
ugggaauggcuuuggaucu

SEQ ID NO: 1195563 - RNA, 24 nt, Human
ugucugcucaccaagacucaguug

SEQ ID NO: 1195564 - RNA, 19 nt, Human
uguuauacagccuggguua

SEQ ID NO: 1195565 - RNA, 27 nt, Human
uuauacugcugccuucggauucccaug

SEQ ID NO: 1195566 - RNA, 23 nt, Human
uucuuuauacugcugccuucgga

SEQ ID NO: 1195567 - RNA, 19 nt, Human
uugcacugagaacaucuuu

SEQ ID NO: 1195568 - RNA, 23 nt, Human
uuuguguaucuuugaguucuucu

SEQ ID NO: 1195569 - RNA, 21 nt, Human
cagaauggaaggccaaaggca

SEQ ID NO: 1195570 - RNA, 22 nt, Human
cauugggccuggcaaauaucua

SEQ ID NO: 1195571 - RNA, 18 nt, Human
ccagggaaagcaggguug

SEQ ID NO: 1195572 - RNA, 21 nt, Human
gcugguaacgagauugacauc

SEQ ID NO: 1195573 - RNA, 20 nt, Human
uaacgagauugacaucuaaa

SEQ ID NO: 1195574 - RNA, 22 nt, Human
uaccagggaaagcaggguugac

SEQ ID NO: 1195575 - RNA, 23 nt, Human
uggaaggccaaaggcauuaaagg

SEQ ID NO: 1195576 - RNA, 19 nt, Human
uggccccuaccuccacccc

SEQ ID NO: 1195577 - RNA, 20 nt, Human
uugggucaaaaggcugcugg

SEQ ID NO: 1195578 - RNA, 19 nt, Human
aaaugaaagaauaaaaacc

SEQ ID NO: 1195579 - RNA, 27 nt, Human
aaugaaagaauaaaaaccgaaaaagaa

SEQ ID NO: 1195580 - RNA, 18 nt, Human
acucguagcuccuucccu

SEQ ID NO: 1195581 - RNA, 26 nt, Human
cucggcggcuacucguagcuccuucc

SEQ ID NO: 1195582 - RNA, 20 nt, Human
cucguagcuccuucccucca

SEQ ID NO: 1195583 - RNA, 18 nt, Human
gcgcggcgggggcggcgg

SEQ ID NO: 1195584 - RNA, 23 nt, Human
gcgggggcggcggcucagcuggg

SEQ ID NO: 1195585 - RNA, 22 nt, Human
gggcgcggcgggggcggcggcu

SEQ ID NO: 1195586 - RNA, 22 nt, Human
gggggcgcggcgggggcggcgg

SEQ ID NO: 1195587 - RNA, 21 nt, Human
ucccuuguaaaaaugaaagaa

SEQ ID NO: 1195588 - RNA, 22 nt, Human
ucccuuguaaaaaugaaagaau

SEQ ID NO: 1195589 - RNA, 18 nt, Human
ucgcuggcuccgcggccu

SEQ ID NO: 1195590 - RNA, 19 nt, Human
ucgcuggcuccgcggccuc

SEQ ID NO: 1195591 - RNA, 24 nt, Human
aaaaauaucucaauccagacaaga

SEQ ID NO: 1195592 - RNA, 25 nt, Human
aaacauaaguccacacaaaggacca

SEQ ID NO: 1195593 - RNA, 22 nt, Human
aaggaccaaagauuaccuuacu

SEQ ID NO: 1195594 - RNA, 22 nt, Human
aaugcaauuuacaaugugcauu

SEQ ID NO: 1195595 - RNA, 22 nt, Human
acacaaaggaccaaagauuacc

SEQ ID NO: 1195596 - RNA, 19 nt, Human
acuaaaaauaucucaaucc

SEQ ID NO: 1195597 - RNA, 18 nt, Human
agacaagauaaaaaucaa

SEQ ID NO: 1195598 - RNA, 19 nt, Human
agcuauagaccaucauagg

SEQ ID NO: 1195599 - RNA, 25 nt, Human
auaaaaaucaacacauguauuuuua

SEQ ID NO: 1195600 - RNA, 21 nt, Human
augguaaacagcccuacugca

SEQ ID NO: 1195601 - RNA, 21 nt, Human
caaacagugcuacaccgaacu

SEQ ID NO: 1195602 - RNA, 24 nt, Human
caauccagacaagauaaaaaucaa

SEQ ID NO: 1195603 - RNA, 26 nt, Human
caccgaacuacugcuccgcuuucccc

SEQ ID NO: 1195604 - RNA, 18 nt, Human
ccagugcaguuuucuccu

SEQ ID NO: 1195605 - RNA, 21 nt, Human
ccccgggcccgaugccagccc

SEQ ID NO: 1195606 - RNA, 23 nt, Human
cccgccgagcgcagggcagcggg

SEQ ID NO: 1195607 - RNA, 19 nt, Human
ccucgccgcaaacagugcu

SEQ ID NO: 1195608 - RNA, 18 nt, Human
ccucuccuuccuuucucc

SEQ ID NO: 1195609 - RNA, 20 nt, Human
cuccucuccuuccuuucucc

SEQ ID NO: 1195610 - RNA, 23 nt, Human
cucuccuuccuuucuccucgccg

SEQ ID NO: 1195611 - RNA, 18 nt, Human
gaauucauuugguguuca

SEQ ID NO: 1195612 - RNA, 24 nt, Human
gcaaaaccaaaauauuacucaaau

SEQ ID NO: 1195613 - RNA, 20 nt, Human
gcaaacagugcuacaccgaa

SEQ ID NO: 1195614 - RNA, 22 nt, Human
gcuuccaaugguaaacagcccu

SEQ ID NO: 1195615 - RNA, 19 nt, Human
gcuucuagauugaucuccu

SEQ ID NO: 1195616 - RNA, 20 nt, Human
ggcagaucuccaugcuucua

SEQ ID NO: 1195617 - RNA, 19 nt, Human
uaaaaugguccagcuauag

SEQ ID NO: 1195618 - RNA, 18 nt, Human
uaucucaauccagacaag

SEQ ID NO: 1195619 - RNA, 18 nt, Human
ucaaaguuauaaugcaau

SEQ ID NO: 1195620 - RNA, 21 nt, Human
uccacacaaaggaccaaagau

SEQ ID NO: 1195621 - RNA, 20 nt, Human
uccagagugcaaaaccaaaa

SEQ ID NO: 1195622 - RNA, 21 nt, Human
ucuccucuccuuccuuucucc

SEQ ID NO: 1195623 - RNA, 22 nt, Human
ugaagaauccauucaguuucug

SEQ ID NO: 1195624 - RNA, 19 nt, Human
ugaucuccuccucuuuccc

SEQ ID NO: 1195625 - RNA, 19 nt, Human
ugaugacauaaaaauaguc

SEQ ID NO: 1195626 - RNA, 24 nt, Human
ugcaaaaccaaaauauuacucaaa

SEQ ID NO: 1195627 - RNA, 23 nt, Human
uuauugaugacauaaaaauaguc

SEQ ID NO: 1195628 - RNA, 21 nt, Human
uuccccgggcccgaugccagc

SEQ ID NO: 1195629 - RNA, 21 nt, Human
uugaauucauuugguguucau

SEQ ID NO: 1195630 - RNA, 22 nt, Human
aaaccagcuucaggucggccgg

SEQ ID NO: 1195631 - RNA, 20 nt, Human
aauaaaaucaaagucuauga

SEQ ID NO: 1195632 - RNA, 21 nt, Human
gggaauccaugauuugguagg

SEQ ID NO: 1195633 - RNA, 28 nt, Human
aaaaauaaugcagggauaaccgguaccc

SEQ ID NO: 1195634 - RNA, 20 nt, Human
aaagaugccacucucauuuc

SEQ ID NO: 1195635 - RNA, 20 nt, Human
aaagcuuucccuggauccac

SEQ ID NO: 1195636 - RNA, 26 nt, Human
aagaugccacucucauuucuggaaca

SEQ ID NO: 1195637 - RNA, 21 nt, Human
acaaagcuuuucagucucauu

SEQ ID NO: 1195638 - RNA, 21 nt, Human
acaaaggaaaaaucucccuuu

SEQ ID NO: 1195639 - RNA, 26 nt, Human
acagagcaguaaaagccaucucaaag

SEQ ID NO: 1195640 - RNA, 21 nt, Human
accuguuuauaguacacugau

SEQ ID NO: 1195641 - RNA, 26 nt, Human
acucucugagggugucugaggggagu

SEQ ID NO: 1195642 - RNA, 18 nt, Human
agcaguaaaagccaucuc

SEQ ID NO: 1195643 - RNA, 25 nt, Human
agccaucucaaagucagugagacuc

SEQ ID NO: 1195644 - RNA, 22 nt, Human
aggcauuuguuggauuucucac

SEQ ID NO: 1195645 - RNA, 20 nt, Human
auuuccacauuucccuacua

SEQ ID NO: 1195646 - RNA, 23 nt, Human
caaaccagacagcuuuuuacuga

SEQ ID NO: 1195647 - RNA, 21 nt, Human
cacuucccccccacccaaaaa

SEQ ID NO: 1195648 - RNA, 20 nt, Human
cagggauaacuaaaaaccug

SEQ ID NO: 1195649 - RNA, 24 nt, Human
caguaaaagccaucucaaagucag

SEQ ID NO: 1195650 - RNA, 18 nt, Human
cccauacaaagcuuuuca

SEQ ID NO: 1195651 - RNA, 22 nt, Human
cggugaauccuuggacaaaagc

SEQ ID NO: 1195652 - RNA, 20 nt, Human
cuacuauuuggaugcaggga

SEQ ID NO: 1195653 - RNA, 18 nt, Human
cugaggggagugcugugu

SEQ ID NO: 1195654 - RNA, 20 nt, Human
gaacagagcaguaaaagcca

SEQ ID NO: 1195655 - RNA, 23 nt, Human
gacaaaagcuuucccuggaucca

SEQ ID NO: 1195656 - RNA, 22 nt, Human
gaugaccuagagcuuggugguc

SEQ ID NO: 1195657 - RNA, 24 nt, Human
gccauguacccugaucaaacaaua

SEQ ID NO: 1195658 - RNA, 25 nt, Human
ggacaaaagcuuucccuggauccac

SEQ ID NO: 1195659 - RNA, 20 nt, Human
gggauaacuaaaaaccuguu

SEQ ID NO: 1195660 - RNA, 18 nt, Human
guagagggagaacagagc

SEQ ID NO: 1195661 - RNA, 22 nt, Human
gucagugagacucuauggaagc

SEQ ID NO: 1195662 - RNA, 24 nt, Human
gucauuucccaucagugugaacuc

SEQ ID NO: 1195663 - RNA, 21 nt, Human
uaaaacaaauaucuguguugc

SEQ ID NO: 1195664 - RNA, 27 nt, Human
uaaaacaaauaucuguguugcuaaugc

SEQ ID NO: 1195665 - RNA, 19 nt, Human
uagaaaaggaugagcuaug

SEQ ID NO: 1195666 - RNA, 20 nt, Human
uauggcuuaaggucuuccca

SEQ ID NO: 1195667 - RNA, 19 nt, Human
ucagagucaaccugcaccg

SEQ ID NO: 1195668 - RNA, 21 nt, Human
uccauagugauuccauaaaga

SEQ ID NO: 1195669 - RNA, 18 nt, Human
uccccagcacauguggag

SEQ ID NO: 1195670 - RNA, 21 nt, Human
ucccuggauccacuacacuug

SEQ ID NO: 1195671 - RNA, 21 nt, Human
ucuggaacacucugccauauu

SEQ ID NO: 1195672 - RNA, 19 nt, Human
ugaauccuuggacaaaagc

SEQ ID NO: 1195673 - RNA, 22 nt, Human
ugagacucuauggaagcagcuu

SEQ ID NO: 1195674 - RNA, 19 nt, Human
ugaugguuuaacaaaggaa

SEQ ID NO: 1195675 - RNA, 28 nt, Human
ugcaccguucauaagcacuuccccccca

SEQ ID NO: 1195676 - RNA, 21 nt, Human
uggaugcagggauggaugacc

SEQ ID NO: 1195677 - RNA, 23 nt, Human
uggcuuaaggucuucccaugucc

SEQ ID NO: 1195678 - RNA, 21 nt, Human
uggguguucgaggcugaaggu

SEQ ID NO: 1195679 - RNA, 21 nt, Human
uguauauaugaaaggcauuug

SEQ ID NO: 1195680 - RNA, 21 nt, Human
uguuggauuucucaccaauuu

SEQ ID NO: 1195681 - RNA, 21 nt, Human
uuaaggucuucccaugucccc

SEQ ID NO: 1195682 - RNA, 27 nt, Human
uucccauacaaagcuuuucagucucau

SEQ ID NO: 1195683 - RNA, 22 nt, Human
uucgcuguuguugggugaggug

SEQ ID NO: 1195684 - RNA, 24 nt, Human
uugguggucccauggucauuuccc

SEQ ID NO: 1195685 - RNA, 26 nt, Human
uuuccacauuucccuacuauuuggau

SEQ ID NO: 1195686 - RNA, 22 nt, Human
accgcagcccagaucugcagca

SEQ ID NO: 1195687 - RNA, 22 nt, Human
agcccagaucugcagcaggaaa

SEQ ID NO: 1195688 - RNA, 19 nt, Human
cagcccagaucugcagcag

SEQ ID NO: 1195689 - RNA, 24 nt, Human
ccuggcaccgcagcccagaucugc

SEQ ID NO: 1195690 - RNA, 18 nt, Human
cgcuggggucagcuugcu

SEQ ID NO: 1195691 - RNA, 19 nt, Human
cugcacggccugcuccggg

SEQ ID NO: 1195692 - RNA, 19 nt, Human
cuggggucagcuugcucug

SEQ ID NO: 1195693 - RNA, 23 nt, Human
gagugcucggcguagagcuucug

SEQ ID NO: 1195694 - RNA, 18 nt, Human
gcagggagugcucggcgu

SEQ ID NO: 1195695 - RNA, 18 nt, Human
gcccuggcaccgcagccc

SEQ ID NO: 1195696 - RNA, 19 nt, Human
uaggaacggaaauacagua

SEQ ID NO: 1195697 - RNA, 20 nt, Human
ucgcuggggucagcuugcuu

SEQ ID NO: 1195698 - RNA, 20 nt, Human
ucugcacggccugcuccggg

SEQ ID NO: 1195699 - RNA, 21 nt, Human
uggcaccgcagcccagaucuu

SEQ ID NO: 1195700 - RNA, 24 nt, Human
uggggucagcuugcucuguggcuc

SEQ ID NO: 1195701 - RNA, 25 nt, Human
aaaaaacaacaugggaauagaagua

SEQ ID NO: 1195702 - RNA, 24 nt, Human
aaaccacaaccaaagauguuacag

SEQ ID NO: 1195703 - RNA, 21 nt, Human
aaagagugguuuucuuuagga

SEQ ID NO: 1195704 - RNA, 27 nt, Human
aaccaagugauuaggaaaaccacaacc

SEQ ID NO: 1195705 - RNA, 23 nt, Human
acaaccagcaaaugauuucaccu

SEQ ID NO: 1195706 - RNA, 21 nt, Human
acagagugcacacaauucuga

SEQ ID NO: 1195707 - RNA, 18 nt, Human
acuuuccagcuuaaaauu

SEQ ID NO: 1195708 - RNA, 20 nt, Human
agcuacuaaaaaacuugcau

SEQ ID NO: 1195709 - RNA, 24 nt, Human
aggacugacuccauauugccauuu

SEQ ID NO: 1195710 - RNA, 21 nt, Human
agugcacacaauucugacagg

SEQ ID NO: 1195711 - RNA, 22 nt, Human
auaaaaacuaacccccccaucu

SEQ ID NO: 1195712 - RNA, 25 nt, Human
caaaaaauaaacaaccagcaaauga

SEQ ID NO: 1195713 - RNA, 24 nt, Human
caauaucccacacuauuuucuggu

SEQ ID NO: 1195714 - RNA, 22 nt, Human
cacaacugaauagcacguacac

SEQ ID NO: 1195715 - RNA, 21 nt, Human
cagcaaaugauuucaccucuu

SEQ ID NO: 1195716 - RNA, 19 nt, Human
ccgcugccacuccucccgc

SEQ ID NO: 1195717 - RNA, 20 nt, Human
ccgcugccacuccucccgcc

SEQ ID NO: 1195718 - RNA, 23 nt, Human
ccuggccgcugccacuccucccg

SEQ ID NO: 1195719 - RNA, 19 nt, Human
cugguggcagggagggugu

SEQ ID NO: 1195720 - RNA, 21 nt, Human
cugguggcagggagggugugu

SEQ ID NO: 1195721 - RNA, 20 nt, Human
gugugccgggugccugcggg

SEQ ID NO: 1195722 - RNA, 25 nt, Human
uaaaaaaagcauuuacacuuaaaaa

SEQ ID NO: 1195723 - RNA, 23 nt, Human
uaaccaagugauuaggaaaacca

SEQ ID NO: 1195724 - RNA, 23 nt, Human
uaagaggcuaucaaguaccagua

SEQ ID NO: 1195725 - RNA, 19 nt, Human
uacacuuaaaaagugggau

SEQ ID NO: 1195726 - RNA, 26 nt, Human
uaccaaaaaauaaacaaccagcaaau

SEQ ID NO: 1195727 - RNA, 27 nt, Human
uaccaaaaaauaaacaaccagcaaaug

SEQ ID NO: 1195728 - RNA, 20 nt, Human
uagaaguaauuuaaaauguu

SEQ ID NO: 1195729 - RNA, 21 nt, Human
uaggaaaaccacaaccaaaga

SEQ ID NO: 1195730 - RNA, 22 nt, Human
uaggaaacaauucuacuaaaaa

SEQ ID NO: 1195731 - RNA, 24 nt, Human
uaggaaacaauucuacuaaaaaac

SEQ ID NO: 1195732 - RNA, 23 nt, Human
uauaaaaacuaacccccccaucu

SEQ ID NO: 1195733 - RNA, 22 nt, Human
uauggaauguuaagcugacacc

SEQ ID NO: 1195734 - RNA, 23 nt, Human
uauuccagugacuuuccagcuua

SEQ ID NO: 1195735 - RNA, 18 nt, Human
ucaagacauuaaaugcag

SEQ ID NO: 1195736 - RNA, 21 nt, Human
ucuagagcuacuaaaaaacuu

SEQ ID NO: 1195737 - RNA, 23 nt, Human
ucuuucacagcacaguaaccaag

SEQ ID NO: 1195738 - RNA, 25 nt, Human
ugacacccgagacagucagagccuc

SEQ ID NO: 1195739 - RNA, 24 nt, Human
ugacuccauauugccauuuaauau

SEQ ID NO: 1195740 - RNA, 21 nt, Human
ugcacacaauucugacaggga

SEQ ID NO: 1195741 - RNA, 21 nt, Human
ugccgggugccugcgggcugc

SEQ ID NO: 1195742 - RNA, 21 nt, Human
uggccgcugccacuccucccg

SEQ ID NO: 1195743 - RNA, 21 nt, Human
ugguggcagggagggugugug

SEQ ID NO: 1195744 - RNA, 24 nt, Human
uuaggaaaaccacaaccaaagaug

SEQ ID NO: 1195745 - RNA, 24 nt, Human
uuauuccagugacuuuccagcuua

SEQ ID NO: 1195746 - RNA, 27 nt, Human
uucaauaucccacacuauuuucugguu

SEQ ID NO: 1195747 - RNA, 24 nt, Human
uucacagcacaguaaccaagugau

SEQ ID NO: 1195748 - RNA, 28 nt, Human
uucacagcacaguaaccaagugauucua

SEQ ID NO: 1195749 - RNA, 22 nt, Human
uucuacuaaaaaacaacauggg

SEQ ID NO: 1195750 - RNA, 22 nt, Human
uuguaccaaaaaauaaacaacc

SEQ ID NO: 1195751 - RNA, 20 nt, Human
uuuacacuuaaaaaguggga

SEQ ID NO: 1195752 - RNA, 23 nt, Human
uuuauuuucauaauugagauuuu

SEQ ID NO: 1195753 - RNA, 21 nt, Human
uuucacagcacaguaaccaag

SEQ ID NO: 1195754 - RNA, 25 nt, Human
caaguuggaagacgauuuaauuuca

SEQ ID NO: 1195755 - RNA, 26 nt, Human
ccccacucuuuuggaguccaacugga

SEQ ID NO: 1195756 - RNA, 22 nt, Human
gccccacucuuuuggaguccaa

SEQ ID NO: 1195757 - RNA, 20 nt, Human
uaagcagauagcaaaugcug

SEQ ID NO: 1195758 - RNA, 25 nt, Human
ugccccacucuuuuggaguccaacu

SEQ ID NO: 1195759 - RNA, 18 nt, Human
uuggaguccaacuggaga

SEQ ID NO: 1195760 - RNA, 19 nt, Human
aaaagcccaaagacaaagg

SEQ ID NO: 1195761 - RNA, 22 nt, Human
aaacaggcaagacuuuccccau

SEQ ID NO: 1195762 - RNA, 19 nt, Human
aaacaggguucacuuaugc

SEQ ID NO: 1195763 - RNA, 20 nt, Human
aaccaaaguaaaugggacag

SEQ ID NO: 1195764 - RNA, 23 nt, Human
aagaaaaugauagcaaugaccac

SEQ ID NO: 1195765 - RNA, 22 nt, Human
aagcacuggggacccuggaacu

SEQ ID NO: 1195766 - RNA, 18 nt, Human
aagcaguggcggugggga

SEQ ID NO: 1195767 - RNA, 18 nt, Human
aaggaaaaacacaaaugu

SEQ ID NO: 1195768 - RNA, 18 nt, Human
aaggagucgauucuucuu

SEQ ID NO: 1195769 - RNA, 19 nt, Human
aaggcaccauugaaggaaa

SEQ ID NO: 1195770 - RNA, 18 nt, Human
aagggcaaaagcccaaag

SEQ ID NO: 1195771 - RNA, 21 nt, Human
aauugcuccucaucaggagac

SEQ ID NO: 1195772 - RNA, 22 nt, Human
acaaaaacaccugaugaaaaaa

SEQ ID NO: 1195773 - RNA, 22 nt, Human
acaacccaaauguccaucaaca

SEQ ID NO: 1195774 - RNA, 21 nt, Human
acacagcaagagggagggagc

SEQ ID NO: 1195775 - RNA, 22 nt, Human
acccaaaagaaaaugauagcaa

SEQ ID NO: 1195776 - RNA, 24 nt, Human
acccuggaacuuuucccggcacuc

SEQ ID NO: 1195777 - RNA, 19 nt, Human
accucauacuuucccuucu

SEQ ID NO: 1195778 - RNA, 21 nt, Human
agaaaaacccagacuucccaa

SEQ ID NO: 1195779 - RNA, 22 nt, Human
agaauaaccucucuacacuaga

SEQ ID NO: 1195780 - RNA, 19 nt, Human
agacuguuagagcccaaac

SEQ ID NO: 1195781 - RNA, 19 nt, Human
agcagaaaaacccagacuu

SEQ ID NO: 1195782 - RNA, 22 nt, Human
agcagaaaaacccagacuuccc

SEQ ID NO: 1195783 - RNA, 27 nt, Human
agcuguccagaacuccuggaggacccc

SEQ ID NO: 1195784 - RNA, 18 nt, Human
aggaacgaaaucauuuac

SEQ ID NO: 1195785 - RNA, 21 nt, Human
aggaagccuuggaaaacaggc

SEQ ID NO: 1195786 - RNA, 19 nt, Human
aggcaagacuuuccccaua

SEQ ID NO: 1195787 - RNA, 20 nt, Human
augaagcaagacuagagccc

SEQ ID NO: 1195788 - RNA, 18 nt, Human
caaagggcaaaagcccaa

SEQ ID NO: 1195789 - RNA, 22 nt, Human
caaggacucccuuccuuugcuu

SEQ ID NO: 1195790 - RNA, 23 nt, Human
cacaacgaauccagccaggacaa

SEQ ID NO: 1195791 - RNA, 23 nt, Human
cacaguuucaaagggcaaaagcc

SEQ ID NO: 1195792 - RNA, 20 nt, Human
caccucauacuuucccuucu

SEQ ID NO: 1195793 - RNA, 19 nt, Human
cagagcagcuguccagaac

SEQ ID NO: 1195794 - RNA, 20 nt, Human
cagcaggccuccauuucccu

SEQ ID NO: 1195795 - RNA, 20 nt, Human
cagcccuugcaaagacuguc

SEQ ID NO: 1195796 - RNA, 23 nt, Human
caggaaagagggguugcuggagg

SEQ ID NO: 1195797 - RNA, 20 nt, Human
caucaugcccccagcccaac

SEQ ID NO: 1195798 - RNA, 18 nt, Human
caucggauggaaccagcu

SEQ ID NO: 1195799 - RNA, 19 nt, Human
cauugaccuucaggucugc

SEQ ID NO: 1195800 - RNA, 24 nt, Human
ccaaaaccugguaacaacccaaau

SEQ ID NO: 1195801 - RNA, 23 nt, Human
ccaauugcauggccuccugccac

SEQ ID NO: 1195802 - RNA, 18 nt, Human
ccacccauacaaugggau

SEQ ID NO: 1195803 - RNA, 23 nt, Human
ccacccauacaaugggauccuac

SEQ ID NO: 1195804 - RNA, 24 nt, Human
ccagcaucucuccuggcaacucca

SEQ ID NO: 1195805 - RNA, 20 nt, Human
ccauacaaugggauccuacc

SEQ ID NO: 1195806 - RNA, 30 nt, Human
cccaaaagaaaaugauagcaaugaccaccc

SEQ ID NO: 1195807 - RNA, 19 nt, Human
cccaaagacaaaggggucc

SEQ ID NO: 1195808 - RNA, 20 nt, Human
cccccagcccaacaccucau

SEQ ID NO: 1195809 - RNA, 21 nt, Human
ccccggcgguggagaaggcuc

SEQ ID NO: 1195810 - RNA, 23 nt, Human
ccgaacccaagcacuucccagcc

SEQ ID NO: 1195811 - RNA, 21 nt, Human
ccuaacugccacacccaaaag

SEQ ID NO: 1195812 - RNA, 19 nt, Human
ccuccuagaacaacggaaa

SEQ ID NO: 1195813 - RNA, 23 nt, Human
ccuccuagaacaacggaaauggg

SEQ ID NO: 1195814 - RNA, 22 nt, Human
ccuguaaccuugaacccaaggc

SEQ ID NO: 1195815 - RNA, 22 nt, Human
ccuucaggucugcagcaggccu

SEQ ID NO: 1195816 - RNA, 19 nt, Human
cggcacuccaaagucacag

SEQ ID NO: 1195817 - RNA, 18 nt, Human
cuaacugccacacccaaa

SEQ ID NO: 1195818 - RNA, 19 nt, Human
cuagacagucuuggguagg

SEQ ID NO: 1195819 - RNA, 19 nt, Human
cuagagcccaauugcaugg

SEQ ID NO: 1195820 - RNA, 20 nt, Human
cuagagcccaauugcauggc

SEQ ID NO: 1195821 - RNA, 23 nt, Human
cuauacccucccaguuccccaca

SEQ ID NO: 1195822 - RNA, 20 nt, Human
cucauguugccucagcguca

SEQ ID NO: 1195823 - RNA, 18 nt, Human
cuccucucaaaaguccaa

SEQ ID NO: 1195824 - RNA, 23 nt, Human
cucuacacuagagggcucauuuc

SEQ ID NO: 1195825 - RNA, 23 nt, Human
cugcagcaggccuccauuucccc

SEQ ID NO: 1195826 - RNA, 18 nt, Human
cugccaguaucuagacag

SEQ ID NO: 1195827 - RNA, 20 nt, Human
cuucuaagcuucccugaaca

SEQ ID NO: 1195828 - RNA, 19 nt, Human
gaacuccuggaggaccccc

SEQ ID NO: 1195829 - RNA, 20 nt, Human
gacagugauagaugcacugg

SEQ ID NO: 1195830 - RNA, 23 nt, Human
gacuguuagagcccaaacuuuug

SEQ ID NO: 1195831 - RNA, 18 nt, Human
gacuucccaauggccuca

SEQ ID NO: 1195832 - RNA, 23 nt, Human
gaugggggacagugaggagcagg

SEQ ID NO: 1195833 - RNA, 18 nt, Human
gccaguaucuagacaguc

SEQ ID NO: 1195834 - RNA, 25 nt, Human
gggagcuaaauuagacuaagcaaug

SEQ ID NO: 1195835 - RNA, 19 nt, Human
guggaggaagccuuggaaa

SEQ ID NO: 1195836 - RNA, 22 nt, Human
guggaggaagccuuggaaaaca

SEQ ID NO: 1195837 - RNA, 21 nt, Human
uaaacccucagaauaaccucu

SEQ ID NO: 1195838 - RNA, 18 nt, Human
uaacugacccuuuagccc

SEQ ID NO: 1195839 - RNA, 19 nt, Human
uacagccuuuccuguaacc

SEQ ID NO: 1195840 - RNA, 22 nt, Human
uacugaaaccucucugcccuuc

SEQ ID NO: 1195841 - RNA, 23 nt, Human
uagguccugaggugaaaaaaaag

SEQ ID NO: 1195842 - RNA, 24 nt, Human
uagguccugaggugaaaaaaaagg

SEQ ID NO: 1195843 - RNA, 18 nt, Human
uaucuagacagucuuggg

SEQ ID NO: 1195844 - RNA, 19 nt, Human
uauguggcucuugaagcau

SEQ ID NO: 1195845 - RNA, 22 nt, Human
ucaaagggcaaaagcccaaaga

SEQ ID NO: 1195846 - RNA, 18 nt, Human
ucaaauacaccauuccua

SEQ ID NO: 1195847 - RNA, 21 nt, Human
ucacaguuucaaagggcaaaa

SEQ ID NO: 1195848 - RNA, 23 nt, Human
ucacugucuugauuaugggggag

SEQ ID NO: 1195849 - RNA, 23 nt, Human
ucaggagacuguuagagcccaaa

SEQ ID NO: 1195850 - RNA, 21 nt, Human
ucauuuccaggccaauacuca

SEQ ID NO: 1195851 - RNA, 19 nt, Human
uccacccauacaaugggau

SEQ ID NO: 1195852 - RNA, 21 nt, Human
uccagaacuccuggaggaccc

SEQ ID NO: 1195853 - RNA, 18 nt, Human
ucccagccaaggacuccc

SEQ ID NO: 1195854 - RNA, 20 nt, Human
ucccauggcaagugggagcc

SEQ ID NO: 1195855 - RNA, 22 nt, Human
uccuguaaccuugaacccaagg

SEQ ID NO: 1195856 - RNA, 21 nt, Human
ucgguggcaggguggaggaag

SEQ ID NO: 1195857 - RNA, 18 nt, Human
ucuaagcuucccugaaca

SEQ ID NO: 1195858 - RNA, 22 nt, Human
ucuauagugacagcaagccaag

SEQ ID NO: 1195859 - RNA, 21 nt, Human
ugaaaaaaaaggagcuuccgu

SEQ ID NO: 1195860 - RNA, 18 nt, Human
ugaaaacuccuguaccuu

SEQ ID NO: 1195861 - RNA, 23 nt, Human
ugaaaccucucugcccuucuaag

SEQ ID NO: 1195862 - RNA, 18 nt, Human
ugaagcauucacaguuuc

SEQ ID NO: 1195863 - RNA, 18 nt, Human
ugauagcaaugaccaccu

SEQ ID NO: 1195864 - RNA, 32 nt, Human
ugauaugcacaaaaacaccugaugaaaaaaag

SEQ ID NO: 1195865 - RNA, 20 nt, Human
ugcacagcagaaaaacccag

SEQ ID NO: 1195866 - RNA, 19 nt, Human
ugccaaaaacccuccaacu

SEQ ID NO: 1195867 - RNA, 18 nt, Human
ugccacacccaaaagaaa

SEQ ID NO: 1195868 - RNA, 22 nt, Human
ugcugaaaacuccuguaccuug

SEQ ID NO: 1195869 - RNA, 18 nt, Human
ugcuggaggcgcaaggcc

SEQ ID NO: 1195870 - RNA, 22 nt, Human
uggaaaacaggcaagacuuucc

SEQ ID NO: 1195871 - RNA, 24 nt, Human
uggaaaacaggcaagacuuucccc

SEQ ID NO: 1195872 - RNA, 23 nt, Human
uggaaaauugcuccucaucagga

SEQ ID NO: 1195873 - RNA, 24 nt, Human
uggaggacccccguuuugugaaga

SEQ ID NO: 1195874 - RNA, 18 nt, Human
uggccaaaaccugguaac

SEQ ID NO: 1195875 - RNA, 22 nt, Human
uggcgguggggaugggggacag

SEQ ID NO: 1195876 - RNA, 22 nt, Human
ugucauggccaaaaccugguaa

SEQ ID NO: 1195877 - RNA, 24 nt, Human
uguccugccaguaucuagacaguc

SEQ ID NO: 1195878 - RNA, 21 nt, Human
ugugcugagugaaagaggcca

SEQ ID NO: 1195879 - RNA, 23 nt, Human
uuaaacaaucauugaccuucagg

SEQ ID NO: 1195880 - RNA, 22 nt, Human
uuacagccuuuccuguaaccuu

SEQ ID NO: 1195881 - RNA, 21 nt, Human
uuccugguucaguugaaugaa

SEQ ID NO: 1195882 - RNA, 20 nt, Human
uucgaacauucugacuuuga

SEQ ID NO: 1195883 - RNA, 25 nt, Human
uucuauggaauucuagaaaauggga

SEQ ID NO: 1195884 - RNA, 19 nt, Human
uugauuaugggggagguuu

SEQ ID NO: 1195885 - RNA, 18 nt, Human
uugcauggccuccugcca

SEQ ID NO: 1195886 - RNA, 22 nt, Human
uugugguggucaguguguaaau

SEQ ID NO: 1195887 - RNA, 20 nt, Human
uuuaagcuuuuacauucuag

SEQ ID NO: 1195888 - RNA, 18 nt, Human
uuucccuucuucccuguc

SEQ ID NO: 1195889 - RNA, 22 nt, Human
aaaccaccaggaagacuccagu

SEQ ID NO: 1195890 - RNA, 22 nt, Human
aaagaaacauuucaacagagaa

SEQ ID NO: 1195891 - RNA, 19 nt, Human
aaaugcuggagaugagacg

SEQ ID NO: 1195892 - RNA, 18 nt, Human
aacucccaucccuaccuc

SEQ ID NO: 1195893 - RNA, 24 nt, Human
aagcuaaaggcaguuccuucccaa

SEQ ID NO: 1195894 - RNA, 25 nt, Human
acagaagcagcaagaagggcgggaa

SEQ ID NO: 1195895 - RNA, 22 nt, Human
acugcaauucacucagcaaacu

SEQ ID NO: 1195896 - RNA, 24 nt, Human
agaagagacuccucuguucacaga

SEQ ID NO: 1195897 - RNA, 22 nt, Human
agaccaagaaccggaaggagga

SEQ ID NO: 1195898 - RNA, 21 nt, Human
agagaccagauauucagagac

SEQ ID NO: 1195899 - RNA, 20 nt, Human
agcaagaagggcgggaacac

SEQ ID NO: 1195900 - RNA, 21 nt, Human
agcaagaagggcgggaacacu

SEQ ID NO: 1195901 - RNA, 21 nt, Human
agcacacccugccugcauggc

SEQ ID NO: 1195902 - RNA, 24 nt, Human
agcgauucuccuuccucagccucc

SEQ ID NO: 1195903 - RNA, 18 nt, Human
aggaagcagaccaugaga

SEQ ID NO: 1195904 - RNA, 21 nt, Human
agggaggaagaggaggggcgg

SEQ ID NO: 1195905 - RNA, 19 nt, Human
agggcuggugucauuggca

SEQ ID NO: 1195906 - RNA, 19 nt, Human
aggggcuuguucuucugug

SEQ ID NO: 1195907 - RNA, 23 nt, Human
agggggugggcugaugcugcggg

SEQ ID NO: 1195908 - RNA, 21 nt, Human
aggucuggcaacuagccugcc

SEQ ID NO: 1195909 - RNA, 18 nt, Human
caaccaggacaaggccgg

SEQ ID NO: 1195910 - RNA, 20 nt, Human
caaguucugggucccugccu

SEQ ID NO: 1195911 - RNA, 23 nt, Human
caccaaaggucuggcaacuagcc

SEQ ID NO: 1195912 - RNA, 23 nt, Human
caccacuaccucugccuucuggg

SEQ ID NO: 1195913 - RNA, 18 nt, Human
caccuuagcaaguccugg

SEQ ID NO: 1195914 - RNA, 18 nt, Human
caccuuagcaaguccugg

SEQ ID NO: 1195915 - RNA, 23 nt, Human
caccuucacucuggucacggguc

SEQ ID NO: 1195916 - RNA, 18 nt, Human
cacuccaaauuacccagc

SEQ ID NO: 1195917 - RNA, 19 nt, Human
cacucuggaacccacuguc

SEQ ID NO: 1195918 - RNA, 19 nt, Human
cagauuguguccuccagga

SEQ ID NO: 1195919 - RNA, 24 nt, Human
cagcaaaaguucuaacaccaaagg

SEQ ID NO: 1195920 - RNA, 19 nt, Human
cagcacacccugccugcau

SEQ ID NO: 1195921 - RNA, 19 nt, Human
cagccuccugagugcuggg

SEQ ID NO: 1195922 - RNA, 27 nt, Human
cagcuuguacuaaagaaacauuucaac

SEQ ID NO: 1195923 - RNA, 25 nt, Human
ccaaagauuuacuggggcuaacuaa

SEQ ID NO: 1195924 - RNA, 18 nt, Human
ccaaaggucuggcaacua

SEQ ID NO: 1195925 - RNA, 19 nt, Human
ccaccaggcaagaguccaa

SEQ ID NO: 1195926 - RNA, 18 nt, Human
ccaggcaagaguccaaac

SEQ ID NO: 1195927 - RNA, 18 nt, Human
ccaggcauccgcccugcc

SEQ ID NO: 1195928 - RNA, 19 nt, Human
cccagcacacccugccugc

SEQ ID NO: 1195929 - RNA, 24 nt, Human
cccaggcuggugcaaucucggcuc

SEQ ID NO: 1195930 - RNA, 18 nt, Human
cccaucccuaccucagaa

SEQ ID NO: 1195931 - RNA, 24 nt, Human
ccccagagggcacagaagcagcaa

SEQ ID NO: 1195932 - RNA, 18 nt, Human
ccccccaggccugcucuc

SEQ ID NO: 1195933 - RNA, 18 nt, Human
cccuggagaagcuugagg

SEQ ID NO: 1195934 - RNA, 19 nt, Human
ccgcuccgucagugccugc

SEQ ID NO: 1195935 - RNA, 20 nt, Human
ccuagaccaagaaccggaag

SEQ ID NO: 1195936 - RNA, 19 nt, Human
ccucugccuucugggcuca

SEQ ID NO: 1195937 - RNA, 23 nt, Human
ccucuguucacagaagcuaaagg

SEQ ID NO: 1195938 - RNA, 22 nt, Human
ccugccaggaacuuccucucca

SEQ ID NO: 1195939 - RNA, 18 nt, Human
ccugccaucuugugccug

SEQ ID NO: 1195940 - RNA, 22 nt, Human
ccugccaucuugugccuggagc

SEQ ID NO: 1195941 - RNA, 24 nt, Human
ccuucugggcucaagcgauucucc

SEQ ID NO: 1195942 - RNA, 22 nt, Human
cggccaucccagcaaaaguucu

SEQ ID NO: 1195943 - RNA, 18 nt, Human
cggcucaccacuaccucu

SEQ ID NO: 1195944 - RNA, 21 nt, Human
cggcuccucguccugcauccc

SEQ ID NO: 1195945 - RNA, 20 nt, Human
cgggacgagaccaccaggca

SEQ ID NO: 1195946 - RNA, 24 nt, Human
cucaagcgauucuccuuccucagc

SEQ ID NO: 1195947 - RNA, 19 nt, Human
cucaccacuaccucugccu

SEQ ID NO: 1195948 - RNA, 23 nt, Human
cucagaccacucuggaacccacu

SEQ ID NO: 1195949 - RNA, 24 nt, Human
cucagaguccugaacucccauccc

SEQ ID NO: 1195950 - RNA, 20 nt, Human
cuccuguguccuggccgcuc

SEQ ID NO: 1195951 - RNA, 18 nt, Human
cugaacucccaucccuac

SEQ ID NO: 1195952 - RNA, 21 nt, Human
cugccuggaucuccucaccug

SEQ ID NO: 1195953 - RNA, 20 nt, Human
cugggcucaagcgauucucc

SEQ ID NO: 1195954 - RNA, 19 nt, Human
cugggguccaugcagcucu

SEQ ID NO: 1195955 - RNA, 21 nt, Human
cuuuuagcacugcaauucacu

SEQ ID NO: 1195956 - RNA, 23 nt, Human
gagacaggcagccuagaccaaga

SEQ ID NO: 1195957 - RNA, 22 nt, Human
gagccccccaggccugcucucc

SEQ ID NO: 1195958 - RNA, 20 nt, Human
gcaauccuguaccaagaccc

SEQ ID NO: 1195959 - RNA, 24 nt, Human
gcauccccgcugcuacuuccagaa

SEQ ID NO: 1195960 - RNA, 22 nt, Human
gccaggaacuuccucuccacaa

SEQ ID NO: 1195961 - RNA, 19 nt, Human
gccaguugggcagaugcgg

SEQ ID NO: 1195962 - RNA, 20 nt, Human
gcucuuguugcccaggcugg

SEQ ID NO: 1195963 - RNA, 19 nt, Human
ggaggaagaggaggggcgg

SEQ ID NO: 1195964 - RNA, 19 nt, Human
ggagggaggaagaggaggg

SEQ ID NO: 1195965 - RNA, 22 nt, Human
ggagggaggaagaggaggggcg

SEQ ID NO: 1195966 - RNA, 21 nt, Human
ggaguuggcagggccaaagau

SEQ ID NO: 1195967 - RNA, 19 nt, Human
ggcacagaagcagcaagaa

SEQ ID NO: 1195968 - RNA, 25 nt, Human
ggccugcucuccuguguccuggccg

SEQ ID NO: 1195969 - RNA, 22 nt, Human
ggggugggcugaugcugcgggc

SEQ ID NO: 1195970 - RNA, 24 nt, Human
ggugagggccacuccugggaggga

SEQ ID NO: 1195971 - RNA, 23 nt, Human
guccaugcagcucuaggcugagu

SEQ ID NO: 1195972 - RNA, 20 nt, Human
gucuggagccugcacuguuc

SEQ ID NO: 1195973 - RNA, 25 nt, Human
guuaucuucucagaguccugaacuc

SEQ ID NO: 1195974 - RNA, 19 nt, Human
uaccucugccuucugggcu

SEQ ID NO: 1195975 - RNA, 21 nt, Human
uaugacauguuaucuucucag

SEQ ID NO: 1195976 - RNA, 24 nt, Human
ucaccacuaccucugccuucuggg

SEQ ID NO: 1195977 - RNA, 20 nt, Human
ucaccacugucuguucucug

SEQ ID NO: 1195978 - RNA, 21 nt, Human
ucauccaggaaacauacucac

SEQ ID NO: 1195979 - RNA, 20 nt, Human
ucccuggagaagcuugagga

SEQ ID NO: 1195980 - RNA, 19 nt, Human
ucccugggacuugccggcu

SEQ ID NO: 1195981 - RNA, 23 nt, Human
uccugaacucccaucccuaccuc

SEQ ID NO: 1195982 - RNA, 20 nt, Human
uccugagcaaccuggagucc

SEQ ID NO: 1195983 - RNA, 19 nt, Human
uccuguguccuggccgcuc

SEQ ID NO: 1195984 - RNA, 24 nt, Human
ucucuucacucgagagaugaggac

SEQ ID NO: 1195985 - RNA, 21 nt, Human
ucuggcaacuagccugccauc

SEQ ID NO: 1195986 - RNA, 24 nt, Human
ugacagaccugccuuggcugagcg

SEQ ID NO: 1195987 - RNA, 22 nt, Human
ugagcaaccuggaguccucugu

SEQ ID NO: 1195988 - RNA, 23 nt, Human
ugaggaagcagaaaugcuggaga

SEQ ID NO: 1195989 - RNA, 18 nt, Human
ugcacuguuccaugagcc

SEQ ID NO: 1195990 - RNA, 26 nt, Human
ugcccaggcuggugcaaucucggcuc

SEQ ID NO: 1195991 - RNA, 20 nt, Human
ugccuggaucuccucaccuc

SEQ ID NO: 1195992 - RNA, 23 nt, Human
ugccuuggcugagcguucaccug

SEQ ID NO: 1195993 - RNA, 21 nt, Human
ugcucuuguugcccaggcugg

SEQ ID NO: 1195994 - RNA, 21 nt, Human
uggcugagcguucaccugucu

SEQ ID NO: 1195995 - RNA, 19 nt, Human
ugggaaccuuguugccagu

SEQ ID NO: 1195996 - RNA, 20 nt, Human
ugggagggggugggcugaug

SEQ ID NO: 1195997 - RNA, 21 nt, Human
ugggagggggugggcugaugc

SEQ ID NO: 1195998 - RNA, 18 nt, Human
ugggguccagagggaccg

SEQ ID NO: 1195999 - RNA, 22 nt, Human
ugggguccaugcagcucuaggc

SEQ ID NO: 1196000 - RNA, 18 nt, Human
uggugcaaucucggcuca

SEQ ID NO: 1196001 - RNA, 24 nt, Human
uuaacgccucuuuugcagucuccc

SEQ ID NO: 1196002 - RNA, 28 nt, Human
uuagauguuuguuaauugcucuuggucu

SEQ ID NO: 1196003 - RNA, 19 nt, Human
uucccugggacuugccggc

SEQ ID NO: 1196004 - RNA, 25 nt, Human
uucccugggacuugccggcuuuuag

SEQ ID NO: 1196005 - RNA, 23 nt, Human
uuccucagccuccugagugcugg

SEQ ID NO: 1196006 - RNA, 23 nt, Human
uucugggcucaagcgauucuccu

SEQ ID NO: 1196007 - RNA, 18 nt, Human
uucuucagacuuugcugc

SEQ ID NO: 1196008 - RNA, 21 nt, Human
uuguugcccaggcuggugcaa

SEQ ID NO: 1196009 - RNA, 27 nt, Human
uuuagcacugcaauucacucagcaaac

SEQ ID NO: 1196010 - RNA, 19 nt, Human
uuugccucagcuuguacua

SEQ ID NO: 1196011 - RNA, 21 nt, Human
uuuguaaaccaccaggaagac

SEQ ID NO: 1196012 - RNA, 24 nt, Human
uuuugcucuuguugcccaggcugg

SEQ ID NO: 1196013 - RNA, 23 nt, Human
caggaaaagcaggacuggcaaua

SEQ ID NO: 1196014 - RNA, 20 nt, Human
cagggcuguagggcaguugc

SEQ ID NO: 1196015 - RNA, 20 nt, Human
caguugccuucucuguccuu

SEQ ID NO: 1196016 - RNA, 21 nt, Human
ccgauacugcaggucuuuccu

SEQ ID NO: 1196017 - RNA, 19 nt, Human
ccggcaaaugccugccagg

SEQ ID NO: 1196018 - RNA, 19 nt, Human
ccuccacggaaacagggau

SEQ ID NO: 1196019 - RNA, 21 nt, Human
cuaaaagacagagcacuguaa

SEQ ID NO: 1196020 - RNA, 21 nt, Human
cugguaacaagagugacaccu

SEQ ID NO: 1196021 - RNA, 19 nt, Human
cuuuccuuuucuugucugg

SEQ ID NO: 1196022 - RNA, 20 nt, Human
gauacugcaggucuuuccuu

SEQ ID NO: 1196023 - RNA, 22 nt, Human
ggaaacagggaucugguaccug

SEQ ID NO: 1196024 - RNA, 24 nt, Human
uaccuggaggagagggacuucugc

SEQ ID NO: 1196025 - RNA, 21 nt, Human
ucccuaguuccccucccaccc

SEQ ID NO: 1196026 - RNA, 23 nt, Human
ucuuuccuuuucuugucuggguu

SEQ ID NO: 1196027 - RNA, 18 nt, Human
ugcugguaacaagaguga

SEQ ID NO: 1196028 - RNA, 19 nt, Human
uggguuagugcccacaacc

SEQ ID NO: 1196029 - RNA, 20 nt, Human
ugucuggguuagugcccaca

SEQ ID NO: 1196030 - RNA, 18 nt, Human
aagcgaaaacaauuagca

SEQ ID NO: 1196031 - RNA, 23 nt, Human
accguccagagcgauuuaguugu

SEQ ID NO: 1196032 - RNA, 18 nt, Human
cagugagcauuucucuuc

SEQ ID NO: 1196033 - RNA, 23 nt, Human
caugacauuuuucuaauauucuu

SEQ ID NO: 1196034 - RNA, 22 nt, Human
uaaugagaaauaagucacugag

SEQ ID NO: 1196035 - RNA, 19 nt, Human
ucacugagugagaugcggu

SEQ ID NO: 1196036 - RNA, 20 nt, Human
uggcugauuucguggggggu

SEQ ID NO: 1196037 - RNA, 22 nt, Human
uguggcugauuucguggggggu

SEQ ID NO: 1196038 - RNA, 22 nt, Human
uugugcagugagcauuucucuu

SEQ ID NO: 1196039 - RNA, 21 nt, Human
aaaaaugcugcuuagccaccc

SEQ ID NO: 1196040 - RNA, 18 nt, Human
aaaaaugcugcuuagccc

SEQ ID NO: 1196041 - RNA, 20 nt, Human
aaaauaauacucccacacca

SEQ ID NO: 1196042 - RNA, 24 nt, Human
aaagugcugggauaacagguguga

SEQ ID NO: 1196043 - RNA, 24 nt, Human
aaaguguugggauuacaggcguga

SEQ ID NO: 1196044 - RNA, 23 nt, Human
aaccuccuggacucaagcaaucc

SEQ ID NO: 1196045 - RNA, 25 nt, Human
aagcaauccucccaucucagccucc

SEQ ID NO: 1196046 - RNA, 24 nt, Human
aaguaccugggauuacaggcacau

SEQ ID NO: 1196047 - RNA, 22 nt, Human
aagugaguuccagaccucauaa

SEQ ID NO: 1196048 - RNA, 21 nt, Human
aaguguugggauuacaggcgu

SEQ ID NO: 1196049 - RNA, 26 nt, Human
aaguguugggauuacaggcgugagcc

SEQ ID NO: 1196050 - RNA, 18 nt, Human
acaccacuuggaacaccc

SEQ ID NO: 1196051 - RNA, 18 nt, Human
acaggguuucaccauguu

SEQ ID NO: 1196052 - RNA, 21 nt, Human
acaggguuucaccauguuggc

SEQ ID NO: 1196053 - RNA, 24 nt, Human
acaggguuucaccauguuggccag

SEQ ID NO: 1196054 - RNA, 21 nt, Human
acaguggcgcaaucuuggcuc

SEQ ID NO: 1196055 - RNA, 24 nt, Human
accacuuggaacaccccaguuuug

SEQ ID NO: 1196056 - RNA, 18 nt, Human
accauguuggccaggcug

SEQ ID NO: 1196057 - RNA, 19 nt, Human
acccaggcuggaguacagu

SEQ ID NO: 1196058 - RNA, 23 nt, Human
accuccuccuccucucucuccca

SEQ ID NO: 1196059 - RNA, 25 nt, Human
acuauguugcccaggcuggacucca

SEQ ID NO: 1196060 - RNA, 25 nt, Human
acucaaaaaaugcugcuuagccacc

SEQ ID NO: 1196061 - RNA, 20 nt, Human
acucaagcaauccucccauc

SEQ ID NO: 1196062 - RNA, 19 nt, Human
acugcagccucaaccuccu

SEQ ID NO: 1196063 - RNA, 18 nt, Human
acugcagccuccaccucc

SEQ ID NO: 1196064 - RNA, 18 nt, Human
agccaccgcaccuggccu

SEQ ID NO: 1196065 - RNA, 20 nt, Human
aggagcugccuugagagagu

SEQ ID NO: 1196066 - RNA, 22 nt, Human
aggagcugccuugagagagugg

SEQ ID NO: 1196067 - RNA, 25 nt, Human
aggcuggagugcaguggcacagucu

SEQ ID NO: 1196068 - RNA, 24 nt, Human
aggugauccgccugacucagccuc

SEQ ID NO: 1196069 - RNA, 20 nt, Human
aguacaguggcgcaaucuug

SEQ ID NO: 1196070 - RNA, 24 nt, Human
aguacaguggcgcaaucuuggcuc

SEQ ID NO: 1196071 - RNA, 21 nt, Human
agugcaguggcacagucuuug

SEQ ID NO: 1196072 - RNA, 19 nt, Human
auaccuccuccuccucucu

SEQ ID NO: 1196073 - RNA, 25 nt, Human
aucccaaugugcgugcguuguccau

SEQ ID NO: 1196074 - RNA, 21 nt, Human
augggcuguuuuuguguccag

SEQ ID NO: 1196075 - RNA, 19 nt, Human
auguagucucccguuuucu

SEQ ID NO: 1196076 - RNA, 20 nt, Human
auguugcccaggcuggacuc

SEQ ID NO: 1196077 - RNA, 24 nt, Human
auuuuuuuauuuuugguagagaca

SEQ ID NO: 1196078 - RNA, 21 nt, Human
caaaaaaugcugcuuagccac

SEQ ID NO: 1196079 - RNA, 23 nt, Human
caaaaaaugcugcuuagccaccc

SEQ ID NO: 1196080 - RNA, 24 nt, Human
caaagugcugggauaacaggugug

SEQ ID NO: 1196081 - RNA, 24 nt, Human
caaaguguugggauuacaggcgug

SEQ ID NO: 1196082 - RNA, 25 nt, Human
caaccuccuggacucaagcaauccu

SEQ ID NO: 1196083 - RNA, 28 nt, Human
caacuccuggacucgagugauccucccu

SEQ ID NO: 1196084 - RNA, 27 nt, Human
caagcaauccucccaucucagccuccc

SEQ ID NO: 1196085 - RNA, 22 nt, Human
caaguaccugggauuacaggca

SEQ ID NO: 1196086 - RNA, 21 nt, Human
cacaaacaucacacugccuuc

SEQ ID NO: 1196087 - RNA, 24 nt, Human
cacacaaacaucacacugccuucc

SEQ ID NO: 1196088 - RNA, 18 nt, Human
caccacuuggaacacccc

SEQ ID NO: 1196089 - RNA, 21 nt, Human
caccauguuggccaggcuggu

SEQ ID NO: 1196090 - RNA, 24 nt, Human
caccauguuggccaggcuggucuc

SEQ ID NO: 1196091 - RNA, 27 nt, Human
caccauguuggccaggcuggucucaaa

SEQ ID NO: 1196092 - RNA, 20 nt, Human
caccgcaccuggccuggucc

SEQ ID NO: 1196093 - RNA, 22 nt, Human
caccggcacacacaaacaucac

SEQ ID NO: 1196094 - RNA, 19 nt, Human
cacuauguugcccaggcug

SEQ ID NO: 1196095 - RNA, 24 nt, Human
cacuauguugcccaggcuggacuc

SEQ ID NO: 1196096 - RNA, 19 nt, Human
cacugcagccucaaccucc

SEQ ID NO: 1196097 - RNA, 23 nt, Human
cacugcagccuccaccuccuggg

SEQ ID NO: 1196098 - RNA, 20 nt, Human
cagccucaaccuccuggacu

SEQ ID NO: 1196099 - RNA, 25 nt, Human
cagccucaaccuccuggacucaagc

SEQ ID NO: 1196100 - RNA, 23 nt, Human
cagccuccaccuccuggguucaa

SEQ ID NO: 1196101 - RNA, 24 nt, Human
caggguuucaccauguuggccagg

SEQ ID NO: 1196102 - RNA, 19 nt, Human
caugcccccacacccagcu

SEQ ID NO: 1196103 - RNA, 24 nt, Human
cauguuggccaggcuggucucaaa

SEQ ID NO: 1196104 - RNA, 21 nt, Human
ccaaagugcugggauaacagg

SEQ ID NO: 1196105 - RNA, 24 nt, Human
ccaaagugcugggauaacaggugu

SEQ ID NO: 1196106 - RNA, 22 nt, Human
ccaaaguguugggauuacaggc

SEQ ID NO: 1196107 - RNA, 22 nt, Human
ccaaaguguugggauuacaggc

SEQ ID NO: 1196108 - RNA, 24 nt, Human
ccaaaguguugggauuacaggcgu

SEQ ID NO: 1196109 - RNA, 21 nt, Human
ccacaccacuuggaacacccc

SEQ ID NO: 1196110 - RNA, 26 nt, Human
ccaccuccuggguucaagcaauucuu

SEQ ID NO: 1196111 - RNA, 22 nt, Human
ccauaccuccuccuccucucuc

SEQ ID NO: 1196112 - RNA, 19 nt, Human
ccaugccugaccucacugg

SEQ ID NO: 1196113 - RNA, 23 nt, Human
cccauaccuccuccuccucucuc

SEQ ID NO: 1196114 - RNA, 24 nt, Human
cccucuguugcccaggcuggagug

SEQ ID NO: 1196115 - RNA, 20 nt, Human
ccucaaccuccuggacucaa

SEQ ID NO: 1196116 - RNA, 22 nt, Human
ccucaggugauccgccugacuc

SEQ ID NO: 1196117 - RNA, 19 nt, Human
ccuccaccuccuggguuca

SEQ ID NO: 1196118 - RNA, 26 nt, Human
ccucccaccuuggccucccaaagugc

SEQ ID NO: 1196119 - RNA, 24 nt, Human
ccuccuggguucaagcaauucucc

SEQ ID NO: 1196120 - RNA, 18 nt, Human
ccugaccucaggugaucc

SEQ ID NO: 1196121 - RNA, 23 nt, Human
ccugaccucaggugauccgccug

SEQ ID NO: 1196122 - RNA, 24 nt, Human
ccugaccucaggugauccgccuga

SEQ ID NO: 1196123 - RNA, 20 nt, Human
ccuggacucaagcaauccuc

SEQ ID NO: 1196124 - RNA, 22 nt, Human
ccuggacucgagugauccuccc

SEQ ID NO: 1196125 - RNA, 22 nt, Human
ccuggguucaagcaauucuccc

SEQ ID NO: 1196126 - RNA, 19 nt, Human
ccuuugugcuauaaaguuu

SEQ ID NO: 1196127 - RNA, 27 nt, Human
cgagugauccucccaccuuggccuccc

SEQ ID NO: 1196128 - RNA, 25 nt, Human
cguguaggagcugccuugagagagu

SEQ ID NO: 1196129 - RNA, 24 nt, Human
cucaaaaaaugcugcuuagccacc

SEQ ID NO: 1196130 - RNA, 24 nt, Human
cucaagcaauccucccaucucagc

SEQ ID NO: 1196131 - RNA, 19 nt, Human
cucaaguaccugggauuac

SEQ ID NO: 1196132 - RNA, 21 nt, Human
cucacugcagccuccaccucc

SEQ ID NO: 1196133 - RNA, 24 nt, Human
cucacugcagccuccaccuccugg

SEQ ID NO: 1196134 - RNA, 21 nt, Human
cucagccucccaaguagcugg

SEQ ID NO: 1196135 - RNA, 24 nt, Human
cucagccucccaaguagcuggggc

SEQ ID NO: 1196136 - RNA, 24 nt, Human
cucccacaccacuuggaacacccc

SEQ ID NO: 1196137 - RNA, 23 nt, Human
cucccucuguugcccaggcugga

SEQ ID NO: 1196138 - RNA, 24 nt, Human
cucccucuguugcccaggcuggag

SEQ ID NO: 1196139 - RNA, 19 nt, Human
cucccugccucagccucuc

SEQ ID NO: 1196140 - RNA, 21 nt, Human
cuccuggguucaagcaauucu

SEQ ID NO: 1196141 - RNA, 24 nt, Human
cucgagugauccucccaccuuggc

SEQ ID NO: 1196142 - RNA, 24 nt, Human
cucgcucugucacccaggcuggag

SEQ ID NO: 1196143 - RNA, 20 nt, Human
cucugucacccaggcuggag

SEQ ID NO: 1196144 - RNA, 23 nt, Human
cucugucacccaggcuggaguac

SEQ ID NO: 1196145 - RNA, 23 nt, Human
cucuguugcccaggcuggagugc

SEQ ID NO: 1196146 - RNA, 22 nt, Human
cugcagccucaaccuccuggac

SEQ ID NO: 1196147 - RNA, 23 nt, Human
cugcagccuccaccuccuggguu

SEQ ID NO: 1196148 - RNA, 24 nt, Human
cugcagccuccaccuccuggguuc

SEQ ID NO: 1196149 - RNA, 21 nt, Human
cuggcacaugcccccacaccc

SEQ ID NO: 1196150 - RNA, 19 nt, Human
cugucacccaggcuggagu

SEQ ID NO: 1196151 - RNA, 24 nt, Human
gaccucaggugauccgccugacuc

SEQ ID NO: 1196152 - RNA, 24 nt, Human
gagggucucacuauguugcccagg

SEQ ID NO: 1196153 - RNA, 25 nt, Human
gagugauccucccaccuuggccucc

SEQ ID NO: 1196154 - RNA, 25 nt, Human
gagugauccucccaccuuggccucc

SEQ ID NO: 1196155 - RNA, 18 nt, Human
gauaacaggugugagcca

SEQ ID NO: 1196156 - RNA, 24 nt, Human
gauuacaggcacaugcuaccaugc

SEQ ID NO: 1196157 - RNA, 18 nt, Human
gauuacaggcgugagcca

SEQ ID NO: 1196158 - RNA, 22 nt, Human
gauuacaggcgugagccaccgc

SEQ ID NO: 1196159 - RNA, 23 nt, Human
gauuacaggcgugagccaccgca

SEQ ID NO: 1196160 - RNA, 19 nt, Human
gcccaggcuggagugcagu

SEQ ID NO: 1196161 - RNA, 18 nt, Human
gccucaaccuccuggacu

SEQ ID NO: 1196162 - RNA, 21 nt, Human
gcucacugcagccuccaccuc

SEQ ID NO: 1196163 - RNA, 24 nt, Human
gcucccucuguugcccaggcugga

SEQ ID NO: 1196164 - RNA, 19 nt, Human
gcuggaguacaguggcgca

SEQ ID NO: 1196165 - RNA, 19 nt, Human
gcuggagugcaguggcaca

SEQ ID NO: 1196166 - RNA, 23 nt, Human
gcuggucucaaacuccugaccuc

SEQ ID NO: 1196167 - RNA, 21 nt, Human
ggagucauccccauaccuccu

SEQ ID NO: 1196168 - RNA, 24 nt, Human
ggcuggucucaaacuccugaccuc

SEQ ID NO: 1196169 - RNA, 22 nt, Human
ggguuucaccauguuggccagg

SEQ ID NO: 1196170 - RNA, 21 nt, Human
guagagacaggguuucaccau

SEQ ID NO: 1196171 - RNA, 22 nt, Human
guagagacaggguuucaccaug

SEQ ID NO: 1196172 - RNA, 25 nt, Human
guccauuuccuuuuaacccugccuu

SEQ ID NO: 1196173 - RNA, 24 nt, Human
gugauccgccugacucagccuccc

SEQ ID NO: 1196174 - RNA, 18 nt, Human
uaaagugaguuccagacc

SEQ ID NO: 1196175 - RNA, 23 nt, Human
uaacagcagaccuucccauccca

SEQ ID NO: 1196176 - RNA, 24 nt, Human
uaauuucuguauuuuuuauugaga

SEQ ID NO: 1196177 - RNA, 23 nt, Human
uaauuuuuuuauuuuugguagag

SEQ ID NO: 1196178 - RNA, 24 nt, Human
uaauuuuuuuauuuuugguagaga

SEQ ID NO: 1196179 - RNA, 22 nt, Human
uacaggcacaugcuaccaugcc

SEQ ID NO: 1196180 - RNA, 22 nt, Human
uacaggcgugagccaccgcacc

SEQ ID NO: 1196181 - RNA, 23 nt, Human
uacaggcgugagccaccgcaccu

SEQ ID NO: 1196182 - RNA, 23 nt, Human
uacaguggcgcaaucuuggcuca

SEQ ID NO: 1196183 - RNA, 24 nt, Human
uaccuccuccuccucucucuccca

SEQ ID NO: 1196184 - RNA, 21 nt, Human
uacuggcacaugcccccacac

SEQ ID NO: 1196185 - RNA, 22 nt, Human
uagagacaggguuucaccaugu

SEQ ID NO: 1196186 - RNA, 23 nt, Human
uaugggcuguuuuuguguccagu

SEQ ID NO: 1196187 - RNA, 18 nt, Human
uauguugcccaggcugga

SEQ ID NO: 1196188 - RNA, 24 nt, Human
uauguugcccaggcuggacuccaa

SEQ ID NO: 1196189 - RNA, 23 nt, Human
ucaaguaccugggauuacaggca

SEQ ID NO: 1196190 - RNA, 18 nt, Human
ucacugagcgcugcugua

SEQ ID NO: 1196191 - RNA, 19 nt, Human
ucacugcagccucaaccuc

SEQ ID NO: 1196192 - RNA, 20 nt, Human
ucacugcagccucaaccucc

SEQ ID NO: 1196193 - RNA, 23 nt, Human
ucacugcagccucaaccuccugg

SEQ ID NO: 1196194 - RNA, 23 nt, Human
ucacugcagccuccaccuccugg

SEQ ID NO: 1196195 - RNA, 24 nt, Human
ucacugcagccuccaccuccuggg

SEQ ID NO: 1196196 - RNA, 25 nt, Human
ucacugcagccuccaccuccugggu

SEQ ID NO: 1196197 - RNA, 27 nt, Human
ucacugcagccuccaccuccuggguuc

SEQ ID NO: 1196198 - RNA, 22 nt, Human
ucacugggcucugccuggucac

SEQ ID NO: 1196199 - RNA, 23 nt, Human
ucacugggcucugccuggucacu

SEQ ID NO: 1196200 - RNA, 20 nt, Human
ucagccucccaaguagcugg

SEQ ID NO: 1196201 - RNA, 23 nt, Human
ucagccucccaaguagcuggggc

SEQ ID NO: 1196202 - RNA, 20 nt, Human
ucauccccauaccuccuccu

SEQ ID NO: 1196203 - RNA, 23 nt, Human
ucccaaagugcugggauaacagg

SEQ ID NO: 1196204 - RNA, 24 nt, Human
ucccaaaguguugggauuacaggc

SEQ ID NO: 1196205 - RNA, 24 nt, Human
ucccaaguagcuggggcuacuggc

SEQ ID NO: 1196206 - RNA, 20 nt, Human
ucccucuguugcccaggcug

SEQ ID NO: 1196207 - RNA, 22 nt, Human
ucccucuguugcccaggcugga

SEQ ID NO: 1196208 - RNA, 24 nt, Human
ucccucuguugcccaggcuggagu

SEQ ID NO: 1196209 - RNA, 19 nt, Human
ucccugucacccacccaaa

SEQ ID NO: 1196210 - RNA, 27 nt, Human
uccucccaucucagccucccaaguagc

SEQ ID NO: 1196211 - RNA, 21 nt, Human
uccuggguucaagcaauucuc

SEQ ID NO: 1196212 - RNA, 25 nt, Human
uccuggguucaagcaauucucccug

SEQ ID NO: 1196213 - RNA, 24 nt, Human
ucucaaguaccugggauuacaggc

SEQ ID NO: 1196214 - RNA, 22 nt, Human
ucucacuauguugcccaggcug

SEQ ID NO: 1196215 - RNA, 23 nt, Human
ucucacuauguugcccaggcugg

SEQ ID NO: 1196216 - RNA, 24 nt, Human
ucucacuauguugcccaggcugga

SEQ ID NO: 1196217 - RNA, 19 nt, Human
ucucccugccucagccucu

SEQ ID NO: 1196218 - RNA, 19 nt, Human
ucucgcucugucacccagg

SEQ ID NO: 1196219 - RNA, 23 nt, Human
ucucgcucugucacccaggcugg

SEQ ID NO: 1196220 - RNA, 24 nt, Human
ucucgcucugucacccaggcugga

SEQ ID NO: 1196221 - RNA, 25 nt, Human
ucucgcucugucacccaggcuggag

SEQ ID NO: 1196222 - RNA, 26 nt, Human
ucucgcucugucacccaggcuggagu

SEQ ID NO: 1196223 - RNA, 18 nt, Human
ucugucacccaggcugga

SEQ ID NO: 1196224 - RNA, 24 nt, Human
ucugucacccaggcuggaguacag

SEQ ID NO: 1196225 - RNA, 18 nt, Human
ucuguugcccaggcugga

SEQ ID NO: 1196226 - RNA, 24 nt, Human
ucuguugcccaggcuggagugcag

SEQ ID NO: 1196227 - RNA, 21 nt, Human
ucuuuguucacugcagccuca

SEQ ID NO: 1196228 - RNA, 18 nt, Human
ugaccucaggugauccgc

SEQ ID NO: 1196229 - RNA, 24 nt, Human
ugacucagccucccaaaguguugg

SEQ ID NO: 1196230 - RNA, 22 nt, Human
ugagacaagggcucccucuguu

SEQ ID NO: 1196231 - RNA, 18 nt, Human
ugagaugggggagggucu

SEQ ID NO: 1196232 - RNA, 20 nt, Human
ugcccaggcuggacuccaac

SEQ ID NO: 1196233 - RNA, 18 nt, Human
ugcccaggcuggagugca

SEQ ID NO: 1196234 - RNA, 21 nt, Human
ugcccaggcuggagugcagug

SEQ ID NO: 1196235 - RNA, 22 nt, Human
ugcccaggcuggagugcagugg

SEQ ID NO: 1196236 - RNA, 24 nt, Human
ugcccaggcuggagugcaguggca

SEQ ID NO: 1196237 - RNA, 24 nt, Human
ugccucagccucucaaguaccugg

SEQ ID NO: 1196238 - RNA, 23 nt, Human
ugcuauaaaguuugcagagcacu

SEQ ID NO: 1196239 - RNA, 18 nt, Human
ugcuggagggucauuugg

SEQ ID NO: 1196240 - RNA, 21 nt, Human
uggaacaccccaguuuuggga

SEQ ID NO: 1196241 - RNA, 24 nt, Human
uggaguacaguggcgcaaucuugg

SEQ ID NO: 1196242 - RNA, 21 nt, Human
uggagugcaguggcacagucu

SEQ ID NO: 1196243 - RNA, 22 nt, Human
uggagugcaguggcacagucuu

SEQ ID NO: 1196244 - RNA, 23 nt, Human
uggagugcaguggcacagucuuu

SEQ ID NO: 1196245 - RNA, 23 nt, Human
uggcaagugauuagcuuugggag

SEQ ID NO: 1196246 - RNA, 24 nt, Human
uggccaggcuggucucaaacuccu

SEQ ID NO: 1196247 - RNA, 20 nt, Human
uggcuccccggcacuguuuu

SEQ ID NO: 1196248 - RNA, 21 nt, Human
ugggauaacaggugugagcca

SEQ ID NO: 1196249 - RNA, 22 nt, Human
ugggauaacaggugugagccau

SEQ ID NO: 1196250 - RNA, 22 nt, Human
ugggauuacaggcacaugcuac

SEQ ID NO: 1196251 - RNA, 24 nt, Human
ugggauuacaggcacaugcuacca

SEQ ID NO: 1196252 - RNA, 25 nt, Human
ugggauuacaggcacaugcuaccau

SEQ ID NO: 1196253 - RNA, 18 nt, Human
ugggauuacaggcgugag

SEQ ID NO: 1196254 - RNA, 19 nt, Human
ugggauuacaggcgugagc

SEQ ID NO: 1196255 - RNA, 21 nt, Human
ugggauuacaggcgugagcca

SEQ ID NO: 1196256 - RNA, 22 nt, Human
ugggauuacaggcgugagccac

SEQ ID NO: 1196257 - RNA, 23 nt, Human
ugggauuacaggcgugagccacc

SEQ ID NO: 1196258 - RNA, 24 nt, Human
ugggauuacaggcgugagccaccg

SEQ ID NO: 1196259 - RNA, 21 nt, Human
ugggguacaguggcaagugau

SEQ ID NO: 1196260 - RNA, 22 nt, Human
uggguucaagcaauucucccug

SEQ ID NO: 1196261 - RNA, 23 nt, Human
ugguagagacaggguuucaccau

SEQ ID NO: 1196262 - RNA, 24 nt, Human
ugguagagacaggguuucaccaug

SEQ ID NO: 1196263 - RNA, 22 nt, Human
uuacugcaagggaaaaaauaau

SEQ ID NO: 1196264 - RNA, 22 nt, Human
uucaagcaauucucccugccuc

SEQ ID NO: 1196265 - RNA, 24 nt, Human
uucacugcagccucaaccuccugg

SEQ ID NO: 1196266 - RNA, 24 nt, Human
uugcccaggcuggagugcaguggc

SEQ ID NO: 1196267 - RNA, 18 nt, Human
uuggccucccaaagugcu

SEQ ID NO: 1196268 - RNA, 24 nt, Human
uugguagagacaggguuucaccau

SEQ ID NO: 1196269 - RNA, 24 nt, Human
uuucaccauguuggccaggcuggu

SEQ ID NO: 1196270 - RNA, 23 nt, Human
uuugggaaaaggcagcguccaga

SEQ ID NO: 1196271 - RNA, 23 nt, Human
uuuuauuuuugguagagacaggg

SEQ ID NO: 1196272 - RNA, 22 nt, Human
uuuuugguagagacaggguuuc

SEQ ID NO: 1196273 - RNA, 24 nt, Human
uuuuugguagagacaggguuucac

SEQ ID NO: 1196274 - RNA, 26 nt, Human
uuuuuuuauuuuugguagagacaggg

SEQ ID NO: 1196275 - RNA, 18 nt, Human
aaacaagcaguuuauuua

SEQ ID NO: 1196276 - RNA, 22 nt, Human
aagcgccggaaucuccucagcu

SEQ ID NO: 1196277 - RNA, 25 nt, Human
agcaccaggagcugcagaagaagga

SEQ ID NO: 1196278 - RNA, 21 nt, Human
agcagcuauguacgaaaaagu

SEQ ID NO: 1196279 - RNA, 18 nt, Human
aggcggcagcgauggacc

SEQ ID NO: 1196280 - RNA, 24 nt, Human
caaacgagcacacaagcagcacca

SEQ ID NO: 1196281 - RNA, 25 nt, Human
cacagaaucaguauuuuuccccauc

SEQ ID NO: 1196282 - RNA, 18 nt, Human
caugccacuaauggagaa

SEQ ID NO: 1196283 - RNA, 25 nt, Human
ccagguccgcaccaaacgagcacac

SEQ ID NO: 1196284 - RNA, 24 nt, Human
cggcagcgauggaccagggcagag

SEQ ID NO: 1196285 - RNA, 18 nt, Human
cuacauguagcagcuaug

SEQ ID NO: 1196286 - RNA, 19 nt, Human
cuggaguaaagaagcaggu

SEQ ID NO: 1196287 - RNA, 19 nt, Human
gagcaugccacuaauggag

SEQ ID NO: 1196288 - RNA, 18 nt, Human
gaguaaagaagcagguuc

SEQ ID NO: 1196289 - RNA, 23 nt, Human
gguauuuucacagaaucaguauu

SEQ ID NO: 1196290 - RNA, 21 nt, Human
gugguggaaccaaauugcagu

SEQ ID NO: 1196291 - RNA, 19 nt, Human
uaagagcugaaugagcaug

SEQ ID NO: 1196292 - RNA, 23 nt, Human
uaguagucaggaugugguggaac

SEQ ID NO: 1196293 - RNA, 21 nt, Human
ucagcugccguuucacaaaag

SEQ ID NO: 1196294 - RNA, 18 nt, Human
ugacuugaagggaaaagu

SEQ ID NO: 1196295 - RNA, 21 nt, Human
uguuguuguuguuguuuuuga

SEQ ID NO: 1196296 - RNA, 26 nt, Human
uucacagaaucaguauuuuuccccau

SEQ ID NO: 1196297 - RNA, 23 nt, Human
uuucacagaaucaguauuuuucc

SEQ ID NO: 1196298 - RNA, 21 nt, Human
uuuuuauguuguuguuguugu

SEQ ID NO: 1196299 - RNA, 24 nt, Human
aaagugcugggauuacaggcauga

SEQ ID NO: 1196300 - RNA, 25 nt, Human
aagcgauucuccugccucagccucc

SEQ ID NO: 1196301 - RNA, 20 nt, Human
aagggguuucaccauauugg

SEQ ID NO: 1196302 - RNA, 21 nt, Human
aagggguuucaccauauuggu

SEQ ID NO: 1196303 - RNA, 24 nt, Human
aagggguuucaccauauuggucag

SEQ ID NO: 1196304 - RNA, 20 nt, Human
aaguagcugggauuacaggc

SEQ ID NO: 1196305 - RNA, 26 nt, Human
aaguagcugggauuacaggcgccugc

SEQ ID NO: 1196306 - RNA, 19 nt, Human
aagugcugggauuacaggc

SEQ ID NO: 1196307 - RNA, 21 nt, Human
aagugcugggauuacaggcau

SEQ ID NO: 1196308 - RNA, 26 nt, Human
aagugcugggauuacaggcaugagcc

SEQ ID NO: 1196309 - RNA, 20 nt, Human
aauccacccgccuuggcuuc

SEQ ID NO: 1196310 - RNA, 19 nt, Human
acaggcgccugccaccacg

SEQ ID NO: 1196311 - RNA, 24 nt, Human
accauauuggucaggcugguuuug

SEQ ID NO: 1196312 - RNA, 25 nt, Human
acccgccuuggcuucccaaagugcu

SEQ ID NO: 1196313 - RNA, 24 nt, Human
accucguaauccacccgccuuggc

SEQ ID NO: 1196314 - RNA, 19 nt, Human
acucaucugacaccccccc

SEQ ID NO: 1196315 - RNA, 25 nt, Human
acucugucgcccaggcuggagugca

SEQ ID NO: 1196316 - RNA, 23 nt, Human
agaguuucauuuggcaagcaccu

SEQ ID NO: 1196317 - RNA, 24 nt, Human
agcgauucuccugccucagccucc

SEQ ID NO: 1196318 - RNA, 21 nt, Human
aggcaaagguggagaguaggg

SEQ ID NO: 1196319 - RNA, 25 nt, Human
aggcuggagugcagugucacgaucu

SEQ ID NO: 1196320 - RNA, 24 nt, Human
agggguuucaccauauuggucagg

SEQ ID NO: 1196321 - RNA, 24 nt, Human
agugcagugucacgaucuuggcuc

SEQ ID NO: 1196322 - RNA, 22 nt, Human
auaacccguguuaaggagcaag

SEQ ID NO: 1196323 - RNA, 21 nt, Human
aucucguuaugauaacccgug

SEQ ID NO: 1196324 - RNA, 20 nt, Human
caaagaaacuguacuaaugc

SEQ ID NO: 1196325 - RNA, 24 nt, Human
caaagugcugggauuacaggcaug

SEQ ID NO: 1196326 - RNA, 22 nt, Human
caagcgauucuccugccucagc

SEQ ID NO: 1196327 - RNA, 19 nt, Human
caccauauuggucaggcug

SEQ ID NO: 1196328 - RNA, 21 nt, Human
caccauauuggucaggcuggu

SEQ ID NO: 1196329 - RNA, 24 nt, Human
caccauauuggucaggcugguuuu

SEQ ID NO: 1196330 - RNA, 23 nt, Human
cacccgccuuggcuucccaaagu

SEQ ID NO: 1196331 - RNA, 24 nt, Human
cacccgccuuggcuucccaaagug

SEQ ID NO: 1196332 - RNA, 24 nt, Human
cacucugucgcccaggcuggagug

SEQ ID NO: 1196333 - RNA, 23 nt, Human
cacugugaccucugcccuguggg

SEQ ID NO: 1196334 - RNA, 18 nt, Human
cagacucugaauccaacu

SEQ ID NO: 1196335 - RNA, 20 nt, Human
cagaguuucauuuggcaagc

SEQ ID NO: 1196336 - RNA, 26 nt, Human
caggcgccugccaccacgguaauuuu

SEQ ID NO: 1196337 - RNA, 24 nt, Human
cauucuuccuuuuuccuccuuacu

SEQ ID NO: 1196338 - RNA, 23 nt, Human
ccaaagugcugggauuacaggca

SEQ ID NO: 1196339 - RNA, 24 nt, Human
ccaaagugcugggauuacaggcau

SEQ ID NO: 1196340 - RNA, 22 nt, Human
ccaaguagcugggauuacaggc

SEQ ID NO: 1196341 - RNA, 23 nt, Human
ccaucuuuccagacucugaaucc

SEQ ID NO: 1196342 - RNA, 24 nt, Human
cccaaagugcugggauuacaggca

SEQ ID NO: 1196343 - RNA, 23 nt, Human
cccaaguagcugggauuacaggc

SEQ ID NO: 1196344 - RNA, 24 nt, Human
cccaaguagcugggauuacaggcg

SEQ ID NO: 1196345 - RNA, 21 nt, Human
cccccuucuuccuccuaacuu

SEQ ID NO: 1196346 - RNA, 19 nt, Human
cccuccuuccuacuuccuu

SEQ ID NO: 1196347 - RNA, 18 nt, Human
cccuccuuccuccuuucu

SEQ ID NO: 1196348 - RNA, 19 nt, Human
cccucucccuccuuccucc

SEQ ID NO: 1196349 - RNA, 19 nt, Human
ccuacuucccucucccucc

SEQ ID NO: 1196350 - RNA, 19 nt, Human
ccuacuucccucucccucc

SEQ ID NO: 1196351 - RNA, 19 nt, Human
ccuacuuccucuuccucca

SEQ ID NO: 1196352 - RNA, 24 nt, Human
ccucacucugucgcccaggcugga

SEQ ID NO: 1196353 - RNA, 26 nt, Human
ccucacucugucgcccaggcuggagu

SEQ ID NO: 1196354 - RNA, 27 nt, Human
ccucacucugucgcccaggcuggagug

SEQ ID NO: 1196355 - RNA, 18 nt, Human
ccucccuccuuccuacuu

SEQ ID NO: 1196356 - RNA, 20 nt, Human
ccucccuccuuccuacuucc

SEQ ID NO: 1196357 - RNA, 22 nt, Human
ccucuuccuccauuuucuuucc

SEQ ID NO: 1196358 - RNA, 20 nt, Human
ccugaccucguaauccaccc

SEQ ID NO: 1196359 - RNA, 21 nt, Human
ccugccaucaaacuucccuug

SEQ ID NO: 1196360 - RNA, 26 nt, Human
ccugccaucaaacuucccuuguggca

SEQ ID NO: 1196361 - RNA, 23 nt, Human
ccugccucagccucccaaguagc

SEQ ID NO: 1196362 - RNA, 24 nt, Human
ccugccucagccucccaaguagcu

SEQ ID NO: 1196363 - RNA, 22 nt, Human
ccugucuuccuuuuuucuucuu

SEQ ID NO: 1196364 - RNA, 23 nt, Human
ccuucauucuuccuuuuuccucc

SEQ ID NO: 1196365 - RNA, 18 nt, Human
ccuucgucuucuucuucc

SEQ ID NO: 1196366 - RNA, 19 nt, Human
ccuucuuccuccucccucc

SEQ ID NO: 1196367 - RNA, 19 nt, Human
cgcugaaguuuggaaagga

SEQ ID NO: 1196368 - RNA, 24 nt, Human
cucacucugucgcccaggcuggag

SEQ ID NO: 1196369 - RNA, 19 nt, Human
cucacugugaccucugccc

SEQ ID NO: 1196370 - RNA, 21 nt, Human
cucacugugaccucugcccug

SEQ ID NO: 1196371 - RNA, 24 nt, Human
cucagccucccaaguagcugggau

SEQ ID NO: 1196372 - RNA, 20 nt, Human
cucccuccuuccuacuuccu

SEQ ID NO: 1196373 - RNA, 22 nt, Human
cuccuccuucgucuucuucuuc

SEQ ID NO: 1196374 - RNA, 24 nt, Human
cuccugaccucguaauccacccgc

SEQ ID NO: 1196375 - RNA, 24 nt, Human
cucuacacucaucugacacccccc

SEQ ID NO: 1196376 - RNA, 18 nt, Human
cucucugacggagccuca

SEQ ID NO: 1196377 - RNA, 24 nt, Human
cuguaaagauuguaucuuccaucu

SEQ ID NO: 1196378 - RNA, 24 nt, Human
cugugaccucugcccuguggguuc

SEQ ID NO: 1196379 - RNA, 24 nt, Human
cuguggguucaagcgauucuccug

SEQ ID NO: 1196380 - RNA, 24 nt, Human
cuucccucucccuccuuccuccuu

SEQ ID NO: 1196381 - RNA, 18 nt, Human
cuuccuacuuccucuucc

SEQ ID NO: 1196382 - RNA, 19 nt, Human
cuuccuccuuucuacuucc

SEQ ID NO: 1196383 - RNA, 19 nt, Human
cuuccuucuuccuccuccc

SEQ ID NO: 1196384 - RNA, 25 nt, Human
cuuccuuuuucccccuucuuccucc

SEQ ID NO: 1196385 - RNA, 19 nt, Human
cuucuuccuccucccuccu

SEQ ID NO: 1196386 - RNA, 23 nt, Human
cuucuucuuccuuuuucccccuu

SEQ ID NO: 1196387 - RNA, 26 nt, Human
cuucuucuuuuuucuuccuuccaucu

SEQ ID NO: 1196388 - RNA, 21 nt, Human
gaccucguaauccacccgccu

SEQ ID NO: 1196389 - RNA, 25 nt, Human
gaccucguaauccacccgccuuggc

SEQ ID NO: 1196390 - RNA, 24 nt, Human
gagaagggguuucaccauauuggu

SEQ ID NO: 1196391 - RNA, 18 nt, Human
gauuacaggcaugagccg

SEQ ID NO: 1196392 - RNA, 22 nt, Human
gauuacaggcaugagccgcugc

SEQ ID NO: 1196393 - RNA, 22 nt, Human
gauuacaggcaugagccgcugc

SEQ ID NO: 1196394 - RNA, 18 nt, Human
gauuacaggcgccugcca

SEQ ID NO: 1196395 - RNA, 21 nt, Human
gcccaggcuggagugcagugu

SEQ ID NO: 1196396 - RNA, 22 nt, Human
gccuuggcuucccaaagugcug

SEQ ID NO: 1196397 - RNA, 24 nt, Human
gccuuggcuucccaaagugcuggg

SEQ ID NO: 1196398 - RNA, 24 nt, Human
gcgauucuccugccucagccuccc

SEQ ID NO: 1196399 - RNA, 23 nt, Human
gcugguuuugaacuccugaccuc

SEQ ID NO: 1196400 - RNA, 22 nt, Human
ggauuacaggcaugagccgcug

SEQ ID NO: 1196401 - RNA, 24 nt, Human
ggcugguuuugaacuccugaccuc

SEQ ID NO: 1196402 - RNA, 22 nt, Human
gggguuucaccauauuggucag

SEQ ID NO: 1196403 - RNA, 23 nt, Human
gggguuucaccauauuggucagg

SEQ ID NO: 1196404 - RNA, 20 nt, Human
ggguucaagcgauucuccug

SEQ ID NO: 1196405 - RNA, 20 nt, Human
gguuuggcuuauuaccggcu

SEQ ID NO: 1196406 - RNA, 24 nt, Human
guaauccacccgccuuggcuuccc

SEQ ID NO: 1196407 - RNA, 18 nt, Human
guagcugggauuacaggc

SEQ ID NO: 1196408 - RNA, 24 nt, Human
guguguccuccuccuucgucuucu

SEQ ID NO: 1196409 - RNA, 23 nt, Human
uaaaaaguguguccuccuccuuc

SEQ ID NO: 1196410 - RNA, 24 nt, Human
uaauuuuuguauuuuuaguagaga

SEQ ID NO: 1196411 - RNA, 19 nt, Human
uacacacuccaaguccugc

SEQ ID NO: 1196412 - RNA, 21 nt, Human
uacuaagauuccaaacgcuga

SEQ ID NO: 1196413 - RNA, 21 nt, Human
uacuuccuucuuccuccuccc

SEQ ID NO: 1196414 - RNA, 24 nt, Human
uaguacaucaugcauacacacucc

SEQ ID NO: 1196415 - RNA, 23 nt, Human
uaguagagaagggguuucaccau

SEQ ID NO: 1196416 - RNA, 24 nt, Human
uaguagagaagggguuucaccaua

SEQ ID NO: 1196417 - RNA, 20 nt, Human
ucaaaacacaauuuguugua

SEQ ID NO: 1196418 - RNA, 19 nt, Human
ucaagcgauucuccugccu

SEQ ID NO: 1196419 - RNA, 24 nt, Human
ucacucugucgcccaggcuggagu

SEQ ID NO: 1196420 - RNA, 24 nt, Human
ucacugugaccucugcccuguggg

SEQ ID NO: 1196421 - RNA, 20 nt, Human
ucagccucccaaguagcugg

SEQ ID NO: 1196422 - RNA, 19 nt, Human
ucaucugacacccccccaa

SEQ ID NO: 1196423 - RNA, 24 nt, Human
ucaugcauacacacuccaaguccu

SEQ ID NO: 1196424 - RNA, 23 nt, Human
uccaucuuccuucuucccucuga

SEQ ID NO: 1196425 - RNA, 24 nt, Human
ucccaaagugcugggauuacaggc

SEQ ID NO: 1196426 - RNA, 24 nt, Human
ucccaaguagcugggauuacaggc

SEQ ID NO: 1196427 - RNA, 20 nt, Human
ucccuccuuccuccuuucuc

SEQ ID NO: 1196428 - RNA, 18 nt, Human
ucccucucccuccuuccu

SEQ ID NO: 1196429 - RNA, 22 nt, Human
ucccuuguggcagcaacaguuu

SEQ ID NO: 1196430 - RNA, 25 nt, Human
uccuaacuucuuccuccuuucuacu

SEQ ID NO: 1196431 - RNA, 22 nt, Human
uccuccuccuucgucuucuucu

SEQ ID NO: 1196432 - RNA, 25 nt, Human
uccuucauucuuccuuuuuccuccu

SEQ ID NO: 1196433 - RNA, 24 nt, Human
uccuucuuccuccucccuccuucc

SEQ ID NO: 1196434 - RNA, 22 nt, Human
uccuucuucuuuuuucuucccu

SEQ ID NO: 1196435 - RNA, 24 nt, Human
uccuuucuacugccuucuuccucc

SEQ ID NO: 1196436 - RNA, 21 nt, Human
uccuuuucccugauuccuccu

SEQ ID NO: 1196437 - RNA, 24 nt, Human
ucgcccaggcuggagugcaguguc

SEQ ID NO: 1196438 - RNA, 27 nt, Human
ucuacuuccuccugucuuccuuuuuuc

SEQ ID NO: 1196439 - RNA, 24 nt, Human
ucucccuccuuccuccuuucuacu

SEQ ID NO: 1196440 - RNA, 26 nt, Human
ucuccugccucagccucccaaguagc

SEQ ID NO: 1196441 - RNA, 18 nt, Human
ucugucucucucucucuc

SEQ ID NO: 1196442 - RNA, 19 nt, Human
ucuuccuacuuccucuucc

SEQ ID NO: 1196443 - RNA, 20 nt, Human
ucuuccuccuuucuacuucc

SEQ ID NO: 1196444 - RNA, 19 nt, Human
ucuuccuuuuuucuucuuc

SEQ ID NO: 1196445 - RNA, 24 nt, Human
ucuucuuccuuuuucccccuucuc

SEQ ID NO: 1196446 - RNA, 22 nt, Human
ugaacuccugaccucguaaucc

SEQ ID NO: 1196447 - RNA, 21 nt, Human
ugaacuggagcaauuuaaaua

SEQ ID NO: 1196448 - RNA, 20 nt, Human
ugacacccccccaaagaaac

SEQ ID NO: 1196449 - RNA, 22 nt, Human
ugaggcugauuauuacguuggc

SEQ ID NO: 1196450 - RNA, 24 nt, Human
ugauuauuacguuggcaccaaucu

SEQ ID NO: 1196451 - RNA, 24 nt, Human
ugccucagccucccaaguagcugg

SEQ ID NO: 1196452 - RNA, 18 nt, Human
ugcugggauuacaggcau

SEQ ID NO: 1196453 - RNA, 23 nt, Human
uggagcaauuuaaauauuucuuu

SEQ ID NO: 1196454 - RNA, 19 nt, Human
uggagugcagugucacgau

SEQ ID NO: 1196455 - RNA, 23 nt, Human
uggagugcagugucacgaucuug

SEQ ID NO: 1196456 - RNA, 24 nt, Human
uggagugcagugucacgaucuugg

SEQ ID NO: 1196457 - RNA, 18 nt, Human
ugggauuacaggcaugag

SEQ ID NO: 1196458 - RNA, 19 nt, Human
ugggauuacaggcaugagc

SEQ ID NO: 1196459 - RNA, 20 nt, Human
ugggauuacaggcaugagcc

SEQ ID NO: 1196460 - RNA, 20 nt, Human
ugggauuacaggcaugagcc

SEQ ID NO: 1196461 - RNA, 20 nt, Human
ugggauuacaggcaugagcc

SEQ ID NO: 1196462 - RNA, 21 nt, Human
ugggauuacaggcaugagccg

SEQ ID NO: 1196463 - RNA, 22 nt, Human
ugggauuacaggcaugagccgc

SEQ ID NO: 1196464 - RNA, 24 nt, Human
ugggauuacaggcaugagccgcug

SEQ ID NO: 1196465 - RNA, 24 nt, Human
ugggauuacaggcaugagccgcug

SEQ ID NO: 1196466 - RNA, 21 nt, Human
ugggauuacaggcgccugcca

SEQ ID NO: 1196467 - RNA, 22 nt, Human
ugggauuacaggcgccugccac

SEQ ID NO: 1196468 - RNA, 24 nt, Human
ugggauuacaggcgccugccacca

SEQ ID NO: 1196469 - RNA, 23 nt, Human
uggguucaagcgauucuccugcc

SEQ ID NO: 1196470 - RNA, 24 nt, Human
uggguucaagcgauucuccugccu

SEQ ID NO: 1196471 - RNA, 24 nt, Human
uggucaggcugguuuugaacuccu

SEQ ID NO: 1196472 - RNA, 21 nt, Human
ugucgcccaggcuggagugca

SEQ ID NO: 1196473 - RNA, 21 nt, Human
uguguaaaaaguguguccucc

SEQ ID NO: 1196474 - RNA, 18 nt, Human
uuaguagagaagggguuu

SEQ ID NO: 1196475 - RNA, 22 nt, Human
uuaguagagaagggguuucacc

SEQ ID NO: 1196476 - RNA, 24 nt, Human
uuaguagagaagggguuucaccau

SEQ ID NO: 1196477 - RNA, 21 nt, Human
uucaagcgauucuccugccuc

SEQ ID NO: 1196478 - RNA, 23 nt, Human
uucaagcgauucuccugccucag

SEQ ID NO: 1196479 - RNA, 24 nt, Human
uucaagcgauucuccugccucagc

SEQ ID NO: 1196480 - RNA, 21 nt, Human
uucccccuucuuccuccuaac

SEQ ID NO: 1196481 - RNA, 21 nt, Human
uucccuuguggcagcaacagu

SEQ ID NO: 1196482 - RNA, 21 nt, Human
uuccuacuucccucucccucc

SEQ ID NO: 1196483 - RNA, 22 nt, Human
uuccuccuuucuacugccuucu

SEQ ID NO: 1196484 - RNA, 24 nt, Human
uuccucuacacucaucugacaccc

SEQ ID NO: 1196485 - RNA, 21 nt, Human
uuccuucuuccuccucccucc

SEQ ID NO: 1196486 - RNA, 18 nt, Human
uuccuucuucuuuuuucu

SEQ ID NO: 1196487 - RNA, 23 nt, Human
uucuuccuccuuucuacuuccuc

SEQ ID NO: 1196488 - RNA, 24 nt, Human
uuucaccauauuggucaggcuggu

SEQ ID NO: 1196489 - RNA, 24 nt, Human
uuuuuaguagagaagggguuucac

SEQ ID NO: 1196490 - RNA, 23 nt, Human
uuuuucuuccuuccaucuuccuu

SEQ ID NO: 1196491 - RNA, 20 nt, Human
uuuuuguauuuuuaguagag

SEQ ID NO: 1196492 - RNA, 21 nt, Human
agagggaccuuauucaggcuu

SEQ ID NO: 1196493 - RNA, 19 nt, Human
agauggcuucaggaagaca

SEQ ID NO: 1196494 - RNA, 19 nt, Human
aggaagacagcacagaaga

SEQ ID NO: 1196495 - RNA, 23 nt, Human
cagaagagggaccuuauucaggc

SEQ ID NO: 1196496 - RNA, 22 nt, Human
cagaaggaagccaggcauggug

SEQ ID NO: 1196497 - RNA, 20 nt, Human
caggaagacagcacagaaga

SEQ ID NO: 1196498 - RNA, 23 nt, Human
cuccacagauggcuucaggaaga

SEQ ID NO: 1196499 - RNA, 18 nt, Human
cuuggugcugaaccaauc

SEQ ID NO: 1196500 - RNA, 21 nt, Human
ucaggcuugaaccagaaggaa

SEQ ID NO: 1196501 - RNA, 20 nt, Human
aaaacaggaaaacacugagc

SEQ ID NO: 1196502 - RNA, 20 nt, Human
aaacaaaauagucuagaagc

SEQ ID NO: 1196503 - RNA, 23 nt, Human
aaacacugagcuaaagaaccaaa

SEQ ID NO: 1196504 - RNA, 21 nt, Human
aaagaaacuggucuuccagag

SEQ ID NO: 1196505 - RNA, 23 nt, Human
aaagaaauaggaagguaaaauua

SEQ ID NO: 1196506 - RNA, 19 nt, Human
aaagaugaugaaagaaucc

SEQ ID NO: 1196507 - RNA, 23 nt, Human
aaaguccugggauuacaggcgua

SEQ ID NO: 1196508 - RNA, 27 nt, Human
aaauagccuuagauugaaagaaacugg

SEQ ID NO: 1196509 - RNA, 25 nt, Human
aagaaaacaggaaaacacugagcua

SEQ ID NO: 1196510 - RNA, 24 nt, Human
aagucacaaaaauuggacuagaau

SEQ ID NO: 1196511 - RNA, 24 nt, Human
aaugcaguagcgugaucucagcuc

SEQ ID NO: 1196512 - RNA, 18 nt, Human
acaggcguaagccaccau

SEQ ID NO: 1196513 - RNA, 18 nt, Human
acaggguuucaccguguu

SEQ ID NO: 1196514 - RNA, 19 nt, Human
acaggguuucaccguguua

SEQ ID NO: 1196515 - RNA, 20 nt, Human
acaggguuucaccguguuag

SEQ ID NO: 1196516 - RNA, 24 nt, Human
acaggguuucaccguguuagccag

SEQ ID NO: 1196517 - RNA, 18 nt, Human
accauguuggccaggcug

SEQ ID NO: 1196518 - RNA, 18 nt, Human
acgggguuucaccauguu

SEQ ID NO: 1196519 - RNA, 23 nt, Human
acgggguuucaccauguuggcca

SEQ ID NO: 1196520 - RNA, 24 nt, Human
acgggguuucaccauguuggccag

SEQ ID NO: 1196521 - RNA, 25 nt, Human
acucugucgcccaagcaggaaugca

SEQ ID NO: 1196522 - RNA, 19 nt, Human
acuggaaccagacaaaccu

SEQ ID NO: 1196523 - RNA, 18 nt, Human
agacaaaccuggacuuga

SEQ ID NO: 1196524 - RNA, 18 nt, Human
agacaggguuucaccgug

SEQ ID NO: 1196525 - RNA, 19 nt, Human
agagacaggguuucaccgu

SEQ ID NO: 1196526 - RNA, 19 nt, Human
agagauuguuggauagaua

SEQ ID NO: 1196527 - RNA, 21 nt, Human
agauagauagauagauagaua

SEQ ID NO: 1196528 - RNA, 18 nt, Human
agccuucugaauagcugg

SEQ ID NO: 1196529 - RNA, 25 nt, Human
aggcuggagugcaguggcgugaucu

SEQ ID NO: 1196530 - RNA, 19 nt, Human
agguaggggacugaggaag

SEQ ID NO: 1196531 - RNA, 22 nt, Human
agguaggggacugaggaaggug

SEQ ID NO: 1196532 - RNA, 24 nt, Human
aggugaucugcccgccuuggccuc

SEQ ID NO: 1196533 - RNA, 18 nt, Human
aguagcugggacuacagg

SEQ ID NO: 1196534 - RNA, 19 nt, Human
aguagcugggacuacaggc

SEQ ID NO: 1196535 - RNA, 19 nt, Human
agugcaguggcgugaucuc

SEQ ID NO: 1196536 - RNA, 20 nt, Human
agugcaguggcgugaucucg

SEQ ID NO: 1196537 - RNA, 23 nt, Human
agugcaguggcgugaucucggcu

SEQ ID NO: 1196538 - RNA, 24 nt, Human
agugcaguggcgugaucucggcuc

SEQ ID NO: 1196539 - RNA, 24 nt, Human
aguuuaugcuucuuucaguuccau

SEQ ID NO: 1196540 - RNA, 21 nt, Human
auaauuuuuaaaacguuggag

SEQ ID NO: 1196541 - RNA, 23 nt, Human
aucuacuaucuucuuugguuagg

SEQ ID NO: 1196542 - RNA, 18 nt, Human
auucuccugccucagccu

SEQ ID NO: 1196543 - RNA, 21 nt, Human
auucuccugccucagccuccc

SEQ ID NO: 1196544 - RNA, 24 nt, Human
caaaguccugggauuacaggcgua

SEQ ID NO: 1196545 - RNA, 23 nt, Human
caaccuccaccucccggguucaa

SEQ ID NO: 1196546 - RNA, 22 nt, Human
caagugauucuccugccucagc

SEQ ID NO: 1196547 - RNA, 21 nt, Human
cacacauauauagucuagggu

SEQ ID NO: 1196548 - RNA, 24 nt, Human
caccacgcccggcuaauuuuugua

SEQ ID NO: 1196549 - RNA, 21 nt, Human
caccauguuggccaggcuggu

SEQ ID NO: 1196550 - RNA, 22 nt, Human
caccauguuggccaggcugguc

SEQ ID NO: 1196551 - RNA, 27 nt, Human
caccauguuggccaggcuggucccaaa

SEQ ID NO: 1196552 - RNA, 18 nt, Human
caccguguuagccaggau

SEQ ID NO: 1196553 - RNA, 24 nt, Human
caccguguuagccaggauggucuc

SEQ ID NO: 1196554 - RNA, 24 nt, Human
cacgccaccacgcccggcuaauuu

SEQ ID NO: 1196555 - RNA, 22 nt, Human
cacgccauucuccugccucagc

SEQ ID NO: 1196556 - RNA, 19 nt, Human
cacucugucgcccaagcag

SEQ ID NO: 1196557 - RNA, 19 nt, Human
cacugagcuaaagaaccaa

SEQ ID NO: 1196558 - RNA, 21 nt, Human
cacugcaaccuccaccucccg

SEQ ID NO: 1196559 - RNA, 23 nt, Human
cacugcaaccuccaccucccggg

SEQ ID NO: 1196560 - RNA, 22 nt, Human
cagagucucacuguugcccagg

SEQ ID NO: 1196561 - RNA, 22 nt, Human
caggaaaacacugagcuaaaga

SEQ ID NO: 1196562 - RNA, 21 nt, Human
caggcgcccaccaucacgccc

SEQ ID NO: 1196563 - RNA, 24 nt, Human
caggguuucaccguguuagccagg

SEQ ID NO: 1196564 - RNA, 18 nt, Human
cauauaaacacacauaua

SEQ ID NO: 1196565 - RNA, 22 nt, Human
cauccuuauacuguuuuguggg

SEQ ID NO: 1196566 - RNA, 24 nt, Human
cauguuggccaggcuggucccaaa

SEQ ID NO: 1196567 - RNA, 22 nt, Human
ccaaaguccugggauuacaggc

SEQ ID NO: 1196568 - RNA, 24 nt, Human
ccaaaguccugggauuacaggcgu

SEQ ID NO: 1196569 - RNA, 25 nt, Human
ccaaaguguuguugggauuacaggc

SEQ ID NO: 1196570 - RNA, 27 nt, Human
ccaaaguguuguugggauuacaggcgu

SEQ ID NO: 1196571 - RNA, 24 nt, Human
ccaccucccggguucaagugauuc

SEQ ID NO: 1196572 - RNA, 20 nt, Human
cccagguucacgccauucuc

SEQ ID NO: 1196573 - RNA, 23 nt, Human
cccgaguagcugggacuacaggc

SEQ ID NO: 1196574 - RNA, 24 nt, Human
cccgaguagcugggacuacaggcg

SEQ ID NO: 1196575 - RNA, 23 nt, Human
cccggguucaagugauucuccuc

SEQ ID NO: 1196576 - RNA, 23 nt, Human
cccggguucaagugauucuccug

SEQ ID NO: 1196577 - RNA, 24 nt, Human
ccucccggguucaagugauucucc

SEQ ID NO: 1196578 - RNA, 19 nt, Human
ccugacaggugaucugccc

SEQ ID NO: 1196579 - RNA, 23 nt, Human
ccugacaggugaucugcccgccu

SEQ ID NO: 1196580 - RNA, 23 nt, Human
ccugccucagccucccgaguagc

SEQ ID NO: 1196581 - RNA, 24 nt, Human
ccugccucagccucccgaguagcu

SEQ ID NO: 1196582 - RNA, 24 nt, Human
cgggguuucaccauguuggccagg

SEQ ID NO: 1196583 - RNA, 24 nt, Human
cucacugcaaccuccaccucccgg

SEQ ID NO: 1196584 - RNA, 19 nt, Human
cucacuguugcccaggcug

SEQ ID NO: 1196585 - RNA, 24 nt, Human
cucacuguugcccaggcuggagug

SEQ ID NO: 1196586 - RNA, 24 nt, Human
cucagccucccgaguagcugggac

SEQ ID NO: 1196587 - RNA, 24 nt, Human
cucagccuucugaauagcugggac

SEQ ID NO: 1196588 - RNA, 20 nt, Human
cucccggguucaagugauuc

SEQ ID NO: 1196589 - RNA, 23 nt, Human
cuccugacaggugaucugcccgc

SEQ ID NO: 1196590 - RNA, 24 nt, Human
cuccugaccucaugacccgccugc

SEQ ID NO: 1196591 - RNA, 18 nt, Human
cugcaaccuccaccuccc

SEQ ID NO: 1196592 - RNA, 23 nt, Human
cugcaaccuccaccucccggguu

SEQ ID NO: 1196593 - RNA, 24 nt, Human
cugcaaccuccaccucccggguuc

SEQ ID NO: 1196594 - RNA, 23 nt, Human
cugccucagccuucugaauagcu

SEQ ID NO: 1196595 - RNA, 24 nt, Human
cugcgagcuccgcuucccagguuc

SEQ ID NO: 1196596 - RNA, 21 nt, Human
cugcuguuacuuacuagcucu

SEQ ID NO: 1196597 - RNA, 18 nt, Human
cugugcuagagggaaauu

SEQ ID NO: 1196598 - RNA, 18 nt, Human
cugugguccuguccaaaa

SEQ ID NO: 1196599 - RNA, 23 nt, Human
cuucugaauagcugggacuacag

SEQ ID NO: 1196600 - RNA, 22 nt, Human
cuuuccagcacagaauuucugg

SEQ ID NO: 1196601 - RNA, 26 nt, Human
gaauagcugggacuacaguggcacac

SEQ ID NO: 1196602 - RNA, 20 nt, Human
gaccucaugacccgccugcc

SEQ ID NO: 1196603 - RNA, 19 nt, Human
gagcuaaagaaccaaauug

SEQ ID NO: 1196604 - RNA, 25 nt, Human
gaguagcugggacuacaggcgccca

SEQ ID NO: 1196605 - RNA, 19 nt, Human
gaucauguguaaaccccug

SEQ ID NO: 1196606 - RNA, 18 nt, Human
gauuacaggcguaagcca

SEQ ID NO: 1196607 - RNA, 21 nt, Human
gauuacaggcguaagccacca

SEQ ID NO: 1196608 - RNA, 24 nt, Human
gauuacaggcguaagccaccaugc

SEQ ID NO: 1196609 - RNA, 18 nt, Human
gauuacaggcgugagcca

SEQ ID NO: 1196610 - RNA, 19 nt, Human
gauuacaggcgugagccac

SEQ ID NO: 1196611 - RNA, 22 nt, Human
gauuacaggcgugagccacugc

SEQ ID NO: 1196612 - RNA, 19 nt, Human
gauucuccugccucagccu

SEQ ID NO: 1196613 - RNA, 22 nt, Human
gccaccaugcccggccccuuau

SEQ ID NO: 1196614 - RNA, 23 nt, Human
gcccagcuaauuuuuuguauuuu

SEQ ID NO: 1196615 - RNA, 20 nt, Human
gcccaggcuggagugcagug

SEQ ID NO: 1196616 - RNA, 24 nt, Human
gcccaggcuggagugcaguggcgu

SEQ ID NO: 1196617 - RNA, 22 nt, Human
gcccggcuaauuuuuguauuuu

SEQ ID NO: 1196618 - RNA, 19 nt, Human
gcuggagugcaguggcgug

SEQ ID NO: 1196619 - RNA, 18 nt, Human
ggaggaaagguaaucagu

SEQ ID NO: 1196620 - RNA, 19 nt, Human
ggauagagucuagaagcau

SEQ ID NO: 1196621 - RNA, 24 nt, Human
ggauggucucaaucuccugaccuc

SEQ ID NO: 1196622 - RNA, 24 nt, Human
ggauuacaggcguaagccaccaug

SEQ ID NO: 1196623 - RNA, 19 nt, Human
ggcacacgccaccacgccc

SEQ ID NO: 1196624 - RNA, 22 nt, Human
ggcuggagugcaguggcgugau

SEQ ID NO: 1196625 - RNA, 18 nt, Human
gggagggaaacugguagg

SEQ ID NO: 1196626 - RNA, 23 nt, Human
gggguuucaccauguuggccagg

SEQ ID NO: 1196627 - RNA, 22 nt, Human
ggguucaagugauucuccugcc

SEQ ID NO: 1196628 - RNA, 23 nt, Human
ggguucaagugauucuccugccu

SEQ ID NO: 1196629 - RNA, 21 nt, Human
guagaaacgggguuucaccau

SEQ ID NO: 1196630 - RNA, 22 nt, Human
guagaaacgggguuucaccaug

SEQ ID NO: 1196631 - RNA, 23 nt, Human
gucucacuguugcccaggcugga

SEQ ID NO: 1196632 - RNA, 24 nt, Human
gugauucuccugccucagccuucu

SEQ ID NO: 1196633 - RNA, 23 nt, Human
gugcuagagggaaauuuuggaaa

SEQ ID NO: 1196634 - RNA, 20 nt, Human
guguuguugggauuacaggc

SEQ ID NO: 1196635 - RNA, 25 nt, Human
guuaacaacccaaauaaaugagggg

SEQ ID NO: 1196636 - RNA, 21 nt, Human
guugcuucuggggagggaaac

SEQ ID NO: 1196637 - RNA, 22 nt, Human
guuguugggauuacaggcguga

SEQ ID NO: 1196638 - RNA, 21 nt, Human
uaaaaggacaggaaagaaaua

SEQ ID NO: 1196639 - RNA, 22 nt, Human
uaaaaggacaggaaagaaauag

SEQ ID NO: 1196640 - RNA, 21 nt, Human
uaaacaaaauagucuagaagc

SEQ ID NO: 1196641 - RNA, 22 nt, Human
uaauuuuuguauuuuugguaga

SEQ ID NO: 1196642 - RNA, 24 nt, Human
uaauuuuuuguauuuuuaguagag

SEQ ID NO: 1196643 - RNA, 25 nt, Human
uaauuuuuuguauuuuuaguagaga

SEQ ID NO: 1196644 - RNA, 23 nt, Human
uacaggcguaagccaccaugccc

SEQ ID NO: 1196645 - RNA, 19 nt, Human
uacaggcgugagccacugc

SEQ ID NO: 1196646 - RNA, 23 nt, Human
uacaggcgugagccacugcgccc

SEQ ID NO: 1196647 - RNA, 22 nt, Human
uagaaacgggguuucaccaugu

SEQ ID NO: 1196648 - RNA, 20 nt, Human
uagaauuccugaguacccau

SEQ ID NO: 1196649 - RNA, 22 nt, Human
uagagacaggguuucaccgugu

SEQ ID NO: 1196650 - RNA, 22 nt, Human
uagauagauagauagauagaua

SEQ ID NO: 1196651 - RNA, 22 nt, Human
uagauagauagauagauagaua

SEQ ID NO: 1196652 - RNA, 22 nt, Human
uagauagauagauagauagaua

SEQ ID NO: 1196653 - RNA, 22 nt, Human
uagauagauagauagauagaua

SEQ ID NO: 1196654 - RNA, 22 nt, Human
uagauagauagauagauagaua

SEQ ID NO: 1196655 - RNA, 22 nt, Human
uagauagauagauagauaggua

SEQ ID NO: 1196656 - RNA, 26 nt, Human
uagauagauagguacacacaugggua

SEQ ID NO: 1196657 - RNA, 24 nt, Human
uagcgugaucucagcucacugcaa

SEQ ID NO: 1196658 - RNA, 26 nt, Human
uaggaaaaagucacaaaaauuggacu

SEQ ID NO: 1196659 - RNA, 21 nt, Human
uaguagagacaggguuucacc

SEQ ID NO: 1196660 - RNA, 24 nt, Human
uaguagagacaggguuucaccgug

SEQ ID NO: 1196661 - RNA, 25 nt, Human
uaguagagacaggguuucaccgugu

SEQ ID NO: 1196662 - RNA, 18 nt, Human
uaugggaguuuaugcuuc

SEQ ID NO: 1196663 - RNA, 19 nt, Human
uauuuuugguagaaacggg

SEQ ID NO: 1196664 - RNA, 19 nt, Human
ucaagugauucuccugccu

SEQ ID NO: 1196665 - RNA, 24 nt, Human
ucaccguguuagccaggauggucu

SEQ ID NO: 1196666 - RNA, 23 nt, Human
ucacugcaaccuccaccucccgg

SEQ ID NO: 1196667 - RNA, 24 nt, Human
ucacugcaaccuccaccucccggg

SEQ ID NO: 1196668 - RNA, 25 nt, Human
ucacugcaaccuccaccucccgggu

SEQ ID NO: 1196669 - RNA, 27 nt, Human
ucacugcaaccuccaccucccggguuc

SEQ ID NO: 1196670 - RNA, 19 nt, Human
ucacugcgagcuccgcuuc

SEQ ID NO: 1196671 - RNA, 23 nt, Human
ucagccucccgaguagcugggac

SEQ ID NO: 1196672 - RNA, 24 nt, Human
ucccaaaguccugggauuacaggc

SEQ ID NO: 1196673 - RNA, 27 nt, Human
ucccaaaguguuguugggauuacaggc

SEQ ID NO: 1196674 - RNA, 19 nt, Human
ucccagguucacgccauuc

SEQ ID NO: 1196675 - RNA, 21 nt, Human
ucccagguucacgccauucuc

SEQ ID NO: 1196676 - RNA, 22 nt, Human
ucccagguucacgccauucucc

SEQ ID NO: 1196677 - RNA, 24 nt, Human
ucccagguucacgccauucuccug

SEQ ID NO: 1196678 - RNA, 24 nt, Human
ucccgaguagcugggacuacaggc

SEQ ID NO: 1196679 - RNA, 21 nt, Human
ucccggguucaagugauucuc

SEQ ID NO: 1196680 - RNA, 24 nt, Human
ucccggguucaagugauucuccug

SEQ ID NO: 1196681 - RNA, 24 nt, Human
uccuucagaacauaaaugcucuua

SEQ ID NO: 1196682 - RNA, 21 nt, Human
ucuaggugcuggguuuauggg

SEQ ID NO: 1196683 - RNA, 24 nt, Human
ucucacucugucgcccaagcagga

SEQ ID NO: 1196684 - RNA, 21 nt, Human
ucucacuguugcccaggcugg

SEQ ID NO: 1196685 - RNA, 21 nt, Human
ucucacuguugcccaggcugg

SEQ ID NO: 1196686 - RNA, 22 nt, Human
ucucacuguugcccaggcugga

SEQ ID NO: 1196687 - RNA, 24 nt, Human
ucucacuguugcccaggcuggagu

SEQ ID NO: 1196688 - RNA, 24 nt, Human
ucuccugccucagccucccgagua

SEQ ID NO: 1196689 - RNA, 24 nt, Human
ucuccugccucagccuucugaaua

SEQ ID NO: 1196690 - RNA, 24 nt, Human
ucugcauauaaacacacauauaua

SEQ ID NO: 1196691 - RNA, 22 nt, Human
ugacuggagauucccccauuca

SEQ ID NO: 1196692 - RNA, 21 nt, Human
ugagcuuucaaauuucuguuu

SEQ ID NO: 1196693 - RNA, 20 nt, Human
ugaggcagagucucacucug

SEQ ID NO: 1196694 - RNA, 22 nt, Human
ugaggcagagucucacucuguc

SEQ ID NO: 1196695 - RNA, 26 nt, Human
ugcagaaacaugguacaauuuaaaau

SEQ ID NO: 1196696 - RNA, 22 nt, Human
ugcaguggcgugaucucggcuc

SEQ ID NO: 1196697 - RNA, 18 nt, Human
ugcccaggcuggagugca

SEQ ID NO: 1196698 - RNA, 21 nt, Human
ugcccaggcuggagugcagug

SEQ ID NO: 1196699 - RNA, 22 nt, Human
ugcccaggcuggagugcagugg

SEQ ID NO: 1196700 - RNA, 24 nt, Human
ugcccaggcuggagugcaguggcg

SEQ ID NO: 1196701 - RNA, 24 nt, Human
ugccucagccucccgaguagcugg

SEQ ID NO: 1196702 - RNA, 24 nt, Human
ugccucagccuucugaauagcugg

SEQ ID NO: 1196703 - RNA, 20 nt, Human
uggaaacaguccaguagaaa

SEQ ID NO: 1196704 - RNA, 19 nt, Human
uggagugcaguggcgugau

SEQ ID NO: 1196705 - RNA, 23 nt, Human
uggagugcaguggcgugaucucg

SEQ ID NO: 1196706 - RNA, 24 nt, Human
uggagugcaguggcgugaucucgg

SEQ ID NO: 1196707 - RNA, 18 nt, Human
uggauagauaauguuggc

SEQ ID NO: 1196708 - RNA, 24 nt, Human
uggauagauaauguuggcaauugu

SEQ ID NO: 1196709 - RNA, 24 nt, Human
uggccaggcuggucccaaacuccu

SEQ ID NO: 1196710 - RNA, 20 nt, Human
uggcgugaucucggcucacu

SEQ ID NO: 1196711 - RNA, 22 nt, Human
uggcuuuuucaaaucauguuua

SEQ ID NO: 1196712 - RNA, 21 nt, Human
ugggacuacaggcgcccacca

SEQ ID NO: 1196713 - RNA, 22 nt, Human
ugggacuacaggcgcccaccau

SEQ ID NO: 1196714 - RNA, 26 nt, Human
ugggacuacaguggcacacgccacca

SEQ ID NO: 1196715 - RNA, 18 nt, Human
ugggauuacaggcguaag

SEQ ID NO: 1196716 - RNA, 22 nt, Human
ugggauuacaggcguaagccac

SEQ ID NO: 1196717 - RNA, 24 nt, Human
ugggauuacaggcguaagccacca

SEQ ID NO: 1196718 - RNA, 25 nt, Human
ugggauuacaggcguaagccaccau

SEQ ID NO: 1196719 - RNA, 18 nt, Human
ugggauuacaggcgugag

SEQ ID NO: 1196720 - RNA, 19 nt, Human
ugggauuacaggcgugagc

SEQ ID NO: 1196721 - RNA, 21 nt, Human
ugggauuacaggcgugagcca

SEQ ID NO: 1196722 - RNA, 22 nt, Human
ugggauuacaggcgugagccac

SEQ ID NO: 1196723 - RNA, 22 nt, Human
ugggauuacaggcgugagccac

SEQ ID NO: 1196724 - RNA, 24 nt, Human
ugggauuacaggcgugagccacug

SEQ ID NO: 1196725 - RNA, 26 nt, Human
ugggauuacaggcgugagccacugcg

SEQ ID NO: 1196726 - RNA, 20 nt, Human
uggggagggaaacugguagg

SEQ ID NO: 1196727 - RNA, 24 nt, Human
ugguagaaacgggguuucaccaug

SEQ ID NO: 1196728 - RNA, 20 nt, Human
ugguagguaggggacugagg

SEQ ID NO: 1196729 - RNA, 22 nt, Human
ugucccuaaaggugaaauacau

SEQ ID NO: 1196730 - RNA, 21 nt, Human
uguugcccaggcuggagugca

SEQ ID NO: 1196731 - RNA, 19 nt, Human
uguuuaccucugcucucuc

SEQ ID NO: 1196732 - RNA, 19 nt, Human
uuaaagcauacaccuuugc

SEQ ID NO: 1196733 - RNA, 22 nt, Human
uuaguagagacaggguuucacc

SEQ ID NO: 1196734 - RNA, 24 nt, Human
uuaguagagacaggguuucaccgu

SEQ ID NO: 1196735 - RNA, 22 nt, Human
uucaaaucauguuuaccucugc

SEQ ID NO: 1196736 - RNA, 21 nt, Human
uucaagugauucuccugccuc

SEQ ID NO: 1196737 - RNA, 23 nt, Human
uucaagugauucuccugccucag

SEQ ID NO: 1196738 - RNA, 24 nt, Human
uucaagugauucuccugccucagc

SEQ ID NO: 1196739 - RNA, 23 nt, Human
uucugcauauaaacacacauaua

SEQ ID NO: 1196740 - RNA, 24 nt, Human
uugguagaaacgggguuucaccau

SEQ ID NO: 1196741 - RNA, 21 nt, Human
uuuaauauaucuauauacaga

SEQ ID NO: 1196742 - RNA, 24 nt, Human
uuucaccauguuggccaggcuggu

SEQ ID NO: 1196743 - RNA, 19 nt, Human
uuucaccguguuagccagg

SEQ ID NO: 1196744 - RNA, 24 nt, Human
uuuuuaguagagacaggguuucac

SEQ ID NO: 1196745 - RNA, 24 nt, Human
uuuuugguagaaacgggguuucac

SEQ ID NO: 1196746 - RNA, 21 nt, Human
uuuuuguauuuuuaguagaga

SEQ ID NO: 1196747 - RNA, 18 nt, Human
uuuuuguauuuuugguag

SEQ ID NO: 1196748 - RNA, 24 nt, Human
uuuuuuguauuuuuaguagagaca

SEQ ID NO: 1196749 - RNA, 18 nt, Human
aaucacggcagaagacaa

SEQ ID NO: 1196750 - RNA, 25 nt, Human
acagaaaaggugugaggaaggaccc

SEQ ID NO: 1196751 - RNA, 20 nt, Human
acagaguugagauuguugac

SEQ ID NO: 1196752 - RNA, 21 nt, Human
acuugaugauaaauaggagag

SEQ ID NO: 1196753 - RNA, 20 nt, Human
aggcaagagagggagcuugg

SEQ ID NO: 1196754 - RNA, 21 nt, Human
aggcaagagagggagcuugug

SEQ ID NO: 1196755 - RNA, 20 nt, Human
auugcccuuccuuaagcaca

SEQ ID NO: 1196756 - RNA, 24 nt, Human
cacaaaacccugggcuuccucauu

SEQ ID NO: 1196757 - RNA, 26 nt, Human
cacagaaaaggugugaggaaggaccc

SEQ ID NO: 1196758 - RNA, 21 nt, Human
caccgcgccucuuugcaggau

SEQ ID NO: 1196759 - RNA, 20 nt, Human
cagccacacaaaacccuggg

SEQ ID NO: 1196760 - RNA, 21 nt, Human
cagccacacaaaacccugggc

SEQ ID NO: 1196761 - RNA, 23 nt, Human
ccaaagggacuucuuacauggug

SEQ ID NO: 1196762 - RNA, 21 nt, Human
cccacagugaaccggacaguc

SEQ ID NO: 1196763 - RNA, 21 nt, Human
ccucucacagagcaggcugag

SEQ ID NO: 1196764 - RNA, 18 nt, Human
cuccaggggacaagcagc

SEQ ID NO: 1196765 - RNA, 21 nt, Human
cucuuugcaggaucagccauc

SEQ ID NO: 1196766 - RNA, 24 nt, Human
cuuuucagccacacaaaacccugg

SEQ ID NO: 1196767 - RNA, 22 nt, Human
gccugaaaggcuuuucagccac

SEQ ID NO: 1196768 - RNA, 25 nt, Human
ggcagaagacaaaggaagaccaaag

SEQ ID NO: 1196769 - RNA, 22 nt, Human
gggaacuccucuuuauaaaacc

SEQ ID NO: 1196770 - RNA, 21 nt, Human
gugcaggggaacuccucuuua

SEQ ID NO: 1196771 - RNA, 21 nt, Human
gugccacuuggcaguuuucaa

SEQ ID NO: 1196772 - RNA, 19 nt, Human
uccacauggcuggggaggc

SEQ ID NO: 1196773 - RNA, 21 nt, Human
uccccacagugaaccggacag

SEQ ID NO: 1196774 - RNA, 19 nt, Human
ugaaaggcuuuucagccac

SEQ ID NO: 1196775 - RNA, 21 nt, Human
uggcaggcaagagagggagcu

SEQ ID NO: 1196776 - RNA, 22 nt, Human
aaaaaacauuaucuauaggguu

SEQ ID NO: 1196777 - RNA, 27 nt, Human
aaacaacaaaaacuaaaaagggaggcc

SEQ ID NO: 1196778 - RNA, 24 nt, Human
aagcaguaaucaugaaacagugau

SEQ ID NO: 1196779 - RNA, 21 nt, Human
aaggccccucuuccaccauac

SEQ ID NO: 1196780 - RNA, 21 nt, Human
aaguagagacuuuucccagau

SEQ ID NO: 1196781 - RNA, 25 nt, Human
aagugucccuuuaaggcaaagaaga

SEQ ID NO: 1196782 - RNA, 22 nt, Human
aaucaucuugucuccuaguucu

SEQ ID NO: 1196783 - RNA, 19 nt, Human
accugugaugacuaaucca

SEQ ID NO: 1196784 - RNA, 18 nt, Human
acuagucucugagugccu

SEQ ID NO: 1196785 - RNA, 22 nt, Human
auaacaaucgcuuuucaaauau

SEQ ID NO: 1196786 - RNA, 21 nt, Human
auagacaacccaaccacagua

SEQ ID NO: 1196787 - RNA, 26 nt, Human
caaaacaaucccugcaaaaacuuaaa

SEQ ID NO: 1196788 - RNA, 20 nt, Human
caaauagaagccugaaauau

SEQ ID NO: 1196789 - RNA, 25 nt, Human
caccugaggccucauaauaccacuc

SEQ ID NO: 1196790 - RNA, 18 nt, Human
caggaauuucuucuccuu

SEQ ID NO: 1196791 - RNA, 21 nt, Human
caucuugucuccuaguucuca

SEQ ID NO: 1196792 - RNA, 18 nt, Human
cauguauacacacuuuau

SEQ ID NO: 1196793 - RNA, 22 nt, Human
cauuuaaacaacaaaaacuaaa

SEQ ID NO: 1196794 - RNA, 27 nt, Human
cauuuaaacaacaaaaacuaaaaauga

SEQ ID NO: 1196795 - RNA, 18 nt, Human
ccaccuagaaauaucaac

SEQ ID NO: 1196796 - RNA, 23 nt, Human
ccaccuagaaauaucaacaauau

SEQ ID NO: 1196797 - RNA, 19 nt, Human
ccacucgagacacugacag

SEQ ID NO: 1196798 - RNA, 19 nt, Human
cccaccauugaauuucaaa

SEQ ID NO: 1196799 - RNA, 23 nt, Human
cuaauucuaucccaccauugaau

SEQ ID NO: 1196800 - RNA, 26 nt, Human
cuccuaguucucacaccauuggaaca

SEQ ID NO: 1196801 - RNA, 24 nt, Human
cugaacguuaaaagaaaucuauca

SEQ ID NO: 1196802 - RNA, 19 nt, Human
cuuccauuuccugaccuaa

SEQ ID NO: 1196803 - RNA, 20 nt, Human
gacaagcuucauaauagauu

SEQ ID NO: 1196804 - RNA, 20 nt, Human
gagccuaaaaaugauggcca

SEQ ID NO: 1196805 - RNA, 19 nt, Human
gauaaauauccugaaagac

SEQ ID NO: 1196806 - RNA, 23 nt, Human
uaaagugaaucaucuugucuccu

SEQ ID NO: 1196807 - RNA, 20 nt, Human
uaaauauagacaacccaacc

SEQ ID NO: 1196808 - RNA, 23 nt, Human
uaacguaacaauagaucacacuc

SEQ ID NO: 1196809 - RNA, 19 nt, Human
uaagaaccugugaugacua

SEQ ID NO: 1196810 - RNA, 18 nt, Human
uaagauauacacaaggcc

SEQ ID NO: 1196811 - RNA, 18 nt, Human
uaagucaaucaagcaaaa

SEQ ID NO: 1196812 - RNA, 26 nt, Human
uaauggcauacuaggggacaagcuuc

SEQ ID NO: 1196813 - RNA, 24 nt, Human
uacaaacagaauagauacacugca

SEQ ID NO: 1196814 - RNA, 23 nt, Human
uacauucacuuaaaaauggauua

SEQ ID NO: 1196815 - RNA, 20 nt, Human
uaccaucgaagaauuuuuuc

SEQ ID NO: 1196816 - RNA, 20 nt, Human
uaccccaaggcaccugaggc

SEQ ID NO: 1196817 - RNA, 20 nt, Human
uaccuaguuauaaauaacgu

SEQ ID NO: 1196818 - RNA, 18 nt, Human
uaccucacacuuauagca

SEQ ID NO: 1196819 - RNA, 23 nt, Human
uacucuuccuuuaaaauccaagg

SEQ ID NO: 1196820 - RNA, 19 nt, Human
uauaacaaucgcuuuucaa

SEQ ID NO: 1196821 - RNA, 20 nt, Human
uaucacgacagacauuuuac

SEQ ID NO: 1196822 - RNA, 21 nt, Human
uaugauauauauuagaauagg

SEQ ID NO: 1196823 - RNA, 18 nt, Human
ucaaaagacacaaaugca

SEQ ID NO: 1196824 - RNA, 21 nt, Human
ucaaaagacacaaaugcagua

SEQ ID NO: 1196825 - RNA, 21 nt, Human
ucaacugugguagcaaaguca

SEQ ID NO: 1196826 - RNA, 20 nt, Human
uccacacaucuggucaaggc

SEQ ID NO: 1196827 - RNA, 21 nt, Human
uccacacaucuggucaaggca

SEQ ID NO: 1196828 - RNA, 21 nt, Human
uccuugauaacaccaccuaga

SEQ ID NO: 1196829 - RNA, 24 nt, Human
ucuaagauauacacaaggccagca

SEQ ID NO: 1196830 - RNA, 18 nt, Human
ucugaacguuaaaagaaa

SEQ ID NO: 1196831 - RNA, 21 nt, Human
ucuuuuacaaacagaauagau

SEQ ID NO: 1196832 - RNA, 23 nt, Human
ugaaacagugauuauauaaguca

SEQ ID NO: 1196833 - RNA, 21 nt, Human
ugaagaaguagagacuuuucc

SEQ ID NO: 1196834 - RNA, 21 nt, Human
ugacuaauccaagcauccugu

SEQ ID NO: 1196835 - RNA, 23 nt, Human
ugcauucuaagauauacacaagg

SEQ ID NO: 1196836 - RNA, 22 nt, Human
ugccuucaaaagacacaaaugc

SEQ ID NO: 1196837 - RNA, 24 nt, Human
ugguaccucacacuuauagcacau

SEQ ID NO: 1196838 - RNA, 20 nt, Human
uguacacagugguuugugug

SEQ ID NO: 1196839 - RNA, 22 nt, Human
uguacacagugguuugugugua

SEQ ID NO: 1196840 - RNA, 24 nt, Human
uguuaaguucgagccuaaaaauga

SEQ ID NO: 1196841 - RNA, 24 nt, Human
uucaaaacaaucccugcaaaaacu

SEQ ID NO: 1196842 - RNA, 20 nt, Human
uuuaaaauccaaggauccuu

SEQ ID NO: 1196843 - RNA, 26 nt, Human
uuuaaacaacaaaaacuaaaaaugaa

SEQ ID NO: 1196844 - RNA, 22 nt, Human
uuuguacacagugguuugugug

SEQ ID NO: 1196845 - RNA, 19 nt, Human
aaaaaaaaaucucucaagc

SEQ ID NO: 1196846 - RNA, 21 nt, Human
aaaagaagcgcaggggcggga

SEQ ID NO: 1196847 - RNA, 20 nt, Human
aaaaucucucaagcaagaga

SEQ ID NO: 1196848 - RNA, 22 nt, Human
aaacauuuuauguaggaaacag

SEQ ID NO: 1196849 - RNA, 23 nt, Human
aaagggagaggaagggggcggag

SEQ ID NO: 1196850 - RNA, 19 nt, Human
aacauuuuauguaggaaac

SEQ ID NO: 1196851 - RNA, 22 nt, Human
aaccugcagucucuuccgccuc

SEQ ID NO: 1196852 - RNA, 26 nt, Human
aagaaggagguggucugggaagagga

SEQ ID NO: 1196853 - RNA, 27 nt, Human
aagcaagagaauuucugaucaaaucug

SEQ ID NO: 1196854 - RNA, 18 nt, Human
aagcaaucaaaaaucagc

SEQ ID NO: 1196855 - RNA, 26 nt, Human
aagcaggaggacagagaggagggacc

SEQ ID NO: 1196856 - RNA, 20 nt, Human
aagcggggccgggcuacaga

SEQ ID NO: 1196857 - RNA, 26 nt, Human
aaggauggagggaaaacaaggauggg

SEQ ID NO: 1196858 - RNA, 19 nt, Human
aaggauggagggaggaggg

SEQ ID NO: 1196859 - RNA, 23 nt, Human
aaugaaggaaaaggaugaaggaa

SEQ ID NO: 1196860 - RNA, 19 nt, Human
aauugaacuuuggagaaga

SEQ ID NO: 1196861 - RNA, 25 nt, Human
agagaggagggagaagaggaggggg

SEQ ID NO: 1196862 - RNA, 19 nt, Human
agagaggauaagaggaggg

SEQ ID NO: 1196863 - RNA, 30 nt, Human
agaggaggagggaaggaggaugaugaugaa

SEQ ID NO: 1196864 - RNA, 22 nt, Human
agaggagggagaagaggagggg

SEQ ID NO: 1196865 - RNA, 21 nt, Human
agagggagggaaaaggauagg

SEQ ID NO: 1196866 - RNA, 28 nt, Human
agagggcagaggggagggaggaggacag

SEQ ID NO: 1196867 - RNA, 25 nt, Human
agaggggagggaggaggacagaggg

SEQ ID NO: 1196868 - RNA, 20 nt, Human
agaggggggaaagggagagg

SEQ ID NO: 1196869 - RNA, 23 nt, Human
agaggguaagggaaaagaagcgc

SEQ ID NO: 1196870 - RNA, 23 nt, Human
agaugccaaagaguaauaauagc

SEQ ID NO: 1196871 - RNA, 21 nt, Human
agauuuaaucacuaaauccaa

SEQ ID NO: 1196872 - RNA, 20 nt, Human
agcugcuggggacuggcagc

SEQ ID NO: 1196873 - RNA, 21 nt, Human
aggaagggggcggaggaggga

SEQ ID NO: 1196874 - RNA, 25 nt, Human
aggagagaggagggagaagaggagg

SEQ ID NO: 1196875 - RNA, 18 nt, Human
aggagaggaggagggaag

SEQ ID NO: 1196876 - RNA, 19 nt, Human
aggagggaagagggaggga

SEQ ID NO: 1196877 - RNA, 18 nt, Human
aggagggaggggaaggga

SEQ ID NO: 1196878 - RNA, 18 nt, Human
aggaugaaggaaagaagg

SEQ ID NO: 1196879 - RNA, 21 nt, Human
aggcacuaagaaaaaagauuc

SEQ ID NO: 1196880 - RNA, 19 nt, Human
aggcagcggcggaacucau

SEQ ID NO: 1196881 - RNA, 18 nt, Human
aggcucacaaaauugaac

SEQ ID NO: 1196882 - RNA, 21 nt, Human
agggagagggcagaggggagg

SEQ ID NO: 1196883 - RNA, 20 nt, Human
agggagggaaaaggauaggu

SEQ ID NO: 1196884 - RNA, 19 nt, Human
agggaggggaagggagagg

SEQ ID NO: 1196885 - RNA, 21 nt, Human
agggcagaggggggaaaggga

SEQ ID NO: 1196886 - RNA, 21 nt, Human
auggugaggcaggagaggagg

SEQ ID NO: 1196887 - RNA, 22 nt, Human
caaaauagguguuuuuugaggc

SEQ ID NO: 1196888 - RNA, 21 nt, Human
caaaaugagaucagcaaaacc

SEQ ID NO: 1196889 - RNA, 22 nt, Human
caaaaugagaucagcaaaacca

SEQ ID NO: 1196890 - RNA, 18 nt, Human
caaaguucucugcguucc

SEQ ID NO: 1196891 - RNA, 26 nt, Human
caacagaggacaaaaaaaaaucucuc

SEQ ID NO: 1196892 - RNA, 24 nt, Human
caagcaagagaauuucugaucaaa

SEQ ID NO: 1196893 - RNA, 24 nt, Human
caauuuauauaucaucaugaaaua

SEQ ID NO: 1196894 - RNA, 20 nt, Human
cacugcugcggaaaaggacc

SEQ ID NO: 1196895 - RNA, 21 nt, Human
cagagaggauaagaggagggc

SEQ ID NO: 1196896 - RNA, 22 nt, Human
caggagaggaggacgaagaggu

SEQ ID NO: 1196897 - RNA, 18 nt, Human
caggggcgggaaagaagg

SEQ ID NO: 1196898 - RNA, 19 nt, Human
cccggccgggcggccuugg

SEQ ID NO: 1196899 - RNA, 21 nt, Human
ccgccgcggugccuccucuuc

SEQ ID NO: 1196900 - RNA, 20 nt, Human
ccguuggggccaagaccaaa

SEQ ID NO: 1196901 - RNA, 20 nt, Human
ccucccgccucgaggacagg

SEQ ID NO: 1196902 - RNA, 18 nt, Human
ccuccucuuccucucucg

SEQ ID NO: 1196903 - RNA, 22 nt, Human
ccuccucuuccucucucggguu

SEQ ID NO: 1196904 - RNA, 19 nt, Human
ccugcagucucuuccgccu

SEQ ID NO: 1196905 - RNA, 25 nt, Human
cggaaaaggaccauuaaaggcaaua

SEQ ID NO: 1196906 - RNA, 20 nt, Human
cggaggcuccucagcccugg

SEQ ID NO: 1196907 - RNA, 18 nt, Human
cgggaaagaaggaggugg

SEQ ID NO: 1196908 - RNA, 21 nt, Human
cggggacccgguccagccccc

SEQ ID NO: 1196909 - RNA, 22 nt, Human
cuaaauccaaaaugagaucagc

SEQ ID NO: 1196910 - RNA, 19 nt, Human
cuccagcuccccaugcucg

SEQ ID NO: 1196911 - RNA, 23 nt, Human
cucccggacccggucccggaggc

SEQ ID NO: 1196912 - RNA, 22 nt, Human
cugccccccucccgccucgagg

SEQ ID NO: 1196913 - RNA, 22 nt, Human
cugggaagaggagagaggaggg

SEQ ID NO: 1196914 - RNA, 19 nt, Human
cugggggaacccguugggg

SEQ ID NO: 1196915 - RNA, 22 nt, Human
cugggggcgggggcuaaggggc

SEQ ID NO: 1196916 - RNA, 25 nt, Human
gaaaaaagauuccucuaagcaauca

SEQ ID NO: 1196917 - RNA, 18 nt, Human
gaaaagcaggaggacaga

SEQ ID NO: 1196918 - RNA, 19 nt, Human
gaaaagcaggaggacagag

SEQ ID NO: 1196919 - RNA, 27 nt, Human
gaaagaaggagguggucugggaagagg

SEQ ID NO: 1196920 - RNA, 19 nt, Human
gacagagaggauaagagga

SEQ ID NO: 1196921 - RNA, 23 nt, Human
gacuggcagcugggggcgggggc

SEQ ID NO: 1196922 - RNA, 18 nt, Human
gagcugcuggggacuggc

SEQ ID NO: 1196923 - RNA, 18 nt, Human
gagcugcuggggacuggc

SEQ ID NO: 1196924 - RNA, 22 nt, Human
gagggaagagggagggaaaagg

SEQ ID NO: 1196925 - RNA, 23 nt, Human
gagggaaggaggaugaugaugag

SEQ ID NO: 1196926 - RNA, 19 nt, Human
gagggaggaggacagaggg

SEQ ID NO: 1196927 - RNA, 19 nt, Human
gaugaugaggaagggagga

SEQ ID NO: 1196928 - RNA, 20 nt, Human
gcaggcacagcgggcagugc

SEQ ID NO: 1196929 - RNA, 19 nt, Human
gccgggcuacagaugcugc

SEQ ID NO: 1196930 - RNA, 19 nt, Human
ggaaagaaggauggaggga

SEQ ID NO: 1196931 - RNA, 18 nt, Human
ggaagaggagagaggagg

SEQ ID NO: 1196932 - RNA, 22 nt, Human
ggaaggaggaugaugaugagga

SEQ ID NO: 1196933 - RNA, 22 nt, Human
ggagaaaaguaggagaggagga

SEQ ID NO: 1196934 - RNA, 22 nt, Human
ggagaaaaguaggagaggagga

SEQ ID NO: 1196935 - RNA, 24 nt, Human
ggagaaaaguaggagaggaggagg

SEQ ID NO: 1196936 - RNA, 24 nt, Human
ggagagaggagggagaagaggagg

SEQ ID NO: 1196937 - RNA, 29 nt, Human
ggagaggaagggggcggaggagggagggg

SEQ ID NO: 1196938 - RNA, 20 nt, Human
ggagagggcagaggggaggg

SEQ ID NO: 1196939 - RNA, 21 nt, Human
ggagagggcagaggggaggga

SEQ ID NO: 1196940 - RNA, 21 nt, Human
ggaggagggaagagggaggua

SEQ ID NO: 1196941 - RNA, 25 nt, Human
ggaggagggaggggaagggagaggg

SEQ ID NO: 1196942 - RNA, 29 nt, Human
ggaggagggaggggaagggagagggcagg

SEQ ID NO: 1196943 - RNA, 21 nt, Human
ggagggaaaacaaggauggag

SEQ ID NO: 1196944 - RNA, 22 nt, Human
ggagguggucugggaagaggag

SEQ ID NO: 1196945 - RNA, 20 nt, Human
ggauaagaggagggcagagg

SEQ ID NO: 1196946 - RNA, 22 nt, Human
ggcggagaaaaguaggagagga

SEQ ID NO: 1196947 - RNA, 21 nt, Human
gggaaaacaaggauggaggga

SEQ ID NO: 1196948 - RNA, 19 nt, Human
gggaagaggagagaggagg

SEQ ID NO: 1196949 - RNA, 23 nt, Human
gggaaggaggaugaugaugagga

SEQ ID NO: 1196950 - RNA, 20 nt, Human
gggagaagaggagggggagg

SEQ ID NO: 1196951 - RNA, 21 nt, Human
gggagggaggaggacagaggg

SEQ ID NO: 1196952 - RNA, 19 nt, Human
gggcggaggcuuggggacg

SEQ ID NO: 1196953 - RNA, 24 nt, Human
ggggaagggagagggcagagggga

SEQ ID NO: 1196954 - RNA, 18 nt, Human
ggggacuggcagcugggg

SEQ ID NO: 1196955 - RNA, 19 nt, Human
ggggagggaggaggacaga

SEQ ID NO: 1196956 - RNA, 22 nt, Human
ggggagggaggaggacagaggg

SEQ ID NO: 1196957 - RNA, 19 nt, Human
ggggcgggggcuaaggggc

SEQ ID NO: 1196958 - RNA, 18 nt, Human
ggggcgggggcugggggc

SEQ ID NO: 1196959 - RNA, 19 nt, Human
ggggcgggggcugggggcg

SEQ ID NO: 1196960 - RNA, 23 nt, Human
ggugacagaaugaaggaaaagga

SEQ ID NO: 1196961 - RNA, 25 nt, Human
guccagccccccaugcucccggacc

SEQ ID NO: 1196962 - RNA, 24 nt, Human
gugaggcaggagaggaggacgaag

SEQ ID NO: 1196963 - RNA, 20 nt, Human
gugcucagcuccuggugcuu

SEQ ID NO: 1196964 - RNA, 20 nt, Human
gugcuucuccccucccugcc

SEQ ID NO: 1196965 - RNA, 22 nt, Human
guggaaaagcaggaggacagag

SEQ ID NO: 1196966 - RNA, 19 nt, Human
uaagaaaaaagauuccucu

SEQ ID NO: 1196967 - RNA, 28 nt, Human
uaagaggagggcagaggggggaaaggga

SEQ ID NO: 1196968 - RNA, 23 nt, Human
uaauuaaaagcaauuuauauauc

SEQ ID NO: 1196969 - RNA, 21 nt, Human
uaggagaggaggagggaagga

SEQ ID NO: 1196970 - RNA, 19 nt, Human
uaguaaggucacuaggcuc

SEQ ID NO: 1196971 - RNA, 22 nt, Human
ucacuaaauccaaaaugagauc

SEQ ID NO: 1196972 - RNA, 22 nt, Human
ucagcaaaaccagauacuagua

SEQ ID NO: 1196973 - RNA, 23 nt, Human
uccaaaaugagaucagcaaaacc

SEQ ID NO: 1196974 - RNA, 21 nt, Human
ucccaagacucucacugcagg

SEQ ID NO: 1196975 - RNA, 19 nt, Human
uccccucccugccccccuc

SEQ ID NO: 1196976 - RNA, 19 nt, Human
ucccugccccccucccgcc

SEQ ID NO: 1196977 - RNA, 23 nt, Human
ucuuuccggcugaggaccacaag

SEQ ID NO: 1196978 - RNA, 18 nt, Human
ugaaggaaaaggaugaag

SEQ ID NO: 1196979 - RNA, 23 nt, Human
ugagaucagcaaaaccagauacu

SEQ ID NO: 1196980 - RNA, 19 nt, Human
ugaggaagggaggaugaug

SEQ ID NO: 1196981 - RNA, 22 nt, Human
ugaggaagggaggaugauggug

SEQ ID NO: 1196982 - RNA, 23 nt, Human
ugaggaagggaggaugaugguga

SEQ ID NO: 1196983 - RNA, 18 nt, Human
ugaggcaggagaggagga

SEQ ID NO: 1196984 - RNA, 22 nt, Human
ugaugaggaagggaggaugaug

SEQ ID NO: 1196985 - RNA, 19 nt, Human
ugcggaaaaggaccauuaa

SEQ ID NO: 1196986 - RNA, 21 nt, Human
ugcugcggcugcccgggcagc

SEQ ID NO: 1196987 - RNA, 22 nt, Human
uggagaagagagaugccaaaga

SEQ ID NO: 1196988 - RNA, 22 nt, Human
uggagggaggagggaagaggga

SEQ ID NO: 1196989 - RNA, 18 nt, Human
ugggaagaggagagagga

SEQ ID NO: 1196990 - RNA, 21 nt, Human
uggugaggcaggagaggagga

SEQ ID NO: 1196991 - RNA, 23 nt, Human
uuuuauguaggaaacagcaguua

SEQ ID NO: 1196992 - RNA, 19 nt, Human
aacaaaaacuacaaucugc

SEQ ID NO: 1196993 - RNA, 26 nt, Human
acaugguucugauuuggaaaacaucu

SEQ ID NO: 1196994 - RNA, 19 nt, Human
auagcagccuaacaauuua

SEQ ID NO: 1196995 - RNA, 18 nt, Human
caagguacagcauuuucu

SEQ ID NO: 1196996 - RNA, 18 nt, Human
caggugauguaaggagag

SEQ ID NO: 1196997 - RNA, 19 nt, Human
cccaccuuugcagcccuag

SEQ ID NO: 1196998 - RNA, 24 nt, Human
ccgcgaauccuucuccaucucucu

SEQ ID NO: 1196999 - RNA, 21 nt, Human
ccggccaaaacaaaaacuaca

SEQ ID NO: 1197000 - RNA, 22 nt, Human
ccggccaaaacaaaaacuacaa

SEQ ID NO: 1197001 - RNA, 19 nt, Human
ccuaacaucagugaacaca

SEQ ID NO: 1197002 - RNA, 22 nt, Human
cgcgaauccuucuccaucucuc

SEQ ID NO: 1197003 - RNA, 21 nt, Human
cggccaaaacaaaaacuacaa

SEQ ID NO: 1197004 - RNA, 22 nt, Human
cuagaaaauagcagccuaacaa

SEQ ID NO: 1197005 - RNA, 20 nt, Human
cuauaauguaacuggggaau

SEQ ID NO: 1197006 - RNA, 22 nt, Human
cuuugcagcccuagcagcccua

SEQ ID NO: 1197007 - RNA, 20 nt, Human
gaagaucccccaccuccaag

SEQ ID NO: 1197008 - RNA, 22 nt, Human
gaauccuucuccaucucucuca

SEQ ID NO: 1197009 - RNA, 23 nt, Human
gcagcccuaacaucagugaacac

SEQ ID NO: 1197010 - RNA, 23 nt, Human
gccaaaacaaaaacuacaaucug

SEQ ID NO: 1197011 - RNA, 19 nt, Human
gccgccuuugacaaucagu

SEQ ID NO: 1197012 - RNA, 21 nt, Human
ggcaggugauguaaggagaga

SEQ ID NO: 1197013 - RNA, 19 nt, Human
ggccaaaacaaaaacuaca

SEQ ID NO: 1197014 - RNA, 19 nt, Human
guguguguuucuccacugg

SEQ ID NO: 1197015 - RNA, 19 nt, Human
uacaaucugccgccuuuga

SEQ ID NO: 1197016 - RNA, 21 nt, Human
ucaacaugguucugauuugga

SEQ ID NO: 1197017 - RNA, 18 nt, Human
ucagcccuggcaacucau

SEQ ID NO: 1197018 - RNA, 21 nt, Human
ucuagaaaauagcagccuaac

SEQ ID NO: 1197019 - RNA, 21 nt, Human
ugaggaaaaaagauaaauagg

SEQ ID NO: 1197020 - RNA, 22 nt, Human
ugaucggggccucuaacgauga

SEQ ID NO: 1197021 - RNA, 21 nt, Human
ugauguguguguuucuccacu

SEQ ID NO: 1197022 - RNA, 23 nt, Human
uggcuccgaaccgccuaucuccc

SEQ ID NO: 1197023 - RNA, 20 nt, Human
ugggcaggugauguaaggag

SEQ ID NO: 1197024 - RNA, 19 nt, Human
ugucaccgccgcgaauccu

SEQ ID NO: 1197025 - RNA, 24 nt, Human
uuaggaaauugaggaaaaaagaua

SEQ ID NO: 1197026 - RNA, 19 nt, Human
uuccggccaaaacaaaaac

SEQ ID NO: 1197027 - RNA, 22 nt, Human
uugauguguguguuucuccacu

SEQ ID NO: 1197028 - RNA, 18 nt, Human
uuuuuuuuuuuuccuuug

SEQ ID NO: 1197029 - RNA, 22 nt, Human
uuuuuuuuuuuuuuuuuccuuu

SEQ ID NO: 1197030 - RNA, 23 nt, Human
uuuuuuuuuuuuuuuuuuccuuu

SEQ ID NO: 1197031 - RNA, 20 nt, Human
aaaaaauagauacaacuaga

SEQ ID NO: 1197032 - RNA, 18 nt, Human
aaacagaguaaaaaucaa

SEQ ID NO: 1197033 - RNA, 19 nt, Human
aaagugcugggauuacaga

SEQ ID NO: 1197034 - RNA, 26 nt, Human
aaccaggacaucuucuacguccuucc

SEQ ID NO: 1197035 - RNA, 24 nt, Human
aagaggcaccauuuccucaccacc

SEQ ID NO: 1197036 - RNA, 24 nt, Human
aagauagcuacgaauaaccccaca

SEQ ID NO: 1197037 - RNA, 24 nt, Human
aagcgauucaccugccucagccuc

SEQ ID NO: 1197038 - RNA, 19 nt, Human
aaguagcuaggauuacagg

SEQ ID NO: 1197039 - RNA, 20 nt, Human
aagugcugggauuacagacu

SEQ ID NO: 1197040 - RNA, 23 nt, Human
aagugcugggauuacagacuugu

SEQ ID NO: 1197041 - RNA, 22 nt, Human
aaguugggggaaaaucuaaagc

SEQ ID NO: 1197042 - RNA, 21 nt, Human
acacugggcuaauuuuuguau

SEQ ID NO: 1197043 - RNA, 19 nt, Human
acagacaggguuucaccau

SEQ ID NO: 1197044 - RNA, 22 nt, Human
acaggguaagaauucccagaac

SEQ ID NO: 1197045 - RNA, 18 nt, Human
acaggguuucaccauguu

SEQ ID NO: 1197046 - RNA, 23 nt, Human
acaggguuucaccauguuggcca

SEQ ID NO: 1197047 - RNA, 24 nt, Human
acaggguuucaccauguuggccag

SEQ ID NO: 1197048 - RNA, 18 nt, Human
accauguuggccaggcug

SEQ ID NO: 1197049 - RNA, 24 nt, Human
agcgauucaccugccucagccucc

SEQ ID NO: 1197050 - RNA, 22 nt, Human
aggaggagguggaaucggagag

SEQ ID NO: 1197051 - RNA, 18 nt, Human
aggugcucaccaccacac

SEQ ID NO: 1197052 - RNA, 22 nt, Human
aguacagacaggguuucaccau

SEQ ID NO: 1197053 - RNA, 22 nt, Human
agugcugggauuacagacuugu

SEQ ID NO: 1197054 - RNA, 24 nt, Human
aguggcaugaucucagcucacugc

SEQ ID NO: 1197055 - RNA, 24 nt, Human
auaaaauuuuauuaaaugaacuuc

SEQ ID NO: 1197056 - RNA, 20 nt, Human
auagauacaacuagauaaag

SEQ ID NO: 1197057 - RNA, 26 nt, Human
caaagugcugggauuacagacuugug

SEQ ID NO: 1197058 - RNA, 23 nt, Human
cacacagugaagucuacaauuaa

SEQ ID NO: 1197059 - RNA, 22 nt, Human
cacacccucggacaaccacucc

SEQ ID NO: 1197060 - RNA, 24 nt, Human
caccacacugggcuaauuuuugua

SEQ ID NO: 1197061 - RNA, 21 nt, Human
caccauguuggccaggcuggu

SEQ ID NO: 1197062 - RNA, 24 nt, Human
caccauguuggccaggcuggucuc

SEQ ID NO: 1197063 - RNA, 23 nt, Human
caccugucuuggccucccaaagu

SEQ ID NO: 1197064 - RNA, 24 nt, Human
caccugucuuggccucccaaagug

SEQ ID NO: 1197065 - RNA, 23 nt, Human
cacugcaaacucugccuccuggg

SEQ ID NO: 1197066 - RNA, 22 nt, Human
cagcaaacagaguaaaaaucaa

SEQ ID NO: 1197067 - RNA, 24 nt, Human
caggguuucaccauguuggccagg

SEQ ID NO: 1197068 - RNA, 24 nt, Human
caggugcucaccaccacacugggc

SEQ ID NO: 1197069 - RNA, 23 nt, Human
cauguuggccaggcuggucucaa

SEQ ID NO: 1197070 - RNA, 19 nt, Human
ccaaagugcugggauuaca

SEQ ID NO: 1197071 - RNA, 23 nt, Human
ccaaagugcugggauuacagacu

SEQ ID NO: 1197072 - RNA, 21 nt, Human
ccaagccggcccaccuuugcu

SEQ ID NO: 1197073 - RNA, 23 nt, Human
ccaccuuugcugccaucuaacuc

SEQ ID NO: 1197074 - RNA, 18 nt, Human
ccacugaucuucccuccu

SEQ ID NO: 1197075 - RNA, 22 nt, Human
cccaaguagcuaggauuacagg

SEQ ID NO: 1197076 - RNA, 23 nt, Human
cccaaguagcuaggauuacaggu

SEQ ID NO: 1197077 - RNA, 23 nt, Human
cccaggcuggcaugcaguggcau

SEQ ID NO: 1197078 - RNA, 22 nt, Human
cccagggcucgcggaaggaccc

SEQ ID NO: 1197079 - RNA, 22 nt, Human
cccaucggccaccacugggcac

SEQ ID NO: 1197080 - RNA, 18 nt, Human
cccgcaguuccccacucu

SEQ ID NO: 1197081 - RNA, 20 nt, Human
cccucggacaaccacuccug

SEQ ID NO: 1197082 - RNA, 24 nt, Human
ccuccuggguucaagcgauucacc

SEQ ID NO: 1197083 - RNA, 23 nt, Human
ccugccucagccucccaaguagc

SEQ ID NO: 1197084 - RNA, 24 nt, Human
ccugccucagccucccaaguagcu

SEQ ID NO: 1197085 - RNA, 19 nt, Human
ccugggguggggagagggg

SEQ ID NO: 1197086 - RNA, 21 nt, Human
ccuggguucaagcgauucacc

SEQ ID NO: 1197087 - RNA, 22 nt, Human
ccuggguucaagcgauucaccu

SEQ ID NO: 1197088 - RNA, 23 nt, Human
ccuggguucaagcgauucaccug

SEQ ID NO: 1197089 - RNA, 24 nt, Human
ccuuugcugccaucuaacuccgcc

SEQ ID NO: 1197090 - RNA, 23 nt, Human
cgaggaggagguggaaucggaga

SEQ ID NO: 1197091 - RNA, 26 nt, Human
cggggcagcggagagaggaggaaagc

SEQ ID NO: 1197092 - RNA, 23 nt, Human
cucacugcaaacucugccuccug

SEQ ID NO: 1197093 - RNA, 24 nt, Human
cucacugcaaacucugccuccugg

SEQ ID NO: 1197094 - RNA, 24 nt, Human
cucccaaguagcuaggauuacagg

SEQ ID NO: 1197095 - RNA, 25 nt, Human
cuccugguuuuaacuucauaucacu

SEQ ID NO: 1197096 - RNA, 19 nt, Human
cucggacaaccacuccuga

SEQ ID NO: 1197097 - RNA, 23 nt, Human
cuguaucuuuaaggaguuucaug

SEQ ID NO: 1197098 - RNA, 23 nt, Human
cugucuuggccucccaaagugcu

SEQ ID NO: 1197099 - RNA, 21 nt, Human
gaccucaacugaugcaccugu

SEQ ID NO: 1197100 - RNA, 18 nt, Human
gccaaaucagccaguacu

SEQ ID NO: 1197101 - RNA, 18 nt, Human
gcgauucaccugccucag

SEQ ID NO: 1197102 - RNA, 24 nt, Human
gcgauucaccugccucagccuccc

SEQ ID NO: 1197103 - RNA, 18 nt, Human
gcggaaggacccaguugg

SEQ ID NO: 1197104 - RNA, 22 nt, Human
ggaaaaucuaaagcauaggcuc

SEQ ID NO: 1197105 - RNA, 21 nt, Human
ggacaggaaccgcaggggcac

SEQ ID NO: 1197106 - RNA, 18 nt, Human
ggagagguggaaggagga

SEQ ID NO: 1197107 - RNA, 22 nt, Human
ggauuacaggugcucaccacca

SEQ ID NO: 1197108 - RNA, 22 nt, Human
ggcagaaagaaggcuccacuga

SEQ ID NO: 1197109 - RNA, 18 nt, Human
gggcagcggagagaggag

SEQ ID NO: 1197110 - RNA, 24 nt, Human
ggguucaagcgauucaccugccuc

SEQ ID NO: 1197111 - RNA, 22 nt, Human
ggguuucaccauguuggccagg

SEQ ID NO: 1197112 - RNA, 24 nt, Human
gguaacacaagauggcagaaagaa

SEQ ID NO: 1197113 - RNA, 22 nt, Human
ggugcucaccaccacacugggc

SEQ ID NO: 1197114 - RNA, 18 nt, Human
gugcugggauuacagacu

SEQ ID NO: 1197115 - RNA, 24 nt, Human
guucaagcgauucaccugccucag

SEQ ID NO: 1197116 - RNA, 19 nt, Human
guucugaaagcuuuucuua

SEQ ID NO: 1197117 - RNA, 19 nt, Human
guucugaaagcuuuucuua

SEQ ID NO: 1197118 - RNA, 22 nt, Human
uaaaacuacuacagcaaacaga

SEQ ID NO: 1197119 - RNA, 22 nt, Human
uaacacaagauggcagaaagaa

SEQ ID NO: 1197120 - RNA, 24 nt, Human
uaauuuuuguauuuuuaguacaga

SEQ ID NO: 1197121 - RNA, 22 nt, Human
uacaacuagauaaauagagaaa

SEQ ID NO: 1197122 - RNA, 22 nt, Human
uacagacaggguuucaccaugu

SEQ ID NO: 1197123 - RNA, 23 nt, Human
uacgaauaaccccacacagugaa

SEQ ID NO: 1197124 - RNA, 23 nt, Human
uagauacaacuagauaaauagag

SEQ ID NO: 1197125 - RNA, 20 nt, Human
uagcuacgaauaaccccaca

SEQ ID NO: 1197126 - RNA, 19 nt, Human
uaggauuacaggugcucac

SEQ ID NO: 1197127 - RNA, 21 nt, Human
uaggauuacaggugcucacca

SEQ ID NO: 1197128 - RNA, 24 nt, Human
uaggauuacaggugcucaccacca

SEQ ID NO: 1197129 - RNA, 19 nt, Human
uaggcucacaaaaaucugg

SEQ ID NO: 1197130 - RNA, 24 nt, Human
uaguacagacaggguuucaccaug

SEQ ID NO: 1197131 - RNA, 22 nt, Human
uaucccaucgccgcgcgccugg

SEQ ID NO: 1197132 - RNA, 24 nt, Human
uaucccaucgccgcgcgccugggg

SEQ ID NO: 1197133 - RNA, 22 nt, Human
ucacaccaagccggcccaccuu

SEQ ID NO: 1197134 - RNA, 22 nt, Human
ucaccaggcucggugaauccaa

SEQ ID NO: 1197135 - RNA, 18 nt, Human
ucacugcaaacucugccu

SEQ ID NO: 1197136 - RNA, 24 nt, Human
ucacugcaaacucugccuccuggg

SEQ ID NO: 1197137 - RNA, 18 nt, Human
ucagccucccaaguagcu

SEQ ID NO: 1197138 - RNA, 20 nt, Human
ucagccucccaaguagcuag

SEQ ID NO: 1197139 - RNA, 18 nt, Human
ucauaucacugaaagagg

SEQ ID NO: 1197140 - RNA, 18 nt, Human
ucccaaagugcugggauu

SEQ ID NO: 1197141 - RNA, 24 nt, Human
ucccaaagugcugggauuacagac

SEQ ID NO: 1197142 - RNA, 23 nt, Human
ucccaagaaagauagcuacgaau

SEQ ID NO: 1197143 - RNA, 23 nt, Human
ucccaaguagcuaggauuacagg

SEQ ID NO: 1197144 - RNA, 24 nt, Human
ucccaaguagcuaggauuacaggu

SEQ ID NO: 1197145 - RNA, 19 nt, Human
uccuggguucaagcgauuc

SEQ ID NO: 1197146 - RNA, 24 nt, Human
uccuggguucaagcgauucaccug

SEQ ID NO: 1197147 - RNA, 20 nt, Human
uccuguucuguugcccaggc

SEQ ID NO: 1197148 - RNA, 22 nt, Human
uccuguucuguugcccaggcug

SEQ ID NO: 1197149 - RNA, 23 nt, Human
uccuguucuguugcccaggcugg

SEQ ID NO: 1197150 - RNA, 20 nt, Human
ucggacaaccacuccugagu

SEQ ID NO: 1197151 - RNA, 22 nt, Human
ucugggauucaaagaugacaca

SEQ ID NO: 1197152 - RNA, 24 nt, Human
ucuguugcccaggcuggcaugcag

SEQ ID NO: 1197153 - RNA, 20 nt, Human
ucuuggccucccaaagugcu

SEQ ID NO: 1197154 - RNA, 19 nt, Human
ugaaaacuuuacaagcuug

SEQ ID NO: 1197155 - RNA, 20 nt, Human
ugaccggggcagcggagaga

SEQ ID NO: 1197156 - RNA, 24 nt, Human
ugagucauucucaccaggcucggu

SEQ ID NO: 1197157 - RNA, 22 nt, Human
ugcaguggcaugaucucagcuc

SEQ ID NO: 1197158 - RNA, 22 nt, Human
ugccaucuaacuccgccgaccu

SEQ ID NO: 1197159 - RNA, 23 nt, Human
ugccucagccucccaaguagcua

SEQ ID NO: 1197160 - RNA, 24 nt, Human
ugccucagccucccaaguagcuag

SEQ ID NO: 1197161 - RNA, 25 nt, Human
ugcugggauuacagacuugugaaga

SEQ ID NO: 1197162 - RNA, 24 nt, Human
uggcaugaucucagcucacugcaa

SEQ ID NO: 1197163 - RNA, 23 nt, Human
uggcaugcaguggcaugaucuca

SEQ ID NO: 1197164 - RNA, 24 nt, Human
uggcaugcaguggcaugaucucag

SEQ ID NO: 1197165 - RNA, 23 nt, Human
uggccaggcuggucucaaucccu

SEQ ID NO: 1197166 - RNA, 18 nt, Human
uggccucccaaagugcug

SEQ ID NO: 1197167 - RNA, 21 nt, Human
uggggagaggggccgugaccc

SEQ ID NO: 1197168 - RNA, 19 nt, Human
ugggguggggagaggggcc

SEQ ID NO: 1197169 - RNA, 20 nt, Human
ugggguggggagaggggccg

SEQ ID NO: 1197170 - RNA, 21 nt, Human
ugggguggggagaggggccgu

SEQ ID NO: 1197171 - RNA, 21 nt, Human
ugguugaccggggcagcggag

SEQ ID NO: 1197172 - RNA, 22 nt, Human
ugguugaccggggcagcggaga

SEQ ID NO: 1197173 - RNA, 31 nt, Human
uguggaaauccuucccaagaaagauagcuag

SEQ ID NO: 1197174 - RNA, 19 nt, Human
uguucuguugcccaggcug

SEQ ID NO: 1197175 - RNA, 22 nt, Human
uguucuguugcccaggcuggca

SEQ ID NO: 1197176 - RNA, 24 nt, Human
uuaguacagacaggguuucaccau

SEQ ID NO: 1197177 - RNA, 21 nt, Human
uucaagcgauucaccugccuc

SEQ ID NO: 1197178 - RNA, 23 nt, Human
uucaagcgauucaccugccucag

SEQ ID NO: 1197179 - RNA, 21 nt, Human
uucccaagaaagauagcuacg

SEQ ID NO: 1197180 - RNA, 21 nt, Human
uuccugguucugaaagcuuuu

SEQ ID NO: 1197181 - RNA, 24 nt, Human
uuucaccauguuggccaggcuggu

SEQ ID NO: 1197182 - RNA, 22 nt, Human
uuuuguauuuuuaguacagaca

SEQ ID NO: 1197183 - RNA, 24 nt, Human
uuuuuaguacagacaggguuucac

SEQ ID NO: 1197184 - RNA, 20 nt, Human
uuuuuguauuuuuaguacag

SEQ ID NO: 1197185 - RNA, 20 nt, Human
aaaaaauagauacaacuaga

SEQ ID NO: 1197186 - RNA, 18 nt, Human
aaacagaguaaaaaucaa

SEQ ID NO: 1197187 - RNA, 26 nt, Human
aaagauagcuacgaauaaccccacac

SEQ ID NO: 1197188 - RNA, 19 nt, Human
aaagugcugggauuacaga

SEQ ID NO: 1197189 - RNA, 26 nt, Human
aaccaggacaucuucuacguccuucc

SEQ ID NO: 1197190 - RNA, 24 nt, Human
aagaggcaccauuuccucaccacc

SEQ ID NO: 1197191 - RNA, 24 nt, Human
aagcgauucaccugccucagccuc

SEQ ID NO: 1197192 - RNA, 19 nt, Human
aaguagcuaggauuacagg

SEQ ID NO: 1197193 - RNA, 20 nt, Human
aagugcugggauuacagacu

SEQ ID NO: 1197194 - RNA, 23 nt, Human
aagugcugggauuacagacuugu

SEQ ID NO: 1197195 - RNA, 22 nt, Human
aaguugggggaaaaucuaaagc

SEQ ID NO: 1197196 - RNA, 21 nt, Human
acacugggcuaauuuuuguau

SEQ ID NO: 1197197 - RNA, 19 nt, Human
acagacaggguuucaccau

SEQ ID NO: 1197198 - RNA, 22 nt, Human
acaggguaagaauucccagaac

SEQ ID NO: 1197199 - RNA, 18 nt, Human
acaggguuucaccauguu

SEQ ID NO: 1197200 - RNA, 23 nt, Human
acaggguuucaccauguuggcca

SEQ ID NO: 1197201 - RNA, 24 nt, Human
acaggguuucaccauguuggccag

SEQ ID NO: 1197202 - RNA, 18 nt, Human
accauguuggccaggcug

SEQ ID NO: 1197203 - RNA, 24 nt, Human
agcgauucaccugccucagccucc

SEQ ID NO: 1197204 - RNA, 22 nt, Human
aggaggagguggaaucggagag

SEQ ID NO: 1197205 - RNA, 18 nt, Human
aggugcucaccaccacac

SEQ ID NO: 1197206 - RNA, 22 nt, Human
agugcugggauuacagacuugu

SEQ ID NO: 1197207 - RNA, 24 nt, Human
aguggcaugaucucagcucacugc

SEQ ID NO: 1197208 - RNA, 24 nt, Human
auaaaauuuuauuaaaugaacuuc

SEQ ID NO: 1197209 - RNA, 20 nt, Human
auagauacaacuagauaaag

SEQ ID NO: 1197210 - RNA, 23 nt, Human
augcaguggcaugaucucagcuc

SEQ ID NO: 1197211 - RNA, 26 nt, Human
caaagugcugggauuacagacuugug

SEQ ID NO: 1197212 - RNA, 23 nt, Human
cacacagugaagucuacaauuaa

SEQ ID NO: 1197213 - RNA, 22 nt, Human
cacacccucggacaaccacucc

SEQ ID NO: 1197214 - RNA, 24 nt, Human
caccacacugggcuaauuuuugua

SEQ ID NO: 1197215 - RNA, 21 nt, Human
caccauguuggccaggcuggu

SEQ ID NO: 1197216 - RNA, 24 nt, Human
caccauguuggccaggcuggucuc

SEQ ID NO: 1197217 - RNA, 23 nt, Human
caccugucuuggccucccaaagu

SEQ ID NO: 1197218 - RNA, 24 nt, Human
caccugucuuggccucccaaagug

SEQ ID NO: 1197219 - RNA, 23 nt, Human
cacugcaaacucugccuccuggg

SEQ ID NO: 1197220 - RNA, 22 nt, Human
cagcaaacagaguaaaaaucaa

SEQ ID NO: 1197221 - RNA, 24 nt, Human
caggguuucaccauguuggccagg

SEQ ID NO: 1197222 - RNA, 24 nt, Human
caggugcucaccaccacacugggc

SEQ ID NO: 1197223 - RNA, 23 nt, Human
cauguuggccaggcuggucucaa

SEQ ID NO: 1197224 - RNA, 19 nt, Human
ccaaagugcugggauuaca

SEQ ID NO: 1197225 - RNA, 23 nt, Human
ccaaagugcugggauuacagacu

SEQ ID NO: 1197226 - RNA, 21 nt, Human
ccaagccggcccaccuuugcu

SEQ ID NO: 1197227 - RNA, 23 nt, Human
ccaccuuugcugccaucuaacuc

SEQ ID NO: 1197228 - RNA, 18 nt, Human
ccacugaucuucccuccu

SEQ ID NO: 1197229 - RNA, 22 nt, Human
cccaaguagcuaggauuacagg

SEQ ID NO: 1197230 - RNA, 23 nt, Human
cccaaguagcuaggauuacaggu

SEQ ID NO: 1197231 - RNA, 23 nt, Human
cccaggcuggcaugcaguggcau

SEQ ID NO: 1197232 - RNA, 22 nt, Human
cccagggcucgcggaaggaccc

SEQ ID NO: 1197233 - RNA, 22 nt, Human
cccaucggccaccacugggcac

SEQ ID NO: 1197234 - RNA, 18 nt, Human
cccgcaguuccccacucu

SEQ ID NO: 1197235 - RNA, 20 nt, Human
cccucggacaaccacuccug

SEQ ID NO: 1197236 - RNA, 24 nt, Human
ccuccuggguucaagcgauucacc

SEQ ID NO: 1197237 - RNA, 23 nt, Human
ccugccucagccucccaaguagc

SEQ ID NO: 1197238 - RNA, 19 nt, Human
ccugggguggggagagggg

SEQ ID NO: 1197239 - RNA, 21 nt, Human
ccuggguucaagcgauucacc

SEQ ID NO: 1197240 - RNA, 22 nt, Human
ccuggguucaagcgauucaccu

SEQ ID NO: 1197241 - RNA, 23 nt, Human
ccuggguucaagcgauucaccug

SEQ ID NO: 1197242 - RNA, 24 nt, Human
ccugucuuggccucccaaagugcu

SEQ ID NO: 1197243 - RNA, 24 nt, Human
ccuuugcugccaucuaacuccgcc

SEQ ID NO: 1197244 - RNA, 23 nt, Human
cgaggaggagguggaaucggaga

SEQ ID NO: 1197245 - RNA, 20 nt, Human
cgcggaaggacccaguugga

SEQ ID NO: 1197246 - RNA, 26 nt, Human
cggggcagcggagagaggaggaaagc

SEQ ID NO: 1197247 - RNA, 23 nt, Human
cucacugcaaacucugccuccug

SEQ ID NO: 1197248 - RNA, 24 nt, Human
cucacugcaaacucugccuccugg

SEQ ID NO: 1197249 - RNA, 24 nt, Human
cucccaaguagcuaggauuacagg

SEQ ID NO: 1197250 - RNA, 25 nt, Human
cuccugguuuuaacuucauaucacu

SEQ ID NO: 1197251 - RNA, 19 nt, Human
cucggacaaccacuccuga

SEQ ID NO: 1197252 - RNA, 23 nt, Human
cugccucagccucccaaguagcu

SEQ ID NO: 1197253 - RNA, 23 nt, Human
cuguaucuuuaaggaguuucaug

SEQ ID NO: 1197254 - RNA, 21 nt, Human
gaccucaacugaugcaccugu

SEQ ID NO: 1197255 - RNA, 18 nt, Human
gccaaaucagccaguacu

SEQ ID NO: 1197256 - RNA, 18 nt, Human
gccccuggaggaguuccc

SEQ ID NO: 1197257 - RNA, 18 nt, Human
gcgauucaccugccucag

SEQ ID NO: 1197258 - RNA, 24 nt, Human
gcgauucaccugccucagccuccc

SEQ ID NO: 1197259 - RNA, 18 nt, Human
gcucaccaccacacuggg

SEQ ID NO: 1197260 - RNA, 22 nt, Human
ggaaaaucuaaagcauaggcuc

SEQ ID NO: 1197261 - RNA, 22 nt, Human
ggauuacaggugcucaccacca

SEQ ID NO: 1197262 - RNA, 22 nt, Human
ggcagaaagaaggcuccacuga

SEQ ID NO: 1197263 - RNA, 18 nt, Human
gggcagcggagagaggag

SEQ ID NO: 1197264 - RNA, 24 nt, Human
ggguucaagcgauucaccugccuc

SEQ ID NO: 1197265 - RNA, 22 nt, Human
ggguuucaccauguuggccagg

SEQ ID NO: 1197266 - RNA, 24 nt, Human
gguaacacaagauggcagaaagaa

SEQ ID NO: 1197267 - RNA, 22 nt, Human
gucuuggccucccaaagugcug

SEQ ID NO: 1197268 - RNA, 18 nt, Human
gugcugggauuacagacu

SEQ ID NO: 1197269 - RNA, 19 nt, Human
guucugaaagcuuuucuua

SEQ ID NO: 1197270 - RNA, 19 nt, Human
guucugaaagcuuuucuua

SEQ ID NO: 1197271 - RNA, 22 nt, Human
uaaaacuacuacagcaaacaga

SEQ ID NO: 1197272 - RNA, 22 nt, Human
uaacacaagauggcagaaagaa

SEQ ID NO: 1197273 - RNA, 24 nt, Human
uaauuuuuguauuuuuaguacaga

SEQ ID NO: 1197274 - RNA, 22 nt, Human
uacaacuagauaaauagagaaa

SEQ ID NO: 1197275 - RNA, 22 nt, Human
uacagacaggguuucaccaugu

SEQ ID NO: 1197276 - RNA, 23 nt, Human
uacgaauaaccccacacagugaa

SEQ ID NO: 1197277 - RNA, 23 nt, Human
uagauacaacuagauaaauagag

SEQ ID NO: 1197278 - RNA, 20 nt, Human
uagcuacgaauaaccccaca

SEQ ID NO: 1197279 - RNA, 19 nt, Human
uaggauuacaggugcucac

SEQ ID NO: 1197280 - RNA, 21 nt, Human
uaggauuacaggugcucacca

SEQ ID NO: 1197281 - RNA, 24 nt, Human
uaggauuacaggugcucaccacca

SEQ ID NO: 1197282 - RNA, 19 nt, Human
uaggcucacaaaaaucugg

SEQ ID NO: 1197283 - RNA, 24 nt, Human
uaguacagacaggguuucaccaug

SEQ ID NO: 1197284 - RNA, 22 nt, Human
uaucccaucgccgcgcgccugg

SEQ ID NO: 1197285 - RNA, 24 nt, Human
uaucccaucgccgcgcgccugggg

SEQ ID NO: 1197286 - RNA, 22 nt, Human
ucacaccaagccggcccaccuu

SEQ ID NO: 1197287 - RNA, 22 nt, Human
ucaccaggcucggugaauccaa

SEQ ID NO: 1197288 - RNA, 18 nt, Human
ucacugcaaacucugccu

SEQ ID NO: 1197289 - RNA, 24 nt, Human
ucacugcaaacucugccuccuggg

SEQ ID NO: 1197290 - RNA, 20 nt, Human
ucagccucccaaguagcuag

SEQ ID NO: 1197291 - RNA, 18 nt, Human
ucauaucacugaaagagg

SEQ ID NO: 1197292 - RNA, 18 nt, Human
ucccaaagugcugggauu

SEQ ID NO: 1197293 - RNA, 24 nt, Human
ucccaaagugcugggauuacagac

SEQ ID NO: 1197294 - RNA, 23 nt, Human
ucccaagaaagauagcuacgaau

SEQ ID NO: 1197295 - RNA, 23 nt, Human
ucccaaguagcuaggauuacagg

SEQ ID NO: 1197296 - RNA, 24 nt, Human
ucccaaguagcuaggauuacaggu

SEQ ID NO: 1197297 - RNA, 19 nt, Human
uccuggguucaagcgauuc

SEQ ID NO: 1197298 - RNA, 24 nt, Human
uccuggguucaagcgauucaccug

SEQ ID NO: 1197299 - RNA, 20 nt, Human
uccuguucuguugcccaggc

SEQ ID NO: 1197300 - RNA, 23 nt, Human
uccuguucuguugcccaggcugg

SEQ ID NO: 1197301 - RNA, 20 nt, Human
ucggacaaccacuccugagu

SEQ ID NO: 1197302 - RNA, 22 nt, Human
ucugggauucaaagaugacaca

SEQ ID NO: 1197303 - RNA, 24 nt, Human
ucuguugcccaggcuggcaugcag

SEQ ID NO: 1197304 - RNA, 20 nt, Human
ucuuggccucccaaagugcu

SEQ ID NO: 1197305 - RNA, 19 nt, Human
ugaaaacuuuacaagcuug

SEQ ID NO: 1197306 - RNA, 20 nt, Human
ugaccggggcagcggagaga

SEQ ID NO: 1197307 - RNA, 24 nt, Human
ugagucauucucaccaggcucggu

SEQ ID NO: 1197308 - RNA, 22 nt, Human
ugccaucuaacuccgccgaccu

SEQ ID NO: 1197309 - RNA, 23 nt, Human
ugccucagccucccaaguagcua

SEQ ID NO: 1197310 - RNA, 24 nt, Human
ugccucagccucccaaguagcuag

SEQ ID NO: 1197311 - RNA, 25 nt, Human
ugcugggauuacagacuugugaaga

SEQ ID NO: 1197312 - RNA, 24 nt, Human
uggcaugaucucagcucacugcaa

SEQ ID NO: 1197313 - RNA, 23 nt, Human
uggcaugcaguggcaugaucuca

SEQ ID NO: 1197314 - RNA, 24 nt, Human
uggcaugcaguggcaugaucucag

SEQ ID NO: 1197315 - RNA, 23 nt, Human
uggccaggcuggucucaaucccu

SEQ ID NO: 1197316 - RNA, 21 nt, Human
uggggagaggggccgugaccc

SEQ ID NO: 1197317 - RNA, 19 nt, Human
ugggguggggagaggggcc

SEQ ID NO: 1197318 - RNA, 20 nt, Human
ugggguggggagaggggccg

SEQ ID NO: 1197319 - RNA, 21 nt, Human
ugggguggggagaggggccgu

SEQ ID NO: 1197320 - RNA, 21 nt, Human
ugguugaccggggcagcggag

SEQ ID NO: 1197321 - RNA, 22 nt, Human
ugguugaccggggcagcggaga

SEQ ID NO: 1197322 - RNA, 31 nt, Human; identical to SEQ ID NO: 1197173

SEQ ID NO: 1197323 - RNA, 19 nt, Human
uguucuguugcccaggcug

SEQ ID NO: 1197324 - RNA, 22 nt, Human
uguucuguugcccaggcuggca

SEQ ID NO: 1197325 - RNA, 24 nt, Human
uuaguacagacaggguuucaccau

SEQ ID NO: 1197326 - RNA, 21 nt, Human
uucaagcgauucaccugccuc

SEQ ID NO: 1197327 - RNA, 23 nt, Human
uucaagcgauucaccugccucag

SEQ ID NO: 1197328 - RNA, 21 nt, Human
uucccaagaaagauagcuacg

SEQ ID NO: 1197329 - RNA, 21 nt, Human
uuccugguucugaaagcuuuu

SEQ ID NO: 1197330 - RNA, 24 nt, Human
uuucaccauguuggccaggcuggu

SEQ ID NO: 1197331 - RNA, 24 nt, Human
uuuuuaguacagacaggguuucac

SEQ ID NO: 1197332 - RNA, 20 nt, Human
uuuuuguauuuuuaguacag

SEQ ID NO: 1197333 - RNA, 23 nt, Human
uuuuuguauuuuuaguacagaca

SEQ ID NO: 1197334 - RNA, 19 nt, Human
auaauugcagaaauuuuua

SEQ ID NO: 1197335 - RNA, 20 nt, Human
cugcaugguuuucaggacug

SEQ ID NO: 1197336 - RNA, 18 nt, Human
uacucuuccggccugcau

SEQ ID NO: 1197337 - RNA, 22 nt, Human
uuugucaauguaaauguuaguc

SEQ ID NO: 1197338 - RNA, 20 nt, Human
aaaaaugguuauggcagagc

SEQ ID NO: 1197339 - RNA, 18 nt, Human
aaagccuagcuaagagcc

SEQ ID NO: 1197340 - RNA, 24 nt, Human
aaagcuccuuccuucaugcugccu

SEQ ID NO: 1197341 - RNA, 20 nt, Human
aaaggagaagccauauuggg

SEQ ID NO: 1197342 - RNA, 21 nt, Human
aacaccaucccugcucuucug

SEQ ID NO: 1197343 - RNA, 26 nt, Human
aacucuccgcuccuuaaauucacucc

SEQ ID NO: 1197344 - RNA, 21 nt, Human
aagcauaucaaacaccgacuc

SEQ ID NO: 1197345 - RNA, 19 nt, Human
acaaggacggugccagacc

SEQ ID NO: 1197346 - RNA, 27 nt, Human
acaccauuagaaacuggguccacccaa

SEQ ID NO: 1197347 - RNA, 24 nt, Human
acacugggcaacaaagauaacacc

SEQ ID NO: 1197348 - RNA, 24 nt, Human
acauggccaccucgacauaucccc

SEQ ID NO: 1197349 - RNA, 23 nt, Human
accuugaggacucauuuaagaaa

SEQ ID NO: 1197350 - RNA, 21 nt, Human
acgcuacccucgggaccccag

SEQ ID NO: 1197351 - RNA, 21 nt, Human
agaaagcagugagaaaaugug

SEQ ID NO: 1197352 - RNA, 26 nt, Human
agaaagcagugagaaaaugugguggc

SEQ ID NO: 1197353 - RNA, 19 nt, Human
agaguucuccagucaccuc

SEQ ID NO: 1197354 - RNA, 20 nt, Human
aggaaaucagaaagagucag

SEQ ID NO: 1197355 - RNA, 23 nt, Human
agggaucccaauucaaggaucuu

SEQ ID NO: 1197356 - RNA, 20 nt, Human
agggcacagagcagagagga

SEQ ID NO: 1197357 - RNA, 20 nt, Human
aggggaaaaaggguccuuga

SEQ ID NO: 1197358 - RNA, 23 nt, Human
aggggaaaaaggguccuugaaaa

SEQ ID NO: 1197359 - RNA, 23 nt, Human
caaaugcacaccauuagaaacug

SEQ ID NO: 1197360 - RNA, 23 nt, Human
caaggucacuggugcuggugacc

SEQ ID NO: 1197361 - RNA, 20 nt, Human
cacuucucacucccuccuca

SEQ ID NO: 1197362 - RNA, 22 nt, Human
cacuucucacucccuccucacu

SEQ ID NO: 1197363 - RNA, 20 nt, Human
cagaaagaguguuucuggug

SEQ ID NO: 1197364 - RNA, 20 nt, Human
cagagccaguaggccaacag

SEQ ID NO: 1197365 - RNA, 26 nt, Human
cagcaaggcaauguaauucuauagaa

SEQ ID NO: 1197366 - RNA, 22 nt, Human
cagcagaaagcagugagaaaaa

SEQ ID NO: 1197367 - RNA, 19 nt, Human
cagcagugagcacuguggc

SEQ ID NO: 1197368 - RNA, 20 nt, Human
caggaggcaccugacccaga

SEQ ID NO: 1197369 - RNA, 21 nt, Human
caggaggcaccugacccagac

SEQ ID NO: 1197370 - RNA, 18 nt, Human
cagugagaaaauguggug

SEQ ID NO: 1197371 - RNA, 24 nt, Human
cauuucccaggacagguccugcuc

SEQ ID NO: 1197372 - RNA, 23 nt, Human
ccaccagagccaguaggccaaca

SEQ ID NO: 1197373 - RNA, 18 nt, Human
ccagcccgcggcucuggg

SEQ ID NO: 1197374 - RNA, 21 nt, Human
ccagcccgcggcucugggacg

SEQ ID NO: 1197375 - RNA, 23 nt, Human
ccagcucccaauggugcugcaaa

SEQ ID NO: 1197376 - RNA, 21 nt, Human
ccaguaggccaacaggcaguc

SEQ ID NO: 1197377 - RNA, 22 nt, Human
cccccggagaagccuuagcugc

SEQ ID NO: 1197378 - RNA, 19 nt, Human
cccccuggggcugcccucu

SEQ ID NO: 1197379 - RNA, 19 nt, Human
cccccuggggcugcccucu

SEQ ID NO: 1197380 - RNA, 26 nt, Human
ccccgcugccauccacagcgccuccc

SEQ ID NO: 1197381 - RNA, 22 nt, Human
cccucccauugucuagccucag

SEQ ID NO: 1197382 - RNA, 21 nt, Human
cccucgggaccccagcugcac

SEQ ID NO: 1197383 - RNA, 19 nt, Human
ccgcugccauccacagcgc

SEQ ID NO: 1197384 - RNA, 19 nt, Human
ccucaguaccucuugauac

SEQ ID NO: 1197385 - RNA, 21 nt, Human
ccuggacaagggaggagagga

SEQ ID NO: 1197386 - RNA, 18 nt, Human
ccuggcaacauggccacc

SEQ ID NO: 1197387 - RNA, 19 nt, Human
ccuggggcugcccucucag

SEQ ID NO: 1197388 - RNA, 24 nt, Human
cgccccgcugccauccacagcgcc

SEQ ID NO: 1197389 - RNA, 24 nt, Human
cuacccucgggaccccagcugcac

SEQ ID NO: 1197390 - RNA, 19 nt, Human
cucacagcgccccgcugcc

SEQ ID NO: 1197391 - RNA, 19 nt, Human
cucaucccugacccccugg

SEQ ID NO: 1197392 - RNA, 26 nt, Human
cucccauugucucccaucagccucgg

SEQ ID NO: 1197393 - RNA, 19 nt, Human
cucuucuaaagcagcucca

SEQ ID NO: 1197394 - RNA, 19 nt, Human
cugcucuucuggcuggugg

SEQ ID NO: 1197395 - RNA, 20 nt, Human
cuggacaagggaggagagga

SEQ ID NO: 1197396 - RNA, 21 nt, Human
cuguggcugggagcucagggc

SEQ ID NO: 1197397 - RNA, 22 nt, Human
cuucaugcugccuauuaaacuc

SEQ ID NO: 1197398 - RNA, 21 nt, Human
cuucucacucccuccucacug

SEQ ID NO: 1197399 - RNA, 22 nt, Human
cuuguguguggaaaaaggagaa

SEQ ID NO: 1197400 - RNA, 21 nt, Human
gagcacacaccuggacaaggg

SEQ ID NO: 1197401 - RNA, 21 nt, Human
gagcagcuggagcugcuugug

SEQ ID NO: 1197402 - RNA, 21 nt, Human
gagcccgcuggcaaccuuuga

SEQ ID NO: 1197403 - RNA, 23 nt, Human
gagcugcuuguggugcagcuggu

SEQ ID NO: 1197404 - RNA, 20 nt, Human
gaggagaagauguugcagca

SEQ ID NO: 1197405 - RNA, 20 nt, Human
gaggaucccugagcucuugu

SEQ ID NO: 1197406 - RNA, 19 nt, Human
gauucucacgguuuuccuc

SEQ ID NO: 1197407 - RNA, 22 nt, Human
gcaacaaagauaacaccauccc

SEQ ID NO: 1197408 - RNA, 23 nt, Human
gcaauagugagcacacaccugga

SEQ ID NO: 1197409 - RNA, 21 nt, Human
gcacuggagcugcaggaggua

SEQ ID NO: 1197410 - RNA, 18 nt, Human
gcagagcaggaaaucaga

SEQ ID NO: 1197411 - RNA, 20 nt, Human
gcauuucccaggacaggucc

SEQ ID NO: 1197412 - RNA, 20 nt, Human
gcggcucugggacgcuaccc

SEQ ID NO: 1197413 - RNA, 22 nt, Human
gcugguuggcaguuacaugaag

SEQ ID NO: 1197414 - RNA, 18 nt, Human
ggacaagggaggagagga

SEQ ID NO: 1197415 - RNA, 18 nt, Human
ggagcagcuggagcugcu

SEQ ID NO: 1197416 - RNA, 18 nt, Human
ggugaccuugaggacuca

SEQ ID NO: 1197417 - RNA, 22 nt, Human
guaaaagaaagcuccuuccuuc

SEQ ID NO: 1197418 - RNA, 18 nt, Human
guggagcagcuggagcug

SEQ ID NO: 1197419 - RNA, 20 nt, Human
gugggaggcacagcaagugg

SEQ ID NO: 1197420 - RNA, 18 nt, Human
guucuuauucccgaucca

SEQ ID NO: 1197421 - RNA, 19 nt, Human
uaaaagcaauccagcuccc

SEQ ID NO: 1197422 - RNA, 21 nt, Human
uaaaaggcuaaggugcaaggg

SEQ ID NO: 1197423 - RNA, 22 nt, Human
uaaaccacgcaugaauaugcca

SEQ ID NO: 1197424 - RNA, 19 nt, Human
uaacuuguucagaaggagg

SEQ ID NO: 1197425 - RNA, 22 nt, Human
uaacuuguucagaaggaggaau

SEQ ID NO: 1197426 - RNA, 18 nt, Human
uaguggauaaccagagcc

SEQ ID NO: 1197427 - RNA, 18 nt, Human
uauagaacaucagggccc

SEQ ID NO: 1197428 - RNA, 19 nt, Human
ucaaacaccgacuccucau

SEQ ID NO: 1197429 - RNA, 24 nt, Human
ucaaacaccgacuccucauauaac

SEQ ID NO: 1197430 - RNA, 22 nt, Human
ucaacagaaaacaaaaaacccu

SEQ ID NO: 1197431 - RNA, 23 nt, Human
ucacaggaggcaccugacccaga

SEQ ID NO: 1197432 - RNA, 22 nt, Human
uccacagcgccucccagcccgc

SEQ ID NO: 1197433 - RNA, 22 nt, Human
uccagaaaaugacaauaauagg

SEQ ID NO: 1197434 - RNA, 20 nt, Human
uccagccagugaagugaggu

SEQ ID NO: 1197435 - RNA, 27 nt, Human
ucccugcucuucuggcuggugguggac

SEQ ID NO: 1197436 - RNA, 18 nt, Human
uccuggaggagaagaugu

SEQ ID NO: 1197437 - RNA, 19 nt, Human
ucucacagcgccccgcugc

SEQ ID NO: 1197438 - RNA, 19 nt, Human
ucuccgcuccuuaaauuca

SEQ ID NO: 1197439 - RNA, 20 nt, Human
ucucuucuaaagcagcucca

SEQ ID NO: 1197440 - RNA, 18 nt, Human
ucuggugggaggcacagc

SEQ ID NO: 1197441 - RNA, 18 nt, Human
ugagaaaaugugguggcc

SEQ ID NO: 1197442 - RNA, 23 nt, Human
ugagcacacaccuggacaaggga

SEQ ID NO: 1197443 - RNA, 18 nt, Human
ugagucagggcagagcag

SEQ ID NO: 1197444 - RNA, 21 nt, Human
ugcaggagguaggggaugaag

SEQ ID NO: 1197445 - RNA, 21 nt, Human
ugcucaaggucacuggugcug

SEQ ID NO: 1197446 - RNA, 20 nt, Human
ugcugccuauuaaacucucc

SEQ ID NO: 1197447 - RNA, 23 nt, Human
ugcuguguuccccuauuggcuaa

SEQ ID NO: 1197448 - RNA, 19 nt, Human
ugcuuguggugcagcuggu

SEQ ID NO: 1197449 - RNA, 19 nt, Human
uggaaaaaggagaagccau

SEQ ID NO: 1197450 - RNA, 19 nt, Human
uggaaaaaugguuauggca

SEQ ID NO: 1197451 - RNA, 21 nt, Human
uggagcagcuggagcugcuug

SEQ ID NO: 1197452 - RNA, 20 nt, Human
uggcaacauggccaccucga

SEQ ID NO: 1197453 - RNA, 18 nt, Human
uggcagagcaggaaauca

SEQ ID NO: 1197454 - RNA, 21 nt, Human
uggcagagcaggaaaucagaa

SEQ ID NO: 1197455 - RNA, 22 nt, Human
uggcagagcaggaaaucagaaa

SEQ ID NO: 1197456 - RNA, 19 nt, Human
uggccccaggguugggcgu

SEQ ID NO: 1197457 - RNA, 21 nt, Human
uggcuaguaucucggggcacu

SEQ ID NO: 1197458 - RNA, 21 nt, Human
uggcucaucccugacccccug

SEQ ID NO: 1197459 - RNA, 18 nt, Human
uggcuggggugcaguugg

SEQ ID NO: 1197460 - RNA, 18 nt, Human
uggcuggggugcaguugg

SEQ ID NO: 1197461 - RNA, 25 nt, Human
uggcuggggugcaguugggggugca

SEQ ID NO: 1197462 - RNA, 25 nt, Human
uggcuggugguggacacaaacauug

SEQ ID NO: 1197463 - RNA, 18 nt, Human
ugggaaggccgagaggug

SEQ ID NO: 1197464 - RNA, 19 nt, Human
ugggaggcacagcaagugg

SEQ ID NO: 1197465 - RNA, 22 nt, Human
ugggaggcacagcaagugggaa

SEQ ID NO: 1197466 - RNA, 19 nt, Human
uggugcuggugaccuugag

SEQ ID NO: 1197467 - RNA, 24 nt, Human
ugucagaguggagcagcuggagcu

SEQ ID NO: 1197468 - RNA, 20 nt, Human
uguggaaaaaggagaagcca

SEQ ID NO: 1197469 - RNA, 24 nt, Human
uuccuggaggagaagauguugcca

SEQ ID NO: 1197470 - RNA, 22 nt, Human
uucucagcaaggcaauguaauu

SEQ ID NO: 1197471 - RNA, 22 nt, Human
uuugccuggcaacauggccacc

SEQ ID NO: 1197472 - RNA, 23 nt, Human
aucaccgcagcuucuugaguaac

SEQ ID NO: 1197473 - RNA, 19 nt, Human
cacaaaaguaaaaaucacc

SEQ ID NO: 1197474 - RNA, 22 nt, Human
uaagcaucuuuucauugguuuc

SEQ ID NO: 1197475 - RNA, 22 nt, Human
ucuugaguaacuuucuugacuu

SEQ ID NO: 1197476 - RNA, 21 nt, Human
ucuuuggcagcauucuuaaca

SEQ ID NO: 1197477 - RNA, 22 nt, Human
ugauaugggaccauguuucuca

SEQ ID NO: 1197478 - RNA, 20 nt, Human
uugcugguucgauccuuuau

SEQ ID NO: 1197479 - RNA, 21 nt, Human
uuggcagcauucuuaacaucu

SEQ ID NO: 1197480 - RNA, 23 nt, Human
cacauuuacccccucuuccugaa

SEQ ID NO: 1197481 - RNA, 23 nt, Human
cauuccauacaauccacauuuac

SEQ ID NO: 1197482 - RNA, 18 nt, Human
cuuuauucuggaaguagg

SEQ ID NO: 1197483 - RNA, 18 nt, Human
ggagccaccugucaccug

SEQ ID NO: 1197484 - RNA, 25 nt, Human
uccauacaauccacauuuacccccu

SEQ ID NO: 1197485 - RNA, 27 nt, Human
uccuugguaaucacuuuauucuggaag

SEQ ID NO: 1197486 - RNA, 25 nt, Human
ucucuuuuuccuuuaguuccugugc

SEQ ID NO: 1197487 - RNA, 21 nt, Human
ugacucgaucucuuuuuccuu

SEQ ID NO: 1197488 - RNA, 22 nt, Human
ugcugaguacugccguccugca

SEQ ID NO: 1197489 - RNA, 24 nt, Human
uuccauacaauccacauuuacccc

SEQ ID NO: 1197490 - RNA, 25 nt, Human
uuccuugguaaucacuuuauucugg

SEQ ID NO: 1197491 - RNA, 18 nt, Human
aaaacccucaaaccagga

SEQ ID NO: 1197492 - RNA, 19 nt, Human
aaacacacaaagccacaca

SEQ ID NO: 1197493 - RNA, 23 nt, Human
aaaggcaaguccaaauugaaaca

SEQ ID NO: 1197494 - RNA, 19 nt, Human
aacugcugggaacacagga

SEQ ID NO: 1197495 - RNA, 19 nt, Human
aacugucccauggauccca

SEQ ID NO: 1197496 - RNA, 18 nt, Human
aagcagcugcucagcugg

SEQ ID NO: 1197497 - RNA, 24 nt, Human
aagcaggaaccaagacaaaggcaa

SEQ ID NO: 1197498 - RNA, 21 nt, Human
acaaacacacaaagccacacc

SEQ ID NO: 1197499 - RNA, 23 nt, Human
acacaaauguggaggccacaacc

SEQ ID NO: 1197500 - RNA, 21 nt, Human
acacacacacagacacauaca

SEQ ID NO: 1197501 - RNA, 19 nt, Human
acacacacagacacauaca

SEQ ID NO: 1197502 - RNA, 19 nt, Human
acacauacacaaacacaca

SEQ ID NO: 1197503 - RNA, 22 nt, Human
acacucccacaguaacacacag

SEQ ID NO: 1197504 - RNA, 19 nt, Human
acagacacauacacaaaca

SEQ ID NO: 1197505 - RNA, 18 nt, Human
accucacugucucccuuc

SEQ ID NO: 1197506 - RNA, 19 nt, Human
acucugugucccagaauga

SEQ ID NO: 1197507 - RNA, 19 nt, Human
acugcugggaacacaggaa

SEQ ID NO: 1197508 - RNA, 19 nt, Human
agaagacaggugacagugc

SEQ ID NO: 1197509 - RNA, 24 nt, Human
agacaaaggcaaguccaaauugaa

SEQ ID NO: 1197510 - RNA, 24 nt, Human
agacacauacacaaacacacaaag

SEQ ID NO: 1197511 - RNA, 25 nt, Human
agacacauacacaaacacacaaagc

SEQ ID NO: 1197512 - RNA, 22 nt, Human
agacugaaaucccaagacaaug

SEQ ID NO: 1197513 - RNA, 24 nt, Human
agaggucuccuucucuaccaagcc

SEQ ID NO: 1197514 - RNA, 22 nt, Human
aggaaaaugguacaggcagagc

SEQ ID NO: 1197515 - RNA, 22 nt, Human
aggaaccaagacaaaggcaagu

SEQ ID NO: 1197516 - RNA, 22 nt, Human
aggcaggaaccacgacaaaggc

SEQ ID NO: 1197517 - RNA, 23 nt, Human
aggccacaacccacccagcauca

SEQ ID NO: 1197518 - RNA, 22 nt, Human
aggggcagacgauggggaaccc

SEQ ID NO: 1197519 - RNA, 24 nt, Human
agggguuuugugaaagaaucaugc

SEQ ID NO: 1197520 - RNA, 24 nt, Human
agggugucagggcugucagccugc

SEQ ID NO: 1197521 - RNA, 21 nt, Human
agguauuaaaacccucaaacc

SEQ ID NO: 1197522 - RNA, 22 nt, Human
aggugcuaucugggaaaagcag

SEQ ID NO: 1197523 - RNA, 19 nt, Human
auaaaacauucuccaggaa

SEQ ID NO: 1197524 - RNA, 18 nt, Human
augauagugucucuccuu

SEQ ID NO: 1197525 - RNA, 22 nt, Human
augcuagcuggagcccauagcu

SEQ ID NO: 1197526 - RNA, 18 nt, Human
auguccacuaaugcuguu

SEQ ID NO: 1197527 - RNA, 18 nt, Human
caaaagauggccuggcac

SEQ ID NO: 1197528 - RNA, 21 nt, Human
caaacacacaaagccacacac

SEQ ID NO: 1197529 - RNA, 20 nt, Human
caaauguggaggccacaacc

SEQ ID NO: 1197530 - RNA, 22 nt, Human
caacacucccacaguaacacac

SEQ ID NO: 1197531 - RNA, 18 nt, Human
caaguccaaauugaaaca

SEQ ID NO: 1197532 - RNA, 19 nt, Human
caccagguuguauacucac

SEQ ID NO: 1197533 - RNA, 20 nt, Human
cacgacaaaggcagguccaa

SEQ ID NO: 1197534 - RNA, 20 nt, Human
cacuccaaauuuuuccugca

SEQ ID NO: 1197535 - RNA, 23 nt, Human
cagccugccuaagcagaggaaaa

SEQ ID NO: 1197536 - RNA, 22 nt, Human
caggaaccaagacaaaggcaag

SEQ ID NO: 1197537 - RNA, 23 nt, Human
caugaaaucucaagaugauggag

SEQ ID NO: 1197538 - RNA, 21 nt, Human
cauucugcagaaagccccacc

SEQ ID NO: 1197539 - RNA, 23 nt, Human
ccaacacucgcaacacucccaca

SEQ ID NO: 1197540 - RNA, 23 nt, Human
ccacccagcaucaaucuauucca

SEQ ID NO: 1197541 - RNA, 23 nt, Human
ccacggaguucuuauccacaaag

SEQ ID NO: 1197542 - RNA, 23 nt, Human
ccagcaucaaucuauuccacuuc

SEQ ID NO: 1197543 - RNA, 22 nt, Human
cccacaguaacacacagcccag

SEQ ID NO: 1197544 - RNA, 18 nt, Human
cccaguagcuucugaggc

SEQ ID NO: 1197545 - RNA, 18 nt, Human
ccccauccacccuucacc

SEQ ID NO: 1197546 - RNA, 21 nt, Human
ccuaggaucauggaacugucc

SEQ ID NO: 1197547 - RNA, 22 nt, Human
ccucacaacgugaagcagcugc

SEQ ID NO: 1197548 - RNA, 23 nt, Human
ccuggcacuugaccucucugcca

SEQ ID NO: 1197549 - RNA, 21 nt, Human
cuccauggucagaucacaugg

SEQ ID NO: 1197550 - RNA, 22 nt, Human
cucgcaacacucccacaguaac

SEQ ID NO: 1197551 - RNA, 31 nt, Human; identical to SEQ ID NO: 1002988

SEQ ID NO: 1197552 - RNA, 22 nt, Human
cuggagcaccagggugucaggg

SEQ ID NO: 1197553 - RNA, 18 nt, Human
cugucccauggaucccac

SEQ ID NO: 1197554 - RNA, 22 nt, Human
cuugaccucacugucucccuuc

SEQ ID NO: 1197555 - RNA, 21 nt, Human
gaaaucccaagacaauggaga

SEQ ID NO: 1197556 - RNA, 21 nt, Human
gaagacguugagccagaccaa

SEQ ID NO: 1197557 - RNA, 19 nt, Human
gaagauguugagccagauc

SEQ ID NO: 1197558 - RNA, 22 nt, Human
gacaauggaagucaguaaaaga

SEQ ID NO: 1197559 - RNA, 19 nt, Human
gacugaaaucccaagacaa

SEQ ID NO: 1197560 - RNA, 20 nt, Human
gagaagacaggugacagugc

SEQ ID NO: 1197561 - RNA, 21 nt, Human
gauguugaaaaauguucacag

SEQ ID NO: 1197562 - RNA, 20 nt, Human
gcagagcuggcuugguauca

SEQ ID NO: 1197563 - RNA, 18 nt, Human
gccacaacccacccagca

SEQ ID NO: 1197564 - RNA, 20 nt, Human
gcucuccucuucuuuguaga

SEQ ID NO: 1197565 - RNA, 26 nt, Human
gcuggcucacaucuacccucuccuag

SEQ ID NO: 1197566 - RNA, 18 nt, Human
ggauaaaggcugccugug

SEQ ID NO: 1197567 - RNA, 20 nt, Human
ggcagguccaaagucaagca

SEQ ID NO: 1197568 - RNA, 19 nt, Human
gggagaugucuguucuugg

SEQ ID NO: 1197569 - RNA, 18 nt, Human
gguacaggcagagcuggc

SEQ ID NO: 1197570 - RNA, 22 nt, Human
guucuuggguguggugcucucc

SEQ ID NO: 1197571 - RNA, 19 nt, Human
uaaaacccucaaaccagga

SEQ ID NO: 1197572 - RNA, 19 nt, Human
uaaaagaggacacaaaugu

SEQ ID NO: 1197573 - RNA, 23 nt, Human
uacagguauuaaaacccucaaac

SEQ ID NO: 1197574 - RNA, 26 nt, Human
uacauacacacacacagacacauaca

SEQ ID NO: 1197575 - RNA, 22 nt, Human
uacccuaaaagucucaaacuua

SEQ ID NO: 1197576 - RNA, 24 nt, Human
uaucccagacugaaaucccaagac

SEQ ID NO: 1197577 - RNA, 21 nt, Human
ucaaaccaggaguuuuccaga

SEQ ID NO: 1197578 - RNA, 22 nt, Human
ucacagaaggugucugcggaaa

SEQ ID NO: 1197579 - RNA, 19 nt, Human
ucagugaaagauggcuggg

SEQ ID NO: 1197580 - RNA, 23 nt, Human
uccauggucagaucacaugggag

SEQ ID NO: 1197581 - RNA, 18 nt, Human
ucccacagagaagacagg

SEQ ID NO: 1197582 - RNA, 19 nt, Human
ucccaugaggaucauuuuc

SEQ ID NO: 1197583 - RNA, 22 nt, Human
ucucacaggugcagaugugguu

SEQ ID NO: 1197584 - RNA, 21 nt, Human
ucugugucccagaaugaaauc

SEQ ID NO: 1197585 - RNA, 23 nt, Human
ucuguucuuggguguggugcucu

SEQ ID NO: 1197586 - RNA, 24 nt, Human
ugaaagaaucaugccccaugagga

SEQ ID NO: 1197587 - RNA, 19 nt, Human
ugaaagauggcugggcucu

SEQ ID NO: 1197588 - RNA, 26 nt, Human
ugacauccaacacucgcaacacuccc

SEQ ID NO: 1197589 - RNA, 24 nt, Human
ugacugauuuugcaauuaugggaa

SEQ ID NO: 1197590 - RNA, 25 nt, Human
ugagaaaggcaggaaccacgacaaa

SEQ ID NO: 1197591 - RNA, 22 nt, Human
ugagauguugagcagucuuugg

SEQ ID NO: 1197592 - RNA, 22 nt, Human
ugagauguugagcagucuuugg

SEQ ID NO: 1197593 - RNA, 21 nt, Human
ugcagauccuuuuggaucugu

SEQ ID NO: 1197594 - RNA, 19 nt, Human
ugccugugauaacgcauug

SEQ ID NO: 1197595 - RNA, 22 nt, Human
uggaagauguugagccagaucc

SEQ ID NO: 1197596 - RNA, 22 nt, Human
uggaagucaguaaaagaggaca

SEQ ID NO: 1197597 - RNA, 21 nt, Human
uggagcaccagggugucaggg

SEQ ID NO: 1197598 - RNA, 19 nt, Human
uggcaggggaucuaugaga

SEQ ID NO: 1197599 - RNA, 20 nt, Human
uggcucacaucuacccucuc

SEQ ID NO: 1197600 - RNA, 22 nt, Human
uggcugggcucuugaccucacu

SEQ ID NO: 1197601 - RNA, 21 nt, Human
uggcuugguaucaggauaaag

SEQ ID NO: 1197602 - RNA, 21 nt, Human
ugggagagagaaacugcuggg

SEQ ID NO: 1197603 - RNA, 23 nt, Human
ugggugucagugaaagauggcug

SEQ ID NO: 1197604 - RNA, 22 nt, Human
ugguacaggcagagcuggcuug

SEQ ID NO: 1197605 - RNA, 18 nt, Human
ugguaucaggauaaaggc

SEQ ID NO: 1197606 - RNA, 24 nt, Human
uggugagauguugagcagucuuug

SEQ ID NO: 1197607 - RNA, 19 nt, Human
ugugaaagaaucaugcccc

SEQ ID NO: 1197608 - RNA, 23 nt, Human
ugugaacagggaagaguuuagug

SEQ ID NO: 1197609 - RNA, 26 nt, Human
ugugaacagggaagaguuuaguguga

SEQ ID NO: 1197610 - RNA, 28 nt, Human
uuacauacacacacacagacacauacac

SEQ ID NO: 1197611 - RNA, 19 nt, Human
uucacccuuuuugcuggug

SEQ ID NO: 1197612 - RNA, 26 nt, Human
uucaggacaauaaaacauucuccagg

SEQ ID NO: 1197613 - RNA, 23 nt, Human
uucuuuguagaagaguaccugac

SEQ ID NO: 1197614 - RNA, 21 nt, Human
uugcaagucugacaaucaugu

SEQ ID NO: 1197615 - RNA, 24 nt, Human
uuggccacaauuugcacuccaaau

SEQ ID NO: 1197616 - RNA, 25 nt, Human
uuuggaucuguagugauuuugugcu

SEQ ID NO: 1197617 - RNA, 18 nt, Human
uuuuaugauggucuucug

SEQ ID NO: 1197618 - RNA, 18 nt, Human
uuuuuuggcaggggcagc

SEQ ID NO: 1197619 - RNA, 20 nt, Human
aaagaagguugggcucuuga

SEQ ID NO: 1197620 - RNA, 19 nt, Human
aaagccgcggccacucuug

SEQ ID NO: 1197621 - RNA, 24 nt, Human
aagcaugaaaaaaaguguuguugg

SEQ ID NO: 1197622 - RNA, 24 nt, Human
accaggugacuuguagcaacggcc

SEQ ID NO: 1197623 - RNA, 24 nt, Human
agaaacaagcccagaucaucugca

SEQ ID NO: 1197624 - RNA, 19 nt, Human
auuuuauucaugucucucu

SEQ ID NO: 1197625 - RNA, 19 nt, Human
caaaccacacuuugguagc

SEQ ID NO: 1197626 - RNA, 26 nt, Human
cacuuuuguaaggucagaauuggagg

SEQ ID NO: 1197627 - RNA, 19 nt, Human
cagugccccuccucaguuc

SEQ ID NO: 1197628 - RNA, 21 nt, Human
cauccugggucucucagaagc

SEQ ID NO: 1197629 - RNA, 20 nt, Human
ccagggcugggaaguaaggc

SEQ ID NO: 1197630 - RNA, 23 nt, Human
cccgaccccaggugucccaaagc

SEQ ID NO: 1197631 - RNA, 21 nt, Human
ccucaugguggacccgacccc

SEQ ID NO: 1197632 - RNA, 20 nt, Human
ccugggucucucagaagcuc

SEQ ID NO: 1197633 - RNA, 24 nt, Human
cgccucuccuuucucuguaccaga

SEQ ID NO: 1197634 - RNA, 23 nt, Human
cgugguuccacucagcgccucuc

SEQ ID NO: 1197635 - RNA, 20 nt, Human
cucaaugccauguacucucc

SEQ ID NO: 1197636 - RNA, 18 nt, Human
cuccccuggccucagccc

SEQ ID NO: 1197637 - RNA, 21 nt, Human
cucugaguccuuagagguggg

SEQ ID NO: 1197638 - RNA, 18 nt, Human
cucuugaccucacugcau

SEQ ID NO: 1197639 - RNA, 22 nt, Human
cucuugggauuguugaggccca

SEQ ID NO: 1197640 - RNA, 24 nt, Human
cugcaucccuucauccugggucuc

SEQ ID NO: 1197641 - RNA, 21 nt, Human
cugguguggugugcuccucuu

SEQ ID NO: 1197642 - RNA, 23 nt, Human
gaagcucucucagacugaccuuu

SEQ ID NO: 1197643 - RNA, 23 nt, Human
gaaguaaggcccagggcagugcc

SEQ ID NO: 1197644 - RNA, 24 nt, Human
gccauguacucuccugggaggguc

SEQ ID NO: 1197645 - RNA, 18 nt, Human
ggccacucuugggcgggu

SEQ ID NO: 1197646 - RNA, 19 nt, Human
gucuuuuccucacuuggcc

SEQ ID NO: 1197647 - RNA, 22 nt, Human
uaccagaaucucugccagaaac

SEQ ID NO: 1197648 - RNA, 18 nt, Human
ucaacuacuuuaguucuc

SEQ ID NO: 1197649 - RNA, 23 nt, Human
ucacugcaucccuucauccuggg

SEQ ID NO: 1197650 - RNA, 21 nt, Human
ucagaagcucucucagacuga

SEQ ID NO: 1197651 - RNA, 19 nt, Human
ucagugaaagaagguuggg

SEQ ID NO: 1197652 - RNA, 22 nt, Human
ucccuucauccugggucucuca

SEQ ID NO: 1197653 - RNA, 21 nt, Human
uccugggucucucagaagcuc

SEQ ID NO: 1197654 - RNA, 23 nt, Human
uccugggucucucagaagcucuc

SEQ ID NO: 1197655 - RNA, 23 nt, Human
ucucaaugccauguacucuccug

SEQ ID NO: 1197656 - RNA, 20 nt, Human
ucucuugggauuguugaggc

SEQ ID NO: 1197657 - RNA, 25 nt, Human
ucuguaccagaaucucugccagaaa

SEQ ID NO: 1197658 - RNA, 19 nt, Human
ucuuuuccucacuuggccg

SEQ ID NO: 1197659 - RNA, 19 nt, Human
ugaaagaagguugggcucu

SEQ ID NO: 1197660 - RNA, 18 nt, Human
ugccagaaacaagcccag

SEQ ID NO: 1197661 - RNA, 24 nt, Human
ugccagaaacaagcccagaucauc

SEQ ID NO: 1197662 - RNA, 21 nt, Human
ugccauguacucuccugggag

SEQ ID NO: 1197663 - RNA, 20 nt, Human
ugcgaugucuccccuggccu

SEQ ID NO: 1197664 - RNA, 21 nt, Human
uggaggccagggcugggaagu

SEQ ID NO: 1197665 - RNA, 18 nt, Human
ugggaaguaaggcccagg

SEQ ID NO: 1197666 - RNA, 24 nt, Human
ugggcucuugaccucacugcaucc

SEQ ID NO: 1197667 - RNA, 18 nt, Human
ugggucucucagaagcuc

SEQ ID NO: 1197668 - RNA, 22 nt, Human
uggugugcuccucuucgcguac

SEQ ID NO: 1197669 - RNA, 24 nt, Human
uguuggagguugcgaugucucccc

SEQ ID NO: 1197670 - RNA, 23 nt, Human
uuguaaggucagaauuggaggcc

SEQ ID NO: 1197671 - RNA, 22 nt, Human
uuguuggagguugcgaugucuc

SEQ ID NO: 1197672 - RNA, 23 nt, Human
accucaaaaaauucauggaggaa

SEQ ID NO: 1197673 - RNA, 21 nt, Human
auagcaucaacaaguaugaag

SEQ ID NO: 1197674 - RNA, 26 nt, Human
caacaaguaugaaauuacuuugaaaa

SEQ ID NO: 1197675 - RNA, 19 nt, Human
cagggccaacugcgggagg

SEQ ID NO: 1197676 - RNA, 20 nt, Human
ccuggcccucaggcguacgu

SEQ ID NO: 1197677 - RNA, 26 nt, Human
cggaacaccacagggccaacugcggg

SEQ ID NO: 1197678 - RNA, 18 nt, Human
cucuccacaaaaccaaca

SEQ ID NO: 1197679 - RNA, 20 nt, Human
uagcaucaacaaguaugaaa

SEQ ID NO: 1197680 - RNA, 21 nt, Human
uaugaaauuacuuugaaaaca

SEQ ID NO: 1197681 - RNA, 21 nt, Human
ucucuccacaaaaccaacaug

SEQ ID NO: 1197682 - RNA, 20 nt, Human
uguaaaauuuuauugugaaa

SEQ ID NO: 1197683 - RNA, 19 nt, Human
uuugauuugcaaacaagga

SEQ ID NO: 1197684 - RNA, 20 nt, Human
uuccucuaaguuuauaguuu

SEQ ID NO: 1197685 - RNA, 26 nt, Human
aagaaagaaaugucuugucuauucag

SEQ ID NO: 1197686 - RNA, 24 nt, Human
aagcaggaagaucacuugagccca

SEQ ID NO: 1197687 - RNA, 19 nt, Human
acacuuuacaguacagaag

SEQ ID NO: 1197688 - RNA, 22 nt, Human
acagugaugguaaaucauuuuc

SEQ ID NO: 1197689 - RNA, 23 nt, Human
agaucacuugagcccaggaguuc

SEQ ID NO: 1197690 - RNA, 27 nt, Human
agcaagugguuagaaaaucauauuuua

SEQ ID NO: 1197691 - RNA, 21 nt, Human
aguucauacugccagaauugc

SEQ ID NO: 1197692 - RNA, 24 nt, Human
aucacuugagcccaggaguucaag

SEQ ID NO: 1197693 - RNA, 18 nt, Human
caaaguccccuaauccuc

SEQ ID NO: 1197694 - RNA, 18 nt, Human
caggaguucaagguuaca

SEQ ID NO: 1197695 - RNA, 24 nt, Human
caggaguucaagguuacagugaga

SEQ ID NO: 1197696 - RNA, 19 nt, Human
caggcaauuuaucaaaguc

SEQ ID NO: 1197697 - RNA, 21 nt, Human
ccccuaauccuccaaaaucgc

SEQ ID NO: 1197698 - RNA, 21 nt, Human
ccuguagucccagcuacucag

SEQ ID NO: 1197699 - RNA, 27 nt, Human
cuagacagugaugguaaaucauuuucu

SEQ ID NO: 1197700 - RNA, 21 nt, Human
gagcaagugguuagaaaauca

SEQ ID NO: 1197701 - RNA, 24 nt, Human
gaucacuugagcccaggaguucaa

SEQ ID NO: 1197702 - RNA, 18 nt, Human
gccuguagucccagcuac

SEQ ID NO: 1197703 - RNA, 23 nt, Human
gccuguagucccagcuacucaga

SEQ ID NO: 1197704 - RNA, 21 nt, Human
gucuccggcaauaaaucacaa

SEQ ID NO: 1197705 - RNA, 22 nt, Human
uacagaagaaaaugucuccggc

SEQ ID NO: 1197706 - RNA, 19 nt, Human
uacucagaaaguugaagca

SEQ ID NO: 1197707 - RNA, 20 nt, Human
ucaaaguccccuaauccucc

SEQ ID NO: 1197708 - RNA, 24 nt, Human
ucaagaugaugacucagggccuuu

SEQ ID NO: 1197709 - RNA, 23 nt, Human
ucuaccaaaagaaagaaaugucu

SEQ ID NO: 1197710 - RNA, 21 nt, Human
ugaaagagagaaauuaauaug

SEQ ID NO: 1197711 - RNA, 20 nt, Human
ugaagcaggaagaucacuug

SEQ ID NO: 1197712 - RNA, 24 nt, Human
ugaagcaggaagaucacuugagcc

SEQ ID NO: 1197713 - RNA, 24 nt, Human
uguagucccagcuacucagaaagu

SEQ ID NO: 1197714 - RNA, 20 nt, Human
uuccucuaaguuuauaguuu

SEQ ID NO: 1197715 - RNA, 21 nt, Human
aacuccuugcuucuuuacuug

SEQ ID NO: 1197716 - RNA, 18 nt, Human
aacugguguagagugagg

SEQ ID NO: 1197717 - RNA, 20 nt, Human
accagaaacuucaccauguc

SEQ ID NO: 1197718 - RNA, 20 nt, Human
agaaagcugcugcaugaagg

SEQ ID NO: 1197719 - RNA, 22 nt, Human
agccacaugaagggcuguagcc

SEQ ID NO: 1197720 - RNA, 20 nt, Human
agcccuuggcagcagccaca

SEQ ID NO: 1197721 - RNA, 19 nt, Human
auguagaaggagaugcugg

SEQ ID NO: 1197722 - RNA, 19 nt, Human
cacaaagugcuucugccag

SEQ ID NO: 1197723 - RNA, 18 nt, Human
cagcagcauggaggggag

SEQ ID NO: 1197724 - RNA, 20 nt, Human
cagugucuguaggcuucuca

SEQ ID NO: 1197725 - RNA, 27 nt, Human
cauucugcuucuucuggagcaucucca

SEQ ID NO: 1197726 - RNA, 23 nt, Human
ccaccagaaacuucaccaugucc

SEQ ID NO: 1197727 - RNA, 21 nt, Human
ccagaaauugaugucugugcc

SEQ ID NO: 1197728 - RNA, 21 nt, Human
ccagggcugcuggcccucccc

SEQ ID NO: 1197729 - RNA, 23 nt, Human
ccccagggcugcuggcccucccc

SEQ ID NO: 1197730 - RNA, 18 nt, Human
ccccggagcgagccugcc

SEQ ID NO: 1197731 - RNA, 21 nt, Human
ccucgacuggcugaauguccu

SEQ ID NO: 1197732 - RNA, 20 nt, Human
ccucucuuggacagacagcu

SEQ ID NO: 1197733 - RNA, 20 nt, Human
ccugaauuaaaagucugagg

SEQ ID NO: 1197734 - RNA, 18 nt, Human
ccuugaguagaccuucgu

SEQ ID NO: 1197735 - RNA, 21 nt, Human
cucagaaucagggacugaaaa

SEQ ID NO: 1197736 - RNA, 23 nt, Human
cucagaaucagggacugaaaauc

SEQ ID NO: 1197737 - RNA, 20 nt, Human
cucaugcuucucagggcucc

SEQ ID NO: 1197738 - RNA, 23 nt, Human
cuccaaaugcuccacgagacccu

SEQ ID NO: 1197739 - RNA, 21 nt, Human
cucuucauccagacuccugcc

SEQ ID NO: 1197740 - RNA, 24 nt, Human
cugaaaaucuauuuguccauagca

SEQ ID NO: 1197741 - RNA, 25 nt, Human
cugcaacaucugcugcucuucuucu

SEQ ID NO: 1197742 - RNA, 27 nt, Human
cugcaacaucugcugcucuucuucuuu

SEQ ID NO: 1197743 - RNA, 25 nt, Human
cuuuacuugcuccagaagaagaucc

SEQ ID NO: 1197744 - RNA, 22 nt, Human
gaaucagggacugaaaaucuau

SEQ ID NO: 1197745 - RNA, 23 nt, Human
gccacagaaagcugcugcaugaa

SEQ ID NO: 1197746 - RNA, 21 nt, Human
gcgugguggguuugucuggcu

SEQ ID NO: 1197747 - RNA, 26 nt, Human
gcucuucuucuuuucuugacugcucc

SEQ ID NO: 1197748 - RNA, 21 nt, Human
gggcauccugcaacaucugcu

SEQ ID NO: 1197749 - RNA, 22 nt, Human
ggugaugacagauaggcucuuc

SEQ ID NO: 1197750 - RNA, 19 nt, Human
guccucuuugucuugcugg

SEQ ID NO: 1197751 - RNA, 23 nt, Human
gucuugauguagaaggagaugcu

SEQ ID NO: 1197752 - RNA, 23 nt, Human
uagaaggagaugcuggcguggug

SEQ ID NO: 1197753 - RNA, 22 nt, Human
uagccagccugaauuaaaaguc

SEQ ID NO: 1197754 - RNA, 25 nt, Human
ucaaugacuuuauuccaugucuccu

SEQ ID NO: 1197755 - RNA, 24 nt, Human
ucauuuuuguccauuuccuuugca

SEQ ID NO: 1197756 - RNA, 25 nt, Human
uccaccagaaacuucaccaugucca

SEQ ID NO: 1197757 - RNA, 22 nt, Human
uccacgagacccucaucagcca

SEQ ID NO: 1197758 - RNA, 19 nt, Human
uccagaagaagauccuuca

SEQ ID NO: 1197759 - RNA, 20 nt, Human
uccuuucugcuucuugaagg

SEQ ID NO: 1197760 - RNA, 25 nt, Human
ugaauguccuuucugcuucuugaag

SEQ ID NO: 1197761 - RNA, 26 nt, Human
ugaauguccuuucugcuucuugaagg

SEQ ID NO: 1197762 - RNA, 18 nt, Human
ugacaauaccuccacugg

SEQ ID NO: 1197763 - RNA, 24 nt, Human
ugaccagaaauugaugucugugcc

SEQ ID NO: 1197764 - RNA, 22 nt, Human
ugcaugaagggguguccagucc

SEQ ID NO: 1197765 - RNA, 21 nt, Human
ugccaggauggagcaagccuc

SEQ ID NO: 1197766 - RNA, 18 nt, Human
ugccccagggcugcuggc

SEQ ID NO: 1197767 - RNA, 21 nt, Human
ugcuccagaucaacuccuugc

SEQ ID NO: 1197768 - RNA, 20 nt, Human
uggaggggaguccagccauc

SEQ ID NO: 1197769 - RNA, 23 nt, Human
uggcagcagccacaugaagggcu

SEQ ID NO: 1197770 - RNA, 19 nt, Human
uggcugaauguccuuucug

SEQ ID NO: 1197771 - RNA, 18 nt, Human
uggcugagcugggcaccu

SEQ ID NO: 1197772 - RNA, 24 nt, Human
ugucacaaagugcuucugccagga

SEQ ID NO: 1197773 - RNA, 20 nt, Human
uuacuugcuccagaagaaga

SEQ ID NO: 1197774 - RNA, 19 nt, Human
uucaccuucaccauugaca

SEQ ID NO: 1197775 - RNA, 22 nt, Human
uucuccaccagaaacuucacca

SEQ ID NO: 1197776 - RNA, 21 nt, Human
uucuucuggagcaucuccaaa

SEQ ID NO: 1197777 - RNA, 20 nt, Human
agacggcgccggcgcccgca

SEQ ID NO: 1197778 - RNA, 22 nt, Human
agccggcacuucaccagcuugg

SEQ ID NO: 1197779 - RNA, 20 nt, Human
caccaaguaacccgcgccaa

SEQ ID NO: 1197780 - RNA, 18 nt, Human
caccagcuuggagcagca

SEQ ID NO: 1197781 - RNA, 20 nt, Human
caccuugcccuucugcagcc

SEQ ID NO: 1197782 - RNA, 26 nt, Human
caccuugcccuucugcagccggcacu

SEQ ID NO: 1197783 - RNA, 21 nt, Human
cacugcguagacggcgccggc

SEQ ID NO: 1197784 - RNA, 18 nt, Human
ccgcacagcugcccuggc

SEQ ID NO: 1197785 - RNA, 19 nt, Human
ccggcgcccgcacucagcu

SEQ ID NO: 1197786 - RNA, 22 nt, Human
cgcacucagcuguugacagucu

SEQ ID NO: 1197787 - RNA, 22 nt, Human
cgggagggauacggacccggug

SEQ ID NO: 1197788 - RNA, 22 nt, Human
cgggguggggcggaaucgggag

SEQ ID NO: 1197789 - RNA, 18 nt, Human
cguagacggcgccggcgc

SEQ ID NO: 1197790 - RNA, 22 nt, Human
cugcagccggcacuucaccagc

SEQ ID NO: 1197791 - RNA, 23 nt, Human
cugcagccggcacuucaccagcu

SEQ ID NO: 1197792 - RNA, 26 nt, Human
ggccaggaccaaaugugucuccuucu

SEQ ID NO: 1197793 - RNA, 21 nt, Human
gggagggauacggacccggug

SEQ ID NO: 1197794 - RNA, 24 nt, Human
gggguggggcggaaucgggaggga

SEQ ID NO: 1197795 - RNA, 23 nt, Human
ggguggggcggaaucgggaggga

SEQ ID NO: 1197796 - RNA, 22 nt, Human
ggugacuccgggguggccagga

SEQ ID NO: 1197797 - RNA, 22 nt, Human
gguggggcggaaucgggaggga

SEQ ID NO: 1197798 - RNA, 19 nt, Human
uacgcugcuccggaguccc

SEQ ID NO: 1197799 - RNA, 18 nt, Human
ucaccuugcccuucugca

SEQ ID NO: 1197800 - RNA, 22 nt, Human
ucagcuguugacagucuuucuu

SEQ ID NO: 1197801 - RNA, 21 nt, Human
ucggcgcgacggugaauuucc

SEQ ID NO: 1197802 - RNA, 25 nt, Human
ugcaauggucaccuugcccuucugc

SEQ ID NO: 1197803 - RNA, 19 nt, Human
ugcaccacaccaaguaacc

SEQ ID NO: 1197804 - RNA, 20 nt, Human
ugcaccacaccaaguaaccc

SEQ ID NO: 1197805 - RNA, 23 nt, Human
ugcccuucugcagccggcacuuc

SEQ ID NO: 1197806 - RNA, 23 nt, Human
ugcuccggagucccaccgcagga

SEQ ID NO: 1197807 - RNA, 23 nt, Human
uggagcagcagauguugacggag

SEQ ID NO: 1197808 - RNA, 24 nt, Human
uggggcggaaucgggagggauacg

SEQ ID NO: 1197809 - RNA, 19 nt, Human
ugguuugggugacuccggg

SEQ ID NO: 1197810 - RNA, 24 nt, Human
uguuguacuccaggaaggagcggc

SEQ ID NO: 1197811 - RNA, 25 nt, Human
uugacagucuuucuuccagcucucc

SEQ ID NO: 1197812 - RNA, 26 nt, Human
uugcaccacaccaaguaacccgcgcc

SEQ ID NO: 1197813 - RNA, 24 nt, Human
uuggagcagcagauguugacggag

SEQ ID NO: 1197814 - RNA, 20 nt, Human
uuuuuguuucccuccggaga

SEQ ID NO: 1197815 - RNA, 23 nt, Human
aaacgacagggaagcaucugcag

SEQ ID NO: 1197816 - RNA, 20 nt, Human
aaaugcacgaagccagcagg

SEQ ID NO: 1197817 - RNA, 20 nt, Human
aacacaauucucuuugcagc

SEQ ID NO: 1197818 - RNA, 22 nt, Human
aacacaauucucuuugcagcca

SEQ ID NO: 1197819 - RNA, 18 nt, Human
aagccuccgacaggagca

SEQ ID NO: 1197820 - RNA, 19 nt, Human
aagggccaccuguaggcac

SEQ ID NO: 1197821 - RNA, 19 nt, Human
aagugucugcucauucagu

SEQ ID NO: 1197822 - RNA, 20 nt, Human
acagacagcacuuccucggg

SEQ ID NO: 1197823 - RNA, 22 nt, Human
acagagccaggaacuggcaggu

SEQ ID NO: 1197824 - RNA, 25 nt, Human
accaucuccaggcuggcggcugcug

SEQ ID NO: 1197825 - RNA, 22 nt, Human
acgaagccagcaggguggaucc

SEQ ID NO: 1197826 - RNA, 18 nt, Human
acugugcugggcauggcu

SEQ ID NO: 1197827 - RNA, 18 nt, Human
agaacuccucacuuccgc

SEQ ID NO: 1197828 - RNA, 19 nt, Human
agaacuccucacuuccgcc

SEQ ID NO: 1197829 - RNA, 19 nt, Human
agacacuaaacgacaggga

SEQ ID NO: 1197830 - RNA, 22 nt, Human
agagccucccagagccaggccu

SEQ ID NO: 1197831 - RNA, 18 nt, Human
agcauccacaggugggga

SEQ ID NO: 1197832 - RNA, 22 nt, Human
agccaaagcugggagcgucgga

SEQ ID NO: 1197833 - RNA, 18 nt, Human
agccacuggccgaacucc

SEQ ID NO: 1197834 - RNA, 18 nt, Human
agccagcaggguggaucc

SEQ ID NO: 1197835 - RNA, 22 nt, Human
agcuggccccggccacggcccc

SEQ ID NO: 1197836 - RNA, 19 nt, Human
agcuugaggcgcgccagcu

SEQ ID NO: 1197837 - RNA, 18 nt, Human
aggcaaucgguuuggucu

SEQ ID NO: 1197838 - RNA, 20 nt, Human
aggcaggugggcgacugggc

SEQ ID NO: 1197839 - RNA, 19 nt, Human
agggccgccagcugugagc

SEQ ID NO: 1197840 - RNA, 19 nt, Human
agguaguugcaggguccag

SEQ ID NO: 1197841 - RNA, 25 nt, Human
agugcccccaaaugcacgaagccag

SEQ ID NO: 1197842 - RNA, 21 nt, Human
aucuccagcagaacuucugcc

SEQ ID NO: 1197843 - RNA, 23 nt, Human
caacaggccaucauccaucucuu

SEQ ID NO: 1197844 - RNA, 24 nt, Human
caacgcgaucucuuuucugcagcu

SEQ ID NO: 1197845 - RNA, 18 nt, Human
caacugugcgaggaggag

SEQ ID NO: 1197846 - RNA, 18 nt, Human
caagagguccccagcuga

SEQ ID NO: 1197847 - RNA, 22 nt, Human
caauuaccaggccgacggaagu

SEQ ID NO: 1197848 - RNA, 21 nt, Human
cacaguagagucacuucuguc

SEQ ID NO: 1197849 - RNA, 18 nt, Human
caccagggccagcaggau

SEQ ID NO: 1197850 - RNA, 24 nt, Human
cacccccaacugcaggacgggaac

SEQ ID NO: 1197851 - RNA, 20 nt, Human
cacccucuuccucuaccucc

SEQ ID NO: 1197852 - RNA, 22 nt, Human
cacccucuuccucuaccuccag

SEQ ID NO: 1197853 - RNA, 19 nt, Human
caccgaggggcccgccucc

SEQ ID NO: 1197854 - RNA, 22 nt, Human
cacugggccucugcacaaggcu

SEQ ID NO: 1197855 - RNA, 23 nt, Human
cacugggccucugcacaaggcuc

SEQ ID NO: 1197856 - RNA, 20 nt, Human
cagcaccuugaggccgcccu

SEQ ID NO: 1197857 - RNA, 18 nt, Human
cagcacuuccucggggca

SEQ ID NO: 1197858 - RNA, 22 nt, Human
cagcagcaccucugacgccuga

SEQ ID NO: 1197859 - RNA, 24 nt, Human
cagcagcaccucugacgccugagc

SEQ ID NO: 1197860 - RNA, 18 nt, Human
cagcaggaugugcacgcg

SEQ ID NO: 1197861 - RNA, 19 nt, Human
cagccacguacuccccauc

SEQ ID NO: 1197862 - RNA, 19 nt, Human
cagccagggagcugggcag

SEQ ID NO: 1197863 - RNA, 20 nt, Human
cagcccacgcucagcggcug

SEQ ID NO: 1197864 - RNA, 22 nt, Human
cagccucgugggcagucaggug

SEQ ID NO: 1197865 - RNA, 23 nt, Human
cagcucggagcacgcgugggcga

SEQ ID NO: 1197866 - RNA, 21 nt, Human
caggagaggcuggaaagccag

SEQ ID NO: 1197867 - RNA, 24 nt, Human
caggagaggcuggaaagccaggua

SEQ ID NO: 1197868 - RNA, 22 nt, Human
caggaggacaauccaagccccg

SEQ ID NO: 1197869 - RNA, 26 nt, Human
cagggccaggcggugccacaugcgcg

SEQ ID NO: 1197870 - RNA, 21 nt, Human
caggggaucggggauaagcac

SEQ ID NO: 1197871 - RNA, 22 nt, Human
cagguggccugaggguaggcag

SEQ ID NO: 1197872 - RNA, 18 nt, Human
cagguucaucuccagcag

SEQ ID NO: 1197873 - RNA, 19 nt, Human
caguagcaacgagcacucu

SEQ ID NO: 1197874 - RNA, 23 nt, Human
cauagggcgcccugugggccauc

SEQ ID NO: 1197875 - RNA, 22 nt, Human
caucugcagccaaagcugggag

SEQ ID NO: 1197876 - RNA, 21 nt, Human
cauggcgcgcggcugcuucuc

SEQ ID NO: 1197877 - RNA, 24 nt, Human
cauuugccacagcacguccagaga

SEQ ID NO: 1197878 - RNA, 22 nt, Human
ccacagccacguacuccccauc

SEQ ID NO: 1197879 - RNA, 19 nt, Human
ccagagccauuuccacgag

SEQ ID NO: 1197880 - RNA, 18 nt, Human
ccaggaggccacugccaa

SEQ ID NO: 1197881 - RNA, 18 nt, Human
ccagucccgacgucagga

SEQ ID NO: 1197882 - RNA, 21 nt, Human
cccaaaugcacgaagccagca

SEQ ID NO: 1197883 - RNA, 18 nt, Human
cccaccgaggggcccgcc

SEQ ID NO: 1197884 - RNA, 24 nt, Human
cccauagcagccucgugggcaguc

SEQ ID NO: 1197885 - RNA, 22 nt, Human
cccauccgggggccugcagcca

SEQ ID NO: 1197886 - RNA, 19 nt, Human
cccccaacugcaggacggg

SEQ ID NO: 1197887 - RNA, 24 nt, Human
cccgagcuuggccuucacgaugac

SEQ ID NO: 1197888 - RNA, 20 nt, Human
cccgcaggcucaggcaccug

SEQ ID NO: 1197889 - RNA, 23 nt, Human
cccgcaggcucaggcaccuggcu

SEQ ID NO: 1197890 - RNA, 19 nt, Human
cccgggagcucccccugcu

SEQ ID NO: 1197891 - RNA, 21 nt, Human
cccuggacgcugugaagccuc

SEQ ID NO: 1197892 - RNA, 21 nt, Human
cccuggaggccggcggguccc

SEQ ID NO: 1197893 - RNA, 23 nt, Human
cccuggaggccggcgggucccug

SEQ ID NO: 1197894 - RNA, 21 nt, Human
cccuggaugcugugaagccuc

SEQ ID NO: 1197895 - RNA, 23 nt, Human
cccugggccaggccauacgcuuc

SEQ ID NO: 1197896 - RNA, 25 nt, Human
cccugggccaggccauauaagcccu

SEQ ID NO: 1197897 - RNA, 20 nt, Human
ccgcccucccagucguccug

SEQ ID NO: 1197898 - RNA, 18 nt, Human
ccgggggccugcagcccc

SEQ ID NO: 1197899 - RNA, 20 nt, Human
ccucccagagccaggccucc

SEQ ID NO: 1197900 - RNA, 22 nt, Human
ccucccggucuccccauucauc

SEQ ID NO: 1197901 - RNA, 22 nt, Human
ccucggggcaggaguaggaagc

SEQ ID NO: 1197902 - RNA, 19 nt, Human
ccucguagcccucggcgcc

SEQ ID NO: 1197903 - RNA, 21 nt, Human
ccugcagccagggagcugggc

SEQ ID NO: 1197904 - RNA, 23 nt, Human
ccugcggccugcuucucugagac

SEQ ID NO: 1197905 - RNA, 21 nt, Human
ccugcuggaacggggguccca

SEQ ID NO: 1197906 - RNA, 21 nt, Human
ccuggcagggggcugcaggcc

SEQ ID NO: 1197907 - RNA, 22 nt, Human
ccuucugccacuccaucucagg

SEQ ID NO: 1197908 - RNA, 24 nt, Human
cgaaaucagcacccccaacugcag

SEQ ID NO: 1197909 - RNA, 22 nt, Human
cgcucccuccaccgggaaucug

SEQ ID NO: 1197910 - RNA, 18 nt, Human
cggcaggcucccacugcu

SEQ ID NO: 1197911 - RNA, 21 nt, Human
cggcauggcuguggaagagca

SEQ ID NO: 1197912 - RNA, 23 nt, Human
cggccugcuucucugagacagag

SEQ ID NO: 1197913 - RNA, 20 nt, Human
cgggaaucugugaccccagc

SEQ ID NO: 1197914 - RNA, 24 nt, Human
cgucaggaggacaauccaagcccc

SEQ ID NO: 1197915 - RNA, 21 nt, Human
cuccacagccacguacucccc

SEQ ID NO: 1197916 - RNA, 23 nt, Human
cuccagggaccccugcucacucu

SEQ ID NO: 1197917 - RNA, 21 nt, Human
cucccagagccaggccucccc

SEQ ID NO: 1197918 - RNA, 21 nt, Human
cuccccagcugugccagugcc

SEQ ID NO: 1197919 - RNA, 18 nt, Human
cuccugcuggaacggggg

SEQ ID NO: 1197920 - RNA, 21 nt, Human
cuccuuauuuuucucuuuuuu

SEQ ID NO: 1197921 - RNA, 18 nt, Human
cugacccgcaccgccagg

SEQ ID NO: 1197922 - RNA, 21 nt, Human
cugcacuguggccuggcgcuc

SEQ ID NO: 1197923 - RNA, 25 nt, Human
cugcaggccuucccaucgccggccu

SEQ ID NO: 1197924 - RNA, 20 nt, Human
cugcagugcuccuccggggc

SEQ ID NO: 1197925 - RNA, 26 nt, Human
cugccagggucagaguggaauuguac

SEQ ID NO: 1197926 - RNA, 19 nt, Human
cugcugguguuggcugugg

SEQ ID NO: 1197927 - RNA, 22 nt, Human
cuggccucuggaccaagccugg

SEQ ID NO: 1197928 - RNA, 23 nt, Human
cuucucugagacagagccaggaa

SEQ ID NO: 1197929 - RNA, 18 nt, Human
cuucugccacuccaucuc

SEQ ID NO: 1197930 - RNA, 21 nt, Human
cuuggcagcaccugcacagcc

SEQ ID NO: 1197931 - RNA, 20 nt, Human
gaacuggcagguaguugcag

SEQ ID NO: 1197932 - RNA, 22 nt, Human
gaacuugaagggcccugcggug

SEQ ID NO: 1197933 - RNA, 27 nt, Human
gacaggaagugucugcucauucagugc

SEQ ID NO: 1197934 - RNA, 21 nt, Human
gagaggaaagugucugugaug

SEQ ID NO: 1197935 - RNA, 19 nt, Human
gagcagccgugcaggcugg

SEQ ID NO: 1197936 - RNA, 22 nt, Human
gagcagguucaggagaggcugg

SEQ ID NO: 1197937 - RNA, 22 nt, Human
gagcauguccagagccauuucc

SEQ ID NO: 1197938 - RNA, 22 nt, Human
gcacaaggcucauccagcuccu

SEQ ID NO: 1197939 - RNA, 21 nt, Human
gcaggcuuucuucuaauaaag

SEQ ID NO: 1197940 - RNA, 25 nt, Human
gcaggcuuucuucuaauaaaggcuc

SEQ ID NO: 1197941 - RNA, 18 nt, Human
gccagaaccauccuccuc

SEQ ID NO: 1197942 - RNA, 23 nt, Human
gccagaugugccugaagaaggcg

SEQ ID NO: 1197943 - RNA, 18 nt, Human
gccagcaggaugugcacg

SEQ ID NO: 1197944 - RNA, 18 nt, Human
gccagggucagaguggaa

SEQ ID NO: 1197945 - RNA, 22 nt, Human
gccccguagacacuaaacgaca

SEQ ID NO: 1197946 - RNA, 25 nt, Human
gcuggccccggccacggcccccggc

SEQ ID NO: 1197947 - RNA, 18 nt, Human
gcugugagcugcuggugu

SEQ ID NO: 1197948 - RNA, 18 nt, Human
ggagcacgcgugggcgag

SEQ ID NO: 1197949 - RNA, 21 nt, Human
ggaguccgaaaucagcacccc

SEQ ID NO: 1197950 - RNA, 26 nt, Human
ggauaagcacacgaaugcauguucuc

SEQ ID NO: 1197951 - RNA, 19 nt, Human
ggcacccucuuccucuacc

SEQ ID NO: 1197952 - RNA, 18 nt, Human
ggcaggaguaggaagccc

SEQ ID NO: 1197953 - RNA, 18 nt, Human
ggccagcaggugcagggc

SEQ ID NO: 1197954 - RNA, 19 nt, Human
ggcccccggcugucccgcc

SEQ ID NO: 1197955 - RNA, 22 nt, Human
ggccugcggccugcuucucuga

SEQ ID NO: 1197956 - RNA, 18 nt, Human
ggccugggcccauagcag

SEQ ID NO: 1197957 - RNA, 20 nt, Human
ggcgaggcgaaggugguaga

SEQ ID NO: 1197958 - RNA, 19 nt, Human
ggcucagagccucccagag

SEQ ID NO: 1197959 - RNA, 20 nt, Human
ggcuucauggccagcaggau

SEQ ID NO: 1197960 - RNA, 21 nt, Human
gggcgaggcgaaggugguaga

SEQ ID NO: 1197961 - RNA, 22 nt, Human
guccucgccucuccugcagugc

SEQ ID NO: 1197962 - RNA, 22 nt, Human
gucuccccauucaucuucaaaa

SEQ ID NO: 1197963 - RNA, 21 nt, Human
uaccuccagcuccagagacuu

SEQ ID NO: 1197964 - RNA, 22 nt, Human
uacgcagcugcuccaaggacac

SEQ ID NO: 1197965 - RNA, 21 nt, Human
uagagcgcagcacggagcgcc

SEQ ID NO: 1197966 - RNA, 21 nt, Human
uagcaggccagcucuccagac

SEQ ID NO: 1197967 - RNA, 23 nt, Human
uagcaggccagcucuccagacac

SEQ ID NO: 1197968 - RNA, 21 nt, Human
uaggcugcaaggcagcagucc

SEQ ID NO: 1197969 - RNA, 23 nt, Human
uaguccgccagcagcuucuccag

SEQ ID NO: 1197970 - RNA, 21 nt, Human
ucauggcgcgcggcugcuucu

SEQ ID NO: 1197971 - RNA, 22 nt, Human
ucauggcgcgcggcugcuucuc

SEQ ID NO: 1197972 - RNA, 24 nt, Human
uccacagguggggaaaggacgucc

SEQ ID NO: 1197973 - RNA, 23 nt, Human
uccaccgggaaucugugacccca

SEQ ID NO: 1197974 - RNA, 21 nt, Human
uccaugagguacuccaccuuc

SEQ ID NO: 1197975 - RNA, 23 nt, Human
ucccagagccaggccuccccauc

SEQ ID NO: 1197976 - RNA, 19 nt, Human
uccccagcugacccgcacc

SEQ ID NO: 1197977 - RNA, 24 nt, Human
uccccaggcuggacaggaaguguc

SEQ ID NO: 1197978 - RNA, 22 nt, Human
uccucagccauggcgcccuggg

SEQ ID NO: 1197979 - RNA, 23 nt, Human
uccucggccucggacacggggcu

SEQ ID NO: 1197980 - RNA, 20 nt, Human
uccugugccaugaacaccag

SEQ ID NO: 1197981 - RNA, 30 nt, Human
ucucaauuuccaacaggccaucauccaucu

SEQ ID NO: 1197982 - RNA, 19 nt, Human
ucuccacacagcccacgcu

SEQ ID NO: 1197983 - RNA, 19 nt, Human
ucuccacagccacguacuc

SEQ ID NO: 1197984 - RNA, 19 nt, Human
ucuccaggcuggcggcugc

SEQ ID NO: 1197985 - RNA, 21 nt, Human
ucuccagggaccccugcucac

SEQ ID NO: 1197986 - RNA, 22 nt, Human
ucucuuuucugcagcuggcccc

SEQ ID NO: 1197987 - RNA, 21 nt, Human
ucugcagccaaagcugggagc

SEQ ID NO: 1197988 - RNA, 21 nt, Human
ucugcagggccuugaccaggg

SEQ ID NO: 1197989 - RNA, 22 nt, Human
ucuucgcacgcucuaguuuuac

SEQ ID NO: 1197990 - RNA, 22 nt, Human
ucuugaagugacaauaggcccu

SEQ ID NO: 1197991 - RNA, 18 nt, Human
ugaaauaugugacacacc

SEQ ID NO: 1197992 - RNA, 18 nt, Human
ugaagugacaauaggccc

SEQ ID NO: 1197993 - RNA, 24 nt, Human
ugacacaccguagcuucccuuccu

SEQ ID NO: 1197994 - RNA, 23 nt, Human
ugaccccagcaauuaccaggccg

SEQ ID NO: 1197995 - RNA, 18 nt, Human
ugagacagagccaggaac

SEQ ID NO: 1197996 - RNA, 19 nt, Human
ugagacagagccaggaacu

SEQ ID NO: 1197997 - RNA, 20 nt, Human
ugaggguaggcaggugggcg

SEQ ID NO: 1197998 - RNA, 22 nt, Human
ugaguguuccauggacaagagc

SEQ ID NO: 1197999 - RNA, 21 nt, Human
ugcacaaggcucauccagcuc

SEQ ID NO: 1198000 - RNA, 20 nt, Human
ugcaggcacaucuucugcag

SEQ ID NO: 1198001 - RNA, 20 nt, Human
ugccacagcacguccagagg

SEQ ID NO: 1198002 - RNA, 19 nt, Human
ugccagugccccgugugcu

SEQ ID NO: 1198003 - RNA, 18 nt, Human
ugcccgggagcucccccu

SEQ ID NO: 1198004 - RNA, 22 nt, Human
ugcccuggaggccggcggguug

SEQ ID NO: 1198005 - RNA, 20 nt, Human
uggaacgggggucccaucag

SEQ ID NO: 1198006 - RNA, 23 nt, Human
uggagccacuggccgaacuccau

SEQ ID NO: 1198007 - RNA, 18 nt, Human
uggcagcaccugcacagc

SEQ ID NO: 1198008 - RNA, 26 nt, Human
uggcagcaccugcacagccucgucca

SEQ ID NO: 1198009 - RNA, 19 nt, Human
uggccucuggaccaagccu

SEQ ID NO: 1198010 - RNA, 22 nt, Human
uggccugcggccugcuucucug

SEQ ID NO: 1198011 - RNA, 22 nt, Human
uggcggcugcugcgacauccag

SEQ ID NO: 1198012 - RNA, 24 nt, Human
uggcucagggacaucgccgggcgg

SEQ ID NO: 1198013 - RNA, 18 nt, Human
uggcucgagaagugacgg

SEQ ID NO: 1198014 - RNA, 19 nt, Human
uggcuguggcugcaagcag

SEQ ID NO: 1198015 - RNA, 24 nt, Human
ugggauggaacccucagugucugg

SEQ ID NO: 1198016 - RNA, 22 nt, Human
ugggcauggcugugaccgccag

SEQ ID NO: 1198017 - RNA, 18 nt, Human
ugggccucugcacaaggc

SEQ ID NO: 1198018 - RNA, 23 nt, Human
ugggcgacugggcucuguggaag

SEQ ID NO: 1198019 - RNA, 21 nt, Human
ugguccaggaaauacaaacug

SEQ ID NO: 1198020 - RNA, 22 nt, Human
uguagcaggccagcucuccaga

SEQ ID NO: 1198021 - RNA, 21 nt, Human
uguagucacugguguucugca

SEQ ID NO: 1198022 - RNA, 20 nt, Human
uguccauaguuuuucuccuu

SEQ ID NO: 1198023 - RNA, 25 nt, Human
ugugagcugcugguguuggcugugg

SEQ ID NO: 1198024 - RNA, 21 nt, Human
uuaccaggccgacggaagugu

SEQ ID NO: 1198025 - RNA, 24 nt, Human
uucaggagaggcuggaaagccagg

SEQ ID NO: 1198026 - RNA, 24 nt, Human
uucagguccucgccucuccugcag

SEQ ID NO: 1198027 - RNA, 19 nt, Human
uucagugaccgcugagugc

SEQ ID NO: 1198028 - RNA, 19 nt, Human
uuccaacaggccaucaucc

SEQ ID NO: 1198029 - RNA, 22 nt, Human
uuccucagccauggcgcccugg

SEQ ID NO: 1198030 - RNA, 20 nt, Human
uuccucagcuacggcacccu

SEQ ID NO: 1198031 - RNA, 22 nt, Human
uuccucagcuacggcacccugg

SEQ ID NO: 1198032 - RNA, 19 nt, Human
uuccucuaccuccagcucc

SEQ ID NO: 1198033 - RNA, 21 nt, Human
uuccucuaccuccagcuccag

SEQ ID NO: 1198034 - RNA, 21 nt, Human
uuccuggccucuggaccaagc

SEQ ID NO: 1198035 - RNA, 18 nt, Human
uugaagggcccugcggug

SEQ ID NO: 1198036 - RNA, 20 nt, Human
aaauaauuuauugaugauac

SEQ ID NO: 1198037 - RNA, 18 nt, Human
acaaagcgacucgcgccc

SEQ ID NO: 1198038 - RNA, 23 nt, Human
cacccggggccgcccccggauuc

SEQ ID NO: 1198039 - RNA, 23 nt, Human
ccugcaccacgccgggccagaag

SEQ ID NO: 1198040 - RNA, 18 nt, Human
cgcgcgccacagcggccg

SEQ ID NO: 1198041 - RNA, 21 nt, Human
cuucccguccuuguccaggac

SEQ ID NO: 1198042 - RNA, 20 nt, Human
gaagaugggcgggcgccccg

SEQ ID NO: 1198043 - RNA, 22 nt, Human
gccccggcagcucggccagggg

SEQ ID NO: 1198044 - RNA, 24 nt, Human
gggucccuccagggcgcgcccugc

SEQ ID NO: 1198045 - RNA, 23 nt, Human
ggucccuccagggcgcgcccugc

SEQ ID NO: 1198046 - RNA, 19 nt, Human
uccuuguccaggacgccgc

SEQ ID NO: 1198047 - RNA, 24 nt, Human
ucgcgcccacccggggccgccccc

SEQ ID NO: 1198048 - RNA, 19 nt, Human
auguagcaggacccagccu

SEQ ID NO: 1198049 - RNA, 22 nt, Human
cacacacuacaguagcccacuc

SEQ ID NO: 1198050 - RNA, 24 nt, Human
cccccucacccuuagcuaaaagcc

SEQ ID NO: 1198051 - RNA, 20 nt, Human
ccuucaguacuguggagacc

SEQ ID NO: 1198052 - RNA, 20 nt, Human
cgucgaagccaucauuauuc

SEQ ID NO: 1198053 - RNA, 26 nt, Human
cuccucaugaaucccccaguggggau

SEQ ID NO: 1198054 - RNA, 22 nt, Human
cuuugaaucacacacacuacag

SEQ ID NO: 1198055 - RNA, 23 nt, Human
cuuugaaucacacacacuacagu

SEQ ID NO: 1198056 - RNA, 23 nt, Human
gaaguucccccucacccuuagcu

SEQ ID NO: 1198057 - RNA, 22 nt, Human
gacccagccuuugaaucacaca

SEQ ID NO: 1198058 - RNA, 19 nt, Human
ggguggccugcagcuccuu

SEQ ID NO: 1198059 - RNA, 22 nt, Human
uagcccacucccuccucaugaa

SEQ ID NO: 1198060 - RNA, 26 nt, Human
ucacacacacuacaguagcccacucc

SEQ ID NO: 1198061 - RNA, 19 nt, Human
ucccuccucaugaaucccc

SEQ ID NO: 1198062 - RNA, 20 nt, Human
uccgaaguucccccucaccc

SEQ ID NO: 1198063 - RNA, 18 nt, Human
ugccugaggguggccugc

SEQ ID NO: 1198064 - RNA, 20 nt, Human
ugccugaggguggccugcag

SEQ ID NO: 1198065 - RNA, 21 nt, Human
ugccugaggguggccugcagc

SEQ ID NO: 1198066 - RNA, 19 nt, Human
ugggcuccgaaguuccccc

SEQ ID NO: 1198067 - RNA, 21 nt, Human
uggugucugccugaggguggc

SEQ ID NO: 1198068 - RNA, 18 nt, Human
uguagcaggacccagccu

SEQ ID NO: 1198069 - RNA, 19 nt, Human
cagggagggcaaugucagg

SEQ ID NO: 1198070 - RNA, 27 nt, Human
cucgcugacauccucuccagcucccaa

SEQ ID NO: 1198071 - RNA, 20 nt, Human
gcucgcugacauccucucca

SEQ ID NO: 1198072 - RNA, 22 nt, Human
aaaacaaaacagaacaacaaaa

SEQ ID NO: 1198073 - RNA, 23 nt, Human
aaaaccaaaacaaaacagaacaa

SEQ ID NO: 1198074 - RNA, 19 nt, Human
aaacaaaacagaacaacaa

SEQ ID NO: 1198075 - RNA, 26 nt, Human
aaaccaaaacaaaacagaacaacaaa

SEQ ID NO: 1198076 - RNA, 28 nt, Human
aaaccaaaacaaaacagaacaacaaaaa

SEQ ID NO: 1198077 - RNA, 22 nt, Human
acaccaaaaccaaaacaaaaca

SEQ ID NO: 1198078 - RNA, 23 nt, Human
accaaaacaaaacagaacaacaa

SEQ ID NO: 1198079 - RNA, 21 nt, Human
accaaaaccaaaacaaaacag

SEQ ID NO: 1198080 - RNA, 20 nt, Human
acuccugcuuacuuaggaac

SEQ ID NO: 1198081 - RNA, 23 nt, Human
agacaccaaaaccaaaacaaaac

SEQ ID NO: 1198082 - RNA, 24 nt, Human
agacaccaaaaccaaaacaaaaca

SEQ ID NO: 1198083 - RNA, 23 nt, Human
agccguccuguccucccuggccc

SEQ ID NO: 1198084 - RNA, 23 nt, Human
caaaacaaaacagaacaacaaaa

SEQ ID NO: 1198085 - RNA, 22 nt, Human
caaaaccaaaacaaaacagaac

SEQ ID NO: 1198086 - RNA, 28 nt, Human
caaaauaaacagaugaaauaaaagggua

SEQ ID NO: 1198087 - RNA, 20 nt, Human
cacuccugcuuacuuaggaa

SEQ ID NO: 1198088 - RNA, 27 nt, Human
cagacaccaaaaccaaaacaaaacaga

SEQ ID NO: 1198089 - RNA, 20 nt, Human
cagacagagccuucccccuu

SEQ ID NO: 1198090 - RNA, 19 nt, Human
cagcggggaagagagaccg

SEQ ID NO: 1198091 - RNA, 21 nt, Human
ccaaaacaaaacagaacaaca

SEQ ID NO: 1198092 - RNA, 24 nt, Human
ccaaaaccaaaacaaaacagaaca

SEQ ID NO: 1198093 - RNA, 25 nt, Human
cccaaaauuggagcauucucaggac

SEQ ID NO: 1198094 - RNA, 25 nt, Human
cccacacgccuugcaaagacagccg

SEQ ID NO: 1198095 - RNA, 20 nt, Human
ccccaaaauuggagcauucu

SEQ ID NO: 1198096 - RNA, 24 nt, Human
ccccugauccagcgugccuggccc

SEQ ID NO: 1198097 - RNA, 20 nt, Human
cgcgcggcgacagggcccgg

SEQ ID NO: 1198098 - RNA, 18 nt, Human
cguccuguccucccuggc

SEQ ID NO: 1198099 - RNA, 23 nt, Human
cguccuguccucccuggcccaga

SEQ ID NO: 1198100 - RNA, 18 nt, Human
cuccacacuccugcuuac

SEQ ID NO: 1198101 - RNA, 22 nt, Human
cucccuggcccagacagagccu

SEQ ID NO: 1198102 - RNA, 24 nt, Human
cucgggcucccccugauccagcgu

SEQ ID NO: 1198103 - RNA, 19 nt, Human
cuugcaaagacagccgucc

SEQ ID NO: 1198104 - RNA, 23 nt, Human
gagcugccggaaccggggcucgc

SEQ ID NO: 1198105 - RNA, 22 nt, Human
ggaacggacggccgcccgcagg

SEQ ID NO: 1198106 - RNA, 18 nt, Human
gggguggcgggaccgggc

SEQ ID NO: 1198107 - RNA, 18 nt, Human
gguacagacaccaaaacc

SEQ ID NO: 1198108 - RNA, 20 nt, Human
guccuguccucccuggccca

SEQ ID NO: 1198109 - RNA, 24 nt, Human
guggcgggaccgggcagcggggaa

SEQ ID NO: 1198110 - RNA, 20 nt, Human
uaaacagaugaaauaaaagg

SEQ ID NO: 1198111 - RNA, 23 nt, Human
uacagacaccaaaaccaaaacaa

SEQ ID NO: 1198112 - RNA, 24 nt, Human
uacagacaccaaaaccaaaacaaa

SEQ ID NO: 1198113 - RNA, 22 nt, Human
uauucagaaguacuuucuuaac

SEQ ID NO: 1198114 - RNA, 20 nt, Human
ucccuggcccagacagagcc

SEQ ID NO: 1198115 - RNA, 20 nt, Human
ugcuccaaaacaggcaauau

SEQ ID NO: 1198116 - RNA, 19 nt, Human
ugcuccacacuccugcuua

SEQ ID NO: 1198117 - RNA, 23 nt, Human
ugguacagacaccaaaaccaaaa

SEQ ID NO: 1198118 - RNA, 28 nt, Human
ccacauucugagcucuccauuccaauuu

SEQ ID NO: 1198119 - RNA, 21 nt, Human
ggguccccuuucccucugccc

SEQ ID NO: 1198120 - RNA, 20 nt, Human
guccccuuucccucugcccu

SEQ ID NO: 1198121 - RNA, 21 nt, Human
ugagcucuccauuccaauuuu

SEQ ID NO: 1198122 - RNA, 21 nt, Human
uucucuggggccacauucuga

SEQ ID NO: 1198123 - RNA, 22 nt, Human
ggacgcgaaucucagcgagaga

SEQ ID NO: 1198124 - RNA, 23 nt, Human
aaagcagcgggcauggaggaaug

SEQ ID NO: 1198125 - RNA, 23 nt, Human
aagcagcgggcauggaggaaugu

SEQ ID NO: 1198126 - RNA, 24 nt, Human
aagccacuuccuccugggaacuga

SEQ ID NO: 1198127 - RNA, 30 nt, Human
agaagccacuuccuccugggaacugaaccc

SEQ ID NO: 1198128 - RNA, 23 nt, Human
cagaagccacuuccuccugggaa

SEQ ID NO: 1198129 - RNA, 19 nt, Human
cagcugcagguacuaagag

SEQ ID NO: 1198130 - RNA, 18 nt, Human
ccccuucccucuucuccc

SEQ ID NO: 1198131 - RNA, 20 nt, Human
ccccuucccucuucucccau

SEQ ID NO: 1198132 - RNA, 18 nt, Human
ccucggagguuccaccuu

SEQ ID NO: 1198133 - RNA, 20 nt, Human
cuucagaagccacuuccucc

SEQ ID NO: 1198134 - RNA, 22 nt, Human
ggccccuucccucuucucccau

SEQ ID NO: 1198135 - RNA, 19 nt, Human
gggcagggguguggagaag

SEQ ID NO: 1198136 - RNA, 19 nt, Human
uaaacaaagcagcgggcau

SEQ ID NO: 1198137 - RNA, 24 nt, Human
uaagaggggauaaacaaagcagcg

SEQ ID NO: 1198138 - RNA, 18 nt, Human
ugccagggggugggcagg

SEQ ID NO: 1198139 - RNA, 19 nt, Human
ugccaggugcuggggugug

SEQ ID NO: 1198140 - RNA, 18 nt, Human
uggagaagcagcugcagg

SEQ ID NO: 1198141 - RNA, 19 nt, Human
ugggcagggguguggagaa

SEQ ID NO: 1198142 - RNA, 18 nt, Human
uggggugugugucugggu

SEQ ID NO: 1198143 - RNA, 20 nt, Human
ugucugggugagcgagugag

SEQ ID NO: 1198144 - RNA, 19 nt, Human
ugugguaagugccaggugc

SEQ ID NO: 1198145 - RNA, 26 nt, Human
acaaauaaagagcccacugagaaaag

SEQ ID NO: 1198146 - RNA, 21 nt, Human
acagacuagcuauucuuaacu

SEQ ID NO: 1198147 - RNA, 19 nt, Human
caaccaaugaagaaaaugc

SEQ ID NO: 1198148 - RNA, 22 nt, Human
ccacugagaaaaggaaggcaga

SEQ ID NO: 1198149 - RNA, 19 nt, Human
gagaaaaggaaggcagaca

SEQ ID NO: 1198150 - RNA, 22 nt, Human
uaaauacaaccaaugaagaaaa

SEQ ID NO: 1198151 - RNA, 24 nt, Human
uaacaaauaaagagcccacugaga

SEQ ID NO: 1198152 - RNA, 20 nt, Human
uacagcauggacgucuugca

SEQ ID NO: 1198153 - RNA, 23 nt, Human
ugguacuuuaggcaauuuauuaa

SEQ ID NO: 1198154 - RNA, 20 nt, Human
ugugugcguaugcuguaugu

SEQ ID NO: 1198155 - RNA, 21 nt, Human
ugugugcguaugcuguaugug

SEQ ID NO: 1198156 - RNA, 18 nt, Human
ugagccucuguguccuug

SEQ ID NO: 1198157 - RNA, 18 nt, Human
accucuuuucuuucccca

SEQ ID NO: 1198158 - RNA, 18 nt, Human
ccucuuuucuuuccccau

SEQ ID NO: 1198159 - RNA, 19 nt, Human
uuaaccucuuuucuuuccc

SEQ ID NO: 1198160 - RNA, 20 nt, Human
aagcagccuccacccaccag

SEQ ID NO: 1198161 - RNA, 26 nt, Human
aggauucggaaaggaacagggagguu

SEQ ID NO: 1198162 - RNA, 23 nt, Human
aggggguucuccaagcagccucc

SEQ ID NO: 1198163 - RNA, 19 nt, Human
aguucugagcccuuuaccu

SEQ ID NO: 1198164 - RNA, 25 nt, Human
caagcagccuccacccaccagccuc

SEQ ID NO: 1198165 - RNA, 20 nt, Human
ccccgcagccgguguugccc

SEQ ID NO: 1198166 - RNA, 18 nt, Human
cccgugcagccagagggu

SEQ ID NO: 1198167 - RNA, 26 nt, Human
ccucuccgggcagagaugauggggaa

SEQ ID NO: 1198168 - RNA, 19 nt, Human
cggcacggagaagccaagg

SEQ ID NO: 1198169 - RNA, 21 nt, Human
cggccccaagcgaguccccgg

SEQ ID NO: 1198170 - RNA, 21 nt, Human
cuccaagcagccuccacccac

SEQ ID NO: 1198171 - RNA, 19 nt, Human
cuuuaccucaucccucgag

SEQ ID NO: 1198172 - RNA, 21 nt, Human
gagaugauggggaacccgugc

SEQ ID NO: 1198173 - RNA, 21 nt, Human
gccuccacccaccagccucgc

SEQ ID NO: 1198174 - RNA, 22 nt, Human
gcgcuccggcacggagaagcca

SEQ ID NO: 1198175 - RNA, 21 nt, Human
gcggccguaacggccccgggc

SEQ ID NO: 1198176 - RNA, 20 nt, Human
ggcacggagaagccaagggg

SEQ ID NO: 1198177 - RNA, 20 nt, Human
ggcggccguaacggccccgg

SEQ ID NO: 1198178 - RNA, 21 nt, Human
gggaacccgugcagccagagg

SEQ ID NO: 1198179 - RNA, 21 nt, Human
gggcggccguaacggccccgg

SEQ ID NO: 1198180 - RNA, 20 nt, Human
uccaagcagccuccacccac

SEQ ID NO: 1198181 - RNA, 28 nt, Human
ucuccaagcagccuccacccaccagccu

SEQ ID NO: 1198182 - RNA, 22 nt, Human
ucuccgggcagagaugaugggg

SEQ ID NO: 1198183 - RNA, 24 nt, Human
uggggaacccgugcagccagaggg

SEQ ID NO: 1198184 - RNA, 23 nt, Human
agacgccgaggcggggaugaacu

SEQ ID NO: 1198185 - RNA, 19 nt, Human
agggaacagcaggugcaga

SEQ ID NO: 1198186 - RNA, 21 nt, Human
agguccaggguucgaggcuuc

SEQ ID NO: 1198187 - RNA, 19 nt, Human
caccucuucacaguugaag

SEQ ID NO: 1198188 - RNA, 19 nt, Human
caccugguguggcuggggc

SEQ ID NO: 1198189 - RNA, 23 nt, Human
cagcagcaccagcuuccaaggaa

SEQ ID NO: 1198190 - RNA, 22 nt, Human
cagcagcagcaccagcuuccaa

SEQ ID NO: 1198191 - RNA, 21 nt, Human
caucgugugaccaagcgggac

SEQ ID NO: 1198192 - RNA, 21 nt, Human
cccaccgacgucacuuccaaa

SEQ ID NO: 1198193 - RNA, 21 nt, Human
ccgagguggacgucaaggcca

SEQ ID NO: 1198194 - RNA, 21 nt, Human
cuccaagcucucuuucacauc

SEQ ID NO: 1198195 - RNA, 18 nt, Human
cugggcuggguccggggc

SEQ ID NO: 1198196 - RNA, 22 nt, Human
cuggggucuccaagcucucuuu

SEQ ID NO: 1198197 - RNA, 18 nt, Human
cuuccaaagcugaagguu

SEQ ID NO: 1198198 - RNA, 23 nt, Human
gcaccagcuuccaaggaacaaaa

SEQ ID NO: 1198199 - RNA, 21 nt, Human
gcagagacgccgaggcgggga

SEQ ID NO: 1198200 - RNA, 18 nt, Human
ggcuggguccggggcagg

SEQ ID NO: 1198201 - RNA, 26 nt, Human
ggguccggggcagggguccgaggugg

SEQ ID NO: 1198202 - RNA, 18 nt, Human
ucacuuccaaagcugaag

SEQ ID NO: 1198203 - RNA, 18 nt, Human
uccucugggugggguggg

SEQ ID NO: 1198204 - RNA, 23 nt, Human
ucuucacaguugaaggcgcugcu

SEQ ID NO: 1198205 - RNA, 21 nt, Human
ugaccaagcgggacaggucca

SEQ ID NO: 1198206 - RNA, 21 nt, Human
ugcaccugguguggcuggggc

SEQ ID NO: 1198207 - RNA, 18 nt, Human
uggcuggggcuggggcac

SEQ ID NO: 1198208 - RNA, 22 nt, Human
uggcuggggcuggggcacaggg

SEQ ID NO: 1198209 - RNA, 18 nt, Human
uggggugggaggaugacg

SEQ ID NO: 1198210 - RNA, 26 nt, Human
uggggugggaggaugacgguugagcu

SEQ ID NO: 1198211 - RNA, 23 nt, Human
uggguggggugggaggaugacgg

SEQ ID NO: 1198212 - RNA, 19 nt, Human
ugguguggcuggggcuggg

SEQ ID NO: 1198213 - RNA, 22 nt, Human
uucacauccaggccgguagacc

SEQ ID NO: 1198214 - RNA, 23 nt, Human
acccuggcagcccccagcgcccu

SEQ ID NO: 1198215 - RNA, 18 nt, Human
aggacacccuggcagccc

SEQ ID NO: 1198216 - RNA, 24 nt, Human
aggagggcaggggucuugugucca

SEQ ID NO: 1198217 - RNA, 23 nt, Human
cacccggaacagggggacagcag

SEQ ID NO: 1198218 - RNA, 21 nt, Human
cacuccuguuacaauguaagg

SEQ ID NO: 1198219 - RNA, 18 nt, Human
caggcacaucuguccagc

SEQ ID NO: 1198220 - RNA, 23 nt, Human
ccacuauauucccggcacccgga

SEQ ID NO: 1198221 - RNA, 23 nt, Human
ccacuauauucccggcacccgga

SEQ ID NO: 1198222 - RNA, 22 nt, Human
cccccagcgcccuguggccagu

SEQ ID NO: 1198223 - RNA, 19 nt, Human
ccggaacaggagggcaggg

SEQ ID NO: 1198224 - RNA, 21 nt, Human
cucagcauuugaauguccaaa

SEQ ID NO: 1198225 - RNA, 18 nt, Human
guccagcacuccuguuac

SEQ ID NO: 1198226 - RNA, 18 nt, Human
ugcgacagacaggcacau

SEQ ID NO: 1198227 - RNA, 18 nt, Human
uggccuggcugucagagc

SEQ ID NO: 1198228 - RNA, 19 nt, Human
aacaacagcaccuuccuca

SEQ ID NO: 1198229 - RNA, 18 nt, Human
aagaagaaucugguggug

SEQ ID NO: 1198230 - RNA, 18 nt, Human
agaucucaaaaguugacu

SEQ ID NO: 1198231 - RNA, 21 nt, Human
aggaagaagauguuuccaaaa

SEQ ID NO: 1198232 - RNA, 22 nt, Human
aggaagaagauguuuccaaaag

SEQ ID NO: 1198233 - RNA, 19 nt, Human
caacagcaccuuccucagg

SEQ ID NO: 1198234 - RNA, 25 nt, Human
cagagaguuucuuucaacgaggucu

SEQ ID NO: 1198235 - RNA, 21 nt, Human
cccugaagaaaaugauuacca

SEQ ID NO: 1198236 - RNA, 27 nt, Human
cgacauacuucugcuuaauuuuggaau

SEQ ID NO: 1198237 - RNA, 25 nt, Human
cucaaaaguugacuucaaagaagaa

SEQ ID NO: 1198238 - RNA, 20 nt, Human
cugguggugguauuggcacc

SEQ ID NO: 1198239 - RNA, 24 nt, Human
cugucugcuccucuccuaaagcag

SEQ ID NO: 1198240 - RNA, 21 nt, Human
gaagaaaaugauuaccagagg

SEQ ID NO: 1198241 - RNA, 19 nt, Human
gaagaagauguuuccaaaa

SEQ ID NO: 1198242 - RNA, 22 nt, Human
uauugcuggagauuugcccuua

SEQ ID NO: 1198243 - RNA, 21 nt, Human
uauuggcaccaagagaugaga

SEQ ID NO: 1198244 - RNA, 19 nt, Human
ucagacaccaacguguacu

SEQ ID NO: 1198245 - RNA, 22 nt, Human
uccuaaagguugguaaugaaaa

SEQ ID NO: 1198246 - RNA, 19 nt, Human
ucucaggaagaagauguuu

SEQ ID NO: 1198247 - RNA, 22 nt, Human
ugaagaaaaugauuaccagagg

SEQ ID NO: 1198248 - RNA, 24 nt, Human
ugacagauaagccgacauacuucu

SEQ ID NO: 1198249 - RNA, 21 nt, Human
uggaaaguaugacaccagaga

SEQ ID NO: 1198250 - RNA, 22 nt, Human
uuaaacaacagcaccuuccuca

SEQ ID NO: 1198251 - RNA, 24 nt, Human
uugcugagaggagagacugugauu

SEQ ID NO: 1198252 - RNA, 20 nt, Human
uuuccaaaagcaaaguucag

SEQ ID NO: 1198253 - RNA, 22 nt, Human
aaaccugaaaagucugugcucu

SEQ ID NO: 1198254 - RNA, 21 nt, Human
agugguuuuggcacgaugaga

SEQ ID NO: 1198255 - RNA, 22 nt, Human
cagcuuuucugugaaaaguaac

SEQ ID NO: 1198256 - RNA, 26 nt, Human
cuaaaaccugaaaagucugugcucuc

SEQ ID NO: 1198257 - RNA, 19 nt, Human
cucucaguggaaagaacac

SEQ ID NO: 1198258 - RNA, 30 nt, Human
gaaagaacacaacaugagauuucugcagag

SEQ ID NO: 1198259 - RNA, 22 nt, Human
ggcuuccaacagacagcagcuu

SEQ ID NO: 1198260 - RNA, 26 nt, Human
uaacagcuccuuuuccuuagcuaaaa

SEQ ID NO: 1198261 - RNA, 19 nt, Human
uagcuaaaaccugaaaagu

SEQ ID NO: 1198262 - RNA, 25 nt, Human
ucugugaaaaguaacagcuccuuuu

SEQ ID NO: 1198263 - RNA, 19 nt, Human
uggaaagaacacaacauga

SEQ ID NO: 1198264 - RNA, 21 nt, Human
uggaaagaacacaacaugaga

SEQ ID NO: 1198265 - RNA, 22 nt, Human
uggaaagaacacaacaugagau

SEQ ID NO: 1198266 - RNA, 19 nt, Human
uggcuuccaacagacagca

SEQ ID NO: 1198267 - RNA, 21 nt, Human
ugugaaaaguaacagcuccuu

SEQ ID NO: 1198268 - RNA, 19 nt, Human
uuuggcacgaugagauugc

SEQ ID NO: 1198269 - RNA, 20 nt, Human
uuuuggcacgaugagauugc

SEQ ID NO: 1198270 - RNA, 24 nt, Human
accaaaugcagagacucugaaggc

SEQ ID NO: 1198271 - RNA, 21 nt, Human
acgagauccuggccacggaug

SEQ ID NO: 1198272 - RNA, 21 nt, Human
cagagacucugaaggccacgc

SEQ ID NO: 1198273 - RNA, 19 nt, Human
ccacgccgcugcgggcugc

SEQ ID NO: 1198274 - RNA, 22 nt, Human
ccccaugccugaucucaucuuc

SEQ ID NO: 1198275 - RNA, 19 nt, Human
cgguggccgcgccucugcu

SEQ ID NO: 1198276 - RNA, 23 nt, Human
cugcucgcacguucccccggccu

SEQ ID NO: 1198277 - RNA, 20 nt, Human
gacgacugcauuuccgauuu

SEQ ID NO: 1198278 - RNA, 19 nt, Human
uggccacggaugcgguggc

SEQ ID NO: 1198279 - RNA, 18 nt, Human
uggccgcgccucugcucg

SEQ ID NO: 1198280 - RNA, 19 nt, Human
ugugcaaauggauauggaa

SEQ ID NO: 1198281 - RNA, 19 nt, Human
uuccccaugccugaucuca

SEQ ID NO: 1198282 - RNA, 20 nt, Human
uucugagcauccacaauucu

SEQ ID NO: 1198283 - RNA, 26 nt, Human
uuuccgauuuuaaccaaaacuucacu

SEQ ID NO: 1198284 - RNA, 25 nt, Human
aaaaagaaauaaacuucggguaaag

SEQ ID NO: 1198285 - RNA, 20 nt, Human
aaauaaaaaaguuuaaaagc

SEQ ID NO: 1198286 - RNA, 26 nt, Human
aagaaauaaacuucggguaaagagaa

SEQ ID NO: 1198287 - RNA, 25 nt, Human
aaggaaacagaacagaauuucuugg

SEQ ID NO: 1198288 - RNA, 19 nt, Human
auagcacuucccuuucucu

SEQ ID NO: 1198289 - RNA, 19 nt, Human
auuaaucagcuuuguaaau

SEQ ID NO: 1198290 - RNA, 21 nt, Human
caaaaccaguacaacugagcu

SEQ ID NO: 1198291 - RNA, 21 nt, Human
caagaaacugcuacaucuggu

SEQ ID NO: 1198292 - RNA, 20 nt, Human
caccgcucagccccugguuc

SEQ ID NO: 1198293 - RNA, 20 nt, Human
cagccccugguuccuguggu

SEQ ID NO: 1198294 - RNA, 22 nt, Human
cagcuuuguaaauauuuugcca

SEQ ID NO: 1198295 - RNA, 23 nt, Human
cauguuaaugcagaaaugugaac

SEQ ID NO: 1198296 - RNA, 21 nt, Human
ccagcugggaggagcuggauu

SEQ ID NO: 1198297 - RNA, 20 nt, Human
ccgcucagccccugguuccu

SEQ ID NO: 1198298 - RNA, 21 nt, Human
cgaacggacaguguugccucc

SEQ ID NO: 1198299 - RNA, 24 nt, Human
cuccguucacccuagcgucuucca

SEQ ID NO: 1198300 - RNA, 21 nt, Human
cuuggcggggguggggggggg

SEQ ID NO: 1198301 - RNA, 19 nt, Human
gauuccaaaauauuccuua

SEQ ID NO: 1198302 - RNA, 22 nt, Human
gcuuuuuuuuuccaaaaaauua

SEQ ID NO: 1198303 - RNA, 19 nt, Human
ggaaaaaaaucucuuuugg

SEQ ID NO: 1198304 - RNA, 19 nt, Human
ggacaguguugccucccuu

SEQ ID NO: 1198305 - RNA, 21 nt, Human
uaaaaacaauaaagcuauagc

SEQ ID NO: 1198306 - RNA, 20 nt, Human
uaaaacacugccagucaggc

SEQ ID NO: 1198307 - RNA, 20 nt, Human
uaacucuacagcaggacaau

SEQ ID NO: 1198308 - RNA, 19 nt, Human
uacaaaggaaaauguagca

SEQ ID NO: 1198309 - RNA, 19 nt, Human
uacaaaggaaaauguagca

SEQ ID NO: 1198310 - RNA, 24 nt, Human
uacaaaggaaaauguagcaacagu

SEQ ID NO: 1198311 - RNA, 21 nt, Human
uacaacugagcugccuuugag

SEQ ID NO: 1198312 - RNA, 23 nt, Human
uacaacugagcugccuuugaguc

SEQ ID NO: 1198313 - RNA, 22 nt, Human
uaucuuguuuguguccaugaag

SEQ ID NO: 1198314 - RNA, 21 nt, Human
ucagccccugguuccuguggu

SEQ ID NO: 1198315 - RNA, 18 nt, Human
ucagggagaagagaauag

SEQ ID NO: 1198316 - RNA, 22 nt, Human
ucuuccagcugggaggagcugg

SEQ ID NO: 1198317 - RNA, 26 nt, Human
ugaaacagacagacauuauaaaggug

SEQ ID NO: 1198318 - RNA, 19 nt, Human
ugauuacaaaggaaaaugu

SEQ ID NO: 1198319 - RNA, 22 nt, Human
ugauucaaguggggaaaaaaaa

SEQ ID NO: 1198320 - RNA, 24 nt, Human
uggcaugaaaaagaaauaaacuuc

SEQ ID NO: 1198321 - RNA, 23 nt, Human
uggcgggggugggggggggaagc

SEQ ID NO: 1198322 - RNA, 19 nt, Human
uggguccuuaaaacacugc

SEQ ID NO: 1198323 - RNA, 21 nt, Human
uggguccuuaaaacacugcca

SEQ ID NO: 1198324 - RNA, 21 nt, Human
uuaaaacacugccagucaggc

SEQ ID NO: 1198325 - RNA, 24 nt, Human
uuggcacauauauuuuagguuugu

SEQ ID NO: 1198326 - RNA, 22 nt, Human
uuugaaguggcaugaaaaagaa

SEQ ID NO: 1198327 - RNA, 18 nt, Human
cccaaagaagcggccacc

SEQ ID NO: 1198328 - RNA, 20 nt, Human
cccaaagaagcggccaccuc

SEQ ID NO: 1198329 - RNA, 19 nt, Human
cugguagacuugcacuauc

SEQ ID NO: 1198330 - RNA, 20 nt, Human
cuuugcuucagaagccuggu

SEQ ID NO: 1198331 - RNA, 19 nt, Human
ucccaaagaagcggccacc

SEQ ID NO: 1198332 - RNA, 24 nt, Human
ucugaagaauuccucuuugggaac

SEQ ID NO: 1198333 - RNA, 21 nt, Human
aacugccuuucuucuccccau

SEQ ID NO: 1198334 - RNA, 19 nt, Human
acugccuuucuucucccca

SEQ ID NO: 1198335 - RNA, 27 nt, Human
ucauaacugccuuucuucuccccaucu

SEQ ID NO: 1198336 - RNA, 20 nt, Human
ugaagucggguaccugcugu

SEQ ID NO: 1198337 - RNA, 18 nt, Human
ugucauaacugccuuucu

SEQ ID NO: 1198338 - RNA, 24 nt, Human
uggcccgggcgccgcuggacuccu

SEQ ID NO: 1198339 - RNA, 19 nt, Human
uugaaauuccaaucgcugc

SEQ ID NO: 1198340 - RNA, 20 nt, Human
acuagcucucugccaugugc

SEQ ID NO: 1198341 - RNA, 19 nt, Human
aggaugggaaugaggagga

SEQ ID NO: 1198342 - RNA, 20 nt, Human
aggccaggccaggccuggaa

SEQ ID NO: 1198343 - RNA, 24 nt, Human
caagucccaaggcaauaguuucug

SEQ ID NO: 1198344 - RNA, 20 nt, Human
caagugacaggaugggaaug

SEQ ID NO: 1198345 - RNA, 18 nt, Human
cacaggcauguucuccca

SEQ ID NO: 1198346 - RNA, 18 nt, Human
cacauugauccuccugcu

SEQ ID NO: 1198347 - RNA, 20 nt, Human
cagcugggcugaucucccuu

SEQ ID NO: 1198348 - RNA, 19 nt, Human
ccacauugauccuccugcu

SEQ ID NO: 1198349 - RNA, 22 nt, Human
ccagcagaggcuagggcugccc

SEQ ID NO: 1198350 - RNA, 20 nt, Human
cccacuguagcagcaaaggc

SEQ ID NO: 1198351 - RNA, 23 nt, Human
cgcagggcccacuguagcagcaa

SEQ ID NO: 1198352 - RNA, 22 nt, Human
cucacaacucucugaggcaguu

SEQ ID NO: 1198353 - RNA, 22 nt, Human
cugaucucccuuuucucacagu

SEQ ID NO: 1198354 - RNA, 22 nt, Human
cuguagcagcaaaggcuggagg

SEQ ID NO: 1198355 - RNA, 21 nt, Human
cuugaucuucccucaggaaga

SEQ ID NO: 1198356 - RNA, 18 nt, Human
gaaugaggaggaaguuuu

SEQ ID NO: 1198357 - RNA, 18 nt, Human
gacaggaugggaaugagg

SEQ ID NO: 1198358 - RNA, 23 nt, Human
gagaacacaggcauguucuccca

SEQ ID NO: 1198359 - RNA, 22 nt, Human
gagcuugcugguaacugagcuc

SEQ ID NO: 1198360 - RNA, 19 nt, Human
gaguccuugcauaccccuc

SEQ ID NO: 1198361 - RNA, 21 nt, Human
gcaguucuguucggcugccuc

SEQ ID NO: 1198362 - RNA, 20 nt, Human
gccccgggggagaacacagg

SEQ ID NO: 1198363 - RNA, 18 nt, Human
ggagaggaggcucuauug

SEQ ID NO: 1198364 - RNA, 20 nt, Human
ggccuggaagguccgagcuu

SEQ ID NO: 1198365 - RNA, 19 nt, Human
gggcugaucucccuuuucu

SEQ ID NO: 1198366 - RNA, 22 nt, Human
uagcagcaaaggcuggaggcau

SEQ ID NO: 1198367 - RNA, 26 nt, Human
uagcagcaaaggcuggaggcauccag

SEQ ID NO: 1198368 - RNA, 19 nt, Human
uagccagaacuuuggaaau

SEQ ID NO: 1198369 - RNA, 20 nt, Human
uagccagaacuuuggaaauc

SEQ ID NO: 1198370 - RNA, 24 nt, Human
uagccagaacuuuggaaauccaca

SEQ ID NO: 1198371 - RNA, 22 nt, Human
uagcucucugccaugugccaag

SEQ ID NO: 1198372 - RNA, 24 nt, Human
uccaggaagaacuagcucucugcc

SEQ ID NO: 1198373 - RNA, 20 nt, Human
ucccaaggcaauaguuucug

SEQ ID NO: 1198374 - RNA, 20 nt, Human
ucugcaguucuguucggcug

SEQ ID NO: 1198375 - RNA, 25 nt, Human
ucugcaguucuguucggcugccucc

SEQ ID NO: 1198376 - RNA, 20 nt, Human
ucugcaguucuguucggcuu

SEQ ID NO: 1198377 - RNA, 23 nt, Human
ugaagaaaccaagccuuggaaaa

SEQ ID NO: 1198378 - RNA, 24 nt, Human
ugaagaaaccaagccuuguguaga

SEQ ID NO: 1198379 - RNA, 24 nt, Human
ugaaugguccucccgcagggccca

SEQ ID NO: 1198380 - RNA, 24 nt, Human
ugagcucaaauuguagccagaacu

SEQ ID NO: 1198381 - RNA, 27 nt, Human
ugaguccuugcauaccccucacaacuc

SEQ ID NO: 1198382 - RNA, 18 nt, Human
uggaaauccacaguuacc

SEQ ID NO: 1198383 - RNA, 20 nt, Human
uggcaagucccaaggcaaua

SEQ ID NO: 1198384 - RNA, 25 nt, Human
ugagcaggaaggaucuacagggcuu

SEQ ID NO: 1198385 - RNA, 24 nt, Human
aagacccagccccaucuggccacc

SEQ ID NO: 1198386 - RNA, 19 nt, Human
agacagaacaaggcacccg

SEQ ID NO: 1198387 - RNA, 19 nt, Human
aggcacccgacggguagaa

SEQ ID NO: 1198388 - RNA, 20 nt, Human
caagacagaacaaggcaccc

SEQ ID NO: 1198389 - RNA, 25 nt, Human
caagacccagccccaucuggccacc

SEQ ID NO: 1198390 - RNA, 23 nt, Human
caaggccggugacagcaaggcca

SEQ ID NO: 1198391 - RNA, 21 nt, Human
cagcaaggcaguccaagacag

SEQ ID NO: 1198392 - RNA, 18 nt, Human
cagcaaggccacguuauc

SEQ ID NO: 1198393 - RNA, 18 nt, Human
caguguggcucccaaguc

SEQ ID NO: 1198394 - RNA, 23 nt, Human
cuggccaccaaggacaaggcagc

SEQ ID NO: 1198395 - RNA, 21 nt, Human
gccccaagacccagccccauc

SEQ ID NO: 1198396 - RNA, 30 nt, Human
gccccaagacccagccccaucuggccaccc

SEQ ID NO: 1198397 - RNA, 25 nt, Human
uguggcucccaagucucguuuccac

SEQ ID NO: 1198398 - RNA, 22 nt, Human
uuuccacucagccccaagaccc

SEQ ID NO: 1198399 - RNA, 21 nt, Human
agggauugggcagggcagugg

SEQ ID NO: 1198400 - RNA, 19 nt, Human
gggcaguggcugcugcagg

SEQ ID NO: 1198401 - RNA, 18 nt, Human
ggguaugggagggauugg

SEQ ID NO: 1198402 - RNA, 22 nt, Human
aaaagaaagagugcagaguggc

SEQ ID NO: 1198403 - RNA, 20 nt, Human
agagugcagaguggccggua

SEQ ID NO: 1198404 - RNA, 24 nt, Human
augguucaggcgaaaagaaagagu

SEQ ID NO: 1198405 - RNA, 21 nt, Human
auuguagaaaaugugcgucca

SEQ ID NO: 1198406 - RNA, 20 nt, Human
caacaggacauugacaagaa

SEQ ID NO: 1198407 - RNA, 21 nt, Human
cagaguggccgguaggacuug

SEQ ID NO: 1198408 - RNA, 22 nt, Human
ccaauggcaugguucaggcgaa

SEQ ID NO: 1198409 - RNA, 24 nt, Human
ggaggaucuuggagaagcuuguga

SEQ ID NO: 1198410 - RNA, 23 nt, Human
gugcagaguggccgguaggacuu

SEQ ID NO: 1198411 - RNA, 21 nt, Human
guggccgguaggacuuguggc

SEQ ID NO: 1198412 - RNA, 22 nt, Human
uagaagagucccccaaaaauca

SEQ ID NO: 1198413 - RNA, 20 nt, Human
ucaccaaggaggaucuugga

SEQ ID NO: 1198414 - RNA, 24 nt, Human
ucccccaaaaaucauuguagaaaa

SEQ ID NO: 1198415 - RNA, 24 nt, Human
ugugaagagaccagugacugcugc

SEQ ID NO: 1198416 - RNA, 18 nt, Human
uucaacccuccaauggca

SEQ ID NO: 1198417 - RNA, 25 nt, Human
uugacaagaugguagcuccagggau

SEQ ID NO: 1198418 - RNA, 19 nt, Human
acaagcuucuccaagaucc

SEQ ID NO: 1198419 - RNA, 21 nt, Human
aggcaguggcaggaaucgugg

SEQ ID NO: 1198420 - RNA, 21 nt, Human
caguggcaggaaucgugggac

SEQ ID NO: 1198421 - RNA, 24 nt, Human
ccgaugucggggccagucucuucu

SEQ ID NO: 1198422 - RNA, 18 nt, Human
cggggccagucucuucuu

SEQ ID NO: 1198423 - RNA, 26 nt, Human
ucacuggucucuucacaagcuucucc

SEQ ID NO: 1198424 - RNA, 19 nt, Human
ucucaccccauucacacgg

SEQ ID NO: 1198425 - RNA, 18 nt, Human
ucuuucuccucuccuugc

SEQ ID NO: 1198426 - RNA, 22 nt, Human
ugcuucucaccccauucacacg

SEQ ID NO: 1198427 - RNA, 18 nt, Human
uugcuucucaccccauuc

SEQ ID NO: 1198428 - RNA, 24 nt, Human
aaccaggugcuccucugccaucag

SEQ ID NO: 1198429 - RNA, 20 nt, Human
acccugaggagggcugaaaa

SEQ ID NO: 1198430 - RNA, 18 nt, Human
agagaagaaccaggugcu

SEQ ID NO: 1198431 - RNA, 23 nt, Human
aggugcuccucugccaugccaag

SEQ ID NO: 1198432 - RNA, 19 nt, Human
cagugaacaaccggugcag

SEQ ID NO: 1198433 - RNA, 18 nt, Human
ccagagaagaaccaggug

SEQ ID NO: 1198434 - RNA, 24 nt, Human
gagagccacccugaggagggccag

SEQ ID NO: 1198435 - RNA, 23 nt, Human
gggcagugaacaaccggugcagg

SEQ ID NO: 1198436 - RNA, 20 nt, Human
guauagccagagaagaaccg

SEQ ID NO: 1198437 - RNA, 22 nt, Human
ucugugacucgcacacuggggc

SEQ ID NO: 1198438 - RNA, 18 nt, Human
aggugcaaaagcuggacc

SEQ ID NO: 1198439 - RNA, 23 nt, Human
cacacaggugcaaaagcuggacc

SEQ ID NO: 1198440 - RNA, 19 nt, Human
ccucucgucucucuucuuc

SEQ ID NO: 1198441 - RNA, 19 nt, Human
cuuuccccucugucuguuu

SEQ ID NO: 1198442 - RNA, 26 nt, Human
ucacuucuuuccccucugucuguuuu

SEQ ID NO: 1198443 - RNA, 28 nt, Human
ucucucuucuuccccuuuguucucuccc

SEQ ID NO: 1198444 - RNA, 18 nt, Human
caagggccagcccucugg

SEQ ID NO: 1198445 - RNA, 22 nt, Human
cauucuucccaucugccaggag

SEQ ID NO: 1198446 - RNA, 23 nt, Human
cuggcacagguggcauucuuccc

SEQ ID NO: 1198447 - RNA, 21 nt, Human
uucacuagacgcguuauucuc

SEQ ID NO: 1198448 - RNA, 24 nt, Human
uugaauuaaaggcuuuaaauccau

SEQ ID NO: 1198449 - RNA, 19 nt, Human
cuuacaauuuugcuacaaa

SEQ ID NO: 1198450 - RNA, 18 nt, Human
aacacuucgggaggcuga

SEQ ID NO: 1198451 - RNA, 22 nt, Human
aacccggggucccuuccuggag

SEQ ID NO: 1198452 - RNA, 22 nt, Human
aacccggggucccuuccuggag

SEQ ID NO: 1198453 - RNA, 22 nt, Human
aacccggggucccuuccuggag

SEQ ID NO: 1198454 - RNA, 22 nt, Human
aacccgguguccccuccuggag

SEQ ID NO: 1198455 - RNA, 23 nt, Human
aagcaacccacaugaccaucaac

SEQ ID NO: 1198456 - RNA, 22 nt, Human
aagcaacccacaugaccaucag

SEQ ID NO: 1198457 - RNA, 22 nt, Human
acccgggucccuuccuggagac

SEQ ID NO: 1198458 - RNA, 22 nt, Human
agcagaagcaacccacaugacc

SEQ ID NO: 1198459 - RNA, 27 nt, Human
agcgaauagcagaagcaaccgguaccc

SEQ ID NO: 1198460 - RNA, 20 nt, Human
aggcugaggcagguggaucg

SEQ ID NO: 1198461 - RNA, 24 nt, Human
aggcugaggcagguggaucgucug

SEQ ID NO: 1198462 - RNA, 23 nt, Human
aguggcucgugccuguaauccca

SEQ ID NO: 1198463 - RNA, 24 nt, Human
aguggcucgugccuguaaucccaa

SEQ ID NO: 1198464 - RNA, 24 nt, Human
caacacuucgggaggcugaggcag

SEQ ID NO: 1198465 - RNA, 20 nt, Human
cagcaguaaaaaggaaugau

SEQ ID NO: 1198466 - RNA, 19 nt, Human
ccgggguccccuccuggag

SEQ ID NO: 1198467 - RNA, 19 nt, Human
ccggggucccuuccuggag

SEQ ID NO: 1198468 - RNA, 19 nt, Human
ccggggucccuuccuggag

SEQ ID NO: 1198469 - RNA, 18 nt, Human
ccgggucccuuccuggag

SEQ ID NO: 1198470 - RNA, 20 nt, Human
ccuaggcguaugcccaagag

SEQ ID NO: 1198471 - RNA, 22 nt, Human
ccuccuggagaggacgugggca

SEQ ID NO: 1198472 - RNA, 22 nt, Human
ccuccuggagaggacgugggca

SEQ ID NO: 1198473 - RNA, 19 nt, Human
ccuggagaggacgugggca

SEQ ID NO: 1198474 - RNA, 19 nt, Human
ccuggagaggacgugggca

SEQ ID NO: 1198475 - RNA, 20 nt, Human
ccuguaaucccaacacuucg

SEQ ID NO: 1198476 - RNA, 23 nt, Human
cgggaggcugaggcagguggauc

SEQ ID NO: 1198477 - RNA, 22 nt, Human
cgugaacccggggucccuuccu

SEQ ID NO: 1198478 - RNA, 22 nt, Human
cgugaacccggggucccuuccu

SEQ ID NO: 1198479 - RNA, 22 nt, Human
cgugaacccggggucccuuccu

SEQ ID NO: 1198480 - RNA, 19 nt, Human
cgugccuguaaucccaaca

SEQ ID NO: 1198481 - RNA, 22 nt, Human
cguggacccggggucccuuccu

SEQ ID NO: 1198482 - RNA, 18 nt, Human
cguggacccgggucccuu

SEQ ID NO: 1198483 - RNA, 18 nt, Human
cguggacccgggucccuu

SEQ ID NO: 1198484 - RNA, 18 nt, Human
cguggacccgggucccuu

SEQ ID NO: 1198485 - RNA, 21 nt, Human
cucgugaacccggggucccuu

SEQ ID NO: 1198486 - RNA, 21 nt, Human
cucgugaacccggggucccuu

SEQ ID NO: 1198487 - RNA, 21 nt, Human
cucgugaacccggggucccuu

SEQ ID NO: 1198488 - RNA, 22 nt, Human
cucgugaacccgguguccccuc

SEQ ID NO: 1198489 - RNA, 24 nt, Human
cucgugccuguaaucccaacacuu

SEQ ID NO: 1198490 - RNA, 21 nt, Human
cucguggacccggggucccuu

SEQ ID NO: 1198491 - RNA, 20 nt, Human
cucguggacccgggucccuu

SEQ ID NO: 1198492 - RNA, 20 nt, Human
cucguggacccgggucccuu

SEQ ID NO: 1198493 - RNA, 22 nt, Human
cuuccuggagacgacgugggca

SEQ ID NO: 1198494 - RNA, 22 nt, Human
cuuccuggagaggacgugggca

SEQ ID NO: 1198495 - RNA, 22 nt, Human
cuuccuggagaggacgugggca

SEQ ID NO: 1198496 - RNA, 22 nt, Human
cuuccuggagaggacgugggca

SEQ ID NO: 1198497 - RNA, 22 nt, Human
cuuccuggagaggacgugggca

SEQ ID NO: 1198498 - RNA, 22 nt, Human
cuuccuggagagggcgugggca

SEQ ID NO: 1198499 - RNA, 21 nt, Human
gacccgggucccuuccuggag

SEQ ID NO: 1198500 - RNA, 21 nt, Human
gacccgggucccuuccuggag

SEQ ID NO: 1198501 - RNA, 20 nt, Human
gcgguggauucacacagcag

SEQ ID NO: 1198502 - RNA, 23 nt, Human
ggcacaguggcucgugccuguaa

SEQ ID NO: 1198503 - RNA, 22 nt, Human
ggcagcucgugaacccgguguc

SEQ ID NO: 1198504 - RNA, 19 nt, Human
gugccuguaaucccaacac

SEQ ID NO: 1198505 - RNA, 19 nt, Human
uaaaaaggaaugauggccg

SEQ ID NO: 1198506 - RNA, 22 nt, Human
uaagcgaauagcagaagcaacc

SEQ ID NO: 1198507 - RNA, 24 nt, Human
ucgggaggcugaggcagguggauc

SEQ ID NO: 1198508 - RNA, 19 nt, Human
ucgugaacccggugucccc

SEQ ID NO: 1198509 - RNA, 20 nt, Human
ugaggcagguggaucgucug

SEQ ID NO: 1198510 - RNA, 19 nt, Human
ugcccaagagugcacagga

SEQ ID NO: 1198511 - RNA, 23 nt, Human
ugccuguaaucccaacacuucgg

SEQ ID NO: 1198512 - RNA, 18 nt, Human
uggagacgacgugggcag

SEQ ID NO: 1198513 - RNA, 24 nt, Human
uggccgggcacaguggcucgugcc

SEQ ID NO: 1198514 - RNA, 21 nt, Human
uggcucgugccuguaauccca

SEQ ID NO: 1198515 - RNA, 24 nt, Human
uggcucgugccuguaaucccaaca

SEQ ID NO: 1198516 - RNA, 20 nt, Human
uucguggacccgggucccuu

SEQ ID NO: 1198517 - RNA, 21 nt, Human
ucuccauguaagugcugagaa

SEQ ID NO: 1198518 - RNA, 19 nt, Human
aagcaggagggaaguuucc

SEQ ID NO: 1198519 - RNA, 23 nt, Human
aaguuucuuugacuccuguggaa

SEQ ID NO: 1198520 - RNA, 21 nt, Human
agucugcacgaaggagucugu

SEQ ID NO: 1198521 - RNA, 22 nt, Human
cagucugcacgaaggagucugu

SEQ ID NO: 1198522 - RNA, 19 nt, Human
ggagucuguuugcacucca

SEQ ID NO: 1198523 - RNA, 20 nt, Human
uccaggagcagugguuuugu

SEQ ID NO: 1198524 - RNA, 27 nt, Human
ugcucagaauucucagucugcacgaag

SEQ ID NO: 1198525 - RNA, 23 nt, Human
ugcugugguaggagguccaggag

SEQ ID NO: 1198526 - RNA, 24 nt, Human
ugcugugguaggagguccaggagc

SEQ ID NO: 1198527 - RNA, 23 nt, Human
agacgaggccaccacuggugagc

SEQ ID NO: 1198528 - RNA, 21 nt, Human
agcugauuccaggaaggauaa

SEQ ID NO: 1198529 - RNA, 23 nt, Human
augaccaccaccaaaguuuccag

SEQ ID NO: 1198530 - RNA, 25 nt, Human
caagugugauuuugaggaauccauc

SEQ ID NO: 1198531 - RNA, 24 nt, Human
caccaaaacugccuccaugaccac

SEQ ID NO: 1198532 - RNA, 19 nt, Human
caccucuugcuuugacagg

SEQ ID NO: 1198533 - RNA, 22 nt, Human
cacggcuaagugggcacuuggu

SEQ ID NO: 1198534 - RNA, 21 nt, Human
cagagcacccuggcgguuggu

SEQ ID NO: 1198535 - RNA, 23 nt, Human
caggagcuccuccuggugguagc

SEQ ID NO: 1198536 - RNA, 31 nt, Human
caucuagaccgugauccaaaucuuggagacc

SEQ ID NO: 1198537 - RNA, 20 nt, Human
caucuaguccuuuugagcaa

SEQ ID NO: 1198538 - RNA, 21 nt, Human
cauucuuucauguuccucuga

SEQ ID NO: 1198539 - RNA, 18 nt, Human
cauugcauuggggauguc

SEQ ID NO: 1198540 - RNA, 18 nt, Human
cauuggggaugucaacug

SEQ ID NO: 1198541 - RNA, 25 nt, Human
ccacuggugagcgggguccccaugg

SEQ ID NO: 1198542 - RNA, 21 nt, Human
ccuccuggugguagcccccau

SEQ ID NO: 1198543 - RNA, 19 nt, Human
ccugaaccuuccagcagca

SEQ ID NO: 1198544 - RNA, 20 nt, Human
ccugaaccuuccagcagcau

SEQ ID NO: 1198545 - RNA, 24 nt, Human
cucugaggaagacugugacugaug

SEQ ID NO: 1198546 - RNA, 23 nt, Human
cuuuggugauguucuucaguguc

SEQ ID NO: 1198547 - RNA, 23 nt, Human
cuuuuucuugccacugccuuggu

SEQ ID NO: 1198548 - RNA, 19 nt, Human
gacagggcuuuccuaacuu

SEQ ID NO: 1198549 - RNA, 20 nt, Human
gacagggcuuuccuaacuuc

SEQ ID NO: 1198550 - RNA, 18 nt, Human
gagacugugguguggcag

SEQ ID NO: 1198551 - RNA, 20 nt, Human
gagcacccuggcgguuggug

SEQ ID NO: 1198552 - RNA, 24 nt, Human
gcaaaguauuggccuccaccacca

SEQ ID NO: 1198553 - RNA, 20 nt, Human
gcaguuuugaggagaaaggg

SEQ ID NO: 1198554 - RNA, 21 nt, Human
gcaguuuugaggagaaagggu

SEQ ID NO: 1198555 - RNA, 19 nt, Human
gcucucaggagcuccuccu

SEQ ID NO: 1198556 - RNA, 23 nt, Human
ggagcuccuccuggugguagccc

SEQ ID NO: 1198557 - RNA, 18 nt, Human
uaaaagacgaggccacca

SEQ ID NO: 1198558 - RNA, 24 nt, Human
uaaguaauugugggacaccaaaac

SEQ ID NO: 1198559 - RNA, 22 nt, Human
uagcucuuugguuguacaacuc

SEQ ID NO: 1198560 - RNA, 21 nt, Human
ucaaucacuucaauuuuccca

SEQ ID NO: 1198561 - RNA, 23 nt, Human
ucuauaaaagacgaggccaccac

SEQ ID NO: 1198562 - RNA, 19 nt, Human
ucugaauggaagcugacuu

SEQ ID NO: 1198563 - RNA, 19 nt, Human
ucugaggaagacugugacu

SEQ ID NO: 1198564 - RNA, 25 nt, Human
ugaaacagcaucagcuuguguggca

SEQ ID NO: 1198565 - RNA, 23 nt, Human
ugacaaaagcaaagcgcuuuuuc

SEQ ID NO: 1198566 - RNA, 21 nt, Human
ugaucaaaugcacugaaacag

SEQ ID NO: 1198567 - RNA, 20 nt, Human
ugccuggaugaagcacuagc

SEQ ID NO: 1198568 - RNA, 25 nt, Human
uggaaaagguuuugaagagccugcu

SEQ ID NO: 1198569 - RNA, 19 nt, Human
ugggaaaggcacugaacag

SEQ ID NO: 1198570 - RNA, 28 nt, Human
ugucuaucccaccaaaacugccuccaug

SEQ ID NO: 1198571 - RNA, 24 nt, Human
ugugcauucuuucauguuccucug

SEQ ID NO: 1198572 - RNA, 18 nt, Human
ugugggacaccaaaacua

SEQ ID NO: 1198573 - RNA, 21 nt, Human
ugugguguggcaguuuugagg

SEQ ID NO: 1198574 - RNA, 21 nt, Human
uuucacggcuaagugggcacu

SEQ ID NO: 1198575 - RNA, 22 nt, Human
uuugaggagaaagggugggagc

SEQ ID NO: 1198576 - RNA, 21 nt, Human
aaaacacugucaaggcaauug

SEQ ID NO: 1198577 - RNA, 21 nt, Human
accacagucauggucuaccuu

SEQ ID NO: 1198578 - RNA, 19 nt, Human
accucguucaggccaccag

SEQ ID NO: 1198579 - RNA, 20 nt, Human
auaguaauggcaaaguauac

SEQ ID NO: 1198580 - RNA, 18 nt, Human
ccacggagaaacugucca

SEQ ID NO: 1198581 - RNA, 18 nt, Human
ccgcugcuccucccgccu

SEQ ID NO: 1198582 - RNA, 19 nt, Human
ccucaggaagagcagccca

SEQ ID NO: 1198583 - RNA, 18 nt, Human
ccugagccgcugcuccuc

SEQ ID NO: 1198584 - RNA, 21 nt, Human
cuuccccgccgccccgguacc

SEQ ID NO: 1198585 - RNA, 22 nt, Human
gagccgcugcuccucccgccuc

SEQ ID NO: 1198586 - RNA, 20 nt, Human
uaguacauaguaauggcaaa

SEQ ID NO: 1198587 - RNA, 20 nt, Human
ucaaggcaauuggaguccau

SEQ ID NO: 1198588 - RNA, 25 nt, Human
ucuuuacauaauguugcaacagcca

SEQ ID NO: 1198589 - RNA, 18 nt, Human
ugacgccacugaaaccac

SEQ ID NO: 1198590 - RNA, 24 nt, Human
uugcaacagccacuaaaaacacug

SEQ ID NO: 1198591 - RNA, 18 nt, Human
cagcaggauuuuucuucc

SEQ ID NO: 1198592 - RNA, 22 nt, Human
gcaaaagggacagcaagagcuc

SEQ ID NO: 1198593 - RNA, 22 nt, Human
aaacagaaaauccacagggcug

SEQ ID NO: 1198594 - RNA, 20 nt, Human
agaaaauccacagggcaagg

SEQ ID NO: 1198595 - RNA, 24 nt, Human
agcccgaagauaaacuccagcccc

SEQ ID NO: 1198596 - RNA, 21 nt, Human
aguggagaagaaguugggaaa

SEQ ID NO: 1198597 - RNA, 18 nt, Human
auaguuguccaucaggaa

SEQ ID NO: 1198598 - RNA, 26 nt, Human
caaacuuccagucccaacgccucaca

SEQ ID NO: 1198599 - RNA, 20 nt, Human
cacacagcaguucuucuugu

SEQ ID NO: 1198600 - RNA, 18 nt, Human
cagccccaacaccggcgg

SEQ ID NO: 1198601 - RNA, 19 nt, Human
cagguugaacaggaaaauc

SEQ ID NO: 1198602 - RNA, 24 nt, Human
caucaggaagggcaggcagaugau

SEQ ID NO: 1198603 - RNA, 20 nt, Human
caucucggaacacacagcag

SEQ ID NO: 1198604 - RNA, 25 nt, Human
ccacccggaaauaccugucuaccgc

SEQ ID NO: 1198605 - RNA, 18 nt, Human
ccaucaggaagggcaggc

SEQ ID NO: 1198606 - RNA, 19 nt, Human
cccaaacuuccagucccaa

SEQ ID NO: 1198607 - RNA, 22 nt, Human
cccaaacuuccagucccaacgc

SEQ ID NO: 1198608 - RNA, 26 nt, Human
cccaacaccggcggcaacaccuugac

SEQ ID NO: 1198609 - RNA, 25 nt, Human
ccccaacaccggcggcaacaccuug

SEQ ID NO: 1198610 - RNA, 18 nt, Human
ccgaagauaaacuccagc

SEQ ID NO: 1198611 - RNA, 23 nt, Human
cgccucugguuuuguuggggucc

SEQ ID NO: 1198612 - RNA, 20 nt, Human
cucaccugucaucuuccucu

SEQ ID NO: 1198613 - RNA, 24 nt, Human
cucuggagcgccucugguuuuguu

SEQ ID NO: 1198614 - RNA, 21 nt, Human
gaacaggaaaauccggcugga

SEQ ID NO: 1198615 - RNA, 24 nt, Human
ggagaucuuguucagggcguggug

SEQ ID NO: 1198616 - RNA, 19 nt, Human
ggcaacaccuugacaauga

SEQ ID NO: 1198617 - RNA, 21 nt, Human
gguuuuguugggguccccugu

SEQ ID NO: 1198618 - RNA, 21 nt, Human
guccaggcggugggguuuggg

SEQ ID NO: 1198619 - RNA, 19 nt, Human
guccccaaacuuccagucc

SEQ ID NO: 1198620 - RNA, 23 nt, Human
guuguccaucaggaagggcaggc

SEQ ID NO: 1198621 - RNA, 23 nt, Human
ucaaaguggagaagaaguuggga

SEQ ID NO: 1198622 - RNA, 22 nt, Human
ucaggaagggcaggcagaugau

SEQ ID NO: 1198623 - RNA, 25 nt, Human
ucccaacgccucacauaguugucca

SEQ ID NO: 1198624 - RNA, 24 nt, Human
ucggaacacacagcaguucuucuu

SEQ ID NO: 1198625 - RNA, 22 nt, Human
ugaucaaaguggagaagaaguu

SEQ ID NO: 1198626 - RNA, 20 nt, Human
ugcccagaagcccgaagaua

SEQ ID NO: 1198627 - RNA, 19 nt, Human
uugacaaugaagucaucuc

SEQ ID NO: 1198628 - RNA, 24 nt, Human
uugagguggaaacagaaaauccac

SEQ ID NO: 1198629 - RNA, 23 nt, Human
uugcgcgcgucuuucucguuccu

SEQ ID NO: 1198630 - RNA, 20 nt, Human
uugggguccccugugagcuc

SEQ ID NO: 1198631 - RNA, 23 nt, Human
uuucucguuccugucgucuucgu

SEQ ID NO: 1198632 - RNA, 21 nt, Human
uuugcugaauuucucucucca

SEQ ID NO: 1198633 - RNA, 19 nt, Human
acgcaccggccucgcacgu

SEQ ID NO: 1198634 - RNA, 18 nt, Human
aggaaaaaugaaaaagcc

SEQ ID NO: 1198635 - RNA, 22 nt, Human
aggaaaaaugaaaaagccagac

SEQ ID NO: 1198636 - RNA, 22 nt, Human
caaggaaaaaugaaaaagccag

SEQ ID NO: 1198637 - RNA, 18 nt, Human
uccucuauuuuauuugau

SEQ ID NO: 1198638 - RNA, 24 nt, Human
aaaaugcugagauuacagguguga

SEQ ID NO: 1198639 - RNA, 23 nt, Human
aaacucuuccaaaacucccacuu

SEQ ID NO: 1198640 - RNA, 18 nt, Human
aaagcaggacggagcccg

SEQ ID NO: 1198641 - RNA, 20 nt, Human
aaaugaccugugacauauga

SEQ ID NO: 1198642 - RNA, 24 nt, Human
aaaugcccuauaccccacaucccu

SEQ ID NO: 1198643 - RNA, 26 nt, Human
aaaugcugagauuacaggugugagcc

SEQ ID NO: 1198644 - RNA, 20 nt, Human
aacauggugaagccccaucu

SEQ ID NO: 1198645 - RNA, 21 nt, Human
aacauggugaagccccaucuc

SEQ ID NO: 1198646 - RNA, 19 nt, Human
aacucuuccaaaacuccca

SEQ ID NO: 1198647 - RNA, 18 nt, Human
aaucgcuugaaccuggga

SEQ ID NO: 1198648 - RNA, 24 nt, Human
aaucgcuugaaccugggaggcgga

SEQ ID NO: 1198649 - RNA, 23 nt, Human
acaagaagggaaccauuugcagu

SEQ ID NO: 1198650 - RNA, 20 nt, Human
acagaccgagacuccgucuc

SEQ ID NO: 1198651 - RNA, 24 nt, Human
acagaccgagacuccgucucaaaa

SEQ ID NO: 1198652 - RNA, 23 nt, Human
acagggacacgugcccucccuca

SEQ ID NO: 1198653 - RNA, 19 nt, Human
accacugcacuccagccug

SEQ ID NO: 1198654 - RNA, 18 nt, Human
accccacaucccuaaucc

SEQ ID NO: 1198655 - RNA, 18 nt, Human
acugcacuccagccuggg

SEQ ID NO: 1198656 - RNA, 24 nt, Human
acugcacuccagccugggugacag

SEQ ID NO: 1198657 - RNA, 19 nt, Human
agaaacccuuccccagccc

SEQ ID NO: 1198658 - RNA, 21 nt, Human
agaaacccuuccccagccccu

SEQ ID NO: 1198659 - RNA, 20 nt, Human
agaggcagguggaucaccug

SEQ ID NO: 1198660 - RNA, 20 nt, Human
agaguggggggcaccugggc

SEQ ID NO: 1198661 - RNA, 18 nt, Human
agauuacaggugugagcc

SEQ ID NO: 1198662 - RNA, 19 nt, Human
agcaacaggggguggccag

SEQ ID NO: 1198663 - RNA, 24 nt, Human
agcacuuugggaggcagaggcagg

SEQ ID NO: 1198664 - RNA, 23 nt, Human
agcccaggcucccugucgaggac

SEQ ID NO: 1198665 - RNA, 24 nt, Human
agccuggccaacauggugaagccc

SEQ ID NO: 1198666 - RNA, 24 nt, Human
agccugggugacagaccgagacuc

SEQ ID NO: 1198667 - RNA, 21 nt, Human
aggaagcagucagggcugaag

SEQ ID NO: 1198668 - RNA, 24 nt, Human
aggacggagcccaggcucccuguc

SEQ ID NO: 1198669 - RNA, 18 nt, Human
aggcagguggaucaccug

SEQ ID NO: 1198670 - RNA, 23 nt, Human
aggcagguggaucaccugaaggu

SEQ ID NO: 1198671 - RNA, 27 nt, Human
aggcagguggaucaccugaaggucagg

SEQ ID NO: 1198672 - RNA, 22 nt, Human
aggcgggagaaucgcuugaacc

SEQ ID NO: 1198673 - RNA, 24 nt, Human
aggcgggagaaucgcuugaaccug

SEQ ID NO: 1198674 - RNA, 24 nt, Human
aguggugggcaccuguaaucccag

SEQ ID NO: 1198675 - RNA, 22 nt, Human
auguggcugauuuaguggacug

SEQ ID NO: 1198676 - RNA, 20 nt, Human
auucauucaaccugauccca

SEQ ID NO: 1198677 - RNA, 24 nt, Human
caaaaugcugagauuacaggugug

SEQ ID NO: 1198678 - RNA, 24 nt, Human
caacauggugaagccccaucucua

SEQ ID NO: 1198679 - RNA, 24 nt, Human
cacacccagccuugagggauguuu

SEQ ID NO: 1198680 - RNA, 21 nt, Human
cacagccccucagcuucuagg

SEQ ID NO: 1198681 - RNA, 20 nt, Human
caccacugcacuccagccug

SEQ ID NO: 1198682 - RNA, 26 nt, Human
caccacugcacuccagccugggugac

SEQ ID NO: 1198683 - RNA, 22 nt, Human
caccuguaaucccagcuacuga

SEQ ID NO: 1198684 - RNA, 24 nt, Human
caccuguaaucccagcuacugagg

SEQ ID NO: 1198685 - RNA, 24 nt, Human
cacgccuguaaucccagcacuuug

SEQ ID NO: 1198686 - RNA, 21 nt, Human
cacggggaggugaccacuugg

SEQ ID NO: 1198687 - RNA, 18 nt, Human
cacuccagccugggugac

SEQ ID NO: 1198688 - RNA, 24 nt, Human
cacuccagccugggugacagaccg

SEQ ID NO: 1198689 - RNA, 19 nt, Human
cacugcacuccagccuggg

SEQ ID NO: 1198690 - RNA, 19 nt, Human
cacugcacuccagccuggg

SEQ ID NO: 1198691 - RNA, 22 nt, Human
cacugcacuccagccuggguga

SEQ ID NO: 1198692 - RNA, 23 nt, Human
cacugcacuccagccugggugac

SEQ ID NO: 1198693 - RNA, 24 nt, Human
cacugcacuccagccugggugaca

SEQ ID NO: 1198694 - RNA, 25 nt, Human
cacugcacuccagccugggugacag

SEQ ID NO: 1198695 - RNA, 28 nt, Human
cagaggcagguggaucaccugaagguca

SEQ ID NO: 1198696 - RNA, 19 nt, Human
cagcacaugcugggauugg

SEQ ID NO: 1198697 - RNA, 24 nt, Human
cagcacuuugggaggcagaggcag

SEQ ID NO: 1198698 - RNA, 26 nt, Human
cagcacuuugggaggcagaggcaggu

SEQ ID NO: 1198699 - RNA, 21 nt, Human
cagcagcaguagcgggaugag

SEQ ID NO: 1198700 - RNA, 23 nt, Human
cagcaguagcgggaugagaaacu

SEQ ID NO: 1198701 - RNA, 19 nt, Human
cagcauuucugccugcugu

SEQ ID NO: 1198702 - RNA, 22 nt, Human
caggcagaaugacacuaaaaua

SEQ ID NO: 1198703 - RNA, 25 nt, Human
cagguggaucaccugaaggucagga

SEQ ID NO: 1198704 - RNA, 20 nt, Human
caguagcgggaugagaaacu

SEQ ID NO: 1198705 - RNA, 20 nt, Human
cauccaaacucuuccaaaac

SEQ ID NO: 1198706 - RNA, 23 nt, Human
cauccaaacucuuccaaaacucc

SEQ ID NO: 1198707 - RNA, 21 nt, Human
ccaaaaugcugagauuacagg

SEQ ID NO: 1198708 - RNA, 24 nt, Human
ccaaaaugcugagauuacaggugu

SEQ ID NO: 1198709 - RNA, 22 nt, Human
ccaacuagaaacagggggccac

SEQ ID NO: 1198710 - RNA, 18 nt, Human
ccacaucccuaauccugg

SEQ ID NO: 1198711 - RNA, 20 nt, Human
ccacugcacuccagccuggg

SEQ ID NO: 1198712 - RNA, 20 nt, Human
ccacugcacuccagccuggg

SEQ ID NO: 1198713 - RNA, 20 nt, Human
ccacugcacuccagccuggg

SEQ ID NO: 1198714 - RNA, 20 nt, Human
ccacugcacuccagccuggg

SEQ ID NO: 1198715 - RNA, 21 nt, Human
ccacugcacuccagccugggu

SEQ ID NO: 1198716 - RNA, 21 nt, Human
ccacugcacuccagccugggu

SEQ ID NO: 1198717 - RNA, 23 nt, Human
ccacugcacuccagccuggguga

SEQ ID NO: 1198718 - RNA, 24 nt, Human
ccacugcacuccagccugggugac

SEQ ID NO: 1198719 - RNA, 25 nt, Human
ccacugcacuccagccugggugaca

SEQ ID NO: 1198720 - RNA, 24 nt, Human
ccagaccagccuggccaacauggu

SEQ ID NO: 1198721 - RNA, 24 nt, Human
cccagcagcaguagcgggaugaga

SEQ ID NO: 1198722 - RNA, 22 nt, Human
ccccacaucccuaauccuggac

SEQ ID NO: 1198723 - RNA, 23 nt, Human
ccccaucucuacuaaaaauacaa

SEQ ID NO: 1198724 - RNA, 19 nt, Human
cccccugcuccaggcuggg

SEQ ID NO: 1198725 - RNA, 24 nt, Human
ccccugcuccaggcugggcgucag

SEQ ID NO: 1198726 - RNA, 24 nt, Human
cccgccgaauggagcgagaguggg

SEQ ID NO: 1198727 - RNA, 18 nt, Human
cccggggcugcucugggc

SEQ ID NO: 1198728 - RNA, 18 nt, Human
cccuauaccccacauccc

SEQ ID NO: 1198729 - RNA, 22 nt, Human
cccuauaccccacaucccuaau

SEQ ID NO: 1198730 - RNA, 19 nt, Human
ccgcacuuggccucccaaa

SEQ ID NO: 1198731 - RNA, 20 nt, Human
ccugcccgcccucccuccuc

SEQ ID NO: 1198732 - RNA, 23 nt, Human
ccuggccaacauggugaagcccc

SEQ ID NO: 1198733 - RNA, 24 nt, Human
ccuggccaacauggugaagcccca

SEQ ID NO: 1198734 - RNA, 22 nt, Human
ccugggugacagaccgagacuc

SEQ ID NO: 1198735 - RNA, 20 nt, Human
ccuggucucaagugaugucc

SEQ ID NO: 1198736 - RNA, 20 nt, Human
ccuggucucaagugaugucc

SEQ ID NO: 1198737 - RNA, 25 nt, Human
ccuguaaucccagcuacugaggcgg

SEQ ID NO: 1198738 - RNA, 23 nt, Human
cgcaguggugggcaccuguaauc

SEQ ID NO: 1198739 - RNA, 23 nt, Human
cgccuguaaucccagcacuuugg

SEQ ID NO: 1198740 - RNA, 24 nt, Human
cgccuguaaucccagcacuuuggg

SEQ ID NO: 1198741 - RNA, 20 nt, Human
cucacaauguugccagggcu

SEQ ID NO: 1198742 - RNA, 22 nt, Human
cucacgccuguaaucccagcac

SEQ ID NO: 1198743 - RNA, 24 nt, Human
cucacgccuguaaucccagcacuu

SEQ ID NO: 1198744 - RNA, 18 nt, Human
cucauccaaacucuucca

SEQ ID NO: 1198745 - RNA, 21 nt, Human
cucccaaaaugcugagauuac

SEQ ID NO: 1198746 - RNA, 19 nt, Human
cuccgucucaaaaaaaaaa

SEQ ID NO: 1198747 - RNA, 22 nt, Human
cuccgucucaaaaaaaaaaauc

SEQ ID NO: 1198748 - RNA, 23 nt, Human
cucucauccaaacucuuccaaaa

SEQ ID NO: 1198749 - RNA, 22 nt, Human
cucuuccaaaacucccacuuau

SEQ ID NO: 1198750 - RNA, 19 nt, Human
cugaucccagcagcaguaa

SEQ ID NO: 1198751 - RNA, 19 nt, Human
cuugaaccugggaggcgga

SEQ ID NO: 1198752 - RNA, 21 nt, Human
cuuugcucccuugauggaaaa

SEQ ID NO: 1198753 - RNA, 19 nt, Human
gaagccccaucucuacuaa

SEQ ID NO: 1198754 - RNA, 24 nt, Human
gacagaccgagacuccgucucaaa

SEQ ID NO: 1198755 - RNA, 21 nt, Human
gaccaguuccuuggcguacag

SEQ ID NO: 1198756 - RNA, 20 nt, Human
gaucaccugaaggucaggaa

SEQ ID NO: 1198757 - RNA, 18 nt, Human
gauuacaggugugagccc

SEQ ID NO: 1198758 - RNA, 18 nt, Human
gcagguggaucaccugaa

SEQ ID NO: 1198759 - RNA, 24 nt, Human
gccaacauggugaagccccaucuc

SEQ ID NO: 1198760 - RNA, 18 nt, Human
gccaccuucaggaaaauu

SEQ ID NO: 1198761 - RNA, 21 nt, Human
gccccucagcuucuaggcugc

SEQ ID NO: 1198762 - RNA, 24 nt, Human
gccuccacacccagccuugaggga

SEQ ID NO: 1198763 - RNA, 25 nt, Human
gcgucagaaacccuuccccagcccc

SEQ ID NO: 1198764 - RNA, 24 nt, Human
gcgucucucauccaaacucuucca

SEQ ID NO: 1198765 - RNA, 23 nt, Human
gcugguuuggaacuccuggucuc

SEQ ID NO: 1198766 - RNA, 18 nt, Human
ggacacgugcccucccuc

SEQ ID NO: 1198767 - RNA, 21 nt, Human
ggagagcugugcagagguugg

SEQ ID NO: 1198768 - RNA, 18 nt, Human
ggaggugaccacuugggg

SEQ ID NO: 1198769 - RNA, 23 nt, Human
ggaguuccagaccagccuggccg

SEQ ID NO: 1198770 - RNA, 23 nt, Human
ggcaccuguaaucccagcuacug

SEQ ID NO: 1198771 - RNA, 23 nt, Human
ggcacgguggcucacgccuguaa

SEQ ID NO: 1198772 - RNA, 21 nt, Human
ggcucacgccuguaaucccag

SEQ ID NO: 1198773 - RNA, 24 nt, Human
ggcugguuuggaacuccuggucuc

SEQ ID NO: 1198774 - RNA, 24 nt, Human
gggcgcaguggugggcaccuguaa

SEQ ID NO: 1198775 - RNA, 23 nt, Human
ggggagccccagauggagggaug

SEQ ID NO: 1198776 - RNA, 21 nt, Human
gggggcccgacagucccguag

SEQ ID NO: 1198777 - RNA, 23 nt, Human
gguggcucacgccuguaauccca

SEQ ID NO: 1198778 - RNA, 20 nt, Human
guaggauguagcccuuuggg

SEQ ID NO: 1198779 - RNA, 23 nt, Human
guggcucacgccuguaaucccag

SEQ ID NO: 1198780 - RNA, 23 nt, Human
gugugagcaacaggggguggcca

SEQ ID NO: 1198781 - RNA, 23 nt, Human
uaaagguuuauugugcuggugca

SEQ ID NO: 1198782 - RNA, 24 nt, Human
uacaggugugagccuccacaccca

SEQ ID NO: 1198783 - RNA, 18 nt, Human
uagcugggcgcaguggug

SEQ ID NO: 1198784 - RNA, 19 nt, Human
uaucucagcaccuggagag

SEQ ID NO: 1198785 - RNA, 24 nt, Human
ucacuuugucaggggagcugugcu

SEQ ID NO: 1198786 - RNA, 21 nt, Human
uccacacccagccuugaggga

SEQ ID NO: 1198787 - RNA, 24 nt, Human
uccagccugggugacagaccgaga

SEQ ID NO: 1198788 - RNA, 23 nt, Human
ucccaaaaugcugagauuacagg

SEQ ID NO: 1198789 - RNA, 20 nt, Human
ucccacuuauucuuugcucc

SEQ ID NO: 1198790 - RNA, 22 nt, Human
ucccgccgaauggagcgagagu

SEQ ID NO: 1198791 - RNA, 18 nt, Human
uccgugcuggugcccggg

SEQ ID NO: 1198792 - RNA, 19 nt, Human
uccgugcuggugcccgggg

SEQ ID NO: 1198793 - RNA, 18 nt, Human
ucgcuugaaccugggagg

SEQ ID NO: 1198794 - RNA, 24 nt, Human
ucucaaaaaaaaaaaucuuguuuc

SEQ ID NO: 1198795 - RNA, 22 nt, Human
ucucuacuaaaaauacaaaauu

SEQ ID NO: 1198796 - RNA, 23 nt, Human
ucucucauccaaacucuuccaaa

SEQ ID NO: 1198797 - RNA, 20 nt, Human
ucugcugcuggagcucugag

SEQ ID NO: 1198798 - RNA, 18 nt, Human
ucuuguuuccguagagug

SEQ ID NO: 1198799 - RNA, 18 nt, Human
ugaaaggacacaagaagg

SEQ ID NO: 1198800 - RNA, 21 nt, Human
ugaaaggacacaagaagggaa

SEQ ID NO: 1198801 - RNA, 22 nt, Human
ugaaccugggaggcggauugca

SEQ ID NO: 1198802 - RNA, 19 nt, Human
ugaagccccaucucuacua

SEQ ID NO: 1198803 - RNA, 22 nt, Human
ugaccugugacauaugauuccc

SEQ ID NO: 1198804 - RNA, 18 nt, Human
ugagauuacaggugugag

SEQ ID NO: 1198805 - RNA, 18 nt, Human
ugagauuacaggugugag

SEQ ID NO: 1198806 - RNA, 19 nt, Human
ugagauuacaggugugagc

SEQ ID NO: 1198807 - RNA, 19 nt, Human
ugagauuacaggugugagc

SEQ ID NO: 1198808 - RNA, 24 nt, Human
ugagauuacaggugugagccucca

SEQ ID NO: 1198809 - RNA, 18 nt, Human
ugagccuccacacccagc

SEQ ID NO: 1198810 - RNA, 24 nt, Human
ugaggcgggagaaucgcuugaacc

SEQ ID NO: 1198811 - RNA, 21 nt, Human
ugagggauguuuuauccuggc

SEQ ID NO: 1198812 - RNA, 22 nt, Human
ugaggugaaggaugauggcacu

SEQ ID NO: 1198813 - RNA, 27 nt, Human
ugcaccaagauugcaccacugcacucc

SEQ ID NO: 1198814 - RNA, 21 nt, Human
ugcaccacugcacuccagccu

SEQ ID NO: 1198815 - RNA, 24 nt, Human
ugcuccaggcugggcgucagaaac

SEQ ID NO: 1198816 - RNA, 20 nt, Human
ugcugagauuacagguguga

SEQ ID NO: 1198817 - RNA, 25 nt, Human
uggaucaccugaaggucaggaguuc

SEQ ID NO: 1198818 - RNA, 24 nt, Human
uggccaacauggugaagccccauc

SEQ ID NO: 1198819 - RNA, 22 nt, Human
uggcucacgccuguaaucccag

SEQ ID NO: 1198820 - RNA, 24 nt, Human
uggcucacgccuguaaucccagca

SEQ ID NO: 1198821 - RNA, 19 nt, Human
ugggaggcagaggcaggug

SEQ ID NO: 1198822 - RNA, 24 nt, Human
ugggaggcagaggcagguggauca

SEQ ID NO: 1198823 - RNA, 24 nt, Human
ugggcgucagaaacccuuccccag

SEQ ID NO: 1198824 - RNA, 24 nt, Human
uggucucaagugauguccgcacuu

SEQ ID NO: 1198825 - RNA, 21 nt, Human
uggugggcaccuguaauccca

SEQ ID NO: 1198826 - RNA, 22 nt, Human
uggugggcaccuguaaucccag

SEQ ID NO: 1198827 - RNA, 18 nt, Human
uguaaucccagcuacuga

SEQ ID NO: 1198828 - RNA, 23 nt, Human
uguagaaucagcacaugcuggga

SEQ ID NO: 1198829 - RNA, 22 nt, Human
uguccgcacuuggccucccaaa

SEQ ID NO: 1198830 - RNA, 20 nt, Human
ugugagccuccacacccagc

SEQ ID NO: 1198831 - RNA, 23 nt, Human
uuaaaugcccuauaccccacauc

SEQ ID NO: 1198832 - RNA, 24 nt, Human
uuagcugggcgcaguggugggcac

SEQ ID NO: 1198833 - RNA, 21 nt, Human
uucaaccugaucccagcagca

SEQ ID NO: 1198834 - RNA, 18 nt, Human
uuccuuggcguacaggac

SEQ ID NO: 1198835 - RNA, 22 nt, Human
uugcacugagccaagauugcac

SEQ ID NO: 1198836 - RNA, 18 nt, Human
uuggccucccaaaaugcu

SEQ ID NO: 1198837 - RNA, 23 nt, Human
uuggcgucucucauccaaacucu

SEQ ID NO: 1198838 - RNA, 24 nt, Human
uugggccgggcacgguggcucacg

SEQ ID NO: 1198839 - RNA, 21 nt, Human
uugggggagccccagauggag

SEQ ID NO: 1198840 - RNA, 19 nt, Human
uuuucauacacggggaggu

SEQ ID NO: 1198841 - RNA, 18 nt, Human
ugaaugacaggaguguca

SEQ ID NO: 1198842 - RNA, 21 nt, Human
ugcuuuagcaacauagcugaa

SEQ ID NO: 1198843 - RNA, 24 nt, Human
cugaaaccuugaauagagauguga

SEQ ID NO: 1198844 - RNA, 18 nt, Human
agcucugugggcucuggc

SEQ ID NO: 1198845 - RNA, 27 nt, Human
cacccccagcucugugggcucuggcuc

SEQ ID NO: 1198846 - RNA, 24 nt, Human
ccaaugccaccacccccagcucug

SEQ ID NO: 1198847 - RNA, 18 nt, Human
cccaaugccaccaccccc

SEQ ID NO: 1198848 - RNA, 23 nt, Human
ccccaaugccaccacccccagcu

SEQ ID NO: 1198849 - RNA, 18 nt, Human
cucugugggcucuggcuc

SEQ ID NO: 1198850 - RNA, 26 nt, Human
agggacugggguuuauuggagggggc

SEQ ID NO: 1198851 - RNA, 21 nt, Human
ggacugggguuuauuggaggg

SEQ ID NO: 1198852 - RNA, 18 nt, Human
uggaugauugacacuuga

SEQ ID NO: 1198853 - RNA, 19 nt, Human
uugaagggcuggaugauug

SEQ ID NO: 1198854 - RNA, 19 nt, Human
uugacacuugaauggcauc

SEQ ID NO: 1198855 - RNA, 19 nt, Human
aaauccucaggggccucuc

SEQ ID NO: 1198856 - RNA, 20 nt, Human
aaauccucaggggccucucu

SEQ ID NO: 1198857 - RNA, 20 nt, Human
aguuuuucuuuuuucuuuuc

SEQ ID NO: 1198858 - RNA, 23 nt, Human
cacacgugguuaauccagauuca

SEQ ID NO: 1198859 - RNA, 20 nt, Human
ccucuuaaagcaagaacugc

SEQ ID NO: 1198860 - RNA, 19 nt, Human
guugggcuuaguuuuucuu

SEQ ID NO: 1198861 - RNA, 20 nt, Human
ucacacgugguuaauccaga

SEQ ID NO: 1198862 - RNA, 20 nt, Human
ucacggggagggggaaaugg

SEQ ID NO: 1198863 - RNA, 18 nt, Human
uccagauucacggggagg

SEQ ID NO: 1198864 - RNA, 22 nt, Human
ucucccauucuguuguucagac

SEQ ID NO: 1198865 - RNA, 21 nt, Human
ucuuuuuugcuaguaaaauga

SEQ ID NO: 1198866 - RNA, 24 nt, Human
uuuuucuuuuuucuuuucuuuuuu

SEQ ID NO: 1198867 - RNA, 22 nt, Human
acaccuccuccuccuccucuga

SEQ ID NO: 1198868 - RNA, 19 nt, Human
acagaaucuccucaggaag

SEQ ID NO: 1198869 - RNA, 19 nt, Human
accuccuccuccuccucug

SEQ ID NO: 1198870 - RNA, 22 nt, Human
agaaucccucugcuguccacau

SEQ ID NO: 1198871 - RNA, 20 nt, Human
augucuuccccaccgcggaa

SEQ ID NO: 1198872 - RNA, 20 nt, Human
caaacaccuccuccuccucc

SEQ ID NO: 1198873 - RNA, 20 nt, Human
caaagccaccauccaggagc

SEQ ID NO: 1198874 - RNA, 23 nt, Human
caaagccaccauccaggagcugg

SEQ ID NO: 1198875 - RNA, 19 nt, Human
caccuccuccuccuccucu

SEQ ID NO: 1198876 - RNA, 26 nt, Human
caccuccuccuccuccucugacuggc

SEQ ID NO: 1198877 - RNA, 19 nt, Human
cccucggggggaugugggg

SEQ ID NO: 1198878 - RNA, 21 nt, Human
ccucacagaaucuccucagga

SEQ ID NO: 1198879 - RNA, 19 nt, Human
ccuggcuccccgguuccug

SEQ ID NO: 1198880 - RNA, 22 nt, Human
cuccuccuccucugacuggcua

SEQ ID NO: 1198881 - RNA, 21 nt, Human
cuccuugggaugccaaacacc

SEQ ID NO: 1198882 - RNA, 23 nt, Human
cuccuugggaugccaaacaccuc

SEQ ID NO: 1198883 - RNA, 19 nt, Human
gagcuggggcagggggucu

SEQ ID NO: 1198884 - RNA, 21 nt, Human
gagcuggggcagggggucuuc

SEQ ID NO: 1198885 - RNA, 22 nt, Human
gagcuggggcagggggucuucu

SEQ ID NO: 1198886 - RNA, 20 nt, Human
gcccuggcuccccgguuccu

SEQ ID NO: 1198887 - RNA, 21 nt, Human
gcccuggcuccccgguuccug

SEQ ID NO: 1198888 - RNA, 23 nt, Human
ggaauugcccacgaacacaaucu

SEQ ID NO: 1198889 - RNA, 20 nt, Human
ggccggggguacggaccccc

SEQ ID NO: 1198890 - RNA, 21 nt, Human
gggaugugggggugaguuuca

SEQ ID NO: 1198891 - RNA, 18 nt, Human
gggcagagggagagcuuc

SEQ ID NO: 1198892 - RNA, 18 nt, Human
uaucacagagccagaucu

SEQ ID NO: 1198893 - RNA, 20 nt, Human
uaucacagagccagaucucu

SEQ ID NO: 1198894 - RNA, 19 nt, Human
ucaaagccaccauccagga

SEQ ID NO: 1198895 - RNA, 21 nt, Human
ucagagaccucuuccucuucu

SEQ ID NO: 1198896 - RNA, 21 nt, Human
uccaggagcuggggcaggggg

SEQ ID NO: 1198897 - RNA, 23 nt, Human
uccccgguuccuggcuccucuuc

SEQ ID NO: 1198898 - RNA, 23 nt, Human
uggcuccccgguuccuggcuccu

SEQ ID NO: 1198899 - RNA, 22 nt, Human
ugggaugccaaacaccuccucc

SEQ ID NO: 1198900 - RNA, 20 nt, Human
uggggcagggggucuucuuc

SEQ ID NO: 1198901 - RNA, 25 nt, Human
ugugggggugaguuucaaggguggg

SEQ ID NO: 1198902 - RNA, 21 nt, Human
uuccuggcuccucuucuguua

SEQ ID NO: 1198903 - RNA, 22 nt, Human
gagcagccgcaguuggucagug

SEQ ID NO: 1198904 - RNA, 18 nt, Human
aaagagcauccaugaggg

SEQ ID NO: 1198905 - RNA, 19 nt, Human
agacagcuggucaacccag

SEQ ID NO: 1198906 - RNA, 20 nt, Human
agaugacccuacuguaaagg

SEQ ID NO: 1198907 - RNA, 20 nt, Human
aggaacacaggcaggauaca

SEQ ID NO: 1198908 - RNA, 26 nt, Human
aggaacacaggcaggauacaggaaca

SEQ ID NO: 1198909 - RNA, 20 nt, Human
augacccuacuguaaagggu

SEQ ID NO: 1198910 - RNA, 19 nt, Human
caggauacaggaacaugau

SEQ ID NO: 1198911 - RNA, 23 nt, Human
cauaaagagcauccaugagggua

SEQ ID NO: 1198912 - RNA, 22 nt, Human
gcaaacacuccuccacugagac

SEQ ID NO: 1198913 - RNA, 20 nt, Human
uaaagggucauccauaaaga

SEQ ID NO: 1198914 - RNA, 23 nt, Human
uaaagggucauccauaaagagca

SEQ ID NO: 1198915 - RNA, 23 nt, Human
uccagaugacccuacuguaaagg

SEQ ID NO: 1198916 - RNA, 20 nt, Human
ucuccagaugacccuacugu

SEQ ID NO: 1198917 - RNA, 23 nt, Human
acugcaauuugugucuucuaauu

SEQ ID NO: 1198918 - RNA, 25 nt, Human
augaagggcaucugacagaucuaca

SEQ ID NO: 1198919 - RNA, 26 nt, Human
caaccaccugaccaacaccuuucagu

SEQ ID NO: 1198920 - RNA, 21 nt, Human
caucccucugcugaacuccag

SEQ ID NO: 1198921 - RNA, 18 nt, Human
ccaugaagggcaucugac

SEQ ID NO: 1198922 - RNA, 22 nt, Human
cuccagagccacaggucacaga

SEQ ID NO: 1198923 - RNA, 24 nt, Human
cucugcugaacuccagagccacag

SEQ ID NO: 1198924 - RNA, 29 nt, Human
cuuucagucugcaguauacauccccuuua

SEQ ID NO: 1198925 - RNA, 19 nt, Human
gucacagagcacucauucc

SEQ ID NO: 1198926 - RNA, 20 nt, Human
uacaggcuuugugaguugga

SEQ ID NO: 1198927 - RNA, 23 nt, Human
uacuuucuaccuuuaccacaaga

SEQ ID NO: 1198928 - RNA, 19 nt, Human
ucuaccuuuaccacaagaa

SEQ ID NO: 1198929 - RNA, 19 nt, Human
ucugcaguauacaucccuc

SEQ ID NO: 1198930 - RNA, 20 nt, Human
ucugcugaacuccagagcca

SEQ ID NO: 1198931 - RNA, 25 nt, Human
ugcaaaacacuucacgguacuuucu

SEQ ID NO: 1198932 - RNA, 19 nt, Human
uggucaaugcaaaacacuu

SEQ ID NO: 1198933 - RNA, 19 nt, Human
uuggagguuucuguacuug

SEQ ID NO: 1198934 - RNA, 24 nt, Human
uugguaauaguaaucagaggcuuu

SEQ ID NO: 1198935 - RNA, 20 nt, Human
aaaaacacauaaaaaagcau

SEQ ID NO: 1198936 - RNA, 22 nt, Human
aaaaacacauaaaaaagcauua

SEQ ID NO: 1198937 - RNA, 21 nt, Human
aaaagaaaaacaaaaacaaag

SEQ ID NO: 1198938 - RNA, 26 nt, Human
aaaaggaaaaggccugaacagcuuga

SEQ ID NO: 1198939 - RNA, 24 nt, Human
aaaagucuucaucuuuuucuuuuu

SEQ ID NO: 1198940 - RNA, 22 nt, Human
aaaauccuuuguccuuacaacc

SEQ ID NO: 1198941 - RNA, 23 nt, Human
aaacacagcuaauacauguuccu

SEQ ID NO: 1198942 - RNA, 26 nt, Human
aaagaaaaacaaaaacaaagccauag

SEQ ID NO: 1198943 - RNA, 22 nt, Human
aacacggauuauaacaaaucca

SEQ ID NO: 1198944 - RNA, 20 nt, Human
aacagcuugacaaacagcaa

SEQ ID NO: 1198945 - RNA, 22 nt, Human
aaccaauucacuuuuccucuca

SEQ ID NO: 1198946 - RNA, 21 nt, Human
aaccugcuugucccuucaccu

SEQ ID NO: 1198947 - RNA, 18 nt, Human
aagcauuaucugacaaag

SEQ ID NO: 1198948 - RNA, 22 nt, Human
aauucuuuaaucaggcacuuga

SEQ ID NO: 1198949 - RNA, 24 nt, Human
acaaacacauauucugcccugaaa

SEQ ID NO: 1198950 - RNA, 19 nt, Human
acagcuaauacauguuccu

SEQ ID NO: 1198951 - RNA, 18 nt, Human
accuuuucccuucuuucu

SEQ ID NO: 1198952 - RNA, 23 nt, Human
agacgaucauguauaccuaaaac

SEQ ID NO: 1198953 - RNA, 27 nt, Human
agccagaaguaaaaaggaaaaggccug

SEQ ID NO: 1198954 - RNA, 26 nt, Human
agguaaaguggaaaaacuaaauaguu

SEQ ID NO: 1198955 - RNA, 20 nt, Human
aguaaauagauaaaaaauaa

SEQ ID NO: 1198956 - RNA, 23 nt, Human
aguaauaaugaagguaaaaugcc

SEQ ID NO: 1198957 - RNA, 21 nt, Human
auaagccagaaguaaaaagga

SEQ ID NO: 1198958 - RNA, 20 nt, Human
auacagcgaguauugacaac

SEQ ID NO: 1198959 - RNA, 21 nt, Human
auggcaacuacuuagaaucca

SEQ ID NO: 1198960 - RNA, 18 nt, Human
auuaaguauccuugggca

SEQ ID NO: 1198961 - RNA, 18 nt, Human
caaaaauggcagaaaaaa

SEQ ID NO: 1198962 - RNA, 26 nt, Human
caaaagaaaaacaaaaacaaagccau

SEQ ID NO: 1198963 - RNA, 22 nt, Human
caaagaacuaauagagagauga

SEQ ID NO: 1198964 - RNA, 24 nt, Human
caauucacuuuuccucucaacaaa

SEQ ID NO: 1198965 - RNA, 28 nt, Human
cacaaacacauauucugcccugaaaaug

SEQ ID NO: 1198966 - RNA, 22 nt, Human
cacacacaaaaguauggcuuua

SEQ ID NO: 1198967 - RNA, 20 nt, Human
cacacacacaaaaguauggc

SEQ ID NO: 1198968 - RNA, 21 nt, Human
cacauaaaccugcuugucccu

SEQ ID NO: 1198969 - RNA, 22 nt, Human
cacauaaaccugcuugucccuu

SEQ ID NO: 1198970 - RNA, 25 nt, Human
cagaaaaagagcgaauacuguguca

SEQ ID NO: 1198971 - RNA, 21 nt, Human
cagcaacagaauaauuuccaa

SEQ ID NO: 1198972 - RNA, 26 nt, Human
cauaaaaaagcauuaucugacaaaga

SEQ ID NO: 1198973 - RNA, 25 nt, Human
caucacacacacacacaaaaguaug

SEQ ID NO: 1198974 - RNA, 18 nt, Human
ccacccacaaauaaacaa

SEQ ID NO: 1198975 - RNA, 19 nt, Human
cccacaaauaaacaaaagc

SEQ ID NO: 1198976 - RNA, 22 nt, Human
cccacaaauaaacaaaagcuua

SEQ ID NO: 1198977 - RNA, 18 nt, Human
cucaacaaaaaucaagua

SEQ ID NO: 1198978 - RNA, 21 nt, Human
cucggcucccagccgccggcc

SEQ ID NO: 1198979 - RNA, 26 nt, Human
gaacuagagccaaaaauggcagaaaa

SEQ ID NO: 1198980 - RNA, 21 nt, Human
gauuacuuuuuauaagacuau

SEQ ID NO: 1198981 - RNA, 18 nt, Human
gcagugaugaaucucuau

SEQ ID NO: 1198982 - RNA, 24 nt, Human
gcuaaaaccugaacuagagccaaa

SEQ ID NO: 1198983 - RNA, 21 nt, Human
uaaaaccugaacuagagccaa

SEQ ID NO: 1198984 - RNA, 22 nt, Human
uaaaagaaaagguuaugaccac

SEQ ID NO: 1198985 - RNA, 21 nt, Human
uaaaaugcaucacaguaggca

SEQ ID NO: 1198986 - RNA, 24 nt, Human
uaaaaugcaucacaguaggcaccc

SEQ ID NO: 1198987 - RNA, 27 nt, Human
uaacaaaauaaauuaucagcauuucca

SEQ ID NO: 1198988 - RNA, 21 nt, Human
uaacuggacuaguuuagauau

SEQ ID NO: 1198989 - RNA, 20 nt, Human
uaauuucuuuuuugcaucuc

SEQ ID NO: 1198990 - RNA, 22 nt, Human
uacaaaagaaaaacaaaaacaa

SEQ ID NO: 1198991 - RNA, 27 nt, Human
uacuggggcaucacacacacacacagu

SEQ ID NO: 1198992 - RNA, 21 nt, Human
uagaguuuguaguauacacuu

SEQ ID NO: 1198993 - RNA, 20 nt, Human
uauucauagaaaauuuaauc

SEQ ID NO: 1198994 - RNA, 20 nt, Human
ucaaguuuucauacuaaaug

SEQ ID NO: 1198995 - RNA, 25 nt, Human
ucacaaacacauauucugcccugaa

SEQ ID NO: 1198996 - RNA, 19 nt, Human
ucacacacacacacaaaag

SEQ ID NO: 1198997 - RNA, 25 nt, Human
uccagugaguguuuuguuuuucaau

SEQ ID NO: 1198998 - RNA, 19 nt, Human
ucucacuaaaacacagcua

SEQ ID NO: 1198999 - RNA, 18 nt, Human
ucuuuuuugcaucucagc

SEQ ID NO: 1199000 - RNA, 23 nt, Human
ugaaauacauuuuccuuaaagca

SEQ ID NO: 1199001 - RNA, 21 nt, Human
ugacaaagaaaaguagaaaag

SEQ ID NO: 1199002 - RNA, 22 nt, Human
ugacaaagaaaaguagaaaaga

SEQ ID NO: 1199003 - RNA, 19 nt, Human
ugcacuacauuauuuuaac

SEQ ID NO: 1199004 - RNA, 21 nt, Human
ugcuaaucaagcuaaaaccug

SEQ ID NO: 1199005 - RNA, 21 nt, Human
uggagaauaacuccacccaca

SEQ ID NO: 1199006 - RNA, 24 nt, Human
ugucaaaaaccuuugcuaaucaag

SEQ ID NO: 1199007 - RNA, 20 nt, Human
uguuguuuaaguauauuuca

SEQ ID NO: 1199008 - RNA, 20 nt, Human
uuaacuuucuguaaucugca

SEQ ID NO: 1199009 - RNA, 24 nt, Human
uuaauguucaaaucaacagcaaaa

SEQ ID NO: 1199010 - RNA, 22 nt, Human
uuaugauggauagcaauucauu

SEQ ID NO: 1199011 - RNA, 20 nt, Human
uucaaaaaauguaaaaacac

SEQ ID NO: 1199012 - RNA, 21 nt, Human
uucaaguuuucauacuaaaug

SEQ ID NO: 1199013 - RNA, 18 nt, Human
uuccacauagaaaucgcu

SEQ ID NO: 1199014 - RNA, 21 nt, Human
uugaacuugguaacuuuguca

SEQ ID NO: 1199015 - RNA, 23 nt, Human
uuggagaauaacuccacccacaa

SEQ ID NO: 1199016 - RNA, 22 nt, Human
uuuaacugauuacuuuuuauaa

SEQ ID NO: 1199017 - RNA, 20 nt, Human
uuuccacauagaaaucgcuu

SEQ ID NO: 1199018 - RNA, 20 nt, Human
aauccaacugaguuuuccuc

SEQ ID NO: 1199019 - RNA, 21 nt, Human
cagagccugcauguacuuucc

SEQ ID NO: 1199020 - RNA, 19 nt, Human
cagcgaaucaccaauccaa

SEQ ID NO: 1199021 - RNA, 23 nt, Human
ccuguccacaacacugcuaggga

SEQ ID NO: 1199022 - RNA, 21 nt, Human
cuaugauauuggccagauuua

SEQ ID NO: 1199023 - RNA, 18 nt, Human
cuccagccuccuguuucc

SEQ ID NO: 1199024 - RNA, 20 nt, Human
ucuguaacauaggucacuau

SEQ ID NO: 1199025 - RNA, 19 nt, Human
uuaaagcaacagagccugc

SEQ ID NO: 1199026 - RNA, 18 nt, Human
uuagugcaauuucuguaa

SEQ ID NO: 1199027 - RNA, 23 nt, Human
uuuaaagcaacagagccugcaug

SEQ ID NO: 1199028 - RNA, 21 nt, Human
ccgcgccgacgcggcgcccgc

SEQ ID NO: 1199029 - RNA, 20 nt, Human
ccgcugcccgcugcacugga

SEQ ID NO: 1199030 - RNA, 18 nt, Human
gcucgggccgcugcccgc

SEQ ID NO: 1199031 - RNA, 22 nt, Human
ggccgcugcccgcugcacugga

SEQ ID NO: 1199032 - RNA, 23 nt, Human
aagcuggcugcauccuggggaca

SEQ ID NO: 1199033 - RNA, 18 nt, Human
gagucucagccuuuccug

SEQ ID NO: 1199034 - RNA, 20 nt, Human
gcuuauuuugccccuggauu

SEQ ID NO: 1199035 - RNA, 18 nt, Human
ggcugcauccuggggaca

SEQ ID NO: 1199036 - RNA, 19 nt, Human
ucagccuuuccugaaagcu

SEQ ID NO: 1199037 - RNA, 25 nt, Human
ucccggaggauaaugcuuauuuugc

SEQ ID NO: 1199038 - RNA, 26 nt, Human
ucccggaggauaaugcuuauuuugcc

SEQ ID NO: 1199039 - RNA, 18 nt, Human
uccuggggacacugacuc

SEQ ID NO: 1199040 - RNA, 18 nt, Human
ugccccuggauuuuccuu

SEQ ID NO: 1199041 - RNA, 21 nt, Human
uggcugcauccuggggacacu

SEQ ID NO: 1199042 - RNA, 19 nt, Human
uuccuucggauucuucucg

SEQ ID NO: 1199043 - RNA, 18 nt, Human
uugccccuggauuuuccu

SEQ ID NO: 1199044 - RNA, 23 nt, Human
aagcgcugaggccgcuguccacc

SEQ ID NO: 1199045 - RNA, 24 nt, Human
acuggaagaauaaaguuccucuuu

SEQ ID NO: 1199046 - RNA, 20 nt, Human
agcggaagcgcugaggccgc

SEQ ID NO: 1199047 - RNA, 19 nt, Human
aucgguguucgcgugccuu

SEQ ID NO: 1199048 - RNA, 19 nt, Human
cagcagcgccaggcgggcc

SEQ ID NO: 1199049 - RNA, 22 nt, Human
cagcggaagcgcugaggccgcu

SEQ ID NO: 1199050 - RNA, 23 nt, Human
cccggcagcagcagcgccaggcg

SEQ ID NO: 1199051 - RNA, 19 nt, Human
cccuucccgggcuccccgg

SEQ ID NO: 1199052 - RNA, 20 nt, Human
ccggcucccagcucucagcc

SEQ ID NO: 1199053 - RNA, 26 nt, Human
ccugaccuugcccuggguacgccagc

SEQ ID NO: 1199054 - RNA, 18 nt, Human
ccugugcgcgccgguggc

SEQ ID NO: 1199055 - RNA, 23 nt, Human
ccugugcgcgccgguggcggcug

SEQ ID NO: 1199056 - RNA, 20 nt, Human
cgccgguggcggcuggaggc

SEQ ID NO: 1199057 - RNA, 23 nt, Human
cggcucccagcucucagccuccc

SEQ ID NO: 1199058 - RNA, 21 nt, Human
cucccuucccgggcuccccgg

SEQ ID NO: 1199059 - RNA, 22 nt, Human
cuggaggcucgcggcucccuuc

SEQ ID NO: 1199060 - RNA, 22 nt, Human
cuuccggguccuccgcccggca

SEQ ID NO: 1199061 - RNA, 22 nt, Human
gcagcagcagcgccaggcgggc

SEQ ID NO: 1199062 - RNA, 22 nt, Human
gccgucguggcuacuuccgauc

SEQ ID NO: 1199063 - RNA, 20 nt, Human
ggaaagaccugugcgcgccg

SEQ ID NO: 1199064 - RNA, 19 nt, Human
gggcuccccggcucccagc

SEQ ID NO: 1199065 - RNA, 23 nt, Human
ucacaccuccaccgccggcacgg

SEQ ID NO: 1199066 - RNA, 18 nt, Human
ucccgggcuccccggcuc

SEQ ID NO: 1199067 - RNA, 27 nt, Human
uccgcccggcagcagcagcgccaggcg

SEQ ID NO: 1199068 - RNA, 18 nt, Human
ugcccuggguacgccagc

SEQ ID NO: 1199069 - RNA, 22 nt, Human
uggaagaauaaaguuccucuuu

SEQ ID NO: 1199070 - RNA, 18 nt, Human
aaacaugaaauccccagg

SEQ ID NO: 1199071 - RNA, 23 nt, Human
aagaacaggcagcaacucagaug

SEQ ID NO: 1199072 - RNA, 23 nt, Human
acaggucucauuuuugcucuuuu

SEQ ID NO: 1199073 - RNA, 18 nt, Human
accuguggcuccugggac

SEQ ID NO: 1199074 - RNA, 18 nt, Human
acucccugcaggacacac

SEQ ID NO: 1199075 - RNA, 18 nt, Human
agagcuuuuuccugccaa

SEQ ID NO: 1199076 - RNA, 27 nt, Human
agcuuuuuccugccaaugcucuuccau

SEQ ID NO: 1199077 - RNA, 21 nt, Human
auggugcuggaagguggagag

SEQ ID NO: 1199078 - RNA, 23 nt, Human
caaccaaugcaaccuuuccaagc

SEQ ID NO: 1199079 - RNA, 22 nt, Human
cagagugaaaacaugaaauccc

SEQ ID NO: 1199080 - RNA, 18 nt, Human
cagcaagagaccuggacu

SEQ ID NO: 1199081 - RNA, 23 nt, Human
caggacacacagcaagaggggag

SEQ ID NO: 1199082 - RNA, 20 nt, Human
cucuguauagccucuagagc

SEQ ID NO: 1199083 - RNA, 23 nt, Human
cuuuuguucuuaacaucaaaauc

SEQ ID NO: 1199084 - RNA, 27 nt, Human
cuuuuuuucuucucuguauagccucuu

SEQ ID NO: 1199085 - RNA, 24 nt, Human
gaaauccccagggugaugcuccuc

SEQ ID NO: 1199086 - RNA, 18 nt, Human
gcagcaacucagaugugc

SEQ ID NO: 1199087 - RNA, 19 nt, Human
gccuggaaguuuccauacu

SEQ ID NO: 1199088 - RNA, 22 nt, Human
gggagaggggagaggagaaagu

SEQ ID NO: 1199089 - RNA, 21 nt, Human
uagccucuagagcuuuuuccu

SEQ ID NO: 1199090 - RNA, 27 nt, Human
uaucuggagugcuuuuuaaaacaauuu

SEQ ID NO: 1199091 - RNA, 31 nt, Human
ucccuuguaagcaaauaaauugacaggagcu

SEQ ID NO: 1199092 - RNA, 24 nt, Human
ucuccauaggaauagacaccacuc

SEQ ID NO: 1199093 - RNA, 21 nt, Human
ucuggagugcuuuuuaaaaca

SEQ ID NO: 1199094 - RNA, 20 nt, Human
ucuguauagccucuagagcu

SEQ ID NO: 1199095 - RNA, 19 nt, Human
ucuucucuguauagccucu

SEQ ID NO: 1199096 - RNA, 18 nt, Human
ugaagaacaggcagcaac

SEQ ID NO: 1199097 - RNA, 21 nt, Human
ugaagaacaggcagcaacuca

SEQ ID NO: 1199098 - RNA, 26 nt, Human
ugcuggaagguggagaguuggccacc

SEQ ID NO: 1199099 - RNA, 18 nt, Human
uggaagguggagaguugg

SEQ ID NO: 1199100 - RNA, 21 nt, Human
ugggagaggggagaggagaaa

SEQ ID NO: 1199101 - RNA, 23 nt, Human
ugggagaggggagaggagaaagu

SEQ ID NO: 1199102 - RNA, 26 nt, Human
ugugaagaacaggcagcaacucagau

SEQ ID NO: 1199103 - RNA, 21 nt, Human
uuacuguuacaugaacagugu

SEQ ID NO: 1199104 - RNA, 24 nt, Human
uuauuuggcaggugggggagggga

SEQ ID NO: 1199105 - RNA, 21 nt, Human
uucacaaacauucucgauuac

SEQ ID NO: 1199106 - RNA, 21 nt, Human
uuccauacuucuuuuguucuu

SEQ ID NO: 1199107 - RNA, 21 nt, Human
uuccugccaaugcucuuccau

SEQ ID NO: 1199108 - RNA, 18 nt, Human
uuggcaggugggggaggg

SEQ ID NO: 1199109 - RNA, 23 nt, Human
uuuuucuucucuguauagccucu

SEQ ID NO: 1199110 - RNA, 24 nt, Human
uuuuuuuuuuuuuuuaacuuuuga

SEQ ID NO: 1199111 - RNA, 21 nt, Human
uaugugcaauagccccauaaa

SEQ ID NO: 1199112 - RNA, 25 nt, Human
ucuuacagauucacuaugugcaaua

SEQ ID NO: 1199113 - RNA, 20 nt, Human
ccugcgauggcaggggcugu

SEQ ID NO: 1199114 - RNA, 21 nt, Human
ccugcgauggcaggggcuguc

SEQ ID NO: 1199115 - RNA, 23 nt, Human
ccuuccugcgauggcaggggcug

SEQ ID NO: 1199116 - RNA, 29 nt, Human
ucagcugcauguccauggcuggauccagg

SEQ ID NO: 1199117 - RNA, 24 nt, Human
aaaugccugagauugccuaacacc

SEQ ID NO: 1199118 - RNA, 19 nt, Human
caugucuccgauaagcauc

SEQ ID NO: 1199119 - RNA, 27 nt, Human
cuuucugauuauuuucaugucuccgau

SEQ ID NO: 1199120 - RNA, 22 nt, Human
aaaaacugcgaaagccuaucaa

SEQ ID NO: 1199121 - RNA, 25 nt, Human
caacuugaaagaugaguagggauac

SEQ ID NO: 1199122 - RNA, 24 nt, Human
caggaucagaagccccaguuccaa

SEQ ID NO: 1199123 - RNA, 22 nt, Human
cgaauggggugggaaaggcuag

SEQ ID NO: 1199124 - RNA, 19 nt, Human
cuggccaccaaggccguuc

SEQ ID NO: 1199125 - RNA, 19 nt, Human
cuugaaagaugaguaggga

SEQ ID NO: 1199126 - RNA, 20 nt, Human
gaaagccuaucaacuugaaa

SEQ ID NO: 1199127 - RNA, 18 nt, Human
gccaggaucagaagcccc

SEQ ID NO: 1199128 - RNA, 21 nt, Human
uagccaggaucagaagcccca

SEQ ID NO: 1199129 - RNA, 26 nt, Human
uucacggacgaaaaacugcgaaagcc

SEQ ID NO: 1199130 - RNA, 21 nt, Human
acuccaaggagcuaggagggg

SEQ ID NO: 1199131 - RNA, 22 nt, Human
agacagccaccuguccuuucug

SEQ ID NO: 1199132 - RNA, 20 nt, Human
aggcaauggccaaagccaca

SEQ ID NO: 1199133 - RNA, 21 nt, Human
aggccaugaggagacagccac

SEQ ID NO: 1199134 - RNA, 18 nt, Human
aguagcagcagcaguauc

SEQ ID NO: 1199135 - RNA, 25 nt, Human
auuaguagcagcagcaguaucuugg

SEQ ID NO: 1199136 - RNA, 19 nt, Human
caggcaauggccaaagcca

SEQ ID NO: 1199137 - RNA, 21 nt, Human
gcaguaucuuggcaaaaggag

SEQ ID NO: 1199138 - RNA, 23 nt, Human
gggcuucugugggcuaguucugc

SEQ ID NO: 1199139 - RNA, 26 nt, Human
guagcagcagcaguaucuuggcaaaa

SEQ ID NO: 1199140 - RNA, 19 nt, Human
uaggaggggauuaguagca

SEQ ID NO: 1199141 - RNA, 20 nt, Human
uccaaggagcuaggagggga

SEQ ID NO: 1199142 - RNA, 23 nt, Human
ucucugcaggccaugaggagaca

SEQ ID NO: 1199143 - RNA, 19 nt, Human
ucugcaggccaugaggaga

SEQ ID NO: 1199144 - RNA, 21 nt, Human
uuaguagcagcagcaguaucu

SEQ ID NO: 1199145 - RNA, 22 nt, Human
uuaguagcagcagcaguaucuu

SEQ ID NO: 1199146 - RNA, 25 nt, Human
uuaguagcagcagcaguaucuuggc

SEQ ID NO: 1199147 - RNA, 21 nt, Human
aagcaggguuccagauaccuc

SEQ ID NO: 1199148 - RNA, 22 nt, Human
agauaccuccaggugcagcuuc

SEQ ID NO: 1199149 - RNA, 24 nt, Human
uuccagauaccuccaggugcagcu

SEQ ID NO: 1199150 - RNA, 19 nt, Human
ccucugcuaacaacugcuc

SEQ ID NO: 1199151 - RNA, 20 nt, Human
cugccucugcuaacaacugc

SEQ ID NO: 1199152 - RNA, 23 nt, Human
cugccucugcuaacaacugcucc

SEQ ID NO: 1199153 - RNA, 23 nt, Human
cugcuggugcuguggcuucuccu

SEQ ID NO: 1199154 - RNA, 22 nt, Human
gugcuguggcuucuccugucug

SEQ ID NO: 1199155 - RNA, 18 nt, Human
ucccugacaugcugccuc

SEQ ID NO: 1199156 - RNA, 19 nt, Human
ucugcuaacaacugcucca

SEQ ID NO: 1199157 - RNA, 18 nt, Human
ugcuguggcuucuccuga

SEQ ID NO: 1199158 - RNA, 18 nt, Human
acccgcagcgccuccuuc

SEQ ID NO: 1199159 - RNA, 23 nt, Human
agacuuucacuuuccccccuugg

SEQ ID NO: 1199160 - RNA, 18 nt, Human
agagggggaggggagggc

SEQ ID NO: 1199161 - RNA, 23 nt, Human
caacucgggagcgagcgggcuag

SEQ ID NO: 1199162 - RNA, 22 nt, Human
cacccgcagcgccuccuucacu

SEQ ID NO: 1199163 - RNA, 19 nt, Human
cacuuuccccccuuggucg

SEQ ID NO: 1199164 - RNA, 22 nt, Human
cacuuuguagccauucuggggc

SEQ ID NO: 1199165 - RNA, 24 nt, Human
cccgcagcgccuccuucacuccga

SEQ ID NO: 1199166 - RNA, 23 nt, Human
cccggggagagggggaggggagg

SEQ ID NO: 1199167 - RNA, 23 nt, Human
cuccgaagacuuucacuuucccc

SEQ ID NO: 1199168 - RNA, 20 nt, Human
cugauggugcuccuggccgg

SEQ ID NO: 1199169 - RNA, 20 nt, Human
cugauggugcuccuggccgg

SEQ ID NO: 1199170 - RNA, 19 nt, Human
cugcacacugucaucugcc

SEQ ID NO: 1199171 - RNA, 22 nt, Human
cuucaucaucuucaucaaugca

SEQ ID NO: 1199172 - RNA, 20 nt, Human
cuugcggagcccgcgccccc

SEQ ID NO: 1199173 - RNA, 19 nt, Human
gaggggagggccuccggga

SEQ ID NO: 1199174 - RNA, 19 nt, Human
gcacaguguucccuucugg

SEQ ID NO: 1199175 - RNA, 21 nt, Human
gcagcgccuccuucacuccga

SEQ ID NO: 1199176 - RNA, 19 nt, Human
gcgccugauggugcuccug

SEQ ID NO: 1199177 - RNA, 19 nt, Human
ggagagggggaggggaggg

SEQ ID NO: 1199178 - RNA, 21 nt, Human
ggggagagggggaggggaggg

SEQ ID NO: 1199179 - RNA, 20 nt, Human
ggggaggggagggccuccgg

SEQ ID NO: 1199180 - RNA, 19 nt, Human
ugcggagcccgcgcccccg

SEQ ID NO: 1199181 - RNA, 24 nt, Human
uggaaaagccgaggaaauucgagg

SEQ ID NO: 1199182 - RNA, 23 nt, Human
uucccuucugggguccugcggcc

SEQ ID NO: 1199183 - RNA, 19 nt, Human
acccgcagacugcuccucc

SEQ ID NO: 1199184 - RNA, 23 nt, Human
ccacaguuggaacucguccacac

SEQ ID NO: 1199185 - RNA, 21 nt, Human
ccagagacuccucgccccugg

SEQ ID NO: 1199186 - RNA, 23 nt, Human
ccaguucuccggugaucuucucu

SEQ ID NO: 1199187 - RNA, 21 nt, Human
ccccaggcagccauucaccuu

SEQ ID NO: 1199188 - RNA, 26 nt, Human
ccuccagcgucuccagagacuccucg

SEQ ID NO: 1199189 - RNA, 25 nt, Human
ccuucagccacaguuggaacucguc

SEQ ID NO: 1199190 - RNA, 18 nt, Human
cgaaugacacccgcagac

SEQ ID NO: 1199191 - RNA, 22 nt, Human
cgccccaggcagccauucaccc

SEQ ID NO: 1199192 - RNA, 21 nt, Human
cuccagagacuccucgccccu

SEQ ID NO: 1199193 - RNA, 21 nt, Human
gccauucaccuucuccaccac

SEQ ID NO: 1199194 - RNA, 23 nt, Human
gcuugcaguuccgccccaggcag

SEQ ID NO: 1199195 - RNA, 19 nt, Human
ggaaaaucuuuggcaaugu

SEQ ID NO: 1199196 - RNA, 20 nt, Human
uccacaccugccugguacuc

SEQ ID NO: 1199197 - RNA, 24 nt, Human
uccacaccugccugguacuccuca

SEQ ID NO: 1199198 - RNA, 20 nt, Human
uccgaaugacacccgcagac

SEQ ID NO: 1199199 - RNA, 19 nt, Human
uccugcaguguggagaggc

SEQ ID NO: 1199200 - RNA, 25 nt, Human
ucuccaccaccgccuucagccacag

SEQ ID NO: 1199201 - RNA, 19 nt, Human
ucuccagagacuccucgcc

SEQ ID NO: 1199202 - RNA, 23 nt, Human
ucuccagagacuccucgccccug

SEQ ID NO: 1199203 - RNA, 22 nt, Human
ugccugguacuccucaugcucc

SEQ ID NO: 1199204 - RNA, 20 nt, Human
ugcuccagcagaucuacacg

SEQ ID NO: 1199205 - RNA, 20 nt, Human
uggagaggcgcugcgugaug

SEQ ID NO: 1199206 - RNA, 21 nt, Human
uuccgaaugacacccgcagac

SEQ ID NO: 1199207 - RNA, 19 nt, Human
uucuccaccaccgccuuca

SEQ ID NO: 1199208 - RNA, 20 nt, Human
aaaacaccuaaaauugacuc

SEQ ID NO: 1199209 - RNA, 20 nt, Human
aaagggagagauggcauuga

SEQ ID NO: 1199210 - RNA, 20 nt, Human
caagagcacccaguaccugc

SEQ ID NO: 1199211 - RNA, 24 nt, Human
cagcagcugaggccacauggucac

SEQ ID NO: 1199212 - RNA, 19 nt, Human
ccagagcggggucuucggc

SEQ ID NO: 1199213 - RNA, 23 nt, Human
ccgccagagcugcggacaggccc

SEQ ID NO: 1199214 - RNA, 24 nt, Human
cgccagagcugcggacaggccccc

SEQ ID NO: 1199215 - RNA, 21 nt, Human
cgcccaggggauccgcagcag

SEQ ID NO: 1199216 - RNA, 18 nt, Human
cuuaguggcccaaaacac

SEQ ID NO: 1199217 - RNA, 24 nt, Human
cuugccgcggauacuuaguggccc

SEQ ID NO: 1199218 - RNA, 18 nt, Human
gggccugcggggagccgc

SEQ ID NO: 1199219 - RNA, 20 nt, Human
gguggaaagggagagauggc

SEQ ID NO: 1199220 - RNA, 19 nt, Human
gucacagccaaguucagca

SEQ ID NO: 1199221 - RNA, 20 nt, Human
ucagcagguggaaagggaga

SEQ ID NO: 1199222 - RNA, 22 nt, Human
ucccagagcggggucuucggcu

SEQ ID NO: 1199223 - RNA, 19 nt, Human
ugaaccuaugugagaacug

SEQ ID NO: 1199224 - RNA, 21 nt, Human
ugagaacugggaagaugugug

SEQ ID NO: 1199225 - RNA, 24 nt, Human
ugcuaccccuggcacgcccagggg

SEQ ID NO: 1199226 - RNA, 19 nt, Human
uggaaagggagagauggca

SEQ ID NO: 1199227 - RNA, 22 nt, Human
uggggccugcggggagccgcca

SEQ ID NO: 1199228 - RNA, 25 nt, Human
ugugagaacugggaagauguguggg

SEQ ID NO: 1199229 - RNA, 18 nt, Human
cuugcugaauucucuaag

SEQ ID NO: 1199230 - RNA, 21 nt, Human
ucucuugcugaauucucuaag

SEQ ID NO: 1199231 - RNA, 19 nt, Human
ucugugugugugaaaguga

SEQ ID NO: 1199232 - RNA, 21 nt, Human
aggcacacccggggcuguggc

SEQ ID NO: 1199233 - RNA, 21 nt, Human
caccgggugccuucccauucu

SEQ ID NO: 1199234 - RNA, 21 nt, Human
ccgcccagguuggaggguguc

SEQ ID NO: 1199235 - RNA, 21 nt, Human
cgggugccuucccauucuccu

SEQ ID NO: 1199236 - RNA, 22 nt, Human
cuucccauucuccuggcugcca

SEQ ID NO: 1199237 - RNA, 21 nt, Human
gcugacggggagaucuuggac

SEQ ID NO: 1199238 - RNA, 18 nt, Human
ggccgcccagguuggagg

SEQ ID NO: 1199239 - RNA, 20 nt, Human
ggggaugcugacggggagau

SEQ ID NO: 1199240 - RNA, 20 nt, Human
ggggaugcugacggggagau

SEQ ID NO: 1199241 - RNA, 20 nt, Human
ggggaugcugacggggagau

SEQ ID NO: 1199242 - RNA, 21 nt, Human
uauccuggggaugcugacggg

SEQ ID NO: 1199243 - RNA, 21 nt, Human
uauccuggggaugcugacggg

SEQ ID NO: 1199244 - RNA, 22 nt, Human
ugaaaggcagcagccgccuucc

SEQ ID NO: 1199245 - RNA, 22 nt, Human
ugcagcugcuccugcacugggg

SEQ ID NO: 1199246 - RNA, 19 nt, Human
uggcuccucaggcacaccc

SEQ ID NO: 1199247 - RNA, 18 nt, Human
uggcugccagccacuccc

SEQ ID NO: 1199248 - RNA, 18 nt, Human
uggcuggcuccucaggca

SEQ ID NO: 1199249 - RNA, 19 nt, Human
uggggaugcugacggggag

SEQ ID NO: 1199250 - RNA, 19 nt, Human
uggggaugcugacggggag

SEQ ID NO: 1199251 - RNA, 19 nt, Human
uggggaugcugacggggag

SEQ ID NO: 1199252 - RNA, 23 nt, Human
uggggaugcugacggggagaucu

SEQ ID NO: 1199253 - RNA, 23 nt, Human
uggggaugcugacggggagaucu

SEQ ID NO: 1199254 - RNA, 23 nt, Human
uggggaugcugacggggagaucu

SEQ ID NO: 1199255 - RNA, 23 nt, Human
aaaguacagcaaggcagaggcca

SEQ ID NO: 1199256 - RNA, 18 nt, Human
aagcggcccaaagaugac

SEQ ID NO: 1199257 - RNA, 22 nt, Human
aagcggcccaaagaugaccacu

SEQ ID NO: 1199258 - RNA, 24 nt, Human
acacaaagcccccuaagaaagugc

SEQ ID NO: 1199259 - RNA, 21 nt, Human
accaccagcaacacaaagccc

SEQ ID NO: 1199260 - RNA, 23 nt, Human
acgcgccguguagccaggaacac

SEQ ID NO: 1199261 - RNA, 21 nt, Human
agaaagugcauguccagcccc

SEQ ID NO: 1199262 - RNA, 19 nt, Human
agcaaggcagaggccaccc

SEQ ID NO: 1199263 - RNA, 20 nt, Human
agcagcagacccuggggcag

SEQ ID NO: 1199264 - RNA, 19 nt, Human
agccaggcaugguagaggc

SEQ ID NO: 1199265 - RNA, 22 nt, Human
agccaggcaugguagaggcgcc

SEQ ID NO: 1199266 - RNA, 19 nt, Human
aggaaggugugggaggaga

SEQ ID NO: 1199267 - RNA, 18 nt, Human
aggcagaggccacccaga

SEQ ID NO: 1199268 - RNA, 18 nt, Human
aggccacccagagcagca

SEQ ID NO: 1199269 - RNA, 20 nt, Human
aggugugggaggagacggug

SEQ ID NO: 1199270 - RNA, 19 nt, Human
auggaacugcagaagcggc

SEQ ID NO: 1199271 - RNA, 25 nt, Human
auggaacugcagaagcggcccaaag

SEQ ID NO: 1199272 - RNA, 22 nt, Human
caaggcagaggccacccagagc

SEQ ID NO: 1199273 - RNA, 20 nt, Human
caccaccagcaacacaaagc

SEQ ID NO: 1199274 - RNA, 22 nt, Human
cacugguggccggcugccaggc

SEQ ID NO: 1199275 - RNA, 22 nt, Human
cagaggccacccagagcagcac

SEQ ID NO: 1199276 - RNA, 27 nt, Human
cagcaaggcagaggccacccagagcag

SEQ ID NO: 1199277 - RNA, 21 nt, Human
cagcucguggagcagcagacc

SEQ ID NO: 1199278 - RNA, 18 nt, Human
caggagccagucaggucc

SEQ ID NO: 1199279 - RNA, 19 nt, Human
caggggcugcccagaaggc

SEQ ID NO: 1199280 - RNA, 22 nt, Human
ccaccagcaacacaaagccccc

SEQ ID NO: 1199281 - RNA, 21 nt, Human
ccucgaugagcaggaaggccc

SEQ ID NO: 1199282 - RNA, 23 nt, Human
cgaagcaggagccagucaggucc

SEQ ID NO: 1199283 - RNA, 21 nt, Human
cgccacugguggccggcugcc

SEQ ID NO: 1199284 - RNA, 18 nt, Human
gacccuggggcaguggcu

SEQ ID NO: 1199285 - RNA, 21 nt, Human
gagcagcagacccuggggcag

SEQ ID NO: 1199286 - RNA, 24 nt, Human
gagcaggcagcaaaaggugagcaa

SEQ ID NO: 1199287 - RNA, 18 nt, Human
gagcaggcagcccagcag

SEQ ID NO: 1199288 - RNA, 22 nt, Human
gcaaggcagaggccacccagag

SEQ ID NO: 1199289 - RNA, 19 nt, Human
gcagcucguggagcagcag

SEQ ID NO: 1199290 - RNA, 24 nt, Human
gcagcucguggagcagcagacccu

SEQ ID NO: 1199291 - RNA, 19 nt, Human
gccaggaacaccaccagca

SEQ ID NO: 1199292 - RNA, 21 nt, Human
gcggccuguucgcuuccaaag

SEQ ID NO: 1199293 - RNA, 21 nt, Human
gcugccaggcagcugcggcgg

SEQ ID NO: 1199294 - RNA, 19 nt, Human
ggcagaggccacccagagc

SEQ ID NO: 1199295 - RNA, 18 nt, Human
ggcccggccggcuccccg

SEQ ID NO: 1199296 - RNA, 24 nt, Human
gggcggccuguucgcuuccaaagu

SEQ ID NO: 1199297 - RNA, 20 nt, Human
gugggaggagacgguguagc

SEQ ID NO: 1199298 - RNA, 20 nt, Human
uaccagucggcucagguguc

SEQ ID NO: 1199299 - RNA, 18 nt, Human
uauguugaagaaguugcc

SEQ ID NO: 1199300 - RNA, 19 nt, Human
uccagccccaggcugaauu

SEQ ID NO: 1199301 - RNA, 22 nt, Human
ugagcaggcagcccagcagugc

SEQ ID NO: 1199302 - RNA, 19 nt, Human
ugcagaagcggcccaaaga

SEQ ID NO: 1199303 - RNA, 26 nt, Human
ugccagccaggcaugguagaggcgcc

SEQ ID NO: 1199304 - RNA, 20 nt, Human
uggcucgaagcaggagccag

SEQ ID NO: 1199305 - RNA, 19 nt, Human
uguagccaggaacaccacc

SEQ ID NO: 1199306 - RNA, 21 nt, Human
acacaugggaaaggugacugc

SEQ ID NO: 1199307 - RNA, 23 nt, Human
gacacagggugaugccaaagacg

SEQ ID NO: 1199308 - RNA, 24 nt, Human
ugccaaagacgcagaaacacaugg

SEQ ID NO: 1199309 - RNA, 21 nt, Human
ugccauuucugggcucuaaaa

SEQ ID NO: 1199310 - RNA, 19 nt, Human
acugaacgcaggggauucc

SEQ ID NO: 1199311 - RNA, 20 nt, Human
agcuggaucuucuggcacag

SEQ ID NO: 1199312 - RNA, 21 nt, Human
cacacgcucagaagauagcca

SEQ ID NO: 1199313 - RNA, 28 nt, Human
cagccccugagcguccaccuucggcccu

SEQ ID NO: 1199314 - RNA, 24 nt, Human
ccccugagcguccaccuucggccc

SEQ ID NO: 1199315 - RNA, 19 nt, Human
cuggcacacgcucagaaga

SEQ ID NO: 1199316 - RNA, 25 nt, Human
uacuuucauuucugcuaucccugau

SEQ ID NO: 1199317 - RNA, 22 nt, Human
uccgcugagccuccagccccug

SEQ ID NO: 1199318 - RNA, 20 nt, Human
ugaacgcaggggauuccgcu

SEQ ID NO: 1199319 - RNA, 19 nt, Human
ugagggcacuggaaccgcu

SEQ ID NO: 1199320 - RNA, 19 nt, Human
uggaucuucuggcacacgc

SEQ ID NO: 1199321 - RNA, 21 nt, Human
aggaagcggacagaugccaag

SEQ ID NO: 1199322 - RNA, 19 nt, Human
aggcacccaaggggucucc

SEQ ID NO: 1199323 - RNA, 23 nt, Human
aggccuggggcuagcagggggcu

SEQ ID NO: 1199324 - RNA, 22 nt, Human
cagaugccaaggcacccaaggg

SEQ ID NO: 1199325 - RNA, 22 nt, Human
cugagcacccagcggcugagga

SEQ ID NO: 1199326 - RNA, 22 nt, Human
ucugaaaggccuggggcuagca

SEQ ID NO: 1199327 - RNA, 21 nt, Human
ugaggaagcggacagaugcca

SEQ ID NO: 1199328 - RNA, 18 nt, Human
uggggcuagcagggggcu

SEQ ID NO: 1199329 - RNA, 19 nt, Human
accuccuggccacgucucc

SEQ ID NO: 1199330 - RNA, 22 nt, Human
agcaagaccuccuggccacguc

SEQ ID NO: 1199331 - RNA, 18 nt, Human
cacgucuccagcuauacc

SEQ ID NO: 1199332 - RNA, 20 nt, Human
ccuccuggccacgucuccag

SEQ ID NO: 1199333 - RNA, 24 nt, Human
ccuccuggccacgucuccagcuau

SEQ ID NO: 1199334 - RNA, 27 nt, Human
cucaacuccuuuaucagauccuugcag

SEQ ID NO: 1199335 - RNA, 19 nt, Human
cuccuggccacgucuccag

SEQ ID NO: 1199336 - RNA, 21 nt, Human
cuggccacgucuccagcuaua

SEQ ID NO: 1199337 - RNA, 19 nt, Human
cuggguaaagaaugguuca

SEQ ID NO: 1199338 - RNA, 22 nt, Human
guuacuacuggaucauccaaau

SEQ ID NO: 1199339 - RNA, 20 nt, Human
uccuggccacgucuccagcu

SEQ ID NO: 1199340 - RNA, 28 nt, Human
ucuuuaguuuuaagaucuuuguuucacc

SEQ ID NO: 1199341 - RNA, 23 nt, Human
uguuucacccuggguaaagaaug

SEQ ID NO: 1199342 - RNA, 20 nt, Human
uuucacccuggguaaagaau

SEQ ID NO: 1199343 - RNA, 22 nt, Human
aagcaaacuauucauuugaaac

SEQ ID NO: 1199344 - RNA, 22 nt, Human
acagccaaagguaaaagggccu

SEQ ID NO: 1199345 - RNA, 20 nt, Human
acagugagguuuuuguuggc

SEQ ID NO: 1199346 - RNA, 21 nt, Human
accuucuuuggagccacuagu

SEQ ID NO: 1199347 - RNA, 22 nt, Human
agaguucaaccagaugacgcug

SEQ ID NO: 1199348 - RNA, 18 nt, Human
agcucuuuuuuuuuucuu

SEQ ID NO: 1199349 - RNA, 21 nt, Human
auagcucuuuuuuuuuucuuu

SEQ ID NO: 1199350 - RNA, 22 nt, Human
auagcucuuuuuuuuuucuuuu

SEQ ID NO: 1199351 - RNA, 23 nt, Human
auagcucuuuuuuuuuucuuuuu

SEQ ID NO: 1199352 - RNA, 24 nt, Human
auccccagugcuuaaaaaaauuug

SEQ ID NO: 1199353 - RNA, 21 nt, Human
augaaauucucucaaaugagg

SEQ ID NO: 1199354 - RNA, 20 nt, Human
auucauuugaaacaaaacca

SEQ ID NO: 1199355 - RNA, 18 nt, Human
caaagguaaaagggccua

SEQ ID NO: 1199356 - RNA, 21 nt, Human
caucuucaaauccacaaugaa

SEQ ID NO: 1199357 - RNA, 18 nt, Human
caugccagugccugguga

SEQ ID NO: 1199358 - RNA, 21 nt, Human
ccagugcuuaaaaaaauuugu

SEQ ID NO: 1199359 - RNA, 22 nt, Human
ccugaaggucucuucucuacuc

SEQ ID NO: 1199360 - RNA, 21 nt, Human
cguaaggaaaauaaaugccag

SEQ ID NO: 1199361 - RNA, 19 nt, Human
gaaaaccuucucguaagga

SEQ ID NO: 1199362 - RNA, 21 nt, Human
gaaaauaaaugccagcucuuc

SEQ ID NO: 1199363 - RNA, 18 nt, Human
gaaggucucuucucuacu

SEQ ID NO: 1199364 - RNA, 30 nt, Human
gugggauggggauaagguggggagaaaaaa

SEQ ID NO: 1199365 - RNA, 19 nt, Human
uaagcuucugguuuaauua

SEQ ID NO: 1199366 - RNA, 23 nt, Human
uacaaagacucuuucuucaugcc

SEQ ID NO: 1199367 - RNA, 21 nt, Human
uacgaaaaccuucucguaagg

SEQ ID NO: 1199368 - RNA, 18 nt, Human
ucaaauccacaaugaaau

SEQ ID NO: 1199369 - RNA, 21 nt, Human
uccacaaugaaauucucucaa

SEQ ID NO: 1199370 - RNA, 18 nt, Human
uccagaguucaaccagau

SEQ ID NO: 1199371 - RNA, 20 nt, Human
ucuacgaaaaccuucucgua

SEQ ID NO: 1199372 - RNA, 18 nt, Human
ucuucaugccagugccug

SEQ ID NO: 1199373 - RNA, 20 nt, Human
ugaacaaacaaauauuacca

SEQ ID NO: 1199374 - RNA, 19 nt, Human
ugggauggggauaaggugg

SEQ ID NO: 1199375 - RNA, 18 nt, Human
uggggauaagguggggag

SEQ ID NO: 1199376 - RNA, 27 nt, Human
uguccauuuacaaagacucuuucuuca

SEQ ID NO: 1199377 - RNA, 23 nt, Human
uucaauguccauuuacaaagacu

SEQ ID NO: 1199378 - RNA, 22 nt, Human
uucaccaaauuuggugagagga

SEQ ID NO: 1199379 - RNA, 20 nt, Human
uucuuuggagccacuacggu

SEQ ID NO: 1199380 - RNA, 18 nt, Human
uuucaaggaaggguaaca

SEQ ID NO: 1199381 - RNA, 20 nt, Human
uuucuuguugcuguacuuug

SEQ ID NO: 1199382 - RNA, 25 nt, Human
uuuuuuuuuucuuuuuuucauuuuu

SEQ ID NO: 1199383 - RNA, 19 nt, Human
uuuuuuuuuuuuuuuccag

SEQ ID NO: 1199384 - RNA, 24 nt, Human
caacaggaagcugcagacucccag

SEQ ID NO: 1199385 - RNA, 19 nt, Human
caggaagcugcagacuccc

SEQ ID NO: 1199386 - RNA, 19 nt, Human
acucugugguccacuggag

SEQ ID NO: 1199387 - RNA, 24 nt, Human
aaaucccucagcagaggugucucu

SEQ ID NO: 1199388 - RNA, 18 nt, Human
aggagcugaaguucugca

SEQ ID NO: 1199389 - RNA, 19 nt, Human
aggaggagcugaaguucug

SEQ ID NO: 1199390 - RNA, 18 nt, Human
uccgcccgcggacagucc

SEQ ID NO: 1199391 - RNA, 21 nt, Human
uccgcggggacuuucucugga

SEQ ID NO: 1199392 - RNA, 20 nt, Human
ggauuuggaagguugucugu

SEQ ID NO: 1199393 - RNA, 19 nt, Human
uagaugaugccaguggaac

SEQ ID NO: 1199394 - RNA, 20 nt, Human
uggaacuuccaaagaagcau

SEQ ID NO: 1199395 - RNA, 23 nt, Human
aaacacucacagaguaguucccg

SEQ ID NO: 1199396 - RNA, 23 nt, Human
aagcacuugguuccaaucccugg

SEQ ID NO: 1199397 - RNA, 22 nt, Human
auccuccuccuccuccucacca

SEQ ID NO: 1199398 - RNA, 18 nt, Human
augguaaagauaaagcac

SEQ ID NO: 1199399 - RNA, 21 nt, Human
cagaguaguucccgugauuuu

SEQ ID NO: 1199400 - RNA, 21 nt, Human
cagcaugccucaaaauaucaa

SEQ ID NO: 1199401 - RNA, 22 nt, Human
cauccuccuccuccuccucacc

SEQ ID NO: 1199402 - RNA, 22 nt, Human
ccucaaaauaucaacauccucc

SEQ ID NO: 1199403 - RNA, 22 nt, Human
cuccuccucaccaucaucaguc

SEQ ID NO: 1199404 - RNA, 19 nt, Human
cugaagguacuucuacaac

SEQ ID NO: 1199405 - RNA, 24 nt, Human
uaaaacacucacagaguaguuccc

SEQ ID NO: 1199406 - RNA, 23 nt, Human
uccuccucaccaucaucagucgc

SEQ ID NO: 1199407 - RNA, 18 nt, Human
ucgguuucucagugucuu

SEQ ID NO: 1199408 - RNA, 25 nt, Human
uuccaaucccuggagauucuaauuc

SEQ ID NO: 1199409 - RNA, 23 nt, Human
aaggccacauuucgagccacaug

SEQ ID NO: 1199410 - RNA, 20 nt, Human
accccauuuugcccuccccc

SEQ ID NO: 1199411 - RNA, 18 nt, Human
auuuugcccucccccauc

SEQ ID NO: 1199412 - RNA, 23 nt, Human
caacacccagucccagauccaaa

SEQ ID NO: 1199413 - RNA, 22 nt, Human
cacccagucccagauccaaagc

SEQ ID NO: 1199414 - RNA, 19 nt, Human
cacccugcugcuguuccca

SEQ ID NO: 1199415 - RNA, 22 nt, Human
caccgcacccugcugcuguucc

SEQ ID NO: 1199416 - RNA, 23 nt, Human
ccauuuugcccucccccaucaac

SEQ ID NO: 1199417 - RNA, 22 nt, Human
cccaucaacacccagucccaga

SEQ ID NO: 1199418 - RNA, 20 nt, Human
cccugcugcuguucccaagc

SEQ ID NO: 1199419 - RNA, 23 nt, Human
ccgcacccugcugcuguuccccc

SEQ ID NO: 1199420 - RNA, 29 nt, Human
cugcuguucccaagccucucggugaccac

SEQ ID NO: 1199421 - RNA, 23 nt, Human
gcaaaagcuuccuuaacugcgga

SEQ ID NO: 1199422 - RNA, 18 nt, Human
uauggaguucaaugcccg

SEQ ID NO: 1199423 - RNA, 18 nt, Human
ucccagauccaaagccuc

SEQ ID NO: 1199424 - RNA, 22 nt, Human
uccuuaacugcggacggaccuu

SEQ ID NO: 1199425 - RNA, 20 nt, Human
ugcaaaagcuuccuuaacug

SEQ ID NO: 1199426 - RNA, 21 nt, Human
uggccaccgcacccugcugcu

SEQ ID NO: 1199427 - RNA, 26 nt, Human
uuggccaccgcacccugcugcuguuc

SEQ ID NO: 1199428 - RNA, 21 nt, Human
agcaaccccaugcaacacuga

SEQ ID NO: 1199429 - RNA, 25 nt, Human
agcaaccccaugcaacacugaggac

SEQ ID NO: 1199430 - RNA, 25 nt, Human
augcaacacugaggacauccccuca

SEQ ID NO: 1199431 - RNA, 19 nt, Human
cagcaaccccaugcaacac

SEQ ID NO: 1199432 - RNA, 26 nt, Human
caggaagagcaggaugucacugaggc

SEQ ID NO: 1199433 - RNA, 23 nt, Human
caggaagcccaggauguaaacca

SEQ ID NO: 1199434 - RNA, 18 nt, Human
caggccgaugcuuucugc

SEQ ID NO: 1199435 - RNA, 23 nt, Human
cauugcagauggggccuccuggg

SEQ ID NO: 1199436 - RNA, 21 nt, Human
ccacagcaaccccaugcaaca

SEQ ID NO: 1199437 - RNA, 22 nt, Human
ccccuuccccucauucuccaaa

SEQ ID NO: 1199438 - RNA, 22 nt, Human
ccugcucuggggcucugccuuu

SEQ ID NO: 1199439 - RNA, 21 nt, Human
ccugggugcuggaaccagugu

SEQ ID NO: 1199440 - RNA, 24 nt, Human
ccuuccccucauucuccaaaaugg

SEQ ID NO: 1199441 - RNA, 22 nt, Human
cucggccuucaccuucauuggc

SEQ ID NO: 1199442 - RNA, 20 nt, Human
cuggaaccagugucgcagag

SEQ ID NO: 1199443 - RNA, 22 nt, Human
gaugauguaaugcucggccuuc

SEQ ID NO: 1199444 - RNA, 22 nt, Human
gauggggccuccugggugcugg

SEQ ID NO: 1199445 - RNA, 24 nt, Human
gcauugcagauggggccuccuggg

SEQ ID NO: 1199446 - RNA, 23 nt, Human
gcugccgguccugccacuccaga

SEQ ID NO: 1199447 - RNA, 22 nt, Human
ggacauccccucaccucucagg

SEQ ID NO: 1199448 - RNA, 21 nt, Human
uccugggugcuggaaccagug

SEQ ID NO: 1199449 - RNA, 20 nt, Human
uggcauugcagauggggccu

SEQ ID NO: 1199450 - RNA, 20 nt, Human
ugucgcagaggguauggcuu

SEQ ID NO: 1199451 - RNA, 21 nt, Human
uguuucuggcauugcagaugg

SEQ ID NO: 1199452 - RNA, 19 nt, Human
uuccuguuucugagucucc

SEQ ID NO: 1199453 - RNA, 20 nt, Human
uugccgccggcgcccgggcc

SEQ ID NO: 1199454 - RNA, 23 nt, Human
uuucugcuuuuggccccuucccc

SEQ ID NO: 1199455 - RNA, 23 nt, Human
uccucacacuccccaugcacaaa

SEQ ID NO: 1199456 - RNA, 20 nt, Human
agccagacgccugucuuugg

SEQ ID NO: 1199457 - RNA, 21 nt, Human
ggcucuggacuccugcagcca

SEQ ID NO: 1199458 - RNA, 21 nt, Human
aacugcuuucuuaauuaaaug

SEQ ID NO: 1199459 - RNA, 23 nt, Human
acccacccucucuugccaacacc

SEQ ID NO: 1199460 - RNA, 19 nt, Human
agccaaguggugaauccag

SEQ ID NO: 1199461 - RNA, 19 nt, Human
agggaggacucgcuugguc

SEQ ID NO: 1199462 - RNA, 18 nt, Human
auucuuauccuuucuguu

SEQ ID NO: 1199463 - RNA, 24 nt, Human
caacaccacagguaagugcuucca

SEQ ID NO: 1199464 - RNA, 19 nt, Human
caccacacggccacccacc

SEQ ID NO: 1199465 - RNA, 22 nt, Human
caccacacggccacccacccuc

SEQ ID NO: 1199466 - RNA, 21 nt, Human
caccacagguaagugcuucca

SEQ ID NO: 1199467 - RNA, 21 nt, Human
cacccucucuugccaacacca

SEQ ID NO: 1199468 - RNA, 21 nt, Human
cccacccucucuugccaacac

SEQ ID NO: 1199469 - RNA, 19 nt, Human
ccugacaccacacggccac

SEQ ID NO: 1199470 - RNA, 23 nt, Human
ccugacaccacacggccacccac

SEQ ID NO: 1199471 - RNA, 22 nt, Human
ccuuuaaaauagagaggacggg

SEQ ID NO: 1199472 - RNA, 22 nt, Human
cggccacccacccucucuugcc

SEQ ID NO: 1199473 - RNA, 23 nt, Human
gagaucuucagggagaucaggag

SEQ ID NO: 1199474 - RNA, 26 nt, Human
gagcaagucccuuagacuuaagauuu

SEQ ID NO: 1199475 - RNA, 19 nt, Human
ggagggaggacucgcuugg

SEQ ID NO: 1199476 - RNA, 23 nt, Human
ggcagaggcuguagaugauucau

SEQ ID NO: 1199477 - RNA, 19 nt, Human
uaaaauagagaggacgggu

SEQ ID NO: 1199478 - RNA, 21 nt, Human
uccaauugggagggaggacuc

SEQ ID NO: 1199479 - RNA, 21 nt, Human
ugaacagcaacugcuuucuua

SEQ ID NO: 1199480 - RNA, 19 nt, Human
ugacaccacacggccaccc

SEQ ID NO: 1199481 - RNA, 20 nt, Human
ugacuucuggccacuuggcu

SEQ ID NO: 1199482 - RNA, 24 nt, Human
gcaaggaagggccacagucaggga

SEQ ID NO: 1199483 - RNA, 22 nt, Human
ggaaggcaaggaagggccacag

SEQ ID NO: 1199484 - RNA, 18 nt, Human
ggaccuggaaggcaagga

SEQ ID NO: 1199485 - RNA, 21 nt, Human
uggaaggcaaggaagggccac

SEQ ID NO: 1199486 - RNA, 22 nt, Human
accagagggacagcgcacccuc

SEQ ID NO: 1199487 - RNA, 24 nt, Human
cacgaacuccaguacuggucugcg

SEQ ID NO: 1199488 - RNA, 23 nt, Human
cacucugcuaacuuccuggcacu

SEQ ID NO: 1199489 - RNA, 20 nt, Human
cagagggacagcgcacccuc

SEQ ID NO: 1199490 - RNA, 18 nt, Human
cagcaccacgaacuccag

SEQ ID NO: 1199491 - RNA, 21 nt, Human
ccacucugcuaacuuccuggc

SEQ ID NO: 1199492 - RNA, 18 nt, Human
ccagcaccacgaacucca

SEQ ID NO: 1199493 - RNA, 20 nt, Human
cccuccggucgaagcggggu

SEQ ID NO: 1199494 - RNA, 19 nt, Human
ccuacccggggcccagagu

SEQ ID NO: 1199495 - RNA, 19 nt, Human
ccuccggucgaagcggggu

SEQ ID NO: 1199496 - RNA, 21 nt, Human
ccuggcacuuacguuuccuac

SEQ ID NO: 1199497 - RNA, 27 nt, Human
cucauaaugcugcuuuuuguggcaguc

SEQ ID NO: 1199498 - RNA, 19 nt, Human
cuuccagcaccacgaacuc

SEQ ID NO: 1199499 - RNA, 21 nt, Human
gggcccagagucgggcggcgg

SEQ ID NO: 1199500 - RNA, 22 nt, Human
uaacuuccuggcacuuacguuu

SEQ ID NO: 1199501 - RNA, 19 nt, Human
uacuggucugcguuguagg

SEQ ID NO: 1199502 - RNA, 20 nt, Human
uccagcaccacgaacuccag

SEQ ID NO: 1199503 - RNA, 23 nt, Human
ucuuccagcaccacgaacuccag

SEQ ID NO: 1199504 - RNA, 18 nt, Human
aucuacucccucacucca

SEQ ID NO: 1199505 - RNA, 24 nt, Human
ccccuggccuucauccugcccauc

SEQ ID NO: 1199506 - RNA, 23 nt, Human
ccuagugaugcuuaauccuuuuc

SEQ ID NO: 1199507 - RNA, 25 nt, Human
ccucugaucagaacucacuuggagc

SEQ ID NO: 1199508 - RNA, 19 nt, Human
uaucuacucccucacucca

SEQ ID NO: 1199509 - RNA, 18 nt, Human
uguuuuaucuacucccuc

SEQ ID NO: 1199510 - RNA, 24 nt, Human
uguuuuaucuacucccucacucca

SEQ ID NO: 1199511 - RNA, 23 nt, Human
aacaucucuagagcacagcagcg

SEQ ID NO: 1199512 - RNA, 21 nt, Human
acaaaacaucucuagagcaca

SEQ ID NO: 1199513 - RNA, 22 nt, Human
agggccacugcuaguucuuggu

SEQ ID NO: 1199514 - RNA, 21 nt, Human
aggggaaaagguaaaauugga

SEQ ID NO: 1199515 - RNA, 18 nt, Human
agguggcuuuuauuugca

SEQ ID NO: 1199516 - RNA, 20 nt, Human
aguagaggaugcacggcccu

SEQ ID NO: 1199517 - RNA, 21 nt, Human
aguuugaacaagcuccuccca

SEQ ID NO: 1199518 - RNA, 22 nt, Human
caaaaaaaaaacaacaaaccga

SEQ ID NO: 1199519 - RNA, 21 nt, Human
caaaacaucucuagagcacag

SEQ ID NO: 1199520 - RNA, 28 nt, Human
caacaugaacaaauuagaaccuuaaaua

SEQ ID NO: 1199521 - RNA, 18 nt, Human
caccagaaguggcugugu

SEQ ID NO: 1199522 - RNA, 18 nt, Human
cacguagccucuccuccu

SEQ ID NO: 1199523 - RNA, 20 nt, Human
cacguagccucuccuccugu

SEQ ID NO: 1199524 - RNA, 20 nt, Human
cacguugccucuccuccugu

SEQ ID NO: 1199525 - RNA, 23 nt, Human
cacucuggcuuugccuuugacuc

SEQ ID NO: 1199526 - RNA, 22 nt, Human
cacugcuucagcccuacaggaa

SEQ ID NO: 1199527 - RNA, 22 nt, Human
cagcccuacaggaagaacaaaa

SEQ ID NO: 1199528 - RNA, 24 nt, Human
caggaagaacaaaacaucucuaga

SEQ ID NO: 1199529 - RNA, 26 nt, Human
caggaagaacaaaacaucucuagagc

SEQ ID NO: 1199530 - RNA, 21 nt, Human
ccagaaguggcugugucaggg

SEQ ID NO: 1199531 - RNA, 20 nt, Human
ccccaggugagugguaacca

SEQ ID NO: 1199532 - RNA, 18 nt, Human
cccguagauaccuguugc

SEQ ID NO: 1199533 - RNA, 21 nt, Human
cccguagauaccuguugcuga

SEQ ID NO: 1199534 - RNA, 22 nt, Human
cccguagauaccuguugcugaa

SEQ ID NO: 1199535 - RNA, 23 nt, Human
ccuguucacguugccucuccucc

SEQ ID NO: 1199536 - RNA, 23 nt, Human
cguagccucuccuccugucuccu

SEQ ID NO: 1199537 - RNA, 21 nt, Human
cuaagugcccaacaugaacaa

SEQ ID NO: 1199538 - RNA, 21 nt, Human
cuagagcacagcagcguuccu

SEQ ID NO: 1199539 - RNA, 18 nt, Human
cucacaaaaaaaaaacaa

SEQ ID NO: 1199540 - RNA, 24 nt, Human
cucacaaaaaaaaaacaacaaacc

SEQ ID NO: 1199541 - RNA, 21 nt, Human
cuccugucuccuguucaggag

SEQ ID NO: 1199542 - RNA, 21 nt, Human
cucuccagauccuccagggua

SEQ ID NO: 1199543 - RNA, 21 nt, Human
cuggagucaaggggaaaaggu

SEQ ID NO: 1199544 - RNA, 22 nt, Human
cuguuagcuccugcuggaaugc

SEQ ID NO: 1199545 - RNA, 23 nt, Human
cuguucacguagccucuccuccu

SEQ ID NO: 1199546 - RNA, 23 nt, Human
cuguucacguugccucuccuccu

SEQ ID NO: 1199547 - RNA, 22 nt, Human
gccuggagcugucuucccacac

SEQ ID NO: 1199548 - RNA, 26 nt, Human
gcugcacucuggcuuugccuuugacu

SEQ ID NO: 1199549 - RNA, 26 nt, Human
gcuggaaugccagggcucuuccucug

SEQ ID NO: 1199550 - RNA, 21 nt, Human
ggaaugccagggcucuuccuc

SEQ ID NO: 1199551 - RNA, 22 nt, Human
ggccagggguucagccgucugg

SEQ ID NO: 1199552 - RNA, 19 nt, Human
ggcucuggggccagggguu

SEQ ID NO: 1199553 - RNA, 23 nt, Human
gggcucuggggccagggguucag

SEQ ID NO: 1199554 - RNA, 21 nt, Human
ggucucaucuuguagcugcuc

SEQ ID NO: 1199555 - RNA, 20 nt, Human
guagcagaccaguguuaaaa

SEQ ID NO: 1199556 - RNA, 22 nt, Human
ucacaaaaaaaaaacaacaaac

SEQ ID NO: 1199557 - RNA, 21 nt, Human
ucacguagccucuccuccugu

SEQ ID NO: 1199558 - RNA, 20 nt, Human
uccaagcugcacucuggcuu

SEQ ID NO: 1199559 - RNA, 19 nt, Human
ucucaucuuguagcugcuc

SEQ ID NO: 1199560 - RNA, 28 nt, Human
ucucuagcuccuuccuuagggggccgcc

SEQ ID NO: 1199561 - RNA, 22 nt, Human
ucuggagucaaggggaaaaggu

SEQ ID NO: 1199562 - RNA, 20 nt, Human
ucuguaccagauguaucuca

SEQ ID NO: 1199563 - RNA, 23 nt, Human
ucuguaccagauguaucucaugc

SEQ ID NO: 1199564 - RNA, 22 nt, Human
ugaacaagcuccucccaagcuu

SEQ ID NO: 1199565 - RNA, 23 nt, Human
ugagaaggccuaacaaaauggca

SEQ ID NO: 1199566 - RNA, 21 nt, Human
ugagugguaaccaccagaagu

SEQ ID NO: 1199567 - RNA, 22 nt, Human
ugaguugacugauuauugcgga

SEQ ID NO: 1199568 - RNA, 21 nt, Human
ugccuuugacucagguggcuu

SEQ ID NO: 1199569 - RNA, 25 nt, Human
ugcuccaagcugcacucuggcuuug

SEQ ID NO: 1199570 - RNA, 22 nt, Human
ugcuucagcccuacaggaagaa

SEQ ID NO: 1199571 - RNA, 24 nt, Human
uggaaugccagggcucuuccucug

SEQ ID NO: 1199572 - RNA, 26 nt, Human
uggaaugccagggcucuuccucugac

SEQ ID NO: 1199573 - RNA, 25 nt, Human
uguaccagauguaucucaugcuucu

SEQ ID NO: 1199574 - RNA, 22 nt, Human
uguuaaaaagucuggagucaag

SEQ ID NO: 1199575 - RNA, 24 nt, Human
uguucaggagacucaacaucugau

SEQ ID NO: 1199576 - RNA, 23 nt, Human
uuaacaguagcagaccaguguua

SEQ ID NO: 1199577 - RNA, 23 nt, Human
uucagcccuacaggaagaacaaa

SEQ ID NO: 1199578 - RNA, 19 nt, Human
uuccaccucagccuggagc

SEQ ID NO: 1199579 - RNA, 24 nt, Human
uuccucugccaauaugcuuuuaac

SEQ ID NO: 1199580 - RNA, 25 nt, Human
uucuuugcuccaagcugcacucugg

SEQ ID NO: 1199581 - RNA, 18 nt, Human
uugcuccaagcugcacuc

SEQ ID NO: 1199582 - RNA, 18 nt, Human
aacuccuagcccaguccc

SEQ ID NO: 1199583 - RNA, 19 nt, Human
acccugauguccccacuuc

SEQ ID NO: 1199584 - RNA, 19 nt, Human
aggagcagaggcgagucug

SEQ ID NO: 1199585 - RNA, 24 nt, Human
auuucucuuccuuucuucucgcug

SEQ ID NO: 1199586 - RNA, 19 nt, Human
caacuccuagcccaguccc

SEQ ID NO: 1199587 - RNA, 19 nt, Human
cacacccaagcuccugggc

SEQ ID NO: 1199588 - RNA, 21 nt, Human
cacacccugcucgucagcaca

SEQ ID NO: 1199589 - RNA, 22 nt, Human
cacagacucacccccacucucu

SEQ ID NO: 1199590 - RNA, 20 nt, Human
cacucucuggggcuggggcc

SEQ ID NO: 1199591 - RNA, 22 nt, Human
cagcacacccaagcuccugggc

SEQ ID NO: 1199592 - RNA, 23 nt, Human
cauccuccauuccguccaacucc

SEQ ID NO: 1199593 - RNA, 23 nt, Human
ccaaacacagacucacccccacu

SEQ ID NO: 1199594 - RNA, 20 nt, Human
ccaacuccuagcccaguccc

SEQ ID NO: 1199595 - RNA, 24 nt, Human
ccacuggaccacaggagcagaggc

SEQ ID NO: 1199596 - RNA, 19 nt, Human
ccacuuccaaguccugacu

SEQ ID NO: 1199597 - RNA, 22 nt, Human
ccacuuccaaguccugacuccu

SEQ ID NO: 1199598 - RNA, 20 nt, Human
ccagcucccagccugggagu

SEQ ID NO: 1199599 - RNA, 19 nt, Human
ccucuggcuucuucuggga

SEQ ID NO: 1199600 - RNA, 21 nt, Human
ccugggcuacuggggcuccua

SEQ ID NO: 1199601 - RNA, 21 nt, Human
ccuuucuucucgcuguccucc

SEQ ID NO: 1199602 - RNA, 21 nt, Human
cgcugcagcuucuccauggcc

SEQ ID NO: 1199603 - RNA, 22 nt, Human
cgcugcagcuucuccauggccc

SEQ ID NO: 1199604 - RNA, 23 nt, Human
cuccccaaacacagacucacccc

SEQ ID NO: 1199605 - RNA, 22 nt, Human
cuccuagcccagucccgggggc

SEQ ID NO: 1199606 - RNA, 24 nt, Human
cucuuccuuucuucucgcuguccu

SEQ ID NO: 1199607 - RNA, 22 nt, Human
cugcagcuucuccauggccccc

SEQ ID NO: 1199608 - RNA, 24 nt, Human
cuggggcuggggccgcuaccucug

SEQ ID NO: 1199609 - RNA, 21 nt, Human
cuuccuuucuucucgcugucc

SEQ ID NO: 1199610 - RNA, 25 nt, Human
gcccacacuuugcauuucucuuccu

SEQ ID NO: 1199611 - RNA, 25 nt, Human
gcugcagcuucuccauggcccccug

SEQ ID NO: 1199612 - RNA, 18 nt, Human
gcugcccacacuuugcau

SEQ ID NO: 1199613 - RNA, 20 nt, Human
ggcccggugggucuccccaa

SEQ ID NO: 1199614 - RNA, 23 nt, Human
gggcuacuggggcuccuagaguc

SEQ ID NO: 1199615 - RNA, 21 nt, Human
ggggcuccuagagugggcuca

SEQ ID NO: 1199616 - RNA, 20 nt, Human
ggggcuggggccgcuaccuc

SEQ ID NO: 1199617 - RNA, 24 nt, Human
gugggucuccccaaacacagacuc

SEQ ID NO: 1199618 - RNA, 22 nt, Human
uccccaaacacagacucacccc

SEQ ID NO: 1199619 - RNA, 19 nt, Human
uccggccacuggaccacag

SEQ ID NO: 1199620 - RNA, 21 nt, Human
uccggccacuggaccacagga

SEQ ID NO: 1199621 - RNA, 21 nt, Human
ucgcugcagcuucuccauggc

SEQ ID NO: 1199622 - RNA, 23 nt, Human
ucuccccaaacacagacucaccc

SEQ ID NO: 1199623 - RNA, 20 nt, Human
ugacuccuuugagccauccc

SEQ ID NO: 1199624 - RNA, 22 nt, Human
ugccagggcagguauccagcuc

SEQ ID NO: 1199625 - RNA, 26 nt, Human
uggauuuccuucagcuacccugaugu

SEQ ID NO: 1199626 - RNA, 24 nt, Human
uggggcuggggccgcuaccucugg

SEQ ID NO: 1199627 - RNA, 24 nt, Human
uguccggccacuggaccacaggag

SEQ ID NO: 1199628 - RNA, 18 nt, Human
uguggauuuccuucagcu

SEQ ID NO: 1199629 - RNA, 20 nt, Human
uuccguccaacuccuagccc

SEQ ID NO: 1199630 - RNA, 18 nt, Human
uuggcggcugcccacacu

SEQ ID NO: 1199631 - RNA, 20 nt, Human
uuggcggcugcccacacuuu

SEQ ID NO: 1199632 - RNA, 22 nt, Human
agcugccuucuucaccugaagc

SEQ ID NO: 1199633 - RNA, 21 nt, Human
gaaguuuuuggaccagccuuc

SEQ ID NO: 1199634 - RNA, 26 nt, Human
gagcugccuucuucaccugaagccga

SEQ ID NO: 1199635 - RNA, 22 nt, Human
uaagggaaucagaacuuccccu

SEQ ID NO: 1199636 - RNA, 21 nt, Human
ucacugguuuccucugaucgu

SEQ ID NO: 1199637 - RNA, 25 nt, Human
uuggaccagccuucuguuuuugagu

SEQ ID NO: 1199638 - RNA, 27 nt, Human
uuuuuggaccagccuucuguuuuugag

SEQ ID NO: 1199639 - RNA, 19 nt, Human
aagcgcaacucugagaaca

SEQ ID NO: 1199640 - RNA, 23 nt, Human
acucugagaacacacugagagaa

SEQ ID NO: 1199641 - RNA, 25 nt, Human
acucugagaacacacugagagaaaa

SEQ ID NO: 1199642 - RNA, 20 nt, Human
agguagcacaggaaugaucc

SEQ ID NO: 1199643 - RNA, 22 nt, Human
caaaagcgcaacucugagaaca

SEQ ID NO: 1199644 - RNA, 21 nt, Human
gagcugugcgguucuaaaggg

SEQ ID NO: 1199645 - RNA, 22 nt, Human
gaucuugaucggaacuugggug

SEQ ID NO: 1199646 - RNA, 20 nt, Human
gggcuggaaggaaagguggg

SEQ ID NO: 1199647 - RNA, 21 nt, Human
uagcacaggaaugauccucuu

SEQ ID NO: 1199648 - RNA, 23 nt, Human
ucggaacuuggguggagauucca

SEQ ID NO: 1199649 - RNA, 25 nt, Human
ucugagaacacacugagagaaaaca

SEQ ID NO: 1199650 - RNA, 26 nt, Human
ugaagcagguagcacaggaaugaucc

SEQ ID NO: 1199651 - RNA, 21 nt, Human
ugggaaccacuccucaaaagc

SEQ ID NO: 1199652 - RNA, 23 nt, Human
ugugaagcagguagcacaggaau

SEQ ID NO: 1199653 - RNA, 23 nt, Human
uugguaguaguacggucaccauu

SEQ ID NO: 1199654 - RNA, 19 nt, Human
caacuuggggcauugaugu

SEQ ID NO: 1199655 - RNA, 19 nt, Human
cagaggucucucuucauuu

SEQ ID NO: 1199656 - RNA, 20 nt, Human
gccuugguuccuuuagucug

SEQ ID NO: 1199657 - RNA, 25 nt, Human
uaaguuggggauccagaggucucuc

SEQ ID NO: 1199658 - RNA, 18 nt, Human
ugccuugguuccuuuagu

SEQ ID NO: 1199659 - RNA, 19 nt, Human
ugccuugguuccuuuaguc

SEQ ID NO: 1199660 - RNA, 24 nt, Human
aaaaaagaaagccaaaguggucca

SEQ ID NO: 1199661 - RNA, 24 nt, Human
aaaaaguacugauuuuaaaaacua

SEQ ID NO: 1199662 - RNA, 26 nt, Human
aaacaguuaugagaccauucuuccac

SEQ ID NO: 1199663 - RNA, 24 nt, Human
aaaugggucucaaaauucugugac

SEQ ID NO: 1199664 - RNA, 21 nt, Human
aacuuuuuaaaugggucucaa

SEQ ID NO: 1199665 - RNA, 23 nt, Human
aaugggucucaaaauucugugac

SEQ ID NO: 1199666 - RNA, 24 nt, Human
aaugggucucaaaauucugugaca

SEQ ID NO: 1199667 - RNA, 23 nt, Human
agaaagccaaagugguccacaaa

SEQ ID NO: 1199668 - RNA, 26 nt, Human
agaaagccaaagugguccacaaaaca

SEQ ID NO: 1199669 - RNA, 23 nt, Human
agauccuugacagacacauucuu

SEQ ID NO: 1199670 - RNA, 18 nt, Human
caaaacauucuccuuucc

SEQ ID NO: 1199671 - RNA, 19 nt, Human
caaagauccuugacagaca

SEQ ID NO: 1199672 - RNA, 21 nt, Human
caaaguugccacgacaaagau

SEQ ID NO: 1199673 - RNA, 22 nt, Human
caaauuuuuggccaaguuguuu

SEQ ID NO: 1199674 - RNA, 24 nt, Human
cacgacaaagauccuugacagaca

SEQ ID NO: 1199675 - RNA, 25 nt, Human
cacgacaaagauccuugacagacac

SEQ ID NO: 1199676 - RNA, 22 nt, Human
cagcaaaguugccacgacaaag

SEQ ID NO: 1199677 - RNA, 22 nt, Human
cagccuccuucucaaauuuuca

SEQ ID NO: 1199678 - RNA, 19 nt, Human
cauggugccuuuugacaga

SEQ ID NO: 1199679 - RNA, 24 nt, Human
ccagcagugguggacuugcccgaa

SEQ ID NO: 1199680 - RNA, 21 nt, Human
cccacauuguccccaggaaga

SEQ ID NO: 1199681 - RNA, 18 nt, Human
ccccaggaagagcuucac

SEQ ID NO: 1199682 - RNA, 22 nt, Human
cucccauuuuggcuuuuagggg

SEQ ID NO: 1199683 - RNA, 19 nt, Human
cuucugagcuuucuaggca

SEQ ID NO: 1199684 - RNA, 23 nt, Human
gacaaagauccuugacagacaca

SEQ ID NO: 1199685 - RNA, 23 nt, Human
gcaaaaaagaaagccaaaguggu

SEQ ID NO: 1199686 - RNA, 24 nt, Human
gccaaguuguuuccauuaaaaagu

SEQ ID NO: 1199687 - RNA, 22 nt, Human
ggauaauauucauuuagccuuc

SEQ ID NO: 1199688 - RNA, 22 nt, Human
ggcuaccuugccagcuccagca

SEQ ID NO: 1199689 - RNA, 23 nt, Human
gucaccagcaaaguugccacgac

SEQ ID NO: 1199690 - RNA, 18 nt, Human
uaccuugccagcuccagc

SEQ ID NO: 1199691 - RNA, 21 nt, Human
uaccuugccagcuccagcagc

SEQ ID NO: 1199692 - RNA, 18 nt, Human
uagccuucugagcuuucu

SEQ ID NO: 1199693 - RNA, 24 nt, Human
uauuagggauaauauucauuuagc

SEQ ID NO: 1199694 - RNA, 25 nt, Human
uauuagggauaauauucauuuagcc

SEQ ID NO: 1199695 - RNA, 25 nt, Human
uauuagggauaauauucauuuagcc

SEQ ID NO: 1199696 - RNA, 26 nt, Human
uauuagggauaauauucauuuagccu

SEQ ID NO: 1199697 - RNA, 21 nt, Human
ucaccagcaaaguugccacga

SEQ ID NO: 1199698 - RNA, 19 nt, Human
ucacucaaaucuucauggu

SEQ ID NO: 1199699 - RNA, 26 nt, Human
ucucccauuuuggcuuuuaggggaag

SEQ ID NO: 1199700 - RNA, 23 nt, Human
ucuuuugucaaugccacugcauu

SEQ ID NO: 1199701 - RNA, 22 nt, Human
ugaaacaaacaguuaugagacc

SEQ ID NO: 1199702 - RNA, 18 nt, Human
ugagaccauucuuccacc

SEQ ID NO: 1199703 - RNA, 23 nt, Human
ugcaucguugucauuaaccaguc

SEQ ID NO: 1199704 - RNA, 24 nt, Human
ugcaucguugucauuaaccagucu

SEQ ID NO: 1199705 - RNA, 21 nt, Human
ugcauuuguagaucagauggc

SEQ ID NO: 1199706 - RNA, 28 nt, Human
ugccacgacaaagauccuugacagacac

SEQ ID NO: 1199707 - RNA, 24 nt, Human
uggcagguauuagggauaauauuc

SEQ ID NO: 1199708 - RNA, 22 nt, Human
ugguccacaaaacauucuccuu

SEQ ID NO: 1199709 - RNA, 24 nt, Human
uuaaacuuuuuaaaugggucucaa

SEQ ID NO: 1199710 - RNA, 24 nt, Human
uuaagugcccaauugaaacaaaca

SEQ ID NO: 1199711 - RNA, 19 nt, Human
uucauggugccuuuugaca

SEQ ID NO: 1199712 - RNA, 18 nt, Human
uuccaccacugauuaaga

SEQ ID NO: 1199713 - RNA, 23 nt, Human
uucuccuuuccuucugaauguuu

SEQ ID NO: 1199714 - RNA, 23 nt, Human
uugaagcccacauuguccccagg

SEQ ID NO: 1199715 - RNA, 20 nt, Human
uuucuaggcagacuuggcua

SEQ ID NO: 1199716 - RNA, 19 nt, Human
aaggggcgcagugagcugg

SEQ ID NO: 1199717 - RNA, 18 nt, Human
acaccagaucuuccaaag

SEQ ID NO: 1199718 - RNA, 22 nt, Human
acaccagaucuuccaaagcagu

SEQ ID NO: 1199719 - RNA, 18 nt, Human
acagaugucuccgaagga

SEQ ID NO: 1199720 - RNA, 23 nt, Human
accucaccuuucccuccccucaa

SEQ ID NO: 1199721 - RNA, 18 nt, Human
agaucuuccaaagcaguu

SEQ ID NO: 1199722 - RNA, 18 nt, Human
agauggaggcugggccaa

SEQ ID NO: 1199723 - RNA, 22 nt, Human
aggcugggccaccuguucuggg

SEQ ID NO: 1199724 - RNA, 26 nt, Human
aggguccugguuuaauggcucugugu

SEQ ID NO: 1199725 - RNA, 24 nt, Human
augccuggcccugagauucuggcu

SEQ ID NO: 1199726 - RNA, 25 nt, Human
caccacugccgucggcuccggccca

SEQ ID NO: 1199727 - RNA, 20 nt, Human
caccguuggugaugcugauc

SEQ ID NO: 1199728 - RNA, 23 nt, Human
caggguccugguuuaauggcucu

SEQ ID NO: 1199729 - RNA, 20 nt, Human
ccagacagaugucuccgaag

SEQ ID NO: 1199730 - RNA, 19 nt, Human
ccccucaaaaauggaugua

SEQ ID NO: 1199731 - RNA, 21 nt, Human
ccgcugccaccacugccgucg

SEQ ID NO: 1199732 - RNA, 28 nt, Human
ccgcugccaccacugccgucggcuccgg

SEQ ID NO: 1199733 - RNA, 24 nt, Human
ccguaugugggggaugccaacccc

SEQ ID NO: 1199734 - RNA, 22 nt, Human
ccguggaaggcggcaggaagcg

SEQ ID NO: 1199735 - RNA, 23 nt, Human
ccucaccuuucccuccccucaaa

SEQ ID NO: 1199736 - RNA, 24 nt, Human
ccuuccgacaaugaauucugcugc

SEQ ID NO: 1199737 - RNA, 20 nt, Human
cggcaggaagcggaacacgg

SEQ ID NO: 1199738 - RNA, 21 nt, Human
cucaauauacuucugacccca

SEQ ID NO: 1199739 - RNA, 19 nt, Human
cucgggaccccuaaccuca

SEQ ID NO: 1199740 - RNA, 19 nt, Human
cuucugaccccaucauccc

SEQ ID NO: 1199741 - RNA, 18 nt, Human
cuuguaaagccugcucuu

SEQ ID NO: 1199742 - RNA, 19 nt, Human
gaacacggaggccuuuccc

SEQ ID NO: 1199743 - RNA, 20 nt, Human
gacaagcuuguauguagauu

SEQ ID NO: 1199744 - RNA, 18 nt, Human
gagcuacaccagaucuuc

SEQ ID NO: 1199745 - RNA, 21 nt, Human
gagcuacaccagaucuuccaa

SEQ ID NO: 1199746 - RNA, 21 nt, Human
gaugccuggcccugagauucu

SEQ ID NO: 1199747 - RNA, 19 nt, Human
gccgcugccucgcuuucgc

SEQ ID NO: 1199748 - RNA, 26 nt, Human
gccuggcccugagauucuggcuucac

SEQ ID NO: 1199749 - RNA, 21 nt, Human
ggauggauagacaagcuugua

SEQ ID NO: 1199750 - RNA, 21 nt, Human
ggcugggccaccuguucuggg

SEQ ID NO: 1199751 - RNA, 18 nt, Human
guccagggcccagaugcc

SEQ ID NO: 1199752 - RNA, 19 nt, Human
uacaccagaucuuccaaag

SEQ ID NO: 1199753 - RNA, 25 nt, Human
uaccguggaaggcggcaggaagcgg

SEQ ID NO: 1199754 - RNA, 21 nt, Human
uagucuucuuccugaccacac

SEQ ID NO: 1199755 - RNA, 24 nt, Human
uauagucuucuuccugaccacacc

SEQ ID NO: 1199756 - RNA, 19 nt, Human
uauuuccuuccgacaauga

SEQ ID NO: 1199757 - RNA, 25 nt, Human
ucagcuaauauaaguacaguuuuca

SEQ ID NO: 1199758 - RNA, 21 nt, Human
uccaaagcaguuuauauuucc

SEQ ID NO: 1199759 - RNA, 25 nt, Human
ucccucuaagucucucgggaccccc

SEQ ID NO: 1199760 - RNA, 18 nt, Human
uccgggcuggaaaagggg

SEQ ID NO: 1199761 - RNA, 24 nt, Human
ucggucaggauucuuuguuuguuu

SEQ ID NO: 1199762 - RNA, 20 nt, Human
ucuaagucucucgggacccu

SEQ ID NO: 1199763 - RNA, 20 nt, Human
ucucuaaauacccuguuggg

SEQ ID NO: 1199764 - RNA, 21 nt, Human
ucucuaaauacccuguugggg

SEQ ID NO: 1199765 - RNA, 18 nt, Human
ucuuguacagcaacuggg

SEQ ID NO: 1199766 - RNA, 18 nt, Human
ugaagcaucuuguaaagc

SEQ ID NO: 1199767 - RNA, 19 nt, Human
ugacccaauccaggaguaa

SEQ ID NO: 1199768 - RNA, 19 nt, Human
ugagagacgaagauggagg

SEQ ID NO: 1199769 - RNA, 21 nt, Human
ugcacagaagggccagcuuua

SEQ ID NO: 1199770 - RNA, 22 nt, Human
ugccaccacugccgucggcucc

SEQ ID NO: 1199771 - RNA, 22 nt, Human
ugccugcugugcugcuuucugc

SEQ ID NO: 1199772 - RNA, 21 nt, Human
uggugaugcugaucgccagac

SEQ ID NO: 1199773 - RNA, 20 nt, Human
ugguugccugccaggccgca

SEQ ID NO: 1199774 - RNA, 21 nt, Human
ugugaaccuucuugaacagaa

SEQ ID NO: 1199775 - RNA, 22 nt, Human
ugugaagggcuucuagcgguua

SEQ ID NO: 1199776 - RNA, 22 nt, Human
uguuacugugaacccuuuggca

SEQ ID NO: 1199777 - RNA, 22 nt, Human
uucaccguuggugaugcugauc

SEQ ID NO: 1199778 - RNA, 18 nt, Human
uucuggcuucacuaccac

SEQ ID NO: 1199779 - RNA, 19 nt, Human
uugguugguugccugccag

SEQ ID NO: 1199780 - RNA, 21 nt, Human
uugugcucuaugcaggaugga

SEQ ID NO: 1199781 - RNA, 24 nt, Human
ucaaugccauauuccuggggaaac

SEQ ID NO: 1199782 - RNA, 21 nt, Human
ucaaugccauauuccugguua

SEQ ID NO: 1199783 - RNA, 21 nt, Human
accccaagugcagacccgcac

SEQ ID NO: 1199784 - RNA, 19 nt, Human
ccaagugcagacccgcacu

SEQ ID NO: 1199785 - RNA, 23 nt, Human
ccgcacuucguguaacuccuacc

SEQ ID NO: 1199786 - RNA, 23 nt, Human
cgugcugaccaccccaagugcag

SEQ ID NO: 1199787 - RNA, 20 nt, Human
uccacauccaaaguucuguu

SEQ ID NO: 1199788 - RNA, 20 nt, Human
ugaccaccccaagugcagac

SEQ ID NO: 1199789 - RNA, 24 nt, Human
ugcacguuccacauccaaaguucu

SEQ ID NO: 1199790 - RNA, 18 nt, Human
aaauauccaccccaaaag

SEQ ID NO: 1199791 - RNA, 22 nt, Human
agucacugagcaaauauccacc

SEQ ID NO: 1199792 - RNA, 22 nt, Human
caaaagggacauggaggccaau

SEQ ID NO: 1199793 - RNA, 23 nt, Human
ccaauggaccacucagaacacga

SEQ ID NO: 1199794 - RNA, 22 nt, Human
ccacucagaacacgaugaccaa

SEQ ID NO: 1199795 - RNA, 21 nt, Human
cccaaaagggacauggaggcc

SEQ ID NO: 1199796 - RNA, 21 nt, Human
cucagaacacgaugaccaagc

SEQ ID NO: 1199797 - RNA, 19 nt, Human
uccaccccaaaagggacau

SEQ ID NO: 1199798 - RNA, 22 nt, Human
ugagcaaauauccaccccaaaa

SEQ ID NO: 1199799 - RNA, 22 nt, Human
auuaggaacguuugaccaaaca

SEQ ID NO: 1199800 - RNA, 18 nt, Human
caccgacacaauggaaaa

SEQ ID NO: 1199801 - RNA, 20 nt, Human
ccacgugauggaaauggagc

SEQ ID NO: 1199802 - RNA, 19 nt, Human
cccgcgccgcgccgcgccg

SEQ ID NO: 1199803 - RNA, 18 nt, Human
ccgcccgcgccgcgccgc

SEQ ID NO: 1199804 - RNA, 22 nt, Human
cgacacaauggaaaagaaaucc

SEQ ID NO: 1199805 - RNA, 22 nt, Human
cgccgcccgcgccgcgccgcgc

SEQ ID NO: 1199806 - RNA, 23 nt, Human
gaaaagaaauccucgaagguaga

SEQ ID NO: 1199807 - RNA, 19 nt, Human
gaggaggcgccggccuucc

SEQ ID NO: 1199808 - RNA, 18 nt, Human
gcauguaaaaaagacacc

SEQ ID NO: 1199809 - RNA, 22 nt, Human
gcauguaaaaaagacaccgaca

SEQ ID NO: 1199810 - RNA, 22 nt, Human
uaaaaaagacaccgacacaaug

SEQ ID NO: 1199811 - RNA, 24 nt, Human
ucugcaggaaagaagagaaagggc

SEQ ID NO: 1199812 - RNA, 23 nt, Human
uggaaauggagcugcaagugaca

SEQ ID NO: 1199813 - RNA, 23 nt, Human
aaaaaccuuugauggcucacuaa

SEQ ID NO: 1199814 - RNA, 20 nt, Human
aaacagcaaaaagucuaagg

SEQ ID NO: 1199815 - RNA, 23 nt, Human
aaaucacaaaaagcuucuggaac

SEQ ID NO: 1199816 - RNA, 26 nt, Human
aaaucacaaaaagcuucuggaacuua

SEQ ID NO: 1199817 - RNA, 18 nt, Human
aacagacaggacccucag

SEQ ID NO: 1199818 - RNA, 23 nt, Human
aaccaucucuccaagaaaacaga

SEQ ID NO: 1199819 - RNA, 18 nt, Human
aagaaaacagaacauuug

SEQ ID NO: 1199820 - RNA, 21 nt, Human
aagacugaccucuguugagac

SEQ ID NO: 1199821 - RNA, 21 nt, Human
aaucugucuacuguccccccu

SEQ ID NO: 1199822 - RNA, 18 nt, Human
aauuuuaacuaaugucag

SEQ ID NO: 1199823 - RNA, 23 nt, Human
acaaaaagcuucuggaacuuaga

SEQ ID NO: 1199824 - RNA, 24 nt, Human
agaaagguaucuuuugacacccuc

SEQ ID NO: 1199825 - RNA, 18 nt, Human
agacaguuguuaaacucu

SEQ ID NO: 1199826 - RNA, 18 nt, Human
agcaaaaagucuaagguu

SEQ ID NO: 1199827 - RNA, 23 nt, Human
agcaaaaagucuaagguuuuagc

SEQ ID NO: 1199828 - RNA, 19 nt, Human
aggaggagagugcucugcu

SEQ ID NO: 1199829 - RNA, 24 nt, Human
aggcaggcaggcccccuugagcuu

SEQ ID NO: 1199830 - RNA, 20 nt, Human
aggcugcucgggggucaggg

SEQ ID NO: 1199831 - RNA, 21 nt, Human
auaaacagcaaaaagucuaag

SEQ ID NO: 1199832 - RNA, 20 nt, Human
augcugggagcuguagaccg

SEQ ID NO: 1199833 - RNA, 18 nt, Human
auggagcaauaaaaacca

SEQ ID NO: 1199834 - RNA, 22 nt, Human
auuucauucauuucaucuucca

SEQ ID NO: 1199835 - RNA, 23 nt, Human
caaagcaguguuaauaacccuua

SEQ ID NO: 1199836 - RNA, 21 nt, Human
caaaucacaaaaagcuucugg

SEQ ID NO: 1199837 - RNA, 21 nt, Human
cacccacuguccugcacccac

SEQ ID NO: 1199838 - RNA, 20 nt, Human
cagcagcgguggcugcagaa

SEQ ID NO: 1199839 - RNA, 22 nt, Human
cagcauccuccucacaauaucu

SEQ ID NO: 1199840 - RNA, 19 nt, Human
cagcugcaggucuguugga

SEQ ID NO: 1199841 - RNA, 19 nt, Human
caggcccccuugagcugug

SEQ ID NO: 1199842 - RNA, 22 nt, Human
caggcgccccucccccagccuc

SEQ ID NO: 1199843 - RNA, 24 nt, Human
cagggacauuuaagucugcagagg

SEQ ID NO: 1199844 - RNA, 24 nt, Human
ccagagguggagccuacagaggca

SEQ ID NO: 1199845 - RNA, 25 nt, Human
ccaucagccucugccuauauaccuc

SEQ ID NO: 1199846 - RNA, 24 nt, Human
ccaucucuccaagaaaacagaaca

SEQ ID NO: 1199847 - RNA, 22 nt, Human
ccccagagguggagccuacaga

SEQ ID NO: 1199848 - RNA, 19 nt, Human
cccccucccacuaucuuag

SEQ ID NO: 1199849 - RNA, 18 nt, Human
cccuacucccaaaucaca

SEQ ID NO: 1199850 - RNA, 20 nt, Human
cccuacugggggaugccucc

SEQ ID NO: 1199851 - RNA, 25 nt, Human
ccucugaaguaauuuagcucaaccc

SEQ ID NO: 1199852 - RNA, 18 nt, Human
ccugggugucagcagcgg

SEQ ID NO: 1199853 - RNA, 19 nt, Human
cggcaggcgccccuccccc

SEQ ID NO: 1199854 - RNA, 20 nt, Human
cucacaaaauaucaaauaau

SEQ ID NO: 1199855 - RNA, 19 nt, Human
cucgcgcacggugugcugc

SEQ ID NO: 1199856 - RNA, 18 nt, Human
cucuguuuuuuccccauc

SEQ ID NO: 1199857 - RNA, 21 nt, Human
cugccccuacugggggaugcc

SEQ ID NO: 1199858 - RNA, 21 nt, Human
cugccccuacugggggaugcc

SEQ ID NO: 1199859 - RNA, 24 nt, Human
cugcugccugaucguuccucugga

SEQ ID NO: 1199860 - RNA, 20 nt, Human
cuuuguuccguugcugguga

SEQ ID NO: 1199861 - RNA, 21 nt, Human
gaagacgagugaagaugauca

SEQ ID NO: 1199862 - RNA, 20 nt, Human
gaagccuucuucucucaacu

SEQ ID NO: 1199863 - RNA, 23 nt, Human
gaagucacugagcauucaaggaa

SEQ ID NO: 1199864 - RNA, 18 nt, Human
gacacuggcuaacucucc

SEQ ID NO: 1199865 - RNA, 19 nt, Human
gagaaauccuuauucugcc

SEQ ID NO: 1199866 - RNA, 19 nt, Human
gagaugccaucaaacaugg

SEQ ID NO: 1199867 - RNA, 24 nt, Human
gagcaauaaaaaccaucucuccaa

SEQ ID NO: 1199868 - RNA, 22 nt, Human
gcacccacugucuggcacuccc

SEQ ID NO: 1199869 - RNA, 19 nt, Human
gccacugguuuccaaacag

SEQ ID NO: 1199870 - RNA, 22 nt, Human
gcuuaaaaaccuuugauggcuc

SEQ ID NO: 1199871 - RNA, 21 nt, Human
ggaaaaggacaaagaagaaag

SEQ ID NO: 1199872 - RNA, 26 nt, Human
ggagacagguaagaagucacugagca

SEQ ID NO: 1199873 - RNA, 18 nt, Human
ggcaggcgccccuccccc

SEQ ID NO: 1199874 - RNA, 19 nt, Human
ggcuaguacagaaaaaggc

SEQ ID NO: 1199875 - RNA, 21 nt, Human
gggcucaugggugcagguguu

SEQ ID NO: 1199876 - RNA, 20 nt, Human
ggugcugcauugcaguuuga

SEQ ID NO: 1199877 - RNA, 21 nt, Human
gugaggcacuguguuccuuug

SEQ ID NO: 1199878 - RNA, 20 nt, Human
guuccuuuggaggaggagag

SEQ ID NO: 1199879 - RNA, 19 nt, Human
uaacagacaggacccucag

SEQ ID NO: 1199880 - RNA, 21 nt, Human
uaacagacaggacccucagcu

SEQ ID NO: 1199881 - RNA, 23 nt, Human
uaacauaaacagcaaaaagucua

SEQ ID NO: 1199882 - RNA, 18 nt, Human
uaagguuuuagccugaaa

SEQ ID NO: 1199883 - RNA, 21 nt, Human
uaccaaauaauccacauacac

SEQ ID NO: 1199884 - RNA, 23 nt, Human
uagaagauauuauaauuucugau

SEQ ID NO: 1199885 - RNA, 18 nt, Human
ucagauggaaaugcagaa

SEQ ID NO: 1199886 - RNA, 20 nt, Human
uccaaguacacuagcuagug

SEQ ID NO: 1199887 - RNA, 20 nt, Human
ucccaaaucacaaaaagcuu

SEQ ID NO: 1199888 - RNA, 18 nt, Human
ucccccagccucggugcu

SEQ ID NO: 1199889 - RNA, 19 nt, Human
uccccccaggugagucccu

SEQ ID NO: 1199890 - RNA, 24 nt, Human
uccucacaauaucucugagagaug

SEQ ID NO: 1199891 - RNA, 24 nt, Human
ucucagaucuccagcugcgugcug

SEQ ID NO: 1199892 - RNA, 21 nt, Human
ucucuggaucuuugcugggga

SEQ ID NO: 1199893 - RNA, 21 nt, Human
ucucuguggugaagacugacc

SEQ ID NO: 1199894 - RNA, 20 nt, Human
ucugcauucuucacauaguu

SEQ ID NO: 1199895 - RNA, 19 nt, Human
ucugcguugcucaugcugg

SEQ ID NO: 1199896 - RNA, 21 nt, Human
ucugugcccugcccccagagg

SEQ ID NO: 1199897 - RNA, 21 nt, Human
ucuuugacuaggaaagggaac

SEQ ID NO: 1199898 - RNA, 24 nt, Human
ugacaaaggaaaaggacaaagaag

SEQ ID NO: 1199899 - RNA, 19 nt, Human
ugacccgguuuuccaggug

SEQ ID NO: 1199900 - RNA, 20 nt, Human
ugacccgguuuuccaggugu

SEQ ID NO: 1199901 - RNA, 22 nt, Human
ugaccugcaaaugcugcugccu

SEQ ID NO: 1199902 - RNA, 26 nt, Human
ugagaaaugagguaaaaaaacuucaa

SEQ ID NO: 1199903 - RNA, 21 nt, Human
ugaguggcucucuggaucuuu

SEQ ID NO: 1199904 - RNA, 18 nt, Human
ugcagugcagcauccucc

SEQ ID NO: 1199905 - RNA, 23 nt, Human
ugcagugcagcauccuccucaca

SEQ ID NO: 1199906 - RNA, 18 nt, Human
ugcccugcccccagaggu

SEQ ID NO: 1199907 - RNA, 23 nt, Human
ugcccugcccccagagguggagc

SEQ ID NO: 1199908 - RNA, 21 nt, Human
ugccuauauaccuccaauaac

SEQ ID NO: 1199909 - RNA, 20 nt, Human
ugccucaggcuuugcuuuuc

SEQ ID NO: 1199910 - RNA, 19 nt, Human
ugccucgcccugcuucagc

SEQ ID NO: 1199911 - RNA, 20 nt, Human
ugccugggugucagcagcgg

SEQ ID NO: 1199912 - RNA, 19 nt, Human
ugcuagagguccacucuag

SEQ ID NO: 1199913 - RNA, 18 nt, Human
ugcugcauugcaguuuga

SEQ ID NO: 1199914 - RNA, 24 nt, Human
ugcugcugccugaucguuccucug

SEQ ID NO: 1199915 - RNA, 20 nt, Human
ugcuugugcucugcauguag

SEQ ID NO: 1199916 - RNA, 18 nt, Human
ugcuuuguuuaccuaauc

SEQ ID NO: 1199917 - RNA, 24 nt, Human
ugcuuuguuuaccuaaucaagccu

SEQ ID NO: 1199918 - RNA, 20 nt, Human
uggaagaagagcacugagaa

SEQ ID NO: 1199919 - RNA, 22 nt, Human
uggaagaagagcacugagaaau

SEQ ID NO: 1199920 - RNA, 24 nt, Human
uggaagaagagcacugagaaaucc

SEQ ID NO: 1199921 - RNA, 19 nt, Human
uggaauauucuuucucccc

SEQ ID NO: 1199922 - RNA, 21 nt, Human
uggaauauucuuucuccccuu

SEQ ID NO: 1199923 - RNA, 24 nt, Human
uggcucccgaaauaaaauaauuuu

SEQ ID NO: 1199924 - RNA, 23 nt, Human
uggcugcagaacagcgguggcug

SEQ ID NO: 1199925 - RNA, 19 nt, Human
uggcuggaacuauagcuuc

SEQ ID NO: 1199926 - RNA, 23 nt, Human
ugggagaaccacuacucuccuca

SEQ ID NO: 1199927 - RNA, 23 nt, Human
ugggugcagguguuuaauacaug

SEQ ID NO: 1199928 - RNA, 20 nt, Human
ugguguggauguccuuucug

SEQ ID NO: 1199929 - RNA, 24 nt, Human
ugguuuuccuucuaacagacagga

SEQ ID NO: 1199930 - RNA, 18 nt, Human
ugucuacuguccccccuc

SEQ ID NO: 1199931 - RNA, 19 nt, Human
uguggugggcuccacccag

SEQ ID NO: 1199932 - RNA, 18 nt, Human
uguuuguugguuuuccuu

SEQ ID NO: 1199933 - RNA, 18 nt, Human
uuaaaaaacaaaucuaau

SEQ ID NO: 1199934 - RNA, 18 nt, Human
uucaccucuuucccccca

SEQ ID NO: 1199935 - RNA, 18 nt, Human
uucauggagcaauaaaaa

SEQ ID NO: 1199936 - RNA, 20 nt, Human
uucucgagucuuagcuuuca

SEQ ID NO: 1199937 - RNA, 19 nt, Human
uugauccaagccagaaauc

SEQ ID NO: 1199938 - RNA, 22 nt, Human
uugcagaaucuuuggacgaggu

SEQ ID NO: 1199939 - RNA, 19 nt, Human
uugcagugcagcauccucc

SEQ ID NO: 1199940 - RNA, 19 nt, Human
uugcagugcagcauccucc

SEQ ID NO: 1199941 - RNA, 21 nt, Human
uugcagugcagcauccuccuc

SEQ ID NO: 1199942 - RNA, 19 nt, Human
uuggaggaggagagugcuc

SEQ ID NO: 1199943 - RNA, 24 nt, Human
uugguguggauguccuuucuguuu

SEQ ID NO: 1199944 - RNA, 21 nt, Human
uuguguuauuccucugcuuaa

SEQ ID NO: 1199945 - RNA, 18 nt, Human
uuuaauaagaaugucuag

SEQ ID NO: 1199946 - RNA, 23 nt, Human
uuuauauuacacugaaauaauua

SEQ ID NO: 1199947 - RNA, 21 nt, Human
uuuccaguuuuucugcucugu

SEQ ID NO: 1199948 - RNA, 24 nt, Human
uuugaucgucugaagccuucuucu

SEQ ID NO: 1199949 - RNA, 22 nt, Human
uuuggcuaguacagaaaaaggc

SEQ ID NO: 1199950 - RNA, 21 nt, Human
uuugugguuuuaucuacuuuu

SEQ ID NO: 1199951 - RNA, 22 nt, Human
uuuugcucauauuguugucucu

SEQ ID NO: 1199952 - RNA, 22 nt, Human
aaaaaaaggcacacuucucaac

SEQ ID NO: 1199953 - RNA, 20 nt, Human
aaaaaacaacuaaaaaacuu

SEQ ID NO: 1199954 - RNA, 23 nt, Human
aaaaaacaacuaaaaaacuucac

SEQ ID NO: 1199955 - RNA, 20 nt, Human
aaaaaacaacuaauaaauga

SEQ ID NO: 1199956 - RNA, 25 nt, Human
aaaaaagcuaacacaagccggaccc

SEQ ID NO: 1199957 - RNA, 23 nt, Human
aaaaaagcuaacacaagcuuaag

SEQ ID NO: 1199958 - RNA, 18 nt, Human
aaaaaggcacacuucuca

SEQ ID NO: 1199959 - RNA, 21 nt, Human
aaaagaaaaaagcuaacacaa

SEQ ID NO: 1199960 - RNA, 22 nt, Human
aaaauacaguacagaaccagga

SEQ ID NO: 1199961 - RNA, 23 nt, Human
aaacaacaacaacaacaacaaaa

SEQ ID NO: 1199962 - RNA, 23 nt, Human
aaacaacuaaaaaacuucacuuu

SEQ ID NO: 1199963 - RNA, 25 nt, Human
aaacaguaaaaauaagacuuaaaac

SEQ ID NO: 1199964 - RNA, 19 nt, Human
aacaacaacaacaacaaaa

SEQ ID NO: 1199965 - RNA, 27 nt, Human
aacacuuaagaaaacaacaacaacaac

SEQ ID NO: 1199966 - RNA, 19 nt, Human
aagaaaacaacaacaacaa

SEQ ID NO: 1199967 - RNA, 23 nt, Human
aagaaauaaauuuauauguacaa

SEQ ID NO: 1199968 - RNA, 25 nt, Human
aagacuuaaaacugcugccuacagu

SEQ ID NO: 1199969 - RNA, 23 nt, Human
aaggaggaaacucugaaagaaaa

SEQ ID NO: 1199970 - RNA, 21 nt, Human
acaaaaaugccaaaaauuaau

SEQ ID NO: 1199971 - RNA, 20 nt, Human
acaacaaaacaaaaacagac

SEQ ID NO: 1199972 - RNA, 26 nt, Human
acaacaacaacaaaacaaaaacagac

SEQ ID NO: 1199973 - RNA, 23 nt, Human
acaacaacaacaacaaaacaaaa

SEQ ID NO: 1199974 - RNA, 19 nt, Human
acaacaacaacaacaacaa

SEQ ID NO: 1199975 - RNA, 22 nt, Human
acaacaacaacaacaacaaaac

SEQ ID NO: 1199976 - RNA, 24 nt, Human
acaacaacaacaacaacaaaacaa

SEQ ID NO: 1199977 - RNA, 27 nt, Human
acaaggaaaaacaguauuuccauuuca

SEQ ID NO: 1199978 - RNA, 23 nt, Human
acacaguucauuuccacagcauu

SEQ ID NO: 1199979 - RNA, 21 nt, Human
acagucuauucuaggaaacca

SEQ ID NO: 1199980 - RNA, 22 nt, Human
accugaauuauaaacuuagcac

SEQ ID NO: 1199981 - RNA, 28 nt, Human
agaaaacaacuugcugguugaauaccac

SEQ ID NO: 1199982 - RNA, 21 nt, Human
aggaaacucugaaagaaaaca

SEQ ID NO: 1199983 - RNA, 24 nt, Human
auaaauauacaaaaaugccaaaaa

SEQ ID NO: 1199984 - RNA, 20 nt, Human
auauauauauaucuacuuca

SEQ ID NO: 1199985 - RNA, 18 nt, Human
auccaguaauauaaugcu

SEQ ID NO: 1199986 - RNA, 22 nt, Human
auuagacaauuacaucugugcu

SEQ ID NO: 1199987 - RNA, 24 nt, Human
caaaacaaaaacagacaauuugac

SEQ ID NO: 1199988 - RNA, 20 nt, Human
caaaagaaaaaagcuaacac

SEQ ID NO: 1199989 - RNA, 21 nt, Human
caaaagaaaaaagcuaacaca

SEQ ID NO: 1199990 - RNA, 21 nt, Human
caaauccaaguuagcuaauuc

SEQ ID NO: 1199991 - RNA, 21 nt, Human
caacaaaacaaaaacagacaa

SEQ ID NO: 1199992 - RNA, 19 nt, Human
caacaacaaaacaaaaaca

SEQ ID NO: 1199993 - RNA, 19 nt, Human
caacaacaacaaaacaaaa

SEQ ID NO: 1199994 - RNA, 21 nt, Human
caaccuguaacaaaacaugcc

SEQ ID NO: 1199995 - RNA, 20 nt, Human
caaguuuagcugaaaacuuc

SEQ ID NO: 1199996 - RNA, 18 nt, Human
cacugaggauuaagcuga

SEQ ID NO: 1199997 - RNA, 20 nt, Human
cagaaugauacgugaagauc

SEQ ID NO: 1199998 - RNA, 20 nt, Human
cagcacagccauucucuucc

SEQ ID NO: 1199999 - RNA, 24 nt, Human
caguaaaaauaagacuuaaaacug

SEQ ID NO: 1200000 - RNA, 21 nt, Human
cauucgcauggaauaaaaaca

SEQ ID NO: 1200001 - RNA, 26 nt, Human
cauucucuuccugaugagggacuuug

SEQ ID NO: 1200002 - RNA, 23 nt, Human
ccaguaauauaaugcucugcaaa

SEQ ID NO: 1200003 - RNA, 21 nt, Human
ccuucugcaaauacucuacaa

SEQ ID NO: 1200004 - RNA, 21 nt, Human
cgugaagaucucaacaugaag

SEQ ID NO: 1200005 - RNA, 24 nt, Human
cucaauauaaauuguagccaaaga

SEQ ID NO: 1200006 - RNA, 19 nt, Human
cucugaaagaaaacaacuu

SEQ ID NO: 1200007 - RNA, 25 nt, Human
cuugccaaaagcuuccacaaaucca

SEQ ID NO: 1200008 - RNA, 18 nt, Human
gaaaacaacaacaacaac

SEQ ID NO: 1200009 - RNA, 21 nt, Human
gaauaccacaaaaaacaacua

SEQ ID NO: 1200010 - RNA, 24 nt, Human
gcaaaagaaaaaagcuaacacaag

SEQ ID NO: 1200011 - RNA, 25 nt, Human
ggacggcaaaaucuuagcagcaaag

SEQ ID NO: 1200012 - RNA, 22 nt, Human
guagauauauauauauauauau

SEQ ID NO: 1200013 - RNA, 18 nt, Human
gugaagaucucaacauga

SEQ ID NO: 1200014 - RNA, 25 nt, Human
uaaaaaaaguauuuuacagacagau

SEQ ID NO: 1200015 - RNA, 23 nt, Human
uaaaacugcuuucaaaaaacaac

SEQ ID NO: 1200016 - RNA, 21 nt, Human
uaaaugacguuuaaaaaccug

SEQ ID NO: 1200017 - RNA, 24 nt, Human
uaaaugacguuuaaaaaccugcau

SEQ ID NO: 1200018 - RNA, 23 nt, Human
uaaaugcaauauaacuuuuugaa

SEQ ID NO: 1200019 - RNA, 21 nt, Human
uaacauaaaauaauuuugcuu

SEQ ID NO: 1200020 - RNA, 22 nt, Human
uaagaaaacaacaacaacaaca

SEQ ID NO: 1200021 - RNA, 19 nt, Human
uaagcugaaaaauuaguaa

SEQ ID NO: 1200022 - RNA, 21 nt, Human
uacccucuucuucauaacauc

SEQ ID NO: 1200023 - RNA, 25 nt, Human
uagcacuuacaaauaugaaaauuca

SEQ ID NO: 1200024 - RNA, 23 nt, Human
ucaacuguccccuagugcacuuu

SEQ ID NO: 1200025 - RNA, 26 nt, Human
uccacagcauuuuccuauauagccag

SEQ ID NO: 1200026 - RNA, 23 nt, Human
uccacggauaaaaaagucagcac

SEQ ID NO: 1200027 - RNA, 25 nt, Human
uccacggauaaaaaagucagcacag

SEQ ID NO: 1200028 - RNA, 18 nt, Human
ucugcaaaagaaauaaau

SEQ ID NO: 1200029 - RNA, 19 nt, Human
ucuucaguuauucacaccu

SEQ ID NO: 1200030 - RNA, 21 nt, Human
ugaaacgccaagaacugauga

SEQ ID NO: 1200031 - RNA, 25 nt, Human
ugaaagaaaacaacuugcugguuga

SEQ ID NO: 1200032 - RNA, 22 nt, Human
ugaagaaacuuguuuaaaauug

SEQ ID NO: 1200033 - RNA, 22 nt, Human
ugcacaaacauuaaaauauuaa

SEQ ID NO: 1200034 - RNA, 21 nt, Human
ugccaaaagcuuccacaaauc

SEQ ID NO: 1200035 - RNA, 22 nt, Human
ugccaaaagcuuccacaaaucc

SEQ ID NO: 1200036 - RNA, 22 nt, Human
ugccaugcacucaagggaaaag

SEQ ID NO: 1200037 - RNA, 19 nt, Human
uggcgugaaacgccaagaa

SEQ ID NO: 1200038 - RNA, 19 nt, Human
uggggcaaaagaaaaaagc

SEQ ID NO: 1200039 - RNA, 21 nt, Human
uguaaaggaaaaaaugggaau

SEQ ID NO: 1200040 - RNA, 25 nt, Human
ugugacaguagauauauauauauau

SEQ ID NO: 1200041 - RNA, 26 nt, Human
uguucuuaaagaacccuuuccuuggu

SEQ ID NO: 1200042 - RNA, 21 nt, Human
uuaguacaaaacuagaaauac

SEQ ID NO: 1200043 - RNA, 22 nt, Human
uuguaaaggaaaaaaugggaau

SEQ ID NO: 1200044 - RNA, 23 nt, Human
aauuugguguagaaaaauaauuu

SEQ ID NO: 1200045 - RNA, 23 nt, Human
gaaaauguaucucuaaugucuuc

SEQ ID NO: 1200046 - RNA, 19 nt, Human
ugcucaauuugguguagaa

SEQ ID NO: 1200047 - RNA, 18 nt, Human
uguaucucuaaugucuuc

SEQ ID NO: 1200048 - RNA, 24 nt, Human
ugugccggacacucagcagguacc

SEQ ID NO: 1200049 - RNA, 19 nt, Human
uucuggggaugaggggcag

SEQ ID NO: 1200050 - RNA, 21 nt, Human
aggcgaguggcagccccccga

SEQ ID NO: 1200051 - RNA, 22 nt, Human
ccaacaccagcaauguuccacu

SEQ ID NO: 1200052 - RNA, 20 nt, Human
ccuucuuuuccucuuucagc

SEQ ID NO: 1200053 - RNA, 22 nt, Human
cuagcugccuccuuagggcuug

SEQ ID NO: 1200054 - RNA, 26 nt, Human
cugacgauagucugugaacuuucucu

SEQ ID NO: 1200055 - RNA, 25 nt, Human
cugauguugguggcuugccuucuuu

SEQ ID NO: 1200056 - RNA, 21 nt, Human
cugugaacuuucucuuggccc

SEQ ID NO: 1200057 - RNA, 22 nt, Human
gccuucuuuuccucuuucagcu

SEQ ID NO: 1200058 - RNA, 20 nt, Human
guucuguuguuuauccucag

SEQ ID NO: 1200059 - RNA, 21 nt, Human
uaccaacaccagcaauguucc

SEQ ID NO: 1200060 - RNA, 21 nt, Human
uccugggccucuagcugccuc

SEQ ID NO: 1200061 - RNA, 19 nt, Human
ugccuucuuuuccucuuuc

SEQ ID NO: 1200062 - RNA, 19 nt, Human
uggcagccccccgaagugg

SEQ ID NO: 1200063 - RNA, 22 nt, Human
uggcuugccuucuuuuggaagc

SEQ ID NO: 1200064 - RNA, 19 nt, Human
ugguaugauccugggccuc

SEQ ID NO: 1200065 - RNA, 26 nt, Human
ugguaugauccugggccucuagcugc

SEQ ID NO: 1200066 - RNA, 18 nt, Human
ugucucaggguuagugcc

SEQ ID NO: 1200067 - RNA, 20 nt, Human
agccaccaggcugcauccug

SEQ ID NO: 1200068 - RNA, 21 nt, Human
caccaggcugcauccugauuc

SEQ ID NO: 1200069 - RNA, 20 nt, Human
cugagucacaaaagccacca

SEQ ID NO: 1200070 - RNA, 20 nt, Human
gccaccaggcugcauccuga

SEQ ID NO: 1200071 - RNA, 23 nt, Human
aaacaaaaaaaugcaugcucuaa

SEQ ID NO: 1200072 - RNA, 24 nt, Human
aaacaaaaaaaugcaugcucuaau

SEQ ID NO: 1200073 - RNA, 21 nt, Human
aagaaagaaaauaauggcaga

SEQ ID NO: 1200074 - RNA, 22 nt, Human
aagaaagcaaacaaaaaaaugc

SEQ ID NO: 1200075 - RNA, 19 nt, Human
accaucagaucuugugaua

SEQ ID NO: 1200076 - RNA, 21 nt, Human
agaaagcaaacaaaaaaaugc

SEQ ID NO: 1200077 - RNA, 23 nt, Human
agaaagcaaacaaaaaaaugcau

SEQ ID NO: 1200078 - RNA, 20 nt, Human
augguggcaggaaggagaag

SEQ ID NO: 1200079 - RNA, 18 nt, Human
ccaucagaucuugugaua

SEQ ID NO: 1200080 - RNA, 25 nt, Human
ggaaggagaagaaugagagucaagc

SEQ ID NO: 1200081 - RNA, 24 nt, Human
gucaagcaaagggagaagccccuu

SEQ ID NO: 1200082 - RNA, 20 nt, Human
uaaagaaagaaaauaauggc

SEQ ID NO: 1200083 - RNA, 24 nt, Human
uacaaaaccaucagaucuugugau

SEQ ID NO: 1200084 - RNA, 23 nt, Human
ugaaaagaaagcaaacaaaaaaa

SEQ ID NO: 1200085 - RNA, 23 nt, Human
uggcaggaaggagaagaaugaga

SEQ ID NO: 1200086 - RNA, 24 nt, Human
aaagugcugggauuacaggcauga

SEQ ID NO: 1200087 - RNA, 20 nt, Human
aacagucaagucccacccag

SEQ ID NO: 1200088 - RNA, 24 nt, Human
aagcaaucugcccacuuuggcuuc

SEQ ID NO: 1200089 - RNA, 19 nt, Human
aagugcugggauuacaggc

SEQ ID NO: 1200090 - RNA, 21 nt, Human
aagugcugggauuacaggcau

SEQ ID NO: 1200091 - RNA, 26 nt, Human
aagugcugggauuacaggcaugagcc

SEQ ID NO: 1200092 - RNA, 18 nt, Human
acagcucacugcagccuc

SEQ ID NO: 1200093 - RNA, 24 nt, Human
acagcucacugcagccucaaacau

SEQ ID NO: 1200094 - RNA, 23 nt, Human
acccaguaagcaccugagagcuu

SEQ ID NO: 1200095 - RNA, 21 nt, Human
acuacagguguguaccaccgu

SEQ ID NO: 1200096 - RNA, 27 nt, Human
acucuguugcccaggcuggagugcugu

SEQ ID NO: 1200097 - RNA, 18 nt, Human
agacaggguuucuccaug

SEQ ID NO: 1200098 - RNA, 23 nt, Human
agacaggguuucuccauguugcc

SEQ ID NO: 1200099 - RNA, 21 nt, Human
agggaaggacugcugagucac

SEQ ID NO: 1200100 - RNA, 18 nt, Human
aggugcuggugauagagc

SEQ ID NO: 1200101 - RNA, 18 nt, Human
agugcugggauuacaggc

SEQ ID NO: 1200102 - RNA, 25 nt, Human
auaaagcuguuuagaaggcuuaaag

SEQ ID NO: 1200103 - RNA, 25 nt, Human
auagagcccaaggaacuugguugcu

SEQ ID NO: 1200104 - RNA, 24 nt, Human
caaagugcugggauuacaggcaug

SEQ ID NO: 1200105 - RNA, 22 nt, Human
caagucccacccaguaagcacc

SEQ ID NO: 1200106 - RNA, 23 nt, Human
caccgugccugacuaauuuccgg

SEQ ID NO: 1200107 - RNA, 24 nt, Human
caccuuagccucccugguggcugg

SEQ ID NO: 1200108 - RNA, 24 nt, Human
cacucuguugcccaggcuggagug

SEQ ID NO: 1200109 - RNA, 24 nt, Human
caggguuucacucuguugcccagg

SEQ ID NO: 1200110 - RNA, 24 nt, Human
caggguuucuccauguugccuagg

SEQ ID NO: 1200111 - RNA, 21 nt, Human
caguaaccuaauuuccccacu

SEQ ID NO: 1200112 - RNA, 23 nt, Human
cauguugccuaggcugcuacuga

SEQ ID NO: 1200113 - RNA, 24 nt, Human
cauguugccuaggcugcuacugaa

SEQ ID NO: 1200114 - RNA, 23 nt, Human
ccaaagugcugggauuacaggca

SEQ ID NO: 1200115 - RNA, 24 nt, Human
ccaaagugcugggauuacaggcau

SEQ ID NO: 1200116 - RNA, 24 nt, Human
cccaaagugcugggauuacaggca

SEQ ID NO: 1200117 - RNA, 21 nt, Human
ccuaggaucaagcaaucugcc

SEQ ID NO: 1200118 - RNA, 25 nt, Human
ccucccaccuuagccucccuggugg

SEQ ID NO: 1200119 - RNA, 18 nt, Human
ccucccugguggcuggga

SEQ ID NO: 1200120 - RNA, 23 nt, Human
ccugguggcugggacuacaggug

SEQ ID NO: 1200121 - RNA, 24 nt, Human
cuccauguugccuaggcugcuacu

SEQ ID NO: 1200122 - RNA, 24 nt, Human
cuuagccucccugguggcugggac

SEQ ID NO: 1200123 - RNA, 24 nt, Human
gacuacagguguguaccaccgugc

SEQ ID NO: 1200124 - RNA, 20 nt, Human
gagacaggguuucuccaugu

SEQ ID NO: 1200125 - RNA, 21 nt, Human
gagacaggguuucuccauguu

SEQ ID NO: 1200126 - RNA, 18 nt, Human
gauuacaggcaugagcca

SEQ ID NO: 1200127 - RNA, 18 nt, Human
gauuacaggcaugagcca

SEQ ID NO: 1200128 - RNA, 22 nt, Human
gauuacaggcaugagccaucac

SEQ ID NO: 1200129 - RNA, 21 nt, Human
ggacuacagguguguaccacc

SEQ ID NO: 1200130 - RNA, 24 nt, Human
ggacuacagguguguaccaccgug

SEQ ID NO: 1200131 - RNA, 23 nt, Human
ggauuacaggcaugagccaucac

SEQ ID NO: 1200132 - RNA, 18 nt, Human
ggugauagagcccaagga

SEQ ID NO: 1200133 - RNA, 21 nt, Human
guagagacaggguuucuccau

SEQ ID NO: 1200134 - RNA, 23 nt, Human
guggacuguuuuacuaaguggga

SEQ ID NO: 1200135 - RNA, 22 nt, Human
guggcugggacuacaggugugu

SEQ ID NO: 1200136 - RNA, 24 nt, Human
guuucacucuguugcccaggcugg

SEQ ID NO: 1200137 - RNA, 22 nt, Human
uaaccuaauuuccccacuuucc

SEQ ID NO: 1200138 - RNA, 23 nt, Human
uacaggcaugagccaucacaucc

SEQ ID NO: 1200139 - RNA, 22 nt, Human
uagagacaggguuucuccaugu

SEQ ID NO: 1200140 - RNA, 22 nt, Human
uagcaacaacagucaaguccca

SEQ ID NO: 1200141 - RNA, 20 nt, Human
uagcaucacagcucacugca

SEQ ID NO: 1200142 - RNA, 18 nt, Human
uaggaucaagcaaucugc

SEQ ID NO: 1200143 - RNA, 20 nt, Human
uaggaucaagcaaucugccc

SEQ ID NO: 1200144 - RNA, 19 nt, Human
uagggaaggacugcugagu

SEQ ID NO: 1200145 - RNA, 21 nt, Human
uauacuaguaauuccaaaaca

SEQ ID NO: 1200146 - RNA, 20 nt, Human
ucacucuguugcccaggcug

SEQ ID NO: 1200147 - RNA, 21 nt, Human
ucacucuguugcccaggcugg

SEQ ID NO: 1200148 - RNA, 22 nt, Human
ucacucuguugcccaggcugga

SEQ ID NO: 1200149 - RNA, 24 nt, Human
ucacucuguugcccaggcuggagu

SEQ ID NO: 1200150 - RNA, 26 nt, Human
ucacugcagccucaaacaucccuggg

SEQ ID NO: 1200151 - RNA, 18 nt, Human
ucaggucuccucccaccu

SEQ ID NO: 1200152 - RNA, 24 nt, Human
ucccaaagugcugggauuacaggc

SEQ ID NO: 1200153 - RNA, 23 nt, Human
ucccugggaucaggucuccuccc

SEQ ID NO: 1200154 - RNA, 24 nt, Human
ucccugggaucaggucuccuccca

SEQ ID NO: 1200155 - RNA, 22 nt, Human
ucccugguggcugggacuacag

SEQ ID NO: 1200156 - RNA, 24 nt, Human
ucccugguggcugggacuacaggu

SEQ ID NO: 1200157 - RNA, 18 nt, Human
uccuaggaucaagcaauc

SEQ ID NO: 1200158 - RNA, 20 nt, Human
uccuaggaucaagcaaucug

SEQ ID NO: 1200159 - RNA, 21 nt, Human
uccuaggaucaagcaaucugc

SEQ ID NO: 1200160 - RNA, 26 nt, Human
ucuuggagaauacuuuucuuuuucuu

SEQ ID NO: 1200161 - RNA, 18 nt, Human
ucuuuuucuugaaacagg

SEQ ID NO: 1200162 - RNA, 24 nt, Human
ugaacuccuaggaucaagcaaucu

SEQ ID NO: 1200163 - RNA, 19 nt, Human
ugcccaggcuggagugcug

SEQ ID NO: 1200164 - RNA, 24 nt, Human
ugccuaggcugcuacugaacuccu

SEQ ID NO: 1200165 - RNA, 21 nt, Human
ugggacuacagguguguacca

SEQ ID NO: 1200166 - RNA, 23 nt, Human
ugggacuacagguguguaccacc

SEQ ID NO: 1200167 - RNA, 24 nt, Human
ugggacuacagguguguaccaccg

SEQ ID NO: 1200168 - RNA, 18 nt, Human
ugggauuacaggcaugag

SEQ ID NO: 1200169 - RNA, 19 nt, Human
ugggauuacaggcaugagc

SEQ ID NO: 1200170 - RNA, 21 nt, Human
ugggauuacaggcaugagcca

SEQ ID NO: 1200171 - RNA, 21 nt, Human
ugggauuacaggcaugagcca

SEQ ID NO: 1200172 - RNA, 22 nt, Human
ugggauuacaggcaugagccau

SEQ ID NO: 1200173 - RNA, 23 nt, Human
ugggauuacaggcaugagccauc

SEQ ID NO: 1200174 - RNA, 24 nt, Human
ugggauuacaggcaugagccauca

SEQ ID NO: 1200175 - RNA, 27 nt, Human
ugggauuacaggcaugagccaucacau

SEQ ID NO: 1200176 - RNA, 31 nt, Human
ugggauuacaggcaugagccaucacauccgg

SEQ ID NO: 1200177 - RNA, 24 nt, Human
uguagagacaggguuucuccaugu

SEQ ID NO: 1200178 - RNA, 24 nt, Human
uucacucuguugcccaggcuggag

SEQ ID NO: 1200179 - RNA, 20 nt, Human
uugcccaggcuggagugcug

SEQ ID NO: 1200180 - RNA, 24 nt, Human
uuguagagacaggguuucuccaug

SEQ ID NO: 1200181 - RNA, 18 nt, Human
uuuacugaguaccugcca

SEQ ID NO: 1200182 - RNA, 22 nt, Human
uuucacucuguugcccaggcug

SEQ ID NO: 1200183 - RNA, 24 nt, Human
uuucacucuguugcccaggcugga

SEQ ID NO: 1200184 - RNA, 18 nt, Human
uuuguagagacaggguuu

SEQ ID NO: 1200185 - RNA, 22 nt, Human
uuuuguuuuuuuguuuuuguag

SEQ ID NO: 1200186 - RNA, 25 nt, Human
uuuuuuuguuuuuguagagacaggg

SEQ ID NO: 1200187 - RNA, 23 nt, Human
aaaaaacaacuucacuccuggga

SEQ ID NO: 1200188 - RNA, 21 nt, Human
aaaaacaaauaaaacaaaaau

SEQ ID NO: 1200189 - RNA, 19 nt, Human
aaaaagaaacccagggucc

SEQ ID NO: 1200190 - RNA, 21 nt, Human
aaaacaaauaaauaaaaagga

SEQ ID NO: 1200191 - RNA, 24 nt, Human
aaaccuggagaaagguccgcgacg

SEQ ID NO: 1200192 - RNA, 24 nt, Human
aaaggcagguggaccacaagguca

SEQ ID NO: 1200193 - RNA, 19 nt, Human
aacauggugaaaccccauc

SEQ ID NO: 1200194 - RNA, 20 nt, Human
aacauggugaaaccccaucu

SEQ ID NO: 1200195 - RNA, 20 nt, Human
aacauggugaaaccccaucu

SEQ ID NO: 1200196 - RNA, 21 nt, Human
aacauggugaaaccccaucuc

SEQ ID NO: 1200197 - RNA, 21 nt, Human
aagaagaggggcugcaaugaa

SEQ ID NO: 1200198 - RNA, 22 nt, Human
aagacaccacagaccaauguga

SEQ ID NO: 1200199 - RNA, 21 nt, Human
aagaugcuuuugcucucacug

SEQ ID NO: 1200200 - RNA, 22 nt, Human
aagaugcuuuugcucucacuga

SEQ ID NO: 1200201 - RNA, 25 nt, Human
aagcauccaaacacauaagcuagga

SEQ ID NO: 1200202 - RNA, 19 nt, Human
aauccaaaagucaagaagc

SEQ ID NO: 1200203 - RNA, 24 nt, Human
aauugcuugaacccgggaggcgga

SEQ ID NO: 1200204 - RNA, 18 nt, Human
acaccacuacacuccagc

SEQ ID NO: 1200205 - RNA, 18 nt, Human
acagagugagacuccauc

SEQ ID NO: 1200206 - RNA, 24 nt, Human
accacuacacuccagccuggguga

SEQ ID NO: 1200207 - RNA, 24 nt, Human
accccaucucuacuaaaaauacaa

SEQ ID NO: 1200208 - RNA, 18 nt, Human
acuacacuccagccuggg

SEQ ID NO: 1200209 - RNA, 24 nt, Human
acuacacuccagccugggugacag

SEQ ID NO: 1200210 - RNA, 24 nt, Human
acuccagccugggugacagaguga

SEQ ID NO: 1200211 - RNA, 22 nt, Human
agaauugcuugaacccgggagg

SEQ ID NO: 1200212 - RNA, 21 nt, Human
agacaccacagaccaauguga

SEQ ID NO: 1200213 - RNA, 19 nt, Human
agacuccaucaaaaaacaa

SEQ ID NO: 1200214 - RNA, 26 nt, Human
agcccugauggcaaaggaaauaagcc

SEQ ID NO: 1200215 - RNA, 22 nt, Human
agccuggccaacauggugaaac

SEQ ID NO: 1200216 - RNA, 24 nt, Human
agccuggccaacauggugaaaccc

SEQ ID NO: 1200217 - RNA, 24 nt, Human
agccugggugacagagugagacuc

SEQ ID NO: 1200218 - RNA, 31 nt, Human
agccuuguuccacuucaucuaguaguuccaa

SEQ ID NO: 1200219 - RNA, 22 nt, Human
aggaaaaaagugguuacucugg

SEQ ID NO: 1200220 - RNA, 22 nt, Human
aggcaaauagaauggagucagg

SEQ ID NO: 1200221 - RNA, 24 nt, Human
aggcaggagaauugcuugaacccg

SEQ ID NO: 1200222 - RNA, 25 nt, Human
aggcagguggaccacaaggucaguc

SEQ ID NO: 1200223 - RNA, 20 nt, Human
aggcgacgcccgcccggccc

SEQ ID NO: 1200224 - RNA, 19 nt, Human
aggcggagguugcagugag

SEQ ID NO: 1200225 - RNA, 20 nt, Human
aggcggagguugcagugagc

SEQ ID NO: 1200226 - RNA, 24 nt, Human
aggcggagguugcagugagcagag

SEQ ID NO: 1200227 - RNA, 21 nt, Human
aggcugaggcaggagaauugc

SEQ ID NO: 1200228 - RNA, 24 nt, Human
aggcugaggcaggagaauugcuug

SEQ ID NO: 1200229 - RNA, 28 nt, Human
agguggaccacaaggucagucaggaguu

SEQ ID NO: 1200230 - RNA, 22 nt, Human
auggcaaaggaaauaagccauc

SEQ ID NO: 1200231 - RNA, 19 nt, Human
augguguagcccugcucca

SEQ ID NO: 1200232 - RNA, 24 nt, Human
auuacaccacuacacuccagccug

SEQ ID NO: 1200233 - RNA, 18 nt, Human
caaaaaacaacuucacuc

SEQ ID NO: 1200234 - RNA, 21 nt, Human
caaaacagguuuauugguuau

SEQ ID NO: 1200235 - RNA, 21 nt, Human
caaaaccagcuaaaaauaaag

SEQ ID NO: 1200236 - RNA, 21 nt, Human
caaaagccgucuucaaauaau

SEQ ID NO: 1200237 - RNA, 22 nt, Human
caaaggaauccaaaagucaaga

SEQ ID NO: 1200238 - RNA, 19 nt, Human
caacaugagaaaccugggc

SEQ ID NO: 1200239 - RNA, 24 nt, Human
caacauggugaaaccccaucucua

SEQ ID NO: 1200240 - RNA, 19 nt, Human
cacaaaagaauguuagcaa

SEQ ID NO: 1200241 - RNA, 18 nt, Human
cacacccucgaagacacc

SEQ ID NO: 1200242 - RNA, 19 nt, Human
cacacccucgaagacacca

SEQ ID NO: 1200243 - RNA, 24 nt, Human
cacaccuguaaucccagcacuuug

SEQ ID NO: 1200244 - RNA, 23 nt, Human
cacacgccgcagaggcgacgccc

SEQ ID NO: 1200245 - RNA, 18 nt, Human
cacaggcugaaaaccugg

SEQ ID NO: 1200246 - RNA, 18 nt, Human
caccuguaaucccagcac

SEQ ID NO: 1200247 - RNA, 19 nt, Human
caccuguaaucccagcacu

SEQ ID NO: 1200248 - RNA, 24 nt, Human
caccuguaaucccagcuacucagg

SEQ ID NO: 1200249 - RNA, 22 nt, Human
cacuccagccugggugacagag

SEQ ID NO: 1200250 - RNA, 22 nt, Human
cacuccagccugggugacagag

SEQ ID NO: 1200251 - RNA, 24 nt, Human
cacuccagccugggugacagagug

SEQ ID NO: 1200252 - RNA, 20 nt, Human
cagaaauuauacuucuucca

SEQ ID NO: 1200253 - RNA, 24 nt, Human
cagcacuuuggaagccaaaggcag

SEQ ID NO: 1200254 - RNA, 24 nt, Human
cagcuacucaggaggcugaggcag

SEQ ID NO: 1200255 - RNA, 23 nt, Human
cagguggaccacaaggucaguca

SEQ ID NO: 1200256 - RNA, 20 nt, Human
caucaaaaaacaaauaaaac

SEQ ID NO: 1200257 - RNA, 26 nt, Human
caucaaaaaacaaauaaaacaaaaag

SEQ ID NO: 1200258 - RNA, 28 nt, Human
ccacaaggucagucaggaguucgagacc

SEQ ID NO: 1200259 - RNA, 21 nt, Human
ccacauucuucacuuucuuca

SEQ ID NO: 1200260 - RNA, 20 nt, Human
ccacuacacuccagccuggg

SEQ ID NO: 1200261 - RNA, 20 nt, Human
ccacuacacuccagccuggg

SEQ ID NO: 1200262 - RNA, 21 nt, Human
ccacuacacuccagccugggu

SEQ ID NO: 1200263 - RNA, 23 nt, Human
ccacuacacuccagccuggguga

SEQ ID NO: 1200264 - RNA, 24 nt, Human
ccacuacacuccagccugggugac

SEQ ID NO: 1200265 - RNA, 25 nt, Human
ccacuacacuccagccugggugaca

SEQ ID NO: 1200266 - RNA, 25 nt, Human
ccagcuaaaaauaaaggaaauaaaa

SEQ ID NO: 1200267 - RNA, 18 nt, Human
cccaaaaaacaacuucac

SEQ ID NO: 1200268 - RNA, 24 nt, Human
cccaaauuaugaaaaauaaugcac

SEQ ID NO: 1200269 - RNA, 20 nt, Human
ccgugccucacaccuguaau

SEQ ID NO: 1200270 - RNA, 20 nt, Human
ccuaauuucagccaaguggu

SEQ ID NO: 1200271 - RNA, 22 nt, Human
ccucgaagacaccacagaccaa

SEQ ID NO: 1200272 - RNA, 25 nt, Human
ccugauacuaagcccaagauucuuc

SEQ ID NO: 1200273 - RNA, 23 nt, Human
ccuggccaacauggugaaacccc

SEQ ID NO: 1200274 - RNA, 24 nt, Human
ccuggccaacauggugaaacccca

SEQ ID NO: 1200275 - RNA, 21 nt, Human
ccugggcacuguggaaagccc

SEQ ID NO: 1200276 - RNA, 22 nt, Human
ccugggugacagagugagacuc

SEQ ID NO: 1200277 - RNA, 21 nt, Human
ccuguaaucccagcuacucag

SEQ ID NO: 1200278 - RNA, 27 nt, Human
ccugugacugaagcauuaccggggucc

SEQ ID NO: 1200279 - RNA, 20 nt, Human
cgaagacaccacagaccaau

SEQ ID NO: 1200280 - RNA, 24 nt, Human
cgagaccagccuggccaacauggu

SEQ ID NO: 1200281 - RNA, 19 nt, Human
cgcaccuguaaucccagcu

SEQ ID NO: 1200282 - RNA, 24 nt, Human
cgggaggcggagguugcagugagc

SEQ ID NO: 1200283 - RNA, 24 nt, Human
cgugccucacaccuguaaucccag

SEQ ID NO: 1200284 - RNA, 22 nt, Human
cucacaccuguaaucccagcac

SEQ ID NO: 1200285 - RNA, 24 nt, Human
cucacaccuguaaucccagcacuu

SEQ ID NO: 1200286 - RNA, 19 nt, Human
cucacugagccuuguucca

SEQ ID NO: 1200287 - RNA, 18 nt, Human
cuccgaaggaaguuuggg

SEQ ID NO: 1200288 - RNA, 19 nt, Human
cugauacuaagcccaagau

SEQ ID NO: 1200289 - RNA, 23 nt, Human
cuggccaacauggugaaacccca

SEQ ID NO: 1200290 - RNA, 21 nt, Human
cuguaaucccagcuacucagg

SEQ ID NO: 1200291 - RNA, 20 nt, Human
cuuucuucaaauccucuaaa

SEQ ID NO: 1200292 - RNA, 22 nt, Human
gacagagugagacuccaucaaa

SEQ ID NO: 1200293 - RNA, 23 nt, Human
gagacagacaaaacauucaacau

SEQ ID NO: 1200294 - RNA, 24 nt, Human
gccaacauggugaaaccccaucuc

SEQ ID NO: 1200295 - RNA, 22 nt, Human
ggagguugcagugagcagagau

SEQ ID NO: 1200296 - RNA, 22 nt, Human
ggagguugcagugagcagagau

SEQ ID NO: 1200297 - RNA, 23 nt, Human
ggagguugcagugagcagagauu

SEQ ID NO: 1200298 - RNA, 20 nt, Human
ggagguugcagugagcaggc

SEQ ID NO: 1200299 - RNA, 23 nt, Human
ggcgugguggcacgcaccuguaa

SEQ ID NO: 1200300 - RNA, 24 nt, Human
gguggcacgcaccuguaaucccag

SEQ ID NO: 1200301 - RNA, 27 nt, Human
guggaccacaaggucagucaggaguuc

SEQ ID NO: 1200302 - RNA, 22 nt, Human
uaaaaagaaacccagggucccu

SEQ ID NO: 1200303 - RNA, 25 nt, Human
uaaaaagaaacccagggucccugcu

SEQ ID NO: 1200304 - RNA, 22 nt, Human
uaaaacaaauaaauaaaaagga

SEQ ID NO: 1200305 - RNA, 22 nt, Human
uaacagacagacuaaaaagaaa

SEQ ID NO: 1200306 - RNA, 21 nt, Human
uaagagacagacaaaacauuc

SEQ ID NO: 1200307 - RNA, 23 nt, Human
uaagagacagacaaaacauucaa

SEQ ID NO: 1200308 - RNA, 19 nt, Human
uacacagugacauaaucag

SEQ ID NO: 1200309 - RNA, 22 nt, Human
uaccaggucucuucaaaggaau

SEQ ID NO: 1200310 - RNA, 20 nt, Human
uagccgggcgugguggcacg

SEQ ID NO: 1200311 - RNA, 21 nt, Human
uauuuuacacaaaagaauguu

SEQ ID NO: 1200312 - RNA, 22 nt, Human
ucagucuagaacuaaaagaaga

SEQ ID NO: 1200313 - RNA, 26 nt, Human
ucagucuagaacuaaaagaagagggg

SEQ ID NO: 1200314 - RNA, 27 nt, Human
ucauucucauucuccgcauaccaggaa

SEQ ID NO: 1200315 - RNA, 21 nt, Human
uccaaaagucaagaagcaaaa

SEQ ID NO: 1200316 - RNA, 22 nt, Human
uccacaaggagcgguaaaaaaa

SEQ ID NO: 1200317 - RNA, 25 nt, Human
uccacauucacaaucucaugcccaa

SEQ ID NO: 1200318 - RNA, 23 nt, Human
uccagccugggugacagagugag

SEQ ID NO: 1200319 - RNA, 24 nt, Human
uccagccugggugacagagugaga

SEQ ID NO: 1200320 - RNA, 23 nt, Human
uccaugcuaauugauuccaaaag

SEQ ID NO: 1200321 - RNA, 21 nt, Human
ucucuacuaaaaauacaaaaa

SEQ ID NO: 1200322 - RNA, 21 nt, Human
ugaaaaugauggagucuuccu

SEQ ID NO: 1200323 - RNA, 22 nt, Human
ugaaaaugauggagucuuccug

SEQ ID NO: 1200324 - RNA, 19 nt, Human
ugaaaccccaucucuacua

SEQ ID NO: 1200325 - RNA, 23 nt, Human
ugacugaagcauuacuacauuua

SEQ ID NO: 1200326 - RNA, 19 nt, Human
ugaggaaaugguagucacu

SEQ ID NO: 1200327 - RNA, 24 nt, Human
ugaggcaggagaauugcuugaacc

SEQ ID NO: 1200328 - RNA, 25 nt, Human
ugaggcaggagaauugcuugaaccc

SEQ ID NO: 1200329 - RNA, 19 nt, Human
ugcaaugaaggaagaaguc

SEQ ID NO: 1200330 - RNA, 20 nt, Human
ugcccaaaaaacaacuucac

SEQ ID NO: 1200331 - RNA, 21 nt, Human
ugccucacaccuguaauccca

SEQ ID NO: 1200332 - RNA, 24 nt, Human
ugccucacaccuguaaucccagca

SEQ ID NO: 1200333 - RNA, 24 nt, Human
ugcugaagcacacccucgaagaca

SEQ ID NO: 1200334 - RNA, 19 nt, Human
uggacaaaaccagcuaaaa

SEQ ID NO: 1200335 - RNA, 22 nt, Human
uggcacgcaccuguaaucccag

SEQ ID NO: 1200336 - RNA, 24 nt, Human
uggccaacauggugaaaccccauc

SEQ ID NO: 1200337 - RNA, 18 nt, Human
uggcugggcaccgugccu

SEQ ID NO: 1200338 - RNA, 24 nt, Human
ugguggcacgcaccuguaauccca

SEQ ID NO: 1200339 - RNA, 18 nt, Human
uuagccgggcgugguggc

SEQ ID NO: 1200340 - RNA, 20 nt, Human
uuagccgggcgugguggcac

SEQ ID NO: 1200341 - RNA, 20 nt, Human
uucacuguccuccaucguua

SEQ ID NO: 1200342 - RNA, 20 nt, Human
uucacuguccuccaucguua

SEQ ID NO: 1200343 - RNA, 24 nt, Human
uugaacccgggaggcggagguugc

SEQ ID NO: 1200344 - RNA, 19 nt, Human
uugcagugagcagagauua

SEQ ID NO: 1200345 - RNA, 20 nt, Human
uugcagugagcagagauuac

SEQ ID NO: 1200346 - RNA, 24 nt, Human
uugcuugaacccgggaggcggagg

SEQ ID NO: 1200347 - RNA, 21 nt, Human
uuuaaaaaggaaaaaaguggu

SEQ ID NO: 1200348 - RNA, 21 nt, Human
ugccuguggacccuugcauug

SEQ ID NO: 1200349 - RNA, 23 nt, Human
uggacccuugcauuggguaaccu

SEQ ID NO: 1200350 - RNA, 19 nt, Human
uggagcuguggcagaaacu

SEQ ID NO: 1200351 - RNA, 22 nt, Human
aaggccccagacacaaguucag

SEQ ID NO: 1200352 - RNA, 19 nt, Human
acagaggacacuuuuccca

SEQ ID NO: 1200353 - RNA, 19 nt, Human
cacagaggacacuuuuccc

SEQ ID NO: 1200354 - RNA, 25 nt, Human
caccuaaggccccagacacaaguuc

SEQ ID NO: 1200355 - RNA, 18 nt, Human
cccagacacaaguucagc

SEQ ID NO: 1200356 - RNA, 23 nt, Human
ucacagaggacacuuuucccacc

SEQ ID NO: 1200357 - RNA, 19 nt, Human
uguaaugggcaaagucaga

SEQ ID NO: 1200358 - RNA, 19 nt, Human
aaagcaaugccgccuccuc

SEQ ID NO: 1200359 - RNA, 19 nt, Human
aagcaacccccagauaaga

SEQ ID NO: 1200360 - RNA, 23 nt, Human
acuguccccuuuggagaugggag

SEQ ID NO: 1200361 - RNA, 19 nt, Human
agauccaaggaguguuucg

SEQ ID NO: 1200362 - RNA, 18 nt, Human
agcaaagcaacccccaga

SEQ ID NO: 1200363 - RNA, 23 nt, Human
aggcagguagagcucugaaccca

SEQ ID NO: 1200364 - RNA, 21 nt, Human
aggcgccaccguucggugaaa

SEQ ID NO: 1200365 - RNA, 22 nt, Human
agguagagcucugaacccaaac

SEQ ID NO: 1200366 - RNA, 22 nt, Human
auaagcaaagcaacccccagau

SEQ ID NO: 1200367 - RNA, 22 nt, Human
caaagcaacccccagauaagac

SEQ ID NO: 1200368 - RNA, 21 nt, Human
cacaucaacacacuuagacca

SEQ ID NO: 1200369 - RNA, 23 nt, Human
cacugccggcugcauagacagca

SEQ ID NO: 1200370 - RNA, 24 nt, Human
cagccuccaggcagguagagcucu

SEQ ID NO: 1200371 - RNA, 23 nt, Human
ccaaaagcaaugccgccuccucc

SEQ ID NO: 1200372 - RNA, 20 nt, Human
ccacaucaacacacuuagac

SEQ ID NO: 1200373 - RNA, 19 nt, Human
ccagucuucagggccaaaa

SEQ ID NO: 1200374 - RNA, 23 nt, Human
cccgaucuggggcucguaucgug

SEQ ID NO: 1200375 - RNA, 21 nt, Human
ccgcagucuuucugcaccacg

SEQ ID NO: 1200376 - RNA, 22 nt, Human
ccuccaggcagccugcucugaa

SEQ ID NO: 1200377 - RNA, 26 nt, Human
ccuccaggcagccugcucugaagucu

SEQ ID NO: 1200378 - RNA, 23 nt, Human
ccuucugcacuguccccuuugga

SEQ ID NO: 1200379 - RNA, 19 nt, Human
cgccuccuccaggcagccu

SEQ ID NO: 1200380 - RNA, 23 nt, Human
cucugaacccaaacgcccgaucu

SEQ ID NO: 1200381 - RNA, 19 nt, Human
cuuagaccaauagcacugc

SEQ ID NO: 1200382 - RNA, 18 nt, Human
gaguuggagccagucuuc

SEQ ID NO: 1200383 - RNA, 21 nt, Human
gcaaagcaacccccagauaag

SEQ ID NO: 1200384 - RNA, 22 nt, Human
gccccgugugggccgcagucuu

SEQ ID NO: 1200385 - RNA, 18 nt, Human
ggagaugggagcuuugag

SEQ ID NO: 1200386 - RNA, 18 nt, Human
guauaagcaaagcaaccc

SEQ ID NO: 1200387 - RNA, 20 nt, Human
uagauccaaggaguguuucg

SEQ ID NO: 1200388 - RNA, 22 nt, Human
uagcccacaaagucacagcuga

SEQ ID NO: 1200389 - RNA, 22 nt, Human
ucacagcugaggccacaucaac

SEQ ID NO: 1200390 - RNA, 21 nt, Human
uccaaggaguguuucgaaaag

SEQ ID NO: 1200391 - RNA, 21 nt, Human
uccaggcagccugcucugaag

SEQ ID NO: 1200392 - RNA, 19 nt, Human
uccccuuuggagaugggag

SEQ ID NO: 1200393 - RNA, 25 nt, Human
ucucggccagcgcuggccugcccug

SEQ ID NO: 1200394 - RNA, 23 nt, Human
ucugaagucucccccucuggcuu

SEQ ID NO: 1200395 - RNA, 21 nt, Human
ucugcaccacguccugcucuc

SEQ ID NO: 1200396 - RNA, 24 nt, Human
ucugcacuguccccuuuggagaug

SEQ ID NO: 1200397 - RNA, 19 nt, Human
ugagcgguaggcgccaccg

SEQ ID NO: 1200398 - RNA, 20 nt, Human
uggcuuuagcccacaaaguc

SEQ ID NO: 1200399 - RNA, 21 nt, Human
ggggaauugcuugcacaagcc

SEQ ID NO: 1200400 - RNA, 22 nt, Human
acaacccauguucuccccacaa

SEQ ID NO: 1200401 - RNA, 19 nt, Human
acgaagaucugaggcgcua

SEQ ID NO: 1200402 - RNA, 18 nt, Human
agcccaaacgugcagcag

SEQ ID NO: 1200403 - RNA, 18 nt, Human
caagcccaaacgugcagc

SEQ ID NO: 1200404 - RNA, 22 nt, Human
caagcccaaacgugcagcagcc

SEQ ID NO: 1200405 - RNA, 21 nt, Human
caccccgcacaacccauguuc

SEQ ID NO: 1200406 - RNA, 18 nt, Human
cagcaggcuccuccuucc

SEQ ID NO: 1200407 - RNA, 27 nt, Human
cagcaggcuccuccuucccuccagccc

SEQ ID NO: 1200408 - RNA, 19 nt, Human
cagccccaguuucaccccg

SEQ ID NO: 1200409 - RNA, 19 nt, Human
caggcuccuccuucccucc

SEQ ID NO: 1200410 - RNA, 24 nt, Human
caguuucaccccgcacaacccaug

SEQ ID NO: 1200411 - RNA, 18 nt, Human
ccaacgaagaucugaggc

SEQ ID NO: 1200412 - RNA, 19 nt, Human
ccacagcaggcuccuccuu

SEQ ID NO: 1200413 - RNA, 22 nt, Human
cccgcacaacccauguucuccc

SEQ ID NO: 1200414 - RNA, 20 nt, Human
ccuccuucccuccagcccca

SEQ ID NO: 1200415 - RNA, 19 nt, Human
cuccuccuucccuccagcc

SEQ ID NO: 1200416 - RNA, 23 nt, Human
cuccuccuucccuccagccccag

SEQ ID NO: 1200417 - RNA, 22 nt, Human
gcuccuccuucccuccagcccc

SEQ ID NO: 1200418 - RNA, 23 nt, Human
ccucugaaugugaggagaauagg

SEQ ID NO: 1200419 - RNA, 20 nt, Human
cuuugugcaguugcugccug

SEQ ID NO: 1200420 - RNA, 21 nt, Human
gcugccuguacagucuuugug

SEQ ID NO: 1200421 - RNA, 19 nt, Human
uacagucuuuguguccucu

SEQ ID NO: 1200422 - RNA, 19 nt, Human
uggguucuuugugcaguug

SEQ ID NO: 1200423 - RNA, 18 nt, Human
uguccucugaaugugagg

SEQ ID NO: 1200424 - RNA, 20 nt, Human
aggcacggcggucuccccgc

SEQ ID NO: 1200425 - RNA, 19 nt, Human
caccgcgcgcacgucgggc

SEQ ID NO: 1200426 - RNA, 20 nt, Human
cagcagcgccugugcccgcu

SEQ ID NO: 1200427 - RNA, 18 nt, Human
cagcgcaggcgcaaggcc

SEQ ID NO: 1200428 - RNA, 22 nt, Human
cagcgcccgcagggccucgggc

SEQ ID NO: 1200429 - RNA, 18 nt, Human
cagcgccugugcccgcuc

SEQ ID NO: 1200430 - RNA, 18 nt, Human
cagcguguccacgucggc

SEQ ID NO: 1200431 - RNA, 24 nt, Human
caggcuggcgccgggccccgcggg

SEQ ID NO: 1200432 - RNA, 21 nt, Human
cagggcugggcugcccagcac

SEQ ID NO: 1200433 - RNA, 33 nt, Human
ccaccaccaccgcgcgcacgucgggcuccaggg

SEQ ID NO: 1200434 - RNA, 21 nt, Human
ccacgcccacgcuggcgacgc

SEQ ID NO: 1200435 - RNA, 24 nt, Human
ccagggcugggcugcccagcacgu

SEQ ID NO: 1200436 - RNA, 23 nt, Human
cccaccaccaccgcgcgcacguc

SEQ ID NO: 1200437 - RNA, 23 nt, Human
cccacgcccacgcuggcgacgcc

SEQ ID NO: 1200438 - RNA, 24 nt, Human
cccgcagggccucgggcgcgccag

SEQ ID NO: 1200439 - RNA, 20 nt, Human
cccgcgagccagcccggggc

SEQ ID NO: 1200440 - RNA, 25 nt, Human
cccgcgccacagcacgccgucgcag

SEQ ID NO: 1200441 - RNA, 23 nt, Human
cccgcggggccgccgaagcccag

SEQ ID NO: 1200442 - RNA, 21 nt, Human
ccgcgcgcacgucgggcucca

SEQ ID NO: 1200443 - RNA, 19 nt, Human
ccucccgcgggcugcggga

SEQ ID NO: 1200444 - RNA, 21 nt, Human
ccucccgcgggcugcgggagc

SEQ ID NO: 1200445 - RNA, 23 nt, Human
cgaagaccuccaggcuggcgccg

SEQ ID NO: 1200446 - RNA, 22 nt, Human
cgccaauccgcccccgccuccc

SEQ ID NO: 1200447 - RNA, 23 nt, Human
cgccgaagcccaggcgccgcagc

SEQ ID NO: 1200448 - RNA, 25 nt, Human
cgccgggacccucgcccugcagugg

SEQ ID NO: 1200449 - RNA, 21 nt, Human
cgcggccagggcugggcugcc

SEQ ID NO: 1200450 - RNA, 18 nt, Human
cgggggcgccggccaggc

SEQ ID NO: 1200451 - RNA, 18 nt, Human
cgugcagccagucgccgg

SEQ ID NO: 1200452 - RNA, 20 nt, Human
cucgcagcgcccgcagggcc

SEQ ID NO: 1200453 - RNA, 22 nt, Human
gaagaccuccaggcuggcgccg

SEQ ID NO: 1200454 - RNA, 20 nt, Human
gaagcgaguggucagccggc

SEQ ID NO: 1200455 - RNA, 21 nt, Human
gcagcgcaggcgcaaggccgc

SEQ ID NO: 1200456 - RNA, 18 nt, Human
gccgggacccucgcccug

SEQ ID NO: 1200457 - RNA, 20 nt, Human
gcggccagggcugggcugcc

SEQ ID NO: 1200458 - RNA, 21 nt, Human
ggaagcgaguggucagccggc

SEQ ID NO: 1200459 - RNA, 19 nt, Human
gggcgccggccaggcgcug

SEQ ID NO: 1200460 - RNA, 19 nt, Human
ggggccgccgaagcccagg

SEQ ID NO: 1200461 - RNA, 24 nt, Human
guagcugaagugcgggucaaagcc

SEQ ID NO: 1200462 - RNA, 19 nt, Human
ucaaagcccaccaccaccg

SEQ ID NO: 1200463 - RNA, 22 nt, Human
ucaaagcccaccaccaccgcgc

SEQ ID NO: 1200464 - RNA, 22 nt, Human
ucauuggcuaccggccuuggga

SEQ ID NO: 1200465 - RNA, 20 nt, Human
uccagcggcgcgugcagcca

SEQ ID NO: 1200466 - RNA, 18 nt, Human
uccgcggccagggcuggg

SEQ ID NO: 1200467 - RNA, 22 nt, Human
ucgggccccacgcccacgcugg

SEQ ID NO: 1200468 - RNA, 22 nt, Human
ucuugcugcuguuguuggugau

SEQ ID NO: 1200469 - RNA, 23 nt, Human
ugcaguaggccgugccgaagacc

SEQ ID NO: 1200470 - RNA, 23 nt, Human
uggcagggcggcauucggaguga

SEQ ID NO: 1200471 - RNA, 21 nt, Human
uggcgccgggccccgcggggc

SEQ ID NO: 1200472 - RNA, 23 nt, Human
uuggaagcgaguggucagccggc

SEQ ID NO: 1200473 - RNA, 18 nt, Human
uuggugaugaagcccagg

SEQ ID NO: 1200474 - RNA, 20 nt, Human
agagagcagggccaucccac

SEQ ID NO: 1200475 - RNA, 18 nt, Human
agcaggccaaggugggga

SEQ ID NO: 1200476 - RNA, 18 nt, Human
agcaggguggcccgaggc

SEQ ID NO: 1200477 - RNA, 25 nt, Human
agcaggguggcccgaggcuuguggc

SEQ ID NO: 1200478 - RNA, 24 nt, Human
aggccccgggagggagaacugggg

SEQ ID NO: 1200479 - RNA, 18 nt, Human
agggccaucccacugcuc

SEQ ID NO: 1200480 - RNA, 20 nt, Human
caaaaccaagagcuuccagc

SEQ ID NO: 1200481 - RNA, 23 nt, Human
caagguggggagcaggguggccc

SEQ ID NO: 1200482 - RNA, 22 nt, Human
cagcagugcugucugcuguggc

SEQ ID NO: 1200483 - RNA, 24 nt, Human
ccacuggagagcccagcaggcccc

SEQ ID NO: 1200484 - RNA, 21 nt, Human
cccacguucugggccuggggc

SEQ ID NO: 1200485 - RNA, 18 nt, Human
cccccagcaaggcucucu

SEQ ID NO: 1200486 - RNA, 21 nt, Human
ccccgggagggagaacugggg

SEQ ID NO: 1200487 - RNA, 21 nt, Human
ccggcccccagcaaggcucuc

SEQ ID NO: 1200488 - RNA, 23 nt, Human
cguucggccacuggagagcccag

SEQ ID NO: 1200489 - RNA, 21 nt, Human
cucucugggcccacguucugg

SEQ ID NO: 1200490 - RNA, 24 nt, Human
cugggcccacguucugggccuggg

SEQ ID NO: 1200491 - RNA, 18 nt, Human
gccccgggagggagaacu

SEQ ID NO: 1200492 - RNA, 22 nt, Human
gccccgggagggagaacugggg

SEQ ID NO: 1200493 - RNA, 19 nt, Human
gcugucugcuguggccugg

SEQ ID NO: 1200494 - RNA, 20 nt, Human
ggaguccagcaggccaaggu

SEQ ID NO: 1200495 - RNA, 22 nt, Human
ggcacuggcgccucugucugcc

SEQ ID NO: 1200496 - RNA, 24 nt, Human
ggccuggggcgccaggaaaagcug

SEQ ID NO: 1200497 - RNA, 19 nt, Human
ggcgccaggaaaagcuggu

SEQ ID NO: 1200498 - RNA, 24 nt, Human
gggcugggggucaagggcgucuuc

SEQ ID NO: 1200499 - RNA, 20 nt, Human
ggggagcagcuccccgcugc

SEQ ID NO: 1200500 - RNA, 18 nt, Human
gucaagggcgucuucacc

SEQ ID NO: 1200501 - RNA, 19 nt, Human
uagacaaaaccaagagcuu

SEQ ID NO: 1200502 - RNA, 19 nt, Human
uccgcgcggccgcugccuc

SEQ ID NO: 1200503 - RNA, 25 nt, Human
uccgcgcggccgcugccucucagca

SEQ ID NO: 1200504 - RNA, 26 nt, Human
uccgcgcggccgcugccucucagcag

SEQ ID NO: 1200505 - RNA, 20 nt, Human
uccucugcuccuguccccgu

SEQ ID NO: 1200506 - RNA, 21 nt, Human
ucguggcugccggcccccagc

SEQ ID NO: 1200507 - RNA, 21 nt, Human
ucuucaccccagagugagggc

SEQ ID NO: 1200508 - RNA, 23 nt, Human
ugaccguccucugcuccuguccc

SEQ ID NO: 1200509 - RNA, 19 nt, Human
ugcuccuguccccguuccc

SEQ ID NO: 1200510 - RNA, 19 nt, Human
uggaugaccguccucugcu

SEQ ID NO: 1200511 - RNA, 19 nt, Human
ugggcugggggucaagggc

SEQ ID NO: 1200512 - RNA, 21 nt, Human
uggggagcaggguggcccgag

SEQ ID NO: 1200513 - RNA, 24 nt, Human
uggggaguccagcaggccaaggug

SEQ ID NO: 1200514 - RNA, 19 nt, Human
uguccccguucccucuccc

SEQ ID NO: 1200515 - RNA, 19 nt, Human
ugucugccccucguggcug

SEQ ID NO: 1200516 - RNA, 18 nt, Human
uucugggccuggggcgcc

SEQ ID NO: 1200517 - RNA, 23 nt, Human
cgagcagagcugaaccucaaauc

SEQ ID NO: 1200518 - RNA, 22 nt, Human
ucgugggcccagggcauaaacu

SEQ ID NO: 1200519 - RNA, 27 nt, Human
ugaaccucaaauccucgugggcccagg

SEQ ID NO: 1200520 - RNA, 18 nt, Human
uggugaccgagcagagcu

SEQ ID NO: 1200521 - RNA, 25 nt, Human
aaaggaaaaaaaaaaaaaaaaggac

SEQ ID NO: 1200522 - RNA, 25 nt, Human
aacaccuuuccuacuuguuuuggga

SEQ ID NO: 1200523 - RNA, 23 nt, Human
acaaaaugcuccagagcuucccc

SEQ ID NO: 1200524 - RNA, 22 nt, Human
acagucagugugugcuuuugaa

SEQ ID NO: 1200525 - RNA, 20 nt, Human
agaacaucugucgccacuga

SEQ ID NO: 1200526 - RNA, 21 nt, Human
agagcugggagggucuaugga

SEQ ID NO: 1200527 - RNA, 19 nt, Human
agaggugacuccguauaua

SEQ ID NO: 1200528 - RNA, 30 nt, Human
agccggacgcucugacggcugcuggccugg

SEQ ID NO: 1200529 - RNA, 21 nt, Human
aggcuggcauggcugcccucc

SEQ ID NO: 1200530 - RNA, 20 nt, Human
agggggcccugggaggccuc

SEQ ID NO: 1200531 - RNA, 21 nt, Human
caaaaugcuccagagcuuccc

SEQ ID NO: 1200532 - RNA, 22 nt, Human
caaaaugcuccagagcuucccc

SEQ ID NO: 1200533 - RNA, 18 nt, Human
cacugcugcccaagcuga

SEQ ID NO: 1200534 - RNA, 22 nt, Human
cagcacucaaaggaaaaaaaaa

SEQ ID NO: 1200535 - RNA, 19 nt, Human
cagcccgcugcucaccuug

SEQ ID NO: 1200536 - RNA, 23 nt, Human
cagcuggcugguuugguuccccc

SEQ ID NO: 1200537 - RNA, 25 nt, Human
caggauggcuccuggccuccuuucu

SEQ ID NO: 1200538 - RNA, 19 nt, Human
caggggacuggagcucuaa

SEQ ID NO: 1200539 - RNA, 19 nt, Human
cauagauccuuccugcuac

SEQ ID NO: 1200540 - RNA, 19 nt, Human
ccccaucgcagcuguuccc

SEQ ID NO: 1200541 - RNA, 22 nt, Human
cccccguggugaccugcucacu

SEQ ID NO: 1200542 - RNA, 18 nt, Human
cccguggugaccugcuca

SEQ ID NO: 1200543 - RNA, 19 nt, Human
cccucagcuuuccuucugg

SEQ ID NO: 1200544 - RNA, 18 nt, Human
cccucgagaaaaaugggg

SEQ ID NO: 1200545 - RNA, 21 nt, Human
ccgguggcugcccaccaagcu

SEQ ID NO: 1200546 - RNA, 25 nt, Human
ccuccaguaagagacgggcagagac

SEQ ID NO: 1200547 - RNA, 22 nt, Human
ccucucuagacaccuuuuauug

SEQ ID NO: 1200548 - RNA, 20 nt, Human
ccugcucauucuggacagag

SEQ ID NO: 1200549 - RNA, 22 nt, Human
ccuuuccuacuuguuuugggaa

SEQ ID NO: 1200550 - RNA, 18 nt, Human
cgucuuguccuccugcac

SEQ ID NO: 1200551 - RNA, 21 nt, Human
cucaaaggaaaaaaaaaaaaa

SEQ ID NO: 1200552 - RNA, 23 nt, Human
cucaaaggaaaaaaaaaaaaaaa

SEQ ID NO: 1200553 - RNA, 18 nt, Human
cuccaguaagagacgggg

SEQ ID NO: 1200554 - RNA, 19 nt, Human
cucuaagcugggugacugu

SEQ ID NO: 1200555 - RNA, 19 nt, Human
cugcugccgcugccgcugc

SEQ ID NO: 1200556 - RNA, 20 nt, Human
cugcuggccuggguggaggg

SEQ ID NO: 1200557 - RNA, 18 nt, Human
cuggcauggcugcccucc

SEQ ID NO: 1200558 - RNA, 19 nt, Human
cugguguugguugcagaug

SEQ ID NO: 1200559 - RNA, 18 nt, Human
cuucgcuguuuugacaca

SEQ ID NO: 1200560 - RNA, 18 nt, Human
cuuggcucuccuuccugg

SEQ ID NO: 1200561 - RNA, 24 nt, Human
cuuuccuacuuguuuugggaauau

SEQ ID NO: 1200562 - RNA, 21 nt, Human
gaagauucugggcugaagaug

SEQ ID NO: 1200563 - RNA, 18 nt, Human
gacacagucagugugugc

SEQ ID NO: 1200564 - RNA, 19 nt, Human
gacagucuccucacugacu

SEQ ID NO: 1200565 - RNA, 27 nt, Human
gagaaaaauggggggcagccgguaccc

SEQ ID NO: 1200566 - RNA, 21 nt, Human
gagagggggcccugggaggcc

SEQ ID NO: 1200567 - RNA, 23 nt, Human
gagcuuccccaucgcagcuguuc

SEQ ID NO: 1200568 - RNA, 21 nt, Human
gaggauuccccuuuuucuccc

SEQ ID NO: 1200569 - RNA, 19 nt, Human
gagggggcccugggaggcc

SEQ ID NO: 1200570 - RNA, 21 nt, Human
gaugguuucaucauggaaggu

SEQ ID NO: 1200571 - RNA, 18 nt, Human
gaugguuuugccauugau

SEQ ID NO: 1200572 - RNA, 20 nt, Human
gcacugcugcccaagcugau

SEQ ID NO: 1200573 - RNA, 19 nt, Human
gcauuguccugccaucgua

SEQ ID NO: 1200574 - RNA, 30 nt, Human
gcccaccaagcugaugucgcugcccuccuu

SEQ ID NO: 1200575 - RNA, 18 nt, Human
gcccgcugcucaccuugu

SEQ ID NO: 1200576 - RNA, 19 nt, Human
gccgcccgucuuguccucc

SEQ ID NO: 1200577 - RNA, 18 nt, Human
gcucucugggauggugcc

SEQ ID NO: 1200578 - RNA, 22 nt, Human
gcugaagugguuuauccaggga

SEQ ID NO: 1200579 - RNA, 20 nt, Human
gcuggcauggcugcccuccu

SEQ ID NO: 1200580 - RNA, 20 nt, Human
ggaaacaugacucucgcugc

SEQ ID NO: 1200581 - RNA, 22 nt, Human
ggacuggagcucuaagcugggu

SEQ ID NO: 1200582 - RNA, 23 nt, Human
ggacuggagcucuaagcugggug

SEQ ID NO: 1200583 - RNA, 18 nt, Human
ggagaggauucucacaaa

SEQ ID NO: 1200584 - RNA, 22 nt, Human
ggagcccagcuggcugguuugg

SEQ ID NO: 1200585 - RNA, 23 nt, Human
ggagcucuaagcugggugacugu

SEQ ID NO: 1200586 - RNA, 20 nt, Human
ggagggaaggcuggcugugg

SEQ ID NO: 1200587 - RNA, 21 nt, Human
ggagggucuauggagcccagc

SEQ ID NO: 1200588 - RNA, 20 nt, Human
ggauggugccucccaaguag

SEQ ID NO: 1200589 - RNA, 28 nt, Human
ggcugcuggccuggguggagggaaggcu

SEQ ID NO: 1200590 - RNA, 21 nt, Human
ggcuggcauggcugcccuccu

SEQ ID NO: 1200591 - RNA, 19 nt, Human
ggcuuggcucuccuuccug

SEQ ID NO: 1200592 - RNA, 18 nt, Human
gggaauauccacucuggg

SEQ ID NO: 1200593 - RNA, 22 nt, Human
gggacuggagcucuaagcuggg

SEQ ID NO: 1200594 - RNA, 24 nt, Human
gggaggggguuuagugccuccagu

SEQ ID NO: 1200595 - RNA, 20 nt, Human
gggucccaccaggaugcugc

SEQ ID NO: 1200596 - RNA, 20 nt, Human
ggucuauggagcccagcugg

SEQ ID NO: 1200597 - RNA, 21 nt, Human
gguucucaguauagacagucu

SEQ ID NO: 1200598 - RNA, 21 nt, Human
gugagggcacugcugcccaag

SEQ ID NO: 1200599 - RNA, 22 nt, Human
guucacagucgaugucauuacu

SEQ ID NO: 1200600 - RNA, 24 nt, Human
uaggcggugcucagcauagauccu

SEQ ID NO: 1200601 - RNA, 24 nt, Human
uaguggaugucuucacgacagucu

SEQ ID NO: 1200602 - RNA, 18 nt, Human
ucacugagguagcugcug

SEQ ID NO: 1200603 - RNA, 23 nt, Human
uccagggagagggggcccuggga

SEQ ID NO: 1200604 - RNA, 21 nt, Human
ucccucgagaaaaaugggggg

SEQ ID NO: 1200605 - RNA, 22 nt, Human
uccuucugguaccuaguggaug

SEQ ID NO: 1200606 - RNA, 21 nt, Human
ucgaugucauuacucuucgcu

SEQ ID NO: 1200607 - RNA, 24 nt, Human
ucgcuguuuugacacagguggacu

SEQ ID NO: 1200608 - RNA, 23 nt, Human
ucugggcugaagauguccagaga

SEQ ID NO: 1200609 - RNA, 26 nt, Human
ucuuucccuccagucugcuuggugcu

SEQ ID NO: 1200610 - RNA, 18 nt, Human
ugaaaacaccuuuccuac

SEQ ID NO: 1200611 - RNA, 19 nt, Human
ugaccucucuggggagagg

SEQ ID NO: 1200612 - RNA, 22 nt, Human
ugaggucaacccagggaggggg

SEQ ID NO: 1200613 - RNA, 25 nt, Human
ugcccaagcugaugaagcuggggcc

SEQ ID NO: 1200614 - RNA, 21 nt, Human
uggaagguucuaacucgugac

SEQ ID NO: 1200615 - RNA, 22 nt, Human
uggaugucuucacgacagucuc

SEQ ID NO: 1200616 - RNA, 22 nt, Human
uggccugcccacugaugcuugu

SEQ ID NO: 1200617 - RNA, 24 nt, Human
ugggaauauccacucugggugcag

SEQ ID NO: 1200618 - RNA, 19 nt, Human
uggggggcagcugaagugg

SEQ ID NO: 1200619 - RNA, 21 nt, Human
ugggugucacugagguagcug

SEQ ID NO: 1200620 - RNA, 19 nt, Human
ugugugcuuuugaaaacac

SEQ ID NO: 1200621 - RNA, 25 nt, Human
uucacgacagucucuggccucuuuu

SEQ ID NO: 1200622 - RNA, 26 nt, Human
uuccccaucgcagcuguucccggcug

SEQ ID NO: 1200623 - RNA, 18 nt, Human
uucccggcuggguugggc

SEQ ID NO: 1200624 - RNA, 21 nt, Human
uugcugcccccucagcuuucc

SEQ ID NO: 1200625 - RNA, 23 nt, Human
uugcugggccuguguguuguuuu

SEQ ID NO: 1200626 - RNA, 20 nt, Human
uugggcacugccauccagcc

SEQ ID NO: 1200627 - RNA, 19 nt, Human
uugguacagggggucccac

SEQ ID NO: 1200628 - RNA, 20 nt, Human
uuucaggggcuccugagccc

SEQ ID NO: 1200629 - RNA, 21 nt, Human
uuugggcacugccauccagcc

SEQ ID NO: 1200630 - RNA, 18 nt, Human
uuuucugggagacucugg

SEQ ID NO: 1200631 - RNA, 21 nt, Human
aaaccagcgaguuucagugga

SEQ ID NO: 1200632 - RNA, 19 nt, Human
accaucuccuuguucuccu

SEQ ID NO: 1200633 - RNA, 20 nt, Human
acugcugugagagcugaggc

SEQ ID NO: 1200634 - RNA, 25 nt, Human
agaguucucaagaacagucagacuc

SEQ ID NO: 1200635 - RNA, 23 nt, Human
agcggcucuucugcuccaggaag

SEQ ID NO: 1200636 - RNA, 18 nt, Human
agcuaguuuagaccaucu

SEQ ID NO: 1200637 - RNA, 18 nt, Human
aggcagaagaggacuuga

SEQ ID NO: 1200638 - RNA, 18 nt, Human
agggauggugcagcagcc

SEQ ID NO: 1200639 - RNA, 20 nt, Human
augggaagcuccugcgggug

SEQ ID NO: 1200640 - RNA, 23 nt, Human
caaaaccagcgaguuucagugga

SEQ ID NO: 1200641 - RNA, 23 nt, Human
caacaggagacauuggcuguggc

SEQ ID NO: 1200642 - RNA, 24 nt, Human
cacugcugugagagcugaggcaga

SEQ ID NO: 1200643 - RNA, 19 nt, Human
cagcagccaaaacuuccug

SEQ ID NO: 1200644 - RNA, 25 nt, Human
cagcaggggcgggguucagcggcuc

SEQ ID NO: 1200645 - RNA, 19 nt, Human
cagcggcucuucugcucuu

SEQ ID NO: 1200646 - RNA, 23 nt, Human
cagcugcugcucuccaccugcug

SEQ ID NO: 1200647 - RNA, 21 nt, Human
cauuuggacuacuaaaccacu

SEQ ID NO: 1200648 - RNA, 21 nt, Human
ccaccgcggcagcccgccuuu

SEQ ID NO: 1200649 - RNA, 24 nt, Human
ccaccgggagcagcagcuccuccu

SEQ ID NO: 1200650 - RNA, 20 nt, Human
ccagcaccaggacagguucu

SEQ ID NO: 1200651 - RNA, 23 nt, Human
ccagcugcugcucuccaccugcu

SEQ ID NO: 1200652 - RNA, 19 nt, Human
ccaggacagguucuaugcc

SEQ ID NO: 1200653 - RNA, 21 nt, Human
cccaggucggggacuuggggc

SEQ ID NO: 1200654 - RNA, 19 nt, Human
cccuuaguggugaaggccc

SEQ ID NO: 1200655 - RNA, 22 nt, Human
cccuuaguggugaaggcccuac

SEQ ID NO: 1200656 - RNA, 24 nt, Human
ccggccagcugcugcucuccaccu

SEQ ID NO: 1200657 - RNA, 18 nt, Human
ccucagagaccacucucu

SEQ ID NO: 1200658 - RNA, 21 nt, Human
ccugagcgcuauucucugggc

SEQ ID NO: 1200659 - RNA, 18 nt, Human
ccugcgggugagcugcag

SEQ ID NO: 1200660 - RNA, 27 nt, Human
cgccuugccuuucuagcgggcuccuca

SEQ ID NO: 1200661 - RNA, 22 nt, Human
cgggguucagcggcucuucugc

SEQ ID NO: 1200662 - RNA, 22 nt, Human
cuccggccagcugcugcucucc

SEQ ID NO: 1200663 - RNA, 21 nt, Human
cucucuuggcuuggucucugg

SEQ ID NO: 1200664 - RNA, 18 nt, Human
cucuggguccugagcgcu

SEQ ID NO: 1200665 - RNA, 21 nt, Human
cugguuccaaauauugggguc

SEQ ID NO: 1200666 - RNA, 25 nt, Human
gaguccccaccgggagcagcagcuc

SEQ ID NO: 1200667 - RNA, 24 nt, Human
gcccuugcagcgcuucgcgggggc

SEQ ID NO: 1200668 - RNA, 22 nt, Human
gccgcugaacggcuucucccca

SEQ ID NO: 1200669 - RNA, 26 nt, Human
gcggagguggcgggggcggugguuga

SEQ ID NO: 1200670 - RNA, 19 nt, Human
gggaguccccaccgggagc

SEQ ID NO: 1200671 - RNA, 22 nt, Human
gggcgggcuggcuguccagccu

SEQ ID NO: 1200672 - RNA, 23 nt, Human
gguucuggaguccucggcgggug

SEQ ID NO: 1200673 - RNA, 22 nt, Human
gugcagcagccaaaacuucccc

SEQ ID NO: 1200674 - RNA, 19 nt, Human
uacacagcauuuggacuac

SEQ ID NO: 1200675 - RNA, 19 nt, Human
uacaggcuuggcauccuuc

SEQ ID NO: 1200676 - RNA, 23 nt, Human
uacuggguuuuaguagaaaagaa

SEQ ID NO: 1200677 - RNA, 22 nt, Human
uauucagaaguagauaaacuuc

SEQ ID NO: 1200678 - RNA, 23 nt, Human
uauuuugcgcucuuugcacccca

SEQ ID NO: 1200679 - RNA, 20 nt, Human
uccacaugugagugccaagu

SEQ ID NO: 1200680 - RNA, 18 nt, Human
uccaggaaguccagcugc

SEQ ID NO: 1200681 - RNA, 19 nt, Human
ucccguguguugagcuagu

SEQ ID NO: 1200682 - RNA, 18 nt, Human
ucccucuagggauuacug

SEQ ID NO: 1200683 - RNA, 23 nt, Human
ucccucuagggauuacuggguuu

SEQ ID NO: 1200684 - RNA, 25 nt, Human
ucuagggauuacuggguuuuaguag

SEQ ID NO: 1200685 - RNA, 22 nt, Human
ugaaggcccuaccgcagauggc

SEQ ID NO: 1200686 - RNA, 19 nt, Human
ugagcugcagcuuccuggu

SEQ ID NO: 1200687 - RNA, 23 nt, Human
ugaggaacugcaggcugaaaggg

SEQ ID NO: 1200688 - RNA, 18 nt, Human
ugaggcagaagaggacuu

SEQ ID NO: 1200689 - RNA, 19 nt, Human
ugaggugcguuguccagac

SEQ ID NO: 1200690 - RNA, 21 nt, Human
ugagugccaaguguaccugga

SEQ ID NO: 1200691 - RNA, 21 nt, Human
ugcagaguucucaagaacagu

SEQ ID NO: 1200692 - RNA, 19 nt, Human
ugcagcagccaaaacuucc

SEQ ID NO: 1200693 - RNA, 19 nt, Human
ugcagugagaucagcaggg

SEQ ID NO: 1200694 - RNA, 21 nt, Human
ugcgcucuuugcaccccaggg

SEQ ID NO: 1200695 - RNA, 19 nt, Human
uggaguccucggcgggugg

SEQ ID NO: 1200696 - RNA, 18 nt, Human
uggcgaauggacgcugcc

SEQ ID NO: 1200697 - RNA, 19 nt, Human
uggcgggggcgguggucag

SEQ ID NO: 1200698 - RNA, 18 nt, Human
ugggagggcuauuuugcg

SEQ ID NO: 1200699 - RNA, 21 nt, Human
ugggaucugggaaaagccucu

SEQ ID NO: 1200700 - RNA, 22 nt, Human
ugggcuccuccagguugcccag

SEQ ID NO: 1200701 - RNA, 21 nt, Human
ugucauaauacacagcauuug

SEQ ID NO: 1200702 - RNA, 24 nt, Human
uguccagacugacaaugggagggc

SEQ ID NO: 1200703 - RNA, 23 nt, Human
uguccagccucuggguccugagc

SEQ ID NO: 1200704 - RNA, 24 nt, Human
uguccagccucuggguccugagcg

SEQ ID NO: 1200705 - RNA, 22 nt, Human
ugucuguugcccacauaaucuu

SEQ ID NO: 1200706 - RNA, 23 nt, Human
ugugcagugagaucagcaggggc

SEQ ID NO: 1200707 - RNA, 27 nt, Human
ugugugcagugagaucagcaggggcgg

SEQ ID NO: 1200708 - RNA, 20 nt, Human
uucagcggcucuucugcucc

SEQ ID NO: 1200709 - RNA, 21 nt, Human
uucuuuaugggaagcuccugc

SEQ ID NO: 1200710 - RNA, 23 nt, Human
uucuuuaugggaagcuccugcgg

SEQ ID NO: 1200711 - RNA, 19 nt, Human
uugcaccccaggguaccca

SEQ ID NO: 1200712 - RNA, 24 nt, Human
uugccugggcucuuucuguuccug

SEQ ID NO: 1200713 - RNA, 18 nt, Human
uuggcuuggucucugggc

SEQ ID NO: 1200714 - RNA, 22 nt, Human
ccagguugguggaggcggggcg

SEQ ID NO: 1200715 - RNA, 21 nt, Human
cugcuggcggccgcggggcgg

SEQ ID NO: 1200716 - RNA, 22 nt, Human
cugcuggcggccgcggggcggc

SEQ ID NO: 1200717 - RNA, 19 nt, Human
acucaggggcaccugacuc

SEQ ID NO: 1200718 - RNA, 21 nt, Human
aguuguucuguggauccaaaa

SEQ ID NO: 1200719 - RNA, 21 nt, Human
cauucauguaagguggacuca

SEQ ID NO: 1200720 - RNA, 22 nt, Human
ccugacuugauacuugcuaccu

SEQ ID NO: 1200721 - RNA, 21 nt, Human
cucaggggcaccugacuugau

SEQ ID NO: 1200722 - RNA, 20 nt, Human
gagcaggaggagggguugcu

SEQ ID NO: 1200723 - RNA, 18 nt, Human
ggaaucugcaaggugcuc

SEQ ID NO: 1200724 - RNA, 18 nt, Human
ucaggggcaccugacuug

SEQ ID NO: 1200725 - RNA, 22 nt, Human
ucguauugaucuuucucccgua

SEQ ID NO: 1200726 - RNA, 22 nt, Human
ucuguggauccaaaagagcauu

SEQ ID NO: 1200727 - RNA, 18 nt, Human
ugggagcaggaggagggg

SEQ ID NO: 1200728 - RNA, 19 nt, Human
ugggagcaggaggaggggu

SEQ ID NO: 1200729 - RNA, 18 nt, Human
ugguguuagguguuucuu

SEQ ID NO: 1200730 - RNA, 23 nt, Human
uucuguggauccaaaagagcauu

SEQ ID NO: 1200731 - RNA, 26 nt, Human
cacauuuucccucccucucuuuucuc

SEQ ID NO: 1200732 - RNA, 18 nt, Human
cccucccucucuuuucuc

SEQ ID NO: 1200733 - RNA, 22 nt, Human
uccuaaucuuacacaaaccaag

SEQ ID NO: 1200734 - RNA, 23 nt, Human
ugauuucugggucacauuuuccc

SEQ ID NO: 1200735 - RNA, 21 nt, Human
aaaaaauacaauauacauuag

SEQ ID NO: 1200736 - RNA, 24 nt, Human
aagaacaauguucauaccaacuga

SEQ ID NO: 1200737 - RNA, 21 nt, Human
aagaauuugaaaucaagucua

SEQ ID NO: 1200738 - RNA, 21 nt, Human
aagaugacaacuuagacaaaa

SEQ ID NO: 1200739 - RNA, 25 nt, Human
aagcaaugaaacaguugacaguuau

SEQ ID NO: 1200740 - RNA, 21 nt, Human
aaggaaauaccauucagccau

SEQ ID NO: 1200741 - RNA, 23 nt, Human
aagggaaacaaggaaagacaaaa

SEQ ID NO: 1200742 - RNA, 21 nt, Human
acauacacucucucucucccc

SEQ ID NO: 1200743 - RNA, 21 nt, Human
accacaauuuauucauccauu

SEQ ID NO: 1200744 - RNA, 24 nt, Human
accagaagcagggaaaacuucaac

SEQ ID NO: 1200745 - RNA, 22 nt, Human
agaacuggaggggcgcagccuc

SEQ ID NO: 1200746 - RNA, 21 nt, Human
agaguauauuaauguuaaaac

SEQ ID NO: 1200747 - RNA, 22 nt, Human
agcagcuaugaaaauaacguuu

SEQ ID NO: 1200748 - RNA, 21 nt, Human
aguguaaaaauuuacuucuaa

SEQ ID NO: 1200749 - RNA, 22 nt, Human
auaaaaccacuaaauucauagg

SEQ ID NO: 1200750 - RNA, 21 nt, Human
caaaccagaagcagggaaaac

SEQ ID NO: 1200751 - RNA, 22 nt, Human
caacugauauaugccagcaagc

SEQ ID NO: 1200752 - RNA, 24 nt, Human
caagaacaauguucauaccaacug

SEQ ID NO: 1200753 - RNA, 24 nt, Human
caaggaaguagaaaugccuccuuu

SEQ ID NO: 1200754 - RNA, 23 nt, Human
caauuuauucauccauucccuua

SEQ ID NO: 1200755 - RNA, 18 nt, Human
caggagauuccuagguug

SEQ ID NO: 1200756 - RNA, 18 nt, Human
caugucugccuccuucac

SEQ ID NO: 1200757 - RNA, 26 nt, Human
ccaaaaaauacaauauacauuaguaa

SEQ ID NO: 1200758 - RNA, 23 nt, Human
ccacaguaagaccuggcuggagu

SEQ ID NO: 1200759 - RNA, 24 nt, Human
ccagaagcagggaaaacuucaaca

SEQ ID NO: 1200760 - RNA, 21 nt, Human
ccagugccacagcgggucacg

SEQ ID NO: 1200761 - RNA, 18 nt, Human
cgggucacggcgcagggc

SEQ ID NO: 1200762 - RNA, 25 nt, Human
cuagaaaaucuucagcaaaccagaa

SEQ ID NO: 1200763 - RNA, 20 nt, Human
cucaaggaaguagaaaugcc

SEQ ID NO: 1200764 - RNA, 19 nt, Human
cugaaaaacacaugugaug

SEQ ID NO: 1200765 - RNA, 20 nt, Human
cuguuuccuaagaggcagcu

SEQ ID NO: 1200766 - RNA, 22 nt, Human
cuguuuguauauuucuuaugcu

SEQ ID NO: 1200767 - RNA, 22 nt, Human
cuucuagaaaaucuucagcaaa

SEQ ID NO: 1200768 - RNA, 23 nt, Human
cuuugaguuacacaacaauucuu

SEQ ID NO: 1200769 - RNA, 24 nt, Human
cuuuucaaggaaauaccauucagc

SEQ ID NO: 1200770 - RNA, 19 nt, Human
gaaagacaaaaacaggugg

SEQ ID NO: 1200771 - RNA, 20 nt, Human
gaaauaccauucagccaugg

SEQ ID NO: 1200772 - RNA, 19 nt, Human
gaaaucaagucuauaaaag

SEQ ID NO: 1200773 - RNA, 19 nt, Human
gcggcgaagacgcgcggag

SEQ ID NO: 1200774 - RNA, 18 nt, Human
ggcuauggauguucugga

SEQ ID NO: 1200775 - RNA, 22 nt, Human
uaaagucucugaaauguaacau

SEQ ID NO: 1200776 - RNA, 25 nt, Human
uaacguuuuccccuccuuugugagu

SEQ ID NO: 1200777 - RNA, 19 nt, Human
uaagaggcagcucaagaac

SEQ ID NO: 1200778 - RNA, 24 nt, Human
uaagaggcagcucaagaacaaugu

SEQ ID NO: 1200779 - RNA, 20 nt, Human
ucacagaggacaagaauuuc

SEQ ID NO: 1200780 - RNA, 24 nt, Human
ugaaaaaucugauuuuuauaaaag

SEQ ID NO: 1200781 - RNA, 19 nt, Human
ugaaaauaacguuuucccc

SEQ ID NO: 1200782 - RNA, 21 nt, Human
ugaaaauaacguuuuccccuc

SEQ ID NO: 1200783 - RNA, 21 nt, Human
ugaaaucaagucuauaaaagc

SEQ ID NO: 1200784 - RNA, 23 nt, Human
ugacagcacaucaaugauauccc

SEQ ID NO: 1200785 - RNA, 19 nt, Human
ugaguaguacagcucaugu

SEQ ID NO: 1200786 - RNA, 25 nt, Human
ugccagcaagcaguagggaaagacg

SEQ ID NO: 1200787 - RNA, 21 nt, Human
ugcuacacacacacauacacu

SEQ ID NO: 1200788 - RNA, 23 nt, Human
uggcaacagcaaaacucaaggaa

SEQ ID NO: 1200789 - RNA, 19 nt, Human
uggcccagugccacagcgg

SEQ ID NO: 1200790 - RNA, 20 nt, Human
uggcccagugccacagcggg

SEQ ID NO: 1200791 - RNA, 18 nt, Human
ugguggugggggaagggc

SEQ ID NO: 1200792 - RNA, 21 nt, Human
uuaguauggaaaaucuuguua

SEQ ID NO: 1200793 - RNA, 21 nt, Human
uucaugaaauauuaagggaaa

SEQ ID NO: 1200794 - RNA, 19 nt, Human
uugcuuuccucauuugacc

SEQ ID NO: 1200795 - RNA, 24 nt, Human
uuuuccucuaaagucucugaaaug

SEQ ID NO: 1200796 - RNA, 20 nt, Human
aacagucuccagcgucccug

SEQ ID NO: 1200797 - RNA, 19 nt, Human
aaccagaggcugccauccu

SEQ ID NO: 1200798 - RNA, 18 nt, Human
aaccaggguucaaaaaca

SEQ ID NO: 1200799 - RNA, 24 nt, Human
aaccguguggggaacagagaccug

SEQ ID NO: 1200800 - RNA, 19 nt, Human
aaccuaaaugaugccuuuc

SEQ ID NO: 1200801 - RNA, 19 nt, Human
aacuuggcucugucacuga

SEQ ID NO: 1200802 - RNA, 20 nt, Human
aacuuuuuauuucuuccuuc

SEQ ID NO: 1200803 - RNA, 21 nt, Human
aagaaugggaacgaaaagaga

SEQ ID NO: 1200804 - RNA, 23 nt, Human
aagagaaagaggacacagggaca

SEQ ID NO: 1200805 - RNA, 22 nt, Human
aagaggacacagggacaaaacc

SEQ ID NO: 1200806 - RNA, 21 nt, Human
aaggcuccaggaggggguugc

SEQ ID NO: 1200807 - RNA, 23 nt, Human
aaguagucaagagaauuuugaga

SEQ ID NO: 1200808 - RNA, 21 nt, Human
aagugacuucauugaugugaa

SEQ ID NO: 1200809 - RNA, 18 nt, Human
aaguucucuggaaaauga

SEQ ID NO: 1200810 - RNA, 19 nt, Human
aauccucucucuuuccacc

SEQ ID NO: 1200811 - RNA, 23 nt, Human
aauuuuuauuuuuggccugaggg

SEQ ID NO: 1200812 - RNA, 22 nt, Human
acaagucuacuggaauaucauc

SEQ ID NO: 1200813 - RNA, 23 nt, Human
acaccagcuucccccaaagacag

SEQ ID NO: 1200814 - RNA, 18 nt, Human
acagaacuagaggacacg

SEQ ID NO: 1200815 - RNA, 19 nt, Human
acagacauucuucagacug

SEQ ID NO: 1200816 - RNA, 20 nt, Human
acaggaggagcugcuuugug

SEQ ID NO: 1200817 - RNA, 21 nt, Human
acaguccauccagucucacac

SEQ ID NO: 1200818 - RNA, 21 nt, Human
accugccccuccggccagccc

SEQ ID NO: 1200819 - RNA, 18 nt, Human
acugcaucuuggugagug

SEQ ID NO: 1200820 - RNA, 18 nt, Human
agaaagaggacacaggga

SEQ ID NO: 1200821 - RNA, 22 nt, Human
agaaagaggacacagggacaaa

SEQ ID NO: 1200822 - RNA, 23 nt, Human
agaaagaggacacagggacaaaa

SEQ ID NO: 1200823 - RNA, 18 nt, Human
agaaauacaaucacucca

SEQ ID NO: 1200824 - RNA, 21 nt, Human
agacacaugcaaauggccuuc

SEQ ID NO: 1200825 - RNA, 31 nt, Human
agacagcaucuuggucaucuccacguccccu

SEQ ID NO: 1200826 - RNA, 25 nt, Human
agauacugaacaucgcugaagaacu

SEQ ID NO: 1200827 - RNA, 22 nt, Human
agauauuggucugccagaaaua

SEQ ID NO: 1200828 - RNA, 19 nt, Human
agauucccuaucaggcagc

SEQ ID NO: 1200829 - RNA, 19 nt, Human
agccuggaggaugccagug

SEQ ID NO: 1200830 - RNA, 20 nt, Human
agcucuggggccuuucucgu

SEQ ID NO: 1200831 - RNA, 20 nt, Human
agcugaccggagagguacag

SEQ ID NO: 1200832 - RNA, 18 nt, Human
agcugcuuugugaggaga

SEQ ID NO: 1200833 - RNA, 20 nt, Human
agcuggugguuuguagaggc

SEQ ID NO: 1200834 - RNA, 19 nt, Human
aggaacugggguaggcaca

SEQ ID NO: 1200835 - RNA, 22 nt, Human
aggaagaaugggaacgaaaaga

SEQ ID NO: 1200836 - RNA, 18 nt, Human
aggacuauuuuuuccuug

SEQ ID NO: 1200837 - RNA, 22 nt, Human
aggaggagcugcuuugugagga

SEQ ID NO: 1200838 - RNA, 23 nt, Human
aggcccagccacccacauggcca

SEQ ID NO: 1200839 - RNA, 21 nt, Human
aggcucccaaagaagugggaa

SEQ ID NO: 1200840 - RNA, 23 nt, Human
agucaugguacuuuuauguuucu

SEQ ID NO: 1200841 - RNA, 19 nt, Human
auaguggagcccccugagg

SEQ ID NO: 1200842 - RNA, 19 nt, Human
aucauccccacgguggauc

SEQ ID NO: 1200843 - RNA, 22 nt, Human
aucccugaccagggguggaagu

SEQ ID NO: 1200844 - RNA, 22 nt, Human
aucuggagaggguucgcugggg

SEQ ID NO: 1200845 - RNA, 24 nt, Human
aucuuggucaucuccacgucccca

SEQ ID NO: 1200846 - RNA, 20 nt, Human
auggccacagugccuggaac

SEQ ID NO: 1200847 - RNA, 21 nt, Human
auggccacagugccuggaacc

SEQ ID NO: 1200848 - RNA, 18 nt, Human
auggucccucugugcugg

SEQ ID NO: 1200849 - RNA, 24 nt, Human
augugcuauuggggaugggggugg

SEQ ID NO: 1200850 - RNA, 21 nt, Human
auguggauaggaacuggggua

SEQ ID NO: 1200851 - RNA, 22 nt, Human
caacagacaagaccugcucccc

SEQ ID NO: 1200852 - RNA, 26 nt, Human
caacaguugcuucagucuuuaucuga

SEQ ID NO: 1200853 - RNA, 22 nt, Human
caacaugauuccuaaucccuga

SEQ ID NO: 1200854 - RNA, 21 nt, Human
caacucuuguuccaucaggaa

SEQ ID NO: 1200855 - RNA, 23 nt, Human
caagugacuucauugaugugaac

SEQ ID NO: 1200856 - RNA, 23 nt, Human
caagugcaaaauugcccuuuaaa

SEQ ID NO: 1200857 - RNA, 24 nt, Human
caaucauguuaaagucacccaggu

SEQ ID NO: 1200858 - RNA, 27 nt, Human
cacaagucucccuccuccucggagucc

SEQ ID NO: 1200859 - RNA, 21 nt, Human
caccaacccacagacauucuu

SEQ ID NO: 1200860 - RNA, 22 nt, Human
caccuguuccagccaacagucu

SEQ ID NO: 1200861 - RNA, 19 nt, Human
cacguccccacauagccug

SEQ ID NO: 1200862 - RNA, 24 nt, Human
cacugggccaggccuggggcacug

SEQ ID NO: 1200863 - RNA, 22 nt, Human
cacuguaugccaggcgcuaggc

SEQ ID NO: 1200864 - RNA, 23 nt, Human
cagaacauaugguaaguaccaga

SEQ ID NO: 1200865 - RNA, 21 nt, Human
cagaacgcagugaugaagcug

SEQ ID NO: 1200866 - RNA, 24 nt, Human
cagacaagaccugcuccccuggga

SEQ ID NO: 1200867 - RNA, 25 nt, Human
cagacaagaccugcuccccugggaa

SEQ ID NO: 1200868 - RNA, 20 nt, Human
cagcacacugggccaggccu

SEQ ID NO: 1200869 - RNA, 22 nt, Human
cagcaccagguacaagccugaa

SEQ ID NO: 1200870 - RNA, 21 nt, Human
cagccggaguggggcaggaga

SEQ ID NO: 1200871 - RNA, 18 nt, Human
caggagguuccugggcca

SEQ ID NO: 1200872 - RNA, 18 nt, Human
caggcucuuugcugggug

SEQ ID NO: 1200873 - RNA, 22 nt, Human
caggguuaacccgccccgcucc

SEQ ID NO: 1200874 - RNA, 21 nt, Human
cagugcuauaaguuccauaca

SEQ ID NO: 1200875 - RNA, 23 nt, Human
caugaccagaacauaugguaagu

SEQ ID NO: 1200876 - RNA, 22 nt, Human
cauggccacagugccuggaacc

SEQ ID NO: 1200877 - RNA, 26 nt, Human
cauucuugauggagaggagcuggaag

SEQ ID NO: 1200878 - RNA, 18 nt, Human
ccaaagaagugggaacac

SEQ ID NO: 1200879 - RNA, 18 nt, Human
ccaaagacagcaucuugg

SEQ ID NO: 1200880 - RNA, 27 nt, Human
ccaaggcugcgacuggucagcacccca

SEQ ID NO: 1200881 - RNA, 22 nt, Human
ccaccaggcucccaaagaagug

SEQ ID NO: 1200882 - RNA, 21 nt, Human
ccaggaggggguugcuugggg

SEQ ID NO: 1200883 - RNA, 18 nt, Human
ccaggggagaacuggcug

SEQ ID NO: 1200884 - RNA, 22 nt, Human
ccauacauuuucagcauugaca

SEQ ID NO: 1200885 - RNA, 23 nt, Human
ccauccugcucccauuaucauuu

SEQ ID NO: 1200886 - RNA, 23 nt, Human
cccaaagacagcaucuuggucau

SEQ ID NO: 1200887 - RNA, 21 nt, Human
cccauggaugaaaggccucua

SEQ ID NO: 1200888 - RNA, 22 nt, Human
cccccaagccuauccuggcagg

SEQ ID NO: 1200889 - RNA, 26 nt, Human
cccccaccccccuagugcgucccccu

SEQ ID NO: 1200890 - RNA, 19 nt, Human
ccccgcucuggccaccugg

SEQ ID NO: 1200891 - RNA, 24 nt, Human
cccgcagcggccugcaugguccuu

SEQ ID NO: 1200892 - RNA, 26 nt, Human
cccguaagaucccggagaauguccug

SEQ ID NO: 1200893 - RNA, 20 nt, Human
ccgcuccucucuuuccuucc

SEQ ID NO: 1200894 - RNA, 18 nt, Human
ccguguggaagcucuggg

SEQ ID NO: 1200895 - RNA, 19 nt, Human
ccuaaucccugaccagggg

SEQ ID NO: 1200896 - RNA, 21 nt, Human
ccuacgccuccuuccgaugua

SEQ ID NO: 1200897 - RNA, 22 nt, Human
ccuacugggccuucuggggccc

SEQ ID NO: 1200898 - RNA, 22 nt, Human
ccuacugggccuucuggggccc

SEQ ID NO: 1200899 - RNA, 18 nt, Human
ccucucucuuuccaccug

SEQ ID NO: 1200900 - RNA, 20 nt, Human
ccucucuuuccuuccgcugu

SEQ ID NO: 1200901 - RNA, 20 nt, Human
ccucugcucauagaggugaa

SEQ ID NO: 1200902 - RNA, 19 nt, Human
ccucuucagugucaucgcu

SEQ ID NO: 1200903 - RNA, 25 nt, Human
ccugacuacagcauacguagucggg

SEQ ID NO: 1200904 - RNA, 22 nt, Human
ccuggggacagccaggccacag

SEQ ID NO: 1200905 - RNA, 24 nt, Human
cgcacaccaacccacagacauucu

SEQ ID NO: 1200906 - RNA, 21 nt, Human
cggcaggggaggguuggugau

SEQ ID NO: 1200907 - RNA, 19 nt, Human
cggcgggggacucgggcac

SEQ ID NO: 1200908 - RNA, 20 nt, Human
cguguggaagcucuggggcc

SEQ ID NO: 1200909 - RNA, 24 nt, Human
cguguggaagcucuggggccuuuc

SEQ ID NO: 1200910 - RNA, 19 nt, Human
cuagaucguaccugccccu

SEQ ID NO: 1200911 - RNA, 22 nt, Human
cucaaucauguuaaagucaccc

SEQ ID NO: 1200912 - RNA, 21 nt, Human
cucacacgugaaugaaccaac

SEQ ID NO: 1200913 - RNA, 21 nt, Human
cuccucucuuuccuuccgcug

SEQ ID NO: 1200914 - RNA, 24 nt, Human
cucugguucagagagcaagucgga

SEQ ID NO: 1200915 - RNA, 20 nt, Human
cucugugcuggguucuccuc

SEQ ID NO: 1200916 - RNA, 20 nt, Human
cugaguucauucuugaugga

SEQ ID NO: 1200917 - RNA, 22 nt, Human
cugcaggaaagaaugugggugc

SEQ ID NO: 1200918 - RNA, 22 nt, Human
cugccagcuuaaugagcugugu

SEQ ID NO: 1200919 - RNA, 19 nt, Human
cugcccugcucccaccaga

SEQ ID NO: 1200920 - RNA, 22 nt, Human
cugcccuguccucccggccgcg

SEQ ID NO: 1200921 - RNA, 20 nt, Human
cugccuggggacagccaggc

SEQ ID NO: 1200922 - RNA, 21 nt, Human
cugccugucccuugcgucaug

SEQ ID NO: 1200923 - RNA, 21 nt, Human
cugcugcccuguccucccggc

SEQ ID NO: 1200924 - RNA, 19 nt, Human
cuggagauaaagccuuucu

SEQ ID NO: 1200925 - RNA, 19 nt, Human
cugggcucacuucuucuug

SEQ ID NO: 1200926 - RNA, 22 nt, Human
cuggguucuccucggccucggc

SEQ ID NO: 1200927 - RNA, 25 nt, Human
cuuacagucaugguacuuuuauguu

SEQ ID NO: 1200928 - RNA, 27 nt, Human
cuugaccuugggccucauaccgguucc

SEQ ID NO: 1200929 - RNA, 21 nt, Human
cuugauuuggccucuucagcu

SEQ ID NO: 1200930 - RNA, 24 nt, Human
cuugcugguacagucaagugacuu

SEQ ID NO: 1200931 - RNA, 24 nt, Human
cuuuuuauuucuuccuucugggaa

SEQ ID NO: 1200932 - RNA, 20 nt, Human
gaacgcagugaugaagcugg

SEQ ID NO: 1200933 - RNA, 23 nt, Human
gaagcucuggggccuuucucguc

SEQ ID NO: 1200934 - RNA, 23 nt, Human
gaaggcuucagguaacuuuuuau

SEQ ID NO: 1200935 - RNA, 20 nt, Human
gacuguggaccaaaccuggg

SEQ ID NO: 1200936 - RNA, 21 nt, Human
gagaaaagacacauuuaucgu

SEQ ID NO: 1200937 - RNA, 20 nt, Human
gagcauccuccucacuagaa

SEQ ID NO: 1200938 - RNA, 19 nt, Human
gagcggcaggggaggguug

SEQ ID NO: 1200939 - RNA, 22 nt, Human
gaggggguugcuuggggaaccc

SEQ ID NO: 1200940 - RNA, 18 nt, Human
gagguuccugggccaccu

SEQ ID NO: 1200941 - RNA, 23 nt, Human
gauaacugaaguugaaggaagaa

SEQ ID NO: 1200942 - RNA, 25 nt, Human
gcaccccaggauggucccucugugc

SEQ ID NO: 1200943 - RNA, 19 nt, Human
gcagaagacagaguagggu

SEQ ID NO: 1200944 - RNA, 21 nt, Human
gccccggggcucccuuccccu

SEQ ID NO: 1200945 - RNA, 26 nt, Human
gccuugcccaucugccaaacccucca

SEQ ID NO: 1200946 - RNA, 20 nt, Human
gcgggucccaguucccggag

SEQ ID NO: 1200947 - RNA, 18 nt, Human
gcggugcuugugaaggag

SEQ ID NO: 1200948 - RNA, 18 nt, Human
gcugcgacuggucagcac

SEQ ID NO: 1200949 - RNA, 21 nt, Human
gcugggugcccauggcucugc

SEQ ID NO: 1200950 - RNA, 20 nt, Human
gcuggguucuccucggccuc

SEQ ID NO: 1200951 - RNA, 20 nt, Human
ggaagccaggccaaggcugc

SEQ ID NO: 1200952 - RNA, 21 nt, Human
ggacacgcccugaucugugcu

SEQ ID NO: 1200953 - RNA, 21 nt, Human
ggagauggggaaguagcacag

SEQ ID NO: 1200954 - RNA, 23 nt, Human
ggagggaacgguaaccagaggga

SEQ ID NO: 1200955 - RNA, 18 nt, Human
ggagguggaagcggugcu

SEQ ID NO: 1200956 - RNA, 23 nt, Human
ggcaaacaugaaacccugaguuu

SEQ ID NO: 1200957 - RNA, 20 nt, Human
ggcacuugaggaacucggga

SEQ ID NO: 1200958 - RNA, 19 nt, Human
ggccuaugggggaggcugg

SEQ ID NO: 1200959 - RNA, 21 nt, Human
ggccugggcaaucagcacugu

SEQ ID NO: 1200960 - RNA, 19 nt, Human
ggccugggccuccagggga

SEQ ID NO: 1200961 - RNA, 23 nt, Human
ggcucuggagcugaccggagagg

SEQ ID NO: 1200962 - RNA, 18 nt, Human
gggaacgaaaagagaaag

SEQ ID NO: 1200963 - RNA, 19 nt, Human
gggaaggagcacucggguc

SEQ ID NO: 1200964 - RNA, 24 nt, Human
gggcagaagacagaguaggguccu

SEQ ID NO: 1200965 - RNA, 20 nt, Human
gggccuuggagggaagagcu

SEQ ID NO: 1200966 - RNA, 22 nt, Human
ggggaccaagggaguguggccu

SEQ ID NO: 1200967 - RNA, 19 nt, Human
ggggaggguuggugauggg

SEQ ID NO: 1200968 - RNA, 21 nt, Human
ggggaggguuggugauggggu

SEQ ID NO: 1200969 - RNA, 22 nt, Human
ggggauggggguggcagagugg

SEQ ID NO: 1200970 - RNA, 21 nt, Human
ggggcacugccagcugcuucu

SEQ ID NO: 1200971 - RNA, 24 nt, Human
gggugugagugguggccccgagaa

SEQ ID NO: 1200972 - RNA, 18 nt, Human
ggugguuuguagaggcuu

SEQ ID NO: 1200973 - RNA, 18 nt, Human
ggugugugcugagcuggg

SEQ ID NO: 1200974 - RNA, 23 nt, Human
ggugugugcugagcugggggcag

SEQ ID NO: 1200975 - RNA, 21 nt, Human
gguguugaccccccacccccc

SEQ ID NO: 1200976 - RNA, 23 nt, Human
guaccagaaccaggguucaaaaa

SEQ ID NO: 1200977 - RNA, 18 nt, Human
guagaaaugauguggaua

SEQ ID NO: 1200978 - RNA, 18 nt, Human
gucccucugugcuggguu

SEQ ID NO: 1200979 - RNA, 18 nt, Human
gugugcugagcugggggc

SEQ ID NO: 1200980 - RNA, 24 nt, Human
guucaaaaacagggcuuuccaucu

SEQ ID NO: 1200981 - RNA, 19 nt, Human
guucacugccuacgccucc

SEQ ID NO: 1200982 - RNA, 20 nt, Human
guuggcaaacaugaaacccu

SEQ ID NO: 1200983 - RNA, 18 nt, Human
uaaaagggcccauggaug

SEQ ID NO: 1200984 - RNA, 22 nt, Human
uaaauagucuuuccaguauccu

SEQ ID NO: 1200985 - RNA, 19 nt, Human
uaaaugaugccuuucuugg

SEQ ID NO: 1200986 - RNA, 28 nt, Human
uaaaugcagauaucuugauagaugaccc

SEQ ID NO: 1200987 - RNA, 18 nt, Human
uaacccgccccgcucugg

SEQ ID NO: 1200988 - RNA, 19 nt, Human
uaagaaaagcaccuuggua

SEQ ID NO: 1200989 - RNA, 20 nt, Human
uaagagaucuguauauagug

SEQ ID NO: 1200990 - RNA, 19 nt, Human
uaagucucugaucaugugg

SEQ ID NO: 1200991 - RNA, 22 nt, Human
uaagucucugaucauguggcaa

SEQ ID NO: 1200992 - RNA, 22 nt, Human
uaagugaauuaauuccuccuuu

SEQ ID NO: 1200993 - RNA, 26 nt, Human
uacauuuucagcauugacaccaaccu

SEQ ID NO: 1200994 - RNA, 23 nt, Human
uaccagaaccaggguucaaaaac

SEQ ID NO: 1200995 - RNA, 24 nt, Human
uacccuggcucuugucuugagaac

SEQ ID NO: 1200996 - RNA, 19 nt, Human
uacugggccuucuggggcc

SEQ ID NO: 1200997 - RNA, 24 nt, Human
uagagaacaagccgcugaagagaa

SEQ ID NO: 1200998 - RNA, 23 nt, Human
uagcagauucccuaucaggcagc

SEQ ID NO: 1200999 - RNA, 18 nt, Human
uaggguccuugcuccagg

SEQ ID NO: 1201000 - RNA, 22 nt, Human
uaguggagcccccugaggcugg

SEQ ID NO: 1201001 - RNA, 19 nt, Human
uauccuggcaggccugggc

SEQ ID NO: 1201002 - RNA, 27 nt, Human
ucacaggucuucacggcaccaagaucu

SEQ ID NO: 1201003 - RNA, 22 nt, Human
ucacuagaacucugggaugugc

SEQ ID NO: 1201004 - RNA, 22 nt, Human
ucagccacaccagcuuccccca

SEQ ID NO: 1201005 - RNA, 28 nt, Human
ucaggcugaauagcuccggcaacccaua

SEQ ID NO: 1201006 - RNA, 24 nt, Human
ucaggggcguucucagucauuggc

SEQ ID NO: 1201007 - RNA, 20 nt, Human
ucagguucacugccuacgcc

SEQ ID NO: 1201008 - RNA, 19 nt, Human
ucagucuucgcugcugguc

SEQ ID NO: 1201009 - RNA, 19 nt, Human
uccaggauucugggucaac

SEQ ID NO: 1201010 - RNA, 20 nt, Human
ucccaggggaggcguccguc

SEQ ID NO: 1201011 - RNA, 21 nt, Human
ucccccaaaccugucccucuu

SEQ ID NO: 1201012 - RNA, 26 nt, Human
ucccccaaagacagcaucuuggucau

SEQ ID NO: 1201013 - RNA, 22 nt, Human
ucccggagaauguccugaggcu

SEQ ID NO: 1201014 - RNA, 20 nt, Human
ucccucugugcuggguucuc

SEQ ID NO: 1201015 - RNA, 21 nt, Human
ucccucugugcuggguucucc

SEQ ID NO: 1201016 - RNA, 18 nt, Human
ucccugaccaggggugga

SEQ ID NO: 1201017 - RNA, 21 nt, Human
uccuccucacuagaacucugg

SEQ ID NO: 1201018 - RNA, 24 nt, Human
uccucggccucggcugugcccacc

SEQ ID NO: 1201019 - RNA, 24 nt, Human
ucgcucccuccugcugcccugucc

SEQ ID NO: 1201020 - RNA, 18 nt, Human
ucgcugggguccacuuuc

SEQ ID NO: 1201021 - RNA, 21 nt, Human
ucgcuucagaaaacacaggag

SEQ ID NO: 1201022 - RNA, 23 nt, Human
ucuccagcgucccugacagaugu

SEQ ID NO: 1201023 - RNA, 20 nt, Human
ucuccaguaacuugauguug

SEQ ID NO: 1201024 - RNA, 23 nt, Human
ucuccaguaacuugauguugccc

SEQ ID NO: 1201025 - RNA, 27 nt, Human
ucucccccaaaccugucccucuuguug

SEQ ID NO: 1201026 - RNA, 21 nt, Human
ucucccuccuccucggagucc

SEQ ID NO: 1201027 - RNA, 24 nt, Human
ucucucagagcagaaugcaugaau

SEQ ID NO: 1201028 - RNA, 21 nt, Human
ucugaaguacaucuggagagg

SEQ ID NO: 1201029 - RNA, 19 nt, Human
ucugacagaugcgacacaa

SEQ ID NO: 1201030 - RNA, 22 nt, Human
ucugagcuagagucaagagggc

SEQ ID NO: 1201031 - RNA, 19 nt, Human
ucugcccugcucccaccag

SEQ ID NO: 1201032 - RNA, 22 nt, Human
ucugcccugcucccaccagaag

SEQ ID NO: 1201033 - RNA, 23 nt, Human
ucuggagaggguucgcugggguc

SEQ ID NO: 1201034 - RNA, 20 nt, Human
ucugggucaacaucaucccc

SEQ ID NO: 1201035 - RNA, 26 nt, Human
ucuguccuucucuguagcagauuccc

SEQ ID NO: 1201036 - RNA, 19 nt, Human
ucuucagugucaucgcuuu

SEQ ID NO: 1201037 - RNA, 21 nt, Human
ucuuccuucccuccuccauug

SEQ ID NO: 1201038 - RNA, 22 nt, Human
ucuugauggagaggagcuggaa

SEQ ID NO: 1201039 - RNA, 23 nt, Human
ucuuggugagugggaaguuuuug

SEQ ID NO: 1201040 - RNA, 22 nt, Human
ugaaaggccucuagcaccaagu

SEQ ID NO: 1201041 - RNA, 26 nt, Human
ugaacaaacugcaggcuucccacaca

SEQ ID NO: 1201042 - RNA, 19 nt, Human
ugaacuacuugaucugcau

SEQ ID NO: 1201043 - RNA, 26 nt, Human
ugaagaacacgaauauuuagagaaca

SEQ ID NO: 1201044 - RNA, 22 nt, Human
ugaaggcacagcacaggggucu

SEQ ID NO: 1201045 - RNA, 22 nt, Human
ugaccucugcaauuuucagcau

SEQ ID NO: 1201046 - RNA, 18 nt, Human
ugacuacagcauacguag

SEQ ID NO: 1201047 - RNA, 19 nt, Human
ugacuacagcauacguagu

SEQ ID NO: 1201048 - RNA, 18 nt, Human
ugagaugccaggaugugg

SEQ ID NO: 1201049 - RNA, 21 nt, Human
ugagcgcacaccaacccacag

SEQ ID NO: 1201050 - RNA, 19 nt, Human
ugaguccuggugaccugga

SEQ ID NO: 1201051 - RNA, 23 nt, Human
ugauagaaggcccgcuccucucu

SEQ ID NO: 1201052 - RNA, 19 nt, Human
ugauagaugaccuugguuc

SEQ ID NO: 1201053 - RNA, 23 nt, Human
ugaugugaacagcacacugggcc

SEQ ID NO: 1201054 - RNA, 18 nt, Human
ugauguugcccacuacua

SEQ ID NO: 1201055 - RNA, 19 nt, Human
ugauuccuaaucccugacc

SEQ ID NO: 1201056 - RNA, 21 nt, Human
ugauuugggaaaugagacacu

SEQ ID NO: 1201057 - RNA, 20 nt, Human
ugcaaagaaaguaaauggug

SEQ ID NO: 1201058 - RNA, 24 nt, Human
ugcagcucacucugggaaggagca

SEQ ID NO: 1201059 - RNA, 19 nt, Human
ugccagugcaccucgaggg

SEQ ID NO: 1201060 - RNA, 21 nt, Human
ugcccugcucccaccagaagu

SEQ ID NO: 1201061 - RNA, 21 nt, Human
ugcccuguccucccggccgcg

SEQ ID NO: 1201062 - RNA, 19 nt, Human
ugccuggaaccgugugggg

SEQ ID NO: 1201063 - RNA, 22 nt, Human
ugccuggaaccguguggggaac

SEQ ID NO: 1201064 - RNA, 19 nt, Human
ugccuggggacagccaggc

SEQ ID NO: 1201065 - RNA, 19 nt, Human
ugccuuuaucuuacugguu

SEQ ID NO: 1201066 - RNA, 21 nt, Human
ugcuauaaguuccauacagag

SEQ ID NO: 1201067 - RNA, 22 nt, Human
ugcuggugcuucugguagaacu

SEQ ID NO: 1201068 - RNA, 18 nt, Human
ugcugguggugucggagc

SEQ ID NO: 1201069 - RNA, 23 nt, Human
ugcuucuguccccagaugcucuc

SEQ ID NO: 1201070 - RNA, 19 nt, Human
uggaagaauccacuaagga

SEQ ID NO: 1201071 - RNA, 21 nt, Human
uggaagcggugcuugugaagg

SEQ ID NO: 1201072 - RNA, 22 nt, Human
uggagaggguucgcuggggucc

SEQ ID NO: 1201073 - RNA, 19 nt, Human
uggagauauuggucugcca

SEQ ID NO: 1201074 - RNA, 22 nt, Human
uggcaggccugggcaaucagca

SEQ ID NO: 1201075 - RNA, 24 nt, Human
uggccgagggcagucuugaaauug

SEQ ID NO: 1201076 - RNA, 21 nt, Human
uggcgggaagccaggccaagg

SEQ ID NO: 1201077 - RNA, 19 nt, Human
uggcuucuagaucguaccu

SEQ ID NO: 1201078 - RNA, 19 nt, Human
ugggaaaugagacacugca

SEQ ID NO: 1201079 - RNA, 23 nt, Human
ugggacaaccuuugcccagcaga

SEQ ID NO: 1201080 - RNA, 26 nt, Human
ugggacggaggagggcacuugaggaa

SEQ ID NO: 1201081 - RNA, 18 nt, Human
uggggauggggguggcag

SEQ ID NO: 1201082 - RNA, 22 nt, Human
ugggggaggcugggugcccaug

SEQ ID NO: 1201083 - RNA, 21 nt, Human
ugggguuucagccacaccagc

SEQ ID NO: 1201084 - RNA, 18 nt, Human
ugggugugagugguggcc

SEQ ID NO: 1201085 - RNA, 25 nt, Human
ugggugugagugguggccccgagaa

SEQ ID NO: 1201086 - RNA, 18 nt, Human
uggguuggugccagcauu

SEQ ID NO: 1201087 - RNA, 19 nt, Human
ugguacagucaagugacuu

SEQ ID NO: 1201088 - RNA, 21 nt, Human
uggucagcaccccaggauggu

SEQ ID NO: 1201089 - RNA, 23 nt, Human
uggugaugggguggauccuccag

SEQ ID NO: 1201090 - RNA, 18 nt, Human
uggugucggagcaacuug

SEQ ID NO: 1201091 - RNA, 24 nt, Human
uguaauaaucagauagagacaaga

SEQ ID NO: 1201092 - RNA, 19 nt, Human
uguaccaggacugcucugc

SEQ ID NO: 1201093 - RNA, 22 nt, Human
ugucacagacuucacuccaagg

SEQ ID NO: 1201094 - RNA, 23 nt, Human
ugucacugaaaccugguguuuuu

SEQ ID NO: 1201095 - RNA, 21 nt, Human
ugucagacgcagggcucugga

SEQ ID NO: 1201096 - RNA, 27 nt, Human
ugugaugggaaggagaacagggugagc

SEQ ID NO: 1201097 - RNA, 25 nt, Human
ugugcccacccgugucuggggugug

SEQ ID NO: 1201098 - RNA, 19 nt, Human
ugugcugagcugggggcag

SEQ ID NO: 1201099 - RNA, 20 nt, Human
ugugcugucagacgcagggc

SEQ ID NO: 1201100 - RNA, 21 nt, Human
ugugugcugagcugggggcag

SEQ ID NO: 1201101 - RNA, 21 nt, Human
uguucccgcagcggccugcau

SEQ ID NO: 1201102 - RNA, 22 nt, Human
uucacugccaccucuguccuuc

SEQ ID NO: 1201103 - RNA, 22 nt, Human
uucacuugcaggguuaacccgc

SEQ ID NO: 1201104 - RNA, 18 nt, Human
uucagcauuuucuucaaa

SEQ ID NO: 1201105 - RNA, 21 nt, Human
uuccaguaaaagggcccaugg

SEQ ID NO: 1201106 - RNA, 22 nt, Human
uuccccguaagaucccggagaa

SEQ ID NO: 1201107 - RNA, 19 nt, Human
uucccugacagcaaauucg

SEQ ID NO: 1201108 - RNA, 19 nt, Human
uuccgcuguuaaacaucuc

SEQ ID NO: 1201109 - RNA, 19 nt, Human
uuccugggccaccuguucc

SEQ ID NO: 1201110 - RNA, 20 nt, Human
uuccuucccuccuccauugg

SEQ ID NO: 1201111 - RNA, 22 nt, Human
uugcaggguuaacccgccccgc

SEQ ID NO: 1201112 - RNA, 23 nt, Human
uuucuaaugggagacagugguug

SEQ ID NO: 1201113 - RNA, 21 nt, Human
uuuucagcauugacaccaacc

SEQ ID NO: 1201114 - RNA, 24 nt, Human
uuuuucaggcacucuugaugaaca

SEQ ID NO: 1201115 - RNA, 21 nt, Human
ccucucacccccuucccaggc

SEQ ID NO: 1201116 - RNA, 23 nt, Human
ccucucacccccuucccaggcca

SEQ ID NO: 1201117 - RNA, 22 nt, Human
cucucacccccuucccaggcca

SEQ ID NO: 1201118 - RNA, 24 nt, Human
cuuuuucuuuccuuccucucaccc

SEQ ID NO: 1201119 - RNA, 20 nt, Human
uccuuuuucuuuccuuccuc

SEQ ID NO: 1201120 - RNA, 22 nt, Human
uuuccuuccucucacccccuuc

SEQ ID NO: 1201121 - RNA, 21 nt, Human
aacagaaaacaugcacacgag

SEQ ID NO: 1201122 - RNA, 21 nt, Human
aaggcacccuccccuccccua

SEQ ID NO: 1201123 - RNA, 30 nt, Human
agacgucguccgcgcccgcguacuccucgg

SEQ ID NO: 1201124 - RNA, 21 nt, Human
agcgccuccucugggcagagc

SEQ ID NO: 1201125 - RNA, 21 nt, Human
agggagccucaaaacauagca

SEQ ID NO: 1201126 - RNA, 20 nt, Human
agguugaaaaucgaaggcca

SEQ ID NO: 1201127 - RNA, 23 nt, Human
cacccuccccuccccuaaucccc

SEQ ID NO: 1201128 - RNA, 23 nt, Human
cagaucacucagccaacaagccc

SEQ ID NO: 1201129 - RNA, 24 nt, Human
cagccaacaagcccccuucagccu

SEQ ID NO: 1201130 - RNA, 19 nt, Human
cccagggcuggccccgcac

SEQ ID NO: 1201131 - RNA, 21 nt, Human
cccagguugaaaaucgaaggc

SEQ ID NO: 1201132 - RNA, 20 nt, Human
ccccagggcuggccccgcac

SEQ ID NO: 1201133 - RNA, 19 nt, Human
ccccgggcuggugccccuc

SEQ ID NO: 1201134 - RNA, 21 nt, Human
ccccucgccgcccgccgccgc

SEQ ID NO: 1201135 - RNA, 24 nt, Human
ccccuucuuuccugugcuuguccc

SEQ ID NO: 1201136 - RNA, 18 nt, Human
cccuccccuccccuaauc

SEQ ID NO: 1201137 - RNA, 22 nt, Human
cccuggaaggcacccuccccuc

SEQ ID NO: 1201138 - RNA, 24 nt, Human
ccucaaaacauagcacagaggcac

SEQ ID NO: 1201139 - RNA, 25 nt, Human
ccuccccuccccuaauccccagguu

SEQ ID NO: 1201140 - RNA, 23 nt, Human
ccuccucugggcagagcuggggc

SEQ ID NO: 1201141 - RNA, 18 nt, Human
ccucugggcagagcuggg

SEQ ID NO: 1201142 - RNA, 22 nt, Human
ccuggaaggcacccuccccucc

SEQ ID NO: 1201143 - RNA, 20 nt, Human
cgggcgggggcuggggcugc

SEQ ID NO: 1201144 - RNA, 22 nt, Human
cguccgcgcccgcguacuccuc

SEQ ID NO: 1201145 - RNA, 22 nt, Human
cuccucggcgacgggcgacugg

SEQ ID NO: 1201146 - RNA, 22 nt, Human
cucgggcgggggcuggggcugc

SEQ ID NO: 1201147 - RNA, 22 nt, Human
cuggccccgcacugguucagga

SEQ ID NO: 1201148 - RNA, 20 nt, Human
cuggggcugcuuucuccucu

SEQ ID NO: 1201149 - RNA, 22 nt, Human
cugguccccuucuuuccugugc

SEQ ID NO: 1201150 - RNA, 18 nt, Human
gagcggcccgaaggaggc

SEQ ID NO: 1201151 - RNA, 19 nt, Human
gagcuggggcugcuuucuc

SEQ ID NO: 1201152 - RNA, 21 nt, Human
gaggcucuggggacucguggg

SEQ ID NO: 1201153 - RNA, 23 nt, Human
gcacccuccccuccccuaauccc

SEQ ID NO: 1201154 - RNA, 22 nt, Human
gccauuugguuguagcuuuaga

SEQ ID NO: 1201155 - RNA, 18 nt, Human
gcgacgggcgacugggag

SEQ ID NO: 1201156 - RNA, 18 nt, Human
gcgccccgggcuggugcc

SEQ ID NO: 1201157 - RNA, 18 nt, Human
gcucuggggacucguggg

SEQ ID NO: 1201158 - RNA, 23 nt, Human
gcuggccccgcacugguucagga

SEQ ID NO: 1201159 - RNA, 18 nt, Human
gcuggcugccugggguca

SEQ ID NO: 1201160 - RNA, 19 nt, Human
gcuggcugccuggggucau

SEQ ID NO: 1201161 - RNA, 18 nt, Human
gcuggggcugcgaccagg

SEQ ID NO: 1201162 - RNA, 22 nt, Human
gcuuucuccucugcagaucacu

SEQ ID NO: 1201163 - RNA, 20 nt, Human
gggcaaaggccagacuggaa

SEQ ID NO: 1201164 - RNA, 18 nt, Human
gggcagagcuggggcugc

SEQ ID NO: 1201165 - RNA, 20 nt, Human
gggcgggggcuggggcugcg

SEQ ID NO: 1201166 - RNA, 23 nt, Human
gggggcuggggcugcgaccaggc

SEQ ID NO: 1201167 - RNA, 26 nt, Human
guccccuucuuuccugugcuuguccc

SEQ ID NO: 1201168 - RNA, 22 nt, Human
guccugaguagagcccuggaag

SEQ ID NO: 1201169 - RNA, 22 nt, Human
uaaaaugaaugguagaauauca

SEQ ID NO: 1201170 - RNA, 23 nt, Human
uagagcccuggaaggcacccucc

SEQ ID NO: 1201171 - RNA, 19 nt, Human
uaguccugaguagagcccu

SEQ ID NO: 1201172 - RNA, 21 nt, Human
ucaaaacauagcacagaggca

SEQ ID NO: 1201173 - RNA, 18 nt, Human
ucacucagccaacaagcc

SEQ ID NO: 1201174 - RNA, 20 nt, Human
ucgaugacggcgaagggcuu

SEQ ID NO: 1201175 - RNA, 19 nt, Human
ucgccgcccgccgccgcgc

SEQ ID NO: 1201176 - RNA, 21 nt, Human
ugaaaaacugcaagacccaaa

SEQ ID NO: 1201177 - RNA, 18 nt, Human
ugcaagaaggccagggca

SEQ ID NO: 1201178 - RNA, 20 nt, Human
ugcaagacccaaaggaauua

SEQ ID NO: 1201179 - RNA, 23 nt, Human
ugcaagacccaaaggaauuaaaa

SEQ ID NO: 1201180 - RNA, 28 nt, Human
ugcgaccaggcggugcugagccggcgcc

SEQ ID NO: 1201181 - RNA, 21 nt, Human
ugcuuucuccucugcagauca

SEQ ID NO: 1201182 - RNA, 21 nt, Human
uggcgcgccuccccagggcug

SEQ ID NO: 1201183 - RNA, 23 nt, Human
uggggucaugcccagcuggcaug

SEQ ID NO: 1201184 - RNA, 24 nt, Human
uggggucaugcccagcuggcaugg

SEQ ID NO: 1201185 - RNA, 19 nt, Human
uguggcuggcugccugggg

SEQ ID NO: 1201186 - RNA, 23 nt, Human
uuaguccugaguagagcccugga

SEQ ID NO: 1201187 - RNA, 22 nt, Human
aaaaaaaccuaaaccacaguga

SEQ ID NO: 1201188 - RNA, 26 nt, Human
aaaaaaaccuaaaccacagugacucc

SEQ ID NO: 1201189 - RNA, 21 nt, Human
aaagaaaaauuagccgggcau

SEQ ID NO: 1201190 - RNA, 21 nt, Human
aaaggggaaccaauaucccug

SEQ ID NO: 1201191 - RNA, 19 nt, Human
aacauggugaaaccccauu

SEQ ID NO: 1201192 - RNA, 20 nt, Human
aacauggugaaaccccauuu

SEQ ID NO: 1201193 - RNA, 21 nt, Human
aacauggugaaaccccauuuc

SEQ ID NO: 1201194 - RNA, 21 nt, Human
aacauggugaaaccccauuuc

SEQ ID NO: 1201195 - RNA, 20 nt, Human
acaccacugcacuccagccu

SEQ ID NO: 1201196 - RNA, 24 nt, Human
acaccacugcacuccagccugggc

SEQ ID NO: 1201197 - RNA, 22 nt, Human
acagagcgaaacugucucaaaa

SEQ ID NO: 1201198 - RNA, 22 nt, Human
accacugcacuccagccugggc

SEQ ID NO: 1201199 - RNA, 18 nt, Human
accccauuucuacuaaaa

SEQ ID NO: 1201200 - RNA, 25 nt, Human
accuuaagugggauggggagaaaaa

SEQ ID NO: 1201201 - RNA, 24 nt, Human
acugcacuccagccugggcaacag

SEQ ID NO: 1201202 - RNA, 24 nt, Human
acugcacuccagccugggcaacag

SEQ ID NO: 1201203 - RNA, 24 nt, Human
acuugaggucaggaguuugagacc

SEQ ID NO: 1201204 - RNA, 21 nt, Human
acuuugggggcucuagagagg

SEQ ID NO: 1201205 - RNA, 22 nt, Human
agccuggccaacauggugaaac

SEQ ID NO: 1201206 - RNA, 24 nt, Human
agccuggccaacauggugaaaccc

SEQ ID NO: 1201207 - RNA, 22 nt, Human
agcucacuugaggucaggaguu

SEQ ID NO: 1201208 - RNA, 22 nt, Human
agcucacuugaggucaggaguu

SEQ ID NO: 1201209 - RNA, 23 nt, Human
agcucacuugaggucaggaguuu

SEQ ID NO: 1201210 - RNA, 21 nt, Human
aggaaggcaggcaugggcucu

SEQ ID NO: 1201211 - RNA, 20 nt, Human
aggaguuugagaccagccug

SEQ ID NO: 1201212 - RNA, 24 nt, Human
aggcagacguugcagaaagccaag

SEQ ID NO: 1201213 - RNA, 18 nt, Human
aggcaggcaugggcucuu

SEQ ID NO: 1201214 - RNA, 18 nt, Human
aggccacccagcauacaa

SEQ ID NO: 1201215 - RNA, 24 nt, Human
aucacaccacugcacuccagccug

SEQ ID NO: 1201216 - RNA, 28 nt, Human
aucacaccacugcacuccagccugggca

SEQ ID NO: 1201217 - RNA, 21 nt, Human
auccagcuggugggaggggag

SEQ ID NO: 1201218 - RNA, 22 nt, Human
aucccacuacuaaggaggcuga

SEQ ID NO: 1201219 - RNA, 22 nt, Human
aucccagcacucugggaggcca

SEQ ID NO: 1201220 - RNA, 19 nt, Human
augggcauccagcuggugg

SEQ ID NO: 1201221 - RNA, 21 nt, Human
caaacagcagcaccuccucaa

SEQ ID NO: 1201222 - RNA, 24 nt, Human
caacauggugaaaccccauuucua

SEQ ID NO: 1201223 - RNA, 24 nt, Human
caaggcagucagcucacuugaggu

SEQ ID NO: 1201224 - RNA, 21 nt, Human
cacaccacugcacuccagccu

SEQ ID NO: 1201225 - RNA, 23 nt, Human
caccuguaaucccacuacuaagg

SEQ ID NO: 1201226 - RNA, 24 nt, Human
cacuacuaaggaggcugaggcagg

SEQ ID NO: 1201227 - RNA, 24 nt, Human
cacuccagccugggcaacagagcg

SEQ ID NO: 1201228 - RNA, 19 nt, Human
cacugcacuccagccuggg

SEQ ID NO: 1201229 - RNA, 21 nt, Human
cacugcacuccagccugggca

SEQ ID NO: 1201230 - RNA, 22 nt, Human
cacugcacuccagccugggcaa

SEQ ID NO: 1201231 - RNA, 23 nt, Human
cacugcacuccagccugggcaac

SEQ ID NO: 1201232 - RNA, 24 nt, Human
cacugcacuccagccugggcaaca

SEQ ID NO: 1201233 - RNA, 25 nt, Human
cacugcacuccagccugggcaacaa

SEQ ID NO: 1201234 - RNA, 23 nt, Human
cacuugaggucaggaguuugaga

SEQ ID NO: 1201235 - RNA, 21 nt, Human
cagcacucugggaggccaagg

SEQ ID NO: 1201236 - RNA, 24 nt, Human
cagcacucugggaggccaaggcag

SEQ ID NO: 1201237 - RNA, 24 nt, Human
cagcucacuugaggucaggaguuu

SEQ ID NO: 1201238 - RNA, 20 nt, Human
caugggcucuuucagugagg

SEQ ID NO: 1201239 - RNA, 20 nt, Human
ccacugcacuccagccuggg

SEQ ID NO: 1201240 - RNA, 20 nt, Human
ccacugcacuccagccuggg

SEQ ID NO: 1201241 - RNA, 21 nt, Human
ccacugcacuccagccugggc

SEQ ID NO: 1201242 - RNA, 23 nt, Human
ccacugcacuccagccugggcaa

SEQ ID NO: 1201243 - RNA, 24 nt, Human
ccacugcacuccagccugggcaac

SEQ ID NO: 1201244 - RNA, 21 nt, Human
ccagcugcugccugacuuugg

SEQ ID NO: 1201245 - RNA, 22 nt, Human
ccagcugcugccugacuuuggg

SEQ ID NO: 1201246 - RNA, 18 nt, Human
cccacuacuaaggaggcu

SEQ ID NO: 1201247 - RNA, 23 nt, Human
cccacuacuaaggaggcugaggc

SEQ ID NO: 1201248 - RNA, 20 nt, Human
cccaucaccuuaagugggau

SEQ ID NO: 1201249 - RNA, 29 nt, Human
ccccugagcacucauaccuaaaagcaaag

SEQ ID NO: 1201250 - RNA, 22 nt, Human
cccuugccccaucaccuuaagu

SEQ ID NO: 1201251 - RNA, 22 nt, Human
ccuaaaccacagugacucccaa

SEQ ID NO: 1201252 - RNA, 25 nt, Human
ccuaaaccacagugacucccaaaag

SEQ ID NO: 1201253 - RNA, 22 nt, Human
ccugacuuugggggcucuagag

SEQ ID NO: 1201254 - RNA, 23 nt, Human
ccuggccaacauggugaaacccc

SEQ ID NO: 1201255 - RNA, 24 nt, Human
ccuggccaacauggugaaacccca

SEQ ID NO: 1201256 - RNA, 24 nt, Human
cgaaacugucucaaaaaaaaagau

SEQ ID NO: 1201257 - RNA, 21 nt, Human
cuaaaaauaccaaaagaaaaa

SEQ ID NO: 1201258 - RNA, 23 nt, Human
cuaaaagcaaacagcagcaccuc

SEQ ID NO: 1201259 - RNA, 24 nt, Human
cucacuugaggucaggaguuugag

SEQ ID NO: 1201260 - RNA, 23 nt, Human
cuggccaacauggugaaacccca

SEQ ID NO: 1201261 - RNA, 21 nt, Human
gaaggcagacguugcagaaag

SEQ ID NO: 1201262 - RNA, 23 nt, Human
gagaccagccuggccaacauggu

SEQ ID NO: 1201263 - RNA, 24 nt, Human
gcacuccagccugggcaacagagc

SEQ ID NO: 1201264 - RNA, 21 nt, Human
gccaacauggugaaaccccau

SEQ ID NO: 1201265 - RNA, 19 nt, Human
gccaagaucacaccacugc

SEQ ID NO: 1201266 - RNA, 24 nt, Human
gccaaggcagucagcucacuugag

SEQ ID NO: 1201267 - RNA, 26 nt, Human
gccacaacauccggggccguggcccg

SEQ ID NO: 1201268 - RNA, 24 nt, Human
gcucacuugaggucaggaguuuga

SEQ ID NO: 1201269 - RNA, 22 nt, Human
ggagaaccucuucaaccuggaa

SEQ ID NO: 1201270 - RNA, 21 nt, Human
ggcauccagcuggugggaggg

SEQ ID NO: 1201271 - RNA, 24 nt, Human
gggcauaguagcgggcaccuguaa

SEQ ID NO: 1201272 - RNA, 19 nt, Human
ggucaggaguuugagacca

SEQ ID NO: 1201273 - RNA, 23 nt, Human
uaacaaaagaugacgacuaauua

SEQ ID NO: 1201274 - RNA, 20 nt, Human
uaccuaaaagcaaacagcag

SEQ ID NO: 1201275 - RNA, 23 nt, Human
uauuuuguucccccaaaguacca

SEQ ID NO: 1201276 - RNA, 23 nt, Human
ucacaccacugcacuccagccug

SEQ ID NO: 1201277 - RNA, 22 nt, Human
ucacuugaggucaggaguuuga

SEQ ID NO: 1201278 - RNA, 19 nt, Human
ucagugagggccccugagc

SEQ ID NO: 1201279 - RNA, 21 nt, Human
ucccugacuauuuuguucccc

SEQ ID NO: 1201280 - RNA, 21 nt, Human
ucccuugccccaucaccuuaa

SEQ ID NO: 1201281 - RNA, 23 nt, Human
ucccuugggggagcacacucuca

SEQ ID NO: 1201282 - RNA, 23 nt, Human
ugagaccagccuggccaacaugg

SEQ ID NO: 1201283 - RNA, 24 nt, Human
ugaggcaggagaaccucuucaacc

SEQ ID NO: 1201284 - RNA, 20 nt, Human
ugagggccccugagcacuca

SEQ ID NO: 1201285 - RNA, 18 nt, Human
ugaggucaggaguuugag

SEQ ID NO: 1201286 - RNA, 24 nt, Human
ugauggagagaagccucccuuggg

SEQ ID NO: 1201287 - RNA, 24 nt, Human
ugccccaucaccuuaagugggauu

SEQ ID NO: 1201288 - RNA, 24 nt, Human
uggccaacauggugaaaccccauu

SEQ ID NO: 1201289 - RNA, 21 nt, Human
ugggaggccaaggcagucagc

SEQ ID NO: 1201290 - RNA, 27 nt, Human
uuucuacuaaaaauaccaaaagaaaaa

SEQ ID NO: 1201291 - RNA, 21 nt, Human
aaaaaacagacagccaauaca

SEQ ID NO: 1201292 - RNA, 21 nt, Human
aaacagaagcagaaaaaguaa

SEQ ID NO: 1201293 - RNA, 30 nt, Human
aagcagaaaaaguaauaaguuaaauccaag

SEQ ID NO: 1201294 - RNA, 23 nt, Human
aagccucucuccgagggcggccc

SEQ ID NO: 1201295 - RNA, 18 nt, Human
aaggcugcagugagcuga

SEQ ID NO: 1201296 - RNA, 19 nt, Human
acacagagacaucaaaaaa

SEQ ID NO: 1201297 - RNA, 20 nt, Human
acccaccuccccacacagcc

SEQ ID NO: 1201298 - RNA, 19 nt, Human
acccucaggacaagagagg

SEQ ID NO: 1201299 - RNA, 24 nt, Human
accuccaauggucagcauuuucuu

SEQ ID NO: 1201300 - RNA, 22 nt, Human
agacagccaauacaucuagaac

SEQ ID NO: 1201301 - RNA, 21 nt, Human
aggaguggaagcuggcucagg

SEQ ID NO: 1201302 - RNA, 24 nt, Human
aggaucacuugagccuaggaguuc

SEQ ID NO: 1201303 - RNA, 19 nt, Human
aggcagcugggguggaaac

SEQ ID NO: 1201304 - RNA, 22 nt, Human
aggcugcagugagcugagauca

SEQ ID NO: 1201305 - RNA, 23 nt, Human
aggcuguuuggcacacagagaca

SEQ ID NO: 1201306 - RNA, 18 nt, Human
agguaggaggaucacuug

SEQ ID NO: 1201307 - RNA, 23 nt, Human
agguaggaggaucacuugagccu

SEQ ID NO: 1201308 - RNA, 24 nt, Human
agguugagguaggaggaucacuug

SEQ ID NO: 1201309 - RNA, 20 nt, Human
aguucaaggcugcagugagc

SEQ ID NO: 1201310 - RNA, 23 nt, Human
aucacuugagccuaggaguucaa

SEQ ID NO: 1201311 - RNA, 24 nt, Human
aucacuugagccuaggaguucaag

SEQ ID NO: 1201312 - RNA, 20 nt, Human
caagagaggcagcuggggug

SEQ ID NO: 1201313 - RNA, 18 nt, Human
cacccaccuccccacaca

SEQ ID NO: 1201314 - RNA, 19 nt, Human
cacccaccuccccacacag

SEQ ID NO: 1201315 - RNA, 18 nt, Human
cacugagcuuuccuguag

SEQ ID NO: 1201316 - RNA, 21 nt, Human
cacugagcuuuccuguagucc

SEQ ID NO: 1201317 - RNA, 21 nt, Human
cagcagucucuagcuugaucc

SEQ ID NO: 1201318 - RNA, 24 nt, Human
cagucucuagcuugauccaggagg

SEQ ID NO: 1201319 - RNA, 18 nt, Human
cagugaggacauguguuu

SEQ ID NO: 1201320 - RNA, 19 nt, Human
cagugaguucucuauucuu

SEQ ID NO: 1201321 - RNA, 19 nt, Human
caucaaaaaacagacagcc

SEQ ID NO: 1201322 - RNA, 20 nt, Human
caucaaaaaacagacagcca

SEQ ID NO: 1201323 - RNA, 22 nt, Human
caucaaaaaacagacagccaau

SEQ ID NO: 1201324 - RNA, 23 nt, Human
caucaaaaaacagacagccaaua

SEQ ID NO: 1201325 - RNA, 22 nt, Human
ccaauacaucuagaacaagccu

SEQ ID NO: 1201326 - RNA, 21 nt, Human
ccacccaccuccccacacagc

SEQ ID NO: 1201327 - RNA, 24 nt, Human
ccacccaccuccccacacagccag

SEQ ID NO: 1201328 - RNA, 19 nt, Human
ccccaucaccgcaccccuc

SEQ ID NO: 1201329 - RNA, 19 nt, Human
ccccaucaccgcaccccuc

SEQ ID NO: 1201330 - RNA, 22 nt, Human
ccccucagcagugccugggcuc

SEQ ID NO: 1201331 - RNA, 26 nt, Human
ccucccagguggcucaucaguggugg

SEQ ID NO: 1201332 - RNA, 21 nt, Human
ccucuccacccaccuccccac

SEQ ID NO: 1201333 - RNA, 23 nt, Human
ccugggcucaccucuccacccac

SEQ ID NO: 1201334 - RNA, 22 nt, Human
ccuguagucccaguuacucugg

SEQ ID NO: 1201335 - RNA, 18 nt, Human
cuagaacaagccucucuc

SEQ ID NO: 1201336 - RNA, 24 nt, Human
cucaccucuccacccaccucccca

SEQ ID NO: 1201337 - RNA, 23 nt, Human
cugauggcaagauuccaggcagg

SEQ ID NO: 1201338 - RNA, 19 nt, Human
cugcagugagcugagauca

SEQ ID NO: 1201339 - RNA, 20 nt, Human
cugcagugagcugagaucac

SEQ ID NO: 1201340 - RNA, 21 nt, Human
gaagugcccugauaaaaucuc

SEQ ID NO: 1201341 - RNA, 19 nt, Human
gaccccaucaccgcacccc

SEQ ID NO: 1201342 - RNA, 24 nt, Human
gccuaggaguucaaggcugcagug

SEQ ID NO: 1201343 - RNA, 23 nt, Human
ggaaacugucacuccagccuaac

SEQ ID NO: 1201344 - RNA, 19 nt, Human
ggaggagguugcugauggc

SEQ ID NO: 1201345 - RNA, 22 nt, Human
ggagguugagguaggaggauca

SEQ ID NO: 1201346 - RNA, 23 nt, Human
ggaucacuugagccuaggaguuc

SEQ ID NO: 1201347 - RNA, 18 nt, Human
gggcucaccucuccaccc

SEQ ID NO: 1201348 - RNA, 21 nt, Human
guuuggcacacagagacauca

SEQ ID NO: 1201349 - RNA, 19 nt, Human
uaacauucagugaggacau

SEQ ID NO: 1201350 - RNA, 19 nt, Human
uaaguuaaauccaagaaug

SEQ ID NO: 1201351 - RNA, 21 nt, Human
uagcuugauccaggaggcacu

SEQ ID NO: 1201352 - RNA, 20 nt, Human
ucaagauuugcauaccucca

SEQ ID NO: 1201353 - RNA, 18 nt, Human
ucacuugagccuaggagu

SEQ ID NO: 1201354 - RNA, 22 nt, Human
uccaggaggcacuggggaggag

SEQ ID NO: 1201355 - RNA, 23 nt, Human
uccaggaggcacuggggaggagg

SEQ ID NO: 1201356 - RNA, 19 nt, Human
ucuagcuugauccaggagg

SEQ ID NO: 1201357 - RNA, 20 nt, Human
ucuccacccaccuccccaca

SEQ ID NO: 1201358 - RNA, 18 nt, Human
ucucuauucagguaggag

SEQ ID NO: 1201359 - RNA, 22 nt, Human
ucucuauucagguaggagugga

SEQ ID NO: 1201360 - RNA, 20 nt, Human
ucuugggcuggggggugggc

SEQ ID NO: 1201361 - RNA, 24 nt, Human
ugagccuaggaguucaaggcugca

SEQ ID NO: 1201362 - RNA, 22 nt, Human
ugaggacauguguuuaucaugu

SEQ ID NO: 1201363 - RNA, 20 nt, Human
ugagguaggaggaucacuug

SEQ ID NO: 1201364 - RNA, 24 nt, Human
ugagguaggaggaucacuugagcc

SEQ ID NO: 1201365 - RNA, 19 nt, Human
ugccagcagucucuagcuu

SEQ ID NO: 1201366 - RNA, 20 nt, Human
uggaaacagaagcagaaaaa

SEQ ID NO: 1201367 - RNA, 19 nt, Human
uggauggacuguccuccca

SEQ ID NO: 1201368 - RNA, 21 nt, Human
ugggcagggacauuccugggg

SEQ ID NO: 1201369 - RNA, 21 nt, Human
uggggaggagguugcugaugg

SEQ ID NO: 1201370 - RNA, 24 nt, Human
uguagucccaguuacucuggaggu

SEQ ID NO: 1201371 - RNA, 18 nt, Human
ugucccacagguauagaa

SEQ ID NO: 1201372 - RNA, 24 nt, Human
uuccuguagucccaguuacucugg

SEQ ID NO: 1201373 - RNA, 21 nt, Human
uugagccuaggaguucaaggc

SEQ ID NO: 1201374 - RNA, 19 nt, Human
cugcaauguuccaccagcc

SEQ ID NO: 1201375 - RNA, 21 nt, Human
accccacuuccugccccucuc

SEQ ID NO: 1201376 - RNA, 18 nt, Human
acucagggcugugagcug

SEQ ID NO: 1201377 - RNA, 26 nt, Human
aucucguucauccuuucucucucugc

SEQ ID NO: 1201378 - RNA, 21 nt, Human
ccccacuuccugccccucuca

SEQ ID NO: 1201379 - RNA, 25 nt, Human
cccucucauuccuccuccuuccucu

SEQ ID NO: 1201380 - RNA, 19 nt, Human
ccuccuuccucucugucac

SEQ ID NO: 1201381 - RNA, 23 nt, Human
cuggaccccacuuccugccccuc

SEQ ID NO: 1201382 - RNA, 24 nt, Human
gaggucuggcagggcugagggcac

SEQ ID NO: 1201383 - RNA, 21 nt, Human
gccccucucauuccuccuccu

SEQ ID NO: 1201384 - RNA, 23 nt, Human
uaguaggcuuccuguauccacau

SEQ ID NO: 1201385 - RNA, 22 nt, Human
ucauccuuucucucucugccau

SEQ ID NO: 1201386 - RNA, 19 nt, Human
ucauuccuccuccuuccuc

SEQ ID NO: 1201387 - RNA, 18 nt, Human
uccuccuccuuccucucu

SEQ ID NO: 1201388 - RNA, 22 nt, Human
uccuccuccuuccucucuguca

SEQ ID NO: 1201389 - RNA, 24 nt, Human
ucucugccauggcugaggccacca

SEQ ID NO: 1201390 - RNA, 20 nt, Human
ugagggcacaaaggggcucc

SEQ ID NO: 1201391 - RNA, 21 nt, Human
ugguuugugcauucacuguuc

SEQ ID NO: 1201392 - RNA, 23 nt, Human
uguauccacauccuugagccaag

SEQ ID NO: 1201393 - RNA, 21 nt, Human
uuccugccccucucauuccuc

SEQ ID NO: 1201394 - RNA, 19 nt, Human
auccuguaaaacuaagaaa

SEQ ID NO: 1201395 - RNA, 22 nt, Human
ccuguaaaacuaagaaaacagg

SEQ ID NO: 1201396 - RNA, 19 nt, Human
uucaccuugucuaugcaaa

SEQ ID NO: 1201397 - RNA, 18 nt, Human
agccccugagcucugucc

SEQ ID NO: 1201398 - RNA, 24 nt, Human
agccccugagcucuguccaagcag

SEQ ID NO: 1201399 - RNA, 19 nt, Human
agcucuguccaagcagcag

SEQ ID NO: 1201400 - RNA, 20 nt, Human
aggaagguuugcaccaggac

SEQ ID NO: 1201401 - RNA, 25 nt, Human
caagcagcagcaguucccaacagag

SEQ ID NO: 1201402 - RNA, 25 nt, Human
cagcaguucccaacagagcucuggu

SEQ ID NO: 1201403 - RNA, 20 nt, Human
ccggacagccagggcugggc

SEQ ID NO: 1201404 - RNA, 18 nt, Human
cucugagccccugagcuc

SEQ ID NO: 1201405 - RNA, 24 nt, Human
cucugcucugagccccugagcucc

SEQ ID NO: 1201406 - RNA, 19 nt, Human
cuguccaagcagcagcagu

SEQ ID NO: 1201407 - RNA, 18 nt, Human
cuguguuuccaacucugc

SEQ ID NO: 1201408 - RNA, 22 nt, Human
gcagcagcaguucccaacagag

SEQ ID NO: 1201409 - RNA, 19 nt, Human
ggucccggaaagccggaca

SEQ ID NO: 1201410 - RNA, 19 nt, Human
guucccaacagagcucugg

SEQ ID NO: 1201411 - RNA, 22 nt, Human
ugagccccugagcucuguccaa

SEQ ID NO: 1201412 - RNA, 18 nt, Human
ugcucugagccccugagc

SEQ ID NO: 1201413 - RNA, 19 nt, Human
uugcacuguguuuccaacu

SEQ ID NO: 1201414 - RNA, 24 nt, Human
uugcacuguguuuccaacucugcu

SEQ ID NO: 1201415 - RNA, 21 nt, Human
aaucuucauuuugauguuuca

SEQ ID NO: 1201416 - RNA, 23 nt, Human
caaggcaaugaaccccuaacccc

SEQ ID NO: 1201417 - RNA, 21 nt, Human
caccgaagucucccggagcag

SEQ ID NO: 1201418 - RNA, 18 nt, Human
caggucacagagcgacgg

SEQ ID NO: 1201419 - RNA, 19 nt, Human
cgacggagugaguggcaga

SEQ ID NO: 1201420 - RNA, 24 nt, Human
cucggcuucagggguguccuggag

SEQ ID NO: 1201421 - RNA, 18 nt, Human
cucuggcugaagugcccc

SEQ ID NO: 1201422 - RNA, 21 nt, Human
gaggacacaaggcaaugaacc

SEQ ID NO: 1201423 - RNA, 20 nt, Human
ggagcagaggacacaaggca

SEQ ID NO: 1201424 - RNA, 20 nt, Human
ggcaaugaaccccuaacccc

SEQ ID NO: 1201425 - RNA, 21 nt, Human
ucaccgaagucucccggagca

SEQ ID NO: 1201426 - RNA, 25 nt, Human
ucucccggagcagaggacacaaggc

SEQ ID NO: 1201427 - RNA, 22 nt, Human
ugaaccccuaaccccgcgcucu

SEQ ID NO: 1201428 - RNA, 24 nt, Human
ugugagcaccaguuuaggguuuua

SEQ ID NO: 1201429 - RNA, 18 nt, Human
uuuuuuuuuuuuuuuuug

SEQ ID NO: 1201430 - RNA, 28 nt, Human
uuuuuuuuuuuuuuuuuuuuuuuggggg

SEQ ID NO: 1201431 - RNA, 20 nt, Human
caccucacagacaccgcuuc

SEQ ID NO: 1201432 - RNA, 21 nt, Human
ccgcuguccucgcugccgccg

SEQ ID NO: 1201433 - RNA, 24 nt, Human
ccgcuguccucgcugccgccgguu

SEQ ID NO: 1201434 - RNA, 23 nt, Human
ccucacagacaccgcuucucuca

SEQ ID NO: 1201435 - RNA, 22 nt, Human
ccucgcugccgccgccacccca

SEQ ID NO: 1201436 - RNA, 20 nt, Human
ucgcugccgccgccacccca

SEQ ID NO: 1201437 - RNA, 26 nt, Human
ucgcugccgccgccaccccagugugu

SEQ ID NO: 1201438 - RNA, 24 nt, Human
ucucucagggaaugcgacaaaggc

SEQ ID NO: 1201439 - RNA, 20 nt, Human
ugcgacaaaggcacccugcc

SEQ ID NO: 1201440 - RNA, 20 nt, Human
gcgguggggagacacagcag

SEQ ID NO: 1201441 - RNA, 18 nt, Human
ggcagacggcggugggga

SEQ ID NO: 1201442 - RNA, 19 nt, Human
ugcacgguuggggcagacg

SEQ ID NO: 1201443 - RNA, 23 nt, Human
uggggcagacggcgguggggaga

SEQ ID NO: 1201444 - RNA, 20 nt, Human
uucccaugcaaaaauuugca

SEQ ID NO: 1201445 - RNA, 20 nt, Human
agaaaaaaaucccuucggga

SEQ ID NO: 1201446 - RNA, 25 nt, Human
agaaaaaaaucccuucgggaaugaa

SEQ ID NO: 1201447 - RNA, 22 nt, Human
cccuucgggaaugaaggaccgg

SEQ ID NO: 1201448 - RNA, 24 nt, Human
uaacagaaaaaaaucccuucggga

SEQ ID NO: 1201449 - RNA, 21 nt, Human
uagaugugcuaucaaaaacug

SEQ ID NO: 1201450 - RNA, 24 nt, Human
uagaugugcuaucaaaaacuguug

SEQ ID NO: 1201451 - RNA, 24 nt, Human
ucacgugcuuucucuucucuccug

SEQ ID NO: 1201452 - RNA, 22 nt, Human
ugaguuaacagaaaaaaauccc

SEQ ID NO: 1201453 - RNA, 20 nt, Human
ggcggagaggagcacaacag

SEQ ID NO: 1201454 - RNA, 22 nt, Human
ucgcgccacgcaaacuguggug

SEQ ID NO: 1201455 - RNA, 20 nt, Human
ucgugugcaaguccagaggg

SEQ ID NO: 1201456 - RNA, 25 nt, Human
ugggagaagucaaaccccaguggcg

SEQ ID NO: 1201457 - RNA, 22 nt, Human
ugggggcggagaggagcacaac

SEQ ID NO: 1201458 - RNA, 22 nt, Human
ugugaugaggguuucaaagcgu

SEQ ID NO: 1201459 - RNA, 20 nt, Human
acugagauguccagagcaga

SEQ ID NO: 1201460 - RNA, 18 nt, Human
uccagagcagaugaagaa

SEQ ID NO: 1201461 - RNA, 19 nt, Human
uccagagcagaugaagaau

SEQ ID NO: 1201462 - RNA, 18 nt, Human
uguccagagcagaugaag

SEQ ID NO: 1201463 - RNA, 19 nt, Human
uguccagagcagaugaaga

SEQ ID NO: 1201464 - RNA, 26 nt, Human
acaggcgacgagauguucacaaugcg

SEQ ID NO: 1201465 - RNA, 23 nt, Human
agcagguucacauugccccccuc

SEQ ID NO: 1201466 - RNA, 21 nt, Human
agccgucucggagcugucucc

SEQ ID NO: 1201467 - RNA, 20 nt, Human
cacgagacccacggcucuuu

SEQ ID NO: 1201468 - RNA, 20 nt, Human
ccccugcagggggaggugag

SEQ ID NO: 1201469 - RNA, 19 nt, Human
cccucgucgccgagcccca

SEQ ID NO: 1201470 - RNA, 19 nt, Human
ccuccucuucuccucucuc

SEQ ID NO: 1201471 - RNA, 18 nt, Human
ccucuucuccucucucuu

SEQ ID NO: 1201472 - RNA, 18 nt, Human
cggcccggcccagcgcgg

SEQ ID NO: 1201473 - RNA, 28 nt, Human
cuccgaggugaagccgucucggagcugu

SEQ ID NO: 1201474 - RNA, 26 nt, Human
cuccuccucuucuccucucucuucuu

SEQ ID NO: 1201475 - RNA, 20 nt, Human
cuccucucucuucuuccuug

SEQ ID NO: 1201476 - RNA, 27 nt, Human
cucucucuucuuccuugguggccgaga

SEQ ID NO: 1201477 - RNA, 19 nt, Human
cucugccuccuccucuucu

SEQ ID NO: 1201478 - RNA, 21 nt, Human
cucuugcucccccguuucucu

SEQ ID NO: 1201479 - RNA, 22 nt, Human
cugccuccuccucuucuccucu

SEQ ID NO: 1201480 - RNA, 23 nt, Human
cugucuccaggugaccgugggcu

SEQ ID NO: 1201481 - RNA, 22 nt, Human
gaagaucuuucuuccucugccu

SEQ ID NO: 1201482 - RNA, 22 nt, Human
gagagcucuucugcccccacga

SEQ ID NO: 1201483 - RNA, 24 nt, Human
gccgagagcucuucugcccccacg

SEQ ID NO: 1201484 - RNA, 20 nt, Human
gccgucucggagcugucucc

SEQ ID NO: 1201485 - RNA, 26 nt, Human
gcgccgaguuaaccccguugugaguc

SEQ ID NO: 1201486 - RNA, 21 nt, Human
gcucccccguuucucucacuc

SEQ ID NO: 1201487 - RNA, 21 nt, Human
ucacauugccccccucauuca

SEQ ID NO: 1201488 - RNA, 20 nt, Human
uccuccucuucuccucucuc

SEQ ID NO: 1201489 - RNA, 20 nt, Human
uccuugguggccgagagcuc

SEQ ID NO: 1201490 - RNA, 18 nt, Human
ucuccaggugaccguggg

SEQ ID NO: 1201491 - RNA, 21 nt, Human
ucuccaggugaccgugggcuc

SEQ ID NO: 1201492 - RNA, 21 nt, Human
ucugaagaucuuucuuccucu

SEQ ID NO: 1201493 - RNA, 18 nt, Human
ucuucuccucucucuucu

SEQ ID NO: 1201494 - RNA, 22 nt, Human
ucuuucuuccucugccuccucc

SEQ ID NO: 1201495 - RNA, 25 nt, Human
ugaagccgucucggagcugucucca

SEQ ID NO: 1201496 - RNA, 22 nt, Human
ugaccgugggcucuggccgccc

SEQ ID NO: 1201497 - RNA, 19 nt, Human
ugauggguucucugaagau

SEQ ID NO: 1201498 - RNA, 22 nt, Human
ugccccccucauucaccgucac

SEQ ID NO: 1201499 - RNA, 23 nt, Human
ugcgggcagggacguggacaaug

SEQ ID NO: 1201500 - RNA, 21 nt, Human
ugcgggcgcuggucacguccg

SEQ ID NO: 1201501 - RNA, 22 nt, Human
uggaaggagcagguguagaggc

SEQ ID NO: 1201502 - RNA, 21 nt, Human
uuuugcguuaucccucacagu

SEQ ID NO: 1201503 - RNA, 21 nt, Human
aaaaacaagaucucaccagaa

SEQ ID NO: 1201504 - RNA, 21 nt, Human
aaaaagcaaaacaaacaaaaa

SEQ ID NO: 1201505 - RNA, 23 nt, Human
aaacaaaaaaacaagaucucacc

SEQ ID NO: 1201506 - RNA, 19 nt, Human
aaagcaaaacaaacaaaaa

SEQ ID NO: 1201507 - RNA, 20 nt, Human
aagcaaaacaaacaaaaaaa

SEQ ID NO: 1201508 - RNA, 22 nt, Human
aagcaaaacaaacaaaaaaaca

SEQ ID NO: 1201509 - RNA, 23 nt, Human
aagcaaaacaaacaaaaaaacaa

SEQ ID NO: 1201510 - RNA, 21 nt, Human
aauaggagcaagagagaggaa

SEQ ID NO: 1201511 - RNA, 20 nt, Human
acaaaaaaacaagaucucac

SEQ ID NO: 1201512 - RNA, 19 nt, Human
acacuuuuuuuuuuuuuuu

SEQ ID NO: 1201513 - RNA, 20 nt, Human
acagagagagacuccgucuc

SEQ ID NO: 1201514 - RNA, 24 nt, Human
acagagagagacuccgucucaaaa

SEQ ID NO: 1201515 - RNA, 19 nt, Human
acaguucugcaggcuuuac

SEQ ID NO: 1201516 - RNA, 20 nt, Human
acaguucugcaggcuuuaca

SEQ ID NO: 1201517 - RNA, 19 nt, Human
acccaggcuggagugcacu

SEQ ID NO: 1201518 - RNA, 20 nt, Human
acccaggcuggagugcacug

SEQ ID NO: 1201519 - RNA, 23 nt, Human
acugcauuccagccuggcgacag

SEQ ID NO: 1201520 - RNA, 25 nt, Human
acugcauuccagccuggcgacagag

SEQ ID NO: 1201521 - RNA, 22 nt, Human
acuuuuuuuuuuuuuuuuuuuu

SEQ ID NO: 1201522 - RNA, 21 nt, Human
agccuggcgacagagagagac

SEQ ID NO: 1201523 - RNA, 24 nt, Human
agugcacuggcacgaucuuggcuc

SEQ ID NO: 1201524 - RNA, 21 nt, Human
aucccaagaagagcaaaaagc

SEQ ID NO: 1201525 - RNA, 22 nt, Human
aucucccaccaggccccaccuc

SEQ ID NO: 1201526 - RNA, 23 nt, Human
caaaaaaacaagaucucaccaga

SEQ ID NO: 1201527 - RNA, 25 nt, Human
caagaagagcaaaaagcggguggug

SEQ ID NO: 1201528 - RNA, 21 nt, Human
cacugcacugcauuccagccu

SEQ ID NO: 1201529 - RNA, 18 nt, Human
cacugcauuccagccugg

SEQ ID NO: 1201530 - RNA, 18 nt, Human
cacugcauuccagccugg

SEQ ID NO: 1201531 - RNA, 22 nt, Human
cacugcauuccagccuggcgac

SEQ ID NO: 1201532 - RNA, 23 nt, Human
cacugcauuccagccuggcgaca

SEQ ID NO: 1201533 - RNA, 24 nt, Human
cacugcauuccagccuggcgacag

SEQ ID NO: 1201534 - RNA, 19 nt, Human
cacuuuuuuuuuuuuuuuu

SEQ ID NO: 1201535 - RNA, 21 nt, Human
cagccuggcgacagagagaga

SEQ ID NO: 1201536 - RNA, 22 nt, Human
cagggucucgcugucacccagg

SEQ ID NO: 1201537 - RNA, 24 nt, Human
caugucacauggcaagaauaggag

SEQ ID NO: 1201538 - RNA, 24 nt, Human
ccauacacuuuuuuuuuuuuuuuu

SEQ ID NO: 1201539 - RNA, 21 nt, Human
cccaccaggccccaccuccaa

SEQ ID NO: 1201540 - RNA, 21 nt, Human
ccugugauccaaucaucuccc

SEQ ID NO: 1201541 - RNA, 25 nt, Human
cgucucaaaaaagcaaaacaaacaa

SEQ ID NO: 1201542 - RNA, 18 nt, Human
cucacaguucugcaggcu

SEQ ID NO: 1201543 - RNA, 19 nt, Human
cucaggaauguuaaaauca

SEQ ID NO: 1201544 - RNA, 21 nt, Human
cucccaccaggccccaccucc

SEQ ID NO: 1201545 - RNA, 19 nt, Human
cuuccgaggaagccucagg

SEQ ID NO: 1201546 - RNA, 24 nt, Human
gacagagagagacuccgucucaaa

SEQ ID NO: 1201547 - RNA, 20 nt, Human
gacagggucucgcugucacc

SEQ ID NO: 1201548 - RNA, 19 nt, Human
gcaagaauaggagcaagag

SEQ ID NO: 1201549 - RNA, 21 nt, Human
gcacugcauuccagccuggcg

SEQ ID NO: 1201550 - RNA, 26 nt, Human
ggcucacugcacugcauuccagccug

SEQ ID NO: 1201551 - RNA, 23 nt, Human
gucucgcugucacccaggcugga

SEQ ID NO: 1201552 - RNA, 20 nt, Human
uacacuuuuuuuuuuuuuua

SEQ ID NO: 1201553 - RNA, 20 nt, Human
uacgucaggccuguuauaug

SEQ ID NO: 1201554 - RNA, 18 nt, Human
ucacccaggcuggagugc

SEQ ID NO: 1201555 - RNA, 20 nt, Human
ucacugcacugcauuccagc

SEQ ID NO: 1201556 - RNA, 19 nt, Human
uccacaugagauuucagac

SEQ ID NO: 1201557 - RNA, 23 nt, Human
ucccaccaggccccaccuccaau

SEQ ID NO: 1201558 - RNA, 23 nt, Human
ucgcugucacccaggcuggagug

SEQ ID NO: 1201559 - RNA, 21 nt, Human
ucucaaaaaagcaaaacaaac

SEQ ID NO: 1201560 - RNA, 28 nt, Human
ucuccaguaugccuucucuucccaaggg

SEQ ID NO: 1201561 - RNA, 20 nt, Human
ucucgcugucacccaggcug

SEQ ID NO: 1201562 - RNA, 21 nt, Human
ucucgcugucacccaggcugg

SEQ ID NO: 1201563 - RNA, 22 nt, Human
ucucgcugucacccaggcugga

SEQ ID NO: 1201564 - RNA, 24 nt, Human
ucucgcugucacccaggcuggagu

SEQ ID NO: 1201565 - RNA, 22 nt, Human
ugauccaaucaucucccaccag

SEQ ID NO: 1201566 - RNA, 21 nt, Human
ugcacugcauuccagccuggc

SEQ ID NO: 1201567 - RNA, 24 nt, Human
ugcacugcauuccagccuggcgac

SEQ ID NO: 1201568 - RNA, 20 nt, Human
uggagacagggucucgcugu

SEQ ID NO: 1201569 - RNA, 20 nt, Human
uggagugcacuggcacgauc

SEQ ID NO: 1201570 - RNA, 24 nt, Human
uggagugcacuggcacgaucuugg

SEQ ID NO: 1201571 - RNA, 23 nt, Human
ugucacauggcaagaauaggagc

SEQ ID NO: 1201572 - RNA, 26 nt, Human
uuuuuuuuuucuggagacagggucuc

SEQ ID NO: 1201573 - RNA, 18 nt, Human
uuuuuuuuuuuuuuucug

SEQ ID NO: 1201574 - RNA, 28 nt, Human
uuuuuuuuuuuuuuuucuggagacaggg

SEQ ID NO: 1201575 - RNA, 19 nt, Human
aggccccaggaccggggug

SEQ ID NO: 1201576 - RNA, 18 nt, Human
agggaccugcucucacug

SEQ ID NO: 1201577 - RNA, 19 nt, Human
caggaccgggguguccugg

SEQ ID NO: 1201578 - RNA, 18 nt, Human
gacccagccucuccacug

SEQ ID NO: 1201579 - RNA, 18 nt, Human
gacuccuggcaugcaggc

SEQ ID NO: 1201580 - RNA, 21 nt, Human
ggaccugcucucacugauucu

SEQ ID NO: 1201581 - RNA, 19 nt, Human
uccacugucucuuggaggg

SEQ ID NO: 1201582 - RNA, 21 nt, Human
ucucuuggaggaagcacaggg

SEQ ID NO: 1201583 - RNA, 25 nt, Human
ucucuuggaggaagcacagggcggu

SEQ ID NO: 1201584 - RNA, 23 nt, Human
uggcaugcaggccagagggaccu

SEQ ID NO: 1201585 - RNA, 23 nt, Human
aaacacucugcuuuaaagagaaa

SEQ ID NO: 1201586 - RNA, 22 nt, Human
aucugauuuuuucccuauuuuc

SEQ ID NO: 1201587 - RNA, 20 nt, Human
cccacaggcugucaaacuua

SEQ ID NO: 1201588 - RNA, 26 nt, Human
cggcauaccuuauguuauuuuucagu

SEQ ID NO: 1201589 - RNA, 23 nt, Human
cuauugauagacuucucaacugg

SEQ ID NO: 1201590 - RNA, 25 nt, Human
uauuacaaauguuuuugacacaagg

SEQ ID NO: 1201591 - RNA, 25 nt, Human
ucacguauuuguuuccggcauaccu

SEQ ID NO: 1201592 - RNA, 20 nt, Human
uccccaguuugaaaucucug

SEQ ID NO: 1201593 - RNA, 20 nt, Human
uccuuauaaauggcuuguca

SEQ ID NO: 1201594 - RNA, 19 nt, Human
ugaugccauggcuuuccuu

SEQ ID NO: 1201595 - RNA, 19 nt, Human
ugugccuguaagcuuaauc

SEQ ID NO: 1201596 - RNA, 20 nt, Human
uuguaauuuuuuacaucaua

SEQ ID NO: 1201597 - RNA, 22 nt, Human
agaggggggccgaucuccuccg

SEQ ID NO: 1201598 - RNA, 22 nt, Human
cagcagaauuggggccgggucg

SEQ ID NO: 1201599 - RNA, 20 nt, Human
cagcccugggccuggggcuu

SEQ ID NO: 1201600 - RNA, 22 nt, Human
cccugggccuggggcuuggucc

SEQ ID NO: 1201601 - RNA, 24 nt, Human
ccucgccuccuuggcuccuuucuu

SEQ ID NO: 1201602 - RNA, 18 nt, Human
ccuuucuuccuuccccac

SEQ ID NO: 1201603 - RNA, 20 nt, Human
cgccuccuuggcuccuuucu

SEQ ID NO: 1201604 - RNA, 24 nt, Human
cuccgggccaagccugcagcuccc

SEQ ID NO: 1201605 - RNA, 19 nt, Human
cuccuuucuuccuucccca

SEQ ID NO: 1201606 - RNA, 18 nt, Human
cuuucuuccuuccccacg

SEQ ID NO: 1201607 - RNA, 18 nt, Human
ggccaagccugcagcucc

SEQ ID NO: 1201608 - RNA, 20 nt, Human
ggccuggggcuugguccugg

SEQ ID NO: 1201609 - RNA, 18 nt, Human
gggaggcugguggggguc

SEQ ID NO: 1201610 - RNA, 18 nt, Human
gggagggaggcugguggg

SEQ ID NO: 1201611 - RNA, 19 nt, Human
ggucccagguccuagaggg

SEQ ID NO: 1201612 - RNA, 18 nt, Human
gguggcggggagggaggg

SEQ ID NO: 1201613 - RNA, 21 nt, Human
gguucuuaccucgccuccuug

SEQ ID NO: 1201614 - RNA, 23 nt, Human
gguucuuaccucgccuccuuggc

SEQ ID NO: 1201615 - RNA, 23 nt, Human
uccuggucgcuggggcuggguuc

SEQ ID NO: 1201616 - RNA, 21 nt, Human
uccuuccccacggccggccaa

SEQ ID NO: 1201617 - RNA, 19 nt, Human
uccuuggcuccuuucuucc

SEQ ID NO: 1201618 - RNA, 24 nt, Human
ucgccuccuuggcuccuuucuucc

SEQ ID NO: 1201619 - RNA, 18 nt, Human
ucgcuggggcuggguucu

SEQ ID NO: 1201620 - RNA, 21 nt, Human
ucucagcccugggccuggggc

SEQ ID NO: 1201621 - RNA, 23 nt, Human
uggguucuuaccucgccuccuug

SEQ ID NO: 1201622 - RNA, 21 nt, Human
uuccuuccccacggccggcca

SEQ ID NO: 1201623 - RNA, 19 nt, Human
uugguccuggucgcugggg

SEQ ID NO: 1201624 - RNA, 24 nt, Human
aggaaagguggggagccgaugggg

SEQ ID NO: 1201625 - RNA, 20 nt, Human
gacccggaaagaggaaaggu

SEQ ID NO: 1201626 - RNA, 19 nt, Human
ucuccgaguucuggaccca

SEQ ID NO: 1201627 - RNA, 24 nt, Human
ugcccagaaguucacuuucugguc

SEQ ID NO: 1201628 - RNA, 26 nt, Human
ugccccggaggcugugacuuggcuga

SEQ ID NO: 1201629 - RNA, 20 nt, Human
ugccugaaggugccccggag

SEQ ID NO: 1201630 - RNA, 22 nt, Human
ugccugaaggugccccggaggc

SEQ ID NO: 1201631 - RNA, 24 nt, Human
ugccugaaggugccccggaggcug

SEQ ID NO: 1201632 - RNA, 21 nt, Human
uggucuccgaguucuggaccc

SEQ ID NO: 1201633 - RNA, 22 nt, Human
accaacgugacggccaguccug

SEQ ID NO: 1201634 - RNA, 20 nt, Human
aggaggcaggugaggcagag

SEQ ID NO: 1201635 - RNA, 21 nt, Human
ucaaggaggcaggugaggcag

SEQ ID NO: 1201636 - RNA, 29 nt, Human
auuacauucauaugguuucucuccugugu

SEQ ID NO: 1201637 - RNA, 18 nt, Human
auuucuccccuguaugug

SEQ ID NO: 1201638 - RNA, 27 nt, Human
caaaggguuucucuccugugugaguuc

SEQ ID NO: 1201639 - RNA, 21 nt, Human
cuaaaggcuuucccacacuga

SEQ ID NO: 1201640 - RNA, 30 nt, Human
cugaugaucaaugagauaugauuuccuucu

SEQ ID NO: 1201641 - RNA, 20 nt, Human
cuggccgguauguauuuucu

SEQ ID NO: 1201642 - RNA, 24 nt, Human
cuuuccacauucacuacauuuaua

SEQ ID NO: 1201643 - RNA, 18 nt, Human
gaugaucagugagggcug

SEQ ID NO: 1201644 - RNA, 25 nt, Human
gauuuccuucuaaaugcauuuccac

SEQ ID NO: 1201645 - RNA, 21 nt, Human
gauuucuccccuguguguguu

SEQ ID NO: 1201646 - RNA, 24 nt, Human
gguugcuuucuggcgaaaggacuu

SEQ ID NO: 1201647 - RNA, 20 nt, Human
uaccacauucauugcaaaca

SEQ ID NO: 1201648 - RNA, 18 nt, Human
uacugauuuccugcagaa

SEQ ID NO: 1201649 - RNA, 18 nt, Human
uaggguuuuucuucugag

SEQ ID NO: 1201650 - RNA, 21 nt, Human
ucaaugagauaugauuuccuu

SEQ ID NO: 1201651 - RNA, 22 nt, Human
ucuaaaugcauuuccacauuga

SEQ ID NO: 1201652 - RNA, 21 nt, Human
ucucugaugaucagugagggc

SEQ ID NO: 1201653 - RNA, 18 nt, Human
ucugauguacagugaggg

SEQ ID NO: 1201654 - RNA, 23 nt, Human
ucuggccgguauguauuuucuga

SEQ ID NO: 1201655 - RNA, 21 nt, Human
ugaauucucugauguagauug

SEQ ID NO: 1201656 - RNA, 21 nt, Human
ugcaaacaaaggguuucucuc

SEQ ID NO: 1201657 - RNA, 23 nt, Human
uuaccacauucauugcaaacaaa

SEQ ID NO: 1201658 - RNA, 19 nt, Human
uucccacauucauuacaaa

SEQ ID NO: 1201659 - RNA, 27 nt, Human
aaacaaugaaugaaagaauuauagaac

SEQ ID NO: 1201660 - RNA, 22 nt, Human
aacaaaacaaugaaugaaagaa

SEQ ID NO: 1201661 - RNA, 22 nt, Human
accaagaaaguagaacaaaaca

SEQ ID NO: 1201662 - RNA, 23 nt, Human
auaagucccucugaacagggucc

SEQ ID NO: 1201663 - RNA, 22 nt, Human
caagaaaguagaacaaaacaau

SEQ ID NO: 1201664 - RNA, 21 nt, Human
ccaagaaaguagaacaaaaca

SEQ ID NO: 1201665 - RNA, 20 nt, Human
cuggcaucgguauaugacug

SEQ ID NO: 1201666 - RNA, 18 nt, Human
uagaacaaaacaaugaau

SEQ ID NO: 1201667 - RNA, 21 nt, Human
uaugaggaaggugacaggggc

SEQ ID NO: 1201668 - RNA, 22 nt, Human
ucccucugaacaggguccaggc

SEQ ID NO: 1201669 - RNA, 18 nt, Human
ucugaacaggguccaggc

SEQ ID NO: 1201670 - RNA, 20 nt, Human
ugacaggggcuuuaauuuuu

SEQ ID NO: 1201671 - RNA, 23 nt, Human
ugaggaaggugacaggggcuuua

SEQ ID NO: 1201672 - RNA, 22 nt, Human
uggaaugaaauacauuuggaua

SEQ ID NO: 1201673 - RNA, 24 nt, Human
ugucaccaagaaaguagaacaaaa

SEQ ID NO: 1201674 - RNA, 21 nt, Human
agcugagcagccggacggcac

SEQ ID NO: 1201675 - RNA, 19 nt, Human
ccagcagcugagcagccgg

SEQ ID NO: 1201676 - RNA, 19 nt, Human
ugcuccacuucccugcuug

SEQ ID NO: 1201677 - RNA, 25 nt, Human
uugcuccacuucccugcuugcuggc

SEQ ID NO: 1201678 - RNA, 19 nt, Human
uugcuggcucucauugucc

SEQ ID NO: 1201679 - RNA, 22 nt, Human
ccaggcacgaugccaucaugcu

SEQ ID NO: 1201680 - RNA, 21 nt, Human
cuucgugugugcuggccccac

SEQ ID NO: 1201681 - RNA, 18 nt, Human
gaugccaucaugcuguga

SEQ ID NO: 1201682 - RNA, 19 nt, Human
ugccaucaugcugugagug

SEQ ID NO: 1201683 - RNA, 19 nt, Human
ugggaaggcaggcuccagg

SEQ ID NO: 1201684 - RNA, 19 nt, Human
ugggaaggcaggcuccagg

SEQ ID NO: 1201685 - RNA, 23 nt, Human
ugggaaggcaggcuccaggcacg

SEQ ID NO: 1201686 - RNA, 24 nt, Human
ugugugcuggccccacugguuuug

SEQ ID NO: 1201687 - RNA, 20 nt, Human
aauggaauuaggagaaacca

SEQ ID NO: 1201688 - RNA, 21 nt, Human
acaaagaaaagcuuuuuuaca

SEQ ID NO: 1201689 - RNA, 25 nt, Human
acaugacaucucuguacaagucucu

SEQ ID NO: 1201690 - RNA, 19 nt, Human
accuggaccgagugccugg

SEQ ID NO: 1201691 - RNA, 22 nt, Human
agaaaucuauagccacaucccu

SEQ ID NO: 1201692 - RNA, 19 nt, Human
agaugggcucucugcuuaa

SEQ ID NO: 1201693 - RNA, 24 nt, Human
agcaugaccaccuggauaccaccc

SEQ ID NO: 1201694 - RNA, 20 nt, Human
agcccugggaggcucagggc

SEQ ID NO: 1201695 - RNA, 28 nt, Human
aucuauagccacaucccugaaugucacc

SEQ ID NO: 1201696 - RNA, 20 nt, Human
auguuggguaaggugggcac

SEQ ID NO: 1201697 - RNA, 20 nt, Human
caaauucuguuaugaaaaag

SEQ ID NO: 1201698 - RNA, 18 nt, Human
caacaugacaucucugua

SEQ ID NO: 1201699 - RNA, 20 nt, Human
caccuggaccgagugccugg

SEQ ID NO: 1201700 - RNA, 18 nt, Human
cagccgccucccgacugg

SEQ ID NO: 1201701 - RNA, 18 nt, Human
cagggcugcccgaggggc

SEQ ID NO: 1201702 - RNA, 19 nt, Human
caguaugaauauuuugaug

SEQ ID NO: 1201703 - RNA, 22 nt, Human
cagugaaauuucucugauguuc

SEQ ID NO: 1201704 - RNA, 20 nt, Human
cagugugaauucucuggugu

SEQ ID NO: 1201705 - RNA, 21 nt, Human
cauccagcguuauuuccagaa

SEQ ID NO: 1201706 - RNA, 19 nt, Human
caugaccaccuggauacca

SEQ ID NO: 1201707 - RNA, 24 nt, Human
cauggauucuuccuguacaaauuc

SEQ ID NO: 1201708 - RNA, 22 nt, Human
ccagagccagugcugucagggg

SEQ ID NO: 1201709 - RNA, 19 nt, Human
ccagugugaauucucuggu

SEQ ID NO: 1201710 - RNA, 19 nt, Human
ccauccaggguucuuuccc

SEQ ID NO: 1201711 - RNA, 19 nt, Human
ccaugcuucccugcuccuc

SEQ ID NO: 1201712 - RNA, 23 nt, Human
ccggugacacaaaguugcuguag

SEQ ID NO: 1201713 - RNA, 23 nt, Human
ccucuggaaaaacacagacugga

SEQ ID NO: 1201714 - RNA, 23 nt, Human
ccuggccgcuggcggaguagugu

SEQ ID NO: 1201715 - RNA, 20 nt, Human
ccuguucuccagguccucug

SEQ ID NO: 1201716 - RNA, 18 nt, Human
cgcgcaggaacgcagccg

SEQ ID NO: 1201717 - RNA, 21 nt, Human
cuaaaggccuuccuacauucc

SEQ ID NO: 1201718 - RNA, 23 nt, Human
cuaaaggccuuccuacauuccag

SEQ ID NO: 1201719 - RNA, 24 nt, Human
cuaaagggcuuuccacauaucuga

SEQ ID NO: 1201720 - RNA, 18 nt, Human
cuacauuuuuuacacuga

SEQ ID NO: 1201721 - RNA, 19 nt, Human
cuccagguccucugccucc

SEQ ID NO: 1201722 - RNA, 24 nt, Human
cuccccgcaaccgguuccgccgcg

SEQ ID NO: 1201723 - RNA, 26 nt, Human
cugagcagggcccaggcauucccacu

SEQ ID NO: 1201724 - RNA, 22 nt, Human
cugccucgagugcgcaagcgcg

SEQ ID NO: 1201725 - RNA, 22 nt, Human
cuggaaaaacacagacuggaga

SEQ ID NO: 1201726 - RNA, 24 nt, Human
cuucugguucugguuuuccaugga

SEQ ID NO: 1201727 - RNA, 20 nt, Human
gaaaaacacagacuggagaa

SEQ ID NO: 1201728 - RNA, 23 nt, Human
gaaauuucucugauguuccauau

SEQ ID NO: 1201729 - RNA, 23 nt, Human
gaauaacaaagaaaaggggaggc

SEQ ID NO: 1201730 - RNA, 25 nt, Human
gaauggaauuaggagaaaccaguuu

SEQ ID NO: 1201731 - RNA, 20 nt, Human
gaaugucaccaauccuaaaa

SEQ ID NO: 1201732 - RNA, 23 nt, Human
gaguguugggauuuugauuaucu

SEQ ID NO: 1201733 - RNA, 18 nt, Human
gaugggcucucugcuuaa

SEQ ID NO: 1201734 - RNA, 18 nt, Human
gcuuagaaauggcaaguc

SEQ ID NO: 1201735 - RNA, 18 nt, Human
ggcacgcuuucuaaaggg

SEQ ID NO: 1201736 - RNA, 24 nt, Human
ggggcccuucagggagcaagggag

SEQ ID NO: 1201737 - RNA, 21 nt, Human
guagcccggaauacauuuccc

SEQ ID NO: 1201738 - RNA, 21 nt, Human
uagagaaaucuauagccacau

SEQ ID NO: 1201739 - RNA, 20 nt, Human
uagcaugaccaccuggauac

SEQ ID NO: 1201740 - RNA, 21 nt, Human
uaguucuccaacaugacaucu

SEQ ID NO: 1201741 - RNA, 27 nt, Human
uauagauuucuuauauuucugaaguuu

SEQ ID NO: 1201742 - RNA, 20 nt, Human
uaugaccaaagucucugccc

SEQ ID NO: 1201743 - RNA, 25 nt, Human
ucaccagugugaauugucugauguu

SEQ ID NO: 1201744 - RNA, 18 nt, Human
uccaggguucuuucccuu

SEQ ID NO: 1201745 - RNA, 19 nt, Human
ucggaucugugacuguggc

SEQ ID NO: 1201746 - RNA, 22 nt, Human
ucucucugagcagggcccaggc

SEQ ID NO: 1201747 - RNA, 20 nt, Human
ucucugagcagggcccaggc

SEQ ID NO: 1201748 - RNA, 25 nt, Human
ugaacaacagauaaacacuuuccca

SEQ ID NO: 1201749 - RNA, 23 nt, Human
ugcccgaggggcuuagucccaga

SEQ ID NO: 1201750 - RNA, 19 nt, Human
ugccuggccgcuggcggag

SEQ ID NO: 1201751 - RNA, 21 nt, Human
ugcucagcccugggaggcuca

SEQ ID NO: 1201752 - RNA, 19 nt, Human
uggaugaacucuuggauaa

SEQ ID NO: 1201753 - RNA, 18 nt, Human
ugggaggcucagggcugc

SEQ ID NO: 1201754 - RNA, 21 nt, Human
uggggccgcaccuggaccgag

SEQ ID NO: 1201755 - RNA, 24 nt, Human
ugucaccaauccuaaaaauucuau

SEQ ID NO: 1201756 - RNA, 18 nt, Human
ugugacuguggcucugcc

SEQ ID NO: 1201757 - RNA, 23 nt, Human
ugugacuguggcucugccucauc

SEQ ID NO: 1201758 - RNA, 18 nt, Human
uguggggccgcaccugga

SEQ ID NO: 1201759 - RNA, 25 nt, Human
uucagggagcaagggagaagugugg

SEQ ID NO: 1201760 - RNA, 21 nt, Human
uucccagaggccuucgcggcc

SEQ ID NO: 1201761 - RNA, 23 nt, Human
uucgauuauguuggguaaggugg

SEQ ID NO: 1201762 - RNA, 22 nt, Human
uucucauuaguaugaguucuau

SEQ ID NO: 1201763 - RNA, 21 nt, Human
uucuccagguccucugccucc

SEQ ID NO: 1201764 - RNA, 20 nt, Human
uucucugcauuucuuuccag

SEQ ID NO: 1201765 - RNA, 22 nt, Human
uucugguucugguuuuccaugg

SEQ ID NO: 1201766 - RNA, 23 nt, Human
uuuccgugcacggggcugcugcg

SEQ ID NO: 1201767 - RNA, 24 nt, Human
uuugugggucccuaugaaacugag

SEQ ID NO: 1201768 - RNA, 25 nt, Human
uuuguuuuuuccccuuuguuccugg

SEQ ID NO: 1201769 - RNA, 19 nt, Human
uuuuccccuuuguuccugg

SEQ ID NO: 1201770 - RNA, 27 nt, Human
aaaucaaucuuaaacuagaaacuucua

SEQ ID NO: 1201771 - RNA, 23 nt, Human
aagcuucccccucccccuuuuuu

SEQ ID NO: 1201772 - RNA, 18 nt, Human
accuucccuggccgccgg

SEQ ID NO: 1201773 - RNA, 21 nt, Human
acugcugucugcgggcagcuu

SEQ ID NO: 1201774 - RNA, 22 nt, Human
acuggaaugcagagguucucuu

SEQ ID NO: 1201775 - RNA, 23 nt, Human
agcacuauuugauaauuucuuuc

SEQ ID NO: 1201776 - RNA, 27 nt, Human
auaagcuucccccucccccuuuuuuuc

SEQ ID NO: 1201777 - RNA, 20 nt, Human
augccuaagaaaacacaaaa

SEQ ID NO: 1201778 - RNA, 22 nt, Human
caucuuauucuguucagcacua

SEQ ID NO: 1201779 - RNA, 22 nt, Human
ccaccggggcuccccuggcugc

SEQ ID NO: 1201780 - RNA, 22 nt, Human
ccauccgaccuucccuggccgc

SEQ ID NO: 1201781 - RNA, 21 nt, Human
ccauccuuuacuuuguaauaa

SEQ ID NO: 1201782 - RNA, 20 nt, Human
ccaucgcgccuuccccggcc

SEQ ID NO: 1201783 - RNA, 20 nt, Human
cccagugcgcgugcgugggc

SEQ ID NO: 1201784 - RNA, 18 nt, Human
ccccuggcugccgccgcc

SEQ ID NO: 1201785 - RNA, 24 nt, Human
cccuggccgccggcaccgggccuc

SEQ ID NO: 1201786 - RNA, 25 nt, Human
cccuuuuuuuccccuccaccugugc

SEQ ID NO: 1201787 - RNA, 24 nt, Human
ccgccgccaucgcgccuuccccgg

SEQ ID NO: 1201788 - RNA, 23 nt, Human
ccgccgccgccgggcuuucccug

SEQ ID NO: 1201789 - RNA, 20 nt, Human
ccgccgccggggcugcccug

SEQ ID NO: 1201790 - RNA, 22 nt, Human
ccgccggcaccgggccuccccu

SEQ ID NO: 1201791 - RNA, 22 nt, Human
ccgccggggcugcccuggccgc

SEQ ID NO: 1201792 - RNA, 19 nt, Human
ccugcgggacgucucuguc

SEQ ID NO: 1201793 - RNA, 22 nt, Human
cgccgccauccgaccuucccug

SEQ ID NO: 1201794 - RNA, 22 nt, Human
cgccgccaucgcgccuuccccg

SEQ ID NO: 1201795 - RNA, 20 nt, Human
cggggcugcccuggccgccg

SEQ ID NO: 1201796 - RNA, 18 nt, Human
cucagaccguggggucaa

SEQ ID NO: 1201797 - RNA, 20 nt, Human
cucccgcggccuaccuccgc

SEQ ID NO: 1201798 - RNA, 19 nt, Human
cuccucaggcugugccggg

SEQ ID NO: 1201799 - RNA, 20 nt, Human
cugccaccggggcuccccug

SEQ ID NO: 1201800 - RNA, 18 nt, Human
cugcgggacacugcuguc

SEQ ID NO: 1201801 - RNA, 18 nt, Human
gagaaacuggaauaacug

SEQ ID NO: 1201802 - RNA, 23 nt, Human
gcaggauugguaugacuggaaug

SEQ ID NO: 1201803 - RNA, 20 nt, Human
gccgccgccggggcugcccu

SEQ ID NO: 1201804 - RNA, 21 nt, Human
gcggcugcccuggccaacgcc

SEQ ID NO: 1201805 - RNA, 22 nt, Human
gcgugcgugggcgcuaugcgcg

SEQ ID NO: 1201806 - RNA, 19 nt, Human
uaaagcaaugcugagagac

SEQ ID NO: 1201807 - RNA, 22 nt, Human
uaagaaaacacaaaaucaaucu

SEQ ID NO: 1201808 - RNA, 21 nt, Human
uaauaaagcaaugcugagaga

SEQ ID NO: 1201809 - RNA, 19 nt, Human
uaugacaugaagagagcac

SEQ ID NO: 1201810 - RNA, 19 nt, Human
ucacaaacucaaagaacgu

SEQ ID NO: 1201811 - RNA, 23 nt, Human
uccauaaugcagggggaaaaaug

SEQ ID NO: 1201812 - RNA, 21 nt, Human
ucccccucccccuuuuuuucc

SEQ ID NO: 1201813 - RNA, 21 nt, Human
uccccuggccgccgccaucgc

SEQ ID NO: 1201814 - RNA, 24 nt, Human
uccccuggcugccgccgccggggc

SEQ ID NO: 1201815 - RNA, 18 nt, Human
ucccuggccgccgccgcc

SEQ ID NO: 1201816 - RNA, 18 nt, Human
ucccuggccgccgccgcc

SEQ ID NO: 1201817 - RNA, 22 nt, Human
ucccuggccgccgccgccgccg

SEQ ID NO: 1201818 - RNA, 22 nt, Human
ucuuucauccucaugggcucua

SEQ ID NO: 1201819 - RNA, 19 nt, Human
ugaagagagcacauauucc

SEQ ID NO: 1201820 - RNA, 20 nt, Human
ugccaccggggcuccccugg

SEQ ID NO: 1201821 - RNA, 19 nt, Human
uggaaugcagagguucucu

SEQ ID NO: 1201822 - RNA, 20 nt, Human
uggccgccgccgccgccggg

SEQ ID NO: 1201823 - RNA, 20 nt, Human
uggggucaacucggcugcuc

SEQ ID NO: 1201824 - RNA, 22 nt, Human
uucccugcccgccgcggcugcc

SEQ ID NO: 1201825 - RNA, 24 nt, Human
uuggacaucucagaccgugggguu

SEQ ID NO: 1201826 - RNA, 20 nt, Human
uuugauaauuucuuucaucc

SEQ ID NO: 1201827 - RNA, 24 nt, Human
uuuucaagauaagcuucccccucc

SEQ ID NO: 1201828 - RNA, 18 nt, Human
uuuuccccuccaccugug

SEQ ID NO: 1201829 - RNA, 19 nt, Human
caaaggguuucucgccagu

SEQ ID NO: 1201830 - RNA, 22 nt, Human
caaaggguuucucgccaguaug

SEQ ID NO: 1201831 - RNA, 23 nt, Human
cauuggaaugaauuuuuugaugc

SEQ ID NO: 1201832 - RNA, 23 nt, Human
ggcucuuucucuugcucuaguaa

SEQ ID NO: 1201833 - RNA, 19 nt, Human
guaaugauaucgaaaggcc

SEQ ID NO: 1201834 - RNA, 18 nt, Human
uaacauguuuggguaaau

SEQ ID NO: 1201835 - RNA, 18 nt, Human
ugaaccacgauuaaaggc

SEQ ID NO: 1201836 - RNA, 19 nt, Human
uggaaugaauuuuuugaug

SEQ ID NO: 1201837 - RNA, 24 nt, Human
uugguaaugauaucgaaaggccuu

SEQ ID NO: 1201838 - RNA, 18 nt, Human
uuuucuggagauauuuuc

SEQ ID NO: 1201839 - RNA, 21 nt, Human
aggagcgcuuccccccgcccc

SEQ ID NO: 1201840 - RNA, 20 nt, Human
cccccgccccgggcgcccgc

SEQ ID NO: 1201841 - RNA, 20 nt, Human
ccugggccgcggcccccaca

SEQ ID NO: 1201842 - RNA, 18 nt, Human
gaaggaggggccgaggcc

SEQ ID NO: 1201843 - RNA, 20 nt, Human
gagcgcuuccccccgccccg

SEQ ID NO: 1201844 - RNA, 22 nt, Human
gcaguccaacccauccugggcc

SEQ ID NO: 1201845 - RNA, 19 nt, Human
uccccccgccccgggcgcc

SEQ ID NO: 1201846 - RNA, 23 nt, Human
cgccaggacagcaaagaugucgg

SEQ ID NO: 1201847 - RNA, 21 nt, Human
gcccggagcgccaggacagca

SEQ ID NO: 1201848 - RNA, 18 nt, Human
ggcgaggucugcuggcag

SEQ ID NO: 1201849 - RNA, 20 nt, Human
gggcagccuugcaaggcuug

SEQ ID NO: 1201850 - RNA, 19 nt, Human
ugguggggucccgugaggc

SEQ ID NO: 1201851 - RNA, 21 nt, Human
uugcaaggcuugagcauggug

SEQ ID NO: 1201852 - RNA, 19 nt, Human
aagggugucccagagcucc

SEQ ID NO: 1201853 - RNA, 22 nt, Human
agaccucuucccuagacaaggg

SEQ ID NO: 1201854 - RNA, 19 nt, Human
caguaagaccucuucccua

SEQ ID NO: 1201855 - RNA, 20 nt, Human
ccucuucccuagacaagggu

SEQ ID NO: 1201856 - RNA, 19 nt, Human
gacaagggugucccagagc

SEQ ID NO: 1201857 - RNA, 20 nt, Human
ggacacaaagucaggugagg

SEQ ID NO: 1201858 - RNA, 23 nt, Human
ucccagagcuccuccgcuggagu

SEQ ID NO: 1201859 - RNA, 19 nt, Human
ucccuagacaagggugucc

SEQ ID NO: 1201860 - RNA, 19 nt, Human
ucccuagacaagggugucc

SEQ ID NO: 1201861 - RNA, 24 nt, Human
ugucccagagcuccuccgcuggag

SEQ ID NO: 1201862 - RNA, 24 nt, Human
cacacaggcuaggccccuaggagc

SEQ ID NO: 1201863 - RNA, 18 nt, Human
ccacacaggcuaggcccc

SEQ ID NO: 1201864 - RNA, 19 nt, Human
cuaggcuucuagggggucc

SEQ ID NO: 1201865 - RNA, 24 nt, Human
gagggccacacaggcuaggccccu

SEQ ID NO: 1201866 - RNA, 23 nt, Human
uaggagcagaagacacagagaag

SEQ ID NO: 1201867 - RNA, 19 nt, Human
uaggccccuaggagcagaa

SEQ ID NO: 1201868 - RNA, 23 nt, Human
aaauaacauuucagaauggaaca

SEQ ID NO: 1201869 - RNA, 21 nt, Human
aaugguuggcugacagggaaa

SEQ ID NO: 1201870 - RNA, 18 nt, Human
acagggaaaacguucaca

SEQ ID NO: 1201871 - RNA, 18 nt, Human
acagugauaaauaagugg

SEQ ID NO: 1201872 - RNA, 18 nt, Human
acguucccacagugauga

SEQ ID NO: 1201873 - RNA, 22 nt, Human
acucuggugaauaagugggugg

SEQ ID NO: 1201874 - RNA, 24 nt, Human
agugaaaacguucccacagugaug

SEQ ID NO: 1201875 - RNA, 24 nt, Human
agugaagagguucccacugugaug

SEQ ID NO: 1201876 - RNA, 20 nt, Human
agugggugugaaugaacagg

SEQ ID NO: 1201877 - RNA, 19 nt, Human
auguaaaugggcaccuucc

SEQ ID NO: 1201878 - RNA, 26 nt, Human
caagagguucccacugugaugauuga

SEQ ID NO: 1201879 - RNA, 24 nt, Human
caaguccacagaaauaagcugaaa

SEQ ID NO: 1201880 - RNA, 21 nt, Human
cacuguugagaaugagugucu

SEQ ID NO: 1201881 - RNA, 21 nt, Human
cauguucccacugugaugaau

SEQ ID NO: 1201882 - RNA, 19 nt, Human
ccacacuguguugagugag

SEQ ID NO: 1201883 - RNA, 20 nt, Human
ccagggaaaagggucucguu

SEQ ID NO: 1201884 - RNA, 22 nt, Human
cccacuguggugaaugaauggg

SEQ ID NO: 1201885 - RNA, 26 nt, Human
cccauaaacaguggcucggguaacug

SEQ ID NO: 1201886 - RNA, 20 nt, Human
ccccccucuccuucccuuuc

SEQ ID NO: 1201887 - RNA, 22 nt, Human
ccccucuccuucccuuucccca

SEQ ID NO: 1201888 - RNA, 23 nt, Human
ccugacacugaacagguucccau

SEQ ID NO: 1201889 - RNA, 19 nt, Human
ccuguggugaaugacuggc

SEQ ID NO: 1201890 - RNA, 23 nt, Human
cugauuuccccccucuccuuccc

SEQ ID NO: 1201891 - RNA, 22 nt, Human
cugguucccauuguacugagug

SEQ ID NO: 1201892 - RNA, 27 nt, Human
cuguaaugaaugaguggaugacaguug

SEQ ID NO: 1201893 - RNA, 20 nt, Human
cugugaugaaugaauggguu

SEQ ID NO: 1201894 - RNA, 27 nt, Human
cugugaugaaugaguggcugacaguug

SEQ ID NO: 1201895 - RNA, 22 nt, Human
cuuaacccuuggcaugccuggc

SEQ ID NO: 1201896 - RNA, 20 nt, Human
gaacagcuucccacucuggg

SEQ ID NO: 1201897 - RNA, 20 nt, Human
gaacagguucccaagguggu

SEQ ID NO: 1201898 - RNA, 18 nt, Human
gaacugguucucaugugg

SEQ ID NO: 1201899 - RNA, 18 nt, Human
gacaguauuucagcgccc

SEQ ID NO: 1201900 - RNA, 19 nt, Human
gagcugauuuucaucgugg

SEQ ID NO: 1201901 - RNA, 21 nt, Human
gagguuuguacuguggugaau

SEQ ID NO: 1201902 - RNA, 20 nt, Human
gagugagugggggagaguua

SEQ ID NO: 1201903 - RNA, 18 nt, Human
gaugagugugugauagug

SEQ ID NO: 1201904 - RNA, 19 nt, Human
gcaugccuggcugucuggc

SEQ ID NO: 1201905 - RNA, 18 nt, Human
gggaaugguuggcugaca

SEQ ID NO: 1201906 - RNA, 22 nt, Human
ggucuuacugugauguaugugu

SEQ ID NO: 1201907 - RNA, 20 nt, Human
ggugacaaggaauaaguucc

SEQ ID NO: 1201908 - RNA, 20 nt, Human
guaccuccuacugugauuaa

SEQ ID NO: 1201909 - RNA, 21 nt, Human
gugaacagguucccacaguag

SEQ ID NO: 1201910 - RNA, 19 nt, Human
gugacagugagcagguucc

SEQ ID NO: 1201911 - RNA, 24 nt, Human
uaaaugagcacaugacagugacca

SEQ ID NO: 1201912 - RNA, 19 nt, Human
uaacggguuuccacuguga

SEQ ID NO: 1201913 - RNA, 19 nt, Human
uaacggguuuccacuguga

SEQ ID NO: 1201914 - RNA, 22 nt, Human
uaagugggugacaaagaacagg

SEQ ID NO: 1201915 - RNA, 21 nt, Human
uagagcugggcuggggaaagg

SEQ ID NO: 1201916 - RNA, 18 nt, Human
uaggugacagugcacagg

SEQ ID NO: 1201917 - RNA, 26 nt, Human
uagguggaugacagugaacugguuuu

SEQ ID NO: 1201918 - RNA, 20 nt, Human
ucagugugaugaaagaguga

SEQ ID NO: 1201919 - RNA, 18 nt, Human
uccaggacaguauuucag

SEQ ID NO: 1201920 - RNA, 24 nt, Human
uccccccucuccuucccuuucccc

SEQ ID NO: 1201921 - RNA, 19 nt, Human
ucuccuucccuuuccccau

SEQ ID NO: 1201922 - RNA, 24 nt, Human
ucugacagugaacaggaucccaca

SEQ ID NO: 1201923 - RNA, 23 nt, Human
ucuguggucuuucuuuugccucu

SEQ ID NO: 1201924 - RNA, 22 nt, Human
ucuucccacaaugaaugauugg

SEQ ID NO: 1201925 - RNA, 24 nt, Human
ucuuuuuccucucuguggucuuuc

SEQ ID NO: 1201926 - RNA, 22 nt, Human
ugaaaacguucccacagugaug

SEQ ID NO: 1201927 - RNA, 20 nt, Human
ugaacagguggcucacagua

SEQ ID NO: 1201928 - RNA, 25 nt, Human
ugaacagguggcucacaguagcagg

SEQ ID NO: 1201929 - RNA, 21 nt, Human
ugaacagguucccaugugaug

SEQ ID NO: 1201930 - RNA, 18 nt, Human
ugaacagguucugacagu

SEQ ID NO: 1201931 - RNA, 20 nt, Human
ugaacagguuuucacuguga

SEQ ID NO: 1201932 - RNA, 18 nt, Human
ugaaggagagggugacag

SEQ ID NO: 1201933 - RNA, 18 nt, Human
ugaaugaaugggugacag

SEQ ID NO: 1201934 - RNA, 22 nt, Human
ugaaugaauugaugagagugaa

SEQ ID NO: 1201935 - RNA, 18 nt, Human
ugaaugaguggcugacag

SEQ ID NO: 1201936 - RNA, 18 nt, Human
ugaaugaguggcugacag

SEQ ID NO: 1201937 - RNA, 22 nt, Human
ugaaugagugggagagagugaa

SEQ ID NO: 1201938 - RNA, 24 nt, Human
ugaaugagugggugacaguaaugg

SEQ ID NO: 1201939 - RNA, 22 nt, Human
ugaaugagugggugagagugaa

SEQ ID NO: 1201940 - RNA, 18 nt, Human
ugaaugagugguugacag

SEQ ID NO: 1201941 - RNA, 22 nt, Human
ugaaugagugguugagagugaa

SEQ ID NO: 1201942 - RNA, 21 nt, Human
ugaaugagugugugaaaguca

SEQ ID NO: 1201943 - RNA, 22 nt, Human
ugaaugggcuggugagagugaa

SEQ ID NO: 1201944 - RNA, 23 nt, Human
ugacagugaacagguucuuccca

SEQ ID NO: 1201945 - RNA, 21 nt, Human
ugacagugaacagguuuccau

SEQ ID NO: 1201946 - RNA, 19 nt, Human
ugagcacaugacagugacc

SEQ ID NO: 1201947 - RNA, 19 nt, Human
ugaguagcugacaauggac

SEQ ID NO: 1201948 - RNA, 18 nt, Human
ugaguaggugacagugca

SEQ ID NO: 1201949 - RNA, 23 nt, Human
ugagucauugaacugccucagug

SEQ ID NO: 1201950 - RNA, 21 nt, Human
ugagugagugggugacaguga

SEQ ID NO: 1201951 - RNA, 21 nt, Human
ugagugagugggugacaguga

SEQ ID NO: 1201952 - RNA, 21 nt, Human
ugagugagugggugacaguga

SEQ ID NO: 1201953 - RNA, 18 nt, Human
ugagugccugacacugaa

SEQ ID NO: 1201954 - RNA, 21 nt, Human
ugaguggaugacagugaacau

SEQ ID NO: 1201955 - RNA, 24 nt, Human
ugagugggugagagugaacaggau

SEQ ID NO: 1201956 - RNA, 25 nt, Human
ugagugggugagagugaacaggauu

SEQ ID NO: 1201957 - RNA, 23 nt, Human
ugagugguugagagugaacaggu

SEQ ID NO: 1201958 - RNA, 22 nt, Human
ugagugguugagagugaacagu

SEQ ID NO: 1201959 - RNA, 23 nt, Human
ugagugucugacgguaaacaggu

SEQ ID NO: 1201960 - RNA, 21 nt, Human
ugaugagugagugggugacac

SEQ ID NO: 1201961 - RNA, 22 nt, Human
ugauuuccccccucuccuuccc

SEQ ID NO: 1201962 - RNA, 20 nt, Human
ugccucagugaccccaguaa

SEQ ID NO: 1201963 - RNA, 18 nt, Human
uggcauugaaaugcuucc

SEQ ID NO: 1201964 - RNA, 21 nt, Human
ugggugaaagugaagagguuc

SEQ ID NO: 1201965 - RNA, 23 nt, Human
ugggugacaaugaaccgguuucc

SEQ ID NO: 1201966 - RNA, 18 nt, Human
ugggugacaguaaugggg

SEQ ID NO: 1201967 - RNA, 18 nt, Human
ugggugacagugaacagg

SEQ ID NO: 1201968 - RNA, 18 nt, Human
ugggugacagugaacagg

SEQ ID NO: 1201969 - RNA, 18 nt, Human
ugggugacagugaacagg

SEQ ID NO: 1201970 - RNA, 18 nt, Human
ugggugacagugaacagg

SEQ ID NO: 1201971 - RNA, 18 nt, Human
ugggugacagugaacagg

SEQ ID NO: 1201972 - RNA, 18 nt, Human
ugggugacagugaacagg

SEQ ID NO: 1201973 - RNA, 18 nt, Human
ugggugacagugaacagg

SEQ ID NO: 1201974 - RNA, 23 nt, Human
ugggugacagugaacagguuucc

SEQ ID NO: 1201975 - RNA, 18 nt, Human
ugggugacagugaagagg

SEQ ID NO: 1201976 - RNA, 22 nt, Human
ugguacauguuccguucacaug

SEQ ID NO: 1201977 - RNA, 22 nt, Human
uggugaaugaguggucaacagg

SEQ ID NO: 1201978 - RNA, 21 nt, Human
uggugagugagugggugacau

SEQ ID NO: 1201979 - RNA, 29 nt, Human
ugguuagugagugcuugacagccaagagg

SEQ ID NO: 1201980 - RNA, 19 nt, Human
ugguugagagugaacaggu

SEQ ID NO: 1201981 - RNA, 19 nt, Human
ugguugagagugaacaggu

SEQ ID NO: 1201982 - RNA, 18 nt, Human
uguaaugaauaaguuggu

SEQ ID NO: 1201983 - RNA, 24 nt, Human
ugugaugagugagugggggagagu

SEQ ID NO: 1201984 - RNA, 20 nt, Human
ugugaugauugagugggugu

SEQ ID NO: 1201985 - RNA, 20 nt, Human
ugugcugaaugagugguuga

SEQ ID NO: 1201986 - RNA, 28 nt, Human
ugugggaaaugaguggcugaccgugagg

SEQ ID NO: 1201987 - RNA, 22 nt, Human
uguggugaauaagugggugaca

SEQ ID NO: 1201988 - RNA, 22 nt, Human
uguggugaaugaaugggugcca

SEQ ID NO: 1201989 - RNA, 22 nt, Human
uguggugaaugagugggugaca

SEQ ID NO: 1201990 - RNA, 19 nt, Human
uguggugaauguguggcug

SEQ ID NO: 1201991 - RNA, 18 nt, Human
uguguugagugaauagcu

SEQ ID NO: 1201992 - RNA, 18 nt, Human
uguguugagugaguagcu

SEQ ID NO: 1201993 - RNA, 20 nt, Human
uguuggugaccauaaacagg

SEQ ID NO: 1201994 - RNA, 19 nt, Human
uucaagggcaaguccacag

SEQ ID NO: 1201995 - RNA, 21 nt, Human
uucacacucugaugaugagug

SEQ ID NO: 1201996 - RNA, 19 nt, Human
uucacugugaugaaugggc

SEQ ID NO: 1201997 - RNA, 19 nt, Human
uucccacuguaauaaauga

SEQ ID NO: 1201998 - RNA, 20 nt, Human
uugacagugaacagguuuuc

SEQ ID NO: 1201999 - RNA, 19 nt, Human
uuguacugagugugugggu

SEQ ID NO: 1202000 - RNA, 19 nt, Human
uuucagcgcccugcauuug

SEQ ID NO: 1202001 - RNA, 19 nt, Human
agagaauucuauagccaca

SEQ ID NO: 1202002 - RNA, 23 nt, Human
uccagagagaauucuauagccac

SEQ ID NO: 1202003 - RNA, 22 nt, Human
ucccuauauaaauugugcugug

SEQ ID NO: 1202004 - RNA, 19 nt, Human
uccuccagagagaauucua

SEQ ID NO: 1202005 - RNA, 18 nt, Human
auugugcggcugcgggac

SEQ ID NO: 1202006 - RNA, 18 nt, Human
cauugugcggcugcggga

SEQ ID NO: 1202007 - RNA, 23 nt, Human
ccagccuucggggucccccaucc

SEQ ID NO: 1202008 - RNA, 20 nt, Human
ccgcccgcauugugcggcug

SEQ ID NO: 1202009 - RNA, 22 nt, Human
ccuccacuucccccagccuucg

SEQ ID NO: 1202010 - RNA, 19 nt, Human
cgagaggggcggggcggca

SEQ ID NO: 1202011 - RNA, 21 nt, Human
cgccgggacgcgaucacucgg

SEQ ID NO: 1202012 - RNA, 25 nt, Human
cggcugcgggacacuugugucuuug

SEQ ID NO: 1202013 - RNA, 18 nt, Human
cugugcgcgcguccgucc

SEQ ID NO: 1202014 - RNA, 21 nt, Human
cugugcgcgcguccguccccu

SEQ ID NO: 1202015 - RNA, 23 nt, Human
gagaggggcggggcggcaggggu

SEQ ID NO: 1202016 - RNA, 22 nt, Human
ggcacgcagacgucgcucgcca

SEQ ID NO: 1202017 - RNA, 18 nt, Human
guccccuccacuuccccc

SEQ ID NO: 1202018 - RNA, 24 nt, Human
guccccuccacuucccccagccuu

SEQ ID NO: 1202019 - RNA, 19 nt, Human
ucccccagccuucgggguc

SEQ ID NO: 1202020 - RNA, 22 nt, Human
ucggggucccccauccgcuugg

SEQ ID NO: 1202021 - RNA, 24 nt, Human
ugccccgagaggggcggggcggca

SEQ ID NO: 1202022 - RNA, 21 nt, Human
uucccccagccuucggggucc

SEQ ID NO: 1202023 - RNA, 24 nt, Human
uucggggucccccauccgcuuggc

SEQ ID NO: 1202024 - RNA, 24 nt, Human
aaagcuuucccacacuccuuacau

SEQ ID NO: 1202025 - RNA, 22 nt, Human
aaaguagaaaauaaguugaaaa

SEQ ID NO: 1202026 - RNA, 19 nt, Human
acaaaccagcuggccguga

SEQ ID NO: 1202027 - RNA, 23 nt, Human
acgaagcauaaaggcuuucccgc

SEQ ID NO: 1202028 - RNA, 18 nt, Human
acuaaaagcuuucccaca

SEQ ID NO: 1202029 - RNA, 19 nt, Human
agaauaucccagugagacc

SEQ ID NO: 1202030 - RNA, 19 nt, Human
aggguuuuacaccaguaug

SEQ ID NO: 1202031 - RNA, 22 nt, Human
aguaagguaaaaacuaagucua

SEQ ID NO: 1202032 - RNA, 24 nt, Human
auagaucuuucuuuaagucccugu

SEQ ID NO: 1202033 - RNA, 29 nt, Human
augaauucuuugauguauucuaaggucuu

SEQ ID NO: 1202034 - RNA, 19 nt, Human
caaaagguuuuauaccagu

SEQ ID NO: 1202035 - RNA, 21 nt, Human
cacauucuuuacauuuauagg

SEQ ID NO: 1202036 - RNA, 23 nt, Human
cacuaaaagcuuucccacacucc

SEQ ID NO: 1202037 - RNA, 21 nt, Human
caguaaggacugaacgaagca

SEQ ID NO: 1202038 - RNA, 19 nt, Human
caguaugaauucuuugaug

SEQ ID NO: 1202039 - RNA, 19 nt, Human
caguaugaauuuucugaug

SEQ ID NO: 1202040 - RNA, 21 nt, Human
cagugaacugcccacgccgac

SEQ ID NO: 1202041 - RNA, 24 nt, Human
cagugugaauucucugauguucag

SEQ ID NO: 1202042 - RNA, 24 nt, Human
cagugugaauucucugguguucag

SEQ ID NO: 1202043 - RNA, 18 nt, Human
caugaguucuucuguguu

SEQ ID NO: 1202044 - RNA, 21 nt, Human
caugaguucuucuguguucag

SEQ ID NO: 1202045 - RNA, 20 nt, Human
ccaagugugagucacagcuu

SEQ ID NO: 1202046 - RNA, 21 nt, Human
ccacucauuucuaaaaaugga

SEQ ID NO: 1202047 - RNA, 19 nt, Human
ccagugugaauucucugau

SEQ ID NO: 1202048 - RNA, 19 nt, Human
ccagugugaauucucuggu

SEQ ID NO: 1202049 - RNA, 19 nt, Human
cccacgccgacuaaaggac

SEQ ID NO: 1202050 - RNA, 20 nt, Human
cccacgccgacuaaaggacu

SEQ ID NO: 1202051 - RNA, 24 nt, Human
cccucuacgaauaaaggccuuucc

SEQ ID NO: 1202052 - RNA, 20 nt, Human
ccuguugacccucaaacuca

SEQ ID NO: 1202053 - RNA, 23 nt, Human
cuaaaggucuucccacaucguac

SEQ ID NO: 1202054 - RNA, 22 nt, Human
cuaaaggucuuuccacauuccu

SEQ ID NO: 1202055 - RNA, 22 nt, Human
cucaacucaccggggcacuguc

SEQ ID NO: 1202056 - RNA, 20 nt, Human
cucuccaguaugaauucuag

SEQ ID NO: 1202057 - RNA, 22 nt, Human
cuuuaagucccuguugacccuc

SEQ ID NO: 1202058 - RNA, 23 nt, Human
cuuuacagucauaggguuuuaaa

SEQ ID NO: 1202059 - RNA, 19 nt, Human
gacuaaaggacuucccaca

SEQ ID NO: 1202060 - RNA, 24 nt, Human
guaugaauuuucugauguucagug

SEQ ID NO: 1202061 - RNA, 28 nt, Human
gucuauagccacaucccugaacgucacc

SEQ ID NO: 1202062 - RNA, 18 nt, Human
uaagguagaaaccaaauc

SEQ ID NO: 1202063 - RNA, 21 nt, Human
uacacuaaaagcuuucccaca

SEQ ID NO: 1202064 - RNA, 21 nt, Human
uaccuguaugaauucucucau

SEQ ID NO: 1202065 - RNA, 19 nt, Human
uaugccgauuaagcugucc

SEQ ID NO: 1202066 - RNA, 18 nt, Human
ucacaucccucgccacca

SEQ ID NO: 1202067 - RNA, 25 nt, Human
ucaccagugugaauucucugauguu

SEQ ID NO: 1202068 - RNA, 25 nt, Human
ucaccagugugaauucucugguguu

SEQ ID NO: 1202069 - RNA, 18 nt, Human
ucccucuacgaauaaagg

SEQ ID NO: 1202070 - RNA, 23 nt, Human
uccuuacauucguagggcuucac

SEQ ID NO: 1202071 - RNA, 23 nt, Human
uccuuacauucguaggguuuuac

SEQ ID NO: 1202072 - RNA, 22 nt, Human
ucuaaaggucuuuccacauucc

SEQ ID NO: 1202073 - RNA, 19 nt, Human
ucuacacuacgacuaaagg

SEQ ID NO: 1202074 - RNA, 21 nt, Human
ucucugauguucaguaaggac

SEQ ID NO: 1202075 - RNA, 18 nt, Human
ucuuggucuuaugccugg

SEQ ID NO: 1202076 - RNA, 19 nt, Human
ugaauguccuuuucugaag

SEQ ID NO: 1202077 - RNA, 19 nt, Human
ugaauguccuuuucugaag

SEQ ID NO: 1202078 - RNA, 23 nt, Human
ugagaacgaacucgaaaggucuu

SEQ ID NO: 1202079 - RNA, 22 nt, Human
ugagagaagucuauagccacau

SEQ ID NO: 1202080 - RNA, 20 nt, Human
ugguuuuacacccguaugaa

SEQ ID NO: 1202081 - RNA, 19 nt, Human
uucuccaacaucacaucuc

SEQ ID NO: 1202082 - RNA, 26 nt, Human
uuucucacuauugugaauucucugau

SEQ ID NO: 1202083 - RNA, 19 nt, Human
aaaguugaagguggugagc

SEQ ID NO: 1202084 - RNA, 19 nt, Human
aagauccucuugggcugcc

SEQ ID NO: 1202085 - RNA, 22 nt, Human
acgcagcaggucuuucagagca

SEQ ID NO: 1202086 - RNA, 23 nt, Human
acucaguuuggagggugcucaga

SEQ ID NO: 1202087 - RNA, 22 nt, Human
acuccaaggggcucaagauggg

SEQ ID NO: 1202088 - RNA, 20 nt, Human
agacagacacuccauguccc

SEQ ID NO: 1202089 - RNA, 23 nt, Human
aggaggacccugaguuggggguc

SEQ ID NO: 1202090 - RNA, 23 nt, Human
aggcaggaggacccugaguuggg

SEQ ID NO: 1202091 - RNA, 23 nt, Human
agggguucuugagguaccugagc

SEQ ID NO: 1202092 - RNA, 25 nt, Human
aggucuuucagagcauucauggagg

SEQ ID NO: 1202093 - RNA, 21 nt, Human
agguggugagcugggaacagu

SEQ ID NO: 1202094 - RNA, 19 nt, Human
aguggcucagggcaggcag

SEQ ID NO: 1202095 - RNA, 25 nt, Human
caacuccaggccuaacuugcucagc

SEQ ID NO: 1202096 - RNA, 20 nt, Human
caucuggggguaguacaggc

SEQ ID NO: 1202097 - RNA, 21 nt, Human
cauuuccaugaaaguugaagg

SEQ ID NO: 1202098 - RNA, 20 nt, Human
ccucuugggcugccugacuu

SEQ ID NO: 1202099 - RNA, 22 nt, Human
cucaguuuggagggugcucaga

SEQ ID NO: 1202100 - RNA, 24 nt, Human
cuccaggccuaacuugcucagccc

SEQ ID NO: 1202101 - RNA, 26 nt, Human
cuccaggccuaacuugcucagcccac

SEQ ID NO: 1202102 - RNA, 21 nt, Human
cuuucuccagcagaacuccaa

SEQ ID NO: 1202103 - RNA, 22 nt, Human
gagggucuugagaguagcagca

SEQ ID NO: 1202104 - RNA, 23 nt, Human
gcagaacuccaaggggcucaaga

SEQ ID NO: 1202105 - RNA, 24 nt, Human
gggcaggcaggaggacccugaguu

SEQ ID NO: 1202106 - RNA, 21 nt, Human
ggguccuggauccgacagucc

SEQ ID NO: 1202107 - RNA, 23 nt, Human
ggugagcugggaacaguggcuca

SEQ ID NO: 1202108 - RNA, 25 nt, Human
guagcagcaacuuucuccagcagaa

SEQ ID NO: 1202109 - RNA, 27 nt, Human
gucuugagaguagcagcaacuuucucc

SEQ ID NO: 1202110 - RNA, 23 nt, Human
gugacgcagcaggucuuucagag

SEQ ID NO: 1202111 - RNA, 20 nt, Human
uaagacgagggucuugagag

SEQ ID NO: 1202112 - RNA, 20 nt, Human
uagcagcaacuuucuccagc

SEQ ID NO: 1202113 - RNA, 28 nt, Human
ucccugaguguacgcaucagcucagccc

SEQ ID NO: 1202114 - RNA, 21 nt, Human
ugagcugggaacaguggcuca

SEQ ID NO: 1202115 - RNA, 21 nt, Human
ugagcugggaacaguggcuca

SEQ ID NO: 1202116 - RNA, 22 nt, Human
ugcuccaggugcucuuugauau

SEQ ID NO: 1202117 - RNA, 23 nt, Human
uggaggucucauuuccaugaaag

SEQ ID NO: 1202118 - RNA, 19 nt, Human
uggcucagggcaggcagga

SEQ ID NO: 1202119 - RNA, 18 nt, Human
ugggaacaguggcucagg

SEQ ID NO: 1202120 - RNA, 22 nt, Human
uggggugaggaucucccaauug

SEQ ID NO: 1202121 - RNA, 21 nt, Human
uugaagguggugagcugggaa

SEQ ID NO: 1202122 - RNA, 21 nt, Human
uugauauuacugaucuuuuuu

SEQ ID NO: 1202123 - RNA, 24 nt, Human
gagccaaguccugguuggaaccgg

SEQ ID NO: 1202124 - RNA, 20 nt, Human
guccugguuggaaccggagc

SEQ ID NO: 1202125 - RNA, 27 nt, Human
uggaaccggagcucugaacaccaccaa

SEQ ID NO: 1202126 - RNA, 24 nt, Human
cugccuccaaaucaagagcaugga

SEQ ID NO: 1202127 - RNA, 23 nt, Human
cuuuccugccuccaaaucaagag

SEQ ID NO: 1202128 - RNA, 22 nt, Human
uucacaguccuuuccugccucc

SEQ ID NO: 1202129 - RNA, 24 nt, Human
aaaaaacagauguaaaacaacuaa

SEQ ID NO: 1202130 - RNA, 18 nt, Human
aaacagauguaaaacaac

SEQ ID NO: 1202131 - RNA, 19 nt, Human
aaacagauguaaaacaacu

SEQ ID NO: 1202132 - RNA, 22 nt, Human
aaacagauguaaaacaacuaau

SEQ ID NO: 1202133 - RNA, 21 nt, Human
acaggcagcaccaucucccuc

SEQ ID NO: 1202134 - RNA, 21 nt, Human
acgcuccgcucugguccgaau

SEQ ID NO: 1202135 - RNA, 20 nt, Human
agcaaaaaacagauguaaaa

SEQ ID NO: 1202136 - RNA, 20 nt, Human
aggcagcaccaucucccucu

SEQ ID NO: 1202137 - RNA, 21 nt, Human
aggcagcaccaucucccucuc

SEQ ID NO: 1202138 - RNA, 22 nt, Human
cacucugcccucauggggcuua

SEQ ID NO: 1202139 - RNA, 21 nt, Human
cagaauccacaggcagcacca

SEQ ID NO: 1202140 - RNA, 27 nt, Human
cagaauccacaggcagcaccaucuccc

SEQ ID NO: 1202141 - RNA, 20 nt, Human
caguguggaaaggcuagccu

SEQ ID NO: 1202142 - RNA, 18 nt, Human
ccaaauuccugcucuggu

SEQ ID NO: 1202143 - RNA, 20 nt, Human
ccugaagcacccuuggcugg

SEQ ID NO: 1202144 - RNA, 21 nt, Human
ccugaagcacccuuggcugga

SEQ ID NO: 1202145 - RNA, 19 nt, Human
ccugcucugguuuuaacuc

SEQ ID NO: 1202146 - RNA, 24 nt, Human
cgaaugaagagccauuugcacuca

SEQ ID NO: 1202147 - RNA, 20 nt, Human
cuuagcaaaaaacagaugua

SEQ ID NO: 1202148 - RNA, 18 nt, Human
cuuguuccugaagcaccc

SEQ ID NO: 1202149 - RNA, 24 nt, Human
gcccucauggggcuuacgguccuu

SEQ ID NO: 1202150 - RNA, 21 nt, Human
uaacucagugagcuucaacac

SEQ ID NO: 1202151 - RNA, 22 nt, Human
uaacucagugagcuucaacacc

SEQ ID NO: 1202152 - RNA, 23 nt, Human
uacgguccuuagcaaaaaacaga

SEQ ID NO: 1202153 - RNA, 23 nt, Human
uagcaaaaaacagauguaaaaca

SEQ ID NO: 1202154 - RNA, 27 nt, Human
uagcaaaaaacagauguaaaacaacua

SEQ ID NO: 1202155 - RNA, 29 nt, Human
uagcaaaaaacagauguaaaagggacccc

SEQ ID NO: 1202156 - RNA, 22 nt, Human
ucccucuccauagccuuugcug

SEQ ID NO: 1202157 - RNA, 19 nt, Human
ugaagcacccuuggcugga

SEQ ID NO: 1202158 - RNA, 24 nt, Human
ugcugauccuuguuccugaagcac

SEQ ID NO: 1202159 - RNA, 20 nt, Human
aaaaagacaauccugcccuc

SEQ ID NO: 1202160 - RNA, 24 nt, Human
aaguccacuucaaauuaaauaugg

SEQ ID NO: 1202161 - RNA, 20 nt, Human
acacagaaaaaaaaagacaa

SEQ ID NO: 1202162 - RNA, 28 nt, Human
aggaagaggcggaggcagguccgggcuu

SEQ ID NO: 1202163 - RNA, 24 nt, Human
aggagcucacagucuaguggggga

SEQ ID NO: 1202164 - RNA, 25 nt, Human
aggcggaggcagguccgggcuucga

SEQ ID NO: 1202165 - RNA, 19 nt, Human
agugggggaaacagauagg

SEQ ID NO: 1202166 - RNA, 19 nt, Human
caaaauaaaaacccccaga

SEQ ID NO: 1202167 - RNA, 19 nt, Human
ccaaaauagaagguuuuca

SEQ ID NO: 1202168 - RNA, 19 nt, Human
ccgccgaggcagccaccgg

SEQ ID NO: 1202169 - RNA, 18 nt, Human
cgggcggucgacgcggug

SEQ ID NO: 1202170 - RNA, 22 nt, Human
cggugggcccccuccccggucc

SEQ ID NO: 1202171 - RNA, 19 nt, Human
cuggaggaagaggcggagg

SEQ ID NO: 1202172 - RNA, 23 nt, Human
cuggggacacagaaaaaaaaaga

SEQ ID NO: 1202173 - RNA, 20 nt, Human
gaauaacaaaauaaaaaccc

SEQ ID NO: 1202174 - RNA, 21 nt, Human
gaauaacaaaauaaaaacccc

SEQ ID NO: 1202175 - RNA, 22 nt, Human
gacgcggugggcccccuccccg

SEQ ID NO: 1202176 - RNA, 20 nt, Human
gcggcggcggaggcggcggg

SEQ ID NO: 1202177 - RNA, 18 nt, Human
ggaggacgaggcacggga

SEQ ID NO: 1202178 - RNA, 24 nt, Human
ggcgcggcggcggaggcggcggga

SEQ ID NO: 1202179 - RNA, 24 nt, Human
ggggcgcggcggcggaggcggcgg

SEQ ID NO: 1202180 - RNA, 28 nt, Human
uaaaaagggaugauguccaaugcagugg

SEQ ID NO: 1202181 - RNA, 18 nt, Human
uaagugcuggggacacag

SEQ ID NO: 1202182 - RNA, 23 nt, Human
uagauauaugaagauuaaaaaaa

SEQ ID NO: 1202183 - RNA, 23 nt, Human
uaguaugaauaguauuuuaagug

SEQ ID NO: 1202184 - RNA, 19 nt, Human
uccugcccucgaggagcuc

SEQ ID NO: 1202185 - RNA, 21 nt, Human
ugaauggaugguaaaaaggga

SEQ ID NO: 1202186 - RNA, 26 nt, Human
ugaauggaugguaaaaagggaugaug

SEQ ID NO: 1202187 - RNA, 18 nt, Human
uuuauaaacuucacuugc

SEQ ID NO: 1202188 - RNA, 22 nt, Human
aagaccacuaccacguuccgcc

SEQ ID NO: 1202189 - RNA, 20 nt, Human
accaccuucuuuuucuugcc

SEQ ID NO: 1202190 - RNA, 24 nt, Human
accagagaagggggcccccucaga

SEQ ID NO: 1202191 - RNA, 18 nt, Human
acccguggccgcagccgu

SEQ ID NO: 1202192 - RNA, 25 nt, Human
agacggcgaccugggacgucaagca

SEQ ID NO: 1202193 - RNA, 21 nt, Human
agagaagggggcccccucaga

SEQ ID NO: 1202194 - RNA, 21 nt, Human
agaggaucagcaagagguugc

SEQ ID NO: 1202195 - RNA, 21 nt, Human
agcagcagguucuuaggaggg

SEQ ID NO: 1202196 - RNA, 25 nt, Human
agccaccgggcgagacugugcuggc

SEQ ID NO: 1202197 - RNA, 20 nt, Human
agcgucuaccuccccccggc

SEQ ID NO: 1202198 - RNA, 20 nt, Human
aggaagugggagaugcucug

SEQ ID NO: 1202199 - RNA, 18 nt, Human
aggaggcggugguggugg

SEQ ID NO: 1202200 - RNA, 21 nt, Human
aggcccggcagccccagagga

SEQ ID NO: 1202201 - RNA, 26 nt, Human
aggcggugguggugggggucgagggc

SEQ ID NO: 1202202 - RNA, 22 nt, Human
aggcgguggugguggggguucg

SEQ ID NO: 1202203 - RNA, 25 nt, Human
aggggcccccgguaggcgguggggc

SEQ ID NO: 1202204 - RNA, 23 nt, Human
aggggcgugggggcugaaccaga

SEQ ID NO: 1202205 - RNA, 21 nt, Human
agguagguguuggcaggcggg

SEQ ID NO: 1202206 - RNA, 24 nt, Human
caagagguugcagggguggcagcu

SEQ ID NO: 1202207 - RNA, 23 nt, Human
caaggcguacuuggggugacccu

SEQ ID NO: 1202208 - RNA, 21 nt, Human
caccacaguccagguguacac

SEQ ID NO: 1202209 - RNA, 18 nt, Human
caccaugcgccgcacgcc

SEQ ID NO: 1202210 - RNA, 18 nt, Human
cagcgccuggaaaggacc

SEQ ID NO: 1202211 - RNA, 22 nt, Human
cagcugcaccacuggucgcagg

SEQ ID NO: 1202212 - RNA, 21 nt, Human
cagcugggggugcuguggagc

SEQ ID NO: 1202213 - RNA, 20 nt, Human
caggagcugaggcuccggcc

SEQ ID NO: 1202214 - RNA, 20 nt, Human
cagggcagccaccagccccg

SEQ ID NO: 1202215 - RNA, 19 nt, Human
cagucggagcccaccacag

SEQ ID NO: 1202216 - RNA, 23 nt, Human
cauagccgccguacuggggcagg

SEQ ID NO: 1202217 - RNA, 24 nt, Human
cauggcccccaccccggccaccaa

SEQ ID NO: 1202218 - RNA, 18 nt, Human
caugguggccgcugccac

SEQ ID NO: 1202219 - RNA, 20 nt, Human
ccauggcugagggcgggggc

SEQ ID NO: 1202220 - RNA, 20 nt, Human
cccagcggcugccacggcca

SEQ ID NO: 1202221 - RNA, 22 nt, Human
cccauagccgccguacuggggc

SEQ ID NO: 1202222 - RNA, 24 nt, Human
ccccaacucaguaaggcccgggcc

SEQ ID NO: 1202223 - RNA, 18 nt, Human
ccccaccccggccaccaa

SEQ ID NO: 1202224 - RNA, 20 nt, Human
ccccaccccggccaccaaaa

SEQ ID NO: 1202225 - RNA, 23 nt, Human
ccccaccccggccaccaaaaccg

SEQ ID NO: 1202226 - RNA, 19 nt, Human
ccccagcggcugccacggc

SEQ ID NO: 1202227 - RNA, 20 nt, Human
ccccagcggcugccacggcc

SEQ ID NO: 1202228 - RNA, 22 nt, Human
ccccaggggcugcuggggcucc

SEQ ID NO: 1202229 - RNA, 26 nt, Human
ccccaggggcugcugggggggaccgc

SEQ ID NO: 1202230 - RNA, 21 nt, Human
ccccggccaccaaaaccgccu

SEQ ID NO: 1202231 - RNA, 18 nt, Human
ccccgugccugggggcuc

SEQ ID NO: 1202232 - RNA, 23 nt, Human
cccguggccgcagccguggcucc

SEQ ID NO: 1202233 - RNA, 18 nt, Human
cccucaggcccggggggg

SEQ ID NO: 1202234 - RNA, 19 nt, Human
cccucggcucugccgccug

SEQ ID NO: 1202235 - RNA, 19 nt, Human
ccgcagccguggcuccggg

SEQ ID NO: 1202236 - RNA, 21 nt, Human
ccggccccauagccgccguac

SEQ ID NO: 1202237 - RNA, 19 nt, Human
ccggcgcugugggcgcugc

SEQ ID NO: 1202238 - RNA, 21 nt, Human
ccucuagcagcugggccucug

SEQ ID NO: 1202239 - RNA, 21 nt, Human
ccuggcagggcagggggugga

SEQ ID NO: 1202240 - RNA, 23 nt, Human
ccuucuuuuucuugccgaugccc

SEQ ID NO: 1202241 - RNA, 23 nt, Human
cgacacaggaucuuuggccuauc

SEQ ID NO: 1202242 - RNA, 20 nt, Human
cgccugggcugucacacugg

SEQ ID NO: 1202243 - RNA, 24 nt, Human
cgggggcaccagcuuggggaaggu

SEQ ID NO: 1202244 - RNA, 24 nt, Human
cggguccaggaagcggggcugggg

SEQ ID NO: 1202245 - RNA, 18 nt, Human
cggugcaggcgggcggcu

SEQ ID NO: 1202246 - RNA, 22 nt, Human
cgguucaggaaggccagcuugg

SEQ ID NO: 1202247 - RNA, 18 nt, Human
cguagaggggauggcugg

SEQ ID NO: 1202248 - RNA, 24 nt, Human
cgucaagcagcuugggcagggggu

SEQ ID NO: 1202249 - RNA, 24 nt, Human
cuacugcgcgccagguacugggcu

SEQ ID NO: 1202250 - RNA, 18 nt, Human
cucaggcccgggggggcc

SEQ ID NO: 1202251 - RNA, 22 nt, Human
cuccacgcucaggcugcugcuc

SEQ ID NO: 1202252 - RNA, 21 nt, Human
cuccuugcccuccacgcucag

SEQ ID NO: 1202253 - RNA, 19 nt, Human
cugaagaaggaggccuugc

SEQ ID NO: 1202254 - RNA, 22 nt, Human
cugggccuggcagggcaggggg

SEQ ID NO: 1202255 - RNA, 24 nt, Human
cuguuagcgcaguccuggccugua

SEQ ID NO: 1202256 - RNA, 20 nt, Human
cuucaucuucagcagcgggg

SEQ ID NO: 1202257 - RNA, 20 nt, Human
cuugccgggacccagcagca

SEQ ID NO: 1202258 - RNA, 19 nt, Human
cuuggccaggcuggggacu

SEQ ID NO: 1202259 - RNA, 22 nt, Human
cuugggcuugccgggacccagc

SEQ ID NO: 1202260 - RNA, 21 nt, Human
cuuuguauguggucuuguucc

SEQ ID NO: 1202261 - RNA, 19 nt, Human
gaccaucgcagcucagguu

SEQ ID NO: 1202262 - RNA, 19 nt, Human
gagaagaagcuguacugua

SEQ ID NO: 1202263 - RNA, 19 nt, Human
gagacugugcuggcccggc

SEQ ID NO: 1202264 - RNA, 26 nt, Human
gagccaggcccggcagccccagagga

SEQ ID NO: 1202265 - RNA, 26 nt, Human
gagcggcucuagugccugcgggucca

SEQ ID NO: 1202266 - RNA, 22 nt, Human
gagggcccccgugccugggggc

SEQ ID NO: 1202267 - RNA, 27 nt, Human
gagucaggcaggguguccagggccuuc

SEQ ID NO: 1202268 - RNA, 24 nt, Human
gcagccccagaggaucagcaagag

SEQ ID NO: 1202269 - RNA, 18 nt, Human
gcaggcaggggcccccgg

SEQ ID NO: 1202270 - RNA, 20 nt, Human
gcagggguggcagcuccaga

SEQ ID NO: 1202271 - RNA, 24 nt, Human
gccaaacugggugaggagaagaag

SEQ ID NO: 1202272 - RNA, 22 nt, Human
gccccauagccgccguacuggg

SEQ ID NO: 1202273 - RNA, 21 nt, Human
gcccgggcccccgaccccagc

SEQ ID NO: 1202274 - RNA, 18 nt, Human
gcccguugucccagcagc

SEQ ID NO: 1202275 - RNA, 18 nt, Human
gccgggacccagcagcag

SEQ ID NO: 1202276 - RNA, 21 nt, Human
gccucggccgccaccacagcu

SEQ ID NO: 1202277 - RNA, 18 nt, Human
gccucggggcguggacag

SEQ ID NO: 1202278 - RNA, 19 nt, Human
gccugcggguccaggaagc

SEQ ID NO: 1202279 - RNA, 21 nt, Human
gcucggccagugggcagugcc

SEQ ID NO: 1202280 - RNA, 23 nt, Human
gcucugggggcagacccguggcc

SEQ ID NO: 1202281 - RNA, 18 nt, Human
gcugcugccgucuccgac

SEQ ID NO: 1202282 - RNA, 19 nt, Human
gcugucagcugggggugcu

SEQ ID NO: 1202283 - RNA, 20 nt, Human
gcugucagcugggggugcug

SEQ ID NO: 1202284 - RNA, 22 nt, Human
gcuguugccacugccauaggcg

SEQ ID NO: 1202285 - RNA, 18 nt, Human
ggagcugcugccgucucc

SEQ ID NO: 1202286 - RNA, 23 nt, Human
ggcaggggguggaggaggcggug

SEQ ID NO: 1202287 - RNA, 18 nt, Human
ggcagguagguguuggca

SEQ ID NO: 1202288 - RNA, 21 nt, Human
ggcagguagguguuggcaggc

SEQ ID NO: 1202289 - RNA, 20 nt, Human
ggcauggccaugguggccgc

SEQ ID NO: 1202290 - RNA, 19 nt, Human
ggcccgggggggccgugcg

SEQ ID NO: 1202291 - RNA, 20 nt, Human
ggccgcauggcccccacccc

SEQ ID NO: 1202292 - RNA, 20 nt, Human
ggcucugccgccugggcugu

SEQ ID NO: 1202293 - RNA, 22 nt, Human
gggacugagaccgggccugggc

SEQ ID NO: 1202294 - RNA, 20 nt, Human
gggagcugcugccgucuccg

SEQ ID NO: 1202295 - RNA, 18 nt, Human
gggcaccagcuuggggaa

SEQ ID NO: 1202296 - RNA, 23 nt, Human
gggcagguagguguuggcaggcg

SEQ ID NO: 1202297 - RNA, 21 nt, Human
gggcaguaggcggcccucggg

SEQ ID NO: 1202298 - RNA, 20 nt, Human
gggccauggcugagggcggg

SEQ ID NO: 1202299 - RNA, 18 nt, Human
gggcugaaccagagaagg

SEQ ID NO: 1202300 - RNA, 19 nt, Human
ggggcaccagcuuggggaa

SEQ ID NO: 1202301 - RNA, 24 nt, Human
ggggcucugccagucgcuggcugu

SEQ ID NO: 1202302 - RNA, 19 nt, Human
gggggcugaaccagagaag

SEQ ID NO: 1202303 - RNA, 19 nt, Human
gggguggaggaggcggugg

SEQ ID NO: 1202304 - RNA, 18 nt, Human
ggguccaggagcugaggc

SEQ ID NO: 1202305 - RNA, 22 nt, Human
gggugcuguggagcaacuucgg

SEQ ID NO: 1202306 - RNA, 24 nt, Human
ggugacccucaggcccgggggggc

SEQ ID NO: 1202307 - RNA, 23 nt, Human
ggugcuguggagcaacuucggcc

SEQ ID NO: 1202308 - RNA, 19 nt, Human
gguguccagcagcggggcg

SEQ ID NO: 1202309 - RNA, 22 nt, Human
uaaggcccgggcccccgacccc

SEQ ID NO: 1202310 - RNA, 21 nt, Human
uacgcuuuguccggccccaua

SEQ ID NO: 1202311 - RNA, 24 nt, Human
uacggaugcuguuggccaaacugg

SEQ ID NO: 1202312 - RNA, 18 nt, Human
uagcagcugggccucugg

SEQ ID NO: 1202313 - RNA, 19 nt, Human
uagcgcaguccuggccugu

SEQ ID NO: 1202314 - RNA, 18 nt, Human
ucaccgggugggaagacc

SEQ ID NO: 1202315 - RNA, 21 nt, Human
ucacuggguguccagcagcgg

SEQ ID NO: 1202316 - RNA, 21 nt, Human
ucaggcaggguguccagggcc

SEQ ID NO: 1202317 - RNA, 21 nt, Human
ucaggcccgggggggccgugc

SEQ ID NO: 1202318 - RNA, 22 nt, Human
ucaggcucguagaggggauggc

SEQ ID NO: 1202319 - RNA, 21 nt, Human
uccccgagcggcucuagugcc

SEQ ID NO: 1202320 - RNA, 21 nt, Human
ucgcagguucacccgcccguu

SEQ ID NO: 1202321 - RNA, 18 nt, Human
ucgccggguggcggugca

SEQ ID NO: 1202322 - RNA, 18 nt, Human
ucucuggaagagagaggg

SEQ ID NO: 1202323 - RNA, 21 nt, Human
ucucuggaagagagagggccc

SEQ ID NO: 1202324 - RNA, 20 nt, Human
ucugccuugcguccccgucc

SEQ ID NO: 1202325 - RNA, 21 nt, Human
ugagcacaaguccaggcgcaa

SEQ ID NO: 1202326 - RNA, 22 nt, Human
ugccugggggcucugccagucg

SEQ ID NO: 1202327 - RNA, 19 nt, Human
ugccugggggucaagcagc

SEQ ID NO: 1202328 - RNA, 21 nt, Human
ugccugggggucaagcagcug

SEQ ID NO: 1202329 - RNA, 21 nt, Human
ugccuuugcggguagagacca

SEQ ID NO: 1202330 - RNA, 18 nt, Human
ugcgccgcacgccccggg

SEQ ID NO: 1202331 - RNA, 20 nt, Human
ugcugcagguccugggagag

SEQ ID NO: 1202332 - RNA, 19 nt, Human
uggaagagagagggccccc

SEQ ID NO: 1202333 - RNA, 23 nt, Human
uggaggaggcggugguggugggg

SEQ ID NO: 1202334 - RNA, 21 nt, Human
uggcucaggcucugggggcag

SEQ ID NO: 1202335 - RNA, 20 nt, Human
uggcuccuugggcuugccuc

SEQ ID NO: 1202336 - RNA, 20 nt, Human
ugggaagaccacuaccacgg

SEQ ID NO: 1202337 - RNA, 24 nt, Human
ugggggcugaaccagagaaggggg

SEQ ID NO: 1202338 - RNA, 24 nt, Human
ugggugguaggugagcgggccaug

SEQ ID NO: 1202339 - RNA, 20 nt, Human
ugucguuggcgucugcugca

SEQ ID NO: 1202340 - RNA, 23 nt, Human
ugucuggcucaggcucugggggc

SEQ ID NO: 1202341 - RNA, 24 nt, Human
uguggucuuguuccgccgccccag

SEQ ID NO: 1202342 - RNA, 20 nt, Human
uuagcgcaguccuggccugu

SEQ ID NO: 1202343 - RNA, 19 nt, Human
uucaucuucagcagcgggg

SEQ ID NO: 1202344 - RNA, 22 nt, Human
uugcagggguggcagcuccaga

SEQ ID NO: 1202345 - RNA, 21 nt, Human
uuggccaggcuggggacuguc

SEQ ID NO: 1202346 - RNA, 19 nt, Human
uuggcgugugggguggccc

SEQ ID NO: 1202347 - RNA, 22 nt, Human
uugguggcaggcaggggccccc

SEQ ID NO: 1202348 - RNA, 19 nt, Human
uuguauguggucuuguucc

SEQ ID NO: 1202349 - RNA, 23 nt, Human
agucagacacaaaagcaaacuuc

SEQ ID NO: 1202350 - RNA, 18 nt, Human
ugaggaagucagacacaa

SEQ ID NO: 1202351 - RNA, 21 nt, Human
ugggguuggaaugaggaaguc

SEQ ID NO: 1202352 - RNA, 20 nt, Human
uucgaaguuccuucucuggg

SEQ ID NO: 1202353 - RNA, 23 nt, Human
uucgaaguuccuucucugggguu

SEQ ID NO: 1202354 - RNA, 18 nt, Human
ggacaggcaugaguuuua

SEQ ID NO: 1202355 - RNA, 22 nt, Human
guauaggucgauuucucaucuc

SEQ ID NO: 1202356 - RNA, 19 nt, Human
guuccuguuuucucaccga

SEQ ID NO: 1202357 - RNA, 21 nt, Human
uacuuccaguguuccuguuuu

SEQ ID NO: 1202358 - RNA, 18 nt, Human
ucuaaauuucuguaaccu

SEQ ID NO: 1202359 - RNA, 24 nt, Human
uuguauaggucgauuucucaucuc

SEQ ID NO: 1202360 - RNA, 20 nt, Human
uuucucaucucuguaauugg

SEQ ID NO: 1202361 - RNA, 27 nt, Human
cacugucuuugccugcuuuggagguga

SEQ ID NO: 1202362 - RNA, 20 nt, Human
cagcagcgcugauggaucuc

SEQ ID NO: 1202363 - RNA, 18 nt, Human
caggagcuguaaccaggg

SEQ ID NO: 1202364 - RNA, 21 nt, Human
caggagcuguaaccaggggca

SEQ ID NO: 1202365 - RNA, 22 nt, Human
ccagcagcgcugauggaucuga

SEQ ID NO: 1202366 - RNA, 19 nt, Human
cugauggugauuucauacc

SEQ ID NO: 1202367 - RNA, 21 nt, Human
cuggcuucucccagcagcgcu

SEQ ID NO: 1202368 - RNA, 20 nt, Human
gccuggcuucucccagcagc

SEQ ID NO: 1202369 - RNA, 19 nt, Human
gggaauuggccaccguggu

SEQ ID NO: 1202370 - RNA, 19 nt, Human
gucacagugccuggggaau

SEQ ID NO: 1202371 - RNA, 18 nt, Human
gugcagccaacacugucu

SEQ ID NO: 1202372 - RNA, 19 nt, Human
ugaucaauaguggguauuu

SEQ ID NO: 1202373 - RNA, 19 nt, Human
ugccuggggaauuggccac

SEQ ID NO: 1202374 - RNA, 22 nt, Human
uggugcagccaacacugucuuu

SEQ ID NO: 1202375 - RNA, 24 nt, Human
uguguccccgucuucagccgugag

SEQ ID NO: 1202376 - RNA, 28 nt, Human
aaauaucuucugcaaacccucuacaucc

SEQ ID NO: 1202377 - RNA, 21 nt, Human
aucuucugcaaacccucuaca

SEQ ID NO: 1202378 - RNA, 27 nt, Human
cucaaauaucuucugcaaacccucuac

SEQ ID NO: 1202379 - RNA, 20 nt, Human
cucaggauccucaaauaucu

SEQ ID NO: 1202380 - RNA, 22 nt, Human
ucaggauccucaaauaucuucu

SEQ ID NO: 1202381 - RNA, 19 nt, Human
aacgcgguuaccggaagga

SEQ ID NO: 1202382 - RNA, 23 nt, Human
agggaggaaguccccccaaguuu

SEQ ID NO: 1202383 - RNA, 23 nt, Human
agggggaggggagggaggaaguc

SEQ ID NO: 1202384 - RNA, 18 nt, Human
caaguuugcaacccggca

SEQ ID NO: 1202385 - RNA, 18 nt, Human
cagaacccggucccaggg

SEQ ID NO: 1202386 - RNA, 19 nt, Human
cagaacccggucccagggc

SEQ ID NO: 1202387 - RNA, 23 nt, Human
ccagggggaggggagggaggaag

SEQ ID NO: 1202388 - RNA, 20 nt, Human
cccagggggaggggagggag

SEQ ID NO: 1202389 - RNA, 27 nt, Human
cccccaaguuugcaacccggcagcgug

SEQ ID NO: 1202390 - RNA, 21 nt, Human
ccggucccagggcaguugcac

SEQ ID NO: 1202391 - RNA, 22 nt, Human
cggucccagggcaguugcacgg

SEQ ID NO: 1202392 - RNA, 21 nt, Human
gaaguccccccaaguuugcaa

SEQ ID NO: 1202393 - RNA, 20 nt, Human
gaggggagggaggaaguccc

SEQ ID NO: 1202394 - RNA, 19 nt, Human
ggaaggaacgcgaggagcg

SEQ ID NO: 1202395 - RNA, 22 nt, Human
uugcacggcgcccagggggagg

SEQ ID NO: 1202396 - RNA, 24 nt, Human
aaucgcuugaagccaggaguucga

SEQ ID NO: 1202397 - RNA, 21 nt, Human
aaugaacaaaagcaucagaga

SEQ ID NO: 1202398 - RNA, 20 nt, Human
acucaagaaaaaaaaaaaau

SEQ ID NO: 1202399 - RNA, 25 nt, Human
agaaaaaaaaaaaaucacucuguag

SEQ ID NO: 1202400 - RNA, 21 nt, Human
agaaccccaacauauaaaaca

SEQ ID NO: 1202401 - RNA, 24 nt, Human
agaaucgcuugaagccaggaguuc

SEQ ID NO: 1202402 - RNA, 19 nt, Human
agacaaguauaaaauucca

SEQ ID NO: 1202403 - RNA, 24 nt, Human
agcacuuugggaggcugagguggg

SEQ ID NO: 1202404 - RNA, 20 nt, Human
agccaauuggaauuucuuca

SEQ ID NO: 1202405 - RNA, 23 nt, Human
aggaguucgagaccaaccugggc

SEQ ID NO: 1202406 - RNA, 22 nt, Human
aggccaggcgugguggcucacg

SEQ ID NO: 1202407 - RNA, 24 nt, Human
aggccaggcgugguggcucacgcc

SEQ ID NO: 1202408 - RNA, 24 nt, Human
aggcgugguggcucacgccuguaa

SEQ ID NO: 1202409 - RNA, 24 nt, Human
aggcugaggugggagaaucgcuug

SEQ ID NO: 1202410 - RNA, 18 nt, Human
aggugggagaaucgcuug

SEQ ID NO: 1202411 - RNA, 23 nt, Human
auaaauuuuuaaaauaaaacaaa

SEQ ID NO: 1202412 - RNA, 18 nt, Human
aucauacuacucaaaacu

SEQ ID NO: 1202413 - RNA, 21 nt, Human
aucgcuugaagccaggaguuc

SEQ ID NO: 1202414 - RNA, 24 nt, Human
aucgcuugaagccaggaguucgag

SEQ ID NO: 1202415 - RNA, 21 nt, Human
augaaauaaaagcacagugcc

SEQ ID NO: 1202416 - RNA, 22 nt, Human
auuuccucaagcuauuuuauca

SEQ ID NO: 1202417 - RNA, 19 nt, Human
auuuuaucaaccuccuucc

SEQ ID NO: 1202418 - RNA, 21 nt, Human
caagaaaagcugaaguaaaga

SEQ ID NO: 1202419 - RNA, 22 nt, Human
caaguccaaacauuaucgaaaa

SEQ ID NO: 1202420 - RNA, 20 nt, Human
cacccagcggccgccgcugc

SEQ ID NO: 1202421 - RNA, 24 nt, Human
cacgccuguaaucccagcacuuug

SEQ ID NO: 1202422 - RNA, 18 nt, Human
cagaaaugaacaaaagca

SEQ ID NO: 1202423 - RNA, 24 nt, Human
cagcacuuugggaggcugaggugg

SEQ ID NO: 1202424 - RNA, 21 nt, Human
cagcugaaugaaauaaaagca

SEQ ID NO: 1202425 - RNA, 19 nt, Human
caggagagcccuucgagua

SEQ ID NO: 1202426 - RNA, 22 nt, Human
cauaaauaauguaucuauacaa

SEQ ID NO: 1202427 - RNA, 25 nt, Human
ccaggaguucgagaccaaccugggc

SEQ ID NO: 1202428 - RNA, 22 nt, Human
cccauggacccaggaaauaagg

SEQ ID NO: 1202429 - RNA, 20 nt, Human
ccgcucggcugcacccagcg

SEQ ID NO: 1202430 - RNA, 23 nt, Human
cgccuguaaucccagcacuuugg

SEQ ID NO: 1202431 - RNA, 24 nt, Human
cgccuguaaucccagcacuuuggg

SEQ ID NO: 1202432 - RNA, 20 nt, Human
cucaagaaaaaaaaaaaauc

SEQ ID NO: 1202433 - RNA, 22 nt, Human
cucacgccuguaaucccagcac

SEQ ID NO: 1202434 - RNA, 24 nt, Human
cucacgccuguaaucccagcacuu

SEQ ID NO: 1202435 - RNA, 18 nt, Human
cucaugcuucccauggac

SEQ ID NO: 1202436 - RNA, 22 nt, Human
cuccacaccgcucggcugcacc

SEQ ID NO: 1202437 - RNA, 18 nt, Human
cuuagauuagaaagauuu

SEQ ID NO: 1202438 - RNA, 19 nt, Human
cuugucccaagucccaaca

SEQ ID NO: 1202439 - RNA, 22 nt, Human
gacucaugcuucccauggaccc

SEQ ID NO: 1202440 - RNA, 24 nt, Human
gguggcucacgccuguaaucccag

SEQ ID NO: 1202441 - RNA, 21 nt, Human
gucccaagucccaacagacuc

SEQ ID NO: 1202442 - RNA, 22 nt, Human
gugaaacucuuuguuccaauga

SEQ ID NO: 1202443 - RNA, 23 nt, Human
gugaggccaggcgugguggcuca

SEQ ID NO: 1202444 - RNA, 23 nt, Human
guggcucacgccuguaaucccag

SEQ ID NO: 1202445 - RNA, 19 nt, Human
guucauguauagaucuuua

SEQ ID NO: 1202446 - RNA, 25 nt, Human
guuuguguucuaucucuucagaguu

SEQ ID NO: 1202447 - RNA, 21 nt, Human
uaaaacaaauaaauugguuau

SEQ ID NO: 1202448 - RNA, 23 nt, Human
uaaaugcuagcuuauacauucug

SEQ ID NO: 1202449 - RNA, 22 nt, Human
uaaauuguucaagaaaagcuga

SEQ ID NO: 1202450 - RNA, 24 nt, Human
uaacagaaaugaacaaaagcauca

SEQ ID NO: 1202451 - RNA, 26 nt, Human
uaacagaaaugaacaaaagcaucaga

SEQ ID NO: 1202452 - RNA, 18 nt, Human
uaauugcuuuaguccaag

SEQ ID NO: 1202453 - RNA, 22 nt, Human
uacaaggaauaaaaaauaaaaa

SEQ ID NO: 1202454 - RNA, 20 nt, Human
uauaaaauuuacuauuaaau

SEQ ID NO: 1202455 - RNA, 26 nt, Human
uaucauacuacucaaaacugcaaaau

SEQ ID NO: 1202456 - RNA, 20 nt, Human
uaucucuucagaguugggag

SEQ ID NO: 1202457 - RNA, 20 nt, Human
ucaacaugugauagaaaaau

SEQ ID NO: 1202458 - RNA, 21 nt, Human
ucauguauagaucuuuauccu

SEQ ID NO: 1202459 - RNA, 18 nt, Human
uccaaagaaaaaaaguca

SEQ ID NO: 1202460 - RNA, 19 nt, Human
uccaaagaaaaaaagucag

SEQ ID NO: 1202461 - RNA, 21 nt, Human
uccgcuccacaccgcucggcu

SEQ ID NO: 1202462 - RNA, 21 nt, Human
ucuacaaacucuuacccuaga

SEQ ID NO: 1202463 - RNA, 23 nt, Human
ucucacucaagaaaaaaaaaaaa

SEQ ID NO: 1202464 - RNA, 21 nt, Human
ugaaauaaaagcacagugccc

SEQ ID NO: 1202465 - RNA, 26 nt, Human
ugaggugggagaaucgcuugaagcca

SEQ ID NO: 1202466 - RNA, 23 nt, Human
ugaguacagcugcuuauaccuca

SEQ ID NO: 1202467 - RNA, 20 nt, Human
ugauuauaaacaauuucccc

SEQ ID NO: 1202468 - RNA, 20 nt, Human
ugcagaggggacagaaauga

SEQ ID NO: 1202469 - RNA, 18 nt, Human
ugccaguagacacaguuu

SEQ ID NO: 1202470 - RNA, 22 nt, Human
uggcucacgccuguaaucccag

SEQ ID NO: 1202471 - RNA, 24 nt, Human
uggcucacgccuguaaucccagca

SEQ ID NO: 1202472 - RNA, 22 nt, Human
ugggaggauacuuuuuuuagua

SEQ ID NO: 1202473 - RNA, 19 nt, Human
ugggaggcugaggugggag

SEQ ID NO: 1202474 - RNA, 23 nt, Human
ugggaggcugaggugggagaauc

SEQ ID NO: 1202475 - RNA, 24 nt, Human
ugggaggcugaggugggagaaucg

SEQ ID NO: 1202476 - RNA, 24 nt, Human
ugggcaauacagugagacccuguc

SEQ ID NO: 1202477 - RNA, 24 nt, Human
ugguggcucacgccuguaauccca

SEQ ID NO: 1202478 - RNA, 23 nt, Human
ugucuuguuuucuucuuguccca

SEQ ID NO: 1202479 - RNA, 18 nt, Human
uuaguacuugguuuuccu

SEQ ID NO: 1202480 - RNA, 22 nt, Human
uugaagccaggaguucgagacc

SEQ ID NO: 1202481 - RNA, 19 nt, Human
uugcuuuaguccaagucca

SEQ ID NO: 1202482 - RNA, 24 nt, Human
uugggaggcugaggugggagaauc

SEQ ID NO: 1202483 - RNA, 21 nt, Human
uugguuuuccuugugaagaug

SEQ ID NO: 1202484 - RNA, 18 nt, Human
uuuuuuuuuuuuuuuuug

SEQ ID NO: 1202485 - RNA, 20 nt, Human
uuuuuuuuuuuuuuuuugcc

SEQ ID NO: 1202486 - RNA, 22 nt, Human
uuuuuuuuuuuuuuuuugccaa

SEQ ID NO: 1202487 - RNA, 19 nt, Human
agagaauucuaugaccaca

SEQ ID NO: 1202488 - RNA, 26 nt, Human
cugggcaggguccaggcaugcccacu

SEQ ID NO: 1202489 - RNA, 18 nt, Human
gggcaggguccaggcaug

SEQ ID NO: 1202490 - RNA, 20 nt, Human
ucuaugaccacaucacugaa

SEQ ID NO: 1202491 - RNA, 26 nt, Human
ugcccacuccucuggagagaauucua

SEQ ID NO: 1202492 - RNA, 25 nt, Human
uucuaugaccacaucacugaaugcc

SEQ ID NO: 1202493 - RNA, 18 nt, Human
aaccagccucuccaccug

SEQ ID NO: 1202494 - RNA, 22 nt, Human
cagccggcacccuugcuugcca

SEQ ID NO: 1202495 - RNA, 22 nt, Human
gagccuucccuucuugcagcca

SEQ ID NO: 1202496 - RNA, 22 nt, Human
gcagccaacugaggcagccggc

SEQ ID NO: 1202497 - RNA, 21 nt, Human
uaagcgagccuucccuucuuu

SEQ ID NO: 1202498 - RNA, 21 nt, Human
ucuccaccuggacagugggcc

SEQ ID NO: 1202499 - RNA, 20 nt, Human
ucuugcagccaacugaggca

SEQ ID NO: 1202500 - RNA, 26 nt, Human
ugcagccaacugaggcagccggcacc

SEQ ID NO: 1202501 - RNA, 25 nt, Human
uggacagugggccuuaagcgagccu

SEQ ID NO: 1202502 - RNA, 18 nt, Human
uugcagccaacugaggca

SEQ ID NO: 1202503 - RNA, 23 nt, Human
agcgccuucugcuugugcugccc

SEQ ID NO: 1202504 - RNA, 19 nt, Human
ccguguccaugaguggaac

SEQ ID NO: 1202505 - RNA, 20 nt, Human
cugcugccguucagcaccca

SEQ ID NO: 1202506 - RNA, 24 nt, Human
cugcugccguucagcacccagcag

SEQ ID NO: 1202507 - RNA, 23 nt, Human
uggaggcugcugcugccguucag

SEQ ID NO: 1202508 - RNA, 20 nt, Human
gccucacaggucccgggggc

SEQ ID NO: 1202509 - RNA, 19 nt, Human
uggaggcagggcugaagug

SEQ ID NO: 1202510 - RNA, 18 nt, Human
aaacagaagcagccggcg

SEQ ID NO: 1202511 - RNA, 18 nt, Human
aaacagaagcagccggcg

SEQ ID NO: 1202512 - RNA, 30 nt, Human
aaaggugugcacacucgacccuggccuccc

SEQ ID NO: 1202513 - RNA, 20 nt, Human
aagcagccggcgagcccucc

SEQ ID NO: 1202514 - RNA, 21 nt, Human
aagcagccggcgagcccucca

SEQ ID NO: 1202515 - RNA, 23 nt, Human
aaggagaaggcccuguuuuuugg

SEQ ID NO: 1202516 - RNA, 23 nt, Human
aaggcgcccccucccucuggccc

SEQ ID NO: 1202517 - RNA, 20 nt, Human
aaggcucugcauggcugcug

SEQ ID NO: 1202518 - RNA, 21 nt, Human
aagggacacagcgugaggggc

SEQ ID NO: 1202519 - RNA, 20 nt, Human
aaggggccuugauucacugc

SEQ ID NO: 1202520 - RNA, 23 nt, Human
acaaagcuucccaggugcagguc

SEQ ID NO: 1202521 - RNA, 19 nt, Human
acagaaccuuccccagccg

SEQ ID NO: 1202522 - RNA, 21 nt, Human
acccuggagagacuggggccu

SEQ ID NO: 1202523 - RNA, 24 nt, Human
accgcagguauugaaacagaagca

SEQ ID NO: 1202524 - RNA, 18 nt, Human
accucccccucagagcca

SEQ ID NO: 1202525 - RNA, 25 nt, Human
accuccugcaaaggugugcacacca

SEQ ID NO: 1202526 - RNA, 22 nt, Human
acugguugccucuggcacacgu

SEQ ID NO: 1202527 - RNA, 24 nt, Human
agaagacucggggcucggggcuug

SEQ ID NO: 1202528 - RNA, 20 nt, Human
agaagaggcuggaacaggcc

SEQ ID NO: 1202529 - RNA, 21 nt, Human
agacagggucuuagggcugcc

SEQ ID NO: 1202530 - RNA, 22 nt, Human
agaggcuggaacaggccugggc

SEQ ID NO: 1202531 - RNA, 18 nt, Human
agccccagaaccgagcuc

SEQ ID NO: 1202532 - RNA, 23 nt, Human
agccggcuuggacucgcuggccc

SEQ ID NO: 1202533 - RNA, 22 nt, Human
agcugggcagugggcugcagug

SEQ ID NO: 1202534 - RNA, 21 nt, Human
agcugggcgggcuccacuccc

SEQ ID NO: 1202535 - RNA, 18 nt, Human
aggacugugggcagccag

SEQ ID NO: 1202536 - RNA, 21 nt, Human
aggagagcauguggaagaugg

SEQ ID NO: 1202537 - RNA, 21 nt, Human
aggagcugggcagugggcugc

SEQ ID NO: 1202538 - RNA, 20 nt, Human
aggaggcucuuucagcaggc

SEQ ID NO: 1202539 - RNA, 21 nt, Human
aggaggcugagcagagacuuc

SEQ ID NO: 1202540 - RNA, 21 nt, Human
aggagggcagggugggcccag

SEQ ID NO: 1202541 - RNA, 24 nt, Human
aggauggagauuucuuucacaguu

SEQ ID NO: 1202542 - RNA, 19 nt, Human
aggcaucgcgcguccggcu

SEQ ID NO: 1202543 - RNA, 23 nt, Human
aggcccugggagccgcacuccac

SEQ ID NO: 1202544 - RNA, 23 nt, Human
aggcccuugcucaggaagggguu

SEQ ID NO: 1202545 - RNA, 20 nt, Human
aggcuccaggccccaccagc

SEQ ID NO: 1202546 - RNA, 19 nt, Human
aggggccgcugacccggag

SEQ ID NO: 1202547 - RNA, 22 nt, Human
aggugcugggggcagccgaacc

SEQ ID NO: 1202548 - RNA, 22 nt, Human
agucuggaugguccugccuggg

SEQ ID NO: 1202549 - RNA, 22 nt, Human
agugggcaguccaggagcucug

SEQ ID NO: 1202550 - RNA, 18 nt, Human
agugucauugccuggacg

SEQ ID NO: 1202551 - RNA, 22 nt, Human
auuucccccacgcacagguucc

SEQ ID NO: 1202552 - RNA, 22 nt, Human
caaguaccucccccucagagcc

SEQ ID NO: 1202553 - RNA, 21 nt, Human
cacaaaccaggagaacggguu

SEQ ID NO: 1202554 - RNA, 19 nt, Human
cacaccuugagguggcagc

SEQ ID NO: 1202555 - RNA, 27 nt, Human
cacagcuggaccugcccugagcugggg

SEQ ID NO: 1202556 - RNA, 24 nt, Human
cacccaggaaacucgacgagcugc

SEQ ID NO: 1202557 - RNA, 24 nt, Human
caccccucccucugucaccacugg

SEQ ID NO: 1202558 - RNA, 19 nt, Human
caccccucccucugucucc

SEQ ID NO: 1202559 - RNA, 20 nt, Human
caccccucccucugucucca

SEQ ID NO: 1202560 - RNA, 18 nt, Human
caccggaacaggggacug

SEQ ID NO: 1202561 - RNA, 25 nt, Human
caccugggugagggcuacaggaggc

SEQ ID NO: 1202562 - RNA, 20 nt, Human
cacugagcuccacaacugcc

SEQ ID NO: 1202563 - RNA, 22 nt, Human
cacugagcuccacaacugccaa

SEQ ID NO: 1202564 - RNA, 19 nt, Human
cagagcuggcugugggugg

SEQ ID NO: 1202565 - RNA, 20 nt, Human
cagcaccauggacaggggca

SEQ ID NO: 1202566 - RNA, 22 nt, Human
cagcagugcagucuccccgggc

SEQ ID NO: 1202567 - RNA, 26 nt, Human
cagcccccugcccugugauuucagga

SEQ ID NO: 1202568 - RNA, 19 nt, Human
cagccgaacccgccccagc

SEQ ID NO: 1202569 - RNA, 21 nt, Human
cagccggguggagcuccuggg

SEQ ID NO: 1202570 - RNA, 20 nt, Human
cagcggcugagcuugcuggg

SEQ ID NO: 1202571 - RNA, 20 nt, Human
cagcggcugagcuugcuggg

SEQ ID NO: 1202572 - RNA, 18 nt, Human
cagcgggcagcccccacu

SEQ ID NO: 1202573 - RNA, 19 nt, Human
cagcucagcaccgggaccc

SEQ ID NO: 1202574 - RNA, 20 nt, Human
cagcugcugcuuucucuggg

SEQ ID NO: 1202575 - RNA, 20 nt, Human
caggaaaccgccccgaccau

SEQ ID NO: 1202576 - RNA, 20 nt, Human
caggaccccgaggagggcag

SEQ ID NO: 1202577 - RNA, 19 nt, Human
caggacgucuuggccgggg

SEQ ID NO: 1202578 - RNA, 21 nt, Human
cagggcaggugaaggagaagg

SEQ ID NO: 1202579 - RNA, 18 nt, Human
cagggcagugagagaaga

SEQ ID NO: 1202580 - RNA, 24 nt, Human
cagggcagugagagaagaggcugg

SEQ ID NO: 1202581 - RNA, 19 nt, Human
cagggugggcccaggagcu

SEQ ID NO: 1202582 - RNA, 22 nt, Human
cagguaccugggcucucccagg

SEQ ID NO: 1202583 - RNA, 20 nt, Human
caggucgggguccaagcugg

SEQ ID NO: 1202584 - RNA, 18 nt, Human
cagugccagccacaaacc

SEQ ID NO: 1202585 - RNA, 25 nt, Human
cagugccagccacaaaccaggagaa

SEQ ID NO: 1202586 - RNA, 22 nt, Human
caucaacaucgcaggagguucc

SEQ ID NO: 1202587 - RNA, 20 nt, Human
caucugaggccacugagcuc

SEQ ID NO: 1202588 - RNA, 20 nt, Human
ccaaaagggcuugagacccu

SEQ ID NO: 1202589 - RNA, 20 nt, Human
ccaacccugugaagugaggu

SEQ ID NO: 1202590 - RNA, 19 nt, Human
ccaagucuaggucugugcc

SEQ ID NO: 1202591 - RNA, 26 nt, Human
ccaaugcccucucccugccaucuucu

SEQ ID NO: 1202592 - RNA, 19 nt, Human
ccacauccuccugcccggg

SEQ ID NO: 1202593 - RNA, 23 nt, Human
ccaggaccuggagguaccugcag

SEQ ID NO: 1202594 - RNA, 18 nt, Human
ccaggacgaaggagagca

SEQ ID NO: 1202595 - RNA, 19 nt, Human
ccaggagaacggguucguc

SEQ ID NO: 1202596 - RNA, 18 nt, Human
ccaggcuugggugaggag

SEQ ID NO: 1202597 - RNA, 22 nt, Human
ccagggccagggagaccaaagg

SEQ ID NO: 1202598 - RNA, 24 nt, Human
ccaggggccccugcucugcucccu

SEQ ID NO: 1202599 - RNA, 21 nt, Human
ccagugguccuccuuccuggu

SEQ ID NO: 1202600 - RNA, 24 nt, Human
ccagugguccuccuuccugguggu

SEQ ID NO: 1202601 - RNA, 19 nt, Human
ccaugccuguggcuccucc

SEQ ID NO: 1202602 - RNA, 24 nt, Human
cccaaccccaccccagccccugau

SEQ ID NO: 1202603 - RNA, 18 nt, Human
cccacauccuccugcccg

SEQ ID NO: 1202604 - RNA, 19 nt, Human
cccacgcaggucgccugcg

SEQ ID NO: 1202605 - RNA, 20 nt, Human
cccacgcaggucgccugcgg

SEQ ID NO: 1202606 - RNA, 22 nt, Human
ccccaagggcagcacuuggccc

SEQ ID NO: 1202607 - RNA, 26 nt, Human
ccccaccccagccccugaucgagguu

SEQ ID NO: 1202608 - RNA, 20 nt, Human
ccccagccgcuggccacagc

SEQ ID NO: 1202609 - RNA, 21 nt, Human
ccccaggaaaccgccccgacc

SEQ ID NO: 1202610 - RNA, 19 nt, Human
ccccgaggagggcagggug

SEQ ID NO: 1202611 - RNA, 24 nt, Human
ccccucagcccugccacucagcuc

SEQ ID NO: 1202612 - RNA, 18 nt, Human
ccccucccucugucucca

SEQ ID NO: 1202613 - RNA, 22 nt, Human
ccccuucucucccgggcaccca

SEQ ID NO: 1202614 - RNA, 19 nt, Human
cccgggaucuuugucaucc

SEQ ID NO: 1202615 - RNA, 18 nt, Human
cccuccagcucugcccca

SEQ ID NO: 1202616 - RNA, 19 nt, Human
cccuccaucugcacagcua

SEQ ID NO: 1202617 - RNA, 20 nt, Human
cccugagcugggggugggaa

SEQ ID NO: 1202618 - RNA, 22 nt, Human
cccugagcugggggugggaagg

SEQ ID NO: 1202619 - RNA, 23 nt, Human
cccugcuggugguuucuccccgg

SEQ ID NO: 1202620 - RNA, 22 nt, Human
cccuguuuuuuggccccaaggg

SEQ ID NO: 1202621 - RNA, 18 nt, Human
ccgaagggcagcagugca

SEQ ID NO: 1202622 - RNA, 19 nt, Human
ccgcagcuugggggcagcg

SEQ ID NO: 1202623 - RNA, 20 nt, Human
ccgccccagcucagccgccc

SEQ ID NO: 1202624 - RNA, 22 nt, Human
ccgggauaggguccugcccucu

SEQ ID NO: 1202625 - RNA, 25 nt, Human
ccgggcacccaggaaacucgacgag

SEQ ID NO: 1202626 - RNA, 21 nt, Human
ccgggggugaggaccuuuccu

SEQ ID NO: 1202627 - RNA, 25 nt, Human
ccgggggugggagcccuccaggggu

SEQ ID NO: 1202628 - RNA, 23 nt, Human
ccggggugggugguggccccggg

SEQ ID NO: 1202629 - RNA, 19 nt, Human
ccggugcagcaggugcugc

SEQ ID NO: 1202630 - RNA, 21 nt, Human
ccggugguccuccuuccuggu

SEQ ID NO: 1202631 - RNA, 21 nt, Human
ccggugguccuccuuccuggu

SEQ ID NO: 1202632 - RNA, 25 nt, Human
ccucacagaggggccuugggcuggg

SEQ ID NO: 1202633 - RNA, 21 nt, Human
ccucagagccaucgacucccu

SEQ ID NO: 1202634 - RNA, 22 nt, Human
ccuccaggaaccccugucaccu

SEQ ID NO: 1202635 - RNA, 20 nt, Human
ccuccccucagcccugccac

SEQ ID NO: 1202636 - RNA, 23 nt, Human
ccugcauccgcuaaguccagggg

SEQ ID NO: 1202637 - RNA, 20 nt, Human
ccugccacucagcucagcac

SEQ ID NO: 1202638 - RNA, 22 nt, Human
ccuggagagacuggggccucca

SEQ ID NO: 1202639 - RNA, 22 nt, Human
ccuggagagucucauuggggcu

SEQ ID NO: 1202640 - RNA, 19 nt, Human
ccuggagcccggcuuugag

SEQ ID NO: 1202641 - RNA, 21 nt, Human
ccuggcaccuucuccuggaga

SEQ ID NO: 1202642 - RNA, 22 nt, Human
ccuggcccaaccccaccccagc

SEQ ID NO: 1202643 - RNA, 20 nt, Human
ccuggugguccuccuuccug

SEQ ID NO: 1202644 - RNA, 20 nt, Human
ccuggugguccuccuuccug

SEQ ID NO: 1202645 - RNA, 18 nt, Human
ccugugauuucaggacaa

SEQ ID NO: 1202646 - RNA, 23 nt, Human
ccuugucaaacaccccucccucu

SEQ ID NO: 1202647 - RNA, 21 nt, Human
cgaaggagagcauguggaaga

SEQ ID NO: 1202648 - RNA, 20 nt, Human
cgaggacggagcagaugggc

SEQ ID NO: 1202649 - RNA, 20 nt, Human
cgaggagggcagggugggcc

SEQ ID NO: 1202650 - RNA, 20 nt, Human
cgcaggcauggcuccaugcu

SEQ ID NO: 1202651 - RNA, 19 nt, Human
cgcccccucccucuggccc

SEQ ID NO: 1202652 - RNA, 19 nt, Human
cgccuggggcagcauuggc

SEQ ID NO: 1202653 - RNA, 23 nt, Human
cggcucagagagcccagaggcgg

SEQ ID NO: 1202654 - RNA, 20 nt, Human
cggcugagcuugcuggggcc

SEQ ID NO: 1202655 - RNA, 19 nt, Human
cggcuuugagugucugccu

SEQ ID NO: 1202656 - RNA, 27 nt, Human
cgggacccacugagaccuggggccccg

SEQ ID NO: 1202657 - RNA, 26 nt, Human
cguucagccggguggagcuccugggg

SEQ ID NO: 1202658 - RNA, 21 nt, Human
cucaggaagggguugauggug

SEQ ID NO: 1202659 - RNA, 23 nt, Human
cucaggaccccgaggagggcagg

SEQ ID NO: 1202660 - RNA, 21 nt, Human
cuccagaagugggagcccucc

SEQ ID NO: 1202661 - RNA, 21 nt, Human
cuccagaagugggagcccucc

SEQ ID NO: 1202662 - RNA, 23 nt, Human
cuccaggaaccccugucaccucc

SEQ ID NO: 1202663 - RNA, 23 nt, Human
cucccgggcacccacagggccuc

SEQ ID NO: 1202664 - RNA, 25 nt, Human
cucccgggcacccacagggccucug

SEQ ID NO: 1202665 - RNA, 18 nt, Human
cuccgggggugggagccc

SEQ ID NO: 1202666 - RNA, 21 nt, Human
cuccgggggugggagcccucc

SEQ ID NO: 1202667 - RNA, 21 nt, Human
cucucccugccaucuucuggg

SEQ ID NO: 1202668 - RNA, 18 nt, Human
cucuccuggcccaacccc

SEQ ID NO: 1202669 - RNA, 25 nt, Human
cucugggcucugggcaucgcugggg

SEQ ID NO: 1202670 - RNA, 23 nt, Human
cucugggucucucgugggggccc

SEQ ID NO: 1202671 - RNA, 18 nt, Human
cugaauggcugcagggca

SEQ ID NO: 1202672 - RNA, 20 nt, Human
cugacccuggagagacuggg

SEQ ID NO: 1202673 - RNA, 21 nt, Human
cugagcccugacacgugggga

SEQ ID NO: 1202674 - RNA, 20 nt, Human
cugaggcaguaggggaucuu

SEQ ID NO: 1202675 - RNA, 22 nt, Human
cugccagaggugccgggccagc

SEQ ID NO: 1202676 - RNA, 19 nt, Human
cugcccagaggcccggcag

SEQ ID NO: 1202677 - RNA, 22 nt, Human
cugccgugggccugucggagga

SEQ ID NO: 1202678 - RNA, 25 nt, Human
cugccuggcuggaggcccugggagc

SEQ ID NO: 1202679 - RNA, 23 nt, Human
cugcggccugugccucuggggcc

SEQ ID NO: 1202680 - RNA, 19 nt, Human
cugcgugccugccugcccu

SEQ ID NO: 1202681 - RNA, 21 nt, Human
cugcgugccugccugcccucc

SEQ ID NO: 1202682 - RNA, 20 nt, Human
cugcucugcucccugcacgu

SEQ ID NO: 1202683 - RNA, 20 nt, Human
cuggcauggggccuggucug

SEQ ID NO: 1202684 - RNA, 24 nt, Human
cuggcccaaccccaccccagcccc

SEQ ID NO: 1202685 - RNA, 21 nt, Human
cuggccccucgcggucuuccc

SEQ ID NO: 1202686 - RNA, 22 nt, Human
cuggccucaggagugacacugg

SEQ ID NO: 1202687 - RNA, 20 nt, Human
cugggagccgcacuccaccc

SEQ ID NO: 1202688 - RNA, 18 nt, Human
cugggccacugguugccu

SEQ ID NO: 1202689 - RNA, 20 nt, Human
cuggggcgggaacuggaggc

SEQ ID NO: 1202690 - RNA, 21 nt, Human
cugucaccuccugcaaaggug

SEQ ID NO: 1202691 - RNA, 18 nt, Human
cugugcccccucuggugg

SEQ ID NO: 1202692 - RNA, 20 nt, Human
cuguggguuauuuugggcuu

SEQ ID NO: 1202693 - RNA, 18 nt, Human
cuucagaaaugccaaccc

SEQ ID NO: 1202694 - RNA, 19 nt, Human
cuugagccucuggcucagg

SEQ ID NO: 1202695 - RNA, 25 nt, Human
cuugggcccuggaacgcaucccagg

SEQ ID NO: 1202696 - RNA, 19 nt, Human
cuuggucugguggccuugg

SEQ ID NO: 1202697 - RNA, 18 nt, Human
cuugugcugugagggcug

SEQ ID NO: 1202698 - RNA, 23 nt, Human
cuuugugcucaguuucucccuuc

SEQ ID NO: 1202699 - RNA, 23 nt, Human
gaagaccccgagagggggccuug

SEQ ID NO: 1202700 - RNA, 18 nt, Human
gacaggggcagcugcugc

SEQ ID NO: 1202701 - RNA, 19 nt, Human
gaccccgaggagggcaggg

SEQ ID NO: 1202702 - RNA, 23 nt, Human
gacgucuuggccgggggucucca

SEQ ID NO: 1202703 - RNA, 20 nt, Human
gacugagcugcugacccugg

SEQ ID NO: 1202704 - RNA, 19 nt, Human
gagcccugacacgugggga

SEQ ID NO: 1202705 - RNA, 21 nt, Human
gagcugggggugggaagggcu

SEQ ID NO: 1202706 - RNA, 19 nt, Human
gaggaccuuuccuccagga

SEQ ID NO: 1202707 - RNA, 24 nt, Human
gaggcccagcuugucccuugggcc

SEQ ID NO: 1202708 - RNA, 25 nt, Human
gaggcccagcuugucccuugggccu

SEQ ID NO: 1202709 - RNA, 21 nt, Human
gagggcuggcaaguaccuccc

SEQ ID NO: 1202710 - RNA, 22 nt, Human
gaggucugcucugccgugggcc

SEQ ID NO: 1202711 - RNA, 24 nt, Human
gagugccggcgagcugggcgggcu

SEQ ID NO: 1202712 - RNA, 20 nt, Human
gagugucugccucaugcucc

SEQ ID NO: 1202713 - RNA, 23 nt, Human
gauucuugagccucuggcucagg

SEQ ID NO: 1202714 - RNA, 18 nt, Human
gcacgggaaggcgccccc

SEQ ID NO: 1202715 - RNA, 19 nt, Human
gcacuguggguuauuuugg

SEQ ID NO: 1202716 - RNA, 21 nt, Human
gcagagcccagguguggggga

SEQ ID NO: 1202717 - RNA, 18 nt, Human
gcagcaggugcugccccc

SEQ ID NO: 1202718 - RNA, 22 nt, Human
gcagcggcucagagagcccaga

SEQ ID NO: 1202719 - RNA, 24 nt, Human
gcagcggcugagcuugcuggggcc

SEQ ID NO: 1202720 - RNA, 18 nt, Human
gcaguaggggaucuuugu

SEQ ID NO: 1202721 - RNA, 24 nt, Human
gcccagaggcccggcaggucccug

SEQ ID NO: 1202722 - RNA, 24 nt, Human
gcccagaggcggccccacauccuc

SEQ ID NO: 1202723 - RNA, 18 nt, Human
gccccuugcagccuugcc

SEQ ID NO: 1202724 - RNA, 21 nt, Human
gcccucucugggccucaaucu

SEQ ID NO: 1202725 - RNA, 21 nt, Human
gccgaguggccggggaacggg

SEQ ID NO: 1202726 - RNA, 19 nt, Human
gccggcgagcugggcgggc

SEQ ID NO: 1202727 - RNA, 18 nt, Human
gccugcagcuccagggag

SEQ ID NO: 1202728 - RNA, 19 nt, Human
gccugccugcccuccagcu

SEQ ID NO: 1202729 - RNA, 20 nt, Human
gccuggcuggaggcccuggg

SEQ ID NO: 1202730 - RNA, 23 nt, Human
gccuggcuggaggcccugggagc

SEQ ID NO: 1202731 - RNA, 18 nt, Human
gccuguggcuucuccggg

SEQ ID NO: 1202732 - RNA, 19 nt, Human
gcucggggcuuggucuggu

SEQ ID NO: 1202733 - RNA, 23 nt, Human
gcucggguggggggcaggucugg

SEQ ID NO: 1202734 - RNA, 18 nt, Human
gcugcagagaagugggca

SEQ ID NO: 1202735 - RNA, 18 nt, Human
gcugcagucagcaccaug

SEQ ID NO: 1202736 - RNA, 23 nt, Human
gcugcagucagcaccauggacag

SEQ ID NO: 1202737 - RNA, 18 nt, Human
gcugccaggggccccugc

SEQ ID NO: 1202738 - RNA, 23 nt, Human
gcugggacgccuguugcuccugg

SEQ ID NO: 1202739 - RNA, 19 nt, Human
gcugggagaguggggagga

SEQ ID NO: 1202740 - RNA, 23 nt, Human
gcuuggacucgcuggcccugagc

SEQ ID NO: 1202741 - RNA, 24 nt, Human
gcuugggggcagcggcugagcuug

SEQ ID NO: 1202742 - RNA, 21 nt, Human
ggacccacguucagccgggug

SEQ ID NO: 1202743 - RNA, 22 nt, Human
ggagaaaggagaaagggcugcc

SEQ ID NO: 1202744 - RNA, 19 nt, Human
ggagacgcugcaggcccau

SEQ ID NO: 1202745 - RNA, 22 nt, Human
ggagcucgcgauccaagggaca

SEQ ID NO: 1202746 - RNA, 20 nt, Human
ggagggggugggugaggcug

SEQ ID NO: 1202747 - RNA, 24 nt, Human
ggaguccugggggccccggggugg

SEQ ID NO: 1202748 - RNA, 21 nt, Human
ggcaggaggcggcaccacgug

SEQ ID NO: 1202749 - RNA, 22 nt, Human
ggcaguggucggggaacuggug

SEQ ID NO: 1202750 - RNA, 22 nt, Human
ggccaguguccuggguccagcc

SEQ ID NO: 1202751 - RNA, 19 nt, Human
ggcggccccacauccuccu

SEQ ID NO: 1202752 - RNA, 18 nt, Human
ggcgggcuccacucccuc

SEQ ID NO: 1202753 - RNA, 18 nt, Human
ggcgucccaguuccuggc

SEQ ID NO: 1202754 - RNA, 18 nt, Human
ggcguugaggagcugggc

SEQ ID NO: 1202755 - RNA, 19 nt, Human
ggcuccaggccccaccagc

SEQ ID NO: 1202756 - RNA, 19 nt, Human
ggcucggggcuuggucugg

SEQ ID NO: 1202757 - RNA, 23 nt, Human
ggcucugggcaucgcuggggugg

SEQ ID NO: 1202758 - RNA, 22 nt, Human
ggcugcaguggggcgccccucu

SEQ ID NO: 1202759 - RNA, 24 nt, Human
ggcugcccgccaugccuguggcuc

SEQ ID NO: 1202760 - RNA, 22 nt, Human
ggcuggaggcccugggagccgc

SEQ ID NO: 1202761 - RNA, 18 nt, Human
ggcuggcccugcccgggc

SEQ ID NO: 1202762 - RNA, 18 nt, Human
ggcuggggcgggaacugg

SEQ ID NO: 1202763 - RNA, 23 nt, Human
ggcuguggguggggaacagcagg

SEQ ID NO: 1202764 - RNA, 24 nt, Human
ggcuuggacucgcuggcccugagc

SEQ ID NO: 1202765 - RNA, 26 nt, Human
gggaggcccagcuugucccuugggcc

SEQ ID NO: 1202766 - RNA, 19 nt, Human
gggauccccaggcagcccc

SEQ ID NO: 1202767 - RNA, 27 nt, Human
gggcagcacuuggcccuggcccggcgg

SEQ ID NO: 1202768 - RNA, 22 nt, Human
gggcagcauuggcugugggugg

SEQ ID NO: 1202769 - RNA, 23 nt, Human
gggcagccaguggccccuggcag

SEQ ID NO: 1202770 - RNA, 18 nt, Human
gggcagcgggcagccccc

SEQ ID NO: 1202771 - RNA, 21 nt, Human
gggcagggugggcccaggagc

SEQ ID NO: 1202772 - RNA, 24 nt, Human
gggcaggucugggggugccagggg

SEQ ID NO: 1202773 - RNA, 20 nt, Human
gggcaguccaggagcucugc

SEQ ID NO: 1202774 - RNA, 22 nt, Human
gggccagggagaccaaaggggc

SEQ ID NO: 1202775 - RNA, 23 nt, Human
gggccagggccagggagaccaaa

SEQ ID NO: 1202776 - RNA, 21 nt, Human
gggccagggcugccagaggug

SEQ ID NO: 1202777 - RNA, 20 nt, Human
gggccuuguggcugacgguu

SEQ ID NO: 1202778 - RNA, 18 nt, Human
gggcucggggcuuggucu

SEQ ID NO: 1202779 - RNA, 21 nt, Human
gggcugacacugagccagcgc

SEQ ID NO: 1202780 - RNA, 25 nt, Human
gggcugaggcaguaggggaucuuug

SEQ ID NO: 1202781 - RNA, 21 nt, Human
gggcugcaguggggcgccccu

SEQ ID NO: 1202782 - RNA, 19 nt, Human
gggcugggagaguggggag

SEQ ID NO: 1202783 - RNA, 19 nt, Human
gggggcguugaggagcugg

SEQ ID NO: 1202784 - RNA, 22 nt, Human
gggggugggaagggcuggggcg

SEQ ID NO: 1202785 - RNA, 22 nt, Human
ggggugaggaccuuuccuccag

SEQ ID NO: 1202786 - RNA, 20 nt, Human
ggggugggaagggcuggggc

SEQ ID NO: 1202787 - RNA, 19 nt, Human
ggggugggagcccuccagg

SEQ ID NO: 1202788 - RNA, 23 nt, Human
gggucucucgugggggcccgggg

SEQ ID NO: 1202789 - RNA, 21 nt, Human
gggugggagccggcuuggacu

SEQ ID NO: 1202790 - RNA, 24 nt, Human
ggugaagaccccgagagggggccu

SEQ ID NO: 1202791 - RNA, 25 nt, Human
ggugcugcccccugugcccccucug

SEQ ID NO: 1202792 - RNA, 18 nt, Human
ggugcugggggcagccga

SEQ ID NO: 1202793 - RNA, 18 nt, Human
ggugguccuccuuccugg

SEQ ID NO: 1202794 - RNA, 18 nt, Human
ggugguccuccuuccugg

SEQ ID NO: 1202795 - RNA, 18 nt, Human
ggugguccuccuuccugg

SEQ ID NO: 1202796 - RNA, 18 nt, Human
ggugguccuccuuccugg

SEQ ID NO: 1202797 - RNA, 18 nt, Human
ggugguccuccuuccugg

SEQ ID NO: 1202798 - RNA, 18 nt, Human
ggugguccuccuuccugg

SEQ ID NO: 1202799 - RNA, 18 nt, Human
ggugguccuccuuccugg

SEQ ID NO: 1202800 - RNA, 18 nt, Human
ggugguucuccuuccugg

SEQ ID NO: 1202801 - RNA, 18 nt, Human
ggugguucuccuuccugg

SEQ ID NO: 1202802 - RNA, 18 nt, Human
ggugguucuccuuccugg

SEQ ID NO: 1202803 - RNA, 21 nt, Human
guagaagacucggggcucggg

SEQ ID NO: 1202804 - RNA, 19 nt, Human
guaggggcagcgggcagcc

SEQ ID NO: 1202805 - RNA, 24 nt, Human
gucuaggucugugccgauuggagg

SEQ ID NO: 1202806 - RNA, 23 nt, Human
gugaagaccccgagagggggccu

SEQ ID NO: 1202807 - RNA, 18 nt, Human
gugaggaccuuuccucca

SEQ ID NO: 1202808 - RNA, 21 nt, Human
gugcguggugaccaaaagggc

SEQ ID NO: 1202809 - RNA, 19 nt, Human
guggagacgcugcaggccc

SEQ ID NO: 1202810 - RNA, 20 nt, Human
gugggugaggcuggagggcc

SEQ ID NO: 1202811 - RNA, 19 nt, Human
guggucugucuuccuuggg

SEQ ID NO: 1202812 - RNA, 21 nt, Human
guggugaccaaaagggcuuga

SEQ ID NO: 1202813 - RNA, 21 nt, Human
guuccuggcaccuucuccugg

SEQ ID NO: 1202814 - RNA, 18 nt, Human
uaaggaaacagcgucgcc

SEQ ID NO: 1202815 - RNA, 21 nt, Human
ucacagaggggccuugggcug

SEQ ID NO: 1202816 - RNA, 20 nt, Human
ucagcaccauggacaggggc

SEQ ID NO: 1202817 - RNA, 22 nt, Human
ucauuggggcuucgaaggccuc

SEQ ID NO: 1202818 - RNA, 21 nt, Human
uccaggccccaccagcugcuc

SEQ ID NO: 1202819 - RNA, 24 nt, Human
ucccaggggacaugcagagcccag

SEQ ID NO: 1202820 - RNA, 27 nt, Human
uccccaggcagccccgagacagggucu

SEQ ID NO: 1202821 - RNA, 18 nt, Human
uccccgggcacccaggaa

SEQ ID NO: 1202822 - RNA, 22 nt, Human
uccccgggcacccaggaaacuc

SEQ ID NO: 1202823 - RNA, 22 nt, Human
ucccgggcacccacagggccuc

SEQ ID NO: 1202824 - RNA, 21 nt, Human
ucccucuggcccgaggcuccc

SEQ ID NO: 1202825 - RNA, 21 nt, Human
ucccugcacguccacgggccg

SEQ ID NO: 1202826 - RNA, 19 nt, Human
ucccugggucccuggugcu

SEQ ID NO: 1202827 - RNA, 23 nt, Human
ucccuguuccccggccuggcuuc

SEQ ID NO: 1202828 - RNA, 21 nt, Human
ucccuucacagccguuuacaa

SEQ ID NO: 1202829 - RNA, 21 nt, Human
uccgcccagcagcagcaggug

SEQ ID NO: 1202830 - RNA, 25 nt, Human
uccgcuaaguccaggggugggagca

SEQ ID NO: 1202831 - RNA, 18 nt, Human
uccucagccaggcgaugu

SEQ ID NO: 1202832 - RNA, 20 nt, Human
uccugagaguggacucucuu

SEQ ID NO: 1202833 - RNA, 18 nt, Human
uccugcccccaggaaacc

SEQ ID NO: 1202834 - RNA, 18 nt, Human
uccuucgagaggugggug

SEQ ID NO: 1202835 - RNA, 19 nt, Human
ucgacucccuccacggaug

SEQ ID NO: 1202836 - RNA, 18 nt, Human
ucgagagguggguguggg

SEQ ID NO: 1202837 - RNA, 22 nt, Human
ucgagguuggcaaagguggccc

SEQ ID NO: 1202838 - RNA, 24 nt, Human
ucuaggcugggugcugcccagagg

SEQ ID NO: 1202839 - RNA, 24 nt, Human
ucucauugcuguuggugucaucuc

SEQ ID NO: 1202840 - RNA, 18 nt, Human
ucucucugccucuguccc

SEQ ID NO: 1202841 - RNA, 20 nt, Human
ucucugguaggagcucggca

SEQ ID NO: 1202842 - RNA, 22 nt, Human
ucugaggaggcucagauggguc

SEQ ID NO: 1202843 - RNA, 19 nt, Human
ucugcacagcuaaugagcu

SEQ ID NO: 1202844 - RNA, 18 nt, Human
ucugcauggcugcugcau

SEQ ID NO: 1202845 - RNA, 19 nt, Human
ucugcauggcugcugcaug

SEQ ID NO: 1202846 - RNA, 23 nt, Human
ucugcggccugugccucuggggc

SEQ ID NO: 1202847 - RNA, 22 nt, Human
ucugcugggagcucgcgaucca

SEQ ID NO: 1202848 - RNA, 19 nt, Human
ucugggcaucgcuggggug

SEQ ID NO: 1202849 - RNA, 23 nt, Human
ucugggccucaaucucucccucc

SEQ ID NO: 1202850 - RNA, 21 nt, Human
ucugucccugggucccuggug

SEQ ID NO: 1202851 - RNA, 18 nt, Human
ucuguggcagacccagga

SEQ ID NO: 1202852 - RNA, 22 nt, Human
ucuuccuuuccggugguccucc

SEQ ID NO: 1202853 - RNA, 22 nt, Human
ucuuccuuuccggugguccucc

SEQ ID NO: 1202854 - RNA, 22 nt, Human
ucuuccuuuccggugguccucc

SEQ ID NO: 1202855 - RNA, 22 nt, Human
ucuuccuuuccgguggucuucc

SEQ ID NO: 1202856 - RNA, 22 nt, Human
ucuuccuuuccgguggucuucc

SEQ ID NO: 1202857 - RNA, 24 nt, Human
ugaaagcuuccaccuccuucgaga

SEQ ID NO: 1202858 - RNA, 21 nt, Human
ugaagugaggucugcucugcc

SEQ ID NO: 1202859 - RNA, 18 nt, Human
ugacccggagcuccacug

SEQ ID NO: 1202860 - RNA, 19 nt, Human
ugacccuggagagacuggg

SEQ ID NO: 1202861 - RNA, 23 nt, Human
ugacccuggagagacuggggccu

SEQ ID NO: 1202862 - RNA, 19 nt, Human
ugacugugacugagcugcu

SEQ ID NO: 1202863 - RNA, 20 nt, Human
ugacugugacugagcugcug

SEQ ID NO: 1202864 - RNA, 21 nt, Human
ugagaccacagggcuggagaa

SEQ ID NO: 1202865 - RNA, 21 nt, Human
ugagcugggggugggaagggc

SEQ ID NO: 1202866 - RNA, 18 nt, Human
ugaggaggcucagauggg

SEQ ID NO: 1202867 - RNA, 23 nt, Human
ugauguggugugguccccuccgg

SEQ ID NO: 1202868 - RNA, 20 nt, Human
ugcagagcccaggugugggg

SEQ ID NO: 1202869 - RNA, 20 nt, Human
ugcagggcagugagagaaga

SEQ ID NO: 1202870 - RNA, 19 nt, Human
ugcaugggcugcgugcgug

SEQ ID NO: 1202871 - RNA, 19 nt, Human
ugccagaggugccgggcca

SEQ ID NO: 1202872 - RNA, 22 nt, Human
ugccaggggcugguaggcucug

SEQ ID NO: 1202873 - RNA, 20 nt, Human
ugcccagaggcccggcaggu

SEQ ID NO: 1202874 - RNA, 21 nt, Human
ugcccugagcuggggguggga

SEQ ID NO: 1202875 - RNA, 19 nt, Human
ugcccugugauuucaggac

SEQ ID NO: 1202876 - RNA, 20 nt, Human
ugccucugucccuggguccc

SEQ ID NO: 1202877 - RNA, 20 nt, Human
ugccugccugcccuccagcu

SEQ ID NO: 1202878 - RNA, 21 nt, Human
ugccuggacagcccccauugu

SEQ ID NO: 1202879 - RNA, 24 nt, Human
ugccugggcugcagagaagugggc

SEQ ID NO: 1202880 - RNA, 26 nt, Human
ugccugggcugcagagaagugggcag

SEQ ID NO: 1202881 - RNA, 18 nt, Human
ugccuguggcuccuccuc

SEQ ID NO: 1202882 - RNA, 21 nt, Human
ugccuguggucugucuuccuu

SEQ ID NO: 1202883 - RNA, 22 nt, Human
ugcgaccagggauucuugagcc

SEQ ID NO: 1202884 - RNA, 21 nt, Human
ugcggagcccagaggggaggc

SEQ ID NO: 1202885 - RNA, 18 nt, Human
ugcucggguggggggcag

SEQ ID NO: 1202886 - RNA, 24 nt, Human
ugcugcccccugugcccccucugg

SEQ ID NO: 1202887 - RNA, 22 nt, Human
ugcugggggcagccgaacccgc

SEQ ID NO: 1202888 - RNA, 23 nt, Human
ugcugggggcagccgaacccgcc

SEQ ID NO: 1202889 - RNA, 21 nt, Human
ugcugguaggggcagcgggca

SEQ ID NO: 1202890 - RNA, 23 nt, Human
ugcuuggccacguccccccggga

SEQ ID NO: 1202891 - RNA, 23 nt, Human
uggaacccccuccagcucugccc

SEQ ID NO: 1202892 - RNA, 19 nt, Human
uggaggcccacgcaggucg

SEQ ID NO: 1202893 - RNA, 20 nt, Human
uggaggcccacgcaggucgc

SEQ ID NO: 1202894 - RNA, 21 nt, Human
uggcaaguaccucccccucag

SEQ ID NO: 1202895 - RNA, 25 nt, Human
uggcaaguaccucccccucagagcc

SEQ ID NO: 1202896 - RNA, 26 nt, Human
uggcaauauugcaauuauuagauucc

SEQ ID NO: 1202897 - RNA, 20 nt, Human
uggcagagcuggcugugggu

SEQ ID NO: 1202898 - RNA, 22 nt, Human
uggcagagcuggcugugggugg

SEQ ID NO: 1202899 - RNA, 22 nt, Human
uggcagaggcccagccauaggc

SEQ ID NO: 1202900 - RNA, 21 nt, Human
uggcauggggccuggucugcc

SEQ ID NO: 1202901 - RNA, 19 nt, Human
uggcccaaccccaccccag

SEQ ID NO: 1202902 - RNA, 19 nt, Human
uggccccagcuccuugugc

SEQ ID NO: 1202903 - RNA, 22 nt, Human
ugggacgagucaggugcugggg

SEQ ID NO: 1202904 - RNA, 22 nt, Human
ugggacuguggaacccccucca

SEQ ID NO: 1202905 - RNA, 19 nt, Human
ugggagaguggggaggacu

SEQ ID NO: 1202906 - RNA, 24 nt, Human
ugggagaguggggaggacuguggg

SEQ ID NO: 1202907 - RNA, 22 nt, Human
ugggagugucugcuggacagug

SEQ ID NO: 1202908 - RNA, 21 nt, Human
ugggcagugggcugcaguggg

SEQ ID NO: 1202909 - RNA, 22 nt, Human
ugggcccaggagcuggacgcag

SEQ ID NO: 1202910 - RNA, 20 nt, Human
ugggccccgagcuuuggcag

SEQ ID NO: 1202911 - RNA, 19 nt, Human
ugggcuuggcaauauugca

SEQ ID NO: 1202912 - RNA, 20 nt, Human
uggggcccagugaugcuagg

SEQ ID NO: 1202913 - RNA, 19 nt, Human
ugggggaugcugggacgcc

SEQ ID NO: 1202914 - RNA, 24 nt, Human
ugggggccccuugugcugugaggg

SEQ ID NO: 1202915 - RNA, 22 nt, Human
ugggggcugaggcaguagggga

SEQ ID NO: 1202916 - RNA, 19 nt, Human
ugggggucccgggugaugu

SEQ ID NO: 1202917 - RNA, 18 nt, Human
ugggggugggaagggcug

SEQ ID NO: 1202918 - RNA, 18 nt, Human
ugggggugggaagggcug

SEQ ID NO: 1202919 - RNA, 20 nt, Human
ugggggugggaagggcuggg

SEQ ID NO: 1202920 - RNA, 18 nt, Human
ugggucccuggugcuugg

SEQ ID NO: 1202921 - RNA, 24 nt, Human
ugggugcugcccagaggcccggca

SEQ ID NO: 1202922 - RNA, 23 nt, Human
uggguggcgguguugaugggggu

SEQ ID NO: 1202923 - RNA, 19 nt, Human
uggucgagagcgagcuggg

SEQ ID NO: 1202924 - RNA, 18 nt, Human
uggucugucuuccuccuc

SEQ ID NO: 1202925 - RNA, 21 nt, Human
uggugguccuccuuccuggug

SEQ ID NO: 1202926 - RNA, 21 nt, Human
uggugguccuccuuccuggug

SEQ ID NO: 1202927 - RNA, 21 nt, Human
uggugguccuccuuccuggug

SEQ ID NO: 1202928 - RNA, 21 nt, Human
uggugguccuccuuccuggug

SEQ ID NO: 1202929 - RNA, 21 nt, Human
uggugguccuccuuccuggug

SEQ ID NO: 1202930 - RNA, 21 nt, Human
uggugguccuccuuccuggug

SEQ ID NO: 1202931 - RNA, 21 nt, Human
uggugguccuccuuccuggug

SEQ ID NO: 1202932 - RNA, 20 nt, Human
uggugguccuccuugccggu

SEQ ID NO: 1202933 - RNA, 21 nt, Human
uggugguucuccuuccuggug

SEQ ID NO: 1202934 - RNA, 21 nt, Human
uggugguucuccuuccuggug

SEQ ID NO: 1202935 - RNA, 21 nt, Human
uggugguucuccuuccuggug

SEQ ID NO: 1202936 - RNA, 19 nt, Human
ugucauugccuggacagcc

SEQ ID NO: 1202937 - RNA, 24 nt, Human
ugucggaggaggcugagcagagac

SEQ ID NO: 1202938 - RNA, 18 nt, Human
ugugaccuuagagcccca

SEQ ID NO: 1202939 - RNA, 23 nt, Human
ugugacugagcugcugacccugg

SEQ ID NO: 1202940 - RNA, 20 nt, Human
ugugagggcuggcaaguacc

SEQ ID NO: 1202941 - RNA, 20 nt, Human
ugugcccgggugguccugcc

SEQ ID NO: 1202942 - RNA, 23 nt, Human
ugugcucaguuucucccuucuga

SEQ ID NO: 1202943 - RNA, 23 nt, Human
uguggaagauggucccgggggug

SEQ ID NO: 1202944 - RNA, 27 nt, Human
uguggggcccagugaugcuagggcugg

SEQ ID NO: 1202945 - RNA, 22 nt, Human
ugugggggaugcugggacgccu

SEQ ID NO: 1202946 - RNA, 22 nt, Human
uguggguuauuuugggcuuggc

SEQ ID NO: 1202947 - RNA, 20 nt, Human
ugugguauggcaggaggcgg

SEQ ID NO: 1202948 - RNA, 21 nt, Human
ugugguauggcaggaggcggc

SEQ ID NO: 1202949 - RNA, 18 nt, Human
uguguagaagacucgggg

SEQ ID NO: 1202950 - RNA, 25 nt, Human
uguguuguccgacauccuuccucug

SEQ ID NO: 1202951 - RNA, 21 nt, Human
uguuggugucaucucucugcc

SEQ ID NO: 1202952 - RNA, 21 nt, Human
uucaggacaaagcuucccagg

SEQ ID NO: 1202953 - RNA, 22 nt, Human
uucccuucccuugucaaacacc

SEQ ID NO: 1202954 - RNA, 22 nt, Human
uuccuggcaccuucuccuggag

SEQ ID NO: 1202955 - RNA, 24 nt, Human
uuccuggugguccuccuuccuggu

SEQ ID NO: 1202956 - RNA, 24 nt, Human
uuccuggugguccuccuuccuggu

SEQ ID NO: 1202957 - RNA, 24 nt, Human
uuccuggugguccuccuuccuggu

SEQ ID NO: 1202958 - RNA, 24 nt, Human
uuccuggugguccuccuuccuggu

SEQ ID NO: 1202959 - RNA, 24 nt, Human
uuccuggugguccuccuuccuggu

SEQ ID NO: 1202960 - RNA, 23 nt, Human
uuccuuggaggcugcgggucucc

SEQ ID NO: 1202961 - RNA, 24 nt, Human
uugcagccuugccgguggucuucc

SEQ ID NO: 1202962 - RNA, 19 nt, Human
uugcuggggccuguggcuu

SEQ ID NO: 1202963 - RNA, 24 nt, Human
uugcuggggccuguggcuucuccg

SEQ ID NO: 1202964 - RNA, 26 nt, Human
uugcuggggccuguggcuucuccggg

SEQ ID NO: 1202965 - RNA, 18 nt, Human
uuggggcugcuggcccuu

SEQ ID NO: 1202966 - RNA, 20 nt, Human
uuguacguggcuccuuugcu

SEQ ID NO: 1202967 - RNA, 19 nt, Human
cagcagccuucccgggcag

SEQ ID NO: 1202968 - RNA, 18 nt, Human
caggaggggcugaggguc

SEQ ID NO: 1202969 - RNA, 24 nt, Human
caggucgaaugaacaaaugcauga

SEQ ID NO: 1202970 - RNA, 23 nt, Human
ccuucccgggcaggccucccccg

SEQ ID NO: 1202971 - RNA, 23 nt, Human
cucaacauuggccccgugccagc

SEQ ID NO: 1202972 - RNA, 24 nt, Human
cucucaggacaggucgaaugaaca

SEQ ID NO: 1202973 - RNA, 22 nt, Human
gaaugaacaaaugcaugaggca

SEQ ID NO: 1202974 - RNA, 27 nt, Human
gcagcagccuucccgggcaggccuccc

SEQ ID NO: 1202975 - RNA, 25 nt, Human
gccacccucccauccugguggacuc

SEQ ID NO: 1202976 - RNA, 20 nt, Human
gcucagagccuggccacccu

SEQ ID NO: 1202977 - RNA, 22 nt, Human
gcucagagccuggccacccucc

SEQ ID NO: 1202978 - RNA, 24 nt, Human
ggcaggccucccccggcugcggca

SEQ ID NO: 1202979 - RNA, 20 nt, Human
gggagugggggccagggggc

SEQ ID NO: 1202980 - RNA, 20 nt, Human
ggggagugggggccaggggg

SEQ ID NO: 1202981 - RNA, 23 nt, Human
ggggagugggggccagggggcag

SEQ ID NO: 1202982 - RNA, 21 nt, Human
ggggcaggggcagcagccuuc

SEQ ID NO: 1202983 - RNA, 19 nt, Human
gggggagugggggccaggg

SEQ ID NO: 1202984 - RNA, 23 nt, Human
ggugcucaguggcucaaccggag

SEQ ID NO: 1202985 - RNA, 22 nt, Human
gugcucaguggcucagagccug

SEQ ID NO: 1202986 - RNA, 24 nt, Human
ucaguggcucagagccuggccacc

SEQ ID NO: 1202987 - RNA, 22 nt, Human
ucccgggcaggccucccccggc

SEQ ID NO: 1202988 - RNA, 21 nt, Human
ugcucaguggcucagagccug

SEQ ID NO: 1202989 - RNA, 18 nt, Human
ugggggccagggggcagg

SEQ ID NO: 1202990 - RNA, 23 nt, Human
agacacacagucagagccuggau

SEQ ID NO: 1202991 - RNA, 21 nt, Human
ucuggaagcuccugggagggc

SEQ ID NO: 1202992 - RNA, 26 nt, Human
uggauuucuggcaggucuggaagcuc

SEQ ID NO: 1202993 - RNA, 21 nt, Human
ugggagggcccgacaagggca

SEQ ID NO: 1202994 - RNA, 21 nt, Human
uguuaugaguguccugacugc

SEQ ID NO: 1202995 - RNA, 19 nt, Human
ccccuccuggucuuuaauc

SEQ ID NO: 1202996 - RNA, 25 nt, Human
cuguuguggggaaagaaagcggcuu

SEQ ID NO: 1202997 - RNA, 20 nt, Human
agcccgucagcucgcucuca

SEQ ID NO: 1202998 - RNA, 28 nt, Human
cagccagucccccuguccaacaaggccc

SEQ ID NO: 1202999 - RNA, 22 nt, Human
ccaguaggcagccagucccccu

SEQ ID NO: 1203000 - RNA, 19 nt, Human
guugcagaugguggagcag

SEQ ID NO: 1203001 - RNA, 20 nt, Human
uccgcgcgcucgcuggagcc

SEQ ID NO: 1203002 - RNA, 18 nt, Human
ucggccugcuccagaccc

SEQ ID NO: 1203003 - RNA, 18 nt, Human
uguccggagucgaggcuc

SEQ ID NO: 1203004 - RNA, 22 nt, Human
aagcugcagcuggugugugucu

SEQ ID NO: 1203005 - RNA, 18 nt, Human
agcugcagcuggugugug

SEQ ID NO: 1203006 - RNA, 20 nt, Human
aggccugccuugccccgcug

SEQ ID NO: 1203007 - RNA, 21 nt, Human
agggagggggagcugagggcc

SEQ ID NO: 1203008 - RNA, 23 nt, Human
agggggagcugagggcccagaca

SEQ ID NO: 1203009 - RNA, 18 nt, Human
agguggagggagggggag

SEQ ID NO: 1203010 - RNA, 19 nt, Human
agguguguaggagcuggca

SEQ ID NO: 1203011 - RNA, 20 nt, Human
cacugccugcaggguggccc

SEQ ID NO: 1203012 - RNA, 22 nt, Human
ccccaggccugccuugccccgc

SEQ ID NO: 1203013 - RNA, 23 nt, Human
ccccgcuggcaguugcccaggaa

SEQ ID NO: 1203014 - RNA, 18 nt, Human
gagcugagggcccagaca

SEQ ID NO: 1203015 - RNA, 18 nt, Human
ggguagguggagggaggg

SEQ ID NO: 1203016 - RNA, 22 nt, Human
gguagguggagggagggggagc

SEQ ID NO: 1203017 - RNA, 21 nt, Human
gguaucccguggggucguagu

SEQ ID NO: 1203018 - RNA, 20 nt, Human
guuuccuccgucugggcugg

SEQ ID NO: 1203019 - RNA, 22 nt, Human
uccugaccaauccuugcucugc

SEQ ID NO: 1203020 - RNA, 18 nt, Human
ucguucagagccuuucuc

SEQ ID NO: 1203021 - RNA, 26 nt, Human
ugagggcccagacacugccugcaggg

SEQ ID NO: 1203022 - RNA, 25 nt, Human
ugccuugccccgcuggcaguugccc

SEQ ID NO: 1203023 - RNA, 23 nt, Human
uggcaggcgucaguacgaagcug

SEQ ID NO: 1203024 - RNA, 20 nt, Human
uggugggugugaggggguag

SEQ ID NO: 1203025 - RNA, 19 nt, Human
ugggcaggggggcuaggcu

SEQ ID NO: 1203026 - RNA, 19 nt, Human
uggguggcaggagaagagg

SEQ ID NO: 1203027 - RNA, 18 nt, Human
aaagcugugcggccagcc

SEQ ID NO: 1203028 - RNA, 21 nt, Human
aacuggucuccucccucccug

SEQ ID NO: 1203029 - RNA, 21 nt, Human
agcagccgcaccagguccacg

SEQ ID NO: 1203030 - RNA, 18 nt, Human
agcuuccagacaacagcc

SEQ ID NO: 1203031 - RNA, 21 nt, Human
aggaggccaccacggcggggc

SEQ ID NO: 1203032 - RNA, 20 nt, Human
augcugcugagcuuggaggc

SEQ ID NO: 1203033 - RNA, 20 nt, Human
caaguugacaagcaguuuca

SEQ ID NO: 1203034 - RNA, 22 nt, Human
cacgcuguagugaagggccgug

SEQ ID NO: 1203035 - RNA, 18 nt, Human
cagacgccugucuccagc

SEQ ID NO: 1203036 - RNA, 19 nt, Human
caggagcagccgcaccagg

SEQ ID NO: 1203037 - RNA, 18 nt, Human
caguuucaggaagugugg

SEQ ID NO: 1203038 - RNA, 21 nt, Human
caguuucaggaagugugggga

SEQ ID NO: 1203039 - RNA, 26 nt, Human
cauggugacaggccaccaugagggcc

SEQ ID NO: 1203040 - RNA, 25 nt, Human
cauuuccuucucuuaagagcuucca

SEQ ID NO: 1203041 - RNA, 24 nt, Human
ccacugcuccugcaggagcuccug

SEQ ID NO: 1203042 - RNA, 21 nt, Human
ccugaguucaguggagaggaa

SEQ ID NO: 1203043 - RNA, 20 nt, Human
cggggaggaggaggaggccg

SEQ ID NO: 1203044 - RNA, 24 nt, Human
cggggaggaggaggaggccggugg

SEQ ID NO: 1203045 - RNA, 18 nt, Human
cucccugucguggcugac

SEQ ID NO: 1203046 - RNA, 24 nt, Human
cugcaggagcuccuggaucuucuu

SEQ ID NO: 1203047 - RNA, 25 nt, Human
cuuccuguucagugccugcuucuuc

SEQ ID NO: 1203048 - RNA, 19 nt, Human
cuuucugucgcugccccac

SEQ ID NO: 1203049 - RNA, 21 nt, Human
gaaagccuccugcuccccugg

SEQ ID NO: 1203050 - RNA, 23 nt, Human
gacucccagcaucagcgcagucu

SEQ ID NO: 1203051 - RNA, 22 nt, Human
gagcuuggaggcuggcugcuug

SEQ ID NO: 1203052 - RNA, 18 nt, Human
gaggaggaggccgguggc

SEQ ID NO: 1203053 - RNA, 23 nt, Human
gcggggaggaggaggaggccggu

SEQ ID NO: 1203054 - RNA, 20 nt, Human
ggagaucuccacuggcgggg

SEQ ID NO: 1203055 - RNA, 22 nt, Human
ggagcucagcagcuggcucugg

SEQ ID NO: 1203056 - RNA, 21 nt, Human
ggcggggaggaggaggaggcc

SEQ ID NO: 1203057 - RNA, 20 nt, Human
gggagugaggcuggaccucg

SEQ ID NO: 1203058 - RNA, 27 nt, Human
gggccgaggauccaucguugccacugg

SEQ ID NO: 1203059 - RNA, 20 nt, Human
ggggaggaggaggaggccgg

SEQ ID NO: 1203060 - RNA, 19 nt, Human
gugagccugggccgaguag

SEQ ID NO: 1203061 - RNA, 20 nt, Human
guguggggagugaggcugga

SEQ ID NO: 1203062 - RNA, 23 nt, Human
uacccaugcuccaggcaguucca

SEQ ID NO: 1203063 - RNA, 18 nt, Human
uccccugguuccucccug

SEQ ID NO: 1203064 - RNA, 25 nt, Human
ucccugcugggggagucuuucuguc

SEQ ID NO: 1203065 - RNA, 24 nt, Human
ucccugggagauuggaacuggucu

SEQ ID NO: 1203066 - RNA, 19 nt, Human
uccggcuggagacgcggaa

SEQ ID NO: 1203067 - RNA, 20 nt, Human
uccuugggugggugagccug

SEQ ID NO: 1203068 - RNA, 23 nt, Human
ucugugguggucccaguuucugg

SEQ ID NO: 1203069 - RNA, 20 nt, Human
ugacaagcaguuucaggaag

SEQ ID NO: 1203070 - RNA, 21 nt, Human
ugacaagcaguuucaggaagu

SEQ ID NO: 1203071 - RNA, 22 nt, Human
ugaugguccacauugcagacgc

SEQ ID NO: 1203072 - RNA, 19 nt, Human
uggaacuggucuccucccu

SEQ ID NO: 1203073 - RNA, 23 nt, Human
uggcugacucccagcaucagcgc

SEQ ID NO: 1203074 - RNA, 20 nt, Human
ugugcggccagccuugucag

SEQ ID NO: 1203075 - RNA, 21 nt, Human
ugugcggccagccuugucagu

SEQ ID NO: 1203076 - RNA, 24 nt, Human
uucacauuuccuucucuuaagagc

SEQ ID NO: 1203077 - RNA, 25 nt, Human
uucacauuuccuucucuuaagagcu

SEQ ID NO: 1203078 - RNA, 19 nt, Human
uucacgauggagaaguugg

SEQ ID NO: 1203079 - RNA, 20 nt, Human
uucaggaaguguggggagug

SEQ ID NO: 1203080 - RNA, 21 nt, Human
uugauggcgcuggccagcucc

SEQ ID NO: 1203081 - RNA, 22 nt, Human
uuggaggcuggcugcuugaugg

SEQ ID NO: 1203082 - RNA, 24 nt, Human
uugguggccuucccgggugcuccu

SEQ ID NO: 1203083 - RNA, 20 nt, Human
caccggaaaacaacccucag

SEQ ID NO: 1203084 - RNA, 22 nt, Human
caugucccaagaucaccggaaa

SEQ ID NO: 1203085 - RNA, 24 nt, Human
ccaacacuuuucacaauuccagca

SEQ ID NO: 1203086 - RNA, 19 nt, Human
ccaagaucaccggaaaaca

SEQ ID NO: 1203087 - RNA, 24 nt, Human
ccacaguggcaacaaucucaauuu

SEQ ID NO: 1203088 - RNA, 23 nt, Human
cccucaggaccagcucugcucag

SEQ ID NO: 1203089 - RNA, 21 nt, Human
ccgccuucagcuuaguaacuc

SEQ ID NO: 1203090 - RNA, 22 nt, Human
ccggaaaacaacccucaggacc

SEQ ID NO: 1203091 - RNA, 22 nt, Human
cggaaaacaacccucaggacca

SEQ ID NO: 1203092 - RNA, 21 nt, Human
ggaaaacaacccucaggacca

SEQ ID NO: 1203093 - RNA, 18 nt, Human
aaaaggcugugaccagga

SEQ ID NO: 1203094 - RNA, 22 nt, Human
aaggacagugaagugcugcugc

SEQ ID NO: 1203095 - RNA, 20 nt, Human
aggaugucugaugggcucug

SEQ ID NO: 1203096 - RNA, 25 nt, Human
ccagggguggguggugguuccgggg

SEQ ID NO: 1203097 - RNA, 26 nt, Human
ccagggguggguggugguuccgggug

SEQ ID NO: 1203098 - RNA, 22 nt, Human
gggcgucgucccuaaacucugc

SEQ ID NO: 1203099 - RNA, 21 nt, Human
uaaacucugccagcucagaag

SEQ ID NO: 1203100 - RNA, 19 nt, Human
uccacacagagccugaagu

SEQ ID NO: 1203101 - RNA, 20 nt, Human
ucccuaaacucugccagcuc

SEQ ID NO: 1203102 - RNA, 22 nt, Human
ugaagugcugcugcccaggggu

SEQ ID NO: 1203103 - RNA, 20 nt, Human
ugaguuuucaggagcagucc

SEQ ID NO: 1203104 - RNA, 24 nt, Human
ugaguuuucaggagcagucccaca

SEQ ID NO: 1203105 - RNA, 19 nt, Human
ugcugcccaggggugggug

SEQ ID NO: 1203106 - RNA, 24 nt, Human
uggcuuguuucuucccuuuugagu

SEQ ID NO: 1203107 - RNA, 18 nt, Human
uggggaaaaggcugugac

SEQ ID NO: 1203108 - RNA, 18 nt, Human
uggguggugguuggggaa

SEQ ID NO: 1203109 - RNA, 23 nt, Human
cacaccucgagacuucaacucaa

SEQ ID NO: 1203110 - RNA, 23 nt, Human
uucacaccucgagacuucaacuc

SEQ ID NO: 1203111 - RNA, 21 nt, Human
aaagaaaauuuaaggcccaga

SEQ ID NO: 1203112 - RNA, 19 nt, Human
accgacuacccgaaccuca

SEQ ID NO: 1203113 - RNA, 22 nt, Human
aggaaaaaggggauaguuagaa

SEQ ID NO: 1203114 - RNA, 19 nt, Human
uacacuauagaaaaccaga

SEQ ID NO: 1203115 - RNA, 18 nt, Human
uaggaaucagcucugaug

SEQ ID NO: 1203116 - RNA, 22 nt, Human
uauagaaaaccagacaaagaaa

SEQ ID NO: 1203117 - RNA, 23 nt, Human
uuagaauuggguuacuaaaaagu

SEQ ID NO: 1203118 - RNA, 21 nt, Human
gaaggcaggcacuacuuugac

SEQ ID NO: 1203119 - RNA, 23 nt, Human
gggcugggggauccgaaggcagg

SEQ ID NO: 1203120 - RNA, 22 nt, Human
ucccacacuguuuccaugacaa

SEQ ID NO: 1203121 - RNA, 23 nt, Human
uguuccguucccacacuguuucc

SEQ ID NO: 1203122 - RNA, 24 nt, Human
uguugcuuaaacaggaaagggucc

SEQ ID NO: 1203123 - RNA, 22 nt, Human
uuucugcaucuggaggccacag

SEQ ID NO: 1203124 - RNA, 22 nt, Human
aaaacacuaaauacacaguaau

SEQ ID NO: 1203125 - RNA, 23 nt, Human
aaaacuguugccugagacucagg

SEQ ID NO: 1203126 - RNA, 18 nt, Human
aaaauaagcaucaccaaa

SEQ ID NO: 1203127 - RNA, 18 nt, Human
aaaaucagccuuaaguau

SEQ ID NO: 1203128 - RNA, 19 nt, Human
aaccauuuaaaguuacauu

SEQ ID NO: 1203129 - RNA, 18 nt, Human
aacuagaaaguaaguucu

SEQ ID NO: 1203130 - RNA, 22 nt, Human
aagcaucaccaaauuucuguaa

SEQ ID NO: 1203131 - RNA, 23 nt, Human
aagcguuugccaaacugagucca

SEQ ID NO: 1203132 - RNA, 21 nt, Human
aaguguaaaaacacgcggaac

SEQ ID NO: 1203133 - RNA, 18 nt, Human
aaugaccccgcaauagga

SEQ ID NO: 1203134 - RNA, 22 nt, Human
acagaauuccugaaagaaaaac

SEQ ID NO: 1203135 - RNA, 29 nt, Human
acaugcgcacgcacacacacgcaaacaca

SEQ ID NO: 1203136 - RNA, 22 nt, Human
acccuguuuaauucugcucagu

SEQ ID NO: 1203137 - RNA, 21 nt, Human
accucagauaaggaaaggcca

SEQ ID NO: 1203138 - RNA, 23 nt, Human
acgcacacacacgcaaacacaca

SEQ ID NO: 1203139 - RNA, 18 nt, Human
acuacaccucagauaagg

SEQ ID NO: 1203140 - RNA, 24 nt, Human
acuggaaucaccaaaugcaugcgc

SEQ ID NO: 1203141 - RNA, 19 nt, Human
agacccaagaggugaacag

SEQ ID NO: 1203142 - RNA, 18 nt, Human
agaggaaguggcucuggu

SEQ ID NO: 1203143 - RNA, 19 nt, Human
agaguuccuccggcuugcc

SEQ ID NO: 1203144 - RNA, 25 nt, Human
agcacaugcgcacgcacacacacgg

SEQ ID NO: 1203145 - RNA, 20 nt, Human
agcauccuuuggugaaccau

SEQ ID NO: 1203146 - RNA, 24 nt, Human
aggaaguggcucugguugccuaug

SEQ ID NO: 1203147 - RNA, 22 nt, Human
aguaaguucucccuuuuucuuu

SEQ ID NO: 1203148 - RNA, 20 nt, Human
auaaauaagcagaaacacaa

SEQ ID NO: 1203149 - RNA, 21 nt, Human
caaaugcaugcgcaguaacac

SEQ ID NO: 1203150 - RNA, 24 nt, Human
caacaagaaugcacauucaagcau

SEQ ID NO: 1203151 - RNA, 22 nt, Human
caacuucuaugacccaacaagu

SEQ ID NO: 1203152 - RNA, 20 nt, Human
caagaaugcacauucaagca

SEQ ID NO: 1203153 - RNA, 20 nt, Human
caagcaucugaaugcaugau

SEQ ID NO: 1203154 - RNA, 22 nt, Human
caaguuaacuaaagaaugacac

SEQ ID NO: 1203155 - RNA, 19 nt, Human
cacacaaacuuauugcgug

SEQ ID NO: 1203156 - RNA, 26 nt, Human
cacgcacacacacgcaaacacacaau

SEQ ID NO: 1203157 - RNA, 19 nt, Human
cagaaucucagaacauaau

SEQ ID NO: 1203158 - RNA, 19 nt, Human
caucugaaugcaugaucug

SEQ ID NO: 1203159 - RNA, 20 nt, Human
caugaucuguuaauacugaa

SEQ ID NO: 1203160 - RNA, 19 nt, Human
ccaggagauguuggguuca

SEQ ID NO: 1203161 - RNA, 18 nt, Human
ccauccacaaugcuuaga

SEQ ID NO: 1203162 - RNA, 22 nt, Human
cccaagaggugaacaggaggga

SEQ ID NO: 1203163 - RNA, 22 nt, Human
cccuuuuucuuucaaaugaucc

SEQ ID NO: 1203164 - RNA, 23 nt, Human
ccgggucuguuuccagccccacu

SEQ ID NO: 1203165 - RNA, 19 nt, Human
ccucucgccuuuccgcccc

SEQ ID NO: 1203166 - RNA, 25 nt, Human
cuaaagaaugacacugaaaccauaa

SEQ ID NO: 1203167 - RNA, 22 nt, Human
cugaaaccauaagguaacuccc

SEQ ID NO: 1203168 - RNA, 24 nt, Human
gaacaaguguaaaaacacgcggaa

SEQ ID NO: 1203169 - RNA, 25 nt, Human
gaacaaguguaaaaacacgcggaac

SEQ ID NO: 1203170 - RNA, 22 nt, Human
gaaguggcucugguugccuaug

SEQ ID NO: 1203171 - RNA, 22 nt, Human
gagcuugcucgggucuccccug

SEQ ID NO: 1203172 - RNA, 21 nt, Human
gcaaacacacaaucacuucau

SEQ ID NO: 1203173 - RNA, 24 nt, Human
gcagaaacacaaagggagguacug

SEQ ID NO: 1203174 - RNA, 24 nt, Human
gcggaaagcaacuucuaugaccca

SEQ ID NO: 1203175 - RNA, 22 nt, Human
ggaaagcaacuucuaugaccca

SEQ ID NO: 1203176 - RNA, 19 nt, Human
ggaaguggcucugguugcc

SEQ ID NO: 1203177 - RNA, 18 nt, Human
guuaagccuucuccaaag

SEQ ID NO: 1203178 - RNA, 22 nt, Human
guugccugagacucaggggagc

SEQ ID NO: 1203179 - RNA, 18 nt, Human
uaaaagaagaaagaucau

SEQ ID NO: 1203180 - RNA, 25 nt, Human
uaaaauaaucuucuaauaaaaucag

SEQ ID NO: 1203181 - RNA, 22 nt, Human
uaaauuacacagcucccaaguu

SEQ ID NO: 1203182 - RNA, 18 nt, Human
uaagcagaaacacaaagg

SEQ ID NO: 1203183 - RNA, 19 nt, Human
uaaguggagaacagaagug

SEQ ID NO: 1203184 - RNA, 22 nt, Human
uaaguuugcauucugguucuca

SEQ ID NO: 1203185 - RNA, 22 nt, Human
uacacaguaauuaaauaucuag

SEQ ID NO: 1203186 - RNA, 23 nt, Human
uagagcauccuuuggugaaccau

SEQ ID NO: 1203187 - RNA, 26 nt, Human
uagcacuggaaucaccaaaugcaugc

SEQ ID NO: 1203188 - RNA, 18 nt, Human
uagguguaagcguuugcc

SEQ ID NO: 1203189 - RNA, 20 nt, Human
uauuuugacauaaaauuggc

SEQ ID NO: 1203190 - RNA, 18 nt, Human
ucaaaacacuaaauacac

SEQ ID NO: 1203191 - RNA, 23 nt, Human
ucaagcccacaacaagaaugcac

SEQ ID NO: 1203192 - RNA, 25 nt, Human
uccacaguuaagccuucuccaaaga

SEQ ID NO: 1203193 - RNA, 21 nt, Human
uccgugacaaaacuguugccu

SEQ ID NO: 1203194 - RNA, 26 nt, Human
uccgugacaaaacuguugccugagac

SEQ ID NO: 1203195 - RNA, 20 nt, Human
uccuuccauccacaaugcuu

SEQ ID NO: 1203196 - RNA, 24 nt, Human
ucggcgacauggcggccgacgugc

SEQ ID NO: 1203197 - RNA, 23 nt, Human
ucuucuaauaaaaucagccuuaa

SEQ ID NO: 1203198 - RNA, 24 nt, Human
ucuugcugcgaagguccccaggag

SEQ ID NO: 1203199 - RNA, 24 nt, Human
ugaaauaauacgcaaagccuaaau

SEQ ID NO: 1203200 - RNA, 20 nt, Human
ugaauagcuuuuauagaacc

SEQ ID NO: 1203201 - RNA, 24 nt, Human
ugacccaacaaguguaaaccaaaa

SEQ ID NO: 1203202 - RNA, 18 nt, Human
ugaggaggagauggauau

SEQ ID NO: 1203203 - RNA, 18 nt, Human
ugcacaucaucaucaagu

SEQ ID NO: 1203204 - RNA, 18 nt, Human
ugccugagacucagggga

SEQ ID NO: 1203205 - RNA, 20 nt, Human
ugcucaguguaccucaugac

SEQ ID NO: 1203206 - RNA, 20 nt, Human
uggaaucaccaaaugcaugc

SEQ ID NO: 1203207 - RNA, 23 nt, Human
uggcaaaaauaagcaucaccaaa

SEQ ID NO: 1203208 - RNA, 22 nt, Human
uggcuccgguggaggagacacc

SEQ ID NO: 1203209 - RNA, 24 nt, Human
ugggcaaauacuacaccaaccccg

SEQ ID NO: 1203210 - RNA, 22 nt, Human
ugggcaaauacuacaccagagg

SEQ ID NO: 1203211 - RNA, 21 nt, Human
ugucacaguuucucauugcag

SEQ ID NO: 1203212 - RNA, 20 nt, Human
ugucacggagcuugcucggg

SEQ ID NO: 1203213 - RNA, 24 nt, Human
ugucucagugcuuuccucuugcug

SEQ ID NO: 1203214 - RNA, 23 nt, Human
ugugauguuggguauuugcuuau

SEQ ID NO: 1203215 - RNA, 24 nt, Human
uguugccugagacucaggggagcu

SEQ ID NO: 1203216 - RNA, 21 nt, Human
uuaaagaccuuccaugucugg

SEQ ID NO: 1203217 - RNA, 22 nt, Human
uuacacacaaacuuauugcgug

SEQ ID NO: 1203218 - RNA, 24 nt, Human
uuggcaaaaauaagcaucaccaaa

SEQ ID NO: 1203219 - RNA, 21 nt, Human
uuugugauguuggguauuugc

SEQ ID NO: 1203220 - RNA, 22 nt, Human
uuuucuuuggucucuaggccug

SEQ ID NO: 1203221 - RNA, 21 nt, Human
accagcccuugcugcuguugc

SEQ ID NO: 1203222 - RNA, 20 nt, Human
agcacccugaccccuuucgc

SEQ ID NO: 1203223 - RNA, 25 nt, Human
ccugaccccuuucgcuucggcuuuc

SEQ ID NO: 1203224 - RNA, 24 nt, Human
cucccuggcauccgauguuccuga

SEQ ID NO: 1203225 - RNA, 20 nt, Human
cuccucccucccuggcaucc

SEQ ID NO: 1203226 - RNA, 22 nt, Human
cugccgggcuauggcuuuucuu

SEQ ID NO: 1203227 - RNA, 25 nt, Human
gcccuugcugcuguugccucagcac

SEQ ID NO: 1203228 - RNA, 18 nt, Human
ugccucagcacccugacc

SEQ ID NO: 1203229 - RNA, 24 nt, Human
aagccugcaggcaaguggggcugg

SEQ ID NO: 1203230 - RNA, 21 nt, Human
aggagaagcgaggaggacccg

SEQ ID NO: 1203231 - RNA, 23 nt, Human
aggaggaggagaggagaagcgag

SEQ ID NO: 1203232 - RNA, 21 nt, Human
aggggccuuugagugacaggu

SEQ ID NO: 1203233 - RNA, 20 nt, Human
aggucaggaggaggagagga

SEQ ID NO: 1203234 - RNA, 22 nt, Human
augaguucucugcaggacaaag

SEQ ID NO: 1203235 - RNA, 22 nt, Human
caggacaaagcaaagcuggagg

SEQ ID NO: 1203236 - RNA, 19 nt, Human
ccacugcccagcuccuggg

SEQ ID NO: 1203237 - RNA, 24 nt, Human
ccuccugcugcuccuuggcuugcu

SEQ ID NO: 1203238 - RNA, 21 nt, Human
cgaaggugagcagaaccugcu

SEQ ID NO: 1203239 - RNA, 19 nt, Human
cgaggaggacccgaaggug

SEQ ID NO: 1203240 - RNA, 22 nt, Human
cgaggaggacccgaaggugagc

SEQ ID NO: 1203241 - RNA, 21 nt, Human
gaggaggagaggagaagcgag

SEQ ID NO: 1203242 - RNA, 19 nt, Human
gcugcuccuuggcuugcuc

SEQ ID NO: 1203243 - RNA, 18 nt, Human
ggacccgaaggugagcag

SEQ ID NO: 1203244 - RNA, 18 nt, Human
ggagaagcgaggaggacc

SEQ ID NO: 1203245 - RNA, 22 nt, Human
ggagaagcgaggaggacccgaa

SEQ ID NO: 1203246 - RNA, 21 nt, Human
ggagaggagaagcgaggagga

SEQ ID NO: 1203247 - RNA, 23 nt, Human
ucaggaggaggagaggagaagcg

SEQ ID NO: 1203248 - RNA, 20 nt, Human
uccugcugcuccuuggcuug

SEQ ID NO: 1203249 - RNA, 21 nt, Human
uccugcugcuccuuggcuugc

SEQ ID NO: 1203250 - RNA, 21 nt, Human
ucugcaggacaaagcaaagcu

SEQ ID NO: 1203251 - RNA, 19 nt, Human
ugcuggagggagacggugg

SEQ ID NO: 1203252 - RNA, 21 nt, Human
acaaaaaacaagcucugugga

SEQ ID NO: 1203253 - RNA, 19 nt, Human
accugauucaguccgugcu

SEQ ID NO: 1203254 - RNA, 22 nt, Human
agagggugugggggucugaagc

SEQ ID NO: 1203255 - RNA, 24 nt, Human
aggagagggugugggggucugaag

SEQ ID NO: 1203256 - RNA, 22 nt, Human
cagcagcaggagaggguguggg

SEQ ID NO: 1203257 - RNA, 19 nt, Human
ccagugaguggcggcuuuu

SEQ ID NO: 1203258 - RNA, 22 nt, Human
ccccggcaggugcguguaccug

SEQ ID NO: 1203259 - RNA, 18 nt, Human
cucuguggagugcugggc

SEQ ID NO: 1203260 - RNA, 18 nt, Human
gagugcugggcagguaac

SEQ ID NO: 1203261 - RNA, 20 nt, Human
gcaccucggucagugcgucc

SEQ ID NO: 1203262 - RNA, 22 nt, Human
gggggucugaagcuguccuggu

SEQ ID NO: 1203263 - RNA, 22 nt, Human
ucagcaucaguuggagacacag

SEQ ID NO: 1203264 - RNA, 21 nt, Human
ucgccgccgcagccuugaggc

SEQ ID NO: 1203265 - RNA, 20 nt, Human
agcagcuauaggccugaggc

SEQ ID NO: 1203266 - RNA, 22 nt, Human
cccacucuuauucuggagccua

SEQ ID NO: 1203267 - RNA, 23 nt, Human
cuauaggccugaggcugaacaca

SEQ ID NO: 1203268 - RNA, 19 nt, Human
gcggaagguguggccacag

SEQ ID NO: 1203269 - RNA, 20 nt, Human
ggcggaagguguggccacag

SEQ ID NO: 1203270 - RNA, 20 nt, Human
ggugucagagcauggggcac

SEQ ID NO: 1203271 - RNA, 20 nt, Human
ucugagcugucccacucuua

SEQ ID NO: 1203272 - RNA, 20 nt, Human
ugaggugggugucagagcau

SEQ ID NO: 1203273 - RNA, 18 nt, Human
uggcaagaguggggcaga

SEQ ID NO: 1203274 - RNA, 20 nt, Human
uggcaagugggugcucuugg

SEQ ID NO: 1203275 - RNA, 23 nt, Human
uggcaagugggugcucuugguuc

SEQ ID NO: 1203276 - RNA, 19 nt, Human
uggggaaauggcaagagug

SEQ ID NO: 1203277 - RNA, 25 nt, Human
uguggccacagcagcuauaggccug

SEQ ID NO: 1203278 - RNA, 22 nt, Human
uccaugagugguagacuuacug

SEQ ID NO: 1203279 - RNA, 18 nt, Human
ugggagcagaagaucuag

SEQ ID NO: 1203280 - RNA, 26 nt, Human
accccgagagccuguccauggagaau

SEQ ID NO: 1203281 - RNA, 20 nt, Human
agaaggacaggucugcccag

SEQ ID NO: 1203282 - RNA, 22 nt, Human
agcuagcuaccccgagagccug

SEQ ID NO: 1203283 - RNA, 18 nt, Human
cgagagccuguccaugga

SEQ ID NO: 1203284 - RNA, 18 nt, Human
cgugggugcugcccugca

SEQ ID NO: 1203285 - RNA, 18 nt, Human
gcuagcuaccccgagagc

SEQ ID NO: 1203286 - RNA, 19 nt, Human
guccauggagaaugauggu

SEQ ID NO: 1203287 - RNA, 18 nt, Human
gugaggaggguuucuggg

SEQ ID NO: 1203288 - RNA, 18 nt, Human
ugcucccuuccacguggg

SEQ ID NO: 1203289 - RNA, 18 nt, Human
ugugaggcacagaaggac

SEQ ID NO: 1203290 - RNA, 19 nt, Human
ugugaggcacagaaggaca

SEQ ID NO: 1203291 - RNA, 21 nt, Human
uuucugggugcucccuuccac

SEQ ID NO: 1203292 - RNA, 21 nt, Human
cagugacaaccucgggggcag

SEQ ID NO: 1203293 - RNA, 21 nt, Human
aaacgcacuggaggacggcac

SEQ ID NO: 1203294 - RNA, 21 nt, Human
aaccauucccaccaacaccaa

SEQ ID NO: 1203295 - RNA, 21 nt, Human
acaccaauauccccuggaccg

SEQ ID NO: 1203296 - RNA, 22 nt, Human
accaacaccaauauccccugga

SEQ ID NO: 1203297 - RNA, 19 nt, Human
acuuccaggaacauaagaa

SEQ ID NO: 1203298 - RNA, 20 nt, Human
agaggaagcagcacacagaa

SEQ ID NO: 1203299 - RNA, 21 nt, Human
caccaacaccaauauccccug

SEQ ID NO: 1203300 - RNA, 19 nt, Human
cagcagauccugggcauga

SEQ ID NO: 1203301 - RNA, 20 nt, Human
cccaccaacaccaauauccc

SEQ ID NO: 1203302 - RNA, 21 nt, Human
gaaaacgcacuggaggacggc

SEQ ID NO: 1203303 - RNA, 21 nt, Human
gagcgcagcagauccugggca

SEQ ID NO: 1203304 - RNA, 23 nt, Human
ggaaugggagcaagaaugcguga

SEQ ID NO: 1203305 - RNA, 21 nt, Human
ucaggaaugggagcaagaaug

SEQ ID NO: 1203306 - RNA, 22 nt, Human
ucccaccaacaccaauaucccc

SEQ ID NO: 1203307 - RNA, 23 nt, Human
ucuguagcuucaggaaugggagc

SEQ ID NO: 1203308 - RNA, 20 nt, Human
ugaacagaaaucuguggacu

SEQ ID NO: 1203309 - RNA, 18 nt, Human
ugccgaaaagaggugcca

SEQ ID NO: 1203310 - RNA, 21 nt, Human
uucuauaguguaagcaucacu

SEQ ID NO: 1203311 - RNA, 18 nt, Human
caccaagugacacgaagg

SEQ ID NO: 1203312 - RNA, 25 nt, Human
cacgaagggaaucagcaguuuccca

SEQ ID NO: 1203313 - RNA, 18 nt, Human
uaauuugaccaccaucca

SEQ ID NO: 1203314 - RNA, 25 nt, Human
ucagcaguuucccauaagcaucuag

SEQ ID NO: 1203315 - RNA, 24 nt, Human
caacaagguggcccuaacguacug

SEQ ID NO: 1203316 - RNA, 22 nt, Human
cacaggcucggugcuaaggcac

SEQ ID NO: 1203317 - RNA, 19 nt, Human
gacccgaagauggcaacaa

SEQ ID NO: 1203318 - RNA, 21 nt, Human
ccacugaucuuuucacugucu

SEQ ID NO: 1203319 - RNA, 19 nt, Human
ggcgucugcaaagauaacc

SEQ ID NO: 1203320 - RNA, 21 nt, Human
gguggugaaaauaaaacacaa

SEQ ID NO: 1203321 - RNA, 20 nt, Human
ugaaaauaaaacacaaguca

SEQ ID NO: 1203322 - RNA, 26 nt, Human
ugugguggaggggugcucuccugagc

SEQ ID NO: 1203323 - RNA, 22 nt, Human
caagcaaaucucugcaacucuc

SEQ ID NO: 1203324 - RNA, 22 nt, Human
cacaagcaaaucucugcaacuc

SEQ ID NO: 1203325 - RNA, 27 nt, Human
cacaagcaaaucucugcaacucuccuc

SEQ ID NO: 1203326 - RNA, 27 nt, Human
cagcacaagcaaaucucugcaacucuc

SEQ ID NO: 1203327 - RNA, 25 nt, Human
gacagcacaagcaaaucucugcaac

SEQ ID NO: 1203328 - RNA, 23 nt, Human
ugcaaaugacagcacaagcaaau

SEQ ID NO: 1203329 - RNA, 20 nt, Human
ugcaacucuccuccugaaag

SEQ ID NO: 1203330 - RNA, 20 nt, Human
uaccucaaauaugaucucac

SEQ ID NO: 1203331 - RNA, 22 nt, Human
aagcggaggcaggcgggugggg

SEQ ID NO: 1203332 - RNA, 23 nt, Human
agcacuguggccugcucuccugg

SEQ ID NO: 1203333 - RNA, 21 nt, Human
aggcaggcggguggggguggg

SEQ ID NO: 1203334 - RNA, 22 nt, Human
aggcaggcggguggggguggga

SEQ ID NO: 1203335 - RNA, 24 nt, Human
aggcaggcgggugggggugggagu

SEQ ID NO: 1203336 - RNA, 29 nt, Human
aggcaggcggguggggguggggggacccc

SEQ ID NO: 1203337 - RNA, 21 nt, Human
aggcgggugggggugggagug

SEQ ID NO: 1203338 - RNA, 25 nt, Human
cacccagcacaggggcagggccugc

SEQ ID NO: 1203339 - RNA, 18 nt, Human
cacuguggccugcucucc

SEQ ID NO: 1203340 - RNA, 22 nt, Human
cacuguggccugcucuccuggc

SEQ ID NO: 1203341 - RNA, 18 nt, Human
cgggaacagcuggagcug

SEQ ID NO: 1203342 - RNA, 20 nt, Human
gaagcggaggcaggcgggug

SEQ ID NO: 1203343 - RNA, 18 nt, Human
gagugccauauuugcagu

SEQ ID NO: 1203344 - RNA, 18 nt, Human
ggaggcaggcgggugggg

SEQ ID NO: 1203345 - RNA, 18 nt, Human
ggaguagcccaggccuag

SEQ ID NO: 1203346 - RNA, 23 nt, Human
ggcagggccugcaggaaggccuc

SEQ ID NO: 1203347 - RNA, 22 nt, Human
uggccugcucuccuggcaccca

SEQ ID NO: 1203348 - RNA, 18 nt, Human
aaguaggaggcugggucu

SEQ ID NO: 1203349 - RNA, 19 nt, Human
accuggggcugaucacauc

SEQ ID NO: 1203350 - RNA, 22 nt, Human
acggcgcaggcccaguagcugc

SEQ ID NO: 1203351 - RNA, 22 nt, Human
agcagcaggggcagcccuggaa

SEQ ID NO: 1203352 - RNA, 22 nt, Human
agcagccggucagcagccagca

SEQ ID NO: 1203353 - RNA, 20 nt, Human
agccacgucgcccaggaccc

SEQ ID NO: 1203354 - RNA, 22 nt, Human
agccagcagcaggggcagcccu

SEQ ID NO: 1203355 - RNA, 24 nt, Human
agccagccgcucucggcuugcgcc

SEQ ID NO: 1203356 - RNA, 19 nt, Human
agcccgacgcccaccuuga

SEQ ID NO: 1203357 - RNA, 23 nt, Human
cagcagcaggggcagcccuggaa

SEQ ID NO: 1203358 - RNA, 20 nt, Human
cagcccgacgcccaccuuga

SEQ ID NO: 1203359 - RNA, 25 nt, Human
ccacgucgcccaggaccacauccag

SEQ ID NO: 1203360 - RNA, 25 nt, Human
ccccagcggcuaucgaggaagaagu

SEQ ID NO: 1203361 - RNA, 21 nt, Human
ccgacgcccaccuugaccaag

SEQ ID NO: 1203362 - RNA, 21 nt, Human
ccgcugucgugcccgcugucc

SEQ ID NO: 1203363 - RNA, 20 nt, Human
cggucagcagccagcagcag

SEQ ID NO: 1203364 - RNA, 18 nt, Human
cucggcuugcgccccagc

SEQ ID NO: 1203365 - RNA, 19 nt, Human
gaccaaguaggaggcuggg

SEQ ID NO: 1203366 - RNA, 19 nt, Human
gaccacauccacacucagg

SEQ ID NO: 1203367 - RNA, 20 nt, Human
gcaggggcagcccuggaaca

SEQ ID NO: 1203368 - RNA, 20 nt, Human
gcccaggaccacauccacac

SEQ ID NO: 1203369 - RNA, 23 nt, Human
gcccgcuguccgggucguaccug

SEQ ID NO: 1203370 - RNA, 24 nt, Human
gcccuggaacacuccguacugcuc

SEQ ID NO: 1203371 - RNA, 22 nt, Human
uaccuggggcugaucacaucgg

SEQ ID NO: 1203372 - RNA, 26 nt, Human
uaccuggggcugaucacaucgggggc

SEQ ID NO: 1203373 - RNA, 20 nt, Human
uaggaaagcgaaggguggcg

SEQ ID NO: 1203374 - RNA, 19 nt, Human
ucagcagccagcagcaggg

SEQ ID NO: 1203375 - RNA, 20 nt, Human
uccacuguggcauccucggc

SEQ ID NO: 1203376 - RNA, 18 nt, Human
uccgggucguaccugggg

SEQ ID NO: 1203377 - RNA, 22 nt, Human
uggggcugaucacaucgggggc

SEQ ID NO: 1203378 - RNA, 18 nt, Human
aaggaaucacauugccac

SEQ ID NO: 1203379 - RNA, 23 nt, Human
acauugccacaucuccuucuggc

SEQ ID NO: 1203380 - RNA, 22 nt, Human
aucuccuucuggcugcgcacug

SEQ ID NO: 1203381 - RNA, 20 nt, Human
cacuguaagccaggcguccu

SEQ ID NO: 1203382 - RNA, 20 nt, Human
cacuguaagccaggcguccu

SEQ ID NO: 1203383 - RNA, 21 nt, Human
uaagccaggcguccuugguuc

SEQ ID NO: 1203384 - RNA, 21 nt, Human
uacaaaaggaaucacauugcc

SEQ ID NO: 1203385 - RNA, 22 nt, Human
uacaugcuuuuuuaaaaucaau

SEQ ID NO: 1203386 - RNA, 25 nt, Human
ucccucugggcacgcgcagcgucug

SEQ ID NO: 1203387 - RNA, 24 nt, Human
ugccacaucuccuucuggcugcgc

SEQ ID NO: 1203388 - RNA, 19 nt, Human
uggcugcgcacuguaagcc

SEQ ID NO: 1203389 - RNA, 24 nt, Human
cgacuagguuaauuccuaaggugc

SEQ ID NO: 1203390 - RNA, 21 nt, Human
gaugcugccuuccccgcuuac

SEQ ID NO: 1203391 - RNA, 24 nt, Human
uccuaaggugcagucaugugaggu

SEQ ID NO: 1203392 - RNA, 21 nt, Human
cugacaccgaggggccuugag

SEQ ID NO: 1203393 - RNA, 20 nt, Human
agcuauuuauuaaagaacca

SEQ ID NO: 1203394 - RNA, 19 nt, Human
aaaacguucauaucgcgcc

SEQ ID NO: 1203395 - RNA, 20 nt, Human
aaaaugaacauguaaaugcc

SEQ ID NO: 1203396 - RNA, 21 nt, Human
aacaaaacguucauaucgcgc

SEQ ID NO: 1203397 - RNA, 21 nt, Human
aacaccuuccauaacaucuuu

SEQ ID NO: 1203398 - RNA, 21 nt, Human
aauucgccgcuuuucuuccuc

SEQ ID NO: 1203399 - RNA, 18 nt, Human
agucaagacacucucucu

SEQ ID NO: 1203400 - RNA, 20 nt, Human
cacuccgcgcgaccgagagc

SEQ ID NO: 1203401 - RNA, 23 nt, Human
cacugcaagcgcugcaaugaacu

SEQ ID NO: 1203402 - RNA, 18 nt, Human
caguaacaccuuccauaa

SEQ ID NO: 1203403 - RNA, 26 nt, Human
ccacugggcuuauuaaauggcugcau

SEQ ID NO: 1203404 - RNA, 18 nt, Human
ccguauuucucacuguuu

SEQ ID NO: 1203405 - RNA, 20 nt, Human
ccuuggcggcgcuaggcuga

SEQ ID NO: 1203406 - RNA, 20 nt, Human
cuccuucuauuugcugaucc

SEQ ID NO: 1203407 - RNA, 27 nt, Human
cuguauaugaucuaauguuuccuuccu

SEQ ID NO: 1203408 - RNA, 18 nt, Human
cuuaucuucuccauaggu

SEQ ID NO: 1203409 - RNA, 25 nt, Human
gcugcaaugaacugucucuaccuuc

SEQ ID NO: 1203410 - RNA, 21 nt, Human
uaguuuguuucuguauaugau

SEQ ID NO: 1203411 - RNA, 21 nt, Human
uauaaacacugcaagcgcugc

SEQ ID NO: 1203412 - RNA, 22 nt, Human
uauaaacacugcaagcgcugca

SEQ ID NO: 1203413 - RNA, 21 nt, Human
uauuccucuugcagcagcaac

SEQ ID NO: 1203414 - RNA, 23 nt, Human
uauuucucacuguuuuuuucucu

SEQ ID NO: 1203415 - RNA, 20 nt, Human
ucaaucuucucuucauccuc

SEQ ID NO: 1203416 - RNA, 22 nt, Human
ucaaucuucucuucauccuccu

SEQ ID NO: 1203417 - RNA, 24 nt, Human
ucaaucuucucuucauccuccuca

SEQ ID NO: 1203418 - RNA, 21 nt, Human
ucacuguuuuuuucucuucug

SEQ ID NO: 1203419 - RNA, 25 nt, Human
uccacacgaucacuccgcgcgaccg

SEQ ID NO: 1203420 - RNA, 19 nt, Human
ucuguuugauuauuugucu

SEQ ID NO: 1203421 - RNA, 19 nt, Human
ugaucaucuacaguaacac

SEQ ID NO: 1203422 - RNA, 19 nt, Human
ugcaagcgcugcaaugaac

SEQ ID NO: 1203423 - RNA, 21 nt, Human
ugcaaugaacugucucuaccu

SEQ ID NO: 1203424 - RNA, 21 nt, Human
ugcugaggcuuaucuucucca

SEQ ID NO: 1203425 - RNA, 22 nt, Human
uguaaagcagggauauaaacac

SEQ ID NO: 1203426 - RNA, 21 nt, Human
ugugaagaacuuuccagaugc

SEQ ID NO: 1203427 - RNA, 21 nt, Human
ugugaucaucuacaguaacac

SEQ ID NO: 1203428 - RNA, 18 nt, Human
uucaaaaggauucucacc

SEQ ID NO: 1203429 - RNA, 23 nt, Human
uucaucaugugaucaucuacagu

SEQ ID NO: 1203430 - RNA, 26 nt, Human
uucuccauagguuuugcuaguuuggg

SEQ ID NO: 1203431 - RNA, 19 nt, Human
uugcuaguuuggguuucuu

SEQ ID NO: 1203432 - RNA, 18 nt, Human
uguuagaggagccacugc

SEQ ID NO: 1203433 - RNA, 23 nt, Human
acgcugcagagaucgagugugug

SEQ ID NO: 1203434 - RNA, 20 nt, Human
cgagugugugcaccacgacc

SEQ ID NO: 1203435 - RNA, 20 nt, Human
uccagagacugcgccugucc

SEQ ID NO: 1203436 - RNA, 23 nt, Human
ucgagugugugcaccacgaccug

SEQ ID NO: 1203437 - RNA, 18 nt, Human
ucgccggcagccuggguu

SEQ ID NO: 1203438 - RNA, 19 nt, Human
ucgccggcagccuggguuc

SEQ ID NO: 1203439 - RNA, 24 nt, Human
ucgccggcagccuggguucuucuu

SEQ ID NO: 1203440 - RNA, 26 nt, Human
ugauaacaaccucauuuuguacuuca

SEQ ID NO: 1203441 - RNA, 20 nt, Human
uagguuucagcaccuccaac

SEQ ID NO: 1203442 - RNA, 22 nt, Human
uccuagaggcaaggaagaagag

SEQ ID NO: 1203443 - RNA, 18 nt, Human
uucagcaccuccaacucc

SEQ ID NO: 1203444 - RNA, 23 nt, Human
aguguucacucccugacuugggg

SEQ ID NO: 1203445 - RNA, 21 nt, Human
guguucacucccugacuuggg

SEQ ID NO: 1203446 - RNA, 21 nt, Human
gagccucaguuuaucuuccug

SEQ ID NO: 1203447 - RNA, 23 nt, Human
gagccucaguuuaucuuccuggu

SEQ ID NO: 1203448 - RNA, 22 nt, Human
uuccugaaucagucuauggggg

SEQ ID NO: 1203449 - RNA, 22 nt, Human
gauucggaauccagcucugcca

SEQ ID NO: 1203450 - RNA, 21 nt, Human
cccgugggcacucaguaaaca

SEQ ID NO: 1203451 - RNA, 18 nt, Human
ccgcgacgucccgccagg

SEQ ID NO: 1203452 - RNA, 18 nt, Human
ugggcacucaguaaacau

SEQ ID NO: 1203453 - RNA, 21 nt, Human
acagaggacagcccgugguca

SEQ ID NO: 1203454 - RNA, 25 nt, Human
caccacagccacagaggacagcccg

SEQ ID NO: 1203455 - RNA, 23 nt, Human
cagaggacagcccguggucacuc

SEQ ID NO: 1203456 - RNA, 20 nt, Human
ccacagaggacagcccgugg

SEQ ID NO: 1203457 - RNA, 24 nt, Human
aacagcacugacaacaaucacagg

SEQ ID NO: 1203458 - RNA, 19 nt, Human
aagcccuccacccugcucc

SEQ ID NO: 1203459 - RNA, 20 nt, Human
aaguacccagggggacaguc

SEQ ID NO: 1203460 - RNA, 23 nt, Human
aauacaaggaauaacagcacuga

SEQ ID NO: 1203461 - RNA, 26 nt, Human
acaaggaauaacagcacugacaacaa

SEQ ID NO: 1203462 - RNA, 19 nt, Human
acccaguucacacuccccc

SEQ ID NO: 1203463 - RNA, 19 nt, Human
accggaugcagaaguccug

SEQ ID NO: 1203464 - RNA, 19 nt, Human
agagagcagcccaugauca

SEQ ID NO: 1203465 - RNA, 23 nt, Human
agagagcagcccaugaucaccau

SEQ ID NO: 1203466 - RNA, 18 nt, Human
agagggugggaggugagg

SEQ ID NO: 1203467 - RNA, 22 nt, Human
agagggugggaggugaggaggc

SEQ ID NO: 1203468 - RNA, 21 nt, Human
agcagcccaugaucaccauca

SEQ ID NO: 1203469 - RNA, 18 nt, Human
aggagagaaccgcaacac

SEQ ID NO: 1203470 - RNA, 18 nt, Human
aggcagagggugggaggu

SEQ ID NO: 1203471 - RNA, 23 nt, Human
aggcagagggugggaggugagga

SEQ ID NO: 1203472 - RNA, 23 nt, Human
cacagcagcaucaggguagugac

SEQ ID NO: 1203473 - RNA, 19 nt, Human
cacaucaagcccuccaccc

SEQ ID NO: 1203474 - RNA, 24 nt, Human
cacaucaagcccuccacccugcuc

SEQ ID NO: 1203475 - RNA, 25 nt, Human
cacccugcuccaguccugcuaggag

SEQ ID NO: 1203476 - RNA, 21 nt, Human
caccgggaauuguggaggcca

SEQ ID NO: 1203477 - RNA, 20 nt, Human
cacuguugguaauacaagga

SEQ ID NO: 1203478 - RNA, 21 nt, Human
cagagagcagcccaugaucac

SEQ ID NO: 1203479 - RNA, 20 nt, Human
cagcaugacauaucucccuu

SEQ ID NO: 1203480 - RNA, 24 nt, Human
cagcccaugaucaccaucacauca

SEQ ID NO: 1203481 - RNA, 23 nt, Human
cagcucucacaaguggccccaca

SEQ ID NO: 1203482 - RNA, 21 nt, Human
caggaagagccucugcuggca

SEQ ID NO: 1203483 - RNA, 25 nt, Human
caggccagugcccacuacugacgcc

SEQ ID NO: 1203484 - RNA, 22 nt, Human
cagguggaacagccguucuccu

SEQ ID NO: 1203485 - RNA, 19 nt, Human
ccagaguuuucuaacaccg

SEQ ID NO: 1203486 - RNA, 22 nt, Human
ccccaggccagugcccacuacu

SEQ ID NO: 1203487 - RNA, 18 nt, Human
ccccauuccuucuucugc

SEQ ID NO: 1203488 - RNA, 25 nt, Human
ccccauuccuucuucugcuccccaa

SEQ ID NO: 1203489 - RNA, 18 nt, Human
ccccccaggccagugccc

SEQ ID NO: 1203490 - RNA, 20 nt, Human
cccguguguucuggugggcc

SEQ ID NO: 1203491 - RNA, 19 nt, Human
ccugugcaguugcccccca

SEQ ID NO: 1203492 - RNA, 18 nt, Human
ccuucaguccucccgccu

SEQ ID NO: 1203493 - RNA, 25 nt, Human
cggcgggcaggugggcagacacuuc

SEQ ID NO: 1203494 - RNA, 24 nt, Human
cgggcaggugggcagacacuuccc

SEQ ID NO: 1203495 - RNA, 26 nt, Human
cgguucagggcgagcauguccacggg

SEQ ID NO: 1203496 - RNA, 22 nt, Human
cucccgccuugacugccagaga

SEQ ID NO: 1203497 - RNA, 23 nt, Human
gaugccuucccggcggaugaaca

SEQ ID NO: 1203498 - RNA, 20 nt, Human
gccccagaguuuucuaacac

SEQ ID NO: 1203499 - RNA, 22 nt, Human
gccccagggacccaguucacac

SEQ ID NO: 1203500 - RNA, 21 nt, Human
ggagaaaucaacccagaggga

SEQ ID NO: 1203501 - RNA, 19 nt, Human
ggcaccagcaaaggcagag

SEQ ID NO: 1203502 - RNA, 19 nt, Human
ggcagccacacuguggugu

SEQ ID NO: 1203503 - RNA, 21 nt, Human
ggccaaagugcccggcgggca

SEQ ID NO: 1203504 - RNA, 23 nt, Human
ggccagugcccacuacugacgcc

SEQ ID NO: 1203505 - RNA, 19 nt, Human
gugcugugcugaggccuuc

SEQ ID NO: 1203506 - RNA, 19 nt, Human
gugggcaccagcaaaggca

SEQ ID NO: 1203507 - RNA, 25 nt, Human
guuggaaccagauuguccuucaguc

SEQ ID NO: 1203508 - RNA, 23 nt, Human
uacagccugugcaguugcccccc

SEQ ID NO: 1203509 - RNA, 21 nt, Human
ucacugaggauguugucacug

SEQ ID NO: 1203510 - RNA, 19 nt, Human
ucagggcgagcauguccac

SEQ ID NO: 1203511 - RNA, 21 nt, Human
uccccauuccuucuucugcuc

SEQ ID NO: 1203512 - RNA, 18 nt, Human
ucccggcggaugaacagg

SEQ ID NO: 1203513 - RNA, 22 nt, Human
uccuggcugaagcagcucucac

SEQ ID NO: 1203514 - RNA, 22 nt, Human
ucuaacaccgggaauuguggag

SEQ ID NO: 1203515 - RNA, 20 nt, Human
ucuccucugagcagaugauu

SEQ ID NO: 1203516 - RNA, 27 nt, Human
ucuucgguguccgcuugaccucacuuu

SEQ ID NO: 1203517 - RNA, 28 nt, Human
ugacaagccuggcugcgaccuguuccug

SEQ ID NO: 1203518 - RNA, 24 nt, Human
ugacgccuugcuaaguucccagug

SEQ ID NO: 1203519 - RNA, 24 nt, Human
ugcaccuguugaccuccuggccgc

SEQ ID NO: 1203520 - RNA, 25 nt, Human
ugcuaggagagaaccgcaacacgac

SEQ ID NO: 1203521 - RNA, 21 nt, Human
ugcugaggccuucuucggugu

SEQ ID NO: 1203522 - RNA, 19 nt, Human
ugcuucuuccuucgguuca

SEQ ID NO: 1203523 - RNA, 20 nt, Human
uggcugaagcagcucucaca

SEQ ID NO: 1203524 - RNA, 21 nt, Human
ugggaggugaggaggccugaa

SEQ ID NO: 1203525 - RNA, 23 nt, Human
ugugugugcaggggcuccagccg

SEQ ID NO: 1203526 - RNA, 18 nt, Human
agaaggaagggagggcag

SEQ ID NO: 1203527 - RNA, 23 nt, Human
agcggauggggucguuuuugacc

SEQ ID NO: 1203528 - RNA, 26 nt, Human
agcugccucucucccacaacccccau

SEQ ID NO: 1203529 - RNA, 25 nt, Human
aggaagggagggcagcaguuccuug

SEQ ID NO: 1203530 - RNA, 23 nt, Human
auucuagggaccacugauuugga

SEQ ID NO: 1203531 - RNA, 22 nt, Human
cagcugccucucucccacaacc

SEQ ID NO: 1203532 - RNA, 22 nt, Human
ccaucagguuucugggaacaga

SEQ ID NO: 1203533 - RNA, 20 nt, Human
ccucucucccacaaccccca

SEQ ID NO: 1203534 - RNA, 19 nt, Human
ccucugaaguucucagcuu

SEQ ID NO: 1203535 - RNA, 19 nt, Human
cugccucucucccacaacc

SEQ ID NO: 1203536 - RNA, 22 nt, Human
gagagggacugagauacuccag

SEQ ID NO: 1203537 - RNA, 18 nt, Human
ggaagugguccuuuugga

SEQ ID NO: 1203538 - RNA, 19 nt, Human
ucccagcugccucucuccc

SEQ ID NO: 1203539 - RNA, 23 nt, Human
ucucccacaacccccauccacug

SEQ ID NO: 1203540 - RNA, 27 nt, Human
ucucccacaacccccauccacugagag

SEQ ID NO: 1203541 - RNA, 18 nt, Human
ucucccagcugccucucu

SEQ ID NO: 1203542 - RNA, 19 nt, Human
ucucccagcugccucucuc

SEQ ID NO: 1203543 - RNA, 23 nt, Human
ucucucccacaacccccauccac

SEQ ID NO: 1203544 - RNA, 24 nt, Human
ucucuggaugcaccucugaaguuc

SEQ ID NO: 1203545 - RNA, 21 nt, Human
ugauuuggacagcaacucagc

SEQ ID NO: 1203546 - RNA, 22 nt, Human
ugcucaaggcauucuggcuuca

SEQ ID NO: 1203547 - RNA, 24 nt, Human
uggcauugaccaucagguuucugg

SEQ ID NO: 1203548 - RNA, 24 nt, Human
ugucucccagcugccucucuccca

SEQ ID NO: 1203549 - RNA, 18 nt, Human
uuaaguagaaggaaggga

SEQ ID NO: 1203550 - RNA, 28 nt, Human
uucuagggaccacugauuuuccuggugg

SEQ ID NO: 1203551 - RNA, 20 nt, Human
uucucuggaugcaccucuga

SEQ ID NO: 1203552 - RNA, 21 nt, Human
uuugaccgucugugucuuccu

SEQ ID NO: 1203553 - RNA, 18 nt, Human
uuuggacagcaacucagc

SEQ ID NO: 1203554 - RNA, 19 nt, Human
uaguagguuucucacccug

SEQ ID NO: 1203555 - RNA, 22 nt, Human
uaguagguuucucacccugccu

SEQ ID NO: 1203556 - RNA, 29 nt, Human
uccaaguuauuccuccuuuuccaugagaa

SEQ ID NO: 1203557 - RNA, 24 nt, Human
uggccugugcuugcagcuuaguag

SEQ ID NO: 1203558 - RNA, 21 nt, Human
gaaaauacagcuucuguagca

SEQ ID NO: 1203559 - RNA, 20 nt, Human
ucuguagcaucguuagccuu

SEQ ID NO: 1203560 - RNA, 22 nt, Human
accgaggugggaaaacggggcg

SEQ ID NO: 1203561 - RNA, 18 nt, Human
agagucggcagcggggag

SEQ ID NO: 1203562 - RNA, 24 nt, Human
aggugggaaaacggggcggggccg

SEQ ID NO: 1203563 - RNA, 20 nt, Human
augcugggaaccuggggcag

SEQ ID NO: 1203564 - RNA, 19 nt, Human
gaaccuggggcagagucgg

SEQ ID NO: 1203565 - RNA, 19 nt, Human
ggagggggcgaccgaggug

SEQ ID NO: 1203566 - RNA, 20 nt, Human
ggccggagacgacuccaggg

SEQ ID NO: 1203567 - RNA, 19 nt, Human
gggcagagucggcagcggg

SEQ ID NO: 1203568 - RNA, 21 nt, Human
gugggaaaacggggcggggcc

SEQ ID NO: 1203569 - RNA, 25 nt, Human
uccagggcugggugaggcgcugacc

SEQ ID NO: 1203570 - RNA, 19 nt, Human
ugcugggaaccuggggcag

SEQ ID NO: 1203571 - RNA, 20 nt, Human
ugggaaaacggggcggggcc

SEQ ID NO: 1203572 - RNA, 19 nt, Human
uguggucagaaugcuggga

SEQ ID NO: 1203573 - RNA, 21 nt, Human
uuguggucagaaugcugggaa

SEQ ID NO: 1203574 - RNA, 23 nt, Human
aaaagacucaaacaucuucucug

SEQ ID NO: 1203575 - RNA, 27 nt, Human
aaacaucuucucugacguggguccccu

SEQ ID NO: 1203576 - RNA, 25 nt, Human
aagaaaaaaacauuguacuugggga

SEQ ID NO: 1203577 - RNA, 18 nt, Human
aaguucuccauguucuuc

SEQ ID NO: 1203578 - RNA, 20 nt, Human
acagaaagaggcucaacaaa

SEQ ID NO: 1203579 - RNA, 18 nt, Human
acccauuuaucuccuucu

SEQ ID NO: 1203580 - RNA, 20 nt, Human
agacacagaaagaggcucaa

SEQ ID NO: 1203581 - RNA, 19 nt, Human
agagacacagaaagaggcu

SEQ ID NO: 1203582 - RNA, 21 nt, Human
agccgcgaaaagacucaaaca

SEQ ID NO: 1203583 - RNA, 18 nt, Human
aggcaaacugaggccagc

SEQ ID NO: 1203584 - RNA, 19 nt, Human
aggcaagaaaaaaacauug

SEQ ID NO: 1203585 - RNA, 26 nt, Human
aggcaagaaaaaaacauuguacuugg

SEQ ID NO: 1203586 - RNA, 24 nt, Human
aggggugggguuccuaaagggugg

SEQ ID NO: 1203587 - RNA, 19 nt, Human
aguggacccauuuaucucc

SEQ ID NO: 1203588 - RNA, 24 nt, Human
aucuucucugacguggguccgcug

SEQ ID NO: 1203589 - RNA, 19 nt, Human
augcacauccucagauagc

SEQ ID NO: 1203590 - RNA, 24 nt, Human
augcagcucccaacagcuguaccc

SEQ ID NO: 1203591 - RNA, 25 nt, Human
caaacccaaaguggaaccgccguga

SEQ ID NO: 1203592 - RNA, 18 nt, Human
cacaaacccaaaguggaa

SEQ ID NO: 1203593 - RNA, 22 nt, Human
caccuccccuugccaaaaagcc

SEQ ID NO: 1203594 - RNA, 21 nt, Human
cagcaaccaccaacagcuguc

SEQ ID NO: 1203595 - RNA, 26 nt, Human
cagccccucuugaaggcaguccuuga

SEQ ID NO: 1203596 - RNA, 23 nt, Human
cagcucccaacagcuguaccccu

SEQ ID NO: 1203597 - RNA, 18 nt, Human
caggggacccaggcagag

SEQ ID NO: 1203598 - RNA, 21 nt, Human
caguggacccauuuaucuccu

SEQ ID NO: 1203599 - RNA, 21 nt, Human
cauuguacuuggggaguugcc

SEQ ID NO: 1203600 - RNA, 22 nt, Human
ccaaaaagccacauuucuugcc

SEQ ID NO: 1203601 - RNA, 23 nt, Human
ccaaaguggaaccgccgugaaaa

SEQ ID NO: 1203602 - RNA, 19 nt, Human
ccagguucaaaaucaccuc

SEQ ID NO: 1203603 - RNA, 22 nt, Human
ccaguggacccauuuaucuccu

SEQ ID NO: 1203604 - RNA, 23 nt, Human
cccacagucauuagggagcagcc

SEQ ID NO: 1203605 - RNA, 24 nt, Human
cccagcacugaaacaauucucuuc

SEQ ID NO: 1203606 - RNA, 27 nt, Human
ccccagcacugaaacaauucccccugg

SEQ ID NO: 1203607 - RNA, 18 nt, Human
cccucuucuucccucugg

SEQ ID NO: 1203608 - RNA, 20 nt, Human
ccgguggccugucucugugg

SEQ ID NO: 1203609 - RNA, 19 nt, Human
ccgugcagggguacaacca

SEQ ID NO: 1203610 - RNA, 20 nt, Human
ccucuggaaccacagacagg

SEQ ID NO: 1203611 - RNA, 18 nt, Human
cggccaggggacccaggc

SEQ ID NO: 1203612 - RNA, 20 nt, Human
cgugcagggguacaaccauc

SEQ ID NO: 1203613 - RNA, 20 nt, Human
cguggguccgcugaucuccc

SEQ ID NO: 1203614 - RNA, 20 nt, Human
cucacaggauggcaagcugu

SEQ ID NO: 1203615 - RNA, 24 nt, Human
cucaggcaagaaaaaaacauugua

SEQ ID NO: 1203616 - RNA, 21 nt, Human
cugacuguguuccucccuggg

SEQ ID NO: 1203617 - RNA, 23 nt, Human
cuguaccccuguugcacagucuu

SEQ ID NO: 1203618 - RNA, 21 nt, Human
cuguagguggaagugggggca

SEQ ID NO: 1203619 - RNA, 26 nt, Human
cuuccccaacacuguguccagcaccc

SEQ ID NO: 1203620 - RNA, 18 nt, Human
cuuggcuucuguaacagg

SEQ ID NO: 1203621 - RNA, 24 nt, Human
cuuucauuucuuuccaacaugaaa

SEQ ID NO: 1203622 - RNA, 23 nt, Human
gaagagccgcgaaaagacucaaa

SEQ ID NO: 1203623 - RNA, 18 nt, Human
gaaguucuccauguucuu

SEQ ID NO: 1203624 - RNA, 23 nt, Human
gacuguagugugcaagauugugu

SEQ ID NO: 1203625 - RNA, 18 nt, Human
gccagguucaaaaucacc

SEQ ID NO: 1203626 - RNA, 25 nt, Human
ggagaugcacauccucagauagccc

SEQ ID NO: 1203627 - RNA, 19 nt, Human
ggggaguugccuuugauca

SEQ ID NO: 1203628 - RNA, 18 nt, Human
gugaggcagaggggagcc

SEQ ID NO: 1203629 - RNA, 24 nt, Human
uaaggggugggguuccuaaagggu

SEQ ID NO: 1203630 - RNA, 23 nt, Human
uacuuggggaguugccuuugauc

SEQ ID NO: 1203631 - RNA, 18 nt, Human
uagguggaagugggggca

SEQ ID NO: 1203632 - RNA, 23 nt, Human
ucacaaacccaaaguggaaccgc

SEQ ID NO: 1203633 - RNA, 19 nt, Human
ucagauagcccacagucau

SEQ ID NO: 1203634 - RNA, 23 nt, Human
ucaggcaagaaaaaaacauugua

SEQ ID NO: 1203635 - RNA, 19 nt, Human
uccccugguacuccacacc

SEQ ID NO: 1203636 - RNA, 20 nt, Human
uccgguggccugucucugug

SEQ ID NO: 1203637 - RNA, 19 nt, Human
uccucccugggaaauaauu

SEQ ID NO: 1203638 - RNA, 24 nt, Human
uccucucaugaucgaggacuucac

SEQ ID NO: 1203639 - RNA, 21 nt, Human
uccuuggugacuguagugugc

SEQ ID NO: 1203640 - RNA, 18 nt, Human
ucugcccucccccagcac

SEQ ID NO: 1203641 - RNA, 18 nt, Human
ucugcccucccccagcac

SEQ ID NO: 1203642 - RNA, 22 nt, Human
ucuguaacaggcaaacugaggc

SEQ ID NO: 1203643 - RNA, 18 nt, Human
ugcccucccccagcacug

SEQ ID NO: 1203644 - RNA, 18 nt, Human
ugcuuaucugcaagucug

SEQ ID NO: 1203645 - RNA, 23 nt, Human
uggaaccacagacagggagacug

SEQ ID NO: 1203646 - RNA, 19 nt, Human
uggaaggaaaagcgcuugg

SEQ ID NO: 1203647 - RNA, 22 nt, Human
uggaagugggggcauugucaca

SEQ ID NO: 1203648 - RNA, 20 nt, Human
uggaggugggucugcuccuc

SEQ ID NO: 1203649 - RNA, 21 nt, Human
uggcugacaacugccagguuc

SEQ ID NO: 1203650 - RNA, 22 nt, Human
uguaacaggcaaacugaggcca

SEQ ID NO: 1203651 - RNA, 19 nt, Human
ugugaccguugcucuccag

SEQ ID NO: 1203652 - RNA, 26 nt, Human
ugugugcgguuugguuucuaaucuuu

SEQ ID NO: 1203653 - RNA, 23 nt, Human
uguuagcccuuggcuucuguaac

SEQ ID NO: 1203654 - RNA, 22 nt, Human
uguugcacagucuuccccaaca

SEQ ID NO: 1203655 - RNA, 27 nt, Human
uguuuugcuuucucaaauaauucccca

SEQ ID NO: 1203656 - RNA, 22 nt, Human
uguuuuguuuugcuuucucaaa

SEQ ID NO: 1203657 - RNA, 22 nt, Human
uuagcccuuggcuucuguaaca

SEQ ID NO: 1203658 - RNA, 22 nt, Human
uucacaaacccaaaguggaacc

SEQ ID NO: 1203659 - RNA, 21 nt, Human
uuccccaacacuguguccagc

SEQ ID NO: 1203660 - RNA, 21 nt, Human
uuccucccugggaaauaauuc

SEQ ID NO: 1203661 - RNA, 24 nt, Human
uuccuggcuuccucuugcugacug

SEQ ID NO: 1203662 - RNA, 27 nt, Human
uugccuuugaucaaagaaagggguaau

SEQ ID NO: 1203663 - RNA, 23 nt, Human
uuggaggugggucugcuccucuc

SEQ ID NO: 1203664 - RNA, 24 nt, Human
uuuuccccucuucuucccucugga

SEQ ID NO: 1203665 - RNA, 21 nt, Human
aacacagccaagucugaaucc

SEQ ID NO: 1203666 - RNA, 18 nt, Human
cacagccaagucugaauc

SEQ ID NO: 1203667 - RNA, 21 nt, Human
cagcucagucaacacagccaa

SEQ ID NO: 1203668 - RNA, 21 nt, Human
cagcuggucucucugcagccu

SEQ ID NO: 1203669 - RNA, 21 nt, Human
caguagaaaaauagaugaugc

SEQ ID NO: 1203670 - RNA, 22 nt, Human
ccagcucagucaacacagccaa

SEQ ID NO: 1203671 - RNA, 25 nt, Human
ccugcggagguagggacgccugggg

SEQ ID NO: 1203672 - RNA, 20 nt, Human
ccuggggagguggggguacc

SEQ ID NO: 1203673 - RNA, 20 nt, Human
gagguagggacgccugggga

SEQ ID NO: 1203674 - RNA, 24 nt, Human
gccugcggagguagggacgccugg

SEQ ID NO: 1203675 - RNA, 19 nt, Human
ggaggcggguauuccuggg

SEQ ID NO: 1203676 - RNA, 22 nt, Human
ggguauuccuggggaggagggg

SEQ ID NO: 1203677 - RNA, 22 nt, Human
uagaaaaauagaugaugcuuaa

SEQ ID NO: 1203678 - RNA, 18 nt, Human
uagcagauucuuccuacu

SEQ ID NO: 1203679 - RNA, 22 nt, Human
uggggaggcggggguaccuggg

SEQ ID NO: 1203680 - RNA, 22 nt, Human
uggggagguggggguacccggg

SEQ ID NO: 1203681 - RNA, 22 nt, Human
uggggagguggggguacccggg

SEQ ID NO: 1203682 - RNA, 23 nt, Human
uggggagguggggguacccgggg

SEQ ID NO: 1203683 - RNA, 25 nt, Human
uggggagguggggguacccggggag

SEQ ID NO: 1203684 - RNA, 19 nt, Human
aagcggccuguggacagga

SEQ ID NO: 1203685 - RNA, 19 nt, Human
agaguggugugcuccucuu

SEQ ID NO: 1203686 - RNA, 21 nt, Human
caaugagcaccugugaggccu

SEQ ID NO: 1203687 - RNA, 21 nt, Human
caaugagcuccuguggggcuu

SEQ ID NO: 1203688 - RNA, 19 nt, Human
ccgccuucuugaaggucug

SEQ ID NO: 1203689 - RNA, 21 nt, Human
cgggaaaagauacaaccucau

SEQ ID NO: 1203690 - RNA, 23 nt, Human
cuagagucacacccuggguugac

SEQ ID NO: 1203691 - RNA, 22 nt, Human
cugagaguggugugcuccucuu

SEQ ID NO: 1203692 - RNA, 19 nt, Human
cugugggcacccuccuggg

SEQ ID NO: 1203693 - RNA, 23 nt, Human
cuuccuggauuucugaaugaggg

SEQ ID NO: 1203694 - RNA, 19 nt, Human
gcccugacaggugucuucu

SEQ ID NO: 1203695 - RNA, 23 nt, Human
gcccugacaggugucuucuucug

SEQ ID NO: 1203696 - RNA, 19 nt, Human
gucacacccuggguugacc

SEQ ID NO: 1203697 - RNA, 22 nt, Human
ucagaagacccgggaaaagaua

SEQ ID NO: 1203698 - RNA, 24 nt, Human
uccuucuccgucgcugugucgaac

SEQ ID NO: 1203699 - RNA, 20 nt, Human
ucgcugugucgaacucuucc

SEQ ID NO: 1203700 - RNA, 22 nt, Human
ucgcugugucgaacucuuccug

SEQ ID NO: 1203701 - RNA, 21 nt, Human
ucuccugcaaaacaaugagcu

SEQ ID NO: 1203702 - RNA, 26 nt, Human
ucugugggcacccuccugggggugga

SEQ ID NO: 1203703 - RNA, 23 nt, Human
ucuuccuggauuucugaaugagg

SEQ ID NO: 1203704 - RNA, 18 nt, Human
ugacguggguccacuccu

SEQ ID NO: 1203705 - RNA, 19 nt, Human
uggcuggguuguggucauc

SEQ ID NO: 1203706 - RNA, 20 nt, Human
ugugggcacccuccuggggg

SEQ ID NO: 1203707 - RNA, 30 nt, Human
uucuccgucgcugugucgaacucuuccugg

SEQ ID NO: 1203708 - RNA, 23 nt, Human
uugaaggucugugggcacccucc

SEQ ID NO: 1203709 - RNA, 22 nt, Human
aaccaagaagggaguggaaugg

SEQ ID NO: 1203710 - RNA, 23 nt, Human
aaggaggagaauuuuucugaacc

SEQ ID NO: 1203711 - RNA, 19 nt, Human
agagcagggugaggggcag

SEQ ID NO: 1203712 - RNA, 19 nt, Human
aggcagagccggaaggggg

SEQ ID NO: 1203713 - RNA, 21 nt, Human
aggcagagccggaagggggac

SEQ ID NO: 1203714 - RNA, 25 nt, Human
aguugggugcuuucccccggggccc

SEQ ID NO: 1203715 - RNA, 19 nt, Human
aucccguuccaagcagacu

SEQ ID NO: 1203716 - RNA, 18 nt, Human
auggcaccaucccuccca

SEQ ID NO: 1203717 - RNA, 21 nt, Human
caaguaggugcuuuauaauau

SEQ ID NO: 1203718 - RNA, 24 nt, Human
cacagguguaagcuccaggagagc

SEQ ID NO: 1203719 - RNA, 22 nt, Human
cccacuuaucccguuccaagca

SEQ ID NO: 1203720 - RNA, 19 nt, Human
ccccauccgcccgcgccug

SEQ ID NO: 1203721 - RNA, 23 nt, Human
cccccggggcccgcagggacguc

SEQ ID NO: 1203722 - RNA, 20 nt, Human
ccggaucgaugcucucugcu

SEQ ID NO: 1203723 - RNA, 27 nt, Human
cucucugcucucgcucuuuucccuuug

SEQ ID NO: 1203724 - RNA, 19 nt, Human
gcccgcgccugccggugcc

SEQ ID NO: 1203725 - RNA, 18 nt, Human
ggaauggacaugccgggc

SEQ ID NO: 1203726 - RNA, 21 nt, Human
ggcagccaguauucagggcag

SEQ ID NO: 1203727 - RNA, 21 nt, Human
ggggacgggaguuugugggcc

SEQ ID NO: 1203728 - RNA, 18 nt, Human
ggggcccgcagggacguc

SEQ ID NO: 1203729 - RNA, 18 nt, Human
gugcuuucccccggggcc

SEQ ID NO: 1203730 - RNA, 22 nt, Human
guucugguaguuuguaaauccu

SEQ ID NO: 1203731 - RNA, 26 nt, Human
uccagccccgucacguuucugcuaga

SEQ ID NO: 1203732 - RNA, 19 nt, Human
ucccccggggcccgcaggg

SEQ ID NO: 1203733 - RNA, 19 nt, Human
ucccuggauggcaccaucc

SEQ ID NO: 1203734 - RNA, 20 nt, Human
ucccuggauggcaccauccc

SEQ ID NO: 1203735 - RNA, 23 nt, Human
ucccuggauggcaccaucccucc

SEQ ID NO: 1203736 - RNA, 22 nt, Human
uccuuugaguuuucucuggaua

SEQ ID NO: 1203737 - RNA, 23 nt, Human
ugccagggugggguaaggccccc

SEQ ID NO: 1203738 - RNA, 19 nt, Human
uggaauggacaugccgggc

SEQ ID NO: 1203739 - RNA, 20 nt, Human
uggauacaaugaugucaucu

SEQ ID NO: 1203740 - RNA, 20 nt, Human
uggcaguugugccugguccc

SEQ ID NO: 1203741 - RNA, 23 nt, Human
uguaagcuccaggagagcagggu

SEQ ID NO: 1203742 - RNA, 25 nt, Human
uuucugcuagaagccgaggcgggag

SEQ ID NO: 1203743 - RNA, 27 nt, Human
aaaaacaccaccuucaccaccucacag

SEQ ID NO: 1203744 - RNA, 23 nt, Human
aaagcuuuugccaagcuugcacu

SEQ ID NO: 1203745 - RNA, 20 nt, Human
aacagcaccaugggggugcc

SEQ ID NO: 1203746 - RNA, 23 nt, Human
aacagcaccaugggggugcccaa

SEQ ID NO: 1203747 - RNA, 20 nt, Human
aaccaacauauucuucugcc

SEQ ID NO: 1203748 - RNA, 21 nt, Human
aacugcaggaucccgucuuug

SEQ ID NO: 1203749 - RNA, 19 nt, Human
aagagcacuggcuuggucu

SEQ ID NO: 1203750 - RNA, 21 nt, Human
aaggaacugguuccgguacuu

SEQ ID NO: 1203751 - RNA, 18 nt, Human
aaguacccuuuuaggauc

SEQ ID NO: 1203752 - RNA, 19 nt, Human
aagucagcuuuagccccaa

SEQ ID NO: 1203753 - RNA, 21 nt, Human
aagugcaggcgguacuggcuc

SEQ ID NO: 1203754 - RNA, 21 nt, Human
aaucauagucaacuuaacucc

SEQ ID NO: 1203755 - RNA, 20 nt, Human
acaaagaacacagccaacag

SEQ ID NO: 1203756 - RNA, 23 nt, Human
acaaagccuucacaguccgaguc

SEQ ID NO: 1203757 - RNA, 22 nt, Human
acaaaggcuccuguccacccuc

SEQ ID NO: 1203758 - RNA, 20 nt, Human
acacagccaacaggaaggcc

SEQ ID NO: 1203759 - RNA, 18 nt, Human
acagccaacaggaaggcc

SEQ ID NO: 1203760 - RNA, 23 nt, Human
acaucuccaccauccacgggccc

SEQ ID NO: 1203761 - RNA, 21 nt, Human
accaacauauucuucugccau

SEQ ID NO: 1203762 - RNA, 18 nt, Human
accagagcacagcugucc

SEQ ID NO: 1203763 - RNA, 19 nt, Human
accuggguuucuuagaggc

SEQ ID NO: 1203764 - RNA, 18 nt, Human
acuggauuggaauggcug

SEQ ID NO: 1203765 - RNA, 21 nt, Human
acuggauuggaauggcuguuu

SEQ ID NO: 1203766 - RNA, 22 nt, Human
agaaagguggaaaagaagucaa

SEQ ID NO: 1203767 - RNA, 23 nt, Human
agaaagguggaaaagaagucaag

SEQ ID NO: 1203768 - RNA, 23 nt, Human
agaauccuguuaaaggacaaagg

SEQ ID NO: 1203769 - RNA, 18 nt, Human
agacucggggcugagacu

SEQ ID NO: 1203770 - RNA, 22 nt, Human
agagacaaccuuggccccacug

SEQ ID NO: 1203771 - RNA, 21 nt, Human
agagaggaguugucaaaucca

SEQ ID NO: 1203772 - RNA, 19 nt, Human
agaucaacaaaggugaagg

SEQ ID NO: 1203773 - RNA, 20 nt, Human
agcaaaaagcuuuugccaag

SEQ ID NO: 1203774 - RNA, 23 nt, Human
agcgagaaggacucagaccagaa

SEQ ID NO: 1203775 - RNA, 28 nt, Human
agcggcucccagaugcuuuuggagacca

SEQ ID NO: 1203776 - RNA, 21 nt, Human
agcugcugggucugguuaagc

SEQ ID NO: 1203777 - RNA, 22 nt, Human
aggcagcgaaccauugggucca

SEQ ID NO: 1203778 - RNA, 22 nt, Human
aggccacgauccauggccccag

SEQ ID NO: 1203779 - RNA, 22 nt, Human
aggcuggaggucaggcaccugg

SEQ ID NO: 1203780 - RNA, 20 nt, Human
agggaauguagugugggaag

SEQ ID NO: 1203781 - RNA, 26 nt, Human
auagaacacuuuguucauauggauaa

SEQ ID NO: 1203782 - RNA, 19 nt, Human
auccacgggcccuccucca

SEQ ID NO: 1203783 - RNA, 18 nt, Human
augguguuggggagcuag

SEQ ID NO: 1203784 - RNA, 25 nt, Human
caaagaacacagccaacaggaaggc

SEQ ID NO: 1203785 - RNA, 19 nt, Human
caaagccuccugcaccuuc

SEQ ID NO: 1203786 - RNA, 21 nt, Human
caacagcaccaugggggugcc

SEQ ID NO: 1203787 - RNA, 21 nt, Human
caacaggcauuugccaauguu

SEQ ID NO: 1203788 - RNA, 24 nt, Human
cacaagggugcacaucuccaccau

SEQ ID NO: 1203789 - RNA, 24 nt, Human
cacaucuccaccauccacgggccc

SEQ ID NO: 1203790 - RNA, 26 nt, Human
cacccacgacaacauccccauugucu

SEQ ID NO: 1203791 - RNA, 18 nt, Human
cacccugguggacaggaa

SEQ ID NO: 1203792 - RNA, 19 nt, Human
cacccugguggacaggaac

SEQ ID NO: 1203793 - RNA, 19 nt, Human
cagaaccuucuucauggcc

SEQ ID NO: 1203794 - RNA, 22 nt, Human
cagagacaaccuuggccccacu

SEQ ID NO: 1203795 - RNA, 20 nt, Human
cagagcaaaaaacuucccac

SEQ ID NO: 1203796 - RNA, 18 nt, Human
cagaggccacgauccaug

SEQ ID NO: 1203797 - RNA, 23 nt, Human
cagcagcagcuccacaagggugc

SEQ ID NO: 1203798 - RNA, 19 nt, Human
cagccgugugcggcaggcg

SEQ ID NO: 1203799 - RNA, 19 nt, Human
cagcgagaaggacucagac

SEQ ID NO: 1203800 - RNA, 20 nt, Human
caggaagauuaucuucucca

SEQ ID NO: 1203801 - RNA, 19 nt, Human
caggacaaagaacacagcc

SEQ ID NO: 1203802 - RNA, 21 nt, Human
caggacaaagaacacagccaa

SEQ ID NO: 1203803 - RNA, 22 nt, Human
caggacagcggcucccagaugc

SEQ ID NO: 1203804 - RNA, 21 nt, Human
caggaggcagcgaaccauugg

SEQ ID NO: 1203805 - RNA, 19 nt, Human
caggcaggacagcggcucc

SEQ ID NO: 1203806 - RNA, 21 nt, Human
caguggccauggcacccacga

SEQ ID NO: 1203807 - RNA, 19 nt, Human
caucagggccaucuucugc

SEQ ID NO: 1203808 - RNA, 20 nt, Human
caucguagccaccagucacc

SEQ ID NO: 1203809 - RNA, 18 nt, Human
caugaccagagcacagcu

SEQ ID NO: 1203810 - RNA, 20 nt, Human
ccacaaccucuuuauccucc

SEQ ID NO: 1203811 - RNA, 22 nt, Human
ccacaaccucuuuauccuccaa

SEQ ID NO: 1203812 - RNA, 23 nt, Human
ccacacagcagcagcuccacaag

SEQ ID NO: 1203813 - RNA, 21 nt, Human
ccacagggaacuuccccagca

SEQ ID NO: 1203814 - RNA, 21 nt, Human
ccacauagggucugcugggcc

SEQ ID NO: 1203815 - RNA, 19 nt, Human
ccacgauccauggccccag

SEQ ID NO: 1203816 - RNA, 18 nt, Human
ccacuaaucuccagcugu

SEQ ID NO: 1203817 - RNA, 23 nt, Human
ccacuaaucuccagcuguuccgg

SEQ ID NO: 1203818 - RNA, 19 nt, Human
ccagccgaagucuagaagc

SEQ ID NO: 1203819 - RNA, 22 nt, Human
ccagcuguccucaaugucuucc

SEQ ID NO: 1203820 - RNA, 20 nt, Human
cccacacacucacugugccg

SEQ ID NO: 1203821 - RNA, 22 nt, Human
cccacacacucacugugccgcg

SEQ ID NO: 1203822 - RNA, 19 nt, Human
ccccaaggucacugcuggc

SEQ ID NO: 1203823 - RNA, 21 nt, Human
ccccagccgaagucuagaagc

SEQ ID NO: 1203824 - RNA, 21 nt, Human
cccugggccucuaaguacccu

SEQ ID NO: 1203825 - RNA, 19 nt, Human
cccuggggaggauacgggg

SEQ ID NO: 1203826 - RNA, 20 nt, Human
cccuggggaggauacggggg

SEQ ID NO: 1203827 - RNA, 22 nt, Human
ccgcaaaccugugagcaggcac

SEQ ID NO: 1203828 - RNA, 20 nt, Human
ccuccaacagcaccaugggg

SEQ ID NO: 1203829 - RNA, 22 nt, Human
ccuccaacagcaccaugggggu

SEQ ID NO: 1203830 - RNA, 22 nt, Human
ccucggagccguggcugggcca

SEQ ID NO: 1203831 - RNA, 20 nt, Human
ccucuaaguacccuuuuagg

SEQ ID NO: 1203832 - RNA, 20 nt, Human
ccucuugggcugcaagggcu

SEQ ID NO: 1203833 - RNA, 20 nt, Human
ccugcaccuucuuccagcuu

SEQ ID NO: 1203834 - RNA, 18 nt, Human
ccuggggaggauacgggg

SEQ ID NO: 1203835 - RNA, 27 nt, Human
ccuggguuucuuagaggcuuuggcugg

SEQ ID NO: 1203836 - RNA, 18 nt, Human
ccuucaaaaacagcuccu

SEQ ID NO: 1203837 - RNA, 23 nt, Human
cgacaccaggcuccgccucaggu

SEQ ID NO: 1203838 - RNA, 18 nt, Human
cgagaaggacucagacca

SEQ ID NO: 1203839 - RNA, 18 nt, Human
cggggcugagacuggaga

SEQ ID NO: 1203840 - RNA, 22 nt, Human
cgugugguaggucugccagugg

SEQ ID NO: 1203841 - RNA, 20 nt, Human
cguuucauccucuuuguaaa

SEQ ID NO: 1203842 - RNA, 23 nt, Human
cucacugugccgcgcaggcagcc

SEQ ID NO: 1203843 - RNA, 19 nt, Human
cuccaucgucuuccugccc

SEQ ID NO: 1203844 - RNA, 18 nt, Human
cucccgcuccacauaggg

SEQ ID NO: 1203845 - RNA, 22 nt, Human
cuccugaugagugaggaguugg

SEQ ID NO: 1203846 - RNA, 19 nt, Human
cugaugcuucauccagcca

SEQ ID NO: 1203847 - RNA, 23 nt, Human
cugcaacgagguucauauugugc

SEQ ID NO: 1203848 - RNA, 22 nt, Human
cugcucagcagggcagccgugu

SEQ ID NO: 1203849 - RNA, 29 nt, Human
cuggaacucacgcaucauguaauccacau

SEQ ID NO: 1203850 - RNA, 21 nt, Human
cuguccucagcccugagcucu

SEQ ID NO: 1203851 - RNA, 20 nt, Human
cuuaucugccuucccaugca

SEQ ID NO: 1203852 - RNA, 22 nt, Human
cuucagagacaaccuuggcccc

SEQ ID NO: 1203853 - RNA, 23 nt, Human
cuuuguucauauggauaauccca

SEQ ID NO: 1203854 - RNA, 21 nt, Human
gaaccgguggauuaaaaacac

SEQ ID NO: 1203855 - RNA, 19 nt, Human
gacaccaggcuccgccuca

SEQ ID NO: 1203856 - RNA, 20 nt, Human
gacagcuuuuggaguugagg

SEQ ID NO: 1203857 - RNA, 19 nt, Human
gaccacguggaaggcugac

SEQ ID NO: 1203858 - RNA, 18 nt, Human
gacuguuugcuguggauc

SEQ ID NO: 1203859 - RNA, 23 nt, Human
gagacaaccuuggccccacugga

SEQ ID NO: 1203860 - RNA, 22 nt, Human
gagcagcaggaggcagcgaacc

SEQ ID NO: 1203861 - RNA, 19 nt, Human
gagcaggcaccgcucugac

SEQ ID NO: 1203862 - RNA, 18 nt, Human
gaggucccaaggaacugg

SEQ ID NO: 1203863 - RNA, 21 nt, Human
gauucucuuacuccauccugu

SEQ ID NO: 1203864 - RNA, 22 nt, Human
gcaaagaaucccuuuccuuaaa

SEQ ID NO: 1203865 - RNA, 24 nt, Human
gcacugugggguaccuguggcugu

SEQ ID NO: 1203866 - RNA, 18 nt, Human
gccaccaggcaggacagc

SEQ ID NO: 1203867 - RNA, 20 nt, Human
gccuguggcucucagccagg

SEQ ID NO: 1203868 - RNA, 18 nt, Human
gcgaggccuggucugcag

SEQ ID NO: 1203869 - RNA, 23 nt, Human
gcgcaguaauccuugauguccca

SEQ ID NO: 1203870 - RNA, 24 nt, Human
gcgcugauaaccagcuggaaguug

SEQ ID NO: 1203871 - RNA, 19 nt, Human
ggaacuuccccagcaggcc

SEQ ID NO: 1203872 - RNA, 22 nt, Human
ggacaucagggccaucuucugc

SEQ ID NO: 1203873 - RNA, 20 nt, Human
ggcagccgugugcggcaggc

SEQ ID NO: 1203874 - RNA, 21 nt, Human
ggcuccuagaggcauugaagu

SEQ ID NO: 1203875 - RNA, 24 nt, Human
gggaagguagaagugcaggcggua

SEQ ID NO: 1203876 - RNA, 22 nt, Human
ggguuccacaggcggaugaagg

SEQ ID NO: 1203877 - RNA, 19 nt, Human
gguauggccagccacaacc

SEQ ID NO: 1203878 - RNA, 22 nt, Human
ggucacagaaagguggaaaaga

SEQ ID NO: 1203879 - RNA, 22 nt, Human
ggugauggggcaguuucccaga

SEQ ID NO: 1203880 - RNA, 23 nt, Human
guccacacagcagcagcuccacc

SEQ ID NO: 1203881 - RNA, 21 nt, Human
guccacagggaacuuccccag

SEQ ID NO: 1203882 - RNA, 20 nt, Human
gugauucucuuacuccaucc

SEQ ID NO: 1203883 - RNA, 24 nt, Human
guggagcucagaggccacgaucca

SEQ ID NO: 1203884 - RNA, 21 nt, Human
guugaagaugggcuugagugu

SEQ ID NO: 1203885 - RNA, 22 nt, Human
guuggugguugggcugugauug

SEQ ID NO: 1203886 - RNA, 18 nt, Human
guuugcuguggaucuugc

SEQ ID NO: 1203887 - RNA, 23 nt, Human
uaaaaacaccaccuucaccaccu

SEQ ID NO: 1203888 - RNA, 23 nt, Human
uaaggaccacguggaaggcugac

SEQ ID NO: 1203889 - RNA, 21 nt, Human
uacccucaaagccuccugcac

SEQ ID NO: 1203890 - RNA, 20 nt, Human
uagaggcuuuggcuggcaau

SEQ ID NO: 1203891 - RNA, 18 nt, Human
uagauguagccguccaug

SEQ ID NO: 1203892 - RNA, 21 nt, Human
uagcaucucguccgacacacu

SEQ ID NO: 1203893 - RNA, 18 nt, Human
uagccaggucacagaaag

SEQ ID NO: 1203894 - RNA, 24 nt, Human
uagcuucuaugcaaagcagacuuc

SEQ ID NO: 1203895 - RNA, 21 nt, Human
uaucuucuccaccgaggcacu

SEQ ID NO: 1203896 - RNA, 18 nt, Human
uauugucagcaccagaga

SEQ ID NO: 1203897 - RNA, 21 nt, Human
ucaaaaacagcuccuuuagca

SEQ ID NO: 1203898 - RNA, 24 nt, Human
ucaaugucuuccagggggcgcucu

SEQ ID NO: 1203899 - RNA, 26 nt, Human
ucaaugucuuccagggggcgcucucc

SEQ ID NO: 1203900 - RNA, 23 nt, Human
ucaggcaccuggcuaagggugau

SEQ ID NO: 1203901 - RNA, 18 nt, Human
uccacaaggaugugcguc

SEQ ID NO: 1203902 - RNA, 24 nt, Human
uccacauacaggaugucugccaca

SEQ ID NO: 1203903 - RNA, 21 nt, Human
uccacauagggucugcugggc

SEQ ID NO: 1203904 - RNA, 27 nt, Human
uccaugaccagagcacagccggggucc

SEQ ID NO: 1203905 - RNA, 18 nt, Human
uccaugcagcugcucagc

SEQ ID NO: 1203906 - RNA, 19 nt, Human
uccaugcagcugcucagca

SEQ ID NO: 1203907 - RNA, 20 nt, Human
ucccacuuggaggcccuggg

SEQ ID NO: 1203908 - RNA, 24 nt, Human
ucccacuuggaggcccuggggagg

SEQ ID NO: 1203909 - RNA, 19 nt, Human
ucccagagcaaaaaacuuc

SEQ ID NO: 1203910 - RNA, 18 nt, Human
uccccauugucuaggucc

SEQ ID NO: 1203911 - RNA, 19 nt, Human
uccccauugucuaggucca

SEQ ID NO: 1203912 - RNA, 18 nt, Human
ucccuggacucccacuug

SEQ ID NO: 1203913 - RNA, 24 nt, Human
ucggagccguggcugggccacugu

SEQ ID NO: 1203914 - RNA, 23 nt, Human
ucguagccaccagucaccaggaa

SEQ ID NO: 1203915 - RNA, 21 nt, Human
ucuccauagcagaacacaccu

SEQ ID NO: 1203916 - RNA, 22 nt, Human
ucugccuccuuaucugccuucc

SEQ ID NO: 1203917 - RNA, 22 nt, Human
ucuucauggccuugaugaaggc

SEQ ID NO: 1203918 - RNA, 27 nt, Human
ucuuuguaaauggacuguuugcugugg

SEQ ID NO: 1203919 - RNA, 23 nt, Human
ugaacaggagacuaccacauuca

SEQ ID NO: 1203920 - RNA, 21 nt, Human
ugaaccgguggauuaaaaaca

SEQ ID NO: 1203921 - RNA, 20 nt, Human
ugaaggcguccaugcccagg

SEQ ID NO: 1203922 - RNA, 25 nt, Human
ugagacuggagagcuuccuggaggu

SEQ ID NO: 1203923 - RNA, 25 nt, Human
ugaggaauuaacaaccggaacuugu

SEQ ID NO: 1203924 - RNA, 24 nt, Human
ugaggaugcuguuguuccugcuau

SEQ ID NO: 1203925 - RNA, 19 nt, Human
ugagggaucucugcuaagu

SEQ ID NO: 1203926 - RNA, 20 nt, Human
ugagugauucucuuacucca

SEQ ID NO: 1203927 - RNA, 20 nt, Human
ugauaagccccugggccucu

SEQ ID NO: 1203928 - RNA, 20 nt, Human
ugaucaggacaaagaacaca

SEQ ID NO: 1203929 - RNA, 22 nt, Human
ugcaggaagauuaucuucucca

SEQ ID NO: 1203930 - RNA, 18 nt, Human
ugcccauggacacuccca

SEQ ID NO: 1203931 - RNA, 19 nt, Human
ugccuggaugugccagaag

SEQ ID NO: 1203932 - RNA, 24 nt, Human
ugcucagaaccuucuucauggccu

SEQ ID NO: 1203933 - RNA, 19 nt, Human
uggaagccaugugggaugg

SEQ ID NO: 1203934 - RNA, 21 nt, Human
uggacagcuuuuggaguugag

SEQ ID NO: 1203935 - RNA, 19 nt, Human
uggauuggaauggcuguuu

SEQ ID NO: 1203936 - RNA, 22 nt, Human
uggccauggcacccacgacaac

SEQ ID NO: 1203937 - RNA, 26 nt, Human
uggcccccagacacagcaaacuccuu

SEQ ID NO: 1203938 - RNA, 19 nt, Human
ugggaaaggucaacaggca

SEQ ID NO: 1203939 - RNA, 23 nt, Human
ugggaaaggucaacaggcauuug

SEQ ID NO: 1203940 - RNA, 23 nt, Human
ugggauggagagccuucagccgg

SEQ ID NO: 1203941 - RNA, 20 nt, Human
ugggguaccuguggcugucc

SEQ ID NO: 1203942 - RNA, 22 nt, Human
uggguccacacagcagcagcuc

SEQ ID NO: 1203943 - RNA, 24 nt, Human
uguccacuucucccgcuccacaua

SEQ ID NO: 1203944 - RNA, 25 nt, Human
uguccagaucaacaaaggugaaggc

SEQ ID NO: 1203945 - RNA, 21 nt, Human
ugucccuggacucccacuugu

SEQ ID NO: 1203946 - RNA, 18 nt, Human
uguggagcucagaggcca

SEQ ID NO: 1203947 - RNA, 22 nt, Human
uguuggggagcuagcagccucc

SEQ ID NO: 1203948 - RNA, 23 nt, Human
uuaacaaccggaacuuguugugu

SEQ ID NO: 1203949 - RNA, 18 nt, Human
uuaagaguuucugcaagg

SEQ ID NO: 1203950 - RNA, 21 nt, Human
uucaaauggccuuuccagguc

SEQ ID NO: 1203951 - RNA, 19 nt, Human
uucacaagaugucccccca

SEQ ID NO: 1203952 - RNA, 21 nt, Human
uuccccagcaggccuccauuc

SEQ ID NO: 1203953 - RNA, 22 nt, Human
uuccuugggcuuauacgccgcu

SEQ ID NO: 1203954 - RNA, 21 nt, Human
uugagacaaagggguuccaca

SEQ ID NO: 1203955 - RNA, 22 nt, Human
uuguauguccacuucucccgcu

SEQ ID NO: 1203956 - RNA, 23 nt, Human
uuuaagaguuucugcaaggaaac

SEQ ID NO: 1203957 - RNA, 26 nt, Human
uuuacaaucccccgugaugaggaucc

SEQ ID NO: 1203958 - RNA, 23 nt, Human
ucugcaguggccucgcuccuuuu

SEQ ID NO: 1203959 - RNA, 21 nt, Human
ccacggcaucgugauaccaaa

SEQ ID NO: 1203960 - RNA, 22 nt, Human
acagauccccccacccaaccac

SEQ ID NO: 1203961 - RNA, 24 nt, Human
cacccaaccacugccaaccugcac

SEQ ID NO: 1203962 - RNA, 22 nt, Human
ccaaccacugccaaccugcacc

SEQ ID NO: 1203963 - RNA, 23 nt, Human
cgucuugcaaacagaucccccca

SEQ ID NO: 1203964 - RNA, 21 nt, Human
cugcacccucuuggcuccaug

SEQ ID NO: 1203965 - RNA, 20 nt, Human
cuugcaaacagaucccccca

SEQ ID NO: 1203966 - RNA, 18 nt, Human
cuuuguuccuucaaugcc

SEQ ID NO: 1203967 - RNA, 18 nt, Human
ugacaccgucuugcaaac

SEQ ID NO: 1203968 - RNA, 22 nt, Human
ugccaaccugcacccucuuggc

SEQ ID NO: 1203969 - RNA, 22 nt, Human
ugccacagaaaggcuccaugac

SEQ ID NO: 1203970 - RNA, 23 nt, Human
uugacacugagauaccguguagc

SEQ ID NO: 1203971 - RNA, 22 nt, Human
acauuccugaaugagccggaag

SEQ ID NO: 1203972 - RNA, 22 nt, Human
ggagcacgucuccccguuccag

SEQ ID NO: 1203973 - RNA, 21 nt, Human
ucugcaguugccacacauucc

SEQ ID NO: 1203974 - RNA, 22 nt, Human
ugagccggaagcgggucgagca

SEQ ID NO: 1203975 - RNA, 22 nt, Human
ugcaagucugcaguugccacac

SEQ ID NO: 1203976 - RNA, 19 nt, Human
uuuccgccgcagacgggcu

SEQ ID NO: 1203977 - RNA, 18 nt, Human
acgcuucuuccucugggc

SEQ ID NO: 1203978 - RNA, 21 nt, Human
aggggcggucggggucagggg

SEQ ID NO: 1203979 - RNA, 24 nt, Human
aggugcugaggacgguggcccggc

SEQ ID NO: 1203980 - RNA, 19 nt, Human
cacagggcuucuggcuucu

SEQ ID NO: 1203981 - RNA, 24 nt, Human
cagcacgaggggccgcgugacccc

SEQ ID NO: 1203982 - RNA, 21 nt, Human
cagcacgaggggccgcguggu

SEQ ID NO: 1203983 - RNA, 20 nt, Human
ccccacuccgaagcagcucc

SEQ ID NO: 1203984 - RNA, 20 nt, Human
cccggcucagccucucccca

SEQ ID NO: 1203985 - RNA, 20 nt, Human
ccgcagccccacgccuuccu

SEQ ID NO: 1203986 - RNA, 24 nt, Human
ccgcucagcugccacagggcuucu

SEQ ID NO: 1203987 - RNA, 28 nt, Human
ccugggagaguggcccaggccccccuuc

SEQ ID NO: 1203988 - RNA, 19 nt, Human
cugggagaguggcccaggc

SEQ ID NO: 1203989 - RNA, 19 nt, Human
gcagcuccugcaggaaacc

SEQ ID NO: 1203990 - RNA, 21 nt, Human
gccgcagccccacgccuuccu

SEQ ID NO: 1203991 - RNA, 23 nt, Human
gcgggggugggggcccgaggggc

SEQ ID NO: 1203992 - RNA, 18 nt, Human
gcgggucucccccgggcu

SEQ ID NO: 1203993 - RNA, 24 nt, Human
ggagaguggcccaggccccccuuc

SEQ ID NO: 1203994 - RNA, 22 nt, Human
ggcccgaggggcggucgggguc

SEQ ID NO: 1203995 - RNA, 19 nt, Human
ggcggugaccgggugggga

SEQ ID NO: 1203996 - RNA, 22 nt, Human
gggaugcggaagccaggagcuc

SEQ ID NO: 1203997 - RNA, 20 nt, Human
gggcuucuggcuucuggcuu

SEQ ID NO: 1203998 - RNA, 21 nt, Human
gggggugggggcccgaggggc

SEQ ID NO: 1203999 - RNA, 21 nt, Human
gguggccccgggccacguccu

SEQ ID NO: 1204000 - RNA, 21 nt, Human
ucacagacaaggugcugagga

SEQ ID NO: 1204001 - RNA, 18 nt, Human
uccugcaggaaaccuggg

SEQ ID NO: 1204002 - RNA, 19 nt, Human
uccuggauccggcuugcuc

SEQ ID NO: 1204003 - RNA, 19 nt, Human
ucuccgcucagcugccaca

SEQ ID NO: 1204004 - RNA, 22 nt, Human
ugaccggguggggagaggccgg

SEQ ID NO: 1204005 - RNA, 19 nt, Human
ugccacagggcuucuggcu

SEQ ID NO: 1204006 - RNA, 19 nt, Human
ugccuugggggaugcggaa

SEQ ID NO: 1204007 - RNA, 19 nt, Human
ugcggaagccaggagcucc

SEQ ID NO: 1204008 - RNA, 24 nt, Human
uggcaccccaggaugcugacgccg

SEQ ID NO: 1204009 - RNA, 19 nt, Human
uggcccaggccccccuucc

SEQ ID NO: 1204010 - RNA, 18 nt, Human
uggccccgggccacgucc

SEQ ID NO: 1204011 - RNA, 19 nt, Human
uggccccgggccacguccu

SEQ ID NO: 1204012 - RNA, 20 nt, Human
ugggauggggacugguggcc

SEQ ID NO: 1204013 - RNA, 23 nt, Human
uguggcuggggaacucccaggac

SEQ ID NO: 1204014 - RNA, 21 nt, Human
uuccugagugugacugcgcug

SEQ ID NO: 1204015 - RNA, 22 nt, Human
ccacugacacgggugcugagga

SEQ ID NO: 1204016 - RNA, 19 nt, Human
cguggugucucauuuccac

SEQ ID NO: 1204017 - RNA, 21 nt, Human
uccacugacacgggugcugag

SEQ ID NO: 1204018 - RNA, 19 nt, Human
uccuggugucugggcccca

SEQ ID NO: 1204019 - RNA, 19 nt, Human
ugaggaaggccugugucuu

SEQ ID NO: 1204020 - RNA, 19 nt, Human
gagcucugcgacgccuuuc

SEQ ID NO: 1204021 - RNA, 24 nt, Human
uccgcuuggucacucugagcucug

SEQ ID NO: 1204022 - RNA, 19 nt, Human
ucuuuguccuucuuuuucu

SEQ ID NO: 1204023 - RNA, 23 nt, Human
aggcgggaccgaggacccggaga

SEQ ID NO: 1204024 - RNA, 18 nt, Human
cagcuggggucacgaagg

SEQ ID NO: 1204025 - RNA, 22 nt, Human
cccccgcgggcgcaguccccgc

SEQ ID NO: 1204026 - RNA, 20 nt, Human
ccccgcgggcgcaguccccg

SEQ ID NO: 1204027 - RNA, 23 nt, Human
ccuuugugaccugcccgccccuc

SEQ ID NO: 1204028 - RNA, 24 nt, Human
cggcagcuggggucacgaaggcug

SEQ ID NO: 1204029 - RNA, 25 nt, Human
cggggaggggccuuugugaccugcc

SEQ ID NO: 1204030 - RNA, 22 nt, Human
cuccccggcacugugaugccgg

SEQ ID NO: 1204031 - RNA, 18 nt, Human
gagcgcccccggcugcug

SEQ ID NO: 1204032 - RNA, 22 nt, Human
gagcgcccccggcugcugaggc

SEQ ID NO: 1204033 - RNA, 21 nt, Human
ggcgguguuggaacguggaca

SEQ ID NO: 1204034 - RNA, 20 nt, Human
ugaccugcccgccccucccc

SEQ ID NO: 1204035 - RNA, 23 nt, Human
ugagccgcgggugggcggggagg

SEQ ID NO: 1204036 - RNA, 24 nt, Human
uuugguaauagggcagccuccccc

SEQ ID NO: 1204037 - RNA, 24 nt, Human
ugagcuccaagcucaaaaggcaau

SEQ ID NO: 1204038 - RNA, 21 nt, Human
agccuaguggccacuguaacc

SEQ ID NO: 1204039 - RNA, 21 nt, Human
agccugucugccuccagccuc

SEQ ID NO: 1204040 - RNA, 22 nt, Human
aggccccaggcacagggagccu

SEQ ID NO: 1204041 - RNA, 18 nt, Human
aggcuuugaggagggggc

SEQ ID NO: 1204042 - RNA, 21 nt, Human
aggugguggccagcacucagg

SEQ ID NO: 1204043 - RNA, 24 nt, Human
augcuggccaccuccaggugaggc

SEQ ID NO: 1204044 - RNA, 22 nt, Human
caggccccaggcacagggagcc

SEQ ID NO: 1204045 - RNA, 23 nt, Human
caggugguggccagcacucaggc

SEQ ID NO: 1204046 - RNA, 18 nt, Human
ccagaccaggcugauuca

SEQ ID NO: 1204047 - RNA, 26 nt, Human
ccagagccugggacagggguugaggg

SEQ ID NO: 1204048 - RNA, 21 nt, Human
ccagccucuggccgggucaca

SEQ ID NO: 1204049 - RNA, 26 nt, Human
ccccacagcugcccauaccuccagac

SEQ ID NO: 1204050 - RNA, 18 nt, Human
ccccaggcacagggagcc

SEQ ID NO: 1204051 - RNA, 20 nt, Human
cccccacagcugcccauacc

SEQ ID NO: 1204052 - RNA, 21 nt, Human
cccccacagcugcccauaccu

SEQ ID NO: 1204053 - RNA, 19 nt, Human
ccuccagaccaggcugauu

SEQ ID NO: 1204054 - RNA, 18 nt, Human
ccuccagccucuggccgg

SEQ ID NO: 1204055 - RNA, 22 nt, Human
cgccagacagcaggugguggcc

SEQ ID NO: 1204056 - RNA, 24 nt, Human
cgccagacagcaggugguggccag

SEQ ID NO: 1204057 - RNA, 19 nt, Human
cuccagccucuggccgggu

SEQ ID NO: 1204058 - RNA, 20 nt, Human
cugggcuucuucuguggaga

SEQ ID NO: 1204059 - RNA, 21 nt, Human
cugggggacaucucaugggcu

SEQ ID NO: 1204060 - RNA, 18 nt, Human
gagugcugucucccucug

SEQ ID NO: 1204061 - RNA, 22 nt, Human
gcacagggagccuccacccaca

SEQ ID NO: 1204062 - RNA, 20 nt, Human
gcaccagaucugggggccug

SEQ ID NO: 1204063 - RNA, 22 nt, Human
gcaccagaucugggggccuggu

SEQ ID NO: 1204064 - RNA, 20 nt, Human
gccccaggcacagggagccu

SEQ ID NO: 1204065 - RNA, 23 nt, Human
gccccaggcacagggagccucca

SEQ ID NO: 1204066 - RNA, 20 nt, Human
gccuggggugcugggggaca

SEQ ID NO: 1204067 - RNA, 22 nt, Human
gcugcugagcccugcacccugc

SEQ ID NO: 1204068 - RNA, 22 nt, Human
ggcaccagaucugggggccugg

SEQ ID NO: 1204069 - RNA, 23 nt, Human
ggcaccagaucugggggccuggu

SEQ ID NO: 1204070 - RNA, 21 nt, Human
ggccaguguggauuggagagg

SEQ ID NO: 1204071 - RNA, 19 nt, Human
ggcccagggccuggggugc

SEQ ID NO: 1204072 - RNA, 19 nt, Human
ggccuggggugcuggggga

SEQ ID NO: 1204073 - RNA, 21 nt, Human
ggcuucuucuguggagaggug

SEQ ID NO: 1204074 - RNA, 21 nt, Human
ggcuuugaggagggggccugg

SEQ ID NO: 1204075 - RNA, 24 nt, Human
gggcaccagaucugggggccuggu

SEQ ID NO: 1204076 - RNA, 18 nt, Human
gggccugguccuggcugu

SEQ ID NO: 1204077 - RNA, 26 nt, Human
ggucugggcuucuucuguggagaggg

SEQ ID NO: 1204078 - RNA, 19 nt, Human
ucaugggcuuccacaggcu

SEQ ID NO: 1204079 - RNA, 22 nt, Human
uccacaggcuuugaggaggggg

SEQ ID NO: 1204080 - RNA, 22 nt, Human
uccaccggcccccacagcugcc

SEQ ID NO: 1204081 - RNA, 22 nt, Human
uccgguccugaugcuggccacc

SEQ ID NO: 1204082 - RNA, 18 nt, Human
uccuuggggcugucaggg

SEQ ID NO: 1204083 - RNA, 19 nt, Human
uccuuggggcugucagggu

SEQ ID NO: 1204084 - RNA, 21 nt, Human
uccuuggggcugucagggugg

SEQ ID NO: 1204085 - RNA, 24 nt, Human
ucuggccgggucacaggccugaca

SEQ ID NO: 1204086 - RNA, 20 nt, Human
ugaugcuggccaccuccagg

SEQ ID NO: 1204087 - RNA, 20 nt, Human
ugccguggcuggugacgaug

SEQ ID NO: 1204088 - RNA, 20 nt, Human
uggcacucgccccagggcau

SEQ ID NO: 1204089 - RNA, 22 nt, Human
uggccagcacucaggccccagg

SEQ ID NO: 1204090 - RNA, 21 nt, Human
ugggggccugguccuggcugu

SEQ ID NO: 1204091 - RNA, 23 nt, Human
uguccaccggcccccacagcugc

SEQ ID NO: 1204092 - RNA, 25 nt, Human
uguucccccugggucaggcucaggg

SEQ ID NO: 1204093 - RNA, 24 nt, Human
uuccacaggcuuugaggagggggc

SEQ ID NO: 1204094 - RNA, 23 nt, Human
uugacgggagugcugucucccuc

SEQ ID NO: 1204095 - RNA, 21 nt, Human
acgacacccuggacggcgucc

SEQ ID NO: 1204096 - RNA, 20 nt, Human
agcgaccucguucgcgaugc

SEQ ID NO: 1204097 - RNA, 18 nt, Human
agcgaugccaugggcggc

SEQ ID NO: 1204098 - RNA, 18 nt, Human
agcgaugccgugggcggc

SEQ ID NO: 1204099 - RNA, 22 nt, Human
augcccugggcagcgaccucgu

SEQ ID NO: 1204100 - RNA, 22 nt, Human
augcccugggcagcgaccucgu

SEQ ID NO: 1204101 - RNA, 18 nt, Human
auuccagaauacuuacua

SEQ ID NO: 1204102 - RNA, 19 nt, Human
cccuggacggcguccuccu

SEQ ID NO: 1204103 - RNA, 19 nt, Human
cccuggacggcguccuccu

SEQ ID NO: 1204104 - RNA, 20 nt, Human
ccucgguagcgaugcccugg

SEQ ID NO: 1204105 - RNA, 20 nt, Human
ccucgguagcgaugcccugg

SEQ ID NO: 1204106 - RNA, 20 nt, Human
ccucguuugcgauguccugg

SEQ ID NO: 1204107 - RNA, 20 nt, Human
ccucguuugcgauguccugg

SEQ ID NO: 1204108 - RNA, 20 nt, Human
ccucguuugcgauguccugg

SEQ ID NO: 1204109 - RNA, 20 nt, Human
ccucguuugcgauguccugg

SEQ ID NO: 1204110 - RNA, 18 nt, Human
ccucucuccaucuccucu

SEQ ID NO: 1204111 - RNA, 23 nt, Human
ccuuagagaugccgugggcggcg

SEQ ID NO: 1204112 - RNA, 24 nt, Human
ccuugugaacuagagacuccucag

SEQ ID NO: 1204113 - RNA, 21 nt, Human
cgacgcccugggcggcguccu

SEQ ID NO: 1204114 - RNA, 21 nt, Human
cggcgaccucguuagcgacgc

SEQ ID NO: 1204115 - RNA, 21 nt, Human
cggcgaccucguuagcgacgc

SEQ ID NO: 1204116 - RNA, 21 nt, Human
cggcgaccucguuagcgaugc

SEQ ID NO: 1204117 - RNA, 21 nt, Human
cggcgaccucguuagugaugc

SEQ ID NO: 1204118 - RNA, 21 nt, Human
cggcgaccucuuuagcgacgc

SEQ ID NO: 1204119 - RNA, 21 nt, Human
cggugaccucguuagcgaugc

SEQ ID NO: 1204120 - RNA, 24 nt, Human
cggugaccucuuuagcgacgcccu

SEQ ID NO: 1204121 - RNA, 24 nt, Human
cucacguugacuggccucucucca

SEQ ID NO: 1204122 - RNA, 19 nt, Human
cuccuuagcgaugcccugg

SEQ ID NO: 1204123 - RNA, 19 nt, Human
cuccuuagcgaugcccugg

SEQ ID NO: 1204124 - RNA, 19 nt, Human
cuccuuagcgaugcccugg

SEQ ID NO: 1204125 - RNA, 19 nt, Human
cucuccaucuccucugucc

SEQ ID NO: 1204126 - RNA, 19 nt, Human
cucuuuagcgacgcccugg

SEQ ID NO: 1204127 - RNA, 19 nt, Human
cucuuuagcgaugcccugg

SEQ ID NO: 1204128 - RNA, 24 nt, Human
gacgguguccuccuuagagaugcc

SEQ ID NO: 1204129 - RNA, 19 nt, Human
gcccugcgcggugaccucg

SEQ ID NO: 1204130 - RNA, 18 nt, Human
gcccugggcagcguccuc

SEQ ID NO: 1204131 - RNA, 20 nt, Human
ggcaaccucguuagcgaugc

SEQ ID NO: 1204132 - RNA, 21 nt, Human
ggccuccuuguuagugaugcc

SEQ ID NO: 1204133 - RNA, 20 nt, Human
ggcgaccucguuagcgacgc

SEQ ID NO: 1204134 - RNA, 20 nt, Human
ggcgaccucguuagcgacgc

SEQ ID NO: 1204135 - RNA, 20 nt, Human
ggcgaccucguuagcgacgc

SEQ ID NO: 1204136 - RNA, 20 nt, Human
ggcgaccucguuagcgaugc

SEQ ID NO: 1204137 - RNA, 20 nt, Human
ggcgaccucguuagcgaugc

SEQ ID NO: 1204138 - RNA, 20 nt, Human
ggugaccucuuuagcgacgc

SEQ ID NO: 1204139 - RNA, 24 nt, Human
guccucauagggagcuuucuuggc

SEQ ID NO: 1204140 - RNA, 21 nt, Human
gugggcggcgaccucguuagc

SEQ ID NO: 1204141 - RNA, 21 nt, Human
gugggcggcguccucauuagc

SEQ ID NO: 1204142 - RNA, 21 nt, Human
gugggcggcguccucguuagc

SEQ ID NO: 1204143 - RNA, 21 nt, Human
gugggcggcguccucguuagc

SEQ ID NO: 1204144 - RNA, 24 nt, Human
uaccgaugccuuguaugguguccu

SEQ ID NO: 1204145 - RNA, 22 nt, Human
uaccucuucuucuuuacccggg

SEQ ID NO: 1204146 - RNA, 21 nt, Human
uagcgauauugugggcggcgu

SEQ ID NO: 1204147 - RNA, 23 nt, Human
uccagaauacuuacuagauucau

SEQ ID NO: 1204148 - RNA, 23 nt, Human
ucguuagcgacgacgccguggag

SEQ ID NO: 1204149 - RNA, 18 nt, Human
ucuccaucuccucugucc

SEQ ID NO: 1204150 - RNA, 23 nt, Human
ucucuccaucuccucuguccuug

SEQ ID NO: 1204151 - RNA, 26 nt, Human
ugcguccucguuugcgaugccguggg

SEQ ID NO: 1204152 - RNA, 19 nt, Human
uggccugggcggccuccuu

SEQ ID NO: 1204153 - RNA, 21 nt, Human
ugggcggcguccucuuuaagg

SEQ ID NO: 1204154 - RNA, 27 nt, Human
uuagcgaugcccugggcggcguccucc

SEQ ID NO: 1204155 - RNA, 24 nt, Human
uugugggcggcguccucauuaacg

SEQ ID NO: 1204156 - RNA, 21 nt, Human
uuucuuggcaagugauuccag

SEQ ID NO: 1204157 - RNA, 24 nt, Human
acaggccaggguggggacagggug

SEQ ID NO: 1204158 - RNA, 21 nt, Human
accauccucagagccaccagu

SEQ ID NO: 1204159 - RNA, 19 nt, Human
agagccaccacccggcccu

SEQ ID NO: 1204160 - RNA, 22 nt, Human
aggcggcggugguguggggcgg

SEQ ID NO: 1204161 - RNA, 21 nt, Human
agggagaggucugcaggcggc

SEQ ID NO: 1204162 - RNA, 20 nt, Human
agggagccggccaagggaga

SEQ ID NO: 1204163 - RNA, 21 nt, Human
aggguggggacaggguggggc

SEQ ID NO: 1204164 - RNA, 24 nt, Human
aggguggggacaggguggggcugg

SEQ ID NO: 1204165 - RNA, 22 nt, Human
aggugaggaccgugggugggug

SEQ ID NO: 1204166 - RNA, 22 nt, Human
caccacccggcccuccacagcc

SEQ ID NO: 1204167 - RNA, 20 nt, Human
cagcagcgacuggguccugg

SEQ ID NO: 1204168 - RNA, 22 nt, Human
caggcccugaaguacacgcaga

SEQ ID NO: 1204169 - RNA, 22 nt, Human
caggugaggaccgugggugggu

SEQ ID NO: 1204170 - RNA, 26 nt, Human
ccacagccaggccacagcuccaggug

SEQ ID NO: 1204171 - RNA, 23 nt, Human
ccaggugaggaccgugggugggu

SEQ ID NO: 1204172 - RNA, 22 nt, Human
ccucagagccaccacccggccc

SEQ ID NO: 1204173 - RNA, 25 nt, Human
ccucagagccaccacccggcccucc

SEQ ID NO: 1204174 - RNA, 20 nt, Human
ccuccacagccaggccacag

SEQ ID NO: 1204175 - RNA, 26 nt, Human
ccuccacagccaggccacagcuccag

SEQ ID NO: 1204176 - RNA, 21 nt, Human
cuccgcgcccgcccgcccgcc

SEQ ID NO: 1204177 - RNA, 24 nt, Human
cuccuuacaggccaggguggggac

SEQ ID NO: 1204178 - RNA, 24 nt, Human
cugcccaagggaccacagcagcga

SEQ ID NO: 1204179 - RNA, 18 nt, Human
gacaggguggggcugggg

SEQ ID NO: 1204180 - RNA, 19 nt, Human
gaggcuccgcgcccgcccg

SEQ ID NO: 1204181 - RNA, 20 nt, Human
gcuccuuacaggccagggug

SEQ ID NO: 1204182 - RNA, 24 nt, Human
ggcggcggugguguggggcgggcc

SEQ ID NO: 1204183 - RNA, 22 nt, Human
ggcuggggaccauccucagagc

SEQ ID NO: 1204184 - RNA, 22 nt, Human
gggaccauccucagagccacca

SEQ ID NO: 1204185 - RNA, 21 nt, Human
gggguuccugugcaaaucccu

SEQ ID NO: 1204186 - RNA, 23 nt, Human
ggguggggacaggguggggcugg

SEQ ID NO: 1204187 - RNA, 19 nt, Human
ggguuccugugcaaauccc

SEQ ID NO: 1204188 - RNA, 19 nt, Human
guggggagggcucgcugga

SEQ ID NO: 1204189 - RNA, 24 nt, Human
uccucagagccaccacccggcccu

SEQ ID NO: 1204190 - RNA, 22 nt, Human
uccugugcaaaucccuccuuaa

SEQ ID NO: 1204191 - RNA, 19 nt, Human
ugagugcuccuuacaggcc

SEQ ID NO: 1204192 - RNA, 22 nt, Human
ugcaggcggcgguggugugggg

SEQ ID NO: 1204193 - RNA, 23 nt, Human
uggaugguaggaagagugagugc

SEQ ID NO: 1204194 - RNA, 20 nt, Human
uggggacaggguggggcugg

SEQ ID NO: 1204195 - RNA, 21 nt, Human
uggggacaggguggggcuggg

SEQ ID NO: 1204196 - RNA, 24 nt, Human
uggggaccauccucagagccacca

SEQ ID NO: 1204197 - RNA, 19 nt, Human
cagccaccggcucaccuug

SEQ ID NO: 1204198 - RNA, 23 nt, Human
cggcucaccuugcagggcaacgc

SEQ ID NO: 1204199 - RNA, 22 nt, Human
ggcucaccuugcagggcaacgc

SEQ ID NO: 1204200 - RNA, 20 nt, Human
gggcagaggcugccaaccug

SEQ ID NO: 1204201 - RNA, 21 nt, Human
aagcugcaaacuucuuaaguc

SEQ ID NO: 1204202 - RNA, 19 nt, Human
agaaagcaauauggaaaaa

SEQ ID NO: 1204203 - RNA, 22 nt, Human
agaaagcaauauggaaaaagga

SEQ ID NO: 1204204 - RNA, 20 nt, Human
agcaauauggaaaaaggagg

SEQ ID NO: 1204205 - RNA, 22 nt, Human
agcaauauggaaaaaggaggaa

SEQ ID NO: 1204206 - RNA, 21 nt, Human
auggaaaaaggaggaaaggaa

SEQ ID NO: 1204207 - RNA, 19 nt, Human
cacuguggagcuuagugcu

SEQ ID NO: 1204208 - RNA, 18 nt, Human
ccccugcuugucugaggc

SEQ ID NO: 1204209 - RNA, 23 nt, Human
cuugaguugcuucuugauaauga

SEQ ID NO: 1204210 - RNA, 20 nt, Human
gaaaaaggaggaaaggaagg

SEQ ID NO: 1204211 - RNA, 20 nt, Human
ggaaaaaggaggaaaggaag

SEQ ID NO: 1204212 - RNA, 25 nt, Human
ggaaaggaaggucuucuguacuugg

SEQ ID NO: 1204213 - RNA, 21 nt, Human
gucaucuugaguugcuucuug

SEQ ID NO: 1204214 - RNA, 19 nt, Human
uagaacagaaagcaauaug

SEQ ID NO: 1204215 - RNA, 24 nt, Human
uagaacagaaagcaauauggaaaa

SEQ ID NO: 1204216 - RNA, 24 nt, Human
uagugcuugcuuacaggaccagca

SEQ ID NO: 1204217 - RNA, 22 nt, Human
ucuuaagucauucucuaaaaca

SEQ ID NO: 1204218 - RNA, 24 nt, Human
ucuugaguugcuucuugauaauga

SEQ ID NO: 1204219 - RNA, 24 nt, Human
uggaaaaaggaggaaaggaagguc

SEQ ID NO: 1204220 - RNA, 23 nt, Human
ugggauacggguccaagcugcaa

SEQ ID NO: 1204221 - RNA, 22 nt, Human
uggggccagguuggggcaagga

SEQ ID NO: 1204222 - RNA, 21 nt, Human
uuccuuagcagacuugccccu

SEQ ID NO: 1204223 - RNA, 19 nt, Human
aggcagagaccuggaugug

SEQ ID NO: 1204224 - RNA, 20 nt, Human
aggcagagaccuggauguga

SEQ ID NO: 1204225 - RNA, 19 nt, Human
caaauagccaggcagagac

SEQ ID NO: 1204226 - RNA, 23 nt, Human
cacacaacagguccuugggacag

SEQ ID NO: 1204227 - RNA, 27 nt, Human
cagaggccuccucccaaaugcaggcuu

SEQ ID NO: 1204228 - RNA, 22 nt, Human
ccagaggccuccucccaaaugc

SEQ ID NO: 1204229 - RNA, 18 nt, Human
cuccucccaaaugcaggc

SEQ ID NO: 1204230 - RNA, 20 nt, Human
gacaggaagcacugagucca

SEQ ID NO: 1204231 - RNA, 23 nt, Human
ggagcaaauagccaggcagagac

SEQ ID NO: 1204232 - RNA, 24 nt, Human
uagccaggcagagaccuggauguu

SEQ ID NO: 1204233 - RNA, 20 nt, Human
uugggacaggaagcacugag

SEQ ID NO: 1204234 - RNA, 21 nt, Human
accguaauuuauaacacucuu

SEQ ID NO: 1204235 - RNA, 18 nt, Human
accugagucguccuccuu

SEQ ID NO: 1204236 - RNA, 21 nt, Human
acuggggaauuagccccacaa

SEQ ID NO: 1204237 - RNA, 21 nt, Human
agaagccugugaucacauacc

SEQ ID NO: 1204238 - RNA, 22 nt, Human
cagaaguaaaguuucaccuucc

SEQ ID NO: 1204239 - RNA, 23 nt, Human
cucaaacaacuaaguguucaaca

SEQ ID NO: 1204240 - RNA, 24 nt, Human
cuucuaaaaucuaggcacagaagu

SEQ ID NO: 1204241 - RNA, 22 nt, Human
gacauauagguuauuucuaauu

SEQ ID NO: 1204242 - RNA, 19 nt, Human
gaggaugggaagacaggaa

SEQ ID NO: 1204243 - RNA, 24 nt, Human
ggaaaaaguuauguuuaaaaaugc

SEQ ID NO: 1204244 - RNA, 18 nt, Human
gggaauuagccccacaau

SEQ ID NO: 1204245 - RNA, 19 nt, Human
guauaauacuccauuuugu

SEQ ID NO: 1204246 - RNA, 20 nt, Human
guccuccuuauccugacuuc

SEQ ID NO: 1204247 - RNA, 21 nt, Human
uaaguguucaacaugacguuu

SEQ ID NO: 1204248 - RNA, 22 nt, Human
uagccuauucauauauuuccua

SEQ ID NO: 1204249 - RNA, 24 nt, Human
uauaaaauggggcauucagucuga

SEQ ID NO: 1204250 - RNA, 18 nt, Human
uauauauguugaaaauca

SEQ ID NO: 1204251 - RNA, 23 nt, Human
ucacauaccugagucguccuccu

SEQ ID NO: 1204252 - RNA, 22 nt, Human
uccaaaggguggaacaacuacc

SEQ ID NO: 1204253 - RNA, 19 nt, Human
ucccuacaacuugcuuuuc

SEQ ID NO: 1204254 - RNA, 18 nt, Human
ugaaagugccauaucaag

SEQ ID NO: 1204255 - RNA, 23 nt, Human
ugaagugaaggagacauuacaaa

SEQ ID NO: 1204256 - RNA, 22 nt, Human
ugaauauaaugaaaucuuccca

SEQ ID NO: 1204257 - RNA, 21 nt, Human
ugacguuuuuagcacgcaucu

SEQ ID NO: 1204258 - RNA, 20 nt, Human
uggaaaggggcgggaccugc

SEQ ID NO: 1204259 - RNA, 21 nt, Human
uggaacaacuaccugcgagaa

SEQ ID NO: 1204260 - RNA, 21 nt, Human
ugugaucacauaccugagucg

SEQ ID NO: 1204261 - RNA, 22 nt, Human
ugugaucacauaccugagucgu

SEQ ID NO: 1204262 - RNA, 23 nt, Human
uuacuggggaauuagccccacag

SEQ ID NO: 1204263 - RNA, 21 nt, Human
uuagaaacaaugaauauaaug

SEQ ID NO: 1204264 - RNA, 24 nt, Human
uuauucggcaauucauauuucugu

SEQ ID NO: 1204265 - RNA, 21 nt, Human
uugaaugcgaguguggaaaaa

SEQ ID NO: 1204266 - RNA, 20 nt, Human
uuucaaacguuuucuggcca

SEQ ID NO: 1204267 - RNA, 21 nt, Human
uuuucuggccaugcuauugcc

SEQ ID NO: 1204268 - RNA, 18 nt, Human
uuuuguggauccaccgua

SEQ ID NO: 1204269 - RNA, 18 nt, Human
cagccaggggcagcaggc

SEQ ID NO: 1204270 - RNA, 21 nt, Human
ccaggaagacagccaggggca

SEQ ID NO: 1204271 - RNA, 22 nt, Human
uggguugggaaaugucgggcca

SEQ ID NO: 1204272 - RNA, 21 nt, Human
aaccuucccuggagaucugcc

SEQ ID NO: 1204273 - RNA, 23 nt, Human
aggugcaggagagaggaguaagu

SEQ ID NO: 1204274 - RNA, 22 nt, Human
caguaaccuucccuggagaucu

SEQ ID NO: 1204275 - RNA, 22 nt, Human
cccugcacaguaaccuucccug

SEQ ID NO: 1204276 - RNA, 23 nt, Human
cucaggauggacaccugacaguc

SEQ ID NO: 1204277 - RNA, 24 nt, Human
cugaggaccacgagguccaggcac

SEQ ID NO: 1204278 - RNA, 19 nt, Human
gagcaggugcaggagagag

SEQ ID NO: 1204279 - RNA, 26 nt, Human
ggacaccugacagucgcugaggacca

SEQ ID NO: 1204280 - RNA, 18 nt, Human
ucgcugaggaccacgagg

SEQ ID NO: 1204281 - RNA, 18 nt, Human
ucgcugaggaccacgagg

SEQ ID NO: 1204282 - RNA, 21 nt, Human
ugcccagacgcuaagcugggg

SEQ ID NO: 1204283 - RNA, 18 nt, Human
aaaggcaccugaacgagg

SEQ ID NO: 1204284 - RNA, 24 nt, Human
aaaugacaucauaaccuucuggau

SEQ ID NO: 1204285 - RNA, 21 nt, Human
aagcaggggcggcugccaggu

SEQ ID NO: 1204286 - RNA, 22 nt, Human
aaggggcagaucuggauccgca

SEQ ID NO: 1204287 - RNA, 23 nt, Human
aagggugccagcaaggccagggg

SEQ ID NO: 1204288 - RNA, 24 nt, Human
aagguugcugcagcccaggccucu

SEQ ID NO: 1204289 - RNA, 20 nt, Human
acacgggcuugcugggacac

SEQ ID NO: 1204290 - RNA, 20 nt, Human
acagcugggccgugaccggc

SEQ ID NO: 1204291 - RNA, 19 nt, Human
acauguaucaucauugacc

SEQ ID NO: 1204292 - RNA, 19 nt, Human
accugguggggaccccaug

SEQ ID NO: 1204293 - RNA, 22 nt, Human
agaaaaggccaacacgggcuug

SEQ ID NO: 1204294 - RNA, 21 nt, Human
agaaguguacaucgguccucc

SEQ ID NO: 1204295 - RNA, 18 nt, Human
agacaaugcuacucccca

SEQ ID NO: 1204296 - RNA, 18 nt, Human
agacgggcagcaccugcc

SEQ ID NO: 1204297 - RNA, 24 nt, Human
agcaggggcggcugccaggucacc

SEQ ID NO: 1204298 - RNA, 20 nt, Human
agccagggccugaagucccu

SEQ ID NO: 1204299 - RNA, 23 nt, Human
aggaagaagccaagucuugggaa

SEQ ID NO: 1204300 - RNA, 21 nt, Human
aggagaagccgcugucggggg

SEQ ID NO: 1204301 - RNA, 19 nt, Human
aggccccugagcuuugccu

SEQ ID NO: 1204302 - RNA, 18 nt, Human
aggcccuggccacccaca

SEQ ID NO: 1204303 - RNA, 20 nt, Human
aggccgggagcuccaccuuc

SEQ ID NO: 1204304 - RNA, 22 nt, Human
aggggcggcugccaggucaccc

SEQ ID NO: 1204305 - RNA, 18 nt, Human
aggguggucugcagcugc

SEQ ID NO: 1204306 - RNA, 18 nt, Human
agguggcccuuugugggc

SEQ ID NO: 1204307 - RNA, 18 nt, Human
aucugccacaguguaggg

SEQ ID NO: 1204308 - RNA, 21 nt, Human
augaugucccucuugaugguc

SEQ ID NO: 1204309 - RNA, 23 nt, Human
augucacagcugcgguccacggc

SEQ ID NO: 1204310 - RNA, 19 nt, Human
caagucuugggaaauuccu

SEQ ID NO: 1204311 - RNA, 19 nt, Human
cacacagcugggccgugac

SEQ ID NO: 1204312 - RNA, 20 nt, Human
cacagcagcugccccagggc

SEQ ID NO: 1204313 - RNA, 21 nt, Human
cacauguaucaucauugaccc

SEQ ID NO: 1204314 - RNA, 22 nt, Human
cacccuggaagugggcggggcu

SEQ ID NO: 1204315 - RNA, 21 nt, Human
caccgcucucggcugcccccc

SEQ ID NO: 1204316 - RNA, 21 nt, Human
cacugcauggcaguggaggac

SEQ ID NO: 1204317 - RNA, 22 nt, Human
cagaaaaggccaacacgggcuu

SEQ ID NO: 1204318 - RNA, 18 nt, Human
cagcacaggcuccagcgg

SEQ ID NO: 1204319 - RNA, 18 nt, Human
cagcaccugccuccuggc

SEQ ID NO: 1204320 - RNA, 23 nt, Human
cagcaucuugccugcugcucagg

SEQ ID NO: 1204321 - RNA, 21 nt, Human
cagcccaggccucugccuccc

SEQ ID NO: 1204322 - RNA, 18 nt, Human
cagcugccagcuccagga

SEQ ID NO: 1204323 - RNA, 19 nt, Human
cagcugccccagggcccgc

SEQ ID NO: 1204324 - RNA, 21 nt, Human
caggagaggccacauucugua

SEQ ID NO: 1204325 - RNA, 18 nt, Human
caggcucuggaaagugcc

SEQ ID NO: 1204326 - RNA, 22 nt, Human
cagggccuccaggacugaccug

SEQ ID NO: 1204327 - RNA, 21 nt, Human
caggggcaggccgggagcucc

SEQ ID NO: 1204328 - RNA, 21 nt, Human
cagguccucccacucggccuc

SEQ ID NO: 1204329 - RNA, 24 nt, Human
ccacaagcugccccgggaggcccc

SEQ ID NO: 1204330 - RNA, 22 nt, Human
ccacccaguagcugagcuuccc

SEQ ID NO: 1204331 - RNA, 23 nt, Human
ccaccgcucucggcugccccccu

SEQ ID NO: 1204332 - RNA, 20 nt, Human
ccaccuucccagcagcuuug

SEQ ID NO: 1204333 - RNA, 23 nt, Human
ccacggcaucugcugacgugucg

SEQ ID NO: 1204334 - RNA, 28 nt, Human
ccaggcacaggcacggcagcuccuggcu

SEQ ID NO: 1204335 - RNA, 20 nt, Human
ccaguccgugacgaggaacc

SEQ ID NO: 1204336 - RNA, 23 nt, Human
cccacacgcucugacacugcguc

SEQ ID NO: 1204337 - RNA, 26 nt, Human
cccaugacguccugacaagguggcuu

SEQ ID NO: 1204338 - RNA, 20 nt, Human
ccccacguccuccucuccgc

SEQ ID NO: 1204339 - RNA, 19 nt, Human
cccccccugcugccggugg

SEQ ID NO: 1204340 - RNA, 20 nt, Human
ccccccuuaagggugccagc

SEQ ID NO: 1204341 - RNA, 21 nt, Human
ccccgggacuuggccgcgggc

SEQ ID NO: 1204342 - RNA, 25 nt, Human
ccccgggaggccccugagcuuugcc

SEQ ID NO: 1204343 - RNA, 23 nt, Human
ccccgggucacgcgcugcggccc

SEQ ID NO: 1204344 - RNA, 28 nt, Human
ccccgugccuucagcggcugcgcgucca

SEQ ID NO: 1204345 - RNA, 22 nt, Human
ccccuucucuuccuucaguccc

SEQ ID NO: 1204346 - RNA, 18 nt, Human
cccgagugucuggggcug

SEQ ID NO: 1204347 - RNA, 23 nt, Human
cccguggcccgagugucuggggc

SEQ ID NO: 1204348 - RNA, 22 nt, Human
cccucaguccagggcuggcccc

SEQ ID NO: 1204349 - RNA, 21 nt, Human
cccucaucucaacaguuuccc

SEQ ID NO: 1204350 - RNA, 19 nt, Human
cccugguagccuggggugg

SEQ ID NO: 1204351 - RNA, 21 nt, Human
ccgccccugccccacggcacu

SEQ ID NO: 1204352 - RNA, 19 nt, Human
ccgccgggggagggcccga

SEQ ID NO: 1204353 - RNA, 21 nt, Human
ccgccgggggagggcccgagu

SEQ ID NO: 1204354 - RNA, 19 nt, Human
ccgguccacccaguagcug

SEQ ID NO: 1204355 - RNA, 18 nt, Human
ccguagagcucaaagcug

SEQ ID NO: 1204356 - RNA, 21 nt, Human
ccucacacugacgcccgccac

SEQ ID NO: 1204357 - RNA, 19 nt, Human
ccuccgggcggcggacgca

SEQ ID NO: 1204358 - RNA, 23 nt, Human
ccuccucccucuggucccugggc

SEQ ID NO: 1204359 - RNA, 18 nt, Human
ccuccuggcucuccucac

SEQ ID NO: 1204360 - RNA, 20 nt, Human
ccugccccacggcacgggga

SEQ ID NO: 1204361 - RNA, 26 nt, Human
ccugggagccugggccucaguggugg

SEQ ID NO: 1204362 - RNA, 20 nt, Human
ccugggguggggaguccagg

SEQ ID NO: 1204363 - RNA, 19 nt, Human
cgccaugguguccgccggg

SEQ ID NO: 1204364 - RNA, 24 nt, Human
cgccccugccccacggcacgggga

SEQ ID NO: 1204365 - RNA, 22 nt, Human
cgccuccgguccacccaguagc

SEQ ID NO: 1204366 - RNA, 23 nt, Human
cgcgcagccgucagaggggacac

SEQ ID NO: 1204367 - RNA, 19 nt, Human
cgcgcugcggccccgcgcc

SEQ ID NO: 1204368 - RNA, 25 nt, Human
cgcguacacgcaggagcaucgcgca

SEQ ID NO: 1204369 - RNA, 18 nt, Human
cggaacgucgcgcgguuc

SEQ ID NO: 1204370 - RNA, 19 nt, Human
cgggcagcaccugccuccu

SEQ ID NO: 1204371 - RNA, 21 nt, Human
cgucagggccuccaggacuga

SEQ ID NO: 1204372 - RNA, 24 nt, Human
cuccaccgcucucggcugcccccc

SEQ ID NO: 1204373 - RNA, 18 nt, Human
cuccuggguguccaggcu

SEQ ID NO: 1204374 - RNA, 21 nt, Human
cuccuggguguccaggcucau

SEQ ID NO: 1204375 - RNA, 21 nt, Human
cugcucaaagacgaacagcag

SEQ ID NO: 1204376 - RNA, 18 nt, Human
cugcuccugcugcagcuc

SEQ ID NO: 1204377 - RNA, 19 nt, Human
cugcugcccccccugcugc

SEQ ID NO: 1204378 - RNA, 24 nt, Human
cugcugcccccccugcugccggug

SEQ ID NO: 1204379 - RNA, 26 nt, Human
cuggaccacccacuuguugucccugg

SEQ ID NO: 1204380 - RNA, 21 nt, Human
cuggcgcugcagguacuccug

SEQ ID NO: 1204381 - RNA, 20 nt, Human
cugggccaccuucauggcgu

SEQ ID NO: 1204382 - RNA, 19 nt, Human
cugucucgggcuguggggg

SEQ ID NO: 1204383 - RNA, 19 nt, Human
gaagaagccaagucuuggg

SEQ ID NO: 1204384 - RNA, 18 nt, Human
gacccucagucuggugug

SEQ ID NO: 1204385 - RNA, 18 nt, Human
gacgggugcauggugggg

SEQ ID NO: 1204386 - RNA, 22 nt, Human
gagaggccacauucuguaaucc

SEQ ID NO: 1204387 - RNA, 18 nt, Human
gagcuggggcuggguguc

SEQ ID NO: 1204388 - RNA, 20 nt, Human
gaggaagaagccaagucuug

SEQ ID NO: 1204389 - RNA, 20 nt, Human
gaggaagaagccaagucuug

SEQ ID NO: 1204390 - RNA, 19 nt, Human
gcacagcagcugccccagg

SEQ ID NO: 1204391 - RNA, 21 nt, Human
gcagagccuggcacagcagcu

SEQ ID NO: 1204392 - RNA, 18 nt, Human
gcagagccuggcacagcg

SEQ ID NO: 1204393 - RNA, 19 nt, Human
gcagucugcugcccccccu

SEQ ID NO: 1204394 - RNA, 21 nt, Human
gccccgugccuucagcggcug

SEQ ID NO: 1204395 - RNA, 28 nt, Human
gcgcagccgucagaggggagggaacgcc

SEQ ID NO: 1204396 - RNA, 18 nt, Human
gcgggcugggcuacgggg

SEQ ID NO: 1204397 - RNA, 22 nt, Human
gcgucaggggucgcagaccagc

SEQ ID NO: 1204398 - RNA, 18 nt, Human
gcuccaaggacgccagcc

SEQ ID NO: 1204399 - RNA, 25 nt, Human
gcuccugcaggcaaagccccaggau

SEQ ID NO: 1204400 - RNA, 18 nt, Human
gcucucggcugccccccu

SEQ ID NO: 1204401 - RNA, 18 nt, Human
gcugccccagggcccgcu

SEQ ID NO: 1204402 - RNA, 21 nt, Human
gcugccccagguaggccuggc

SEQ ID NO: 1204403 - RNA, 22 nt, Human
gcugccugucucgggcuguggg

SEQ ID NO: 1204404 - RNA, 18 nt, Human
gcuucugcugcuccugcu

SEQ ID NO: 1204405 - RNA, 22 nt, Human
gcuugcuucugcugcuccugcu

SEQ ID NO: 1204406 - RNA, 22 nt, Human
ggaaggucuaggaaggcaaaag

SEQ ID NO: 1204407 - RNA, 23 nt, Human
ggaagucuuccaggaacuccugc

SEQ ID NO: 1204408 - RNA, 18 nt, Human
ggacgagaagaaggugac

SEQ ID NO: 1204409 - RNA, 22 nt, Human
ggagaaguguacaucgguccuc

SEQ ID NO: 1204410 - RNA, 18 nt, Human
ggagagcuggugaugggg

SEQ ID NO: 1204411 - RNA, 19 nt, Human
ggagagcuggugauggggg

SEQ ID NO: 1204412 - RNA, 23 nt, Human
ggaggaagaagccaagucuuggg

SEQ ID NO: 1204413 - RNA, 19 nt, Human
ggauccccucaucucaaca

SEQ ID NO: 1204414 - RNA, 20 nt, Human
ggcagcaccugccuccuggc

SEQ ID NO: 1204415 - RNA, 21 nt, Human
ggcaguggaggacgucagggc

SEQ ID NO: 1204416 - RNA, 21 nt, Human
ggccgggagcuccaccuuccc

SEQ ID NO: 1204417 - RNA, 27 nt, Human
ggcgacaggggcaggccgggagcucca

SEQ ID NO: 1204418 - RNA, 18 nt, Human
ggcucuggaaagugcccc

SEQ ID NO: 1204419 - RNA, 21 nt, Human
ggcucuggaaagugccccagg

SEQ ID NO: 1204420 - RNA, 22 nt, Human
gggaagaaggagucgggguugg

SEQ ID NO: 1204421 - RNA, 23 nt, Human
gggaaggucuaggaaggcaaaag

SEQ ID NO: 1204422 - RNA, 18 nt, Human
gggagccccuucucuucc

SEQ ID NO: 1204423 - RNA, 23 nt, Human
gggcacaggccuccucccuggga

SEQ ID NO: 1204424 - RNA, 22 nt, Human
gggcagggucuggcauggccga

SEQ ID NO: 1204425 - RNA, 25 nt, Human
ggggauggccaggcucuggaaagug

SEQ ID NO: 1204426 - RNA, 20 nt, Human
ggggcuggacgagaagaagg

SEQ ID NO: 1204427 - RNA, 22 nt, Human
gguccuccagcccuggaugcag

SEQ ID NO: 1204428 - RNA, 21 nt, Human
gucacagcugcgguccacggc

SEQ ID NO: 1204429 - RNA, 18 nt, Human
guccagggcuggccccgu

SEQ ID NO: 1204430 - RNA, 24 nt, Human
gucuaggaaggcaaaagcaggggc

SEQ ID NO: 1204431 - RNA, 20 nt, Human
gugagugggucccagccccg

SEQ ID NO: 1204432 - RNA, 19 nt, Human
uaagggugccagcaaggcc

SEQ ID NO: 1204433 - RNA, 19 nt, Human
uacccuggguccugggagc

SEQ ID NO: 1204434 - RNA, 20 nt, Human
uagaaccagauggucagggg

SEQ ID NO: 1204435 - RNA, 28 nt, Human
ucagagcugugaagaccuggugggggag

SEQ ID NO: 1204436 - RNA, 23 nt, Human
ucagcggcugcgcguccaacagc

SEQ ID NO: 1204437 - RNA, 20 nt, Human
uccacauguugugugcgggc

SEQ ID NO: 1204438 - RNA, 20 nt, Human
uccagauguuccggagcccg

SEQ ID NO: 1204439 - RNA, 22 nt, Human
uccaggccccgcaggcgcaugc

SEQ ID NO: 1204440 - RNA, 23 nt, Human
uccaggcccugagcaucccccgg

SEQ ID NO: 1204441 - RNA, 18 nt, Human
uccaugcacacuaugucu

SEQ ID NO: 1204442 - RNA, 20 nt, Human
uccaugcacacuaugucucg

SEQ ID NO: 1204443 - RNA, 21 nt, Human
uccaugcacacuaugucucgg

SEQ ID NO: 1204444 - RNA, 20 nt, Human
ucccaaggacgaagucagcc

SEQ ID NO: 1204445 - RNA, 18 nt, Human
ucccagcagcuuuggugc

SEQ ID NO: 1204446 - RNA, 21 nt, Human
uccccacguccuccucuccgc

SEQ ID NO: 1204447 - RNA, 18 nt, Human
ucccucuggucccugggc

SEQ ID NO: 1204448 - RNA, 20 nt, Human
ucccucuggucccugggcuu

SEQ ID NO: 1204449 - RNA, 23 nt, Human
ucccucuggucccugggcuugcu

SEQ ID NO: 1204450 - RNA, 18 nt, Human
ucccuggaaagagggugg

SEQ ID NO: 1204451 - RNA, 21 nt, Human
ucccuggaaagaggguggucu

SEQ ID NO: 1204452 - RNA, 23 nt, Human
ucccugggcagggucuggcaugg

SEQ ID NO: 1204453 - RNA, 21 nt, Human
ucccuucaggcagagcugggg

SEQ ID NO: 1204454 - RNA, 18 nt, Human
uccgccgggggagggccc

SEQ ID NO: 1204455 - RNA, 21 nt, Human
uccgugagugggucccagccc

SEQ ID NO: 1204456 - RNA, 22 nt, Human
uccgugagugggucccagcccu

SEQ ID NO: 1204457 - RNA, 18 nt, Human
uccucccacucggccuca

SEQ ID NO: 1204458 - RNA, 21 nt, Human
uccuccccacguccuccucuc

SEQ ID NO: 1204459 - RNA, 24 nt, Human
uccugauguacccuggguccuggg

SEQ ID NO: 1204460 - RNA, 18 nt, Human
uccuggguguccaggcuc

SEQ ID NO: 1204461 - RNA, 19 nt, Human
uccuugauugcuuuuucug

SEQ ID NO: 1204462 - RNA, 21 nt, Human
ucgauguccucaugcuccagc

SEQ ID NO: 1204463 - RNA, 19 nt, Human
ucuccuccacacgguccau

SEQ ID NO: 1204464 - RNA, 22 nt, Human
ucuccuggguguccaggcucau

SEQ ID NO: 1204465 - RNA, 21 nt, Human
ugaagaccugguggggacccc

SEQ ID NO: 1204466 - RNA, 22 nt, Human
ugaccuggacauggacacgggg

SEQ ID NO: 1204467 - RNA, 19 nt, Human
ugagaacaggagaggccac

SEQ ID NO: 1204468 - RNA, 21 nt, Human
ugaggagaaaccagggccuua

SEQ ID NO: 1204469 - RNA, 25 nt, Human
ugaggcagagccgcagguaguaguc

SEQ ID NO: 1204470 - RNA, 21 nt, Human
ugcaaaaccuggggagccaca

SEQ ID NO: 1204471 - RNA, 26 nt, Human
ugcacacagcugggccgugaccggcg

SEQ ID NO: 1204472 - RNA, 22 nt, Human
ugcacagguggauggcgcuguc

SEQ ID NO: 1204473 - RNA, 25 nt, Human
ugcaccagaaucgccuugcgccucc

SEQ ID NO: 1204474 - RNA, 23 nt, Human
ugcagaggcuguagcagcguggg

SEQ ID NO: 1204475 - RNA, 18 nt, Human
ugcaucugcaaaaccugg

SEQ ID NO: 1204476 - RNA, 26 nt, Human
ugcaucugcaaaaccuggggagccac

SEQ ID NO: 1204477 - RNA, 18 nt, Human
ugccagcaaggccagggg

SEQ ID NO: 1204478 - RNA, 19 nt, Human
ugccagcaaggccaggggg

SEQ ID NO: 1204479 - RNA, 18 nt, Human
ugccucagcauuuucagc

SEQ ID NO: 1204480 - RNA, 19 nt, Human
ugccucagcauuuucagca

SEQ ID NO: 1204481 - RNA, 18 nt, Human
ugcuauuuuguaucuguc

SEQ ID NO: 1204482 - RNA, 18 nt, Human
ugcucccggccuccuccc

SEQ ID NO: 1204483 - RNA, 25 nt, Human
ugcugggucagguccucccacucgg

SEQ ID NO: 1204484 - RNA, 26 nt, Human
ugcugucuucaggccccgcagcacca

SEQ ID NO: 1204485 - RNA, 19 nt, Human
uggaaagaggguggucugc

SEQ ID NO: 1204486 - RNA, 21 nt, Human
uggaaagaggguggucugcag

SEQ ID NO: 1204487 - RNA, 21 nt, Human
uggaagugggcggggcuggac

SEQ ID NO: 1204488 - RNA, 22 nt, Human
uggaagugggcggggcuggacg

SEQ ID NO: 1204489 - RNA, 22 nt, Human
uggaaucggcggcagucaguga

SEQ ID NO: 1204490 - RNA, 18 nt, Human
uggagagcuggugauggg

SEQ ID NO: 1204491 - RNA, 24 nt, Human
uggaggaagaagccaagucuuggg

SEQ ID NO: 1204492 - RNA, 18 nt, Human
uggaugcagaugccuggg

SEQ ID NO: 1204493 - RNA, 23 nt, Human
uggcaagcucugucgacucugcc

SEQ ID NO: 1204494 - RNA, 25 nt, Human
uggcaagcucugucgacucugcuca

SEQ ID NO: 1204495 - RNA, 20 nt, Human
uggcacaccuugcacgcgau

SEQ ID NO: 1204496 - RNA, 21 nt, Human
uggcauggccgaggggccccg

SEQ ID NO: 1204497 - RNA, 22 nt, Human
uggccaggcucuggaaagugcc

SEQ ID NO: 1204498 - RNA, 23 nt, Human
uggcgacaggggcaggccgggag

SEQ ID NO: 1204499 - RNA, 20 nt, Human
ugggaaggucuaggaaggca

SEQ ID NO: 1204500 - RNA, 18 nt, Human
ugggagacgcuguuggcg

SEQ ID NO: 1204501 - RNA, 21 nt, Human
ugggagccugggccucagugg

SEQ ID NO: 1204502 - RNA, 18 nt, Human
ugggaggcgaccccaagg

SEQ ID NO: 1204503 - RNA, 22 nt, Human
ugggcagacucagagcugugaa

SEQ ID NO: 1204504 - RNA, 23 nt, Human
uggggcuccaaggacgccagccg

SEQ ID NO: 1204505 - RNA, 20 nt, Human
uggguggcggcagucaguga

SEQ ID NO: 1204506 - RNA, 19 nt, Human
uggugaugggggucccugg

SEQ ID NO: 1204507 - RNA, 19 nt, Human
ugguggggcuggaauugau

SEQ ID NO: 1204508 - RNA, 22 nt, Human
uggugucacagaugagcagcgg

SEQ ID NO: 1204509 - RNA, 21 nt, Human
ugugcacacagcugggccgug

SEQ ID NO: 1204510 - RNA, 18 nt, Human
uguggaaucggcggcagu

SEQ ID NO: 1204511 - RNA, 21 nt, Human
uucauccucgacauccggaau

SEQ ID NO: 1204512 - RNA, 23 nt, Human
uugcgaggcuccacgugguccug

SEQ ID NO: 1204513 - RNA, 19 nt, Human
uugguggugaaggaggcug

SEQ ID NO: 1204514 - RNA, 19 nt, Human
uugguggugaaggaggcug

SEQ ID NO: 1204515 - RNA, 24 nt, Human
uugguggugaaggaggcugucuuu

SEQ ID NO: 1204516 - RNA, 21 nt, Human
uuucuuugacuuuggcacaug

SEQ ID NO: 1204517 - RNA, 24 nt, Human
ccuuagccaggagaguccuggggc

SEQ ID NO: 1204518 - RNA, 23 nt, Human
gaaauccccugauuucuccaccu

SEQ ID NO: 1204519 - RNA, 21 nt, Human
cccacagccgggguccucucu

SEQ ID NO: 1204520 - RNA, 18 nt, Human
ccccgcucccuccucuuc

SEQ ID NO: 1204521 - RNA, 20 nt, Human
ccccgcucccuccucuucuc

SEQ ID NO: 1204522 - RNA, 20 nt, Human
ccuccucuucucccacagcc

SEQ ID NO: 1204523 - RNA, 24 nt, Human
cgccccgcucccuccucuucuccc

SEQ ID NO: 1204524 - RNA, 18 nt, Human
cucccuccucuucuccca

SEQ ID NO: 1204525 - RNA, 24 nt, Human
gccccgcucccuccucuucuccca

SEQ ID NO: 1204526 - RNA, 18 nt, Human
gcgcgccgucuccuggcu

SEQ ID NO: 1204527 - RNA, 23 nt, Human
ggggcgcgccgucuccuggcuuc

SEQ ID NO: 1204528 - RNA, 18 nt, Human
caagaaaggaagauggcg

SEQ ID NO: 1204529 - RNA, 20 nt, Human
gaagauggcgggaggaccca

SEQ ID NO: 1204530 - RNA, 21 nt, Human
gggaggacccaggagcagagc

SEQ ID NO: 1204531 - RNA, 22 nt, Human
aaccucauccacaagcacuuga

SEQ ID NO: 1204532 - RNA, 22 nt, Human
aagcacaagggcugccagaaac

SEQ ID NO: 1204533 - RNA, 28 nt, Human
aagugaauccuucuuucucgugaaaccc

SEQ ID NO: 1204534 - RNA, 20 nt, Human
acaagggcugccagaaaccu

SEQ ID NO: 1204535 - RNA, 19 nt, Human
acagacaacuucacagcaa

SEQ ID NO: 1204536 - RNA, 27 nt, Human
acagacaacuucacagcaacacgcaaa

SEQ ID NO: 1204537 - RNA, 21 nt, Human
acaggacauuaaacacaguuc

SEQ ID NO: 1204538 - RNA, 24 nt, Human
accucacacaaggucagaucccac

SEQ ID NO: 1204539 - RNA, 18 nt, Human
accuugacagagagaaaa

SEQ ID NO: 1204540 - RNA, 19 nt, Human
acuaugggcuccauucaga

SEQ ID NO: 1204541 - RNA, 22 nt, Human
acuucuuggguaaggacuaguu

SEQ ID NO: 1204542 - RNA, 24 nt, Human
aggcuaaccucacacaaggucaga

SEQ ID NO: 1204543 - RNA, 21 nt, Human
agugaacugcauuccccaagc

SEQ ID NO: 1204544 - RNA, 21 nt, Human
augaagcacaaugaauggacg

SEQ ID NO: 1204545 - RNA, 23 nt, Human
caacaccugggacuacaacagga

SEQ ID NO: 1204546 - RNA, 25 nt, Human
caacuucacagcaacacgcaaagcc

SEQ ID NO: 1204547 - RNA, 21 nt, Human
caauguuuggcaagcguccca

SEQ ID NO: 1204548 - RNA, 18 nt, Human
cacacacaaagaugggga

SEQ ID NO: 1204549 - RNA, 19 nt, Human
cacgcaaagccuaagcgua

SEQ ID NO: 1204550 - RNA, 21 nt, Human
cagacuucaggcuaaccucac

SEQ ID NO: 1204551 - RNA, 22 nt, Human
cagacuucaggcuaaccucaca

SEQ ID NO: 1204552 - RNA, 25 nt, Human
ccacauguaaaccaucugcaggguu

SEQ ID NO: 1204553 - RNA, 21 nt, Human
ccagaggcuacuacuucuugg

SEQ ID NO: 1204554 - RNA, 20 nt, Human
cccaaaccacauguaaacca

SEQ ID NO: 1204555 - RNA, 23 nt, Human
cccaaaccacauguaaaccaucu

SEQ ID NO: 1204556 - RNA, 19 nt, Human
ccugggacuacaacaggac

SEQ ID NO: 1204557 - RNA, 23 nt, Human
cuacacacuaaagcacgccuuua

SEQ ID NO: 1204558 - RNA, 24 nt, Human
ggacuacaacaggacauuaaacaa

SEQ ID NO: 1204559 - RNA, 21 nt, Human
ggacucaauguuuggcaagcg

SEQ ID NO: 1204560 - RNA, 22 nt, Human
ggcugccagaaaccuugacaga

SEQ ID NO: 1204561 - RNA, 25 nt, Human
uaaaagcacaagggcugccagaaac

SEQ ID NO: 1204562 - RNA, 24 nt, Human
uaagagauuuucuuagguuguuuu

SEQ ID NO: 1204563 - RNA, 24 nt, Human
uacaacaccugggacuacaacagg

SEQ ID NO: 1204564 - RNA, 19 nt, Human
uauaaaagcacaagggcug

SEQ ID NO: 1204565 - RNA, 24 nt, Human
uauauauccucaagugaaugauac

SEQ ID NO: 1204566 - RNA, 20 nt, Human
uccccaagcaccugcuucua

SEQ ID NO: 1204567 - RNA, 22 nt, Human
uccccaagcaccugcuucuaag

SEQ ID NO: 1204568 - RNA, 22 nt, Human
ugaauggacggcuauucgucca

SEQ ID NO: 1204569 - RNA, 28 nt, Human
ugcuucuaagagauuuucuuagguuguu

SEQ ID NO: 1204570 - RNA, 20 nt, Human
ugggaagugaauccuucuuu

SEQ ID NO: 1204571 - RNA, 18 nt, Human
uguguaaauauauauaua

SEQ ID NO: 1204572 - RNA, 18 nt, Human
uguguaaauauauauaua

SEQ ID NO: 1204573 - RNA, 22 nt, Human
uguguaaauauauauauauaua

SEQ ID NO: 1204574 - RNA, 24 nt, Human
uguguguaaauauauauauauaac

SEQ ID NO: 1204575 - RNA, 21 nt, Human
uucacagcaacacgcaaagcc

SEQ ID NO: 1204576 - RNA, 31 nt, Human
uuuauuguguguaaauauauauauauauauu

SEQ ID NO: 1204577 - RNA, 19 nt, Human
uuucucgugaaacccaaac

SEQ ID NO: 1204578 - RNA, 20 nt, Human
uuucuuauguuuugacauuc

SEQ ID NO: 1204579 - RNA, 22 nt, Human
uuuuccaacuaugggcuccauu

SEQ ID NO: 1204580 - RNA, 26 nt, Human
aggaaggccugguggaacagaggacu

SEQ ID NO: 1204581 - RNA, 20 nt, Human
ccccugaggaaggccuggug

SEQ ID NO: 1204582 - RNA, 21 nt, Human
ccccugaggaaggccuggugg

SEQ ID NO: 1204583 - RNA, 19 nt, Human
cuccagugaggaacugagg

SEQ ID NO: 1204584 - RNA, 22 nt, Human
gccaaauauauguccuugccac

SEQ ID NO: 1204585 - RNA, 24 nt, Human
ggacuccagugaggaacugacugu

SEQ ID NO: 1204586 - RNA, 23 nt, Human
ugaaaacacacuucgauaagucc

SEQ ID NO: 1204587 - RNA, 21 nt, Human
ugugaaaacacacuucgauaa

SEQ ID NO: 1204588 - RNA, 21 nt, Human
aaagggcagaggagagcagga

SEQ ID NO: 1204589 - RNA, 21 nt, Human
aaccaaugcgaugaggacgca

SEQ ID NO: 1204590 - RNA, 23 nt, Human
acagaggcaggaggcaggaggga

SEQ ID NO: 1204591 - RNA, 21 nt, Human
acgcacagcacuccagggcug

SEQ ID NO: 1204592 - RNA, 25 nt, Human
acgcacagcacuccagggcugcagc

SEQ ID NO: 1204593 - RNA, 19 nt, Human
aggagcagggccuggucag

SEQ ID NO: 1204594 - RNA, 21 nt, Human
aggaggcaggagggaaggagu

SEQ ID NO: 1204595 - RNA, 21 nt, Human
agggcagaggagagcaggaaa

SEQ ID NO: 1204596 - RNA, 19 nt, Human
aggggguucagaucaccug

SEQ ID NO: 1204597 - RNA, 20 nt, Human
cagaggcaggaggcaggagg

SEQ ID NO: 1204598 - RNA, 18 nt, Human
cagcacuccagggcugca

SEQ ID NO: 1204599 - RNA, 18 nt, Human
caggaggcaggagggaag

SEQ ID NO: 1204600 - RNA, 19 nt, Human
caggagggaaggagugcag

SEQ ID NO: 1204601 - RNA, 21 nt, Human
caggagggaaggagugcagca

SEQ ID NO: 1204602 - RNA, 22 nt, Human
ccgaccccagcagaggagcagg

SEQ ID NO: 1204603 - RNA, 24 nt, Human
cgaugaggacgcacagcacuccag

SEQ ID NO: 1204604 - RNA, 25 nt, Human
cgcacagcacuccagggcugcagcu

SEQ ID NO: 1204605 - RNA, 19 nt, Human
cggggccgaccccagcagg

SEQ ID NO: 1204606 - RNA, 21 nt, Human
gcucggggggccuuuggccgg

SEQ ID NO: 1204607 - RNA, 18 nt, Human
ggagcagggccuggucag

SEQ ID NO: 1204608 - RNA, 21 nt, Human
ggaggcaggagggaaggagug

SEQ ID NO: 1204609 - RNA, 20 nt, Human
gggcagggcccuggagcacg

SEQ ID NO: 1204610 - RNA, 19 nt, Human
gggccgaccccagcagagg

SEQ ID NO: 1204611 - RNA, 19 nt, Human
gguccuuuucagaaagggc

SEQ ID NO: 1204612 - RNA, 18 nt, Human
guccuuuucagaaagggc

SEQ ID NO: 1204613 - RNA, 18 nt, Human
ugauucuguuuggcaagu

SEQ ID NO: 1204614 - RNA, 18 nt, Human
ugcagcacauaugugcgu

SEQ ID NO: 1204615 - RNA, 24 nt, Human
ugcucggggggccuuuggccgggu

SEQ ID NO: 1204616 - RNA, 18 nt, Human
uggagcacgaaccaaugc

SEQ ID NO: 1204617 - RNA, 18 nt, Human
uggcaagucauaagcugu

SEQ ID NO: 1204618 - RNA, 19 nt, Human
uggccggguugcccaggaa

SEQ ID NO: 1204619 - RNA, 18 nt, Human
uuuggcaagucauaagcu

SEQ ID NO: 1204620 - RNA, 19 nt, Human
aaagcagaacaaaauaaga

SEQ ID NO: 1204621 - RNA, 18 nt, Human
aacaggaguuucaaaagc

SEQ ID NO: 1204622 - RNA, 24 nt, Human
agccagcaucuauuuuuaacaggg

SEQ ID NO: 1204623 - RNA, 20 nt, Human
agcccagacuacugagcccc

SEQ ID NO: 1204624 - RNA, 21 nt, Human
agcuacaauuaaauauugauc

SEQ ID NO: 1204625 - RNA, 21 nt, Human
agggagaaucaucuuugucuu

SEQ ID NO: 1204626 - RNA, 22 nt, Human
auaaagacaaacauaaagcaga

SEQ ID NO: 1204627 - RNA, 25 nt, Human
auaaagacaaacauaaagcagaaca

SEQ ID NO: 1204628 - RNA, 26 nt, Human
auccuggaccuuuccucuuuccuccu

SEQ ID NO: 1204629 - RNA, 21 nt, Human
auucugguuuugacaguuugg

SEQ ID NO: 1204630 - RNA, 22 nt, Human
cacagcccagacuacugagccc

SEQ ID NO: 1204631 - RNA, 24 nt, Human
cagaacaaaauaagauauucuuuc

SEQ ID NO: 1204632 - RNA, 18 nt, Human
cagguccuggacgccacc

SEQ ID NO: 1204633 - RNA, 20 nt, Human
cagguccuggacgccacccu

SEQ ID NO: 1204634 - RNA, 22 nt, Human
cauaaagcagaacaaaauaaga

SEQ ID NO: 1204635 - RNA, 19 nt, Human
cauaccggaugaugauuua

SEQ ID NO: 1204636 - RNA, 18 nt, Human
cccaaaagaucugccacc

SEQ ID NO: 1204637 - RNA, 21 nt, Human
cccaaaagaucugccaccugc

SEQ ID NO: 1204638 - RNA, 22 nt, Human
cccagagggucuggaggguucu

SEQ ID NO: 1204639 - RNA, 18 nt, Human
ccccucuccucccucuaa

SEQ ID NO: 1204640 - RNA, 20 nt, Human
ccucuaaaaaggggagaaaa

SEQ ID NO: 1204641 - RNA, 23 nt, Human
ccuguuccauugaugcccaaaag

SEQ ID NO: 1204642 - RNA, 20 nt, Human
cucuaaaaaggggagaaaaa

SEQ ID NO: 1204643 - RNA, 21 nt, Human
cucuaaaaaggggagaaaaac

SEQ ID NO: 1204644 - RNA, 19 nt, Human
cucuccucccucuaaaaag

SEQ ID NO: 1204645 - RNA, 21 nt, Human
cuuuccucuuuccuccuuacu

SEQ ID NO: 1204646 - RNA, 25 nt, Human
cuuuccuuucuucauuuugguuuuu

SEQ ID NO: 1204647 - RNA, 28 nt, Human
gucuugugguagucgcucuucccucugg

SEQ ID NO: 1204648 - RNA, 18 nt, Human
gugguagucgcucuuccc

SEQ ID NO: 1204649 - RNA, 20 nt, Human
uaaaaugcugugcauacaac

SEQ ID NO: 1204650 - RNA, 19 nt, Human
uaaagacaaacauaaagca

SEQ ID NO: 1204651 - RNA, 21 nt, Human
uaaagacaaacauaaagcaga

SEQ ID NO: 1204652 - RNA, 18 nt, Human
uaaguucuuggauuuggc

SEQ ID NO: 1204653 - RNA, 25 nt, Human
uacaaguuuguaugaaauacugguu

SEQ ID NO: 1204654 - RNA, 22 nt, Human
uagcccagagggucuggagggu

SEQ ID NO: 1204655 - RNA, 21 nt, Human
uaguguucuaaagaaguacau

SEQ ID NO: 1204656 - RNA, 21 nt, Human
ucaguggacaccuucaggucu

SEQ ID NO: 1204657 - RNA, 23 nt, Human
ucauuguuagggccugauucgga

SEQ ID NO: 1204658 - RNA, 20 nt, Human
ucuaaaaaggggagaaaaac

SEQ ID NO: 1204659 - RNA, 19 nt, Human
ugcccaaaagaucugccac

SEQ ID NO: 1204660 - RNA, 21 nt, Human
uggaacaauauugauccagga

SEQ ID NO: 1204661 - RNA, 20 nt, Human
uggaauucaaauacucuuaa

SEQ ID NO: 1204662 - RNA, 20 nt, Human
uguuucaacuaacuuauuuc

SEQ ID NO: 1204663 - RNA, 19 nt, Human
uuacuauuauuuuaguccg

SEQ ID NO: 1204664 - RNA, 20 nt, Human
uuccauugaugcccaaaaga

SEQ ID NO: 1204665 - RNA, 20 nt, Human
uucugguuuugacaguuugg

SEQ ID NO: 1204666 - RNA, 21 nt, Human
uuguaugaaauacugguuuca

SEQ ID NO: 1204667 - RNA, 21 nt, Human
uugucuuuuuacauuuccccu

SEQ ID NO: 1204668 - RNA, 24 nt, Human
uuucauggcugcacuuaaaaugcu

SEQ ID NO: 1204669 - RNA, 22 nt, Human
gcugaacacacuguagggcccu

SEQ ID NO: 1204670 - RNA, 20 nt, Human
ggcccuagaaauugcaggug

SEQ ID NO: 1204671 - RNA, 19 nt, Human
aaaaaggugaauacaggcu

SEQ ID NO: 1204672 - RNA, 23 nt, Human
aaaaauacaaaagaaagccaucc

SEQ ID NO: 1204673 - RNA, 23 nt, Human
aacacuuuauauuaguuaacuag

SEQ ID NO: 1204674 - RNA, 19 nt, Human
aagcagguucuacaugaug

SEQ ID NO: 1204675 - RNA, 22 nt, Human
aaugauauuacaguugaaugua

SEQ ID NO: 1204676 - RNA, 21 nt, Human
acacaauuacaaugauauuac

SEQ ID NO: 1204677 - RNA, 18 nt, Human
acugaaaaaggugaauac

SEQ ID NO: 1204678 - RNA, 18 nt, Human
agaaaucaaaaggauuua

SEQ ID NO: 1204679 - RNA, 19 nt, Human
auaaaaccaugucaauauc

SEQ ID NO: 1204680 - RNA, 22 nt, Human
aucaaugucaaagcagguucua

SEQ ID NO: 1204681 - RNA, 25 nt, Human
cacaaaauauacuuacaauuucaaa

SEQ ID NO: 1204682 - RNA, 22 nt, Human
caccaaaggauaauauauuagc

SEQ ID NO: 1204683 - RNA, 23 nt, Human
ccauacauucaugcacuguuggc

SEQ ID NO: 1204684 - RNA, 21 nt, Human
gcccaauaacugagaaggcac

SEQ ID NO: 1204685 - RNA, 24 nt, Human
ggacaaaugugaucuaaaaucaga

SEQ ID NO: 1204686 - RNA, 25 nt, Human
gugguguaauaauuugccuaaguua

SEQ ID NO: 1204687 - RNA, 21 nt, Human
uaacugagaaggcacacaauu

SEQ ID NO: 1204688 - RNA, 19 nt, Human
uacaaacauucauugugcu

SEQ ID NO: 1204689 - RNA, 23 nt, Human
uacaaacauucauugugcucuuu

SEQ ID NO: 1204690 - RNA, 21 nt, Human
uacacugaaaaaggugaauac

SEQ ID NO: 1204691 - RNA, 24 nt, Human
uacuuugugacuggggacuggaau

SEQ ID NO: 1204692 - RNA, 24 nt, Human
uaugacagaaauacacugaaaaag

SEQ ID NO: 1204693 - RNA, 21 nt, Human
ugaauacaggcuucacaaaau

SEQ ID NO: 1204694 - RNA, 20 nt, Human
ugagaaggcacacaauuaca

SEQ ID NO: 1204695 - RNA, 23 nt, Human
ugagaaggcacacaauuacaaug

SEQ ID NO: 1204696 - RNA, 25 nt, Human
ugaggacaaaugugaucuaaaauca

SEQ ID NO: 1204697 - RNA, 23 nt, Human
ugucauauguccaaaacuaaaau

SEQ ID NO: 1204698 - RNA, 22 nt, Human
uguccaaaacuaaaauaaaacc

SEQ ID NO: 1204699 - RNA, 19 nt, Human
cugggugacaugcuguucu

SEQ ID NO: 1204700 - RNA, 18 nt, Human
gccagaauucauucuggg

SEQ ID NO: 1204701 - RNA, 21 nt, Human
ugacaugcuguucuuggcugc

SEQ ID NO: 1204702 - RNA, 23 nt, Human
ugacaugcuguucuuggcugcua

SEQ ID NO: 1204703 - RNA, 21 nt, Human
uggcugcuaaggaagugauau

SEQ ID NO: 1204704 - RNA, 18 nt, Human
acuccauugggugcuuuu

SEQ ID NO: 1204705 - RNA, 22 nt, Human
ucuuuuggcucugucacucuga

SEQ ID NO: 1204706 - RNA, 20 nt, Human
uggcucugucacucugaggu

SEQ ID NO: 1204707 - RNA, 18 nt, Human
aaaacccuuggagggccc

SEQ ID NO: 1204708 - RNA, 20 nt, Human
acacugccccugggcagagc

SEQ ID NO: 1204709 - RNA, 20 nt, Human
accccagccacaggcccuuc

SEQ ID NO: 1204710 - RNA, 22 nt, Human
agagcacucaccuuccugaaga

SEQ ID NO: 1204711 - RNA, 25 nt, Human
agcacucaccuuccugaagacccag

SEQ ID NO: 1204712 - RNA, 22 nt, Human
agcagaccccagccacaggccc

SEQ ID NO: 1204713 - RNA, 22 nt, Human
agggacgcagagcucacacuga

SEQ ID NO: 1204714 - RNA, 22 nt, Human
ccacaggcccuucggauggucc

SEQ ID NO: 1204715 - RNA, 21 nt, Human
cucaccuuccugaagacccag

SEQ ID NO: 1204716 - RNA, 22 nt, Human
gaagacccagguugugcaaggg

SEQ ID NO: 1204717 - RNA, 23 nt, Human
ugaagacccagguugugcaaggg

SEQ ID NO: 1204718 - RNA, 18 nt, Human
ugugcaagggcccuccgc

SEQ ID NO: 1204719 - RNA, 27 nt, Human
uuucuggauucuucauacaggucagug

SEQ ID NO: 1204720 - RNA, 20 nt, Human
cagccacuggcuucaucuug

SEQ ID NO: 1204721 - RNA, 18 nt, Human
ccagccacuggcuucauc

SEQ ID NO: 1204722 - RNA, 21 nt, Human
gcuagaaucaucuucaaucca

SEQ ID NO: 1204723 - RNA, 20 nt, Human
ucaucuucaauccagccacu

SEQ ID NO: 1204724 - RNA, 21 nt, Human
agaccgaagccugaggcggaa

SEQ ID NO: 1204725 - RNA, 24 nt, Human
agcgccgcucccaacuccgcgccc

SEQ ID NO: 1204726 - RNA, 19 nt, Human
caccgagccgcugcucgag

SEQ ID NO: 1204727 - RNA, 23 nt, Human
cagaccgaagccugaggcggaac

SEQ ID NO: 1204728 - RNA, 23 nt, Human
cccgcggcugcgcagaccgaagc

SEQ ID NO: 1204729 - RNA, 23 nt, Human
ccgcucccaacuccgcgcccgcc

SEQ ID NO: 1204730 - RNA, 21 nt, Human
ccgcugcucgagcgccgcucc

SEQ ID NO: 1204731 - RNA, 21 nt, Human
ccucaguguggauggccaggg

SEQ ID NO: 1204732 - RNA, 22 nt, Human
cgccggcagcguagugcuggug

SEQ ID NO: 1204733 - RNA, 19 nt, Human
gccugaggcggaacugccc

SEQ ID NO: 1204734 - RNA, 20 nt, Human
gcuggugccugcagcccugg

SEQ ID NO: 1204735 - RNA, 24 nt, Human
uaaauagcucggggugcuccacga

SEQ ID NO: 1204736 - RNA, 20 nt, Human
uagcucggggugcuccacga

SEQ ID NO: 1204737 - RNA, 18 nt, Human
ugcccagagggaucucgg

SEQ ID NO: 1204738 - RNA, 20 nt, Human
ccacucuccaaacaagccuu

SEQ ID NO: 1204739 - RNA, 21 nt, Human
ccaguaaagucaccagggaca

SEQ ID NO: 1204740 - RNA, 22 nt, Human
ccuuccguggcccaguaaaguc

SEQ ID NO: 1204741 - RNA, 21 nt, Human
cugaaugccuuccguggccca

SEQ ID NO: 1204742 - RNA, 18 nt, Human
guccugaauggucuggau

SEQ ID NO: 1204743 - RNA, 22 nt, Human
uuccguggcccaguaaagucac

SEQ ID NO: 1204744 - RNA, 22 nt, Human
aggaagaggugggguggcaggg

SEQ ID NO: 1204745 - RNA, 22 nt, Human
aggauuggugccaggaaggcag

SEQ ID NO: 1204746 - RNA, 20 nt, Human
aggcagacaccagcgaggaa

SEQ ID NO: 1204747 - RNA, 20 nt, Human
aggcagcagccccaaagcgc

SEQ ID NO: 1204748 - RNA, 20 nt, Human
aggcccaggacaaacuccag

SEQ ID NO: 1204749 - RNA, 22 nt, Human
aggucuuucucugcucccagug

SEQ ID NO: 1204750 - RNA, 18 nt, Human
augcagaagaugaagagg

SEQ ID NO: 1204751 - RNA, 18 nt, Human
caccaggcugaccaggaa

SEQ ID NO: 1204752 - RNA, 22 nt, Human
caccguguuggagguccagggc

SEQ ID NO: 1204753 - RNA, 18 nt, Human
cagcagccccaaagcgcc

SEQ ID NO: 1204754 - RNA, 19 nt, Human
caggcugaccaggaacacc

SEQ ID NO: 1204755 - RNA, 27 nt, Human
ccaccaggcugaccaggaacaccgugu

SEQ ID NO: 1204756 - RNA, 20 nt, Human
cgaggaagaggugggguggc

SEQ ID NO: 1204757 - RNA, 19 nt, Human
gcaggcagcagccccaaag

SEQ ID NO: 1204758 - RNA, 22 nt, Human
gccaaacuguuccccaccaggc

SEQ ID NO: 1204759 - RNA, 19 nt, Human
gccgcguguggaugcagaa

SEQ ID NO: 1204760 - RNA, 18 nt, Human
ggaagaggugggguggca

SEQ ID NO: 1204761 - RNA, 23 nt, Human
ggugacgaggagguucggaaccc

SEQ ID NO: 1204762 - RNA, 20 nt, Human
ggugacgaggagguugaagg

SEQ ID NO: 1204763 - RNA, 22 nt, Human
guccagggccgcguguggaugc

SEQ ID NO: 1204764 - RNA, 22 nt, Human
ucagcaaaggcaggucuuucuc

SEQ ID NO: 1204765 - RNA, 21 nt, Human
uccagggccaggauuggugcc

SEQ ID NO: 1204766 - RNA, 21 nt, Human
ugacuuugcaggcagcagccc

SEQ ID NO: 1204767 - RNA, 21 nt, Human
ugcagaagaugaagagggcca

SEQ ID NO: 1204768 - RNA, 22 nt, Human
uggaugcagaagaugaagaggg

SEQ ID NO: 1204769 - RNA, 18 nt, Human
uggcagggcccauuugug

SEQ ID NO: 1204770 - RNA, 21 nt, Human
uggugccaggaaggcagacac

SEQ ID NO: 1204771 - RNA, 18 nt, Human
uguuggagguccagggcc

SEQ ID NO: 1204772 - RNA, 19 nt, Human
uugaaggagccugauggug

SEQ ID NO: 1204773 - RNA, 19 nt, Human
gcgggcagcuccgagaucu

SEQ ID NO: 1204774 - RNA, 18 nt, Human
uccacuguagacuuggga

SEQ ID NO: 1204775 - RNA, 22 nt, Human
uucugcucccccaggugcauca

SEQ ID NO: 1204776 - RNA, 18 nt, Human
uuucugagccucuugcuc

SEQ ID NO: 1204777 - RNA, 23 nt, Human
aaaaauaccagucuucacuuaca

SEQ ID NO: 1204778 - RNA, 19 nt, Human
aaaagaagaaaaauaccag

SEQ ID NO: 1204779 - RNA, 21 nt, Human
acucugagagcaaaagaagaa

SEQ ID NO: 1204780 - RNA, 24 nt, Human
acucugagagcaaaagaagaaaaa

SEQ ID NO: 1204781 - RNA, 21 nt, Human
caaaagaagaaaaauaccagu

SEQ ID NO: 1204782 - RNA, 21 nt, Human
ccucuaacaagguaacucuga

SEQ ID NO: 1204783 - RNA, 19 nt, Human
gcaaaagaagaaaaauacc

SEQ ID NO: 1204784 - RNA, 18 nt, Human
uaccagucuucacuuaca

SEQ ID NO: 1204785 - RNA, 21 nt, Human
ucugagagcaaaagaagaaaa

SEQ ID NO: 1204786 - RNA, 21 nt, Human
aaaauauaccauguacaucug

SEQ ID NO: 1204787 - RNA, 20 nt, Human
aaguaaccaggagaauaguc

SEQ ID NO: 1204788 - RNA, 20 nt, Human
auaguccaucaaaaaaauaa

SEQ ID NO: 1204789 - RNA, 18 nt, Human
gggaaaguaaccaggaga

SEQ ID NO: 1204790 - RNA, 18 nt, Human
ucaaaauauaccauguac

SEQ ID NO: 1204791 - RNA, 20 nt, Human
aaacacaggccuggccucgg

SEQ ID NO: 1204792 - RNA, 23 nt, Human
aaacacuagaguugcaauuugcc

SEQ ID NO: 1204793 - RNA, 19 nt, Human
aaggguggaaucggggguc

SEQ ID NO: 1204794 - RNA, 18 nt, Human
agagccagaucuccucag

SEQ ID NO: 1204795 - RNA, 19 nt, Human
aggaaaacacaggccuggc

SEQ ID NO: 1204796 - RNA, 25 nt, Human
aggaagggccuucgcaagcacgugg

SEQ ID NO: 1204797 - RNA, 23 nt, Human
cacaggccuggccucggggcacc

SEQ ID NO: 1204798 - RNA, 22 nt, Human
cacguaacaaauagcuugugug

SEQ ID NO: 1204799 - RNA, 18 nt, Human
cacugagaaccucccaaa

SEQ ID NO: 1204800 - RNA, 22 nt, Human
cagaaaacacuagaguugcaau

SEQ ID NO: 1204801 - RNA, 21 nt, Human
cagaccccagaggaugugaga

SEQ ID NO: 1204802 - RNA, 18 nt, Human
cagcagcccagggcuuau

SEQ ID NO: 1204803 - RNA, 18 nt, Human
cagcgcaggcgugggcag

SEQ ID NO: 1204804 - RNA, 24 nt, Human
cagcgcaggcgugggcagacccca

SEQ ID NO: 1204805 - RNA, 21 nt, Human
ccacagcagcccagggcuuau

SEQ ID NO: 1204806 - RNA, 28 nt, Human
ccacugagaaccucccaaagggcccucc

SEQ ID NO: 1204807 - RNA, 21 nt, Human
ccccugaggcuggaacagucu

SEQ ID NO: 1204808 - RNA, 19 nt, Human
ccugcaccuuugggcagcc

SEQ ID NO: 1204809 - RNA, 21 nt, Human
ccuucgcaagcacgugggagc

SEQ ID NO: 1204810 - RNA, 18 nt, Human
cugagaaccucccaaaga

SEQ ID NO: 1204811 - RNA, 23 nt, Human
cugccguuuuugccacccuugac

SEQ ID NO: 1204812 - RNA, 21 nt, Human
cuggaacagucucugaagagg

SEQ ID NO: 1204813 - RNA, 20 nt, Human
cuggaaguguggaugggcau

SEQ ID NO: 1204814 - RNA, 21 nt, Human
cuggccucggggcaccugcug

SEQ ID NO: 1204815 - RNA, 19 nt, Human
cuguggcacaccugggaga

SEQ ID NO: 1204816 - RNA, 25 nt, Human
gaaccugggccaggauauuuaggaa

SEQ ID NO: 1204817 - RNA, 24 nt, Human
gcgaacuguggaagcaggaagggc

SEQ ID NO: 1204818 - RNA, 21 nt, Human
ggaaggcuccuguauuaagag

SEQ ID NO: 1204819 - RNA, 27 nt, Human
gggaacuguggaggaaaaccgguaccc

SEQ ID NO: 1204820 - RNA, 24 nt, Human
guaacaaauagcuuguguggcuca

SEQ ID NO: 1204821 - RNA, 21 nt, Human
guggcucagcuuucugggaug

SEQ ID NO: 1204822 - RNA, 20 nt, Human
uagcucguggcgucaccccu

SEQ ID NO: 1204823 - RNA, 21 nt, Human
ucacaguaugggagguagggu

SEQ ID NO: 1204824 - RNA, 21 nt, Human
ucagaaaacacuagaguugca

SEQ ID NO: 1204825 - RNA, 23 nt, Human
ucaucagaaaacacuagaguugc

SEQ ID NO: 1204826 - RNA, 19 nt, Human
uccacggggaacuguggag

SEQ ID NO: 1204827 - RNA, 23 nt, Human
uccacggggaacuguggaggaaa

SEQ ID NO: 1204828 - RNA, 19 nt, Human
uccucaguaaggaaggcuc

SEQ ID NO: 1204829 - RNA, 21 nt, Human
uccucaguaaggaaggcuccu

SEQ ID NO: 1204830 - RNA, 23 nt, Human
ucugucccaacacguaacaaaua

SEQ ID NO: 1204831 - RNA, 21 nt, Human
ucuguguucaucagaaaacac

SEQ ID NO: 1204832 - RNA, 19 nt, Human
ugagaauagcgaacugugg

SEQ ID NO: 1204833 - RNA, 24 nt, Human
ugaggugcuuguggcuguggcaca

SEQ ID NO: 1204834 - RNA, 20 nt, Human
ugggagagccagaucuccuc

SEQ ID NO: 1204835 - RNA, 21 nt, Human
ugggagagccagaucuccuca

SEQ ID NO: 1204836 - RNA, 31 nt, Human
uguggaagcaggaagggccuucgcaagcacc

SEQ ID NO: 1204837 - RNA, 19 nt, Human
uuccacggggaacugugga

SEQ ID NO: 1204838 - RNA, 23 nt, Human
agaaacaggaaccuguggccagu

SEQ ID NO: 1204839 - RNA, 18 nt, Human
cagccccaagaaacagga

SEQ ID NO: 1204840 - RNA, 18 nt, Human
ccccaagaaacaggaacc

SEQ ID NO: 1204841 - RNA, 18 nt, Human
gccccaagaaacaggaac

SEQ ID NO: 1204842 - RNA, 22 nt, Human
gccccaagaaacaggaaccugu

SEQ ID NO: 1204843 - RNA, 20 nt, Human
uagcagccccaagaaacagg

SEQ ID NO: 1204844 - RNA, 18 nt, Human
ugaggugaagccccuggc

SEQ ID NO: 1204845 - RNA, 24 nt, Human
aaggacccaaggaguuuguacuug

SEQ ID NO: 1204846 - RNA, 23 nt, Human
aagguguuugagcuguagaguga

SEQ ID NO: 1204847 - RNA, 21 nt, Human
acuugguucugugggcagugg

SEQ ID NO: 1204848 - RNA, 18 nt, Human
agaaaggugaggcugaag

SEQ ID NO: 1204849 - RNA, 22 nt, Human
agccacugaagguguuugagcu

SEQ ID NO: 1204850 - RNA, 22 nt, Human
agcugcccauuuuucugacccc

SEQ ID NO: 1204851 - RNA, 23 nt, Human
agcuggaggccuccggggccagg

SEQ ID NO: 1204852 - RNA, 26 nt, Human
aggacccugguccucaggucuucugc

SEQ ID NO: 1204853 - RNA, 25 nt, Human
aggcagcagcugugucuggccuggc

SEQ ID NO: 1204854 - RNA, 24 nt, Human
aggccgggaacacaggugggcugc

SEQ ID NO: 1204855 - RNA, 18 nt, Human
agugggagccacugaagg

SEQ ID NO: 1204856 - RNA, 25 nt, Human
caaggcauggccaguugcaccugcc

SEQ ID NO: 1204857 - RNA, 24 nt, Human
caccugccuccuucagaggucugu

SEQ ID NO: 1204858 - RNA, 19 nt, Human
cagaggggccgcuguggaa

SEQ ID NO: 1204859 - RNA, 19 nt, Human
cagcucugcuccgccaggg

SEQ ID NO: 1204860 - RNA, 18 nt, Human
cagcugcugugccagcuc

SEQ ID NO: 1204861 - RNA, 25 nt, Human
caguagguagcacagccuuugggaa

SEQ ID NO: 1204862 - RNA, 21 nt, Human
cagugcccacgcgagccgcuc

SEQ ID NO: 1204863 - RNA, 22 nt, Human
cauccucucaucagcagcccca

SEQ ID NO: 1204864 - RNA, 18 nt, Human
ccacugggggucuuggcg

SEQ ID NO: 1204865 - RNA, 22 nt, Human
ccagcagcugaggaaccugugu

SEQ ID NO: 1204866 - RNA, 21 nt, Human
cccacgcgagccgcuccugug

SEQ ID NO: 1204867 - RNA, 20 nt, Human
cccuggggauccacagaggg

SEQ ID NO: 1204868 - RNA, 20 nt, Human
ccgcuccuguggcugugcuc

SEQ ID NO: 1204869 - RNA, 22 nt, Human
ccuagaccaggggcugugggac

SEQ ID NO: 1204870 - RNA, 22 nt, Human
ccuccagggaggacccuggucc

SEQ ID NO: 1204871 - RNA, 24 nt, Human
ccuccagggaggacccugguccuc

SEQ ID NO: 1204872 - RNA, 21 nt, Human
ccucugguggagccauccucu

SEQ ID NO: 1204873 - RNA, 18 nt, Human
ccugugcagcucuguggc

SEQ ID NO: 1204874 - RNA, 20 nt, Human
cgggcuugucaggcagcgcu

SEQ ID NO: 1204875 - RNA, 24 nt, Human
cgugcauugccuccucacacugau

SEQ ID NO: 1204876 - RNA, 22 nt, Human
cuacugggaaggcugcuggcug

SEQ ID NO: 1204877 - RNA, 22 nt, Human
cucaucagcagccccagccacu

SEQ ID NO: 1204878 - RNA, 18 nt, Human
cuccauggcucuugcugc

SEQ ID NO: 1204879 - RNA, 20 nt, Human
cuccauggcucuugcugccu

SEQ ID NO: 1204880 - RNA, 18 nt, Human
cuggaggccuccggggcc

SEQ ID NO: 1204881 - RNA, 19 nt, Human
cuuggcggggacagaaggg

SEQ ID NO: 1204882 - RNA, 19 nt, Human
gaaggggacaaggccaggu

SEQ ID NO: 1204883 - RNA, 22 nt, Human
gagcgggcuugucaggcagcgc

SEQ ID NO: 1204884 - RNA, 24 nt, Human
gcagcugaggaaccuguguuugga

SEQ ID NO: 1204885 - RNA, 19 nt, Human
gccauccucucaucagcag

SEQ ID NO: 1204886 - RNA, 20 nt, Human
gccgggaaagcagacuguca

SEQ ID NO: 1204887 - RNA, 18 nt, Human
gcuccuguggcugugcuc

SEQ ID NO: 1204888 - RNA, 20 nt, Human
gcucuguggcucugcagcug

SEQ ID NO: 1204889 - RNA, 18 nt, Human
ggaacacaggccgggaac

SEQ ID NO: 1204890 - RNA, 20 nt, Human
ggaaggggacaaggccaggu

SEQ ID NO: 1204891 - RNA, 19 nt, Human
ggccaggggccggcuccgg

SEQ ID NO: 1204892 - RNA, 21 nt, Human
ggccuccggggccaggggccg

SEQ ID NO: 1204893 - RNA, 18 nt, Human
ggcgcgggggagcgggcu

SEQ ID NO: 1204894 - RNA, 23 nt, Human
gggaaggggacaaggccaggugc

SEQ ID NO: 1204895 - RNA, 22 nt, Human
gggaggccaccucgggcagggg

SEQ ID NO: 1204896 - RNA, 24 nt, Human
gggaggccaccucgggcaggggca

SEQ ID NO: 1204897 - RNA, 21 nt, Human
gggcagugggagccacugaag

SEQ ID NO: 1204898 - RNA, 25 nt, Human
gggcagugggagccacugaaggugu

SEQ ID NO: 1204899 - RNA, 18 nt, Human
gggcugggaggccaccuc

SEQ ID NO: 1204900 - RNA, 21 nt, Human
ggggagcgggcuugucaggca

SEQ ID NO: 1204901 - RNA, 20 nt, Human
ggggguggguaggggccuag

SEQ ID NO: 1204902 - RNA, 18 nt, Human
ggguaggggccuagacca

SEQ ID NO: 1204903 - RNA, 25 nt, Human
ggguggguaggggccuagaccaggg

SEQ ID NO: 1204904 - RNA, 20 nt, Human
gguucugugggcagugggag

SEQ ID NO: 1204905 - RNA, 19 nt, Human
gguucugugggcagugggg

SEQ ID NO: 1204906 - RNA, 18 nt, Human
gucugguggaugguggau

SEQ ID NO: 1204907 - RNA, 21 nt, Human
gugcagcucuguggcccaggc

SEQ ID NO: 1204908 - RNA, 23 nt, Human
guggaugguggaugccccagccu

SEQ ID NO: 1204909 - RNA, 22 nt, Human
guggcucugcagcugcugugcc

SEQ ID NO: 1204910 - RNA, 21 nt, Human
uagagccccgcaguuggcucc

SEQ ID NO: 1204911 - RNA, 21 nt, Human
ucacaaggauuggcacgaguu

SEQ ID NO: 1204912 - RNA, 21 nt, Human
uccucucaucagcagccccag

SEQ ID NO: 1204913 - RNA, 19 nt, Human
uccugugcagcucuguggc

SEQ ID NO: 1204914 - RNA, 21 nt, Human
ucucaggcccuggggauccac

SEQ ID NO: 1204915 - RNA, 22 nt, Human
ucuggccuggcaccucuggugg

SEQ ID NO: 1204916 - RNA, 18 nt, Human
ugaaguaccagcucugcu

SEQ ID NO: 1204917 - RNA, 20 nt, Human
ugaggcugaagguggcaguu

SEQ ID NO: 1204918 - RNA, 19 nt, Human
ugccccagccugacucagu

SEQ ID NO: 1204919 - RNA, 21 nt, Human
ugccgggaaagcagacuguca

SEQ ID NO: 1204920 - RNA, 21 nt, Human
ugccugagcuacugggaaggc

SEQ ID NO: 1204921 - RNA, 25 nt, Human
ugccuugagagugcaauccagcagc

SEQ ID NO: 1204922 - RNA, 23 nt, Human
uggaggccuccggggccaggggc

SEQ ID NO: 1204923 - RNA, 20 nt, Human
uggcagcuggaggccuccgg

SEQ ID NO: 1204924 - RNA, 21 nt, Human
uggcagcuggaggccuccggg

SEQ ID NO: 1204925 - RNA, 24 nt, Human
uggcuugauuugggcugggaggcc

SEQ ID NO: 1204926 - RNA, 24 nt, Human
uggggauccacagaggggccgcug

SEQ ID NO: 1204927 - RNA, 21 nt, Human
uggggguggguaggggccuag

SEQ ID NO: 1204928 - RNA, 23 nt, Human
uggguaggggccuagaccagggg

SEQ ID NO: 1204929 - RNA, 24 nt, Human
uggguaggggccuagaccaggggc

SEQ ID NO: 1204930 - RNA, 23 nt, Human
ugguucugugggcagugggagcc

SEQ ID NO: 1204931 - RNA, 23 nt, Human
uguggcucugcagcugcugugcc

SEQ ID NO: 1204932 - RNA, 18 nt, Human
uucugugggcagugggag

SEQ ID NO: 1204933 - RNA, 20 nt, Human
uugagcugcucucaggcccu

SEQ ID NO: 1204934 - RNA, 19 nt, Human
uuugagaaaggugaggcug

SEQ ID NO: 1204935 - RNA, 18 nt, Human
uuuucugaccccacccgg

SEQ ID NO: 1204936 - RNA, 20 nt, Human
cccggccgagcuccacggug

SEQ ID NO: 1204937 - RNA, 19 nt, Human
ccgccgcgggccugcgguc

SEQ ID NO: 1204938 - RNA, 23 nt, Human
ccuccgauugggagggagggggc

SEQ ID NO: 1204939 - RNA, 19 nt, Human
cugcugcacugggccuggc

SEQ ID NO: 1204940 - RNA, 22 nt, Human
ggccuggcacgcaccuccucug

SEQ ID NO: 1204941 - RNA, 20 nt, Human
gggccugcggucccggccga

SEQ ID NO: 1204942 - RNA, 19 nt, Human
guguccagggcugcuggcu

SEQ ID NO: 1204943 - RNA, 22 nt, Human
uccacgguggcagggcuggccc

SEQ ID NO: 1204944 - RNA, 19 nt, Human
ugagcaggacacugcugca

SEQ ID NO: 1204945 - RNA, 22 nt, Human
ugcaggccgccgcgggccugcg

SEQ ID NO: 1204946 - RNA, 26 nt, Human
ugggagggagggggcgcucggcuucc

SEQ ID NO: 1204947 - RNA, 20 nt, Human
agacccccgggcggcauccc

SEQ ID NO: 1204948 - RNA, 18 nt, Human
agcgaagcgagugguggc

SEQ ID NO: 1204949 - RNA, 22 nt, Human
agcgggugccgguaacugaacg

SEQ ID NO: 1204950 - RNA, 23 nt, Human
aggcgguggccgggcuagugcgg

SEQ ID NO: 1204951 - RNA, 24 nt, Human
caccccgcgcgcgcgagcagaggc

SEQ ID NO: 1204952 - RNA, 22 nt, Human
ccccaccuugugcacccgcacc

SEQ ID NO: 1204953 - RNA, 18 nt, Human
ccccgcgcgcgcgagcag

SEQ ID NO: 1204954 - RNA, 18 nt, Human
cccgcacccgcccucaau

SEQ ID NO: 1204955 - RNA, 19 nt, Human
cccgcgcucgccgcggcuu

SEQ ID NO: 1204956 - RNA, 26 nt, Human
ccuagcccuggccugaaucccacaac

SEQ ID NO: 1204957 - RNA, 22 nt, Human
cgagcagaggcgguggccgggc

SEQ ID NO: 1204958 - RNA, 22 nt, Human
cgagugguggcggcagguggag

SEQ ID NO: 1204959 - RNA, 26 nt, Human
cgagugguggcggcagguggaguccc

SEQ ID NO: 1204960 - RNA, 21 nt, Human
cgccccaagacccccgggcgg

SEQ ID NO: 1204961 - RNA, 23 nt, Human
cgccccaagacccccgggcggca

SEQ ID NO: 1204962 - RNA, 20 nt, Human
cucaauaccggcgggcagcu

SEQ ID NO: 1204963 - RNA, 24 nt, Human
cucaauaccggcgggcagcuccuc

SEQ ID NO: 1204964 - RNA, 23 nt, Human
cugaaucccacaacuggcgcccc

SEQ ID NO: 1204965 - RNA, 24 nt, Human
cugguggagcaacggacguuucuc

SEQ ID NO: 1204966 - RNA, 18 nt, Human
gagcgcccgcggugaggc

SEQ ID NO: 1204967 - RNA, 19 nt, Human
gaguuugcgagcgagggag

SEQ ID NO: 1204968 - RNA, 18 nt, Human
gcacccgcccucaauacc

SEQ ID NO: 1204969 - RNA, 22 nt, Human
gccugaaucccacaacuggcgc

SEQ ID NO: 1204970 - RNA, 23 nt, Human
gcggugaggcuccagcaccccgc

SEQ ID NO: 1204971 - RNA, 20 nt, Human
ggagcaacggacguuucuca

SEQ ID NO: 1204972 - RNA, 18 nt, Human
ggcggcagcggcgcucuu

SEQ ID NO: 1204973 - RNA, 18 nt, Human
gugcacccgcacccgccc

SEQ ID NO: 1204974 - RNA, 21 nt, Human
gugcacccgcacccgcccuca

SEQ ID NO: 1204975 - RNA, 19 nt, Human
ucccgggaacccgcccggg

SEQ ID NO: 1204976 - RNA, 24 nt, Human
ucucaggcugccugcgaaguggcu

SEQ ID NO: 1204977 - RNA, 22 nt, Human
ucugccgggauccucgccuccc

SEQ ID NO: 1204978 - RNA, 20 nt, Human
ugcgagcgagggagcgggug

SEQ ID NO: 1204979 - RNA, 24 nt, Human
uuucucaggcugccugcgaagugg

SEQ ID NO: 1204980 - RNA, 21 nt, Human
aaacauaauuuaaugcaucgc

SEQ ID NO: 1204981 - RNA, 19 nt, Human
agacgcacugaggccagga

SEQ ID NO: 1204982 - RNA, 18 nt, Human
agcccugagcgugguggg

SEQ ID NO: 1204983 - RNA, 22 nt, Human
aggaggcugucugaggagggca

SEQ ID NO: 1204984 - RNA, 24 nt, Human
aggaggcugucugaggagggcaac

SEQ ID NO: 1204985 - RNA, 24 nt, Human
aggccaggagcggggcagggagga

SEQ ID NO: 1204986 - RNA, 21 nt, Human
aggcgccgggaccucugagcc

SEQ ID NO: 1204987 - RNA, 21 nt, Human
agggauuugucuuuuccaaag

SEQ ID NO: 1204988 - RNA, 21 nt, Human
agggcccggagcccuccgcuu

SEQ ID NO: 1204989 - RNA, 20 nt, Human
agucaggagggaaugcggug

SEQ ID NO: 1204990 - RNA, 19 nt, Human
cagacgcacugaggccagg

SEQ ID NO: 1204991 - RNA, 19 nt, Human
cagcagcagcggcacgccg

SEQ ID NO: 1204992 - RNA, 24 nt, Human
cagggagugcuugcgcuggccggg

SEQ ID NO: 1204993 - RNA, 18 nt, Human
ccaccccgccucgcaccc

SEQ ID NO: 1204994 - RNA, 21 nt, Human
ccccagccccggcuacccaac

SEQ ID NO: 1204995 - RNA, 19 nt, Human
cccccagccccggcuaccc

SEQ ID NO: 1204996 - RNA, 23 nt, Human
cccccagccccggcuacccaacu

SEQ ID NO: 1204997 - RNA, 19 nt, Human
cccccgacguggcgacccc

SEQ ID NO: 1204998 - RNA, 19 nt, Human
cccccgacguggcgacccc

SEQ ID NO: 1204999 - RNA, 19 nt, Human
ccgccaccagcuccuccuu

SEQ ID NO: 1205000 - RNA, 21 nt, Human
ccgccgccgcugccacagccg

SEQ ID NO: 1205001 - RNA, 21 nt, Human
ccucccgccaggcuccgcucc

SEQ ID NO: 1205002 - RNA, 22 nt, Human
ccucccuugccgggauggggau

SEQ ID NO: 1205003 - RNA, 23 nt, Human
ccuccgcuucuaggcacugggag

SEQ ID NO: 1205004 - RNA, 20 nt, Human
ccucugagccugggcccacc

SEQ ID NO: 1205005 - RNA, 21 nt, Human
ccuugccgggauggggaugga

SEQ ID NO: 1205006 - RNA, 22 nt, Human
cgacccccagccccggcuaccc

SEQ ID NO: 1205007 - RNA, 20 nt, Human
cgcccccgacguggcgaccc

SEQ ID NO: 1205008 - RNA, 23 nt, Human
cgccgccgccgcugccacagccg

SEQ ID NO: 1205009 - RNA, 25 nt, Human
cgccucggggcgccgccugcagcag

SEQ ID NO: 1205010 - RNA, 24 nt, Human
cggcgcugccucccgccaggcucc

SEQ ID NO: 1205011 - RNA, 25 nt, Human
cggcgcuggcuccgcggcgcugccc

SEQ ID NO: 1205012 - RNA, 22 nt, Human
cguggcgacccccagccccggc

SEQ ID NO: 1205013 - RNA, 21 nt, Human
cuccgcggguccuggccgcgc

SEQ ID NO: 1205014 - RNA, 21 nt, Human
gacccccagccccggcuaccc

SEQ ID NO: 1205015 - RNA, 23 nt, Human
gacccccagccccggcuacccaa

SEQ ID NO: 1205016 - RNA, 23 nt, Human
gaccggcuccgcggguccuggcc

SEQ ID NO: 1205017 - RNA, 19 nt, Human
gaccgggcggccugcagcc

SEQ ID NO: 1205018 - RNA, 22 nt, Human
gaggagggcaggcucccggccc

SEQ ID NO: 1205019 - RNA, 19 nt, Human
gaggcugucugaggagggc

SEQ ID NO: 1205020 - RNA, 24 nt, Human
gauggggauggagaccaggagcac

SEQ ID NO: 1205021 - RNA, 20 nt, Human
gcacugggaggaggcugucu

SEQ ID NO: 1205022 - RNA, 18 nt, Human
gcccgggcggagaccggg

SEQ ID NO: 1205023 - RNA, 19 nt, Human
gcccugagcgugguggguc

SEQ ID NO: 1205024 - RNA, 21 nt, Human
gccugcagccaccccgccucg

SEQ ID NO: 1205025 - RNA, 18 nt, Human
gcgcugccucccgccagg

SEQ ID NO: 1205026 - RNA, 18 nt, Human
gcggccccgcuccccgcg

SEQ ID NO: 1205027 - RNA, 23 nt, Human
gcgggcggccccgcuccccgcgc

SEQ ID NO: 1205028 - RNA, 20 nt, Human
ggaccucugagccugggccc

SEQ ID NO: 1205029 - RNA, 20 nt, Human
ggagaccaggagcacagccc

SEQ ID NO: 1205030 - RNA, 19 nt, Human
ggcccggagcccuccgcuu

SEQ ID NO: 1205031 - RNA, 20 nt, Human
ggcggcgcgggcggccccgc

SEQ ID NO: 1205032 - RNA, 24 nt, Human
ggcugauggacagggaaaucugca

SEQ ID NO: 1205033 - RNA, 19 nt, Human
gggauggggauggagacca

SEQ ID NO: 1205034 - RNA, 18 nt, Human
gggcagggaggacgcagg

SEQ ID NO: 1205035 - RNA, 23 nt, Human
gggcggagaccgggcggccugca

SEQ ID NO: 1205036 - RNA, 18 nt, Human
ggggagguaauggugggg

SEQ ID NO: 1205037 - RNA, 24 nt, Human
ggggcagggaggacgcagggauuu

SEQ ID NO: 1205038 - RNA, 18 nt, Human
ucacaaagaaggacgccc

SEQ ID NO: 1205039 - RNA, 21 nt, Human
ucccuggccagggcccggagc

SEQ ID NO: 1205040 - RNA, 26 nt, Human
ucccuugccgggauggggauggagac

SEQ ID NO: 1205041 - RNA, 22 nt, Human
uccgcggcgcugccucccgcca

SEQ ID NO: 1205042 - RNA, 18 nt, Human
ucuaggcacugggaggag

SEQ ID NO: 1205043 - RNA, 21 nt, Human
ucugugccgccgccucaaggg

SEQ ID NO: 1205044 - RNA, 19 nt, Human
uggaauucugcugugggug

SEQ ID NO: 1205045 - RNA, 18 nt, Human
uggggcuggucgggagag

SEQ ID NO: 1205046 - RNA, 20 nt, Human
uuaaugcaucgcggugaguc

SEQ ID NO: 1205047 - RNA, 21 nt, Human
ugguagcagagggugguccca

SEQ ID NO: 1205048 - RNA, 19 nt, Human
aauccuguuuccuuagcac

SEQ ID NO: 1205049 - RNA, 19 nt, Human
accuugagaagcacugaaa

SEQ ID NO: 1205050 - RNA, 22 nt, Human
acucugugcauccuggaggcua

SEQ ID NO: 1205051 - RNA, 20 nt, Human
aggcggggcugcagauuagg

SEQ ID NO: 1205052 - RNA, 21 nt, Human
caaaaacacauccgaccugua

SEQ ID NO: 1205053 - RNA, 20 nt, Human
cacucugugcauccuggagg

SEQ ID NO: 1205054 - RNA, 20 nt, Human
cagccgccggcgagcugggg

SEQ ID NO: 1205055 - RNA, 25 nt, Human
caucuccagcuucaggaaugagucc

SEQ ID NO: 1205056 - RNA, 20 nt, Human
ccaaaaacacauccgaccug

SEQ ID NO: 1205057 - RNA, 24 nt, Human
cccaaaaacacauccgaccuguac

SEQ ID NO: 1205058 - RNA, 26 nt, Human
cccaaaaacacauccgaccuguacua

SEQ ID NO: 1205059 - RNA, 19 nt, Human
cugauggcaacgccucccc

SEQ ID NO: 1205060 - RNA, 20 nt, Human
cuuuuguuuucgguugagga

SEQ ID NO: 1205061 - RNA, 18 nt, Human
gaauaguuccacggagcc

SEQ ID NO: 1205062 - RNA, 19 nt, Human
gagaacacgaguagggggg

SEQ ID NO: 1205063 - RNA, 18 nt, Human
gccgguacugagaacacg

SEQ ID NO: 1205064 - RNA, 19 nt, Human
ggcagcagggaguaggcaa

SEQ ID NO: 1205065 - RNA, 19 nt, Human
gugugagggagcgggaaaa

SEQ ID NO: 1205066 - RNA, 21 nt, Human
uaaccuccuguugaagacgac

SEQ ID NO: 1205067 - RNA, 26 nt, Human
uaggcaaaggcggggcugcagauuag

SEQ ID NO: 1205068 - RNA, 22 nt, Human
uagggcuggaauuuuguuccug

SEQ ID NO: 1205069 - RNA, 21 nt, Human
ucagugcaugaccucccuggc

SEQ ID NO: 1205070 - RNA, 19 nt, Human
uccuuagcaccuugauugg

SEQ ID NO: 1205071 - RNA, 22 nt, Human
ucgggagugguccaaucuccuu

SEQ ID NO: 1205072 - RNA, 21 nt, Human
ucucacucugugcauccugga

SEQ ID NO: 1205073 - RNA, 20 nt, Human
ucuccagcuucaggaaugag

SEQ ID NO: 1205074 - RNA, 27 nt, Human
ugaaagcauuccuaacuguuaaccucc

SEQ ID NO: 1205075 - RNA, 19 nt, Human
ugaagacgacagguuuuuc

SEQ ID NO: 1205076 - RNA, 20 nt, Human
ugagggagcgggaaaagcuc

SEQ ID NO: 1205077 - RNA, 20 nt, Human
ugggggcagcagggaguagg

SEQ ID NO: 1205078 - RNA, 25 nt, Human
uguuacagcaucuccagcuucagga

SEQ ID NO: 1205079 - RNA, 18 nt, Human
agggccccgguggcgccc

SEQ ID NO: 1205080 - RNA, 22 nt, Human
caaauugccgugucucagcuga

SEQ ID NO: 1205081 - RNA, 20 nt, Human
cagugcccggcagacaugcc

SEQ ID NO: 1205082 - RNA, 19 nt, Human
ccgcggaaacucggcgguc

SEQ ID NO: 1205083 - RNA, 20 nt, Human
gcccggagggcguggguagg

SEQ ID NO: 1205084 - RNA, 24 nt, Human
gccugcgggcccuugaggguccgc

SEQ ID NO: 1205085 - RNA, 22 nt, Human
gcguugcaccagugcccggcag

SEQ ID NO: 1205086 - RNA, 21 nt, Human
ggcguugcaccagugcccggc

SEQ ID NO: 1205087 - RNA, 19 nt, Human
gucucagcugagcgcgggg

SEQ ID NO: 1205088 - RNA, 22 nt, Human
ucuguggucaaauugccguguc

SEQ ID NO: 1205089 - RNA, 20 nt, Human
ugucucagcugagcgcgggg

SEQ ID NO: 1205090 - RNA, 20 nt, Human
uucuacagucauauuguucu

SEQ ID NO: 1205091 - RNA, 24 nt, Human
ccgccgcccgccagaaggcacuua

SEQ ID NO: 1205092 - RNA, 21 nt, Human
cggcagcgguaggccacgaag

SEQ ID NO: 1205093 - RNA, 20 nt, Human
cgucguagccgccgccgccc

SEQ ID NO: 1205094 - RNA, 22 nt, Human
cucgucguagccgccgccgccc

SEQ ID NO: 1205095 - RNA, 21 nt, Human
uagccgccgccgcccgccaga

SEQ ID NO: 1205096 - RNA, 18 nt, Human
ucgucguagccgccgccg

SEQ ID NO: 1205097 - RNA, 21 nt, Human
uguccagaccaggccgcagag

SEQ ID NO: 1205098 - RNA, 18 nt, Human
cagaacccacacuggggg

SEQ ID NO: 1205099 - RNA, 24 nt, Human
cugugggcuuuagcaauuccuucu

SEQ ID NO: 1205100 - RNA, 19 nt, Human
uagcaauuccuucucuggu

SEQ ID NO: 1205101 - RNA, 26 nt, Human
ugggggcugugggcuuuuuccccggg

SEQ ID NO: 1205102 - RNA, 24 nt, Human
aagcgccaggaacaugaacgagcu

SEQ ID NO: 1205103 - RNA, 19 nt, Human
caggaacaugaacgagcuc

SEQ ID NO: 1205104 - RNA, 21 nt, Human
ccacaucugagccugggggcc

SEQ ID NO: 1205105 - RNA, 18 nt, Human
gagcugcgaggccggugc

SEQ ID NO: 1205106 - RNA, 22 nt, Human
gccaggaacaugaacgagcucc

SEQ ID NO: 1205107 - RNA, 24 nt, Human
gccggugcuggcgcccccggcacg

SEQ ID NO: 1205108 - RNA, 20 nt, Human
ggaacaugaacgagcucccc

SEQ ID NO: 1205109 - RNA, 23 nt, Human
ccccggagacuaagcuuggugcu

SEQ ID NO: 1205110 - RNA, 25 nt, Human
cucugucugggccugggugcacucc

SEQ ID NO: 1205111 - RNA, 24 nt, Human
cugucugggccugggugcacucug

SEQ ID NO: 1205112 - RNA, 19 nt, Human
gcuccccuggcuccucugu

SEQ ID NO: 1205113 - RNA, 20 nt, Human
ggccugggugcacucugggg

SEQ ID NO: 1205114 - RNA, 21 nt, Human
ggccugggugcacucuggggg

SEQ ID NO: 1205115 - RNA, 22 nt, Human
gggccugggugcacucuggggg

SEQ ID NO: 1205116 - RNA, 18 nt, Human
ggugcaagauugagaagg

SEQ ID NO: 1205117 - RNA, 19 nt, Human
gugcaagauugagaaggau

SEQ ID NO: 1205118 - RNA, 20 nt, Human
gugcaagauugagaaggauu

SEQ ID NO: 1205119 - RNA, 25 nt, Human
ucugggccugggugcacucuggggg

SEQ ID NO: 1205120 - RNA, 22 nt, Human
ucugggggugcaagauugagaa

SEQ ID NO: 1205121 - RNA, 22 nt, Human
aaaugcagaggcuggcgcggcu

SEQ ID NO: 1205122 - RNA, 22 nt, Human
acccaaggaguugcuuccaacc

SEQ ID NO: 1205123 - RNA, 19 nt, Human
aggccgagggugggugucc

SEQ ID NO: 1205124 - RNA, 23 nt, Human
caagagccacuacagcaggaagg

SEQ ID NO: 1205125 - RNA, 22 nt, Human
cacacccaaggaguugcuucca

SEQ ID NO: 1205126 - RNA, 20 nt, Human
cacccaaggaguugcuucca

SEQ ID NO: 1205127 - RNA, 21 nt, Human
caccgcugaagccaccuugca

SEQ ID NO: 1205128 - RNA, 21 nt, Human
cagaccaaggcccacggggaa

SEQ ID NO: 1205129 - RNA, 23 nt, Human
caggcugcaaaggagagaccuga

SEQ ID NO: 1205130 - RNA, 21 nt, Human
ccaggcggauaugaaaucacg

SEQ ID NO: 1205131 - RNA, 19 nt, Human
ccauggccuuggcauugcu

SEQ ID NO: 1205132 - RNA, 23 nt, Human
ccgccauggccuuggcauugcuc

SEQ ID NO: 1205133 - RNA, 21 nt, Human
ccugagcuggaaaagugagac

SEQ ID NO: 1205134 - RNA, 19 nt, Human
ccugcaguuugcuccgugg

SEQ ID NO: 1205135 - RNA, 23 nt, Human
ccugcaguuugcuccgugguucc

SEQ ID NO: 1205136 - RNA, 18 nt, Human
ccuugugccucucucccu

SEQ ID NO: 1205137 - RNA, 21 nt, Human
cugcaggggccccuccguggg

SEQ ID NO: 1205138 - RNA, 18 nt, Human
gagaagguggagauagug

SEQ ID NO: 1205139 - RNA, 20 nt, Human
gagggauguccacagggaaa

SEQ ID NO: 1205140 - RNA, 23 nt, Human
gcaaaggagagaccugagcugga

SEQ ID NO: 1205141 - RNA, 25 nt, Human
gccgcggggacccuaggguccgcuu

SEQ ID NO: 1205142 - RNA, 27 nt, Human
gcugggcgggggcgggcuguugacggc

SEQ ID NO: 1205143 - RNA, 22 nt, Human
ggggacccuaggguccgcuccu

SEQ ID NO: 1205144 - RNA, 20 nt, Human
ggugccugcaggggccccuc

SEQ ID NO: 1205145 - RNA, 20 nt, Human
gguggcugggcgggggcggg

SEQ ID NO: 1205146 - RNA, 18 nt, Human
guccgcuccuucgcugcc

SEQ ID NO: 1205147 - RNA, 19 nt, Human
gugccugcaggggccccuc

SEQ ID NO: 1205148 - RNA, 29 nt, Human
uaucuuucuucuuuuucggcugcugagaa

SEQ ID NO: 1205149 - RNA, 18 nt, Human
ucacaugcacacccaagg

SEQ ID NO: 1205150 - RNA, 22 nt, Human
uccacagccaggccgcggggac

SEQ ID NO: 1205151 - RNA, 24 nt, Human
uccacagggaaaugcuugcugcuc

SEQ ID NO: 1205152 - RNA, 22 nt, Human
uccccguguccacagccaggcc

SEQ ID NO: 1205153 - RNA, 20 nt, Human
ucccuggccccgggcuucug

SEQ ID NO: 1205154 - RNA, 23 nt, Human
ucgcagucugaggaagaggcaac

SEQ ID NO: 1205155 - RNA, 19 nt, Human
ucucccagcgagcagaggc

SEQ ID NO: 1205156 - RNA, 24 nt, Human
ucucccagcgagcagaggcgcugc

SEQ ID NO: 1205157 - RNA, 21 nt, Human
ucucuuguugaaugcaagggu

SEQ ID NO: 1205158 - RNA, 20 nt, Human
ucugcucccuugugccucuu

SEQ ID NO: 1205159 - RNA, 19 nt, Human
ucuuucuucuuuuucggcu

SEQ ID NO: 1205160 - RNA, 18 nt, Human
ugaagggaauuaauuguc

SEQ ID NO: 1205161 - RNA, 19 nt, Human
ugagaagguggagauagug

SEQ ID NO: 1205162 - RNA, 25 nt, Human
ugagauuucagggcacaagagccac

SEQ ID NO: 1205163 - RNA, 19 nt, Human
ugcaaaggagagaccugag

SEQ ID NO: 1205164 - RNA, 20 nt, Human
ugcucucccuucucugucuc

SEQ ID NO: 1205165 - RNA, 23 nt, Human
ugcucugcccugugugguccuca

SEQ ID NO: 1205166 - RNA, 22 nt, Human
ugcuugcugcucugcccugugu

SEQ ID NO: 1205167 - RNA, 19 nt, Human
uggccccgggcuucugccu

SEQ ID NO: 1205168 - RNA, 24 nt, Human
uggcgcggcuggcugagcaggcag

SEQ ID NO: 1205169 - RNA, 20 nt, Human
uggcugagcaggcagcggag

SEQ ID NO: 1205170 - RNA, 20 nt, Human
uggcugagcaggcagcggag

SEQ ID NO: 1205171 - RNA, 18 nt, Human
uggcugggcgggggcggg

SEQ ID NO: 1205172 - RNA, 25 nt, Human
ugggcuucugagacugucgcagucu

SEQ ID NO: 1205173 - RNA, 23 nt, Human
ugugagugggaacagccaggcug

SEQ ID NO: 1205174 - RNA, 19 nt, Human
ugugaucaaagagaagacu

SEQ ID NO: 1205175 - RNA, 21 nt, Human
uuacugaggcauacauugugu

SEQ ID NO: 1205176 - RNA, 21 nt, Human
uuccuaacucuugggcuucug

SEQ ID NO: 1205177 - RNA, 21 nt, Human
uucgcugcccgagcacggugc

SEQ ID NO: 1205178 - RNA, 20 nt, Human
uucuagauucucccaggcgg

SEQ ID NO: 1205179 - RNA, 23 nt, Human
uucucugucucgggccugcaguu

SEQ ID NO: 1205180 - RNA, 21 nt, Human
uugcugcucugcccugugugg

SEQ ID NO: 1205181 - RNA, 23 nt, Human
uuggccagucguuucucucccag

SEQ ID NO: 1205182 - RNA, 23 nt, Human
uuucccaguguuuucagcuggau

SEQ ID NO: 1205183 - RNA, 18 nt, Human
uuugcuaggagcugucca

SEQ ID NO: 1205184 - RNA, 18 nt, Human
uuugcuaggagcugucca

SEQ ID NO: 1205185 - RNA, 20 nt, Human
ccuuuauuccuucugguuca

SEQ ID NO: 1205186 - RNA, 23 nt, Human
cugugcuggaggggcugaacugc

SEQ ID NO: 1205187 - RNA, 18 nt, Human
gauuuguucuccggcccc

SEQ ID NO: 1205188 - RNA, 19 nt, Human
ggauuuguucuccggcccc

SEQ ID NO: 1205189 - RNA, 20 nt, Human
gggcacuggcugugcuggag

SEQ ID NO: 1205190 - RNA, 19 nt, Human
uugggcacuggcugugcug

SEQ ID NO: 1205191 - RNA, 21 nt, Human
acccugcucagcagcgugggg

SEQ ID NO: 1205192 - RNA, 19 nt, Human
agcaagggaugcagggccc

SEQ ID NO: 1205193 - RNA, 23 nt, Human
agcgugggguucagagaagcuuc

SEQ ID NO: 1205194 - RNA, 22 nt, Human
caagggaugcagggcccggggc

SEQ ID NO: 1205195 - RNA, 24 nt, Human
cagcagcgugggguucagagaagc

SEQ ID NO: 1205196 - RNA, 23 nt, Human
cagcgugggguucagagaagcuu

SEQ ID NO: 1205197 - RNA, 21 nt, Human
ccugcucagcagcgugggguu

SEQ ID NO: 1205198 - RNA, 18 nt, Human
agggcuccacugaccuga

SEQ ID NO: 1205199 - RNA, 21 nt, Human
ccacugaccugaccucuccua

SEQ ID NO: 1205200 - RNA, 22 nt, Human
cccagggcuccacugaccugac

SEQ ID NO: 1205201 - RNA, 18 nt, Human
gaccugaccucuccuacc

SEQ ID NO: 1205202 - RNA, 21 nt, Human
uacggcuucccuaagauccug

SEQ ID NO: 1205203 - RNA, 21 nt, Human
ugaccugaccucuccuacccc

SEQ ID NO: 1205204 - RNA, 21 nt, Human
aacccuuuuggagaagccaag

SEQ ID NO: 1205205 - RNA, 21 nt, Human
aacuccuauuucuccuuccuc

SEQ ID NO: 1205206 - RNA, 22 nt, Human
aagcccagagcccugagacagg

SEQ ID NO: 1205207 - RNA, 19 nt, Human
acagauguuaccuagccuc

SEQ ID NO: 1205208 - RNA, 18 nt, Human
accuagccuccugagugg

SEQ ID NO: 1205209 - RNA, 24 nt, Human
agcuggaguggaggacaaucaacu

SEQ ID NO: 1205210 - RNA, 25 nt, Human
agcuggaguggaggacaaucaacuu

SEQ ID NO: 1205211 - RNA, 23 nt, Human
aggaaggauuugggaaacagcug

SEQ ID NO: 1205212 - RNA, 19 nt, Human
aggcauucccuucuuucuu

SEQ ID NO: 1205213 - RNA, 23 nt, Human
agggggcaguagguggcuuggaa

SEQ ID NO: 1205214 - RNA, 21 nt, Human
auaacccccugggcugcguac

SEQ ID NO: 1205215 - RNA, 19 nt, Human
auggcagcuauguuuaggu

SEQ ID NO: 1205216 - RNA, 25 nt, Human
cagagcccugagacagcucugcaga

SEQ ID NO: 1205217 - RNA, 26 nt, Human
cagcugcccugaaguucugaagccac

SEQ ID NO: 1205218 - RNA, 25 nt, Human
cagggaaugaagcccagagcccuga

SEQ ID NO: 1205219 - RNA, 18 nt, Human
cagggagagugauggcag

SEQ ID NO: 1205220 - RNA, 21 nt, Human
ccacgcacuccgcgagggggc

SEQ ID NO: 1205221 - RNA, 24 nt, Human
ccacgcacuccgcgagggggcagu

SEQ ID NO: 1205222 - RNA, 24 nt, Human
ccccacgcacuccgcgagggggca

SEQ ID NO: 1205223 - RNA, 23 nt, Human
cccgccagacugguccagcugcc

SEQ ID NO: 1205224 - RNA, 22 nt, Human
cccuucuuucuuuuuuggagcc

SEQ ID NO: 1205225 - RNA, 24 nt, Human
cccuucuuucuuuuuuggagccuu

SEQ ID NO: 1205226 - RNA, 22 nt, Human
ccgcagcuaccacgccuuuugc

SEQ ID NO: 1205227 - RNA, 21 nt, Human
ccgccagacugguccagcugc

SEQ ID NO: 1205228 - RNA, 22 nt, Human
ccuauggccaggauucuggagc

SEQ ID NO: 1205229 - RNA, 25 nt, Human
ccucucgguucggguugcucagcuc

SEQ ID NO: 1205230 - RNA, 21 nt, Human
ccugugcccacuguucgaaaa

SEQ ID NO: 1205231 - RNA, 22 nt, Human
ccuucuuucuuuuuuggagccu

SEQ ID NO: 1205232 - RNA, 24 nt, Human
cgaggcuuuuauaacccccugggc

SEQ ID NO: 1205233 - RNA, 22 nt, Human
cgccgcagcuaccacgccuuuu

SEQ ID NO: 1205234 - RNA, 25 nt, Human
cucauuccaccgccgcagcuaccac

SEQ ID NO: 1205235 - RNA, 23 nt, Human
cuccuauuucuccuuccuccgca

SEQ ID NO: 1205236 - RNA, 20 nt, Human
cuccuugaguguagcacaga

SEQ ID NO: 1205237 - RNA, 19 nt, Human
cugagugguacccuccucc

SEQ ID NO: 1205238 - RNA, 20 nt, Human
cugccgcugccgccgccugc

SEQ ID NO: 1205239 - RNA, 19 nt, Human
cugcugccugcaacuccua

SEQ ID NO: 1205240 - RNA, 22 nt, Human
cuucauggucacaucuaaaugg

SEQ ID NO: 1205241 - RNA, 21 nt, Human
cuuccagggaaugaagcccag

SEQ ID NO: 1205242 - RNA, 22 nt, Human
gaccuguaaaaguucugagccu

SEQ ID NO: 1205243 - RNA, 24 nt, Human
gacucgccaguccguauaaacccu

SEQ ID NO: 1205244 - RNA, 21 nt, Human
gaggaaggaaggauuugggaa

SEQ ID NO: 1205245 - RNA, 19 nt, Human
gagucugcgagccgggagc

SEQ ID NO: 1205246 - RNA, 18 nt, Human
gccaguccguauaaaccc

SEQ ID NO: 1205247 - RNA, 18 nt, Human
gcgagccgggagccccac

SEQ ID NO: 1205248 - RNA, 18 nt, Human
gcugccgcugccgccgcc

SEQ ID NO: 1205249 - RNA, 23 nt, Human
ggaaggauuugggaaacagcugg

SEQ ID NO: 1205250 - RNA, 18 nt, Human
ggacuuaggagcgaagug

SEQ ID NO: 1205251 - RNA, 19 nt, Human
ggcuuggaaguaacugaca

SEQ ID NO: 1205252 - RNA, 19 nt, Human
gggaaugaagcccagagcc

SEQ ID NO: 1205253 - RNA, 21 nt, Human
ggugcugggaggaaggaagga

SEQ ID NO: 1205254 - RNA, 24 nt, Human
gucugcgagccgggagccccacgg

SEQ ID NO: 1205255 - RNA, 18 nt, Human
uaacccccugggcugcgu

SEQ ID NO: 1205256 - RNA, 19 nt, Human
uaccuagccuccugagugg

SEQ ID NO: 1205257 - RNA, 24 nt, Human
uagccuccugagugguacccuccu

SEQ ID NO: 1205258 - RNA, 18 nt, Human
uccagcugcccugaaguu

SEQ ID NO: 1205259 - RNA, 22 nt, Human
uccccauuuuucuucaugguca

SEQ ID NO: 1205260 - RNA, 24 nt, Human
ucccuucuuucuuuuuuggagccu

SEQ ID NO: 1205261 - RNA, 19 nt, Human
uccgcgagggggcaguagg

SEQ ID NO: 1205262 - RNA, 20 nt, Human
ucgaaaaagccagagcccca

SEQ ID NO: 1205263 - RNA, 22 nt, Human
ugaaggacaacauuggcaggga

SEQ ID NO: 1205264 - RNA, 23 nt, Human
ugagugguacccuccuccugcca

SEQ ID NO: 1205265 - RNA, 23 nt, Human
ugaugaaggacaacauuggcagg

SEQ ID NO: 1205266 - RNA, 22 nt, Human
ugcccugaaguucugaagccac

SEQ ID NO: 1205267 - RNA, 22 nt, Human
ugccugagcugauggugggaac

SEQ ID NO: 1205268 - RNA, 22 nt, Human
uggccaggauucuggagcuucg

SEQ ID NO: 1205269 - RNA, 19 nt, Human
uggcugaugaaggacaaca

SEQ ID NO: 1205270 - RNA, 18 nt, Human
ugggaaacagcuggagug

SEQ ID NO: 1205271 - RNA, 21 nt, Human
ugggagucugcgagccgggag

SEQ ID NO: 1205272 - RNA, 19 nt, Human
ugggaugagcuccgcagca

SEQ ID NO: 1205273 - RNA, 19 nt, Human
uguggcaaugggaaacggu

SEQ ID NO: 1205274 - RNA, 21 nt, Human
uguugacaacugucucauucc

SEQ ID NO: 1205275 - RNA, 25 nt, Human
uuggagaagccaagaugggggacgc

SEQ ID NO: 1205276 - RNA, 20 nt, Human
uuuugcugcuugcuacuugc

SEQ ID NO: 1205277 - RNA, 22 nt, Human
aacagccaccaaagacaccacc

SEQ ID NO: 1205278 - RNA, 18 nt, Human
aagacaccaccugucacu

SEQ ID NO: 1205279 - RNA, 24 nt, Human
aagacaccaccugucacuccaucc

SEQ ID NO: 1205280 - RNA, 23 nt, Human
acagccaccaaagacaccaccug

SEQ ID NO: 1205281 - RNA, 25 nt, Human
agugcccaccgauuccacacuuggc

SEQ ID NO: 1205282 - RNA, 21 nt, Human
caaagacaccaccugucacuc

SEQ ID NO: 1205283 - RNA, 23 nt, Human
ccaccaaagacaccaccugucac

SEQ ID NO: 1205284 - RNA, 22 nt, Human
ccaccgauuccacacuuggcuu

SEQ ID NO: 1205285 - RNA, 21 nt, Human
ccaccugucacuccauccagg

SEQ ID NO: 1205286 - RNA, 23 nt, Human
ccagggucucccucuuagccucu

SEQ ID NO: 1205287 - RNA, 22 nt, Human
ccucugagcccaacacaauaag

SEQ ID NO: 1205288 - RNA, 24 nt, Human
cuuccagugcccaccgauuccaca

SEQ ID NO: 1205289 - RNA, 22 nt, Human
gaaggcuuuuggcaaaguugcu

SEQ ID NO: 1205290 - RNA, 19 nt, Human
uagccucugagcccaacac

SEQ ID NO: 1205291 - RNA, 24 nt, Human
ugagcccaacacaauaaggcucaa

SEQ ID NO: 1205292 - RNA, 23 nt, Human
uggcaaaguugcuucccaagcau

SEQ ID NO: 1205293 - RNA, 18 nt, Human
uucccaagcauguuuacu

SEQ ID NO: 1205294 - RNA, 25 nt, Human
agacaccagugucccuucaguucuu

SEQ ID NO: 1205295 - RNA, 22 nt, Human
ccacuccuaagucccauagccu

SEQ ID NO: 1205296 - RNA, 23 nt, Human
ccagugucccuucaguucuuucu

SEQ ID NO: 1205297 - RNA, 23 nt, Human
cccauagccucugacagcuguau

SEQ ID NO: 1205298 - RNA, 22 nt, Human
cugcguaccacuccuaaguccc

SEQ ID NO: 1205299 - RNA, 21 nt, Human
ucacucuugagcugucuucuc

SEQ ID NO: 1205300 - RNA, 22 nt, Human
ucagcucuauuucgggagcuau

SEQ ID NO: 1205301 - RNA, 23 nt, Human
ucaguucuuucugaaguuuuccu

SEQ ID NO: 1205302 - RNA, 20 nt, Human
ucccauagccucugacagcu

SEQ ID NO: 1205303 - RNA, 19 nt, Human
uccuaagucccauagccuc

SEQ ID NO: 1205304 - RNA, 21 nt, Human
ugacaucugcguaccacuccu

SEQ ID NO: 1205305 - RNA, 19 nt, Human
ugagcugucuucucagcuc

SEQ ID NO: 1205306 - RNA, 18 nt, Human
ugcguaccacuccuaagu

SEQ ID NO: 1205307 - RNA, 21 nt, Human
caaagcgcuguacugaauugc

SEQ ID NO: 1205308 - RNA, 18 nt, Human
uguacugaauugccuuug

SEQ ID NO: 1205309 - RNA, 24 nt, Human
aaaacccugcccucaggaagccgu

SEQ ID NO: 1205310 - RNA, 22 nt, Human
ccuccaccccaauggccgggaa

SEQ ID NO: 1205311 - RNA, 18 nt, Human
gcaaaacgccuccacccc

SEQ ID NO: 1205312 - RNA, 22 nt, Human
gcaaaacgccuccaccccaaug

SEQ ID NO: 1205313 - RNA, 24 nt, Human
gccagcaggaauccuggggggcaa

SEQ ID NO: 1205314 - RNA, 22 nt, Human
ucaaagucuucuuuauggaaaa

SEQ ID NO: 1205315 - RNA, 22 nt, Human
uuuaagagauaaaaauugacau

SEQ ID NO: 1205316 - RNA, 19 nt, Human
aaaaauacugugaagagaa

SEQ ID NO: 1205317 - RNA, 23 nt, Human
aaacaaaugacauuaauguucuu

SEQ ID NO: 1205318 - RNA, 24 nt, Human
aaacaauccaaaaguggacaagga

SEQ ID NO: 1205319 - RNA, 21 nt, Human
aagcagucauuuacuccauca

SEQ ID NO: 1205320 - RNA, 19 nt, Human
aaggagcugguauugcagg

SEQ ID NO: 1205321 - RNA, 23 nt, Human
aagggaacuuuuuucuuggauug

SEQ ID NO: 1205322 - RNA, 22 nt, Human
aauaaaaauacugugaagagaa

SEQ ID NO: 1205323 - RNA, 22 nt, Human
acacugaaagaaauucccugga

SEQ ID NO: 1205324 - RNA, 21 nt, Human
agaaacucaauguuggugaug

SEQ ID NO: 1205325 - RNA, 18 nt, Human
agcaccauuuuccuuucu

SEQ ID NO: 1205326 - RNA, 18 nt, Human
aggaaugaccaacaauca

SEQ ID NO: 1205327 - RNA, 21 nt, Human
aggcagauguuguauaaacca

SEQ ID NO: 1205328 - RNA, 20 nt, Human
aggggcugccugggugccgg

SEQ ID NO: 1205329 - RNA, 25 nt, Human
agguggaaacacagagcguuugauc

SEQ ID NO: 1205330 - RNA, 25 nt, Human
auacagccacagaaguguccaggcu

SEQ ID NO: 1205331 - RNA, 18 nt, Human
aucaaagcagucauuuac

SEQ ID NO: 1205332 - RNA, 20 nt, Human
augacaaaaacaauccaaaa

SEQ ID NO: 1205333 - RNA, 24 nt, Human
auuuuggaggauaguagcucgggu

SEQ ID NO: 1205334 - RNA, 21 nt, Human
caaugagcucuaccuccgcuu

SEQ ID NO: 1205335 - RNA, 22 nt, Human
cacagaguccauguccacagcc

SEQ ID NO: 1205336 - RNA, 23 nt, Human
caggaggggcaacugugaguggc

SEQ ID NO: 1205337 - RNA, 21 nt, Human
caguuacccagcacuucuccc

SEQ ID NO: 1205338 - RNA, 18 nt, Human
caucacaacgcugggccu

SEQ ID NO: 1205339 - RNA, 22 nt, Human
caucugcaacaacagacugcuc

SEQ ID NO: 1205340 - RNA, 21 nt, Human
cauuuuccaucacuuuuucuu

SEQ ID NO: 1205341 - RNA, 19 nt, Human
cauuuuccuuucuuuucuu

SEQ ID NO: 1205342 - RNA, 18 nt, Human
ccacauccauguccccag

SEQ ID NO: 1205343 - RNA, 21 nt, Human
ccccagccaguuacccagcac

SEQ ID NO: 1205344 - RNA, 20 nt, Human
cccccagccaguuacccagc

SEQ ID NO: 1205345 - RNA, 22 nt, Human
cccgcgccugcagaugcagacc

SEQ ID NO: 1205346 - RNA, 21 nt, Human
ccgcgccugcagaugcagacc

SEQ ID NO: 1205347 - RNA, 18 nt, Human
ccucaaaauaugcccgga

SEQ ID NO: 1205348 - RNA, 21 nt, Human
ccuguccacuagucuuuccuc

SEQ ID NO: 1205349 - RNA, 20 nt, Human
ccuugaacugcacuggagcu

SEQ ID NO: 1205350 - RNA, 23 nt, Human
cgacaagauaaagguccacccga

SEQ ID NO: 1205351 - RNA, 22 nt, Human
cgccugcagaugcagaccaucu

SEQ ID NO: 1205352 - RNA, 19 nt, Human
cucaaaauaugcccggauu

SEQ ID NO: 1205353 - RNA, 24 nt, Human
cuccagagccgaaggcuguuuuuc

SEQ ID NO: 1205354 - RNA, 21 nt, Human
cugccugaaggagcugguauu

SEQ ID NO: 1205355 - RNA, 21 nt, Human
cuuugcuuucuguuuuacuga

SEQ ID NO: 1205356 - RNA, 20 nt, Human
gaaacaaaugacauuaaugu

SEQ ID NO: 1205357 - RNA, 18 nt, Human
gaccggagcggacaggag

SEQ ID NO: 1205358 - RNA, 21 nt, Human
gaccggagcggacaggagggg

SEQ ID NO: 1205359 - RNA, 21 nt, Human
gagagcagccuuugucugugg

SEQ ID NO: 1205360 - RNA, 24 nt, Human
gcuugcugcagaacgagggagccu

SEQ ID NO: 1205361 - RNA, 20 nt, Human
ggaaaguuuggucguccaca

SEQ ID NO: 1205362 - RNA, 18 nt, Human
ggagcggacaggaggggc

SEQ ID NO: 1205363 - RNA, 21 nt, Human
ggauugcuucuuggguuuggc

SEQ ID NO: 1205364 - RNA, 22 nt, Human
ggggcaacugugaguggcggcc

SEQ ID NO: 1205365 - RNA, 19 nt, Human
ggguaauaugggcuugaaa

SEQ ID NO: 1205366 - RNA, 21 nt, Human
uaacugccauauucugccaaa

SEQ ID NO: 1205367 - RNA, 21 nt, Human
uagagcaccugaggccgugcc

SEQ ID NO: 1205368 - RNA, 21 nt, Human
uagcccacuauggccaccagu

SEQ ID NO: 1205369 - RNA, 25 nt, Human
uagucuuuccucuucaaccaggcuu

SEQ ID NO: 1205370 - RNA, 21 nt, Human
uauacagccacagaagugucc

SEQ ID NO: 1205371 - RNA, 23 nt, Human
uaugccaagaguugauagagaag

SEQ ID NO: 1205372 - RNA, 22 nt, Human
ucacagccuuucauacucuucu

SEQ ID NO: 1205373 - RNA, 23 nt, Human
ucagguagcccacuauggccacc

SEQ ID NO: 1205374 - RNA, 18 nt, Human
uccacauccaugucccca

SEQ ID NO: 1205375 - RNA, 24 nt, Human
uccacuagucuuuccucuucaacc

SEQ ID NO: 1205376 - RNA, 20 nt, Human
uccagguacacuugcauuuu

SEQ ID NO: 1205377 - RNA, 21 nt, Human
uccagguacacuugcauuuug

SEQ ID NO: 1205378 - RNA, 20 nt, Human
ucccguagguggaaacacag

SEQ ID NO: 1205379 - RNA, 24 nt, Human
ucccugaggcugcagaaaucucca

SEQ ID NO: 1205380 - RNA, 23 nt, Human
ucccugauucaagauucauuccc

SEQ ID NO: 1205381 - RNA, 20 nt, Human
ucccugcaagcuccccacag

SEQ ID NO: 1205382 - RNA, 28 nt, Human
uccgugacacugaaagaaauucccugga

SEQ ID NO: 1205383 - RNA, 21 nt, Human
uccugaguucguagguaaaca

SEQ ID NO: 1205384 - RNA, 18 nt, Human
ucgcuguuuucuuugucc

SEQ ID NO: 1205385 - RNA, 23 nt, Human
ucgucucacuggcagcuucuuuu

SEQ ID NO: 1205386 - RNA, 18 nt, Human
ucucaggccaggcaauac

SEQ ID NO: 1205387 - RNA, 20 nt, Human
ucugcaacaacagacugcuc

SEQ ID NO: 1205388 - RNA, 22 nt, Human
ucugcaacaacagacugcucau

SEQ ID NO: 1205389 - RNA, 23 nt, Human
ucuguacaagaugcugcuccgga

SEQ ID NO: 1205390 - RNA, 20 nt, Human
ucuuguggguucacaaauuc

SEQ ID NO: 1205391 - RNA, 21 nt, Human
ucuuguggguucacaaauucu

SEQ ID NO: 1205392 - RNA, 23 nt, Human
ucuuugugguggucgucuuccug

SEQ ID NO: 1205393 - RNA, 18 nt, Human
ucuuuuuuuuuaggaaug

SEQ ID NO: 1205394 - RNA, 24 nt, Human
ugaaauuuccagguacacuugcau

SEQ ID NO: 1205395 - RNA, 24 nt, Human
ugacaaaaacaauccaaaagugga

SEQ ID NO: 1205396 - RNA, 24 nt, Human
ugacacaguugucggcuucgauuu

SEQ ID NO: 1205397 - RNA, 19 nt, Human
ugaccaacaaucaccauuu

SEQ ID NO: 1205398 - RNA, 26 nt, Human
ugauauacagccacagaaguguccag

SEQ ID NO: 1205399 - RNA, 24 nt, Human
ugaugcuugucuggauggaguccu

SEQ ID NO: 1205400 - RNA, 18 nt, Human
ugcccggauuccugagag

SEQ ID NO: 1205401 - RNA, 20 nt, Human
ugcugcacaguccgugacag

SEQ ID NO: 1205402 - RNA, 21 nt, Human
ugcuucuuggguuuggcuuug

SEQ ID NO: 1205403 - RNA, 19 nt, Human
uggaggauaguagcucggg

SEQ ID NO: 1205404 - RNA, 23 nt, Human
uggccaccagcuugaagugacac

SEQ ID NO: 1205405 - RNA, 25 nt, Human
uggcggcaacacagucuucacagaa

SEQ ID NO: 1205406 - RNA, 18 nt, Human
ugguggucgucuuccugg

SEQ ID NO: 1205407 - RNA, 22 nt, Human
ugugguggucgucuuccuggca

SEQ ID NO: 1205408 - RNA, 23 nt, Human
uuauuaucugcuucgugucuucg

SEQ ID NO: 1205409 - RNA, 21 nt, Human
uuccaaaagggaacuuuuuuc

SEQ ID NO: 1205410 - RNA, 23 nt, Human
uugcaggcagguugagggcucac

SEQ ID NO: 1205411 - RNA, 26 nt, Human
uuggauugcuucuuggguuuggcuuu

SEQ ID NO: 1205412 - RNA, 22 nt, Human
aagauucugcccaggaguucac

SEQ ID NO: 1205413 - RNA, 23 nt, Human
agaggaguggggggaggggaggg

SEQ ID NO: 1205414 - RNA, 20 nt, Human
aguaccaauucucagggacu

SEQ ID NO: 1205415 - RNA, 23 nt, Human
aguggggggaggggagggacacu

SEQ ID NO: 1205416 - RNA, 18 nt, Human
ccacugagaggagugggg

SEQ ID NO: 1205417 - RNA, 23 nt, Human
ccacugagaggaguggggggagg

SEQ ID NO: 1205418 - RNA, 18 nt, Human
ccccaugcacgguggugg

SEQ ID NO: 1205419 - RNA, 20 nt, Human
gaaggcagggccggguggcc

SEQ ID NO: 1205420 - RNA, 19 nt, Human
gaaguggccgguggucugg

SEQ ID NO: 1205421 - RNA, 18 nt, Human
gccuggcuggacuccgca

SEQ ID NO: 1205422 - RNA, 22 nt, Human
gcgcaggggcccagcuggucag

SEQ ID NO: 1205423 - RNA, 21 nt, Human
ggaguggggggaggggaggga

SEQ ID NO: 1205424 - RNA, 22 nt, Human
gggggaggggagggacacugcc

SEQ ID NO: 1205425 - RNA, 19 nt, Human
ggugagaggagagggaacg

SEQ ID NO: 1205426 - RNA, 24 nt, Human
guggucuggggcccuucagcaggg

SEQ ID NO: 1205427 - RNA, 22 nt, Human
ucagcaggggccuggcuggacu

SEQ ID NO: 1205428 - RNA, 21 nt, Human
ugagaggagagggaacgugga

SEQ ID NO: 1205429 - RNA, 24 nt, Human
ugagaggaguggggggaggggagg

SEQ ID NO: 1205430 - RNA, 18 nt, Human
uggacgggggagaagugg

SEQ ID NO: 1205431 - RNA, 18 nt, Human
uggcuggacuccgcaagc

SEQ ID NO: 1205432 - RNA, 19 nt, Human
uggggggaggggagggaca

SEQ ID NO: 1205433 - RNA, 21 nt, Human
ugguggugggaaggcagggcc

SEQ ID NO: 1205434 - RNA, 21 nt, Human
ugguggugggaaggcagggcc

SEQ ID NO: 1205435 - RNA, 23 nt, Human
ugguggugggaaggcagggccgg

SEQ ID NO: 1205436 - RNA, 23 nt, Human
uggugguggugggaaggcagggc

SEQ ID NO: 1205437 - RNA, 23 nt, Human
aagcuggagccagggcucagaga

SEQ ID NO: 1205438 - RNA, 21 nt, Human
aagggucccggggagcccggc

SEQ ID NO: 1205439 - RNA, 20 nt, Human
acacugcaaaacgaacacag

SEQ ID NO: 1205440 - RNA, 19 nt, Human
accuucucucugcccccau

SEQ ID NO: 1205441 - RNA, 22 nt, Human
acgaacacagccucagaaaagc

SEQ ID NO: 1205442 - RNA, 25 nt, Human
agaaaagcuggagccagggcucaga

SEQ ID NO: 1205443 - RNA, 19 nt, Human
agaccuucucucugccccc

SEQ ID NO: 1205444 - RNA, 24 nt, Human
agccucagaaaagcuggagccagg

SEQ ID NO: 1205445 - RNA, 20 nt, Human
cacacugcaaaacgaacacc

SEQ ID NO: 1205446 - RNA, 20 nt, Human
cagaccuucucucugccccc

SEQ ID NO: 1205447 - RNA, 22 nt, Human
cagagagugacucacuggacac

SEQ ID NO: 1205448 - RNA, 19 nt, Human
cagcagaggguuugguagg

SEQ ID NO: 1205449 - RNA, 25 nt, Human
cagccucagaaaagcuggagccagg

SEQ ID NO: 1205450 - RNA, 19 nt, Human
ccccucugcuagcuuccuu

SEQ ID NO: 1205451 - RNA, 18 nt, Human
ccuccgcaacgcaggcuc

SEQ ID NO: 1205452 - RNA, 23 nt, Human
ccucugagccccucugcuagcuu

SEQ ID NO: 1205453 - RNA, 20 nt, Human
ccuuuuccggguuuuugucc

SEQ ID NO: 1205454 - RNA, 24 nt, Human
cggcguggagagaauggggcuugc

SEQ ID NO: 1205455 - RNA, 20 nt, Human
cucugcuagcuuccuuuucc

SEQ ID NO: 1205456 - RNA, 20 nt, Human
cugcccccaucuuugugccc

SEQ ID NO: 1205457 - RNA, 20 nt, Human
cugcccccaucuuugugccc

SEQ ID NO: 1205458 - RNA, 20 nt, Human
gaagggucccggggagcccg

SEQ ID NO: 1205459 - RNA, 18 nt, Human
gaguaaggaaccguaugg

SEQ ID NO: 1205460 - RNA, 18 nt, Human
gcaaaacgaacacagccu

SEQ ID NO: 1205461 - RNA, 21 nt, Human
gccugcccucugagccccucu

SEQ ID NO: 1205462 - RNA, 22 nt, Human
gcguuggggcgcgggugcgggg

SEQ ID NO: 1205463 - RNA, 18 nt, Human
gggcgcgggugcggggag

SEQ ID NO: 1205464 - RNA, 20 nt, Human
guggaaggccuaucugcccc

SEQ ID NO: 1205465 - RNA, 18 nt, Human
guggagaagucacgaaug

SEQ ID NO: 1205466 - RNA, 20 nt, Human
guuggggcgcgggugcgggg

SEQ ID NO: 1205467 - RNA, 23 nt, Human
uagcuuccuuuuccggguuuuug

SEQ ID NO: 1205468 - RNA, 19 nt, Human
ucccggggagcccggcugc

SEQ ID NO: 1205469 - RNA, 23 nt, Human
ugacucacuggacacccuccuac

SEQ ID NO: 1205470 - RNA, 23 nt, Human
ugagucagcaaccugcuggugcc

SEQ ID NO: 1205471 - RNA, 26 nt, Human
ugaugagcggcguggagagaaugggg

SEQ ID NO: 1205472 - RNA, 21 nt, Human
ugcaaaacgaacacagccuca

SEQ ID NO: 1205473 - RNA, 19 nt, Human
ugcccugagauguuccagc

SEQ ID NO: 1205474 - RNA, 21 nt, Human
ugccugcccucugagccccuc

SEQ ID NO: 1205475 - RNA, 23 nt, Human
ugcggggaguguccuugggugga

SEQ ID NO: 1205476 - RNA, 25 nt, Human
ugcuagcuuccuuuuccggguuuuu

SEQ ID NO: 1205477 - RNA, 19 nt, Human
ugcuggugccuggugucag

SEQ ID NO: 1205478 - RNA, 26 nt, Human
ugucagcaguuuccggucagagagug

SEQ ID NO: 1205479 - RNA, 22 nt, Human
ugugaaggcguuggggcgcggg

SEQ ID NO: 1205480 - RNA, 24 nt, Human
uucuggucugguaaacacuguugg

SEQ ID NO: 1205481 - RNA, 20 nt, Human
uuuuccgcaaguacucccag

SEQ ID NO: 1205482 - RNA, 22 nt, Human
caagaggggaggggcuccgguu

SEQ ID NO: 1205483 - RNA, 21 nt, Human
ccugcgggcggagcgacuguc

SEQ ID NO: 1205484 - RNA, 18 nt, Human
gcggagcgacuguccucc

SEQ ID NO: 1205485 - RNA, 18 nt, Human
gcguccgaacagcccugc

SEQ ID NO: 1205486 - RNA, 19 nt, Human
gggaggggcuccgguggug

SEQ ID NO: 1205487 - RNA, 20 nt, Human
ggggaggggcuccgguggug

SEQ ID NO: 1205488 - RNA, 18 nt, Human
guaaggagcaagagggga

SEQ ID NO: 1205489 - RNA, 19 nt, Human
guccgaacagcccugcggg

SEQ ID NO: 1205490 - RNA, 24 nt, Human
uguaaggagcaagaggggaggggc

SEQ ID NO: 1205491 - RNA, 19 nt, Human
uguccucccuucuggugua

SEQ ID NO: 1205492 - RNA, 18 nt, Human
cagcccagcgaggaccgg

SEQ ID NO: 1205493 - RNA, 20 nt, Human
caguucuggauccucuuccu

SEQ ID NO: 1205494 - RNA, 19 nt, Human
ccagcgaggaccggcugca

SEQ ID NO: 1205495 - RNA, 25 nt, Human
ccggcugcaguucuggauccucuuc

SEQ ID NO: 1205496 - RNA, 22 nt, Human
ccuacugugugcaggacacugu

SEQ ID NO: 1205497 - RNA, 19 nt, Human
cugcuccacuucagauaug

SEQ ID NO: 1205498 - RNA, 24 nt, Human
gcaguucuggauccucuuccugcu

SEQ ID NO: 1205499 - RNA, 20 nt, Human
uacugugugcaggacacugu

SEQ ID NO: 1205500 - RNA, 20 nt, Human
aaacagagaccaacgcugug

SEQ ID NO: 1205501 - RNA, 27 nt, Human
aaagaaauaaaaacucuggguagaggg

SEQ ID NO: 1205502 - RNA, 23 nt, Human
aagaacugcgaaagggaaauggc

SEQ ID NO: 1205503 - RNA, 23 nt, Human
acagagaaaggcagugcauuugg

SEQ ID NO: 1205504 - RNA, 24 nt, Human
acucuucccuucuucuuucugucg

SEQ ID NO: 1205505 - RNA, 19 nt, Human
agguguggugggaggcggu

SEQ ID NO: 1205506 - RNA, 20 nt, Human
agucauggggacagagaaag

SEQ ID NO: 1205507 - RNA, 18 nt, Human
auggggacagagaaaggc

SEQ ID NO: 1205508 - RNA, 18 nt, Human
caccagaugaccagcuga

SEQ ID NO: 1205509 - RNA, 20 nt, Human
caccagaugaccagcugaau

SEQ ID NO: 1205510 - RNA, 23 nt, Human
cauccuccacaagcagcugggag

SEQ ID NO: 1205511 - RNA, 19 nt, Human
caugugugugucuguauau

SEQ ID NO: 1205512 - RNA, 19 nt, Human
ccagaccuuucuuuuucca

SEQ ID NO: 1205513 - RNA, 20 nt, Human
cccacaguaauccucugaag

SEQ ID NO: 1205514 - RNA, 18 nt, Human
cccauccuacccccacgc

SEQ ID NO: 1205515 - RNA, 23 nt, Human
cccccauccuacccccacgccug

SEQ ID NO: 1205516 - RNA, 18 nt, Human
cccuuugggggugccuca

SEQ ID NO: 1205517 - RNA, 21 nt, Human
ccucuuccagaccuuucuuuu

SEQ ID NO: 1205518 - RNA, 18 nt, Human
ccuggggcaguggaggcc

SEQ ID NO: 1205519 - RNA, 19 nt, Human
cgaaagggaaauggcccac

SEQ ID NO: 1205520 - RNA, 26 nt, Human
gaacacucagacuaauuaaagaaaua

SEQ ID NO: 1205521 - RNA, 19 nt, Human
gaacugcgaaagggaaaug

SEQ ID NO: 1205522 - RNA, 23 nt, Human
gaccguaugcuucccauuugggg

SEQ ID NO: 1205523 - RNA, 21 nt, Human
gaccuuucuuuuuccauuugg

SEQ ID NO: 1205524 - RNA, 25 nt, Human
gaccuuucuuuuuccauuuggaguu

SEQ ID NO: 1205525 - RNA, 20 nt, Human
gcacaucgcccuuugggggu

SEQ ID NO: 1205526 - RNA, 18 nt, Human
gcccccauccuaccccca

SEQ ID NO: 1205527 - RNA, 21 nt, Human
gcgaaagggaaauggcccaca

SEQ ID NO: 1205528 - RNA, 19 nt, Human
ggagauggugaugaagggg

SEQ ID NO: 1205529 - RNA, 23 nt, Human
ggaggccaggaacagguggcagg

SEQ ID NO: 1205530 - RNA, 23 nt, Human
ggcagugcauuuggcuucuaggg

SEQ ID NO: 1205531 - RNA, 23 nt, Human
gguagagggacacucuggggggc

SEQ ID NO: 1205532 - RNA, 20 nt, Human
guggugggaggcggugggcc

SEQ ID NO: 1205533 - RNA, 20 nt, Human
uauuacauccuccacaagca

SEQ ID NO: 1205534 - RNA, 21 nt, Human
ucaguccuggggcaguggagg

SEQ ID NO: 1205535 - RNA, 25 nt, Human
uccacaagcagcugggagcccccau

SEQ ID NO: 1205536 - RNA, 19 nt, Human
uccaguuggcucuguuccu

SEQ ID NO: 1205537 - RNA, 22 nt, Human
uccuccacaagcagcugggagc

SEQ ID NO: 1205538 - RNA, 24 nt, Human
ucucgaacaaccaccggauggucu

SEQ ID NO: 1205539 - RNA, 21 nt, Human
ugaaggggcuggcggccaggu

SEQ ID NO: 1205540 - RNA, 23 nt, Human
ugaaggggcuggcggccaggucc

SEQ ID NO: 1205541 - RNA, 18 nt, Human
ugaccuuugggccaccag

SEQ ID NO: 1205542 - RNA, 19 nt, Human
ugccucaggcugggggucu

SEQ ID NO: 1205543 - RNA, 26 nt, Human
ugggccucuuccagaccuuucuuuuu

SEQ ID NO: 1205544 - RNA, 18 nt, Human
ugggggacagucaugggg

SEQ ID NO: 1205545 - RNA, 22 nt, Human
ugggggucucccugacucuucc

SEQ ID NO: 1205546 - RNA, 21 nt, Human
uguggugggaggcggugggcc

SEQ ID NO: 1205547 - RNA, 21 nt, Human
ugugugaaaaacaugugugug

SEQ ID NO: 1205548 - RNA, 22 nt, Human
uuggcucuguuccucuccaggg

SEQ ID NO: 1205549 - RNA, 21 nt, Human
uuugggggugccucaggcugg

SEQ ID NO: 1205550 - RNA, 20 nt, Human
cacacagcucuugccaccaa

SEQ ID NO: 1205551 - RNA, 23 nt, Human
cacacagcucuugccaccaagaa

SEQ ID NO: 1205552 - RNA, 20 nt, Human
cagcucuugccaccaagaac

SEQ ID NO: 1205553 - RNA, 22 nt, Human
ccuuccuuccccucaggcuucc

SEQ ID NO: 1205554 - RNA, 18 nt, Human
cgcccguacuuccuuccu

SEQ ID NO: 1205555 - RNA, 19 nt, Human
cugagauucuuucuccuuu

SEQ ID NO: 1205556 - RNA, 18 nt, Human
cuuugcucuccauuucgg

SEQ ID NO: 1205557 - RNA, 22 nt, Human
gcuucagauucccaaaucuggg

SEQ ID NO: 1205558 - RNA, 18 nt, Human
gggaagccaaucugauga

SEQ ID NO: 1205559 - RNA, 23 nt, Human
uccuuccuuccccucaggcuucc

SEQ ID NO: 1205560 - RNA, 19 nt, Human
ucuuuucggauguauuucu

SEQ ID NO: 1205561 - RNA, 21 nt, Human
ugaacugauucuuuucggaug

SEQ ID NO: 1205562 - RNA, 24 nt, Human
ugccaccaagaacgacagcaaaag

SEQ ID NO: 1205563 - RNA, 19 nt, Human
ugucuggauugacauagaa

SEQ ID NO: 1205564 - RNA, 18 nt, Human
ugugggcccgcuucagau

SEQ ID NO: 1205565 - RNA, 24 nt, Human
uucaaaagacuuugcucuccauuu

SEQ ID NO: 1205566 - RNA, 19 nt, Human
auaccuuucucuucuuucu

SEQ ID NO: 1205567 - RNA, 22 nt, Human
cugaugacaggaaagggcucuu

SEQ ID NO: 1205568 - RNA, 24 nt, Human
uaccuuucucuucuuucuucuuca

SEQ ID NO: 1205569 - RNA, 23 nt, Human
ucucugaugacaggaaagggcuc

SEQ ID NO: 1205570 - RNA, 19 nt, Human
uuucucuucuuucuucuuc

SEQ ID NO: 1205571 - RNA, 26 nt, Human
aacuguggggcuguuagggaagcuuu

SEQ ID NO: 1205572 - RNA, 26 nt, Human
aagcagcccaggccggcuuggccuuc

SEQ ID NO: 1205573 - RNA, 20 nt, Human
acccacagcgaguggaucca

SEQ ID NO: 1205574 - RNA, 24 nt, Human
acggaauccgggaucaggaaaacc

SEQ ID NO: 1205575 - RNA, 19 nt, Human
agccugggaggaggguggg

SEQ ID NO: 1205576 - RNA, 24 nt, Human
aucaggaaaaccuguccaagcuuc

SEQ ID NO: 1205577 - RNA, 22 nt, Human
caaaaaacccauugacgcuuuc

SEQ ID NO: 1205578 - RNA, 23 nt, Human
cauuuggagaucuaagccgccaa

SEQ ID NO: 1205579 - RNA, 24 nt, Human
cccaaaagcuuagcgcgaguuucc

SEQ ID NO: 1205580 - RNA, 18 nt, Human
ccccggaaucccaaaagc

SEQ ID NO: 1205581 - RNA, 23 nt, Human
ccccuuaauuugcagaugccgcc

SEQ ID NO: 1205582 - RNA, 25 nt, Human
cccgcagggacccacagcgagugga

SEQ ID NO: 1205583 - RNA, 18 nt, Human
ccgcagagcagaggcgca

SEQ ID NO: 1205584 - RNA, 21 nt, Human
ccucucuacaaaccuuuccca

SEQ ID NO: 1205585 - RNA, 21 nt, Human
ccuucggggccuccuccggac

SEQ ID NO: 1205586 - RNA, 21 nt, Human
ccuucuccuggagcgagaacc

SEQ ID NO: 1205587 - RNA, 23 nt, Human
cgcgaguuuccucucuacaaacc

SEQ ID NO: 1205588 - RNA, 19 nt, Human
cgggaucaggaaaaccugu

SEQ ID NO: 1205589 - RNA, 21 nt, Human
cgggaucaggaaaaccugucc

SEQ ID NO: 1205590 - RNA, 21 nt, Human
cugaggcccgcagggacccac

SEQ ID NO: 1205591 - RNA, 22 nt, Human
cugcgguagaucuugcucugca

SEQ ID NO: 1205592 - RNA, 19 nt, Human
gaagggacggaauccggga

SEQ ID NO: 1205593 - RNA, 19 nt, Human
gagcuuagguccuccagga

SEQ ID NO: 1205594 - RNA, 21 nt, Human
ggaauccuaacuguggggcug

SEQ ID NO: 1205595 - RNA, 18 nt, Human
ggcgagugauuaagcagc

SEQ ID NO: 1205596 - RNA, 21 nt, Human
ucccagaguccaggcgaagcg

SEQ ID NO: 1205597 - RNA, 23 nt, Human
ucccagaguccaggcgaagcgcu

SEQ ID NO: 1205598 - RNA, 27 nt, Human
uccggacuucccucgacagccgcucuc

SEQ ID NO: 1205599 - RNA, 21 nt, Human
uccuccggacuucccucgaca

SEQ ID NO: 1205600 - RNA, 19 nt, Human
ucuaagccgccaaaggcga

SEQ ID NO: 1205601 - RNA, 20 nt, Human
ucucugcgguagaucuugcu

SEQ ID NO: 1205602 - RNA, 18 nt, Human
ucuugcucugcacuugcu

SEQ ID NO: 1205603 - RNA, 20 nt, Human
ucuugcucugcacuugcucu

SEQ ID NO: 1205604 - RNA, 21 nt, Human
ugagagcuuagguccuccagg

SEQ ID NO: 1205605 - RNA, 18 nt, Human
ugagccugggaggagggu

SEQ ID NO: 1205606 - RNA, 23 nt, Human
ugagccugggaggaggguggggg

SEQ ID NO: 1205607 - RNA, 28 nt, Human
uggagcgagaacccacaaaaaacccauu

SEQ ID NO: 1205608 - RNA, 18 nt, Human
uggccuucggggccuccu

SEQ ID NO: 1205609 - RNA, 21 nt, Human
uuagggaagcuuuguuucuug

SEQ ID NO: 1205610 - RNA, 23 nt, Human
uugcucuguccccuuaauuugca

SEQ ID NO: 1205611 - RNA, 21 nt, Human
auggaggacugcccuugacca

SEQ ID NO: 1205612 - RNA, 21 nt, Human
ccauggaggacugcccuugac

SEQ ID NO: 1205613 - RNA, 21 nt, Human
gcccuugaccaccuggaacug

SEQ ID NO: 1205614 - RNA, 18 nt, Human
ucuccauggaggacugcc

SEQ ID NO: 1205615 - RNA, 22 nt, Human
acaacguguguccgucuuccag

SEQ ID NO: 1205616 - RNA, 24 nt, Human
aggcacccaaagcaccccgagccc

SEQ ID NO: 1205617 - RNA, 18 nt, Human
augcagccgcugcugcuu

SEQ ID NO: 1205618 - RNA, 27 nt, Human
caaagcaccccgagcccaugguucccc

SEQ ID NO: 1205619 - RNA, 20 nt, Human
cacccaaagcaccccgagcc

SEQ ID NO: 1205620 - RNA, 21 nt, Human
cccaaagcaccccgagcccau

SEQ ID NO: 1205621 - RNA, 18 nt, Human
ccgcaggguuuggggacc

SEQ ID NO: 1205622 - RNA, 25 nt, Human
cucaaccguuggcuuuucccuacaa

SEQ ID NO: 1205623 - RNA, 22 nt, Human
gcgaagcgccgguuugggcggg

SEQ ID NO: 1205624 - RNA, 25 nt, Human
ucagccugaacagugggugggccgg

SEQ ID NO: 1205625 - RNA, 21 nt, Human
uccccaugcaguacuccggcu

SEQ ID NO: 1205626 - RNA, 18 nt, Human
ugaacagugggugggccg

SEQ ID NO: 1205627 - RNA, 21 nt, Human
ugcuuggagcagagaugaaga

SEQ ID NO: 1205628 - RNA, 22 nt, Human
ugcuuggagcagagaugaagaa

SEQ ID NO: 1205629 - RNA, 21 nt, Human
ugggugggccggcaaugacaa

SEQ ID NO: 1205630 - RNA, 19 nt, Human
uuggagcagagaugaagaa

SEQ ID NO: 1205631 - RNA, 23 nt, Human
aaguggcucuuccagggagaagg

SEQ ID NO: 1205632 - RNA, 20 nt, Human
acucgcuccuccaccgagcc

SEQ ID NO: 1205633 - RNA, 20 nt, Human
agaaggaagggaccugaaaa

SEQ ID NO: 1205634 - RNA, 23 nt, Human
agacagacgagaccauugccagg

SEQ ID NO: 1205635 - RNA, 21 nt, Human
aggaagggaccugaaaauccg

SEQ ID NO: 1205636 - RNA, 20 nt, Human
caccugccuucgggaauggg

SEQ ID NO: 1205637 - RNA, 20 nt, Human
caggaggagacucugggugg

SEQ ID NO: 1205638 - RNA, 22 nt, Human
caggaggagacucuggguggug

SEQ ID NO: 1205639 - RNA, 20 nt, Human
cagugguggugggccccuug

SEQ ID NO: 1205640 - RNA, 21 nt, Human
ccaacccagacagacgagacc

SEQ ID NO: 1205641 - RNA, 24 nt, Human
ccaacccagacagacgagaccauu

SEQ ID NO: 1205642 - RNA, 30 nt, Human
ccaacccagacagacgagaccauugccagg

SEQ ID NO: 1205643 - RNA, 20 nt, Human
ccacuccgcagccucuggug

SEQ ID NO: 1205644 - RNA, 19 nt, Human
ccccagcggucaaaagcuc

SEQ ID NO: 1205645 - RNA, 25 nt, Human
ccccagcggucaaaagcucuuugcu

SEQ ID NO: 1205646 - RNA, 18 nt, Human
cccugcucugggccuuuc

SEQ ID NO: 1205647 - RNA, 19 nt, Human
ccgcagccucugguggugc

SEQ ID NO: 1205648 - RNA, 24 nt, Human
ccuccgcggcuaugcagacggcuu

SEQ ID NO: 1205649 - RNA, 19 nt, Human
cgcagaagccccaaccucc

SEQ ID NO: 1205650 - RNA, 22 nt, Human
cuccgcggcuaugcagacggcu

SEQ ID NO: 1205651 - RNA, 25 nt, Human
cucugggugguggggcagugguggu

SEQ ID NO: 1205652 - RNA, 20 nt, Human
gaccugaaaauccgugaaga

SEQ ID NO: 1205653 - RNA, 20 nt, Human
gagccacagguucugaucag

SEQ ID NO: 1205654 - RNA, 24 nt, Human
gaggacgcagaagccccaaccucc

SEQ ID NO: 1205655 - RNA, 25 nt, Human
gaggggaccuugaggcucagaaggg

SEQ ID NO: 1205656 - RNA, 20 nt, Human
gcagugguggugggccccuu

SEQ ID NO: 1205657 - RNA, 20 nt, Human
gcagugguggugggccccuu

SEQ ID NO: 1205658 - RNA, 19 nt, Human
gccagucuuucugagcugg

SEQ ID NO: 1205659 - RNA, 19 nt, Human
gccugcuauacuuccugcu

SEQ ID NO: 1205660 - RNA, 20 nt, Human
gccuuucgaagccugugggc

SEQ ID NO: 1205661 - RNA, 19 nt, Human
ggagucacagaagguucug

SEQ ID NO: 1205662 - RNA, 22 nt, Human
gggcagugguggugggccccuu

SEQ ID NO: 1205663 - RNA, 19 nt, Human
gggccccuuggccacucgc

SEQ ID NO: 1205664 - RNA, 21 nt, Human
gggccggggcgcgccagcgcc

SEQ ID NO: 1205665 - RNA, 22 nt, Human
gggccuuucgaagccugugggc

SEQ ID NO: 1205666 - RNA, 22 nt, Human
gugguggugggccccuuggcca

SEQ ID NO: 1205667 - RNA, 22 nt, Human
uaguucaugaagaaggaaggga

SEQ ID NO: 1205668 - RNA, 20 nt, Human
uccgcagccucugguggugc

SEQ ID NO: 1205669 - RNA, 25 nt, Human
ucuggccacuccgcagccucuggug

SEQ ID NO: 1205670 - RNA, 22 nt, Human
ucugggacuggagcggugagga

SEQ ID NO: 1205671 - RNA, 28 nt, Human
ucuuccagggagaagguucuggagcugg

SEQ ID NO: 1205672 - RNA, 23 nt, Human
ucuuucugagcugggcucugcgg

SEQ ID NO: 1205673 - RNA, 21 nt, Human
ugaggacgcagaagccccaac

SEQ ID NO: 1205674 - RNA, 22 nt, Human
ugaggacgcagaagccccaacc

SEQ ID NO: 1205675 - RNA, 18 nt, Human
ugcuuuguggacagcucc

SEQ ID NO: 1205676 - RNA, 21 nt, Human
uggaaaguggcccugcauaga

SEQ ID NO: 1205677 - RNA, 21 nt, Human
ugggaacugagaguugccugc

SEQ ID NO: 1205678 - RNA, 23 nt, Human
ugggccccagcggucaagacccu

SEQ ID NO: 1205679 - RNA, 28 nt, Human
ugggccccuuggccacucgggagguccc

SEQ ID NO: 1205680 - RNA, 19 nt, Human
uggugggccccuuggccac

SEQ ID NO: 1205681 - RNA, 19 nt, Human
ugguggggcagugguggug

SEQ ID NO: 1205682 - RNA, 20 nt, Human
ugguggugggccccuuggcc

SEQ ID NO: 1205683 - RNA, 22 nt, Human
ugucccugcucugggccuuucg

SEQ ID NO: 1205684 - RNA, 24 nt, Human
uguggagccuuauguggaaguacu

SEQ ID NO: 1205685 - RNA, 18 nt, Human
uuccguucugagcuuugc

SEQ ID NO: 1205686 - RNA, 21 nt, Human
uuucugagcugggcucugcgg

SEQ ID NO: 1205687 - RNA, 20 nt, Human
aaaaugccggcucggccucc

SEQ ID NO: 1205688 - RNA, 20 nt, Human
aaagugcugggauuccuggc

SEQ ID NO: 1205689 - RNA, 24 nt, Human
aaagugcugggauuccuggcguga

SEQ ID NO: 1205690 - RNA, 20 nt, Human
aagccgcuagccagcagccc

SEQ ID NO: 1205691 - RNA, 20 nt, Human
acaaagaggacaaucuagac

SEQ ID NO: 1205692 - RNA, 18 nt, Human
acaagcgaggcucaucac

SEQ ID NO: 1205693 - RNA, 24 nt, Human
agaaguggacaccccaccaggccc

SEQ ID NO: 1205694 - RNA, 18 nt, Human
agagcgcagccgccagcu

SEQ ID NO: 1205695 - RNA, 22 nt, Human
agccagcagccccagcgcgccc

SEQ ID NO: 1205696 - RNA, 24 nt, Human
caaagugcugggauuccuggcgug

SEQ ID NO: 1205697 - RNA, 22 nt, Human
cacccuguauuccgcauaagac

SEQ ID NO: 1205698 - RNA, 19 nt, Human
caccugcucccuguucuuc

SEQ ID NO: 1205699 - RNA, 22 nt, Human
cagcagccccagcgcgcccgcc

SEQ ID NO: 1205700 - RNA, 20 nt, Human
cagccagagcgcagccgcca

SEQ ID NO: 1205701 - RNA, 24 nt, Human
caggaugcccauuuuuuaaaggcu

SEQ ID NO: 1205702 - RNA, 18 nt, Human
caucgggcaggguccugg

SEQ ID NO: 1205703 - RNA, 23 nt, Human
caucgggcaggguccuggcccug

SEQ ID NO: 1205704 - RNA, 22 nt, Human
ccaaagugcugggauuccuggc

SEQ ID NO: 1205705 - RNA, 24 nt, Human
ccaaagugcugggauuccuggcgu

SEQ ID NO: 1205706 - RNA, 20 nt, Human
ccagaaguggacaccccacc

SEQ ID NO: 1205707 - RNA, 19 nt, Human
ccaggcccacgagaagcgg

SEQ ID NO: 1205708 - RNA, 25 nt, Human
ccaggcccacgagaagcggcccacg

SEQ ID NO: 1205709 - RNA, 18 nt, Human
cccagcgcgcccgccaca

SEQ ID NO: 1205710 - RNA, 20 nt, Human
ccccaccaggcccacgagaa

SEQ ID NO: 1205711 - RNA, 18 nt, Human
ccgcggccaacgccaggg

SEQ ID NO: 1205712 - RNA, 19 nt, Human
ccggcucggccucccaaag

SEQ ID NO: 1205713 - RNA, 20 nt, Human
cgcggcagccaccgcggcca

SEQ ID NO: 1205714 - RNA, 22 nt, Human
cggcccacgcggccugggcccg

SEQ ID NO: 1205715 - RNA, 24 nt, Human
cgugcuccgugggcggccuggguc

SEQ ID NO: 1205716 - RNA, 20 nt, Human
cucccaaagugcugggauuc

SEQ ID NO: 1205717 - RNA, 19 nt, Human
cucccuguucuucaugccc

SEQ ID NO: 1205718 - RNA, 18 nt, Human
gauuccuggcgugagcca

SEQ ID NO: 1205719 - RNA, 21 nt, Human
gauuccuggcgugagccaccg

SEQ ID NO: 1205720 - RNA, 21 nt, Human
gcacaaagaggacaaucuaga

SEQ ID NO: 1205721 - RNA, 24 nt, Human
gggcgagcgcccaugucagcucca

SEQ ID NO: 1205722 - RNA, 22 nt, Human
ggguacagccagagcgcagccg

SEQ ID NO: 1205723 - RNA, 20 nt, Human
uagcccagcaagcgugcucc

SEQ ID NO: 1205724 - RNA, 19 nt, Human
uccaugcacacccacccug

SEQ ID NO: 1205725 - RNA, 24 nt, Human
ucccaaagugcugggauuccuggc

SEQ ID NO: 1205726 - RNA, 18 nt, Human
ucggccucccaaagugcu

SEQ ID NO: 1205727 - RNA, 19 nt, Human
ugcccgaauccaugcacac

SEQ ID NO: 1205728 - RNA, 21 nt, Human
ugcucccuguucuucaugccc

SEQ ID NO: 1205729 - RNA, 18 nt, Human
ugcuccgugggcggccug

SEQ ID NO: 1205730 - RNA, 19 nt, Human
uggccaggaugcccauuuu

SEQ ID NO: 1205731 - RNA, 23 nt, Human
ugggauuccuggcgugagccacc

SEQ ID NO: 1205732 - RNA, 24 nt, Human
ugggauuccuggcgugagccaccg

SEQ ID NO: 1205733 - RNA, 18 nt, Human
ugugggcaucgggcaggg

SEQ ID NO: 1205734 - RNA, 19 nt, Human
uccacagauggcaaagggc

SEQ ID NO: 1205735 - RNA, 22 nt, Human
uggcaaagggccuggugcuccc

SEQ ID NO: 1205736 - RNA, 23 nt, Human
uggcaaagggccuggugcuccca

SEQ ID NO: 1205737 - RNA, 23 nt, Human
ugugcaugcccgccgaacagagg

SEQ ID NO: 1205738 - RNA, 21 nt, Human
aaacaagugaugccgcuuccu

SEQ ID NO: 1205739 - RNA, 22 nt, Human
augcgcaggacaugaaaaacaa

SEQ ID NO: 1205740 - RNA, 21 nt, Human
cuuccuuauaccgcuguugca

SEQ ID NO: 1205741 - RNA, 20 nt, Human
ggacaugaaaaacaagugau

SEQ ID NO: 1205742 - RNA, 19 nt, Human
ugaaaaacaagugaugccg

SEQ ID NO: 1205743 - RNA, 25 nt, Human
uuccuuauaccgcuguugcaaguac

SEQ ID NO: 1205744 - RNA, 21 nt, Human
aagcugcucaaggcucuccca

SEQ ID NO: 1205745 - RNA, 24 nt, Human
acaaagccacaagguucuccaugg

SEQ ID NO: 1205746 - RNA, 21 nt, Human
acaagcuccaggaccucaaga

SEQ ID NO: 1205747 - RNA, 19 nt, Human
accugcagccauacccccc

SEQ ID NO: 1205748 - RNA, 19 nt, Human
agaagagaagcuugggggu

SEQ ID NO: 1205749 - RNA, 19 nt, Human
agaguagggggcagcacag

SEQ ID NO: 1205750 - RNA, 19 nt, Human
agcccccagccuggcccag

SEQ ID NO: 1205751 - RNA, 19 nt, Human
aggcagggcguucaagccc

SEQ ID NO: 1205752 - RNA, 20 nt, Human
aggcuggcucagaggccggc

SEQ ID NO: 1205753 - RNA, 19 nt, Human
agggggccccccagcaaac

SEQ ID NO: 1205754 - RNA, 21 nt, Human
augguccugggcagcccagga

SEQ ID NO: 1205755 - RNA, 18 nt, Human
auucugcugccucguggc

SEQ ID NO: 1205756 - RNA, 20 nt, Human
caacucugagggaugcagaa

SEQ ID NO: 1205757 - RNA, 20 nt, Human
cacagcccccagccuggccc

SEQ ID NO: 1205758 - RNA, 21 nt, Human
cacagcccccagccuggccca

SEQ ID NO: 1205759 - RNA, 18 nt, Human
caccagcccagacaaagc

SEQ ID NO: 1205760 - RNA, 18 nt, Human
cacuggggcuucaucuuc

SEQ ID NO: 1205761 - RNA, 24 nt, Human
cagaguagggggcagcacaguucu

SEQ ID NO: 1205762 - RNA, 19 nt, Human
cagcacaguucugagguuc

SEQ ID NO: 1205763 - RNA, 20 nt, Human
cagccauaccccccguccug

SEQ ID NO: 1205764 - RNA, 20 nt, Human
cagcccagacaaagccacaa

SEQ ID NO: 1205765 - RNA, 18 nt, Human
cagcccaggaggcagcag

SEQ ID NO: 1205766 - RNA, 20 nt, Human
cagcccaggaggcagcagcc

SEQ ID NO: 1205767 - RNA, 24 nt, Human
cagcggagccgcagccgaccccug

SEQ ID NO: 1205768 - RNA, 18 nt, Human
caggaacugugggcuggg

SEQ ID NO: 1205769 - RNA, 22 nt, Human
caguaccugugaucaggagucc

SEQ ID NO: 1205770 - RNA, 20 nt, Human
cauggcaugguccugggcag

SEQ ID NO: 1205771 - RNA, 18 nt, Human
ccaccagcccagacaaag

SEQ ID NO: 1205772 - RNA, 21 nt, Human
ccaccagcccagacaaagcca

SEQ ID NO: 1205773 - RNA, 19 nt, Human
ccacugggagaacacagaa

SEQ ID NO: 1205774 - RNA, 24 nt, Human
ccaggacagggaugucugcuucau

SEQ ID NO: 1205775 - RNA, 19 nt, Human
cccagcggagccgcagccg

SEQ ID NO: 1205776 - RNA, 21 nt, Human
cccagcggagccgcagccgca

SEQ ID NO: 1205777 - RNA, 20 nt, Human
ccccacuccccucacaucug

SEQ ID NO: 1205778 - RNA, 21 nt, Human
ccccaggggcuuccaguaccu

SEQ ID NO: 1205779 - RNA, 19 nt, Human
ccccccagcaaacuuggcu

SEQ ID NO: 1205780 - RNA, 23 nt, Human
ccccugggcgaaccucccagccc

SEQ ID NO: 1205781 - RNA, 24 nt, Human
ccccugggcgaaccucccagcccc

SEQ ID NO: 1205782 - RNA, 18 nt, Human
cccgggcuggggcccggg

SEQ ID NO: 1205783 - RNA, 23 nt, Human
ccuaugaacaugaagcugagggu

SEQ ID NO: 1205784 - RNA, 21 nt, Human
ccugcagccauaccccccguc

SEQ ID NO: 1205785 - RNA, 21 nt, Human
ccugccgcuguguccucccca

SEQ ID NO: 1205786 - RNA, 18 nt, Human
ccuuucagcuccccuccc

SEQ ID NO: 1205787 - RNA, 22 nt, Human
cgaaccucccagccccaacucu

SEQ ID NO: 1205788 - RNA, 24 nt, Human
cgcgcccgaagccugcggaaccgg

SEQ ID NO: 1205789 - RNA, 21 nt, Human
cggagccgcagccgcauucug

SEQ ID NO: 1205790 - RNA, 20 nt, Human
cggcugaggcgcagcggcga

SEQ ID NO: 1205791 - RNA, 18 nt, Human
cucccagccccaacucug

SEQ ID NO: 1205792 - RNA, 19 nt, Human
cugcagucuggccuguacc

SEQ ID NO: 1205793 - RNA, 23 nt, Human
cugcuucauuggcggggguaggg

SEQ ID NO: 1205794 - RNA, 20 nt, Human
cuggcacagcccccagccug

SEQ ID NO: 1205795 - RNA, 24 nt, Human
cugggcgaaccucccagccccaac

SEQ ID NO: 1205796 - RNA, 21 nt, Human
cuggggcuucaucuucuugac

SEQ ID NO: 1205797 - RNA, 19 nt, Human
cuguccugcugccagcugg

SEQ ID NO: 1205798 - RNA, 23 nt, Human
cuucccuucuaacaccugcagcc

SEQ ID NO: 1205799 - RNA, 23 nt, Human
cuuuccccacuccccucacaucu

SEQ ID NO: 1205800 - RNA, 18 nt, Human
gaaccgguuaagccgcgg

SEQ ID NO: 1205801 - RNA, 22 nt, Human
gacuaugaaguccacccugaag

SEQ ID NO: 1205802 - RNA, 19 nt, Human
gagagccagaguggggcug

SEQ ID NO: 1205803 - RNA, 19 nt, Human
gccauggccccggggggcc

SEQ ID NO: 1205804 - RNA, 23 nt, Human
gcccgggcuggggcccgggcccu

SEQ ID NO: 1205805 - RNA, 26 nt, Human
gccgaggccauguucucaacagaaga

SEQ ID NO: 1205806 - RNA, 18 nt, Human
gcucacuggggcuucauc

SEQ ID NO: 1205807 - RNA, 23 nt, Human
gcuguguccuccccacaucugga

SEQ ID NO: 1205808 - RNA, 24 nt, Human
ggcaaggaaaggggcucacagagg

SEQ ID NO: 1205809 - RNA, 22 nt, Human
ggcagcacaguucugagguucc

SEQ ID NO: 1205810 - RNA, 18 nt, Human
ggccccugggcgaaccuc

SEQ ID NO: 1205811 - RNA, 18 nt, Human
ggcucagaggccggcacc

SEQ ID NO: 1205812 - RNA, 18 nt, Human
gggaugucugcuucauug

SEQ ID NO: 1205813 - RNA, 23 nt, Human
gggcagggccauggccccggggg

SEQ ID NO: 1205814 - RNA, 21 nt, Human
gggccccugggcgaaccuccc

SEQ ID NO: 1205815 - RNA, 24 nt, Human
gggcccucggcugcugacgcgccc

SEQ ID NO: 1205816 - RNA, 20 nt, Human
ggggcagcacaguucugagg

SEQ ID NO: 1205817 - RNA, 22 nt, Human
gggucagagccagagugggaga

SEQ ID NO: 1205818 - RNA, 21 nt, Human
ggguguuggggucagagccag

SEQ ID NO: 1205819 - RNA, 23 nt, Human
ggucuggguccccagggcaggau

SEQ ID NO: 1205820 - RNA, 24 nt, Human
gucccauucggcaaggaaaggggc

SEQ ID NO: 1205821 - RNA, 18 nt, Human
uaggcuccaccagcccag

SEQ ID NO: 1205822 - RNA, 20 nt, Human
uaucuucuuuccccacuccc

SEQ ID NO: 1205823 - RNA, 18 nt, Human
ucagcccuguaggcucca

SEQ ID NO: 1205824 - RNA, 19 nt, Human
uccaccagcccagacaaag

SEQ ID NO: 1205825 - RNA, 19 nt, Human
uccaccagcccagacaaag

SEQ ID NO: 1205826 - RNA, 20 nt, Human
uccagcccuggagugagcug

SEQ ID NO: 1205827 - RNA, 21 nt, Human
uccaguaccugugaucaggag

SEQ ID NO: 1205828 - RNA, 26 nt, Human
uccccucccuugcgggcagaggcugg

SEQ ID NO: 1205829 - RNA, 25 nt, Human
ucccuugcgggcagaggcagggcgu

SEQ ID NO: 1205830 - RNA, 22 nt, Human
uccugcuucagggagugguagg

SEQ ID NO: 1205831 - RNA, 22 nt, Human
uccuuccacgcagaccuuucag

SEQ ID NO: 1205832 - RNA, 23 nt, Human
ucuaacaccugcagccauacccc

SEQ ID NO: 1205833 - RNA, 22 nt, Human
ucucccagguguggcucagucu

SEQ ID NO: 1205834 - RNA, 21 nt, Human
ugaagcugaggguuccugcag

SEQ ID NO: 1205835 - RNA, 21 nt, Human
ugcaggggaugcaccccacau

SEQ ID NO: 1205836 - RNA, 20 nt, Human
ugcagucuggccuguaccgg

SEQ ID NO: 1205837 - RNA, 20 nt, Human
ugcccuacagcuccuggugc

SEQ ID NO: 1205838 - RNA, 21 nt, Human
ugccgcuguguccuccccaca

SEQ ID NO: 1205839 - RNA, 23 nt, Human
ugccucguggccaggacagggau

SEQ ID NO: 1205840 - RNA, 19 nt, Human
ugccugggaagauguggag

SEQ ID NO: 1205841 - RNA, 19 nt, Human
uggcaugguccugggcagc

SEQ ID NO: 1205842 - RNA, 19 nt, Human
uggcccagcggagccgcag

SEQ ID NO: 1205843 - RNA, 22 nt, Human
uggcuccuuucagcuccccucc

SEQ ID NO: 1205844 - RNA, 18 nt, Human
ugggaagauguggaggcc

SEQ ID NO: 1205845 - RNA, 19 nt, Human
ugggagagccagagugggg

SEQ ID NO: 1205846 - RNA, 19 nt, Human
ugggcagcccaggaggcag

SEQ ID NO: 1205847 - RNA, 19 nt, Human
uggggcugcaggggaugca

SEQ ID NO: 1205848 - RNA, 20 nt, Human
uggggugugaauagggggag

SEQ ID NO: 1205849 - RNA, 21 nt, Human
uucaucuucuugcccuacagc

SEQ ID NO: 1205850 - RNA, 22 nt, Human
uuggggaggcuggcucagaggc

SEQ ID NO: 1205851 - RNA, 21 nt, Human
uuucagggccccugucucccu

SEQ ID NO: 1205852 - RNA, 20 nt, Human
uuuccuaugaacaugaagcu

SEQ ID NO: 1205853 - RNA, 25 nt, Human
uuucuguccugcugccagcuggaga

SEQ ID NO: 1205854 - RNA, 23 nt, Human
aagaggagagguugacaacagaa

SEQ ID NO: 1205855 - RNA, 22 nt, Human
gauccuuuccccuuggaagccu

SEQ ID NO: 1205856 - RNA, 27 nt, Human
uaguugauccuuuccccuuggaagccu

SEQ ID NO: 1205857 - RNA, 21 nt, Human
ucuuggagcuguggcagauuc

SEQ ID NO: 1205858 - RNA, 18 nt, Human
uggcaagaggagagguug

SEQ ID NO: 1205859 - RNA, 20 nt, Human
uuccccuuggaagccuuuac

SEQ ID NO: 1205860 - RNA, 24 nt, Human
uuggaagccuuuacucuuaacugg

SEQ ID NO: 1205861 - RNA, 21 nt, Human
acccccuucagagccccagca

SEQ ID NO: 1205862 - RNA, 19 nt, Human
acgcugaaucuccacugau

SEQ ID NO: 1205863 - RNA, 20 nt, Human
agcccaaacgcaccagaaau

SEQ ID NO: 1205864 - RNA, 24 nt, Human
caaaacugacucugcaaauauucu

SEQ ID NO: 1205865 - RNA, 21 nt, Human
caagcccaaacgcaccagaaa

SEQ ID NO: 1205866 - RNA, 23 nt, Human
cacaccaagcccaaacgcaccag

SEQ ID NO: 1205867 - RNA, 20 nt, Human
caccaagcccaaacgcaccg

SEQ ID NO: 1205868 - RNA, 21 nt, Human
ccaagcccaaacgcaccagaa

SEQ ID NO: 1205869 - RNA, 19 nt, Human
ccccuucagagccccagca

SEQ ID NO: 1205870 - RNA, 20 nt, Human
cuggcugcugcacaccaagc

SEQ ID NO: 1205871 - RNA, 22 nt, Human
gagccccagcaagauggaaaua

SEQ ID NO: 1205872 - RNA, 21 nt, Human
uucuuuacuuaacgcugaauc

SEQ ID NO: 1205873 - RNA, 19 nt, Human
acagcuuucuucuugccug

SEQ ID NO: 1205874 - RNA, 19 nt, Human
ugcccugguacucccuugu

SEQ ID NO: 1205875 - RNA, 22 nt, Human
ugcccugguacucccuuguuga

SEQ ID NO: 1205876 - RNA, 24 nt, Human
aacuggucccaaacccccauccuc

SEQ ID NO: 1205877 - RNA, 22 nt, Human
aagucugauucucacucagaac

SEQ ID NO: 1205878 - RNA, 23 nt, Human
cugaagacauucugcagggggaa

SEQ ID NO: 1205879 - RNA, 26 nt, Human
gagccaagacuaaacucccacaagga

SEQ ID NO: 1205880 - RNA, 20 nt, Human
gccaagacuaaacucccaca

SEQ ID NO: 1205881 - RNA, 21 nt, Human
ucacucagaacuggucccaaa

SEQ ID NO: 1205882 - RNA, 24 nt, Human
ucaugucgagccaagacuaaacuc

SEQ ID NO: 1205883 - RNA, 23 nt, Human
ugaagacauucugcagggggagc

SEQ ID NO: 1205884 - RNA, 18 nt, Human
auuacuaacacccagucc

SEQ ID NO: 1205885 - RNA, 20 nt, Human
cacccaguccugaacaacga

SEQ ID NO: 1205886 - RNA, 18 nt, Human
cgagguagcagcaaaauc

SEQ ID NO: 1205887 - RNA, 21 nt, Human
cugaacaacgagguagcagca

SEQ ID NO: 1205888 - RNA, 22 nt, Human
cugaacaacgagguagcagcaa

SEQ ID NO: 1205889 - RNA, 21 nt, Human
uaauaaauuucucaugaagua

SEQ ID NO: 1205890 - RNA, 21 nt, Human
ugagcaagaacgugaaguuug

SEQ ID NO: 1205891 - RNA, 18 nt, Human
uggauuacuaacacccag

SEQ ID NO: 1205892 - RNA, 22 nt, Human
uguugagcaagaacgugaaguu

SEQ ID NO: 1205893 - RNA, 24 nt, Human
uuaauaaauuucucaugaaguauu

SEQ ID NO: 1205894 - RNA, 24 nt, Human
cccugggggcuccuggcugggcug

SEQ ID NO: 1205895 - RNA, 23 nt, Human
aaccuuccugaaucuuuuuaaaa

SEQ ID NO: 1205896 - RNA, 18 nt, Human
ccccaaaccuuccugaau

SEQ ID NO: 1205897 - RNA, 19 nt, Human
ccugaaucuuuuuaaaacu

SEQ ID NO: 1205898 - RNA, 21 nt, Human
cugaaucuuuuuaaaacuucc

SEQ ID NO: 1205899 - RNA, 25 nt, Human
aaaaaaaaaauaauaacacauagga

SEQ ID NO: 1205900 - RNA, 22 nt, Human
aaccugucuucuucuaauucca

SEQ ID NO: 1205901 - RNA, 20 nt, Human
acacaacaaaagaaugaaaa

SEQ ID NO: 1205902 - RNA, 27 nt, Human
agaaaaaaaaaauaauaacacauagga

SEQ ID NO: 1205903 - RNA, 27 nt, Human
agaaaaaaaaaauaauaacacauagga

SEQ ID NO: 1205904 - RNA, 20 nt, Human
agaaauuuccuugagacuag

SEQ ID NO: 1205905 - RNA, 22 nt, Human
aggaacaacugaaaaugcugac

SEQ ID NO: 1205906 - RNA, 22 nt, Human
agugaacaauuaacgaucuaaa

SEQ ID NO: 1205907 - RNA, 25 nt, Human
caaaccuccacacaacaaaagaaug

SEQ ID NO: 1205908 - RNA, 20 nt, Human
ccacacaacaaaagaaugaa

SEQ ID NO: 1205909 - RNA, 23 nt, Human
cuccacacaacaaaagaaugaaa

SEQ ID NO: 1205910 - RNA, 18 nt, Human
gagcauaucauaaauaug

SEQ ID NO: 1205911 - RNA, 18 nt, Human
gaucuaaaaacauuccau

SEQ ID NO: 1205912 - RNA, 19 nt, Human
uaagaguaucagaugauua

SEQ ID NO: 1205913 - RNA, 21 nt, Human
uaccaaagaagugaacaauua

SEQ ID NO: 1205914 - RNA, 21 nt, Human
uagaaagacggcaauucaagc

SEQ ID NO: 1205915 - RNA, 20 nt, Human
uagaguuauuccucuucagu

SEQ ID NO: 1205916 - RNA, 18 nt, Human
uaggaacaacugaaaaug

SEQ ID NO: 1205917 - RNA, 18 nt, Human
uccacacaacaaaagaau

SEQ ID NO: 1205918 - RNA, 23 nt, Human
uccacacaacaaaagaaugaaau

SEQ ID NO: 1205919 - RNA, 27 nt, Human
uuuuuuuuuuuuuuuuuuuuuuugggg

SEQ ID NO: 1205920 - RNA, 27 nt, Human
ucacugggcaguguuuuucgggucacu

SEQ ID NO: 1205921 - RNA, 21 nt, Human
uucacugucacugggcagugu

SEQ ID NO: 1205922 - RNA, 26 nt, Human
uuuuucgguauuaucaucuuuugaau

SEQ ID NO: 1205923 - RNA, 18 nt, Human
aagagaaaacagcgggaa

SEQ ID NO: 1205924 - RNA, 18 nt, Human
caggaagagaaaacagcg

SEQ ID NO: 1205925 - RNA, 21 nt, Human
uccaggaagagaaaacagcgg

SEQ ID NO: 1205926 - RNA, 20 nt, Human
uuccaggaagagaaaacagc

SEQ ID NO: 1205927 - RNA, 19 nt, Human
aagaagacauaucucaaac

SEQ ID NO: 1205928 - RNA, 25 nt, Human
aagaagacauaucucaaaccacuga

SEQ ID NO: 1205929 - RNA, 19 nt, Human
agagcucuccgagcugaau

SEQ ID NO: 1205930 - RNA, 21 nt, Human
agucuaggucugcccuggagu

SEQ ID NO: 1205931 - RNA, 19 nt, Human
caccacggccaagcaaggc

SEQ ID NO: 1205932 - RNA, 20 nt, Human
cacgaagaagacauaucuca

SEQ ID NO: 1205933 - RNA, 22 nt, Human
cagagcucuccgagcugaaucc

SEQ ID NO: 1205934 - RNA, 19 nt, Human
caggaccacaccacggcca

SEQ ID NO: 1205935 - RNA, 21 nt, Human
cagguuacagacgggagguuc

SEQ ID NO: 1205936 - RNA, 22 nt, Human
caucacgaagaagacauaucuc

SEQ ID NO: 1205937 - RNA, 25 nt, Human
cccaugagucuaggucugcccugga

SEQ ID NO: 1205938 - RNA, 18 nt, Human
gaguccuccuuuacucuc

SEQ ID NO: 1205939 - RNA, 23 nt, Human
uaucucaaaccacugaguggccc

SEQ ID NO: 1205940 - RNA, 24 nt, Human
uaucucaaaccacugaguggcccg

SEQ ID NO: 1205941 - RNA, 20 nt, Human
uccuuggacccuugguaguu

SEQ ID NO: 1205942 - RNA, 21 nt, Human
ucucaaaccacugaguggccc

SEQ ID NO: 1205943 - RNA, 22 nt, Human
ugaacugcaggugcagguuaca

SEQ ID NO: 1205944 - RNA, 24 nt, Human
ugcccuggaguugcaggaccacac

SEQ ID NO: 1205945 - RNA, 21 nt, Human
uggaguugcaggaccacacca

SEQ ID NO: 1205946 - RNA, 21 nt, Human
uguuuguuuggaguccuccuu

SEQ ID NO: 1205947 - RNA, 21 nt, Human
uugguaguuuccugaacugug

SEQ ID NO: 1205948 - RNA, 23 nt, Human
aagccuccaaagucaggguuccg

SEQ ID NO: 1205949 - RNA, 19 nt, Human
uaucauacgcuauugaagc

SEQ ID NO: 1205950 - RNA, 18 nt, Human
ucugaagccuccaaaguc

SEQ ID NO: 1205951 - RNA, 24 nt, Human
ugucugaagccuccaaagucaggg

SEQ ID NO: 1205952 - RNA, 20 nt, Human
uccaguagccagcgcuggcu

SEQ ID NO: 1205953 - RNA, 19 nt, Human
aaaagacagguaaaaauug

SEQ ID NO: 1205954 - RNA, 20 nt, Human
aaaauccaagaaaacuaugg

SEQ ID NO: 1205955 - RNA, 18 nt, Human
aacagucuuuuuucuggc

SEQ ID NO: 1205956 - RNA, 20 nt, Human
aacuguauuucaagcagggu

SEQ ID NO: 1205957 - RNA, 23 nt, Human
aauaugugaguauuuuaaccuac

SEQ ID NO: 1205958 - RNA, 23 nt, Human
acagguaaaaauugaccuuuuca

SEQ ID NO: 1205959 - RNA, 21 nt, Human
acugaagcacaaaagauucua

SEQ ID NO: 1205960 - RNA, 19 nt, Human
acuuuauuuacuucugaag

SEQ ID NO: 1205961 - RNA, 20 nt, Human
aggacuuuuccucccaccuc

SEQ ID NO: 1205962 - RNA, 22 nt, Human
aggguaaucaaaugaaaagcaa

SEQ ID NO: 1205963 - RNA, 19 nt, Human
caaaguaaaugcaacuggc

SEQ ID NO: 1205964 - RNA, 19 nt, Human
caaaguaaaugcaacuggc

SEQ ID NO: 1205965 - RNA, 22 nt, Human
caaguuacugaagcacaaaaga

SEQ ID NO: 1205966 - RNA, 19 nt, Human
caccaaaguaaaugcaacu

SEQ ID NO: 1205967 - RNA, 24 nt, Human
caggguaaucaaaugaaaagcaag

SEQ ID NO: 1205968 - RNA, 18 nt, Human
ccaggacuuuuccuccca

SEQ ID NO: 1205969 - RNA, 23 nt, Human
ccucccaccucagcagcagcugg

SEQ ID NO: 1205970 - RNA, 19 nt, Human
ggaagaaaauccaagaaaa

SEQ ID NO: 1205971 - RNA, 22 nt, Human
uaaaaauugaccuuuucauaag

SEQ ID NO: 1205972 - RNA, 21 nt, Human
uaaaagacagguaaaaauuga

SEQ ID NO: 1205973 - RNA, 18 nt, Human
uacugaagcacaaaagau

SEQ ID NO: 1205974 - RNA, 21 nt, Human
ucaaaauuauaauaacauaua

SEQ ID NO: 1205975 - RNA, 25 nt, Human
ucccagccaggacuuuuccucccac

SEQ ID NO: 1205976 - RNA, 23 nt, Human
uccucccaccucagcagcagcug

SEQ ID NO: 1205977 - RNA, 22 nt, Human
ucucccagccaggacuuuuccu

SEQ ID NO: 1205978 - RNA, 19 nt, Human
ucuuacauuacaaaacaau

SEQ ID NO: 1205979 - RNA, 19 nt, Human
ugaaaagcaagaaaaaaca

SEQ ID NO: 1205980 - RNA, 20 nt, Human
uggaagaaaauccaagaaaa

SEQ ID NO: 1205981 - RNA, 22 nt, Human
uggaagaaaauccaagaaaacu

SEQ ID NO: 1205982 - RNA, 23 nt, Human
uggauuuugcaacuaaucaguuu

SEQ ID NO: 1205983 - RNA, 25 nt, Human
uggcacaaaaguugcuacauaaaua

SEQ ID NO: 1205984 - RNA, 19 nt, Human
uuccucccaccucagcagc

SEQ ID NO: 1205985 - RNA, 23 nt, Human
uuuugcaacuaaucaguuucacg

SEQ ID NO: 1205986 - RNA, 23 nt, Human
uguaaaauuauuauacaggauga

SEQ ID NO: 1205987 - RNA, 22 nt, Human
uuguaacuggagaaaacacugg

SEQ ID NO: 1205988 - RNA, 20 nt, Human
aaaaacaucauucuucuggc

SEQ ID NO: 1205989 - RNA, 23 nt, Human
aagacuuuccacacucaucacag

SEQ ID NO: 1205990 - RNA, 22 nt, Human
aagcaaaaggcugcucaacaac

SEQ ID NO: 1205991 - RNA, 19 nt, Human
aagccuucgcuucugugac

SEQ ID NO: 1205992 - RNA, 20 nt, Human
aagugucugggacuggucuu

SEQ ID NO: 1205993 - RNA, 22 nt, Human
aaugcaauuaaaauucucacaa

SEQ ID NO: 1205994 - RNA, 26 nt, Human
acgaugcacacgcgcuucccccccac

SEQ ID NO: 1205995 - RNA, 19 nt, Human
aggcugcugagacagcauc

SEQ ID NO: 1205996 - RNA, 21 nt, Human
aggugcugaaagcaaaaggcu

SEQ ID NO: 1205997 - RNA, 22 nt, Human
agguuguuggcauguggcgucu

SEQ ID NO: 1205998 - RNA, 20 nt, Human
aguggcaucuggggucaggg

SEQ ID NO: 1205999 - RNA, 21 nt, Human
aguggcaucuggggucagggu

SEQ ID NO: 1206000 - RNA, 21 nt, Human
caaguggcaucuggggucagg

SEQ ID NO: 1206001 - RNA, 21 nt, Human
cacccccagcucaagaugcuu

SEQ ID NO: 1206002 - RNA, 18 nt, Human
cacugugcuguguccagc

SEQ ID NO: 1206003 - RNA, 19 nt, Human
cagcgcucccucccgcggc

SEQ ID NO: 1206004 - RNA, 22 nt, Human
caguaguugacacgaugcacac

SEQ ID NO: 1206005 - RNA, 19 nt, Human
ccagaggcugcaaaccucu

SEQ ID NO: 1206006 - RNA, 19 nt, Human
ccaggaaguuggaagguaa

SEQ ID NO: 1206007 - RNA, 19 nt, Human
ccaggaucugcccuaugcc

SEQ ID NO: 1206008 - RNA, 23 nt, Human
cccacagcugaggcugcugagac

SEQ ID NO: 1206009 - RNA, 18 nt, Human
ccccacagcugaggcugc

SEQ ID NO: 1206010 - RNA, 22 nt, Human
cccccucacacccccagcucaa

SEQ ID NO: 1206011 - RNA, 22 nt, Human
ccucuccgucuaacuaaugcaa

SEQ ID NO: 1206012 - RNA, 22 nt, Human
cuacagccuuaacaccagccug

SEQ ID NO: 1206013 - RNA, 20 nt, Human
cugaaguaucaggagcuugu

SEQ ID NO: 1206014 - RNA, 19 nt, Human
cugacugggaccagcugcg

SEQ ID NO: 1206015 - RNA, 22 nt, Human
cugcaaguuaccugccugagag

SEQ ID NO: 1206016 - RNA, 19 nt, Human
cugucauggggaaacuggg

SEQ ID NO: 1206017 - RNA, 20 nt, Human
cuugcucugcguauuucugu

SEQ ID NO: 1206018 - RNA, 24 nt, Human
gaagugucugggacuggucuucca

SEQ ID NO: 1206019 - RNA, 18 nt, Human
gaaguuggaagguaagug

SEQ ID NO: 1206020 - RNA, 19 nt, Human
gaugcacacgcgcuucccc

SEQ ID NO: 1206021 - RNA, 22 nt, Human
gcaaaaauacuuguaauacuau

SEQ ID NO: 1206022 - RNA, 18 nt, Human
gcagccgggucuucaggc

SEQ ID NO: 1206023 - RNA, 18 nt, Human
gcauaauucacacgcgua

SEQ ID NO: 1206024 - RNA, 23 nt, Human
gccaggaaguuggaagguaagug

SEQ ID NO: 1206025 - RNA, 19 nt, Human
gcucccucccgcggcugcc

SEQ ID NO: 1206026 - RNA, 26 nt, Human
gcugcuagcuuucucuaacccuccgg

SEQ ID NO: 1206027 - RNA, 20 nt, Human
gcuguacuacaguggcugau

SEQ ID NO: 1206028 - RNA, 22 nt, Human
gcuguacuacaguggcugauuu

SEQ ID NO: 1206029 - RNA, 21 nt, Human
ggcagagucauucacaggcug

SEQ ID NO: 1206030 - RNA, 22 nt, Human
gggaccagcugcguguuuaugg

SEQ ID NO: 1206031 - RNA, 25 nt, Human
uaaacccucgaccacagaugucaca

SEQ ID NO: 1206032 - RNA, 19 nt, Human
uaacacaaguggcaucugg

SEQ ID NO: 1206033 - RNA, 21 nt, Human
uacugcuuacuguaaaaguuu

SEQ ID NO: 1206034 - RNA, 18 nt, Human
uagagacaauguacuauu

SEQ ID NO: 1206035 - RNA, 25 nt, Human
ucacacgcguauugucucugggacu

SEQ ID NO: 1206036 - RNA, 19 nt, Human
ucagaacauuuugaacuug

SEQ ID NO: 1206037 - RNA, 22 nt, Human
ucagaacauuuugaacuugcaa

SEQ ID NO: 1206038 - RNA, 20 nt, Human
ucagcacuuuggcugcuagc

SEQ ID NO: 1206039 - RNA, 20 nt, Human
uccacacucaucacagguga

SEQ ID NO: 1206040 - RNA, 18 nt, Human
ucuaccguggagaagcgc

SEQ ID NO: 1206041 - RNA, 21 nt, Human
ucugaaguaucaggagcuugu

SEQ ID NO: 1206042 - RNA, 25 nt, Human
ucugacuuggguucagauacuugcu

SEQ ID NO: 1206043 - RNA, 23 nt, Human
ucugggacugaagugucugggac

SEQ ID NO: 1206044 - RNA, 22 nt, Human
ucugggacuggucuuccagggc

SEQ ID NO: 1206045 - RNA, 18 nt, Human
ucuucacuuucuuuuucu

SEQ ID NO: 1206046 - RNA, 23 nt, Human
ucuucuggcuugaagaauucuga

SEQ ID NO: 1206047 - RNA, 25 nt, Human
ugaaaaacaucauucuucuggcuug

SEQ ID NO: 1206048 - RNA, 26 nt, Human
ugaaaaacaucauucuucuggcuuga

SEQ ID NO: 1206049 - RNA, 22 nt, Human
ugaaagcaaaaggcugcucaac

SEQ ID NO: 1206050 - RNA, 18 nt, Human
ugaaaggcaguucugugg

SEQ ID NO: 1206051 - RNA, 22 nt, Human
ugaaguaucaggagcuuguuuu

SEQ ID NO: 1206052 - RNA, 19 nt, Human
ugagaacacgccucuaccg

SEQ ID NO: 1206053 - RNA, 19 nt, Human
ugaguuuguaauaguaauu

SEQ ID NO: 1206054 - RNA, 19 nt, Human
ugauggugaagcaugcgga

SEQ ID NO: 1206055 - RNA, 23 nt, Human
ugcacacgcgcuucccccccaca

SEQ ID NO: 1206056 - RNA, 20 nt, Human
uggaagguaagugcucggga

SEQ ID NO: 1206057 - RNA, 21 nt, Human
uggcauguggcgucugacuca

SEQ ID NO: 1206058 - RNA, 27 nt, Human
uggcauguggcgucugacucagggugu

SEQ ID NO: 1206059 - RNA, 20 nt, Human
uggcuaguuagaaggcacug

SEQ ID NO: 1206060 - RNA, 25 nt, Human
uggcuguuugaaaggcaguucugug

SEQ ID NO: 1206061 - RNA, 20 nt, Human
ugggacuggucuuccagggc

SEQ ID NO: 1206062 - RNA, 21 nt, Human
ugggccaggaaguuggaaggu

SEQ ID NO: 1206063 - RNA, 23 nt, Human
uguaaauaauacaaaaugcuaca

SEQ ID NO: 1206064 - RNA, 22 nt, Human
uugaagaauucugaaagaggcu

SEQ ID NO: 1206065 - RNA, 22 nt, Human
uugcuuggguguuuaaaagguu

SEQ ID NO: 1206066 - RNA, 19 nt, Human
uuuccacacucaucacagg

SEQ ID NO: 1206067 - RNA, 18 nt, Human
uuucuucagcacuuuggc

SEQ ID NO: 1206068 - RNA, 18 nt, Human
uuugagccucaucugcuu

SEQ ID NO: 1206069 - RNA, 21 nt, Human
uuugagccucaucugcuugac

SEQ ID NO: 1206070 - RNA, 20 nt, Human
aguucuuuaagccuuucuua

SEQ ID NO: 1206071 - RNA, 21 nt, Human
aaugagcuuuuuuugacauuc

SEQ ID NO: 1206072 - RNA, 23 nt, Human
aaugcaaguacagaacuuaugca

SEQ ID NO: 1206073 - RNA, 19 nt, Human
acccuaauuaaccucauca

SEQ ID NO: 1206074 - RNA, 23 nt, Human
caaguacagaacuuaugcauuca

SEQ ID NO: 1206075 - RNA, 24 nt, Human
uacagaacuuaugcauucaucaaa

SEQ ID NO: 1206076 - RNA, 18 nt, Human
ugauuauguuucaguucu

SEQ ID NO: 1206077 - RNA, 23 nt, Human
ugcaaguacagaacuuaugcauu

SEQ ID NO: 1206078 - RNA, 19 nt, Human
uggcauaugcaguauucaa

SEQ ID NO: 1206079 - RNA, 20 nt, Human
aagaaaccuagaaugaccug

SEQ ID NO: 1206080 - RNA, 24 nt, Human
aggagccagggcaagauuagggug

SEQ ID NO: 1206081 - RNA, 22 nt, Human
ccagggcaagauuagggugcag

SEQ ID NO: 1206082 - RNA, 19 nt, Human
ccuuggagagcgaccagau

SEQ ID NO: 1206083 - RNA, 18 nt, Human
cgaccagauuccucaccc

SEQ ID NO: 1206084 - RNA, 21 nt, Human
gauucagccaucuuucuccaa

SEQ ID NO: 1206085 - RNA, 22 nt, Human
uccccugaaggacuccggucgc

SEQ ID NO: 1206086 - RNA, 20 nt, Human
ugacugcacaguguccccug

SEQ ID NO: 1206087 - RNA, 20 nt, Human
ugagaucaaaaucucgauuc

SEQ ID NO: 1206088 - RNA, 21 nt, Human
ugagaucaaaaucucgauuca

SEQ ID NO: 1206089 - RNA, 23 nt, Human
ugcagagaaaucgguuuccucca

SEQ ID NO: 1206090 - RNA, 20 nt, Human
uuagggugcagagaaaucgg

SEQ ID NO: 1206091 - RNA, 24 nt, Human
accacagccuccaucacugaccug

SEQ ID NO: 1206092 - RNA, 24 nt, Human
accacagccuccaucacugaccug

SEQ ID NO: 1206093 - RNA, 24 nt, Human
accacagccuccaucacugaccug

SEQ ID NO: 1206094 - RNA, 24 nt, Human
accacagccuccaucacugaccug

SEQ ID NO: 1206095 - RNA, 21 nt, Human
acugaccuguuucugaccaca

SEQ ID NO: 1206096 - RNA, 21 nt, Human
acugaccuguuucugaccaca

SEQ ID NO: 1206097 - RNA, 21 nt, Human
acugaccuguuucugaccaca

SEQ ID NO: 1206098 - RNA, 24 nt, Human
augugugccccuccaauucaaccu

SEQ ID NO: 1206099 - RNA, 26 nt, Human
caacugaaauucagacaaaucauuuu

SEQ ID NO: 1206100 - RNA, 19 nt, Human
cacagccuccaucacugac

SEQ ID NO: 1206101 - RNA, 19 nt, Human
cacagccuccaucauugac

SEQ ID NO: 1206102 - RNA, 23 nt, Human
cacugaccuguuucugaccacag

SEQ ID NO: 1206103 - RNA, 23 nt, Human
cacugaccuguuucugaccacag

SEQ ID NO: 1206104 - RNA, 21 nt, Human
cacugaccuguuucuguccac

SEQ ID NO: 1206105 - RNA, 22 nt, Human
caugaccaaaugugugccccuc

SEQ ID NO: 1206106 - RNA, 20 nt, Human
ccacagccuccaucacugac

SEQ ID NO: 1206107 - RNA, 20 nt, Human
ccacagccuccaucacugac

SEQ ID NO: 1206108 - RNA, 20 nt, Human
ccacagccuccaucacugac

SEQ ID NO: 1206109 - RNA, 20 nt, Human
ccacagccuccaucacugac

SEQ ID NO: 1206110 - RNA, 20 nt, Human
ccacagccuccaucauugac

SEQ ID NO: 1206111 - RNA, 24 nt, Human
ccuuacuuucugaaucuuuuucuu

SEQ ID NO: 1206112 - RNA, 20 nt, Human
cugcagcagcuguugcuucc

SEQ ID NO: 1206113 - RNA, 26 nt, Human
gaccacagccuccaucacugaccugg

SEQ ID NO: 1206114 - RNA, 26 nt, Human
gaccacagccuccaucacugaccugg

SEQ ID NO: 1206115 - RNA, 26 nt, Human
gaccacagccuccaucacugaccugg

SEQ ID NO: 1206116 - RNA, 26 nt, Human
gaccacagccuccaucacugaccugg

SEQ ID NO: 1206117 - RNA, 26 nt, Human
gaccacagccuccaucauugaccugg

SEQ ID NO: 1206118 - RNA, 26 nt, Human
gaccacagccuccaucauugaccugg

SEQ ID NO: 1206119 - RNA, 26 nt, Human
gaccacggccuccaucacugaccugg

SEQ ID NO: 1206120 - RNA, 26 nt, Human
gccuccaucacugaccuguuucugac

SEQ ID NO: 1206121 - RNA, 26 nt, Human
gccuccaucacugaccuguuucugac

SEQ ID NO: 1206122 - RNA, 26 nt, Human
gccuccaucacugaccuguuucugac

SEQ ID NO: 1206123 - RNA, 26 nt, Human
gccuccaucacugaccuguuucugac

SEQ ID NO: 1206124 - RNA, 26 nt, Human
gccuccaucacugaccuguuucugac

SEQ ID NO: 1206125 - RNA, 26 nt, Human
gccuccaucauugaccuguuucugac

SEQ ID NO: 1206126 - RNA, 26 nt, Human
gccuccaucauugaccuguuucugac

SEQ ID NO: 1206127 - RNA, 22 nt, Human
gcugcagcagcuguugcuuccu

SEQ ID NO: 1206128 - RNA, 22 nt, Human
uccaauucaaccuguuucugac

SEQ ID NO: 1206129 - RNA, 25 nt, Human
ucccucagcugcagcagcuguugcu

SEQ ID NO: 1206130 - RNA, 19 nt, Human
uguuucuguccacagccuc

SEQ ID NO: 1206131 - RNA, 22 nt, Human
acugcaggccuugcagcaagcu

SEQ ID NO: 1206132 - RNA, 19 nt, Human
agcaagcuucacguugcug

SEQ ID NO: 1206133 - RNA, 22 nt, Human
caagcaaucuauuuuacacacu

SEQ ID NO: 1206134 - RNA, 25 nt, Human
caccuucuccggcagcucuuucaaa

SEQ ID NO: 1206135 - RNA, 19 nt, Human
cagcugaggacacagcagg

SEQ ID NO: 1206136 - RNA, 22 nt, Human
cagggcuuucuuccucaccuuc

SEQ ID NO: 1206137 - RNA, 24 nt, Human
cccagcugaggacacagcaggucc

SEQ ID NO: 1206138 - RNA, 23 nt, Human
cccggcuggcugcgcucuucccg

SEQ ID NO: 1206139 - RNA, 18 nt, Human
ccuggggacggccugggc

SEQ ID NO: 1206140 - RNA, 27 nt, Human
ccugugccgcggcgcgcucagagcccg

SEQ ID NO: 1206141 - RNA, 20 nt, Human
cgccucuucuccacccagcu

SEQ ID NO: 1206142 - RNA, 24 nt, Human
cgcggcggcggcagcaacaggcac

SEQ ID NO: 1206143 - RNA, 21 nt, Human
cggcggcagcaacaggcaccg

SEQ ID NO: 1206144 - RNA, 22 nt, Human
cggggagggggcuccccucggc

SEQ ID NO: 1206145 - RNA, 19 nt, Human
cuccccucggcucggcgcc

SEQ ID NO: 1206146 - RNA, 19 nt, Human
cuucuccacccagcugagg

SEQ ID NO: 1206147 - RNA, 22 nt, Human
gaagggucugggaacucagcaa

SEQ ID NO: 1206148 - RNA, 19 nt, Human
ggccugggcgggcggggag

SEQ ID NO: 1206149 - RNA, 23 nt, Human
ggugguucacuguugcuuuccag

SEQ ID NO: 1206150 - RNA, 21 nt, Human
gugcuugggggcauccugggg

SEQ ID NO: 1206151 - RNA, 27 nt, Human
uauuuuacacacuucauaugcagaaac

SEQ ID NO: 1206152 - RNA, 19 nt, Human
ucacguugcugacacuggu

SEQ ID NO: 1206153 - RNA, 18 nt, Human
ucggcucggcgcccgccu

SEQ ID NO: 1206154 - RNA, 19 nt, Human
ugaggacacagcagguccc

SEQ ID NO: 1206155 - RNA, 22 nt, Human
ugcuugggggcauccuggggac

SEQ ID NO: 1206156 - RNA, 24 nt, Human
ugggaagggucugggaacucagca

SEQ ID NO: 1206157 - RNA, 19 nt, Human
uugggaagggucugggaac

SEQ ID NO: 1206158 - RNA, 21 nt, Human
agguuggggaggcgagggcgg

SEQ ID NO: 1206159 - RNA, 20 nt, Human
caggagccgaggcgcggcag

SEQ ID NO: 1206160 - RNA, 22 nt, Human
cagggcaccagcggcgggaggc

SEQ ID NO: 1206161 - RNA, 26 nt, Human
ccccgcugcguccgcgccuucucuuu

SEQ ID NO: 1206162 - RNA, 18 nt, Human
ccgccaggggacaggagc

SEQ ID NO: 1206163 - RNA, 21 nt, Human
ccgcgugcgggggcgggaggg

SEQ ID NO: 1206164 - RNA, 19 nt, Human
ccucuccgccggccggggc

SEQ ID NO: 1206165 - RNA, 18 nt, Human
ccuucucuuuuccggucc

SEQ ID NO: 1206166 - RNA, 22 nt, Human
cugagcuccagauuuccccacc

SEQ ID NO: 1206167 - RNA, 18 nt, Human
gcaccagcggcgggaggc

SEQ ID NO: 1206168 - RNA, 22 nt, Human
gccggccggggcucggcugagc

SEQ ID NO: 1206169 - RNA, 18 nt, Human
ggaggcaagguuggggag

SEQ ID NO: 1206170 - RNA, 21 nt, Human
ggaggcgagggcgguccgcgu

SEQ ID NO: 1206171 - RNA, 18 nt, Human
ggccggggcucggcugag

SEQ ID NO: 1206172 - RNA, 19 nt, Human
ggccggggcucggcugagc

SEQ ID NO: 1206173 - RNA, 23 nt, Human
gggcgguccgcgugcgggggccg

SEQ ID NO: 1206174 - RNA, 24 nt, Human
ucaggcccaaccgcuccccgcugc

SEQ ID NO: 1206175 - RNA, 20 nt, Human
uuugucccuggggcucaggc

SEQ ID NO: 1206176 - RNA, 22 nt, Human
aaaacaaaacuauaccuuuggu

SEQ ID NO: 1206177 - RNA, 23 nt, Human
aacacauucuucugaccuugggc

SEQ ID NO: 1206178 - RNA, 19 nt, Human
aagaaaaccagucaaaggg

SEQ ID NO: 1206179 - RNA, 19 nt, Human
aagaagaaaaccagucaaa

SEQ ID NO: 1206180 - RNA, 22 nt, Human
aagaagaaaaccagucaaaggg

SEQ ID NO: 1206181 - RNA, 19 nt, Human
aagaauaaagaaaggagga

SEQ ID NO: 1206182 - RNA, 24 nt, Human
aauaaaaaacaaaacuauaccuuu

SEQ ID NO: 1206183 - RNA, 21 nt, Human
agaauguaucuuucucaggau

SEQ ID NO: 1206184 - RNA, 22 nt, Human
agaucaaaaaggagauggucaa

SEQ ID NO: 1206185 - RNA, 20 nt, Human
aggaugaagaagaaaaccag

SEQ ID NO: 1206186 - RNA, 24 nt, Human
aguucuccuaaaauaaaaaacaaa

SEQ ID NO: 1206187 - RNA, 22 nt, Human
caaaaagauguuacuaucccac

SEQ ID NO: 1206188 - RNA, 21 nt, Human
caauggacuuuguuuccuaau

SEQ ID NO: 1206189 - RNA, 21 nt, Human
cccacagcaucuugccaaauc

SEQ ID NO: 1206190 - RNA, 21 nt, Human
cuccuaaaauaaaaaacaaaa

SEQ ID NO: 1206191 - RNA, 19 nt, Human
cugaaaaauauccugaaaa

SEQ ID NO: 1206192 - RNA, 19 nt, Human
cuugccaaaucaucaucca

SEQ ID NO: 1206193 - RNA, 21 nt, Human
gaagaagaaaaccagucaaag

SEQ ID NO: 1206194 - RNA, 21 nt, Human
gaagaagaaaaccagucaaag

SEQ ID NO: 1206195 - RNA, 23 nt, Human
gaagccaauucuucccucaaaaa

SEQ ID NO: 1206196 - RNA, 27 nt, Human
ggaugaagaagaaaaccagucaaaggg

SEQ ID NO: 1206197 - RNA, 18 nt, Human
uaacaagcucauuaguaa

SEQ ID NO: 1206198 - RNA, 23 nt, Human
uaucccacagcaucuugccaaau

SEQ ID NO: 1206199 - RNA, 24 nt, Human
ucaucauccaaauucccuucaacu

SEQ ID NO: 1206200 - RNA, 25 nt, Human
ucugaaguagaggguuuugguggag

SEQ ID NO: 1206201 - RNA, 20 nt, Human
ugaaaaaauucugaaguaga

SEQ ID NO: 1206202 - RNA, 22 nt, Human
ugaaaaaauucugaaguagagg

SEQ ID NO: 1206203 - RNA, 21 nt, Human
ugaaguagaggguuuuggugg

SEQ ID NO: 1206204 - RNA, 24 nt, Human
uggacuuuguuuccuaauacaaaa

SEQ ID NO: 1206205 - RNA, 26 nt, Human
uguucaucuuucuaaucguuuacaca

SEQ ID NO: 1206206 - RNA, 19 nt, Human
uuaacacauucuucugacc

SEQ ID NO: 1206207 - RNA, 22 nt, Human
uucacaguggauguacagaugg

SEQ ID NO: 1206208 - RNA, 21 nt, Human
uuccaagaucaacauggacuc

SEQ ID NO: 1206209 - RNA, 23 nt, Human
uuccaagaucaacauggacucuu

SEQ ID NO: 1206210 - RNA, 21 nt, Human
uuccauaugugcuccuagucu

SEQ ID NO: 1206211 - RNA, 23 nt, Human
uugguuacagcguuaacucuuuu

SEQ ID NO: 1206212 - RNA, 25 nt, Human
uuucucaggaugaagaagaaaacca

SEQ ID NO: 1206213 - RNA, 19 nt, Human
agaagggaguggggaagag

SEQ ID NO: 1206214 - RNA, 21 nt, Human
agaagggaguggggaagaggu

SEQ ID NO: 1206215 - RNA, 22 nt, Human
agagaagcagagcuuaaagcug

SEQ ID NO: 1206216 - RNA, 19 nt, Human
aggaagagagaagcagagc

SEQ ID NO: 1206217 - RNA, 21 nt, Human
augaggaagagagaagcagag

SEQ ID NO: 1206218 - RNA, 23 nt, Human
caccacagaguucaaucuuaguu

SEQ ID NO: 1206219 - RNA, 24 nt, Human
ccagggugaugguuauaucuuuuu

SEQ ID NO: 1206220 - RNA, 22 nt, Human
ccagugaaagacuaugcaaacc

SEQ ID NO: 1206221 - RNA, 25 nt, Human
cccucaaguuuacuggugcugcaca

SEQ ID NO: 1206222 - RNA, 24 nt, Human
cugcacacgcaguuccgggauccu

SEQ ID NO: 1206223 - RNA, 23 nt, Human
gguauugggagaugaggaagaga

SEQ ID NO: 1206224 - RNA, 23 nt, Human
uaguucccaacucugcugaucau

SEQ ID NO: 1206225 - RNA, 24 nt, Human
uauggauugaaaaaugaaaauacu

SEQ ID NO: 1206226 - RNA, 22 nt, Human
ugaaaaaugaaaauacucuuga

SEQ ID NO: 1206227 - RNA, 22 nt, Human
ugcaaaccugauagcuccccuc

SEQ ID NO: 1206228 - RNA, 18 nt, Human
ugcugcacacgcaguucc

SEQ ID NO: 1206229 - RNA, 24 nt, Human
ugucauagugagaaagguucaaac

SEQ ID NO: 1206230 - RNA, 25 nt, Human
uuaguucccaacucugcugaucaua

SEQ ID NO: 1206231 - RNA, 21 nt, Human
aagcagccugccauccgguga

SEQ ID NO: 1206232 - RNA, 23 nt, Human
accaccucccuccagguccccca

SEQ ID NO: 1206233 - RNA, 21 nt, Human
accucccuccaggucccccac

SEQ ID NO: 1206234 - RNA, 24 nt, Human
cauccggugaccacuucagagcac

SEQ ID NO: 1206235 - RNA, 25 nt, Human
cccuggagucccguccccucgggag

SEQ ID NO: 1206236 - RNA, 20 nt, Human
gcccugugcacuggcaccug

SEQ ID NO: 1206237 - RNA, 20 nt, Human
uauuucaccaccucccucca

SEQ ID NO: 1206238 - RNA, 20 nt, Human
uauuucaccaccucccucca

SEQ ID NO: 1206239 - RNA, 19 nt, Human
ucacugcagccgcuggaaa

SEQ ID NO: 1206240 - RNA, 20 nt, Human
ucccaggucuaagucagucu

SEQ ID NO: 1206241 - RNA, 22 nt, Human
ucccaggucuaagucagucuug

SEQ ID NO: 1206242 - RNA, 19 nt, Human
ucucugcucgacugccucu

SEQ ID NO: 1206243 - RNA, 19 nt, Human
uuuucuucccaggucuaag

SEQ ID NO: 1206244 - RNA, 21 nt, Human
acauguggaagcugggcuggg

SEQ ID NO: 1206245 - RNA, 19 nt, Human
agagagaggcggugcagau

SEQ ID NO: 1206246 - RNA, 18 nt, Human
cacauguggaagcugggc

SEQ ID NO: 1206247 - RNA, 25 nt, Human
caccuccccuugggccagacagacc

SEQ ID NO: 1206248 - RNA, 21 nt, Human
cacucguuccuccagacccca

SEQ ID NO: 1206249 - RNA, 18 nt, Human
cacuggcccugcagaacc

SEQ ID NO: 1206250 - RNA, 21 nt, Human
cacugggcuuccuggaggucu

SEQ ID NO: 1206251 - RNA, 20 nt, Human
cagaccccauaucucuucca

SEQ ID NO: 1206252 - RNA, 18 nt, Human
cagagcuggcuugguguc

SEQ ID NO: 1206253 - RNA, 25 nt, Human
cagcccccugccugccucuuccagg

SEQ ID NO: 1206254 - RNA, 21 nt, Human
cagcccggcguguccucuccu

SEQ ID NO: 1206255 - RNA, 23 nt, Human
cauccucuuggcucagucccaua

SEQ ID NO: 1206256 - RNA, 18 nt, Human
cccauguaccaagguccu

SEQ ID NO: 1206257 - RNA, 21 nt, Human
ccccugccagggcauccucuu

SEQ ID NO: 1206258 - RNA, 22 nt, Human
ccggcguguccucuccugggcc

SEQ ID NO: 1206259 - RNA, 25 nt, Human
ccucuuccaggggcccugcagggac

SEQ ID NO: 1206260 - RNA, 21 nt, Human
ccugccugccucuuccagggg

SEQ ID NO: 1206261 - RNA, 18 nt, Human
cucguggugcccgaugug

SEQ ID NO: 1206262 - RNA, 19 nt, Human
cucugccugccagccccuc

SEQ ID NO: 1206263 - RNA, 23 nt, Human
cugcagaaccugugucacucguu

SEQ ID NO: 1206264 - RNA, 22 nt, Human
cugccagggcauccucuuggcu

SEQ ID NO: 1206265 - RNA, 20 nt, Human
cugccucugggccucugccu

SEQ ID NO: 1206266 - RNA, 18 nt, Human
cuggggcagguggccccu

SEQ ID NO: 1206267 - RNA, 19 nt, Human
gaccccauaucucuuccac

SEQ ID NO: 1206268 - RNA, 22 nt, Human
gaugcugccugggagccugcag

SEQ ID NO: 1206269 - RNA, 21 nt, Human
gcagagcuggcuugguguccg

SEQ ID NO: 1206270 - RNA, 20 nt, Human
gcagguccugccucugggcc

SEQ ID NO: 1206271 - RNA, 24 nt, Human
gcccauguaccaagguccugggca

SEQ ID NO: 1206272 - RNA, 18 nt, Human
gccccggccuuggugucu

SEQ ID NO: 1206273 - RNA, 18 nt, Human
gccccuuucgugcuuugg

SEQ ID NO: 1206274 - RNA, 23 nt, Human
gccuuggugucuuuguggcccug

SEQ ID NO: 1206275 - RNA, 19 nt, Human
gcuggggcagguggccccu

SEQ ID NO: 1206276 - RNA, 18 nt, Human
ggacagugaaggccgccg

SEQ ID NO: 1206277 - RNA, 18 nt, Human
ggcagguggccccuuugc

SEQ ID NO: 1206278 - RNA, 18 nt, Human
ggccccuuugcaccugca

SEQ ID NO: 1206279 - RNA, 23 nt, Human
ggcuccuccccgccccagcaagc

SEQ ID NO: 1206280 - RNA, 20 nt, Human
gggcuggggcagguggcccc

SEQ ID NO: 1206281 - RNA, 25 nt, Human
ggucugggguucgcaguugagcucc

SEQ ID NO: 1206282 - RNA, 22 nt, Human
ggugucuuuguggcccugcugc

SEQ ID NO: 1206283 - RNA, 22 nt, Human
guggccccuuugcaccugcagc

SEQ ID NO: 1206284 - RNA, 20 nt, Human
uaaaaucaagugccccggcc

SEQ ID NO: 1206285 - RNA, 23 nt, Human
uaccaagguccugggcacuccac

SEQ ID NO: 1206286 - RNA, 21 nt, Human
uccagaagcccccugccaggg

SEQ ID NO: 1206287 - RNA, 20 nt, Human
uccaggggcccugcagggac

SEQ ID NO: 1206288 - RNA, 21 nt, Human
ucccauaaaaucaagugcccc

SEQ ID NO: 1206289 - RNA, 19 nt, Human
uccccgauggccugcucca

SEQ ID NO: 1206290 - RNA, 19 nt, Human
uccccgauggccugcucca

SEQ ID NO: 1206291 - RNA, 24 nt, Human
uccccgauggccugcuccagggcu

SEQ ID NO: 1206292 - RNA, 19 nt, Human
uccugggcccgucuguggg

SEQ ID NO: 1206293 - RNA, 21 nt, Human
uccugggcccgucuguggggc

SEQ ID NO: 1206294 - RNA, 22 nt, Human
uccugggcccgucuguggggca

SEQ ID NO: 1206295 - RNA, 24 nt, Human
ugaaggccaccagguuccagaagc

SEQ ID NO: 1206296 - RNA, 22 nt, Human
ugacccacuggcccugcagaac

SEQ ID NO: 1206297 - RNA, 21 nt, Human
ugcccauguaccaagguccug

SEQ ID NO: 1206298 - RNA, 18 nt, Human
ugccccggccuugguguc

SEQ ID NO: 1206299 - RNA, 19 nt, Human
uggacaccuggcugucggg

SEQ ID NO: 1206300 - RNA, 21 nt, Human
ugggagccugcagagagaggc

SEQ ID NO: 1206301 - RNA, 21 nt, Human
ugggccucugccugccagccc

SEQ ID NO: 1206302 - RNA, 21 nt, Human
ugggcuuccuggaggucuggg

SEQ ID NO: 1206303 - RNA, 24 nt, Human
ugucacaaaggccaccagaugagg

SEQ ID NO: 1206304 - RNA, 23 nt, Human
ugucacucguuccuccagacccc

SEQ ID NO: 1206305 - RNA, 24 nt, Human
uguccggcgcugacccacuggccc

SEQ ID NO: 1206306 - RNA, 18 nt, Human
uuccagaagcccccugcc

SEQ ID NO: 1206307 - RNA, 24 nt, Human
uucguggacaccuggcugucgggg

SEQ ID NO: 1206308 - RNA, 23 nt, Human
uugucacgguggccacggcuccu

SEQ ID NO: 1206309 - RNA, 18 nt, Human
aaaaaaggcagaaugaug

SEQ ID NO: 1206310 - RNA, 18 nt, Human
aaacucgaaaaaaggcag

SEQ ID NO: 1206311 - RNA, 23 nt, Human
aagagcaucacaguaagcuaaag

SEQ ID NO: 1206312 - RNA, 19 nt, Human
aagcuaaaguggucuggaa

SEQ ID NO: 1206313 - RNA, 24 nt, Human
agaaacucgaaaaaaggcagaaug

SEQ ID NO: 1206314 - RNA, 22 nt, Human
agggcagcuggcguggccaccu

SEQ ID NO: 1206315 - RNA, 18 nt, Human
cacuucacucagcagggu

SEQ ID NO: 1206316 - RNA, 22 nt, Human
cagaaugaugucucuucuuccc

SEQ ID NO: 1206317 - RNA, 19 nt, Human
cagcaugaaauuggaaaua

SEQ ID NO: 1206318 - RNA, 25 nt, Human
cagcaugaaauuggaaauacucauu

SEQ ID NO: 1206319 - RNA, 19 nt, Human
cagggcagcuggcguggcc

SEQ ID NO: 1206320 - RNA, 20 nt, Human
cccgcaggcuccggcuuccg

SEQ ID NO: 1206321 - RNA, 22 nt, Human
cccgcaggcuccggcuuccguc

SEQ ID NO: 1206322 - RNA, 21 nt, Human
ccgcccgccgcuccgccgccc

SEQ ID NO: 1206323 - RNA, 19 nt, Human
ccgccgcccgcaggcuccg

SEQ ID NO: 1206324 - RNA, 21 nt, Human
cuccuucuuuaucuuccucag

SEQ ID NO: 1206325 - RNA, 18 nt, Human
cucugcuucucucagggc

SEQ ID NO: 1206326 - RNA, 20 nt, Human
gagaacacuucacucagcag

SEQ ID NO: 1206327 - RNA, 20 nt, Human
ggacagagcccguggucgcg

SEQ ID NO: 1206328 - RNA, 24 nt, Human
ggcugcuuuccgcccgccgcuccg

SEQ ID NO: 1206329 - RNA, 19 nt, Human
guguuguugccgcugcugc

SEQ ID NO: 1206330 - RNA, 21 nt, Human
ucagcagggugugguguugac

SEQ ID NO: 1206331 - RNA, 23 nt, Human
ucagggcagcuggcguggccacc

SEQ ID NO: 1206332 - RNA, 20 nt, Human
ucccugauguagagggaggu

SEQ ID NO: 1206333 - RNA, 18 nt, Human
uccgcccgccgcuccgcc

SEQ ID NO: 1206334 - RNA, 24 nt, Human
ugccuugugccucuguucucuuca

SEQ ID NO: 1206335 - RNA, 19 nt, Human
ugcuuuccgcccgccgcuc

SEQ ID NO: 1206336 - RNA, 23 nt, Human
ugcuuuccgcccgccgcuccgcc

SEQ ID NO: 1206337 - RNA, 20 nt, Human
uggcuucuccuucuuuaucu

SEQ ID NO: 1206338 - RNA, 26 nt, Human
accuuguuccuuugugggcucuucua

SEQ ID NO: 1206339 - RNA, 18 nt, Human
acuuuguagcugucuugg

SEQ ID NO: 1206340 - RNA, 25 nt, Human
agaaagcugaccacaggcugacuca

SEQ ID NO: 1206341 - RNA, 19 nt, Human
agaggccucugggucagcc

SEQ ID NO: 1206342 - RNA, 20 nt, Human
agcuggguggggccaggggc

SEQ ID NO: 1206343 - RNA, 19 nt, Human
aggagggggaagcugcagg

SEQ ID NO: 1206344 - RNA, 21 nt, Human
aggagggggaagcugcaggac

SEQ ID NO: 1206345 - RNA, 19 nt, Human
cacccuuugccggucaccu

SEQ ID NO: 1206346 - RNA, 26 nt, Human
caccuuguuccuuugugggcucuucu

SEQ ID NO: 1206347 - RNA, 23 nt, Human
cagaaagcugaccacaggcugac

SEQ ID NO: 1206348 - RNA, 18 nt, Human
cagagcugggcuaaggac

SEQ ID NO: 1206349 - RNA, 21 nt, Human
cagagcugggcuaaggacugu

SEQ ID NO: 1206350 - RNA, 18 nt, Human
cagggaggggccagguau

SEQ ID NO: 1206351 - RNA, 22 nt, Human
ccccaagauaagcucugccugc

SEQ ID NO: 1206352 - RNA, 23 nt, Human
cccuccagcugugaagguuccau

SEQ ID NO: 1206353 - RNA, 24 nt, Human
cccucgaauccucccccaagauaa

SEQ ID NO: 1206354 - RNA, 22 nt, Human
cccucugcuuccauuucucauc

SEQ ID NO: 1206355 - RNA, 22 nt, Human
ccugcagagcuccacugggaga

SEQ ID NO: 1206356 - RNA, 18 nt, Human
ccugcucugugacccucg

SEQ ID NO: 1206357 - RNA, 19 nt, Human
ccuucaggguuccuccacc

SEQ ID NO: 1206358 - RNA, 22 nt, Human
cuacagguagggggcauagucu

SEQ ID NO: 1206359 - RNA, 24 nt, Human
cucuguuuucucauagcuuuggag

SEQ ID NO: 1206360 - RNA, 19 nt, Human
cugcaggguggggcacagg

SEQ ID NO: 1206361 - RNA, 21 nt, Human
cuuccugcacguccuggggag

SEQ ID NO: 1206362 - RNA, 20 nt, Human
gaagugcccgcuggaugaaa

SEQ ID NO: 1206363 - RNA, 18 nt, Human
gcacagggaagggccugg

SEQ ID NO: 1206364 - RNA, 18 nt, Human
gcagcugagcuggguggg

SEQ ID NO: 1206365 - RNA, 22 nt, Human
ggaaggagggggaagcugcagg

SEQ ID NO: 1206366 - RNA, 19 nt, Human
ggccagggaggggccaggu

SEQ ID NO: 1206367 - RNA, 19 nt, Human
uaagcugcagauaacaguc

SEQ ID NO: 1206368 - RNA, 24 nt, Human
uaagcugcagauaacagucccuga

SEQ ID NO: 1206369 - RNA, 19 nt, Human
ucaggacagguggggaaac

SEQ ID NO: 1206370 - RNA, 22 nt, Human
ucaggacagguggggaaacuga

SEQ ID NO: 1206371 - RNA, 18 nt, Human
ucaggacgguuuccccag

SEQ ID NO: 1206372 - RNA, 26 nt, Human
ucccgaagugcccgcugaccauuggg

SEQ ID NO: 1206373 - RNA, 18 nt, Human
ucccuccagcugugaagg

SEQ ID NO: 1206374 - RNA, 21 nt, Human
ucucauagcuuuggagcugcc

SEQ ID NO: 1206375 - RNA, 20 nt, Human
ucucaucugugaaauggggu

SEQ ID NO: 1206376 - RNA, 18 nt, Human
ugaaagggccagggaggg

SEQ ID NO: 1206377 - RNA, 23 nt, Human
ugaaagggccagggaggggccag

SEQ ID NO: 1206378 - RNA, 20 nt, Human
ugacagggaaggagggggaa

SEQ ID NO: 1206379 - RNA, 23 nt, Human
ugacagggaaggagggggaagcu

SEQ ID NO: 1206380 - RNA, 22 nt, Human
ugacccucgaauccucccccaa

SEQ ID NO: 1206381 - RNA, 18 nt, Human
ugagcuggguggggccag

SEQ ID NO: 1206382 - RNA, 21 nt, Human
ugagcuggguggggccagggg

SEQ ID NO: 1206383 - RNA, 22 nt, Human
ugagcuggguggggccaggggc

SEQ ID NO: 1206384 - RNA, 25 nt, Human
ugccggucaccuuucuuccuucucu

SEQ ID NO: 1206385 - RNA, 22 nt, Human
ugcuuccugugugaaagcaggu

SEQ ID NO: 1206386 - RNA, 22 nt, Human
uggccugcagagcuccucgucg

SEQ ID NO: 1206387 - RNA, 19 nt, Human
ugucccucgaagcauggaa

SEQ ID NO: 1206388 - RNA, 24 nt, Human
uguuccuuugugggcucuucuaag

SEQ ID NO: 1206389 - RNA, 25 nt, Human
uucaggguuccuccacccucuguuu

SEQ ID NO: 1206390 - RNA, 22 nt, Human
uuccuccacccucuguuuucuc

SEQ ID NO: 1206391 - RNA, 22 nt, Human
uugugggcucuucuaaggcagc

SEQ ID NO: 1206392 - RNA, 20 nt, Human
uuucucaucugugaaaugga

SEQ ID NO: 1206393 - RNA, 20 nt, Human
uuucucaucugugaaauggg

SEQ ID NO: 1206394 - RNA, 24 nt, Human
uuuguagcugucuuggcauuuggg

SEQ ID NO: 1206395 - RNA, 24 nt, Human
aagcagaggucgagcaaaaucaaa

SEQ ID NO: 1206396 - RNA, 21 nt, Human
aagccuccaacauaaacagug

SEQ ID NO: 1206397 - RNA, 22 nt, Human
cagaggucgagcaaaaucaaag

SEQ ID NO: 1206398 - RNA, 21 nt, Human
ccacaacucugcuuucaguag

SEQ ID NO: 1206399 - RNA, 24 nt, Human
gcagaggucgagcaaaaucaaagg

SEQ ID NO: 1206400 - RNA, 26 nt, Human
ugggaagcagaggucgagcaaaauca

SEQ ID NO: 1206401 - RNA, 22 nt, Human
uuaaugaaccacaacucugcuu

SEQ ID NO: 1206402 - RNA, 24 nt, Human
aagggugaaacaaaauggcgaaga

SEQ ID NO: 1206403 - RNA, 20 nt, Human
aaguggcucuuggggcaagc

SEQ ID NO: 1206404 - RNA, 18 nt, Human
acaggggacauccucuuc

SEQ ID NO: 1206405 - RNA, 18 nt, Human
acuagcuuucccaccuuu

SEQ ID NO: 1206406 - RNA, 22 nt, Human
augaaggacagauuaaagacca

SEQ ID NO: 1206407 - RNA, 24 nt, Human
augaaggacagauuaaagaccaca

SEQ ID NO: 1206408 - RNA, 19 nt, Human
caccaaauguuccuggccc

SEQ ID NO: 1206409 - RNA, 27 nt, Human
caccuuuucccccuccccagcuggaag

SEQ ID NO: 1206410 - RNA, 23 nt, Human
cauauauuccacaggggacaucc

SEQ ID NO: 1206411 - RNA, 19 nt, Human
caugcaaagcagucugugu

SEQ ID NO: 1206412 - RNA, 21 nt, Human
cccaccuuuucccccucccca

SEQ ID NO: 1206413 - RNA, 22 nt, Human
ccgcaaguuggcuugggacaac

SEQ ID NO: 1206414 - RNA, 22 nt, Human
cuuaaucaccguuagccagaga

SEQ ID NO: 1206415 - RNA, 26 nt, Human
cuuucccaccuuuucccccuccccag

SEQ ID NO: 1206416 - RNA, 21 nt, Human
gaagggaaguggcucuugggg

SEQ ID NO: 1206417 - RNA, 19 nt, Human
gaggaaccaugaagauuuc

SEQ ID NO: 1206418 - RNA, 20 nt, Human
gauuuacugguuucuucccc

SEQ ID NO: 1206419 - RNA, 23 nt, Human
gucaaagauguucagcugcacaa

SEQ ID NO: 1206420 - RNA, 23 nt, Human
guugaacagcugugcuucugauu

SEQ ID NO: 1206421 - RNA, 20 nt, Human
uacaccaaauguuccuggcc

SEQ ID NO: 1206422 - RNA, 22 nt, Human
ucauccauaauuuucuggcugc

SEQ ID NO: 1206423 - RNA, 19 nt, Human
ucaugucgagcaaacuugu

SEQ ID NO: 1206424 - RNA, 18 nt, Human
uccaagcacaguugguga

SEQ ID NO: 1206425 - RNA, 21 nt, Human
ucgucaaagauguucagcugc

SEQ ID NO: 1206426 - RNA, 23 nt, Human
ucuccaaauauauuuacuagcuu

SEQ ID NO: 1206427 - RNA, 19 nt, Human
ucuguguguuuggugccga

SEQ ID NO: 1206428 - RNA, 23 nt, Human
ugaaggacagauuaaagaccaca

SEQ ID NO: 1206429 - RNA, 19 nt, Human
ugaccacucaugguucgac

SEQ ID NO: 1206430 - RNA, 22 nt, Human
ugcugucauuccugagccucug

SEQ ID NO: 1206431 - RNA, 24 nt, Human
uggaacaacaacgugucuuggaua

SEQ ID NO: 1206432 - RNA, 18 nt, Human
uggcccacuuucaagcag

SEQ ID NO: 1206433 - RNA, 22 nt, Human
uguugaacagcugugcuucuga

SEQ ID NO: 1206434 - RNA, 18 nt, Human
uuccagggaguuggaacg

SEQ ID NO: 1206435 - RNA, 20 nt, Human
uuccugagccucugcuuucc

SEQ ID NO: 1206436 - RNA, 24 nt, Human
uuggcuuccucuuuggaaggacgc

SEQ ID NO: 1206437 - RNA, 23 nt, Human
uuguacuuuuccuugccauugug

SEQ ID NO: 1206438 - RNA, 24 nt, Human
uuucccaccuuuucccccucccca

SEQ ID NO: 1206439 - RNA, 24 nt, Human
uuucuggcugcugucauuccugag

SEQ ID NO: 1206440 - RNA, 26 nt, Human
uuuggcuuccucuuuggaaggacggc

SEQ ID NO: 1206441 - RNA, 24 nt, Human
aaacaagaacuaugaaaaaagcaa

SEQ ID NO: 1206442 - RNA, 20 nt, Human
aagcggaagagcaaaaaguc

SEQ ID NO: 1206443 - RNA, 22 nt, Human
accccccucacggcugccaguu

SEQ ID NO: 1206444 - RNA, 20 nt, Human
acccggaagaccgacgugac

SEQ ID NO: 1206445 - RNA, 20 nt, Human
agaaaacccugucaaagaca

SEQ ID NO: 1206446 - RNA, 18 nt, Human
agaaguucuaaggcccga

SEQ ID NO: 1206447 - RNA, 24 nt, Human
agagcaaaaagucgccgaaaaagc

SEQ ID NO: 1206448 - RNA, 23 nt, Human
agcaacacaagaaaagguagggg

SEQ ID NO: 1206449 - RNA, 20 nt, Human
agcuuucucccgaaccaaag

SEQ ID NO: 1206450 - RNA, 21 nt, Human
augaaaaaagcaacuaugaug

SEQ ID NO: 1206451 - RNA, 18 nt, Human
auggagguaaacauaaug

SEQ ID NO: 1206452 - RNA, 22 nt, Human
caccacccuuugaaacaccaug

SEQ ID NO: 1206453 - RNA, 22 nt, Human
cacccuuugaaacaccaugcaa

SEQ ID NO: 1206454 - RNA, 24 nt, Human
cagcuccggcuccggcugagaucu

SEQ ID NO: 1206455 - RNA, 21 nt, Human
cccgcacugcccguucagaag

SEQ ID NO: 1206456 - RNA, 21 nt, Human
ccugucaaagacacccggaag

SEQ ID NO: 1206457 - RNA, 25 nt, Human
cggaagagcaaaaagucgccgaaaa

SEQ ID NO: 1206458 - RNA, 25 nt, Human
cguagaaaacccugucaaagacacc

SEQ ID NO: 1206459 - RNA, 19 nt, Human
cuuuuggucccgcacugcc

SEQ ID NO: 1206460 - RNA, 21 nt, Human
gaagugaacauguauucuucu

SEQ ID NO: 1206461 - RNA, 21 nt, Human
gagaucuaaccccccucacgg

SEQ ID NO: 1206462 - RNA, 25 nt, Human
gcggaagagcaaaaagucgccgaaa

SEQ ID NO: 1206463 - RNA, 25 nt, Human
ggaagagcaaaaagucgccgaaaaa

SEQ ID NO: 1206464 - RNA, 21 nt, Human
gguaaacauaauguauuauga

SEQ ID NO: 1206465 - RNA, 21 nt, Human
uaggaaaugucauaauaaaau

SEQ ID NO: 1206466 - RNA, 21 nt, Human
uaggcccagcuccggcuccgg

SEQ ID NO: 1206467 - RNA, 22 nt, Human
uauuguucuuuauuucuuggaa

SEQ ID NO: 1206468 - RNA, 20 nt, Human
ucacggcugccaggggagga

SEQ ID NO: 1206469 - RNA, 24 nt, Human
ugaaaaaagcaacuaugauggagg

SEQ ID NO: 1206470 - RNA, 26 nt, Human
ugaaaaaagcaacuaugauggaggua

SEQ ID NO: 1206471 - RNA, 25 nt, Human
uggagguaaacauaauguauuauga

SEQ ID NO: 1206472 - RNA, 22 nt, Human
uggcaaaaagcggaagagcaaa

SEQ ID NO: 1206473 - RNA, 24 nt, Human
uuucucccgaaccaaaggagguag

SEQ ID NO: 1206474 - RNA, 26 nt, Human
uuucuuggaagaauuuauuaagaaau

SEQ ID NO: 1206475 - RNA, 19 nt, Human
aaacauucugagcuagauu

SEQ ID NO: 1206476 - RNA, 21 nt, Human
acauauccugcaccuaaaaca

SEQ ID NO: 1206477 - RNA, 24 nt, Human
ccuaaaacauucugagcuagauuc

SEQ ID NO: 1206478 - RNA, 26 nt, Human
ccuaaaacauucugagcuagauucuu

SEQ ID NO: 1206479 - RNA, 23 nt, Human
ccugcaccuaaaacauucugagc

SEQ ID NO: 1206480 - RNA, 19 nt, Human
uacggaagaauccaguaag

SEQ ID NO: 1206481 - RNA, 21 nt, Human
agaccucccacaggcagauga

SEQ ID NO: 1206482 - RNA, 25 nt, Human
caggcagaugaccugcuucuuaugu

SEQ ID NO: 1206483 - RNA, 18 nt, Human
ccucccacaggcagauga

SEQ ID NO: 1206484 - RNA, 22 nt, Human
ccucccacaggcagaugaccug

SEQ ID NO: 1206485 - RNA, 21 nt, Human
uccacagaccucccacaggca

SEQ ID NO: 1206486 - RNA, 24 nt, Human
uccacagaccucccacaggcagau

SEQ ID NO: 1206487 - RNA, 20 nt, Human
uuccacagaccucccacagg

SEQ ID NO: 1206488 - RNA, 19 nt, Human
ugugguggaggaaaccaca

SEQ ID NO: 1206489 - RNA, 25 nt, Human
ugugguggaggaaaccacagaauac

SEQ ID NO: 1206490 - RNA, 21 nt, Human
aguacuagagaugcuggagcc

SEQ ID NO: 1206491 - RNA, 26 nt, Human
ccaaucagacauuucccagaaucuaa

SEQ ID NO: 1206492 - RNA, 21 nt, Human
ccugggcugaauuucugcagc

SEQ ID NO: 1206493 - RNA, 20 nt, Human
ccuguacagaguguccucau

SEQ ID NO: 1206494 - RNA, 27 nt, Human
cuaauucuggcugcuguucauuugggg

SEQ ID NO: 1206495 - RNA, 22 nt, Human
cuggagccucugaggaccucug

SEQ ID NO: 1206496 - RNA, 19 nt, Human
cuugcaguccugggcugaa

SEQ ID NO: 1206497 - RNA, 19 nt, Human
gagccuccuguacagagug

SEQ ID NO: 1206498 - RNA, 18 nt, Human
gagcuaauuagcucgaaa

SEQ ID NO: 1206499 - RNA, 23 nt, Human
uacucuguaaauggaaugugugg

SEQ ID NO: 1206500 - RNA, 21 nt, Human
uaggagagccuucagguagua

SEQ ID NO: 1206501 - RNA, 22 nt, Human
uauauuggacuauucuugaaac

SEQ ID NO: 1206502 - RNA, 18 nt, Human
uaucaugcuacuucaccu

SEQ ID NO: 1206503 - RNA, 21 nt, Human
ucauugaugcacuggauuacc

SEQ ID NO: 1206504 - RNA, 18 nt, Human
ucccagaaucuaaagacc

SEQ ID NO: 1206505 - RNA, 19 nt, Human
ucccagaaucuaaagaccu

SEQ ID NO: 1206506 - RNA, 21 nt, Human
uccugggcugaauuucugcag

SEQ ID NO: 1206507 - RNA, 22 nt, Human
uccugggcugaauuucugcagc

SEQ ID NO: 1206508 - RNA, 21 nt, Human
uccuguacagaguguccucau

SEQ ID NO: 1206509 - RNA, 24 nt, Human
ucuaaagaccccucagggggcccu

SEQ ID NO: 1206510 - RNA, 21 nt, Human
ucugcagcucauugaugcacu

SEQ ID NO: 1206511 - RNA, 19 nt, Human
ucuggccucugccaucacu

SEQ ID NO: 1206512 - RNA, 20 nt, Human
ucuggccucugccaucacuu

SEQ ID NO: 1206513 - RNA, 22 nt, Human
ucuugcaguccugggcugaauu

SEQ ID NO: 1206514 - RNA, 26 nt, Human
ugaaacaauauauauaaaaucaagca

SEQ ID NO: 1206515 - RNA, 19 nt, Human
ugucuauccuuucauccug

SEQ ID NO: 1206516 - RNA, 23 nt, Human
uucccaggcucacuuaucuuugu

SEQ ID NO: 1206517 - RNA, 20 nt, Human
agggcaucuguccuuucuuc

SEQ ID NO: 1206518 - RNA, 18 nt, Human
ucuguccuuucuuccucc

SEQ ID NO: 1206519 - RNA, 20 nt, Human
aggcuggggcggccuggaga

SEQ ID NO: 1206520 - RNA, 21 nt, Human
aaaaagaagcuaauuuaucca

SEQ ID NO: 1206521 - RNA, 21 nt, Human
aaagugcugggauuacgggug

SEQ ID NO: 1206522 - RNA, 24 nt, Human
aaagugcugggauuacggguguga

SEQ ID NO: 1206523 - RNA, 18 nt, Human
aagugcugggauuacggg

SEQ ID NO: 1206524 - RNA, 26 nt, Human
aagugcugggauuacgggugugagcc

SEQ ID NO: 1206525 - RNA, 19 nt, Human
agcuaacacuuacugagca

SEQ ID NO: 1206526 - RNA, 19 nt, Human
auacacacucacauacaca

SEQ ID NO: 1206527 - RNA, 24 nt, Human
caaagugcugggauuacgggugug

SEQ ID NO: 1206528 - RNA, 25 nt, Human
caccuggcugauuucugaaauuaug

SEQ ID NO: 1206529 - RNA, 19 nt, Human
cagcaccgucuucugcugu

SEQ ID NO: 1206530 - RNA, 21 nt, Human
ccaaagugcugggauuacggg

SEQ ID NO: 1206531 - RNA, 24 nt, Human
ccaaagugcugggauuacgggugu

SEQ ID NO: 1206532 - RNA, 20 nt, Human
cuucugcuguaaucuggcua

SEQ ID NO: 1206533 - RNA, 18 nt, Human
gaauauauaaugaaaaag

SEQ ID NO: 1206534 - RNA, 18 nt, Human
gauuacgggugugagcca

SEQ ID NO: 1206535 - RNA, 23 nt, Human
ggauuacgggugugagccaucac

SEQ ID NO: 1206536 - RNA, 21 nt, Human
uaaaaagaagcuaauuuaucc

SEQ ID NO: 1206537 - RNA, 24 nt, Human
uaaaaagaagcuaauuuauccacu

SEQ ID NO: 1206538 - RNA, 19 nt, Human
uaaugaaaaagacagcuaa

SEQ ID NO: 1206539 - RNA, 19 nt, Human
uacacacucacauacacau

SEQ ID NO: 1206540 - RNA, 23 nt, Human
uacgggugugagccaucacaccu

SEQ ID NO: 1206541 - RNA, 21 nt, Human
ucaucaguuuucauuccuuuu

SEQ ID NO: 1206542 - RNA, 23 nt, Human
ucccaaagugcugggauuacggg

SEQ ID NO: 1206543 - RNA, 18 nt, Human
ugaaaaagacagcuaaca

SEQ ID NO: 1206544 - RNA, 19 nt, Human
ugaauauauaaugaaaaag

SEQ ID NO: 1206545 - RNA, 23 nt, Human
ugaucucagcaccgucuucugcu

SEQ ID NO: 1206546 - RNA, 24 nt, Human
ugaugaaauuuaaaaagaagcuaa

SEQ ID NO: 1206547 - RNA, 24 nt, Human
ugcccuuucuaucucugucucuca

SEQ ID NO: 1206548 - RNA, 21 nt, Human
uggcugauuucugaaauuaug

SEQ ID NO: 1206549 - RNA, 18 nt, Human
ugggauuacgggugugag

SEQ ID NO: 1206550 - RNA, 19 nt, Human
ugggauuacgggugugagc

SEQ ID NO: 1206551 - RNA, 22 nt, Human
ugggauuacgggugugagccau

SEQ ID NO: 1206552 - RNA, 23 nt, Human
ugggauuacgggugugagccauc

SEQ ID NO: 1206553 - RNA, 24 nt, Human
ugggauuacgggugugagccauca

SEQ ID NO: 1206554 - RNA, 24 nt, Human
uuaaaaagaagcuaauuuauccac

SEQ ID NO: 1206555 - RNA, 18 nt, Human
uucaugcccuuucuaucu

SEQ ID NO: 1206556 - RNA, 24 nt, Human
uucucucacacacacugucuuuaa

SEQ ID NO: 1206557 - RNA, 18 nt, Human
uucugucuaccuuucucu

SEQ ID NO: 1206558 - RNA, 22 nt, Human
uucugucuaccuuucucucaca

SEQ ID NO: 1206559 - RNA, 22 nt, Human
uuucaugcccuuucuaucucug

SEQ ID NO: 1206560 - RNA, 21 nt, Human
ugaagaagugcgucucuuuuu

SEQ ID NO: 1206561 - RNA, 24 nt, Human
ugaagaagugcgucucuuuuuugc

SEQ ID NO: 1206562 - RNA, 20 nt, Human
ugcgucucuuuuuugcucuu

SEQ ID NO: 1206563 - RNA, 18 nt, Human
cagcgagucacuuccaag

SEQ ID NO: 1206564 - RNA, 22 nt, Human
gugugccaauauuacggcugga

SEQ ID NO: 1206565 - RNA, 18 nt, Human
uacagcgagucacuucca

SEQ ID NO: 1206566 - RNA, 18 nt, Human
ucuccauaggagacuugc

SEQ ID NO: 1206567 - RNA, 25 nt, Human
cagaccucuugaaguccaacggcuu

SEQ ID NO: 1206568 - RNA, 21 nt, Human
aagcugccucuucagcuuugc

SEQ ID NO: 1206569 - RNA, 23 nt, Human
acuaguguuauuuaauauuuccc

SEQ ID NO: 1206570 - RNA, 19 nt, Human
agcuuugcugcuacugcau

SEQ ID NO: 1206571 - RNA, 27 nt, Human
uguguuuauuccuccuccuuuuuuccu

SEQ ID NO: 1206572 - RNA, 20 nt, Human
uuuccugcuuauguuucucu

SEQ ID NO: 1206573 - RNA, 19 nt, Human
cccaaaacccggagaucag

SEQ ID NO: 1206574 - RNA, 23 nt, Human
cccccaaaacccggagaucagau

SEQ ID NO: 1206575 - RNA, 21 nt, Human
uaccuucuggaaggugccccc

SEQ ID NO: 1206576 - RNA, 19 nt, Human
uaggacuccagggcacugu

SEQ ID NO: 1206577 - RNA, 24 nt, Human
uggaaggugcccccaaaacccgga

SEQ ID NO: 1206578 - RNA, 20 nt, Human
cuccccgcaaaccuccacag

SEQ ID NO: 1206579 - RNA, 21 nt, Human
ucuccccgcaaaccuccacag

SEQ ID NO: 1206580 - RNA, 19 nt, Human
ucugaccucucuccccgca

SEQ ID NO: 1206581 - RNA, 23 nt, Human
ugaccucucuccccgcaaaccuc

SEQ ID NO: 1206582 - RNA, 23 nt, Human
aagaauauuccccagauaaugaa

SEQ ID NO: 1206583 - RNA, 19 nt, Human
ccagauaaugaagucaaaa

SEQ ID NO: 1206584 - RNA, 21 nt, Human
ugaguuggauagcuucauuua

SEQ ID NO: 1206585 - RNA, 22 nt, Human
cuggcggucgcaugcacuccuu

SEQ ID NO: 1206586 - RNA, 22 nt, Human
gacacaagacuuucagaagcuu

SEQ ID NO: 1206587 - RNA, 19 nt, Human
gaucugugaauuguucccu

SEQ ID NO: 1206588 - RNA, 21 nt, Human
gcuugcaguucuggccauacu

SEQ ID NO: 1206589 - RNA, 21 nt, Human
ggagggagcaguccgugaaaa

SEQ ID NO: 1206590 - RNA, 27 nt, Human
ucugcagacacaagacuuucagaagcu

SEQ ID NO: 1206591 - RNA, 22 nt, Human
uguuacagguccucugcuggca

SEQ ID NO: 1206592 - RNA, 21 nt, Human
uuacagguccucugcuggcag

SEQ ID NO: 1206593 - RNA, 21 nt, Human
auaaagcaagauacaccaucc

SEQ ID NO: 1206594 - RNA, 19 nt, Human
caagauacaccauccaauc

SEQ ID NO: 1206595 - RNA, 21 nt, Human
caggaagagcugaaagggaug

SEQ ID NO: 1206596 - RNA, 23 nt, Human
cgaugaugugcaguuugugcucc

SEQ ID NO: 1206597 - RNA, 24 nt, Human
cuucucuccaggaagagcugaaag

SEQ ID NO: 1206598 - RNA, 19 nt, Human
gagcugaaagggaugacca

SEQ ID NO: 1206599 - RNA, 24 nt, Human
uacacccccgaugaugugcaguuu

SEQ ID NO: 1206600 - RNA, 19 nt, Human
ugcuuggcaggguauggcu

SEQ ID NO: 1206601 - RNA, 22 nt, Human
uggcaggguauggcuucucucc

SEQ ID NO: 1206602 - RNA, 22 nt, Human
uuggcaggguauggcuucucuc

SEQ ID NO: 1206603 - RNA, 21 nt, Human
ccgcacagagccaugcauaca

SEQ ID NO: 1206604 - RNA, 20 nt, Human
cuugugggcugaguccuggg

SEQ ID NO: 1206605 - RNA, 19 nt, Human
gugggcugaguccugggcu

SEQ ID NO: 1206606 - RNA, 19 nt, Human
uaauacaccucugcgaaau

SEQ ID NO: 1206607 - RNA, 20 nt, Human
uagugaccuuucccuuggua

SEQ ID NO: 1206608 - RNA, 23 nt, Human
uccuugggguagugaccuuuccc

SEQ ID NO: 1206609 - RNA, 19 nt, Human
ugggguagugaccuuuccc

SEQ ID NO: 1206610 - RNA, 18 nt, Human
ugugggcugaguccuggg

SEQ ID NO: 1206611 - RNA, 18 nt, Human
uguguuuguagcuguuac

SEQ ID NO: 1206612 - RNA, 23 nt, Human
uuagugagccuuuuccaggugug

SEQ ID NO: 1206613 - RNA, 23 nt, Human
uuuccagguguguuuguagcugu

SEQ ID NO: 1206614 - RNA, 23 nt, Human
aagcagcccaauaggacacaacc

SEQ ID NO: 1206615 - RNA, 19 nt, Human
aggacacaaccuacaaucu

SEQ ID NO: 1206616 - RNA, 23 nt, Human
aggacuucagugucaagcagccc

SEQ ID NO: 1206617 - RNA, 19 nt, Human
caggacaccacuccugaag

SEQ ID NO: 1206618 - RNA, 20 nt, Human
cugaaggcagcgccuucuuc

SEQ ID NO: 1206619 - RNA, 23 nt, Human
ggacacaaccuacaaucuccccg

SEQ ID NO: 1206620 - RNA, 19 nt, Human
uccugaaggcagcgccuuc

SEQ ID NO: 1206621 - RNA, 18 nt, Human
aggauggugcaccaccgu

SEQ ID NO: 1206622 - RNA, 18 nt, Human
augaauuuucuguuugac

SEQ ID NO: 1206623 - RNA, 23 nt, Human
auguucuaccuccaguaacuuca

SEQ ID NO: 1206624 - RNA, 18 nt, Human
cacagcgguggcugcgac

SEQ ID NO: 1206625 - RNA, 21 nt, Human
cagcgguggcugcgacagcgu

SEQ ID NO: 1206626 - RNA, 20 nt, Human
ccacagcgguggcugcgaca

SEQ ID NO: 1206627 - RNA, 18 nt, Human
ccccagugcugcgguccc

SEQ ID NO: 1206628 - RNA, 22 nt, Human
cgcacugcuuccuugcaagcaa

SEQ ID NO: 1206629 - RNA, 24 nt, Human
cgguggcugcgacagcguggagcg

SEQ ID NO: 1206630 - RNA, 19 nt, Human
cuccccagugcugcggucc

SEQ ID NO: 1206631 - RNA, 24 nt, Human
cucuucccacuuuaucuguguuaa

SEQ ID NO: 1206632 - RNA, 21 nt, Human
cugcaauaauaaccacggagg

SEQ ID NO: 1206633 - RNA, 23 nt, Human
cuggcgaccacagcgguggcuuu

SEQ ID NO: 1206634 - RNA, 23 nt, Human
gcucacaccgcgggcaaccagua

SEQ ID NO: 1206635 - RNA, 25 nt, Human
uaagaucagcucaucaucacaaauu

SEQ ID NO: 1206636 - RNA, 19 nt, Human
uagccacuaauaacugacg

SEQ ID NO: 1206637 - RNA, 24 nt, Human
uaguuccaucuccaacuucuuugu

SEQ ID NO: 1206638 - RNA, 19 nt, Human
uaucgcagccccucggcug

SEQ ID NO: 1206639 - RNA, 19 nt, Human
ucacggcagcgguacacgu

SEQ ID NO: 1206640 - RNA, 22 nt, Human
uccauagccacuaauaacugac

SEQ ID NO: 1206641 - RNA, 21 nt, Human
uccccagugcugcggucccca

SEQ ID NO: 1206642 - RNA, 24 nt, Human
uccccagugcugcgguccccaaac

SEQ ID NO: 1206643 - RNA, 19 nt, Human
uggcugcgacagcguggag

SEQ ID NO: 1206644 - RNA, 21 nt, Human
uucaggauggugcaccaccgu

SEQ ID NO: 1206645 - RNA, 21 nt, Human
uucauuuuuuaggaguucugc

SEQ ID NO: 1206646 - RNA, 23 nt, Human
uucuuugucuugcagaucagcca

SEQ ID NO: 1206647 - RNA, 30 nt, Human
uuggcagcauuaaucaggcaaucucuuccu

SEQ ID NO: 1206648 - RNA, 23 nt, Human
uuucauugauauaacgcacugcu

SEQ ID NO: 1206649 - RNA, 20 nt, Human
ggaauagaaguggugaagga

SEQ ID NO: 1206650 - RNA, 20 nt, Human
ugaccuuaggaauagaagug

SEQ ID NO: 1206651 - RNA, 18 nt, Human
ugacuagaagaugaugcu

SEQ ID NO: 1206652 - RNA, 21 nt, Human
ugauugggaagaggugagaag

SEQ ID NO: 1206653 - RNA, 21 nt, Human
ugccauggauggaagagugac

SEQ ID NO: 1206654 - RNA, 20 nt, Human
ugggaagaggugagaaggca

SEQ ID NO: 1206655 - RNA, 21 nt, Human
aagaaagagaaauuccagugc

SEQ ID NO: 1206656 - RNA, 21 nt, Human
agagcacaguuuucacgcaag

SEQ ID NO: 1206657 - RNA, 20 nt, Human
gaucauaaguaccuucuuuc

SEQ ID NO: 1206658 - RNA, 22 nt, Human
guuucugcuucauuuaauucuu

SEQ ID NO: 1206659 - RNA, 21 nt, Human
ucagugugauguuauuuguga

SEQ ID NO: 1206660 - RNA, 23 nt, Human
ugaagaaagagaaauuccagugc

SEQ ID NO: 1206661 - RNA, 24 nt, Human
ugauucccacucuuucacuuucuc

SEQ ID NO: 1206662 - RNA, 26 nt, Human
uucaggugaagaaauuuaguugaaga

SEQ ID NO: 1206663 - RNA, 24 nt, Human
uucauauuugcuuuucuugguuuc

SEQ ID NO: 1206664 - RNA, 19 nt, Human
uucuugguuucugcuucau

SEQ ID NO: 1206665 - RNA, 18 nt, Human
uuucacgcaaguccugca

SEQ ID NO: 1206666 - RNA, 21 nt, Human
uuucuguacaagcucccucag

SEQ ID NO: 1206667 - RNA, 20 nt, Human
uuugcuuuucuugguuucug

SEQ ID NO: 1206668 - RNA, 19 nt, Human
acagcacaguuggcgcgug

SEQ ID NO: 1206669 - RNA, 21 nt, Human
ccgggggcugcacagcacagu

SEQ ID NO: 1206670 - RNA, 21 nt, Human
ggacaaaucacugauguucuu

SEQ ID NO: 1206671 - RNA, 19 nt, Human
uaugcaaagguaaaagcac

SEQ ID NO: 1206672 - RNA, 23 nt, Human
ucucucagcucuaggaucuugga

SEQ ID NO: 1206673 - RNA, 24 nt, Human
ugcacagcacaguuggcgcgugua

SEQ ID NO: 1206674 - RNA, 22 nt, Human
uuggggcccaacgauucucucu

SEQ ID NO: 1206675 - RNA, 18 nt, Human
aagcagagucacagcuga

SEQ ID NO: 1206676 - RNA, 18 nt, Human
acagaggcuccuggcuuu

SEQ ID NO: 1206677 - RNA, 23 nt, Human
acaugagguuuugguauuugcuc

SEQ ID NO: 1206678 - RNA, 21 nt, Human
agcagagucacagcugaauga

SEQ ID NO: 1206679 - RNA, 19 nt, Human
agcaggcuuuaugguggcu

SEQ ID NO: 1206680 - RNA, 18 nt, Human
augaauuuuccaagcaga

SEQ ID NO: 1206681 - RNA, 20 nt, Human
caagcagagucacagcugaa

SEQ ID NO: 1206682 - RNA, 20 nt, Human
caugagguuuugguauuugc

SEQ ID NO: 1206683 - RNA, 21 nt, Human
ccagaucccaaaugucaagga

SEQ ID NO: 1206684 - RNA, 24 nt, Human
cugguaucuggcacuucucuuucg

SEQ ID NO: 1206685 - RNA, 19 nt, Human
cuuuauuaaugaaagugau

SEQ ID NO: 1206686 - RNA, 21 nt, Human
gguccauuuuucaauuucccu

SEQ ID NO: 1206687 - RNA, 21 nt, Human
guaccuaacauagacuuugcu

SEQ ID NO: 1206688 - RNA, 23 nt, Human
uaugguggcuggguuccaagcag

SEQ ID NO: 1206689 - RNA, 27 nt, Human
uaugguggcuggguuccaagcagauac

SEQ ID NO: 1206690 - RNA, 23 nt, Human
uccaagcagauaccugguugugc

SEQ ID NO: 1206691 - RNA, 25 nt, Human
uccagaucccaaaugucaaggaccc

SEQ ID NO: 1206692 - RNA, 21 nt, Human
ucccaaaugucaaggacccau

SEQ ID NO: 1206693 - RNA, 23 nt, Human
uccugguaucuggcacuucucuu

SEQ ID NO: 1206694 - RNA, 23 nt, Human
ucugugccgaaugaacugagaga

SEQ ID NO: 1206695 - RNA, 24 nt, Human
ucuucugccagcugcucacaugau

SEQ ID NO: 1206696 - RNA, 24 nt, Human
ugccagcugcucacaugauuaugg

SEQ ID NO: 1206697 - RNA, 20 nt, Human
ugcuggguugcggggccacc

SEQ ID NO: 1206698 - RNA, 18 nt, Human
uguuccaaacuuacacuc

SEQ ID NO: 1206699 - RNA, 25 nt, Human
uuaaugaaagugauuuguuuuccuu

SEQ ID NO: 1206700 - RNA, 18 nt, Human
uugcauuggcugcuuugu

SEQ ID NO: 1206701 - RNA, 19 nt, Human
uugcggggccacacaguag

SEQ ID NO: 1206702 - RNA, 21 nt, Human
aagaaauucuuaaagauggcu

SEQ ID NO: 1206703 - RNA, 23 nt, Human
agagaaaaaaaucuucaggauac

SEQ ID NO: 1206704 - RNA, 23 nt, Human
cacauacagguuuaauacacuuc

SEQ ID NO: 1206705 - RNA, 19 nt, Human
cuacuguuaacucuagaua

SEQ ID NO: 1206706 - RNA, 22 nt, Human
uaagaaauucuuaaagauggcu

SEQ ID NO: 1206707 - RNA, 18 nt, Human
uacaaacaagauccacug

SEQ ID NO: 1206708 - RNA, 25 nt, Human
uacaaacaagauccacugucuucca

SEQ ID NO: 1206709 - RNA, 19 nt, Human
ugaaaaauaaauccccuac

SEQ ID NO: 1206710 - RNA, 26 nt, Human
aaacagucaagugaagaugguaaagc

SEQ ID NO: 1206711 - RNA, 22 nt, Human
aaaccuccaucagauccucaau

SEQ ID NO: 1206712 - RNA, 22 nt, Human
aaagagcagcgcggcgagcagu

SEQ ID NO: 1206713 - RNA, 23 nt, Human
aaccaaacaaugggcaaccuccc

SEQ ID NO: 1206714 - RNA, 25 nt, Human
aaccaaacaaugggcaaccucccag

SEQ ID NO: 1206715 - RNA, 19 nt, Human
aaugacuugcaacaucuuc

SEQ ID NO: 1206716 - RNA, 19 nt, Human
acaaacaauagcaugagcc

SEQ ID NO: 1206717 - RNA, 26 nt, Human
acaaacaauagcaugagccaucugug

SEQ ID NO: 1206718 - RNA, 18 nt, Human
acaccuggcccacccagc

SEQ ID NO: 1206719 - RNA, 24 nt, Human
acagaaaauaaauacauuaaaaaa

SEQ ID NO: 1206720 - RNA, 26 nt, Human
acaugcaccacagaccagccagcucc

SEQ ID NO: 1206721 - RNA, 19 nt, Human
acccugcgaggucaaagag

SEQ ID NO: 1206722 - RNA, 19 nt, Human
acccugcgaggucaaagag

SEQ ID NO: 1206723 - RNA, 24 nt, Human
agaaaaaggaaugacuugcaacau

SEQ ID NO: 1206724 - RNA, 22 nt, Human
agaagcagcuaucugucagggg

SEQ ID NO: 1206725 - RNA, 20 nt, Human
agacuaaauuuacaacagca

SEQ ID NO: 1206726 - RNA, 22 nt, Human
agccauaaacuggccccaaaac

SEQ ID NO: 1206727 - RNA, 26 nt, Human
agucaagugaagaugguaaagccaaa

SEQ ID NO: 1206728 - RNA, 19 nt, Human
aguuaacuagcccaaccua

SEQ ID NO: 1206729 - RNA, 18 nt, Human
auaaacuggccccaaaac

SEQ ID NO: 1206730 - RNA, 22 nt, Human
auaaacuggccccaaaacuggc

SEQ ID NO: 1206731 - RNA, 18 nt, Human
augcaccacagaccagcc

SEQ ID NO: 1206732 - RNA, 23 nt, Human
caaccucccaguucuucaguccc

SEQ ID NO: 1206733 - RNA, 21 nt, Human
caagccccccaaaauccagcc

SEQ ID NO: 1206734 - RNA, 24 nt, Human
caagccccccaaaauccagccaua

SEQ ID NO: 1206735 - RNA, 19 nt, Human
caagcugaacagaaaauaa

SEQ ID NO: 1206736 - RNA, 20 nt, Human
cacaugcaccacagaccagg

SEQ ID NO: 1206737 - RNA, 24 nt, Human
caccuggcccacccagcccagagu

SEQ ID NO: 1206738 - RNA, 19 nt, Human
caccugguauuacaacaug

SEQ ID NO: 1206739 - RNA, 19 nt, Human
cagccauaaacuggcccca

SEQ ID NO: 1206740 - RNA, 20 nt, Human
cagcucccugaguaccagag

SEQ ID NO: 1206741 - RNA, 24 nt, Human
cauuuuugucauucagcuugagag

SEQ ID NO: 1206742 - RNA, 18 nt, Human
cccaaccuaugccuuuaa

SEQ ID NO: 1206743 - RNA, 22 nt, Human
cccacccagcccagaguggaaa

SEQ ID NO: 1206744 - RNA, 19 nt, Human
cccagcucgaccgccccuu

SEQ ID NO: 1206745 - RNA, 18 nt, Human
cccguggacauuuucccc

SEQ ID NO: 1206746 - RNA, 18 nt, Human
cccugaguaccagagggc

SEQ ID NO: 1206747 - RNA, 20 nt, Human
ccgccccuugcuuuuccgcu

SEQ ID NO: 1206748 - RNA, 23 nt, Human
ccgccccuugcuuuuccgcuucc

SEQ ID NO: 1206749 - RNA, 19 nt, Human
ccuucguuucccauaaggg

SEQ ID NO: 1206750 - RNA, 23 nt, Human
ccuugcuuuuccgcuuccuggag

SEQ ID NO: 1206751 - RNA, 25 nt, Human
cuaaagcuaccacuaauauucucuu

SEQ ID NO: 1206752 - RNA, 23 nt, Human
cuaaaggacagaaaaaggaauga

SEQ ID NO: 1206753 - RNA, 27 nt, Human
cugaaaccccguggacauuuuccccau

SEQ ID NO: 1206754 - RNA, 20 nt, Human
cugaagucaguuucuccucc

SEQ ID NO: 1206755 - RNA, 22 nt, Human
cugagacuaaauuuacaacagc

SEQ ID NO: 1206756 - RNA, 19 nt, Human
cugcagcacuguaacaugu

SEQ ID NO: 1206757 - RNA, 23 nt, Human
cugugugugugucuuuaauuccu

SEQ ID NO: 1206758 - RNA, 21 nt, Human
cuuaagccacaaacaauagca

SEQ ID NO: 1206759 - RNA, 24 nt, Human
cuucaguucuggucacagguuuuu

SEQ ID NO: 1206760 - RNA, 27 nt, Human
cuucuaaagcuaccacuaauauucucu

SEQ ID NO: 1206761 - RNA, 21 nt, Human
gagaccccugauuucccacuu

SEQ ID NO: 1206762 - RNA, 23 nt, Human
gcaaaaccauuuuaguccuugaa

SEQ ID NO: 1206763 - RNA, 19 nt, Human
gcaaccucccaguucuuca

SEQ ID NO: 1206764 - RNA, 28 nt, Human
gcaaggaacaccuggcccacccagccca

SEQ ID NO: 1206765 - RNA, 18 nt, Human
gcaugagccaucugugcc

SEQ ID NO: 1206766 - RNA, 19 nt, Human
gccauaaacuggccccaaa

SEQ ID NO: 1206767 - RNA, 24 nt, Human
gccgcaguuaacuagcccaaccua

SEQ ID NO: 1206768 - RNA, 18 nt, Human
gggcaaggaacaccuggc

SEQ ID NO: 1206769 - RNA, 24 nt, Human
ggucaaagagcagcgcggcgagca

SEQ ID NO: 1206770 - RNA, 25 nt, Human
uaaaaucucugcagcacuguaacau

SEQ ID NO: 1206771 - RNA, 20 nt, Human
uaacauguucauaauggccc

SEQ ID NO: 1206772 - RNA, 22 nt, Human
uaagccacaaacaauagcauga

SEQ ID NO: 1206773 - RNA, 22 nt, Human
uacaaacagucaagugaagaug

SEQ ID NO: 1206774 - RNA, 26 nt, Human
uacaguauuacaaacagucaagugaa

SEQ ID NO: 1206775 - RNA, 24 nt, Human
uacuacaguauuacaaacagucaa

SEQ ID NO: 1206776 - RNA, 18 nt, Human
uagaagacaagcagcuug

SEQ ID NO: 1206777 - RNA, 23 nt, Human
uagcuucuuagguggaaagcaac

SEQ ID NO: 1206778 - RNA, 25 nt, Human
uagguggaaagcaacuaagucuuuu

SEQ ID NO: 1206779 - RNA, 22 nt, Human
ucagucccuaaaggacagaaaa

SEQ ID NO: 1206780 - RNA, 23 nt, Human
ucaguucuggucacagguuuuua

SEQ ID NO: 1206781 - RNA, 19 nt, Human
ucccugaguaccagagggc

SEQ ID NO: 1206782 - RNA, 20 nt, Human
ucccugaguaccagagggcu

SEQ ID NO: 1206783 - RNA, 21 nt, Human
ucccugaguaccagagggcuu

SEQ ID NO: 1206784 - RNA, 20 nt, Human
uccuucaguucuggucacag

SEQ ID NO: 1206785 - RNA, 22 nt, Human
uccuucaguucuggucacaggu

SEQ ID NO: 1206786 - RNA, 22 nt, Human
ucuuugagucauucuuuuuggg

SEQ ID NO: 1206787 - RNA, 21 nt, Human
ugaaaccccguggacauuuuc

SEQ ID NO: 1206788 - RNA, 23 nt, Human
ugaacagaaaauaaauacauuaa

SEQ ID NO: 1206789 - RNA, 20 nt, Human
ugacuugcaacaucuuccag

SEQ ID NO: 1206790 - RNA, 21 nt, Human
ugauuucccacuuuacaccuc

SEQ ID NO: 1206791 - RNA, 23 nt, Human
ugcaguuuucaguuccuagaguc

SEQ ID NO: 1206792 - RNA, 22 nt, Human
uggagagaagcagcuaucuguc

SEQ ID NO: 1206793 - RNA, 24 nt, Human
uggccccaaaacuggccauaaaua

SEQ ID NO: 1206794 - RNA, 22 nt, Human
uguucggggcucucagcucuga

SEQ ID NO: 1206795 - RNA, 21 nt, Human
uuaacuagcccaaccuaugcc

SEQ ID NO: 1206796 - RNA, 18 nt, Human
uuccgcuuccuggaggcc

SEQ ID NO: 1206797 - RNA, 21 nt, Human
uuguuuuguuuucaaauugug

SEQ ID NO: 1206798 - RNA, 24 nt, Human
uuuucaguuccuagagucuuccuu

SEQ ID NO: 1206799 - RNA, 19 nt, Human
uuuuccgcuuccuggaggc

SEQ ID NO: 1206800 - RNA, 20 nt, Human
acucacuuccgccuccuccg

SEQ ID NO: 1206801 - RNA, 22 nt, Human
acucacuuccgccuccuccggu

SEQ ID NO: 1206802 - RNA, 22 nt, Human
agaccggggccggcgacggaug

SEQ ID NO: 1206803 - RNA, 20 nt, Human
cacugaggaugcgccacagg

SEQ ID NO: 1206804 - RNA, 30 nt, Human
ccggcgacggaugcagggcggcccuccucu

SEQ ID NO: 1206805 - RNA, 21 nt, Human
gaggccccuggagaccggggc

SEQ ID NO: 1206806 - RNA, 24 nt, Human
gccuccuccgguuuaagcaccgcc

SEQ ID NO: 1206807 - RNA, 20 nt, Human
gggccggcgacggaugcagg

SEQ ID NO: 1206808 - RNA, 21 nt, Human
ucacugaggaugcgccacagg

SEQ ID NO: 1206809 - RNA, 23 nt, Human
ucgagccccugcgccugcgcuag

SEQ ID NO: 1206810 - RNA, 24 nt, Human
ugaggccccuggagaccggggccg

SEQ ID NO: 1206811 - RNA, 25 nt, Human
agguaccaggggcuuagcauaagcu

SEQ ID NO: 1206812 - RNA, 19 nt, Human
cagaaagucucuucucucu

SEQ ID NO: 1206813 - RNA, 20 nt, Human
cagcacggaacaaacgauaa

SEQ ID NO: 1206814 - RNA, 22 nt, Human
cagcacggaacaaacgauaagc

SEQ ID NO: 1206815 - RNA, 22 nt, Human
cuggcacagcggugacuccugc

SEQ ID NO: 1206816 - RNA, 26 nt, Human
gaacaaacgauaagccgcucuggcac

SEQ ID NO: 1206817 - RNA, 20 nt, Human
gcucucagguugaaagcaga

SEQ ID NO: 1206818 - RNA, 18 nt, Human
ggaacaaacgauaagccg

SEQ ID NO: 1206819 - RNA, 24 nt, Human
ugaaagcagaaagucucuucucuc

SEQ ID NO: 1206820 - RNA, 21 nt, Human
uggcacagcggugacuccugc

SEQ ID NO: 1206821 - RNA, 22 nt, Human
uugaaagcagaaagucucuucu

SEQ ID NO: 1206822 - RNA, 22 nt, Human
aaaagcugccagagaggcuguu

SEQ ID NO: 1206823 - RNA, 24 nt, Human
acccuucugccuccuggauuuccu

SEQ ID NO: 1206824 - RNA, 20 nt, Human
accgcuguuuaccgaggguc

SEQ ID NO: 1206825 - RNA, 24 nt, Human
cugcuucaccgagggcccugugau

SEQ ID NO: 1206826 - RNA, 19 nt, Human
uggaaacccuucugccucc

SEQ ID NO: 1206827 - RNA, 24 nt, Human
uugccgacagcagcgauuucuugu

SEQ ID NO: 1206828 - RNA, 22 nt, Human
uuucuuguguggaaacccuucu

SEQ ID NO: 1206829 - RNA, 24 nt, Human
auguguguauauauauauauauaa

SEQ ID NO: 1206830 - RNA, 22 nt, Human
caaaauacaauucauccauuaa

SEQ ID NO: 1206831 - RNA, 24 nt, Human
gcacguacaagaccuucucuugaa

SEQ ID NO: 1206832 - RNA, 20 nt, Human
guguguauauauauauauau

SEQ ID NO: 1206833 - RNA, 27 nt, Human
guguguauauauauauauauauuuaaa

SEQ ID NO: 1206834 - RNA, 19 nt, Human
uaaagcuaaggggaaggag

SEQ ID NO: 1206835 - RNA, 19 nt, Human
uacaagaccuucucuugaa

SEQ ID NO: 1206836 - RNA, 31 nt, Human
uauauauauauauuuaaaaaucacauuauaa

SEQ ID NO: 1206837 - RNA, 18 nt, Human
uguauauauauauauaua

SEQ ID NO: 1206838 - RNA, 18 nt, Human
uguguauauauauauaua

SEQ ID NO: 1206839 - RNA, 20 nt, Human
uguguauauauauauauaua

SEQ ID NO: 1206840 - RNA, 21 nt, Human
uguguauauauauauauauau

SEQ ID NO: 1206841 - RNA, 24 nt, Human
uguguguauauauauauauauaac

SEQ ID NO: 1206842 - RNA, 20 nt, Human
uucacaauguguguauauau

SEQ ID NO: 1206843 - RNA, 26 nt, Human
uucacaauguguguauauauauauau

SEQ ID NO: 1206844 - RNA, 22 nt, Human
uucauuauuucacaaugugugu

SEQ ID NO: 1206845 - RNA, 22 nt, Human
uugaacaaguugaauuuucagg

SEQ ID NO: 1206846 - RNA, 23 nt, Human
uuucacaauguguguauauauau

SEQ ID NO: 1206847 - RNA, 21 nt, Human
aagcggcgcagcagccccagg

SEQ ID NO: 1206848 - RNA, 21 nt, Human
acucccagaggcgcugguaag

SEQ ID NO: 1206849 - RNA, 22 nt, Human
cagaagcugcucuugguccagc

SEQ ID NO: 1206850 - RNA, 20 nt, Human
ccugcagggucgcgugggag

SEQ ID NO: 1206851 - RNA, 19 nt, Human
cgaagcggcgcagcagccc

SEQ ID NO: 1206852 - RNA, 19 nt, Human
cugcucuugguccagcagc

SEQ ID NO: 1206853 - RNA, 19 nt, Human
gaaagccagcccaggcuug

SEQ ID NO: 1206854 - RNA, 22 nt, Human
gcgcagcagccccagguagugc

SEQ ID NO: 1206855 - RNA, 23 nt, Human
gggaaagccagcccaggcuuggg

SEQ ID NO: 1206856 - RNA, 25 nt, Human
gguccagcagcuccugcaggguccc

SEQ ID NO: 1206857 - RNA, 18 nt, Human
ucccagaggcgcugguaa

SEQ ID NO: 1206858 - RNA, 21 nt, Human
ucgaagcggcgcagcagcccc

SEQ ID NO: 1206859 - RNA, 19 nt, Human
uugguccagcagcuccugc

SEQ ID NO: 1206860 - RNA, 22 nt, Human
accugggugggagccuuccaag

SEQ ID NO: 1206861 - RNA, 19 nt, Human
agaaccaauuaacagcagc

SEQ ID NO: 1206862 - RNA, 22 nt, Human
caagaaaggguccucgugagaa

SEQ ID NO: 1206863 - RNA, 21 nt, Human
cagcucagcgguucccagcaa

SEQ ID NO: 1206864 - RNA, 22 nt, Human
ccaggacagaaggggaagugga

SEQ ID NO: 1206865 - RNA, 18 nt, Human
ccaggcggucucauggca

SEQ ID NO: 1206866 - RNA, 24 nt, Human
cccccaauucauuuagcagcccca

SEQ ID NO: 1206867 - RNA, 18 nt, Human
cccugguugaggccgcgc

SEQ ID NO: 1206868 - RNA, 26 nt, Human
cgccuugcucaccccaggcggucuca

SEQ ID NO: 1206869 - RNA, 21 nt, Human
cgggcagcagcccaggucgcc

SEQ ID NO: 1206870 - RNA, 18 nt, Human
cuguccuaggagguccga

SEQ ID NO: 1206871 - RNA, 22 nt, Human
gacgcagacacugcgggaagga

SEQ ID NO: 1206872 - RNA, 26 nt, Human
gccuugcucaccccaggcggucucaa

SEQ ID NO: 1206873 - RNA, 21 nt, Human
gcggcggccaaaccuucgggc

SEQ ID NO: 1206874 - RNA, 21 nt, Human
gggaaggaaacaggugucccg

SEQ ID NO: 1206875 - RNA, 25 nt, Human
guggagggggguggucugugugugg

SEQ ID NO: 1206876 - RNA, 20 nt, Human
gugggagccuuccaagaacu

SEQ ID NO: 1206877 - RNA, 19 nt, Human
uaaugaaacuuuaaguaca

SEQ ID NO: 1206878 - RNA, 24 nt, Human
ugagucucuguccuaggagguccg

SEQ ID NO: 1206879 - RNA, 20 nt, Human
uggcuaaggagagucaggug

SEQ ID NO: 1206880 - RNA, 21 nt, Human
uuagcagccccagaacuuucc

SEQ ID NO: 1206881 - RNA, 20 nt, Human
aagagccuugucaccgagga

SEQ ID NO: 1206882 - RNA, 24 nt, Human
caccacggucuucagugcgcugcc

SEQ ID NO: 1206883 - RNA, 21 nt, Human
ccuccccugcugcgcccugga

SEQ ID NO: 1206884 - RNA, 18 nt, Human
ccuggaggcccgagagca

SEQ ID NO: 1206885 - RNA, 23 nt, Human
cgcccuggaggcccgagagcagg

SEQ ID NO: 1206886 - RNA, 22 nt, Human
cuugucaccgaggacccgcucc

SEQ ID NO: 1206887 - RNA, 24 nt, Human
gaaaaugcggggccuucccauagc

SEQ ID NO: 1206888 - RNA, 19 nt, Human
gaccugcagagcuuuggcc

SEQ ID NO: 1206889 - RNA, 23 nt, Human
gagcagggagggcuugggaaaca

SEQ ID NO: 1206890 - RNA, 19 nt, Human
gcccgagagcagggagggc

SEQ ID NO: 1206891 - RNA, 22 nt, Human
ggccacggggacaaaacccucc

SEQ ID NO: 1206892 - RNA, 20 nt, Human
gugcgcugccgucgccucgc

SEQ ID NO: 1206893 - RNA, 22 nt, Human
gugcgcugccgucgccucgcag

SEQ ID NO: 1206894 - RNA, 21 nt, Human
ucgccucgcagagcggccagg

SEQ ID NO: 1206895 - RNA, 21 nt, Human
ugaaaaugcggggccuuccca

SEQ ID NO: 1206896 - RNA, 22 nt, Human
uggaggcccgagagcagggagg

SEQ ID NO: 1206897 - RNA, 21 nt, Human
acagcagcaggcuuucuguac

SEQ ID NO: 1206898 - RNA, 22 nt, Human
agagaggcggcagcaggagagc

SEQ ID NO: 1206899 - RNA, 20 nt, Human
aggcgagugggcgccuggcg

SEQ ID NO: 1206900 - RNA, 18 nt, Human
cacuggacgacugucccu

SEQ ID NO: 1206901 - RNA, 22 nt, Human
cacuggacgacugucccugaca

SEQ ID NO: 1206902 - RNA, 22 nt, Human
cagggcugcgggggcucccagg

SEQ ID NO: 1206903 - RNA, 24 nt, Human
ccccuuccuucuugggauggaggu

SEQ ID NO: 1206904 - RNA, 21 nt, Human
ccucuggcugcugcaggccuc

SEQ ID NO: 1206905 - RNA, 19 nt, Human
cgacugucccugacagagu

SEQ ID NO: 1206906 - RNA, 22 nt, Human
cggcagcaggagagccacagag

SEQ ID NO: 1206907 - RNA, 21 nt, Human
cucccaagaccgcuucacacu

SEQ ID NO: 1206908 - RNA, 20 nt, Human
cucggccgcuaguggggugc

SEQ ID NO: 1206909 - RNA, 21 nt, Human
cugcaggccucccaagaccgc

SEQ ID NO: 1206910 - RNA, 19 nt, Human
cugcgggggcucccagguc

SEQ ID NO: 1206911 - RNA, 21 nt, Human
cugcugggucagccccugugu

SEQ ID NO: 1206912 - RNA, 19 nt, Human
gaccugcugccccuuccuu

SEQ ID NO: 1206913 - RNA, 18 nt, Human
gaggauggaaaauuccgu

SEQ ID NO: 1206914 - RNA, 20 nt, Human
gccacagagagcacgggagc

SEQ ID NO: 1206915 - RNA, 24 nt, Human
gccagcguugccucuugcagacca

SEQ ID NO: 1206916 - RNA, 18 nt, Human
gcugcugcaggccuccca

SEQ ID NO: 1206917 - RNA, 23 nt, Human
ggcgagugggcgccuggcgaggg

SEQ ID NO: 1206918 - RNA, 21 nt, Human
ggcuuucuguacccagagagg

SEQ ID NO: 1206919 - RNA, 19 nt, Human
gggaagugauuccuuccca

SEQ ID NO: 1206920 - RNA, 20 nt, Human
gggaagugauuccuucccaa

SEQ ID NO: 1206921 - RNA, 22 nt, Human
guggggcuuuuucacacuggac

SEQ ID NO: 1206922 - RNA, 18 nt, Human
uacccagagaggcggcag

SEQ ID NO: 1206923 - RNA, 21 nt, Human
uccccuccagacugaagggcu

SEQ ID NO: 1206924 - RNA, 21 nt, Human
ucccugacagaguccaucccc

SEQ ID NO: 1206925 - RNA, 27 nt, Human
uccuccugcugggucagccccuguguc

SEQ ID NO: 1206926 - RNA, 18 nt, Human
ucuccaccucgccuggcc

SEQ ID NO: 1206927 - RNA, 20 nt, Human
ucuugcagaccacucggccg

SEQ ID NO: 1206928 - RNA, 18 nt, Human
ugagagguacaggcgagu

SEQ ID NO: 1206929 - RNA, 18 nt, Human
ugcagcugguggugcggg

SEQ ID NO: 1206930 - RNA, 18 nt, Human
ugcggcagccucuggcuc

SEQ ID NO: 1206931 - RNA, 22 nt, Human
ugcugcaggccucccaagaccg

SEQ ID NO: 1206932 - RNA, 19 nt, Human
uggccgugcagaugugaga

SEQ ID NO: 1206933 - RNA, 18 nt, Human
ugggauggaggugggccu

SEQ ID NO: 1206934 - RNA, 21 nt, Human
uggggugcgcacagcagcagg

SEQ ID NO: 1206935 - RNA, 22 nt, Human
ugguggugcgggcaguggggcu

SEQ ID NO: 1206936 - RNA, 24 nt, Human
ugguggugcgggcaguggggcucc

SEQ ID NO: 1206937 - RNA, 19 nt, Human
uucagaggaggauggaaaa

SEQ ID NO: 1206938 - RNA, 18 nt, Human
aaaaaaaacacaaaggcc

SEQ ID NO: 1206939 - RNA, 24 nt, Human
aaaacaucccaugugaaugaaaca

SEQ ID NO: 1206940 - RNA, 24 nt, Human
aacugaagacgaaagucaagacaa

SEQ ID NO: 1206941 - RNA, 20 nt, Human
aaggauggcaagaaaucacu

SEQ ID NO: 1206942 - RNA, 19 nt, Human
aaugugcccuucuccagag

SEQ ID NO: 1206943 - RNA, 18 nt, Human
acuacaaugcagaacauu

SEQ ID NO: 1206944 - RNA, 19 nt, Human
acugcaguccuucauuggc

SEQ ID NO: 1206945 - RNA, 21 nt, Human
agaaaugagaaaaauguacag

SEQ ID NO: 1206946 - RNA, 20 nt, Human
agacgaaagucaagacaauc

SEQ ID NO: 1206947 - RNA, 21 nt, Human
agccauugcucagcuguagcc

SEQ ID NO: 1206948 - RNA, 19 nt, Human
aggaaccaccaggcaacgu

SEQ ID NO: 1206949 - RNA, 19 nt, Human
auaaaggcuuuuccacugu

SEQ ID NO: 1206950 - RNA, 21 nt, Human
auauaucuauauauauauaca

SEQ ID NO: 1206951 - RNA, 23 nt, Human
auauaucuauauauauauacaca

SEQ ID NO: 1206952 - RNA, 23 nt, Human
aucccaugugaaugaaacaggac

SEQ ID NO: 1206953 - RNA, 23 nt, Human
auuacucugagauucagagaaau

SEQ ID NO: 1206954 - RNA, 25 nt, Human
auuucccuuaugcugcccucuuuca

SEQ ID NO: 1206955 - RNA, 18 nt, Human
auuucuuggcaaccagcc

SEQ ID NO: 1206956 - RNA, 21 nt, Human
caaacacaggaaugaaaaaaa

SEQ ID NO: 1206957 - RNA, 25 nt, Human
caacacagcgcaccccagacucugu

SEQ ID NO: 1206958 - RNA, 22 nt, Human
caacugaagacgaaagucaaga

SEQ ID NO: 1206959 - RNA, 25 nt, Human
caauucaacugaagacgaaagucaa

SEQ ID NO: 1206960 - RNA, 23 nt, Human
cacaaaccacacuuagaucccaa

SEQ ID NO: 1206961 - RNA, 24 nt, Human
cacaggaaugaaaaaaaacacaaa

SEQ ID NO: 1206962 - RNA, 19 nt, Human
caccccagacucugugaca

SEQ ID NO: 1206963 - RNA, 25 nt, Human
cacccuuuaauuucaacacaugacc

SEQ ID NO: 1206964 - RNA, 31 nt, Human
caccuaagucaaagucuucuuuccaagggcc

SEQ ID NO: 1206965 - RNA, 22 nt, Human
cacuggcguagaacacaaggcu

SEQ ID NO: 1206966 - RNA, 24 nt, Human
cagaaucgggcacacaaauacugc

SEQ ID NO: 1206967 - RNA, 21 nt, Human
cagcugauuuccucacccucu

SEQ ID NO: 1206968 - RNA, 26 nt, Human
cagucaaaaaaaaaaaaaaaaauucc

SEQ ID NO: 1206969 - RNA, 22 nt, Human
ccaaagcaccuaagucaaaguc

SEQ ID NO: 1206970 - RNA, 19 nt, Human
ccaacagugaacugaaaag

SEQ ID NO: 1206971 - RNA, 23 nt, Human
ccaaguaauuuucuguccucucu

SEQ ID NO: 1206972 - RNA, 20 nt, Human
ccaccaggcaacgucaacug

SEQ ID NO: 1206973 - RNA, 24 nt, Human
ccaccaggcaacgucaacugauuu

SEQ ID NO: 1206974 - RNA, 24 nt, Human
ccacuccauuacaaauccugacuc

SEQ ID NO: 1206975 - RNA, 22 nt, Human
cccaagaugaugaaaccggcuc

SEQ ID NO: 1206976 - RNA, 22 nt, Human
ccccagccagucacuauuacgc

SEQ ID NO: 1206977 - RNA, 22 nt, Human
ccucccauuacugcccaaaguc

SEQ ID NO: 1206978 - RNA, 18 nt, Human
ccugcugucuuucccagg

SEQ ID NO: 1206979 - RNA, 18 nt, Human
ccuggcacuggcguagaa

SEQ ID NO: 1206980 - RNA, 22 nt, Human
cgcaccccagacucugugacaa

SEQ ID NO: 1206981 - RNA, 21 nt, Human
cuaaaauuaauacaggcaggc

SEQ ID NO: 1206982 - RNA, 20 nt, Human
cucauugaagcacuugguaa

SEQ ID NO: 1206983 - RNA, 18 nt, Human
cucccuucuccaucauuu

SEQ ID NO: 1206984 - RNA, 19 nt, Human
cucccuucuccaucauuuc

SEQ ID NO: 1206985 - RNA, 19 nt, Human
cucugugacaacgcccucc

SEQ ID NO: 1206986 - RNA, 22 nt, Human
cucugugacaacgcccuccugg

SEQ ID NO: 1206987 - RNA, 19 nt, Human
cugugacaacgcccuccug

SEQ ID NO: 1206988 - RNA, 22 nt, Human
cuguguguguguguuuacagaa

SEQ ID NO: 1206989 - RNA, 20 nt, Human
cuuuggaaaccugaaaugcc

SEQ ID NO: 1206990 - RNA, 22 nt, Human
gauuuaaagcuaaucuuaagga

SEQ ID NO: 1206991 - RNA, 23 nt, Human
gcucaauaaaauuaacauggcau

SEQ ID NO: 1206992 - RNA, 22 nt, Human
gcucuuagaaaacuuccuuaaa

SEQ ID NO: 1206993 - RNA, 25 nt, Human
gguuuuguuuuuguugauguuuuca

SEQ ID NO: 1206994 - RNA, 18 nt, Human
guagaacacaaggcucag

SEQ ID NO: 1206995 - RNA, 18 nt, Human
guagccuguggccuaaaa

SEQ ID NO: 1206996 - RNA, 22 nt, Human
uaaagcuaaucuuaaggaaucu

SEQ ID NO: 1206997 - RNA, 24 nt, Human
uaaauaaccauccacaauucuccc

SEQ ID NO: 1206998 - RNA, 20 nt, Human
uacagaaucgggcacacaaa

SEQ ID NO: 1206999 - RNA, 20 nt, Human
uacucugagauucagagaaa

SEQ ID NO: 1207000 - RNA, 19 nt, Human
uacucuguguguguguguu

SEQ ID NO: 1207001 - RNA, 18 nt, Human
uagaacacaaggcucagc

SEQ ID NO: 1207002 - RNA, 23 nt, Human
uauacacauauauacucugugug

SEQ ID NO: 1207003 - RNA, 28 nt, Human
uauacacauauauacucugugugugugg

SEQ ID NO: 1207004 - RNA, 21 nt, Human
uauacaugaaauagccacaaa

SEQ ID NO: 1207005 - RNA, 25 nt, Human
uauauacacauauauacucugugug

SEQ ID NO: 1207006 - RNA, 19 nt, Human
uauauauacacauauauac

SEQ ID NO: 1207007 - RNA, 21 nt, Human
uauauauauacacauauauac

SEQ ID NO: 1207008 - RNA, 21 nt, Human
uauauauauacacauauauac

SEQ ID NO: 1207009 - RNA, 21 nt, Human
uauauauauauacacauaugc

SEQ ID NO: 1207010 - RNA, 19 nt, Human
ucaacccugcucacuauac

SEQ ID NO: 1207011 - RNA, 20 nt, Human
ucaguaaaugagggcaagua

SEQ ID NO: 1207012 - RNA, 28 nt, Human
ucaguaaaugagggcaaguauagagaag

SEQ ID NO: 1207013 - RNA, 31 nt, Human
ucagugccucccauuacugcccaaagucucu

SEQ ID NO: 1207014 - RNA, 22 nt, Human
uccagucaaaaaaaaaaaaaaa

SEQ ID NO: 1207015 - RNA, 28 nt, Human
uccagucaaaaaaaaaaaaaaaaauucc

SEQ ID NO: 1207016 - RNA, 24 nt, Human
ucccacuccauuacaaauccugac

SEQ ID NO: 1207017 - RNA, 22 nt, Human
ucccaugugaaugaaacaggac

SEQ ID NO: 1207018 - RNA, 22 nt, Human
ucccuuucuucuucaauuagaa

SEQ ID NO: 1207019 - RNA, 20 nt, Human
uccucacccucucccaucag

SEQ ID NO: 1207020 - RNA, 23 nt, Human
ucuaacagccuaucacucgcuuu

SEQ ID NO: 1207021 - RNA, 24 nt, Human
ucuccagagaaacacauuucccac

SEQ ID NO: 1207022 - RNA, 27 nt, Human
ucucugcccucccuuucuucuucaauu

SEQ ID NO: 1207023 - RNA, 28 nt, Human
ucuguccucucugcccucccuuucuucu

SEQ ID NO: 1207024 - RNA, 21 nt, Human
ugaaaagggauuuaaagcuaa

SEQ ID NO: 1207025 - RNA, 20 nt, Human
ugaaacaaugaccugacuac

SEQ ID NO: 1207026 - RNA, 21 nt, Human
ugaaauagccacaaaauguag

SEQ ID NO: 1207027 - RNA, 21 nt, Human
ugaagacgaaagucaagacaa

SEQ ID NO: 1207028 - RNA, 18 nt, Human
ugaagcacuugguaaauc

SEQ ID NO: 1207029 - RNA, 19 nt, Human
ugaauuaguaaacccaagu

SEQ ID NO: 1207030 - RNA, 26 nt, Human
ugacucaaaacuaaaauuaauacagg

SEQ ID NO: 1207031 - RNA, 18 nt, Human
ugagaaaaauguacagag

SEQ ID NO: 1207032 - RNA, 19 nt, Human
ugaggacuacgcaaggaug

SEQ ID NO: 1207033 - RNA, 24 nt, Human
ugcccuagugacaaauauauauuu

SEQ ID NO: 1207034 - RNA, 21 nt, Human
uggggauagucacaaaccaca

SEQ ID NO: 1207035 - RNA, 23 nt, Human
ugucaaagucaccagauuucaga

SEQ ID NO: 1207036 - RNA, 21 nt, Human
uguguuuacagaaucgggcac

SEQ ID NO: 1207037 - RNA, 23 nt, Human
uuacugcccaaagucuccuagcc

SEQ ID NO: 1207038 - RNA, 25 nt, Human
uuccagucaaaaaaaaaaaaaaaaa

SEQ ID NO: 1207039 - RNA, 19 nt, Human
uucuucaauuagaaaugag

SEQ ID NO: 1207040 - RNA, 23 nt, Human
uucuuuggaaaccugaaaugccc

SEQ ID NO: 1207041 - RNA, 20 nt, Human
uugaaacaaugaccugacuu

SEQ ID NO: 1207042 - RNA, 20 nt, Human
uuucaccaauucaacugaag

SEQ ID NO: 1207043 - RNA, 18 nt, Human
uuugcaaacccucagugc

SEQ ID NO: 1207044 - RNA, 22 nt, Human
agagaguaaguguggagaacag

SEQ ID NO: 1207045 - RNA, 18 nt, Human
cuugcugucuucugcugg

SEQ ID NO: 1207046 - RNA, 23 nt, Human
cuugcugucuucugcuggcuccu

SEQ ID NO: 1207047 - RNA, 24 nt, Human
gcuugcugucuucugcuggcuccu

SEQ ID NO: 1207048 - RNA, 22 nt, Human
uaccagcucggagauaagggag

SEQ ID NO: 1207049 - RNA, 24 nt, Human
caacaccacaggauucagaaacau

SEQ ID NO: 1207050 - RNA, 23 nt, Human
cugagcaaccaccacagcaacac

SEQ ID NO: 1207051 - RNA, 19 nt, Human
cugcgugucugagcaacca

SEQ ID NO: 1207052 - RNA, 24 nt, Human
uaaggacugcgacuuucuuccuuc

SEQ ID NO: 1207053 - RNA, 18 nt, Human
uucuucagauuuguuuca

SEQ ID NO: 1207054 - RNA, 24 nt, Human
uugauaaggacugcgacuuucuuc

SEQ ID NO: 1207055 - RNA, 18 nt, Human
augaagcuguggaaacuc

SEQ ID NO: 1207056 - RNA, 21 nt, Human
uggaaacucugagauaugaac

SEQ ID NO: 1207057 - RNA, 23 nt, Human
agaguccagcuuugagguucacc

SEQ ID NO: 1207058 - RNA, 19 nt, Human
aggcugugaggaugggccu

SEQ ID NO: 1207059 - RNA, 22 nt, Human
agggggccaguuuuuggugaga

SEQ ID NO: 1207060 - RNA, 23 nt, Human
agguacuuuccaaaacgucuggc

SEQ ID NO: 1207061 - RNA, 19 nt, Human
aguuggaggcgagggggcc

SEQ ID NO: 1207062 - RNA, 20 nt, Human
cagcacaaaucggaguugga

SEQ ID NO: 1207063 - RNA, 18 nt, Human
cagcacccagcacaaauc

SEQ ID NO: 1207064 - RNA, 21 nt, Human
ccgcuggagucgauucuuucc

SEQ ID NO: 1207065 - RNA, 24 nt, Human
ccgcuggagucgauucuuuccugc

SEQ ID NO: 1207066 - RNA, 22 nt, Human
cuggcuguaacucgccuccuuc

SEQ ID NO: 1207067 - RNA, 20 nt, Human
gccugacggcgccgcuggag

SEQ ID NO: 1207068 - RNA, 21 nt, Human
ucgccgcaggagucauuccuu

SEQ ID NO: 1207069 - RNA, 23 nt, Human
ugacaucuaagcugcagcuuccu

SEQ ID NO: 1207070 - RNA, 19 nt, Human
ugagaacccagaguccagc

SEQ ID NO: 1207071 - RNA, 20 nt, Human
uggaggcgagggggccaguu

SEQ ID NO: 1207072 - RNA, 23 nt, Human
uucguaaggacacagaugguugg

SEQ ID NO: 1207073 - RNA, 18 nt, Human
aagcuuugcuggagagag

SEQ ID NO: 1207074 - RNA, 25 nt, Human
caacaucacugaacuuagaggcaau

SEQ ID NO: 1207075 - RNA, 20 nt, Human
ggaagcuuugcuggagagag

SEQ ID NO: 1207076 - RNA, 19 nt, Human
ggaaugggcuucuggcucu

SEQ ID NO: 1207077 - RNA, 21 nt, Human
ggcaacaucacugaacuuaga

SEQ ID NO: 1207078 - RNA, 20 nt, Human
ggcgggaaugggcuucuggc

SEQ ID NO: 1207079 - RNA, 24 nt, Human
gggcgggaaugggcuucuggcucu

SEQ ID NO: 1207080 - RNA, 18 nt, Human
uacagccuccuaagguga

SEQ ID NO: 1207081 - RNA, 26 nt, Human
ucaauggugcagcucugaccuuccuu

SEQ ID NO: 1207082 - RNA, 18 nt, Human
ucccauaagggcaccgug

SEQ ID NO: 1207083 - RNA, 24 nt, Human
ugaugggcacugugauugucugcu

SEQ ID NO: 1207084 - RNA, 18 nt, Human
ugcuggagagaguguaug

SEQ ID NO: 1207085 - RNA, 22 nt, Human
uggaaagacuauacugugaggg

SEQ ID NO: 1207086 - RNA, 19 nt, Human
uggcaacaucacugaacuu

SEQ ID NO: 1207087 - RNA, 22 nt, Human
ugugaggguguuugaugggcac

SEQ ID NO: 1207088 - RNA, 20 nt, Human
uucaauggcaacaucacuga

SEQ ID NO: 1207089 - RNA, 21 nt, Human
uuccugguugggucccauaag

SEQ ID NO: 1207090 - RNA, 20 nt, Human
uugcuggagagaguguaugu

SEQ ID NO: 1207091 - RNA, 22 nt, Human
aaaaagcagaauuucagggaaa

SEQ ID NO: 1207092 - RNA, 21 nt, Human
aaaagaagcagaagcaaagaa

SEQ ID NO: 1207093 - RNA, 23 nt, Human
aaacaacagaaauacccuggggc

SEQ ID NO: 1207094 - RNA, 23 nt, Human
aaacaacauuuaacauguacuga

SEQ ID NO: 1207095 - RNA, 21 nt, Human
aaagcagugcucacaucaugc

SEQ ID NO: 1207096 - RNA, 24 nt, Human
aaagccccugaguagcaucuguuu

SEQ ID NO: 1207097 - RNA, 24 nt, Human
aaaggguaaugggagagucagaac

SEQ ID NO: 1207098 - RNA, 19 nt, Human
aaaugccuuuaucccagca

SEQ ID NO: 1207099 - RNA, 21 nt, Human
aagaugaccucuaagcagcug

SEQ ID NO: 1207100 - RNA, 22 nt, Human
aaucacauuacagcuuggugag

SEQ ID NO: 1207101 - RNA, 18 nt, Human
acaacagaaauacccugg

SEQ ID NO: 1207102 - RNA, 22 nt, Human
acacacauuaacauuuuaaaau

SEQ ID NO: 1207103 - RNA, 22 nt, Human
acauaagugugccuugugccua

SEQ ID NO: 1207104 - RNA, 24 nt, Human
accagaacacagaagcacuugcug

SEQ ID NO: 1207105 - RNA, 22 nt, Human
accucaaugacgugaaacauca

SEQ ID NO: 1207106 - RNA, 21 nt, Human
acuaauucuuucuuuuucucu

SEQ ID NO: 1207107 - RNA, 18 nt, Human
acugaucuuuauucaccg

SEQ ID NO: 1207108 - RNA, 19 nt, Human
acuuuuaaaaaugcagaag

SEQ ID NO: 1207109 - RNA, 20 nt, Human
agaaugacagacguuaagug

SEQ ID NO: 1207110 - RNA, 18 nt, Human
agaauguccuucucuucu

SEQ ID NO: 1207111 - RNA, 24 nt, Human
agagauggcacagaugugaccucc

SEQ ID NO: 1207112 - RNA, 25 nt, Human
agagcuaagauucaaacucagacaa

SEQ ID NO: 1207113 - RNA, 24 nt, Human
agcaacauucuccaggaaucuaua

SEQ ID NO: 1207114 - RNA, 23 nt, Human
agcagcauguuugaagguggccu

SEQ ID NO: 1207115 - RNA, 24 nt, Human
agcuaccauucgcuacacuaaacu

SEQ ID NO: 1207116 - RNA, 18 nt, Human
agcuuggugagagaacca

SEQ ID NO: 1207117 - RNA, 23 nt, Human
aggagacguugggaaccugagca

SEQ ID NO: 1207118 - RNA, 20 nt, Human
aggauuuccagaauguuggc

SEQ ID NO: 1207119 - RNA, 27 nt, Human
aggcuccagaaauuaaaauaaugagcu

SEQ ID NO: 1207120 - RNA, 20 nt, Human
agugaauuucugacuuaaaa

SEQ ID NO: 1207121 - RNA, 18 nt, Human
auaaaauguauaugccug

SEQ ID NO: 1207122 - RNA, 19 nt, Human
auaaaaugugcauugcacc

SEQ ID NO: 1207123 - RNA, 18 nt, Human
aucaccacagagcccuag

SEQ ID NO: 1207124 - RNA, 26 nt, Human
auggagcuggagagcaacauucucca

SEQ ID NO: 1207125 - RNA, 22 nt, Human
auuccacuaacuuccagugacc

SEQ ID NO: 1207126 - RNA, 20 nt, Human
auuucauuggguggggaugg

SEQ ID NO: 1207127 - RNA, 20 nt, Human
caaaauccuuaaaaucuccc

SEQ ID NO: 1207128 - RNA, 18 nt, Human
caaauuugggaaacugac

SEQ ID NO: 1207129 - RNA, 33 nt, Human
caacauaaaaaucaucuaagaccuaucuccuuu

SEQ ID NO: 1207130 - RNA, 23 nt, Human
caacuaaaagcuaacagacaaac

SEQ ID NO: 1207131 - RNA, 20 nt, Human
caacuugguggggucaacuc

SEQ ID NO: 1207132 - RNA, 22 nt, Human
caagaacuugauauuucacagg

SEQ ID NO: 1207133 - RNA, 21 nt, Human
cacauuugaauagggagguuu

SEQ ID NO: 1207134 - RNA, 24 nt, Human
caccucaaugacgugaaacaucac

SEQ ID NO: 1207135 - RNA, 23 nt, Human
cacugcaauuauuuauacacuuu

SEQ ID NO: 1207136 - RNA, 21 nt, Human
cagaaugacagacguuaagug

SEQ ID NO: 1207137 - RNA, 23 nt, Human
cagacauaaaagaauguagauga

SEQ ID NO: 1207138 - RNA, 23 nt, Human
cagcuguuuaauucucaccaaua

SEQ ID NO: 1207139 - RNA, 25 nt, Human
cauuacaugaaguguguaugucuuu

SEQ ID NO: 1207140 - RNA, 23 nt, Human
cauuggguggggauggagcugga

SEQ ID NO: 1207141 - RNA, 21 nt, Human
cauuuaacauguacugaacac

SEQ ID NO: 1207142 - RNA, 24 nt, Human
ccagaauguuggccugcacaucuu

SEQ ID NO: 1207143 - RNA, 19 nt, Human
ccagugaccuggaguucug

SEQ ID NO: 1207144 - RNA, 23 nt, Human
ccauucuuuccauuuugagaacc

SEQ ID NO: 1207145 - RNA, 21 nt, Human
ccugagcagcucuaauccugg

SEQ ID NO: 1207146 - RNA, 21 nt, Human
ccugcaauugaacacagcuac

SEQ ID NO: 1207147 - RNA, 18 nt, Human
cuaaagaaaaaauuaaaa

SEQ ID NO: 1207148 - RNA, 20 nt, Human
cuaaauaaauagauaaaaug

SEQ ID NO: 1207149 - RNA, 22 nt, Human
cuaaauuaucuguggcaacaac

SEQ ID NO: 1207150 - RNA, 20 nt, Human
cuaauucuuucuuuuucucu

SEQ ID NO: 1207151 - RNA, 22 nt, Human
cuaccauucgcuacacuaaacu

SEQ ID NO: 1207152 - RNA, 18 nt, Human
cucacugcccaguuuugg

SEQ ID NO: 1207153 - RNA, 19 nt, Human
cugaacacuacaugcuaug

SEQ ID NO: 1207154 - RNA, 23 nt, Human
cugacuaaaaaagcagaauuuca

SEQ ID NO: 1207155 - RNA, 23 nt, Human
cugaugcuuaauguguaaacauc

SEQ ID NO: 1207156 - RNA, 19 nt, Human
cuugaaguaaagaauucaa

SEQ ID NO: 1207157 - RNA, 28 nt, Human
cuuuuucucucccuccuccuuuuuuuuc

SEQ ID NO: 1207158 - RNA, 20 nt, Human
gaaauacccuggggccaugg

SEQ ID NO: 1207159 - RNA, 18 nt, Human
gaaaugcacccggucaga

SEQ ID NO: 1207160 - RNA, 20 nt, Human
gaagcacuugcugcgucugg

SEQ ID NO: 1207161 - RNA, 24 nt, Human
gacaauucugcucuucaaagauaa

SEQ ID NO: 1207162 - RNA, 19 nt, Human
gagaacccgauguggcagg

SEQ ID NO: 1207163 - RNA, 18 nt, Human
gagcaacauucuccagga

SEQ ID NO: 1207164 - RNA, 23 nt, Human
gagcugcaaauagcuaccauucg

SEQ ID NO: 1207165 - RNA, 20 nt, Human
gaguagaaaaaaaaaucaca

SEQ ID NO: 1207166 - RNA, 20 nt, Human
gauggcacagaugugaccuc

SEQ ID NO: 1207167 - RNA, 18 nt, Human
gcagagauggcacagaug

SEQ ID NO: 1207168 - RNA, 21 nt, Human
gcucuccuuauuuuuuguuuc

SEQ ID NO: 1207169 - RNA, 20 nt, Human
ggcaggagacguugggaacc

SEQ ID NO: 1207170 - RNA, 21 nt, Human
ggcccagauauagccucagag

SEQ ID NO: 1207171 - RNA, 22 nt, Human
ggcuggugguaaaguugaccug

SEQ ID NO: 1207172 - RNA, 19 nt, Human
gucaccuuuuuauuuuuuu

SEQ ID NO: 1207173 - RNA, 24 nt, Human
gucccuuccacugauuucuaguaa

SEQ ID NO: 1207174 - RNA, 18 nt, Human
guggggauggagcuggag

SEQ ID NO: 1207175 - RNA, 18 nt, Human
guugcuaccagaacacag

SEQ ID NO: 1207176 - RNA, 20 nt, Human
guuguugaacucacugccca

SEQ ID NO: 1207177 - RNA, 25 nt, Human
uaaaaaagcagaauuucagggaaac

SEQ ID NO: 1207178 - RNA, 23 nt, Human
uaaaaugugcauugcaccaugac

SEQ ID NO: 1207179 - RNA, 23 nt, Human
uaaaguauaacaauaacaaaaaa

SEQ ID NO: 1207180 - RNA, 18 nt, Human
uaacagaaugacagacgu

SEQ ID NO: 1207181 - RNA, 20 nt, Human
uaaucuauauacacauuccu

SEQ ID NO: 1207182 - RNA, 20 nt, Human
uaaugagcuuccuacaucag

SEQ ID NO: 1207183 - RNA, 21 nt, Human
uacaauacucauaaccauaaa

SEQ ID NO: 1207184 - RNA, 19 nt, Human
uacugagcagggaaagcuc

SEQ ID NO: 1207185 - RNA, 21 nt, Human
uagaagcaucucuggguaacu

SEQ ID NO: 1207186 - RNA, 18 nt, Human
uagggagacuugcaggua

SEQ ID NO: 1207187 - RNA, 19 nt, Human
uaucugauucaauugugcu

SEQ ID NO: 1207188 - RNA, 18 nt, Human
uauggaaaaacaaaacca

SEQ ID NO: 1207189 - RNA, 21 nt, Human
uauuucacaggaaugggguaa

SEQ ID NO: 1207190 - RNA, 21 nt, Human
ucaaacucagacaaucuagcu

SEQ ID NO: 1207191 - RNA, 24 nt, Human
ucaaugcuaagcccaaugucuagc

SEQ ID NO: 1207192 - RNA, 23 nt, Human
ucagaguuuucaaucuagcugac

SEQ ID NO: 1207193 - RNA, 23 nt, Human
ucagucaaagucaauguuuucuu

SEQ ID NO: 1207194 - RNA, 19 nt, Human
ucaguguuguugguagguc

SEQ ID NO: 1207195 - RNA, 21 nt, Human
uccagguuccaaaccaaaccc

SEQ ID NO: 1207196 - RNA, 18 nt, Human
uccucuggucucucucug

SEQ ID NO: 1207197 - RNA, 20 nt, Human
ucgucuuccuggagagccuc

SEQ ID NO: 1207198 - RNA, 19 nt, Human
ucucccuccuccuuuuucu

SEQ ID NO: 1207199 - RNA, 25 nt, Human
ucucuacaaccacauucuuuggcug

SEQ ID NO: 1207200 - RNA, 21 nt, Human
ucugaccacaccagggaaagg

SEQ ID NO: 1207201 - RNA, 19 nt, Human
ugaaagacagacauaaaag

SEQ ID NO: 1207202 - RNA, 21 nt, Human
ugaaagacagacauaaaagaa

SEQ ID NO: 1207203 - RNA, 18 nt, Human
ugaauggaacuaaauaaa

SEQ ID NO: 1207204 - RNA, 21 nt, Human
ugaauugguugcaucugcuuu

SEQ ID NO: 1207205 - RNA, 20 nt, Human
ugacaaguaaauaaaaauua

SEQ ID NO: 1207206 - RNA, 18 nt, Human
ugacagacguuaagugug

SEQ ID NO: 1207207 - RNA, 23 nt, Human
ugacagagaaaagccaagaacuu

SEQ ID NO: 1207208 - RNA, 22 nt, Human
ugaccuggaguucugaccacac

SEQ ID NO: 1207209 - RNA, 21 nt, Human
ugacuccagcuccucuggucu

SEQ ID NO: 1207210 - RNA, 18 nt, Human
ugacuuggcucuccuuau

SEQ ID NO: 1207211 - RNA, 19 nt, Human
ugagaaaaucauuuccugg

SEQ ID NO: 1207212 - RNA, 27 nt, Human
ugagaaaaucauuuccuggaggcacuu

SEQ ID NO: 1207213 - RNA, 20 nt, Human
ugagaacccgauguggcagg

SEQ ID NO: 1207214 - RNA, 20 nt, Human
ugagcagggaaagcucagca

SEQ ID NO: 1207215 - RNA, 23 nt, Human
ugauugauuugcagagauggcac

SEQ ID NO: 1207216 - RNA, 21 nt, Human
ugauuuggcauaaaccauucu

SEQ ID NO: 1207217 - RNA, 19 nt, Human
ugcagaaguccagguucca

SEQ ID NO: 1207218 - RNA, 22 nt, Human
ugccacugucuugugggaacgg

SEQ ID NO: 1207219 - RNA, 21 nt, Human
ugccugggagguguuuuucuu

SEQ ID NO: 1207220 - RNA, 23 nt, Human
uggaagggagaugaauuugguau

SEQ ID NO: 1207221 - RNA, 19 nt, Human
uggccaugcccauccggca

SEQ ID NO: 1207222 - RNA, 19 nt, Human
ugugaaagcauacaucuug

SEQ ID NO: 1207223 - RNA, 22 nt, Human
uguguaugucuuucauaugaua

SEQ ID NO: 1207224 - RNA, 26 nt, Human
uguuccgcacauguaccccagaacuu

SEQ ID NO: 1207225 - RNA, 22 nt, Human
uguuuugguaaaauuuugugac

SEQ ID NO: 1207226 - RNA, 19 nt, Human
uuauggguccuaacaucac

SEQ ID NO: 1207227 - RNA, 23 nt, Human
uucaaauuuaccuauguguucuc

SEQ ID NO: 1207228 - RNA, 21 nt, Human
uucauaaagccccugaguagc

SEQ ID NO: 1207229 - RNA, 21 nt, Human
uuccagugaccuggaguucug

SEQ ID NO: 1207230 - RNA, 23 nt, Human
uucgucuuccuggagagccucca

SEQ ID NO: 1207231 - RNA, 24 nt, Human
uucugaccacaccagggaaagggu

SEQ ID NO: 1207232 - RNA, 18 nt, Human
uucuuucuuuuucucucc

SEQ ID NO: 1207233 - RNA, 18 nt, Human
uugaaguaaagaauucaa

SEQ ID NO: 1207234 - RNA, 20 nt, Human
uugacaccacagugcuaaaa

SEQ ID NO: 1207235 - RNA, 23 nt, Human
uugcaucugcuuuauuccuucuu

SEQ ID NO: 1207236 - RNA, 22 nt, Human
uugcuuccucugagaaacagcu

SEQ ID NO: 1207237 - RNA, 21 nt, Human
uugcuuggugccuuuaaugau

SEQ ID NO: 1207238 - RNA, 20 nt, Human
uuggcccucaaauuucagaa

SEQ ID NO: 1207239 - RNA, 20 nt, Human
uugugccuagucuucuuuuu

SEQ ID NO: 1207240 - RNA, 22 nt, Human
uuuaaacaggugcccaguaaca

SEQ ID NO: 1207241 - RNA, 21 nt, Human
uuuagagcuaauuguggaaaa

SEQ ID NO: 1207242 - RNA, 22 nt, Human
uuucagggaaacaacagaaaua

SEQ ID NO: 1207243 - RNA, 23 nt, Human
uuucuuuuucucucccuccuccu

SEQ ID NO: 1207244 - RNA, 21 nt, Human
uuugacaccacagugcuaaaa

SEQ ID NO: 1207245 - RNA, 18 nt, Human
uuugcagagauggcacag

SEQ ID NO: 1207246 - RNA, 22 nt, Human
uuuguugggucacaaaauuuaa

SEQ ID NO: 1207247 - RNA, 19 nt, Human
uuuuuuguuucuaauguuu

SEQ ID NO: 1207248 - RNA, 20 nt, Human
caauuuguucuuccacgaag

SEQ ID NO: 1207249 - RNA, 24 nt, Human
caugguaaccccuuuuuaaggcaa

SEQ ID NO: 1207250 - RNA, 21 nt, Human
ugcaugguaaccccuuuuuaa

SEQ ID NO: 1207251 - RNA, 21 nt, Human
acuucaucauccaagcaaaca

SEQ ID NO: 1207252 - RNA, 24 nt, Human
uucaucauccaagcaaacaguuga

SEQ ID NO: 1207253 - RNA, 22 nt, Human
aaaaaaaugggaagaggucaaa

SEQ ID NO: 1207254 - RNA, 21 nt, Human
agaaugaguuuuauaugaguu

SEQ ID NO: 1207255 - RNA, 18 nt, Human
agacauuaaaaacaaacu

SEQ ID NO: 1207256 - RNA, 22 nt, Human
agagaacagggcagcguuucac

SEQ ID NO: 1207257 - RNA, 21 nt, Human
aggaaagagaucaguauuuca

SEQ ID NO: 1207258 - RNA, 24 nt, Human
auagaucagagaacccagguuucu

SEQ ID NO: 1207259 - RNA, 23 nt, Human
caaaaaaaugggaagaggucaaa

SEQ ID NO: 1207260 - RNA, 19 nt, Human
cagagccuuauugcuuucc

SEQ ID NO: 1207261 - RNA, 19 nt, Human
cauauuuuuaaagcuaaga

SEQ ID NO: 1207262 - RNA, 20 nt, Human
ccacuugucauuuaugagac

SEQ ID NO: 1207263 - RNA, 22 nt, Human
ccuucaguacucuaaggacaga

SEQ ID NO: 1207264 - RNA, 18 nt, Human
ccuugcucuaguucugug

SEQ ID NO: 1207265 - RNA, 22 nt, Human
ggucuuaauucuauacauaauu

SEQ ID NO: 1207266 - RNA, 20 nt, Human
gucaaauuuccuccacugau

SEQ ID NO: 1207267 - RNA, 20 nt, Human
uaccaugagagaaaugaagc

SEQ ID NO: 1207268 - RNA, 18 nt, Human
uacuuuuucuaauuacac

SEQ ID NO: 1207269 - RNA, 22 nt, Human
uagcccaccugaauccccaagu

SEQ ID NO: 1207270 - RNA, 22 nt, Human
uauaacaauggucaagcagaga

SEQ ID NO: 1207271 - RNA, 19 nt, Human
uauguaaauucaaaacaca

SEQ ID NO: 1207272 - RNA, 22 nt, Human
ucaaaacacauaaaagacuuca

SEQ ID NO: 1207273 - RNA, 22 nt, Human
ucagagcccuauucuccuccgu

SEQ ID NO: 1207274 - RNA, 20 nt, Human
ugaagagucacaucuuuaga

SEQ ID NO: 1207275 - RNA, 21 nt, Human
ugagagaaaugaagcuagaua

SEQ ID NO: 1207276 - RNA, 22 nt, Human
ugggaagaggucaaauuuccuc

SEQ ID NO: 1207277 - RNA, 20 nt, Human
ugguauaauaccuugaugaa

SEQ ID NO: 1207278 - RNA, 24 nt, Human
ugugaggaaagagaucaguauuuc

SEQ ID NO: 1207279 - RNA, 20 nt, Human
uuagaacauuagaauauugu

SEQ ID NO: 1207280 - RNA, 21 nt, Human
uucagugauuccauuucucag

SEQ ID NO: 1207281 - RNA, 22 nt, Human
uuuaaagcuaagagaauuauaa

SEQ ID NO: 1207282 - RNA, 22 nt, Human
uuuuucagugauuccauuucuc

SEQ ID NO: 1207283 - RNA, 20 nt, Human
aaguaggggagaggucuggu

SEQ ID NO: 1207284 - RNA, 22 nt, Human
acuccagagggugagaaaaggg

SEQ ID NO: 1207285 - RNA, 21 nt, Human
auggagaggagggaaugcgau

SEQ ID NO: 1207286 - RNA, 20 nt, Human
cacuggaggagagcugccuu

SEQ ID NO: 1207287 - RNA, 19 nt, Human
cagcagggaggguggcugc

SEQ ID NO: 1207288 - RNA, 23 nt, Human
cagcagggaggguggcugccgug

SEQ ID NO: 1207289 - RNA, 21 nt, Human
ccugguggcagccguaggauc

SEQ ID NO: 1207290 - RNA, 22 nt, Human
cuagagaaugucagggaaaggg

SEQ ID NO: 1207291 - RNA, 21 nt, Human
cucggcaucaagauggagagg

SEQ ID NO: 1207292 - RNA, 20 nt, Human
cugguaugggguccucuugg

SEQ ID NO: 1207293 - RNA, 25 nt, Human
cugguggcagccguaggaucuccuu

SEQ ID NO: 1207294 - RNA, 21 nt, Human
gacacagcagggaggguggcu

SEQ ID NO: 1207295 - RNA, 18 nt, Human
uaggaucuccuuccaagg

SEQ ID NO: 1207296 - RNA, 21 nt, Human
uccuagagaaugucagggaaa

SEQ ID NO: 1207297 - RNA, 21 nt, Human
uggagaggagggaaugcgaug

SEQ ID NO: 1207298 - RNA, 18 nt, Human
ugggaacuccagagggug

SEQ ID NO: 1207299 - RNA, 22 nt, Human
ugguaugggguccucuuggggc

SEQ ID NO: 1207300 - RNA, 23 nt, Human
ugucagggaaagggauguggggu

SEQ ID NO: 1207301 - RNA, 19 nt, Human
uuccuguggacacauuuaa

SEQ ID NO: 1207302 - RNA, 20 nt, Human
uucuugguccgggaagacuc

SEQ ID NO: 1207303 - RNA, 27 nt, Human
aagccugacgcugggcccaggucagaa

SEQ ID NO: 1207304 - RNA, 23 nt, Human
agaaacagaggugcgacagucac

SEQ ID NO: 1207305 - RNA, 23 nt, Human
agccacaagcagccuacaagccu

SEQ ID NO: 1207306 - RNA, 21 nt, Human
aggcacuggggcugggcagcu

SEQ ID NO: 1207307 - RNA, 22 nt, Human
cacgaccagcagugaggagucc

SEQ ID NO: 1207308 - RNA, 22 nt, Human
cagaaugaaugcugagugcuug

SEQ ID NO: 1207309 - RNA, 21 nt, Human
cagcagugaggaguccacaga

SEQ ID NO: 1207310 - RNA, 22 nt, Human
cagccacaagcagccuacaagc

SEQ ID NO: 1207311 - RNA, 23 nt, Human
caggccggggcgaagcaccacga

SEQ ID NO: 1207312 - RNA, 23 nt, Human
caggucagaaacagaggugcgac

SEQ ID NO: 1207313 - RNA, 22 nt, Human
ccagcagugaggaguccacaga

SEQ ID NO: 1207314 - RNA, 23 nt, Human
ccaggccggggcgaagcaccacg

SEQ ID NO: 1207315 - RNA, 18 nt, Human
ccuacaagccugacgcug

SEQ ID NO: 1207316 - RNA, 23 nt, Human
cugaccucuggaccaggcacugg

SEQ ID NO: 1207317 - RNA, 18 nt, Human
cugcccagcaucccugga

SEQ ID NO: 1207318 - RNA, 19 nt, Human
gaacaggagcacaaacaau

SEQ ID NO: 1207319 - RNA, 19 nt, Human
gagaagagcagccacaagc

SEQ ID NO: 1207320 - RNA, 22 nt, Human
gcacuggggcugggcagcugag

SEQ ID NO: 1207321 - RNA, 19 nt, Human
ggggcgaagcaccacgacc

SEQ ID NO: 1207322 - RNA, 23 nt, Human
gugugaaggcaaagggguccaca

SEQ ID NO: 1207323 - RNA, 18 nt, Human
uccacagaugacgaggac

SEQ ID NO: 1207324 - RNA, 21 nt, Human
ucccagugcauagcccuccuc

SEQ ID NO: 1207325 - RNA, 26 nt, Human
uccuccacagcugcugguggacugac

SEQ ID NO: 1207326 - RNA, 22 nt, Human
ucuggaccaggcacuggggcug

SEQ ID NO: 1207327 - RNA, 20 nt, Human
ugaccucuggaccaggcacu

SEQ ID NO: 1207328 - RNA, 19 nt, Human
ugagaagagcagccacaag

SEQ ID NO: 1207329 - RNA, 20 nt, Human
ugagaagagcagccacaagc

SEQ ID NO: 1207330 - RNA, 18 nt, Human
ugagcguuuggcaccugc

SEQ ID NO: 1207331 - RNA, 19 nt, Human
ugaggaguccacagauggg

SEQ ID NO: 1207332 - RNA, 21 nt, Human
ugaggaguccacagaugggug

SEQ ID NO: 1207333 - RNA, 18 nt, Human
ugcauagcccuccuccac

SEQ ID NO: 1207334 - RNA, 22 nt, Human
ugcccagcaucccuggaguuac

SEQ ID NO: 1207335 - RNA, 19 nt, Human
acaacguugaaaacagucc

SEQ ID NO: 1207336 - RNA, 18 nt, Human
agccaaacccuucuucug

SEQ ID NO: 1207337 - RNA, 20 nt, Human
cguugaaaacaguccaggaa

SEQ ID NO: 1207338 - RNA, 22 nt, Human
gagaauaaagacaacguugaaa

SEQ ID NO: 1207339 - RNA, 19 nt, Human
gagccaaacccuucuucug

SEQ ID NO: 1207340 - RNA, 18 nt, Human
gcuucugagccaaacccu

SEQ ID NO: 1207341 - RNA, 23 nt, Human
ucuucuguuucgcagaugagaau

SEQ ID NO: 1207342 - RNA, 18 nt, Human
ugaacucuugacagguag

SEQ ID NO: 1207343 - RNA, 19 nt, Human
ugacagggagcucagagau

SEQ ID NO: 1207344 - RNA, 18 nt, Human
auagagaugcuacugggg

SEQ ID NO: 1207345 - RNA, 19 nt, Human
caagccuuuacuucccacc

SEQ ID NO: 1207346 - RNA, 20 nt, Human
ccaccaaugcuuccagaagu

SEQ ID NO: 1207347 - RNA, 23 nt, Human
gccaagccuuuacuucccaccac

SEQ ID NO: 1207348 - RNA, 19 nt, Human
ucccagagccaagccuuua

SEQ ID NO: 1207349 - RNA, 21 nt, Human
ugauagagaugcuacuggggg

SEQ ID NO: 1207350 - RNA, 19 nt, Human
uuccagaaguuggugauag

SEQ ID NO: 1207351 - RNA, 20 nt, Human
aaaugcugguauugacuaag

SEQ ID NO: 1207352 - RNA, 23 nt, Human
aagacuccuccacauuccuuuga

SEQ ID NO: 1207353 - RNA, 26 nt, Human
aagugguaaauauaaauaaaggcuuu

SEQ ID NO: 1207354 - RNA, 25 nt, Human
aaucuuauuacuucuuacauaauuc

SEQ ID NO: 1207355 - RNA, 20 nt, Human
accaugugaauucugaucua

SEQ ID NO: 1207356 - RNA, 24 nt, Human
agaauuuucgugaugugauuucuc

SEQ ID NO: 1207357 - RNA, 19 nt, Human
agaguuuucaucccugucu

SEQ ID NO: 1207358 - RNA, 19 nt, Human
auucaugucauugagaguu

SEQ ID NO: 1207359 - RNA, 23 nt, Human
cacaccauccaagcacuaagaag

SEQ ID NO: 1207360 - RNA, 19 nt, Human
cagcaaaggcauuuucaca

SEQ ID NO: 1207361 - RNA, 21 nt, Human
cauugagaguucuacaccaug

SEQ ID NO: 1207362 - RNA, 21 nt, Human
cauuucaacccacauauuuua

SEQ ID NO: 1207363 - RNA, 21 nt, Human
cccccagcuauacaucucauc

SEQ ID NO: 1207364 - RNA, 24 nt, Human
ccuagagucugaaguuugugccau

SEQ ID NO: 1207365 - RNA, 22 nt, Human
ccuccauucaugucauugagag

SEQ ID NO: 1207366 - RNA, 21 nt, Human
ccugucaagauaguuuucuca

SEQ ID NO: 1207367 - RNA, 18 nt, Human
cuguaguauguuuguccu

SEQ ID NO: 1207368 - RNA, 21 nt, Human
gaagacuccuccacauuccuu

SEQ ID NO: 1207369 - RNA, 19 nt, Human
ggugcuuagcugaaugaga

SEQ ID NO: 1207370 - RNA, 22 nt, Human
uacccuccauucaugucauuga

SEQ ID NO: 1207371 - RNA, 25 nt, Human
uaccuuauaaugaauuuucuugcac

SEQ ID NO: 1207372 - RNA, 19 nt, Human
uagcucagccaccaaaugu

SEQ ID NO: 1207373 - RNA, 22 nt, Human
uagcugaaugagagugcacaga

SEQ ID NO: 1207374 - RNA, 21 nt, Human
uaguauguuuguccuuggugu

SEQ ID NO: 1207375 - RNA, 24 nt, Human
uaugguugcuugccuguggauuuu

SEQ ID NO: 1207376 - RNA, 21 nt, Human
ucuauaguuucauucucucac

SEQ ID NO: 1207377 - RNA, 23 nt, Human
ucucacguuguauauggucagcc

SEQ ID NO: 1207378 - RNA, 20 nt, Human
ucucucuaccuugaauucau

SEQ ID NO: 1207379 - RNA, 22 nt, Human
ugaauaacuucuccacuaugaa

SEQ ID NO: 1207380 - RNA, 21 nt, Human
ugacauaaaagcugccugaag

SEQ ID NO: 1207381 - RNA, 19 nt, Human
ugagcaaagugguaaauau

SEQ ID NO: 1207382 - RNA, 22 nt, Human
ugauuacagacauaauauuccu

SEQ ID NO: 1207383 - RNA, 22 nt, Human
ugcugcuguauuaagaaaagga

SEQ ID NO: 1207384 - RNA, 18 nt, Human
uggaaaaaugcugguauu

SEQ ID NO: 1207385 - RNA, 23 nt, Human
uggaauuguucaagaggccucau

SEQ ID NO: 1207386 - RNA, 24 nt, Human
uggaauuguucaagaggccucauc

SEQ ID NO: 1207387 - RNA, 19 nt, Human
ugucuggaauuguucaaga

SEQ ID NO: 1207388 - RNA, 21 nt, Human
uuaucaguuaccuuauaauga

SEQ ID NO: 1207389 - RNA, 22 nt, Human
uucccagguuauuucagaauug

SEQ ID NO: 1207390 - RNA, 20 nt, Human
uugguguauuuaguguuaac

SEQ ID NO: 1207391 - RNA, 21 nt, Human
uuuacugaggacuacccucca

SEQ ID NO: 1207392 - RNA, 22 nt, Human
uuuaucaguuaccuuauaauga

SEQ ID NO: 1207393 - RNA, 22 nt, Human
uuuuuugacauaaaagcugccu

SEQ ID NO: 1207394 - RNA, 22 nt, Human
agcuggucccugccgugacaca

SEQ ID NO: 1207395 - RNA, 22 nt, Human
agcuguaucuccuugcagugcc

SEQ ID NO: 1207396 - RNA, 22 nt, Human
agugcuccaaugucuccaacug

SEQ ID NO: 1207397 - RNA, 19 nt, Human
ccaggaaggggaggaucca

SEQ ID NO: 1207398 - RNA, 21 nt, Human
cccugcaucuggcaagucacu

SEQ ID NO: 1207399 - RNA, 21 nt, Human
gccaaccugaaaucgagcccc

SEQ ID NO: 1207400 - RNA, 22 nt, Human
uacagaauaauauaaaucugug

SEQ ID NO: 1207401 - RNA, 22 nt, Human
ucuggcaagucacuggugauua

SEQ ID NO: 1207402 - RNA, 22 nt, Human
ugagcuggucccugcaucuggc

SEQ ID NO: 1207403 - RNA, 19 nt, Human
ugccaggaaggggaggauc

SEQ ID NO: 1207404 - RNA, 21 nt, Human
ugccaggaaggggaggaucca

SEQ ID NO: 1207405 - RNA, 23 nt, Human
uggugauuauaaaaacuuuccag

SEQ ID NO: 1207406 - RNA, 22 nt, Human
accgcuaugcuuuguucacaaa

SEQ ID NO: 1207407 - RNA, 18 nt, Human
agucauguggaacauucu

SEQ ID NO: 1207408 - RNA, 23 nt, Human
ccuucagccagagcuguugaagc

SEQ ID NO: 1207409 - RNA, 24 nt, Human
uggaacauucugcagacagaauug

SEQ ID NO: 1207410 - RNA, 23 nt, Human
uuugaugaaguugagcccagccu

SEQ ID NO: 1207411 - RNA, 21 nt, Human
cagcucccugugcagcgccuc

SEQ ID NO: 1207412 - RNA, 25 nt, Human
ccugcagcucccugugcagcgccuc

SEQ ID NO: 1207413 - RNA, 18 nt, Human
cugcagcucccugugcac

SEQ ID NO: 1207414 - RNA, 19 nt, Human
ucccugugcagcgccucuu

SEQ ID NO: 1207415 - RNA, 19 nt, Human
uggcagucaaugggcuaug

SEQ ID NO: 1207416 - RNA, 18 nt, Human
uguaaaauuccugguugu

SEQ ID NO: 1207417 - RNA, 19 nt, Human
uuguauuuugucuuguugg

SEQ ID NO: 1207418 - RNA, 22 nt, Human
uaguucauucuugcaaguucuu

SEQ ID NO: 1207419 - RNA, 21 nt, Human
accagcugaugagaugagaug

SEQ ID NO: 1207420 - RNA, 21 nt, Human
accuucuuuaaugcgcuguug

SEQ ID NO: 1207421 - RNA, 21 nt, Human
acgaugccaccaucugcagac

SEQ ID NO: 1207422 - RNA, 21 nt, Human
agaaaagaaauccuacaaaaa

SEQ ID NO: 1207423 - RNA, 21 nt, Human
agaaugggacgaguaccuucc

SEQ ID NO: 1207424 - RNA, 23 nt, Human
caaaaaccaccagcaugaaauga

SEQ ID NO: 1207425 - RNA, 24 nt, Human
caaaugauuuaaauauauauucca

SEQ ID NO: 1207426 - RNA, 22 nt, Human
caagagcagaccucugcucuuu

SEQ ID NO: 1207427 - RNA, 23 nt, Human
cacaaaccagcugaugagaugag

SEQ ID NO: 1207428 - RNA, 20 nt, Human
cacucagauuucccagaaaa

SEQ ID NO: 1207429 - RNA, 24 nt, Human
caggagaggcuguucuuugcagug

SEQ ID NO: 1207430 - RNA, 21 nt, Human
ccacacucagauuucccagaa

SEQ ID NO: 1207431 - RNA, 24 nt, Human
cccagaaaagaaauccuacaaaaa

SEQ ID NO: 1207432 - RNA, 22 nt, Human
cuccaagaacugaccaccuucu

SEQ ID NO: 1207433 - RNA, 24 nt, Human
cugcucuuucaagaaaccaacacu

SEQ ID NO: 1207434 - RNA, 24 nt, Human
gaccucugcucuuucaagaaacca

SEQ ID NO: 1207435 - RNA, 22 nt, Human
gcguggcacuuuggaagacucu

SEQ ID NO: 1207436 - RNA, 19 nt, Human
gcuguucuuugcagugaug

SEQ ID NO: 1207437 - RNA, 18 nt, Human
ggauauccugauguccuc

SEQ ID NO: 1207438 - RNA, 21 nt, Human
gucucucucuugucuccuccu

SEQ ID NO: 1207439 - RNA, 21 nt, Human
uacaaaaaccaccagcaugaa

SEQ ID NO: 1207440 - RNA, 22 nt, Human
uagaauagcccaucacgaugcc

SEQ ID NO: 1207441 - RNA, 21 nt, Human
ucagcccauuggugacgccac

SEQ ID NO: 1207442 - RNA, 23 nt, Human
uccacacucagauuucccagaaa

SEQ ID NO: 1207443 - RNA, 20 nt, Human
uccccagaaagcaaucuccg

SEQ ID NO: 1207444 - RNA, 24 nt, Human
uccccagaaagcaaucuccggggu

SEQ ID NO: 1207445 - RNA, 18 nt, Human
ucccccugggugcucucu

SEQ ID NO: 1207446 - RNA, 24 nt, Human
ucuccaagaacugaccaccuucuu

SEQ ID NO: 1207447 - RNA, 21 nt, Human
ucucccaagagcagaccucug

SEQ ID NO: 1207448 - RNA, 18 nt, Human
ucugccugagugucucca

SEQ ID NO: 1207449 - RNA, 22 nt, Human
ugaaaugaaugagaaugggacg

SEQ ID NO: 1207450 - RNA, 18 nt, Human
ugagauggcguggcacuu

SEQ ID NO: 1207451 - RNA, 23 nt, Human
ugccugcagaguggcaggucacu

SEQ ID NO: 1207452 - RNA, 25 nt, Human
uggcguggcacuuuggaagacucuu

SEQ ID NO: 1207453 - RNA, 18 nt, Human
ugucaggagaggcuguuc

SEQ ID NO: 1207454 - RNA, 23 nt, Human
uuaacagcgcggugagaucuuuc

SEQ ID NO: 1207455 - RNA, 26 nt, Human
uucaagaaaccaacacugccugcaga

SEQ ID NO: 1207456 - RNA, 19 nt, Human
uugcugucaggagaggcug

SEQ ID NO: 1207457 - RNA, 18 nt, Human
uuggugacgccacuagaa

SEQ ID NO: 1207458 - RNA, 22 nt, Human
uuugacccggccugggcguccc

SEQ ID NO: 1207459 - RNA, 20 nt, Human
aaaaggcaggccuuggccca

SEQ ID NO: 1207460 - RNA, 18 nt, Human
aaggagaaguugagggcu

SEQ ID NO: 1207461 - RNA, 19 nt, Human
acaccagcuccggcaggau

SEQ ID NO: 1207462 - RNA, 23 nt, Human
accaccaccuccaccagcuccgg

SEQ ID NO: 1207463 - RNA, 21 nt, Human
acccuuugggauggggcccaa

SEQ ID NO: 1207464 - RNA, 23 nt, Human
accuugaaggccgccagcucuga

SEQ ID NO: 1207465 - RNA, 23 nt, Human
acuuucuuuucccuccaugagag

SEQ ID NO: 1207466 - RNA, 21 nt, Human
agagacgcacgaggacuugaa

SEQ ID NO: 1207467 - RNA, 22 nt, Human
agcagggacagcagccagaaga

SEQ ID NO: 1207468 - RNA, 25 nt, Human
agcccagcagggacagcagccagaa

SEQ ID NO: 1207469 - RNA, 24 nt, Human
agcgcagcccucuucagaggacac

SEQ ID NO: 1207470 - RNA, 27 nt, Human
aggcaaaaggcaggccuuggcccagga

SEQ ID NO: 1207471 - RNA, 24 nt, Human
aggcagagguacagagaagagauc

SEQ ID NO: 1207472 - RNA, 26 nt, Human
aggccauggacaggagcuucagggca

SEQ ID NO: 1207473 - RNA, 19 nt, Human
agggaccagaugucugauu

SEQ ID NO: 1207474 - RNA, 22 nt, Human
agggaccagaugucugauuucu

SEQ ID NO: 1207475 - RNA, 19 nt, Human
agggagcaggcacacagcu

SEQ ID NO: 1207476 - RNA, 19 nt, Human
aggggcauaaauaaugaac

SEQ ID NO: 1207477 - RNA, 31 nt, Human
auccaugcauuccacccccacaucuaccccc

SEQ ID NO: 1207478 - RNA, 22 nt, Human
augcagcccagggaccagaugu

SEQ ID NO: 1207479 - RNA, 21 nt, Human
caaaaggcaggccuuggccca

SEQ ID NO: 1207480 - RNA, 24 nt, Human
caacccauccucccugagggugac

SEQ ID NO: 1207481 - RNA, 23 nt, Human
caagggcagaagauuccugaagg

SEQ ID NO: 1207482 - RNA, 31 nt, Human
cacagccggaugcuuugcaggagcagcgccc

SEQ ID NO: 1207483 - RNA, 21 nt, Human
caccuccaccagcuccggggg

SEQ ID NO: 1207484 - RNA, 22 nt, Human
cacggagcaggcaaaaggcagg

SEQ ID NO: 1207485 - RNA, 22 nt, Human
cagcagcagggagcaggcacac

SEQ ID NO: 1207486 - RNA, 24 nt, Human
cagcagcagggagcaggcacacag

SEQ ID NO: 1207487 - RNA, 20 nt, Human
cagcccagcagggacagcag

SEQ ID NO: 1207488 - RNA, 24 nt, Human
cagcccagcagggacagcagccag

SEQ ID NO: 1207489 - RNA, 18 nt, Human
cagggagccuuggcuucc

SEQ ID NO: 1207490 - RNA, 20 nt, Human
cagggccuucauacuacugg

SEQ ID NO: 1207491 - RNA, 23 nt, Human
caggguagguggccaacaccugg

SEQ ID NO: 1207492 - RNA, 26 nt, Human
caucaggaagcuucuccaacauggga

SEQ ID NO: 1207493 - RNA, 20 nt, Human
cauccaugcauuccaccccc

SEQ ID NO: 1207494 - RNA, 19 nt, Human
caugcauuccacccccaca

SEQ ID NO: 1207495 - RNA, 22 nt, Human
ccacccccacaucuaccccaac

SEQ ID NO: 1207496 - RNA, 21 nt, Human
ccacguucuccaccaccuccg

SEQ ID NO: 1207497 - RNA, 21 nt, Human
ccacugccgcccuccuccugc

SEQ ID NO: 1207498 - RNA, 27 nt, Human
ccagcagggcucuguccuggcacagcc

SEQ ID NO: 1207499 - RNA, 19 nt, Human
ccaugcauuccacccccac

SEQ ID NO: 1207500 - RNA, 21 nt, Human
ccccaaggccccaggauucag

SEQ ID NO: 1207501 - RNA, 20 nt, Human
cccccaaggccccaggauuc

SEQ ID NO: 1207502 - RNA, 18 nt, Human
cccuccuccugcaccacc

SEQ ID NO: 1207503 - RNA, 19 nt, Human
ccgcagaugcauggcuucu

SEQ ID NO: 1207504 - RNA, 19 nt, Human
ccgcagcuucagcaguggc

SEQ ID NO: 1207505 - RNA, 22 nt, Human
ccgcagcuucagcaguggcauc

SEQ ID NO: 1207506 - RNA, 22 nt, Human
ccuccaccaccagguucacccc

SEQ ID NO: 1207507 - RNA, 20 nt, Human
ccuuccuucugacacuuucu

SEQ ID NO: 1207508 - RNA, 21 nt, Human
cgugaccaccaccuccaccag

SEQ ID NO: 1207509 - RNA, 22 nt, Human
cuccauggucgugaccaccacc

SEQ ID NO: 1207510 - RNA, 20 nt, Human
cuccauugucuucaggacgg

SEQ ID NO: 1207511 - RNA, 23 nt, Human
cugaaggagaaguugagggcuuc

SEQ ID NO: 1207512 - RNA, 18 nt, Human
cugaagguuuccacaucc

SEQ ID NO: 1207513 - RNA, 24 nt, Human
cugaugagguccgggaccuucucc

SEQ ID NO: 1207514 - RNA, 18 nt, Human
cugccgcccuccuccugc

SEQ ID NO: 1207515 - RNA, 20 nt, Human
gaccucguguccagcuccuc

SEQ ID NO: 1207516 - RNA, 23 nt, Human
gacuuacgaaaggggucucccuc

SEQ ID NO: 1207517 - RNA, 19 nt, Human
gagaucuccccauuccacg

SEQ ID NO: 1207518 - RNA, 19 nt, Human
gagccucucaagaagguga

SEQ ID NO: 1207519 - RNA, 19 nt, Human
gaggacccugucauguagc

SEQ ID NO: 1207520 - RNA, 22 nt, Human
gcaaaaggcaggccuuggccca

SEQ ID NO: 1207521 - RNA, 23 nt, Human
gcaucaggaagcuucuccaacaa

SEQ ID NO: 1207522 - RNA, 18 nt, Human
gcccuccuccugcaccac

SEQ ID NO: 1207523 - RNA, 19 nt, Human
gcugagccacuggucgugc

SEQ ID NO: 1207524 - RNA, 23 nt, Human
gcuggcuucugccauuuccccau

SEQ ID NO: 1207525 - RNA, 19 nt, Human
gcuucugccauuuccccau

SEQ ID NO: 1207526 - RNA, 19 nt, Human
ggagggacuuccgcagaug

SEQ ID NO: 1207527 - RNA, 21 nt, Human
gggcgugccgcagcuucagca

SEQ ID NO: 1207528 - RNA, 22 nt, Human
ggguggugcaccagcgcagccc

SEQ ID NO: 1207529 - RNA, 20 nt, Human
gggugucuguggggcccugc

SEQ ID NO: 1207530 - RNA, 22 nt, Human
gguggcucugaagagcacuccc

SEQ ID NO: 1207531 - RNA, 24 nt, Human
gguugcagggagccuuggcuuccg

SEQ ID NO: 1207532 - RNA, 20 nt, Human
gguuuccauuuccuccacca

SEQ ID NO: 1207533 - RNA, 18 nt, Human
gucgugaccaccaccucc

SEQ ID NO: 1207534 - RNA, 22 nt, Human
gugaugaacagcuccugguaca

SEQ ID NO: 1207535 - RNA, 24 nt, Human
gugcagguauuccagcgcguccag

SEQ ID NO: 1207536 - RNA, 21 nt, Human
uaaugaacccucuggaacuaa

SEQ ID NO: 1207537 - RNA, 23 nt, Human
uaaugaacccucuggaacuaaac

SEQ ID NO: 1207538 - RNA, 19 nt, Human
uagcacauuggaacucagg

SEQ ID NO: 1207539 - RNA, 22 nt, Human
ucaaugauuuucuuugccuucc

SEQ ID NO: 1207540 - RNA, 20 nt, Human
ucauauccuuccuucugaca

SEQ ID NO: 1207541 - RNA, 24 nt, Human
ucauugaacuccaucaccaggcag

SEQ ID NO: 1207542 - RNA, 21 nt, Human
uccacccccacaucuacccca

SEQ ID NO: 1207543 - RNA, 23 nt, Human
uccacccccacaucuaccccaac

SEQ ID NO: 1207544 - RNA, 21 nt, Human
uccagcaccuggcccagcaca

SEQ ID NO: 1207545 - RNA, 20 nt, Human
uccaucaccaggcagagguu

SEQ ID NO: 1207546 - RNA, 26 nt, Human
ucccagggacucuguccuggucacag

SEQ ID NO: 1207547 - RNA, 30 nt, Human
uccccagcaucaccuaaaaugcuggccacu

SEQ ID NO: 1207548 - RNA, 18 nt, Human
uccggcaggaucuccuca

SEQ ID NO: 1207549 - RNA, 21 nt, Human
uccucgcuucauagcugggaa

SEQ ID NO: 1207550 - RNA, 22 nt, Human
ucuccuggagcagggccuucau

SEQ ID NO: 1207551 - RNA, 19 nt, Human
ugaaggagcagcuggucau

SEQ ID NO: 1207552 - RNA, 22 nt, Human
ugaaggagcagcugguccuccc

SEQ ID NO: 1207553 - RNA, 19 nt, Human
ugagaggcaacauuuucug

SEQ ID NO: 1207554 - RNA, 23 nt, Human
ugagaggcaacauuuucuggggu

SEQ ID NO: 1207555 - RNA, 20 nt, Human
ugauuuucuuugccuuccuc

SEQ ID NO: 1207556 - RNA, 21 nt, Human
ugcauguggagcaaggccagg

SEQ ID NO: 1207557 - RNA, 22 nt, Human
ugccaaggccauggacaggagc

SEQ ID NO: 1207558 - RNA, 19 nt, Human
uggaacuaaacaauaggau

SEQ ID NO: 1207559 - RNA, 23 nt, Human
uggacaggagcuucagggcacgg

SEQ ID NO: 1207560 - RNA, 18 nt, Human
uggcaggaucaucaggaa

SEQ ID NO: 1207561 - RNA, 23 nt, Human
uggcccaggaggugcagcagcag

SEQ ID NO: 1207562 - RNA, 21 nt, Human
ugggaagagcugcuuuaucac

SEQ ID NO: 1207563 - RNA, 20 nt, Human
ugggauggggcccaacagcu

SEQ ID NO: 1207564 - RNA, 24 nt, Human
uucacccccaaggccccaggauuc

SEQ ID NO: 1207565 - RNA, 21 nt, Human
uuccacccccacaucuacccc

SEQ ID NO: 1207566 - RNA, 22 nt, Human
uuccccauccgcaggguaggug

SEQ ID NO: 1207567 - RNA, 19 nt, Human
uuccggguggugcaccagc

SEQ ID NO: 1207568 - RNA, 21 nt, Human
uuccuccaccaccagguucac

SEQ ID NO: 1207569 - RNA, 25 nt, Human
uugaacuccaucaccaggcagaggu

SEQ ID NO: 1207570 - RNA, 23 nt, Human
uugggauggggcccaacagcuuc

SEQ ID NO: 1207571 - RNA, 21 nt, Human
uuuucugggguaccacaaaca

SEQ ID NO: 1207572 - RNA, 19 nt, Human
aaacagugugagaauggga

SEQ ID NO: 1207573 - RNA, 22 nt, Human
aagauaagagacagcaaaaaaa

SEQ ID NO: 1207574 - RNA, 25 nt, Human
aagauaagagacagcaaaaaaaugu

SEQ ID NO: 1207575 - RNA, 22 nt, Human
agcaaacagugugagaauggga

SEQ ID NO: 1207576 - RNA, 18 nt, Human
agcaccggaagccgcucc

SEQ ID NO: 1207577 - RNA, 23 nt, Human
aggcugcggaccgggagcagcgg

SEQ ID NO: 1207578 - RNA, 26 nt, Human
augacgcaggcagcaccggaagccgc

SEQ ID NO: 1207579 - RNA, 19 nt, Human
caccggaagccgcuccccu

SEQ ID NO: 1207580 - RNA, 18 nt, Human
cacuggucacauugcccc

SEQ ID NO: 1207581 - RNA, 19 nt, Human
cagcaccggaagccgcucc

SEQ ID NO: 1207582 - RNA, 18 nt, Human
cagccgcuuccgccggga

SEQ ID NO: 1207583 - RNA, 21 nt, Human
ccagagcaaacagugugagaa

SEQ ID NO: 1207584 - RNA, 19 nt, Human
ccugggcuacugaagauaa

SEQ ID NO: 1207585 - RNA, 23 nt, Human
gaagauaagagacagcaaaaaaa

SEQ ID NO: 1207586 - RNA, 21 nt, Human
gaagugcagccgcuuccgccg

SEQ ID NO: 1207587 - RNA, 19 nt, Human
gagcugagggacgcgcgga

SEQ ID NO: 1207588 - RNA, 21 nt, Human
gcaaaaaaauguucuucccuu

SEQ ID NO: 1207589 - RNA, 19 nt, Human
gcagcaccggaagccgcuc

SEQ ID NO: 1207590 - RNA, 19 nt, Human
uaauauuuggagagauuac

SEQ ID NO: 1207591 - RNA, 25 nt, Human
uccugggcuacugaagauaagagac

SEQ ID NO: 1207592 - RNA, 21 nt, Human
ucuccgggcggggaccggaag

SEQ ID NO: 1207593 - RNA, 20 nt, Human
ugacgcaggcagcaccggaa

SEQ ID NO: 1207594 - RNA, 23 nt, Human
ugacgcaggcagcaccggaagcc

SEQ ID NO: 1207595 - RNA, 21 nt, Human
ugagaaugggaugcccuugga

SEQ ID NO: 1207596 - RNA, 18 nt, Human
ugccuuauucuuaauuuc

SEQ ID NO: 1207597 - RNA, 21 nt, Human
ugggaugcccuuggacacugg

SEQ ID NO: 1207598 - RNA, 22 nt, Human
ugggaugcccuuggacacuggu

SEQ ID NO: 1207599 - RNA, 26 nt, Human
ugugagaaugggaugcccuuggacac

SEQ ID NO: 1207600 - RNA, 19 nt, Human
uuuccugggcuacugaaga

SEQ ID NO: 1207601 - RNA, 19 nt, Human
aaacucccccucugcuucc

SEQ ID NO: 1207602 - RNA, 22 nt, Human
uacagaauuuccucugaucauu

SEQ ID NO: 1207603 - RNA, 21 nt, Human
uaguucuguuuggaccacuga

SEQ ID NO: 1207604 - RNA, 19 nt, Human
uaugcuuaguucuguuugg

SEQ ID NO: 1207605 - RNA, 21 nt, Human
ucauuugauuugguuauagau

SEQ ID NO: 1207606 - RNA, 20 nt, Human
ugacuuuuaaaacucccccu

SEQ ID NO: 1207607 - RNA, 20 nt, Human
ugcaaauacaggcaugagca

SEQ ID NO: 1207608 - RNA, 18 nt, Human
uggcacaaugauuuaugc

SEQ ID NO: 1207609 - RNA, 19 nt, Human
guuugcucguuucccucca

SEQ ID NO: 1207610 - RNA, 18 nt, Human
uaaugcuccagaaauagg

SEQ ID NO: 1207611 - RNA, 24 nt, Human
ucccuccauuauguaaugcuccag

SEQ ID NO: 1207612 - RNA, 21 nt, Human
ucuugggagugugcucaguuc

SEQ ID NO: 1207613 - RNA, 18 nt, Human
ugugcucaguucucucca

SEQ ID NO: 1207614 - RNA, 24 nt, Human
uugggagugugcucaguucucucc

SEQ ID NO: 1207615 - RNA, 18 nt, Human
ggagcuggaggggcuggg

SEQ ID NO: 1207616 - RNA, 19 nt, Human
uggagcuggaggggcuggg

SEQ ID NO: 1207617 - RNA, 26 nt, Human
cacacacugaacugggugcugguaac

SEQ ID NO: 1207618 - RNA, 19 nt, Human
cuccccacacacugaacug

SEQ ID NO: 1207619 - RNA, 19 nt, Human
ggggccugugcccuccacu

SEQ ID NO: 1207620 - RNA, 23 nt, Human
agaaauuuguuuuuuucgcugga

SEQ ID NO: 1207621 - RNA, 18 nt, Human
cagggcuuucauucaagg

SEQ ID NO: 1207622 - RNA, 21 nt, Human
cagggcuuucauucaaggugu

SEQ ID NO: 1207623 - RNA, 20 nt, Human
gacuuguuuccuucucuguu

SEQ ID NO: 1207624 - RNA, 20 nt, Human
uuggauuauuuucagggcuu

SEQ ID NO: 1207625 - RNA, 22 nt, Human
uuucagggcuuucauucaaggu

SEQ ID NO: 1207626 - RNA, 18 nt, Human
acuuuccucugaucuugu

SEQ ID NO: 1207627 - RNA, 21 nt, Human
ggcaggcgucuccucaggugg

SEQ ID NO: 1207628 - RNA, 22 nt, Human
gggcaggcgucuccucaggugg

SEQ ID NO: 1207629 - RNA, 21 nt, Human
gguacuuuccucugaucuugu

SEQ ID NO: 1207630 - RNA, 18 nt, Human
guugaugucuguuucagg

SEQ ID NO: 1207631 - RNA, 21 nt, Human
uagaugccucgucaucucuuc

SEQ ID NO: 1207632 - RNA, 18 nt, Human
uagcgguacagguaaugu

SEQ ID NO: 1207633 - RNA, 22 nt, Human
ucaggugggaucagcuucucuu

SEQ ID NO: 1207634 - RNA, 20 nt, Human
uucaggggcaggcgucuccu

SEQ ID NO: 1207635 - RNA, 24 nt, Human
uugagugcuugcucggcaaaugau

SEQ ID NO: 1207636 - RNA, 21 nt, Human
uuguucuaagugacugcgauu

SEQ ID NO: 1207637 - RNA, 18 nt, Human
accccgaaaauggacggu

SEQ ID NO: 1207638 - RNA, 26 nt, Human
caccaccccgaaaauggacgguccca

SEQ ID NO: 1207639 - RNA, 20 nt, Human
caccacgauggccaccaggu

SEQ ID NO: 1207640 - RNA, 21 nt, Human
caccagguugcccaccacccc

SEQ ID NO: 1207641 - RNA, 25 nt, Human
caccccgaaaauggacggucccagg

SEQ ID NO: 1207642 - RNA, 19 nt, Human
ccaccaccccgaaaaugga

SEQ ID NO: 1207643 - RNA, 21 nt, Human
cccaccaccccgaaaauggac

SEQ ID NO: 1207644 - RNA, 22 nt, Human
ccuucugcuccuugcgcgacuu

SEQ ID NO: 1207645 - RNA, 23 nt, Human
cuguguagaagguggucuccuuc

SEQ ID NO: 1207646 - RNA, 18 nt, Human
guugcccaccaccccgaa

SEQ ID NO: 1207647 - RNA, 24 nt, Human
uggccaccagguugcccaccaccc

SEQ ID NO: 1207648 - RNA, 21 nt, Human
aaaaaaaagaaaagaaaagaa

SEQ ID NO: 1207649 - RNA, 21 nt, Human
aaaaaagaaaaaacugaccau

SEQ ID NO: 1207650 - RNA, 23 nt, Human
aaaaccuuucccuuccucaccaa

SEQ ID NO: 1207651 - RNA, 19 nt, Human
aaaagaaaaaagaaaaaac

SEQ ID NO: 1207652 - RNA, 21 nt, Human
aaaagcaacaaagcccaagac

SEQ ID NO: 1207653 - RNA, 21 nt, Human
aaacaaaacagcaccugacaa

SEQ ID NO: 1207654 - RNA, 19 nt, Human
aaacaaacaaacaaacaaa

SEQ ID NO: 1207655 - RNA, 26 nt, Human
aaacaaacaaacaaacaaacaaccuc

SEQ ID NO: 1207656 - RNA, 22 nt, Human
aaacaaacaaacaaacaaccuc

SEQ ID NO: 1207657 - RNA, 23 nt, Human
aaacaaacaaacaaacaaccuca

SEQ ID NO: 1207658 - RNA, 23 nt, Human
aaacaaccucaaaagcuguuggg

SEQ ID NO: 1207659 - RNA, 24 nt, Human
aaagccccucccgcacugcugccc

SEQ ID NO: 1207660 - RNA, 21 nt, Human
aacaaaagcgaaacucugucu

SEQ ID NO: 1207661 - RNA, 22 nt, Human
aacaaaagcgaaacucugucuc

SEQ ID NO: 1207662 - RNA, 18 nt, Human
aacacuuugggaggcuga

SEQ ID NO: 1207663 - RNA, 24 nt, Human
aacacuuugggaggcugaggcggg

SEQ ID NO: 1207664 - RNA, 20 nt, Human
aacauggugaaauccugucu

SEQ ID NO: 1207665 - RNA, 21 nt, Human
aacauggugaaauccugucuc

SEQ ID NO: 1207666 - RNA, 21 nt, Human
aacguggugaaaccccugucu

SEQ ID NO: 1207667 - RNA, 22 nt, Human
aacguggugaaaccccugucuc

SEQ ID NO: 1207668 - RNA, 21 nt, Human
aagaaaaaacugaccauaccc

SEQ ID NO: 1207669 - RNA, 28 nt, Human
aagcaacaaagcccaagacagguaaaca

SEQ ID NO: 1207670 - RNA, 26 nt, Human
aagcagaaagcuagaaugaagggacc

SEQ ID NO: 1207671 - RNA, 18 nt, Human
aaguggaagcaaguauua

SEQ ID NO: 1207672 - RNA, 25 nt, Human
aaucacuugaacccgggaggcggag

SEQ ID NO: 1207673 - RNA, 25 nt, Human
acaagaaaaaccuuucccuuccuca

SEQ ID NO: 1207674 - RNA, 25 nt, Human
acaagaaaaaccuuucccuuccuca

SEQ ID NO: 1207675 - RNA, 22 nt, Human
acagguaaacaaacaaacaaac

SEQ ID NO: 1207676 - RNA, 22 nt, Human
acagucugggaggcugaggcag

SEQ ID NO: 1207677 - RNA, 23 nt, Human
acagucugggaggcugaggcagg

SEQ ID NO: 1207678 - RNA, 19 nt, Human
acccacugggugcugagga

SEQ ID NO: 1207679 - RNA, 20 nt, Human
acccagggccaagggagaug

SEQ ID NO: 1207680 - RNA, 24 nt, Human
accuaaggucaggaguucgagacc

SEQ ID NO: 1207681 - RNA, 24 nt, Human
accugaggucaggaguuugagacu

SEQ ID NO: 1207682 - RNA, 22 nt, Human
accugguucuccacuuaacugc

SEQ ID NO: 1207683 - RNA, 22 nt, Human
accuugacucuacugccuguug

SEQ ID NO: 1207684 - RNA, 23 nt, Human
acucagcacaauuggaaaaaaaa

SEQ ID NO: 1207685 - RNA, 19 nt, Human
acucccagccagggcucuc

SEQ ID NO: 1207686 - RNA, 19 nt, Human
agaaaagaaaagaaaaaag

SEQ ID NO: 1207687 - RNA, 22 nt, Human
agaaucacuugaacccgggagg

SEQ ID NO: 1207688 - RNA, 20 nt, Human
agaaugaagcgagucuagua

SEQ ID NO: 1207689 - RNA, 20 nt, Human
agacagguaaacaaacaaac

SEQ ID NO: 1207690 - RNA, 20 nt, Human
agacagguaaacaaacaaag

SEQ ID NO: 1207691 - RNA, 23 nt, Human
agcaagaagaccuggucccccuc

SEQ ID NO: 1207692 - RNA, 20 nt, Human
agcccgggcaacaaaagcga

SEQ ID NO: 1207693 - RNA, 21 nt, Human
agcccgggcaacaaaagcgaa

SEQ ID NO: 1207694 - RNA, 18 nt, Human
agcccugggcuggccccc

SEQ ID NO: 1207695 - RNA, 22 nt, Human
agccuggccaacguggugaaac

SEQ ID NO: 1207696 - RNA, 24 nt, Human
agccuggccaacguggugaaaccc

SEQ ID NO: 1207697 - RNA, 22 nt, Human
agcucaauccuggugaccaccu

SEQ ID NO: 1207698 - RNA, 22 nt, Human
agcugccacuggagugacaggc

SEQ ID NO: 1207699 - RNA, 20 nt, Human
agcugggugugguggugggu

SEQ ID NO: 1207700 - RNA, 22 nt, Human
agcugggugugguggugggugc

SEQ ID NO: 1207701 - RNA, 18 nt, Human
aggcaggagaaucacuug

SEQ ID NO: 1207702 - RNA, 24 nt, Human
aggcaggagaaucacuugaacccg

SEQ ID NO: 1207703 - RNA, 18 nt, Human
aggcagguggaucaccug

SEQ ID NO: 1207704 - RNA, 22 nt, Human
aggcagguggaucaccugaggu

SEQ ID NO: 1207705 - RNA, 26 nt, Human
aggcagguggaucaccugaggucagg

SEQ ID NO: 1207706 - RNA, 24 nt, Human
aggcgcaguggcucaugccuguaa

SEQ ID NO: 1207707 - RNA, 20 nt, Human
aggcggagauugcagugagc

SEQ ID NO: 1207708 - RNA, 22 nt, Human
aggcggagauugcagugagcug

SEQ ID NO: 1207709 - RNA, 22 nt, Human
aggcgggcggaucaccuaaggu

SEQ ID NO: 1207710 - RNA, 26 nt, Human
aggcgggcggaucaccuaaggucagg

SEQ ID NO: 1207711 - RNA, 24 nt, Human
aggcgugguggcucaugccuguaa

SEQ ID NO: 1207712 - RNA, 24 nt, Human
aggcuaaggcaggagaaucacuug

SEQ ID NO: 1207713 - RNA, 21 nt, Human
aggcugaggcagguggaucac

SEQ ID NO: 1207714 - RNA, 24 nt, Human
aggcugaggcagguggaucaccug

SEQ ID NO: 1207715 - RNA, 19 nt, Human
aggcugaggcgggcggauc

SEQ ID NO: 1207716 - RNA, 21 nt, Human
aggcugaggcgggcggaucac

SEQ ID NO: 1207717 - RNA, 22 nt, Human
agguggaucaccugaggucagg

SEQ ID NO: 1207718 - RNA, 20 nt, Human
agguguuaggcaagggacgg

SEQ ID NO: 1207719 - RNA, 23 nt, Human
aguggcucaugccuguaauccca

SEQ ID NO: 1207720 - RNA, 20 nt, Human
aucaccugaggucaggaguu

SEQ ID NO: 1207721 - RNA, 24 nt, Human
aucgcgccauugcauuccagcccg

SEQ ID NO: 1207722 - RNA, 19 nt, Human
augcaaugcugcuugcccc

SEQ ID NO: 1207723 - RNA, 19 nt, Human
augccuguaaucccaacac

SEQ ID NO: 1207724 - RNA, 23 nt, Human
auugcagugagcugaaucgcgcc

SEQ ID NO: 1207725 - RNA, 18 nt, Human
auugcauuccagcccggg

SEQ ID NO: 1207726 - RNA, 18 nt, Human
caaaacagauaucucagc

SEQ ID NO: 1207727 - RNA, 19 nt, Human
caaaacagcaccugacaau

SEQ ID NO: 1207728 - RNA, 25 nt, Human
caaaacagcaccugacaaugccuga

SEQ ID NO: 1207729 - RNA, 21 nt, Human
caaaagcaacaaagcccaaga

SEQ ID NO: 1207730 - RNA, 23 nt, Human
caaaagcaacaaagcccaagaca

SEQ ID NO: 1207731 - RNA, 26 nt, Human
caaaagcaacaaagcccaagacaggu

SEQ ID NO: 1207732 - RNA, 18 nt, Human
caaacaaacaaacaaccu

SEQ ID NO: 1207733 - RNA, 23 nt, Human
caaacaaacaaacaaccucaaaa

SEQ ID NO: 1207734 - RNA, 22 nt, Human
caaaucauucccaggaaaaucc

SEQ ID NO: 1207735 - RNA, 23 nt, Human
caacaaaagcgaaacucugucuc

SEQ ID NO: 1207736 - RNA, 24 nt, Human
caacacuuugggaggcugaggcgg

SEQ ID NO: 1207737 - RNA, 24 nt, Human
caacauggugaaauccugucucua

SEQ ID NO: 1207738 - RNA, 25 nt, Human
caacguggugaaaccccugucucua

SEQ ID NO: 1207739 - RNA, 24 nt, Human
caagaaaaaccuuucccuuccuca

SEQ ID NO: 1207740 - RNA, 23 nt, Human
caaguggaagcaaguauuaccca

SEQ ID NO: 1207741 - RNA, 19 nt, Human
caccacauaacccacuuac

SEQ ID NO: 1207742 - RNA, 24 nt, Human
caccacauaacccacuuacaaggg

SEQ ID NO: 1207743 - RNA, 26 nt, Human
caccacauaacccacuuacaaggguu

SEQ ID NO: 1207744 - RNA, 23 nt, Human
caccuaaggucaggaguucgaga

SEQ ID NO: 1207745 - RNA, 23 nt, Human
caccugaggucaggaguuugaga

SEQ ID NO: 1207746 - RNA, 23 nt, Human
cagcaagaagaccuggucccccu

SEQ ID NO: 1207747 - RNA, 24 nt, Human
cagcaagaagaccuggucccccuc

SEQ ID NO: 1207748 - RNA, 19 nt, Human
cagcaccugacaaugccug

SEQ ID NO: 1207749 - RNA, 19 nt, Human
cagccagggcucucugcca

SEQ ID NO: 1207750 - RNA, 22 nt, Human
cagccugccugaucacaacuga

SEQ ID NO: 1207751 - RNA, 24 nt, Human
caggaggcuaaggcaggagaauca

SEQ ID NO: 1207752 - RNA, 19 nt, Human
caggauacagaccucccac

SEQ ID NO: 1207753 - RNA, 24 nt, Human
cagguggaucaccugaggucagga

SEQ ID NO: 1207754 - RNA, 24 nt, Human
caugacagcucacaagugugcagu

SEQ ID NO: 1207755 - RNA, 24 nt, Human
caugccuguaaucccaacacuuug

SEQ ID NO: 1207756 - RNA, 19 nt, Human
cauugcauuccagcccggg

SEQ ID NO: 1207757 - RNA, 21 nt, Human
cauugcauuccagcccgggca

SEQ ID NO: 1207758 - RNA, 22 nt, Human
cauugcauuccagcccgggcaa

SEQ ID NO: 1207759 - RNA, 23 nt, Human
cauugcauuccagcccgggcaac

SEQ ID NO: 1207760 - RNA, 24 nt, Human
cauugcauuccagcccgggcaaca

SEQ ID NO: 1207761 - RNA, 20 nt, Human
ccaaaacaaggaagaaaaca

SEQ ID NO: 1207762 - RNA, 21 nt, Human
ccaagacagguaaacaaacaa

SEQ ID NO: 1207763 - RNA, 24 nt, Human
ccacacccagggccaagggagaug

SEQ ID NO: 1207764 - RNA, 24 nt, Human
ccacauaacccacuuacaagggua

SEQ ID NO: 1207765 - RNA, 18 nt, Human
ccacuccuuggcuuggca

SEQ ID NO: 1207766 - RNA, 19 nt, Human
ccagucccagcccugggcu

SEQ ID NO: 1207767 - RNA, 21 nt, Human
ccauacccaccacauaaccca

SEQ ID NO: 1207768 - RNA, 20 nt, Human
ccauugcauuccagcccggg

SEQ ID NO: 1207769 - RNA, 21 nt, Human
ccauugcauuccagcccgggc

SEQ ID NO: 1207770 - RNA, 24 nt, Human
ccauugcauuccagcccgggcaac

SEQ ID NO: 1207771 - RNA, 23 nt, Human
cccaagacagguaaacaaacaaa

SEQ ID NO: 1207772 - RNA, 19 nt, Human
cccacacccagggccaagg

SEQ ID NO: 1207773 - RNA, 25 nt, Human
cccagaguuaaagacgcuuuggaac

SEQ ID NO: 1207774 - RNA, 26 nt, Human
cccagggccaagggagaugccggggc

SEQ ID NO: 1207775 - RNA, 23 nt, Human
cccagucccagcccugggcuggc

SEQ ID NO: 1207776 - RNA, 19 nt, Human
cccccagcuccaccuuuag

SEQ ID NO: 1207777 - RNA, 24 nt, Human
ccccugucucuacuaaaaauacaa

SEQ ID NO: 1207778 - RNA, 21 nt, Human
ccuaaaauggggcuguccuga

SEQ ID NO: 1207779 - RNA, 22 nt, Human
ccuaaggucaggaguucgagac

SEQ ID NO: 1207780 - RNA, 19 nt, Human
ccuccuucuuggggcuucu

SEQ ID NO: 1207781 - RNA, 25 nt, Human
ccuccuucuuggggcuucucugugg

SEQ ID NO: 1207782 - RNA, 27 nt, Human
ccuccuucuuggggcuucucuguggga

SEQ ID NO: 1207783 - RNA, 22 nt, Human
ccugaggucaggaguuugagac

SEQ ID NO: 1207784 - RNA, 22 nt, Human
ccuggccaacauggugaaaucc

SEQ ID NO: 1207785 - RNA, 24 nt, Human
ccuggccaacauggugaaauccug

SEQ ID NO: 1207786 - RNA, 23 nt, Human
ccuggccaacguggugaaacccc

SEQ ID NO: 1207787 - RNA, 25 nt, Human
ccuggccaacguggugaaaccccug

SEQ ID NO: 1207788 - RNA, 19 nt, Human
ccuggggggggauuagggg

SEQ ID NO: 1207789 - RNA, 22 nt, Human
ccugucucuacuaaaaauacaa

SEQ ID NO: 1207790 - RNA, 23 nt, Human
cgaaacucugucucaaaaaaaag

SEQ ID NO: 1207791 - RNA, 24 nt, Human
cgagaccagccuggccaacguggu

SEQ ID NO: 1207792 - RNA, 24 nt, Human
cgccauugcauuccagcccgggca

SEQ ID NO: 1207793 - RNA, 24 nt, Human
cggaucaccuaaggucaggaguuc

SEQ ID NO: 1207794 - RNA, 27 nt, Human
cggaucaccuaaggucaggaguucgag

SEQ ID NO: 1207795 - RNA, 24 nt, Human
cgggcggaucaccuaaggucagga

SEQ ID NO: 1207796 - RNA, 24 nt, Human
cucaugccuguaaucccaacacuu

SEQ ID NO: 1207797 - RNA, 23 nt, Human
cucaugccuguaaucccaacagu

SEQ ID NO: 1207798 - RNA, 20 nt, Human
cucccgcacugcugccccuc

SEQ ID NO: 1207799 - RNA, 25 nt, Human
cucucugccagccauccagugccau

SEQ ID NO: 1207800 - RNA, 21 nt, Human
cugagccugucuccucgucug

SEQ ID NO: 1207801 - RNA, 21 nt, Human
cugagcugcugugugagccug

SEQ ID NO: 1207802 - RNA, 22 nt, Human
cugcugugugagccuggguaag

SEQ ID NO: 1207803 - RNA, 24 nt, Human
cuggccaacauggugaaauccugu

SEQ ID NO: 1207804 - RNA, 23 nt, Human
cuggccccaaccuccuucuuggg

SEQ ID NO: 1207805 - RNA, 25 nt, Human
cugggaggcugaggcagguggauca

SEQ ID NO: 1207806 - RNA, 18 nt, Human
cugguacaaaaacagacc

SEQ ID NO: 1207807 - RNA, 18 nt, Human
cugguugucaucauuccc

SEQ ID NO: 1207808 - RNA, 19 nt, Human
cuuagcuguaagagggagu

SEQ ID NO: 1207809 - RNA, 21 nt, Human
gaaaaucccccagcuccaccu

SEQ ID NO: 1207810 - RNA, 21 nt, Human
gaagucuccucaucccuaaaa

SEQ ID NO: 1207811 - RNA, 19 nt, Human
gauaaaagcaacagccucc

SEQ ID NO: 1207812 - RNA, 18 nt, Human
gaucaccuaaggucagga

SEQ ID NO: 1207813 - RNA, 24 nt, Human
gaucaccuaaggucaggaguucga

SEQ ID NO: 1207814 - RNA, 21 nt, Human
gaucaccugaggucaggaguu

SEQ ID NO: 1207815 - RNA, 24 nt, Human
gaucaccugaggucaggaguuuga

SEQ ID NO: 1207816 - RNA, 23 nt, Human
gcaggagaaucacuugaacccgg

SEQ ID NO: 1207817 - RNA, 20 nt, Human
gccaacauggugaaauccug

SEQ ID NO: 1207818 - RNA, 24 nt, Human
gccaacauggugaaauccugucuc

SEQ ID NO: 1207819 - RNA, 25 nt, Human
gccaacguggugaaaccccugucuc

SEQ ID NO: 1207820 - RNA, 24 nt, Human
gccccaaccuccuucuuggggcuu

SEQ ID NO: 1207821 - RNA, 23 nt, Human
gccuggccaacauggugaaaucc

SEQ ID NO: 1207822 - RNA, 20 nt, Human
gccuuccuuugccuuuguag

SEQ ID NO: 1207823 - RNA, 18 nt, Human
gcgaaacucugucucaaa

SEQ ID NO: 1207824 - RNA, 23 nt, Human
gcugcugugugagccuggguaag

SEQ ID NO: 1207825 - RNA, 24 nt, Human
gcuggccaggcgcaguggcucaug

SEQ ID NO: 1207826 - RNA, 22 nt, Human
gcuguagucccagcuacuaggg

SEQ ID NO: 1207827 - RNA, 18 nt, Human
gcuuggcauucaggcuuu

SEQ ID NO: 1207828 - RNA, 25 nt, Human
ggacugggucaguugcaggagcugc

SEQ ID NO: 1207829 - RNA, 18 nt, Human
ggagauugcagugagcug

SEQ ID NO: 1207830 - RNA, 23 nt, Human
ggagauugcagugagcugaaucg

SEQ ID NO: 1207831 - RNA, 18 nt, Human
ggagcuccauucucuacc

SEQ ID NO: 1207832 - RNA, 22 nt, Human
ggaucaccuaaggucaggaguu

SEQ ID NO: 1207833 - RNA, 23 nt, Human
ggaucaccuaaggucaggaguuc

SEQ ID NO: 1207834 - RNA, 18 nt, Human
ggcaagggacggugccuc

SEQ ID NO: 1207835 - RNA, 21 nt, Human
ggccaggcgugguggcucaug

SEQ ID NO: 1207836 - RNA, 20 nt, Human
ggccuggacaucucuagggg

SEQ ID NO: 1207837 - RNA, 21 nt, Human
ggccuggacaucucuaggggg

SEQ ID NO: 1207838 - RNA, 21 nt, Human
ggcggaucaccuaaggucagg

SEQ ID NO: 1207839 - RNA, 20 nt, Human
ggcucaugccuguaauccca

SEQ ID NO: 1207840 - RNA, 24 nt, Human
gguggcagggcccuguaaucccag

SEQ ID NO: 1207841 - RNA, 23 nt, Human
gguggcucaugccuguaauccca

SEQ ID NO: 1207842 - RNA, 21 nt, Human
gucacguuguucagaaacacc

SEQ ID NO: 1207843 - RNA, 23 nt, Human
gugaagucuccucaucccuaaaa

SEQ ID NO: 1207844 - RNA, 22 nt, Human
gugguggugggugcuguagucc

SEQ ID NO: 1207845 - RNA, 20 nt, Human
uaaaagagguggggcuggau

SEQ ID NO: 1207846 - RNA, 24 nt, Human
uaaaagcagaaagcuagaaugaag

SEQ ID NO: 1207847 - RNA, 21 nt, Human
uaacucccagccagggcucuc

SEQ ID NO: 1207848 - RNA, 20 nt, Human
uaaggcaggagaaucacuug

SEQ ID NO: 1207849 - RNA, 24 nt, Human
uaaggcaggagaaucacuugaacc

SEQ ID NO: 1207850 - RNA, 19 nt, Human
uacaauuagcugggcuugg

SEQ ID NO: 1207851 - RNA, 22 nt, Human
uaccccaccgcagagaaagccg

SEQ ID NO: 1207852 - RNA, 21 nt, Human
uacuaaaaauacaauuagcug

SEQ ID NO: 1207853 - RNA, 18 nt, Human
uagaagggucuuguccuc

SEQ ID NO: 1207854 - RNA, 20 nt, Human
ucaaaucauucccaggaaaa

SEQ ID NO: 1207855 - RNA, 20 nt, Human
ucaccuaaggucaggaguuc

SEQ ID NO: 1207856 - RNA, 19 nt, Human
ucaccugaggucaggaguu

SEQ ID NO: 1207857 - RNA, 20 nt, Human
ucaggauacagaccucccac

SEQ ID NO: 1207858 - RNA, 23 nt, Human
ucagguuuccaugacagcucaca

SEQ ID NO: 1207859 - RNA, 22 nt, Human
ucaugccuguaaucccaacagu

SEQ ID NO: 1207860 - RNA, 19 nt, Human
ucccagaguuaaagacgcu

SEQ ID NO: 1207861 - RNA, 20 nt, Human
ucccuaacucccagccaggg

SEQ ID NO: 1207862 - RNA, 21 nt, Human
ucucuacuaaaaauacaaaaa

SEQ ID NO: 1207863 - RNA, 24 nt, Human
ucucuacuaaaaauacaauuagcu

SEQ ID NO: 1207864 - RNA, 24 nt, Human
ucucuguaaauuuauacuugacuu

SEQ ID NO: 1207865 - RNA, 23 nt, Human
ugaccaugaugagucaggccugg

SEQ ID NO: 1207866 - RNA, 19 nt, Human
ugacgagcgaccuaacugu

SEQ ID NO: 1207867 - RNA, 23 nt, Human
ugagacuggccuggccaacaugg

SEQ ID NO: 1207868 - RNA, 24 nt, Human
ugagacuggccuggccaacauggu

SEQ ID NO: 1207869 - RNA, 21 nt, Human
ugagcugaaucgcgccauugc

SEQ ID NO: 1207870 - RNA, 18 nt, Human
ugagcuggccccaaccuc

SEQ ID NO: 1207871 - RNA, 20 nt, Human
ugaggcagguggaucaccug

SEQ ID NO: 1207872 - RNA, 24 nt, Human
ugaggcagguggaucaccugaggu

SEQ ID NO: 1207873 - RNA, 26 nt, Human
ugaggcagguggaucaccugagguca

SEQ ID NO: 1207874 - RNA, 19 nt, Human
ugaggcgggcggaucaccu

SEQ ID NO: 1207875 - RNA, 24 nt, Human
ugaggcgggcggaucaccuaaggu

SEQ ID NO: 1207876 - RNA, 26 nt, Human
ugaggcgggcggaucaccuaagguca

SEQ ID NO: 1207877 - RNA, 18 nt, Human
ugaggucaggaguuugag

SEQ ID NO: 1207878 - RNA, 21 nt, Human
ugaugagucaggccuggcugg

SEQ ID NO: 1207879 - RNA, 22 nt, Human
ugcaaaacagauaucucagcaa

SEQ ID NO: 1207880 - RNA, 24 nt, Human
ugcaaaacagauaucucagcaacu

SEQ ID NO: 1207881 - RNA, 20 nt, Human
ugccauguccugucaugaca

SEQ ID NO: 1207882 - RNA, 21 nt, Human
ugcccagucccagcccugggc

SEQ ID NO: 1207883 - RNA, 24 nt, Human
ugcccagucccagcccugggcugg

SEQ ID NO: 1207884 - RNA, 21 nt, Human
ugccggggccucgaggccccc

SEQ ID NO: 1207885 - RNA, 21 nt, Human
ugccugaucacaacugaggug

SEQ ID NO: 1207886 - RNA, 25 nt, Human
ugccugaucacaacugagguguuuu

SEQ ID NO: 1207887 - RNA, 23 nt, Human
ugccuguaaucccaacacuuugg

SEQ ID NO: 1207888 - RNA, 24 nt, Human
ugccuguaaucccaacacuuuggg

SEQ ID NO: 1207889 - RNA, 24 nt, Human
ugccuguaaucccaacagucuggg

SEQ ID NO: 1207890 - RNA, 23 nt, Human
ugcuguagucccagcuacuaggg

SEQ ID NO: 1207891 - RNA, 24 nt, Human
uggaacacaugggcuuucaagagc

SEQ ID NO: 1207892 - RNA, 18 nt, Human
uggaagcaaguauuaccc

SEQ ID NO: 1207893 - RNA, 23 nt, Human
uggaucaccugaggucaggaguu

SEQ ID NO: 1207894 - RNA, 24 nt, Human
uggaucaccugaggucaggaguuu

SEQ ID NO: 1207895 - RNA, 27 nt, Human
uggaucaccugaggucaggaguuugag

SEQ ID NO: 1207896 - RNA, 18 nt, Human
uggcaggcuuagcacagc

SEQ ID NO: 1207897 - RNA, 19 nt, Human
uggcaggcuuagcacagcu

SEQ ID NO: 1207898 - RNA, 22 nt, Human
uggcagggcccuguaaucccag

SEQ ID NO: 1207899 - RNA, 24 nt, Human
uggccaacauggugaaauccuguc

SEQ ID NO: 1207900 - RNA, 25 nt, Human
uggccaacguggugaaaccccuguc

SEQ ID NO: 1207901 - RNA, 24 nt, Human
uggccaggcgcaguggcucaugcc

SEQ ID NO: 1207902 - RNA, 24 nt, Human
uggccaggcgugguggcucaugcc

SEQ ID NO: 1207903 - RNA, 24 nt, Human
uggccuggccaacauggugaaauc

SEQ ID NO: 1207904 - RNA, 24 nt, Human
uggcucaugccuguaaucccaaca

SEQ ID NO: 1207905 - RNA, 24 nt, Human
uggcucaugccuguaaucccaaca

SEQ ID NO: 1207906 - RNA, 24 nt, Human
ugggaggcugaggcagguggauca

SEQ ID NO: 1207907 - RNA, 19 nt, Human
ugggaggcugaggcgggcg

SEQ ID NO: 1207908 - RNA, 20 nt, Human
ugggaggcugaggcgggcgg

SEQ ID NO: 1207909 - RNA, 24 nt, Human
ugggaggcugaggcgggcggauca

SEQ ID NO: 1207910 - RNA, 22 nt, Human
uggggaggaauaaugccggccu

SEQ ID NO: 1207911 - RNA, 24 nt, Human
ugguggcagggcccuguaauccca

SEQ ID NO: 1207912 - RNA, 24 nt, Human
ugguggcucaugccuguaauccca

SEQ ID NO: 1207913 - RNA, 23 nt, Human
uggugggugcuguagucccagcu

SEQ ID NO: 1207914 - RNA, 23 nt, Human
ugguggugggugcuguaguccca

SEQ ID NO: 1207915 - RNA, 19 nt, Human
ugucaugaaagacacaguc

SEQ ID NO: 1207916 - RNA, 18 nt, Human
ugugugggaagugcuugg

SEQ ID NO: 1207917 - RNA, 22 nt, Human
uguuggagacgugacccugagc

SEQ ID NO: 1207918 - RNA, 18 nt, Human
uuagcugggcuugguggc

SEQ ID NO: 1207919 - RNA, 21 nt, Human
uuagcuggguguggugguggg

SEQ ID NO: 1207920 - RNA, 24 nt, Human
uuagcugggugugguggugggugc

SEQ ID NO: 1207921 - RNA, 24 nt, Human
uuccaacccagggcucccuaacuc

SEQ ID NO: 1207922 - RNA, 19 nt, Human
uucccaggaaaauccccca

SEQ ID NO: 1207923 - RNA, 19 nt, Human
uucuggagcugccacugga

SEQ ID NO: 1207924 - RNA, 18 nt, Human
uugcagugagcugaaucg

SEQ ID NO: 1207925 - RNA, 21 nt, Human
uugcagugagcugaaucgcgc

SEQ ID NO: 1207926 - RNA, 25 nt, Human
uugggaggcugaggcgggcggauca

SEQ ID NO: 1207927 - RNA, 23 nt, Human
uuucuggagcugccacuggagug

SEQ ID NO: 1207928 - RNA, 25 nt, Human
uuugaaguaccuuuugccaaaagca

SEQ ID NO: 1207929 - RNA, 22 nt, Human
uuuuucagauuaaugaagaaag

SEQ ID NO: 1207930 - RNA, 24 nt, Human
aaggcucuuggguuucccgcuuug

SEQ ID NO: 1207931 - RNA, 21 nt, Human
ccaaacccaagucuuacacuc

SEQ ID NO: 1207932 - RNA, 19 nt, Human
cuuggguuucccgcuuugg

SEQ ID NO: 1207933 - RNA, 19 nt, Human
uagugacccccuccuuucc

SEQ ID NO: 1207934 - RNA, 21 nt, Human
cagcagucccucucugggcga

SEQ ID NO: 1207935 - RNA, 20 nt, Human
gaacccagaugcaggcagca

SEQ ID NO: 1207936 - RNA, 22 nt, Human
gaugcaggcagcagucccucuc

SEQ ID NO: 1207937 - RNA, 24 nt, Human
acuugcagagaggagucgaaacug

SEQ ID NO: 1207938 - RNA, 19 nt, Human
ccgccgcgcucugcucucc

SEQ ID NO: 1207939 - RNA, 26 nt, Human
cguuucauacuucccaaauaguuuua

SEQ ID NO: 1207940 - RNA, 21 nt, Human
gagucucuuacaccuuucugg

SEQ ID NO: 1207941 - RNA, 24 nt, Human
gagucucuuacaccuuucugggcc

SEQ ID NO: 1207942 - RNA, 20 nt, Human
uacaccagaucacgagacau

SEQ ID NO: 1207943 - RNA, 21 nt, Human
ugcagagaggagucgaaacug

SEQ ID NO: 1207944 - RNA, 24 nt, Human
aaacaagcuaacaaaacaaaaggc

SEQ ID NO: 1207945 - RNA, 21 nt, Human
aaauacauaucaugaaaauaa

SEQ ID NO: 1207946 - RNA, 19 nt, Human
aagcagagcucucagagug

SEQ ID NO: 1207947 - RNA, 18 nt, Human
acccagcacccugacccu

SEQ ID NO: 1207948 - RNA, 22 nt, Human
agaaagaaucucuguaagcaga

SEQ ID NO: 1207949 - RNA, 19 nt, Human
agcacccugacccugcugc

SEQ ID NO: 1207950 - RNA, 19 nt, Human
agcaucuauuccucccugg

SEQ ID NO: 1207951 - RNA, 20 nt, Human
aggaacccagcacccugacc

SEQ ID NO: 1207952 - RNA, 22 nt, Human
aggaacccagcacccugacccu

SEQ ID NO: 1207953 - RNA, 22 nt, Human
auuagugugaaugcucugaaau

SEQ ID NO: 1207954 - RNA, 21 nt, Human
cagagcucucagagugacacc

SEQ ID NO: 1207955 - RNA, 19 nt, Human
cagcacccugacccugcug

SEQ ID NO: 1207956 - RNA, 20 nt, Human
cauagaaaaaauacauauca

SEQ ID NO: 1207957 - RNA, 20 nt, Human
cccugacccugcugcuccuc

SEQ ID NO: 1207958 - RNA, 21 nt, Human
cccuggcuggaguugagguga

SEQ ID NO: 1207959 - RNA, 19 nt, Human
ccugacccugcugcuccuc

SEQ ID NO: 1207960 - RNA, 21 nt, Human
gccccuggccugcccugcccu

SEQ ID NO: 1207961 - RNA, 18 nt, Human
gcugucauccccucccca

SEQ ID NO: 1207962 - RNA, 18 nt, Human
gucauccccuccccaagc

SEQ ID NO: 1207963 - RNA, 19 nt, Human
guggggucccugguguggc

SEQ ID NO: 1207964 - RNA, 23 nt, Human
guguuugaaccaucuugaaggca

SEQ ID NO: 1207965 - RNA, 21 nt, Human
uaacaaaacaaaaggcugaac

SEQ ID NO: 1207966 - RNA, 22 nt, Human
uaacuaggaaacaagcuaacaa

SEQ ID NO: 1207967 - RNA, 24 nt, Human
uaggaaacaagcuaacaaaacaaa

SEQ ID NO: 1207968 - RNA, 19 nt, Human
uaucucccaggaugugaag

SEQ ID NO: 1207969 - RNA, 20 nt, Human
ucaguagcugcuccccacag

SEQ ID NO: 1207970 - RNA, 21 nt, Human
uccagggccccuggccugccc

SEQ ID NO: 1207971 - RNA, 24 nt, Human
uccccaagcucucuuguggggucc

SEQ ID NO: 1207972 - RNA, 25 nt, Human
ucucuguaagcagagcucucagagu

SEQ ID NO: 1207973 - RNA, 21 nt, Human
ugaaguacugccucacucugg

SEQ ID NO: 1207974 - RNA, 19 nt, Human
ugacagcagaaagaaucuc

SEQ ID NO: 1207975 - RNA, 23 nt, Human
ugaggugaugggagggaaauuga

SEQ ID NO: 1207976 - RNA, 20 nt, Human
uggagguaacuaggaaacaa

SEQ ID NO: 1207977 - RNA, 21 nt, Human
uggggacccaaggccagccgg

SEQ ID NO: 1207978 - RNA, 23 nt, Human
aagaugcuccgccuccuccugcc

SEQ ID NO: 1207979 - RNA, 18 nt, Human
agcagacgccagggcugc

SEQ ID NO: 1207980 - RNA, 24 nt, Human
agccacaaacgcuagcgggaaccu

SEQ ID NO: 1207981 - RNA, 20 nt, Human
agggaggcaagugugggagc

SEQ ID NO: 1207982 - RNA, 25 nt, Human
cacccccagcuccgcgcccccugcu

SEQ ID NO: 1207983 - RNA, 20 nt, Human
cagcucccacccccagcucc

SEQ ID NO: 1207984 - RNA, 20 nt, Human
ccagaagggcaaguccagca

SEQ ID NO: 1207985 - RNA, 22 nt, Human
ccagcagacgccagggcugcag

SEQ ID NO: 1207986 - RNA, 18 nt, Human
ccagggaggcaagugugg

SEQ ID NO: 1207987 - RNA, 21 nt, Human
ccccugcucguccccuuucac

SEQ ID NO: 1207988 - RNA, 18 nt, Human
cccugcucguccccuuuc

SEQ ID NO: 1207989 - RNA, 19 nt, Human
cccugcucguccccuuuca

SEQ ID NO: 1207990 - RNA, 18 nt, Human
cgccuucggcuuggggug

SEQ ID NO: 1207991 - RNA, 20 nt, Human
cguccccuuucacuuccagg

SEQ ID NO: 1207992 - RNA, 22 nt, Human
cuccugccacuuagagccacaa

SEQ ID NO: 1207993 - RNA, 21 nt, Human
cuucggcuuggggugcccaga

SEQ ID NO: 1207994 - RNA, 27 nt, Human
gcgcccccugcucguccccuuucacuu

SEQ ID NO: 1207995 - RNA, 18 nt, Human
gcucccacccccagcucc

SEQ ID NO: 1207996 - RNA, 19 nt, Human
ggacgccccagccagggag

SEQ ID NO: 1207997 - RNA, 24 nt, Human
guacaggggcugguauggaccugu

SEQ ID NO: 1207998 - RNA, 21 nt, Human
ucacuuccaggcgccuucggc

SEQ ID NO: 1207999 - RNA, 21 nt, Human
uccuccugccacuuagagcca

SEQ ID NO: 1208000 - RNA, 20 nt, Human
ucggaacccggugccuggcg

SEQ ID NO: 1208001 - RNA, 19 nt, Human
ucggcuuggggugcccaga

SEQ ID NO: 1208002 - RNA, 23 nt, Human
ucggcuuggggugcccagaaggg

SEQ ID NO: 1208003 - RNA, 19 nt, Human
ugcuccgccuccuccugcc

SEQ ID NO: 1208004 - RNA, 24 nt, Human
ugcuccgccuccuccugccacuua

SEQ ID NO: 1208005 - RNA, 24 nt, Human
uuccaggcgccuucggcuuggggu

SEQ ID NO: 1208006 - RNA, 21 nt, Human
gagggcgauaggaagcuuugu

SEQ ID NO: 1208007 - RNA, 18 nt, Human
gcuuuguucugugggucc

SEQ ID NO: 1208008 - RNA, 20 nt, Human
ucccccaggagggcgauagg

SEQ ID NO: 1208009 - RNA, 23 nt, Human
ugaacguaggccuccuuuucaag

SEQ ID NO: 1208010 - RNA, 24 nt, Human
uuaggaugaacguaggccuccuuu

SEQ ID NO: 1208011 - RNA, 23 nt, Human
aacagaugccuucacaacaugga

SEQ ID NO: 1208012 - RNA, 24 nt, Human
acuguggggugaaaggugggggag

SEQ ID NO: 1208013 - RNA, 20 nt, Human
aucaauaucaucaucaagcu

SEQ ID NO: 1208014 - RNA, 20 nt, Human
auggaauaaauacuaauuga

SEQ ID NO: 1208015 - RNA, 21 nt, Human
auguuucugugguuguuuucc

SEQ ID NO: 1208016 - RNA, 20 nt, Human
cacuguggggugaaaggugg

SEQ ID NO: 1208017 - RNA, 20 nt, Human
ccguugggcaaaaugagauc

SEQ ID NO: 1208018 - RNA, 21 nt, Human
cugaacagaugccuucacaaa

SEQ ID NO: 1208019 - RNA, 25 nt, Human
cuggcacugcagggacauuccggua

SEQ ID NO: 1208020 - RNA, 24 nt, Human
cuugaaguaccugcuggaguacca

SEQ ID NO: 1208021 - RNA, 21 nt, Human
gaacagaugccuucacaacau

SEQ ID NO: 1208022 - RNA, 19 nt, Human
ggugaaaggugggggaggg

SEQ ID NO: 1208023 - RNA, 22 nt, Human
guuguuuucccagcacugcguc

SEQ ID NO: 1208024 - RNA, 21 nt, Human
uauagggugccaggcccugug

SEQ ID NO: 1208025 - RNA, 20 nt, Human
uaucaucaucaagcugaagu

SEQ ID NO: 1208026 - RNA, 21 nt, Human
ucccuugguuucaaauuuucg

SEQ ID NO: 1208027 - RNA, 26 nt, Human
ucucuagucucaccaucaauaucauc

SEQ ID NO: 1208028 - RNA, 20 nt, Human
ugaaaggugggggagggaaa

SEQ ID NO: 1208029 - RNA, 22 nt, Human
ugaacagaugccuucacaacau

SEQ ID NO: 1208030 - RNA, 22 nt, Human
ugagaagggaagaugaagaagc

SEQ ID NO: 1208031 - RNA, 23 nt, Human
uggaguaccaccguugggcaaaa

SEQ ID NO: 1208032 - RNA, 23 nt, Human
uggcacugcagggacauuccggu

SEQ ID NO: 1208033 - RNA, 18 nt, Human
ugggaucaucaacuauaa

SEQ ID NO: 1208034 - RNA, 19 nt, Human
uggggugaaagguggggga

SEQ ID NO: 1208035 - RNA, 21 nt, Human
uugucuugucccuugguuuca

SEQ ID NO: 1208036 - RNA, 22 nt, Human
uuucccagcacugcgucucugg

SEQ ID NO: 1208037 - RNA, 23 nt, Human
auggcaauacucucugaaguuca

SEQ ID NO: 1208038 - RNA, 20 nt, Human
ggcaauacucucugaaguuc

SEQ ID NO: 1208039 - RNA, 19 nt, Human
agggcaauggcagcaaaaa

SEQ ID NO: 1208040 - RNA, 18 nt, Human
gugggaagggcaauggca

SEQ ID NO: 1208041 - RNA, 18 nt, Human
ugggaagggcaauggcag

SEQ ID NO: 1208042 - RNA, 20 nt, Human
ugugggaagggcaauggcag

SEQ ID NO: 1208043 - RNA, 21 nt, Human
agggcuugcgccuuuucccug

SEQ ID NO: 1208044 - RNA, 21 nt, Human
cagccaggucuucuagggcuu

SEQ ID NO: 1208045 - RNA, 18 nt, Human
cugcugccacuuacacuu

SEQ ID NO: 1208046 - RNA, 23 nt, Human
gccuuuucccugggugcucuugg

SEQ ID NO: 1208047 - RNA, 21 nt, Human
ucccugggugcucuuggccau

SEQ ID NO: 1208048 - RNA, 23 nt, Human
ugaagccagccaggucuucuagg

SEQ ID NO: 1208049 - RNA, 25 nt, Human
ugccuuuaucuucaccuacuggucc

SEQ ID NO: 1208050 - RNA, 21 nt, Human
ugcugcuggagccagugucug

SEQ ID NO: 1208051 - RNA, 21 nt, Human
uucccugggugcucuuggcca

SEQ ID NO: 1208052 - RNA, 19 nt, Human
acuggagacguuggaagac

SEQ ID NO: 1208053 - RNA, 19 nt, Human
caguugauggaagacuggg

SEQ ID NO: 1208054 - RNA, 24 nt, Human
cugaaugucagaagaucagcacaa

SEQ ID NO: 1208055 - RNA, 23 nt, Human
ucagaagaucagcacacuggaga

SEQ ID NO: 1208056 - RNA, 20 nt, Human
aaguagcuuuuccuccagga

SEQ ID NO: 1208057 - RNA, 21 nt, Human
caccaccaaggggaggaaaua

SEQ ID NO: 1208058 - RNA, 23 nt, Human
uaaguagcuuuuccuccaggaga

SEQ ID NO: 1208059 - RNA, 18 nt, Human
uaauaaguagcuuuuccu

SEQ ID NO: 1208060 - RNA, 24 nt, Human
uaauaaguagcuuuuccuccagga

SEQ ID NO: 1208061 - RNA, 27 nt, Human
uacaaagagcugaacacuccaaggugg

SEQ ID NO: 1208062 - RNA, 23 nt, Human
uguaauaauaaguagcuuuuccu

SEQ ID NO: 1208063 - RNA, 18 nt, Human
aaaaugccguauuuggug

SEQ ID NO: 1208064 - RNA, 22 nt, Human
aaccucugccuguuuuuuuccu

SEQ ID NO: 1208065 - RNA, 19 nt, Human
aagccucaggguucuguga

SEQ ID NO: 1208066 - RNA, 21 nt, Human
accaaccagaaaaacgugucu

SEQ ID NO: 1208067 - RNA, 30 nt, Human
agaaaaaaagaacuaaauguaacaaaggag

SEQ ID NO: 1208068 - RNA, 19 nt, Human
aggggcaaaaaacccugua

SEQ ID NO: 1208069 - RNA, 19 nt, Human
caaaaaacccuguaucuga

SEQ ID NO: 1208070 - RNA, 23 nt, Human
cauaaccaaguggaaauacugaa

SEQ ID NO: 1208071 - RNA, 20 nt, Human
caucucagaaauauugguua

SEQ ID NO: 1208072 - RNA, 18 nt, Human
cuauggcuauaaaccucu

SEQ ID NO: 1208073 - RNA, 24 nt, Human
cugaauaaaguaauacaccaacca

SEQ ID NO: 1208074 - RNA, 21 nt, Human
cuuugguaaaggcaaaaugaa

SEQ ID NO: 1208075 - RNA, 20 nt, Human
gaaguuuuccaauggccuga

SEQ ID NO: 1208076 - RNA, 25 nt, Human
gacuuugcugaauuuaacagucuua

SEQ ID NO: 1208077 - RNA, 21 nt, Human
gucaagaaagugguaagucca

SEQ ID NO: 1208078 - RNA, 24 nt, Human
guccauaguguuuuaaagccucag

SEQ ID NO: 1208079 - RNA, 23 nt, Human
gugguauaaaacaucucagaaau

SEQ ID NO: 1208080 - RNA, 18 nt, Human
guugcacagcuguauggu

SEQ ID NO: 1208081 - RNA, 23 nt, Human
uaaaaacagaucuugaauuuuac

SEQ ID NO: 1208082 - RNA, 24 nt, Human
uaaaggcaaaaugaaaaaccugcu

SEQ ID NO: 1208083 - RNA, 26 nt, Human
uaaaguaauacaccaaccagaaaaac

SEQ ID NO: 1208084 - RNA, 24 nt, Human
uaacaaaggaacugacugaauaua

SEQ ID NO: 1208085 - RNA, 21 nt, Human
uaaccaaguggaaauacugaa

SEQ ID NO: 1208086 - RNA, 26 nt, Human
uacaaaaauaaaaacagaucuugaau

SEQ ID NO: 1208087 - RNA, 25 nt, Human
uagaaaaaaagaacuaaauguaaca

SEQ ID NO: 1208088 - RNA, 21 nt, Human
uagcaguauacucgauguagu

SEQ ID NO: 1208089 - RNA, 19 nt, Human
uauaaaacaucucagaaau

SEQ ID NO: 1208090 - RNA, 23 nt, Human
uauaaaacaucucagaaauauug

SEQ ID NO: 1208091 - RNA, 19 nt, Human
ucaauaaaaacugaaaugg

SEQ ID NO: 1208092 - RNA, 19 nt, Human
ucacaaaaaaucauaacca

SEQ ID NO: 1208093 - RNA, 25 nt, Human
ucagugaagauaguaauuuucauau

SEQ ID NO: 1208094 - RNA, 22 nt, Human
ucuaauauauuugucacaguaa

SEQ ID NO: 1208095 - RNA, 21 nt, Human
ucucuuuguaguagaugauga

SEQ ID NO: 1208096 - RNA, 19 nt, Human
ucugugauauauaauucuu

SEQ ID NO: 1208097 - RNA, 19 nt, Human
ugaaaaacauuuaaagugg

SEQ ID NO: 1208098 - RNA, 19 nt, Human
ugaaaaguccaggguuuua

SEQ ID NO: 1208099 - RNA, 22 nt, Human
ugaaauggaaacucacaaaaaa

SEQ ID NO: 1208100 - RNA, 25 nt, Human
ugaauaaauuauaguguuacgcaaa

SEQ ID NO: 1208101 - RNA, 22 nt, Human
ugaauuuaacagucuuacucug

SEQ ID NO: 1208102 - RNA, 22 nt, Human
uguacaaaaauaaaaacagauc

SEQ ID NO: 1208103 - RNA, 21 nt, Human
ugugaagucaguagaucaauu

SEQ ID NO: 1208104 - RNA, 20 nt, Human
ugugauagaaaacgugauga

SEQ ID NO: 1208105 - RNA, 23 nt, Human
uuaaagccucaggguucugugau

SEQ ID NO: 1208106 - RNA, 21 nt, Human
uuaaagugguugguuuauaga

SEQ ID NO: 1208107 - RNA, 21 nt, Human
uucuaugguugcauguguauu

SEQ ID NO: 1208108 - RNA, 19 nt, Human
uucugcaucaccugaucuc

SEQ ID NO: 1208109 - RNA, 24 nt, Human
uugaaaaugccguauuugguguac

SEQ ID NO: 1208110 - RNA, 20 nt, Human
uugaaauuaggcauuucugu

SEQ ID NO: 1208111 - RNA, 24 nt, Human
uugaucaaaaauaguugguaacua

SEQ ID NO: 1208112 - RNA, 18 nt, Human
uugcugaauuuaacaguc

SEQ ID NO: 1208113 - RNA, 20 nt, Human
uugcugaauuuaacagucuu

SEQ ID NO: 1208114 - RNA, 24 nt, Human
cuggaaagucuccaucuuccacag

SEQ ID NO: 1208115 - RNA, 19 nt, Human
uccacagcguaagugggga

SEQ ID NO: 1208116 - RNA, 23 nt, Human
ucuuccacagcguaaguggggac

SEQ ID NO: 1208117 - RNA, 23 nt, Human
agcguuuccccauuccccucgcc

SEQ ID NO: 1208118 - RNA, 24 nt, Human
caagugcacaaaucggacaccucg

SEQ ID NO: 1208119 - RNA, 18 nt, Human
cagauuccccaccguccc

SEQ ID NO: 1208120 - RNA, 24 nt, Human
caguaaccuuccuccccagcucag

SEQ ID NO: 1208121 - RNA, 22 nt, Human
ccugcaguaaccuuccucccca

SEQ ID NO: 1208122 - RNA, 19 nt, Human
cucgccguugccuccgcag

SEQ ID NO: 1208123 - RNA, 18 nt, Human
cugcaguaaccuuccucc

SEQ ID NO: 1208124 - RNA, 20 nt, Human
cuuccaacacuacccggcca

SEQ ID NO: 1208125 - RNA, 18 nt, Human
uccccauuccccucgccc

SEQ ID NO: 1208126 - RNA, 21 nt, Human
ucggugaaauacgaagcguuu

SEQ ID NO: 1208127 - RNA, 24 nt, Human
ugagugccugcaguaaccuuccuc

SEQ ID NO: 1208128 - RNA, 23 nt, Human
uggcugagugccugcaguaaccu

SEQ ID NO: 1208129 - RNA, 30 nt, Human
uuccccauuccccucgcccugcuuccaacu

SEQ ID NO: 1208130 - RNA, 20 nt, Human
uuccccucgcccugcuucca

SEQ ID NO: 1208131 - RNA, 18 nt, Human
aagaagaacucuaaaacc

SEQ ID NO: 1208132 - RNA, 24 nt, Human
aaugcaaugaaauguggacagaga

SEQ ID NO: 1208133 - RNA, 23 nt, Human
cagaucagcagauucagcaaaau

SEQ ID NO: 1208134 - RNA, 20 nt, Human
cauucugcucaucugugcua

SEQ ID NO: 1208135 - RNA, 23 nt, Human
ccaauuuuccuuccaauuucugc

SEQ ID NO: 1208136 - RNA, 19 nt, Human
cccaagaaucugaaagaau

SEQ ID NO: 1208137 - RNA, 24 nt, Human
cugcuggacaugauccuccuguau

SEQ ID NO: 1208138 - RNA, 19 nt, Human
cuggagauaaaauguagca

SEQ ID NO: 1208139 - RNA, 23 nt, Human
ggacagagaguuuccccaauuuu

SEQ ID NO: 1208140 - RNA, 26 nt, Human
uaugcucauucugcucaucugugcua

SEQ ID NO: 1208141 - RNA, 23 nt, Human
ucagcaaaaucccaagaaucuga

SEQ ID NO: 1208142 - RNA, 23 nt, Human
ucagcagauucagcaaaauccca

SEQ ID NO: 1208143 - RNA, 21 nt, Human
ucccaagaaucugaaagaaug

SEQ ID NO: 1208144 - RNA, 18 nt, Human
ucgcugcuggacaugauc

SEQ ID NO: 1208145 - RNA, 20 nt, Human
ucucagacucuggagauaaa

SEQ ID NO: 1208146 - RNA, 18 nt, Human
ugcaagccugagcauuga

SEQ ID NO: 1208147 - RNA, 20 nt, Human
ugcuauaguuauuaacaucu

SEQ ID NO: 1208148 - RNA, 21 nt, Human
uguaugcucauucugcucauc

SEQ ID NO: 1208149 - RNA, 23 nt, Human
aaacaaaaaccauguucaaggaa

SEQ ID NO: 1208150 - RNA, 20 nt, Human
aaggcccucuggacuguacc

SEQ ID NO: 1208151 - RNA, 21 nt, Human
aaucacuucauguuucuccac

SEQ ID NO: 1208152 - RNA, 21 nt, Human
aauggugggagagucaaauac

SEQ ID NO: 1208153 - RNA, 18 nt, Human
acccaacaaauucauagc

SEQ ID NO: 1208154 - RNA, 19 nt, Human
agaagaaaaaccauacuga

SEQ ID NO: 1208155 - RNA, 22 nt, Human
agcccucaaaacaaaaaccaug

SEQ ID NO: 1208156 - RNA, 21 nt, Human
aggcuaaaaacuccuccacag

SEQ ID NO: 1208157 - RNA, 21 nt, Human
aguucugucacuugccaucac

SEQ ID NO: 1208158 - RNA, 27 nt, Human
caaaacaaaaaccauguucaaggaaaa

SEQ ID NO: 1208159 - RNA, 23 nt, Human
caacaaauucauagcccucaaaa

SEQ ID NO: 1208160 - RNA, 23 nt, Human
caacagugccuuuagcuggacaa

SEQ ID NO: 1208161 - RNA, 25 nt, Human
caacugccaccacuaggaugugucc

SEQ ID NO: 1208162 - RNA, 26 nt, Human
caacugccaccacuaggaugugucca

SEQ ID NO: 1208163 - RNA, 20 nt, Human
cacuugccaucacuaaaagu

SEQ ID NO: 1208164 - RNA, 23 nt, Human
cauagcccucaaaacaaaaacca

SEQ ID NO: 1208165 - RNA, 26 nt, Human
cucaaaacaaaaaccauguucaagga

SEQ ID NO: 1208166 - RNA, 19 nt, Human
cuucaacagugccuuuagc

SEQ ID NO: 1208167 - RNA, 20 nt, Human
gaaacugagcacaacaauuc

SEQ ID NO: 1208168 - RNA, 20 nt, Human
gaagaagccucguggucuca

SEQ ID NO: 1208169 - RNA, 18 nt, Human
gacuguaccagaaaaagg

SEQ ID NO: 1208170 - RNA, 23 nt, Human
gccaaguuacuucacauuccagu

SEQ ID NO: 1208171 - RNA, 24 nt, Human
guguccacuggguacauuguucac

SEQ ID NO: 1208172 - RNA, 19 nt, Human
uacaaucuaacuguccccc

SEQ ID NO: 1208173 - RNA, 18 nt, Human
uacauuguucacuguaaa

SEQ ID NO: 1208174 - RNA, 21 nt, Human
uacccaacaaauucauagccc

SEQ ID NO: 1208175 - RNA, 22 nt, Human
uacccaacaaauucauagcccu

SEQ ID NO: 1208176 - RNA, 23 nt, Human
uagaaaaugcuaucccucuuccu

SEQ ID NO: 1208177 - RNA, 23 nt, Human
uagaaaguuuuuaaaaaauaaaa

SEQ ID NO: 1208178 - RNA, 22 nt, Human
uauacauauacauaugcauguu

SEQ ID NO: 1208179 - RNA, 18 nt, Human
uauacauaugcauguuau

SEQ ID NO: 1208180 - RNA, 22 nt, Human
uauagaggcucuaacaaaaaaa

SEQ ID NO: 1208181 - RNA, 24 nt, Human
uaugcuucaacagugccuuuagcu

SEQ ID NO: 1208182 - RNA, 25 nt, Human
ucacuugccaucacuaaaaguagau

SEQ ID NO: 1208183 - RNA, 21 nt, Human
uccacauauacauauacauau

SEQ ID NO: 1208184 - RNA, 20 nt, Human
ucucugaaaauacuuuuugu

SEQ ID NO: 1208185 - RNA, 21 nt, Human
ugccaaguuacuucacauucc

SEQ ID NO: 1208186 - RNA, 18 nt, Human
ugccauugaaacugagca

SEQ ID NO: 1208187 - RNA, 18 nt, Human
ugcuuggugauugaguca

SEQ ID NO: 1208188 - RNA, 18 nt, Human
ugcuuggugauugaguca

SEQ ID NO: 1208189 - RNA, 19 nt, Human
ugcuuggugauugagucau

SEQ ID NO: 1208190 - RNA, 20 nt, Human
ugcuuggugauugagucaug

SEQ ID NO: 1208191 - RNA, 21 nt, Human
uggagaacugaagcccugcug

SEQ ID NO: 1208192 - RNA, 20 nt, Human
ugggaaauuugguacacaug

SEQ ID NO: 1208193 - RNA, 20 nt, Human
uggguacauuguucacugua

SEQ ID NO: 1208194 - RNA, 21 nt, Human
uguauacccaacaaauucaua

SEQ ID NO: 1208195 - RNA, 19 nt, Human
uucaauggcucccaugaug

SEQ ID NO: 1208196 - RNA, 24 nt, Human
uugaaacugagcacaacaauucug

SEQ ID NO: 1208197 - RNA, 24 nt, Human
uugaggcuaaaaacuccuccacag

SEQ ID NO: 1208198 - RNA, 22 nt, Human
uuucaugaagaagccucguggu

SEQ ID NO: 1208199 - RNA, 26 nt, Human
caaauucgaaaucugucagaugcugg

SEQ ID NO: 1208200 - RNA, 23 nt, Human
aaaaacaaaaacaaaaaacaacu

SEQ ID NO: 1208201 - RNA, 24 nt, Human
aaaaacaaaaacaaaaacaaaaac

SEQ ID NO: 1208202 - RNA, 23 nt, Human
aaaacaaaaacaaaaaacaacua

SEQ ID NO: 1208203 - RNA, 22 nt, Human
aaaacaaaaacaaaaacaaaaa

SEQ ID NO: 1208204 - RNA, 26 nt, Human
aaaacaaaaacaaaaacaaaaaacaa

SEQ ID NO: 1208205 - RNA, 20 nt, Human
aaaagcagcccugggaagac

SEQ ID NO: 1208206 - RNA, 25 nt, Human
aaacaaaaacaaaaaacaacuacga

SEQ ID NO: 1208207 - RNA, 26 nt, Human
aaacaaaaacaaaaaacaacuacgaa

SEQ ID NO: 1208208 - RNA, 20 nt, Human
aaacaacuacgaaacuccuu

SEQ ID NO: 1208209 - RNA, 21 nt, Human
aaacuacacacauacacacaa

SEQ ID NO: 1208210 - RNA, 23 nt, Human
aaagaaugaagaucuagucaccc

SEQ ID NO: 1208211 - RNA, 19 nt, Human
aacauggugaaaccccauc

SEQ ID NO: 1208212 - RNA, 20 nt, Human
aacauggugaaaccccaucu

SEQ ID NO: 1208213 - RNA, 21 nt, Human
aacauggugaaaccccaucuc

SEQ ID NO: 1208214 - RNA, 21 nt, Human
aacauggugaaaccccaucuc

SEQ ID NO: 1208215 - RNA, 21 nt, Human
aacccccaaagcaaaacauaa

SEQ ID NO: 1208216 - RNA, 22 nt, Human
aagaaugaagaucuagucaccc

SEQ ID NO: 1208217 - RNA, 23 nt, Human
aagcaagagggcuccaaacaaaa

SEQ ID NO: 1208218 - RNA, 22 nt, Human
aagcaggagaauggcaugaacc

SEQ ID NO: 1208219 - RNA, 24 nt, Human
aagcaggagaauggcaugaaccug

SEQ ID NO: 1208220 - RNA, 20 nt, Human
aauaacuugaggaaugaaaa

SEQ ID NO: 1208221 - RNA, 25 nt, Human
acaaaaacaaaaacaaaaacaaaaa

SEQ ID NO: 1208222 - RNA, 20 nt, Human
acaaacccccaaagcaaaac

SEQ ID NO: 1208223 - RNA, 22 nt, Human
acagccuguaaucccagcacuu

SEQ ID NO: 1208224 - RNA, 24 nt, Human
acagccuguaaucccagcacuuug

SEQ ID NO: 1208225 - RNA, 19 nt, Human
acaguuaggccuucagagc

SEQ ID NO: 1208226 - RNA, 24 nt, Human
accccaucucuacuaaaaauacaa

SEQ ID NO: 1208227 - RNA, 20 nt, Human
acccccaaagcaaaacauaa

SEQ ID NO: 1208228 - RNA, 23 nt, Human
accuguaguccuagcuacuuggg

SEQ ID NO: 1208229 - RNA, 20 nt, Human
acuacauucaaaggcuaaag

SEQ ID NO: 1208230 - RNA, 18 nt, Human
acugcaucuuaaaauaac

SEQ ID NO: 1208231 - RNA, 19 nt, Human
agaaaagagaggggaaaag

SEQ ID NO: 1208232 - RNA, 21 nt, Human
agaaaagagaggggaaaagaa

SEQ ID NO: 1208233 - RNA, 20 nt, Human
agaaauguugaugccugggu

SEQ ID NO: 1208234 - RNA, 21 nt, Human
agacuccugacaucagaaacu

SEQ ID NO: 1208235 - RNA, 19 nt, Human
agagaguaguguguauaag

SEQ ID NO: 1208236 - RNA, 24 nt, Human
agcacuuugggaggccgaggcagg

SEQ ID NO: 1208237 - RNA, 19 nt, Human
agccagucucagugaguca

SEQ ID NO: 1208238 - RNA, 23 nt, Human
agccuguaaucccagcacuuugg

SEQ ID NO: 1208239 - RNA, 24 nt, Human
agccuguaaucccagcacuuuggg

SEQ ID NO: 1208240 - RNA, 22 nt, Human
aggagaaaagaacuggugagaa

SEQ ID NO: 1208241 - RNA, 24 nt, Human
aggcagaucacgaggucaggagau

SEQ ID NO: 1208242 - RNA, 24 nt, Human
aggcaggcagaucacgaggucagg

SEQ ID NO: 1208243 - RNA, 26 nt, Human
aggcaggcagaucacgaggucaggag

SEQ ID NO: 1208244 - RNA, 23 nt, Human
aggccgaggcaggcagaucacga

SEQ ID NO: 1208245 - RNA, 24 nt, Human
aggcggaguuugcagugagccaag

SEQ ID NO: 1208246 - RNA, 22 nt, Human
agguacuaaauggccacaaggc

SEQ ID NO: 1208247 - RNA, 20 nt, Human
augaccuugcaaguuaagga

SEQ ID NO: 1208248 - RNA, 23 nt, Human
caaaaacaaaaacaaaaaacaac

SEQ ID NO: 1208249 - RNA, 21 nt, Human
caaaaacaaaaacaaaaaacc

SEQ ID NO: 1208250 - RNA, 20 nt, Human
caaagcaaaacauaaacacc

SEQ ID NO: 1208251 - RNA, 18 nt, Human
caaauaaaagguaucacu

SEQ ID NO: 1208252 - RNA, 21 nt, Human
cacaaacccccaaagcaaaac

SEQ ID NO: 1208253 - RNA, 23 nt, Human
cacaaacccccaaagcaaaacau

SEQ ID NO: 1208254 - RNA, 19 nt, Human
cacaauauaaauagucauc

SEQ ID NO: 1208255 - RNA, 18 nt, Human
cacacaaacccccaaagc

SEQ ID NO: 1208256 - RNA, 22 nt, Human
cacacaaacccccaaagcaaaa

SEQ ID NO: 1208257 - RNA, 23 nt, Human
cacacaaacccccagcucccgga

SEQ ID NO: 1208258 - RNA, 24 nt, Human
cacacauacacacaaacccccaaa

SEQ ID NO: 1208259 - RNA, 23 nt, Human
caccuguaguccuagcuacuugg

SEQ ID NO: 1208260 - RNA, 24 nt, Human
caccuguaguccuagcuacuuggg

SEQ ID NO: 1208261 - RNA, 23 nt, Human
cacucccucuccccaaacuguaa

SEQ ID NO: 1208262 - RNA, 24 nt, Human
cagcacuuugggaggccgaggcag

SEQ ID NO: 1208263 - RNA, 25 nt, Human
cagcacuuugggaggccgaggcagg

SEQ ID NO: 1208264 - RNA, 20 nt, Human
caggagggagaaaaucuggg

SEQ ID NO: 1208265 - RNA, 22 nt, Human
caggcagaucacgaggucagga

SEQ ID NO: 1208266 - RNA, 19 nt, Human
cagugagucaggagggaga

SEQ ID NO: 1208267 - RNA, 19 nt, Human
cauccacucccucucccca

SEQ ID NO: 1208268 - RNA, 18 nt, Human
caugaaccuggaaggcgg

SEQ ID NO: 1208269 - RNA, 19 nt, Human
caugucaccacaccucugu

SEQ ID NO: 1208270 - RNA, 24 nt, Human
cauucuugucuuagagcuguaaaa

SEQ ID NO: 1208271 - RNA, 21 nt, Human
ccaaagcaaaacauaaacacc

SEQ ID NO: 1208272 - RNA, 18 nt, Human
ccacugcugagagccaca

SEQ ID NO: 1208273 - RNA, 23 nt, Human
ccacugcugagagccacaggccu

SEQ ID NO: 1208274 - RNA, 21 nt, Human
cccaaagcaaaacauaaacac

SEQ ID NO: 1208275 - RNA, 21 nt, Human
ccccaaagcaaaacauaaaca

SEQ ID NO: 1208276 - RNA, 20 nt, Human
cccccaaagcaaaacauaaa

SEQ ID NO: 1208277 - RNA, 23 nt, Human
cccccgaaaaaccuguucacagg

SEQ ID NO: 1208278 - RNA, 22 nt, Human
ccuggcuaacauggugaaaccc

SEQ ID NO: 1208279 - RNA, 23 nt, Human
ccuggcuaacauggugaaacccc

SEQ ID NO: 1208280 - RNA, 24 nt, Human
ccuggcuaacauggugaaacccca

SEQ ID NO: 1208281 - RNA, 18 nt, Human
ccugggaagacacggaga

SEQ ID NO: 1208282 - RNA, 24 nt, Human
cgagaccauccuggcuaacauggu

SEQ ID NO: 1208283 - RNA, 24 nt, Human
cgaggcaggcagaucacgagguca

SEQ ID NO: 1208284 - RNA, 21 nt, Human
cgggcaccuguaguccuagcu

SEQ ID NO: 1208285 - RNA, 18 nt, Human
cuagaguuuacauacccc

SEQ ID NO: 1208286 - RNA, 18 nt, Human
cuauaaaugagaaaagag

SEQ ID NO: 1208287 - RNA, 18 nt, Human
cucauagguuccaacuga

SEQ ID NO: 1208288 - RNA, 23 nt, Human
cuggcuaacauggugaaacccca

SEQ ID NO: 1208289 - RNA, 19 nt, Human
cuugaggaaugaaaaaaga

SEQ ID NO: 1208290 - RNA, 25 nt, Human
cuuucuuuccuccuuuuucuguuuu

SEQ ID NO: 1208291 - RNA, 19 nt, Human
gaccuguuuccucauucgu

SEQ ID NO: 1208292 - RNA, 22 nt, Human
gagaaaagagaggggaaaagaa

SEQ ID NO: 1208293 - RNA, 23 nt, Human
gaguuugcagugagccaagaucg

SEQ ID NO: 1208294 - RNA, 24 nt, Human
gcuaacauggugaaaccccaucuc

SEQ ID NO: 1208295 - RNA, 22 nt, Human
ggaaaaaaaaucagccauaauc

SEQ ID NO: 1208296 - RNA, 25 nt, Human
ggaaaaaacaaaaacaaaaacaaaa

SEQ ID NO: 1208297 - RNA, 24 nt, Human
ggaguuugcagugagccaagaucg

SEQ ID NO: 1208298 - RNA, 22 nt, Human
ggauccugucaaaaugcagauu

SEQ ID NO: 1208299 - RNA, 24 nt, Human
ggcaccuguaguccuagcuacuug

SEQ ID NO: 1208300 - RNA, 21 nt, Human
ggccuauugcuaaaguagcac

SEQ ID NO: 1208301 - RNA, 20 nt, Human
ggcgggcaccuguaguccua

SEQ ID NO: 1208302 - RNA, 26 nt, Human
gggaaaaaacaaaaacaaaaacaaaa

SEQ ID NO: 1208303 - RNA, 31 nt, Human
gggaaaaaacaaaaacaaaaacaaaaacaaa

SEQ ID NO: 1208304 - RNA, 19 nt, Human
gggcuuccucugacagacu

SEQ ID NO: 1208305 - RNA, 24 nt, Human
gggugugguggcgggcaccuguag

SEQ ID NO: 1208306 - RNA, 18 nt, Human
ggugugaggccugggaau

SEQ ID NO: 1208307 - RNA, 27 nt, Human
guaaaguguacacacaguuaggccccc

SEQ ID NO: 1208308 - RNA, 24 nt, Human
guuccaacugaauuguucuagggu

SEQ ID NO: 1208309 - RNA, 18 nt, Human
guuuaugcugggcuguuc

SEQ ID NO: 1208310 - RNA, 28 nt, Human
uaaaaacuacacacauacaaccuucagg

SEQ ID NO: 1208311 - RNA, 19 nt, Human
uaaauaaaaacuacacaca

SEQ ID NO: 1208312 - RNA, 22 nt, Human
uaacauggugaaaccccaucuc

SEQ ID NO: 1208313 - RNA, 24 nt, Human
uaacauggugaaaccccaucucua

SEQ ID NO: 1208314 - RNA, 20 nt, Human
uaagcaagagggcuccaaac

SEQ ID NO: 1208315 - RNA, 19 nt, Human
uaaggaaaaaaaaucagcc

SEQ ID NO: 1208316 - RNA, 22 nt, Human
uaggagaaaagaacuggugaga

SEQ ID NO: 1208317 - RNA, 20 nt, Human
uagggauggugguggcagcu

SEQ ID NO: 1208318 - RNA, 23 nt, Human
uagggauggugguggcagcuuca

SEQ ID NO: 1208319 - RNA, 20 nt, Human
uaggguggggucucagcacc

SEQ ID NO: 1208320 - RNA, 22 nt, Human
uagucacccaauguuggaguuu

SEQ ID NO: 1208321 - RNA, 22 nt, Human
uauaaauagucauccacucccu

SEQ ID NO: 1208322 - RNA, 23 nt, Human
ucaacucugacugcaucuuaaaa

SEQ ID NO: 1208323 - RNA, 18 nt, Human
ucaaguuuuagaugaccu

SEQ ID NO: 1208324 - RNA, 18 nt, Human
ucacgaggucaggagauc

SEQ ID NO: 1208325 - RNA, 24 nt, Human
ucacgaggucaggagaucgagacc

SEQ ID NO: 1208326 - RNA, 21 nt, Human
ucagagcuccaacaaaggaag

SEQ ID NO: 1208327 - RNA, 21 nt, Human
ucaggagggagaaaaucuggg

SEQ ID NO: 1208328 - RNA, 24 nt, Human
uccuccuuuuucuguuuuagagag

SEQ ID NO: 1208329 - RNA, 18 nt, Human
uccuugagaacaugaaga

SEQ ID NO: 1208330 - RNA, 23 nt, Human
ucucacccacacucugucuacag

SEQ ID NO: 1208331 - RNA, 22 nt, Human
ucucuacuaaaaauacaaaaaa

SEQ ID NO: 1208332 - RNA, 19 nt, Human
ucugaguaguucucaacuc

SEQ ID NO: 1208333 - RNA, 19 nt, Human
ugaaaccccaucucuacua

SEQ ID NO: 1208334 - RNA, 23 nt, Human
ugaagcaggagaauggcaugaac

SEQ ID NO: 1208335 - RNA, 24 nt, Human
ugaagcaggagaauggcaugaacc

SEQ ID NO: 1208336 - RNA, 22 nt, Human
ugacugcaucuuaaaauaacug

SEQ ID NO: 1208337 - RNA, 21 nt, Human
ugacuuuugugguugaagggg

SEQ ID NO: 1208338 - RNA, 20 nt, Human
ugagaaagugaaaugguagg

SEQ ID NO: 1208339 - RNA, 22 nt, Human
ugagaacaugaagacuccugac

SEQ ID NO: 1208340 - RNA, 21 nt, Human
ugagagccacaggccuauugc

SEQ ID NO: 1208341 - RNA, 19 nt, Human
ugagccaagaucgugccac

SEQ ID NO: 1208342 - RNA, 19 nt, Human
ugcagccacugcugagagc

SEQ ID NO: 1208343 - RNA, 23 nt, Human
ugcauguuuuggagaauucuguc

SEQ ID NO: 1208344 - RNA, 23 nt, Human
ugcugagagccacaggccuauug

SEQ ID NO: 1208345 - RNA, 21 nt, Human
uggaagauuaccuggggaucc

SEQ ID NO: 1208346 - RNA, 29 nt, Human
uggaaggcggaguuugcagugacaacggu

SEQ ID NO: 1208347 - RNA, 24 nt, Human
uggccacaaggcacaauauaaaua

SEQ ID NO: 1208348 - RNA, 19 nt, Human
uggcgggcaccuguagucc

SEQ ID NO: 1208349 - RNA, 20 nt, Human
ugggaggccgaggcaggcag

SEQ ID NO: 1208350 - RNA, 24 nt, Human
ugggaggccgaggcaggcagauca

SEQ ID NO: 1208351 - RNA, 23 nt, Human
ugggaggcugaagcaggagaaug

SEQ ID NO: 1208352 - RNA, 22 nt, Human
ugguggcgggcaccuguagucc

SEQ ID NO: 1208353 - RNA, 18 nt, Human
uguacacacaguuaggcc

SEQ ID NO: 1208354 - RNA, 22 nt, Human
uguagucaaacaauuauauaaa

SEQ ID NO: 1208355 - RNA, 19 nt, Human
uguccuugagaacaugaag

SEQ ID NO: 1208356 - RNA, 18 nt, Human
ugugaggccugggaaugc

SEQ ID NO: 1208357 - RNA, 23 nt, Human
ugugguggcgggcaccuguaguc

SEQ ID NO: 1208358 - RNA, 21 nt, Human
uguuuuggagaauucugucag

SEQ ID NO: 1208359 - RNA, 18 nt, Human
uuagccgggugugguggc

SEQ ID NO: 1208360 - RNA, 24 nt, Human
uuagccgggugugguggcgggcac

SEQ ID NO: 1208361 - RNA, 22 nt, Human
uugcagugagccaagaucgugc

SEQ ID NO: 1208362 - RNA, 25 nt, Human
uugggaggccgaggcaggcagauca

SEQ ID NO: 1208363 - RNA, 22 nt, Human
uuuagagaguaguguguauaag

SEQ ID NO: 1208364 - RNA, 18 nt, Human
uuugcaaaggccucaaag

SEQ ID NO: 1208365 - RNA, 22 nt, Human
uuugcaaaggccucaaagaggu

SEQ ID NO: 1208366 - RNA, 24 nt, Human
uuugcagugagccaagaucgugcc

SEQ ID NO: 1208367 - RNA, 23 nt, Human
uuuguagagaccgccaaaguaaa

SEQ ID NO: 1208368 - RNA, 28 nt, Human
acacucaucucuccugucagcuccucca

SEQ ID NO: 1208369 - RNA, 21 nt, Human
agcucucacacucaucucucc

SEQ ID NO: 1208370 - RNA, 20 nt, Human
agugcugagauugagccccu

SEQ ID NO: 1208371 - RNA, 21 nt, Human
agugcugagauugagccccuu

SEQ ID NO: 1208372 - RNA, 18 nt, Human
caacuggaagacuagaug

SEQ ID NO: 1208373 - RNA, 21 nt, Human
cuagggucccaacuggaagac

SEQ ID NO: 1208374 - RNA, 21 nt, Human
cuggacacuuccuguggcuga

SEQ ID NO: 1208375 - RNA, 19 nt, Human
gucagcuccuccaaccccc

SEQ ID NO: 1208376 - RNA, 20 nt, Human
ucccagcucucacacucauc

SEQ ID NO: 1208377 - RNA, 21 nt, Human
uccugcccaucccagcucuca

SEQ ID NO: 1208378 - RNA, 22 nt, Human
uccugucagcuccuccaacccc

SEQ ID NO: 1208379 - RNA, 18 nt, Human
ucuccugucuggacacuu

SEQ ID NO: 1208380 - RNA, 21 nt, Human
uguggcugacugccuuggcag

SEQ ID NO: 1208381 - RNA, 19 nt, Human
uuccuguggcugacugccu

SEQ ID NO: 1208382 - RNA, 22 nt, Human
uuccuguggcugacugccuugg

SEQ ID NO: 1208383 - RNA, 21 nt, Human
aagcccagcagauguccggga

SEQ ID NO: 1208384 - RNA, 22 nt, Human
aagcugaagcccucuggaucug

SEQ ID NO: 1208385 - RNA, 21 nt, Human
accuccucacuggaaucggaa

SEQ ID NO: 1208386 - RNA, 24 nt, Human
acucccuggucuuccucccugcug

SEQ ID NO: 1208387 - RNA, 18 nt, Human
agcagcugggccugaccu

SEQ ID NO: 1208388 - RNA, 19 nt, Human
agcccagccaagcccagca

SEQ ID NO: 1208389 - RNA, 23 nt, Human
agcugagcccagccaagcccagc

SEQ ID NO: 1208390 - RNA, 23 nt, Human
aggcacucagcucgccagaccuc

SEQ ID NO: 1208391 - RNA, 24 nt, Human
aggcaggaaagccucuccccaggg

SEQ ID NO: 1208392 - RNA, 21 nt, Human
aggcagguaacucuccuugca

SEQ ID NO: 1208393 - RNA, 21 nt, Human
aggccguggcugugggccccu

SEQ ID NO: 1208394 - RNA, 18 nt, Human
aggcgaggcaguccuggc

SEQ ID NO: 1208395 - RNA, 22 nt, Human
agguccucaauuucccucugca

SEQ ID NO: 1208396 - RNA, 20 nt, Human
auggcgccaguccgggcagc

SEQ ID NO: 1208397 - RNA, 24 nt, Human
augggagcuggcagaaccuacaca

SEQ ID NO: 1208398 - RNA, 25 nt, Human
caaaucgaggccguggcugugggcc

SEQ ID NO: 1208399 - RNA, 24 nt, Human
caaccagcacgcccuuuguggggc

SEQ ID NO: 1208400 - RNA, 20 nt, Human
cacaggcagguaacucuccu

SEQ ID NO: 1208401 - RNA, 19 nt, Human
caccgaggacagcccuggg

SEQ ID NO: 1208402 - RNA, 21 nt, Human
cacuggaaucggaaucuguca

SEQ ID NO: 1208403 - RNA, 23 nt, Human
cagcuccugagcagcugggccug

SEQ ID NO: 1208404 - RNA, 21 nt, Human
caggucgaaaccggccccaca

SEQ ID NO: 1208405 - RNA, 21 nt, Human
caucaagggcaggcacucagc

SEQ ID NO: 1208406 - RNA, 24 nt, Human
ccagcucucccacagccggccucu

SEQ ID NO: 1208407 - RNA, 22 nt, Human
cccagggccaguugagaggcac

SEQ ID NO: 1208408 - RNA, 20 nt, Human
ccccagagcaccacccuucc

SEQ ID NO: 1208409 - RNA, 21 nt, Human
ccccuagggacuucuuccccc

SEQ ID NO: 1208410 - RNA, 21 nt, Human
ccccugcagcggcagcuccug

SEQ ID NO: 1208411 - RNA, 18 nt, Human
ccccuggggcuccggggc

SEQ ID NO: 1208412 - RNA, 20 nt, Human
ccccuggggcuccggggcug

SEQ ID NO: 1208413 - RNA, 19 nt, Human
cccggccccagagcaccac

SEQ ID NO: 1208414 - RNA, 22 nt, Human
cccugcucugcauuuucuucug

SEQ ID NO: 1208415 - RNA, 21 nt, Human
cccuuuguggggcgaggugcc

SEQ ID NO: 1208416 - RNA, 20 nt, Human
ccggccccagagcaccaccc

SEQ ID NO: 1208417 - RNA, 23 nt, Human
ccgggacagcgaguggcuuccuc

SEQ ID NO: 1208418 - RNA, 20 nt, Human
ccguggcugugggccccugg

SEQ ID NO: 1208419 - RNA, 23 nt, Human
ccguggcugugggccccuggggc

SEQ ID NO: 1208420 - RNA, 22 nt, Human
ccuacacacaccuccucacugg

SEQ ID NO: 1208421 - RNA, 20 nt, Human
ccugagcagcugggccugac

SEQ ID NO: 1208422 - RNA, 21 nt, Human
ccugugggugggaaguugggc

SEQ ID NO: 1208423 - RNA, 23 nt, Human
ccuugacgccggcgccgagccuu

SEQ ID NO: 1208424 - RNA, 18 nt, Human
cgaggccguggcuguggg

SEQ ID NO: 1208425 - RNA, 19 nt, Human
cgcacagacaggcgaggca

SEQ ID NO: 1208426 - RNA, 26 nt, Human
cggguguaggugggauucugcucagg

SEQ ID NO: 1208427 - RNA, 19 nt, Human
cucagacucgaagcugaag

SEQ ID NO: 1208428 - RNA, 24 nt, Human
cucauggcgccaguccgggcagcc

SEQ ID NO: 1208429 - RNA, 23 nt, Human
cucccgggcuguaggccgagggc

SEQ ID NO: 1208430 - RNA, 26 nt, Human
cugcucagggcucugccacuguggcu

SEQ ID NO: 1208431 - RNA, 22 nt, Human
cuggaaucggaaucugugccca

SEQ ID NO: 1208432 - RNA, 23 nt, Human
gccaucuuccuccucgaaaggcc

SEQ ID NO: 1208433 - RNA, 19 nt, Human
gcccaaaucugggaccugc

SEQ ID NO: 1208434 - RNA, 20 nt, Human
gcccuggggcagggccccug

SEQ ID NO: 1208435 - RNA, 24 nt, Human
gcccuugacgccggcgccgagccu

SEQ ID NO: 1208436 - RNA, 20 nt, Human
gcgaggcaguccuggccugu

SEQ ID NO: 1208437 - RNA, 23 nt, Human
gcucagggcucugccacuguggc

SEQ ID NO: 1208438 - RNA, 18 nt, Human
gcucugccacuguggcug

SEQ ID NO: 1208439 - RNA, 18 nt, Human
ggaaucggaaucugugcc

SEQ ID NO: 1208440 - RNA, 20 nt, Human
ggacagcgaguggcuuccuc

SEQ ID NO: 1208441 - RNA, 18 nt, Human
ggcagcccuggcgccggg

SEQ ID NO: 1208442 - RNA, 20 nt, Human
ggccccuggggcuccggggc

SEQ ID NO: 1208443 - RNA, 23 nt, Human
ggccguggcugugggccccuggg

SEQ ID NO: 1208444 - RNA, 20 nt, Human
ggcgaugggagcuggcagaa

SEQ ID NO: 1208445 - RNA, 19 nt, Human
ggcugcaucaagggcaggc

SEQ ID NO: 1208446 - RNA, 20 nt, Human
ggggcugcugcugccuuucc

SEQ ID NO: 1208447 - RNA, 21 nt, Human
gggggcugcugcugccuuucc

SEQ ID NO: 1208448 - RNA, 24 nt, Human
guccucaauuucccucugcagcca

SEQ ID NO: 1208449 - RNA, 23 nt, Human
gugcauggcgucugggcacgagg

SEQ ID NO: 1208450 - RNA, 18 nt, Human
gugcuuaggcuuuugggg

SEQ ID NO: 1208451 - RNA, 24 nt, Human
uagggacuucuuccccccggccau

SEQ ID NO: 1208452 - RNA, 18 nt, Human
uccccaggcccugcucug

SEQ ID NO: 1208453 - RNA, 18 nt, Human
uccccccggccaucuucc

SEQ ID NO: 1208454 - RNA, 21 nt, Human
uccccccggccaucuuccucc

SEQ ID NO: 1208455 - RNA, 20 nt, Human
ucccggccccagagcaccac

SEQ ID NO: 1208456 - RNA, 24 nt, Human
ucccggccccagagcaccacccuu

SEQ ID NO: 1208457 - RNA, 19 nt, Human
ucccgggggcugcugcugc

SEQ ID NO: 1208458 - RNA, 22 nt, Human
ucccugcugguuucuucccagg

SEQ ID NO: 1208459 - RNA, 18 nt, Human
ucccuggucuuccucccc

SEQ ID NO: 1208460 - RNA, 23 nt, Human
uccugagcagcugggccugaccu

SEQ ID NO: 1208461 - RNA, 24 nt, Human
uccugagcagcugggccugaccuc

SEQ ID NO: 1208462 - RNA, 21 nt, Human
ucucuccgcaggcaggaaagc

SEQ ID NO: 1208463 - RNA, 21 nt, Human
ucucucggcgaugggagcugg

SEQ ID NO: 1208464 - RNA, 21 nt, Human
ucucuggccgcagccugggac

SEQ ID NO: 1208465 - RNA, 21 nt, Human
ucucuggccgcagccugggac

SEQ ID NO: 1208466 - RNA, 24 nt, Human
ucugcagccagaugcaccgaggac

SEQ ID NO: 1208467 - RNA, 22 nt, Human
ucuggggagaguccuccagcuc

SEQ ID NO: 1208468 - RNA, 19 nt, Human
ucugugcccaaaucuggga

SEQ ID NO: 1208469 - RNA, 24 nt, Human
ucuugccaucgccgcugcccggca

SEQ ID NO: 1208470 - RNA, 19 nt, Human
ugcagcggcagcuccugag

SEQ ID NO: 1208471 - RNA, 21 nt, Human
ugcaguggaagcuugccuguc

SEQ ID NO: 1208472 - RNA, 22 nt, Human
ugcauggcgucugggcacgagg

SEQ ID NO: 1208473 - RNA, 20 nt, Human
ugcggcaaaugccuaccuuc

SEQ ID NO: 1208474 - RNA, 19 nt, Human
ugcugaauucuccacgacg

SEQ ID NO: 1208475 - RNA, 22 nt, Human
uggcagaaccuacacacaccuc

SEQ ID NO: 1208476 - RNA, 20 nt, Human
uggcagcccuggcgccgggu

SEQ ID NO: 1208477 - RNA, 19 nt, Human
uggcgccaguccgggcagc

SEQ ID NO: 1208478 - RNA, 19 nt, Human
uggcugcaucaagggcagg

SEQ ID NO: 1208479 - RNA, 21 nt, Human
ugggcacgaggccucccgggc

SEQ ID NO: 1208480 - RNA, 20 nt, Human
ugggccccuggggcuccggg

SEQ ID NO: 1208481 - RNA, 20 nt, Human
ugggguuucuuggacauccc

SEQ ID NO: 1208482 - RNA, 24 nt, Human
uguaggccgagggcucugaaguuc

SEQ ID NO: 1208483 - RNA, 18 nt, Human
uguccgggacagcgagug

SEQ ID NO: 1208484 - RNA, 20 nt, Human
uguccgggacagcgaguggc

SEQ ID NO: 1208485 - RNA, 24 nt, Human
uguggcugcaucaagggcaggcac

SEQ ID NO: 1208486 - RNA, 24 nt, Human
ugugggccccuggggcuccggggc

SEQ ID NO: 1208487 - RNA, 25 nt, Human
ugugggccccuggggcuccggggcu

SEQ ID NO: 1208488 - RNA, 18 nt, Human
uucccagggcugcugugc

SEQ ID NO: 1208489 - RNA, 22 nt, Human
uucccggccccagagcaccacc

SEQ ID NO: 1208490 - RNA, 20 nt, Human
uuccggucuugggggaugga

SEQ ID NO: 1208491 - RNA, 25 nt, Human
uuccuccucgaaaggcccuggggca

SEQ ID NO: 1208492 - RNA, 19 nt, Human
aaauauccuuucuaagguc

SEQ ID NO: 1208493 - RNA, 19 nt, Human
aagcugaacgccugccacc

SEQ ID NO: 1208494 - RNA, 18 nt, Human
aaggagagcacagccaag

SEQ ID NO: 1208495 - RNA, 22 nt, Human
aaggucccuacaaagggaguga

SEQ ID NO: 1208496 - RNA, 24 nt, Human
aauugggauccaaaauauccuuuc

SEQ ID NO: 1208497 - RNA, 21 nt, Human
acgccugccaccuugacugug

SEQ ID NO: 1208498 - RNA, 19 nt, Human
acuguggguguuccaauca

SEQ ID NO: 1208499 - RNA, 23 nt, Human
agacagggccagacaguuuucua

SEQ ID NO: 1208500 - RNA, 25 nt, Human
agcaaugccaguggccucaguggca

SEQ ID NO: 1208501 - RNA, 22 nt, Human
aggcuaaggagagcacagccaa

SEQ ID NO: 1208502 - RNA, 20 nt, Human
aggucuccgcuccccuccac

SEQ ID NO: 1208503 - RNA, 20 nt, Human
aggugaugcaggaaccagag

SEQ ID NO: 1208504 - RNA, 22 nt, Human
caaaauauccuuucuaaggucc

SEQ ID NO: 1208505 - RNA, 21 nt, Human
cacagccaagggccagaaccg

SEQ ID NO: 1208506 - RNA, 18 nt, Human
cagggucuggugcagagc

SEQ ID NO: 1208507 - RNA, 23 nt, Human
caugggggugauuggcaaugaug

SEQ ID NO: 1208508 - RNA, 21 nt, Human
ccaagggccagaacuuaagau

SEQ ID NO: 1208509 - RNA, 18 nt, Human
cuaccucugucucccuaa

SEQ ID NO: 1208510 - RNA, 24 nt, Human
gaaccagaggcagacagggccaga

SEQ ID NO: 1208511 - RNA, 18 nt, Human
gaauggaggagaucugga

SEQ ID NO: 1208512 - RNA, 19 nt, Human
gagagcacagccaagggcc

SEQ ID NO: 1208513 - RNA, 21 nt, Human
gcaaugauguaguuguguuug

SEQ ID NO: 1208514 - RNA, 20 nt, Human
gcuccccuccacuuucagau

SEQ ID NO: 1208515 - RNA, 18 nt, Human
ggaaaauccgagcaaugc

SEQ ID NO: 1208516 - RNA, 20 nt, Human
uacccaagcugaacgccugc

SEQ ID NO: 1208517 - RNA, 21 nt, Human
ucagaugggugaauggaggag

SEQ ID NO: 1208518 - RNA, 20 nt, Human
uccaaaauauccuuucuaag

SEQ ID NO: 1208519 - RNA, 19 nt, Human
ucuaaggucccuacaaagg

SEQ ID NO: 1208520 - RNA, 21 nt, Human
ucugucucccuaacaucuggg

SEQ ID NO: 1208521 - RNA, 20 nt, Human
ugaagacaccaaaagagaga

SEQ ID NO: 1208522 - RNA, 24 nt, Human
ugaugcaggaaccagaggcagaca

SEQ ID NO: 1208523 - RNA, 20 nt, Human
ugccaccuugacugugggug

SEQ ID NO: 1208524 - RNA, 21 nt, Human
uggaaagggcucaaggugaug

SEQ ID NO: 1208525 - RNA, 19 nt, Human
ugggaaaauccgagcaaug

SEQ ID NO: 1208526 - RNA, 22 nt, Human
uguuugggagaaagaucaugag

SEQ ID NO: 1208527 - RNA, 23 nt, Human
uuacugggaaguaauuucggaaa

SEQ ID NO: 1208528 - RNA, 23 nt, Human
uuggcaaugauguaguuguguuu

SEQ ID NO: 1208529 - RNA, 20 nt, Human
acccguuucaccacccuccc

SEQ ID NO: 1208530 - RNA, 21 nt, Human
agcccccagccccaaucccag

SEQ ID NO: 1208531 - RNA, 20 nt, Human
cagcccccagccccaauccc

SEQ ID NO: 1208532 - RNA, 20 nt, Human
cccagccccaaucccaguac

SEQ ID NO: 1208533 - RNA, 23 nt, Human
ccccagccccaaucccaguaccc

SEQ ID NO: 1208534 - RNA, 23 nt, Human
cccccagccccaaucccaguacc

SEQ ID NO: 1208535 - RNA, 22 nt, Human
ccucuuagacagcccccagccc

SEQ ID NO: 1208536 - RNA, 21 nt, Human
ucuuagacagcccccagcccc

SEQ ID NO: 1208537 - RNA, 23 nt, Human
uuccaguugucagcuuuuuuguu

SEQ ID NO: 1208538 - RNA, 19 nt, Human
agggaugggcuucguuugu

SEQ ID NO: 1208539 - RNA, 19 nt, Human
auccaaccaguuguucugg

SEQ ID NO: 1208540 - RNA, 24 nt, Human
caagauucugacucgguuggucca

SEQ ID NO: 1208541 - RNA, 18 nt, Human
caaggggccgcagccaau

SEQ ID NO: 1208542 - RNA, 23 nt, Human
caccagagaacgccacaagcucc

SEQ ID NO: 1208543 - RNA, 18 nt, Human
cagccaauagggcaggca

SEQ ID NO: 1208544 - RNA, 23 nt, Human
caggcaggcugguucccucccaa

SEQ ID NO: 1208545 - RNA, 26 nt, Human
ccaaugccuggugggucuagaccaag

SEQ ID NO: 1208546 - RNA, 20 nt, Human
ccgcagccaauagggcaggc

SEQ ID NO: 1208547 - RNA, 24 nt, Human
cucccaagaguaauccaaccaguu

SEQ ID NO: 1208548 - RNA, 21 nt, Human
cucccaggcacugcugcugca

SEQ ID NO: 1208549 - RNA, 18 nt, Human
gaccaagauucugacucg

SEQ ID NO: 1208550 - RNA, 20 nt, Human
gggggcccaagcaggggugu

SEQ ID NO: 1208551 - RNA, 23 nt, Human
gucuagaccaagauucugacucg

SEQ ID NO: 1208552 - RNA, 20 nt, Human
gugggucuagaccaagauuc

SEQ ID NO: 1208553 - RNA, 19 nt, Human
gugggucuagaccaaugcc

SEQ ID NO: 1208554 - RNA, 19 nt, Human
ucccaagaguaauccaacc

SEQ ID NO: 1208555 - RNA, 22 nt, Human
ugguccagggggcccaagcagg

SEQ ID NO: 1208556 - RNA, 19 nt, Human
agggaugggcuucguuugu

SEQ ID NO: 1208557 - RNA, 19 nt, Human
auccaaccaguuguucugg

SEQ ID NO: 1208558 - RNA, 24 nt, Human
caagauucugacucgguuggucca

SEQ ID NO: 1208559 - RNA, 18 nt, Human
caaggggccgcagccaau

SEQ ID NO: 1208560 - RNA, 23 nt, Human
caccagagaacgccacaagcucc

SEQ ID NO: 1208561 - RNA, 18 nt, Human
cagccaauagggcaggca

SEQ ID NO: 1208562 - RNA, 23 nt, Human
caggcaggcugguucccucccaa

SEQ ID NO: 1208563 - RNA, 26 nt, Human
ccaaugccuggugggucuagaccaag

SEQ ID NO: 1208564 - RNA, 20 nt, Human
ccgcagccaauagggcaggc

SEQ ID NO: 1208565 - RNA, 24 nt, Human
cucccaagaguaauccaaccaguu

SEQ ID NO: 1208566 - RNA, 21 nt, Human
cucccaggcacugcugcugca

SEQ ID NO: 1208567 - RNA, 18 nt, Human
gaccaagauucugacucg

SEQ ID NO: 1208568 - RNA, 20 nt, Human
gggggcccaagcaggggugu

SEQ ID NO: 1208569 - RNA, 23 nt, Human
gucuagaccaagauucugacucg

SEQ ID NO: 1208570 - RNA, 19 nt, Human
gugggucuagaccaaugcc

SEQ ID NO: 1208571 - RNA, 19 nt, Human
ucccaagaguaauccaacc

SEQ ID NO: 1208572 - RNA, 22 nt, Human
ugguccagggggcccaagcagg

SEQ ID NO: 1208573 - RNA, 22 nt, Human
uggugggucuagaccaagauuc

SEQ ID NO: 1208574 - RNA, 19 nt, Human
aagccccuggguccugccu

SEQ ID NO: 1208575 - RNA, 23 nt, Human
aagcuccaaaggcaucccaagcc

SEQ ID NO: 1208576 - RNA, 21 nt, Human
acacaaaggcccagagaggcc

SEQ ID NO: 1208577 - RNA, 24 nt, Human
accacuuucaagaagagagugcca

SEQ ID NO: 1208578 - RNA, 18 nt, Human
acggggcugggaaccugc

SEQ ID NO: 1208579 - RNA, 22 nt, Human
acugccaggaccauguucucca

SEQ ID NO: 1208580 - RNA, 19 nt, Human
agaaaagcuccaaaggcaa

SEQ ID NO: 1208581 - RNA, 22 nt, Human
agacagggcaccgcuggaccug

SEQ ID NO: 1208582 - RNA, 20 nt, Human
agccucuaaaagccaccagc

SEQ ID NO: 1208583 - RNA, 24 nt, Human
agcgccaagaccggccaagaagga

SEQ ID NO: 1208584 - RNA, 26 nt, Human
agcgccaagaccggccaagaaggaca

SEQ ID NO: 1208585 - RNA, 20 nt, Human
aggcaugggcaggggaugcc

SEQ ID NO: 1208586 - RNA, 20 nt, Human
aggcccuuggccccagacag

SEQ ID NO: 1208587 - RNA, 22 nt, Human
auggcauagagguaaaggggcc

SEQ ID NO: 1208588 - RNA, 22 nt, Human
auuugccuugacccucagcugg

SEQ ID NO: 1208589 - RNA, 23 nt, Human
caccaggcccuuggccccagaca

SEQ ID NO: 1208590 - RNA, 20 nt, Human
cacuccugacuccccagccg

SEQ ID NO: 1208591 - RNA, 21 nt, Human
cacucuacugcucccccuggg

SEQ ID NO: 1208592 - RNA, 23 nt, Human
cacucuggaagccucuaaaagcc

SEQ ID NO: 1208593 - RNA, 18 nt, Human
cagcucaggaaagggcuc

SEQ ID NO: 1208594 - RNA, 20 nt, Human
cagcuccuggaacugcugcu

SEQ ID NO: 1208595 - RNA, 20 nt, Human
cagcugcccaagguccaagc

SEQ ID NO: 1208596 - RNA, 18 nt, Human
cagcugggaacccucccg

SEQ ID NO: 1208597 - RNA, 21 nt, Human
ccaaaggcaucccaagcccaa

SEQ ID NO: 1208598 - RNA, 22 nt, Human
ccaagcccaaugcaaagacuga

SEQ ID NO: 1208599 - RNA, 19 nt, Human
ccaggaccauguucuccag

SEQ ID NO: 1208600 - RNA, 24 nt, Human
cccaauggcauagagguaaagggg

SEQ ID NO: 1208601 - RNA, 20 nt, Human
cccacgcccaacucggcaca

SEQ ID NO: 1208602 - RNA, 23 nt, Human
cccagagaggcccccagacaugc

SEQ ID NO: 1208603 - RNA, 20 nt, Human
cccccgccgccacccacgcc

SEQ ID NO: 1208604 - RNA, 22 nt, Human
cccccgccgccacccacgccca

SEQ ID NO: 1208605 - RNA, 22 nt, Human
ccccuagggugcucuggggcag

SEQ ID NO: 1208606 - RNA, 19 nt, Human
ccccuggguccugccuggg

SEQ ID NO: 1208607 - RNA, 22 nt, Human
ccccuggguccugccugggcuu

SEQ ID NO: 1208608 - RNA, 22 nt, Human
cccgcagggcuccagccaugcu

SEQ ID NO: 1208609 - RNA, 22 nt, Human
cccgccgccacccacgcccaac

SEQ ID NO: 1208610 - RNA, 22 nt, Human
cccggaagccccuggguccugc

SEQ ID NO: 1208611 - RNA, 23 nt, Human
cccuggguccugccugggcugcu

SEQ ID NO: 1208612 - RNA, 18 nt, Human
cccuuggccccagacagg

SEQ ID NO: 1208613 - RNA, 19 nt, Human
ccgcagggcuccagccaug

SEQ ID NO: 1208614 - RNA, 20 nt, Human
ccgccgccacccacgcccaa

SEQ ID NO: 1208615 - RNA, 23 nt, Human
ccgccgccacccacgcccaacuc

SEQ ID NO: 1208616 - RNA, 21 nt, Human
ccucccggugcgggaagguug

SEQ ID NO: 1208617 - RNA, 19 nt, Human
ccucuaaaagccaccagcu

SEQ ID NO: 1208618 - RNA, 25 nt, Human
cgggaagguuggcggguaaggcccc

SEQ ID NO: 1208619 - RNA, 19 nt, Human
cgggacagggucuggcugc

SEQ ID NO: 1208620 - RNA, 23 nt, Human
cucuacugcucccccugggccca

SEQ ID NO: 1208621 - RNA, 19 nt, Human
cucugugcccggaagcccc

SEQ ID NO: 1208622 - RNA, 23 nt, Human
cugaacggggcugggaaccugcu

SEQ ID NO: 1208623 - RNA, 19 nt, Human
cugcccaagguccaagcga

SEQ ID NO: 1208624 - RNA, 22 nt, Human
cuggaaaaagcugaaguccacc

SEQ ID NO: 1208625 - RNA, 24 nt, Human
cuggaagccucuaaaagccaccag

SEQ ID NO: 1208626 - RNA, 24 nt, Human
cuggggccccccgcagggcuccag

SEQ ID NO: 1208627 - RNA, 23 nt, Human
cugugcccggaagccccuggguc

SEQ ID NO: 1208628 - RNA, 23 nt, Human
cugugcccggaagccccuggguc

SEQ ID NO: 1208629 - RNA, 21 nt, Human
gaaagacccccgccgccaccc

SEQ ID NO: 1208630 - RNA, 18 nt, Human
gaaauucaggcaaagcug

SEQ ID NO: 1208631 - RNA, 19 nt, Human
gaccuggggccgaggagga

SEQ ID NO: 1208632 - RNA, 18 nt, Human
gagcucugagagaccacu

SEQ ID NO: 1208633 - RNA, 20 nt, Human
gccacucuacugcucccccu

SEQ ID NO: 1208634 - RNA, 21 nt, Human
gcccggaagccccuggguccu

SEQ ID NO: 1208635 - RNA, 19 nt, Human
gcccugcagcaggcgagac

SEQ ID NO: 1208636 - RNA, 22 nt, Human
gcgagaccuggaugguccaugg

SEQ ID NO: 1208637 - RNA, 23 nt, Human
gcgccaagaccggccaagaagga

SEQ ID NO: 1208638 - RNA, 21 nt, Human
gcugcugguagcugcugcggg

SEQ ID NO: 1208639 - RNA, 21 nt, Human
gcugggaaccugcugcagaag

SEQ ID NO: 1208640 - RNA, 21 nt, Human
ggaccgggccagcucaggaaa

SEQ ID NO: 1208641 - RNA, 20 nt, Human
ggcacuguccaagaagauac

SEQ ID NO: 1208642 - RNA, 18 nt, Human
ggcagcuccuuugggacc

SEQ ID NO: 1208643 - RNA, 18 nt, Human
ggcauggggauggaaaga

SEQ ID NO: 1208644 - RNA, 23 nt, Human
ggcccuuggccccagacaggucc

SEQ ID NO: 1208645 - RNA, 20 nt, Human
gggacccucaauggagccag

SEQ ID NO: 1208646 - RNA, 20 nt, Human
gggcagcagcugcccaaggu

SEQ ID NO: 1208647 - RNA, 23 nt, Human
gggccaagcacacucuggaagcc

SEQ ID NO: 1208648 - RNA, 19 nt, Human
gggccgggacagggucugg

SEQ ID NO: 1208649 - RNA, 19 nt, Human
gggcuccagccaugcucag

SEQ ID NO: 1208650 - RNA, 22 nt, Human
ggggcugggaaccugcugcaga

SEQ ID NO: 1208651 - RNA, 21 nt, Human
gggugguaggcaugggcaggg

SEQ ID NO: 1208652 - RNA, 23 nt, Human
ggguguuuuaacuggaaaaagcu

SEQ ID NO: 1208653 - RNA, 19 nt, Human
guccaauggcauggggaug

SEQ ID NO: 1208654 - RNA, 23 nt, Human
ucaauggucccauuaaugagccu

SEQ ID NO: 1208655 - RNA, 20 nt, Human
uccaagcgagaggccacucu

SEQ ID NO: 1208656 - RNA, 18 nt, Human
uccauggcgggugguagg

SEQ ID NO: 1208657 - RNA, 24 nt, Human
ucccauuaaugagccuguacaugg

SEQ ID NO: 1208658 - RNA, 20 nt, Human
uccccggaaacacugggcug

SEQ ID NO: 1208659 - RNA, 21 nt, Human
uccccggaaacacugggcugg

SEQ ID NO: 1208660 - RNA, 21 nt, Human
ucccggugcgggaagguuggc

SEQ ID NO: 1208661 - RNA, 19 nt, Human
uccuggaacugcugcuugu

SEQ ID NO: 1208662 - RNA, 19 nt, Human
ucugagagaccacuguggc

SEQ ID NO: 1208663 - RNA, 22 nt, Human
ucuggaagccucuaaaagccac

SEQ ID NO: 1208664 - RNA, 18 nt, Human
ugacuauggaaagacccc

SEQ ID NO: 1208665 - RNA, 19 nt, Human
ugacuccccagccgcagcc

SEQ ID NO: 1208666 - RNA, 24 nt, Human
ugacuccccagccgcagccacucu

SEQ ID NO: 1208667 - RNA, 18 nt, Human
ugcacgcuaccagcaguc

SEQ ID NO: 1208668 - RNA, 19 nt, Human
ugcaugcacgcuaccagca

SEQ ID NO: 1208669 - RNA, 21 nt, Human
ugcaugggccgggacaggguc

SEQ ID NO: 1208670 - RNA, 19 nt, Human
ugcccggaagccccugggu

SEQ ID NO: 1208671 - RNA, 18 nt, Human
uggaaaaagcugaagucc

SEQ ID NO: 1208672 - RNA, 24 nt, Human
uggaaaaagcugaaguccaccucg

SEQ ID NO: 1208673 - RNA, 21 nt, Human
uggcauggggauggaaagaaa

SEQ ID NO: 1208674 - RNA, 24 nt, Human
uggcugugcccaucugccgaacaa

SEQ ID NO: 1208675 - RNA, 24 nt, Human
uggggccccccgcaggggggacac

SEQ ID NO: 1208676 - RNA, 23 nt, Human
uggggggcagaacaaacagguug

SEQ ID NO: 1208677 - RNA, 24 nt, Human
uggggggcagaacaaacagguuga

SEQ ID NO: 1208678 - RNA, 20 nt, Human
ugucguggcugugcccaucu

SEQ ID NO: 1208679 - RNA, 18 nt, Human
uucucagcuccuggaacu

SEQ ID NO: 1208680 - RNA, 21 nt, Human
uuggccccagacagguccaaa

SEQ ID NO: 1208681 - RNA, 20 nt, Human
acugaguguuugagccuauc

SEQ ID NO: 1208682 - RNA, 21 nt, Human
uugagccuaucagagacucau

SEQ ID NO: 1208683 - RNA, 21 nt, Human
aagagcccacgccagcccgcc

SEQ ID NO: 1208684 - RNA, 22 nt, Human
accgcuggggguuuggccucaa

SEQ ID NO: 1208685 - RNA, 18 nt, Human
agcaccggcaaggggcug

SEQ ID NO: 1208686 - RNA, 23 nt, Human
aggcgcacgugggcaagaagucc

SEQ ID NO: 1208687 - RNA, 22 nt, Human
ccggcacccgggcccuucucac

SEQ ID NO: 1208688 - RNA, 20 nt, Human
cggaauagcgggaccggcac

SEQ ID NO: 1208689 - RNA, 19 nt, Human
cucccgccgccucucagcc

SEQ ID NO: 1208690 - RNA, 19 nt, Human
cucucagccuaucugcacc

SEQ ID NO: 1208691 - RNA, 19 nt, Human
cuuggaggcgggccguucc

SEQ ID NO: 1208692 - RNA, 22 nt, Human
uccccgagguugucuuggaggc

SEQ ID NO: 1208693 - RNA, 21 nt, Human
ugagacuugccacccugucuu

SEQ ID NO: 1208694 - RNA, 19 nt, Human
uggaggcgggccguucccu

SEQ ID NO: 1208695 - RNA, 19 nt, Human
uggcagcaccggcaagggg

SEQ ID NO: 1208696 - RNA, 21 nt, Human
uggggguuuggccucaaacuu

SEQ ID NO: 1208697 - RNA, 23 nt, Human
ugggguaggaugcccccucccca

SEQ ID NO: 1208698 - RNA, 25 nt, Human
ugggguaggaugcccccuccccauu

SEQ ID NO: 1208699 - RNA, 21 nt, Human
uucucacguggcagcaccggc

SEQ ID NO: 1208700 - RNA, 22 nt, Human
aagaacugaagccuccuuggcc

SEQ ID NO: 1208701 - RNA, 19 nt, Human
aagaagaugccuaggcuuu

SEQ ID NO: 1208702 - RNA, 22 nt, Human
aagaauaaagcugucaaggaaa

SEQ ID NO: 1208703 - RNA, 21 nt, Human
aagacccuuucuacuccaccc

SEQ ID NO: 1208704 - RNA, 24 nt, Human
aagacccuuucuacuccaccccaa

SEQ ID NO: 1208705 - RNA, 23 nt, Human
aaggagcaaggacagaggucagg

SEQ ID NO: 1208706 - RNA, 18 nt, Human
aaggagcugcuucgcagg

SEQ ID NO: 1208707 - RNA, 20 nt, Human
accacuuucacaaagaauaa

SEQ ID NO: 1208708 - RNA, 21 nt, Human
accacuuucacaaagaauaaa

SEQ ID NO: 1208709 - RNA, 23 nt, Human
accccaaaagauagccgcuuugu

SEQ ID NO: 1208710 - RNA, 26 nt, Human
accccaaaagauagccgcuuugugga

SEQ ID NO: 1208711 - RNA, 18 nt, Human
acccccacccccacccca

SEQ ID NO: 1208712 - RNA, 28 nt, Human
acccccacccccaccccaguuuucccac

SEQ ID NO: 1208713 - RNA, 19 nt, Human
acgaacucugaaacaagag

SEQ ID NO: 1208714 - RNA, 19 nt, Human
agaaaagcuuaaucugcag

SEQ ID NO: 1208715 - RNA, 21 nt, Human
agaagucccacccccaccccc

SEQ ID NO: 1208716 - RNA, 18 nt, Human
agguggcucugccuuccu

SEQ ID NO: 1208717 - RNA, 25 nt, Human
caaagaacugaagccuccuuggccg

SEQ ID NO: 1208718 - RNA, 24 nt, Human
caaucagcugcacagaauucaagu

SEQ ID NO: 1208719 - RNA, 23 nt, Human
cacagaaaacagacccguaggcu

SEQ ID NO: 1208720 - RNA, 24 nt, Human
cacccccaccccaguuuucccacu

SEQ ID NO: 1208721 - RNA, 24 nt, Human
cagaugcggcuuugauggccugug

SEQ ID NO: 1208722 - RNA, 22 nt, Human
cagccucugcaaccagugcccu

SEQ ID NO: 1208723 - RNA, 20 nt, Human
cagcuguggauuccgccuuc

SEQ ID NO: 1208724 - RNA, 26 nt, Human
ccaagacccuuucuacuccaccccaa

SEQ ID NO: 1208725 - RNA, 25 nt, Human
ccagugcccuccgugagaaagcucc

SEQ ID NO: 1208726 - RNA, 24 nt, Human
cccacccccaccccaguuuuccca

SEQ ID NO: 1208727 - RNA, 25 nt, Human
cccacccccaccccaguuuucccaa

SEQ ID NO: 1208728 - RNA, 18 nt, Human
cccacccccacccccacc

SEQ ID NO: 1208729 - RNA, 21 nt, Human
cccacccccacccccacccca

SEQ ID NO: 1208730 - RNA, 20 nt, Human
ccccaaaagauagccgcuuu

SEQ ID NO: 1208731 - RNA, 23 nt, Human
cccccacccccaccccaguuuuc

SEQ ID NO: 1208732 - RNA, 24 nt, Human
cccccacccccaccccaguuuucc

SEQ ID NO: 1208733 - RNA, 22 nt, Human
cccuuucuacuccaccccaaaa

SEQ ID NO: 1208734 - RNA, 18 nt, Human
ccucugcaaccagugccc

SEQ ID NO: 1208735 - RNA, 23 nt, Human
ccuuccuaucucagcaggggacg

SEQ ID NO: 1208736 - RNA, 19 nt, Human
ccuucuggucuccgccuug

SEQ ID NO: 1208737 - RNA, 21 nt, Human
cgcuaagcgacccggggcugc

SEQ ID NO: 1208738 - RNA, 21 nt, Human
cggcaaagaacugaagccucc

SEQ ID NO: 1208739 - RNA, 22 nt, Human
cggcaaagaacugaagccuccu

SEQ ID NO: 1208740 - RNA, 24 nt, Human
cguaggcugcagggagaaggagca

SEQ ID NO: 1208741 - RNA, 21 nt, Human
cgucgccagcuguggauuccg

SEQ ID NO: 1208742 - RNA, 20 nt, Human
cucugcaaccagugcccucc

SEQ ID NO: 1208743 - RNA, 22 nt, Human
cugaauauagguaaggguucac

SEQ ID NO: 1208744 - RNA, 22 nt, Human
cugguggacagcagaugcuccc

SEQ ID NO: 1208745 - RNA, 24 nt, Human
gaagucccacccccacccccaccc

SEQ ID NO: 1208746 - RNA, 20 nt, Human
gaggucaggcuaucucccuc

SEQ ID NO: 1208747 - RNA, 21 nt, Human
gcaguuagaagucccaccccc

SEQ ID NO: 1208748 - RNA, 23 nt, Human
ggcaaagaacugaagccuccuug

SEQ ID NO: 1208749 - RNA, 20 nt, Human
ggucuccgccuugcaggcgg

SEQ ID NO: 1208750 - RNA, 20 nt, Human
uaaauuauaccacuuucaca

SEQ ID NO: 1208751 - RNA, 18 nt, Human
uaaggcagccgcggcggc

SEQ ID NO: 1208752 - RNA, 18 nt, Human
uacuucacuuuuuguacc

SEQ ID NO: 1208753 - RNA, 19 nt, Human
uagcagagacgaggcagcg

SEQ ID NO: 1208754 - RNA, 19 nt, Human
uagggaaauaucacucauc

SEQ ID NO: 1208755 - RNA, 22 nt, Human
uagguauagggaaauaucacuc

SEQ ID NO: 1208756 - RNA, 24 nt, Human
uauaccacuuucacaaagaauaaa

SEQ ID NO: 1208757 - RNA, 23 nt, Human
uaucacucaucaaaggguugaca

SEQ ID NO: 1208758 - RNA, 25 nt, Human
uaucucagcaggggacgaacucuga

SEQ ID NO: 1208759 - RNA, 21 nt, Human
ucaggcuaucucccuccaaug

SEQ ID NO: 1208760 - RNA, 25 nt, Human
uccaagacccuuucuacuccacccc

SEQ ID NO: 1208761 - RNA, 22 nt, Human
uccgggguacggucaaccucug

SEQ ID NO: 1208762 - RNA, 21 nt, Human
uccuuggccgcuaagcgaccc

SEQ ID NO: 1208763 - RNA, 19 nt, Human
ugacauagaagcucacaac

SEQ ID NO: 1208764 - RNA, 18 nt, Human
ugauggccugugcuccgc

SEQ ID NO: 1208765 - RNA, 23 nt, Human
ugcaggcggcaaagaacugaagc

SEQ ID NO: 1208766 - RNA, 26 nt, Human
ugcccgaaggagcugcuucgcagggg

SEQ ID NO: 1208767 - RNA, 24 nt, Human
ugucaaggaaaugggcacacacag

SEQ ID NO: 1208768 - RNA, 25 nt, Human
uucaugcaguuagaagucccacccc

SEQ ID NO: 1208769 - RNA, 18 nt, Human
uuccuaucucagcagggg

SEQ ID NO: 1208770 - RNA, 31 nt, Human
uuguacuucacuuuuuguaccuuuuuuauuu

SEQ ID NO: 1208771 - RNA, 23 nt, Human
uuuggugaaaaaauacagauaga

SEQ ID NO: 1208772 - RNA, 23 nt, Human
cacagccucagccugcguucccc

SEQ ID NO: 1208773 - RNA, 23 nt, Human
gaaccacagccucagccugcguu

SEQ ID NO: 1208774 - RNA, 23 nt, Human
acccuggaaauauaaccuucugu

SEQ ID NO: 1208775 - RNA, 21 nt, Human
auccugccaguucccuguggu

SEQ ID NO: 1208776 - RNA, 19 nt, Human
auucugccaacccccaacu

SEQ ID NO: 1208777 - RNA, 23 nt, Human
caaauucugccaacccccaacuu

SEQ ID NO: 1208778 - RNA, 21 nt, Human
cacaggaaaagaguggguccc

SEQ ID NO: 1208779 - RNA, 20 nt, Human
gccaacccccaacuugggac

SEQ ID NO: 1208780 - RNA, 18 nt, Human
ggcacuggaagcugucua

SEQ ID NO: 1208781 - RNA, 23 nt, Human
uaagcaaauucugccaaccccca

SEQ ID NO: 1208782 - RNA, 18 nt, Human
uacuuguuucuucaagcg

SEQ ID NO: 1208783 - RNA, 26 nt, Human
ucaagcgggggggccagagcauagcc

SEQ ID NO: 1208784 - RNA, 22 nt, Human
uccagcaccuguagucuucuua

SEQ ID NO: 1208785 - RNA, 23 nt, Human
uccccagaauccugccaguuccc

SEQ ID NO: 1208786 - RNA, 19 nt, Human
ucccuggguagcugcagaa

SEQ ID NO: 1208787 - RNA, 24 nt, Human
ucccuggguagcugcagaaacccu

SEQ ID NO: 1208788 - RNA, 22 nt, Human
uccuuauaacagccagugguug

SEQ ID NO: 1208789 - RNA, 21 nt, Human
ucuccaggccaauccauucuu

SEQ ID NO: 1208790 - RNA, 21 nt, Human
ucugccaacccccaacuuggg

SEQ ID NO: 1208791 - RNA, 18 nt, Human
ucuucaagcgggggggcc

SEQ ID NO: 1208792 - RNA, 18 nt, Human
ugccaguucccugugguu

SEQ ID NO: 1208793 - RNA, 19 nt, Human
uggcaagcacaggaaaaga

SEQ ID NO: 1208794 - RNA, 21 nt, Human
ugggacaauggaaaugagggu

SEQ ID NO: 1208795 - RNA, 22 nt, Human
uggguagcugcagaaacccugg

SEQ ID NO: 1208796 - RNA, 19 nt, Human
agaaccaaggggauggccc

SEQ ID NO: 1208797 - RNA, 19 nt, Human
auccaaacauguguuggag

SEQ ID NO: 1208798 - RNA, 22 nt, Human
caaggggauggcccauccaaac

SEQ ID NO: 1208799 - RNA, 21 nt, Human
cccauccaaacauguguugga

SEQ ID NO: 1208800 - RNA, 18 nt, Human
ggagauauuccuaaagcu

SEQ ID NO: 1208801 - RNA, 20 nt, Human
ucagcuuucacuuuggcuuc

SEQ ID NO: 1208802 - RNA, 23 nt, Human
ucagcuuucacuuuggcuuccga

SEQ ID NO: 1208803 - RNA, 19 nt, Human
uccuguugcuguuuucacc

SEQ ID NO: 1208804 - RNA, 19 nt, Human
uggcccauccaaacaugug

SEQ ID NO: 1208805 - RNA, 26 nt, Human
ugucuuguucaucugcacagucuuca

SEQ ID NO: 1208806 - RNA, 20 nt, Human
uucagcuuucacuuuggcuu

SEQ ID NO: 1208807 - RNA, 22 nt, Human
uuggagauauuccuaaagcuug

SEQ ID NO: 1208808 - RNA, 19 nt, Human
aaaggggaccuccguggag

SEQ ID NO: 1208809 - RNA, 19 nt, Human
aacccucuuucgcuaaugg

SEQ ID NO: 1208810 - RNA, 23 nt, Human
aucuugaaacaccuucuccucca

SEQ ID NO: 1208811 - RNA, 23 nt, Human
auggaguuagaagagcaguuucc

SEQ ID NO: 1208812 - RNA, 22 nt, Human
caagucaccaucuugaaacacc

SEQ ID NO: 1208813 - RNA, 22 nt, Human
ccaagucaccaucuugaaacac

SEQ ID NO: 1208814 - RNA, 19 nt, Human
ccaucuugaaacaccuucu

SEQ ID NO: 1208815 - RNA, 19 nt, Human
ccuccagcgggaccugauc

SEQ ID NO: 1208816 - RNA, 18 nt, Human
cuccagcgggaccugauc

SEQ ID NO: 1208817 - RNA, 24 nt, Human
cucuuucgcuaauggaguuagaag

SEQ ID NO: 1208818 - RNA, 20 nt, Human
cugugaaauccacggauagu

SEQ ID NO: 1208819 - RNA, 18 nt, Human
gaccugauccgauuguga

SEQ ID NO: 1208820 - RNA, 18 nt, Human
gagcaguuuccagaaacc

SEQ ID NO: 1208821 - RNA, 22 nt, Human
gagcgucagcugugucuucucg

SEQ ID NO: 1208822 - RNA, 18 nt, Human
ugugucuucucgucuguc

SEQ ID NO: 1208823 - RNA, 19 nt, Human
uuccagaaaccaagucacc

SEQ ID NO: 1208824 - RNA, 21 nt, Human
uuccagaaaccaagucaccau

SEQ ID NO: 1208825 - RNA, 19 nt, Human
uugaaacaccuucuccucc

SEQ ID NO: 1208826 - RNA, 19 nt, Human
aaaggggaccuccguggag

SEQ ID NO: 1208827 - RNA, 19 nt, Human
aacccucuuucgcuaaugg

SEQ ID NO: 1208828 - RNA, 23 nt, Human
aucuugaaacaccuucuccucca

SEQ ID NO: 1208829 - RNA, 23 nt, Human
auggaguuagaagagcaguuucc

SEQ ID NO: 1208830 - RNA, 22 nt, Human
caagucaccaucuugaaacacc

SEQ ID NO: 1208831 - RNA, 22 nt, Human
ccaagucaccaucuugaaacac

SEQ ID NO: 1208832 - RNA, 19 nt, Human
ccaucuugaaacaccuucu

SEQ ID NO: 1208833 - RNA, 19 nt, Human
ccuccagcgggaccugauc

SEQ ID NO: 1208834 - RNA, 18 nt, Human
cuccagcgggaccugauc

SEQ ID NO: 1208835 - RNA, 24 nt, Human
cucuuucgcuaauggaguuagaag

SEQ ID NO: 1208836 - RNA, 20 nt, Human
cugugaaauccacggauagu

SEQ ID NO: 1208837 - RNA, 18 nt, Human
gaccugauccgauuguga

SEQ ID NO: 1208838 - RNA, 18 nt, Human
gagcaguuuccagaaacc

SEQ ID NO: 1208839 - RNA, 22 nt, Human
gagcgucagcugugucuucucg

SEQ ID NO: 1208840 - RNA, 18 nt, Human
ugaaacaccuucuccucc

SEQ ID NO: 1208841 - RNA, 18 nt, Human
ugugucuucucgucuguc

SEQ ID NO: 1208842 - RNA, 19 nt, Human
uuccagaaaccaagucacc

SEQ ID NO: 1208843 - RNA, 21 nt, Human
uuccagaaaccaagucaccau

SEQ ID NO: 1208844 - RNA, 19 nt, Human
uugaaacaccuucuccucc

SEQ ID NO: 1208845 - RNA, 22 nt, Human
aaaaauagaaaucccucuggcc

SEQ ID NO: 1208846 - RNA, 19 nt, Human
aaacacucaaagcccucuc

SEQ ID NO: 1208847 - RNA, 20 nt, Human
aaacacucaaagcccucucg

SEQ ID NO: 1208848 - RNA, 18 nt, Human
agaaacacucaaagcccu

SEQ ID NO: 1208849 - RNA, 22 nt, Human
auccaccggcaaaaauagaaau

SEQ ID NO: 1208850 - RNA, 20 nt, Human
cacucaaagcccucucguuu

SEQ ID NO: 1208851 - RNA, 24 nt, Human
cauaagacauagaacuagggcaua

SEQ ID NO: 1208852 - RNA, 20 nt, Human
ccaucagaaacacucaaagc

SEQ ID NO: 1208853 - RNA, 22 nt, Human
cggcaaaaauagaaaucccucu

SEQ ID NO: 1208854 - RNA, 24 nt, Human
cugaaggccuccagcuggccccag

SEQ ID NO: 1208855 - RNA, 21 nt, Human
cuguccugugacccacauaua

SEQ ID NO: 1208856 - RNA, 20 nt, Human
gcccuggaggugagggcagg

SEQ ID NO: 1208857 - RNA, 21 nt, Human
gcugugccuagggcaggaagg

SEQ ID NO: 1208858 - RNA, 20 nt, Human
ggaggugagggcaggguugg

SEQ ID NO: 1208859 - RNA, 23 nt, Human
ggcaggaaggggguuccuuccag

SEQ ID NO: 1208860 - RNA, 19 nt, Human
ggcccuggaggugagggca

SEQ ID NO: 1208861 - RNA, 24 nt, Human
ggcuggggaaggagcagucccagg

SEQ ID NO: 1208862 - RNA, 18 nt, Human
ggguuccuuccagucucc

SEQ ID NO: 1208863 - RNA, 25 nt, Human
guacugaaggccuccagcuggcccc

SEQ ID NO: 1208864 - RNA, 20 nt, Human
ucccaggcccuggaggugag

SEQ ID NO: 1208865 - RNA, 22 nt, Human
uccugugacccacauauacuua

SEQ ID NO: 1208866 - RNA, 21 nt, Human
ucggugcuccagcuguucagu

SEQ ID NO: 1208867 - RNA, 24 nt, Human
ucuccuggcccuccuugcucuaca

SEQ ID NO: 1208868 - RNA, 21 nt, Human
ugaaaaaaauagggcuggaga

SEQ ID NO: 1208869 - RNA, 22 nt, Human
ugaaaugagugcccaggguguc

SEQ ID NO: 1208870 - RNA, 21 nt, Human
ugacccugguccucucucccu

SEQ ID NO: 1208871 - RNA, 20 nt, Human
ugagugcccagggugucggu

SEQ ID NO: 1208872 - RNA, 23 nt, Human
ugagugcccagggugucggugcu

SEQ ID NO: 1208873 - RNA, 22 nt, Human
uggcuggggcuguacugaaggc

SEQ ID NO: 1208874 - RNA, 19 nt, Human
ugguccucucucccugccc

SEQ ID NO: 1208875 - RNA, 23 nt, Human
uguaauagugaaaaaaauagggc

SEQ ID NO: 1208876 - RNA, 22 nt, Human
ugucggugcuccagcuguucag

SEQ ID NO: 1208877 - RNA, 24 nt, Human
uuaaucccaauaacauaagacaua

SEQ ID NO: 1208878 - RNA, 19 nt, Human
uuugaaauggacucuggug

SEQ ID NO: 1208879 - RNA, 21 nt, Human
cccgucccacguggccagggg

SEQ ID NO: 1208880 - RNA, 20 nt, Human
ccgaaaacccaugcagcccc

SEQ ID NO: 1208881 - RNA, 26 nt, Human
cucacagcuguccuggcaugagggcu

SEQ ID NO: 1208882 - RNA, 22 nt, Human
cuccuggccaugccaugguugc

SEQ ID NO: 1208883 - RNA, 23 nt, Human
cuccuggccaugccaugguugcc

SEQ ID NO: 1208884 - RNA, 25 nt, Human
cuccuggccaugccaugguugcccg

SEQ ID NO: 1208885 - RNA, 21 nt, Human
gccaggggagggagaggucau

SEQ ID NO: 1208886 - RNA, 23 nt, Human
ucccacguggccaggggagggag

SEQ ID NO: 1208887 - RNA, 20 nt, Human
uccuggcaugagggcuccug

SEQ ID NO: 1208888 - RNA, 24 nt, Human
ucuugccaaguaccaucauguccc

SEQ ID NO: 1208889 - RNA, 21 nt, Human
ugccaaguaccaucauguccc

SEQ ID NO: 1208890 - RNA, 21 nt, Human
uggcaugagggcuccuggcca

SEQ ID NO: 1208891 - RNA, 20 nt, Human
uggggcagagacugccuguc

SEQ ID NO: 1208892 - RNA, 18 nt, Human
ugucccaaggugaugcug

SEQ ID NO: 1208893 - RNA, 24 nt, Human
aaaaagaaagucuggauuuuaaaa

SEQ ID NO: 1208894 - RNA, 27 nt, Human
aaaaagacaaaacacauuucaugcaga

SEQ ID NO: 1208895 - RNA, 19 nt, Human
aaacuugaaaauacucaug

SEQ ID NO: 1208896 - RNA, 21 nt, Human
aaacuugaaaauacucaugaa

SEQ ID NO: 1208897 - RNA, 18 nt, Human
aagaacuaauaaaauccu

SEQ ID NO: 1208898 - RNA, 26 nt, Human
aagaaugcauaccagaaccggggccc

SEQ ID NO: 1208899 - RNA, 21 nt, Human
aagcuuuucaauucuaguugg

SEQ ID NO: 1208900 - RNA, 19 nt, Human
aaguuucagacugcuacug

SEQ ID NO: 1208901 - RNA, 20 nt, Human
aauccaugauucuuuucccu

SEQ ID NO: 1208902 - RNA, 21 nt, Human
aauguucuuuaccugucuuag

SEQ ID NO: 1208903 - RNA, 20 nt, Human
acauguagaaaaagaaaguc

SEQ ID NO: 1208904 - RNA, 23 nt, Human
agaaaaagaaagucuggauuuua

SEQ ID NO: 1208905 - RNA, 24 nt, Human
agacaaaacacauuucaugcagaa

SEQ ID NO: 1208906 - RNA, 27 nt, Human
aggaauauuagaggaagauuucauagc

SEQ ID NO: 1208907 - RNA, 20 nt, Human
aggaaucaaaaucaaaucca

SEQ ID NO: 1208908 - RNA, 18 nt, Human
caaaagcaggauccucca

SEQ ID NO: 1208909 - RNA, 19 nt, Human
cacuaguaauaaaaaaaga

SEQ ID NO: 1208910 - RNA, 24 nt, Human
cacuaguaauaaaaaaagacaaaa

SEQ ID NO: 1208911 - RNA, 26 nt, Human
cacuguguaaauuucaaggcaagguu

SEQ ID NO: 1208912 - RNA, 19 nt, Human
cagaauacaaagauaaaug

SEQ ID NO: 1208913 - RNA, 22 nt, Human
caggauccuccagauacuuuuc

SEQ ID NO: 1208914 - RNA, 22 nt, Human
caguaugaaaaacuugaaaaua

SEQ ID NO: 1208915 - RNA, 25 nt, Human
cauguagaaaaagaaagucuggauu

SEQ ID NO: 1208916 - RNA, 18 nt, Human
cauuuucaguugcugcug

SEQ ID NO: 1208917 - RNA, 24 nt, Human
ccaguuaaaauaaaaacuaucuca

SEQ ID NO: 1208918 - RNA, 23 nt, Human
ccuccagauacuuuucccgaucu

SEQ ID NO: 1208919 - RNA, 21 nt, Human
cuaaguuaucuaaauaugaug

SEQ ID NO: 1208920 - RNA, 24 nt, Human
cuaucuggcuuuaaccaauccauu

SEQ ID NO: 1208921 - RNA, 19 nt, Human
cucacauguagaaaaagaa

SEQ ID NO: 1208922 - RNA, 21 nt, Human
cucacauguagaaaaagaaag

SEQ ID NO: 1208923 - RNA, 28 nt, Human
cuuaaacacuaguaauaaaaaaagacaa

SEQ ID NO: 1208924 - RNA, 25 nt, Human
gaaaaacuugaaaauacucaugaau

SEQ ID NO: 1208925 - RNA, 21 nt, Human
gauacuuuucccgaucuccau

SEQ ID NO: 1208926 - RNA, 23 nt, Human
gcaauaaaggaaucaaaaucaaa

SEQ ID NO: 1208927 - RNA, 24 nt, Human
gcagaauacaaagauaaaugucug

SEQ ID NO: 1208928 - RNA, 19 nt, Human
gcuacacuccagaucgcaa

SEQ ID NO: 1208929 - RNA, 21 nt, Human
uacaguaugaaaaacuugaaa

SEQ ID NO: 1208930 - RNA, 19 nt, Human
uacucaugaaugaauaaug

SEQ ID NO: 1208931 - RNA, 22 nt, Human
uagaaaaaauagcuauuuucau

SEQ ID NO: 1208932 - RNA, 20 nt, Human
uagauaacacauguguacca

SEQ ID NO: 1208933 - RNA, 18 nt, Human
uaguaaugguucacucuc

SEQ ID NO: 1208934 - RNA, 20 nt, Human
uagugcauuucuuuucuccu

SEQ ID NO: 1208935 - RNA, 19 nt, Human
uaugaaaaacuugaaaaua

SEQ ID NO: 1208936 - RNA, 24 nt, Human
uauuaacacuucacuauaaagaau

SEQ ID NO: 1208937 - RNA, 25 nt, Human
uauuuguuuucaugaugaucugggu

SEQ ID NO: 1208938 - RNA, 20 nt, Human
ugagcaaaugacaugccagu

SEQ ID NO: 1208939 - RNA, 22 nt, Human
ugagguagauaacacaugugua

SEQ ID NO: 1208940 - RNA, 24 nt, Human
ugcaauaaaggaaucaaaaucaaa

SEQ ID NO: 1208941 - RNA, 21 nt, Human
ugcugcugguaucauguguuu

SEQ ID NO: 1208942 - RNA, 19 nt, Human
ugggaacuaaguugaauag

SEQ ID NO: 1208943 - RNA, 22 nt, Human
uguaaauuucaaggcaagguuu

SEQ ID NO: 1208944 - RNA, 19 nt, Human
ugugaugcuuccuuuagug

SEQ ID NO: 1208945 - RNA, 20 nt, Human
uuauuaagaauaguuuacua

SEQ ID NO: 1208946 - RNA, 20 nt, Human
uucaggggucaaccuguacu

SEQ ID NO: 1208947 - RNA, 23 nt, Human
uucaugcagaauacaaagauaaa

SEQ ID NO: 1208948 - RNA, 18 nt, Human
uuuccuguuuuucuuggc

SEQ ID NO: 1208949 - RNA, 22 nt, Human
uuugccacauacucuuguuacc

SEQ ID NO: 1208950 - RNA, 20 nt, Human
uuuucaguugcugcugguau

SEQ ID NO: 1208951 - RNA, 25 nt, Human
uuuucuuggcuuacugacuuugaua

SEQ ID NO: 1208952 - RNA, 25 nt, Human
uuuuucuuugcuuguucuuuccaau

SEQ ID NO: 1208953 - RNA, 22 nt, Human
aaacuggaauuccuugaaucca

SEQ ID NO: 1208954 - RNA, 21 nt, Human
aagcaagagaugagaaaaaga

SEQ ID NO: 1208955 - RNA, 29 nt, Human
aagcaagagaugagaaaaagagggacccc

SEQ ID NO: 1208956 - RNA, 25 nt, Human
aauacaacucaccaaauguuuugcu

SEQ ID NO: 1208957 - RNA, 25 nt, Human
agaaaaagagauuauugggaaaugu

SEQ ID NO: 1208958 - RNA, 25 nt, Human
agaacaaaaguuguaagucguaacc

SEQ ID NO: 1208959 - RNA, 21 nt, Human
caguggaugcuccuuaugucc

SEQ ID NO: 1208960 - RNA, 19 nt, Human
ccggaaaaccagaauacaa

SEQ ID NO: 1208961 - RNA, 23 nt, Human
ccggaaaaccagaauacaacuca

SEQ ID NO: 1208962 - RNA, 21 nt, Human
cugaauaaugaggagucuggg

SEQ ID NO: 1208963 - RNA, 21 nt, Human
ggaaaaccagaauacaacuca

SEQ ID NO: 1208964 - RNA, 20 nt, Human
guacagucgaaaggaugaaa

SEQ ID NO: 1208965 - RNA, 23 nt, Human
uaaaaaaauccaacuccggaaaa

SEQ ID NO: 1208966 - RNA, 21 nt, Human
uacuccucaucauucuugucg

SEQ ID NO: 1208967 - RNA, 26 nt, Human
uagaauaagaucuccuuagcuccgcc

SEQ ID NO: 1208968 - RNA, 19 nt, Human
uauaaaaaaauccaacucc

SEQ ID NO: 1208969 - RNA, 24 nt, Human
uauaaaaaaauccaacuccggaaa

SEQ ID NO: 1208970 - RNA, 22 nt, Human
uccuugaggagaggcccuaugu

SEQ ID NO: 1208971 - RNA, 21 nt, Human
ugaaaagacaguguucauuaa

SEQ ID NO: 1208972 - RNA, 18 nt, Human
ugaggagaggcccuaugu

SEQ ID NO: 1208973 - RNA, 18 nt, Human
ugaggagucuggggaaua

SEQ ID NO: 1208974 - RNA, 21 nt, Human
ugggaaauguacugaauaaug

SEQ ID NO: 1208975 - RNA, 22 nt, Human
ugucccaugguagaauaagauc

SEQ ID NO: 1208976 - RNA, 24 nt, Human
uuuaaaaacucuguuggaccagca

SEQ ID NO: 1208977 - RNA, 26 nt, Human
aacccuagaaagaugaaaccccaccc

SEQ ID NO: 1208978 - RNA, 20 nt, Human
accccacccaggccacauug

SEQ ID NO: 1208979 - RNA, 20 nt, Human
agaaagaugaaaccccaccc

SEQ ID NO: 1208980 - RNA, 22 nt, Human
cagcagugcugugaccugugcc

SEQ ID NO: 1208981 - RNA, 18 nt, Human
ccuucuggaccaacugcc

SEQ ID NO: 1208982 - RNA, 19 nt, Human
cuagaaagaugaaacccca

SEQ ID NO: 1208983 - RNA, 23 nt, Human
cuggaaaauccucuuaauacugg

SEQ ID NO: 1208984 - RNA, 23 nt, Human
cuucuggaccaacugccagaaac

SEQ ID NO: 1208985 - RNA, 22 nt, Human
gaacucacagugugaagucuga

SEQ ID NO: 1208986 - RNA, 20 nt, Human
gccacauuguucagcagugc

SEQ ID NO: 1208987 - RNA, 19 nt, Human
ggagaagcuccaaagagca

SEQ ID NO: 1208988 - RNA, 21 nt, Human
gucugaacucacagugugaag

SEQ ID NO: 1208989 - RNA, 22 nt, Human
guuccuuuguccccuucucuuu

SEQ ID NO: 1208990 - RNA, 19 nt, Human
uagaaagaugaaaccccac

SEQ ID NO: 1208991 - RNA, 26 nt, Human
uagaaagaugaaaccccacccaggcc

SEQ ID NO: 1208992 - RNA, 19 nt, Human
uaggguuuguaacuugaaa

SEQ ID NO: 1208993 - RNA, 19 nt, Human
ucuggaccaacugccagaa

SEQ ID NO: 1208994 - RNA, 19 nt, Human
ugaaauuucaagguauaac

SEQ ID NO: 1208995 - RNA, 20 nt, Human
ugagggaaauggggugagug

SEQ ID NO: 1208996 - RNA, 20 nt, Human
ugcugggagucugaacucac

SEQ ID NO: 1208997 - RNA, 22 nt, Human
uggaccaacugccagaaacacu

SEQ ID NO: 1208998 - RNA, 19 nt, Human
aaccaaaagcccgagacaa

SEQ ID NO: 1208999 - RNA, 18 nt, Human
aagugcuggggugaggug

SEQ ID NO: 1209000 - RNA, 25 nt, Human
aagugcuggggugaggugggcagga

SEQ ID NO: 1209001 - RNA, 22 nt, Human
accgucuuguuagcccuggcug

SEQ ID NO: 1209002 - RNA, 19 nt, Human
agagaagccuccugccucc

SEQ ID NO: 1209003 - RNA, 20 nt, Human
aggcaggggcuggggcaagg

SEQ ID NO: 1209004 - RNA, 23 nt, Human
aggcaggggcuggggcaagggug

SEQ ID NO: 1209005 - RNA, 19 nt, Human
aggcucuagaccugcccag

SEQ ID NO: 1209006 - RNA, 24 nt, Human
agggccagcggcagugggcggaga

SEQ ID NO: 1209007 - RNA, 23 nt, Human
cagagaagccuccugccucccuu

SEQ ID NO: 1209008 - RNA, 22 nt, Human
cagcggcagugggcggagaggg

SEQ ID NO: 1209009 - RNA, 20 nt, Human
cagugggcggagaggguccu

SEQ ID NO: 1209010 - RNA, 21 nt, Human
cagugggcggagaggguccuc

SEQ ID NO: 1209011 - RNA, 22 nt, Human
caguguccgguguuucagccug

SEQ ID NO: 1209012 - RNA, 19 nt, Human
cccagagaagccuccugcc

SEQ ID NO: 1209013 - RNA, 23 nt, Human
cccagagaagccuccugccuccc

SEQ ID NO: 1209014 - RNA, 21 nt, Human
cccaggcucaccgccugcccc

SEQ ID NO: 1209015 - RNA, 19 nt, Human
cccccaggcucuagaccug

SEQ ID NO: 1209016 - RNA, 21 nt, Human
ccccuugggucagcccggccu

SEQ ID NO: 1209017 - RNA, 19 nt, Human
cccggccuggccucccagg

SEQ ID NO: 1209018 - RNA, 19 nt, Human
cccuugggucagcccggcc

SEQ ID NO: 1209019 - RNA, 22 nt, Human
ccgucuuguuagcccuggcugu

SEQ ID NO: 1209020 - RNA, 18 nt, Human
ccucccaggcucaccgcc

SEQ ID NO: 1209021 - RNA, 18 nt, Human
ccucccuucccaguccug

SEQ ID NO: 1209022 - RNA, 18 nt, Human
ccuccugccucccuuccc

SEQ ID NO: 1209023 - RNA, 21 nt, Human
ccuccugccucccuucccagu

SEQ ID NO: 1209024 - RNA, 18 nt, Human
ccucuggagacccccagg

SEQ ID NO: 1209025 - RNA, 19 nt, Human
ccucuggagacccccaggc

SEQ ID NO: 1209026 - RNA, 21 nt, Human
cgagacaaaggcgugaguccc

SEQ ID NO: 1209027 - RNA, 22 nt, Human
cgggcaggacuggggcaagggu

SEQ ID NO: 1209028 - RNA, 21 nt, Human
cugggcaagggugggaggggc

SEQ ID NO: 1209029 - RNA, 18 nt, Human
cuguuaacguucuucucg

SEQ ID NO: 1209030 - RNA, 21 nt, Human
cuuauucucucaguguccggu

SEQ ID NO: 1209031 - RNA, 21 nt, Human
cuucccaguccuggcagaucc

SEQ ID NO: 1209032 - RNA, 22 nt, Human
cuuuauacccagagaagccucc

SEQ ID NO: 1209033 - RNA, 21 nt, Human
gagacaaaggcgugaguccca

SEQ ID NO: 1209034 - RNA, 23 nt, Human
gagugggaggggccaagcagggg

SEQ ID NO: 1209035 - RNA, 24 nt, Human
gagugggaggggccaagcaggggc

SEQ ID NO: 1209036 - RNA, 18 nt, Human
gcccagggccagcggcag

SEQ ID NO: 1209037 - RNA, 18 nt, Human
gcccagggccagcggcag

SEQ ID NO: 1209038 - RNA, 25 nt, Human
gccuccugccucccuucccaguccu

SEQ ID NO: 1209039 - RNA, 18 nt, Human
gccucuggagacccccag

SEQ ID NO: 1209040 - RNA, 19 nt, Human
gccuucucccggagauaag

SEQ ID NO: 1209041 - RNA, 19 nt, Human
ggcaagggugggaggggcc

SEQ ID NO: 1209042 - RNA, 19 nt, Human
ggcaagggugggaggggcc

SEQ ID NO: 1209043 - RNA, 22 nt, Human
ggcaggacuggggcaagggugg

SEQ ID NO: 1209044 - RNA, 21 nt, Human
ggcaggacuggggcaaggguu

SEQ ID NO: 1209045 - RNA, 20 nt, Human
gggaggggccaagcaggggc

SEQ ID NO: 1209046 - RNA, 21 nt, Human
gggcaggaccaggcaggggcu

SEQ ID NO: 1209047 - RNA, 18 nt, Human
gggcaggacuggggcaag

SEQ ID NO: 1209048 - RNA, 22 nt, Human
gggcaggacuggggcaaggguu

SEQ ID NO: 1209049 - RNA, 18 nt, Human
gggugggaggggccgggc

SEQ ID NO: 1209050 - RNA, 18 nt, Human
ggugggaggggccaggcc

SEQ ID NO: 1209051 - RNA, 18 nt, Human
ggugggaggggccaggcc

SEQ ID NO: 1209052 - RNA, 18 nt, Human
ggugggaggggccaggcc

SEQ ID NO: 1209053 - RNA, 24 nt, Human
gguggucuucucuuuuccuccuuu

SEQ ID NO: 1209054 - RNA, 20 nt, Human
uccugccucugcccucugcc

SEQ ID NO: 1209055 - RNA, 22 nt, Human
ucucccggagauaagggauugu

SEQ ID NO: 1209056 - RNA, 21 nt, Human
ugaaaaccaaaagcccgagac

SEQ ID NO: 1209057 - RNA, 21 nt, Human
ugaggugggcaggaccaggca

SEQ ID NO: 1209058 - RNA, 23 nt, Human
ugccccuugagggcccagagccg

SEQ ID NO: 1209059 - RNA, 22 nt, Human
uggccucccaggcucaccgccu

SEQ ID NO: 1209060 - RNA, 23 nt, Human
ugggaggggccaagcaggggcug

SEQ ID NO: 1209061 - RNA, 26 nt, Human
ugggaggggccaagcaggggcugggc

SEQ ID NO: 1209062 - RNA, 20 nt, Human
ugggaggggccaggccggac

SEQ ID NO: 1209063 - RNA, 20 nt, Human
ugggaggggccaggccggac

SEQ ID NO: 1209064 - RNA, 20 nt, Human
ugggaggggccaggccggac

SEQ ID NO: 1209065 - RNA, 20 nt, Human
ugggaggggccaggccggac

SEQ ID NO: 1209066 - RNA, 20 nt, Human
ugggaggggccaggccggac

SEQ ID NO: 1209067 - RNA, 21 nt, Human
ugggucagcccggccuggccu

SEQ ID NO: 1209068 - RNA, 24 nt, Human
uguccgguguuucagccuggagcc

SEQ ID NO: 1209069 - RNA, 20 nt, Human
uuagaauuaauacuguuaac

SEQ ID NO: 1209070 - RNA, 21 nt, Human
uugagggcccagagccgccau

SEQ ID NO: 1209071 - RNA, 20 nt, Human
aaacuggguuaagagcuccc

SEQ ID NO: 1209072 - RNA, 22 nt, Human
aaacuggguuaagagcucccug

SEQ ID NO: 1209073 - RNA, 21 nt, Human
aagaacacgcgccggccacca

SEQ ID NO: 1209074 - RNA, 23 nt, Human
aagugacaaaaaagaggaaaagg

SEQ ID NO: 1209075 - RNA, 21 nt, Human
acaccaggccgaccaccgugc

SEQ ID NO: 1209076 - RNA, 26 nt, Human
acaccaggccgaccaccgugcccagu

SEQ ID NO: 1209077 - RNA, 19 nt, Human
acccgaacuuccagaagac

SEQ ID NO: 1209078 - RNA, 20 nt, Human
acccguucagcucccccacc

SEQ ID NO: 1209079 - RNA, 22 nt, Human
agaagacaaguccgccagccca

SEQ ID NO: 1209080 - RNA, 20 nt, Human
agaaggcucacagggucccc

SEQ ID NO: 1209081 - RNA, 18 nt, Human
agacgguggggcuucagg

SEQ ID NO: 1209082 - RNA, 21 nt, Human
agagcaccuggcgcggccgca

SEQ ID NO: 1209083 - RNA, 20 nt, Human
aggagaucuugaugaccggg

SEQ ID NO: 1209084 - RNA, 20 nt, Human
aggagccgcugggcucaggg

SEQ ID NO: 1209085 - RNA, 23 nt, Human
agugacaaaaaagaggaaaagga

SEQ ID NO: 1209086 - RNA, 19 nt, Human
caaaaaagaggaaaaggaa

SEQ ID NO: 1209087 - RNA, 22 nt, Human
caagaacacgcgccggccacca

SEQ ID NO: 1209088 - RNA, 21 nt, Human
cacagagcaccuggcgcggcc

SEQ ID NO: 1209089 - RNA, 19 nt, Human
cacagggcgccggcgagcu

SEQ ID NO: 1209090 - RNA, 18 nt, Human
caccaaggaaaaccaugg

SEQ ID NO: 1209091 - RNA, 21 nt, Human
cacccgaacuuccagaagaca

SEQ ID NO: 1209092 - RNA, 22 nt, Human
cacccgaacuuccagaagacaa

SEQ ID NO: 1209093 - RNA, 20 nt, Human
caccucucccuugcccuggg

SEQ ID NO: 1209094 - RNA, 22 nt, Human
cagccgugggcucgccguucuc

SEQ ID NO: 1209095 - RNA, 21 nt, Human
cagggcgccggcgagcugucc

SEQ ID NO: 1209096 - RNA, 19 nt, Human
cagguacccguucagcucc

SEQ ID NO: 1209097 - RNA, 22 nt, Human
cauccccucccuggacacacug

SEQ ID NO: 1209098 - RNA, 19 nt, Human
cauggaucuuaccccagac

SEQ ID NO: 1209099 - RNA, 18 nt, Human
ccaaaccacgagaccuuc

SEQ ID NO: 1209100 - RNA, 24 nt, Human
ccaagcccucgcgucccuguggac

SEQ ID NO: 1209101 - RNA, 23 nt, Human
ccagcccaccggcagggccgucc

SEQ ID NO: 1209102 - RNA, 20 nt, Human
ccaggugccaggugcccagc

SEQ ID NO: 1209103 - RNA, 19 nt, Human
cccacggccacaguccugc

SEQ ID NO: 1209104 - RNA, 21 nt, Human
cccagacgaugucccccacgg

SEQ ID NO: 1209105 - RNA, 23 nt, Human
cccagccuccugcgggcccuggg

SEQ ID NO: 1209106 - RNA, 23 nt, Human
cccaggggccgcccuuggccucc

SEQ ID NO: 1209107 - RNA, 21 nt, Human
ccccacggccacaguccugcc

SEQ ID NO: 1209108 - RNA, 21 nt, Human
cccucgcgucccuguggaccc

SEQ ID NO: 1209109 - RNA, 18 nt, Human
cccugggcgcggcugggg

SEQ ID NO: 1209110 - RNA, 22 nt, Human
ccgcgccggccggcacaggccg

SEQ ID NO: 1209111 - RNA, 18 nt, Human
ccggccaccaaggaaaac

SEQ ID NO: 1209112 - RNA, 19 nt, Human
ccggucccgggacucucug

SEQ ID NO: 1209113 - RNA, 31 nt, Human
ccucacaccaggccgaccaccgugccccuuc

SEQ ID NO: 1209114 - RNA, 23 nt, Human
ccuccacacagcacuggucacuc

SEQ ID NO: 1209115 - RNA, 22 nt, Human
ccuccuccacacagcacugguc

SEQ ID NO: 1209116 - RNA, 19 nt, Human
ccuccugcgggcccugggc

SEQ ID NO: 1209117 - RNA, 20 nt, Human
ccucucccucuugcuccucc

SEQ ID NO: 1209118 - RNA, 22 nt, Human
ccucucccucuugcuccuccug

SEQ ID NO: 1209119 - RNA, 18 nt, Human
ccugcggggccugcuggg

SEQ ID NO: 1209120 - RNA, 20 nt, Human
ccuggcgcggccgcaggcgg

SEQ ID NO: 1209121 - RNA, 21 nt, Human
ccuggggcgugcuguaggaga

SEQ ID NO: 1209122 - RNA, 18 nt, Human
cgagaaaagccaagcccu

SEQ ID NO: 1209123 - RNA, 18 nt, Human
cgagaggucacccguguc

SEQ ID NO: 1209124 - RNA, 25 nt, Human
cgaugucccccacggccacaguccu

SEQ ID NO: 1209125 - RNA, 18 nt, Human
cgcugcugcacgccgacu

SEQ ID NO: 1209126 - RNA, 23 nt, Human
cggcuugcggagcucccuguccg

SEQ ID NO: 1209127 - RNA, 20 nt, Human
cgggcccugggcgcggcugg

SEQ ID NO: 1209128 - RNA, 18 nt, Human
cgggccgcugcccagccu

SEQ ID NO: 1209129 - RNA, 18 nt, Human
cgguggggcuucaggcgg

SEQ ID NO: 1209130 - RNA, 19 nt, Human
cgugcccagugggcucugc

SEQ ID NO: 1209131 - RNA, 19 nt, Human
cucacaccaggccgaccac

SEQ ID NO: 1209132 - RNA, 22 nt, Human
cucagggcagcugacgagaaaa

SEQ ID NO: 1209133 - RNA, 20 nt, Human
cuccaggacagcaggugcgc

SEQ ID NO: 1209134 - RNA, 23 nt, Human
cuccuccggcuugcggagcuccc

SEQ ID NO: 1209135 - RNA, 18 nt, Human
cucgugcucgcugucccc

SEQ ID NO: 1209136 - RNA, 22 nt, Human
cugcaggccaggugccaggugc

SEQ ID NO: 1209137 - RNA, 18 nt, Human
cugcccagccuccugcgg

SEQ ID NO: 1209138 - RNA, 18 nt, Human
cugcccagccuccugcgg

SEQ ID NO: 1209139 - RNA, 22 nt, Human
cugccggggcccuguccuccuc

SEQ ID NO: 1209140 - RNA, 21 nt, Human
cuuuaaagugacaaaaaagag

SEQ ID NO: 1209141 - RNA, 18 nt, Human
gcagcugacgagaaaagc

SEQ ID NO: 1209142 - RNA, 18 nt, Human
gcgccucucccucuugcu

SEQ ID NO: 1209143 - RNA, 19 nt, Human
gcucuuacaaaacagagca

SEQ ID NO: 1209144 - RNA, 21 nt, Human
ggaggagccgcugggcucagg

SEQ ID NO: 1209145 - RNA, 21 nt, Human
ggaggagccgcugggcucagg

SEQ ID NO: 1209146 - RNA, 22 nt, Human
ggcacaguccgcucuccccuca

SEQ ID NO: 1209147 - RNA, 19 nt, Human
ggcccuguccuccucgcgc

SEQ ID NO: 1209148 - RNA, 22 nt, Human
ggcuugcggagcucccuguccg

SEQ ID NO: 1209149 - RNA, 26 nt, Human
ggggguccggggcuggccuccggggg

SEQ ID NO: 1209150 - RNA, 23 nt, Human
gggguccggggcuggccuccggg

SEQ ID NO: 1209151 - RNA, 23 nt, Human
gucuugcggcauuugcagccucg

SEQ ID NO: 1209152 - RNA, 27 nt, Human
guggacccuggggacagcucuugaagg

SEQ ID NO: 1209153 - RNA, 22 nt, Human
uaccccagacgaugucccccac

SEQ ID NO: 1209154 - RNA, 22 nt, Human
ucagagaaaggggagaguuuug

SEQ ID NO: 1209155 - RNA, 19 nt, Human
ucagcucccccaccagcuc

SEQ ID NO: 1209156 - RNA, 19 nt, Human
ucagcucccccaccagcuc

SEQ ID NO: 1209157 - RNA, 21 nt, Human
ucagcucccccaccagcucgg

SEQ ID NO: 1209158 - RNA, 19 nt, Human
uccaggacagcaggugcgc

SEQ ID NO: 1209159 - RNA, 21 nt, Human
ucccaggggccgcccuuggcc

SEQ ID NO: 1209160 - RNA, 22 nt, Human
ucccaggggccgcccuuggccu

SEQ ID NO: 1209161 - RNA, 24 nt, Human
uccccgaacagagaucggaagcuc

SEQ ID NO: 1209162 - RNA, 22 nt, Human
uccccuucuucuuacgauuaaa

SEQ ID NO: 1209163 - RNA, 19 nt, Human
ucccucuugcuccuccugg

SEQ ID NO: 1209164 - RNA, 19 nt, Human
ucccucuugcuccuccugg

SEQ ID NO: 1209165 - RNA, 22 nt, Human
ucccuggacacacugccggucc

SEQ ID NO: 1209166 - RNA, 25 nt, Human
ucccuggacacacugccgguccccg

SEQ ID NO: 1209167 - RNA, 19 nt, Human
ucccuguggacccugggga

SEQ ID NO: 1209168 - RNA, 20 nt, Human
uccgggccgcugcccagccu

SEQ ID NO: 1209169 - RNA, 21 nt, Human
uccgggccgcugcccagccuc

SEQ ID NO: 1209170 - RNA, 23 nt, Human
ucgugcucgcugucccccagacg

SEQ ID NO: 1209171 - RNA, 18 nt, Human
ucuccguccuccuucugg

SEQ ID NO: 1209172 - RNA, 22 nt, Human
ucuugaugaccgggcuccgcgg

SEQ ID NO: 1209173 - RNA, 21 nt, Human
ugacaaaaaagaggaaaagga

SEQ ID NO: 1209174 - RNA, 18 nt, Human
ugaccuggucagggaacc

SEQ ID NO: 1209175 - RNA, 19 nt, Human
ugacgagaaaagccaagcc

SEQ ID NO: 1209176 - RNA, 21 nt, Human
ugcacuucucacagagcacca

SEQ ID NO: 1209177 - RNA, 22 nt, Human
ugcaggccaggugccaggugcc

SEQ ID NO: 1209178 - RNA, 30 nt, Human
ugccaggugcccagcgggccccacgcucuu

SEQ ID NO: 1209179 - RNA, 24 nt, Human
ugcccagccuccugcgggcccugg

SEQ ID NO: 1209180 - RNA, 20 nt, Human
ugcuggggacggaagggcuc

SEQ ID NO: 1209181 - RNA, 21 nt, Human
ugggaagaaauacacucagcg

SEQ ID NO: 1209182 - RNA, 24 nt, Human
ugggagacgguggguggguccccc

SEQ ID NO: 1209183 - RNA, 19 nt, Human
ugugcagccugaccgucag

SEQ ID NO: 1209184 - RNA, 21 nt, Human
uuaagagcucccugauuuccg

SEQ ID NO: 1209185 - RNA, 19 nt, Human
uuaccccagacgauguccc

SEQ ID NO: 1209186 - RNA, 23 nt, Human
uuccggggccacgugucuugcgg

SEQ ID NO: 1209187 - RNA, 23 nt, Human
uucuuuauucuuuuuggucuuua

SEQ ID NO: 1209188 - RNA, 21 nt, Human
uuggucuuuaaagugacaaaa

SEQ ID NO: 1209189 - RNA, 19 nt, Human
uuuaaagugacaaaaaaga

SEQ ID NO: 1209190 - RNA, 25 nt, Human
aaacacaacaucugaaauuuaaaac

SEQ ID NO: 1209191 - RNA, 24 nt, Human
aaagaagaaaagagauauaaagga

SEQ ID NO: 1209192 - RNA, 21 nt, Human
aaagcugcauucccaauacaa

SEQ ID NO: 1209193 - RNA, 24 nt, Human
aaagugcugggauuacaggcguga

SEQ ID NO: 1209194 - RNA, 20 nt, Human
aacaugaaaaauacacaaga

SEQ ID NO: 1209195 - RNA, 23 nt, Human
aagaaauucaacuuuuucuugaa

SEQ ID NO: 1209196 - RNA, 20 nt, Human
aagaacaucccgaugucccc

SEQ ID NO: 1209197 - RNA, 21 nt, Human
aagaagaaaagagauauaaag

SEQ ID NO: 1209198 - RNA, 26 nt, Human
aagaagaaaagagauauaaaggaaau

SEQ ID NO: 1209199 - RNA, 20 nt, Human
aaggagggaagccgacagug

SEQ ID NO: 1209200 - RNA, 24 nt, Human
aaguagcuggaguuacaggcaugu

SEQ ID NO: 1209201 - RNA, 19 nt, Human
aagugcugggauuacaggc

SEQ ID NO: 1209202 - RNA, 19 nt, Human
aagugcugggauuacaggc

SEQ ID NO: 1209203 - RNA, 26 nt, Human
aagugcugggauuacaggcgugagcc

SEQ ID NO: 1209204 - RNA, 20 nt, Human
aaugcugcauuuuuuuuuuu

SEQ ID NO: 1209205 - RNA, 18 nt, Human
acagcucacugcagccuc

SEQ ID NO: 1209206 - RNA, 20 nt, Human
acggaggugagaggaaacuc

SEQ ID NO: 1209207 - RNA, 20 nt, Human
acggaggugagaggaaacuc

SEQ ID NO: 1209208 - RNA, 21 nt, Human
acggaggugagaggaaacucu

SEQ ID NO: 1209209 - RNA, 21 nt, Human
acggaggugagaggaaacucu

SEQ ID NO: 1209210 - RNA, 18 nt, Human
acgggguuucuccauguu

SEQ ID NO: 1209211 - RNA, 20 nt, Human
acgggguuucuccauguugg

SEQ ID NO: 1209212 - RNA, 24 nt, Human
acgggguuucuccauguuggccag

SEQ ID NO: 1209213 - RNA, 24 nt, Human
acucuguugcccaggcuugagugc

SEQ ID NO: 1209214 - RNA, 18 nt, Human
acugcagccucgaccucc

SEQ ID NO: 1209215 - RNA, 20 nt, Human
acugugaaugguccauguau

SEQ ID NO: 1209216 - RNA, 21 nt, Human
acuguggugggucuucuccca

SEQ ID NO: 1209217 - RNA, 31 nt, Human
agaaaagagauauaaaggaaaugaaaagaag

SEQ ID NO: 1209218 - RNA, 30 nt, Human
agaaaagagauauaaaggaaaugaaaagag

SEQ ID NO: 1209219 - RNA, 23 nt, Human
agaggugagaggaaaugcuggag

SEQ ID NO: 1209220 - RNA, 23 nt, Human
agcagcacacuguggacugcagu

SEQ ID NO: 1209221 - RNA, 21 nt, Human
aggcccgagagccccuggcaa

SEQ ID NO: 1209222 - RNA, 24 nt, Human
aggcgugugccaccauguccaguu

SEQ ID NO: 1209223 - RNA, 23 nt, Human
aggugagaggaaacucuggagag

SEQ ID NO: 1209224 - RNA, 23 nt, Human
aggugagaggaaacucuggagag

SEQ ID NO: 1209225 - RNA, 24 nt, Human
aggugaucugcccaccucggccuc

SEQ ID NO: 1209226 - RNA, 19 nt, Human
aguagcugggacugcaggc

SEQ ID NO: 1209227 - RNA, 23 nt, Human
aguagcugggacugcaggcgugu

SEQ ID NO: 1209228 - RNA, 20 nt, Human
agugcaauggcgugaucucg

SEQ ID NO: 1209229 - RNA, 24 nt, Human
agugcaauggcgugaucucggcuc

SEQ ID NO: 1209230 - RNA, 24 nt, Human
agugcaguggugcaaucacagcuc

SEQ ID NO: 1209231 - RNA, 24 nt, Human
aguuacaggcaugugccaccaugc

SEQ ID NO: 1209232 - RNA, 19 nt, Human
caaaacaccaguguagguc

SEQ ID NO: 1209233 - RNA, 24 nt, Human
caaaacaccaguguagguccaagg

SEQ ID NO: 1209234 - RNA, 24 nt, Human
caaagugcugggauuacaggcgug

SEQ ID NO: 1209235 - RNA, 18 nt, Human
caacacccagaaacaaua

SEQ ID NO: 1209236 - RNA, 18 nt, Human
caacaggagguggcuuug

SEQ ID NO: 1209237 - RNA, 25 nt, Human
caacaugaaaaauacacaagaacau

SEQ ID NO: 1209238 - RNA, 21 nt, Human
caagaacaucccgaugucccc

SEQ ID NO: 1209239 - RNA, 22 nt, Human
caagggauccuccugccucagc

SEQ ID NO: 1209240 - RNA, 22 nt, Human
caagugauucuccugccucagc

SEQ ID NO: 1209241 - RNA, 27 nt, Human
caagugauucuccugccucagccuccc

SEQ ID NO: 1209242 - RNA, 21 nt, Human
caauagcaacaggagguggcu

SEQ ID NO: 1209243 - RNA, 21 nt, Human
caauccuauacccacauaaaa

SEQ ID NO: 1209244 - RNA, 22 nt, Human
cacacagcaauccuauacccac

SEQ ID NO: 1209245 - RNA, 21 nt, Human
cacacuguggacugcaguuaa

SEQ ID NO: 1209246 - RNA, 25 nt, Human
cacacuguggugggucuucucccag

SEQ ID NO: 1209247 - RNA, 19 nt, Human
cacaggaucacagggugaa

SEQ ID NO: 1209248 - RNA, 24 nt, Human
cacccagaaacaauacuuuacauu

SEQ ID NO: 1209249 - RNA, 24 nt, Human
caccucggccucccaaagugcugg

SEQ ID NO: 1209250 - RNA, 19 nt, Human
cacucuguugcccaggcuu

SEQ ID NO: 1209251 - RNA, 24 nt, Human
cacucuguugcccaggcuugagug

SEQ ID NO: 1209252 - RNA, 23 nt, Human
cacugcaaccucugccuuccggg

SEQ ID NO: 1209253 - RNA, 19 nt, Human
cacugcagccucgaccucc

SEQ ID NO: 1209254 - RNA, 20 nt, Human
cagccuccugaguagcuggg

SEQ ID NO: 1209255 - RNA, 21 nt, Human
cagccucgaccuccugggcuc

SEQ ID NO: 1209256 - RNA, 24 nt, Human
cagccucgaccuccugggcucaag

SEQ ID NO: 1209257 - RNA, 26 nt, Human
caggagcucuuuggcaugacuggugg

SEQ ID NO: 1209258 - RNA, 18 nt, Human
caguguagguccaagagu

SEQ ID NO: 1209259 - RNA, 21 nt, Human
cauccagcaugggagagagau

SEQ ID NO: 1209260 - RNA, 24 nt, Human
cauguuggccaggcuggucuugaa

SEQ ID NO: 1209261 - RNA, 23 nt, Human
cauucaugacauaacuuuuucuu

SEQ ID NO: 1209262 - RNA, 22 nt, Human
ccaaagugcugggauuacaggc

SEQ ID NO: 1209263 - RNA, 22 nt, Human
ccaaagugcugggauuacaggc

SEQ ID NO: 1209264 - RNA, 24 nt, Human
ccaaagugcugggauuacaggcgu

SEQ ID NO: 1209265 - RNA, 24 nt, Human
ccaaguagcuggaguuacaggcau

SEQ ID NO: 1209266 - RNA, 18 nt, Human
ccaccuucuucugccugc

SEQ ID NO: 1209267 - RNA, 21 nt, Human
ccacgcacuccccgagaacac

SEQ ID NO: 1209268 - RNA, 21 nt, Human
ccacgcacuccccgagaacac

SEQ ID NO: 1209269 - RNA, 21 nt, Human
ccacgcacuccccgagaacac

SEQ ID NO: 1209270 - RNA, 21 nt, Human
ccacgcacucccugagaacac

SEQ ID NO: 1209271 - RNA, 19 nt, Human
ccaugcuggcagccgacug

SEQ ID NO: 1209272 - RNA, 19 nt, Human
ccauguuggccaggcuggu

SEQ ID NO: 1209273 - RNA, 21 nt, Human
ccauguuggccaggcuggucu

SEQ ID NO: 1209274 - RNA, 21 nt, Human
ccauguuggccaggcuggucu

SEQ ID NO: 1209275 - RNA, 21 nt, Human
ccccgagaacacagaggugag

SEQ ID NO: 1209276 - RNA, 21 nt, Human
ccccgagaacacggaggugag

SEQ ID NO: 1209277 - RNA, 20 nt, Human
ccccuuuuuuucaaguuggg

SEQ ID NO: 1209278 - RNA, 23 nt, Human
cccgagagccccuggcaaaacac

SEQ ID NO: 1209279 - RNA, 20 nt, Human
cccugagaacacggagguga

SEQ ID NO: 1209280 - RNA, 19 nt, Human
ccggguucaagugauucuc

SEQ ID NO: 1209281 - RNA, 22 nt, Human
ccggguucaagugauucuccug

SEQ ID NO: 1209282 - RNA, 24 nt, Human
ccuccugccucagccuccugagua

SEQ ID NO: 1209283 - RNA, 24 nt, Human
ccuccugggcucaagggauccucc

SEQ ID NO: 1209284 - RNA, 19 nt, Human
ccucgaccuccugggcuca

SEQ ID NO: 1209285 - RNA, 20 nt, Human
ccucgaccuccugggcucaa

SEQ ID NO: 1209286 - RNA, 24 nt, Human
ccugaccuuaggugaucugcccac

SEQ ID NO: 1209287 - RNA, 19 nt, Human
ccugagaacacggagguga

SEQ ID NO: 1209288 - RNA, 23 nt, Human
ccugaguagcugggacugcaggc

SEQ ID NO: 1209289 - RNA, 23 nt, Human
ccugaguagcugggacugcaggc

SEQ ID NO: 1209290 - RNA, 23 nt, Human
ccugccucagccucccaaguagc

SEQ ID NO: 1209291 - RNA, 23 nt, Human
ccugccucagccuccugaguagc

SEQ ID NO: 1209292 - RNA, 20 nt, Human
ccugggcucaagggauccuc

SEQ ID NO: 1209293 - RNA, 24 nt, Human
ccuuccggguucaagugauucucc

SEQ ID NO: 1209294 - RNA, 25 nt, Human
cgaccuccugggcucaagggauccu

SEQ ID NO: 1209295 - RNA, 22 nt, Human
cgagaacacagaggugagagga

SEQ ID NO: 1209296 - RNA, 22 nt, Human
cgagaacacggaggugagagga

SEQ ID NO: 1209297 - RNA, 22 nt, Human
cgagaacacggaggugagagga

SEQ ID NO: 1209298 - RNA, 25 nt, Human
cgagaacacggaggugagaggaaac

SEQ ID NO: 1209299 - RNA, 23 nt, Human
cgauguccccuuuuuuucaaguu

SEQ ID NO: 1209300 - RNA, 24 nt, Human
cucacugcaaccucugccuuccgg

SEQ ID NO: 1209301 - RNA, 24 nt, Human
cucacugcagccucgaccuccugg

SEQ ID NO: 1209302 - RNA, 24 nt, Human
cucagccuccugaguagcugggac

SEQ ID NO: 1209303 - RNA, 24 nt, Human
cuccauguuggccaggcuggucuu

SEQ ID NO: 1209304 - RNA, 23 nt, Human
cuccccgagaacacggaggugag

SEQ ID NO: 1209305 - RNA, 23 nt, Human
cucccugagaacacggaggugag

SEQ ID NO: 1209306 - RNA, 20 nt, Human
cucuuguugcccaggcugga

SEQ ID NO: 1209307 - RNA, 18 nt, Human
cugcaaccucugccuucc

SEQ ID NO: 1209308 - RNA, 24 nt, Human
cugcaaccucugccuuccggguuc

SEQ ID NO: 1209309 - RNA, 22 nt, Human
cugcagccucgaccuccugggc

SEQ ID NO: 1209310 - RNA, 23 nt, Human
cugcagccucgaccuccugggcu

SEQ ID NO: 1209311 - RNA, 23 nt, Human
cugccucagccucccaaguagcu

SEQ ID NO: 1209312 - RNA, 23 nt, Human
cugccucagccuccugaguagcu

SEQ ID NO: 1209313 - RNA, 23 nt, Human
cugccugcuuuuuccagccaugc

SEQ ID NO: 1209314 - RNA, 23 nt, Human
cugccuuccggguucaagugauu

SEQ ID NO: 1209315 - RNA, 24 nt, Human
cugucugcaaacugaggggcaagg

SEQ ID NO: 1209316 - RNA, 20 nt, Human
cuuccggguucaagugauuc

SEQ ID NO: 1209317 - RNA, 22 nt, Human
cuucuucugccugcuuuuucca

SEQ ID NO: 1209318 - RNA, 24 nt, Human
cuuguugcccaggcuggagugcaa

SEQ ID NO: 1209319 - RNA, 24 nt, Human
gaccuuaggugaucugcccaccuc

SEQ ID NO: 1209320 - RNA, 24 nt, Human
gacugcaggcgugugccaccaugu

SEQ ID NO: 1209321 - RNA, 21 nt, Human
gagaacacggaggugagagga

SEQ ID NO: 1209322 - RNA, 20 nt, Human
gagaggaaacucuggagagg

SEQ ID NO: 1209323 - RNA, 21 nt, Human
gagccccuggcaaaacaccag

SEQ ID NO: 1209324 - RNA, 20 nt, Human
gaggaaaugcuggagaggag

SEQ ID NO: 1209325 - RNA, 24 nt, Human
gagugcaguggugcaaucacagcu

SEQ ID NO: 1209326 - RNA, 21 nt, Human
gaucacuuuuuaccgugauac

SEQ ID NO: 1209327 - RNA, 18 nt, Human
gauuacaggcgugagcca

SEQ ID NO: 1209328 - RNA, 19 nt, Human
gauuacaggcgugagccac

SEQ ID NO: 1209329 - RNA, 23 nt, Human
gauuacaggcgugagccacugca

SEQ ID NO: 1209330 - RNA, 21 nt, Human
gauucuccugccucagccucc

SEQ ID NO: 1209331 - RNA, 22 nt, Human
gcaaaacaccaguguaggucca

SEQ ID NO: 1209332 - RNA, 25 nt, Human
gcaacacccagaaacaauacuuuac

SEQ ID NO: 1209333 - RNA, 22 nt, Human
gcaaccucugccuuccggguuc

SEQ ID NO: 1209334 - RNA, 24 nt, Human
gcccaggcuggagugcaauggcgu

SEQ ID NO: 1209335 - RNA, 20 nt, Human
gcucuuguugcccaggcugg

SEQ ID NO: 1209336 - RNA, 21 nt, Human
gcucuuguugcccaggcugga

SEQ ID NO: 1209337 - RNA, 24 nt, Human
gcucuuguugcccaggcuggagug

SEQ ID NO: 1209338 - RNA, 19 nt, Human
gcuggagugcaauggcgug

SEQ ID NO: 1209339 - RNA, 24 nt, Human
gcugucugcaaacugaggggcaag

SEQ ID NO: 1209340 - RNA, 24 nt, Human
ggacugcaggcgugugccaccaug

SEQ ID NO: 1209341 - RNA, 22 nt, Human
ggauccuccugccucagccucc

SEQ ID NO: 1209342 - RNA, 22 nt, Human
ggcuggagugcaauggcgugau

SEQ ID NO: 1209343 - RNA, 23 nt, Human
ggcuggucuugaacuccugaccu

SEQ ID NO: 1209344 - RNA, 18 nt, Human
gggacugcaggcgugugc

SEQ ID NO: 1209345 - RNA, 24 nt, Human
gggauccuccugccucagccuccu

SEQ ID NO: 1209346 - RNA, 18 nt, Human
gggcaaggaagccaguag

SEQ ID NO: 1209347 - RNA, 22 nt, Human
gggcucaagggauccuccugcc

SEQ ID NO: 1209348 - RNA, 23 nt, Human
gggguuucuccauguuggccagg

SEQ ID NO: 1209349 - RNA, 22 nt, Human
gggucucacucuguugcccagg

SEQ ID NO: 1209350 - RNA, 22 nt, Human
ggguucaagugauucuccugcc

SEQ ID NO: 1209351 - RNA, 22 nt, Human
ggguuucuccauguuggccagg

SEQ ID NO: 1209352 - RNA, 19 nt, Human
gguccaagaguccaaaagc

SEQ ID NO: 1209353 - RNA, 19 nt, Human
ggucuugaacuccugaccu

SEQ ID NO: 1209354 - RNA, 26 nt, Human
gugagaggaaacucuggagaggagaa

SEQ ID NO: 1209355 - RNA, 20 nt, Human
gugagaggaaaugcuggaga

SEQ ID NO: 1209356 - RNA, 24 nt, Human
gugaucugcccaccucggccuccc

SEQ ID NO: 1209357 - RNA, 24 nt, Human
gugauucuccugccucagccuccc

SEQ ID NO: 1209358 - RNA, 23 nt, Human
guggugcaaucacagcucacugc

SEQ ID NO: 1209359 - RNA, 20 nt, Human
guuaaggcuuuugugccugc

SEQ ID NO: 1209360 - RNA, 21 nt, Human
uaaaggagggaagccgacagu

SEQ ID NO: 1209361 - RNA, 25 nt, Human
uaaucaaguugacauuuaauaugaa

SEQ ID NO: 1209362 - RNA, 22 nt, Human
uacaggcaugugccaccaugcc

SEQ ID NO: 1209363 - RNA, 21 nt, Human
uacaggcgugagccacugcac

SEQ ID NO: 1209364 - RNA, 22 nt, Human
uacaggcgugagccacugcacu

SEQ ID NO: 1209365 - RNA, 19 nt, Human
uacccacauaaaagcugca

SEQ ID NO: 1209366 - RNA, 25 nt, Human
uauagaaaaaagaagaaaagagaua

SEQ ID NO: 1209367 - RNA, 25 nt, Human
uauuauagaaaaaagaagaaaagag

SEQ ID NO: 1209368 - RNA, 24 nt, Human
ucaacagagaaucggcauccacaa

SEQ ID NO: 1209369 - RNA, 19 nt, Human
ucaagugauucuccugccu

SEQ ID NO: 1209370 - RNA, 20 nt, Human
ucacaaauuuccuuauuuuu

SEQ ID NO: 1209371 - RNA, 24 nt, Human
ucacugcaaccucugccuuccggg

SEQ ID NO: 1209372 - RNA, 23 nt, Human
ucacugcagccucgaccuccugg

SEQ ID NO: 1209373 - RNA, 24 nt, Human
ucacugcagccucgaccuccuggg

SEQ ID NO: 1209374 - RNA, 18 nt, Human
ucagccucccaaguagcu

SEQ ID NO: 1209375 - RNA, 20 nt, Human
ucagccucccaaguagcugg

SEQ ID NO: 1209376 - RNA, 22 nt, Human
ucagccucccaaguagcuggag

SEQ ID NO: 1209377 - RNA, 23 nt, Human
ucagccuccugaguagcugggac

SEQ ID NO: 1209378 - RNA, 18 nt, Human
uccaaaagcuaaagaacu

SEQ ID NO: 1209379 - RNA, 23 nt, Human
uccacaaaaaauuaccagacacc

SEQ ID NO: 1209380 - RNA, 24 nt, Human
ucccaaagugcugggauuacaggc

SEQ ID NO: 1209381 - RNA, 24 nt, Human
ucccaaguagcuggaguuacaggc

SEQ ID NO: 1209382 - RNA, 26 nt, Human
uccccaaaccucuaaaggagggaagc

SEQ ID NO: 1209383 - RNA, 19 nt, Human
ucccugagaacacggaggu

SEQ ID NO: 1209384 - RNA, 21 nt, Human
ucccugagaacacggagguga

SEQ ID NO: 1209385 - RNA, 23 nt, Human
uccggguucaagugauucuccuc

SEQ ID NO: 1209386 - RNA, 24 nt, Human
uccugaguagcugggacugcaggc

SEQ ID NO: 1209387 - RNA, 18 nt, Human
uccugggcucaagggauc

SEQ ID NO: 1209388 - RNA, 22 nt, Human
uccugggcucaagggauccucc

SEQ ID NO: 1209389 - RNA, 18 nt, Human
ucggccucccaaagugcu

SEQ ID NO: 1209390 - RNA, 22 nt, Human
ucgugcagagauuagcaccaca

SEQ ID NO: 1209391 - RNA, 19 nt, Human
ucucacucuguugcccagg

SEQ ID NO: 1209392 - RNA, 21 nt, Human
ucucacucuguugcccaggcu

SEQ ID NO: 1209393 - RNA, 24 nt, Human
ucucacucuguugcccaggcuuga

SEQ ID NO: 1209394 - RNA, 25 nt, Human
ucucacucuguugcccaggcuugag

SEQ ID NO: 1209395 - RNA, 24 nt, Human
ucucaggagcucuuuggcaugacu

SEQ ID NO: 1209396 - RNA, 19 nt, Human
ucucccaguccacugacuc

SEQ ID NO: 1209397 - RNA, 26 nt, Human
ucuccugccucagccucccaaguagc

SEQ ID NO: 1209398 - RNA, 24 nt, Human
ucugacaccacgcacuccccgaga

SEQ ID NO: 1209399 - RNA, 24 nt, Human
ucugacaccacgcacuccccgaga

SEQ ID NO: 1209400 - RNA, 25 nt, Human
ucugcaaacugaggggcaaggaagc

SEQ ID NO: 1209401 - RNA, 23 nt, Human
ucuguggccgaaggcccgagagc

SEQ ID NO: 1209402 - RNA, 18 nt, Human
ucuucuggcaacacccag

SEQ ID NO: 1209403 - RNA, 23 nt, Human
ucuugaacuccugaccuuaggug

SEQ ID NO: 1209404 - RNA, 22 nt, Human
ucuuguugcccaggcuggagug

SEQ ID NO: 1209405 - RNA, 23 nt, Human
ucuuuggcaugacugguggcacu

SEQ ID NO: 1209406 - RNA, 25 nt, Human
ugaaaaauacacaagaacaucccga

SEQ ID NO: 1209407 - RNA, 19 nt, Human
ugacauaacuuuuucuuuu

SEQ ID NO: 1209408 - RNA, 20 nt, Human
ugaccuuaggugaucugccc

SEQ ID NO: 1209409 - RNA, 24 nt, Human
ugaccuuaggugaucugcccaccu

SEQ ID NO: 1209410 - RNA, 25 nt, Human
ugagaacacggaggugagaggaaac

SEQ ID NO: 1209411 - RNA, 23 nt, Human
ugagacagaguuuugcucuuguu

SEQ ID NO: 1209412 - RNA, 21 nt, Human
ugagaggaaacucuggagagg

SEQ ID NO: 1209413 - RNA, 22 nt, Human
ugagaggaaacucuggagagga

SEQ ID NO: 1209414 - RNA, 18 nt, Human
ugagaggaaaugcuggag

SEQ ID NO: 1209415 - RNA, 18 nt, Human
ugagaggaaaugcuggag

SEQ ID NO: 1209416 - RNA, 21 nt, Human
ugagaggaaaugcuggagagg

SEQ ID NO: 1209417 - RNA, 21 nt, Human
ugagaggaaaugcuggagaug

SEQ ID NO: 1209418 - RNA, 19 nt, Human
ugagugcaguggugcaauc

SEQ ID NO: 1209419 - RNA, 24 nt, Human
ugaucugcccaccucggccuccca

SEQ ID NO: 1209420 - RNA, 20 nt, Human
ugauucuccugccucagccu

SEQ ID NO: 1209421 - RNA, 20 nt, Human
ugccaccauguccaguuaaa

SEQ ID NO: 1209422 - RNA, 18 nt, Human
ugcccaggcuggagugca

SEQ ID NO: 1209423 - RNA, 21 nt, Human
ugcccaggcuggagugcaaug

SEQ ID NO: 1209424 - RNA, 21 nt, Human
ugcccaggcuggagugcaaug

SEQ ID NO: 1209425 - RNA, 24 nt, Human
ugcccaggcuggagugcaauggcg

SEQ ID NO: 1209426 - RNA, 24 nt, Human
ugcccaggcuugagugcaguggug

SEQ ID NO: 1209427 - RNA, 24 nt, Human
ugccucagccucccaaguagcugg

SEQ ID NO: 1209428 - RNA, 24 nt, Human
ugccucagccuccugaguagcugg

SEQ ID NO: 1209429 - RNA, 24 nt, Human
ugcucuuguugcccaggcuggagu

SEQ ID NO: 1209430 - RNA, 24 nt, Human
ugcugggauuacaggcgugagcca

SEQ ID NO: 1209431 - RNA, 18 nt, Human
uggagaggagcaggaugg

SEQ ID NO: 1209432 - RNA, 24 nt, Human
uggagucugauguucaagggcagg

SEQ ID NO: 1209433 - RNA, 19 nt, Human
uggagugcaauggcgugau

SEQ ID NO: 1209434 - RNA, 23 nt, Human
uggagugcaauggcgugaucucg

SEQ ID NO: 1209435 - RNA, 24 nt, Human
uggagugcaauggcgugaucucgg

SEQ ID NO: 1209436 - RNA, 22 nt, Human
uggaguuacaggcaugugccac

SEQ ID NO: 1209437 - RNA, 24 nt, Human
uggaguuacaggcaugugccacca

SEQ ID NO: 1209438 - RNA, 24 nt, Human
uggccaggcuggucuugaacuccu

SEQ ID NO: 1209439 - RNA, 20 nt, Human
uggcgugaucucggcucacu

SEQ ID NO: 1209440 - RNA, 18 nt, Human
ugggacugcaggcgugug

SEQ ID NO: 1209441 - RNA, 21 nt, Human
ugggacugcaggcgugugcca

SEQ ID NO: 1209442 - RNA, 24 nt, Human
ugggacugcaggcgugugccacca

SEQ ID NO: 1209443 - RNA, 25 nt, Human
ugggacugcaggcgugugccaccau

SEQ ID NO: 1209444 - RNA, 18 nt, Human
ugggauuacaggcgugag

SEQ ID NO: 1209445 - RNA, 19 nt, Human
ugggauuacaggcgugagc

SEQ ID NO: 1209446 - RNA, 21 nt, Human
ugggauuacaggcgugagcca

SEQ ID NO: 1209447 - RNA, 22 nt, Human
ugggauuacaggcgugagccac

SEQ ID NO: 1209448 - RNA, 22 nt, Human
ugggauuacaggcgugagccac

SEQ ID NO: 1209449 - RNA, 24 nt, Human
ugggauuacaggcgugagccacug

SEQ ID NO: 1209450 - RNA, 24 nt, Human
ugggauuacaggcgugagccacug

SEQ ID NO: 1209451 - RNA, 24 nt, Human
ugggcucaagggauccuccugccu

SEQ ID NO: 1209452 - RNA, 24 nt, Human
uggggucucacucuguugcccagg

SEQ ID NO: 1209453 - RNA, 25 nt, Human
ugggucccaaaguguucuucaaggu

SEQ ID NO: 1209454 - RNA, 19 nt, Human
ugguaggcaaccgcagcug

SEQ ID NO: 1209455 - RNA, 24 nt, Human
uggugcaaucacagcucacugcag

SEQ ID NO: 1209456 - RNA, 23 nt, Human
uguauggucuguauauuuuaugc

SEQ ID NO: 1209457 - RNA, 23 nt, Human
uguccccuuuuuuucaaguuggg

SEQ ID NO: 1209458 - RNA, 22 nt, Human
uguggccgaaggcccgagagcc

SEQ ID NO: 1209459 - RNA, 20 nt, Human
uguugcaaauuuccaaaaau

SEQ ID NO: 1209460 - RNA, 20 nt, Human
uguugcccaggcuggagugc

SEQ ID NO: 1209461 - RNA, 21 nt, Human
uguugcccaggcuugagugca

SEQ ID NO: 1209462 - RNA, 19 nt, Human
uuaaaacugaaagaaaaca

SEQ ID NO: 1209463 - RNA, 21 nt, Human
uucaagugauucuccugccuc

SEQ ID NO: 1209464 - RNA, 23 nt, Human
uucaagugauucuccugccucag

SEQ ID NO: 1209465 - RNA, 24 nt, Human
uucaagugauucuccugccucagc

SEQ ID NO: 1209466 - RNA, 20 nt, Human
uuccagcagcacacugugga

SEQ ID NO: 1209467 - RNA, 24 nt, Human
uuccggguucaagugauucuccug

SEQ ID NO: 1209468 - RNA, 18 nt, Human
uugcccaggcuggagugc

SEQ ID NO: 1209469 - RNA, 23 nt, Human
uugcccaggcuugagugcagugg

SEQ ID NO: 1209470 - RNA, 24 nt, Human
uugcccaggcuugagugcaguggu

SEQ ID NO: 1209471 - RNA, 23 nt, Human
uugcucuuguugcccaggcugga

SEQ ID NO: 1209472 - RNA, 21 nt, Human
uuucuccauguuggccaggcu

SEQ ID NO: 1209473 - RNA, 24 nt, Human
uuugcucuuguugcccaggcugga

SEQ ID NO: 1209474 - RNA, 22 nt, Human
uuuuauuuuuaguagucacggg

SEQ ID NO: 1209475 - RNA, 24 nt, Human
uuuugcucuuguugcccaggcugg

SEQ ID NO: 1209476 - RNA, 20 nt, Human
uuuuuuuuuuugagacagag

SEQ ID NO: 1209477 - RNA, 19 nt, Human
aacaguuucugguggugcu

SEQ ID NO: 1209478 - RNA, 24 nt, Human
aaccccaccucccaacacacccac

SEQ ID NO: 1209479 - RNA, 22 nt, Human
acaaaacaugagggguggccuc

SEQ ID NO: 1209480 - RNA, 18 nt, Human
acaccuuaaaccccaccu

SEQ ID NO: 1209481 - RNA, 22 nt, Human
acagcagcugggaaaauggagg

SEQ ID NO: 1209482 - RNA, 18 nt, Human
accccaccucccaacaca

SEQ ID NO: 1209483 - RNA, 26 nt, Human
acucacucccucaagaauuagcccag

SEQ ID NO: 1209484 - RNA, 21 nt, Human
agagcuggggaugagucugag

SEQ ID NO: 1209485 - RNA, 19 nt, Human
agcuggggaugagucugag

SEQ ID NO: 1209486 - RNA, 24 nt, Human
agggggagugggacaaaacaugag

SEQ ID NO: 1209487 - RNA, 21 nt, Human
agggguggccucauguuauaa

SEQ ID NO: 1209488 - RNA, 22 nt, Human
auuuccagcauaugaauuccag

SEQ ID NO: 1209489 - RNA, 22 nt, Human
caacacacccacaccuggacca

SEQ ID NO: 1209490 - RNA, 21 nt, Human
cacacccacaccuggaccaaa

SEQ ID NO: 1209491 - RNA, 23 nt, Human
caccuuaaaccccaccucccaac

SEQ ID NO: 1209492 - RNA, 25 nt, Human
caccuuaaaccccaccucccaacac

SEQ ID NO: 1209493 - RNA, 24 nt, Human
cacuccaaucacagcagcugggaa

SEQ ID NO: 1209494 - RNA, 19 nt, Human
caugacacagaagcgaagu

SEQ ID NO: 1209495 - RNA, 23 nt, Human
ccacaccuuaaaccccaccuccc

SEQ ID NO: 1209496 - RNA, 30 nt, Human
cccaccucccaacacacccacaccuggacu

SEQ ID NO: 1209497 - RNA, 19 nt, Human
cccucaagaauuagcccag

SEQ ID NO: 1209498 - RNA, 21 nt, Human
ccuaaccacaccuuaaacccc

SEQ ID NO: 1209499 - RNA, 19 nt, Human
ccucccaacacacccacac

SEQ ID NO: 1209500 - RNA, 23 nt, Human
ccucugugccaggccggucgccc

SEQ ID NO: 1209501 - RNA, 24 nt, Human
cuaaccacaccuuaaaccccaccu

SEQ ID NO: 1209502 - RNA, 22 nt, Human
cucccaacacacccacaccugg

SEQ ID NO: 1209503 - RNA, 18 nt, Human
cucucuuccuuccccucu

SEQ ID NO: 1209504 - RNA, 25 nt, Human
cucugugccaggccggucgccccuc

SEQ ID NO: 1209505 - RNA, 18 nt, Human
cuuaaaccccaccuccca

SEQ ID NO: 1209506 - RNA, 25 nt, Human
gagcuggggaugagucugagucucc

SEQ ID NO: 1209507 - RNA, 18 nt, Human
gcuggggaugagucugag

SEQ ID NO: 1209508 - RNA, 21 nt, Human
gggagugggacaaaacaugag

SEQ ID NO: 1209509 - RNA, 22 nt, Human
guccggagagagcgggaagcca

SEQ ID NO: 1209510 - RNA, 23 nt, Human
ucccuaaagagcagcauuaaucu

SEQ ID NO: 1209511 - RNA, 18 nt, Human
ugacucaguuuugaaggc

SEQ ID NO: 1209512 - RNA, 20 nt, Human
ugagucugagucucccuggg

SEQ ID NO: 1209513 - RNA, 18 nt, Human
uggaggccaagagcuggg

SEQ ID NO: 1209514 - RNA, 18 nt, Human
ugggacaaaacaugaggg

SEQ ID NO: 1209515 - RNA, 18 nt, Human
uguccggagagagcggga

SEQ ID NO: 1209516 - RNA, 23 nt, Human
uuaaaccccaccucccaacacac

SEQ ID NO: 1209517 - RNA, 23 nt, Human
uugaaggcugggaagcccaagag

SEQ ID NO: 1209518 - RNA, 23 nt, Human
aaacagaagaugagaaccaccga

SEQ ID NO: 1209519 - RNA, 18 nt, Human
aaaggacugagcuguuuc

SEQ ID NO: 1209520 - RNA, 23 nt, Human
aaauaaacacaucaaaacgugca

SEQ ID NO: 1209521 - RNA, 24 nt, Human
aacaggccaagaccagugcaggca

SEQ ID NO: 1209522 - RNA, 24 nt, Human
aacccuuuauguuccuccuucauc

SEQ ID NO: 1209523 - RNA, 22 nt, Human
aagauaccguguaaagccacag

SEQ ID NO: 1209524 - RNA, 19 nt, Human
aagcagugccacagcacuu

SEQ ID NO: 1209525 - RNA, 21 nt, Human
aagcagugccacagcacuugg

SEQ ID NO: 1209526 - RNA, 22 nt, Human
aagcauaacccagauggaacgc

SEQ ID NO: 1209527 - RNA, 21 nt, Human
aaggaauugcauaacagagaa

SEQ ID NO: 1209528 - RNA, 23 nt, Human
acagguguuuucuugaaaugcuu

SEQ ID NO: 1209529 - RNA, 19 nt, Human
acauaacauuuucuucauc

SEQ ID NO: 1209530 - RNA, 23 nt, Human
acgacuuucuccauucagggcac

SEQ ID NO: 1209531 - RNA, 21 nt, Human
acucagagcagcuauaguagc

SEQ ID NO: 1209532 - RNA, 19 nt, Human
agacagacuggugaaagac

SEQ ID NO: 1209533 - RNA, 20 nt, Human
agacaucuugaugaaaaggu

SEQ ID NO: 1209534 - RNA, 21 nt, Human
agaguuuuaaagcaugagauu

SEQ ID NO: 1209535 - RNA, 24 nt, Human
agcacuuugggaggccgagauggg

SEQ ID NO: 1209536 - RNA, 25 nt, Human
agcuguuucugaggacaggggggca

SEQ ID NO: 1209537 - RNA, 19 nt, Human
aggaagaagacacugcaga

SEQ ID NO: 1209538 - RNA, 25 nt, Human
aggccaagaccagugcaggcaucga

SEQ ID NO: 1209539 - RNA, 20 nt, Human
aggccgagaugggaggauca

SEQ ID NO: 1209540 - RNA, 24 nt, Human
aggugcaguggcucacaucuguaa

SEQ ID NO: 1209541 - RNA, 21 nt, Human
agguguuuucuugaaaugcuu

SEQ ID NO: 1209542 - RNA, 24 nt, Human
aguggcucacaucuguaaucccag

SEQ ID NO: 1209543 - RNA, 21 nt, Human
auaaagaacaggccaagacca

SEQ ID NO: 1209544 - RNA, 22 nt, Human
auagacaucuugaugaaaaggu

SEQ ID NO: 1209545 - RNA, 24 nt, Human
aucagucacucuccuguuucucag

SEQ ID NO: 1209546 - RNA, 21 nt, Human
auggaacgcauccucaguccc

SEQ ID NO: 1209547 - RNA, 23 nt, Human
auugcauaacagagaaaugcccu

SEQ ID NO: 1209548 - RNA, 23 nt, Human
caagaaacagaagaugagaacca

SEQ ID NO: 1209549 - RNA, 27 nt, Human
caagaaacagaagaugagaaccaccga

SEQ ID NO: 1209550 - RNA, 18 nt, Human
cacagcacuugguaaccc

SEQ ID NO: 1209551 - RNA, 24 nt, Human
cacaucuguaaucccagcacuuug

SEQ ID NO: 1209552 - RNA, 24 nt, Human
cagcacuuugggaggccgagaugg

SEQ ID NO: 1209553 - RNA, 18 nt, Human
caggaagaagacacugca

SEQ ID NO: 1209554 - RNA, 22 nt, Human
cauaaagaacaggccaagacca

SEQ ID NO: 1209555 - RNA, 23 nt, Human
cauaugcauacaguacaucugua

SEQ ID NO: 1209556 - RNA, 26 nt, Human
cauccucagucccuauuucccgggga

SEQ ID NO: 1209557 - RNA, 23 nt, Human
caucuguaaucccagcacuuugg

SEQ ID NO: 1209558 - RNA, 22 nt, Human
cauucagagccuccgcgcaucc

SEQ ID NO: 1209559 - RNA, 21 nt, Human
cauuucccaacguggcugcau

SEQ ID NO: 1209560 - RNA, 24 nt, Human
ccaaauaaauaaacacaucaaaac

SEQ ID NO: 1209561 - RNA, 20 nt, Human
ccaaccauaaccgaugggug

SEQ ID NO: 1209562 - RNA, 21 nt, Human
ccacagcacuccagcccuuau

SEQ ID NO: 1209563 - RNA, 24 nt, Human
ccacagcacuccagcccuuaugag

SEQ ID NO: 1209564 - RNA, 26 nt, Human
ccacagcacuccagcccuuaugaggc

SEQ ID NO: 1209565 - RNA, 20 nt, Human
ccagcagcucagaacauguu

SEQ ID NO: 1209566 - RNA, 21 nt, Human
cccaaauaaauaaacacauca

SEQ ID NO: 1209567 - RNA, 20 nt, Human
cccaggaagaagacacugca

SEQ ID NO: 1209568 - RNA, 23 nt, Human
cccaggaagaagacacugcagau

SEQ ID NO: 1209569 - RNA, 20 nt, Human
ccuuaaguuuucuugguucc

SEQ ID NO: 1209570 - RNA, 18 nt, Human
ccuuuauguuccuccuuc

SEQ ID NO: 1209571 - RNA, 19 nt, Human
cuaaagcucacccagucua

SEQ ID NO: 1209572 - RNA, 24 nt, Human
cucacaucuguaaucccagcacuu

SEQ ID NO: 1209573 - RNA, 20 nt, Human
cuccaaugcaacagaaggaa

SEQ ID NO: 1209574 - RNA, 18 nt, Human
cuccagggaagagaccca

SEQ ID NO: 1209575 - RNA, 21 nt, Human
cuguaaucccagcacuuuggg

SEQ ID NO: 1209576 - RNA, 22 nt, Human
gaaacuauaagguaucaaagca

SEQ ID NO: 1209577 - RNA, 18 nt, Human
gaaaugcuucuccaacca

SEQ ID NO: 1209578 - RNA, 20 nt, Human
gccacagcacuugguaaccc

SEQ ID NO: 1209579 - RNA, 24 nt, Human
gcccuggaggucaaggcugcagug

SEQ ID NO: 1209580 - RNA, 19 nt, Human
gucagugaggaagugaaac

SEQ ID NO: 1209581 - RNA, 24 nt, Human
gugcagcaccuaaagcucacccag

SEQ ID NO: 1209582 - RNA, 19 nt, Human
guuuguaaacuagaacugg

SEQ ID NO: 1209583 - RNA, 19 nt, Human
uaaagaacaggccaagacc

SEQ ID NO: 1209584 - RNA, 18 nt, Human
uaaagcucacccagucua

SEQ ID NO: 1209585 - RNA, 25 nt, Human
uaaauaaacacaucaaaacgugcaa

SEQ ID NO: 1209586 - RNA, 22 nt, Human
uaacacacacaaaaagcccuaa

SEQ ID NO: 1209587 - RNA, 18 nt, Human
uaagucuggagggcuggu

SEQ ID NO: 1209588 - RNA, 18 nt, Human
uaccguguaaagccacag

SEQ ID NO: 1209589 - RNA, 21 nt, Human
uaccguguaaagccacagggc

SEQ ID NO: 1209590 - RNA, 25 nt, Human
uaccugcaacaaaccuuucggagca

SEQ ID NO: 1209591 - RNA, 18 nt, Human
uaguuuagaguuuuaaag

SEQ ID NO: 1209592 - RNA, 19 nt, Human
uaucaaagcagugccacag

SEQ ID NO: 1209593 - RNA, 18 nt, Human
uaugcuguugaaaauggg

SEQ ID NO: 1209594 - RNA, 23 nt, Human
uauguuuguaaacuagaacugga

SEQ ID NO: 1209595 - RNA, 24 nt, Human
uauguuuguaaacuagaacuggaa

SEQ ID NO: 1209596 - RNA, 24 nt, Human
uauuccacaccugcacacucagaa

SEQ ID NO: 1209597 - RNA, 19 nt, Human
ucacccagucuauucaucu

SEQ ID NO: 1209598 - RNA, 21 nt, Human
ucacucuccuguuucucagca

SEQ ID NO: 1209599 - RNA, 23 nt, Human
ucagagccuccgcgcaucccaaa

SEQ ID NO: 1209600 - RNA, 19 nt, Human
ucuaaagcacaccagcaca

SEQ ID NO: 1209601 - RNA, 27 nt, Human
ucuguaauugcacugaaauccaaucgu

SEQ ID NO: 1209602 - RNA, 24 nt, Human
ucuugccaggugcaguggcucaca

SEQ ID NO: 1209603 - RNA, 19 nt, Human
ugagcguaguacugggacc

SEQ ID NO: 1209604 - RNA, 21 nt, Human
ugaggacaggggggcagacca

SEQ ID NO: 1209605 - RNA, 24 nt, Human
ugaggacaggggggcagaccaggg

SEQ ID NO: 1209606 - RNA, 25 nt, Human
ugaggacaggggggcagaccagggg

SEQ ID NO: 1209607 - RNA, 23 nt, Human
ugauuuacauaacauuuucuuca

SEQ ID NO: 1209608 - RNA, 25 nt, Human
ugcaacagaaggaauugcauaacag

SEQ ID NO: 1209609 - RNA, 23 nt, Human
ugcacacucagaaacuccaggga

SEQ ID NO: 1209610 - RNA, 22 nt, Human
ugcagugaaccaugauggcacc

SEQ ID NO: 1209611 - RNA, 20 nt, Human
uggcaccacagcacuccagc

SEQ ID NO: 1209612 - RNA, 21 nt, Human
uggcucacaucuguaauccca

SEQ ID NO: 1209613 - RNA, 24 nt, Human
uggcucacaucuguaaucccagca

SEQ ID NO: 1209614 - RNA, 19 nt, Human
ugggaggccgagaugggag

SEQ ID NO: 1209615 - RNA, 24 nt, Human
ugggaggccgagaugggaggauca

SEQ ID NO: 1209616 - RNA, 24 nt, Human
ugucaguaauuugcauagggauau

SEQ ID NO: 1209617 - RNA, 18 nt, Human
ugucauaagauaugcuca

SEQ ID NO: 1209618 - RNA, 21 nt, Human
uguguucaagaaacagaagau

SEQ ID NO: 1209619 - RNA, 23 nt, Human
uuaaaaguacaaugcugauguua

SEQ ID NO: 1209620 - RNA, 23 nt, Human
uuaaagcaugagauucuugucau

SEQ ID NO: 1209621 - RNA, 28 nt, Human
uucaagaaacagaagaugagaaccaccc

SEQ ID NO: 1209622 - RNA, 20 nt, Human
uucagagccuccgcgcaucc

SEQ ID NO: 1209623 - RNA, 19 nt, Human
uucuugguuccgaucgccc

SEQ ID NO: 1209624 - RNA, 25 nt, Human
uugggaggccgagaugggaggauca

SEQ ID NO: 1209625 - RNA, 25 nt, Human
uuguuuguaucagucacucuccugu

SEQ ID NO: 1209626 - RNA, 23 nt, Human
uuuaacaaaccuuccggaugauu

SEQ ID NO: 1209627 - RNA, 23 nt, Human
uuucccaacguggcugcauuacu

SEQ ID NO: 1209628 - RNA, 27 nt, Human
uuuuuuaaauacuguuucagguaaaua

SEQ ID NO: 1209629 - RNA, 19 nt, Human
aaaaugcugcauuggguug

SEQ ID NO: 1209630 - RNA, 24 nt, Human
aaacagauugcacugucaucuucc

SEQ ID NO: 1209631 - RNA, 21 nt, Human
aaagaucuagaauuaaauucu

SEQ ID NO: 1209632 - RNA, 21 nt, Human
aacaacagaaauuuaucucuc

SEQ ID NO: 1209633 - RNA, 19 nt, Human
aagaacuacucagacugug

SEQ ID NO: 1209634 - RNA, 20 nt, Human
aagugcccaccuccuaauuc

SEQ ID NO: 1209635 - RNA, 23 nt, Human
accagcuggggcucugcaggggu

SEQ ID NO: 1209636 - RNA, 20 nt, Human
acuacuuucccuucucucca

SEQ ID NO: 1209637 - RNA, 20 nt, Human
acucagacugugguaucugg

SEQ ID NO: 1209638 - RNA, 19 nt, Human
acugaagucaaaaacagca

SEQ ID NO: 1209639 - RNA, 19 nt, Human
acugagcugccuggugcuc

SEQ ID NO: 1209640 - RNA, 20 nt, Human
acugagcugccuggugcucu

SEQ ID NO: 1209641 - RNA, 18 nt, Human
acuucuggccauggugcu

SEQ ID NO: 1209642 - RNA, 18 nt, Human
acuuucccuucucuccac

SEQ ID NO: 1209643 - RNA, 22 nt, Human
agagauuucuuuuuccugggga

SEQ ID NO: 1209644 - RNA, 19 nt, Human
agagcccuucuaaggacac

SEQ ID NO: 1209645 - RNA, 25 nt, Human
agcaaucuggggugaguuagggccc

SEQ ID NO: 1209646 - RNA, 22 nt, Human
agcacuaggacuaggacagcac

SEQ ID NO: 1209647 - RNA, 21 nt, Human
agguaaucacagagcuggagc

SEQ ID NO: 1209648 - RNA, 19 nt, Human
augagggcucuggccuaug

SEQ ID NO: 1209649 - RNA, 18 nt, Human
auggagcagcugcaagcc

SEQ ID NO: 1209650 - RNA, 20 nt, Human
caacucacaucaggcuagaa

SEQ ID NO: 1209651 - RNA, 21 nt, Human
caacuuaugaauuugagggag

SEQ ID NO: 1209652 - RNA, 19 nt, Human
caagacccacagggaccuc

SEQ ID NO: 1209653 - RNA, 22 nt, Human
caaucuggggugaguuagggcc

SEQ ID NO: 1209654 - RNA, 20 nt, Human
caccuuuuccuucagaggcc

SEQ ID NO: 1209655 - RNA, 23 nt, Human
caccuuuuccuucagaggccugc

SEQ ID NO: 1209656 - RNA, 18 nt, Human
cacgcugggagcuguaga

SEQ ID NO: 1209657 - RNA, 20 nt, Human
cagaaggcucagaaguccau

SEQ ID NO: 1209658 - RNA, 19 nt, Human
cagagcuggagcaccucuc

SEQ ID NO: 1209659 - RNA, 18 nt, Human
cagcuggggcucugcagg

SEQ ID NO: 1209660 - RNA, 19 nt, Human
caggggaggauggagcagc

SEQ ID NO: 1209661 - RNA, 19 nt, Human
cagguucuuugucaguaag

SEQ ID NO: 1209662 - RNA, 20 nt, Human
cauaugauggaaaaggugag

SEQ ID NO: 1209663 - RNA, 20 nt, Human
cauuccagcuccccuucagg

SEQ ID NO: 1209664 - RNA, 22 nt, Human
cauuccagcuccccuucaggga

SEQ ID NO: 1209665 - RNA, 22 nt, Human
ccaugccaacaaggugacccag

SEQ ID NO: 1209666 - RNA, 21 nt, Human
cccacagcaaucugaaguacu

SEQ ID NO: 1209667 - RNA, 28 nt, Human
ccccauacauaagccucacagcucuucc

SEQ ID NO: 1209668 - RNA, 21 nt, Human
ccuggggaucuccaacucugc

SEQ ID NO: 1209669 - RNA, 18 nt, Human
cuaaugccaguaacuaua

SEQ ID NO: 1209670 - RNA, 20 nt, Human
cucacagagacaacuggcac

SEQ ID NO: 1209671 - RNA, 19 nt, Human
cugcugauuagcugggugg

SEQ ID NO: 1209672 - RNA, 18 nt, Human
cugucuugccauuuuuaa

SEQ ID NO: 1209673 - RNA, 23 nt, Human
cuuagaauggaggguggcagcuc

SEQ ID NO: 1209674 - RNA, 18 nt, Human
cuucauaucugaugcuga

SEQ ID NO: 1209675 - RNA, 22 nt, Human
gaaaaugugcaccuuuuccuuc

SEQ ID NO: 1209676 - RNA, 18 nt, Human
gaacacagaaugcaaguu

SEQ ID NO: 1209677 - RNA, 19 nt, Human
gacaccaaugggaucauuc

SEQ ID NO: 1209678 - RNA, 18 nt, Human
gaccauagcacuuaccua

SEQ ID NO: 1209679 - RNA, 23 nt, Human
gagcagcugcaagccuggcuggc

SEQ ID NO: 1209680 - RNA, 21 nt, Human
gcacaacuucuggccauggug

SEQ ID NO: 1209681 - RNA, 24 nt, Human
gcucauggucuugugggcagccug

SEQ ID NO: 1209682 - RNA, 19 nt, Human
gcugcauuggguugugacu

SEQ ID NO: 1209683 - RNA, 22 nt, Human
gcuuauaaguccacaugcugcu

SEQ ID NO: 1209684 - RNA, 23 nt, Human
ggaaagcuucucaaucccuuugg

SEQ ID NO: 1209685 - RNA, 18 nt, Human
ggaaugggaaagcuucuc

SEQ ID NO: 1209686 - RNA, 19 nt, Human
ggagcuaaaaagcaggccg

SEQ ID NO: 1209687 - RNA, 20 nt, Human
ggcccaggagcuaaaaagca

SEQ ID NO: 1209688 - RNA, 26 nt, Human
guccauucuuuucuucuucuuuguua

SEQ ID NO: 1209689 - RNA, 18 nt, Human
gugucugguaagggccaa

SEQ ID NO: 1209690 - RNA, 22 nt, Human
uaaagcaacuauccuggugaug

SEQ ID NO: 1209691 - RNA, 23 nt, Human
uaaagugcccaccuccuaauucc

SEQ ID NO: 1209692 - RNA, 23 nt, Human
uaacuacuuucccuucucuccac

SEQ ID NO: 1209693 - RNA, 26 nt, Human
uaaggacaccaaugggauuggagacc

SEQ ID NO: 1209694 - RNA, 18 nt, Human
uagaagggcacugaucuc

SEQ ID NO: 1209695 - RNA, 20 nt, Human
uagaauggaggguggcagcu

SEQ ID NO: 1209696 - RNA, 22 nt, Human
uagcaaguuuaucugcaagacc

SEQ ID NO: 1209697 - RNA, 23 nt, Human
uaggacuaggacagcacuggcug

SEQ ID NO: 1209698 - RNA, 18 nt, Human
ucagauggaaaugcagaa

SEQ ID NO: 1209699 - RNA, 22 nt, Human
ucagggaguugcuuaaauucuc

SEQ ID NO: 1209700 - RNA, 18 nt, Human
uccaaggaaugggaaagc

SEQ ID NO: 1209701 - RNA, 21 nt, Human
uccaaggaaugggaaagcuuc

SEQ ID NO: 1209702 - RNA, 28 nt, Human
uccauggucaggacaucagccggggucc

SEQ ID NO: 1209703 - RNA, 18 nt, Human
uccauucuuuucuucuuc

SEQ ID NO: 1209704 - RNA, 21 nt, Human
uccuggggaucuccaacucug

SEQ ID NO: 1209705 - RNA, 20 nt, Human
ucucacaguucagaaggcuu

SEQ ID NO: 1209706 - RNA, 23 nt, Human
ucucuaagaaccagcuggggcuc

SEQ ID NO: 1209707 - RNA, 20 nt, Human
ucugcaggggugugacaagu

SEQ ID NO: 1209708 - RNA, 18 nt, Human
ucuggcugcugccuccug

SEQ ID NO: 1209709 - RNA, 19 nt, Human
ucuugugggcagccugggc

SEQ ID NO: 1209710 - RNA, 25 nt, Human
ugaguccccauacauaagccucaca

SEQ ID NO: 1209711 - RNA, 30 nt, Human
ugaguccccauacauaagccucacagcucu

SEQ ID NO: 1209712 - RNA, 18 nt, Human
ugaguuagggcccaggag

SEQ ID NO: 1209713 - RNA, 19 nt, Human
ugaguuagggcccaggagc

SEQ ID NO: 1209714 - RNA, 20 nt, Human
ugaguuagggcccaggagcu

SEQ ID NO: 1209715 - RNA, 18 nt, Human
ugauaguccaaaguguug

SEQ ID NO: 1209716 - RNA, 24 nt, Human
ugcauagaauuuucaaguguuaga

SEQ ID NO: 1209717 - RNA, 24 nt, Human
ugccaacaaggugacccaguagau

SEQ ID NO: 1209718 - RNA, 19 nt, Human
ugcccaacugaaccauuug

SEQ ID NO: 1209719 - RNA, 23 nt, Human
uggaggguggcagcuccaaggaa

SEQ ID NO: 1209720 - RNA, 21 nt, Human
uggcagcaaucuggggugagu

SEQ ID NO: 1209721 - RNA, 21 nt, Human
uggcagcuccaaggaaugggg

SEQ ID NO: 1209722 - RNA, 20 nt, Human
uggccccuggugagucccuc

SEQ ID NO: 1209723 - RNA, 19 nt, Human
ugggaaaacaaaagagcug

SEQ ID NO: 1209724 - RNA, 23 nt, Human
ugggaagccagauuagguaauca

SEQ ID NO: 1209725 - RNA, 20 nt, Human
ugggaucauucagcacuagg

SEQ ID NO: 1209726 - RNA, 20 nt, Human
ugggccuugcagcaucuggg

SEQ ID NO: 1209727 - RNA, 18 nt, Human
uggggcucugcaggggug

SEQ ID NO: 1209728 - RNA, 19 nt, Human
uggguggccuucagggagu

SEQ ID NO: 1209729 - RNA, 18 nt, Human
uggucaggacaucagcag

SEQ ID NO: 1209730 - RNA, 20 nt, Human
uggucuugugggcagccugg

SEQ ID NO: 1209731 - RNA, 21 nt, Human
uguaaagacaacucacaucag

SEQ ID NO: 1209732 - RNA, 21 nt, Human
ugugauggaaucaccagauaa

SEQ ID NO: 1209733 - RNA, 18 nt, Human
ugugggcagccugggcug

SEQ ID NO: 1209734 - RNA, 19 nt, Human
uuaacuacuuucccuucuc

SEQ ID NO: 1209735 - RNA, 19 nt, Human
uucaucuuggaagugaagu

SEQ ID NO: 1209736 - RNA, 19 nt, Human
uucaugauaacgagcuucu

SEQ ID NO: 1209737 - RNA, 23 nt, Human
uuccuggggaucuccaacucugc

SEQ ID NO: 1209738 - RNA, 22 nt, Human
uugcacugucaucuuccugaca

SEQ ID NO: 1209739 - RNA, 20 nt, Human
aaaauagagccaguugcgga

SEQ ID NO: 1209740 - RNA, 22 nt, Human
aacaguucucuggguguucuuc

SEQ ID NO: 1209741 - RNA, 22 nt, Human
aagcagcaggaguggcacaaaa

SEQ ID NO: 1209742 - RNA, 23 nt, Human
acaacacagcagcaguggcacaa

SEQ ID NO: 1209743 - RNA, 26 nt, Human
acaccccuccuccugcccuuucacca

SEQ ID NO: 1209744 - RNA, 20 nt, Human
acagcagcaguggcacaagc

SEQ ID NO: 1209745 - RNA, 19 nt, Human
accugccuggcccuucccc

SEQ ID NO: 1209746 - RNA, 20 nt, Human
accuggaggagcaggugagg

SEQ ID NO: 1209747 - RNA, 25 nt, Human
acuugugagguuuagagagcuccaa

SEQ ID NO: 1209748 - RNA, 18 nt, Human
agacacaacacagcagca

SEQ ID NO: 1209749 - RNA, 20 nt, Human
agagaaggacauguggugcu

SEQ ID NO: 1209750 - RNA, 24 nt, Human
agcagcggcagcauccuggaggga

SEQ ID NO: 1209751 - RNA, 21 nt, Human
agccuguuaaucuuggguguu

SEQ ID NO: 1209752 - RNA, 26 nt, Human
aggaaucuugggcggcauccguggga

SEQ ID NO: 1209753 - RNA, 22 nt, Human
aggacauguggugcuggugaug

SEQ ID NO: 1209754 - RNA, 23 nt, Human
aggcggaggcgguggugguggug

SEQ ID NO: 1209755 - RNA, 19 nt, Human
aggcgggaguggagguggu

SEQ ID NO: 1209756 - RNA, 21 nt, Human
aggcgguggugguggugaugg

SEQ ID NO: 1209757 - RNA, 18 nt, Human
aggugguggaggcggagg

SEQ ID NO: 1209758 - RNA, 23 nt, Human
aggugguggaggcggaggcggug

SEQ ID NO: 1209759 - RNA, 24 nt, Human
agguguuuacaggagcugggggcg

SEQ ID NO: 1209760 - RNA, 21 nt, Human
auccauggcaccugguggcag

SEQ ID NO: 1209761 - RNA, 24 nt, Human
auggcccuccaccagguaccuccc

SEQ ID NO: 1209762 - RNA, 22 nt, Human
auugcccucuauccuucucauc

SEQ ID NO: 1209763 - RNA, 27 nt, Human
caagaaaagacucaauguauaugucca

SEQ ID NO: 1209764 - RNA, 20 nt, Human
caaguccuggcucagaacca

SEQ ID NO: 1209765 - RNA, 24 nt, Human
cacaacacagcagcaguggcacaa

SEQ ID NO: 1209766 - RNA, 22 nt, Human
cacaccccuccuccugcccuuu

SEQ ID NO: 1209767 - RNA, 27 nt, Human
cacaccccuccuccugcccuuucacca

SEQ ID NO: 1209768 - RNA, 23 nt, Human
cacaggccccuucuuugccgccu

SEQ ID NO: 1209769 - RNA, 19 nt, Human
caccagugcacacuauggc

SEQ ID NO: 1209770 - RNA, 21 nt, Human
caccccuccuccugcccuuuc

SEQ ID NO: 1209771 - RNA, 23 nt, Human
caccccuccuccugcccuuucac

SEQ ID NO: 1209772 - RNA, 21 nt, Human
caccucacucuugggugccug

SEQ ID NO: 1209773 - RNA, 22 nt, Human
caccugguggcagcuugcguga

SEQ ID NO: 1209774 - RNA, 18 nt, Human
cagacacaacacagcagc

SEQ ID NO: 1209775 - RNA, 21 nt, Human
cagagcucuacuuaagagaag

SEQ ID NO: 1209776 - RNA, 20 nt, Human
cagauugcccucuauccuuc

SEQ ID NO: 1209777 - RNA, 23 nt, Human
cagauugcccucuauccuucuca

SEQ ID NO: 1209778 - RNA, 27 nt, Human
cagcagcaguggcacaagcagcaggag

SEQ ID NO: 1209779 - RNA, 22 nt, Human
cagcagcggcagcauccuggag

SEQ ID NO: 1209780 - RNA, 19 nt, Human
cagcggcagcauccuggag

SEQ ID NO: 1209781 - RNA, 18 nt, Human
caggugguggcuccuuga

SEQ ID NO: 1209782 - RNA, 25 nt, Human
caucccgcccacuccuuggcaucca

SEQ ID NO: 1209783 - RNA, 18 nt, Human
cauccuugggcugcaggg

SEQ ID NO: 1209784 - RNA, 21 nt, Human
ccacaccccuccuccugcccu

SEQ ID NO: 1209785 - RNA, 25 nt, Human
ccacaccccuccuccugcccuuuca

SEQ ID NO: 1209786 - RNA, 18 nt, Human
ccagacacaacacagcag

SEQ ID NO: 1209787 - RNA, 20 nt, Human
ccauggcaccugguggcagc

SEQ ID NO: 1209788 - RNA, 18 nt, Human
cccagagaggcugagcac

SEQ ID NO: 1209789 - RNA, 21 nt, Human
ccccuucuuugccgccucccc

SEQ ID NO: 1209790 - RNA, 23 nt, Human
cccggggccacaccccuccuccu

SEQ ID NO: 1209791 - RNA, 23 nt, Human
ccuccugcccuuucaccagugca

SEQ ID NO: 1209792 - RNA, 23 nt, Human
ccugccuggcccuucccccaccc

SEQ ID NO: 1209793 - RNA, 21 nt, Human
ccuggcccuucccccacccug

SEQ ID NO: 1209794 - RNA, 23 nt, Human
ccugugccagggcccagagaggc

SEQ ID NO: 1209795 - RNA, 25 nt, Human
ccuuaugcccggggccacaccccuc

SEQ ID NO: 1209796 - RNA, 24 nt, Human
ccuuucaccagugcacacuauggg

SEQ ID NO: 1209797 - RNA, 20 nt, Human
cgcccacuccuuggcaucca

SEQ ID NO: 1209798 - RNA, 22 nt, Human
cggcagcauccuggagggaggc

SEQ ID NO: 1209799 - RNA, 18 nt, Human
cgugugccugagcagugg

SEQ ID NO: 1209800 - RNA, 20 nt, Human
cucauguccagagcucuacu

SEQ ID NO: 1209801 - RNA, 20 nt, Human
cucccggcuggguugaaggc

SEQ ID NO: 1209802 - RNA, 18 nt, Human
cuccugcccuuucaccag

SEQ ID NO: 1209803 - RNA, 26 nt, Human
cuccuuggcauccacagcaacaaaua

SEQ ID NO: 1209804 - RNA, 20 nt, Human
cucuggcuccuuuucuggcu

SEQ ID NO: 1209805 - RNA, 19 nt, Human
cuucuuugccgccuccccu

SEQ ID NO: 1209806 - RNA, 18 nt, Human
gagcacaggccccuucuu

SEQ ID NO: 1209807 - RNA, 24 nt, Human
gaggcgguggugguggugauggug

SEQ ID NO: 1209808 - RNA, 18 nt, Human
gauccuugggcagcaggg

SEQ ID NO: 1209809 - RNA, 21 nt, Human
gauugcccucuauccuucuca

SEQ ID NO: 1209810 - RNA, 18 nt, Human
gcaauaaaggaaucuugg

SEQ ID NO: 1209811 - RNA, 19 nt, Human
gcggaggcggugguggugg

SEQ ID NO: 1209812 - RNA, 26 nt, Human
gcucuggcuccuuuucuggcuucuga

SEQ ID NO: 1209813 - RNA, 22 nt, Human
gcuugggaaaaguacuccgggc

SEQ ID NO: 1209814 - RNA, 21 nt, Human
ggaaaaugcccugugcaaagg

SEQ ID NO: 1209815 - RNA, 19 nt, Human
ggaaucuugggcggcaucc

SEQ ID NO: 1209816 - RNA, 23 nt, Human
ggaggcggaggcggugguggugg

SEQ ID NO: 1209817 - RNA, 18 nt, Human
ggcugcagggagccugug

SEQ ID NO: 1209818 - RNA, 20 nt, Human
ggggggaggcggcaccugga

SEQ ID NO: 1209819 - RNA, 19 nt, Human
gguggaggcggaggcggug

SEQ ID NO: 1209820 - RNA, 22 nt, Human
guggaaagcagauccuugggca

SEQ ID NO: 1209821 - RNA, 22 nt, Human
guggggcagguguuuacaggag

SEQ ID NO: 1209822 - RNA, 21 nt, Human
uccacagcaacaaauaaucac

SEQ ID NO: 1209823 - RNA, 20 nt, Human
uccauggcaccugguggcag

SEQ ID NO: 1209824 - RNA, 22 nt, Human
uccauggcaccugguggcagcu

SEQ ID NO: 1209825 - RNA, 26 nt, Human
ucccgcccacuccuuggcauccacag

SEQ ID NO: 1209826 - RNA, 22 nt, Human
ucccugggggcacuugugaggu

SEQ ID NO: 1209827 - RNA, 20 nt, Human
ucccugugaccccaccucac

SEQ ID NO: 1209828 - RNA, 22 nt, Human
ucccugugaccccaccucacuc

SEQ ID NO: 1209829 - RNA, 24 nt, Human
uccuugggcugcagggagccugug

SEQ ID NO: 1209830 - RNA, 22 nt, Human
ucugcacaggugguggcuccuu

SEQ ID NO: 1209831 - RNA, 22 nt, Human
ucuggcuccuuuucuggcuucu

SEQ ID NO: 1209832 - RNA, 23 nt, Human
ucuggcuccuuuucuggcuucug

SEQ ID NO: 1209833 - RNA, 22 nt, Human
ugagguuuagagagcuccaagu

SEQ ID NO: 1209834 - RNA, 20 nt, Human
ugcccucuauccuucucauc

SEQ ID NO: 1209835 - RNA, 22 nt, Human
ugcccucuauccuucucauccc

SEQ ID NO: 1209836 - RNA, 19 nt, Human
ugcccugugcaaagggaau

SEQ ID NO: 1209837 - RNA, 20 nt, Human
ugccugagcaguggggacaa

SEQ ID NO: 1209838 - RNA, 20 nt, Human
ugcggcacagccgccagaca

SEQ ID NO: 1209839 - RNA, 23 nt, Human
ugcucuggcuccuuuucuggcuu

SEQ ID NO: 1209840 - RNA, 23 nt, Human
uggaggagcaggugagggggagg

SEQ ID NO: 1209841 - RNA, 18 nt, Human
uggcauccacagcaacaa

SEQ ID NO: 1209842 - RNA, 20 nt, Human
uggcccagggcaauucaugg

SEQ ID NO: 1209843 - RNA, 19 nt, Human
uggcuccuugacacugcuu

SEQ ID NO: 1209844 - RNA, 18 nt, Human
uggggacagcagcggcag

SEQ ID NO: 1209845 - RNA, 24 nt, Human
uggguguuuggugccuuagaaguu

SEQ ID NO: 1209846 - RNA, 22 nt, Human
ugugucucaggcagauguuugg

SEQ ID NO: 1209847 - RNA, 22 nt, Human
uuccucauguccagagcucuac

SEQ ID NO: 1209848 - RNA, 24 nt, Human
uucucuggguguucuucgcaauaa

SEQ ID NO: 1209849 - RNA, 19 nt, Human
uucugcacaggugguggcu

SEQ ID NO: 1209850 - RNA, 23 nt, Human
uugggugccugugccagggccca

SEQ ID NO: 1209851 - RNA, 23 nt, Human
uuggguugcacagagucugugcu

SEQ ID NO: 1209852 - RNA, 19 nt, Human
uuuccugcucuggcuccuu

SEQ ID NO: 1209853 - RNA, 19 nt, Human
uuuggugccuuagaaguug

SEQ ID NO: 1209854 - RNA, 21 nt, Human
uuuugccuuuguucaagcuga

SEQ ID NO: 1209855 - RNA, 24 nt, Human
acuaacacauccaccucggcaaaa

SEQ ID NO: 1209856 - RNA, 26 nt, Human
caccaaggagacugcagucaaauaaa

SEQ ID NO: 1209857 - RNA, 18 nt, Human
caccaccugugccucugc

SEQ ID NO: 1209858 - RNA, 18 nt, Human
caccaccugugccucugc

SEQ ID NO: 1209859 - RNA, 22 nt, Human
cgaaaaguacugaaaaugcuau

SEQ ID NO: 1209860 - RNA, 26 nt, Human
cgccucuacugucugccaccaccugu

SEQ ID NO: 1209861 - RNA, 19 nt, Human
cuacugucugccaccaccu

SEQ ID NO: 1209862 - RNA, 24 nt, Human
cuagcugaauuugugauuuccuuu

SEQ ID NO: 1209863 - RNA, 24 nt, Human
cucacagcuuuggccacgcacucc

SEQ ID NO: 1209864 - RNA, 20 nt, Human
gacuugggcaauguggccag

SEQ ID NO: 1209865 - RNA, 21 nt, Human
gggcaauguggccaggagggc

SEQ ID NO: 1209866 - RNA, 20 nt, Human
ggucagaaaaaucaacauuu

SEQ ID NO: 1209867 - RNA, 27 nt, Human
uaaauacauaauacagaagccugugug

SEQ ID NO: 1209868 - RNA, 19 nt, Human
uaugucuuauggucagaaa

SEQ ID NO: 1209869 - RNA, 19 nt, Human
uauuuuucccauuuuguuu

SEQ ID NO: 1209870 - RNA, 18 nt, Human
uccuaggccgaggcuaug

SEQ ID NO: 1209871 - RNA, 22 nt, Human
ugaaaaugcuauuacuagcuga

SEQ ID NO: 1209872 - RNA, 22 nt, Human
ugaguuauccuuauuuuuccca

SEQ ID NO: 1209873 - RNA, 24 nt, Human
ugaguuauccuuauuuuucccauu

SEQ ID NO: 1209874 - RNA, 19 nt, Human
ugccaccaccugugccucu

SEQ ID NO: 1209875 - RNA, 18 nt, Human
uguccuaggccgaggcua

SEQ ID NO: 1209876 - RNA, 24 nt, Human
uuauggucagaaaaaucaacauuu

SEQ ID NO: 1209877 - RNA, 21 nt, Human
aaaauacaucauucccaugaa

SEQ ID NO: 1209878 - RNA, 23 nt, Human
aacaaaaagcccaaucauacagu

SEQ ID NO: 1209879 - RNA, 24 nt, Human
acagcaacagaggcaagucugugc

SEQ ID NO: 1209880 - RNA, 25 nt, Human
acagcaacagaggcaagucugugcc

SEQ ID NO: 1209881 - RNA, 20 nt, Human
acaggacaauaaauucauuu

SEQ ID NO: 1209882 - RNA, 26 nt, Human
caaaauacaucauucccaugaauuuc

SEQ ID NO: 1209883 - RNA, 19 nt, Human
cacaaaauacaucauuccc

SEQ ID NO: 1209884 - RNA, 18 nt, Human
caguguaucuacaaaguu

SEQ ID NO: 1209885 - RNA, 21 nt, Human
cccaaucauacaguguaucua

SEQ ID NO: 1209886 - RNA, 20 nt, Human
cuacacacaugguucugcuc

SEQ ID NO: 1209887 - RNA, 24 nt, Human
cuguacucuugcugcaaacagcaa

SEQ ID NO: 1209888 - RNA, 21 nt, Human
gaaauuacaaucugaacaaaa

SEQ ID NO: 1209889 - RNA, 21 nt, Human
gcaaacagcaacagaggcaag

SEQ ID NO: 1209890 - RNA, 19 nt, Human
uaaaaaacuguacucuugc

SEQ ID NO: 1209891 - RNA, 24 nt, Human
uaaaaaacuguacucuugcugcaa

SEQ ID NO: 1209892 - RNA, 25 nt, Human
uaaaaaacuguacucuugcugcaaa

SEQ ID NO: 1209893 - RNA, 22 nt, Human
uagcauaaauauuucaucuauu

SEQ ID NO: 1209894 - RNA, 25 nt, Human
uauuuugcuuuugaaauaagaaaau

SEQ ID NO: 1209895 - RNA, 23 nt, Human
uccaaaguagagcuuacaguagu

SEQ ID NO: 1209896 - RNA, 23 nt, Human
uccacaaaauacaucauucccau

SEQ ID NO: 1209897 - RNA, 20 nt, Human
ugcugcaaacagcaacagag

SEQ ID NO: 1209898 - RNA, 27 nt, Human
uuaucccacuauaauuuuguucuugau

SEQ ID NO: 1209899 - RNA, 21 nt, Human
uucuuuggucaaagaugaaua

SEQ ID NO: 1209900 - RNA, 24 nt, Human
uuugaaauaaacaguauagacaca

SEQ ID NO: 1209901 - RNA, 22 nt, Human
aaaaaaaaaaaaaaaggcacaa

SEQ ID NO: 1209902 - RNA, 28 nt, Human
aaaaaaaaaaaaaaaggcacaaugagag

SEQ ID NO: 1209903 - RNA, 24 nt, Human
aaaaaaaaggcacaaugagagcuu

SEQ ID NO: 1209904 - RNA, 18 nt, Human
aaaaaaagaaaaaaggug

SEQ ID NO: 1209905 - RNA, 22 nt, Human
aaaaugcccuggucuacaagag

SEQ ID NO: 1209906 - RNA, 27 nt, Human
aaagagaaaaauauaccuuuucaaaag

SEQ ID NO: 1209907 - RNA, 18 nt, Human
aaagugccgggauuacaa

SEQ ID NO: 1209908 - RNA, 24 nt, Human
aaagugccgggauuacaagcauga

SEQ ID NO: 1209909 - RNA, 24 nt, Human
aaagugcugagauuacagguguga

SEQ ID NO: 1209910 - RNA, 22 nt, Human
aacacaaaaauacucaaagaca

SEQ ID NO: 1209911 - RNA, 20 nt, Human
aacuacuacauucacccaga

SEQ ID NO: 1209912 - RNA, 18 nt, Human
aacuacugggugaaaacc

SEQ ID NO: 1209913 - RNA, 20 nt, Human
aacuacugggugaaaaccug

SEQ ID NO: 1209914 - RNA, 24 nt, Human
aagcgauccaccugccuuagccuc

SEQ ID NO: 1209915 - RNA, 22 nt, Human
aagggacaaaagaacacauaca

SEQ ID NO: 1209916 - RNA, 25 nt, Human
aaggggguggggaggugaaaugagg

SEQ ID NO: 1209917 - RNA, 26 nt, Human
aagugccgggauuacaagcaugagcc

SEQ ID NO: 1209918 - RNA, 26 nt, Human
aagugcugagauuacaggugugagcc

SEQ ID NO: 1209919 - RNA, 23 nt, Human
accauacgggccaggcuggucuc

SEQ ID NO: 1209920 - RNA, 19 nt, Human
accuaaggacaacaugacu

SEQ ID NO: 1209921 - RNA, 21 nt, Human
acgcuggucucaaacuccugg

SEQ ID NO: 1209922 - RNA, 23 nt, Human
agacauaaauauaaauaccaaaa

SEQ ID NO: 1209923 - RNA, 22 nt, Human
agauuacaggugugagccacug

SEQ ID NO: 1209924 - RNA, 18 nt, Human
aggaaaggugauaucugu

SEQ ID NO: 1209925 - RNA, 18 nt, Human
aggaaaggugauaucugu

SEQ ID NO: 1209926 - RNA, 20 nt, Human
aggcaagaaugauaaaacua

SEQ ID NO: 1209927 - RNA, 19 nt, Human
aggcacaaugagagcuugg

SEQ ID NO: 1209928 - RNA, 21 nt, Human
agggagggaaaaagacguaag

SEQ ID NO: 1209929 - RNA, 19 nt, Human
aggggguggggaggugaaa

SEQ ID NO: 1209930 - RNA, 21 nt, Human
aggggguggggaggugaaaug

SEQ ID NO: 1209931 - RNA, 18 nt, Human
aguuacuaaccaagaaga

SEQ ID NO: 1209932 - RNA, 22 nt, Human
aguugagaaaaugugaguauaa

SEQ ID NO: 1209933 - RNA, 18 nt, Human
auaaucggaaaaaaagaa

SEQ ID NO: 1209934 - RNA, 23 nt, Human
auauccaaugcuccuauggcaau

SEQ ID NO: 1209935 - RNA, 22 nt, Human
aucuaaacaugaagaaacaacu

SEQ ID NO: 1209936 - RNA, 18 nt, Human
aucugguagacuuccccu

SEQ ID NO: 1209937 - RNA, 24 nt, Human
augaagcaggacauacacacaucu

SEQ ID NO: 1209938 - RNA, 19 nt, Human
auuacaagcaugagccaug

SEQ ID NO: 1209939 - RNA, 21 nt, Human
caaaaaaaaaaaaaaaaggca

SEQ ID NO: 1209940 - RNA, 24 nt, Human
caaaaaaaaaaaaaaaaggcacaa

SEQ ID NO: 1209941 - RNA, 25 nt, Human
caaacuccuggguucaagugauccc

SEQ ID NO: 1209942 - RNA, 24 nt, Human
caaagugccgggauuacaagcaug

SEQ ID NO: 1209943 - RNA, 24 nt, Human
caaagugcugagauuacaggugug

SEQ ID NO: 1209944 - RNA, 28 nt, Human
caagugauccccuugccucagacuccca

SEQ ID NO: 1209945 - RNA, 18 nt, Human
caauaaacacaaaaauac

SEQ ID NO: 1209946 - RNA, 22 nt, Human
caaugauuuauuaauaaaaggc

SEQ ID NO: 1209947 - RNA, 28 nt, Human
cacaaaaauacucaaagacaaagacaca

SEQ ID NO: 1209948 - RNA, 23 nt, Human
caccugccuuagccucccaaagu

SEQ ID NO: 1209949 - RNA, 23 nt, Human
cacucuuccaugaaaaaaacaaa

SEQ ID NO: 1209950 - RNA, 21 nt, Human
cagaucugaggcaaaaaaaaa

SEQ ID NO: 1209951 - RNA, 22 nt, Human
cagccaguuaauaaauguuuaa

SEQ ID NO: 1209952 - RNA, 18 nt, Human
caggacauacacacaucu

SEQ ID NO: 1209953 - RNA, 18 nt, Human
caguagagaugggguuuu

SEQ ID NO: 1209954 - RNA, 19 nt, Human
caguagagaugggguuuua

SEQ ID NO: 1209955 - RNA, 23 nt, Human
caguagagaugggguuuuaccau

SEQ ID NO: 1209956 - RNA, 24 nt, Human
caguagagaugggguuuuaccaua

SEQ ID NO: 1209957 - RNA, 19 nt, Human
ccaaagugccgggauuaca

SEQ ID NO: 1209958 - RNA, 24 nt, Human
ccaaagugccgggauuacaagcau

SEQ ID NO: 1209959 - RNA, 21 nt, Human
ccaaagugcugagauuacagg

SEQ ID NO: 1209960 - RNA, 21 nt, Human
ccaaagugcugagauuacagg

SEQ ID NO: 1209961 - RNA, 24 nt, Human
ccaaagugcugagauuacaggugu

SEQ ID NO: 1209962 - RNA, 26 nt, Human
ccaccugccuuagccucccaaagugc

SEQ ID NO: 1209963 - RNA, 20 nt, Human
ccccuugccucagacuccca

SEQ ID NO: 1209964 - RNA, 23 nt, Human
ccugcacucuuccaugaaaaaaa

SEQ ID NO: 1209965 - RNA, 21 nt, Human
ccuggguucaagugauccccu

SEQ ID NO: 1209966 - RNA, 22 nt, Human
ccuggguucaagugauccccuu

SEQ ID NO: 1209967 - RNA, 22 nt, Human
ccuggguucaagugauccccuu

SEQ ID NO: 1209968 - RNA, 21 nt, Human
cgggauuacaagcaugagcca

SEQ ID NO: 1209969 - RNA, 22 nt, Human
cgggauuacaagcaugagccau

SEQ ID NO: 1209970 - RNA, 23 nt, Human
cuaaauaccauuaauacuaaaag

SEQ ID NO: 1209971 - RNA, 24 nt, Human
cuacuuuaaauuacuuucuuuuuc

SEQ ID NO: 1209972 - RNA, 21 nt, Human
cucccaaagugcugagauuac

SEQ ID NO: 1209973 - RNA, 19 nt, Human
cucccaacccauacaucuu

SEQ ID NO: 1209974 - RNA, 20 nt, Human
cucccaacccauacaucuua

SEQ ID NO: 1209975 - RNA, 23 nt, Human
cugccuuagccucccaaagugcu

SEQ ID NO: 1209976 - RNA, 19 nt, Human
cugcuuccagaucugaggc

SEQ ID NO: 1209977 - RNA, 20 nt, Human
cuguuuuuuuuuuuuuugga

SEQ ID NO: 1209978 - RNA, 21 nt, Human
gaaaaaaacaaagaacaggag

SEQ ID NO: 1209979 - RNA, 20 nt, Human
gaacuacuacauucacccag

SEQ ID NO: 1209980 - RNA, 18 nt, Human
gagaugggguuuuaccau

SEQ ID NO: 1209981 - RNA, 24 nt, Human
gagaugggguuuuaccauacgggc

SEQ ID NO: 1209982 - RNA, 24 nt, Human
gagcuuaagcgauccaccugccuu

SEQ ID NO: 1209983 - RNA, 18 nt, Human
gauuacaagcaugagcca

SEQ ID NO: 1209984 - RNA, 18 nt, Human
gauuacaggugugagcca

SEQ ID NO: 1209985 - RNA, 22 nt, Human
gauuacaggugugagccacugc

SEQ ID NO: 1209986 - RNA, 21 nt, Human
gccuuagccucccaaagugcu

SEQ ID NO: 1209987 - RNA, 24 nt, Human
gcgauccaccugccuuagccuccc

SEQ ID NO: 1209988 - RNA, 18 nt, Human
gcuggaagcugaggagcc

SEQ ID NO: 1209989 - RNA, 24 nt, Human
gcuuaagcgauccaccugccuuag

SEQ ID NO: 1209990 - RNA, 18 nt, Human
ggaaauaggaaaggugau

SEQ ID NO: 1209991 - RNA, 21 nt, Human
ggauuacaagcaugagccaug

SEQ ID NO: 1209992 - RNA, 23 nt, Human
gggauuacaagcaugagccauga

SEQ ID NO: 1209993 - RNA, 25 nt, Human
gggauuacaagcaugagccaugaca

SEQ ID NO: 1209994 - RNA, 24 nt, Human
gggccaggcuggucucaaacucuu

SEQ ID NO: 1209995 - RNA, 21 nt, Human
gggguggggaggugaaaugag

SEQ ID NO: 1209996 - RNA, 18 nt, Human
ggugaaugggaaauagga

SEQ ID NO: 1209997 - RNA, 20 nt, Human
guaaagccuaaugaaauuca

SEQ ID NO: 1209998 - RNA, 23 nt, Human
guacccuggagaauggcugcuuc

SEQ ID NO: 1209999 - RNA, 24 nt, Human
guacccuggagaauggcugcuucc

SEQ ID NO: 1210000 - RNA, 21 nt, Human
guagacuuccccuuaaccaaa

SEQ ID NO: 1210001 - RNA, 21 nt, Human
guagagaugggguuuuaccau

SEQ ID NO: 1210002 - RNA, 23 nt, Human
guggggaauaaaaagcucuucuu

SEQ ID NO: 1210003 - RNA, 21 nt, Human
guuuuuuggggggaagggggu

SEQ ID NO: 1210004 - RNA, 20 nt, Human
uaaaacaauaggaaaaaaac

SEQ ID NO: 1210005 - RNA, 18 nt, Human
uaaaagggacaaaagaac

SEQ ID NO: 1210006 - RNA, 21 nt, Human
uaaauaccauuaauacuaaaa

SEQ ID NO: 1210007 - RNA, 25 nt, Human
uaaauuugaaacaauuugugcauca

SEQ ID NO: 1210008 - RNA, 19 nt, Human
uaacuugaaucuaaacaug

SEQ ID NO: 1210009 - RNA, 23 nt, Human
uacaauaaacacaaaaauacuca

SEQ ID NO: 1210010 - RNA, 20 nt, Human
uacaggugugagccacugcu

SEQ ID NO: 1210011 - RNA, 24 nt, Human
uacaggugugagccacugcuccca

SEQ ID NO: 1210012 - RNA, 21 nt, Human
uaccauacgggccaggcuggu

SEQ ID NO: 1210013 - RNA, 23 nt, Human
uaccauacgggccaggcuggucu

SEQ ID NO: 1210014 - RNA, 20 nt, Human
uagagaugggguuuuaccau

SEQ ID NO: 1210015 - RNA, 25 nt, Human
uagauuaaaagggacaaaagaacac

SEQ ID NO: 1210016 - RNA, 20 nt, Human
uagauuauauuacugaaaaa

SEQ ID NO: 1210017 - RNA, 22 nt, Human
uagcauaaccuaaggacaacau

SEQ ID NO: 1210018 - RNA, 23 nt, Human
uaggaaaggugauaucuguuuuu

SEQ ID NO: 1210019 - RNA, 23 nt, Human
uauaauaacggauuaaggcaaga

SEQ ID NO: 1210020 - RNA, 24 nt, Human
uauauugcccacgcuggucucaaa

SEQ ID NO: 1210021 - RNA, 22 nt, Human
uaucuguuuuuuuuuuuuuugg

SEQ ID NO: 1210022 - RNA, 21 nt, Human
uaugguaauaauuaaaaguua

SEQ ID NO: 1210023 - RNA, 22 nt, Human
ucaacauguagcacaaugaagc

SEQ ID NO: 1210024 - RNA, 21 nt, Human
ucaacauuaccaauccuugau

SEQ ID NO: 1210025 - RNA, 19 nt, Human
ucagacucccaaagugccg

SEQ ID NO: 1210026 - RNA, 22 nt, Human
uccacaauaugcacuuagcccu

SEQ ID NO: 1210027 - RNA, 23 nt, Human
uccagaucugaggcaaaaaaaaa

SEQ ID NO: 1210028 - RNA, 24 nt, Human
uccaugaaaaaaacaaagaacagg

SEQ ID NO: 1210029 - RNA, 24 nt, Human
ucccaaagugccgggauuacaagc

SEQ ID NO: 1210030 - RNA, 23 nt, Human
ucccaaagugcugagauuacagg

SEQ ID NO: 1210031 - RNA, 25 nt, Human
uccuauggcaaucaauaaacuacuu

SEQ ID NO: 1210032 - RNA, 18 nt, Human
uccuggguucaagugauc

SEQ ID NO: 1210033 - RNA, 23 nt, Human
uccuggguucaagugauccccuu

SEQ ID NO: 1210034 - RNA, 23 nt, Human
ucucaaacuccuggguucaagug

SEQ ID NO: 1210035 - RNA, 23 nt, Human
ucucaaacucuugagcuuaagcg

SEQ ID NO: 1210036 - RNA, 23 nt, Human
ucugaggcaaaaaaaaaaaaaaa

SEQ ID NO: 1210037 - RNA, 19 nt, Human
ucuuuauauauaaaacagc

SEQ ID NO: 1210038 - RNA, 19 nt, Human
ugagauuacaggugugagc

SEQ ID NO: 1210039 - RNA, 21 nt, Human
ugagauuacaggugugagcca

SEQ ID NO: 1210040 - RNA, 22 nt, Human
ugagauuacaggugugagccac

SEQ ID NO: 1210041 - RNA, 22 nt, Human
ugagauuacaggugugagccac

SEQ ID NO: 1210042 - RNA, 24 nt, Human
ugagauuacaggugugagccacug

SEQ ID NO: 1210043 - RNA, 21 nt, Human
ugagccacugcucccaaccca

SEQ ID NO: 1210044 - RNA, 19 nt, Human
ugagcuuaagcgauccacc

SEQ ID NO: 1210045 - RNA, 23 nt, Human
ugagguaucacuuaugcuauacu

SEQ ID NO: 1210046 - RNA, 30 nt, Human
ugccgggauuacaagcaugagccaugacaa

SEQ ID NO: 1210047 - RNA, 24 nt, Human
ugccucagacucccaaagugccgg

SEQ ID NO: 1210048 - RNA, 24 nt, Human
ugccuuagccucccaaagugcuga

SEQ ID NO: 1210049 - RNA, 24 nt, Human
ugcugagauuacaggugugagcca

SEQ ID NO: 1210050 - RNA, 22 nt, Human
uggcugcuuccagaucugaggc

SEQ ID NO: 1210051 - RNA, 22 nt, Human
uggguucaagugauccccuugc

SEQ ID NO: 1210052 - RNA, 19 nt, Human
uggugguggggaauaaaaa

SEQ ID NO: 1210053 - RNA, 19 nt, Human
ugucauauaugcauuugag

SEQ ID NO: 1210054 - RNA, 19 nt, Human
uuaacuugaaucuaaacau

SEQ ID NO: 1210055 - RNA, 21 nt, Human
uucaagugauccccuugccuc

SEQ ID NO: 1210056 - RNA, 23 nt, Human
uucaagugauccccuugccucag

SEQ ID NO: 1210057 - RNA, 24 nt, Human
uuuaaauuacuuucuuuuucaacu

SEQ ID NO: 1210058 - RNA, 24 nt, Human
uuuauaagccuccugaugucaugc

SEQ ID NO: 1210059 - RNA, 18 nt, Human
uuucauuccuguucggcu

SEQ ID NO: 1210060 - RNA, 22 nt, Human
uuuuuuucuuuuguuuuuuggg

SEQ ID NO: 1210061 - RNA, 21 nt, Human
agacugggugccuucaaacaa

SEQ ID NO: 1210062 - RNA, 24 nt, Human
gcugccaugaugaaggaccacaga

SEQ ID NO: 1210063 - RNA, 22 nt, Human
gggugccuucaaacaagggaaa

SEQ ID NO: 1210064 - RNA, 24 nt, Human
aaaaaaaaaaaaaaaagagcagag

SEQ ID NO: 1210065 - RNA, 24 nt, Human
aaaaaaaaaaaaaagagcagagag

SEQ ID NO: 1210066 - RNA, 23 nt, Human
aaaaaaaaaaagagcagagaggg

SEQ ID NO: 1210067 - RNA, 21 nt, Human
aaaaacaaacagcagccacca

SEQ ID NO: 1210068 - RNA, 24 nt, Human
aaaaacaaacagcagccaccaaag

SEQ ID NO: 1210069 - RNA, 19 nt, Human
aaaaauaaccaagcuaggc

SEQ ID NO: 1210070 - RNA, 22 nt, Human
aaacaaacagcagccaccaaag

SEQ ID NO: 1210071 - RNA, 25 nt, Human
aaacagacaguuuugccucuucagc

SEQ ID NO: 1210072 - RNA, 20 nt, Human
aaacgacaggcccugggcca

SEQ ID NO: 1210073 - RNA, 20 nt, Human
aaagagcagagagggcugcc

SEQ ID NO: 1210074 - RNA, 18 nt, Human
aaaggaggaagagggaaa

SEQ ID NO: 1210075 - RNA, 24 nt, Human
aaaguacugggauuacaggcguga

SEQ ID NO: 1210076 - RNA, 20 nt, Human
aaaugccagcaguugcaucu

SEQ ID NO: 1210077 - RNA, 19 nt, Human
aacagcuuugaaagugaug

SEQ ID NO: 1210078 - RNA, 21 nt, Human
aacccaaugcaaccuaaacag

SEQ ID NO: 1210079 - RNA, 18 nt, Human
aagauggaugaaaucugg

SEQ ID NO: 1210080 - RNA, 23 nt, Human
aagcuaccacauggcccaagaug

SEQ ID NO: 1210081 - RNA, 24 nt, Human
aagguaguuuuuauucuggguggc

SEQ ID NO: 1210082 - RNA, 19 nt, Human
aaguacugggauuacaggc

SEQ ID NO: 1210083 - RNA, 26 nt, Human
aaguacugggauuacaggcgugagcc

SEQ ID NO: 1210084 - RNA, 24 nt, Human
aagugcugggauauauggcugagu

SEQ ID NO: 1210085 - RNA, 24 nt, Human
aaucccccuuucuggaacucccau

SEQ ID NO: 1210086 - RNA, 18 nt, Human
aaucgcuugaaccuggga

SEQ ID NO: 1210087 - RNA, 24 nt, Human
aaucgcuugaaccugggaggcgga

SEQ ID NO: 1210088 - RNA, 22 nt, Human
aaugacaagaaaugccagaaua

SEQ ID NO: 1210089 - RNA, 18 nt, Human
acaaaaacaaacagcagc

SEQ ID NO: 1210090 - RNA, 19 nt, Human
acaaaaacaaacagcagcc

SEQ ID NO: 1210091 - RNA, 21 nt, Human
acaaaaacaaacagcagccac

SEQ ID NO: 1210092 - RNA, 24 nt, Human
acaaaaacaaacagcagccaccaa

SEQ ID NO: 1210093 - RNA, 21 nt, Human
acaaacagcagccaccaaagc

SEQ ID NO: 1210094 - RNA, 23 nt, Human
acacagcauuuucugccacauau

SEQ ID NO: 1210095 - RNA, 21 nt, Human
acagagugagacucugucuca

SEQ ID NO: 1210096 - RNA, 24 nt, Human
acagagugagacucugucucaaaa

SEQ ID NO: 1210097 - RNA, 20 nt, Human
acauggugaaacccuggcuc

SEQ ID NO: 1210098 - RNA, 21 nt, Human
acauggugaaacccuggcucu

SEQ ID NO: 1210099 - RNA, 22 nt, Human
acauggugaaacccuggcucua

SEQ ID NO: 1210100 - RNA, 22 nt, Human
accauguuggccaggcuggucu

SEQ ID NO: 1210101 - RNA, 24 nt, Human
accugaggucaggaguuugagacu

SEQ ID NO: 1210102 - RNA, 22 nt, Human
acgcggcugcaucauuuugaac

SEQ ID NO: 1210103 - RNA, 18 nt, Human
acuacaggugcacgccac

SEQ ID NO: 1210104 - RNA, 22 nt, Human
acucaaaaccaggcaauccccc

SEQ ID NO: 1210105 - RNA, 24 nt, Human
acuccagccugggagacagaguga

SEQ ID NO: 1210106 - RNA, 24 nt, Human
agaaaugccagaauagaaccugga

SEQ ID NO: 1210107 - RNA, 22 nt, Human
agaaucgcuugaaccugggagg

SEQ ID NO: 1210108 - RNA, 23 nt, Human
agacaggaggaggaauguguggg

SEQ ID NO: 1210109 - RNA, 23 nt, Human
agacuccuaucugguuucuccuc

SEQ ID NO: 1210110 - RNA, 21 nt, Human
agacugggugccuucaaacaa

SEQ ID NO: 1210111 - RNA, 26 nt, Human
agcaaaauaaugacaagaaaugccag

SEQ ID NO: 1210112 - RNA, 24 nt, Human
agcacuuugggaggccgaggcagg

SEQ ID NO: 1210113 - RNA, 20 nt, Human
agccaccaaagcccaagaug

SEQ ID NO: 1210114 - RNA, 18 nt, Human
agccagguaugugguggg

SEQ ID NO: 1210115 - RNA, 21 nt, Human
agcccaucucccgcccuggcc

SEQ ID NO: 1210116 - RNA, 24 nt, Human
agccgcgucacuccgaucugugcc

SEQ ID NO: 1210117 - RNA, 25 nt, Human
agccuagaccaccuacccuggaaac

SEQ ID NO: 1210118 - RNA, 22 nt, Human
agccuggccgacauggugaaac

SEQ ID NO: 1210119 - RNA, 24 nt, Human
agccuggccgacauggugaaaccc

SEQ ID NO: 1210120 - RNA, 24 nt, Human
agccugggagacagagugagacuc

SEQ ID NO: 1210121 - RNA, 24 nt, Human
agcgauucucuugccucagccucc

SEQ ID NO: 1210122 - RNA, 18 nt, Human
agcucauaacagaggccc

SEQ ID NO: 1210123 - RNA, 22 nt, Human
agcugaugccagacccugcagc

SEQ ID NO: 1210124 - RNA, 19 nt, Human
aggaagagggaaaugaaga

SEQ ID NO: 1210125 - RNA, 19 nt, Human
aggaagccuucugcacuca

SEQ ID NO: 1210126 - RNA, 21 nt, Human
aggaggaagagggaaaugaag

SEQ ID NO: 1210127 - RNA, 24 nt, Human
aggcagccugggcccaccuggagc

SEQ ID NO: 1210128 - RNA, 22 nt, Human
aggcaggagaaucgcuugaacc

SEQ ID NO: 1210129 - RNA, 24 nt, Human
aggcaggagaaucgcuugaaccug

SEQ ID NO: 1210130 - RNA, 18 nt, Human
aggcagguggaucaccug

SEQ ID NO: 1210131 - RNA, 22 nt, Human
aggcagguggaucaccugaggu

SEQ ID NO: 1210132 - RNA, 26 nt, Human
aggcagguggaucaccugaggucagg

SEQ ID NO: 1210133 - RNA, 21 nt, Human
aggccgaggcagguggaucac

SEQ ID NO: 1210134 - RNA, 24 nt, Human
aggcggagguugcagugagccgag

SEQ ID NO: 1210135 - RNA, 23 nt, Human
aggcgugagccacugugccuggc

SEQ ID NO: 1210136 - RNA, 24 nt, Human
aggggguugcuggcaaucuuggcg

SEQ ID NO: 1210137 - RNA, 23 nt, Human
agguauguggugggggagcuggg

SEQ ID NO: 1210138 - RNA, 24 nt, Human
aggugauccgccugccuuaaccuc

SEQ ID NO: 1210139 - RNA, 20 nt, Human
agguugaggcaggagaaucg

SEQ ID NO: 1210140 - RNA, 24 nt, Human
agguugaggcaggagaaucgcuug

SEQ ID NO: 1210141 - RNA, 21 nt, Human
agucaagagagacacauucuc

SEQ ID NO: 1210142 - RNA, 24 nt, Human
agugcaauggcacgaucuuggcuc

SEQ ID NO: 1210143 - RNA, 22 nt, Human
auaaacaaaguuuggagguaaa

SEQ ID NO: 1210144 - RNA, 24 nt, Human
aucgugcuauugcacuccagccug

SEQ ID NO: 1210145 - RNA, 18 nt, Human
augagguuucaccauguu

SEQ ID NO: 1210146 - RNA, 24 nt, Human
augagguuucaccauguuggccag

SEQ ID NO: 1210147 - RNA, 19 nt, Human
auggaaaagacccagagcu

SEQ ID NO: 1210148 - RNA, 21 nt, Human
auuacaaauuccuaccugucc

SEQ ID NO: 1210149 - RNA, 18 nt, Human
auugcacuccagccuggg

SEQ ID NO: 1210150 - RNA, 21 nt, Human
auugcacuccagccugggaga

SEQ ID NO: 1210151 - RNA, 23 nt, Human
auugcacuccagccugggagaca

SEQ ID NO: 1210152 - RNA, 23 nt, Human
auugcacuccagccugggagaca

SEQ ID NO: 1210153 - RNA, 24 nt, Human
auugcacuccagccugggagacag

SEQ ID NO: 1210154 - RNA, 24 nt, Human
caaaaacaaacagcagccaccaaa

SEQ ID NO: 1210155 - RNA, 21 nt, Human
caaaaggaaugccagaaagca

SEQ ID NO: 1210156 - RNA, 19 nt, Human
caaaauuagcugggcgugg

SEQ ID NO: 1210157 - RNA, 18 nt, Human
caaacagcagccaccaaa

SEQ ID NO: 1210158 - RNA, 23 nt, Human
caaacagcagccaccaaagccca

SEQ ID NO: 1210159 - RNA, 24 nt, Human
caaaguacugggauuacaggcgug

SEQ ID NO: 1210160 - RNA, 23 nt, Human
caaccuccaccucccagguucaa

SEQ ID NO: 1210161 - RNA, 21 nt, Human
caagaaaugccagaauagaac

SEQ ID NO: 1210162 - RNA, 18 nt, Human
caagagagacacauucuc

SEQ ID NO: 1210163 - RNA, 20 nt, Human
caagcgauucucuugccuca

SEQ ID NO: 1210164 - RNA, 22 nt, Human
caagcgauucucuugccucagc

SEQ ID NO: 1210165 - RNA, 21 nt, Human
caccauguuggccaggcuggu

SEQ ID NO: 1210166 - RNA, 23 nt, Human
caccauguuggccaggcuggucu

SEQ ID NO: 1210167 - RNA, 24 nt, Human
caccauguuggccaggcuggucuu

SEQ ID NO: 1210168 - RNA, 27 nt, Human
caccauguuggccaggcuggucuugaa

SEQ ID NO: 1210169 - RNA, 22 nt, Human
cacccucuuccacugugaccuc

SEQ ID NO: 1210170 - RNA, 18 nt, Human
caccugacuaauuuuugu

SEQ ID NO: 1210171 - RNA, 18 nt, Human
caccugagccagccuggg

SEQ ID NO: 1210172 - RNA, 20 nt, Human
caccugagccagccuggggc

SEQ ID NO: 1210173 - RNA, 23 nt, Human
caccugaggucaggaguuugaga

SEQ ID NO: 1210174 - RNA, 23 nt, Human
caccuggagcccaucucccgccc

SEQ ID NO: 1210175 - RNA, 21 nt, Human
caccuguaauuccagcuacuc

SEQ ID NO: 1210176 - RNA, 24 nt, Human
caccuguaauuccagcuacucagg

SEQ ID NO: 1210177 - RNA, 22 nt, Human
cacuccagccugggagacagag

SEQ ID NO: 1210178 - RNA, 22 nt, Human
cacuccagccugggagacagag

SEQ ID NO: 1210179 - RNA, 24 nt, Human
cacuccagccugggagacagagug

SEQ ID NO: 1210180 - RNA, 21 nt, Human
cacugcaaccuccaccuccca

SEQ ID NO: 1210181 - RNA, 23 nt, Human
cagaauagaaccuggacuggaag

SEQ ID NO: 1210182 - RNA, 23 nt, Human
cagaauuuaucccagggcugccc

SEQ ID NO: 1210183 - RNA, 21 nt, Human
cagcaaaauaaugacaagaaa

SEQ ID NO: 1210184 - RNA, 24 nt, Human
cagcacuuugggaggccgaggcag

SEQ ID NO: 1210185 - RNA, 26 nt, Human
cagcacuuugggaggccgaggcaggu

SEQ ID NO: 1210186 - RNA, 18 nt, Human
cagcagccaccaaagccc

SEQ ID NO: 1210187 - RNA, 21 nt, Human
cagcauccugccaccugcaag

SEQ ID NO: 1210188 - RNA, 24 nt, Human
cagcuacucaggagguugaggcag

SEQ ID NO: 1210189 - RNA, 21 nt, Human
caggaagagcugggaaaggua

SEQ ID NO: 1210190 - RNA, 19 nt, Human
caggacacagugagggucc

SEQ ID NO: 1210191 - RNA, 22 nt, Human
cagggaagggccuguauccauu

SEQ ID NO: 1210192 - RNA, 18 nt, Human
cagggauguggccaaauu

SEQ ID NO: 1210193 - RNA, 23 nt, Human
caggggguugcuggcaaucuugg

SEQ ID NO: 1210194 - RNA, 24 nt, Human
cagguggaucaccugaggucagga

SEQ ID NO: 1210195 - RNA, 22 nt, Human
cauggcccaagauggcugcuca

SEQ ID NO: 1210196 - RNA, 18 nt, Human
cauggcucaacaugcggu

SEQ ID NO: 1210197 - RNA, 24 nt, Human
cauguuggccaggcuggucuugaa

SEQ ID NO: 1210198 - RNA, 24 nt, Human
cauuacaaauuccuaccuguccua

SEQ ID NO: 1210199 - RNA, 22 nt, Human
cauugccagggaggcaggcagg

SEQ ID NO: 1210200 - RNA, 22 nt, Human
cauuucagacaggaggaggaau

SEQ ID NO: 1210201 - RNA, 22 nt, Human
ccaaaguacugggauuacaggc

SEQ ID NO: 1210202 - RNA, 24 nt, Human
ccaaaguacugggauuacaggcgu

SEQ ID NO: 1210203 - RNA, 20 nt, Human
ccaccuacccuggaaacgac

SEQ ID NO: 1210204 - RNA, 24 nt, Human
ccaccucccagguucaagcgauuc

SEQ ID NO: 1210205 - RNA, 18 nt, Human
ccaccuggagcccaucuc

SEQ ID NO: 1210206 - RNA, 19 nt, Human
ccacugugaccucaucuua

SEQ ID NO: 1210207 - RNA, 24 nt, Human
ccagacccugcagcucuaaccucc

SEQ ID NO: 1210208 - RNA, 18 nt, Human
ccaggcagugaggcaagc

SEQ ID NO: 1210209 - RNA, 19 nt, Human
ccaugcgaugccucuuccu

SEQ ID NO: 1210210 - RNA, 22 nt, Human
cccagagcugaugccagacccu

SEQ ID NO: 1210211 - RNA, 18 nt, Human
cccaggcuggagugcaau

SEQ ID NO: 1210212 - RNA, 20 nt, Human
cccagguucaagcgauucuc

SEQ ID NO: 1210213 - RNA, 21 nt, Human
cccagguucaagcgauucucu

SEQ ID NO: 1210214 - RNA, 18 nt, Human
ccccaggggguugcuggc

SEQ ID NO: 1210215 - RNA, 24 nt, Human
cccgaguaacugggacuacaggug

SEQ ID NO: 1210216 - RNA, 22 nt, Human
ccgcaucagccaggucucugcc

SEQ ID NO: 1210217 - RNA, 25 nt, Human
ccgccugccuuaaccucccaaagua

SEQ ID NO: 1210218 - RNA, 23 nt, Human
ccuacaaacacacacuguuuucc

SEQ ID NO: 1210219 - RNA, 18 nt, Human
ccuagaccaccuacccug

SEQ ID NO: 1210220 - RNA, 24 nt, Human
ccucccagguucaagcgauucucu

SEQ ID NO: 1210221 - RNA, 22 nt, Human
ccugaggucaggaguuugagac

SEQ ID NO: 1210222 - RNA, 23 nt, Human
ccugcacaaaaacaaacagcagc

SEQ ID NO: 1210223 - RNA, 22 nt, Human
ccuggccgacauggugaaaccc

SEQ ID NO: 1210224 - RNA, 24 nt, Human
ccuggccgacauggugaaacccug

SEQ ID NO: 1210225 - RNA, 19 nt, Human
ccugggaggcggagguugc

SEQ ID NO: 1210226 - RNA, 20 nt, Human
ccugggcccaccuggagccc

SEQ ID NO: 1210227 - RNA, 21 nt, Human
ccuguaauuccagcuacucag

SEQ ID NO: 1210228 - RNA, 18 nt, Human
ccuuccuuccuccuuuuu

SEQ ID NO: 1210229 - RNA, 24 nt, Human
cgaaggcuccuucucaccucuugc

SEQ ID NO: 1210230 - RNA, 24 nt, Human
cgacaggcccugggccaagugcug

SEQ ID NO: 1210231 - RNA, 24 nt, Human
cgacauggugaaacccuggcucua

SEQ ID NO: 1210232 - RNA, 24 nt, Human
cgagaucgugcuauugcacuccag

SEQ ID NO: 1210233 - RNA, 20 nt, Human
cgaggcagguggaucaccug

SEQ ID NO: 1210234 - RNA, 26 nt, Human
cgaggcagguggaucaccugagguca

SEQ ID NO: 1210235 - RNA, 24 nt, Human
cgcucugucacccaggcuggagug

SEQ ID NO: 1210236 - RNA, 18 nt, Human
cuacccuggaaacgacag

SEQ ID NO: 1210237 - RNA, 24 nt, Human
cuauugcacuccagccugggagac

SEQ ID NO: 1210238 - RNA, 18 nt, Human
cucaaaaaaaaaaaaaaa

SEQ ID NO: 1210239 - RNA, 24 nt, Human
cucaaaaaaaaaaaaaaaaagagc

SEQ ID NO: 1210240 - RNA, 21 nt, Human
cucacuagagcuguugcaaca

SEQ ID NO: 1210241 - RNA, 22 nt, Human
cucacuagagcuguugcaacaa

SEQ ID NO: 1210242 - RNA, 24 nt, Human
cucacugcaaccuccaccucccag

SEQ ID NO: 1210243 - RNA, 24 nt, Human
cucaugucuguaaucgcagcacuu

SEQ ID NO: 1210244 - RNA, 23 nt, Human
cuccuucucaccucuugcagccc

SEQ ID NO: 1210245 - RNA, 24 nt, Human
cucgcucugucacccaggcuggag

SEQ ID NO: 1210246 - RNA, 19 nt, Human
cucugucucaaaaaaaaaa

SEQ ID NO: 1210247 - RNA, 20 nt, Human
cugaggcgggucugagcucc

SEQ ID NO: 1210248 - RNA, 23 nt, Human
cugcaaccuccaccucccagguu

SEQ ID NO: 1210249 - RNA, 24 nt, Human
cugcaaccuccaccucccagguuc

SEQ ID NO: 1210250 - RNA, 22 nt, Human
cugcagcucuaaccuccagcaa

SEQ ID NO: 1210251 - RNA, 24 nt, Human
cugcucaaaugccagcaguugcau

SEQ ID NO: 1210252 - RNA, 24 nt, Human
cugguucugcaggcagccugggcc

SEQ ID NO: 1210253 - RNA, 19 nt, Human
cuguaaucgcagcacuuug

SEQ ID NO: 1210254 - RNA, 21 nt, Human
cuguaauuccagcuacucagg

SEQ ID NO: 1210255 - RNA, 19 nt, Human
cugucacccaggcuggagu

SEQ ID NO: 1210256 - RNA, 23 nt, Human
cuuccugcuagcaaaggcucccc

SEQ ID NO: 1210257 - RNA, 19 nt, Human
cuugaaccugggaggcgga

SEQ ID NO: 1210258 - RNA, 24 nt, Human
cuugccucagccucccgaguaacu

SEQ ID NO: 1210259 - RNA, 24 nt, Human
gaauuaguccuagaucauccauaa

SEQ ID NO: 1210260 - RNA, 24 nt, Human
gacagagugagacucugucucaaa

SEQ ID NO: 1210261 - RNA, 21 nt, Human
gacauggugaaacccuggcuc

SEQ ID NO: 1210262 - RNA, 23 nt, Human
gacccugcagcucuaaccuccag

SEQ ID NO: 1210263 - RNA, 21 nt, Human
gacuuuaaaaguggaauggaa

SEQ ID NO: 1210264 - RNA, 18 nt, Human
gagcugaugccagacccu

SEQ ID NO: 1210265 - RNA, 22 nt, Human
gaggaacucaguggcccagggc

SEQ ID NO: 1210266 - RNA, 21 nt, Human
gaggcagggacagcuccagca

SEQ ID NO: 1210267 - RNA, 23 nt, Human
gaggcagguggaucaccugaggu

SEQ ID NO: 1210268 - RNA, 23 nt, Human
gagguugcagugagccgagaucg

SEQ ID NO: 1210269 - RNA, 18 nt, Human
gagguuucaccauguugg

SEQ ID NO: 1210270 - RNA, 22 nt, Human
gagguuucaccauguuggccag

SEQ ID NO: 1210271 - RNA, 26 nt, Human
gaguaacugggacuacaggugcacgc

SEQ ID NO: 1210272 - RNA, 24 nt, Human
gaucaccugaggucaggaguuuga

SEQ ID NO: 1210273 - RNA, 24 nt, Human
gaucucaggugauccgccugccuu

SEQ ID NO: 1210274 - RNA, 18 nt, Human
gauuacaggcgugagcca

SEQ ID NO: 1210275 - RNA, 19 nt, Human
gauuacaggcgugagccac

SEQ ID NO: 1210276 - RNA, 21 nt, Human
gauuacaggcgugagccacug

SEQ ID NO: 1210277 - RNA, 23 nt, Human
gauuucacaccuuggucgggugu

SEQ ID NO: 1210278 - RNA, 22 nt, Human
gcaaccuccaccucccagguuc

SEQ ID NO: 1210279 - RNA, 19 nt, Human
gcacaaaaacaaacagcag

SEQ ID NO: 1210280 - RNA, 24 nt, Human
gcacuccagccugggagacagagu

SEQ ID NO: 1210281 - RNA, 22 nt, Human
gcaggccgggcgugguggcuca

SEQ ID NO: 1210282 - RNA, 24 nt, Human
gcaggccgggcgugguggcucaug

SEQ ID NO: 1210283 - RNA, 18 nt, Human
gccacugugccuggccug

SEQ ID NO: 1210284 - RNA, 18 nt, Human
gccauggaaaagacccag

SEQ ID NO: 1210285 - RNA, 22 nt, Human
gcccuggccuuccggccuucuc

SEQ ID NO: 1210286 - RNA, 23 nt, Human
gcccuggccuuccggccuucuca

SEQ ID NO: 1210287 - RNA, 24 nt, Human
gccgacauggugaaacccuggcuc

SEQ ID NO: 1210288 - RNA, 19 nt, Human
gccugacuaaaucagcguu

SEQ ID NO: 1210289 - RNA, 20 nt, Human
gccugccuuaaccucccaaa

SEQ ID NO: 1210290 - RNA, 23 nt, Human
gccuggggccauggaaaagaccc

SEQ ID NO: 1210291 - RNA, 24 nt, Human
gcgauucucuugccucagccuccc

SEQ ID NO: 1210292 - RNA, 27 nt, Human
gcucugucacccaggcuggagugcaau

SEQ ID NO: 1210293 - RNA, 24 nt, Human
gcugccaugaugaaggaccacaga

SEQ ID NO: 1210294 - RNA, 20 nt, Human
ggagguugcagugagccgag

SEQ ID NO: 1210295 - RNA, 22 nt, Human
ggagguugcagugagccgagau

SEQ ID NO: 1210296 - RNA, 23 nt, Human
ggagguugcagugagccgagauc

SEQ ID NO: 1210297 - RNA, 24 nt, Human
ggagguugcagugagccgagaucg

SEQ ID NO: 1210298 - RNA, 22 nt, Human
ggaucaccugaggucaggaguu

SEQ ID NO: 1210299 - RNA, 19 nt, Human
ggcaccuguaauuccagcu

SEQ ID NO: 1210300 - RNA, 20 nt, Human
ggccauggaaaagacccaga

SEQ ID NO: 1210301 - RNA, 23 nt, Human
ggccauggaaaagacccagagcu

SEQ ID NO: 1210302 - RNA, 24 nt, Human
ggccauggaaaagacccagagcug

SEQ ID NO: 1210303 - RNA, 21 nt, Human
ggccgggcgugguggcucaug

SEQ ID NO: 1210304 - RNA, 23 nt, Human
ggcgugguggcucaugucuguaa

SEQ ID NO: 1210305 - RNA, 19 nt, Human
ggcugcaucauuuugaaca

SEQ ID NO: 1210306 - RNA, 23 nt, Human
ggcuugcagccgcgucacuccga

SEQ ID NO: 1210307 - RNA, 22 nt, Human
gggacuuuaaaaguggaaugga

SEQ ID NO: 1210308 - RNA, 21 nt, Human
gggauuucacaccuuggucgg

SEQ ID NO: 1210309 - RNA, 24 nt, Human
gggcgugguggcaggcaccuguaa

SEQ ID NO: 1210310 - RNA, 22 nt, Human
gggugccuucaaacaagggaaa

SEQ ID NO: 1210311 - RNA, 18 nt, Human
gguccccuacagaaccug

SEQ ID NO: 1210312 - RNA, 24 nt, Human
gguggcucaugucuguaaucgcag

SEQ ID NO: 1210313 - RNA, 21 nt, Human
ggugguagugauaggggcgcu

SEQ ID NO: 1210314 - RNA, 22 nt, Human
guagagaugagguuucaccaug

SEQ ID NO: 1210315 - RNA, 21 nt, Human
gugaaacccuggcucuacuaa

SEQ ID NO: 1210316 - RNA, 24 nt, Human
gugauccgccugccuuaaccuccc

SEQ ID NO: 1210317 - RNA, 24 nt, Human
gugcugggauauauggcugaguca

SEQ ID NO: 1210318 - RNA, 20 nt, Human
guggaauggaauccaggacu

SEQ ID NO: 1210319 - RNA, 23 nt, Human
guggcucaugucuguaaucgcag

SEQ ID NO: 1210320 - RNA, 24 nt, Human
guugcagugagccgagaucgugcu

SEQ ID NO: 1210321 - RNA, 20 nt, Human
uaaaagaggcuguaguagua

SEQ ID NO: 1210322 - RNA, 21 nt, Human
uaaaagaggcuguaguaguau

SEQ ID NO: 1210323 - RNA, 19 nt, Human
uaagaagcuaccacauggc

SEQ ID NO: 1210324 - RNA, 19 nt, Human
uaagaagcuaccacauggc

SEQ ID NO: 1210325 - RNA, 23 nt, Human
uaauuuuuguauuuuucuguaga

SEQ ID NO: 1210326 - RNA, 25 nt, Human
uaauuuuuguauuuuucuguagaga

SEQ ID NO: 1210327 - RNA, 19 nt, Human
uacaaagaggcagggacag

SEQ ID NO: 1210328 - RNA, 22 nt, Human
uacaggcgugagccacugugcc

SEQ ID NO: 1210329 - RNA, 22 nt, Human
uacaggcgugagccacugugcc

SEQ ID NO: 1210330 - RNA, 23 nt, Human
uacaggcgugagccacugugccu

SEQ ID NO: 1210331 - RNA, 19 nt, Human
uacauugucacaagaagcc

SEQ ID NO: 1210332 - RNA, 20 nt, Human
uacucugugucauuuaagac

SEQ ID NO: 1210333 - RNA, 24 nt, Human
uacugggauuacaggcgugagcca

SEQ ID NO: 1210334 - RNA, 22 nt, Human
uagagaugagguuucaccaugu

SEQ ID NO: 1210335 - RNA, 19 nt, Human
uagcaaaggcuccccuugg

SEQ ID NO: 1210336 - RNA, 24 nt, Human
uagccuggccgacauggugaaacc

SEQ ID NO: 1210337 - RNA, 23 nt, Human
uauugcacuccagccugggagac

SEQ ID NO: 1210338 - RNA, 24 nt, Human
uauugcacuccagccugggagaca

SEQ ID NO: 1210339 - RNA, 19 nt, Human
ucaaaaaaaaaaaaaaaaa

SEQ ID NO: 1210340 - RNA, 21 nt, Human
ucaaucagccuagaccaccua

SEQ ID NO: 1210341 - RNA, 18 nt, Human
ucacccaggcuggagugc

SEQ ID NO: 1210342 - RNA, 19 nt, Human
ucaccugaggucaggaguu

SEQ ID NO: 1210343 - RNA, 23 nt, Human
ucacugcaaccuccaccucccag

SEQ ID NO: 1210344 - RNA, 24 nt, Human
ucacugcaaccuccaccucccagg

SEQ ID NO: 1210345 - RNA, 26 nt, Human
ucacugcaaccuccaccucccagguu

SEQ ID NO: 1210346 - RNA, 23 nt, Human
ucagcucacaccugagccagccu

SEQ ID NO: 1210347 - RNA, 23 nt, Human
uccagccugggagacagagugag

SEQ ID NO: 1210348 - RNA, 24 nt, Human
uccagccugggagacagagugaga

SEQ ID NO: 1210349 - RNA, 18 nt, Human
uccauaagaagcuaccac

SEQ ID NO: 1210350 - RNA, 24 nt, Human
ucccaaaguacugggauuacaggc

SEQ ID NO: 1210351 - RNA, 21 nt, Human
ucccagguucaagcgauucuc

SEQ ID NO: 1210352 - RNA, 21 nt, Human
ucccagguucaagcgauucuc

SEQ ID NO: 1210353 - RNA, 24 nt, Human
ucccagguucaagcgauucucuug

SEQ ID NO: 1210354 - RNA, 23 nt, Human
ucccgaguaacugggacuacagg

SEQ ID NO: 1210355 - RNA, 20 nt, Human
ucccuguguacauguguccc

SEQ ID NO: 1210356 - RNA, 24 nt, Human
ucgcuugaaccugggaggcggagg

SEQ ID NO: 1210357 - RNA, 23 nt, Human
ucuaaugcccuucagugcagagc

SEQ ID NO: 1210358 - RNA, 19 nt, Human
ucucgcucugucacccagg

SEQ ID NO: 1210359 - RNA, 22 nt, Human
ucucgcucugucacccaggcug

SEQ ID NO: 1210360 - RNA, 23 nt, Human
ucucgcucugucacccaggcugg

SEQ ID NO: 1210361 - RNA, 24 nt, Human
ucucgcucugucacccaggcugga

SEQ ID NO: 1210362 - RNA, 26 nt, Human
ucucgcucugucacccaggcuggagu

SEQ ID NO: 1210363 - RNA, 27 nt, Human
ucucgcucugucacccaggcuggagug

SEQ ID NO: 1210364 - RNA, 20 nt, Human
ucucugaggcuggacuuaac

SEQ ID NO: 1210365 - RNA, 22 nt, Human
ucucugaggcuggacuuaacuc

SEQ ID NO: 1210366 - RNA, 22 nt, Human
ucugcaggcagccugggcccac

SEQ ID NO: 1210367 - RNA, 25 nt, Human
ucugcaggcagccugggcccaccug

SEQ ID NO: 1210368 - RNA, 27 nt, Human
ucugcaggcagccugggcccaccugga

SEQ ID NO: 1210369 - RNA, 24 nt, Human
ucuguaaucgcagcacuuugggag

SEQ ID NO: 1210370 - RNA, 24 nt, Human
ucugucacccaggcuggagugcaa

SEQ ID NO: 1210371 - RNA, 23 nt, Human
ucugucucaaaaaaaaaaaaaaa

SEQ ID NO: 1210372 - RNA, 19 nt, Human
ucuuuggcuuuuuccucuu

SEQ ID NO: 1210373 - RNA, 20 nt, Human
ugaaaacaagugcagcacag

SEQ ID NO: 1210374 - RNA, 24 nt, Human
ugaaauaggcuucuucacugcaga

SEQ ID NO: 1210375 - RNA, 24 nt, Human
ugaaccugggaggcggagguugca

SEQ ID NO: 1210376 - RNA, 22 nt, Human
ugaagcaccuuacggaauuggu

SEQ ID NO: 1210377 - RNA, 22 nt, Human
ugagauggagucucgcucuguc

SEQ ID NO: 1210378 - RNA, 22 nt, Human
ugagccgagaucgugcuauugc

SEQ ID NO: 1210379 - RNA, 18 nt, Human
ugaggaacucaguggccc

SEQ ID NO: 1210380 - RNA, 24 nt, Human
ugaggcaggagaaucgcuugaacc

SEQ ID NO: 1210381 - RNA, 25 nt, Human
ugaggcaggagaaucgcuugaaccu

SEQ ID NO: 1210382 - RNA, 24 nt, Human
ugagguuucaccauguuggccagg

SEQ ID NO: 1210383 - RNA, 18 nt, Human
ugaucucaggugauccgc

SEQ ID NO: 1210384 - RNA, 24 nt, Human
ugaucucaggugauccgccugccu

SEQ ID NO: 1210385 - RNA, 24 nt, Human
ugaugccagacccugcagcucuaa

SEQ ID NO: 1210386 - RNA, 20 nt, Human
ugauuuuguuuuuguuuuuu

SEQ ID NO: 1210387 - RNA, 23 nt, Human
ugcaaccuaaacagacaguuuug

SEQ ID NO: 1210388 - RNA, 25 nt, Human
ugcacaaaaacaaacagcagccacc

SEQ ID NO: 1210389 - RNA, 18 nt, Human
ugcacuccagccugggag

SEQ ID NO: 1210390 - RNA, 20 nt, Human
ugcacuccagccugggagac

SEQ ID NO: 1210391 - RNA, 22 nt, Human
ugcacuccagccugggagacag

SEQ ID NO: 1210392 - RNA, 21 nt, Human
ugcagagcccuacaaacacac

SEQ ID NO: 1210393 - RNA, 22 nt, Human
ugcauggaucuaaugcccuuca

SEQ ID NO: 1210394 - RNA, 20 nt, Human
ugccagaauagaaccuggac

SEQ ID NO: 1210395 - RNA, 23 nt, Human
ugccagggaggcaggcagggaug

SEQ ID NO: 1210396 - RNA, 24 nt, Human
ugccucagccucccgaguaacugg

SEQ ID NO: 1210397 - RNA, 24 nt, Human
ugccuuaaccucccaaaguacugg

SEQ ID NO: 1210398 - RNA, 18 nt, Human
ugcggagagaggaggcug

SEQ ID NO: 1210399 - RNA, 21 nt, Human
ugcggagagaggaggcugaga

SEQ ID NO: 1210400 - RNA, 22 nt, Human
uggaauggaauccaggacacag

SEQ ID NO: 1210401 - RNA, 23 nt, Human
uggaauggaauccaggacacagu

SEQ ID NO: 1210402 - RNA, 23 nt, Human
uggacucaauuuagcucauaaca

SEQ ID NO: 1210403 - RNA, 21 nt, Human
uggagcaggccgggcguggug

SEQ ID NO: 1210404 - RNA, 23 nt, Human
uggagugcaauggcacgaucuug

SEQ ID NO: 1210405 - RNA, 24 nt, Human
uggagugcaauggcacgaucuugg

SEQ ID NO: 1210406 - RNA, 23 nt, Human
uggaucaccugaggucaggaguu

SEQ ID NO: 1210407 - RNA, 24 nt, Human
uggaucaccugaggucaggaguuu

SEQ ID NO: 1210408 - RNA, 27 nt, Human
uggaucaccugaggucaggaguuugag

SEQ ID NO: 1210409 - RNA, 22 nt, Human
uggcaggcaccuguaauuccag

SEQ ID NO: 1210410 - RNA, 24 nt, Human
uggccaggcuggucuugaacucuu

SEQ ID NO: 1210411 - RNA, 18 nt, Human
uggcccagggccacuugg

SEQ ID NO: 1210412 - RNA, 24 nt, Human
uggccgacauggugaaacccuggc

SEQ ID NO: 1210413 - RNA, 18 nt, Human
uggcucaugucuguaauc

SEQ ID NO: 1210414 - RNA, 24 nt, Human
uggcucaugucuguaaucgcagca

SEQ ID NO: 1210415 - RNA, 19 nt, Human
ugggaaagguaguuuuuau

SEQ ID NO: 1210416 - RNA, 22 nt, Human
ugggacuacaggugcacgccac

SEQ ID NO: 1210417 - RNA, 22 nt, Human
ugggacuacaggugcacgccac

SEQ ID NO: 1210418 - RNA, 24 nt, Human
ugggacuacaggugcacgccacua

SEQ ID NO: 1210419 - RNA, 21 nt, Human
ugggagacagagugagacucu

SEQ ID NO: 1210420 - RNA, 24 nt, Human
ugggaggccgaggcagguggauca

SEQ ID NO: 1210421 - RNA, 29 nt, Human
ugggaggcggagguugcagugacaacggu

SEQ ID NO: 1210422 - RNA, 24 nt, Human
ugggaggcggagguugcagugagc

SEQ ID NO: 1210423 - RNA, 18 nt, Human
ugggauuacaggcgugag

SEQ ID NO: 1210424 - RNA, 21 nt, Human
ugggauuacaggcgugagcca

SEQ ID NO: 1210425 - RNA, 22 nt, Human
ugggauuacaggcgugagccac

SEQ ID NO: 1210426 - RNA, 22 nt, Human
ugggauuacaggcgugagccac

SEQ ID NO: 1210427 - RNA, 22 nt, Human
ugggauuacaggcgugagccac

SEQ ID NO: 1210428 - RNA, 23 nt, Human
ugggauuacaggcgugagccacu

SEQ ID NO: 1210429 - RNA, 24 nt, Human
ugggauuacaggcgugagccacug

SEQ ID NO: 1210430 - RNA, 21 nt, Human
uggggugguagugauaggggc

SEQ ID NO: 1210431 - RNA, 25 nt, Human
ugguagugauaggggcgcuucgauu

SEQ ID NO: 1210432 - RNA, 24 nt, Human
ugguggcaggcaccuguaauucca

SEQ ID NO: 1210433 - RNA, 21 nt, Human
ugguggcucaugucuguaauc

SEQ ID NO: 1210434 - RNA, 24 nt, Human
uggugggggagcugggccagcugg

SEQ ID NO: 1210435 - RNA, 23 nt, Human
uguagagaugagguuucaccaug

SEQ ID NO: 1210436 - RNA, 24 nt, Human
uguagagaugagguuucaccaugu

SEQ ID NO: 1210437 - RNA, 20 nt, Human
ugucacccaggcuggagugc

SEQ ID NO: 1210438 - RNA, 22 nt, Human
ugucacccaggcuggagugcaa

SEQ ID NO: 1210439 - RNA, 21 nt, Human
uguccagaauuuaucccaggg

SEQ ID NO: 1210440 - RNA, 22 nt, Human
uguccagaauuuaucccagggc

SEQ ID NO: 1210441 - RNA, 20 nt, Human
ugucccauggaguucucccu

SEQ ID NO: 1210442 - RNA, 27 nt, Human
ugucucaaccuuuagugcgcucauugu

SEQ ID NO: 1210443 - RNA, 24 nt, Human
ugucuguaaucgcagcacuuuggg

SEQ ID NO: 1210444 - RNA, 19 nt, Human
ugugaagcaccuuacggaa

SEQ ID NO: 1210445 - RNA, 20 nt, Human
uguggugggggagcugggcc

SEQ ID NO: 1210446 - RNA, 24 nt, Human
uguucugcagaggcuauucaggua

SEQ ID NO: 1210447 - RNA, 21 nt, Human
uuaaagaaaccaucaauacuc

SEQ ID NO: 1210448 - RNA, 18 nt, Human
uuagcugggcgugguggc

SEQ ID NO: 1210449 - RNA, 24 nt, Human
uuagcugggcgugguggcaggcac

SEQ ID NO: 1210450 - RNA, 23 nt, Human
uucaagcgauucucuugccucag

SEQ ID NO: 1210451 - RNA, 20 nt, Human
uucagacaggaggaggaaug

SEQ ID NO: 1210452 - RNA, 24 nt, Human
uuccuccuuuuugcugggagggag

SEQ ID NO: 1210453 - RNA, 24 nt, Human
uuccugcuagcaaaggcuccccuu

SEQ ID NO: 1210454 - RNA, 24 nt, Human
uuccuugucuuaugaagacaccag

SEQ ID NO: 1210455 - RNA, 19 nt, Human
uucuguuuaaggucccuuc

SEQ ID NO: 1210456 - RNA, 24 nt, Human
uugaaccugggaggcggagguugc

SEQ ID NO: 1210457 - RNA, 23 nt, Human
uugaugcaggaguagagagcaaa

SEQ ID NO: 1210458 - RNA, 18 nt, Human
uugcagugagccgagauc

SEQ ID NO: 1210459 - RNA, 21 nt, Human
uugcagugagccgagaucgug

SEQ ID NO: 1210460 - RNA, 22 nt, Human
uugcagugagccgagaucgugc

SEQ ID NO: 1210461 - RNA, 25 nt, Human
uugggaggccgaggcagguggauca

SEQ ID NO: 1210462 - RNA, 23 nt, Human
uugggguggacucaauuuagcuc

SEQ ID NO: 1210463 - RNA, 19 nt, Human
uuuauauucugucucucug

SEQ ID NO: 1210464 - RNA, 24 nt, Human
uuucaccauguuggccaggcuggu

SEQ ID NO: 1210465 - RNA, 22 nt, Human
uuugaacaucugaauuuugggg

SEQ ID NO: 1210466 - RNA, 21 nt, Human
uuuuccucuuugugugucugu

SEQ ID NO: 1210467 - RNA, 18 nt, Human
uuuucugagauggagucu

SEQ ID NO: 1210468 - RNA, 21 nt, Human
uuuuuguauuuuucuguagag

SEQ ID NO: 1210469 - RNA, 24 nt, Human
uuuuuguauuuuucuguagagaug

SEQ ID NO: 1210470 - RNA, 18 nt, Human
aagcuccccaaaccccac

SEQ ID NO: 1210471 - RNA, 20 nt, Human
aagcuccccaaaccccaccu

SEQ ID NO: 1210472 - RNA, 22 nt, Human
aagcuccccaaaccccaccuuc

SEQ ID NO: 1210473 - RNA, 21 nt, Human
accaucagugaaacagaagca

SEQ ID NO: 1210474 - RNA, 25 nt, Human
acuuugagaaacaacugaugaaaaa

SEQ ID NO: 1210475 - RNA, 18 nt, Human
aguguccauccucccagg

SEQ ID NO: 1210476 - RNA, 20 nt, Human
auguuuuacaaccaugaaac

SEQ ID NO: 1210477 - RNA, 18 nt, Human
caacugaugaaaaauaca

SEQ ID NO: 1210478 - RNA, 21 nt, Human
caccaucagugaaacagaagc

SEQ ID NO: 1210479 - RNA, 22 nt, Human
caccuucacagccucuuccaca

SEQ ID NO: 1210480 - RNA, 22 nt, Human
ccaaaccccaccuucacagccu

SEQ ID NO: 1210481 - RNA, 20 nt, Human
ccaagcuccccaaaccccac

SEQ ID NO: 1210482 - RNA, 19 nt, Human
ccgcagcucggccggcgcc

SEQ ID NO: 1210483 - RNA, 21 nt, Human
ccgcagcucggccggcgccgg

SEQ ID NO: 1210484 - RNA, 19 nt, Human
cgcagcucggccggcgccg

SEQ ID NO: 1210485 - RNA, 21 nt, Human
cggccggagcagcucccgcgg

SEQ ID NO: 1210486 - RNA, 19 nt, Human
cggcucccgcagcucggcc

SEQ ID NO: 1210487 - RNA, 18 nt, Human
cuauuguguuaugauguc

SEQ ID NO: 1210488 - RNA, 24 nt, Human
cuccccaaaccccaccuucacagc

SEQ ID NO: 1210489 - RNA, 21 nt, Human
gaaacagaagcagaaguacga

SEQ ID NO: 1210490 - RNA, 23 nt, Human
gcucccgcggcgucagcuggugc

SEQ ID NO: 1210491 - RNA, 21 nt, Human
uacagcaaacauuucagauag

SEQ ID NO: 1210492 - RNA, 22 nt, Human
uaggaagguggcuguuacagca

SEQ ID NO: 1210493 - RNA, 21 nt, Human
ucacuugcaaauucaaggauu

SEQ ID NO: 1210494 - RNA, 22 nt, Human
ucagugaaacagaagcagaagu

SEQ ID NO: 1210495 - RNA, 26 nt, Human
ugaaacagaagcagaaguacgaugac

SEQ ID NO: 1210496 - RNA, 22 nt, Human
ugucaggguggcagaugugccc

SEQ ID NO: 1210497 - RNA, 21 nt, Human
uguuuuacaaccaugaaaaca

SEQ ID NO: 1210498 - RNA, 25 nt, Human
uucacagccucuuccacacgucucu

SEQ ID NO: 1210499 - RNA, 21 nt, Human
aaaauuuaaaauuuguaaaaa

SEQ ID NO: 1210500 - RNA, 19 nt, Human
aaacaauucucuguaagga

SEQ ID NO: 1210501 - RNA, 20 nt, Human
aaagacugaugcaaauugga

SEQ ID NO: 1210502 - RNA, 25 nt, Human
aagaaucuucuaccaaguacucuuu

SEQ ID NO: 1210503 - RNA, 22 nt, Human
aagagacuuuauuacuuacuaa

SEQ ID NO: 1210504 - RNA, 21 nt, Human
aagcacgaagacuucucagcu

SEQ ID NO: 1210505 - RNA, 25 nt, Human
aaguaccuucuuguguaucaauucc

SEQ ID NO: 1210506 - RNA, 19 nt, Human
accaccaggucucagaaac

SEQ ID NO: 1210507 - RNA, 18 nt, Human
acuuagguuaaaucuuuc

SEQ ID NO: 1210508 - RNA, 20 nt, Human
agaaagcuaauuauucacaa

SEQ ID NO: 1210509 - RNA, 19 nt, Human
agcagcuccggccuagccc

SEQ ID NO: 1210510 - RNA, 24 nt, Human
agcuggccucuaacucgggccagc

SEQ ID NO: 1210511 - RNA, 19 nt, Human
agguaaacaaaucugaagc

SEQ ID NO: 1210512 - RNA, 22 nt, Human
aggucucagaaacuucugagcu

SEQ ID NO: 1210513 - RNA, 20 nt, Human
auuucaaauagacuuggcug

SEQ ID NO: 1210514 - RNA, 24 nt, Human
caaaauggcccauaucauacugaa

SEQ ID NO: 1210515 - RNA, 18 nt, Human
cacguccgcccaagcaac

SEQ ID NO: 1210516 - RNA, 24 nt, Human
cacguccgcccaagcaacugagga

SEQ ID NO: 1210517 - RNA, 22 nt, Human
caggagaaccugaaugcgccgc

SEQ ID NO: 1210518 - RNA, 21 nt, Human
caugaguaaagauuagagaaa

SEQ ID NO: 1210519 - RNA, 22 nt, Human
cauuugagaaagcuaauuauuc

SEQ ID NO: 1210520 - RNA, 19 nt, Human
cccacacuuaaaccuauac

SEQ ID NO: 1210521 - RNA, 23 nt, Human
cccuuaacucugggaccgggccc

SEQ ID NO: 1210522 - RNA, 19 nt, Human
ccgcgcgucuagguccugc

SEQ ID NO: 1210523 - RNA, 19 nt, Human
ccgcuguuuccagccucag

SEQ ID NO: 1210524 - RNA, 20 nt, Human
ccgcuguuuccagccucagc

SEQ ID NO: 1210525 - RNA, 21 nt, Human
ccuagccccgcccacuuuggc

SEQ ID NO: 1210526 - RNA, 22 nt, Human
ccuauaccaagacauucaggga

SEQ ID NO: 1210527 - RNA, 23 nt, Human
ccuauaccaagacauucagggac

SEQ ID NO: 1210528 - RNA, 22 nt, Human
cgaccaccaggucucagaaacu

SEQ ID NO: 1210529 - RNA, 23 nt, Human
cgaugcgauccucuagugaaugg

SEQ ID NO: 1210530 - RNA, 21 nt, Human
cggacagauuggguccacguc

SEQ ID NO: 1210531 - RNA, 24 nt, Human
cgucugccuuugguuccgcuguuu

SEQ ID NO: 1210532 - RNA, 20 nt, Human
cugccaaaggguccuguugg

SEQ ID NO: 1210533 - RNA, 22 nt, Human
cuguuugcucccgggcuucaua

SEQ ID NO: 1210534 - RNA, 23 nt, Human
gagaaaaaagaaaugcuaaaugc

SEQ ID NO: 1210535 - RNA, 21 nt, Human
ggagcucuucucauagagacu

SEQ ID NO: 1210536 - RNA, 20 nt, Human
ggaggccuggugaucucaag

SEQ ID NO: 1210537 - RNA, 24 nt, Human
ggccuggugaucucaaguggcugg

SEQ ID NO: 1210538 - RNA, 18 nt, Human
ggcugagcgcccucuggg

SEQ ID NO: 1210539 - RNA, 21 nt, Human
ggguuuccaaacgacuuuccc

SEQ ID NO: 1210540 - RNA, 20 nt, Human
gucuucagucccguguagag

SEQ ID NO: 1210541 - RNA, 21 nt, Human
uaaaaagccuacauuugagaa

SEQ ID NO: 1210542 - RNA, 18 nt, Human
uaaaggcauugugagcua

SEQ ID NO: 1210543 - RNA, 24 nt, Human
uaacaugaguaaagauuagagaaa

SEQ ID NO: 1210544 - RNA, 25 nt, Human
uaccaagacauucagggacauaaca

SEQ ID NO: 1210545 - RNA, 23 nt, Human
uauucuguuuggccagacaccua

SEQ ID NO: 1210546 - RNA, 19 nt, Human
ucaagaguccaauaugaug

SEQ ID NO: 1210547 - RNA, 22 nt, Human
ucaauuuucagacugucccaca

SEQ ID NO: 1210548 - RNA, 19 nt, Human
ucccgggcuucauauucuc

SEQ ID NO: 1210549 - RNA, 20 nt, Human
ucccugaguguaacuuucuc

SEQ ID NO: 1210550 - RNA, 19 nt, Human
uccgcuguuuccagccuca

SEQ ID NO: 1210551 - RNA, 18 nt, Human
ucuguuuggccagacacc

SEQ ID NO: 1210552 - RNA, 21 nt, Human
ucuucagucccguguagaguu

SEQ ID NO: 1210553 - RNA, 19 nt, Human
ucuuguggacuaaguaccu

SEQ ID NO: 1210554 - RNA, 24 nt, Human
ucuuuugacgaugcgauccucuag

SEQ ID NO: 1210555 - RNA, 24 nt, Human
ugaaauuuuaucaguauaacacac

SEQ ID NO: 1210556 - RNA, 19 nt, Human
ugaacaaaauggcccauau

SEQ ID NO: 1210557 - RNA, 22 nt, Human
ugaagcacgaagacuucucagc

SEQ ID NO: 1210558 - RNA, 18 nt, Human
ugaucucaaguggcugcc

SEQ ID NO: 1210559 - RNA, 20 nt, Human
ugccaaaggguccuguuggc

SEQ ID NO: 1210560 - RNA, 19 nt, Human
ugcuguaguauguauucug

SEQ ID NO: 1210561 - RNA, 25 nt, Human
uggaaggagagggcaacaagacgac

SEQ ID NO: 1210562 - RNA, 19 nt, Human
uggccugggguuuccaaac

SEQ ID NO: 1210563 - RNA, 19 nt, Human
uggcugccucccaccagca

SEQ ID NO: 1210564 - RNA, 24 nt, Human
uggcugccucccaccagcagcucc

SEQ ID NO: 1210565 - RNA, 20 nt, Human
ugggaccgggcccugcaccc

SEQ ID NO: 1210566 - RNA, 19 nt, Human
uggguccacguccgcccaa

SEQ ID NO: 1210567 - RNA, 22 nt, Human
uguuaaagaaucuucuaccaag

SEQ ID NO: 1210568 - RNA, 22 nt, Human
uuacaacaucuuucucuuuggu

SEQ ID NO: 1210569 - RNA, 22 nt, Human
uucaagaguccaauaugaugca

SEQ ID NO: 1210570 - RNA, 24 nt, Human
ugccagaaggauacccgauucaau

SEQ ID NO: 1210571 - RNA, 24 nt, Human
aaaauccucugaagaaaggugacu

SEQ ID NO: 1210572 - RNA, 18 nt, Human
aagaaugccaaaauccuc

SEQ ID NO: 1210573 - RNA, 19 nt, Human
caaggagcuuuuggccaau

SEQ ID NO: 1210574 - RNA, 22 nt, Human
cauguguggccggauuauaagc

SEQ ID NO: 1210575 - RNA, 19 nt, Human
gaaaggugacucacaagga

SEQ ID NO: 1210576 - RNA, 20 nt, Human
gguucaacucuuaauucaug

SEQ ID NO: 1210577 - RNA, 23 nt, Human
ugaaauaggcagggucuaggucc

SEQ ID NO: 1210578 - RNA, 24 nt, Human
ugacuuuugggauuuagaucugug

SEQ ID NO: 1210579 - RNA, 21 nt, Human
uggccggauuauaagcugcac

SEQ ID NO: 1210580 - RNA, 22 nt, Human
aaaaacgacccccuuucuggga

SEQ ID NO: 1210581 - RNA, 22 nt, Human
aaagcccuuauaaauacccucc

SEQ ID NO: 1210582 - RNA, 20 nt, Human
aagcggcgcuugcucuuggu

SEQ ID NO: 1210583 - RNA, 18 nt, Human
aauuccuaucaccuccuc

SEQ ID NO: 1210584 - RNA, 19 nt, Human
accagaacaaaaggggcca

SEQ ID NO: 1210585 - RNA, 18 nt, Human
accuccaaccuguuccca

SEQ ID NO: 1210586 - RNA, 20 nt, Human
accuccaaccuguucccaga

SEQ ID NO: 1210587 - RNA, 26 nt, Human
acucccucucuccuccaucccucuuu

SEQ ID NO: 1210588 - RNA, 22 nt, Human
acucuuacaagccucugggggc

SEQ ID NO: 1210589 - RNA, 24 nt, Human
agaaaggacccuuuguucuccaga

SEQ ID NO: 1210590 - RNA, 21 nt, Human
agaccuccaaccuguucccag

SEQ ID NO: 1210591 - RNA, 25 nt, Human
agcugggagucagacaguccacagc

SEQ ID NO: 1210592 - RNA, 21 nt, Human
aggcaggaugagggcugggag

SEQ ID NO: 1210593 - RNA, 25 nt, Human
aucaccccuagacaccagaacaaaa

SEQ ID NO: 1210594 - RNA, 20 nt, Human
augucgaacucguccuucuc

SEQ ID NO: 1210595 - RNA, 22 nt, Human
auuggggugggcccuaacagag

SEQ ID NO: 1210596 - RNA, 25 nt, Human
caaaaagcccuuauaaauacccucu

SEQ ID NO: 1210597 - RNA, 19 nt, Human
caauaguaaaaugcgcccu

SEQ ID NO: 1210598 - RNA, 24 nt, Human
caaucaccccuagacaccagaaca

SEQ ID NO: 1210599 - RNA, 24 nt, Human
cacagauaagaccuccaaccuguu

SEQ ID NO: 1210600 - RNA, 22 nt, Human
cacccagacgcuaagcagagac

SEQ ID NO: 1210601 - RNA, 24 nt, Human
cacccagacgcuaagcagagacgg

SEQ ID NO: 1210602 - RNA, 23 nt, Human
caccccuccccagagaaaggacc

SEQ ID NO: 1210603 - RNA, 23 nt, Human
cacgcggaaaaagaagcggcgcu

SEQ ID NO: 1210604 - RNA, 21 nt, Human
cacuuccuuccuccuauccug

SEQ ID NO: 1210605 - RNA, 25 nt, Human
cacuuccuuccuccuauccugucuc

SEQ ID NO: 1210606 - RNA, 21 nt, Human
caucuuggccucagcugggag

SEQ ID NO: 1210607 - RNA, 22 nt, Human
ccaauacacaacugguugaaga

SEQ ID NO: 1210608 - RNA, 24 nt, Human
ccaccaaaaagcccuuauaaauac

SEQ ID NO: 1210609 - RNA, 18 nt, Human
ccacugcaccccucccca

SEQ ID NO: 1210610 - RNA, 24 nt, Human
ccaguggcccccacuggguaccca

SEQ ID NO: 1210611 - RNA, 22 nt, Human
cccacuggguacccaucuccca

SEQ ID NO: 1210612 - RNA, 22 nt, Human
cccagagacccagucccucucc

SEQ ID NO: 1210613 - RNA, 19 nt, Human
ccccaaguccugggaaccc

SEQ ID NO: 1210614 - RNA, 22 nt, Human
cccccaaguccugggaacccag

SEQ ID NO: 1210615 - RNA, 23 nt, Human
cccccaaguccugggaacccagg

SEQ ID NO: 1210616 - RNA, 20 nt, Human
ccccgcccacugcaccccuc

SEQ ID NO: 1210617 - RNA, 18 nt, Human
ccccuagacaccagaaca

SEQ ID NO: 1210618 - RNA, 24 nt, Human
cccuccccauccugucccugucca

SEQ ID NO: 1210619 - RNA, 20 nt, Human
cccucucuccuccaucccuc

SEQ ID NO: 1210620 - RNA, 22 nt, Human
ccucaagcucuuugcucccuca

SEQ ID NO: 1210621 - RNA, 18 nt, Human
ccuccacuuccuuccucc

SEQ ID NO: 1210622 - RNA, 20 nt, Human
ccuccaucccucuuuuuguc

SEQ ID NO: 1210623 - RNA, 24 nt, Human
ccuccuccuccacuuccuuccucc

SEQ ID NO: 1210624 - RNA, 24 nt, Human
ccuccuuccaauuccuaucaccuc

SEQ ID NO: 1210625 - RNA, 18 nt, Human
ccuuccuccuauccuguc

SEQ ID NO: 1210626 - RNA, 18 nt, Human
cgcaccuucuugagcggc

SEQ ID NO: 1210627 - RNA, 22 nt, Human
cgcccacugcaccccuccccag

SEQ ID NO: 1210628 - RNA, 23 nt, Human
cggagacccuccaguggccccca

SEQ ID NO: 1210629 - RNA, 24 nt, Human
cggcuucuaccuccuuccaauucc

SEQ ID NO: 1210630 - RNA, 22 nt, Human
cuagacaccagaacaaaagggg

SEQ ID NO: 1210631 - RNA, 24 nt, Human
cuccagacucccucucuccuccau

SEQ ID NO: 1210632 - RNA, 18 nt, Human
cuccaucccucaucccaa

SEQ ID NO: 1210633 - RNA, 24 nt, Human
cucccaccaaaaagcccuuauaaa

SEQ ID NO: 1210634 - RNA, 22 nt, Human
cuccccagagaaaggacccuuu

SEQ ID NO: 1210635 - RNA, 21 nt, Human
cucccugaguccgaauuucca

SEQ ID NO: 1210636 - RNA, 22 nt, Human
cucccugcgcugcugcuucugc

SEQ ID NO: 1210637 - RNA, 28 nt, Human
cuccuucgucccucuccccucuuccucu

SEQ ID NO: 1210638 - RNA, 20 nt, Human
cucugcacggcuucuaccuc

SEQ ID NO: 1210639 - RNA, 21 nt, Human
cugcugcuccuccgacacgcg

SEQ ID NO: 1210640 - RNA, 23 nt, Human
cuuugcucccucauguccuucug

SEQ ID NO: 1210641 - RNA, 20 nt, Human
gaacagagggguaaggcagg

SEQ ID NO: 1210642 - RNA, 19 nt, Human
gacccccaaguccugggaa

SEQ ID NO: 1210643 - RNA, 21 nt, Human
gcaccccuccccagagaaagg

SEQ ID NO: 1210644 - RNA, 20 nt, Human
gcaggaugagggcugggagu

SEQ ID NO: 1210645 - RNA, 18 nt, Human
gcccacugcaccccuccc

SEQ ID NO: 1210646 - RNA, 20 nt, Human
gcccacugcaccccucccca

SEQ ID NO: 1210647 - RNA, 22 nt, Human
gcccccacuggguacccaucuc

SEQ ID NO: 1210648 - RNA, 23 nt, Human
gcccuuauaaauacccuccccau

SEQ ID NO: 1210649 - RNA, 19 nt, Human
gcgcugcugcuucugcugc

SEQ ID NO: 1210650 - RNA, 20 nt, Human
ggaacagcuggcgccggcug

SEQ ID NO: 1210651 - RNA, 21 nt, Human
ggcaggaugagggcugggagu

SEQ ID NO: 1210652 - RNA, 20 nt, Human
ggcugggaacagagggguaa

SEQ ID NO: 1210653 - RNA, 20 nt, Human
ggcuggggcugggaacagaa

SEQ ID NO: 1210654 - RNA, 24 nt, Human
gggccagagugugcccggagaccc

SEQ ID NO: 1210655 - RNA, 26 nt, Human
gucagccccgcccacugcaccccucc

SEQ ID NO: 1210656 - RNA, 18 nt, Human
guccuucugcccugggau

SEQ ID NO: 1210657 - RNA, 23 nt, Human
uacaagccucugggggcuuggca

SEQ ID NO: 1210658 - RNA, 22 nt, Human
uauccugucucucaccuccuuc

SEQ ID NO: 1210659 - RNA, 29 nt, Human
ucacccagacgcuaagcagagacggggac

SEQ ID NO: 1210660 - RNA, 21 nt, Human
ucaccccuagacaccagaaca

SEQ ID NO: 1210661 - RNA, 22 nt, Human
uccacagauaagaccuccaacc

SEQ ID NO: 1210662 - RNA, 22 nt, Human
ucccaacucuuacaagccucug

SEQ ID NO: 1210663 - RNA, 20 nt, Human
ucccagagacccagucccuc

SEQ ID NO: 1210664 - RNA, 26 nt, Human
ucccggaccagccggaguauggcauu

SEQ ID NO: 1210665 - RNA, 20 nt, Human
uccuaucaccuccuccucca

SEQ ID NO: 1210666 - RNA, 20 nt, Human
uccuccacuuccuuccuccu

SEQ ID NO: 1210667 - RNA, 20 nt, Human
uccugucucucaccuccuuc

SEQ ID NO: 1210668 - RNA, 19 nt, Human
uccuucgucccucuccccu

SEQ ID NO: 1210669 - RNA, 26 nt, Human
ucuaucuucccuucuucccucugaag

SEQ ID NO: 1210670 - RNA, 22 nt, Human
ucuccaucccucaucccaacuc

SEQ ID NO: 1210671 - RNA, 22 nt, Human
ucucccagucauugcccagccc

SEQ ID NO: 1210672 - RNA, 26 nt, Human
ucucccuccucuucuucaucgcuccu

SEQ ID NO: 1210673 - RNA, 18 nt, Human
ucucuccuccaucccucu

SEQ ID NO: 1210674 - RNA, 18 nt, Human
ucugccagcugguuccug

SEQ ID NO: 1210675 - RNA, 19 nt, Human
ugccccaucuuggccucag

SEQ ID NO: 1210676 - RNA, 20 nt, Human
ugccguagaggaacagggag

SEQ ID NO: 1210677 - RNA, 18 nt, Human
ugcuucugcugcuccucc

SEQ ID NO: 1210678 - RNA, 20 nt, Human
ugggaacagagggguaaggc

SEQ ID NO: 1210679 - RNA, 23 nt, Human
ugggaagggccagagugugcccg

SEQ ID NO: 1210680 - RNA, 23 nt, Human
uguccaggauucucuuccccgau

SEQ ID NO: 1210681 - RNA, 19 nt, Human
ugucccggaccagccggag

SEQ ID NO: 1210682 - RNA, 27 nt, Human
uguucuccagacucccucucuccucca

SEQ ID NO: 1210683 - RNA, 23 nt, Human
uucccuucuucuggaucacagcc

SEQ ID NO: 1210684 - RNA, 24 nt, Human
uuccucaagcucuuugcucccuca

SEQ ID NO: 1210685 - RNA, 19 nt, Human
uucgucccucuccccucuu

SEQ ID NO: 1210686 - RNA, 22 nt, Human
aaagacacagacuucgaagcca

SEQ ID NO: 1210687 - RNA, 20 nt, Human
aaaucacauaaaaaugaggu

SEQ ID NO: 1210688 - RNA, 18 nt, Human
aagaagcccugcccugcc

SEQ ID NO: 1210689 - RNA, 25 nt, Human
aagagcuaggggugccuuuacuggc

SEQ ID NO: 1210690 - RNA, 20 nt, Human
aagccgggaggaggacagga

SEQ ID NO: 1210691 - RNA, 22 nt, Human
aagccgggaggaggacaggaaa

SEQ ID NO: 1210692 - RNA, 20 nt, Human
acaaccaggcugcccacagu

SEQ ID NO: 1210693 - RNA, 18 nt, Human
acaggcaaagacacagac

SEQ ID NO: 1210694 - RNA, 19 nt, Human
agagcccaucccugcaucc

SEQ ID NO: 1210695 - RNA, 18 nt, Human
agaggaacaugucucugc

SEQ ID NO: 1210696 - RNA, 21 nt, Human
agcccaucccugcauccugcc

SEQ ID NO: 1210697 - RNA, 25 nt, Human
agccggugccacagugcucagcaca

SEQ ID NO: 1210698 - RNA, 21 nt, Human
agccucgcagcccgccgccuc

SEQ ID NO: 1210699 - RNA, 20 nt, Human
aggaacuagaagccaggacc

SEQ ID NO: 1210700 - RNA, 21 nt, Human
aggcagccaccagcacugcca

SEQ ID NO: 1210701 - RNA, 24 nt, Human
aggcaggguggaggccaggaggcg

SEQ ID NO: 1210702 - RNA, 24 nt, Human
aggcggaggggguggacugagggc

SEQ ID NO: 1210703 - RNA, 18 nt, Human
aggcugugccccaccccc

SEQ ID NO: 1210704 - RNA, 22 nt, Human
agggaaaagcuggcugagggcu

SEQ ID NO: 1210705 - RNA, 22 nt, Human
agggcugaccggcacccccaug

SEQ ID NO: 1210706 - RNA, 19 nt, Human
aggggguggacugagggcc

SEQ ID NO: 1210707 - RNA, 20 nt, Human
aguagucggugaggggguac

SEQ ID NO: 1210708 - RNA, 24 nt, Human
auaacauggaagacaccuggacac

SEQ ID NO: 1210709 - RNA, 22 nt, Human
auccucuuccagcccaggcuug

SEQ ID NO: 1210710 - RNA, 21 nt, Human
augaagacgaggaugaugcag

SEQ ID NO: 1210711 - RNA, 21 nt, Human
caaagacacagacuucgaagc

SEQ ID NO: 1210712 - RNA, 23 nt, Human
caaagccuccagacuucuccagg

SEQ ID NO: 1210713 - RNA, 22 nt, Human
cacaaccaggcugcccacaguc

SEQ ID NO: 1210714 - RNA, 20 nt, Human
caccguggacacccaccgcg

SEQ ID NO: 1210715 - RNA, 23 nt, Human
cacugccaccaaauguuuaagga

SEQ ID NO: 1210716 - RNA, 23 nt, Human
cagagcccuccaggagggacagg

SEQ ID NO: 1210717 - RNA, 23 nt, Human
cagcacaguaccagugcuuuguu

SEQ ID NO: 1210718 - RNA, 18 nt, Human
cagcagccgugccuggcg

SEQ ID NO: 1210719 - RNA, 21 nt, Human
cagcagccucugccauccucu

SEQ ID NO: 1210720 - RNA, 22 nt, Human
cagccaggcgcaggaacauccc

SEQ ID NO: 1210721 - RNA, 25 nt, Human
caggagggacagggguuagccaggc

SEQ ID NO: 1210722 - RNA, 18 nt, Human
caggcaguuccugaggga

SEQ ID NO: 1210723 - RNA, 20 nt, Human
caggguggaggccaggaggc

SEQ ID NO: 1210724 - RNA, 21 nt, Human
caggguggaggccaggaggcg

SEQ ID NO: 1210725 - RNA, 23 nt, Human
caggucccagagcccuccaggag

SEQ ID NO: 1210726 - RNA, 18 nt, Human
caguucacagcucaaggg

SEQ ID NO: 1210727 - RNA, 30 nt, Human
cauccgaagugcccacaaccaggcugcccc

SEQ ID NO: 1210728 - RNA, 20 nt, Human
caucguggaggaggcagggu

SEQ ID NO: 1210729 - RNA, 19 nt, Human
caucuucaccuccccaccu

SEQ ID NO: 1210730 - RNA, 22 nt, Human
ccacagugcucagcacaguacc

SEQ ID NO: 1210731 - RNA, 19 nt, Human
ccaccaaaugcccccccuu

SEQ ID NO: 1210732 - RNA, 20 nt, Human
ccagcccucccccggucccc

SEQ ID NO: 1210733 - RNA, 24 nt, Human
ccaggcuuguccaggaagccucug

SEQ ID NO: 1210734 - RNA, 21 nt, Human
ccagggcagaacuggugaugu

SEQ ID NO: 1210735 - RNA, 22 nt, Human
ccagggcagaacuggugauguu

SEQ ID NO: 1210736 - RNA, 19 nt, Human
cccacaaccaggcugccca

SEQ ID NO: 1210737 - RNA, 24 nt, Human
cccacaaccaggcugcccacaguc

SEQ ID NO: 1210738 - RNA, 22 nt, Human
cccacccccuuccgucccccca

SEQ ID NO: 1210739 - RNA, 23 nt, Human
cccagcagccucugccauccucu

SEQ ID NO: 1210740 - RNA, 19 nt, Human
cccaggcuuguccaggaag

SEQ ID NO: 1210741 - RNA, 18 nt, Human
cccagggaaaagcuggcu

SEQ ID NO: 1210742 - RNA, 22 nt, Human
cccaugacugugccugaguucc

SEQ ID NO: 1210743 - RNA, 22 nt, Human
ccccacccccuuccgucccccc

SEQ ID NO: 1210744 - RNA, 18 nt, Human
ccccaggaacuagaagcc

SEQ ID NO: 1210745 - RNA, 20 nt, Human
ccccaggaggcugccugacc

SEQ ID NO: 1210746 - RNA, 24 nt, Human
ccccaggaggcugccugacccucu

SEQ ID NO: 1210747 - RNA, 22 nt, Human
ccccaggguauggaagccaggg

SEQ ID NO: 1210748 - RNA, 22 nt, Human
cccccaggaggcugccugaccc

SEQ ID NO: 1210749 - RNA, 18 nt, Human
cccccaugacugugccug

SEQ ID NO: 1210750 - RNA, 22 nt, Human
ccccccaggaggcugccugacc

SEQ ID NO: 1210751 - RNA, 24 nt, Human
ccccccaggaggcugccugacccu

SEQ ID NO: 1210752 - RNA, 18 nt, Human
cccccccuucccauucac

SEQ ID NO: 1210753 - RNA, 22 nt, Human
cccggaguuggauacaaacauc

SEQ ID NO: 1210754 - RNA, 21 nt, Human
cccuccaggagggacaggggu

SEQ ID NO: 1210755 - RNA, 23 nt, Human
ccggugccacagugcucagcaca

SEQ ID NO: 1210756 - RNA, 21 nt, Human
ccguggacacccaccgcggga

SEQ ID NO: 1210757 - RNA, 23 nt, Human
ccuccugcccucccaucccacca

SEQ ID NO: 1210758 - RNA, 22 nt, Human
ccuccuggccccugucccaggc

SEQ ID NO: 1210759 - RNA, 19 nt, Human
ccucuaagugacucgaguu

SEQ ID NO: 1210760 - RNA, 19 nt, Human
ccugaagccgggaggagga

SEQ ID NO: 1210761 - RNA, 22 nt, Human
ccugccugcugagggcgagaau

SEQ ID NO: 1210762 - RNA, 22 nt, Human
ccuuuguagccccacauugccc

SEQ ID NO: 1210763 - RNA, 19 nt, Human
cgaagccagagaccagcgc

SEQ ID NO: 1210764 - RNA, 28 nt, Human
cgagagagguaaaggggccuguccaggu

SEQ ID NO: 1210765 - RNA, 24 nt, Human
cgcagcccgccgccuccugcccuc

SEQ ID NO: 1210766 - RNA, 24 nt, Human
cgcuggccucggccuuugaaaggc

SEQ ID NO: 1210767 - RNA, 19 nt, Human
cguggaggaggcagggucg

SEQ ID NO: 1210768 - RNA, 18 nt, Human
cgugugccucgccgaugc

SEQ ID NO: 1210769 - RNA, 18 nt, Human
cuccaucuucaccucccc

SEQ ID NO: 1210770 - RNA, 18 nt, Human
cuccugcccucccauccc

SEQ ID NO: 1210771 - RNA, 25 nt, Human
cugaaaccucucagcccucaacugg

SEQ ID NO: 1210772 - RNA, 22 nt, Human
cugcauccugccucccacauug

SEQ ID NO: 1210773 - RNA, 20 nt, Human
cugccauccucuuccagccc

SEQ ID NO: 1210774 - RNA, 21 nt, Human
cugcccacagucucggcaagg

SEQ ID NO: 1210775 - RNA, 18 nt, Human
cugcccccuugcuguacu

SEQ ID NO: 1210776 - RNA, 23 nt, Human
cuggcacagcugugauggagcag

SEQ ID NO: 1210777 - RNA, 19 nt, Human
cugggcuggagcugcaugg

SEQ ID NO: 1210778 - RNA, 23 nt, Human
cugugccccacccccuuccgucc

SEQ ID NO: 1210779 - RNA, 27 nt, Human
gaacucagaaagcuucagccaggcggu

SEQ ID NO: 1210780 - RNA, 18 nt, Human
gacacagacuucgaagcc

SEQ ID NO: 1210781 - RNA, 18 nt, Human
gacccucucucuuccaag

SEQ ID NO: 1210782 - RNA, 19 nt, Human
gagaccagcgccggagcug

SEQ ID NO: 1210783 - RNA, 25 nt, Human
gcacagagugaguccucccaaccug

SEQ ID NO: 1210784 - RNA, 20 nt, Human
gcagcccgccgccuccugcc

SEQ ID NO: 1210785 - RNA, 19 nt, Human
gccaggcgcaggaacaucc

SEQ ID NO: 1210786 - RNA, 21 nt, Human
gccccacccccuuccgucccc

SEQ ID NO: 1210787 - RNA, 25 nt, Human
gccccacccccuuccguccccccag

SEQ ID NO: 1210788 - RNA, 21 nt, Human
gcccgccgccuccugcccucc

SEQ ID NO: 1210789 - RNA, 20 nt, Human
gcccggaguuggauacaaac

SEQ ID NO: 1210790 - RNA, 18 nt, Human
gcccugcccugccccaac

SEQ ID NO: 1210791 - RNA, 21 nt, Human
gccgaugcccugcacuuuucc

SEQ ID NO: 1210792 - RNA, 20 nt, Human
gccuuagcugccccaggaac

SEQ ID NO: 1210793 - RNA, 20 nt, Human
gcucaaugacagcuccgugc

SEQ ID NO: 1210794 - RNA, 19 nt, Human
gcuggaaggugaccguucc

SEQ ID NO: 1210795 - RNA, 22 nt, Human
gcugggcuggagcugcaugggu

SEQ ID NO: 1210796 - RNA, 23 nt, Human
ggaacaucccagggaaaagcugg

SEQ ID NO: 1210797 - RNA, 24 nt, Human
ggaagccucugggucuaauggugc

SEQ ID NO: 1210798 - RNA, 23 nt, Human
ggacccucucucuuccaaggccc

SEQ ID NO: 1210799 - RNA, 19 nt, Human
ggagcaccagcccuccccc

SEQ ID NO: 1210800 - RNA, 23 nt, Human
ggaggccaggaggcggagggggu

SEQ ID NO: 1210801 - RNA, 19 nt, Human
ggcgcaggaacaucccagg

SEQ ID NO: 1210802 - RNA, 18 nt, Human
ggcuggagcugcaugggu

SEQ ID NO: 1210803 - RNA, 19 nt, Human
gggcuggagcugcaugggu

SEQ ID NO: 1210804 - RNA, 19 nt, Human
ggggccuguccagguccca

SEQ ID NO: 1210805 - RNA, 18 nt, Human
ggggcgucaugucugaaa

SEQ ID NO: 1210806 - RNA, 24 nt, Human
ggguguuuccuccuggccccuguc

SEQ ID NO: 1210807 - RNA, 25 nt, Human
guccaaggggccccaggagccuggg

SEQ ID NO: 1210808 - RNA, 20 nt, Human
gugcagccccgcaucagccu

SEQ ID NO: 1210809 - RNA, 21 nt, Human
uaaaggggccuguccaggucc

SEQ ID NO: 1210810 - RNA, 19 nt, Human
uagaagccaggacccucuc

SEQ ID NO: 1210811 - RNA, 18 nt, Human
ucagcacaguaccagugc

SEQ ID NO: 1210812 - RNA, 21 nt, Human
ucagguccaaggggccccagg

SEQ ID NO: 1210813 - RNA, 23 nt, Human
uccaagaggcucaaugacagcuc

SEQ ID NO: 1210814 - RNA, 18 nt, Human
uccgaagugcccacaacc

SEQ ID NO: 1210815 - RNA, 19 nt, Human
uccguccccccaggaggcu

SEQ ID NO: 1210816 - RNA, 21 nt, Human
uccuccuggccccugucccag

SEQ ID NO: 1210817 - RNA, 18 nt, Human
ucucggcaaggcuuucag

SEQ ID NO: 1210818 - RNA, 18 nt, Human
ucuucaccuccccaccuc

SEQ ID NO: 1210819 - RNA, 18 nt, Human
ugaccguuccauuucccc

SEQ ID NO: 1210820 - RNA, 24 nt, Human
ugagggcuucccuaaugcaggggu

SEQ ID NO: 1210821 - RNA, 19 nt, Human
ugaggugggaggagugcag

SEQ ID NO: 1210822 - RNA, 20 nt, Human
ugaggugggaggagugcagu

SEQ ID NO: 1210823 - RNA, 25 nt, Human
ugaggugggaggagugcaguggaca

SEQ ID NO: 1210824 - RNA, 21 nt, Human
ugccacagugcucagcacagu

SEQ ID NO: 1210825 - RNA, 22 nt, Human
ugcccacaaccaggcugcccac

SEQ ID NO: 1210826 - RNA, 21 nt, Human
ugccccaaccucaugggaucc

SEQ ID NO: 1210827 - RNA, 25 nt, Human
ugccccaaccucaugggauccugcu

SEQ ID NO: 1210828 - RNA, 23 nt, Human
ugccccacccccuuccguccccc

SEQ ID NO: 1210829 - RNA, 24 nt, Human
ugccccacccccuuccgucccccc

SEQ ID NO: 1210830 - RNA, 18 nt, Human
ugccccucuacuuucuuc

SEQ ID NO: 1210831 - RNA, 20 nt, Human
ugcccugccccaaccucaug

SEQ ID NO: 1210832 - RNA, 20 nt, Human
ugcccuggggcacuguacac

SEQ ID NO: 1210833 - RNA, 22 nt, Human
ugccucggcuucuucuccaucu

SEQ ID NO: 1210834 - RNA, 25 nt, Human
ugccucggcuucuucuccaucuuca

SEQ ID NO: 1210835 - RNA, 24 nt, Human
ugccuggcgggccuuaguagucgg

SEQ ID NO: 1210836 - RNA, 22 nt, Human
ugccuggguucaagggucagug

SEQ ID NO: 1210837 - RNA, 19 nt, Human
ugcuugucuccgccagcag

SEQ ID NO: 1210838 - RNA, 19 nt, Human
uggaagacaccuggacacu

SEQ ID NO: 1210839 - RNA, 19 nt, Human
uggaaggugaccguuccau

SEQ ID NO: 1210840 - RNA, 23 nt, Human
uggacagggagcgccagcagguc

SEQ ID NO: 1210841 - RNA, 21 nt, Human
uggagcauccaggagcccagc

SEQ ID NO: 1210842 - RNA, 22 nt, Human
uggauacaaacaucccaagagc

SEQ ID NO: 1210843 - RNA, 19 nt, Human
ugggauccugcguuucagg

SEQ ID NO: 1210844 - RNA, 21 nt, Human
ugucuggcacagcugugaugg

SEQ ID NO: 1210845 - RNA, 21 nt, Human
uguuuaaggaaaauaggcaaa

SEQ ID NO: 1210846 - RNA, 18 nt, Human
uucacagugauuauagaa

SEQ ID NO: 1210847 - RNA, 22 nt, Human
uucagccaggcgcaggaacauc

SEQ ID NO: 1210848 - RNA, 19 nt, Human
uucagggcugaccggcacc

SEQ ID NO: 1210849 - RNA, 19 nt, Human
uuccccaacaugaacucag

SEQ ID NO: 1210850 - RNA, 23 nt, Human
uugaacagccgggccgucuuugc

SEQ ID NO: 1210851 - RNA, 23 nt, Human
uuuaaggaaaauaggcaaagaaa

SEQ ID NO: 1210852 - RNA, 23 nt, Human
uuuccuauuuuacagcuaaggag

SEQ ID NO: 1210853 - RNA, 22 nt, Human
uuuucacagugauuauagaagu

SEQ ID NO: 1210854 - RNA, 24 nt, Human
uuuugcauaagcccuuccugcuag

SEQ ID NO: 1210855 - RNA, 19 nt, Human
aagccugucccagacagcc

SEQ ID NO: 1210856 - RNA, 18 nt, Human
cagaaccuuaagagaaac

SEQ ID NO: 1210857 - RNA, 22 nt, Human
ccagacagccuugcccugcaga

SEQ ID NO: 1210858 - RNA, 22 nt, Human
cugucccagacagccuugcccu

SEQ ID NO: 1210859 - RNA, 21 nt, Human
ucccagacagccuugcccugc

SEQ ID NO: 1210860 - RNA, 19 nt, Human
cccccagcagcagcagcuu

SEQ ID NO: 1210861 - RNA, 20 nt, Human
aaaaaaaaaaaaaaaagcaa

SEQ ID NO: 1210862 - RNA, 25 nt, Human
aaaaaaaaaaaaaaaagcaagacag

SEQ ID NO: 1210863 - RNA, 25 nt, Human
aaaaaaaaaagaaagaaguugagag

SEQ ID NO: 1210864 - RNA, 23 nt, Human
aaaaacaaagaauacauauccca

SEQ ID NO: 1210865 - RNA, 26 nt, Human
aaaaagcaagacagaaaauaacaaag

SEQ ID NO: 1210866 - RNA, 22 nt, Human
aaaaagcuguaacccaaaucuc

SEQ ID NO: 1210867 - RNA, 30 nt, Human
aaaacaaaaacaaaaacaaaaaaaggcaaa

SEQ ID NO: 1210868 - RNA, 21 nt, Human
aaaauaacaaagacuccuuag

SEQ ID NO: 1210869 - RNA, 23 nt, Human
aaacaaaaacaaaaaaaggcaaa

SEQ ID NO: 1210870 - RNA, 25 nt, Human
aaacaagaggugaaacaaagggacc

SEQ ID NO: 1210871 - RNA, 23 nt, Human
aaacauguaauacauuccagagc

SEQ ID NO: 1210872 - RNA, 19 nt, Human
aaaccaaugacuugauccu

SEQ ID NO: 1210873 - RNA, 19 nt, Human
aaagagagagagaauagca

SEQ ID NO: 1210874 - RNA, 20 nt, Human
aaaucacaauguccuucaac

SEQ ID NO: 1210875 - RNA, 21 nt, Human
aacaacccaaauuuuuuaaau

SEQ ID NO: 1210876 - RNA, 24 nt, Human
aagaaaauaaaauaacaggccaag

SEQ ID NO: 1210877 - RNA, 26 nt, Human
aagacagaaaauaacaaaggggaccc

SEQ ID NO: 1210878 - RNA, 20 nt, Human
aagcaaaccaaugacuugau

SEQ ID NO: 1210879 - RNA, 21 nt, Human
aagcaagacagaaaauaacaa

SEQ ID NO: 1210880 - RNA, 23 nt, Human
aagcaagacagaaaauaacaaag

SEQ ID NO: 1210881 - RNA, 24 nt, Human
aagcacaguggcucaugccuguaa

SEQ ID NO: 1210882 - RNA, 22 nt, Human
aaggaauggagcugccucuucu

SEQ ID NO: 1210883 - RNA, 19 nt, Human
aaguugcuuuccucucucu

SEQ ID NO: 1210884 - RNA, 24 nt, Human
aaucgcuugaacccaggaggcaga

SEQ ID NO: 1210885 - RNA, 21 nt, Human
aaucuacaaacauacuacccu

SEQ ID NO: 1210886 - RNA, 21 nt, Human
acaaaacaaaaacaaaaacaa

SEQ ID NO: 1210887 - RNA, 21 nt, Human
acaaagacuccuuagcccaaa

SEQ ID NO: 1210888 - RNA, 18 nt, Human
acaaucucacuuccucau

SEQ ID NO: 1210889 - RNA, 18 nt, Human
acaccacugcacuccagc

SEQ ID NO: 1210890 - RNA, 20 nt, Human
acaccacugcacuccagccu

SEQ ID NO: 1210891 - RNA, 23 nt, Human
acagagugagacucugccucaaa

SEQ ID NO: 1210892 - RNA, 24 nt, Human
acagagugagacucugccucaaaa

SEQ ID NO: 1210893 - RNA, 22 nt, Human
acaucaggaagccacaagcucc

SEQ ID NO: 1210894 - RNA, 20 nt, Human
accaaugacuugauccuacc

SEQ ID NO: 1210895 - RNA, 21 nt, Human
accacaaaaguuaacaagcag

SEQ ID NO: 1210896 - RNA, 23 nt, Human
accacaaacccauauaguaaacu

SEQ ID NO: 1210897 - RNA, 21 nt, Human
accacauguaaaaacuucagc

SEQ ID NO: 1210898 - RNA, 24 nt, Human
acccaggaggcagagguugcagug

SEQ ID NO: 1210899 - RNA, 24 nt, Human
accccgucucuacuaaaaacacaa

SEQ ID NO: 1210900 - RNA, 23 nt, Human
acuccagccuggcgacagaguga

SEQ ID NO: 1210901 - RNA, 23 nt, Human
acuccauaagccccccacuaaaa

SEQ ID NO: 1210902 - RNA, 20 nt, Human
acuccuugugggucuucuua

SEQ ID NO: 1210903 - RNA, 28 nt, Human
acucugccucaaaaaaaaaaaaaaaaaa

SEQ ID NO: 1210904 - RNA, 23 nt, Human
acugcacuccagccuggcgacag

SEQ ID NO: 1210905 - RNA, 25 nt, Human
acugcacuccagccuggcgacagag

SEQ ID NO: 1210906 - RNA, 18 nt, Human
agaaaauaacaaagacuc

SEQ ID NO: 1210907 - RNA, 25 nt, Human
agaaaucaacaaaguuuugaaaaac

SEQ ID NO: 1210908 - RNA, 18 nt, Human
agaauuucuucauucaau

SEQ ID NO: 1210909 - RNA, 23 nt, Human
agaauuucuucauucaauuacag

SEQ ID NO: 1210910 - RNA, 18 nt, Human
agagcucaugagguagca

SEQ ID NO: 1210911 - RNA, 20 nt, Human
agagguugcagugagccaag

SEQ ID NO: 1210912 - RNA, 23 nt, Human
agagguugcagugagccaagauc

SEQ ID NO: 1210913 - RNA, 24 nt, Human
agagguugcagugagccaagauca

SEQ ID NO: 1210914 - RNA, 21 nt, Human
agccuggcgacagagugagac

SEQ ID NO: 1210915 - RNA, 23 nt, Human
agccuggcgacagagugagacuc

SEQ ID NO: 1210916 - RNA, 23 nt, Human
agcugggugugguggcgcaugcc

SEQ ID NO: 1210917 - RNA, 24 nt, Human
aggcagagguugcagugagccaag

SEQ ID NO: 1210918 - RNA, 24 nt, Human
aggcagguggaucacgaggucagg

SEQ ID NO: 1210919 - RNA, 21 nt, Human
aggccgaggcagguggaucac

SEQ ID NO: 1210920 - RNA, 24 nt, Human
aggcugaggcacaagaaucgcuug

SEQ ID NO: 1210921 - RNA, 25 nt, Human
agguggaucacgaggucaggggauu

SEQ ID NO: 1210922 - RNA, 23 nt, Human
aguggcucaugccuguaauccca

SEQ ID NO: 1210923 - RNA, 24 nt, Human
aucacaccacugcacuccagccug

SEQ ID NO: 1210924 - RNA, 21 nt, Human
auccuggccaaaauggugaaa

SEQ ID NO: 1210925 - RNA, 19 nt, Human
augagguagcaaaaagaga

SEQ ID NO: 1210926 - RNA, 22 nt, Human
augauuaaggcuauaaaagaac

SEQ ID NO: 1210927 - RNA, 19 nt, Human
augccuguaaucccaacac

SEQ ID NO: 1210928 - RNA, 20 nt, Human
auuagcugggugugguggcc

SEQ ID NO: 1210929 - RNA, 18 nt, Human
auuuuugucucucauaau

SEQ ID NO: 1210930 - RNA, 24 nt, Human
caaaaacaaaaacaaaaaaaggcc

SEQ ID NO: 1210931 - RNA, 24 nt, Human
caaaaagagagagagaauagcacc

SEQ ID NO: 1210932 - RNA, 24 nt, Human
caaaauggugaaaccccgucucua

SEQ ID NO: 1210933 - RNA, 24 nt, Human
caaagcaaaccaaugacuugaucc

SEQ ID NO: 1210934 - RNA, 25 nt, Human
caaauaaguaaacaaaaaaagacca

SEQ ID NO: 1210935 - RNA, 24 nt, Human
caacacuuugggaggccgaggcag

SEQ ID NO: 1210936 - RNA, 25 nt, Human
caacacuuugggaggccgaggcagg

SEQ ID NO: 1210937 - RNA, 20 nt, Human
caacguacucccuuaccacg

SEQ ID NO: 1210938 - RNA, 25 nt, Human
caaucuacaaacauacuacccugca

SEQ ID NO: 1210939 - RNA, 22 nt, Human
cacaaacccauauaguaaacua

SEQ ID NO: 1210940 - RNA, 21 nt, Human
cacaccacugcacuccagccu

SEQ ID NO: 1210941 - RNA, 25 nt, Human
caccacugcacuccagccuggcgac

SEQ ID NO: 1210942 - RNA, 25 nt, Human
cacgacugaguauucacagagcacc

SEQ ID NO: 1210943 - RNA, 21 nt, Human
cacuccagccuggcgacagag

SEQ ID NO: 1210944 - RNA, 21 nt, Human
cacuccagccuggcgacagag

SEQ ID NO: 1210945 - RNA, 22 nt, Human
cacuccagccuggcgacagagu

SEQ ID NO: 1210946 - RNA, 23 nt, Human
cacuccagccuggcgacagagug

SEQ ID NO: 1210947 - RNA, 18 nt, Human
cacugcacuccagccugg

SEQ ID NO: 1210948 - RNA, 18 nt, Human
cacugcacuccagccugg

SEQ ID NO: 1210949 - RNA, 18 nt, Human
cacugcacuccagccugg

SEQ ID NO: 1210950 - RNA, 23 nt, Human
cacugcacuccagccuggcgaca

SEQ ID NO: 1210951 - RNA, 24 nt, Human
cacugcacuccagccuggcgacag

SEQ ID NO: 1210952 - RNA, 22 nt, Human
cacuggaaauguaaacugccgg

SEQ ID NO: 1210953 - RNA, 20 nt, Human
cacuguacuuaauacuuuaa

SEQ ID NO: 1210954 - RNA, 22 nt, Human
cagccaaaauuaguuccucauu

SEQ ID NO: 1210955 - RNA, 23 nt, Human
caggccaagcacaguggcucaug

SEQ ID NO: 1210956 - RNA, 19 nt, Human
cagucauuuaaaaagcaag

SEQ ID NO: 1210957 - RNA, 21 nt, Human
cagucccaaaguaccgugagg

SEQ ID NO: 1210958 - RNA, 23 nt, Human
cauauggcccaacagugccuacc

SEQ ID NO: 1210959 - RNA, 24 nt, Human
caugccuguaaucccaacacuuug

SEQ ID NO: 1210960 - RNA, 19 nt, Human
ccacugcacuccagccugg

SEQ ID NO: 1210961 - RNA, 19 nt, Human
ccacugcacuccagccugg

SEQ ID NO: 1210962 - RNA, 19 nt, Human
ccacugcacuccagccugg

SEQ ID NO: 1210963 - RNA, 20 nt, Human
ccacugcacuccagccuggc

SEQ ID NO: 1210964 - RNA, 23 nt, Human
ccacugcacuccagccuggcgac

SEQ ID NO: 1210965 - RNA, 22 nt, Human
ccagagcaaagaugaaucaaaa

SEQ ID NO: 1210966 - RNA, 23 nt, Human
cccaacagugccuacccuccuac

SEQ ID NO: 1210967 - RNA, 23 nt, Human
ccccaaguagccugaaguaacag

SEQ ID NO: 1210968 - RNA, 23 nt, Human
cccccacuaaaaaccuguaaaga

SEQ ID NO: 1210969 - RNA, 18 nt, Human
ccucagacaaccacaaaa

SEQ ID NO: 1210970 - RNA, 21 nt, Human
ccucagacaaccacaaaaguu

SEQ ID NO: 1210971 - RNA, 19 nt, Human
ccuccagaagugucguuuu

SEQ ID NO: 1210972 - RNA, 19 nt, Human
ccuccagaagugucguuuu

SEQ ID NO: 1210973 - RNA, 21 nt, Human
ccuccagaagugucguuuugu

SEQ ID NO: 1210974 - RNA, 23 nt, Human
ccuccuacaaaacaaaaacaaaa

SEQ ID NO: 1210975 - RNA, 26 nt, Human
ccuccuacaaaacaaaaacaaaaacc

SEQ ID NO: 1210976 - RNA, 23 nt, Human
ccuggccaaaauggugaaacccc

SEQ ID NO: 1210977 - RNA, 24 nt, Human
ccuggccaaaauggugaaaccccg

SEQ ID NO: 1210978 - RNA, 21 nt, Human
ccuggcgacagagugagacuc

SEQ ID NO: 1210979 - RNA, 22 nt, Human
ccuguaaucccaacacuuuggg

SEQ ID NO: 1210980 - RNA, 20 nt, Human
ccuguaaucccagcuacucg

SEQ ID NO: 1210981 - RNA, 22 nt, Human
ccuguaaucccagcuacucgag

SEQ ID NO: 1210982 - RNA, 27 nt, Human
cgagaggcugaggcacaagaaucgcuu

SEQ ID NO: 1210983 - RNA, 24 nt, Human
cgaggcagguggaucacgagguca

SEQ ID NO: 1210984 - RNA, 21 nt, Human
cuaaagucuuuacugaugauc

SEQ ID NO: 1210985 - RNA, 24 nt, Human
cucaugccuguaaucccaacacuu

SEQ ID NO: 1210986 - RNA, 24 nt, Human
cuccagccuggcgacagagugaga

SEQ ID NO: 1210987 - RNA, 24 nt, Human
cucccuuaccacgaaggacuucau

SEQ ID NO: 1210988 - RNA, 19 nt, Human
cucugccucaaaaaaaaaa

SEQ ID NO: 1210989 - RNA, 22 nt, Human
cucugccucaaaaaaaaaaaaa

SEQ ID NO: 1210990 - RNA, 18 nt, Human
cugucuuuaggugacucu

SEQ ID NO: 1210991 - RNA, 18 nt, Human
cuuacaguuucccuuuag

SEQ ID NO: 1210992 - RNA, 24 nt, Human
gaagccacaagcuccacuucauuu

SEQ ID NO: 1210993 - RNA, 20 nt, Human
gaaugggauguuuccugucu

SEQ ID NO: 1210994 - RNA, 22 nt, Human
gaccugcaaaauagucccccuc

SEQ ID NO: 1210995 - RNA, 24 nt, Human
gagcaaagaugaaucaaaaaguau

SEQ ID NO: 1210996 - RNA, 18 nt, Human
gaggcugguuuccauggc

SEQ ID NO: 1210997 - RNA, 21 nt, Human
gaggggauaauuuuugucucu

SEQ ID NO: 1210998 - RNA, 18 nt, Human
gauacggaucuaacaacc

SEQ ID NO: 1210999 - RNA, 20 nt, Human
gaucucuaucuucaaaucuc

SEQ ID NO: 1211000 - RNA, 21 nt, Human
gauuggccucagacaaccaca

SEQ ID NO: 1211001 - RNA, 23 nt, Human
gcaagacagaaaauaacaaagac

SEQ ID NO: 1211002 - RNA, 22 nt, Human
gcacuccagccuggcgacagag

SEQ ID NO: 1211003 - RNA, 18 nt, Human
gcagcaaaguuucaaguu

SEQ ID NO: 1211004 - RNA, 24 nt, Human
gccaaaauggugaaaccccgucuc

SEQ ID NO: 1211005 - RNA, 20 nt, Human
gccaagaucacaccacugca

SEQ ID NO: 1211006 - RNA, 18 nt, Human
gcuuucaguggguuccug

SEQ ID NO: 1211007 - RNA, 22 nt, Human
ggaggcagagguugcagugagc

SEQ ID NO: 1211008 - RNA, 18 nt, Human
ggccaaaauggugaaacc

SEQ ID NO: 1211009 - RNA, 19 nt, Human
ggcgacagagugagacucu

SEQ ID NO: 1211010 - RNA, 18 nt, Human
ggcugguuuccauggcug

SEQ ID NO: 1211011 - RNA, 24 nt, Human
gguggcgcaugccuguaaucccag

SEQ ID NO: 1211012 - RNA, 24 nt, Human
gguguggcaaacauucaaaauucu

SEQ ID NO: 1211013 - RNA, 23 nt, Human
ggugugguggcgcaugccuguaa

SEQ ID NO: 1211014 - RNA, 20 nt, Human
gguuaacagaagaggcuagg

SEQ ID NO: 1211015 - RNA, 20 nt, Human
guaaguauacgcccuauacu

SEQ ID NO: 1211016 - RNA, 21 nt, Human
guaauauggaaacuuccugaa

SEQ ID NO: 1211017 - RNA, 22 nt, Human
gucacauggaaaacacaaagca

SEQ ID NO: 1211018 - RNA, 23 nt, Human
guggcgcaugccuguaaucccag

SEQ ID NO: 1211019 - RNA, 18 nt, Human
gugugguggcgcaugccu

SEQ ID NO: 1211020 - RNA, 20 nt, Human
uaaaagaacacgacugagua

SEQ ID NO: 1211021 - RNA, 18 nt, Human
uaaaauaacaggccaagc

SEQ ID NO: 1211022 - RNA, 23 nt, Human
uaacaaagacuccuuagcccaaa

SEQ ID NO: 1211023 - RNA, 22 nt, Human
uaacagaagaggcuaggccaaa

SEQ ID NO: 1211024 - RNA, 23 nt, Human
uaaccagauucgcucaucugugg

SEQ ID NO: 1211025 - RNA, 19 nt, Human
uaacucacagcugaaagug

SEQ ID NO: 1211026 - RNA, 24 nt, Human
uaagauguuccccaaguagccuga

SEQ ID NO: 1211027 - RNA, 22 nt, Human
uaagccccccacuaaaaaccug

SEQ ID NO: 1211028 - RNA, 22 nt, Human
uaaguuauccaaacacaacuga

SEQ ID NO: 1211029 - RNA, 23 nt, Human
uaaguucccuuucuaaacgaggc

SEQ ID NO: 1211030 - RNA, 22 nt, Human
uacaaaacaaaaacaaaaacaa

SEQ ID NO: 1211031 - RNA, 19 nt, Human
uacaagaaggcccagccaa

SEQ ID NO: 1211032 - RNA, 21 nt, Human
uaccacgaaggacuucauuca

SEQ ID NO: 1211033 - RNA, 23 nt, Human
uaccagcaagacuaaagaaaaua

SEQ ID NO: 1211034 - RNA, 23 nt, Human
uacccuccuacaaaacaaaaaca

SEQ ID NO: 1211035 - RNA, 25 nt, Human
uacccuccuacaaaacaaaaacaaa

SEQ ID NO: 1211036 - RNA, 18 nt, Human
uacuccauaagcccccca

SEQ ID NO: 1211037 - RNA, 25 nt, Human
uacuccauaagccccccacuaaaaa

SEQ ID NO: 1211038 - RNA, 23 nt, Human
uacucucauugcucaaguugcuu

SEQ ID NO: 1211039 - RNA, 19 nt, Human
uagcaaaaagagagagaga

SEQ ID NO: 1211040 - RNA, 22 nt, Human
uagcagcugaugacugggaugc

SEQ ID NO: 1211041 - RNA, 19 nt, Human
uagcccaaauuguaccagc

SEQ ID NO: 1211042 - RNA, 21 nt, Human
uagcccaaauuguaccagcaa

SEQ ID NO: 1211043 - RNA, 25 nt, Human
uaucuucaaaucucugagagcccaa

SEQ ID NO: 1211044 - RNA, 22 nt, Human
ucaaaaaaaaaaaaaaaaaaaa

SEQ ID NO: 1211045 - RNA, 23 nt, Human
ucaaaaaaaaaaaaaaaaaaaaa

SEQ ID NO: 1211046 - RNA, 19 nt, Human
ucaaaaaaaaaagaaagaa

SEQ ID NO: 1211047 - RNA, 18 nt, Human
ucaaaauucuccuucaaa

SEQ ID NO: 1211048 - RNA, 19 nt, Human
ucaaaggaauggagcugcc

SEQ ID NO: 1211049 - RNA, 23 nt, Human
ucaaguugugcaauuaaauaaua

SEQ ID NO: 1211050 - RNA, 22 nt, Human
ucacaacacaccugcgaggaca

SEQ ID NO: 1211051 - RNA, 23 nt, Human
ucacaccacugcacuccagccug

SEQ ID NO: 1211052 - RNA, 24 nt, Human
ucacgaggucaggggauugagacc

SEQ ID NO: 1211053 - RNA, 24 nt, Human
ucagcgguguggcaaacauucaaa

SEQ ID NO: 1211054 - RNA, 20 nt, Human
uccacauuuuguaauagaau

SEQ ID NO: 1211055 - RNA, 18 nt, Human
uccagagcaaagaugaau

SEQ ID NO: 1211056 - RNA, 22 nt, Human
uccagccuggcgacagagugag

SEQ ID NO: 1211057 - RNA, 23 nt, Human
uccagccuggcgacagagugaga

SEQ ID NO: 1211058 - RNA, 19 nt, Human
uccauggcugugacaagag

SEQ ID NO: 1211059 - RNA, 18 nt, Human
ucccccucacaaugagau

SEQ ID NO: 1211060 - RNA, 23 nt, Human
uccugaaauacuccauaagcccc

SEQ ID NO: 1211061 - RNA, 20 nt, Human
ucuacaaacauacuacccuu

SEQ ID NO: 1211062 - RNA, 21 nt, Human
ucucuacuaaaaacacaaaaa

SEQ ID NO: 1211063 - RNA, 22 nt, Human
ucugacaggcuuuagcugccag

SEQ ID NO: 1211064 - RNA, 24 nt, Human
ucuggaaggcuuuuaaccccuucu

SEQ ID NO: 1211065 - RNA, 23 nt, Human
ucuucacaacacaccugcgagga

SEQ ID NO: 1211066 - RNA, 18 nt, Human
ucuuugcccuucuacuuc

SEQ ID NO: 1211067 - RNA, 20 nt, Human
ucuuuuugcucaggaaaaga

SEQ ID NO: 1211068 - RNA, 18 nt, Human
ugaaauacuccauaagcc

SEQ ID NO: 1211069 - RNA, 21 nt, Human
ugaaauacuccauaagccccu

SEQ ID NO: 1211070 - RNA, 19 nt, Human
ugacacaucaggaagccac

SEQ ID NO: 1211071 - RNA, 20 nt, Human
ugacaggcuuuagcugccag

SEQ ID NO: 1211072 - RNA, 19 nt, Human
ugaccagagucaaaucaca

SEQ ID NO: 1211073 - RNA, 23 nt, Human
ugacuugauccuaccaacucuaa

SEQ ID NO: 1211074 - RNA, 24 nt, Human
ugagaccauccuggccaaaauggu

SEQ ID NO: 1211075 - RNA, 19 nt, Human
ugaggaccugcaaaauagu

SEQ ID NO: 1211076 - RNA, 24 nt, Human
ugaggcacaagaaucgcuugaacc

SEQ ID NO: 1211077 - RNA, 25 nt, Human
ugagguagcaaaaagagagagagaa

SEQ ID NO: 1211078 - RNA, 23 nt, Human
ugaggugcagcaguuaacagccc

SEQ ID NO: 1211079 - RNA, 22 nt, Human
ugaguccacauuuuguaauaga

SEQ ID NO: 1211080 - RNA, 21 nt, Human
ugcaaaauagucccccucaca

SEQ ID NO: 1211081 - RNA, 23 nt, Human
ugccuguaaucccaacacuuugg

SEQ ID NO: 1211082 - RNA, 23 nt, Human
ugccuguaaucccaacacuuugg

SEQ ID NO: 1211083 - RNA, 22 nt, Human
ugccuguaaucccagcuacucg

SEQ ID NO: 1211084 - RNA, 23 nt, Human
ugccuguaaucccagcuacucga

SEQ ID NO: 1211085 - RNA, 19 nt, Human
uggaaggcuuuuaaccccu

SEQ ID NO: 1211086 - RNA, 23 nt, Human
uggaaugggauguuuccugucuu

SEQ ID NO: 1211087 - RNA, 20 nt, Human
uggagucaaaggaauggagc

SEQ ID NO: 1211088 - RNA, 21 nt, Human
uggcgcaugccuguaauccca

SEQ ID NO: 1211089 - RNA, 22 nt, Human
uggcgcaugccuguaaucccag

SEQ ID NO: 1211090 - RNA, 24 nt, Human
uggcucaugccuguaaucccaaca

SEQ ID NO: 1211091 - RNA, 24 nt, Human
ugggaggccgaggcagguggauca

SEQ ID NO: 1211092 - RNA, 18 nt, Human
ugggauguuuccugucuu

SEQ ID NO: 1211093 - RNA, 18 nt, Human
ugggugugguggcgcaug

SEQ ID NO: 1211094 - RNA, 20 nt, Human
uggguuccuguaacaccauc

SEQ ID NO: 1211095 - RNA, 20 nt, Human
ugguccaggccagcuccacu

SEQ ID NO: 1211096 - RNA, 24 nt, Human
ugguggcgcaugccuguaauccca

SEQ ID NO: 1211097 - RNA, 21 nt, Human
uguaaagaguuuuucuugccu

SEQ ID NO: 1211098 - RNA, 25 nt, Human
uguaaagaguuuuucuugccucuga

SEQ ID NO: 1211099 - RNA, 20 nt, Human
uguaaauugaugacacuguu

SEQ ID NO: 1211100 - RNA, 23 nt, Human
ugucuuugcccuucuacuuccuc

SEQ ID NO: 1211101 - RNA, 18 nt, Human
uguggccuccagaagugu

SEQ ID NO: 1211102 - RNA, 18 nt, Human
uuaaagaaggcagguguc

SEQ ID NO: 1211103 - RNA, 20 nt, Human
uuaaagaaggcaggugucug

SEQ ID NO: 1211104 - RNA, 18 nt, Human
uuaacauuugaaacaagu

SEQ ID NO: 1211105 - RNA, 20 nt, Human
uuagcugggugugguggcgc

SEQ ID NO: 1211106 - RNA, 23 nt, Human
uuagcugggugugguggcgcaug

SEQ ID NO: 1211107 - RNA, 24 nt, Human
uuagcugggugugguggcgcaugc

SEQ ID NO: 1211108 - RNA, 25 nt, Human
uuccccaaguagccugaaguaacag

SEQ ID NO: 1211109 - RNA, 24 nt, Human
uucgaagaauaaaaagcuguaacc

SEQ ID NO: 1211110 - RNA, 18 nt, Human
uucuggaaggcuuuuaac

SEQ ID NO: 1211111 - RNA, 20 nt, Human
uugcagugagccaagaucac

SEQ ID NO: 1211112 - RNA, 22 nt, Human
uuggccucagacaaccacaaaa

SEQ ID NO: 1211113 - RNA, 25 nt, Human
uugggaggccgaggcagguggauca

SEQ ID NO: 1211114 - RNA, 24 nt, Human
uuuccugucuuuaggugacucuuc

SEQ ID NO: 1211115 - RNA, 26 nt, Human
auccccuguccaacaccuucucacca

SEQ ID NO: 1211116 - RNA, 20 nt, Human
cagaggaugccucagauucc

SEQ ID NO: 1211117 - RNA, 22 nt, Human
ccaaaagcucccguuuggcugg

SEQ ID NO: 1211118 - RNA, 19 nt, Human
ccaauccccuguccaacac

SEQ ID NO: 1211119 - RNA, 24 nt, Human
gagccugucccacacugucaggcc

SEQ ID NO: 1211120 - RNA, 26 nt, Human
gccugucccacacugucaggcccuga

SEQ ID NO: 1211121 - RNA, 21 nt, Human
ggaaagaagagccugucccac

SEQ ID NO: 1211122 - RNA, 21 nt, Human
guggagucagaggaugccuca

SEQ ID NO: 1211123 - RNA, 18 nt, Human
ucccacacugucaggccc

SEQ ID NO: 1211124 - RNA, 22 nt, Human
uggaggcagacccuguggcucu

SEQ ID NO: 1211125 - RNA, 18 nt, Human
ugggaaagaagagccugu

SEQ ID NO: 1211126 - RNA, 25 nt, Human
ugucaagagcucccuaauuuuggga

SEQ ID NO: 1211127 - RNA, 19 nt, Human
aaaaagcacaugcaccaca

SEQ ID NO: 1211128 - RNA, 19 nt, Human
aagcuggcaugaaugccau

SEQ ID NO: 1211129 - RNA, 24 nt, Human
agacaaaaaagagauaaucucuug

SEQ ID NO: 1211130 - RNA, 20 nt, Human
agcacaugcaccacaaaggu

SEQ ID NO: 1211131 - RNA, 23 nt, Human
auuaaaaagcacaugcaccacaa

SEQ ID NO: 1211132 - RNA, 18 nt, Human
caacuuuauugagaaacu

SEQ ID NO: 1211133 - RNA, 20 nt, Human
cacauauaccauggcaagac

SEQ ID NO: 1211134 - RNA, 20 nt, Human
cacugccaugaaagugcaaa

SEQ ID NO: 1211135 - RNA, 19 nt, Human
caucuccuccagcagcuuc

SEQ ID NO: 1211136 - RNA, 21 nt, Human
ccagcagcuucucaggcuucu

SEQ ID NO: 1211137 - RNA, 22 nt, Human
ccauuugccacccacauauacc

SEQ ID NO: 1211138 - RNA, 22 nt, Human
cugaagcacauuuggaaucuau

SEQ ID NO: 1211139 - RNA, 18 nt, Human
cugccaugaaagugcaaa

SEQ ID NO: 1211140 - RNA, 18 nt, Human
cuuuguagagcugcccuc

SEQ ID NO: 1211141 - RNA, 21 nt, Human
gagcagucacucugaagcugg

SEQ ID NO: 1211142 - RNA, 22 nt, Human
gcugaagcacauuuggaaucua

SEQ ID NO: 1211143 - RNA, 22 nt, Human
gcugggugcagugauccuuggg

SEQ ID NO: 1211144 - RNA, 19 nt, Human
uaaauuauacaacagcuga

SEQ ID NO: 1211145 - RNA, 26 nt, Human
uaccauggcaagaccuugggcugggu

SEQ ID NO: 1211146 - RNA, 19 nt, Human
ucaagacaaaaaagagaua

SEQ ID NO: 1211147 - RNA, 20 nt, Human
uccacagugggcagugagau

SEQ ID NO: 1211148 - RNA, 24 nt, Human
uccuugggcaucuccuccagcagc

SEQ ID NO: 1211149 - RNA, 21 nt, Human
ucucaggcuucuuguccacag

SEQ ID NO: 1211150 - RNA, 19 nt, Human
ucucugcagcuagcuacuu

SEQ ID NO: 1211151 - RNA, 18 nt, Human
ucuguagccauaacuuuu

SEQ ID NO: 1211152 - RNA, 20 nt, Human
ugaauggauuugaaucccau

SEQ ID NO: 1211153 - RNA, 24 nt, Human
ugcagugauccuugggcaucuccu

SEQ ID NO: 1211154 - RNA, 19 nt, Human
ugccauuaaaaagcacaug

SEQ ID NO: 1211155 - RNA, 20 nt, Human
ugcuuuguagagcugcccuc

SEQ ID NO: 1211156 - RNA, 19 nt, Human
uggagaagacacaugcugc

SEQ ID NO: 1211157 - RNA, 22 nt, Human
ugggcaucuccuccagcagcuu

SEQ ID NO: 1211158 - RNA, 23 nt, Human
ugggcaucuccuccagcagcuuc

SEQ ID NO: 1211159 - RNA, 21 nt, Human
uucaagacaaaaaagagauaa

SEQ ID NO: 1211160 - RNA, 22 nt, Human
uuggaaucuauucauaaacacc

SEQ ID NO: 1211161 - RNA, 23 nt, Human
uuugaagacuuucauugccauuu

SEQ ID NO: 1211162 - RNA, 25 nt, Human
uuuguagagcugcccucucccauuc

SEQ ID NO: 1211163 - RNA, 21 nt, Human
uuuuacagccauuuuaaauua

SEQ ID NO: 1211164 - RNA, 20 nt, Human
acuucaaagagucuauugaa

SEQ ID NO: 1211165 - RNA, 21 nt, Human
gaguggagaugaacuugagug

SEQ ID NO: 1211166 - RNA, 18 nt, Human
gggaaaaggaaaucaaug

SEQ ID NO: 1211167 - RNA, 21 nt, Human
ugaacuauuaauagacaaugc

SEQ ID NO: 1211168 - RNA, 24 nt, Human
uucaaagagucuauugaacuauua

SEQ ID NO: 1211169 - RNA, 19 nt, Human
aaguugaacaagauggaau

SEQ ID NO: 1211170 - RNA, 20 nt, Human
acacagaaggguucucugaa

SEQ ID NO: 1211171 - RNA, 22 nt, Human
acagaacuuguguggcaguaga

SEQ ID NO: 1211172 - RNA, 21 nt, Human
aggaaauaacaagucugucca

SEQ ID NO: 1211173 - RNA, 21 nt, Human
cagcuccuguaugcaucuccu

SEQ ID NO: 1211174 - RNA, 22 nt, Human
cuccagcuccuguaugcaucuc

SEQ ID NO: 1211175 - RNA, 18 nt, Human
gacagaggccaagaauca

SEQ ID NO: 1211176 - RNA, 21 nt, Human
gcaguagagagaggucaggcu

SEQ ID NO: 1211177 - RNA, 20 nt, Human
gucuccaauaccucuggccc

SEQ ID NO: 1211178 - RNA, 20 nt, Human
uaacaagucuguccagcauc

SEQ ID NO: 1211179 - RNA, 23 nt, Human
uaccucuggccacugauuugucc

SEQ ID NO: 1211180 - RNA, 22 nt, Human
uaguccucauacaggaaauaac

SEQ ID NO: 1211181 - RNA, 24 nt, Human
uauuugcauagcauuuuauacaca

SEQ ID NO: 1211182 - RNA, 20 nt, Human
uccagcaucuucauaagccu

SEQ ID NO: 1211183 - RNA, 21 nt, Human
ugaacaagauggaaugugaug

SEQ ID NO: 1211184 - RNA, 24 nt, Human
uggcaguagagagaggucaggcuu

SEQ ID NO: 1211185 - RNA, 23 nt, Human
ugggacagaggccaagaaucauc

SEQ ID NO: 1211186 - RNA, 19 nt, Human
uguggcaguagagagaggu

SEQ ID NO: 1211187 - RNA, 21 nt, Human
uguggcaguagagagagguca

SEQ ID NO: 1211188 - RNA, 20 nt, Human
uuaauguagcaugcaaugcu

SEQ ID NO: 1211189 - RNA, 19 nt, Human
uucauaagccuggauugcu

SEQ ID NO: 1211190 - RNA, 21 nt, Human
uugacuccagcuccuguaugc

SEQ ID NO: 1211191 - RNA, 19 nt, Human
uuggauaugggacagaggc

SEQ ID NO: 1211192 - RNA, 21 nt, Human
uuguguggcaguagagagagg

SEQ ID NO: 1211193 - RNA, 25 nt, Human
aagcggccagagcgggcuccgggcg

SEQ ID NO: 1211194 - RNA, 20 nt, Human
acucugaguaggugaaggag

SEQ ID NO: 1211195 - RNA, 21 nt, Human
agcaaaaagcaagcggccaga

SEQ ID NO: 1211196 - RNA, 22 nt, Human
agcaaaaagcaagcggccagag

SEQ ID NO: 1211197 - RNA, 19 nt, Human
agcaggcgggcaggcuggc

SEQ ID NO: 1211198 - RNA, 23 nt, Human
aggaagcuuucucagcaaaaagc

SEQ ID NO: 1211199 - RNA, 22 nt, Human
caaaaagcaagcggccagagcg

SEQ ID NO: 1211200 - RNA, 19 nt, Human
cagcaaaaagcaagcggcc

SEQ ID NO: 1211201 - RNA, 22 nt, Human
cagcaaaaagcaagcggccaga

SEQ ID NO: 1211202 - RNA, 20 nt, Human
ccaaggugucuggaugggga

SEQ ID NO: 1211203 - RNA, 24 nt, Human
cgggucgagguccaggaagucauc

SEQ ID NO: 1211204 - RNA, 24 nt, Human
cucagcaaaaagcaagcggccaga

SEQ ID NO: 1211205 - RNA, 19 nt, Human
gaagggugccaucuuccag

SEQ ID NO: 1211206 - RNA, 21 nt, Human
gcaaaaagcaagcggccagag

SEQ ID NO: 1211207 - RNA, 19 nt, Human
gccggcgagcaggcgggca

SEQ ID NO: 1211208 - RNA, 22 nt, Human
guccaggaagucauccucgauc

SEQ ID NO: 1211209 - RNA, 19 nt, Human
gugugucugcguguguccc

SEQ ID NO: 1211210 - RNA, 23 nt, Human
uccgggcgccggcgagcaggcgg

SEQ ID NO: 1211211 - RNA, 19 nt, Human
uccucgaucuucuccucca

SEQ ID NO: 1211212 - RNA, 25 nt, Human
uccucgaucuucuccuccauccacu

SEQ ID NO: 1211213 - RNA, 19 nt, Human
ucuucuccuccauccacuc

SEQ ID NO: 1211214 - RNA, 21 nt, Human
uggggaagggugccaucuucc

SEQ ID NO: 1211215 - RNA, 23 nt, Human
uuccagggcaggaagcuuucuca

SEQ ID NO: 1211216 - RNA, 23 nt, Human
aaaaaagagagcaucgucgagga

SEQ ID NO: 1211217 - RNA, 23 nt, Human
aacggccgcaaaaaaaccgcgug

SEQ ID NO: 1211218 - RNA, 19 nt, Human
aggguguguagacggugga

SEQ ID NO: 1211219 - RNA, 19 nt, Human
caaaaaaaccgcgugacgc

SEQ ID NO: 1211220 - RNA, 23 nt, Human
caaaaaaaccgcgugacgcggug

SEQ ID NO: 1211221 - RNA, 21 nt, Human
caaguguagugcacgugcgcg

SEQ ID NO: 1211222 - RNA, 24 nt, Human
cacagagagacccugcgugggggg

SEQ ID NO: 1211223 - RNA, 24 nt, Human
cagaacggccgcaaaaaaaccgcg

SEQ ID NO: 1211224 - RNA, 22 nt, Human
cgagagggcgggagacgcuugg

SEQ ID NO: 1211225 - RNA, 24 nt, Human
cgagagggcgggagacgcuugggg

SEQ ID NO: 1211226 - RNA, 23 nt, Human
cgcgguggagcucgccacggggg

SEQ ID NO: 1211227 - RNA, 24 nt, Human
cgggaggguguguagacgguggag

SEQ ID NO: 1211228 - RNA, 22 nt, Human
cugcguggggggggucugcaga

SEQ ID NO: 1211229 - RNA, 20 nt, Human
gccgcaaaaaaaccgcguga

SEQ ID NO: 1211230 - RNA, 19 nt, Human
gcgcgaaaccaguggggcg

SEQ ID NO: 1211231 - RNA, 23 nt, Human
gcgguggagcucgccacgggggg

SEQ ID NO: 1211232 - RNA, 20 nt, Human
ggcgggagacgcuugggggc

SEQ ID NO: 1211233 - RNA, 21 nt, Human
gggcgggagacgcuugggggc

SEQ ID NO: 1211234 - RNA, 21 nt, Human
ugacaccaaguguagugcacg

SEQ ID NO: 1211235 - RNA, 20 nt, Human
ugcguggggggggucugcag

SEQ ID NO: 1211236 - RNA, 21 nt, Human
ugcguggggggggucugcaga

SEQ ID NO: 1211237 - RNA, 23 nt, Human
uggcaucgcggugugucggcgca

SEQ ID NO: 1211238 - RNA, 22 nt, Human
ugucagagaccgugugacacca

SEQ ID NO: 1211239 - RNA, 19 nt, Human
ugucggcgcaaaaaagaga

SEQ ID NO: 1211240 - RNA, 19 nt, Human
aaaagccaugcacuuccac

SEQ ID NO: 1211241 - RNA, 21 nt, Human
aaaagcgucagacaguuacaa

SEQ ID NO: 1211242 - RNA, 19 nt, Human
aaacuccagcaguggauaa

SEQ ID NO: 1211243 - RNA, 23 nt, Human
aagcgucagacaguuacaacacu

SEQ ID NO: 1211244 - RNA, 20 nt, Human
acacaggcaaaagcgucaga

SEQ ID NO: 1211245 - RNA, 21 nt, Human
acuaccucccauugggggcug

SEQ ID NO: 1211246 - RNA, 18 nt, Human
acuguguucuggaacuga

SEQ ID NO: 1211247 - RNA, 23 nt, Human
agaggagggaggguuuagaaucc

SEQ ID NO: 1211248 - RNA, 23 nt, Human
agcaggagacggaggugggagga

SEQ ID NO: 1211249 - RNA, 25 nt, Human
agccacaccuccagcagggcaccca

SEQ ID NO: 1211250 - RNA, 21 nt, Human
aggagggaggguuuagaaucc

SEQ ID NO: 1211251 - RNA, 23 nt, Human
aggcaaaagcgucagacaguuac

SEQ ID NO: 1211252 - RNA, 18 nt, Human
aggcaggguggauggggc

SEQ ID NO: 1211253 - RNA, 21 nt, Human
aggcaggguggauggggcugu

SEQ ID NO: 1211254 - RNA, 21 nt, Human
aggggaccaguguuccaucuu

SEQ ID NO: 1211255 - RNA, 25 nt, Human
agguagcugcgaaacucccccagga

SEQ ID NO: 1211256 - RNA, 24 nt, Human
agguaucaaagaugggccagaacc

SEQ ID NO: 1211257 - RNA, 24 nt, Human
auccuggugaugcccaggcugugg

SEQ ID NO: 1211258 - RNA, 24 nt, Human
caaaagcgucagacaguuacaaca

SEQ ID NO: 1211259 - RNA, 24 nt, Human
cacacaggcaaaagcgucagacag

SEQ ID NO: 1211260 - RNA, 20 nt, Human
cacacucacacacuccacca

SEQ ID NO: 1211261 - RNA, 25 nt, Human
caccagaaguggcuaggugcagguc

SEQ ID NO: 1211262 - RNA, 21 nt, Human
caccugccucuuggagcgcuc

SEQ ID NO: 1211263 - RNA, 24 nt, Human
cagaagcagguccaccacauacaa

SEQ ID NO: 1211264 - RNA, 23 nt, Human
cagcaggagacggaggugggagg

SEQ ID NO: 1211265 - RNA, 18 nt, Human
cagcagggcacccaggcc

SEQ ID NO: 1211266 - RNA, 18 nt, Human
cagcccaagggcacgcag

SEQ ID NO: 1211267 - RNA, 19 nt, Human
cagcuccaggguugugcuc

SEQ ID NO: 1211268 - RNA, 18 nt, Human
caggagacacuggcaguu

SEQ ID NO: 1211269 - RNA, 19 nt, Human
caucucaugcagaacuuua

SEQ ID NO: 1211270 - RNA, 18 nt, Human
ccaaugcugcugccauca

SEQ ID NO: 1211271 - RNA, 20 nt, Human
ccacagauuggcaagggcac

SEQ ID NO: 1211272 - RNA, 23 nt, Human
ccaggccaugcaugauggccacc

SEQ ID NO: 1211273 - RNA, 20 nt, Human
ccaggcugugggcuggcuug

SEQ ID NO: 1211274 - RNA, 22 nt, Human
cccucuucgcagcuccucacca

SEQ ID NO: 1211275 - RNA, 20 nt, Human
ccuccagcaagaagaggagg

SEQ ID NO: 1211276 - RNA, 19 nt, Human
ccuccagcuccaccgaucc

SEQ ID NO: 1211277 - RNA, 18 nt, Human
ccuuccuucccucuucgc

SEQ ID NO: 1211278 - RNA, 23 nt, Human
ccuuccuucccucuucgcagcuc

SEQ ID NO: 1211279 - RNA, 27 nt, Human
cgcaagcaggccuuccagcucugccaa

SEQ ID NO: 1211280 - RNA, 24 nt, Human
cgcugauguuuucggagaugacuc

SEQ ID NO: 1211281 - RNA, 24 nt, Human
cguuaggaguucuauaguuuggag

SEQ ID NO: 1211282 - RNA, 21 nt, Human
cucaagagaugacaguagcuc

SEQ ID NO: 1211283 - RNA, 22 nt, Human
cucaagagaugacaguagcucc

SEQ ID NO: 1211284 - RNA, 23 nt, Human
cucacacacuccaccauacccua

SEQ ID NO: 1211285 - RNA, 20 nt, Human
cuccaggguugugcucaucc

SEQ ID NO: 1211286 - RNA, 28 nt, Human
cuccaggguugugcucauccgugcugcc

SEQ ID NO: 1211287 - RNA, 19 nt, Human
cuccugggccauagcuggg

SEQ ID NO: 1211288 - RNA, 20 nt, Human
cucggcacugggcacagguc

SEQ ID NO: 1211289 - RNA, 18 nt, Human
cuggcaguugaggcucug

SEQ ID NO: 1211290 - RNA, 19 nt, Human
cuggcaguugaggcucugu

SEQ ID NO: 1211291 - RNA, 20 nt, Human
cugggccauagcugggcuga

SEQ ID NO: 1211292 - RNA, 21 nt, Human
cuugcugagcaggaacucuga

SEQ ID NO: 1211293 - RNA, 18 nt, Human
cuuuguccacuaccuccc

SEQ ID NO: 1211294 - RNA, 23 nt, Human
gaacugaaggcaggguggauggg

SEQ ID NO: 1211295 - RNA, 18 nt, Human
gaaggggaccaguguucc

SEQ ID NO: 1211296 - RNA, 19 nt, Human
gaugcccuccagcuccacc

SEQ ID NO: 1211297 - RNA, 20 nt, Human
gccagcccucugucuucucc

SEQ ID NO: 1211298 - RNA, 25 nt, Human
gccaugcaugauggccacccacucc

SEQ ID NO: 1211299 - RNA, 19 nt, Human
gcugacuguguucuggaac

SEQ ID NO: 1211300 - RNA, 25 nt, Human
gcugacuguguucuggaacugacgc

SEQ ID NO: 1211301 - RNA, 23 nt, Human
gcugggcugaacuuggcaaaagc

SEQ ID NO: 1211302 - RNA, 19 nt, Human
ggagacggaggugggagga

SEQ ID NO: 1211303 - RNA, 20 nt, Human
ggaggaacugaaggcagggu

SEQ ID NO: 1211304 - RNA, 23 nt, Human
ggaggaacugaaggcagggugga

SEQ ID NO: 1211305 - RNA, 21 nt, Human
ggaggguuuagaauccuggug

SEQ ID NO: 1211306 - RNA, 22 nt, Human
ggaggugggaggaacugaaggc

SEQ ID NO: 1211307 - RNA, 20 nt, Human
ggccagugaaggggaccagu

SEQ ID NO: 1211308 - RNA, 19 nt, Human
ggcugagggugguggcuca

SEQ ID NO: 1211309 - RNA, 18 nt, Human
gggccauagcugggcuga

SEQ ID NO: 1211310 - RNA, 24 nt, Human
gggcuggcuuguguuucccccugg

SEQ ID NO: 1211311 - RNA, 22 nt, Human
guuuagaauccuggugaugccc

SEQ ID NO: 1211312 - RNA, 28 nt, Human
uaagcagcuggcccagcguuguaaugac

SEQ ID NO: 1211313 - RNA, 18 nt, Human
uagaagggugaaaggugc

SEQ ID NO: 1211314 - RNA, 18 nt, Human
uagaauccuggugaugcc

SEQ ID NO: 1211315 - RNA, 20 nt, Human
uagcugcgaaacucccccag

SEQ ID NO: 1211316 - RNA, 24 nt, Human
uagcugcgaaacucccccaggaug

SEQ ID NO: 1211317 - RNA, 26 nt, Human
uaggguacaugcaggaugaaguugag

SEQ ID NO: 1211318 - RNA, 18 nt, Human
uagugagcaggggcaggu

SEQ ID NO: 1211319 - RNA, 21 nt, Human
uaucacagagugauaauggag

SEQ ID NO: 1211320 - RNA, 22 nt, Human
ucacugaggucgcugacugugu

SEQ ID NO: 1211321 - RNA, 21 nt, Human
ucagauggacacacaggcaaa

SEQ ID NO: 1211322 - RNA, 20 nt, Human
ucagccagcccucugucuuc

SEQ ID NO: 1211323 - RNA, 19 nt, Human
ucaggguaguuggagaggc

SEQ ID NO: 1211324 - RNA, 20 nt, Human
uccaccacauacaagagccg

SEQ ID NO: 1211325 - RNA, 19 nt, Human
uccucucggcacugggcac

SEQ ID NO: 1211326 - RNA, 22 nt, Human
uccuuccuucccucuucgcagc

SEQ ID NO: 1211327 - RNA, 22 nt, Human
ucgauggccaagaucuuggaca

SEQ ID NO: 1211328 - RNA, 20 nt, Human
ucgcuugcugagcaggaacu

SEQ ID NO: 1211329 - RNA, 26 nt, Human
ucuaccagcaccuccacaaaggcuga

SEQ ID NO: 1211330 - RNA, 21 nt, Human
ucuaucacagagugauaaugg

SEQ ID NO: 1211331 - RNA, 23 nt, Human
ucugcucagcaggagacggaggu

SEQ ID NO: 1211332 - RNA, 24 nt, Human
ugaaggcaggguggauggggcugu

SEQ ID NO: 1211333 - RNA, 20 nt, Human
ugaaggggaccaguguucca

SEQ ID NO: 1211334 - RNA, 20 nt, Human
ugaagggucuaucacagagu

SEQ ID NO: 1211335 - RNA, 22 nt, Human
ugaagguaucaaagaugggcca

SEQ ID NO: 1211336 - RNA, 23 nt, Human
ugacacacucacacacuccacca

SEQ ID NO: 1211337 - RNA, 20 nt, Human
ugagaggaugaaggugccac

SEQ ID NO: 1211338 - RNA, 20 nt, Human
ugcagcugcuggccuuggaa

SEQ ID NO: 1211339 - RNA, 20 nt, Human
ugcccaggcugugggcuggc

SEQ ID NO: 1211340 - RNA, 22 nt, Human
ugcugcugccaucagcugcugc

SEQ ID NO: 1211341 - RNA, 22 nt, Human
uggagacugcccagcccaaggg

SEQ ID NO: 1211342 - RNA, 18 nt, Human
uggcaguugaggcucugu

SEQ ID NO: 1211343 - RNA, 18 nt, Human
uggcaguugaggcucugu

SEQ ID NO: 1211344 - RNA, 20 nt, Human
uggcauaggcguggugcagu

SEQ ID NO: 1211345 - RNA, 22 nt, Human
uggccaagaucuuggacaacac

SEQ ID NO: 1211346 - RNA, 23 nt, Human
uggcucaggguaguuggagaggc

SEQ ID NO: 1211347 - RNA, 24 nt, Human
uggcucaggguaguuggagaggcc

SEQ ID NO: 1211348 - RNA, 23 nt, Human
uggcuuguguuuggcccuggauu

SEQ ID NO: 1211349 - RNA, 23 nt, Human
ugggaggaacugaaggcagggug

SEQ ID NO: 1211350 - RNA, 25 nt, Human
ugggaggaacugaaggcagggugga

SEQ ID NO: 1211351 - RNA, 23 nt, Human
uguagaucaaacaccaaggcugg

SEQ ID NO: 1211352 - RNA, 20 nt, Human
ugucauguggguuuuuacuu

SEQ ID NO: 1211353 - RNA, 24 nt, Human
uguuccaucuucagggcuuacaug

SEQ ID NO: 1211354 - RNA, 23 nt, Human
uucccuguugcugccucuccagc

SEQ ID NO: 1211355 - RNA, 21 nt, Human
uuggaaguaagggcuccucuc

SEQ ID NO: 1211356 - RNA, 25 nt, Human
uuggacaacaccugaagacuuuccu

SEQ ID NO: 1211357 - RNA, 21 nt, Human
uuucauucugccagaccuggu

SEQ ID NO: 1211358 - RNA, 18 nt, Human
uuuuuuuuuuaaagaagu

SEQ ID NO: 1211359 - RNA, 25 nt, Human
uuuuuuuuuuuuaaagaaguaagcc

SEQ ID NO: 1211360 - RNA, 22 nt, Human
uuuuuuuuuuuuuaaagaagua

SEQ ID NO: 1211361 - RNA, 24 nt, Human
uuuuuuuuuuuuuuuuuuuuaaag

SEQ ID NO: 1211362 - RNA, 18 nt, Human
agguucucagucugacuc

SEQ ID NO: 1211363 - RNA, 23 nt, Human
cagcggacacggaguuggccuug

SEQ ID NO: 1211364 - RNA, 19 nt, Human
cagcucguccaccuuggcc

SEQ ID NO: 1211365 - RNA, 20 nt, Human
caggaaggagguggcugcug

SEQ ID NO: 1211366 - RNA, 24 nt, Human
cuccagcucguccaccuuggccug

SEQ ID NO: 1211367 - RNA, 23 nt, Human
cuggcuugggcugugggcagcgg

SEQ ID NO: 1211368 - RNA, 19 nt, Human
gagggccagcuccccacgc

SEQ ID NO: 1211369 - RNA, 18 nt, Human
ggccugagcguccuugag

SEQ ID NO: 1211370 - RNA, 19 nt, Human
ggccuugcagagccggcug

SEQ ID NO: 1211371 - RNA, 20 nt, Human
guguucaggaaggagguggc

SEQ ID NO: 1211372 - RNA, 23 nt, Human
ucagcaucagugauggcggccuu

SEQ ID NO: 1211373 - RNA, 20 nt, Human
uccgcugugggcuggcuugg

SEQ ID NO: 1211374 - RNA, 24 nt, Human
ugagcguccuugagggccagcucc

SEQ ID NO: 1211375 - RNA, 22 nt, Human
uggccugagcguccuugagggc

SEQ ID NO: 1211376 - RNA, 21 nt, Human
ugggcuggcuugggcuguggg

SEQ ID NO: 1211377 - RNA, 21 nt, Human
aagcagaggggaagacuagcu

SEQ ID NO: 1211378 - RNA, 22 nt, Human
aagggaaaguggggcggggagg

SEQ ID NO: 1211379 - RNA, 22 nt, Human
aaguguguaaaaaaaaaauuca

SEQ ID NO: 1211380 - RNA, 22 nt, Human
agcuuacugcaaaaaccuuuuu

SEQ ID NO: 1211381 - RNA, 24 nt, Human
aggaaaucuaugcccggcccgugc

SEQ ID NO: 1211382 - RNA, 19 nt, Human
caauggaagccuugcugcg

SEQ ID NO: 1211383 - RNA, 20 nt, Human
caguuucaggaaacccugcc

SEQ ID NO: 1211384 - RNA, 21 nt, Human
cauacaggagcuccuccccag

SEQ ID NO: 1211385 - RNA, 21 nt, Human
cccagccgcgaugucucggga

SEQ ID NO: 1211386 - RNA, 22 nt, Human
cccauagucauacaggagcuuu

SEQ ID NO: 1211387 - RNA, 19 nt, Human
cccggcccgugcuuggggc

SEQ ID NO: 1211388 - RNA, 18 nt, Human
ccuuugaagaagggaaag

SEQ ID NO: 1211389 - RNA, 22 nt, Human
ccuuugaagaagggaaaguggg

SEQ ID NO: 1211390 - RNA, 22 nt, Human
cgggugggcuucaauggaagcc

SEQ ID NO: 1211391 - RNA, 23 nt, Human
gaagaagggaaaguggggcgggg

SEQ ID NO: 1211392 - RNA, 24 nt, Human
gagaaagcagaggggaagacuagc

SEQ ID NO: 1211393 - RNA, 25 nt, Human
gauuugucucucuaguugcauccac

SEQ ID NO: 1211394 - RNA, 20 nt, Human
gcuucagccacgggugggcu

SEQ ID NO: 1211395 - RNA, 22 nt, Human
ggcccgugcuuggggcccgggg

SEQ ID NO: 1211396 - RNA, 20 nt, Human
ggcggggagggcacggggcc

SEQ ID NO: 1211397 - RNA, 21 nt, Human
gggcagguaagcaacccucuu

SEQ ID NO: 1211398 - RNA, 20 nt, Human
gggcggggagggcacggggc

SEQ ID NO: 1211399 - RNA, 21 nt, Human
gggcggggagggcacggggcc

SEQ ID NO: 1211400 - RNA, 22 nt, Human
uaagcaacccucucccugccca

SEQ ID NO: 1211401 - RNA, 24 nt, Human
uaagcaacccucucccugcccaca

SEQ ID NO: 1211402 - RNA, 23 nt, Human
uaaguguguaaaaaaaaaauuca

SEQ ID NO: 1211403 - RNA, 24 nt, Human
uacugcaaaaaccuuuuuaaaaaa

SEQ ID NO: 1211404 - RNA, 18 nt, Human
uagcuuacugcaaaaacc

SEQ ID NO: 1211405 - RNA, 24 nt, Human
ucccuuugagggcacuuuguccuu

SEQ ID NO: 1211406 - RNA, 18 nt, Human
ugaggugagguacgccgu

SEQ ID NO: 1211407 - RNA, 18 nt, Human
uggaagccuugcugcggu

SEQ ID NO: 1211408 - RNA, 24 nt, Human
uguaacagauauuuaaauacuaca

SEQ ID NO: 1211409 - RNA, 20 nt, Human
ugucgugcaguuugguuugg

SEQ ID NO: 1211410 - RNA, 23 nt, Human
uuaaaaacaucugaaguaauccg

SEQ ID NO: 1211411 - RNA, 18 nt, Human
uugcugcgguccccauag

SEQ ID NO: 1211412 - RNA, 24 nt, Human
uugcugcgguccccauagucauac

SEQ ID NO: 1211413 - RNA, 24 nt, Human
uuggcaguucccacauuugcugug

SEQ ID NO: 1211414 - RNA, 22 nt, Human
acucugacaaccccaggcuccg

SEQ ID NO: 1211415 - RNA, 19 nt, Human
aggccccaagaaaugacag

SEQ ID NO: 1211416 - RNA, 21 nt, Human
cagcagacccgaucacucuga

SEQ ID NO: 1211417 - RNA, 22 nt, Human
cagcagacccgaucacucugac

SEQ ID NO: 1211418 - RNA, 20 nt, Human
ccaagaaaugacagcagacc

SEQ ID NO: 1211419 - RNA, 20 nt, Human
cccaagaaaugacagcagac

SEQ ID NO: 1211420 - RNA, 21 nt, Human
cccaagaaaugacagcagacc

SEQ ID NO: 1211421 - RNA, 22 nt, Human
cccaagaaaugacagcagaccc

SEQ ID NO: 1211422 - RNA, 19 nt, Human
ccccuccugccucuugaga

SEQ ID NO: 1211423 - RNA, 19 nt, Human
cucugacaaccccaggcuc

SEQ ID NO: 1211424 - RNA, 18 nt, Human
ucagucccccuccugccu

SEQ ID NO: 1211425 - RNA, 18 nt, Human
ucugacaaccccaggcuc

SEQ ID NO: 1211426 - RNA, 22 nt, Human
ugacagcagacccgaucacucu

SEQ ID NO: 1211427 - RNA, 22 nt, Human
uggcugauuucaaaugaaaaau

SEQ ID NO: 1211428 - RNA, 25 nt, Human
aaagcacaaaccauguauauaccaa

SEQ ID NO: 1211429 - RNA, 20 nt, Human
acuuuaaagauguuuaagag

SEQ ID NO: 1211430 - RNA, 18 nt, Human
agaacccagccagggacc

SEQ ID NO: 1211431 - RNA, 19 nt, Human
caccgcgcgacgcguaggu

SEQ ID NO: 1211432 - RNA, 18 nt, Human
cagaacccagccagggac

SEQ ID NO: 1211433 - RNA, 21 nt, Human
cagaacccagccagggaccgu

SEQ ID NO: 1211434 - RNA, 23 nt, Human
cagaacccagccagggaccgucc

SEQ ID NO: 1211435 - RNA, 20 nt, Human
cagccagggaccguccgcca

SEQ ID NO: 1211436 - RNA, 20 nt, Human
cagcgucugaagccucuucc

SEQ ID NO: 1211437 - RNA, 20 nt, Human
ccagggccuccagaacccag

SEQ ID NO: 1211438 - RNA, 26 nt, Human
ccuccagaacccagccagggaccguc

SEQ ID NO: 1211439 - RNA, 22 nt, Human
cgcugcagcgucugaagccucu

SEQ ID NO: 1211440 - RNA, 22 nt, Human
cggucccagggccuccagaacc

SEQ ID NO: 1211441 - RNA, 21 nt, Human
gcagcgucugaagccucuucc

SEQ ID NO: 1211442 - RNA, 24 nt, Human
uaaagcacaaaccauguauauacc

SEQ ID NO: 1211443 - RNA, 25 nt, Human
uaaagcacaaaccauguauauacca

SEQ ID NO: 1211444 - RNA, 22 nt, Human
uaaguagaaugcaaaucucuau

SEQ ID NO: 1211445 - RNA, 23 nt, Human
ucaaaaauaaugacucauccaac

SEQ ID NO: 1211446 - RNA, 20 nt, Human
ucccagggccuccagaaccc

SEQ ID NO: 1211447 - RNA, 26 nt, Human
ucccagggccuccagaacccagccag

SEQ ID NO: 1211448 - RNA, 22 nt, Human
uccgccaacucccgcccaccgc

SEQ ID NO: 1211449 - RNA, 20 nt, Human
uccgcggucccagggccucc

SEQ ID NO: 1211450 - RNA, 22 nt, Human
ucugaagccucuuccgcggucc

SEQ ID NO: 1211451 - RNA, 22 nt, Human
ugggaaaguaguuuugauaagc

SEQ ID NO: 1211452 - RNA, 19 nt, Human
uuccuagcauugaucaucu

SEQ ID NO: 1211453 - RNA, 25 nt, Human
uuucaaaaauaaugacucauccaac

SEQ ID NO: 1211454 - RNA, 23 nt, Human
agaagucucgccaucuaugagga

SEQ ID NO: 1211455 - RNA, 21 nt, Human
agccaggcagcccaucagcuc

SEQ ID NO: 1211456 - RNA, 19 nt, Human
cccaucagcucccccugcc

SEQ ID NO: 1211457 - RNA, 22 nt, Human
cccccagagccaggcagcccau

SEQ ID NO: 1211458 - RNA, 21 nt, Human
ccccccagagccaggcagccc

SEQ ID NO: 1211459 - RNA, 23 nt, Human
ccgaagccgggccagccgggcug

SEQ ID NO: 1211460 - RNA, 18 nt, Human
ccgggccagccgggcugg

SEQ ID NO: 1211461 - RNA, 20 nt, Human
ccuuccuccuuucuucccca

SEQ ID NO: 1211462 - RNA, 20 nt, Human
cuccaccccccagagccagg

SEQ ID NO: 1211463 - RNA, 24 nt, Human
cuccaccccccagagccaggcagc

SEQ ID NO: 1211464 - RNA, 22 nt, Human
cuccccuccaccccccagagcc

SEQ ID NO: 1211465 - RNA, 23 nt, Human
gaggggccgggggaggacccugu

SEQ ID NO: 1211466 - RNA, 18 nt, Human
gcccauuuggaggggccg

SEQ ID NO: 1211467 - RNA, 19 nt, Human
gccgggggaggacccugug

SEQ ID NO: 1211468 - RNA, 21 nt, Human
gggggaggacccuguggggaa

SEQ ID NO: 1211469 - RNA, 22 nt, Human
ucagaagucucgccaucuauga

SEQ ID NO: 1211470 - RNA, 23 nt, Human
ucagcucccccugccucugagcu

SEQ ID NO: 1211471 - RNA, 19 nt, Human
ucccccugccucugagcuu

SEQ ID NO: 1211472 - RNA, 21 nt, Human
ucugcagaauuccauuaucag

SEQ ID NO: 1211473 - RNA, 25 nt, Human
ucuucagcucuuucucugccucuuu

SEQ ID NO: 1211474 - RNA, 23 nt, Human
ugccucugagcuuucuucagcuc

SEQ ID NO: 1211475 - RNA, 18 nt, Human
ugcuccccuccacccccc

SEQ ID NO: 1211476 - RNA, 23 nt, Human
uggggucucuuugcucaggaagu

SEQ ID NO: 1211477 - RNA, 22 nt, Human
uuccgggcuagguagagcccau

SEQ ID NO: 1211478 - RNA, 25 nt, Human
uuuagcagccccuugagagccuucc

SEQ ID NO: 1211479 - RNA, 19 nt, Human
uuuggaggggccgggggag

SEQ ID NO: 1211480 - RNA, 23 nt, Human
aaaaaauauuugagaacaaaacc

SEQ ID NO: 1211481 - RNA, 27 nt, Human
aaacguugggagacuaguccagaaacu

SEQ ID NO: 1211482 - RNA, 18 nt, Human
aacaaaaccucugccucu

SEQ ID NO: 1211483 - RNA, 21 nt, Human
accaugacuuuugugaccagu

SEQ ID NO: 1211484 - RNA, 18 nt, Human
acuuuugugaccaguucc

SEQ ID NO: 1211485 - RNA, 20 nt, Human
agaaguagagcuuuuucacu

SEQ ID NO: 1211486 - RNA, 22 nt, Human
agagagggacuaguagguggua

SEQ ID NO: 1211487 - RNA, 20 nt, Human
agagauugcccuggcagagg

SEQ ID NO: 1211488 - RNA, 24 nt, Human
aggaaagcgagaggagccgguacc

SEQ ID NO: 1211489 - RNA, 22 nt, Human
auccccagcaucucugauucuc

SEQ ID NO: 1211490 - RNA, 21 nt, Human
augcaggcaccaugacuuuug

SEQ ID NO: 1211491 - RNA, 19 nt, Human
auucugcuaggucccucuc

SEQ ID NO: 1211492 - RNA, 23 nt, Human
cagcagcugcaggagugggacca

SEQ ID NO: 1211493 - RNA, 20 nt, Human
caggguccuaguguuuccuc

SEQ ID NO: 1211494 - RNA, 18 nt, Human
cauucugcuaggucccuc

SEQ ID NO: 1211495 - RNA, 20 nt, Human
cccuggugcccccagcucag

SEQ ID NO: 1211496 - RNA, 22 nt, Human
ccucaggaggaaagcgagagga

SEQ ID NO: 1211497 - RNA, 19 nt, Human
ccucucaguggaagauaga

SEQ ID NO: 1211498 - RNA, 21 nt, Human
cucaggaggaaagcgagagga

SEQ ID NO: 1211499 - RNA, 19 nt, Human
cuggggcacuggcuuuuuc

SEQ ID NO: 1211500 - RNA, 22 nt, Human
gaaguagagcuuuuucacuguc

SEQ ID NO: 1211501 - RNA, 20 nt, Human
gacuaguccagaaacuugca

SEQ ID NO: 1211502 - RNA, 23 nt, Human
gaugcaggcaccaugacuuuugu

SEQ ID NO: 1211503 - RNA, 20 nt, Human
gcuccuugucuccuacuuga

SEQ ID NO: 1211504 - RNA, 18 nt, Human
gcuggcguccccucccgc

SEQ ID NO: 1211505 - RNA, 21 nt, Human
gggagagagggucaggggggc

SEQ ID NO: 1211506 - RNA, 23 nt, Human
gggggcuuggcagggaugcaggc

SEQ ID NO: 1211507 - RNA, 20 nt, Human
ggucagcguagaaguagagc

SEQ ID NO: 1211508 - RNA, 21 nt, Human
ggugcaggggcaggguaagaa

SEQ ID NO: 1211509 - RNA, 24 nt, Human
gugguaguggggagagagggucag

SEQ ID NO: 1211510 - RNA, 22 nt, Human
uaguguuuccucccugggucag

SEQ ID NO: 1211511 - RNA, 21 nt, Human
ucaguggaagauagauaggcu

SEQ ID NO: 1211512 - RNA, 18 nt, Human
uccccagcaucucugauu

SEQ ID NO: 1211513 - RNA, 19 nt, Human
ucccuggugcccccagcuc

SEQ ID NO: 1211514 - RNA, 18 nt, Human
ucugcuaggucccucuca

SEQ ID NO: 1211515 - RNA, 28 nt, Human
ugagaacaaaaccucugccucuuugagu

SEQ ID NO: 1211516 - RNA, 21 nt, Human
ugcaggggcaggguaagaagc

SEQ ID NO: 1211517 - RNA, 18 nt, Human
ugccagcagcccagcaga

SEQ ID NO: 1211518 - RNA, 19 nt, Human
ugcccuggcagagguuggg

SEQ ID NO: 1211519 - RNA, 19 nt, Human
ugcucuggcauccccagca

SEQ ID NO: 1211520 - RNA, 21 nt, Human
uggggagagagggucaggggg

SEQ ID NO: 1211521 - RNA, 20 nt, Human
uugcucuggcauccccagca

SEQ ID NO: 1211522 - RNA, 25 nt, Human
aaaaaaacaagcagccuuguacaga

SEQ ID NO: 1211523 - RNA, 18 nt, Human
aaaaaacaagcagccuug

SEQ ID NO: 1211524 - RNA, 18 nt, Human
aaaaggccucucucccuu

SEQ ID NO: 1211525 - RNA, 18 nt, Human
aaaauuagcugggcgugg

SEQ ID NO: 1211526 - RNA, 23 nt, Human
aaaguguccacagcaacuuaaaa

SEQ ID NO: 1211527 - RNA, 22 nt, Human
aaauacagacaaauuuucaaau

SEQ ID NO: 1211528 - RNA, 19 nt, Human
aacauagugaaaccccauc

SEQ ID NO: 1211529 - RNA, 20 nt, Human
aacauagugaaaccccaucu

SEQ ID NO: 1211530 - RNA, 20 nt, Human
aacauagugaaaccccaucu

SEQ ID NO: 1211531 - RNA, 21 nt, Human
aacauagugaaaccccaucuc

SEQ ID NO: 1211532 - RNA, 28 nt, Human
aagcagccuuguacagaacagugaaaau

SEQ ID NO: 1211533 - RNA, 20 nt, Human
aagucaguaccaaaugacca

SEQ ID NO: 1211534 - RNA, 25 nt, Human
aauaaaaaaacaagcagccuuguac

SEQ ID NO: 1211535 - RNA, 22 nt, Human
aaucacgaggucaggaguucga

SEQ ID NO: 1211536 - RNA, 24 nt, Human
aaucacgaggucaggaguucgaga

SEQ ID NO: 1211537 - RNA, 24 nt, Human
aaucacuugaacccgggaggcgga

SEQ ID NO: 1211538 - RNA, 31 nt, Human
aauccugcauuuuccuggaguaacauccacc

SEQ ID NO: 1211539 - RNA, 21 nt, Human
acaaacccaggcggucgcaca

SEQ ID NO: 1211540 - RNA, 23 nt, Human
acaccacaagucuucuuuccaau

SEQ ID NO: 1211541 - RNA, 24 nt, Human
acagaacagugaaaaugccaagga

SEQ ID NO: 1211542 - RNA, 18 nt, Human
acagugaaaaugccaagg

SEQ ID NO: 1211543 - RNA, 22 nt, Human
acagugcgagacucugucaaaa

SEQ ID NO: 1211544 - RNA, 24 nt, Human
accccaucucuacuaaaaauacaa

SEQ ID NO: 1211545 - RNA, 24 nt, Human
accucuagccucucugaacggccu

SEQ ID NO: 1211546 - RNA, 23 nt, Human
acgauaaaugucuaaaauguauc

SEQ ID NO: 1211547 - RNA, 24 nt, Human
acugcauuccagcccaggcaacag

SEQ ID NO: 1211548 - RNA, 22 nt, Human
agaaucacuugaacccgggagg

SEQ ID NO: 1211549 - RNA, 19 nt, Human
agagagagagagaaaguca

SEQ ID NO: 1211550 - RNA, 24 nt, Human
agcacuuugggaggcugagguggg

SEQ ID NO: 1211551 - RNA, 22 nt, Human
agccagaauaagaaccucuagc

SEQ ID NO: 1211552 - RNA, 22 nt, Human
agccuggccaacauagugaaac

SEQ ID NO: 1211553 - RNA, 24 nt, Human
agccuggccaacauagugaaaccc

SEQ ID NO: 1211554 - RNA, 18 nt, Human
aggcaggagaaucacuug

SEQ ID NO: 1211555 - RNA, 24 nt, Human
aggcaggagaaucacuugaacccg

SEQ ID NO: 1211556 - RNA, 21 nt, Human
aggcggagguugcagugagcc

SEQ ID NO: 1211557 - RNA, 24 nt, Human
aggcggagguugcagugagccgag

SEQ ID NO: 1211558 - RNA, 24 nt, Human
aggcugaggcaggagaaucacuug

SEQ ID NO: 1211559 - RNA, 18 nt, Human
aggcugauuauuucuucu

SEQ ID NO: 1211560 - RNA, 20 nt, Human
aggcugggugcgguggcuca

SEQ ID NO: 1211561 - RNA, 24 nt, Human
aggugggccaaucacgaggucagg

SEQ ID NO: 1211562 - RNA, 22 nt, Human
auacauacacacauguauauau

SEQ ID NO: 1211563 - RNA, 24 nt, Human
auauauauguguauauauauauau

SEQ ID NO: 1211564 - RNA, 19 nt, Human
auauauguguauauauaca

SEQ ID NO: 1211565 - RNA, 19 nt, Human
auauauguguauauauaua

SEQ ID NO: 1211566 - RNA, 19 nt, Human
auauguguauauauauaua

SEQ ID NO: 1211567 - RNA, 23 nt, Human
aucgcaccacugcauuccagccc

SEQ ID NO: 1211568 - RNA, 22 nt, Human
auguauacauauauguguaugu

SEQ ID NO: 1211569 - RNA, 18 nt, Human
auguauauauguauauac

SEQ ID NO: 1211570 - RNA, 18 nt, Human
auguguauauauauauau

SEQ ID NO: 1211571 - RNA, 20 nt, Human
auguguauauauauauauau

SEQ ID NO: 1211572 - RNA, 22 nt, Human
auuauuucuucuaaugucuucu

SEQ ID NO: 1211573 - RNA, 21 nt, Human
caacaaaaaugcuccccacaa

SEQ ID NO: 1211574 - RNA, 22 nt, Human
caacacagcaaauucaaccaca

SEQ ID NO: 1211575 - RNA, 21 nt, Human
caagcagccuuguacagaaca

SEQ ID NO: 1211576 - RNA, 23 nt, Human
caaucacgaggucaggaguucga

SEQ ID NO: 1211577 - RNA, 21 nt, Human
cacaaacccaggcggucgcac

SEQ ID NO: 1211578 - RNA, 26 nt, Human
cacacaaugcaccaucacuucuuuaa

SEQ ID NO: 1211579 - RNA, 22 nt, Human
cacacagacaucuuucagcagc

SEQ ID NO: 1211580 - RNA, 23 nt, Human
cacagcaaauucaaccacagauc

SEQ ID NO: 1211581 - RNA, 24 nt, Human
cacaucuguaauaccagcacuuug

SEQ ID NO: 1211582 - RNA, 24 nt, Human
caccacugcauuccagcccaggca

SEQ ID NO: 1211583 - RNA, 24 nt, Human
caccuacuugggaggcugaggcag

SEQ ID NO: 1211584 - RNA, 19 nt, Human
cacugcauuccagcccagg

SEQ ID NO: 1211585 - RNA, 21 nt, Human
cacugcauuccagcccaggca

SEQ ID NO: 1211586 - RNA, 22 nt, Human
cacugcauuccagcccaggcaa

SEQ ID NO: 1211587 - RNA, 23 nt, Human
cacugcauuccagcccaggcaac

SEQ ID NO: 1211588 - RNA, 24 nt, Human
cacugcauuccagcccaggcaaca

SEQ ID NO: 1211589 - RNA, 22 nt, Human
cacuugacauuaccaaacaugc

SEQ ID NO: 1211590 - RNA, 24 nt, Human
cagcacuuugggaggcugaggugg

SEQ ID NO: 1211591 - RNA, 20 nt, Human
cagcccaggcaacagugcga

SEQ ID NO: 1211592 - RNA, 23 nt, Human
caggccauuaaauacagacaaau

SEQ ID NO: 1211593 - RNA, 22 nt, Human
cauaacgcauaccagauagucu

SEQ ID NO: 1211594 - RNA, 24 nt, Human
cauggcgauaaacaaggguuccau

SEQ ID NO: 1211595 - RNA, 18 nt, Human
cauuuuuuaauuuuacau

SEQ ID NO: 1211596 - RNA, 22 nt, Human
ccaaucacgaggucaggaguuc

SEQ ID NO: 1211597 - RNA, 22 nt, Human
ccacacaaugcaccaucacuuc

SEQ ID NO: 1211598 - RNA, 19 nt, Human
ccacugcauuccagcccag

SEQ ID NO: 1211599 - RNA, 20 nt, Human
ccacugcauuccagcccagg

SEQ ID NO: 1211600 - RNA, 21 nt, Human
ccacugcauuccagcccaggc

SEQ ID NO: 1211601 - RNA, 24 nt, Human
ccacugcauuccagcccaggcaac

SEQ ID NO: 1211602 - RNA, 26 nt, Human
ccagcugaaccaacacaugcaacucg

SEQ ID NO: 1211603 - RNA, 18 nt, Human
ccccggccagggccgccc

SEQ ID NO: 1211604 - RNA, 19 nt, Human
ccgcccgagcgcccgaccg

SEQ ID NO: 1211605 - RNA, 23 nt, Human
ccuggccaacauagugaaacccc

SEQ ID NO: 1211606 - RNA, 24 nt, Human
ccuggccaacauagugaaacccca

SEQ ID NO: 1211607 - RNA, 18 nt, Human
ccuguaaucccaccuacu

SEQ ID NO: 1211608 - RNA, 19 nt, Human
ccuguaaucccaccuacuu

SEQ ID NO: 1211609 - RNA, 22 nt, Human
ccuguaaucccaccuacuuggg

SEQ ID NO: 1211610 - RNA, 24 nt, Human
cgagaccagccuggccaacauagu

SEQ ID NO: 1211611 - RNA, 22 nt, Human
cgcacauacaugguuuuaaggc

SEQ ID NO: 1211612 - RNA, 21 nt, Human
cgcaccacugcauuccagccc

SEQ ID NO: 1211613 - RNA, 22 nt, Human
cgcccgagcgcccgaccgccag

SEQ ID NO: 1211614 - RNA, 27 nt, Human
cgcucccgccgcuaucgccagcugaac

SEQ ID NO: 1211615 - RNA, 24 nt, Human
cgggaggcggagguugcagugagc

SEQ ID NO: 1211616 - RNA, 21 nt, Human
cuagccucucugaacggccuu

SEQ ID NO: 1211617 - RNA, 22 nt, Human
cuaucacaucaaagaagcaagg

SEQ ID NO: 1211618 - RNA, 21 nt, Human
cucaaacaacuccuaccaaca

SEQ ID NO: 1211619 - RNA, 24 nt, Human
cucacaucuguaauaccagcacuu

SEQ ID NO: 1211620 - RNA, 19 nt, Human
cuccccacaaagucuaccg

SEQ ID NO: 1211621 - RNA, 19 nt, Human
cucugucaaaaaaaaaaaa

SEQ ID NO: 1211622 - RNA, 23 nt, Human
cuggccaacauagugaaacccca

SEQ ID NO: 1211623 - RNA, 22 nt, Human
cuguagaauauauauauaugua

SEQ ID NO: 1211624 - RNA, 18 nt, Human
gaaaauaugauucuuuaa

SEQ ID NO: 1211625 - RNA, 23 nt, Human
gagaucgcaccacugcauuccag

SEQ ID NO: 1211626 - RNA, 23 nt, Human
gagguugcagugagccgagaucg

SEQ ID NO: 1211627 - RNA, 20 nt, Human
gcaccacugcauuccagccc

SEQ ID NO: 1211628 - RNA, 23 nt, Human
gcaggagaaucacuugaacccgg

SEQ ID NO: 1211629 - RNA, 24 nt, Human
gccaacauagugaaaccccaucuc

SEQ ID NO: 1211630 - RNA, 20 nt, Human
gccgagaucgcaccacugca

SEQ ID NO: 1211631 - RNA, 20 nt, Human
ggagguugcagugagccgag

SEQ ID NO: 1211632 - RNA, 22 nt, Human
ggagguugcagugagccgagau

SEQ ID NO: 1211633 - RNA, 24 nt, Human
ggagguugcagugagccgagaucg

SEQ ID NO: 1211634 - RNA, 23 nt, Human
ggccaaucacgaggucaggaguu

SEQ ID NO: 1211635 - RNA, 18 nt, Human
ggcgugguggcgggcgcc

SEQ ID NO: 1211636 - RNA, 24 nt, Human
gggcgugguggcgggcgccuguaa

SEQ ID NO: 1211637 - RNA, 24 nt, Human
gggugcgguggcucacaucuguaa

SEQ ID NO: 1211638 - RNA, 19 nt, Human
guguauacauacauauaug

SEQ ID NO: 1211639 - RNA, 19 nt, Human
guguauauauacauauaua

SEQ ID NO: 1211640 - RNA, 19 nt, Human
guugcagugagccgagauc

SEQ ID NO: 1211641 - RNA, 30 nt, Human
uaaaaaaacaagcagccuuguacagaacag

SEQ ID NO: 1211642 - RNA, 18 nt, Human
uaaaaaaucacucagcuu

SEQ ID NO: 1211643 - RNA, 18 nt, Human
uaaaaagagagaaagaga

SEQ ID NO: 1211644 - RNA, 22 nt, Human
uaacugcauuugcuaagaacug

SEQ ID NO: 1211645 - RNA, 19 nt, Human
uacauacauaacgcauacc

SEQ ID NO: 1211646 - RNA, 20 nt, Human
uacauacauaacgcauacca

SEQ ID NO: 1211647 - RNA, 20 nt, Human
uacauacauauauguguaua

SEQ ID NO: 1211648 - RNA, 19 nt, Human
uacauauauguguauauau

SEQ ID NO: 1211649 - RNA, 19 nt, Human
uacauauauguguauauau

SEQ ID NO: 1211650 - RNA, 22 nt, Human
uacauauauguguauauauaca

SEQ ID NO: 1211651 - RNA, 18 nt, Human
uagcucaaacaacuccua

SEQ ID NO: 1211652 - RNA, 19 nt, Human
uauacauacacacauguau

SEQ ID NO: 1211653 - RNA, 27 nt, Human
uauacauauauguguauguauauaugu

SEQ ID NO: 1211654 - RNA, 18 nt, Human
uauauacauauauaugug

SEQ ID NO: 1211655 - RNA, 24 nt, Human
uauauacauauauauguguauaua

SEQ ID NO: 1211656 - RNA, 18 nt, Human
uauauacauguauacaua

SEQ ID NO: 1211657 - RNA, 22 nt, Human
uauauacauuuuuuuuugugua

SEQ ID NO: 1211658 - RNA, 18 nt, Human
uauauauauauguauaca

SEQ ID NO: 1211659 - RNA, 18 nt, Human
uauauauauguauacaua

SEQ ID NO: 1211660 - RNA, 21 nt, Human
uauauauauguauacauauau

SEQ ID NO: 1211661 - RNA, 24 nt, Human
uauauauauguauacauauaugug

SEQ ID NO: 1211662 - RNA, 18 nt, Human
uauauauguauacauaua

SEQ ID NO: 1211663 - RNA, 18 nt, Human
uauauauguauacauaua

SEQ ID NO: 1211664 - RNA, 18 nt, Human
uauauauguauacauaua

SEQ ID NO: 1211665 - RNA, 24 nt, Human
uauauauguauauacauguauaca

SEQ ID NO: 1211666 - RNA, 20 nt, Human
uauauauguguauauauaua

SEQ ID NO: 1211667 - RNA, 20 nt, Human
uauauguauacauauaugug

SEQ ID NO: 1211668 - RNA, 20 nt, Human
uauauguauacauauaugug

SEQ ID NO: 1211669 - RNA, 24 nt, Human
uauauguauacauauauguguaua

SEQ ID NO: 1211670 - RNA, 24 nt, Human
uauauguauacauauauguguaua

SEQ ID NO: 1211671 - RNA, 24 nt, Human
uauauguauacauauauguguaug

SEQ ID NO: 1211672 - RNA, 19 nt, Human
uauauguguauauauacau

SEQ ID NO: 1211673 - RNA, 18 nt, Human
uauauguguauauauaua

SEQ ID NO: 1211674 - RNA, 18 nt, Human
uauauguguauauaugua

SEQ ID NO: 1211675 - RNA, 18 nt, Human
uauauguguauauaugua

SEQ ID NO: 1211676 - RNA, 19 nt, Human
uauauguguauauauguau

SEQ ID NO: 1211677 - RNA, 19 nt, Human
uauauguguauauauguau

SEQ ID NO: 1211678 - RNA, 28 nt, Human
uauguauacauauauguguauauaugua

SEQ ID NO: 1211679 - RNA, 28 nt, Human
uauguauacauauauguguauauaugua

SEQ ID NO: 1211680 - RNA, 18 nt, Human
uauguauauauguauaua

SEQ ID NO: 1211681 - RNA, 20 nt, Human
uauguauauauguauauaca

SEQ ID NO: 1211682 - RNA, 21 nt, Human
uauguauauauguauauacau

SEQ ID NO: 1211683 - RNA, 24 nt, Human
uauguauauauguauauacaugua

SEQ ID NO: 1211684 - RNA, 22 nt, Human
uauguguauauauacauauaua

SEQ ID NO: 1211685 - RNA, 24 nt, Human
uauguguauauauacauauauaug

SEQ ID NO: 1211686 - RNA, 28 nt, Human
uauguguauauauacauauauaugugua

SEQ ID NO: 1211687 - RNA, 18 nt, Human
uauguguauauauauaua

SEQ ID NO: 1211688 - RNA, 21 nt, Human
uauguguauauauauauauau

SEQ ID NO: 1211689 - RNA, 18 nt, Human
uauguguauauauguaua

SEQ ID NO: 1211690 - RNA, 18 nt, Human
uauguguauauauguaua

SEQ ID NO: 1211691 - RNA, 21 nt, Human
uauguguauauauguauacau

SEQ ID NO: 1211692 - RNA, 21 nt, Human
uauguguauauauguauacau

SEQ ID NO: 1211693 - RNA, 25 nt, Human
uauguguauauauguauacauauau

SEQ ID NO: 1211694 - RNA, 25 nt, Human
uauguguauauauguauacauauau

SEQ ID NO: 1211695 - RNA, 28 nt, Human
uauguguauauauguauacauauaugug

SEQ ID NO: 1211696 - RNA, 18 nt, Human
uauguguauguauauaug

SEQ ID NO: 1211697 - RNA, 24 nt, Human
uauguguauguauauauguauaua

SEQ ID NO: 1211698 - RNA, 26 nt, Human
uauguguauguauauauguauauaaa

SEQ ID NO: 1211699 - RNA, 18 nt, Human
uauucuaccacacaaugc

SEQ ID NO: 1211700 - RNA, 25 nt, Human
ucacaucaaagaagcaaggagacau

SEQ ID NO: 1211701 - RNA, 18 nt, Human
ucacgaggucaggaguuc

SEQ ID NO: 1211702 - RNA, 24 nt, Human
ucacgaggucaggaguucgagacc

SEQ ID NO: 1211703 - RNA, 24 nt, Human
ucacuugaacccgggaggcggagg

SEQ ID NO: 1211704 - RNA, 19 nt, Human
ucaggccauuaaauacaga

SEQ ID NO: 1211705 - RNA, 24 nt, Human
ucaggcugggugcgguggcucaca

SEQ ID NO: 1211706 - RNA, 23 nt, Human
ucaguucaggccauuaaauacag

SEQ ID NO: 1211707 - RNA, 28 nt, Human
ucauaacaacacagcaaauucaaccaca

SEQ ID NO: 1211708 - RNA, 24 nt, Human
ucccgccgcuaucgccagcugaac

SEQ ID NO: 1211709 - RNA, 19 nt, Human
ucgcacaggccccgccggc

SEQ ID NO: 1211710 - RNA, 23 nt, Human
ucucuacuaaaaauacaaaaauu

SEQ ID NO: 1211711 - RNA, 21 nt, Human
ucucugaacggccuuccacuc

SEQ ID NO: 1211712 - RNA, 22 nt, Human
ucugucaaaaaaaaaaaagaga

SEQ ID NO: 1211713 - RNA, 19 nt, Human
ugaaaccccaucucuacua

SEQ ID NO: 1211714 - RNA, 24 nt, Human
ugaauacuuucauccauaaguuuu

SEQ ID NO: 1211715 - RNA, 22 nt, Human
ugagccgagaucgcaccacugc

SEQ ID NO: 1211716 - RNA, 20 nt, Human
ugaggcaggagaaucacuug

SEQ ID NO: 1211717 - RNA, 24 nt, Human
ugaggcaggagaaucacuugaacc

SEQ ID NO: 1211718 - RNA, 25 nt, Human
ugaggcaggagaaucacuugaaccc

SEQ ID NO: 1211719 - RNA, 24 nt, Human
ugaggugggccaaucacgagguca

SEQ ID NO: 1211720 - RNA, 18 nt, Human
ugauacaggcacacagac

SEQ ID NO: 1211721 - RNA, 18 nt, Human
ugauacaggcacacagac

SEQ ID NO: 1211722 - RNA, 18 nt, Human
ugccaaggacgaggacag

SEQ ID NO: 1211723 - RNA, 21 nt, Human
uggcaauaaaaaaacaagcag

SEQ ID NO: 1211724 - RNA, 19 nt, Human
uggcgauaaacaaggguuc

SEQ ID NO: 1211725 - RNA, 22 nt, Human
uggcucacaucuguaauaccag

SEQ ID NO: 1211726 - RNA, 24 nt, Human
uggcucacaucuguaauaccagca

SEQ ID NO: 1211727 - RNA, 19 nt, Human
ugggaggcugaggcaggag

SEQ ID NO: 1211728 - RNA, 24 nt, Human
ugggaggcugaggcaggagaauca

SEQ ID NO: 1211729 - RNA, 24 nt, Human
ugggaggcugaggugggccaauca

SEQ ID NO: 1211730 - RNA, 21 nt, Human
ugggccaaucacgaggucagg

SEQ ID NO: 1211731 - RNA, 24 nt, Human
ugguggcgggcgccuguaauccca

SEQ ID NO: 1211732 - RNA, 18 nt, Human
uguaaucccaccuacuug

SEQ ID NO: 1211733 - RNA, 20 nt, Human
uguauacauacacacaugua

SEQ ID NO: 1211734 - RNA, 22 nt, Human
uguauacauacacacauguaua

SEQ ID NO: 1211735 - RNA, 24 nt, Human
uguauacauacacacauguauaua

SEQ ID NO: 1211736 - RNA, 25 nt, Human
uguauacauacacacauguauauag

SEQ ID NO: 1211737 - RNA, 18 nt, Human
uguauacauacauauaug

SEQ ID NO: 1211738 - RNA, 21 nt, Human
uguauacauacauauaugugu

SEQ ID NO: 1211739 - RNA, 24 nt, Human
uguauacauacauauauguguaua

SEQ ID NO: 1211740 - RNA, 26 nt, Human
uguauacauacauauauguguauaua

SEQ ID NO: 1211741 - RNA, 19 nt, Human
uguauacauauauguguau

SEQ ID NO: 1211742 - RNA, 22 nt, Human
uguauacauauauguguauaua

SEQ ID NO: 1211743 - RNA, 22 nt, Human
uguauacauauauguguauaua

SEQ ID NO: 1211744 - RNA, 24 nt, Human
uguauacauauauguguauauaug

SEQ ID NO: 1211745 - RNA, 24 nt, Human
uguauacauauauguguauauaug

SEQ ID NO: 1211746 - RNA, 24 nt, Human
uguauacauauauguguauguaua

SEQ ID NO: 1211747 - RNA, 18 nt, Human
uguauauacauguauaca

SEQ ID NO: 1211748 - RNA, 18 nt, Human
uguauauacauguauaca

SEQ ID NO: 1211749 - RNA, 19 nt, Human
uguauauauacauauauau

SEQ ID NO: 1211750 - RNA, 21 nt, Human
uguauauauacauauauaugu

SEQ ID NO: 1211751 - RNA, 22 nt, Human
uguauauauacauauauaugug

SEQ ID NO: 1211752 - RNA, 24 nt, Human
uguauauauacauauauaugugua

SEQ ID NO: 1211753 - RNA, 21 nt, Human
uguauauauauauauauuuua

SEQ ID NO: 1211754 - RNA, 21 nt, Human
uguauauauguauacauauau

SEQ ID NO: 1211755 - RNA, 21 nt, Human
uguauauauguauacauauau

SEQ ID NO: 1211756 - RNA, 24 nt, Human
uguauauauguauacauauaugug

SEQ ID NO: 1211757 - RNA, 27 nt, Human
uguauauauguauacauauauguguau

SEQ ID NO: 1211758 - RNA, 19 nt, Human
ugucaaaaaaaaaaaagag

SEQ ID NO: 1211759 - RNA, 20 nt, Human
ugucuaaaauguaucugggg

SEQ ID NO: 1211760 - RNA, 23 nt, Human
ugugaacacaaagaaacuuuaca

SEQ ID NO: 1211761 - RNA, 19 nt, Human
uguguauacauacauauau

SEQ ID NO: 1211762 - RNA, 20 nt, Human
uguguauacauacauauaug

SEQ ID NO: 1211763 - RNA, 24 nt, Human
uguguauacauacauauaugugua

SEQ ID NO: 1211764 - RNA, 18 nt, Human
uguguauauauacauaua

SEQ ID NO: 1211765 - RNA, 20 nt, Human
uguguauauauacauauaua

SEQ ID NO: 1211766 - RNA, 20 nt, Human
uguguauauauacauauaua

SEQ ID NO: 1211767 - RNA, 22 nt, Human
uguguauauauacauauauaug

SEQ ID NO: 1211768 - RNA, 18 nt, Human
uguguauauauauauaua

SEQ ID NO: 1211769 - RNA, 19 nt, Human
uguguauauauauauauau

SEQ ID NO: 1211770 - RNA, 18 nt, Human
uguguauauauguauaca

SEQ ID NO: 1211771 - RNA, 18 nt, Human
uguguauauauguauaca

SEQ ID NO: 1211772 - RNA, 22 nt, Human
uguguauauauguauacauaua

SEQ ID NO: 1211773 - RNA, 22 nt, Human
uguguauauauguauacauaua

SEQ ID NO: 1211774 - RNA, 25 nt, Human
uguguauauauguauacauauaugu

SEQ ID NO: 1211775 - RNA, 25 nt, Human
uguguauauauguauacauauaugu

SEQ ID NO: 1211776 - RNA, 18 nt, Human
uguguauguauauaugua

SEQ ID NO: 1211777 - RNA, 19 nt, Human
uguguauguauauauguau

SEQ ID NO: 1211778 - RNA, 22 nt, Human
uguguauguauauauguauaua

SEQ ID NO: 1211779 - RNA, 18 nt, Human
uuagcacaauuuuacuca

SEQ ID NO: 1211780 - RNA, 18 nt, Human
uuagcugggcgugguggc

SEQ ID NO: 1211781 - RNA, 24 nt, Human
uuagcugggcgugguggcgggcgc

SEQ ID NO: 1211782 - RNA, 24 nt, Human
uugaacccgggaggcggagguugc

SEQ ID NO: 1211783 - RNA, 19 nt, Human
uugcagugagccgagaucg

SEQ ID NO: 1211784 - RNA, 20 nt, Human
uugcagugagccgagaucgc

SEQ ID NO: 1211785 - RNA, 22 nt, Human
uugcagugagccgagaucgcac

SEQ ID NO: 1211786 - RNA, 25 nt, Human
uugggaggcugaggcaggagaauca

SEQ ID NO: 1211787 - RNA, 25 nt, Human
uugggaggcugaggugggccaauca

SEQ ID NO: 1211788 - RNA, 26 nt, Human
uuuuuguguauacauacauauaugug

SEQ ID NO: 1211789 - RNA, 30 nt, Human
uuuuuuuuguguauacauacauauaugugu

SEQ ID NO: 1211790 - RNA, 19 nt, Human
aaagacacugcaccuggac

SEQ ID NO: 1211791 - RNA, 22 nt, Human
aaagugcugggauuacagguga

SEQ ID NO: 1211792 - RNA, 23 nt, Human
aaagugcugggauuacaggugaa

SEQ ID NO: 1211793 - RNA, 23 nt, Human
aacuccugggcucaagcgauccu

SEQ ID NO: 1211794 - RNA, 25 nt, Human
aagcgauccucccaccucagccucc

SEQ ID NO: 1211795 - RNA, 18 nt, Human
aagugcugggauuacagg

SEQ ID NO: 1211796 - RNA, 19 nt, Human
aagugcugggauuacaggu

SEQ ID NO: 1211797 - RNA, 27 nt, Human
caaagugcugggauuacaggugaaaga

SEQ ID NO: 1211798 - RNA, 27 nt, Human
caagcgauccucccaccucagccuccc

SEQ ID NO: 1211799 - RNA, 27 nt, Human
caagcgauccucccaccucagccuccc

SEQ ID NO: 1211800 - RNA, 23 nt, Human
cacaccaaaauagugccugucau

SEQ ID NO: 1211801 - RNA, 21 nt, Human
caccaaaauagugccugucau

SEQ ID NO: 1211802 - RNA, 24 nt, Human
caccucagccucccaaagugcugg

SEQ ID NO: 1211803 - RNA, 20 nt, Human
ccaaagugcugggauuacag

SEQ ID NO: 1211804 - RNA, 21 nt, Human
ccaaagugcugggauuacagg

SEQ ID NO: 1211805 - RNA, 21 nt, Human
ccaaagugcugggauuacagg

SEQ ID NO: 1211806 - RNA, 22 nt, Human
ccaaagugcugggauuacaggu

SEQ ID NO: 1211807 - RNA, 24 nt, Human
ccaggcuggucuugaacuccuggg

SEQ ID NO: 1211808 - RNA, 18 nt, Human
ccugggcucaagcgaucc

SEQ ID NO: 1211809 - RNA, 21 nt, Human
ccuuccuaggcaucuuuccca

SEQ ID NO: 1211810 - RNA, 24 nt, Human
cucaagcgauccucccaccucagc

SEQ ID NO: 1211811 - RNA, 23 nt, Human
cuccugggcucaagcgauccucc

SEQ ID NO: 1211812 - RNA, 24 nt, Human
cugcaccuggacuaucuuucuguu

SEQ ID NO: 1211813 - RNA, 19 nt, Human
cuggucuugaacuccuggg

SEQ ID NO: 1211814 - RNA, 23 nt, Human
gauuacaggugaaagacacugca

SEQ ID NO: 1211815 - RNA, 18 nt, Human
ggcuggucuugaacuccu

SEQ ID NO: 1211816 - RNA, 21 nt, Human
guugcccaggcuggucuugaa

SEQ ID NO: 1211817 - RNA, 18 nt, Human
ucagccucccaaagugcu

SEQ ID NO: 1211818 - RNA, 23 nt, Human
ucccaaagugcugggauuacagg

SEQ ID NO: 1211819 - RNA, 27 nt, Human
uccucccaccucagccucccaaagugc

SEQ ID NO: 1211820 - RNA, 21 nt, Human
uccugggcucaagcgauccuc

SEQ ID NO: 1211821 - RNA, 24 nt, Human
uccugggcucaagcgauccuccca

SEQ ID NO: 1211822 - RNA, 23 nt, Human
ucuugaacuccugggcucaagcg

SEQ ID NO: 1211823 - RNA, 23 nt, Human
ucuuucccagcacugcugcuguc

SEQ ID NO: 1211824 - RNA, 21 nt, Human
ucuuucuguuauugcuguggu

SEQ ID NO: 1211825 - RNA, 24 nt, Human
ugcccaggcuggucuugaacuccu

SEQ ID NO: 1211826 - RNA, 28 nt, Human
ugcccaggcuggucuugaacuccugggc

SEQ ID NO: 1211827 - RNA, 20 nt, Human
ugcugggauuacaggugaaa

SEQ ID NO: 1211828 - RNA, 24 nt, Human
ugcugggauuacaggugaaagaca

SEQ ID NO: 1211829 - RNA, 20 nt, Human
ugggauuacaggugaaagac

SEQ ID NO: 1211830 - RNA, 22 nt, Human
ugggauuacaggugaaagacac

SEQ ID NO: 1211831 - RNA, 24 nt, Human
ugggauuacaggugaaagacacug

SEQ ID NO: 1211832 - RNA, 19 nt, Human
uucccagcacugcugcugu

SEQ ID NO: 1211833 - RNA, 21 nt, Human
aaaacccccaagacauuccag

SEQ ID NO: 1211834 - RNA, 18 nt, Human
aaauauuucuugggucaa

SEQ ID NO: 1211835 - RNA, 18 nt, Human
aagaugugucucuuggau

SEQ ID NO: 1211836 - RNA, 18 nt, Human
agaagaacaggcagaggc

SEQ ID NO: 1211837 - RNA, 19 nt, Human
agaagaacaggcagaggca

SEQ ID NO: 1211838 - RNA, 21 nt, Human
agaagaacaggcagaggcagg

SEQ ID NO: 1211839 - RNA, 22 nt, Human
agaagcucucuuaucuuccaaa

SEQ ID NO: 1211840 - RNA, 19 nt, Human
aggcagggcccacaguggc

SEQ ID NO: 1211841 - RNA, 23 nt, Human
caaaacccccaagacauuccaga

SEQ ID NO: 1211842 - RNA, 20 nt, Human
caaagaugugucucuuggau

SEQ ID NO: 1211843 - RNA, 22 nt, Human
caacaaaucaaucucacauaug

SEQ ID NO: 1211844 - RNA, 21 nt, Human
caagcaggcuccucggggucc

SEQ ID NO: 1211845 - RNA, 23 nt, Human
cacagugacaggaucaaaacccc

SEQ ID NO: 1211846 - RNA, 20 nt, Human
cacauaugccuccucagaaa

SEQ ID NO: 1211847 - RNA, 23 nt, Human
cacauaugccuccucagaaacaa

SEQ ID NO: 1211848 - RNA, 22 nt, Human
cacccagacgccuccgggggac

SEQ ID NO: 1211849 - RNA, 21 nt, Human
cacuuggcaugaaccaacaaa

SEQ ID NO: 1211850 - RNA, 22 nt, Human
cagagguccacauucaaaguca

SEQ ID NO: 1211851 - RNA, 24 nt, Human
cagcaagcaggcuccucggggucc

SEQ ID NO: 1211852 - RNA, 23 nt, Human
cagcagccuucugcgcugggugc

SEQ ID NO: 1211853 - RNA, 19 nt, Human
cagggcgcccucccucucc

SEQ ID NO: 1211854 - RNA, 22 nt, Human
caugaaccaacaaaucaaucuc

SEQ ID NO: 1211855 - RNA, 21 nt, Human
ccaagacauuccagaagaaca

SEQ ID NO: 1211856 - RNA, 21 nt, Human
ccagaagaacaggcagaggca

SEQ ID NO: 1211857 - RNA, 22 nt, Human
cccaagacauuccagaagaaca

SEQ ID NO: 1211858 - RNA, 27 nt, Human
cccacaguggcugaaggacuacaaagg

SEQ ID NO: 1211859 - RNA, 21 nt, Human
ccccaagacauuccagaagaa

SEQ ID NO: 1211860 - RNA, 26 nt, Human
cccccaagacauuccagaagaacagg

SEQ ID NO: 1211861 - RNA, 20 nt, Human
ccccuguaucgaaggaugag

SEQ ID NO: 1211862 - RNA, 21 nt, Human
ccugccugucuuucuacggaa

SEQ ID NO: 1211863 - RNA, 19 nt, Human
ccuuuuuuggucuugaaga

SEQ ID NO: 1211864 - RNA, 24 nt, Human
cgggaugcucgccuccucugccgg

SEQ ID NO: 1211865 - RNA, 18 nt, Human
cucagagguccacauuca

SEQ ID NO: 1211866 - RNA, 19 nt, Human
cugcauaguguuccucacu

SEQ ID NO: 1211867 - RNA, 18 nt, Human
gaacacacuuggcaugaa

SEQ ID NO: 1211868 - RNA, 21 nt, Human
gaacacacuuggcaugaacca

SEQ ID NO: 1211869 - RNA, 20 nt, Human
gaaccaacaaaucaaucuca

SEQ ID NO: 1211870 - RNA, 19 nt, Human
gagagccauccugcgugga

SEQ ID NO: 1211871 - RNA, 24 nt, Human
gcagcagccuucugcgcugggugc

SEQ ID NO: 1211872 - RNA, 18 nt, Human
gcagggcgcccucccucu

SEQ ID NO: 1211873 - RNA, 20 nt, Human
gcgcugggugcgcgaggggu

SEQ ID NO: 1211874 - RNA, 20 nt, Human
gcggcagcagccuucugcgc

SEQ ID NO: 1211875 - RNA, 24 nt, Human
ggacaccucacaggugcgccuccg

SEQ ID NO: 1211876 - RNA, 22 nt, Human
gggaauucccuacauggguauc

SEQ ID NO: 1211877 - RNA, 20 nt, Human
uacaggguuuccuuccuagu

SEQ ID NO: 1211878 - RNA, 21 nt, Human
uagaaaaaggacuguacagua

SEQ ID NO: 1211879 - RNA, 26 nt, Human
uaucaugccgucuccuuuuuuggucu

SEQ ID NO: 1211880 - RNA, 23 nt, Human
ucaaucucacauaugccuccuca

SEQ ID NO: 1211881 - RNA, 21 nt, Human
ucacaggugcgccuccgagcc

SEQ ID NO: 1211882 - RNA, 22 nt, Human
ucugcgcugggugcgcgagggg

SEQ ID NO: 1211883 - RNA, 22 nt, Human
ucugugacugggaccugagagc

SEQ ID NO: 1211884 - RNA, 18 nt, Human
ugacugggaccugagagc

SEQ ID NO: 1211885 - RNA, 20 nt, Human
ugacuuccacgugaauucuu

SEQ ID NO: 1211886 - RNA, 20 nt, Human
ugagccccuggaaucuuccu

SEQ ID NO: 1211887 - RNA, 18 nt, Human
ugcgcugggugcgcgagg

SEQ ID NO: 1211888 - RNA, 21 nt, Human
ugcucagagguccacauucaa

SEQ ID NO: 1211889 - RNA, 19 nt, Human
uggcugaaggacuacaaag

SEQ ID NO: 1211890 - RNA, 21 nt, Human
uuccaaagaugugucucuugg

SEQ ID NO: 1211891 - RNA, 20 nt, Human
uucccugccugucuuucuac

SEQ ID NO: 1211892 - RNA, 18 nt, Human
aaaaaaaaaaagaaagaa

SEQ ID NO: 1211893 - RNA, 23 nt, Human
aaaaaaaaaagaaagaaagauuu

SEQ ID NO: 1211894 - RNA, 23 nt, Human
aaauagcauuauuauauaaggau

SEQ ID NO: 1211895 - RNA, 18 nt, Human
aacuguacaugcaaaaac

SEQ ID NO: 1211896 - RNA, 22 nt, Human
aagaaagaaagauuuagagaaa

SEQ ID NO: 1211897 - RNA, 23 nt, Human
aagcagauguaguuucuuaagac

SEQ ID NO: 1211898 - RNA, 24 nt, Human
acaaaauacaaaccaacugcaguc

SEQ ID NO: 1211899 - RNA, 20 nt, Human
acaacuucacaaaacuguaa

SEQ ID NO: 1211900 - RNA, 19 nt, Human
acagagcaccaggcacaaa

SEQ ID NO: 1211901 - RNA, 19 nt, Human
acugcugaaaccaaacuga

SEQ ID NO: 1211902 - RNA, 20 nt, Human
agaaagaaagauuuagagaa

SEQ ID NO: 1211903 - RNA, 21 nt, Human
agacauccauacuuugcuuca

SEQ ID NO: 1211904 - RNA, 20 nt, Human
agagcaccaggcacaaagca

SEQ ID NO: 1211905 - RNA, 20 nt, Human
aggcaggucaguauauagga

SEQ ID NO: 1211906 - RNA, 20 nt, Human
caaagcauuaacucagcacu

SEQ ID NO: 1211907 - RNA, 22 nt, Human
caacaauacauuggaaauuagc

SEQ ID NO: 1211908 - RNA, 19 nt, Human
caaccaggagacacaucug

SEQ ID NO: 1211909 - RNA, 22 nt, Human
caacuugggacaaagaaaacaa

SEQ ID NO: 1211910 - RNA, 23 nt, Human
caacuugggacaaagaaaacaau

SEQ ID NO: 1211911 - RNA, 28 nt, Human
caagaaauuccgaucaagagagccagua

SEQ ID NO: 1211912 - RNA, 23 nt, Human
cacauuaacugcugaaaccaaac

SEQ ID NO: 1211913 - RNA, 18 nt, Human
cagccugugcaccuugug

SEQ ID NO: 1211914 - RNA, 24 nt, Human
cauuacagagcaccaggcacaaag

SEQ ID NO: 1211915 - RNA, 18 nt, Human
cauugauacagagacugc

SEQ ID NO: 1211916 - RNA, 26 nt, Human
ccaggagacacaucugccgggcuuaa

SEQ ID NO: 1211917 - RNA, 20 nt, Human
ccauacuuugcuucaagcau

SEQ ID NO: 1211918 - RNA, 19 nt, Human
cccagcaaacauugcugag

SEQ ID NO: 1211919 - RNA, 18 nt, Human
cccauacccagcaaacau

SEQ ID NO: 1211920 - RNA, 19 nt, Human
ccucccuuaauguagucaa

SEQ ID NO: 1211921 - RNA, 20 nt, Human
cucaugcaacaaccauauuu

SEQ ID NO: 1211922 - RNA, 24 nt, Human
cuuaaacucccauacccagcaaac

SEQ ID NO: 1211923 - RNA, 23 nt, Human
cuuccagccugugcaccuugugu

SEQ ID NO: 1211924 - RNA, 24 nt, Human
gaaaaauagaaaagcauuuuuccc

SEQ ID NO: 1211925 - RNA, 21 nt, Human
gacaaagaaaacaauguacag

SEQ ID NO: 1211926 - RNA, 18 nt, Human
gacugcuuuccuauacac

SEQ ID NO: 1211927 - RNA, 23 nt, Human
gugcuuuuucccaacaauacauu

SEQ ID NO: 1211928 - RNA, 23 nt, Human
guuaaaaaaaaaaagaaagaaag

SEQ ID NO: 1211929 - RNA, 21 nt, Human
uaaaaaaaaaaagaaagaaag

SEQ ID NO: 1211930 - RNA, 24 nt, Human
uaaaauaucuagacaagauauaau

SEQ ID NO: 1211931 - RNA, 20 nt, Human
uaacaagaaauuccgaucaa

SEQ ID NO: 1211932 - RNA, 21 nt, Human
uaacaagaaauuccgaucaag

SEQ ID NO: 1211933 - RNA, 21 nt, Human
uaagacaauccaguuacugaa

SEQ ID NO: 1211934 - RNA, 21 nt, Human
uacaugcaaaaacccuuuaca

SEQ ID NO: 1211935 - RNA, 19 nt, Human
uagaaaagcauuuuucccu

SEQ ID NO: 1211936 - RNA, 21 nt, Human
uagaauauauagguaaggaaa

SEQ ID NO: 1211937 - RNA, 26 nt, Human
uaguugacauuagcauuucagagcac

SEQ ID NO: 1211938 - RNA, 21 nt, Human
uauaaaagucacccuagguca

SEQ ID NO: 1211939 - RNA, 24 nt, Human
ucacauaguuguauauauuuaacu

SEQ ID NO: 1211940 - RNA, 18 nt, Human
uccagacagucauucaaa

SEQ ID NO: 1211941 - RNA, 22 nt, Human
ucuaaauuuagaacccaaacuc

SEQ ID NO: 1211942 - RNA, 22 nt, Human
ucuguuaaaaaaaaaaagaaag

SEQ ID NO: 1211943 - RNA, 24 nt, Human
ucuguuaaaaaaaaaaagaaagaa

SEQ ID NO: 1211944 - RNA, 29 nt, Human
ugacacacacacacacacaaauaaauaca

SEQ ID NO: 1211945 - RNA, 20 nt, Human
ugagaaaacuaucucauugc

SEQ ID NO: 1211946 - RNA, 18 nt, Human
ugauuugcgucccucccu

SEQ ID NO: 1211947 - RNA, 23 nt, Human
ugcacuaagucacauaguuguau

SEQ ID NO: 1211948 - RNA, 28 nt, Human
ugcgucccucccuuaauguagucaagga

SEQ ID NO: 1211949 - RNA, 19 nt, Human
uggcaacguggaaugguga

SEQ ID NO: 1211950 - RNA, 23 nt, Human
uguaaaaucaauagccacuguga

SEQ ID NO: 1211951 - RNA, 21 nt, Human
uguaaacauugauacagagac

SEQ ID NO: 1211952 - RNA, 23 nt, Human
uguaauucuuguaaaaacuguac

SEQ ID NO: 1211953 - RNA, 23 nt, Human
uuaaacucccauacccagcaaac

SEQ ID NO: 1211954 - RNA, 23 nt, Human
uuagaagacaaaggauucaguau

SEQ ID NO: 1211955 - RNA, 22 nt, Human
uuagagaagacauccauacuuu

SEQ ID NO: 1211956 - RNA, 20 nt, Human
uucaaccaggagacacaucu

SEQ ID NO: 1211957 - RNA, 20 nt, Human
uucacaaaagacuuccagcc

SEQ ID NO: 1211958 - RNA, 24 nt, Human
uuccaguaaaauaguuucaugcuu

SEQ ID NO: 1211959 - RNA, 22 nt, Human
uucccuucccuuauuugcaauu

SEQ ID NO: 1211960 - RNA, 19 nt, Human
uuucacaaauguguugugc

SEQ ID NO: 1211961 - RNA, 22 nt, Human
uuucaugcuuauaaaagucacc

SEQ ID NO: 1211962 - RNA, 18 nt, Human
uuuccaggaauuccguga

SEQ ID NO: 1211963 - RNA, 19 nt, Human
uuuguucuaaagaaaugcu

SEQ ID NO: 1211964 - RNA, 18 nt, Human
aauaaaguagacauccaa

SEQ ID NO: 1211965 - RNA, 24 nt, Human
aauaaaguagacauccaaaaaugu

SEQ ID NO: 1211966 - RNA, 19 nt, Human
aaucuucuuuucuucaggc

SEQ ID NO: 1211967 - RNA, 18 nt, Human
caucagaguuugcugggg

SEQ ID NO: 1211968 - RNA, 22 nt, Human
cucacgguuggcaaucucuucc

SEQ ID NO: 1211969 - RNA, 19 nt, Human
uaaaaacaaagcuuuaauc

SEQ ID NO: 1211970 - RNA, 28 nt, Human
uaaaguagacauccaaaaauguggaugu

SEQ ID NO: 1211971 - RNA, 19 nt, Human
ucugcuuuccaaaaguaaa

SEQ ID NO: 1211972 - RNA, 26 nt, Human
uggaugucauuuaaaaacaaagcuuu

SEQ ID NO: 1211973 - RNA, 21 nt, Human
uucuucaggcaaagccuccgg

SEQ ID NO: 1211974 - RNA, 26 nt, Human
aaaauggggcuacagggaggcuccaa

SEQ ID NO: 1211975 - RNA, 22 nt, Human
aagaagaaaaaagaaguugcaa

SEQ ID NO: 1211976 - RNA, 20 nt, Human
aagcuaaagccugaaaaagu

SEQ ID NO: 1211977 - RNA, 22 nt, Human
aagcuaaagccugaaaaagucc

SEQ ID NO: 1211978 - RNA, 26 nt, Human
aaguaaucggugaagaauaucccagc

SEQ ID NO: 1211979 - RNA, 19 nt, Human
acaaagaagaaaaaagaag

SEQ ID NO: 1211980 - RNA, 21 nt, Human
acagcaaucagaguuauaacc

SEQ ID NO: 1211981 - RNA, 23 nt, Human
agaaaaaagaaguugcaagagga

SEQ ID NO: 1211982 - RNA, 24 nt, Human
agaagaaaaaagaaguugcaagag

SEQ ID NO: 1211983 - RNA, 18 nt, Human
aguaaucggugaagaaua

SEQ ID NO: 1211984 - RNA, 19 nt, Human
caugcugucagaaaauggg

SEQ ID NO: 1211985 - RNA, 27 nt, Human
cauuuuauucuccucauuaaugucuca

SEQ ID NO: 1211986 - RNA, 22 nt, Human
cccaaacuugaacaaauuaggc

SEQ ID NO: 1211987 - RNA, 27 nt, Human
cuaaagccugaaaaaguccuucagcaa

SEQ ID NO: 1211988 - RNA, 22 nt, Human
cugcuagauuugcugauugugc

SEQ ID NO: 1211989 - RNA, 21 nt, Human
cuugaacaaauuaggcacagc

SEQ ID NO: 1211990 - RNA, 20 nt, Human
cuuuagccgggccagcuuuc

SEQ ID NO: 1211991 - RNA, 23 nt, Human
gccgcacuggaggcuuugaaugc

SEQ ID NO: 1211992 - RNA, 19 nt, Human
ggaaacauauauuuccaag

SEQ ID NO: 1211993 - RNA, 20 nt, Human
ggaggcuccaaaugugcuga

SEQ ID NO: 1211994 - RNA, 21 nt, Human
gggaggcuccaaaugugcuga

SEQ ID NO: 1211995 - RNA, 19 nt, Human
uacaaagaagaaaaaagaa

SEQ ID NO: 1211996 - RNA, 25 nt, Human
uacaaagaagaaaaaagaaguugca

SEQ ID NO: 1211997 - RNA, 22 nt, Human
uauaaccaaggucuggaaaacc

SEQ ID NO: 1211998 - RNA, 18 nt, Human
ucagaaaauggggcuaca

SEQ ID NO: 1211999 - RNA, 24 nt, Human
ucucaaaacuguuggaagcuaaag

SEQ ID NO: 1212000 - RNA, 19 nt, Human
ucugcuagauuugcugauu

SEQ ID NO: 1212001 - RNA, 23 nt, Human
ugaagaauaucccagcaaaauaa

SEQ ID NO: 1212002 - RNA, 20 nt, Human
ugacauuggugggugugugu

SEQ ID NO: 1212003 - RNA, 26 nt, Human
ugcugucagaaaauggggcuacaggg

SEQ ID NO: 1212004 - RNA, 19 nt, Human
uggaagcuaaagccugaaa

SEQ ID NO: 1212005 - RNA, 19 nt, Human
uguggcuuuccagcccuuu

SEQ ID NO: 1212006 - RNA, 18 nt, Human
uuccugaguauuuuucuu

SEQ ID NO: 1212007 - RNA, 18 nt, Human
uucuuggagaagaugcac

SEQ ID NO: 1212008 - RNA, 25 nt, Human
ccaagugggacaugaaaugucauuu

SEQ ID NO: 1212009 - RNA, 19 nt, Human
ccccucuguuuucugcacc

SEQ ID NO: 1212010 - RNA, 24 nt, Human
cucuucugucuucaaugcugaggg

SEQ ID NO: 1212011 - RNA, 19 nt, Human
cuucuugcggcaggagaug

SEQ ID NO: 1212012 - RNA, 18 nt, Human
gcugcgcaggauaugaag

SEQ ID NO: 1212013 - RNA, 21 nt, Human
ggcagguggggugcuucuugc

SEQ ID NO: 1212014 - RNA, 24 nt, Human
ucauuugccucuucugucuucaau

SEQ ID NO: 1212015 - RNA, 18 nt, Human
ucugguccccucuguuuu

SEQ ID NO: 1212016 - RNA, 21 nt, Human
ucuucugucuucaaugcugag

SEQ ID NO: 1212017 - RNA, 18 nt, Human
ugaaaugucauuugccuc

SEQ ID NO: 1212018 - RNA, 20 nt, Human
ugaaggagucugguccccuc

SEQ ID NO: 1212019 - RNA, 20 nt, Human
ugcggcaggagaugacgcug

SEQ ID NO: 1212020 - RNA, 21 nt, Human
aagacaacgcccagacaaagc

SEQ ID NO: 1212021 - RNA, 22 nt, Human
aagcacgaggaaggggccccag

SEQ ID NO: 1212022 - RNA, 22 nt, Human
aaggagaagcacgaggaagggg

SEQ ID NO: 1212023 - RNA, 22 nt, Human
agaagcaugggggcugacccuc

SEQ ID NO: 1212024 - RNA, 21 nt, Human
agaaguccgguggccuuggga

SEQ ID NO: 1212025 - RNA, 23 nt, Human
agacaacgcccagacaaagcuca

SEQ ID NO: 1212026 - RNA, 19 nt, Human
agccgaagacaacgcccag

SEQ ID NO: 1212027 - RNA, 21 nt, Human
aggaagcugcccagaaaggga

SEQ ID NO: 1212028 - RNA, 18 nt, Human
aggcagaagcaugggggc

SEQ ID NO: 1212029 - RNA, 18 nt, Human
aggccugggguggggugg

SEQ ID NO: 1212030 - RNA, 22 nt, Human
aggugaggggcaggccuggggu

SEQ ID NO: 1212031 - RNA, 19 nt, Human
aucagguucgugacccacu

SEQ ID NO: 1212032 - RNA, 27 nt, Human
caaagcucaccagcuccagggccaccc

SEQ ID NO: 1212033 - RNA, 22 nt, Human
cacccaccucgggggagagagg

SEQ ID NO: 1212034 - RNA, 22 nt, Human
caccucgggggagagagggggu

SEQ ID NO: 1212035 - RNA, 21 nt, Human
cacucuaggaggagaugacuc

SEQ ID NO: 1212036 - RNA, 18 nt, Human
cagcagagcagggacaga

SEQ ID NO: 1212037 - RNA, 19 nt, Human
cagcagagcagggacagaa

SEQ ID NO: 1212038 - RNA, 26 nt, Human
cagcaguaggaaacagacagaaacag

SEQ ID NO: 1212039 - RNA, 23 nt, Human
cagccacagauggccagaaacuu

SEQ ID NO: 1212040 - RNA, 18 nt, Human
caggaccuucccaaaccc

SEQ ID NO: 1212041 - RNA, 19 nt, Human
caggggcgaaagcagcaga

SEQ ID NO: 1212042 - RNA, 22 nt, Human
ccacccgugggaaugcagcugg

SEQ ID NO: 1212043 - RNA, 23 nt, Human
ccagaaacuuugguuuguguuug

SEQ ID NO: 1212044 - RNA, 20 nt, Human
cccagaucagagaacgaagc

SEQ ID NO: 1212045 - RNA, 26 nt, Human
ccucaaggaagcugcccagaaaggga

SEQ ID NO: 1212046 - RNA, 19 nt, Human
ccucaggaaggagaagcac

SEQ ID NO: 1212047 - RNA, 19 nt, Human
ccucgggggagagaggggg

SEQ ID NO: 1212048 - RNA, 19 nt, Human
ccuuccaccccaugggagc

SEQ ID NO: 1212049 - RNA, 23 nt, Human
ccuucccaaacccucaggaagga

SEQ ID NO: 1212050 - RNA, 21 nt, Human
cgcccagacaaagcucaccag

SEQ ID NO: 1212051 - RNA, 23 nt, Human
cucaggaaggagaagcacgagga

SEQ ID NO: 1212052 - RNA, 25 nt, Human
cugaggcagaagcaugggggcugac

SEQ ID NO: 1212053 - RNA, 21 nt, Human
cuggggugggguggggugggg

SEQ ID NO: 1212054 - RNA, 26 nt, Human
cugguuccuccaucagggcgcugugg

SEQ ID NO: 1212055 - RNA, 19 nt, Human
gaaagcagcagagcaggga

SEQ ID NO: 1212056 - RNA, 20 nt, Human
gaaagcagcagagcagggac

SEQ ID NO: 1212057 - RNA, 24 nt, Human
gaaagcagcagagcagggacagaa

SEQ ID NO: 1212058 - RNA, 22 nt, Human
gaagagacgccacggugcccac

SEQ ID NO: 1212059 - RNA, 18 nt, Human
gacaacgcccagacaaag

SEQ ID NO: 1212060 - RNA, 22 nt, Human
gacugcuuccugagggagcaga

SEQ ID NO: 1212061 - RNA, 19 nt, Human
gagaagcacgaggaagggg

SEQ ID NO: 1212062 - RNA, 19 nt, Human
gagagugggagauuuaggg

SEQ ID NO: 1212063 - RNA, 21 nt, Human
gagccccaucagguucgugac

SEQ ID NO: 1212064 - RNA, 20 nt, Human
gccccagaggugggaaugag

SEQ ID NO: 1212065 - RNA, 23 nt, Human
gccccaggaccuucccaaacccu

SEQ ID NO: 1212066 - RNA, 21 nt, Human
ggaacaggcuccuuccacccc

SEQ ID NO: 1212067 - RNA, 23 nt, Human
ggaggagaugacucagaccccag

SEQ ID NO: 1212068 - RNA, 18 nt, Human
ggcaggccuggggugggg

SEQ ID NO: 1212069 - RNA, 18 nt, Human
ggccugaggcagaagcau

SEQ ID NO: 1212070 - RNA, 20 nt, Human
ggccugaggcagaagcaugg

SEQ ID NO: 1212071 - RNA, 23 nt, Human
gggagauuuagggcagggcagaa

SEQ ID NO: 1212072 - RNA, 20 nt, Human
gggcagggcagaagagacgc

SEQ ID NO: 1212073 - RNA, 22 nt, Human
ggggcaggccugggguggggug

SEQ ID NO: 1212074 - RNA, 25 nt, Human
ggggccugaggcagaagcauggggg

SEQ ID NO: 1212075 - RNA, 21 nt, Human
gggguggggccugaggcagaa

SEQ ID NO: 1212076 - RNA, 23 nt, Human
gguucgugacccacucuaggagg

SEQ ID NO: 1212077 - RNA, 23 nt, Human
guaggaaacagacagaaacagag

SEQ ID NO: 1212078 - RNA, 18 nt, Human
uaggaaacagacagaaac

SEQ ID NO: 1212079 - RNA, 26 nt, Human
uauggcccugaggugaggggcaggcc

SEQ ID NO: 1212080 - RNA, 25 nt, Human
uccuuccaccccaugggagccccag

SEQ ID NO: 1212081 - RNA, 23 nt, Human
ucugguuccuccaucagggcgcu

SEQ ID NO: 1212082 - RNA, 20 nt, Human
ugacccacucuaggaggaga

SEQ ID NO: 1212083 - RNA, 22 nt, Human
ugacgagggucagcaggggcga

SEQ ID NO: 1212084 - RNA, 21 nt, Human
ugagagagcagcaguaggaaa

SEQ ID NO: 1212085 - RNA, 20 nt, Human
ugaggggcaggccuggggug

SEQ ID NO: 1212086 - RNA, 21 nt, Human
ugaggugaggggcaggccugg

SEQ ID NO: 1212087 - RNA, 23 nt, Human
ugaggugaggggcaggccugggg

SEQ ID NO: 1212088 - RNA, 20 nt, Human
ugagguugagagagcagcag

SEQ ID NO: 1212089 - RNA, 18 nt, Human
ugccccaggaccuuccca

SEQ ID NO: 1212090 - RNA, 19 nt, Human
ugccccaggaccuucccaa

SEQ ID NO: 1212091 - RNA, 22 nt, Human
ugccccaggaccuucccaaacc

SEQ ID NO: 1212092 - RNA, 26 nt, Human
uggccagaaacuuugguuuguguuug

SEQ ID NO: 1212093 - RNA, 23 nt, Human
ugggagaagggugcuggaacagg

SEQ ID NO: 1212094 - RNA, 24 nt, Human
ugggagaagggugcuggaacaggc

SEQ ID NO: 1212095 - RNA, 18 nt, Human
ugggagccccagagucug

SEQ ID NO: 1212096 - RNA, 25 nt, Human
ugggaggagcaaugccagccgaaga

SEQ ID NO: 1212097 - RNA, 20 nt, Human
ugggggcugacccucugccu

SEQ ID NO: 1212098 - RNA, 18 nt, Human
uggggugggguggggccu

SEQ ID NO: 1212099 - RNA, 21 nt, Human
uggggugggguggggccugag

SEQ ID NO: 1212100 - RNA, 23 nt, Human
uggggugggguggggccugaggc

SEQ ID NO: 1212101 - RNA, 21 nt, Human
ugggguggggugggguggggc

SEQ ID NO: 1212102 - RNA, 23 nt, Human
ugguuuguguuuguuuucaaguu

SEQ ID NO: 1212103 - RNA, 18 nt, Human
aguucccagcagcugcuc

SEQ ID NO: 1212104 - RNA, 21 nt, Human
ccauuugagccugauauucca

SEQ ID NO: 1212105 - RNA, 21 nt, Human
cccuggauccagacugugccc

SEQ ID NO: 1212106 - RNA, 22 nt, Human
cugcaggcuuucuuuuuugucc

SEQ ID NO: 1212107 - RNA, 23 nt, Human
cuucacaacagccuuugcucuuu

SEQ ID NO: 1212108 - RNA, 18 nt, Human
gcaggugggccagcaguc

SEQ ID NO: 1212109 - RNA, 18 nt, Human
ggagggaccuccauuuga

SEQ ID NO: 1212110 - RNA, 18 nt, Human
uaacuggcaaucccacug

SEQ ID NO: 1212111 - RNA, 21 nt, Human
ucaaugccagagacagucagu

SEQ ID NO: 1212112 - RNA, 18 nt, Human
ucacaacagccuuugcuc

SEQ ID NO: 1212113 - RNA, 25 nt, Human
uccacaccuuccuuaacaugcuuua

SEQ ID NO: 1212114 - RNA, 20 nt, Human
ucccacugcucuucuuccca

SEQ ID NO: 1212115 - RNA, 18 nt, Human
ugaacucuugaacguagu

SEQ ID NO: 1212116 - RNA, 20 nt, Human
ugagaacagggagggugggg

SEQ ID NO: 1212117 - RNA, 21 nt, Human
ugcccugcuuagugcauggag

SEQ ID NO: 1212118 - RNA, 21 nt, Human
uggcaggugggccagcagucg

SEQ ID NO: 1212119 - RNA, 21 nt, Human
ugugaacucuugaacguagua

SEQ ID NO: 1212120 - RNA, 19 nt, Human
ugugugaacucuugaacgu

SEQ ID NO: 1212121 - RNA, 27 nt, Human
uuaacuggcaaucccacugcucuucuu

SEQ ID NO: 1212122 - RNA, 22 nt, Human
uuccuuuaaaucaagacaguuc

SEQ ID NO: 1212123 - RNA, 23 nt, Human
uuuaaaucaagacaguucccagc

SEQ ID NO: 1212124 - RNA, 23 nt, Human
caauuacugaugauccauuuggc

SEQ ID NO: 1212125 - RNA, 22 nt, Human
cauagcaguggucaauuacuga

SEQ ID NO: 1212126 - RNA, 23 nt, Human
caugcaauucaaauuuauuccac

SEQ ID NO: 1212127 - RNA, 21 nt, Human
cuauaugguggguacgaccuu

SEQ ID NO: 1212128 - RNA, 23 nt, Human
gguacgaccuuggcauagcagug

SEQ ID NO: 1212129 - RNA, 19 nt, Human
uaaaaagagaaucucucau

SEQ ID NO: 1212130 - RNA, 22 nt, Human
uaaaaagagaaucucucauuuc

SEQ ID NO: 1212131 - RNA, 20 nt, Human
uagauugcaugaaguucuga

SEQ ID NO: 1212132 - RNA, 21 nt, Human
uuggcauagcaguggucaauu

SEQ ID NO: 1212133 - RNA, 20 nt, Human
uuuauuugucuucucaugua

SEQ ID NO: 1212134 - RNA, 23 nt, Human
uuuguaaguaucuccaucuauau

SEQ ID NO: 1212135 - RNA, 22 nt, Human
aaaaaaaaaauccauucuggaa

SEQ ID NO: 1212136 - RNA, 24 nt, Human
aaaaauacagggauugaaaauggc

SEQ ID NO: 1212137 - RNA, 24 nt, Human
aaacuagcucacacagacucacac

SEQ ID NO: 1212138 - RNA, 24 nt, Human
aaccugucucuccacgcagcgcca

SEQ ID NO: 1212139 - RNA, 21 nt, Human
acccucaaaaaugaacucuga

SEQ ID NO: 1212140 - RNA, 22 nt, Human
accugcugcucccucucaaccc

SEQ ID NO: 1212141 - RNA, 22 nt, Human
accugucucuccacgcagcgcc

SEQ ID NO: 1212142 - RNA, 23 nt, Human
agaaugugcuucuuacgcaugua

SEQ ID NO: 1212143 - RNA, 20 nt, Human
agacaaauucaaaaacaaaa

SEQ ID NO: 1212144 - RNA, 20 nt, Human
agauaaccaguuccacagaa

SEQ ID NO: 1212145 - RNA, 26 nt, Human
agcgaugacacaagagccugcaaaug

SEQ ID NO: 1212146 - RNA, 25 nt, Human
aguaaaauuauauuugaaagcuucc

SEQ ID NO: 1212147 - RNA, 20 nt, Human
caccacacccggcucugcug

SEQ ID NO: 1212148 - RNA, 20 nt, Human
cacuguggaacaaggaauau

SEQ ID NO: 1212149 - RNA, 23 nt, Human
cagcaacucuguuuucuagaggg

SEQ ID NO: 1212150 - RNA, 19 nt, Human
cagggagcuccgagagguc

SEQ ID NO: 1212151 - RNA, 22 nt, Human
cagugagacccacucccggguc

SEQ ID NO: 1212152 - RNA, 18 nt, Human
cauagcacuguggaacaa

SEQ ID NO: 1212153 - RNA, 19 nt, Human
cauagcacuguggaacaag

SEQ ID NO: 1212154 - RNA, 20 nt, Human
cauugccagauuuaaaaaaa

SEQ ID NO: 1212155 - RNA, 24 nt, Human
ccacccccaaaagguagauaaucu

SEQ ID NO: 1212156 - RNA, 24 nt, Human
cccaaaagguagauaaucuuuuua

SEQ ID NO: 1212157 - RNA, 26 nt, Human
cccaggugcuucacugucgccguccu

SEQ ID NO: 1212158 - RNA, 22 nt, Human
cccauagucauacacauacgca

SEQ ID NO: 1212159 - RNA, 18 nt, Human
ccgggggaggcagggguu

SEQ ID NO: 1212160 - RNA, 25 nt, Human
ccucaaaucaguuccaucccuuuuc

SEQ ID NO: 1212161 - RNA, 19 nt, Human
ccucagaacuuaggauaaa

SEQ ID NO: 1212162 - RNA, 20 nt, Human
cucuugauuccaagcucauu

SEQ ID NO: 1212163 - RNA, 22 nt, Human
cugcugcucccucucaacccag

SEQ ID NO: 1212164 - RNA, 24 nt, Human
cugggaucacguuuuccucuccaa

SEQ ID NO: 1212165 - RNA, 21 nt, Human
cuuuguuuuacucuucuuuau

SEQ ID NO: 1212166 - RNA, 21 nt, Human
gaaagcuuccccaccacccac

SEQ ID NO: 1212167 - RNA, 19 nt, Human
gagacccacucccgggucc

SEQ ID NO: 1212168 - RNA, 19 nt, Human
gaggcugcucucuuccugg

SEQ ID NO: 1212169 - RNA, 22 nt, Human
gccagauuuaaaaaaacaacag

SEQ ID NO: 1212170 - RNA, 19 nt, Human
gccauggcagauaaccagu

SEQ ID NO: 1212171 - RNA, 21 nt, Human
gcuuguccuucgcaccugggu

SEQ ID NO: 1212172 - RNA, 22 nt, Human
ggacuggggcuggguaaggaug

SEQ ID NO: 1212173 - RNA, 26 nt, Human
ggcuggggccgggggaggcagggguu

SEQ ID NO: 1212174 - RNA, 18 nt, Human
gggaaaacaccaaaugaa

SEQ ID NO: 1212175 - RNA, 20 nt, Human
gggccgggggaggcaggggu

SEQ ID NO: 1212176 - RNA, 18 nt, Human
gggcuggggccgggggag

SEQ ID NO: 1212177 - RNA, 23 nt, Human
gggcuggggccgggggaggcagg

SEQ ID NO: 1212178 - RNA, 21 nt, Human
gggcuggguaaggaugguggg

SEQ ID NO: 1212179 - RNA, 21 nt, Human
ggggaggaagguguuggcagg

SEQ ID NO: 1212180 - RNA, 24 nt, Human
ggggcuggguaaggaugguggggg

SEQ ID NO: 1212181 - RNA, 22 nt, Human
gguguuggcaggcgacacgcag

SEQ ID NO: 1212182 - RNA, 22 nt, Human
gucucgucaaccugucucucca

SEQ ID NO: 1212183 - RNA, 19 nt, Human
gugguucaaagucaaaaga

SEQ ID NO: 1212184 - RNA, 25 nt, Human
uaaaaaaaaaaauccauucuggaaa

SEQ ID NO: 1212185 - RNA, 23 nt, Human
uauguuaagagcacuggugaaca

SEQ ID NO: 1212186 - RNA, 19 nt, Human
ucaaucccuuuucugaugu

SEQ ID NO: 1212187 - RNA, 21 nt, Human
ucagaaacuagcucacacaga

SEQ ID NO: 1212188 - RNA, 22 nt, Human
ucaguaacaaccaacauucagg

SEQ ID NO: 1212189 - RNA, 23 nt, Human
ucaucuagggauauucuggaaau

SEQ ID NO: 1212190 - RNA, 18 nt, Human
uccacagaagcaacuuca

SEQ ID NO: 1212191 - RNA, 21 nt, Human
uccacagaagcaacuucaugu

SEQ ID NO: 1212192 - RNA, 21 nt, Human
ucccggguccccaccacaccc

SEQ ID NO: 1212193 - RNA, 20 nt, Human
ucgcaccuggguugucucgc

SEQ ID NO: 1212194 - RNA, 23 nt, Human
ucgguaguaaucgcuuguccuuc

SEQ ID NO: 1212195 - RNA, 27 nt, Human
ucuccacgcagcgccacgugucuaccc

SEQ ID NO: 1212196 - RNA, 20 nt, Human
ucugcugaggcacgggcugg

SEQ ID NO: 1212197 - RNA, 21 nt, Human
ugacacaagagccugcaaaug

SEQ ID NO: 1212198 - RNA, 20 nt, Human
ugaggaagauccauagcacu

SEQ ID NO: 1212199 - RNA, 19 nt, Human
ugcugggugggacuggggc

SEQ ID NO: 1212200 - RNA, 24 nt, Human
ugcugggugggacuggggcugggu

SEQ ID NO: 1212201 - RNA, 26 nt, Human
ugcuucacugucgccguccuggcagg

SEQ ID NO: 1212202 - RNA, 24 nt, Human
uggauuauggauuguugaggccau

SEQ ID NO: 1212203 - RNA, 19 nt, Human
uggcaggcgacacgcagug

SEQ ID NO: 1212204 - RNA, 27 nt, Human
uggggcuggguaaggauggucgagagc

SEQ ID NO: 1212205 - RNA, 21 nt, Human
ugggugggacuggggcugggu

SEQ ID NO: 1212206 - RNA, 22 nt, Human
uggugggggaggaagguguugg

SEQ ID NO: 1212207 - RNA, 25 nt, Human
ugugcugggugggacuggggcuggg

SEQ ID NO: 1212208 - RNA, 19 nt, Human
uguugaaaaaauacaggga

SEQ ID NO: 1212209 - RNA, 19 nt, Human
uguugaaaaaauacaggga

SEQ ID NO: 1212210 - RNA, 21 nt, Human
uuaauaaauugcuaauccagu

SEQ ID NO: 1212211 - RNA, 22 nt, Human
uuaaucaguuuuuaauaaauug

SEQ ID NO: 1212212 - RNA, 20 nt, Human
uuagacaucagaaacuagcu

SEQ ID NO: 1212213 - RNA, 20 nt, Human
uuagccucaaaucaguucca

SEQ ID NO: 1212214 - RNA, 20 nt, Human
uuugaaagcuuccccaccac

SEQ ID NO: 1212215 - RNA, 26 nt, Human
uuugaaagcuuccccaccacccaccc

SEQ ID NO: 1212216 - RNA, 19 nt, Human
aaaagcccuuaagccacag

SEQ ID NO: 1212217 - RNA, 22 nt, Human
aaaagcccuuaagccacagaca

SEQ ID NO: 1212218 - RNA, 22 nt, Human
aaacaauagaaagugcaaucac

SEQ ID NO: 1212219 - RNA, 27 nt, Human
aaaccaggacuagacaguucucaggaa

SEQ ID NO: 1212220 - RNA, 26 nt, Human
acaacaguaccaugaaugcuaagagc

SEQ ID NO: 1212221 - RNA, 20 nt, Human
acaguaccaugaaugcuaag

SEQ ID NO: 1212222 - RNA, 20 nt, Human
acuccccucucagguccccc

SEQ ID NO: 1212223 - RNA, 20 nt, Human
agucagagucccgugacaug

SEQ ID NO: 1212224 - RNA, 22 nt, Human
aguuuguaauucagaauggcug

SEQ ID NO: 1212225 - RNA, 22 nt, Human
auucagaauggcuguuaaggaa

SEQ ID NO: 1212226 - RNA, 21 nt, Human
cagaguuuuaucugcaaagcc

SEQ ID NO: 1212227 - RNA, 20 nt, Human
cagcauccacaaguuuccaa

SEQ ID NO: 1212228 - RNA, 22 nt, Human
caugaaugcuaagagcuaggag

SEQ ID NO: 1212229 - RNA, 21 nt, Human
ccacagacagccguggcccgu

SEQ ID NO: 1212230 - RNA, 19 nt, Human
ccccaagaaaggugggagg

SEQ ID NO: 1212231 - RNA, 19 nt, Human
cccccaaaguucugcaaac

SEQ ID NO: 1212232 - RNA, 19 nt, Human
cccguggguggcccugaag

SEQ ID NO: 1212233 - RNA, 18 nt, Human
cccucucuccgcccuucc

SEQ ID NO: 1212234 - RNA, 21 nt, Human
cucuccgcccuuccaaaagcc

SEQ ID NO: 1212235 - RNA, 25 nt, Human
cucuccgcccuuccaaaagcccuua

SEQ ID NO: 1212236 - RNA, 20 nt, Human
cucucuccgcccuuccaaaa

SEQ ID NO: 1212237 - RNA, 19 nt, Human
cucugacgacaaaggcaag

SEQ ID NO: 1212238 - RNA, 18 nt, Human
gaacaagcaacaauaaac

SEQ ID NO: 1212239 - RNA, 22 nt, Human
gacuagacaguucucaggaagg

SEQ ID NO: 1212240 - RNA, 18 nt, Human
gagagguugggggagggc

SEQ ID NO: 1212241 - RNA, 20 nt, Human
gaguuuuaucugcaaagccg

SEQ ID NO: 1212242 - RNA, 21 nt, Human
ggaaaaacaaguuggaucaga

SEQ ID NO: 1212243 - RNA, 22 nt, Human
ggaggaaaauaggggcucagga

SEQ ID NO: 1212244 - RNA, 19 nt, Human
gggcucaggacaguugcaa

SEQ ID NO: 1212245 - RNA, 18 nt, Human
gguugggggagggcccgu

SEQ ID NO: 1212246 - RNA, 21 nt, Human
gugaauuacucuuucuccauu

SEQ ID NO: 1212247 - RNA, 22 nt, Human
uaaaaugccaagucuucuugag

SEQ ID NO: 1212248 - RNA, 22 nt, Human
uaaaucccaaaccaggacuaga

SEQ ID NO: 1212249 - RNA, 22 nt, Human
uaagauaaaucccaaaccagga

SEQ ID NO: 1212250 - RNA, 26 nt, Human
uaagauaaaucccaaaccaggacuuu

SEQ ID NO: 1212251 - RNA, 22 nt, Human
uagcaagcauguuauuauauuc

SEQ ID NO: 1212252 - RNA, 24 nt, Human
uaggagcaacauguuacaaaaaca

SEQ ID NO: 1212253 - RNA, 23 nt, Human
uaggggcucaggacaguugcaaa

SEQ ID NO: 1212254 - RNA, 19 nt, Human
ucaggaaggaauguggcag

SEQ ID NO: 1212255 - RNA, 19 nt, Human
uccaaaagcccuuaagcca

SEQ ID NO: 1212256 - RNA, 24 nt, Human
uccaaaugcgaugggaugauucuc

SEQ ID NO: 1212257 - RNA, 20 nt, Human
uccaauggucagaagggccu

SEQ ID NO: 1212258 - RNA, 24 nt, Human
uccccaagaaaggugggaggaaaa

SEQ ID NO: 1212259 - RNA, 21 nt, Human
uccccucucaggucccccaaa

SEQ ID NO: 1212260 - RNA, 22 nt, Human
ucccucucuccgcccuuccaaa

SEQ ID NO: 1212261 - RNA, 19 nt, Human
ucuccgcccuuccaaaagc

SEQ ID NO: 1212262 - RNA, 18 nt, Human
ucugcaaacucugacgac

SEQ ID NO: 1212263 - RNA, 21 nt, Human
ugacaaaacaauagaaagugc

SEQ ID NO: 1212264 - RNA, 23 nt, Human
ugacaaaacaauagaaagugcaa

SEQ ID NO: 1212265 - RNA, 19 nt, Human
ugacaggaguuacuggaga

SEQ ID NO: 1212266 - RNA, 22 nt, Human
ugacgacaaaggcaagucagag

SEQ ID NO: 1212267 - RNA, 20 nt, Human
ugcgaugggaugauucucuu

SEQ ID NO: 1212268 - RNA, 24 nt, Human
uggcaucccuuaaaaacaaguuuc

SEQ ID NO: 1212269 - RNA, 22 nt, Human
uuaaaaacaaguuuccccaaga

SEQ ID NO: 1212270 - RNA, 19 nt, Human
uucagaauggcuguuaagg

SEQ ID NO: 1212271 - RNA, 19 nt, Human
uuccucugauagcaagcau

SEQ ID NO: 1212272 - RNA, 26 nt, Human
uucuccauuguaauccccgucuugau

SEQ ID NO: 1212273 - RNA, 21 nt, Human
uuuguaauucagaauggcugu

SEQ ID NO: 1212274 - RNA, 21 nt, Human
uuuuucuuuucauggccuggu

SEQ ID NO: 1212275 - RNA, 25 nt, Human
aaaauucuucccaugagagugacuu

SEQ ID NO: 1212276 - RNA, 20 nt, Human
aaacccugcagcaagaguuc

SEQ ID NO: 1212277 - RNA, 25 nt, Human
aggccugugguaccgugagagauga

SEQ ID NO: 1212278 - RNA, 20 nt, Human
aggggaaggagcgcagugug

SEQ ID NO: 1212279 - RNA, 18 nt, Human
caggccugugguaccgug

SEQ ID NO: 1212280 - RNA, 23 nt, Human
ccacugccaaguucuaggacagu

SEQ ID NO: 1212281 - RNA, 22 nt, Human
cccaugugaccaggccuguggu

SEQ ID NO: 1212282 - RNA, 18 nt, Human
cccgcagcagcucagaau

SEQ ID NO: 1212283 - RNA, 18 nt, Human
cgaucccgcguucuccuc

SEQ ID NO: 1212284 - RNA, 24 nt, Human
cgccgccaggaagcggcgaucgaa

SEQ ID NO: 1212285 - RNA, 19 nt, Human
cugcagcaagaguucgauc

SEQ ID NO: 1212286 - RNA, 26 nt, Human
gauggcaaggccugugaggccggcac

SEQ ID NO: 1212287 - RNA, 19 nt, Human
gcaaaauaucccgcagcag

SEQ ID NO: 1212288 - RNA, 18 nt, Human
gcgcgccgccaggaagcg

SEQ ID NO: 1212289 - RNA, 19 nt, Human
ggccugugguaccgugaga

SEQ ID NO: 1212290 - RNA, 23 nt, Human
gugagagaugauggcugugcucu

SEQ ID NO: 1212291 - RNA, 19 nt, Human
ugaccgagccucccgaggg

SEQ ID NO: 1212292 - RNA, 20 nt, Human
ugaggccggcaccacugcca

SEQ ID NO: 1212293 - RNA, 18 nt, Human
ugcaaggcagaggguggc

SEQ ID NO: 1212294 - RNA, 21 nt, Human
uggcaaggccugugaggccgg

SEQ ID NO: 1212295 - RNA, 27 nt, Human
aaaaagcaccugcugcaccauaagccc

SEQ ID NO: 1212296 - RNA, 25 nt, Human
aaaauucuucccaugagagugacuu

SEQ ID NO: 1212297 - RNA, 25 nt, Human
aacacacacacccguuuguuaccca

SEQ ID NO: 1212298 - RNA, 25 nt, Human
aauacaccauucuugucaacagaau

SEQ ID NO: 1212299 - RNA, 20 nt, Human
acaaacacaggcugugggcu

SEQ ID NO: 1212300 - RNA, 21 nt, Human
acaggcugugggcuggcuuug

SEQ ID NO: 1212301 - RNA, 19 nt, Human
acagggucccccagucucu

SEQ ID NO: 1212302 - RNA, 19 nt, Human
aggaaccaaguguguccac

SEQ ID NO: 1212303 - RNA, 19 nt, Human
aggcugugggcuggcuuug

SEQ ID NO: 1212304 - RNA, 21 nt, Human
agggaacuucugggaucagcc

SEQ ID NO: 1212305 - RNA, 23 nt, Human
auacaccauucuugucaacagaa

SEQ ID NO: 1212306 - RNA, 24 nt, Human
auacaccauucuugucaacagaau

SEQ ID NO: 1212307 - RNA, 21 nt, Human
aucuuuuaugugcugaaccag

SEQ ID NO: 1212308 - RNA, 20 nt, Human
cacacccccaccugcccucu

SEQ ID NO: 1212309 - RNA, 26 nt, Human
caccauaagcccugggauguggcagc

SEQ ID NO: 1212310 - RNA, 21 nt, Human
caggcugugggcuggcuuugg

SEQ ID NO: 1212311 - RNA, 19 nt, Human
cagggucugguggaaaagc

SEQ ID NO: 1212312 - RNA, 19 nt, Human
caguaaagguccaggucag

SEQ ID NO: 1212313 - RNA, 23 nt, Human
cauggaauuaagaaaaacaugca

SEQ ID NO: 1212314 - RNA, 22 nt, Human
cauugccaucuccaagugcucu

SEQ ID NO: 1212315 - RNA, 21 nt, Human
ccaagugagggaguuagggac

SEQ ID NO: 1212316 - RNA, 23 nt, Human
ccaguccaaugaaaguuuuagcc

SEQ ID NO: 1212317 - RNA, 19 nt, Human
ccaguccccaggggguugc

SEQ ID NO: 1212318 - RNA, 18 nt, Human
ccauggaauuaagaaaaa

SEQ ID NO: 1212319 - RNA, 24 nt, Human
ccccaggccuuuauacccuucaga

SEQ ID NO: 1212320 - RNA, 21 nt, Human
ccucuggauuuauggagcuga

SEQ ID NO: 1212321 - RNA, 18 nt, Human
ccuggggucagccaggug

SEQ ID NO: 1212322 - RNA, 19 nt, Human
ccugugcccgaguucccug

SEQ ID NO: 1212323 - RNA, 19 nt, Human
cggcccagccggccugugc

SEQ ID NO: 1212324 - RNA, 22 nt, Human
cucuuuagcauuuugcagaugc

SEQ ID NO: 1212325 - RNA, 25 nt, Human
cuggagccgggugggccgggcugca

SEQ ID NO: 1212326 - RNA, 18 nt, Human
cuggguugugaagggucu

SEQ ID NO: 1212327 - RNA, 21 nt, Human
cuuucacuuccacuggagucc

SEQ ID NO: 1212328 - RNA, 18 nt, Human
gaagggucucaaguccaa

SEQ ID NO: 1212329 - RNA, 18 nt, Human
gacagggucccccagucu

SEQ ID NO: 1212330 - RNA, 24 nt, Human
gaugggugggacuguguuggccag

SEQ ID NO: 1212331 - RNA, 21 nt, Human
gcaaggcugaaaagaacacac

SEQ ID NO: 1212332 - RNA, 18 nt, Human
gcagcgggcuuggcuuuc

SEQ ID NO: 1212333 - RNA, 18 nt, Human
gcagcugcagcgggcuug

SEQ ID NO: 1212334 - RNA, 20 nt, Human
gccaucuccaagugcucucc

SEQ ID NO: 1212335 - RNA, 23 nt, Human
ggaccuggggucagccagguggu

SEQ ID NO: 1212336 - RNA, 24 nt, Human
ggaccuggggucagccagguggug

SEQ ID NO: 1212337 - RNA, 21 nt, Human
ggaguuagggacuugggaggg

SEQ ID NO: 1212338 - RNA, 18 nt, Human
gggaccuggggucagcca

SEQ ID NO: 1212339 - RNA, 25 nt, Human
gggcaguuugugguuccugauuugg

SEQ ID NO: 1212340 - RNA, 18 nt, Human
gggucucaaguccaagug

SEQ ID NO: 1212341 - RNA, 21 nt, Human
gggugggacuguguuggccag

SEQ ID NO: 1212342 - RNA, 20 nt, Human
ggucucaaguccaagugagg

SEQ ID NO: 1212343 - RNA, 22 nt, Human
gucuucuucuguucuucacgcc

SEQ ID NO: 1212344 - RNA, 20 nt, Human
gugaccucugcaguacuccu

SEQ ID NO: 1212345 - RNA, 22 nt, Human
guucugugacuucccugugacc

SEQ ID NO: 1212346 - RNA, 23 nt, Human
uaagaaaaacaugcaaaaauaau

SEQ ID NO: 1212347 - RNA, 20 nt, Human
uaagaaccagaacuacuggc

SEQ ID NO: 1212348 - RNA, 24 nt, Human
uagcauuuugcagaugcuuuucuc

SEQ ID NO: 1212349 - RNA, 22 nt, Human
uaucuuauuagagggcaguuug

SEQ ID NO: 1212350 - RNA, 19 nt, Human
ucccugcaugguguaggag

SEQ ID NO: 1212351 - RNA, 25 nt, Human
uccugcauuugguauccagguguca

SEQ ID NO: 1212352 - RNA, 23 nt, Human
ucucaaguccaagugagggaguu

SEQ ID NO: 1212353 - RNA, 22 nt, Human
ucuucuucuguucuucacgccc

SEQ ID NO: 1212354 - RNA, 18 nt, Human
ugacuucccugugaccuc

SEQ ID NO: 1212355 - RNA, 22 nt, Human
ugagauggggacaggcaaugag

SEQ ID NO: 1212356 - RNA, 18 nt, Human
ugagggaguuagggacuu

SEQ ID NO: 1212357 - RNA, 19 nt, Human
ugaugcuggagccgggugg

SEQ ID NO: 1212358 - RNA, 22 nt, Human
ugcagaugcuuuucucaaacug

SEQ ID NO: 1212359 - RNA, 23 nt, Human
ugcagaugcuuuucucaaacugu

SEQ ID NO: 1212360 - RNA, 22 nt, Human
ugcaugguguaggaguguggga

SEQ ID NO: 1212361 - RNA, 20 nt, Human
ugcauuugguauccaggugu

SEQ ID NO: 1212362 - RNA, 18 nt, Human
ugcgugggcagagggaac

SEQ ID NO: 1212363 - RNA, 23 nt, Human
ugcucuccguagggaaacaguuu

SEQ ID NO: 1212364 - RNA, 19 nt, Human
ugcuggagccgggugggcc

SEQ ID NO: 1212365 - RNA, 20 nt, Human
uggaauuaagaaaaacaugc

SEQ ID NO: 1212366 - RNA, 21 nt, Human
uggccagaggccgagaggagg

SEQ ID NO: 1212367 - RNA, 18 nt, Human
ugggaugagauggggaca

SEQ ID NO: 1212368 - RNA, 20 nt, Human
ugggaugagauggggacagg

SEQ ID NO: 1212369 - RNA, 23 nt, Human
ugggauguggcagcugcagcggg

SEQ ID NO: 1212370 - RNA, 24 nt, Human
ugggcagagggaacuucugggauc

SEQ ID NO: 1212371 - RNA, 21 nt, Human
uggggucagccagguggugac

SEQ ID NO: 1212372 - RNA, 19 nt, Human
ugugaagggucucaagucc

SEQ ID NO: 1212373 - RNA, 18 nt, Human
ugugagguucagcauugc

SEQ ID NO: 1212374 - RNA, 21 nt, Human
ugugagguucagcauugccau

SEQ ID NO: 1212375 - RNA, 24 nt, Human
uguggcagcugcagcgggcuuggc

SEQ ID NO: 1212376 - RNA, 19 nt, Human
uuacaaacacaggcugugg

SEQ ID NO: 1212377 - RNA, 24 nt, Human
uucccauauaaaaauucuucccau

SEQ ID NO: 1212378 - RNA, 18 nt, Human
uuccuacucugcuguccu

SEQ ID NO: 1212379 - RNA, 20 nt, Human
uucuucuguucuucacgccc

SEQ ID NO: 1212380 - RNA, 27 nt, Human
uugaaaaaagcaccugcugcaccauaa

SEQ ID NO: 1212381 - RNA, 24 nt, Human
uugaugugcaccccccccaggccu

SEQ ID NO: 1212382 - RNA, 22 nt, Human
uugcaaaaaguaauacaccauu

SEQ ID NO: 1212383 - RNA, 22 nt, Human
uugugaagggucucaaguccaa

SEQ ID NO: 1212384 - RNA, 24 nt, Human
aaaaaaaacaugugagcaaaagaa

SEQ ID NO: 1212385 - RNA, 21 nt, Human
aaaaaguagauauucugaaga

SEQ ID NO: 1212386 - RNA, 21 nt, Human
aaaaugcagucuagaaugcaa

SEQ ID NO: 1212387 - RNA, 20 nt, Human
aaagcucaagaagaccuugg

SEQ ID NO: 1212388 - RNA, 21 nt, Human
aaaucagggagauuucuggug

SEQ ID NO: 1212389 - RNA, 27 nt, Human
aacaaaaaaaacaugugagcaaaagaa

SEQ ID NO: 1212390 - RNA, 23 nt, Human
aacaccgacccuaacucgugcag

SEQ ID NO: 1212391 - RNA, 21 nt, Human
aacaugucucgccucccgcca

SEQ ID NO: 1212392 - RNA, 26 nt, Human
aagaaggagaaggucaacaaaaaaaa

SEQ ID NO: 1212393 - RNA, 19 nt, Human
aagcuacaaaugaacaaca

SEQ ID NO: 1212394 - RNA, 21 nt, Human
acucagcacaccaaggaccug

SEQ ID NO: 1212395 - RNA, 23 nt, Human
agaaggagaaggucaacaaaaaa

SEQ ID NO: 1212396 - RNA, 18 nt, Human
agcaagaaaaccucagcc

SEQ ID NO: 1212397 - RNA, 22 nt, Human
aggcacuguaaaaugcagucua

SEQ ID NO: 1212398 - RNA, 19 nt, Human
agggaugggcuggcaggag

SEQ ID NO: 1212399 - RNA, 18 nt, Human
auaucuguggagucucag

SEQ ID NO: 1212400 - RNA, 18 nt, Human
aucacuaaccuuuccuga

SEQ ID NO: 1212401 - RNA, 25 nt, Human
auccacaggagcaagaaaaccucag

SEQ ID NO: 1212402 - RNA, 22 nt, Human
augcugcccuugagccuuugug

SEQ ID NO: 1212403 - RNA, 19 nt, Human
caaaaaaaacaugugagca

SEQ ID NO: 1212404 - RNA, 23 nt, Human
caaaaaaaacaugugagcaaaag

SEQ ID NO: 1212405 - RNA, 22 nt, Human
caaagaccacuccucuuucugu

SEQ ID NO: 1212406 - RNA, 23 nt, Human
caaagcaauuguuuaaaguacag

SEQ ID NO: 1212407 - RNA, 22 nt, Human
caacaaaaaaaacaugugagca

SEQ ID NO: 1212408 - RNA, 20 nt, Human
caauccaaaucguuaugucu

SEQ ID NO: 1212409 - RNA, 21 nt, Human
cagaagguccgguggaucuuc

SEQ ID NO: 1212410 - RNA, 22 nt, Human
cagcacaccaaggaccugcacc

SEQ ID NO: 1212411 - RNA, 24 nt, Human
cagcacaccaaggaccugcaccgg

SEQ ID NO: 1212412 - RNA, 21 nt, Human
caggagcaagaaaaccucagc

SEQ ID NO: 1212413 - RNA, 24 nt, Human
cagggugauaagaaggagaagguc

SEQ ID NO: 1212414 - RNA, 20 nt, Human
cagucaggucuuucucaucc

SEQ ID NO: 1212415 - RNA, 23 nt, Human
cagucuagaaugcaaaauuccca

SEQ ID NO: 1212416 - RNA, 20 nt, Human
cauuacuucagcaaaaagga

SEQ ID NO: 1212417 - RNA, 24 nt, Human
ccaaggaacaccgacccuaacucg

SEQ ID NO: 1212418 - RNA, 19 nt, Human
ccacaggagcaagaaaacc

SEQ ID NO: 1212419 - RNA, 22 nt, Human
ccagaggcacuguaaaaugcag

SEQ ID NO: 1212420 - RNA, 21 nt, Human
ccagggaauuagagccucaca

SEQ ID NO: 1212421 - RNA, 20 nt, Human
cccaaauaucucaguggagu

SEQ ID NO: 1212422 - RNA, 19 nt, Human
cccugcuuucaagggcaga

SEQ ID NO: 1212423 - RNA, 22 nt, Human
ccugucucuucccguccaagga

SEQ ID NO: 1212424 - RNA, 21 nt, Human
ccuuuccgccgcuguugaggg

SEQ ID NO: 1212425 - RNA, 23 nt, Human
cggccacagggggucgucagcag

SEQ ID NO: 1212426 - RNA, 20 nt, Human
cggccucugaguucccucag

SEQ ID NO: 1212427 - RNA, 18 nt, Human
cggcuggggcaaaguggc

SEQ ID NO: 1212428 - RNA, 20 nt, Human
cuacugccaacaugucucgc

SEQ ID NO: 1212429 - RNA, 22 nt, Human
cuagaaaguauccguauccaga

SEQ ID NO: 1212430 - RNA, 19 nt, Human
cuagaaugcaaaauuccca

SEQ ID NO: 1212431 - RNA, 21 nt, Human
cucaugucuucccuuucuaca

SEQ ID NO: 1212432 - RNA, 19 nt, Human
cuccugccugucucuuccc

SEQ ID NO: 1212433 - RNA, 22 nt, Human
cugaaggacaaagcgguauuga

SEQ ID NO: 1212434 - RNA, 19 nt, Human
cugauuauccagaucaccu

SEQ ID NO: 1212435 - RNA, 18 nt, Human
cugcaagaggcuuuccuc

SEQ ID NO: 1212436 - RNA, 19 nt, Human
gaaacaacacuggguccag

SEQ ID NO: 1212437 - RNA, 21 nt, Human
gaacaacaucucagcaaagca

SEQ ID NO: 1212438 - RNA, 22 nt, Human
gaacaccgacccuaacucgugc

SEQ ID NO: 1212439 - RNA, 20 nt, Human
gaauguaguaggagagcagg

SEQ ID NO: 1212440 - RNA, 19 nt, Human
gacacauucugcagaggga

SEQ ID NO: 1212441 - RNA, 22 nt, Human
gacccagggaauuagagccuca

SEQ ID NO: 1212442 - RNA, 20 nt, Human
gacucagaacuuaucuagag

SEQ ID NO: 1212443 - RNA, 23 nt, Human
gagaaggucaacaaaaaaaacau

SEQ ID NO: 1212444 - RNA, 22 nt, Human
gagcagggugauaagaaggaga

SEQ ID NO: 1212445 - RNA, 22 nt, Human
gagcugucccugccuuucugaa

SEQ ID NO: 1212446 - RNA, 19 nt, Human
gaggggaccgcagggcugg

SEQ ID NO: 1212447 - RNA, 20 nt, Human
gcacaccaaggaccugcacc

SEQ ID NO: 1212448 - RNA, 24 nt, Human
gcagaaggagcaggaccacaagga

SEQ ID NO: 1212449 - RNA, 20 nt, Human
gcagcaagagugauuucuga

SEQ ID NO: 1212450 - RNA, 22 nt, Human
gcaggaccacaaggaaccaaag

SEQ ID NO: 1212451 - RNA, 21 nt, Human
gcccuagaucccuuaaaccuu

SEQ ID NO: 1212452 - RNA, 22 nt, Human
gcgagcaggagacaguggccuu

SEQ ID NO: 1212453 - RNA, 21 nt, Human
gcgauuuucugagacacacca

SEQ ID NO: 1212454 - RNA, 21 nt, Human
gcugggacacauucugcagag

SEQ ID NO: 1212455 - RNA, 18 nt, Human
ggagcaggaccacaagga

SEQ ID NO: 1212456 - RNA, 23 nt, Human
ggauguucucaggaaugcacgag

SEQ ID NO: 1212457 - RNA, 18 nt, Human
ggcaaaguggcuggggca

SEQ ID NO: 1212458 - RNA, 21 nt, Human
ggcacugaaggacaaagcggu

SEQ ID NO: 1212459 - RNA, 19 nt, Human
ggcagaggucccugcggcu

SEQ ID NO: 1212460 - RNA, 21 nt, Human
ggcccuagaucccuuaaaccu

SEQ ID NO: 1212461 - RNA, 19 nt, Human
gggaugggcuggcaggagc

SEQ ID NO: 1212462 - RNA, 24 nt, Human
gguauugacuuucuucaucugugu

SEQ ID NO: 1212463 - RNA, 19 nt, Human
gguucagcauuccgacucc

SEQ ID NO: 1212464 - RNA, 22 nt, Human
guagaauucauguauuuauuuu

SEQ ID NO: 1212465 - RNA, 26 nt, Human
gucuagaaugcaaaauucccagccac

SEQ ID NO: 1212466 - RNA, 24 nt, Human
gugcagcugcagaugaccaugggc

SEQ ID NO: 1212467 - RNA, 22 nt, Human
guggcuggggcaaagcuacaaa

SEQ ID NO: 1212468 - RNA, 19 nt, Human
uaagaucaacucucugcuc

SEQ ID NO: 1212469 - RNA, 24 nt, Human
uacccugcuuucaagggcagaggu

SEQ ID NO: 1212470 - RNA, 23 nt, Human
uacuaugccuggacgugcacgua

SEQ ID NO: 1212471 - RNA, 23 nt, Human
uagcaagacgagcugaaaaagga

SEQ ID NO: 1212472 - RNA, 19 nt, Human
uagcguaggggcgguuuca

SEQ ID NO: 1212473 - RNA, 18 nt, Human
uaggagagcagggugaua

SEQ ID NO: 1212474 - RNA, 23 nt, Human
uauacugcuuguaaacauguggu

SEQ ID NO: 1212475 - RNA, 23 nt, Human
uauccagaaucaauaagaucaac

SEQ ID NO: 1212476 - RNA, 21 nt, Human
uauccagaucaccuagaaagu

SEQ ID NO: 1212477 - RNA, 21 nt, Human
uaucucaguggaguaaagaau

SEQ ID NO: 1212478 - RNA, 22 nt, Human
uauuaugauuuucauuacuuca

SEQ ID NO: 1212479 - RNA, 24 nt, Human
uauucugaagauggagguugucca

SEQ ID NO: 1212480 - RNA, 19 nt, Human
ucacaggccggccugggau

SEQ ID NO: 1212481 - RNA, 21 nt, Human
ucacaggccggccugggaugc

SEQ ID NO: 1212482 - RNA, 23 nt, Human
ucacaggccggccugggaugcug

SEQ ID NO: 1212483 - RNA, 24 nt, Human
ucacauggggagaaaccuuggaca

SEQ ID NO: 1212484 - RNA, 23 nt, Human
ucaccgacacgggaguuccacag

SEQ ID NO: 1212485 - RNA, 18 nt, Human
ucaccuagaaaguauccg

SEQ ID NO: 1212486 - RNA, 23 nt, Human
ucacuaaccuuuccugagccccc

SEQ ID NO: 1212487 - RNA, 25 nt, Human
ucagccccacucuaccaacacacac

SEQ ID NO: 1212488 - RNA, 19 nt, Human
ucaggucuuucucauccca

SEQ ID NO: 1212489 - RNA, 24 nt, Human
ucaugaauaauuaaugaagcgcaa

SEQ ID NO: 1212490 - RNA, 21 nt, Human
uccagaaucaauaagaucaac

SEQ ID NO: 1212491 - RNA, 20 nt, Human
ucccguccaaggaacaccga

SEQ ID NO: 1212492 - RNA, 23 nt, Human
ucccuuucuacauagacacagug

SEQ ID NO: 1212493 - RNA, 22 nt, Human
uccugagcccccauggggacuc

SEQ ID NO: 1212494 - RNA, 21 nt, Human
ucggaacugagcgcgauuuuc

SEQ ID NO: 1212495 - RNA, 23 nt, Human
ucggaacugagcgcgauuuucug

SEQ ID NO: 1212496 - RNA, 21 nt, Human
ucggcuuguauuugcaaacuu

SEQ ID NO: 1212497 - RNA, 18 nt, Human
ucgugaaaaaugucagag

SEQ ID NO: 1212498 - RNA, 19 nt, Human
ucucuuucuuuucccuaca

SEQ ID NO: 1212499 - RNA, 18 nt, Human
ucugaagauggagguugu

SEQ ID NO: 1212500 - RNA, 24 nt, Human
ucuuuccaggucaucacuaaccuu

SEQ ID NO: 1212501 - RNA, 23 nt, Human
ugacaaagaccacuccucuuucu

SEQ ID NO: 1212502 - RNA, 19 nt, Human
ugacaggaaagcucagaga

SEQ ID NO: 1212503 - RNA, 20 nt, Human
ugacagucugaucucucuuu

SEQ ID NO: 1212504 - RNA, 22 nt, Human
ugacugaggggaccgcagggcu

SEQ ID NO: 1212505 - RNA, 26 nt, Human
ugacuucgaaauaauuuuguugauuu

SEQ ID NO: 1212506 - RNA, 21 nt, Human
ugagggucguuauccugauua

SEQ ID NO: 1212507 - RNA, 20 nt, Human
ugccuggacgugcacguagg

SEQ ID NO: 1212508 - RNA, 20 nt, Human
uggaaggaaacgaugugaca

SEQ ID NO: 1212509 - RNA, 21 nt, Human
uggcagcaagagugauuucug

SEQ ID NO: 1212510 - RNA, 18 nt, Human
uggcaucuugaaacauug

SEQ ID NO: 1212511 - RNA, 24 nt, Human
uggcugcucccuuuccgccgcugu

SEQ ID NO: 1212512 - RNA, 19 nt, Human
uggcuggggcaaagcuaca

SEQ ID NO: 1212513 - RNA, 20 nt, Human
uggcuggggcaaagcuacaa

SEQ ID NO: 1212514 - RNA, 21 nt, Human
ugggacgcgacugguuccaaa

SEQ ID NO: 1212515 - RNA, 25 nt, Human
uggggacucagaacuuaucuagagu

SEQ ID NO: 1212516 - RNA, 22 nt, Human
ugggucaaagcggcuggggcaa

SEQ ID NO: 1212517 - RNA, 21 nt, Human
uggguccaggggaccggcacu

SEQ ID NO: 1212518 - RNA, 22 nt, Human
ugucaagugggacgcgacuggu

SEQ ID NO: 1212519 - RNA, 20 nt, Human
uguccagaggcacuguaaaa

SEQ ID NO: 1212520 - RNA, 18 nt, Human
ugugagcuccaaguuggg

SEQ ID NO: 1212521 - RNA, 20 nt, Human
ugugcugguucagcauuccg

SEQ ID NO: 1212522 - RNA, 24 nt, Human
ugugcugguucagcauuccgacuc

SEQ ID NO: 1212523 - RNA, 22 nt, Human
uucaccuuuaggguuuuuuggg

SEQ ID NO: 1212524 - RNA, 25 nt, Human
uucagcaaaaaggaauguaguagga

SEQ ID NO: 1212525 - RNA, 24 nt, Human
uuccugagcccccauggggacuca

SEQ ID NO: 1212526 - RNA, 20 nt, Human
uugacuuucuucaucugugu

SEQ ID NO: 1212527 - RNA, 20 nt, Human
uugaugccagcgaagcauac

SEQ ID NO: 1212528 - RNA, 21 nt, Human
uugggauuauguggaaacucu

SEQ ID NO: 1212529 - RNA, 20 nt, Human
uugggucaaagcggcugggg

SEQ ID NO: 1212530 - RNA, 19 nt, Human
uugguccuuggcuuccugc

SEQ ID NO: 1212531 - RNA, 21 nt, Human
uugguccuuggcuuccugcug

SEQ ID NO: 1212532 - RNA, 19 nt, Human
uuuguugugacaaagacca

SEQ ID NO: 1212533 - RNA, 23 nt, Human
uuuucagagggcgcagguguggu

SEQ ID NO: 1212534 - RNA, 21 nt, Human
uuuugugagcuccaaguuggg

SEQ ID NO: 1212535 - RNA, 24 nt, Human
acacaccacagccagcacacccag

SEQ ID NO: 1212536 - RNA, 23 nt, Human
acaccacagccagcacacccagc

SEQ ID NO: 1212537 - RNA, 20 nt, Human
acagccagcacacccagcgg

SEQ ID NO: 1212538 - RNA, 24 nt, Human
accaugaccacaguguugccguag

SEQ ID NO: 1212539 - RNA, 22 nt, Human
acccagcggcucccgcaggcgc

SEQ ID NO: 1212540 - RNA, 25 nt, Human
aggccagggcgggagccagcaggga

SEQ ID NO: 1212541 - RNA, 18 nt, Human
caccacagccagcacacc

SEQ ID NO: 1212542 - RNA, 21 nt, Human
caccacagccagcacacccag

SEQ ID NO: 1212543 - RNA, 18 nt, Human
caccacguuggccaggcc

SEQ ID NO: 1212544 - RNA, 21 nt, Human
caccacguuggccaggccugc

SEQ ID NO: 1212545 - RNA, 21 nt, Human
caccaugaccacaguguugcc

SEQ ID NO: 1212546 - RNA, 20 nt, Human
cacccgggccccccacgccc

SEQ ID NO: 1212547 - RNA, 22 nt, Human
cacccgggccccccacgcccga

SEQ ID NO: 1212548 - RNA, 18 nt, Human
caggcgcagcacagggcc

SEQ ID NO: 1212549 - RNA, 18 nt, Human
caggcgcagcacagggcc

SEQ ID NO: 1212550 - RNA, 18 nt, Human
cagggccucucagcccgg

SEQ ID NO: 1212551 - RNA, 22 nt, Human
cccgcaggcgcagcacagggcc

SEQ ID NO: 1212552 - RNA, 21 nt, Human
cccggucuccugucaccacgu

SEQ ID NO: 1212553 - RNA, 18 nt, Human
ccgcaggcgcagcacagg

SEQ ID NO: 1212554 - RNA, 19 nt, Human
ccucucagcccggcuaccu

SEQ ID NO: 1212555 - RNA, 19 nt, Human
ccugcaggguguggccuug

SEQ ID NO: 1212556 - RNA, 20 nt, Human
ccugcaggguguggccuugg

SEQ ID NO: 1212557 - RNA, 21 nt, Human
ccugcaggguguggccuuggg

SEQ ID NO: 1212558 - RNA, 20 nt, Human
ccuggcagaccuccagggcc

SEQ ID NO: 1212559 - RNA, 23 nt, Human
ccugggcugauccgaaauaccac

SEQ ID NO: 1212560 - RNA, 23 nt, Human
ccuugggccugcacccgggcccc

SEQ ID NO: 1212561 - RNA, 24 nt, Human
gccacucguccggacacaccacag

SEQ ID NO: 1212562 - RNA, 21 nt, Human
gccugcacccgggccccccac

SEQ ID NO: 1212563 - RNA, 22 nt, Human
gccuggacgucuuggugcaagg

SEQ ID NO: 1212564 - RNA, 18 nt, Human
ggacacgaaggcaagcag

SEQ ID NO: 1212565 - RNA, 19 nt, Human
ggccagcagaggacaggcc

SEQ ID NO: 1212566 - RNA, 18 nt, Human
ggccaggccugcugggaa

SEQ ID NO: 1212567 - RNA, 20 nt, Human
ggugcaaggccaggcagcgg

SEQ ID NO: 1212568 - RNA, 19 nt, Human
uccggacacaccacagcca

SEQ ID NO: 1212569 - RNA, 18 nt, Human
ugcacccgggccccccac

SEQ ID NO: 1212570 - RNA, 21 nt, Human
ugcugggaacacgguggccau

SEQ ID NO: 1212571 - RNA, 21 nt, Human
ugcugggaacacgguggccau

SEQ ID NO: 1212572 - RNA, 21 nt, Human
uggugcaaggccaggcagcgg

SEQ ID NO: 1212573 - RNA, 23 nt, Human
aaagggacuguaggagaaaggga

SEQ ID NO: 1212574 - RNA, 20 nt, Human
aaaugguguggaaugggacg

SEQ ID NO: 1212575 - RNA, 21 nt, Human
aagaaagagauaauacaaaaa

SEQ ID NO: 1212576 - RNA, 24 nt, Human
aagaaagagauaauacaaaaauau

SEQ ID NO: 1212577 - RNA, 21 nt, Human
aagaagaaagagauaauacaa

SEQ ID NO: 1212578 - RNA, 24 nt, Human
aagaagaagaaagagauaauacaa

SEQ ID NO: 1212579 - RNA, 19 nt, Human
aaggaaggagggaggaaag

SEQ ID NO: 1212580 - RNA, 22 nt, Human
aagggaaggguagacuuggagg

SEQ ID NO: 1212581 - RNA, 19 nt, Human
aaggguagacuuggaggca

SEQ ID NO: 1212582 - RNA, 18 nt, Human
acagcugccccacccuca

SEQ ID NO: 1212583 - RNA, 19 nt, Human
agaaaacagauuuuagcag

SEQ ID NO: 1212584 - RNA, 22 nt, Human
agaaagagauaauacaaaaaua

SEQ ID NO: 1212585 - RNA, 22 nt, Human
agaagaaagagauaauacaaaa

SEQ ID NO: 1212586 - RNA, 20 nt, Human
agcagugggcugggggugaa

SEQ ID NO: 1212587 - RNA, 18 nt, Human
agccaggagccccugugg

SEQ ID NO: 1212588 - RNA, 23 nt, Human
agcucaccucccacccaccucug

SEQ ID NO: 1212589 - RNA, 19 nt, Human
aggaaacgcugaccacuga

SEQ ID NO: 1212590 - RNA, 18 nt, Human
aggaaggagaguggaagg

SEQ ID NO: 1212591 - RNA, 20 nt, Human
aggaaggagggaggaaagga

SEQ ID NO: 1212592 - RNA, 22 nt, Human
aggaaggagggaggaaaggagg

SEQ ID NO: 1212593 - RNA, 24 nt, Human
aggaaggagggaggaaaggagggg

SEQ ID NO: 1212594 - RNA, 26 nt, Human
aggaaggagggaggaaaggaggggac

SEQ ID NO: 1212595 - RNA, 20 nt, Human
aggagaaagggaagggcaaa

SEQ ID NO: 1212596 - RNA, 22 nt, Human
aggagggaagaaccugaggagg

SEQ ID NO: 1212597 - RNA, 23 nt, Human
aggagggaagaaccugaggaggg

SEQ ID NO: 1212598 - RNA, 26 nt, Human
aggagggaagaaccugaggaggggga

SEQ ID NO: 1212599 - RNA, 22 nt, Human
aggagggaguccgggaagggaa

SEQ ID NO: 1212600 - RNA, 20 nt, Human
aggauggggagacagagaaa

SEQ ID NO: 1212601 - RNA, 22 nt, Human
aggcagagcucccgauggccuu

SEQ ID NO: 1212602 - RNA, 19 nt, Human
agggaaggguagacuugga

SEQ ID NO: 1212603 - RNA, 21 nt, Human
agggcgcuggagcgggugggg

SEQ ID NO: 1212604 - RNA, 22 nt, Human
aggugagugugcaaggcuuuca

SEQ ID NO: 1212605 - RNA, 21 nt, Human
agguggaguuagggaggccca

SEQ ID NO: 1212606 - RNA, 18 nt, Human
agugagaaggagggaaga

SEQ ID NO: 1212607 - RNA, 22 nt, Human
agugcagcaggcgacuccccaa

SEQ ID NO: 1212608 - RNA, 22 nt, Human
augggggcugugccggccccuu

SEQ ID NO: 1212609 - RNA, 23 nt, Human
caagaagaagaaagagauaauac

SEQ ID NO: 1212610 - RNA, 23 nt, Human
cacaccaccacaacaucaggccg

SEQ ID NO: 1212611 - RNA, 18 nt, Human
cacugagugagcugagca

SEQ ID NO: 1212612 - RNA, 21 nt, Human
cagcucaccucccacccaccu

SEQ ID NO: 1212613 - RNA, 24 nt, Human
cagcuccccacagcugccccaccc

SEQ ID NO: 1212614 - RNA, 22 nt, Human
caggagccccuguggccccagc

SEQ ID NO: 1212615 - RNA, 21 nt, Human
cagggcgcuggagcggguggg

SEQ ID NO: 1212616 - RNA, 22 nt, Human
cagugagaaggagggaagaacc

SEQ ID NO: 1212617 - RNA, 21 nt, Human
ccaccacaacaucaggccggg

SEQ ID NO: 1212618 - RNA, 24 nt, Human
ccaggacagacaagacaaaaggga

SEQ ID NO: 1212619 - RNA, 22 nt, Human
cccaaggagcccccagcucacc

SEQ ID NO: 1212620 - RNA, 22 nt, Human
cccacccaccucuggagcagca

SEQ ID NO: 1212621 - RNA, 24 nt, Human
cccccagcucaccucccacccacc

SEQ ID NO: 1212622 - RNA, 23 nt, Human
cccgauggccuugaagugcguca

SEQ ID NO: 1212623 - RNA, 19 nt, Human
ccggccccuuggccuccug

SEQ ID NO: 1212624 - RNA, 20 nt, Human
ccggccccuuggccuccugc

SEQ ID NO: 1212625 - RNA, 20 nt, Human
ccugugaagguggaggugag

SEQ ID NO: 1212626 - RNA, 23 nt, Human
ccuguggccccagcuccccacag

SEQ ID NO: 1212627 - RNA, 24 nt, Human
cggggcuggggggucgcaggagcg

SEQ ID NO: 1212628 - RNA, 18 nt, Human
cugugccggccccuuggc

SEQ ID NO: 1212629 - RNA, 20 nt, Human
cuuggcugcaccccaacauu

SEQ ID NO: 1212630 - RNA, 23 nt, Human
gacaaaagggacuguaggagaaa

SEQ ID NO: 1212631 - RNA, 20 nt, Human
gacagccaggacagacaaga

SEQ ID NO: 1212632 - RNA, 21 nt, Human
gaccaugaccgaugagggccc

SEQ ID NO: 1212633 - RNA, 19 nt, Human
gagaacaugagagucagcc

SEQ ID NO: 1212634 - RNA, 20 nt, Human
gagcagcaugcaggggcugc

SEQ ID NO: 1212635 - RNA, 22 nt, Human
gagggaggaaaggaggggacag

SEQ ID NO: 1212636 - RNA, 20 nt, Human
gaggugagugugcaaggcuu

SEQ ID NO: 1212637 - RNA, 19 nt, Human
gcacacacacagacagcca

SEQ ID NO: 1212638 - RNA, 19 nt, Human
gcccaaagggaggcuggga

SEQ ID NO: 1212639 - RNA, 22 nt, Human
gccgcacaccaccacaacauca

SEQ ID NO: 1212640 - RNA, 18 nt, Human
gccuccugcuuggcugca

SEQ ID NO: 1212641 - RNA, 20 nt, Human
gccugugaagguggagguga

SEQ ID NO: 1212642 - RNA, 19 nt, Human
gcgccuggggcgcggggcg

SEQ ID NO: 1212643 - RNA, 21 nt, Human
gcgggcgccuggggcgcgggg

SEQ ID NO: 1212644 - RNA, 18 nt, Human
gcugcggaaacgaggugg

SEQ ID NO: 1212645 - RNA, 20 nt, Human
ggaaacgaggugggugggug

SEQ ID NO: 1212646 - RNA, 19 nt, Human
ggaaaggaggggacaggag

SEQ ID NO: 1212647 - RNA, 18 nt, Human
ggaaggagagagugcaaa

SEQ ID NO: 1212648 - RNA, 20 nt, Human
ggaagguggaaaaaccagug

SEQ ID NO: 1212649 - RNA, 23 nt, Human
ggagaguggaaggaaggagggag

SEQ ID NO: 1212650 - RNA, 19 nt, Human
ggaggacuggcucaggggg

SEQ ID NO: 1212651 - RNA, 23 nt, Human
ggagggaagaaccugaggagggg

SEQ ID NO: 1212652 - RNA, 23 nt, Human
ggcaggagccaggagccccugug

SEQ ID NO: 1212653 - RNA, 20 nt, Human
ggcagggaagcaaaaggaag

SEQ ID NO: 1212654 - RNA, 21 nt, Human
ggcaugguggggagguuuggc

SEQ ID NO: 1212655 - RNA, 23 nt, Human
ggcgccuggggcgcggggcggcg

SEQ ID NO: 1212656 - RNA, 18 nt, Human
ggcggggugcggggcaug

SEQ ID NO: 1212657 - RNA, 19 nt, Human
ggcggggugcggggcaugg

SEQ ID NO: 1212658 - RNA, 21 nt, Human
ggcucagggggcucugaaguc

SEQ ID NO: 1212659 - RNA, 18 nt, Human
gggaaggguagacuugga

SEQ ID NO: 1212660 - RNA, 28 nt, Human
gggcuggggggucgcaggagcgggcggg

SEQ ID NO: 1212661 - RNA, 22 nt, Human
gggcugggggugaagucugggg

SEQ ID NO: 1212662 - RNA, 24 nt, Human
ggggagacagagaaacaaauggug

SEQ ID NO: 1212663 - RNA, 23 nt, Human
ggggcgcggggcggcggcggugg

SEQ ID NO: 1212664 - RNA, 19 nt, Human
ggggcggcggcggugggag

SEQ ID NO: 1212665 - RNA, 20 nt, Human
ggggggucgcaggagcgggc

SEQ ID NO: 1212666 - RNA, 23 nt, Human
ggguggggggcgggcgccugggg

SEQ ID NO: 1212667 - RNA, 18 nt, Human
gucuggggccucacuacc

SEQ ID NO: 1212668 - RNA, 26 nt, Human
guggaaggaaggagggaggaaaggag

SEQ ID NO: 1212669 - RNA, 22 nt, Human
guggaguuagggaggcccaaag

SEQ ID NO: 1212670 - RNA, 19 nt, Human
uacaucccacaguaauuca

SEQ ID NO: 1212671 - RNA, 28 nt, Human
ucccacccaccucuggagcagcaugcag

SEQ ID NO: 1212672 - RNA, 19 nt, Human
uccccacagcugccccacc

SEQ ID NO: 1212673 - RNA, 18 nt, Human
ucgggacugagcggggcu

SEQ ID NO: 1212674 - RNA, 20 nt, Human
ugacccagauuuucagccuu

SEQ ID NO: 1212675 - RNA, 24 nt, Human
ugagacgagagaacaugagaguca

SEQ ID NO: 1212676 - RNA, 18 nt, Human
ugagcggggcuggggggu

SEQ ID NO: 1212677 - RNA, 21 nt, Human
ugaggagggggaaagggcagg

SEQ ID NO: 1212678 - RNA, 18 nt, Human
ugagggagagagugagca

SEQ ID NO: 1212679 - RNA, 21 nt, Human
ugagggagagagugagcacga

SEQ ID NO: 1212680 - RNA, 20 nt, Human
uggccccagcuccccacagc

SEQ ID NO: 1212681 - RNA, 22 nt, Human
uggcgcggcggcgcgacgacug

SEQ ID NO: 1212682 - RNA, 23 nt, Human
uggcugcaccccaacauuggggg

SEQ ID NO: 1212683 - RNA, 20 nt, Human
ugggaagggaggacuggcuc

SEQ ID NO: 1212684 - RNA, 18 nt, Human
ugggacgagaccaugacc

SEQ ID NO: 1212685 - RNA, 24 nt, Human
ugggcugggggugaagucuggggc

SEQ ID NO: 1212686 - RNA, 20 nt, Human
uggggggcgggcgccugggg

SEQ ID NO: 1212687 - RNA, 22 nt, Human
uggguggguguucaugagggag

SEQ ID NO: 1212688 - RNA, 22 nt, Human
uguaggagaaagggaagggcaa

SEQ ID NO: 1212689 - RNA, 24 nt, Human
uucaagaugaucaccacaagaaga

SEQ ID NO: 1212690 - RNA, 25 nt, Human
aaaaagcuguaaccagacugagucc

SEQ ID NO: 1212691 - RNA, 20 nt, Human
aaagcucuucacaugccucu

SEQ ID NO: 1212692 - RNA, 20 nt, Human
aacccagccuaaccccguuu

SEQ ID NO: 1212693 - RNA, 21 nt, Human
aagaaaaauaaucuuuccuca

SEQ ID NO: 1212694 - RNA, 18 nt, Human
aagcaaaagcaggacagg

SEQ ID NO: 1212695 - RNA, 21 nt, Human
aagcaaaagcaggacagguga

SEQ ID NO: 1212696 - RNA, 19 nt, Human
aaugaccagguagcugugg

SEQ ID NO: 1212697 - RNA, 21 nt, Human
acagaggagagaacaucccag

SEQ ID NO: 1212698 - RNA, 18 nt, Human
acccaaggcaagauuuca

SEQ ID NO: 1212699 - RNA, 19 nt, Human
accucuuagauccuguggu

SEQ ID NO: 1212700 - RNA, 24 nt, Human
acugagagguuaacauuucucuca

SEQ ID NO: 1212701 - RNA, 22 nt, Human
acuggaaaaauucauccccuca

SEQ ID NO: 1212702 - RNA, 19 nt, Human
acuugcuucccuugcuccc

SEQ ID NO: 1212703 - RNA, 19 nt, Human
agauaaccgggaaaaaagg

SEQ ID NO: 1212704 - RNA, 18 nt, Human
agcggucggcucgccucc

SEQ ID NO: 1212705 - RNA, 24 nt, Human
aggaaaaaauaaaaauaaaaaugu

SEQ ID NO: 1212706 - RNA, 20 nt, Human
aggcauggcaucugaauacc

SEQ ID NO: 1212707 - RNA, 21 nt, Human
aggugagaaggaaaggugagg

SEQ ID NO: 1212708 - RNA, 26 nt, Human
auaucguucccucauuuacccaaaau

SEQ ID NO: 1212709 - RNA, 20 nt, Human
caaauauucacaaguaucuc

SEQ ID NO: 1212710 - RNA, 22 nt, Human
caagccuucagcuuuucucaca

SEQ ID NO: 1212711 - RNA, 21 nt, Human
caccaaucgcuuaacacccac

SEQ ID NO: 1212712 - RNA, 26 nt, Human
caccagauaaccgggaaaaaaggguu

SEQ ID NO: 1212713 - RNA, 19 nt, Human
cacccaccuccuuccuccu

SEQ ID NO: 1212714 - RNA, 19 nt, Human
cacccuguaugaaaaaccc

SEQ ID NO: 1212715 - RNA, 22 nt, Human
caccuccuuccuccuuugcucc

SEQ ID NO: 1212716 - RNA, 19 nt, Human
caccuggaugaagaugaga

SEQ ID NO: 1212717 - RNA, 22 nt, Human
cagcauuccccaaaaccuucuc

SEQ ID NO: 1212718 - RNA, 22 nt, Human
cagcggucggcucgccucccuc

SEQ ID NO: 1212719 - RNA, 23 nt, Human
cauugucaaggucaggugcugac

SEQ ID NO: 1212720 - RNA, 25 nt, Human
ccaaacacccuguaugaaaaacccu

SEQ ID NO: 1212721 - RNA, 19 nt, Human
ccacaacagugcccaucuc

SEQ ID NO: 1212722 - RNA, 18 nt, Human
ccacaucacuccgguccu

SEQ ID NO: 1212723 - RNA, 24 nt, Human
ccaccacaacagugcccaucuccu

SEQ ID NO: 1212724 - RNA, 20 nt, Human
ccagacuuaaugcaccugga

SEQ ID NO: 1212725 - RNA, 24 nt, Human
ccagauaaccgggaaaaaaggguu

SEQ ID NO: 1212726 - RNA, 21 nt, Human
ccagcggucggcucgccuccc

SEQ ID NO: 1212727 - RNA, 23 nt, Human
ccagcggucggcucgccucccuc

SEQ ID NO: 1212728 - RNA, 20 nt, Human
ccaguacagaggagagaaca

SEQ ID NO: 1212729 - RNA, 18 nt, Human
cccacaucacuccugcuu

SEQ ID NO: 1212730 - RNA, 19 nt, Human
ccccaguccuacucuuccu

SEQ ID NO: 1212731 - RNA, 22 nt, Human
ccccgucucucccucacaccca

SEQ ID NO: 1212732 - RNA, 23 nt, Human
ccccgucucucccucacacccac

SEQ ID NO: 1212733 - RNA, 21 nt, Human
ccccucuaccccaguccuacu

SEQ ID NO: 1212734 - RNA, 21 nt, Human
ccgccgccgccugcgcccugc

SEQ ID NO: 1212735 - RNA, 22 nt, Human
ccgccugcgcccugccugcgcc

SEQ ID NO: 1212736 - RNA, 24 nt, Human
ccucacacccacuugcuucccuug

SEQ ID NO: 1212737 - RNA, 23 nt, Human
cgccgccugcgcccugccugcgc

SEQ ID NO: 1212738 - RNA, 24 nt, Human
cgccucccucucccaccggcccaa

SEQ ID NO: 1212739 - RNA, 28 nt, Human
cggccaaacacccuguaugaaaaacccu

SEQ ID NO: 1212740 - RNA, 23 nt, Human
cuaaccccguuuaaaugcuguca

SEQ ID NO: 1212741 - RNA, 20 nt, Human
cuccagcauuccccaaaacc

SEQ ID NO: 1212742 - RNA, 18 nt, Human
cucccucucccaccggcc

SEQ ID NO: 1212743 - RNA, 21 nt, Human
cucgaacuucaacccagccua

SEQ ID NO: 1212744 - RNA, 22 nt, Human
cucuaccccaguccuacucuuc

SEQ ID NO: 1212745 - RNA, 23 nt, Human
cucuacuucccccuccccauucc

SEQ ID NO: 1212746 - RNA, 18 nt, Human
cuucccccuccccauucc

SEQ ID NO: 1212747 - RNA, 20 nt, Human
cuucuuggccacacagugcc

SEQ ID NO: 1212748 - RNA, 23 nt, Human
gaagcagacauggccacagccuu

SEQ ID NO: 1212749 - RNA, 24 nt, Human
gacaccaaaagucaugaggagaga

SEQ ID NO: 1212750 - RNA, 19 nt, Human
gagccacuccuagcugugg

SEQ ID NO: 1212751 - RNA, 21 nt, Human
gaguugcagugggagagacag

SEQ ID NO: 1212752 - RNA, 25 nt, Human
gaucaccagauaaccgggaaaaaag

SEQ ID NO: 1212753 - RNA, 22 nt, Human
gcaaauacuuuuacuacccaaa

SEQ ID NO: 1212754 - RNA, 21 nt, Human
gcaucaccauugucaagguca

SEQ ID NO: 1212755 - RNA, 20 nt, Human
gcccugccugcgccugggcu

SEQ ID NO: 1212756 - RNA, 22 nt, Human
gccugggcuggcggcggggagc

SEQ ID NO: 1212757 - RNA, 23 nt, Human
gcuccagcauuccccaaaaccuu

SEQ ID NO: 1212758 - RNA, 21 nt, Human
gcucuacuucccccuccccau

SEQ ID NO: 1212759 - RNA, 18 nt, Human
ggaagcaaaagcaggaca

SEQ ID NO: 1212760 - RNA, 21 nt, Human
ggacccaaggcaagauuucag

SEQ ID NO: 1212761 - RNA, 24 nt, Human
ggccaaacacccuguaugaaaaac

SEQ ID NO: 1212762 - RNA, 18 nt, Human
ggccccagccuuuuuaaa

SEQ ID NO: 1212763 - RNA, 26 nt, Human
ggccuccuggauuccccucuaccccc

SEQ ID NO: 1212764 - RNA, 20 nt, Human
ggcgccuucaggccacauca

SEQ ID NO: 1212765 - RNA, 25 nt, Human
gggcauugagggaaaacugacuuuc

SEQ ID NO: 1212766 - RNA, 24 nt, Human
ggguguccaaucaggucagagaag

SEQ ID NO: 1212767 - RNA, 20 nt, Human
ggguuuugagggaguugggg

SEQ ID NO: 1212768 - RNA, 20 nt, Human
uaaagcucuucacaugccuc

SEQ ID NO: 1212769 - RNA, 18 nt, Human
uaaccagacugaguccuc

SEQ ID NO: 1212770 - RNA, 20 nt, Human
uaaccagacugaguccucaa

SEQ ID NO: 1212771 - RNA, 21 nt, Human
uacagcaaauauucacaagua

SEQ ID NO: 1212772 - RNA, 23 nt, Human
uacccaaaaucuccuuugcacac

SEQ ID NO: 1212773 - RNA, 20 nt, Human
uacuacccaaacuuccuucc

SEQ ID NO: 1212774 - RNA, 19 nt, Human
uagacuccuacgcacccaa

SEQ ID NO: 1212775 - RNA, 21 nt, Human
uagcuguggcucccacuucac

SEQ ID NO: 1212776 - RNA, 27 nt, Human
uagcuguggcugcccucagggaagggg

SEQ ID NO: 1212777 - RNA, 18 nt, Human
uaguucuccaucacuugc

SEQ ID NO: 1212778 - RNA, 22 nt, Human
uccagcucccuugguuucccac

SEQ ID NO: 1212779 - RNA, 27 nt, Human
ucccaccacaacagugcccaucuccuc

SEQ ID NO: 1212780 - RNA, 19 nt, Human
ucccaccggcccagccucc

SEQ ID NO: 1212781 - RNA, 23 nt, Human
ucccaggauuccgagcaggaccc

SEQ ID NO: 1212782 - RNA, 21 nt, Human
uccccaaaaccuucucaagca

SEQ ID NO: 1212783 - RNA, 20 nt, Human
uccccggccuccuggauucc

SEQ ID NO: 1212784 - RNA, 19 nt, Human
uccccgucucucccucaca

SEQ ID NO: 1212785 - RNA, 19 nt, Human
ucccuaaaugagccacucc

SEQ ID NO: 1212786 - RNA, 18 nt, Human
uccuaaaucccaggauuc

SEQ ID NO: 1212787 - RNA, 20 nt, Human
uccuggauuccccucuaccc

SEQ ID NO: 1212788 - RNA, 19 nt, Human
uccuuuagacuccuacgca

SEQ ID NO: 1212789 - RNA, 23 nt, Human
ucuccaugcaaauacuuuuacua

SEQ ID NO: 1212790 - RNA, 18 nt, Human
ucugccaacuguccccca

SEQ ID NO: 1212791 - RNA, 23 nt, Human
ugaagaaagagcuugaaguucua

SEQ ID NO: 1212792 - RNA, 24 nt, Human
ugaagagaugcaaagaaaguggag

SEQ ID NO: 1212793 - RNA, 23 nt, Human
ugaaggcuauggcuaugucuuug

SEQ ID NO: 1212794 - RNA, 21 nt, Human
ugaauaccaacuccaucugcc

SEQ ID NO: 1212795 - RNA, 22 nt, Human
ugaauaccaacuccaucugcca

SEQ ID NO: 1212796 - RNA, 24 nt, Human
ugaaucaaauguuuuaagucugcc

SEQ ID NO: 1212797 - RNA, 22 nt, Human
ugacauguggagcuggacagga

SEQ ID NO: 1212798 - RNA, 22 nt, Human
ugagcuacccugcccuaaccca

SEQ ID NO: 1212799 - RNA, 22 nt, Human
ugagggaaaacugacuuucugc

SEQ ID NO: 1212800 - RNA, 23 nt, Human
ugauuccuaaaucccaggauucc

SEQ ID NO: 1212801 - RNA, 23 nt, Human
ugcaaauacuuuuacuacccaaa

SEQ ID NO: 1212802 - RNA, 19 nt, Human
ugcaucaccauugucaagg

SEQ ID NO: 1212803 - RNA, 22 nt, Human
ugccuccagcucccuugguuuc

SEQ ID NO: 1212804 - RNA, 27 nt, Human
ugcucccaccacaacagugcccauugu

SEQ ID NO: 1212805 - RNA, 21 nt, Human
uggaguugcagugggagagac

SEQ ID NO: 1212806 - RNA, 19 nt, Human
uggcugcccucagggaagg

SEQ ID NO: 1212807 - RNA, 22 nt, Human
uucauggaccuccugagugaag

SEQ ID NO: 1212808 - RNA, 18 nt, Human
uuccccucuaccccaguc

SEQ ID NO: 1212809 - RNA, 19 nt, Human
uuccucugccuccagcucc

SEQ ID NO: 1212810 - RNA, 23 nt, Human
uugaaguucuaggaacugagagg

SEQ ID NO: 1212811 - RNA, 21 nt, Human
uugcagugggagagacaggag

SEQ ID NO: 1212812 - RNA, 21 nt, Human
uugcugagccuugggcauuga

SEQ ID NO: 1212813 - RNA, 21 nt, Human
uugggguagaaaacuguaucu

SEQ ID NO: 1212814 - RNA, 25 nt, Human
uuuacuacccaaacuuccuuccaaa

SEQ ID NO: 1212815 - RNA, 21 nt, Human
uuuauuuuuguucugcuccuu

SEQ ID NO: 1212816 - RNA, 21 nt, Human
uuucaacaacggccaaacacc

SEQ ID NO: 1212817 - RNA, 22 nt, Human
uuuguccccggccuccuggauu

SEQ ID NO: 1212818 - RNA, 18 nt, Human
uuuugcuccagcauuccc

SEQ ID NO: 1212819 - RNA, 23 nt, Human
uuuugcuccagcauuccccaaaa

SEQ ID NO: 1212820 - RNA, 21 nt, Human
aaacauugaaggaaacaacac

SEQ ID NO: 1212821 - RNA, 21 nt, Human
aaaggcagaaacauugaagga

SEQ ID NO: 1212822 - RNA, 25 nt, Human
aaggcagaaacauugaaggaaacaa

SEQ ID NO: 1212823 - RNA, 24 nt, Human
accuugaaaaucaguuuuaaaagg

SEQ ID NO: 1212824 - RNA, 21 nt, Human
augaaagaaccuugugccgga

SEQ ID NO: 1212825 - RNA, 23 nt, Human
uacuucauauuacacauacuuuu

SEQ ID NO: 1212826 - RNA, 19 nt, Human
uagaucgcagaacgagcga

SEQ ID NO: 1212827 - RNA, 24 nt, Human
ucugaaacauuuuacuucauauua

SEQ ID NO: 1212828 - RNA, 20 nt, Human
ugaaggaaacaacacucaac

SEQ ID NO: 1212829 - RNA, 23 nt, Human
ugaaggaaacaacacucaacaug

SEQ ID NO: 1212830 - RNA, 18 nt, Human
uggaagccacucucaaua

SEQ ID NO: 1212831 - RNA, 25 nt, Human
uugaaggaaacaacacucaacauga

SEQ ID NO: 1212832 - RNA, 21 nt, Human
uuggaagccacucucaauaga

SEQ ID NO: 1212833 - RNA, 24 nt, Human
aaaaagaauccauucuacuuuaga

SEQ ID NO: 1212834 - RNA, 20 nt, Human
aaacagaaaaaaaagaaucc

SEQ ID NO: 1212835 - RNA, 24 nt, Human
aaaucauucauggcaggcauuuga

SEQ ID NO: 1212836 - RNA, 21 nt, Human
aaauuccuuaaagugcuucuc

SEQ ID NO: 1212837 - RNA, 20 nt, Human
aacauaauaugaacauaaaa

SEQ ID NO: 1212838 - RNA, 22 nt, Human
aacccuuuuccuuuauuacucu

SEQ ID NO: 1212839 - RNA, 21 nt, Human
aaggcacuccccacccaauga

SEQ ID NO: 1212840 - RNA, 26 nt, Human
aaucacaugaaagcuauuaaauuaaa

SEQ ID NO: 1212841 - RNA, 21 nt, Human
aauuaucugagggauguuuaa

SEQ ID NO: 1212842 - RNA, 18 nt, Human
acaaauaugcuucaaaac

SEQ ID NO: 1212843 - RNA, 21 nt, Human
acaggagugcagcaggaaguc

SEQ ID NO: 1212844 - RNA, 21 nt, Human
acagugaaauggggucccgga

SEQ ID NO: 1212845 - RNA, 20 nt, Human
acuagagaggaagugacacc

SEQ ID NO: 1212846 - RNA, 22 nt, Human
acuccccacccaaugaccacaa

SEQ ID NO: 1212847 - RNA, 24 nt, Human
agaaaugaaaauaaucaaacagaa

SEQ ID NO: 1212848 - RNA, 20 nt, Human
agacagaaaugaaaauaauc

SEQ ID NO: 1212849 - RNA, 18 nt, Human
agacaggagugcagcagg

SEQ ID NO: 1212850 - RNA, 18 nt, Human
agagaagagguacuagag

SEQ ID NO: 1212851 - RNA, 20 nt, Human
agcaggaaguaaucuccaga

SEQ ID NO: 1212852 - RNA, 23 nt, Human
agcaugaccaugaugcaaaucac

SEQ ID NO: 1212853 - RNA, 19 nt, Human
aggaaauggcaauaguuga

SEQ ID NO: 1212854 - RNA, 22 nt, Human
aggcacuccccacccaaugacc

SEQ ID NO: 1212855 - RNA, 18 nt, Human
aggcugagcaaaagugag

SEQ ID NO: 1212856 - RNA, 21 nt, Human
aggggugagagggccuggcuc

SEQ ID NO: 1212857 - RNA, 20 nt, Human
aguauuuuuuugagauggaa

SEQ ID NO: 1212858 - RNA, 21 nt, Human
agucagacuucauggggccug

SEQ ID NO: 1212859 - RNA, 22 nt, Human
aucaaacagaaaaaaaagaauc

SEQ ID NO: 1212860 - RNA, 24 nt, Human
augaaaauaaucaaacagaaaaaa

SEQ ID NO: 1212861 - RNA, 18 nt, Human
augcucauaauuauaaaa

SEQ ID NO: 1212862 - RNA, 23 nt, Human
augguacuguaaggaaaagauga

SEQ ID NO: 1212863 - RNA, 18 nt, Human
auucauuucuccauccca

SEQ ID NO: 1212864 - RNA, 23 nt, Human
caauaguugagacucauauuugc

SEQ ID NO: 1212865 - RNA, 22 nt, Human
cacagguccacugccacaccca

SEQ ID NO: 1212866 - RNA, 25 nt, Human
cacccaaugaccacaaugagggcac

SEQ ID NO: 1212867 - RNA, 21 nt, Human
caccuucuguaucuaaugaau

SEQ ID NO: 1212868 - RNA, 19 nt, Human
cacuacaacuuugcucuuu

SEQ ID NO: 1212869 - RNA, 21 nt, Human
ccacacccaucaauuucccca

SEQ ID NO: 1212870 - RNA, 19 nt, Human
cccugcaucuccacuacaa

SEQ ID NO: 1212871 - RNA, 21 nt, Human
cucuaguacaaucagacaguu

SEQ ID NO: 1212872 - RNA, 23 nt, Human
cugcagacuccuugacaaaaggc

SEQ ID NO: 1212873 - RNA, 22 nt, Human
cugcugccucugaagccacuua

SEQ ID NO: 1212874 - RNA, 23 nt, Human
gagauggaaagacaugcucaaau

SEQ ID NO: 1212875 - RNA, 20 nt, Human
gcacggaaccuccuaggagu

SEQ ID NO: 1212876 - RNA, 22 nt, Human
gcauuaaaaaaggauauaaagc

SEQ ID NO: 1212877 - RNA, 20 nt, Human
gcucaguuucucuagugguu

SEQ ID NO: 1212878 - RNA, 19 nt, Human
gggcacuugcuguuucugc

SEQ ID NO: 1212879 - RNA, 24 nt, Human
gugaaauggggucccggauccacu

SEQ ID NO: 1212880 - RNA, 23 nt, Human
uaaaagaauauuaaaaugcacag

SEQ ID NO: 1212881 - RNA, 23 nt, Human
uaaaagaauauuaaaaugcacag

SEQ ID NO: 1212882 - RNA, 19 nt, Human
uaaaaugcacagaaauuaa

SEQ ID NO: 1212883 - RNA, 19 nt, Human
uaaaaugcacagaaauuaa

SEQ ID NO: 1212884 - RNA, 22 nt, Human
uaaucaaacagaaaaaaaagaa

SEQ ID NO: 1212885 - RNA, 22 nt, Human
uacaauacugcuuugauggauc

SEQ ID NO: 1212886 - RNA, 19 nt, Human
uacuagagaggaagugaca

SEQ ID NO: 1212887 - RNA, 27 nt, Human
uacuagagaggaagugacacccgcuuc

SEQ ID NO: 1212888 - RNA, 24 nt, Human
uagacagaaaugaaaauaaucaaa

SEQ ID NO: 1212889 - RNA, 22 nt, Human
uaggggugagagggccuggcuc

SEQ ID NO: 1212890 - RNA, 23 nt, Human
uaucacugcaagucagccgugga

SEQ ID NO: 1212891 - RNA, 18 nt, Human
uaucagaaaaagguaaca

SEQ ID NO: 1212892 - RNA, 21 nt, Human
uaugccacaaugugugaaaag

SEQ ID NO: 1212893 - RNA, 19 nt, Human
uaugcuucaaaaccuugcu

SEQ ID NO: 1212894 - RNA, 23 nt, Human
ucaaacagaaaaaaaagaaucca

SEQ ID NO: 1212895 - RNA, 21 nt, Human
ucagauauuacauuuggugcc

SEQ ID NO: 1212896 - RNA, 18 nt, Human
ucauggcaggcauuugaa

SEQ ID NO: 1212897 - RNA, 24 nt, Human
ucauuaacacgaucaagagagaca

SEQ ID NO: 1212898 - RNA, 22 nt, Human
ucccagugcagucagacuucau

SEQ ID NO: 1212899 - RNA, 22 nt, Human
ucuauaaugaugguacuguaag

SEQ ID NO: 1212900 - RNA, 21 nt, Human
ucuccagauaaugguaggguu

SEQ ID NO: 1212901 - RNA, 24 nt, Human
ucuccagauaaugguaggguuugu

SEQ ID NO: 1212902 - RNA, 22 nt, Human
ucugauagguuggcuccucugg

SEQ ID NO: 1212903 - RNA, 21 nt, Human
ugaaauucaaggcacacaugc

SEQ ID NO: 1212904 - RNA, 18 nt, Human
ugaagagaggaacagugg

SEQ ID NO: 1212905 - RNA, 21 nt, Human
ugaagagaggaacaguggcac

SEQ ID NO: 1212906 - RNA, 18 nt, Human
ugacaaaaggcacucccc

SEQ ID NO: 1212907 - RNA, 22 nt, Human
ugagaaagaguuuccuucagug

SEQ ID NO: 1212908 - RNA, 25 nt, Human
ugagaaagaguuuccuucaguggga

SEQ ID NO: 1212909 - RNA, 22 nt, Human
ugagcaaaagugagggggcaag

SEQ ID NO: 1212910 - RNA, 18 nt, Human
ugaggggcuuaucuuuuc

SEQ ID NO: 1212911 - RNA, 18 nt, Human
ugaguauuugcucuaaug

SEQ ID NO: 1212912 - RNA, 26 nt, Human
ugauaucacuguuuuccaagaaacua

SEQ ID NO: 1212913 - RNA, 20 nt, Human
ugaugcaaaucaccucccuc

SEQ ID NO: 1212914 - RNA, 22 nt, Human
ugcagucagacuucauggggcc

SEQ ID NO: 1212915 - RNA, 21 nt, Human
ugccaaagugauuuaacuuac

SEQ ID NO: 1212916 - RNA, 20 nt, Human
ugcugggauucugauagguu

SEQ ID NO: 1212917 - RNA, 19 nt, Human
uggaaagacaugcucaaau

SEQ ID NO: 1212918 - RNA, 23 nt, Human
uggaagauaaaaagugucacugu

SEQ ID NO: 1212919 - RNA, 20 nt, Human
uggacucacuaacaaacacu

SEQ ID NO: 1212920 - RNA, 18 nt, Human
uggcaggcauuugaaauc

SEQ ID NO: 1212921 - RNA, 19 nt, Human
uguagaggguuuuuuuucc

SEQ ID NO: 1212922 - RNA, 22 nt, Human
uguugauaaaaauguaauuuua

SEQ ID NO: 1212923 - RNA, 23 nt, Human
uguuucaauaugcuaaaauucac

SEQ ID NO: 1212924 - RNA, 22 nt, Human
uucauuucuccaucccagugca

SEQ ID NO: 1212925 - RNA, 23 nt, Human
uugacaaaaggcacuccccaccc

SEQ ID NO: 1212926 - RNA, 19 nt, Human
uugagauggaaagacaugc

SEQ ID NO: 1212927 - RNA, 21 nt, Human
uugugcacccagcaaugaccu

SEQ ID NO: 1212928 - RNA, 24 nt, Human
uuuagaaaagauuaauuauccaga

SEQ ID NO: 1212929 - RNA, 19 nt, Human
aaaaaacauucccaccucc

SEQ ID NO: 1212930 - RNA, 21 nt, Human
aaaaaacauucccaccuccca

SEQ ID NO: 1212931 - RNA, 23 nt, Human
aaaaaacauucccaccucccacu

SEQ ID NO: 1212932 - RNA, 23 nt, Human
aaaaagagauuuaagauauggga

SEQ ID NO: 1212933 - RNA, 20 nt, Human
aaaaagcagcauuaaacuau

SEQ ID NO: 1212934 - RNA, 22 nt, Human
aaaaucacaaauaauaugccua

SEQ ID NO: 1212935 - RNA, 19 nt, Human
aaagugcugggauuauagg

SEQ ID NO: 1212936 - RNA, 23 nt, Human
aaagugcugggauuauaggugua

SEQ ID NO: 1212937 - RNA, 23 nt, Human
aacagauagcuagagaugaugag

SEQ ID NO: 1212938 - RNA, 22 nt, Human
aacucuuuucaauccugagcag

SEQ ID NO: 1212939 - RNA, 22 nt, Human
aagcagcauuaaacuaugcagg

SEQ ID NO: 1212940 - RNA, 20 nt, Human
aaggacugaagucugguuau

SEQ ID NO: 1212941 - RNA, 19 nt, Human
aaguaauaaagugcucucc

SEQ ID NO: 1212942 - RNA, 18 nt, Human
aagugcugggauuauagg

SEQ ID NO: 1212943 - RNA, 26 nt, Human
aagugcugggauuauagguguaagcc

SEQ ID NO: 1212944 - RNA, 20 nt, Human
acauuuuaucaauuucucua

SEQ ID NO: 1212945 - RNA, 21 nt, Human
acuggaauacaaguucaaggu

SEQ ID NO: 1212946 - RNA, 22 nt, Human
acuuuuguuagguggauccaag

SEQ ID NO: 1212947 - RNA, 19 nt, Human
agacaauacauacuuugca

SEQ ID NO: 1212948 - RNA, 18 nt, Human
agaugggaaagacugaua

SEQ ID NO: 1212949 - RNA, 22 nt, Human
agcaaaaaguuuaaagauggua

SEQ ID NO: 1212950 - RNA, 23 nt, Human
agcaaaaaguuuaaagaugguaa

SEQ ID NO: 1212951 - RNA, 19 nt, Human
agcacuguaauuauuuucu

SEQ ID NO: 1212952 - RNA, 21 nt, Human
aggaagacucaacaagaucug

SEQ ID NO: 1212953 - RNA, 22 nt, Human
aggcuaaccaugcagcaaaaaa

SEQ ID NO: 1212954 - RNA, 20 nt, Human
agugauccuucugccucagc

SEQ ID NO: 1212955 - RNA, 23 nt, Human
auaaagugcucuccagcugaaaa

SEQ ID NO: 1212956 - RNA, 24 nt, Human
auagcucacuacagccuuugacuc

SEQ ID NO: 1212957 - RNA, 24 nt, Human
aucuaauucaucacauuacucuaa

SEQ ID NO: 1212958 - RNA, 21 nt, Human
caaaaaaagguuaaggguggu

SEQ ID NO: 1212959 - RNA, 18 nt, Human
caaaaaguuuaaagaugg

SEQ ID NO: 1212960 - RNA, 19 nt, Human
caaaggauaaccaaucaaa

SEQ ID NO: 1212961 - RNA, 24 nt, Human
caaagugcugggauuauaggugua

SEQ ID NO: 1212962 - RNA, 24 nt, Human
caauagcuaaaccacaaaggauaa

SEQ ID NO: 1212963 - RNA, 18 nt, Human
caaucucauucauaagca

SEQ ID NO: 1212964 - RNA, 18 nt, Human
caccuugauccugcuacu

SEQ ID NO: 1212965 - RNA, 20 nt, Human
cacuauguugccaggcuggu

SEQ ID NO: 1212966 - RNA, 23 nt, Human
cacuauguugccaggcuggucuc

SEQ ID NO: 1212967 - RNA, 19 nt, Human
cacugcauacaaaaagcac

SEQ ID NO: 1212968 - RNA, 24 nt, Human
cacugcauacaaaaagcacuguaa

SEQ ID NO: 1212969 - RNA, 21 nt, Human
cacugcuccuuuaugucccuc

SEQ ID NO: 1212970 - RNA, 22 nt, Human
cacuucagaaggacauaaugga

SEQ ID NO: 1212971 - RNA, 19 nt, Human
cagaaggacauaauggaaa

SEQ ID NO: 1212972 - RNA, 22 nt, Human
cagaugaguaguuuugaaauca

SEQ ID NO: 1212973 - RNA, 24 nt, Human
cagccuuugacucccugggcccaa

SEQ ID NO: 1212974 - RNA, 18 nt, Human
caggaggugagaggauag

SEQ ID NO: 1212975 - RNA, 19 nt, Human
caggcaauagcuaaaccac

SEQ ID NO: 1212976 - RNA, 21 nt, Human
caguuucauuucuuucucaag

SEQ ID NO: 1212977 - RNA, 24 nt, Human
caugucaauuucccaugaccaaaa

SEQ ID NO: 1212978 - RNA, 24 nt, Human
cauuuuaucaauuucucuaacacu

SEQ ID NO: 1212979 - RNA, 21 nt, Human
ccaaagugcugggauuauagg

SEQ ID NO: 1212980 - RNA, 24 nt, Human
ccaaagugcugggauuauaggugu

SEQ ID NO: 1212981 - RNA, 22 nt, Human
ccacaaaggauaaccaaucaaa

SEQ ID NO: 1212982 - RNA, 23 nt, Human
ccagugauccuucugccucagcc

SEQ ID NO: 1212983 - RNA, 18 nt, Human
ccugaugaucaccugaga

SEQ ID NO: 1212984 - RNA, 26 nt, Human
ccuucugccucagccucccaaagugc

SEQ ID NO: 1212985 - RNA, 22 nt, Human
ccuuugacucccugggcccaag

SEQ ID NO: 1212986 - RNA, 23 nt, Human
cgagcauccuccauucaaaaaau

SEQ ID NO: 1212987 - RNA, 24 nt, Human
cgcguccugaugaucaccugagaa

SEQ ID NO: 1212988 - RNA, 21 nt, Human
cguccugaugaucaccugaga

SEQ ID NO: 1212989 - RNA, 19 nt, Human
cuaugcaggcaauagcuaa

SEQ ID NO: 1212990 - RNA, 21 nt, Human
cucacuacagccuuugacucc

SEQ ID NO: 1212991 - RNA, 18 nt, Human
cuccagugauccuucugc

SEQ ID NO: 1212992 - RNA, 24 nt, Human
cugaagucugguuauuagacaugu

SEQ ID NO: 1212993 - RNA, 27 nt, Human
cugccgaacuuaauuuuccuauuauac

SEQ ID NO: 1212994 - RNA, 24 nt, Human
cugccucagccucccaaagugcug

SEQ ID NO: 1212995 - RNA, 21 nt, Human
cugggauuauagguguaagcc

SEQ ID NO: 1212996 - RNA, 21 nt, Human
gagaggauaggaaauggaagg

SEQ ID NO: 1212997 - RNA, 27 nt, Human
gagcauccuccauucaaaaaauauaaa

SEQ ID NO: 1212998 - RNA, 18 nt, Human
gauuauagguguaagcca

SEQ ID NO: 1212999 - RNA, 19 nt, Human
gauuauagguguaagccac

SEQ ID NO: 1213000 - RNA, 24 nt, Human
gauuauagguguaagccacagugc

SEQ ID NO: 1213001 - RNA, 23 nt, Human
gcuggucucaaacuccuggccuc

SEQ ID NO: 1213002 - RNA, 21 nt, Human
gcuguugauucugugguguug

SEQ ID NO: 1213003 - RNA, 23 nt, Human
ggaguaaaaaauugaagaaauuc

SEQ ID NO: 1213004 - RNA, 24 nt, Human
ggauuauagguguaagccacagug

SEQ ID NO: 1213005 - RNA, 24 nt, Human
ggcuggucucaaacuccuggccuc

SEQ ID NO: 1213006 - RNA, 23 nt, Human
gggaacauggagaugggaaagac

SEQ ID NO: 1213007 - RNA, 21 nt, Human
ggggacagcaggaggugagag

SEQ ID NO: 1213008 - RNA, 26 nt, Human
gguauacaugcuuguaagugugugua

SEQ ID NO: 1213009 - RNA, 23 nt, Human
ggucaaaggcuaaccaugcagca

SEQ ID NO: 1213010 - RNA, 18 nt, Human
guagagauggaaucucac

SEQ ID NO: 1213011 - RNA, 22 nt, Human
guagagauggaaucucacuaug

SEQ ID NO: 1213012 - RNA, 24 nt, Human
gugauccuucugccucagccuccc

SEQ ID NO: 1213013 - RNA, 19 nt, Human
guuucauuucuuucucaag

SEQ ID NO: 1213014 - RNA, 24 nt, Human
uaaaaaagaaucucaaacauaaaa

SEQ ID NO: 1213015 - RNA, 27 nt, Human
uaaaaagagauuuaagauaugggaaca

SEQ ID NO: 1213016 - RNA, 22 nt, Human
uaaaauaucaguucucuauacu

SEQ ID NO: 1213017 - RNA, 23 nt, Human
uaagguggauccagugacacauu

SEQ ID NO: 1213018 - RNA, 24 nt, Human
uaaguguguguauacauaugugca

SEQ ID NO: 1213019 - RNA, 18 nt, Human
uacuggaauacaaguuca

SEQ ID NO: 1213020 - RNA, 19 nt, Human
uagagaaagcacuccaaaa

SEQ ID NO: 1213021 - RNA, 22 nt, Human
uagagauggaaucucacuaugu

SEQ ID NO: 1213022 - RNA, 22 nt, Human
uauguugccaggcuggucucaa

SEQ ID NO: 1213023 - RNA, 23 nt, Human
uauguugccaggcuggucucaaa

SEQ ID NO: 1213024 - RNA, 23 nt, Human
ucaaaagaacugugaaggucaaa

SEQ ID NO: 1213025 - RNA, 24 nt, Human
ucaagauuccacugcauacaaaaa

SEQ ID NO: 1213026 - RNA, 24 nt, Human
ucacuacagccuuugacucccugg

SEQ ID NO: 1213027 - RNA, 25 nt, Human
ucacuacagccuuugacucccuggg

SEQ ID NO: 1213028 - RNA, 28 nt, Human
ucacuacagccuuugacuccgguccucc

SEQ ID NO: 1213029 - RNA, 20 nt, Human
uccacugcauacaaaaagca

SEQ ID NO: 1213030 - RNA, 28 nt, Human
uccagugauccuucugccucagccuccc

SEQ ID NO: 1213031 - RNA, 23 nt, Human
ucccaaagugcugggauuauagg

SEQ ID NO: 1213032 - RNA, 23 nt, Human
ucucacuauguugccaggcuggu

SEQ ID NO: 1213033 - RNA, 18 nt, Human
ucucuauacugcacauug

SEQ ID NO: 1213034 - RNA, 24 nt, Human
ucugccucagccucccaaagugcu

SEQ ID NO: 1213035 - RNA, 29 nt, Human
ucugugguguugguuccaacaacaguggu

SEQ ID NO: 1213036 - RNA, 18 nt, Human
ugaaaucaacagggucca

SEQ ID NO: 1213037 - RNA, 22 nt, Human
ugaaaugagcagaagcuaaagg

SEQ ID NO: 1213038 - RNA, 18 nt, Human
ugaagucugguuauuaga

SEQ ID NO: 1213039 - RNA, 22 nt, Human
ugaagucugguuauuagacaug

SEQ ID NO: 1213040 - RNA, 21 nt, Human
ugaauagacuggcagucaaaa

SEQ ID NO: 1213041 - RNA, 20 nt, Human
ugaaugaacgugagaacaga

SEQ ID NO: 1213042 - RNA, 21 nt, Human
ugacacaaaucuauacacuuc

SEQ ID NO: 1213043 - RNA, 23 nt, Human
ugacacauucauagcucacuaca

SEQ ID NO: 1213044 - RNA, 22 nt, Human
ugaccaaaaucacaaauaauau

SEQ ID NO: 1213045 - RNA, 18 nt, Human
ugaccaaagauuccccaa

SEQ ID NO: 1213046 - RNA, 21 nt, Human
ugacucauaaugagccagugg

SEQ ID NO: 1213047 - RNA, 20 nt, Human
ugacucccugggcccaagcu

SEQ ID NO: 1213048 - RNA, 24 nt, Human
ugacucccugggcccaagcuggga

SEQ ID NO: 1213049 - RNA, 21 nt, Human
ugagaacacgagcauccucca

SEQ ID NO: 1213050 - RNA, 22 nt, Human
ugagaaguagguucauuugcug

SEQ ID NO: 1213051 - RNA, 24 nt, Human
ugagaggauaggaaauggaagggu

SEQ ID NO: 1213052 - RNA, 23 nt, Human
ugagcuaaacagaauugagcuaa

SEQ ID NO: 1213053 - RNA, 21 nt, Human
ugagggaagugagcaaaaagu

SEQ ID NO: 1213054 - RNA, 24 nt, Human
ugagggaagugagcaaaaaguuua

SEQ ID NO: 1213055 - RNA, 22 nt, Human
ugcauaaaugcagguauacaug

SEQ ID NO: 1213056 - RNA, 24 nt, Human
ugccucagccucccaaagugcugg

SEQ ID NO: 1213057 - RNA, 23 nt, Human
uggaaucucacuauguugccagg

SEQ ID NO: 1213058 - RNA, 24 nt, Human
uggccuccagugauccuucugccu

SEQ ID NO: 1213059 - RNA, 24 nt, Human
ugggacuacacgcaugcaucacca

SEQ ID NO: 1213060 - RNA, 18 nt, Human
ugggauuauagguguaag

SEQ ID NO: 1213061 - RNA, 19 nt, Human
ugggauuauagguguaagc

SEQ ID NO: 1213062 - RNA, 21 nt, Human
ugggauuauagguguaagcca

SEQ ID NO: 1213063 - RNA, 22 nt, Human
ugggauuauagguguaagccac

SEQ ID NO: 1213064 - RNA, 20 nt, Human
uggguaaaagguuauaaaag

SEQ ID NO: 1213065 - RNA, 24 nt, Human
ugguaaaaaacauucccaccuccc

SEQ ID NO: 1213066 - RNA, 19 nt, Human
ugguaaaauauaaaaaaug

SEQ ID NO: 1213067 - RNA, 20 nt, Human
uguaaguguguguauacaua

SEQ ID NO: 1213068 - RNA, 18 nt, Human
ugugcaugugucuucucc

SEQ ID NO: 1213069 - RNA, 19 nt, Human
uguguauacauaugugcau

SEQ ID NO: 1213070 - RNA, 21 nt, Human
uguguauacauaugugcaugu

SEQ ID NO: 1213071 - RNA, 19 nt, Human
uguguguauacauaugugc

SEQ ID NO: 1213072 - RNA, 24 nt, Human
uguguguauacauaugugcaugug

SEQ ID NO: 1213073 - RNA, 18 nt, Human
uuaaaaaaugaaugaugg

SEQ ID NO: 1213074 - RNA, 19 nt, Human
uuaauauucugaccaaaga

SEQ ID NO: 1213075 - RNA, 23 nt, Human
uuaauugcaaagugagaauuaac

SEQ ID NO: 1213076 - RNA, 20 nt, Human
uuagagcuuuaaagaauaac

SEQ ID NO: 1213077 - RNA, 20 nt, Human
uucagagggauugagggaag

SEQ ID NO: 1213078 - RNA, 20 nt, Human
uugaguauucacugacauuu

SEQ ID NO: 1213079 - RNA, 24 nt, Human
uugccaggcuggucucaaacuccu

SEQ ID NO: 1213080 - RNA, 20 nt, Human
uuguaaguguguguauacau

SEQ ID NO: 1213081 - RNA, 24 nt, Human
uuguagagauggaaucucacuaug

SEQ ID NO: 1213082 - RNA, 26 nt, Human
uuugacucccugggcccaagcuggga

SEQ ID NO: 1213083 - RNA, 24 nt, Human
uuuguagagauggaaucucacuau

SEQ ID NO: 1213084 - RNA, 19 nt, Human
uuuguuagguggauccaag

SEQ ID NO: 1213085 - RNA, 26 nt, Human
aaaaaaaaaaccaacaacaaaccaaa

SEQ ID NO: 1213086 - RNA, 22 nt, Human
aaaaaaaaaccaacaacaaacc

SEQ ID NO: 1213087 - RNA, 22 nt, Human
aaaaaaaccaacaacaaaccaa

SEQ ID NO: 1213088 - RNA, 22 nt, Human
aaaaaaagguuucucuucuccc

SEQ ID NO: 1213089 - RNA, 21 nt, Human
aaaacaaaacaaaaaaaccuu

SEQ ID NO: 1213090 - RNA, 24 nt, Human
aaaacuccgucucaaaacaaaaca

SEQ ID NO: 1213091 - RNA, 22 nt, Human
aaacagaucaacaguuagagac

SEQ ID NO: 1213092 - RNA, 24 nt, Human
aaaccaaaaaaaccgccccccaaa

SEQ ID NO: 1213093 - RNA, 21 nt, Human
aacaaaacaaaaaaaccuuaa

SEQ ID NO: 1213094 - RNA, 28 nt, Human
aacaacaaaccaaaaaaaccgcccccca

SEQ ID NO: 1213095 - RNA, 20 nt, Human
aacacagugagacccugucu

SEQ ID NO: 1213096 - RNA, 21 nt, Human
aacacagugagacccugucuc

SEQ ID NO: 1213097 - RNA, 20 nt, Human
aaccaaaaaaaccgcccccc

SEQ ID NO: 1213098 - RNA, 24 nt, Human
aaccaaaaaaaccgccccccaaaa

SEQ ID NO: 1213099 - RNA, 24 nt, Human
aaccaccucaaauaguuuuaugga

SEQ ID NO: 1213100 - RNA, 20 nt, Human
aacguagugaaacccugucu

SEQ ID NO: 1213101 - RNA, 21 nt, Human
aacguagugaaacccugucuc

SEQ ID NO: 1213102 - RNA, 20 nt, Human
aagagcgaaaacuccgucuc

SEQ ID NO: 1213103 - RNA, 19 nt, Human
aaguaccugggauuacagg

SEQ ID NO: 1213104 - RNA, 21 nt, Human
aaguauuaaggaaaaugaacc

SEQ ID NO: 1213105 - RNA, 24 nt, Human
aaucacuugaacccgggaggugga

SEQ ID NO: 1213106 - RNA, 24 nt, Human
aaucacuugagcccaggaguucaa

SEQ ID NO: 1213107 - RNA, 26 nt, Human
aaucacuugagcccaggaguucaaga

SEQ ID NO: 1213108 - RNA, 24 nt, Human
aaucuuuaucuuaagacuugagaa

SEQ ID NO: 1213109 - RNA, 21 nt, Human
acaggcacccaccaccacgcc

SEQ ID NO: 1213110 - RNA, 24 nt, Human
acccaggcuagaguacaauggcau

SEQ ID NO: 1213111 - RNA, 21 nt, Human
accuaggauaccuaauuauuc

SEQ ID NO: 1213112 - RNA, 24 nt, Human
accuuaaccaccucaaauaguuuu

SEQ ID NO: 1213113 - RNA, 23 nt, Human
acuaaaaguacaaaauuagccgg

SEQ ID NO: 1213114 - RNA, 18 nt, Human
acuggaauaaaagacaua

SEQ ID NO: 1213115 - RNA, 21 nt, Human
acuucuuuuuuuuuuuuuuuu

SEQ ID NO: 1213116 - RNA, 27 nt, Human
acuucuuuuuuuuuuuuuuuuuuuuuu

SEQ ID NO: 1213117 - RNA, 24 nt, Human
agaaucacuugagcccaggaguuc

SEQ ID NO: 1213118 - RNA, 24 nt, Human
agagauucuccugccucagccuuc

SEQ ID NO: 1213119 - RNA, 24 nt, Human
agcaaaacucuuucuucccgccaa

SEQ ID NO: 1213120 - RNA, 24 nt, Human
agcacuuugggaggcugagguggg

SEQ ID NO: 1213121 - RNA, 25 nt, Human
agcauugcacuccagccugggcaac

SEQ ID NO: 1213122 - RNA, 19 nt, Human
agcccaggaguucaagacc

SEQ ID NO: 1213123 - RNA, 22 nt, Human
agccggcguggugacgcaugcc

SEQ ID NO: 1213124 - RNA, 22 nt, Human
agccuggccaacguagugaaac

SEQ ID NO: 1213125 - RNA, 24 nt, Human
agccuggccaacguagugaaaccc

SEQ ID NO: 1213126 - RNA, 20 nt, Human
agcugggcaugguggugggc

SEQ ID NO: 1213127 - RNA, 23 nt, Human
aggaggcugaggcaggugaauca

SEQ ID NO: 1213128 - RNA, 18 nt, Human
aggaguucaagaccggcc

SEQ ID NO: 1213129 - RNA, 24 nt, Human
aggcagaagaaucgcuuaaacccg

SEQ ID NO: 1213130 - RNA, 18 nt, Human
aggcaggugaaucacuug

SEQ ID NO: 1213131 - RNA, 24 nt, Human
aggcaggugaaucacuugaacccg

SEQ ID NO: 1213132 - RNA, 24 nt, Human
aggcugaggcaggugaaucacuug

SEQ ID NO: 1213133 - RNA, 18 nt, Human
aggcugagguggguggau

SEQ ID NO: 1213134 - RNA, 19 nt, Human
aggguuuugccauguuggc

SEQ ID NO: 1213135 - RNA, 22 nt, Human
aggguuuugccauguuggccag

SEQ ID NO: 1213136 - RNA, 20 nt, Human
agguggagguugcagugagc

SEQ ID NO: 1213137 - RNA, 24 nt, Human
agguggagguugcagugagcggag

SEQ ID NO: 1213138 - RNA, 24 nt, Human
agguggagguugugguaagcugag

SEQ ID NO: 1213139 - RNA, 18 nt, Human
aggugggagaaucacuug

SEQ ID NO: 1213140 - RNA, 23 nt, Human
aggugggagaaucacuugagccc

SEQ ID NO: 1213141 - RNA, 22 nt, Human
agguggguggauugccugagau

SEQ ID NO: 1213142 - RNA, 24 nt, Human
aucacagcauugcacuccagccug

SEQ ID NO: 1213143 - RNA, 24 nt, Human
aucacgucauugcacuccagccug

SEQ ID NO: 1213144 - RNA, 21 nt, Human
augaacccaagaaccuuaacc

SEQ ID NO: 1213145 - RNA, 20 nt, Human
auuagcugggcauggugguc

SEQ ID NO: 1213146 - RNA, 24 nt, Human
auugcacuccagccugggcaacaa

SEQ ID NO: 1213147 - RNA, 24 nt, Human
auugcacuccagccugggcaacaa

SEQ ID NO: 1213148 - RNA, 18 nt, Human
auugccugagaucaggag

SEQ ID NO: 1213149 - RNA, 19 nt, Human
caaaaaaaccgccccccaa

SEQ ID NO: 1213150 - RNA, 20 nt, Human
caaaacaaaaaaaccuuaag

SEQ ID NO: 1213151 - RNA, 27 nt, Human
caaaacaaaaaaaccuuaagcugggug

SEQ ID NO: 1213152 - RNA, 20 nt, Human
caacaaaccaaaaaaaccgc

SEQ ID NO: 1213153 - RNA, 21 nt, Human
caacaaaccaaaaaaaccgcc

SEQ ID NO: 1213154 - RNA, 22 nt, Human
caacacagugagacccugucuc

SEQ ID NO: 1213155 - RNA, 24 nt, Human
caagaccagccuggccaacguagu

SEQ ID NO: 1213156 - RNA, 22 nt, Human
caagagauucuccugccucagc

SEQ ID NO: 1213157 - RNA, 21 nt, Human
caaggugggagaaucacuuga

SEQ ID NO: 1213158 - RNA, 21 nt, Human
caaucuacaauauucagcaaa

SEQ ID NO: 1213159 - RNA, 19 nt, Human
cacaccuguaaucccaaca

SEQ ID NO: 1213160 - RNA, 24 nt, Human
cacaccuguaaucccaacaauuua

SEQ ID NO: 1213161 - RNA, 18 nt, Human
cacccaccaccacgccug

SEQ ID NO: 1213162 - RNA, 23 nt, Human
caccuguaaucccagcuacuagg

SEQ ID NO: 1213163 - RNA, 24 nt, Human
caccuguaaucccagcuacuaggg

SEQ ID NO: 1213164 - RNA, 24 nt, Human
cacgccugucaucccagcacuuug

SEQ ID NO: 1213165 - RNA, 24 nt, Human
cacuccagccugggcaacaagagc

SEQ ID NO: 1213166 - RNA, 24 nt, Human
cacuccagccugggcaacaagagc

SEQ ID NO: 1213167 - RNA, 25 nt, Human
cacuccagccugggcaacaagagcg

SEQ ID NO: 1213168 - RNA, 23 nt, Human
cacugcaaccuucgccuucuggg

SEQ ID NO: 1213169 - RNA, 19 nt, Human
cagaagggaaaaaaacaga

SEQ ID NO: 1213170 - RNA, 24 nt, Human
cagcacuuugggaggcugaggugg

SEQ ID NO: 1213171 - RNA, 24 nt, Human
cagcauugcacuccagccugggca

SEQ ID NO: 1213172 - RNA, 24 nt, Human
cagcuacucaggaggcugaggcag

SEQ ID NO: 1213173 - RNA, 21 nt, Human
caggcacccaccaccacgccu

SEQ ID NO: 1213174 - RNA, 19 nt, Human
cauguuggccagacugacc

SEQ ID NO: 1213175 - RNA, 19 nt, Human
cauugcacuccagccuggg

SEQ ID NO: 1213176 - RNA, 19 nt, Human
cauugcacuccagccuggg

SEQ ID NO: 1213177 - RNA, 19 nt, Human
cauugcacuccagccuggg

SEQ ID NO: 1213178 - RNA, 20 nt, Human
cauugcacuccagccugggc

SEQ ID NO: 1213179 - RNA, 20 nt, Human
cauugcacuccagccugggc

SEQ ID NO: 1213180 - RNA, 21 nt, Human
cauugcacuccagccugggca

SEQ ID NO: 1213181 - RNA, 21 nt, Human
cauugcacuccagccugggca

SEQ ID NO: 1213182 - RNA, 22 nt, Human
cauugcacuccagccugggcaa

SEQ ID NO: 1213183 - RNA, 22 nt, Human
cauugcacuccagccugggcaa

SEQ ID NO: 1213184 - RNA, 23 nt, Human
cauugcacuccagccugggcaac

SEQ ID NO: 1213185 - RNA, 24 nt, Human
cauugcacuccagccugggcaaca

SEQ ID NO: 1213186 - RNA, 24 nt, Human
cauugcacuccagccugggcaaca

SEQ ID NO: 1213187 - RNA, 23 nt, Human
ccaaaaaaaaaaaaaaaaccaac

SEQ ID NO: 1213188 - RNA, 24 nt, Human
ccaaaaaaaccgccccccaaaaaa

SEQ ID NO: 1213189 - RNA, 25 nt, Human
ccaaaaaaaccgccccccaaaaaaa

SEQ ID NO: 1213190 - RNA, 18 nt, Human
ccaaguaccugggauuac

SEQ ID NO: 1213191 - RNA, 22 nt, Human
ccaaguaccugggauuacaggc

SEQ ID NO: 1213192 - RNA, 22 nt, Human
cccaaaaaaaagguuucucuuc

SEQ ID NO: 1213193 - RNA, 21 nt, Human
cccccaaaaaaaagguuucuc

SEQ ID NO: 1213194 - RNA, 22 nt, Human
cccgccaaaaaaaaaaaaaaaa

SEQ ID NO: 1213195 - RNA, 25 nt, Human
cccgccaaaaaaaaaaaaaaaacca

SEQ ID NO: 1213196 - RNA, 21 nt, Human
cccgcgagguggagguugcag

SEQ ID NO: 1213197 - RNA, 18 nt, Human
cccgggagguggagguug

SEQ ID NO: 1213198 - RNA, 25 nt, Human
ccgccaaaaaaaaaaaaaaaaccaa

SEQ ID NO: 1213199 - RNA, 21 nt, Human
ccgucucaaaacaaaacaaaa

SEQ ID NO: 1213200 - RNA, 22 nt, Human
ccuggccaacguagugaaaccc

SEQ ID NO: 1213201 - RNA, 24 nt, Human
ccuggccaacguagugaaacccug

SEQ ID NO: 1213202 - RNA, 22 nt, Human
ccuguaaucccagcuacuaggg

SEQ ID NO: 1213203 - RNA, 24 nt, Human
ccuucuggguucaagagauucucc

SEQ ID NO: 1213204 - RNA, 28 nt, Human
cgaaaacuccgucucaaaacaaaacaaa

SEQ ID NO: 1213205 - RNA, 19 nt, Human
cgagguggagguugcagug

SEQ ID NO: 1213206 - RNA, 24 nt, Human
cgccaaaaaaaaaaaaaaaaccaa

SEQ ID NO: 1213207 - RNA, 23 nt, Human
cgccugucaucccagcacuuugg

SEQ ID NO: 1213208 - RNA, 24 nt, Human
cgccugucaucccagcacuuuggg

SEQ ID NO: 1213209 - RNA, 24 nt, Human
cgcgagguggagguugcagugagc

SEQ ID NO: 1213210 - RNA, 23 nt, Human
cggcguggugacgcaugccugua

SEQ ID NO: 1213211 - RNA, 24 nt, Human
cgggagguggagguugugguaagc

SEQ ID NO: 1213212 - RNA, 24 nt, Human
cgucauugcacuccagccugggca

SEQ ID NO: 1213213 - RNA, 21 nt, Human
cucacaccuguaaucccaaca

SEQ ID NO: 1213214 - RNA, 21 nt, Human
cucacaccuguaaucccaaca

SEQ ID NO: 1213215 - RNA, 24 nt, Human
cucacgccugucaucccagcacuu

SEQ ID NO: 1213216 - RNA, 21 nt, Human
cucagaagggaaaaaaacaga

SEQ ID NO: 1213217 - RNA, 25 nt, Human
cucagaagggaaaaaaacagaucaa

SEQ ID NO: 1213218 - RNA, 23 nt, Human
cuccugccucagccuuccaagua

SEQ ID NO: 1213219 - RNA, 22 nt, Human
cucuaaccaaccuaacacucgc

SEQ ID NO: 1213220 - RNA, 21 nt, Human
cugaagcuuuaaauucuuuga

SEQ ID NO: 1213221 - RNA, 22 nt, Human
cugagaucaggaguucaagacc

SEQ ID NO: 1213222 - RNA, 22 nt, Human
cuuaaacccgcgagguggaggu

SEQ ID NO: 1213223 - RNA, 24 nt, Human
cuuccauaguugcaaagaacaaag

SEQ ID NO: 1213224 - RNA, 21 nt, Human
cuugaacccgggagguggagg

SEQ ID NO: 1213225 - RNA, 24 nt, Human
cuugcucuugucacccaggcuaga

SEQ ID NO: 1213226 - RNA, 19 nt, Human
gaaacccugucucaacuaa

SEQ ID NO: 1213227 - RNA, 19 nt, Human
gaacaaagaaaucaucuuc

SEQ ID NO: 1213228 - RNA, 18 nt, Human
gagguggguggauugccu

SEQ ID NO: 1213229 - RNA, 22 nt, Human
gauucuccugccucagccuucc

SEQ ID NO: 1213230 - RNA, 23 nt, Human
gauugccugagaucaggaguuca

SEQ ID NO: 1213231 - RNA, 25 nt, Human
gcaaaacucuuucuucccgccaaaa

SEQ ID NO: 1213232 - RNA, 21 nt, Human
gcauugcacuccagccugggc

SEQ ID NO: 1213233 - RNA, 24 nt, Human
gcauugcacuccagccugggcaac

SEQ ID NO: 1213234 - RNA, 24 nt, Human
gccaacguagugaaacccugucuc

SEQ ID NO: 1213235 - RNA, 22 nt, Human
gcccaggaguucaagaccggcc

SEQ ID NO: 1213236 - RNA, 21 nt, Human
gcucuugucacccaggcuaga

SEQ ID NO: 1213237 - RNA, 24 nt, Human
ggagaucacgucauugcacuccag

SEQ ID NO: 1213238 - RNA, 23 nt, Human
ggagguugcagugagcggagauc

SEQ ID NO: 1213239 - RNA, 24 nt, Human
ggagguugcagugagcggagauca

SEQ ID NO: 1213240 - RNA, 22 nt, Human
ggagguugugguaagcugagau

SEQ ID NO: 1213241 - RNA, 24 nt, Human
ggagguugugguaagcugagauca

SEQ ID NO: 1213242 - RNA, 20 nt, Human
ggagguugugguaagcuggc

SEQ ID NO: 1213243 - RNA, 19 nt, Human
ggcaccuguaaucccagcu

SEQ ID NO: 1213244 - RNA, 23 nt, Human
ggcaugguggugggcaccuguaa

SEQ ID NO: 1213245 - RNA, 23 nt, Human
ggcguggugacgcaugccuguaa

SEQ ID NO: 1213246 - RNA, 21 nt, Human
gggaaacaccaucucuacuaa

SEQ ID NO: 1213247 - RNA, 22 nt, Human
gggaggcugaggcagaagaauc

SEQ ID NO: 1213248 - RNA, 21 nt, Human
gggugcgguugcucacgccug

SEQ ID NO: 1213249 - RNA, 20 nt, Human
ggguucaagagauucuccug

SEQ ID NO: 1213250 - RNA, 21 nt, Human
ggguuuugccauguuggccag

SEQ ID NO: 1213251 - RNA, 24 nt, Human
gguggugggcaccuguaaucccag

SEQ ID NO: 1213252 - RNA, 19 nt, Human
gguucaagagauucuccug

SEQ ID NO: 1213253 - RNA, 24 nt, Human
guaggguuuugccauguuggccag

SEQ ID NO: 1213254 - RNA, 24 nt, Human
gucauugcacuccagccugggcaa

SEQ ID NO: 1213255 - RNA, 19 nt, Human
uaaaaauacaaauuagcug

SEQ ID NO: 1213256 - RNA, 24 nt, Human
uaaaauaguacuuuuacaaaauca

SEQ ID NO: 1213257 - RNA, 22 nt, Human
uaaccaccucaaauaguuuuau

SEQ ID NO: 1213258 - RNA, 19 nt, Human
uaagacuugagaacuggaa

SEQ ID NO: 1213259 - RNA, 26 nt, Human
uacaaauuagcugggcaugguggugg

SEQ ID NO: 1213260 - RNA, 23 nt, Human
uacuacauuuauuaaaauuccua

SEQ ID NO: 1213261 - RNA, 18 nt, Human
uacuagggaggcugaggc

SEQ ID NO: 1213262 - RNA, 19 nt, Human
uacuagggaggcugaggca

SEQ ID NO: 1213263 - RNA, 22 nt, Human
uagaguacaauggcaugaucuc

SEQ ID NO: 1213264 - RNA, 24 nt, Human
uagaguacaauggcaugaucucgg

SEQ ID NO: 1213265 - RNA, 19 nt, Human
uagcauuuuaaauguaaaa

SEQ ID NO: 1213266 - RNA, 23 nt, Human
uaggguuuugccauguuggccag

SEQ ID NO: 1213267 - RNA, 20 nt, Human
uaguaggguuuugccauguu

SEQ ID NO: 1213268 - RNA, 21 nt, Human
ucaaaacaaaacaaaaaaacc

SEQ ID NO: 1213269 - RNA, 20 nt, Human
ucacagcauugcacuccagc

SEQ ID NO: 1213270 - RNA, 22 nt, Human
ucacgccugucaucccagcacu

SEQ ID NO: 1213271 - RNA, 23 nt, Human
ucacgucauugcacuccagccug

SEQ ID NO: 1213272 - RNA, 18 nt, Human
ucacugcaaccuucgccu

SEQ ID NO: 1213273 - RNA, 24 nt, Human
ucacugcaaccuucgccuucuggg

SEQ ID NO: 1213274 - RNA, 24 nt, Human
ucacuugaacccgggagguggagg

SEQ ID NO: 1213275 - RNA, 23 nt, Human
ucacuugagcccaggaguucaag

SEQ ID NO: 1213276 - RNA, 24 nt, Human
ucagaagggaaaaaaacagaucaa

SEQ ID NO: 1213277 - RNA, 24 nt, Human
ucagcucuuaacugccagcucaca

SEQ ID NO: 1213278 - RNA, 18 nt, Human
ucauugcacuccagccug

SEQ ID NO: 1213279 - RNA, 21 nt, Human
ucauugcacuccagccugggc

SEQ ID NO: 1213280 - RNA, 24 nt, Human
ucauugcacuccagccugggcaac

SEQ ID NO: 1213281 - RNA, 24 nt, Human
uccaaguaccugggauuacaggca

SEQ ID NO: 1213282 - RNA, 24 nt, Human
uccauaguugcaaagaaccggggc

SEQ ID NO: 1213283 - RNA, 23 nt, Human
ucccgccaaaaaaaaaaaaaaaa

SEQ ID NO: 1213284 - RNA, 23 nt, Human
ucccgccaaaaaaaaaaaaaaaa

SEQ ID NO: 1213285 - RNA, 25 nt, Human
ucccgccaaaaaaaaaaaaaaaacc

SEQ ID NO: 1213286 - RNA, 23 nt, Human
ucggccaggugcacugucucaca

SEQ ID NO: 1213287 - RNA, 21 nt, Human
ucuacaauauucagcaaagua

SEQ ID NO: 1213288 - RNA, 20 nt, Human
ucucuacuaaaaguacaaaa

SEQ ID NO: 1213289 - RNA, 26 nt, Human
ucuucccgccaaaaaaaaaaaaaaaa

SEQ ID NO: 1213290 - RNA, 20 nt, Human
ucuugcucuugucacccagg

SEQ ID NO: 1213291 - RNA, 25 nt, Human
ucuugcucuugucacccaggcuaga

SEQ ID NO: 1213292 - RNA, 21 nt, Human
ucuuuaguaggguuuugccau

SEQ ID NO: 1213293 - RNA, 23 nt, Human
ucuuugagccauucagcucuuaa

SEQ ID NO: 1213294 - RNA, 18 nt, Human
ugaagcuuuaaauucuuu

SEQ ID NO: 1213295 - RNA, 18 nt, Human
ugaccaacguggggaaac

SEQ ID NO: 1213296 - RNA, 19 nt, Human
ugagaucacagcauugcac

SEQ ID NO: 1213297 - RNA, 24 nt, Human
ugagaucacagcauugcacuccag

SEQ ID NO: 1213298 - RNA, 21 nt, Human
ugagcccaggaguucaagacc

SEQ ID NO: 1213299 - RNA, 23 nt, Human
ugagcccaggaguucaagaccgg

SEQ ID NO: 1213300 - RNA, 24 nt, Human
ugaggcagaagaaucgcuuaaacc

SEQ ID NO: 1213301 - RNA, 21 nt, Human
ugaggcaggugaaucacuuga

SEQ ID NO: 1213302 - RNA, 24 nt, Human
ugaggcaggugaaucacuugaacc

SEQ ID NO: 1213303 - RNA, 25 nt, Human
ugaggcaggugaaucacuugaaccc

SEQ ID NO: 1213304 - RNA, 18 nt, Human
ugagguggguggauugcc

SEQ ID NO: 1213305 - RNA, 24 nt, Human
ugagguggguggauugccugagau

SEQ ID NO: 1213306 - RNA, 26 nt, Human
ugagguggguggauugccugagauca

SEQ ID NO: 1213307 - RNA, 19 nt, Human
ugcacuccagccugggcaa

SEQ ID NO: 1213308 - RNA, 19 nt, Human
ugcacuccagccugggcaa

SEQ ID NO: 1213309 - RNA, 22 nt, Human
ugcacuccagccugggcaacaa

SEQ ID NO: 1213310 - RNA, 22 nt, Human
ugcacuccagccugggcaacaa

SEQ ID NO: 1213311 - RNA, 24 nt, Human
ugcacugucucacaccuguaaucc

SEQ ID NO: 1213312 - RNA, 18 nt, Human
ugccauguuggccagacu

SEQ ID NO: 1213313 - RNA, 24 nt, Human
ugccucagccuuccaaguaccugg

SEQ ID NO: 1213314 - RNA, 24 nt, Human
ugccuguaauaccagcuacucagg

SEQ ID NO: 1213315 - RNA, 26 nt, Human
uggaauaaaagacauaaagcugggca

SEQ ID NO: 1213316 - RNA, 22 nt, Human
uggaauuagauaagaauaaucc

SEQ ID NO: 1213317 - RNA, 24 nt, Human
uggauugccugagaucaggaguuc

SEQ ID NO: 1213318 - RNA, 24 nt, Human
uggccaacguagugaaacccuguc

SEQ ID NO: 1213319 - RNA, 22 nt, Human
uggcuaauuuuuuuuuuuuuuu

SEQ ID NO: 1213320 - RNA, 20 nt, Human
ugggaggcugaggugggugg

SEQ ID NO: 1213321 - RNA, 22 nt, Human
ugggaggcugagguggguggau

SEQ ID NO: 1213322 - RNA, 24 nt, Human
ugggaggcugagguggguggauug

SEQ ID NO: 1213323 - RNA, 19 nt, Human
ugggauuacaggcacccac

SEQ ID NO: 1213324 - RNA, 21 nt, Human
ugggauuacaggcacccacca

SEQ ID NO: 1213325 - RNA, 24 nt, Human
ugggauuacaggcacccaccacca

SEQ ID NO: 1213326 - RNA, 24 nt, Human
uggguggauugccugagaucagga

SEQ ID NO: 1213327 - RNA, 22 nt, Human
uggugggcaccuguaaucccag

SEQ ID NO: 1213328 - RNA, 24 nt, Human
ugguggugggcaccuguaauccca

SEQ ID NO: 1213329 - RNA, 22 nt, Human
ugucacccaggcuagaguacaa

SEQ ID NO: 1213330 - RNA, 22 nt, Human
ugucucacaccuguaaucccaa

SEQ ID NO: 1213331 - RNA, 24 nt, Human
uuaaacccgcgagguggagguugc

SEQ ID NO: 1213332 - RNA, 18 nt, Human
uuagcugggcaugguggu

SEQ ID NO: 1213333 - RNA, 24 nt, Human
uuagcugggcaugguggugggcac

SEQ ID NO: 1213334 - RNA, 18 nt, Human
uucaagagauucuccugc

SEQ ID NO: 1213335 - RNA, 23 nt, Human
uucaagagauucuccugccucag

SEQ ID NO: 1213336 - RNA, 19 nt, Human
uucaagguuuuccuaauuu

SEQ ID NO: 1213337 - RNA, 20 nt, Human
uucacagcuuccauaguugc

SEQ ID NO: 1213338 - RNA, 24 nt, Human
uucccgccaaaaaaaaaaaaaaaa

SEQ ID NO: 1213339 - RNA, 24 nt, Human
uugaacccgggagguggagguugu

SEQ ID NO: 1213340 - RNA, 20 nt, Human
uugcagugagcggagaucac

SEQ ID NO: 1213341 - RNA, 21 nt, Human
uugcagugagcggagaucacg

SEQ ID NO: 1213342 - RNA, 23 nt, Human
uugccugagaucaggaguucaag

SEQ ID NO: 1213343 - RNA, 24 nt, Human
uugcucacgccugucaucccagca

SEQ ID NO: 1213344 - RNA, 22 nt, Human
uugugguaagcugagaucacag

SEQ ID NO: 1213345 - RNA, 24 nt, Human
uuuuuuuuuuuugagacggagucu

SEQ ID NO: 1213346 - RNA, 22 nt, Human
uuuuuuuuuuuuuugagacgga

SEQ ID NO: 1213347 - RNA, 18 nt, Human
uuuuuuuuuuuuuuuuug

SEQ ID NO: 1213348 - RNA, 19 nt, Human
aaagugcuaggauuacagg

SEQ ID NO: 1213349 - RNA, 24 nt, Human
aaagugcuaggauuacaggcguga

SEQ ID NO: 1213350 - RNA, 18 nt, Human
aagauauuuagcccgaag

SEQ ID NO: 1213351 - RNA, 21 nt, Human
aaggagcccaaucuaaagggc

SEQ ID NO: 1213352 - RNA, 22 nt, Human
aaggaguacauggaugcagaaa

SEQ ID NO: 1213353 - RNA, 19 nt, Human
aagggguuucaccauguug

SEQ ID NO: 1213354 - RNA, 24 nt, Human
aagggguuucaccauguuguccag

SEQ ID NO: 1213355 - RNA, 26 nt, Human
aagugcuaggauuacaggcgugagcc

SEQ ID NO: 1213356 - RNA, 22 nt, Human
aauugacagagaaaggaaaaga

SEQ ID NO: 1213357 - RNA, 23 nt, Human
acacacacuucuaaagcccacca

SEQ ID NO: 1213358 - RNA, 20 nt, Human
acacacuucuaaagcccacc

SEQ ID NO: 1213359 - RNA, 21 nt, Human
acacacuucuaaagcccacca

SEQ ID NO: 1213360 - RNA, 21 nt, Human
acaggcaucugccaccacgcc

SEQ ID NO: 1213361 - RNA, 18 nt, Human
accaagaggcugguuucc

SEQ ID NO: 1213362 - RNA, 23 nt, Human
acucgcuccagccaccugggcag

SEQ ID NO: 1213363 - RNA, 18 nt, Human
acucugucacccaggcug

SEQ ID NO: 1213364 - RNA, 25 nt, Human
acucugucacccaggcuggagcgca

SEQ ID NO: 1213365 - RNA, 20 nt, Human
agagaagggguuucaccaug

SEQ ID NO: 1213366 - RNA, 24 nt, Human
agcgcaguggcacgaucucggcuc

SEQ ID NO: 1213367 - RNA, 19 nt, Human
aggaaagcuggaagggaaa

SEQ ID NO: 1213368 - RNA, 19 nt, Human
aggcugaaagugguccagg

SEQ ID NO: 1213369 - RNA, 24 nt, Human
agggguuucaccauguuguccagg

SEQ ID NO: 1213370 - RNA, 24 nt, Human
aggugauccaccugccucggccuc

SEQ ID NO: 1213371 - RNA, 22 nt, Human
agucagccaggacgcccaaagc

SEQ ID NO: 1213372 - RNA, 24 nt, Human
agugauucuccugccucagccucc

SEQ ID NO: 1213373 - RNA, 19 nt, Human
aguugcugggacuacaggc

SEQ ID NO: 1213374 - RNA, 21 nt, Human
aucaucuugggcggcucugcu

SEQ ID NO: 1213375 - RNA, 18 nt, Human
auucuccugccucagccu

SEQ ID NO: 1213376 - RNA, 23 nt, Human
caaaccccuaagauauuuagccc

SEQ ID NO: 1213377 - RNA, 24 nt, Human
caaagugcuaggauuacaggcgug

SEQ ID NO: 1213378 - RNA, 20 nt, Human
caagcagaugacugacaaag

SEQ ID NO: 1213379 - RNA, 22 nt, Human
caagugauucuccugccucagc

SEQ ID NO: 1213380 - RNA, 19 nt, Human
cacagcaaccucagccccc

SEQ ID NO: 1213381 - RNA, 22 nt, Human
caccaccuccaaccaccauucc

SEQ ID NO: 1213382 - RNA, 24 nt, Human
caccacgcccagcuaauuuuugua

SEQ ID NO: 1213383 - RNA, 24 nt, Human
caccauguuguccaggcuggucuc

SEQ ID NO: 1213384 - RNA, 27 nt, Human
caccauguuguccaggcuggucucaaa

SEQ ID NO: 1213385 - RNA, 23 nt, Human
caccugccucggccucccaaagu

SEQ ID NO: 1213386 - RNA, 18 nt, Human
caccugggcagugcuggg

SEQ ID NO: 1213387 - RNA, 24 nt, Human
cacucugucacccaggcuggagcg

SEQ ID NO: 1213388 - RNA, 20 nt, Human
cagccaggacgcccaaagcu

SEQ ID NO: 1213389 - RNA, 20 nt, Human
cagccuccugaguugcuggg

SEQ ID NO: 1213390 - RNA, 24 nt, Human
cagcuccugucuaucaucuugggc

SEQ ID NO: 1213391 - RNA, 21 nt, Human
caggcaucugccaccacgccc

SEQ ID NO: 1213392 - RNA, 24 nt, Human
caggcgugagccaccgugccuggc

SEQ ID NO: 1213393 - RNA, 22 nt, Human
caggugauccaccugccucggc

SEQ ID NO: 1213394 - RNA, 21 nt, Human
caugagcgugcugcaccuccc

SEQ ID NO: 1213395 - RNA, 23 nt, Human
cauguuguccaggcuggucucaa

SEQ ID NO: 1213396 - RNA, 24 nt, Human
cauguuguccaggcuggucucaaa

SEQ ID NO: 1213397 - RNA, 20 nt, Human
ccaaaggcacacaucuuacu

SEQ ID NO: 1213398 - RNA, 22 nt, Human
ccaaagugcuaggauuacaggc

SEQ ID NO: 1213399 - RNA, 24 nt, Human
ccaaagugcuaggauuacaggcgu

SEQ ID NO: 1213400 - RNA, 23 nt, Human
ccaccaccuccaaccaccauucc

SEQ ID NO: 1213401 - RNA, 24 nt, Human
ccaccaccuccaaccaccauuccc

SEQ ID NO: 1213402 - RNA, 20 nt, Human
ccaccacgcccagcuaauuu

SEQ ID NO: 1213403 - RNA, 20 nt, Human
ccagucagccaggacgccca

SEQ ID NO: 1213404 - RNA, 19 nt, Human
ccaugcuccucccgccaag

SEQ ID NO: 1213405 - RNA, 25 nt, Human
ccccaugagcgugcugcaccucccc

SEQ ID NO: 1213406 - RNA, 21 nt, Human
cccccggggcucaagugauuc

SEQ ID NO: 1213407 - RNA, 23 nt, Human
cccccggggcucaagugauucuc

SEQ ID NO: 1213408 - RNA, 24 nt, Human
cccccggggcucaagugauucucc

SEQ ID NO: 1213409 - RNA, 21 nt, Human
cccggggcucaagugauucuc

SEQ ID NO: 1213410 - RNA, 24 nt, Human
cccggggcucaagugauucuccug

SEQ ID NO: 1213411 - RNA, 21 nt, Human
cccucuggaggguggagagca

SEQ ID NO: 1213412 - RNA, 19 nt, Human
cccucuggccuucagcucc

SEQ ID NO: 1213413 - RNA, 21 nt, Human
ccgccaagacuccaggcgugg

SEQ ID NO: 1213414 - RNA, 20 nt, Human
ccggggcucaagugauucuc

SEQ ID NO: 1213415 - RNA, 22 nt, Human
ccuaagauauuuagcccgaagc

SEQ ID NO: 1213416 - RNA, 22 nt, Human
ccucagagauacauuuaucucu

SEQ ID NO: 1213417 - RNA, 24 nt, Human
ccuccaaccaccauucccuauguc

SEQ ID NO: 1213418 - RNA, 19 nt, Human
ccucuggaggguggagagc

SEQ ID NO: 1213419 - RNA, 18 nt, Human
ccucuggaguccucugcu

SEQ ID NO: 1213420 - RNA, 21 nt, Human
ccugaccucaggugauccacc

SEQ ID NO: 1213421 - RNA, 23 nt, Human
ccugaccucaggugauccaccug

SEQ ID NO: 1213422 - RNA, 23 nt, Human
ccugaccucaggugauccaccug

SEQ ID NO: 1213423 - RNA, 23 nt, Human
ccugaguugcugggacuacaggc

SEQ ID NO: 1213424 - RNA, 24 nt, Human
ccugaguugcugggacuacaggca

SEQ ID NO: 1213425 - RNA, 19 nt, Human
ccuguguccaugcuccucc

SEQ ID NO: 1213426 - RNA, 19 nt, Human
cgccaagacuccaggcgug

SEQ ID NO: 1213427 - RNA, 20 nt, Human
cucaagugauucuccugccu

SEQ ID NO: 1213428 - RNA, 23 nt, Human
cucaagugauucuccugccucag

SEQ ID NO: 1213429 - RNA, 24 nt, Human
cucaagugauucuccugccucagc

SEQ ID NO: 1213430 - RNA, 23 nt, Human
cucacagcaaccucagcccccgg

SEQ ID NO: 1213431 - RNA, 24 nt, Human
cucacucugucacccaggcuggag

SEQ ID NO: 1213432 - RNA, 18 nt, Human
cucacuuucccgccuccc

SEQ ID NO: 1213433 - RNA, 21 nt, Human
cuccacuguccccaggcucac

SEQ ID NO: 1213434 - RNA, 18 nt, Human
cuccugaguugcugggac

SEQ ID NO: 1213435 - RNA, 23 nt, Human
cuccugccucagccuccugaguu

SEQ ID NO: 1213436 - RNA, 22 nt, Human
cucggcucacagcaaccucagc

SEQ ID NO: 1213437 - RNA, 23 nt, Human
cucuggggcucccucccuggucc

SEQ ID NO: 1213438 - RNA, 24 nt, Human
cugaguugcugggacuacaggcau

SEQ ID NO: 1213439 - RNA, 18 nt, Human
cugccacacguguuaguc

SEQ ID NO: 1213440 - RNA, 19 nt, Human
cugccucagccuccugagu

SEQ ID NO: 1213441 - RNA, 23 nt, Human
cugccucggccucccaaagugcu

SEQ ID NO: 1213442 - RNA, 29 nt, Human
cugcugcucccugagccucuggugaccac

SEQ ID NO: 1213443 - RNA, 22 nt, Human
cuguguccaugcuccucccgcc

SEQ ID NO: 1213444 - RNA, 20 nt, Human
cuucuaaagcccaccaaacc

SEQ ID NO: 1213445 - RNA, 21 nt, Human
cuuuccgcaguccccucugga

SEQ ID NO: 1213446 - RNA, 22 nt, Human
cuuuccgcaguccccucuggag

SEQ ID NO: 1213447 - RNA, 19 nt, Human
gaagggguuucaccauguu

SEQ ID NO: 1213448 - RNA, 22 nt, Human
gaagggguuucaccauguuguc

SEQ ID NO: 1213449 - RNA, 18 nt, Human
gacagagaaaggaaaaga

SEQ ID NO: 1213450 - RNA, 24 nt, Human
gaccucaggugauccaccugccuc

SEQ ID NO: 1213451 - RNA, 23 nt, Human
gacugacaaaggagcccaaucua

SEQ ID NO: 1213452 - RNA, 22 nt, Human
gagggagccaccuugcccuucc

SEQ ID NO: 1213453 - RNA, 21 nt, Human
gaucucggcucacagcaaccu

SEQ ID NO: 1213454 - RNA, 18 nt, Human
gauuacaggcgugagcca

SEQ ID NO: 1213455 - RNA, 21 nt, Human
gauuacaggcgugagccaccg

SEQ ID NO: 1213456 - RNA, 24 nt, Human
gauuacaggcgugagccaccgugc

SEQ ID NO: 1213457 - RNA, 19 nt, Human
gcagugaugaugagucucc

SEQ ID NO: 1213458 - RNA, 21 nt, Human
gccacacguguuagucaaagu

SEQ ID NO: 1213459 - RNA, 21 nt, Human
gccaccaccuccaaccaccau

SEQ ID NO: 1213460 - RNA, 22 nt, Human
gcccagcuaauuuuuguauuuu

SEQ ID NO: 1213461 - RNA, 23 nt, Human
gcgcaguggcacgaucucggcuc

SEQ ID NO: 1213462 - RNA, 19 nt, Human
gcuccagccaccugggcag

SEQ ID NO: 1213463 - RNA, 20 nt, Human
gcuccugucuaucaucuugg

SEQ ID NO: 1213464 - RNA, 21 nt, Human
gcugcaccuccccugggccug

SEQ ID NO: 1213465 - RNA, 19 nt, Human
gcuggagcgcaguggcacg

SEQ ID NO: 1213466 - RNA, 23 nt, Human
gcuggucucaaacuccugaccuc

SEQ ID NO: 1213467 - RNA, 22 nt, Human
ggaaagaauggggaggccguuc

SEQ ID NO: 1213468 - RNA, 19 nt, Human
ggagagcagugaugaugag

SEQ ID NO: 1213469 - RNA, 22 nt, Human
ggauuacaggcgugagccaccg

SEQ ID NO: 1213470 - RNA, 24 nt, Human
ggcuggucucaaacuccugaccuc

SEQ ID NO: 1213471 - RNA, 23 nt, Human
gggcucaagugauucuccugccu

SEQ ID NO: 1213472 - RNA, 23 nt, Human
ggggcucaagugauucuccugcc

SEQ ID NO: 1213473 - RNA, 22 nt, Human
gggguuucaccauguuguccag

SEQ ID NO: 1213474 - RNA, 23 nt, Human
gggguuucaccauguuguccagg

SEQ ID NO: 1213475 - RNA, 22 nt, Human
ggguuucaccauguuguccagg

SEQ ID NO: 1213476 - RNA, 24 nt, Human
gugauccaccugccucggccuccc

SEQ ID NO: 1213477 - RNA, 24 nt, Human
gugauucuccugccucagccuccu

SEQ ID NO: 1213478 - RNA, 19 nt, Human
gugcugccaggagcuguuc

SEQ ID NO: 1213479 - RNA, 23 nt, Human
guuucaccauguuguccaggcug

SEQ ID NO: 1213480 - RNA, 24 nt, Human
guuucaccauguuguccaggcugg

SEQ ID NO: 1213481 - RNA, 18 nt, Human
uaaagcccaccaaacccc

SEQ ID NO: 1213482 - RNA, 21 nt, Human
uaaagcccaccaaaccccuaa

SEQ ID NO: 1213483 - RNA, 22 nt, Human
uaaagcccaccaaaccccuaag

SEQ ID NO: 1213484 - RNA, 24 nt, Human
uaauuuuuguauuuuuaguagaga

SEQ ID NO: 1213485 - RNA, 24 nt, Human
uacaggcaucugccaccacgccca

SEQ ID NO: 1213486 - RNA, 22 nt, Human
uacaggcgugagccaccgugcc

SEQ ID NO: 1213487 - RNA, 22 nt, Human
uacaggcgugagccaccgugcc

SEQ ID NO: 1213488 - RNA, 23 nt, Human
uacaggcgugagccaccgugccu

SEQ ID NO: 1213489 - RNA, 18 nt, Human
uagaagaccaucauuugc

SEQ ID NO: 1213490 - RNA, 22 nt, Human
uagagaagggguuucaccaugu

SEQ ID NO: 1213491 - RNA, 18 nt, Human
uaggauuacaggcgugag

SEQ ID NO: 1213492 - RNA, 21 nt, Human
uaggauuacaggcgugagcca

SEQ ID NO: 1213493 - RNA, 22 nt, Human
uaggauuacaggcgugagccac

SEQ ID NO: 1213494 - RNA, 23 nt, Human
uaggauuacaggcgugagccacc

SEQ ID NO: 1213495 - RNA, 23 nt, Human
uaggauuacaggcgugagccacc

SEQ ID NO: 1213496 - RNA, 24 nt, Human
uaggauuacaggcgugagccaccg

SEQ ID NO: 1213497 - RNA, 24 nt, Human
uaguagagaagggguuucaccaug

SEQ ID NO: 1213498 - RNA, 25 nt, Human
ucaacaggccgauggcuggcugcgc

SEQ ID NO: 1213499 - RNA, 23 nt, Human
ucacagcaaccucagcccccggg

SEQ ID NO: 1213500 - RNA, 21 nt, Human
ucaccauguuguccaggcugg

SEQ ID NO: 1213501 - RNA, 21 nt, Human
ucaccccaucuccauacccgg

SEQ ID NO: 1213502 - RNA, 22 nt, Human
ucagaggcuccacuguccccag

SEQ ID NO: 1213503 - RNA, 21 nt, Human
ucaggugauccaccugccucg

SEQ ID NO: 1213504 - RNA, 19 nt, Human
ucagugacugccagugccu

SEQ ID NO: 1213505 - RNA, 19 nt, Human
uccauacccggagggagcc

SEQ ID NO: 1213506 - RNA, 22 nt, Human
uccaucuuccucuuucuccuuu

SEQ ID NO: 1213507 - RNA, 24 nt, Human
ucccaaagugcuaggauuacaggc

SEQ ID NO: 1213508 - RNA, 21 nt, Human
uccucugcucagaggcuccac

SEQ ID NO: 1213509 - RNA, 24 nt, Human
uccugaguugcugggacuacaggc

SEQ ID NO: 1213510 - RNA, 21 nt, Human
ucgcuccagccaccugggcag

SEQ ID NO: 1213511 - RNA, 18 nt, Human
ucggccucccaaagugcu

SEQ ID NO: 1213512 - RNA, 20 nt, Human
ucuaaagcccaccaaacccc

SEQ ID NO: 1213513 - RNA, 18 nt, Human
ucuaaagggcugcugaag

SEQ ID NO: 1213514 - RNA, 21 nt, Human
ucuaucaucuugggcggcucu

SEQ ID NO: 1213515 - RNA, 23 nt, Human
ucucacucugucacccaggcugg

SEQ ID NO: 1213516 - RNA, 24 nt, Human
ucucacucugucacccaggcugga

SEQ ID NO: 1213517 - RNA, 26 nt, Human
ucucacucugucacccaggcuggagc

SEQ ID NO: 1213518 - RNA, 27 nt, Human
ucucacucugucacccaggcuggagcg

SEQ ID NO: 1213519 - RNA, 24 nt, Human
ucuccugccucagccuccugaguu

SEQ ID NO: 1213520 - RNA, 18 nt, Human
ucucuggcugccaccacc

SEQ ID NO: 1213521 - RNA, 19 nt, Human
ucucuggcugccaccaccu

SEQ ID NO: 1213522 - RNA, 24 nt, Human
ucucuggcugccaccaccuccaac

SEQ ID NO: 1213523 - RNA, 19 nt, Human
ucuggcugccaccaccucc

SEQ ID NO: 1213524 - RNA, 18 nt, Human
ucugucacccaggcugga

SEQ ID NO: 1213525 - RNA, 24 nt, Human
ucugucacccaggcuggagcgcag

SEQ ID NO: 1213526 - RNA, 24 nt, Human
ucuuccucuuucuccuuuauuccu

SEQ ID NO: 1213527 - RNA, 18 nt, Human
ugaaacagagucucacuc

SEQ ID NO: 1213528 - RNA, 22 nt, Human
ugaaacagagucucacucuguc

SEQ ID NO: 1213529 - RNA, 24 nt, Human
ugaccucaggugauccaccugccu

SEQ ID NO: 1213530 - RNA, 21 nt, Human
ugacucgcuccagccaccugg

SEQ ID NO: 1213531 - RNA, 18 nt, Human
ugagccucuggaguccuc

SEQ ID NO: 1213532 - RNA, 26 nt, Human
ugaguugcugggacuacaggcaucug

SEQ ID NO: 1213533 - RNA, 18 nt, Human
ugcagaaaagugaggccu

SEQ ID NO: 1213534 - RNA, 21 nt, Human
ugccagugccuugucaacagg

SEQ ID NO: 1213535 - RNA, 23 nt, Human
ugccucagagauacauuuaucuc

SEQ ID NO: 1213536 - RNA, 24 nt, Human
ugccucagccuccugaguugcugg

SEQ ID NO: 1213537 - RNA, 21 nt, Human
ugccucggccucccaaagugc

SEQ ID NO: 1213538 - RNA, 22 nt, Human
ugccucggccucccaaagugcu

SEQ ID NO: 1213539 - RNA, 24 nt, Human
ugccucggccucccaaagugcuag

SEQ ID NO: 1213540 - RNA, 24 nt, Human
ugcuaggauuacaggcgugagcca

SEQ ID NO: 1213541 - RNA, 18 nt, Human
ugcugggacuacaggcau

SEQ ID NO: 1213542 - RNA, 24 nt, Human
uggagcgcaguggcacgaucucgg

SEQ ID NO: 1213543 - RNA, 26 nt, Human
uggaggguggagagcagugacaacgg

SEQ ID NO: 1213544 - RNA, 18 nt, Human
ugggacuacaggcaucug

SEQ ID NO: 1213545 - RNA, 19 nt, Human
ugggacuacaggcaucugc

SEQ ID NO: 1213546 - RNA, 21 nt, Human
ugggacuacaggcaucugcca

SEQ ID NO: 1213547 - RNA, 24 nt, Human
ugggacuacaggcaucugccacca

SEQ ID NO: 1213548 - RNA, 18 nt, Human
uggggaggccguuccgug

SEQ ID NO: 1213549 - RNA, 21 nt, Human
uggggcucccucccugguccu

SEQ ID NO: 1213550 - RNA, 24 nt, Human
uguccaggcuggucucaaacuccu

SEQ ID NO: 1213551 - RNA, 19 nt, Human
ugucuuuuccuucagcaua

SEQ ID NO: 1213552 - RNA, 21 nt, Human
uguucuguauucucacuaaga

SEQ ID NO: 1213553 - RNA, 18 nt, Human
uuaguagagaagggguuu

SEQ ID NO: 1213554 - RNA, 22 nt, Human
uuaguagagaagggguuucacc

SEQ ID NO: 1213555 - RNA, 24 nt, Human
uuaguagagaagggguuucaccau

SEQ ID NO: 1213556 - RNA, 18 nt, Human
uugcaggcugugguggug

SEQ ID NO: 1213557 - RNA, 24 nt, Human
uuucaccauguuguccaggcuggu

SEQ ID NO: 1213558 - RNA, 24 nt, Human
uuuuuaguagagaagggguuucac

SEQ ID NO: 1213559 - RNA, 20 nt, Human
uuuuuguauuuuuaguagag

SEQ ID NO: 1213560 - RNA, 19 nt, Human
aagaggccaggacaccggc

SEQ ID NO: 1213561 - RNA, 27 nt, Human
aaguuuguuuucgucccuuuuuuuuuu

SEQ ID NO: 1213562 - RNA, 19 nt, Human
accagcgcgggcuucuugg

SEQ ID NO: 1213563 - RNA, 20 nt, Human
accguagcccacgggcacca

SEQ ID NO: 1213564 - RNA, 23 nt, Human
aggaagaggccaggacaccggcg

SEQ ID NO: 1213565 - RNA, 20 nt, Human
cacacaggccuccagguggg

SEQ ID NO: 1213566 - RNA, 20 nt, Human
cacaggccuccaggugggcc

SEQ ID NO: 1213567 - RNA, 19 nt, Human
cacucugcauacacucuuc

SEQ ID NO: 1213568 - RNA, 23 nt, Human
cagccgcuccucauugguaaugc

SEQ ID NO: 1213569 - RNA, 20 nt, Human
cagcgcgggcuucuuggccu

SEQ ID NO: 1213570 - RNA, 21 nt, Human
caggccuccaggugggccgug

SEQ ID NO: 1213571 - RNA, 26 nt, Human
ccagcgcgggcuucuuggccuucuuc

SEQ ID NO: 1213572 - RNA, 20 nt, Human
cccacagcaucgccccggcg

SEQ ID NO: 1213573 - RNA, 22 nt, Human
cccacagcaucgccccggcgcc

SEQ ID NO: 1213574 - RNA, 19 nt, Human
cccacgggcaccagcuugg

SEQ ID NO: 1213575 - RNA, 19 nt, Human
ccccaccuuguccuccacc

SEQ ID NO: 1213576 - RNA, 23 nt, Human
ccccccgcaccagcccguccggc

SEQ ID NO: 1213577 - RNA, 23 nt, Human
ccggcgccgccgccguaguugcc

SEQ ID NO: 1213578 - RNA, 21 nt, Human
ccuccagcaagucugucccca

SEQ ID NO: 1213579 - RNA, 27 nt, Human
ccuggaaauauggauggucucuucuuc

SEQ ID NO: 1213580 - RNA, 18 nt, Human
ccuuuuuuuuuuuuuuuu

SEQ ID NO: 1213581 - RNA, 18 nt, Human
cgccccggcgccgccgcc

SEQ ID NO: 1213582 - RNA, 22 nt, Human
cgcgggcacacacacacacuca

SEQ ID NO: 1213583 - RNA, 20 nt, Human
cgucccuuuuuuuuuuuuuu

SEQ ID NO: 1213584 - RNA, 21 nt, Human
cucaugcacgcgggcacacac

SEQ ID NO: 1213585 - RNA, 24 nt, Human
cuccaccacacgcugaaucugcag

SEQ ID NO: 1213586 - RNA, 18 nt, Human
cugaggaagaggccagga

SEQ ID NO: 1213587 - RNA, 24 nt, Human
cuggaaauauggauggucucuucu

SEQ ID NO: 1213588 - RNA, 21 nt, Human
gaaaggguguguuuccguccu

SEQ ID NO: 1213589 - RNA, 20 nt, Human
gagacccacagcaucgcccc

SEQ ID NO: 1213590 - RNA, 22 nt, Human
gcacgcgggcacacacacacac

SEQ ID NO: 1213591 - RNA, 19 nt, Human
gccuccaggugggccgugu

SEQ ID NO: 1213592 - RNA, 19 nt, Human
gcgccgccgccguaguugc

SEQ ID NO: 1213593 - RNA, 24 nt, Human
gcuuggaggccccccgcaccagcc

SEQ ID NO: 1213594 - RNA, 18 nt, Human
gggcaccagcuuggaggc

SEQ ID NO: 1213595 - RNA, 20 nt, Human
gggcaccagcuuggaggccc

SEQ ID NO: 1213596 - RNA, 19 nt, Human
ggucucuucuucgggugcc

SEQ ID NO: 1213597 - RNA, 19 nt, Human
gguguguuuccguccugga

SEQ ID NO: 1213598 - RNA, 18 nt, Human
gucccuuuuuuuuuuuuu

SEQ ID NO: 1213599 - RNA, 27 nt, Human
guuuguuuucgucccuuuuuuuuuuuu

SEQ ID NO: 1213600 - RNA, 23 nt, Human
ucagguggcaggcuacuccuucu

SEQ ID NO: 1213601 - RNA, 20 nt, Human
uccgcguacugcugcagccg

SEQ ID NO: 1213602 - RNA, 18 nt, Human
ucugcagcuuccagauac

SEQ ID NO: 1213603 - RNA, 23 nt, Human
ucuucguucuguuaugugucugg

SEQ ID NO: 1213604 - RNA, 23 nt, Human
ugaagcgcacacaggccuccagg

SEQ ID NO: 1213605 - RNA, 20 nt, Human
ugaguaguucagguggcagg

SEQ ID NO: 1213606 - RNA, 27 nt, Human
uuggaggccccccgcaccagcccgucc

SEQ ID NO: 1213607 - RNA, 26 nt, Human
uuugaagucuuccucuaaugucauuu

SEQ ID NO: 1213608 - RNA, 20 nt, Human
uuuucugacgccagccaagg

SEQ ID NO: 1213609 - RNA, 25 nt, Human
uuuuuugccggucucaguuuuuaau

SEQ ID NO: 1213610 - RNA, 19 nt, Human
uuuuuuuuuuuuuugccgg

SEQ ID NO: 1213611 - RNA, 24 nt, Human
uuuuuuuuuuuuuugccggucuca

SEQ ID NO: 1213612 - RNA, 22 nt, Human
uuuuuuuuuuuuuuuucagcuu

SEQ ID NO: 1213613 - RNA, 22 nt, Human
uuuuuuuuuuuuuuuuugccgg

SEQ ID NO: 1213614 - RNA, 23 nt, Human
uuuuuuuuuuuuuuuuugccggu

SEQ ID NO: 1213615 - RNA, 22 nt, Human
aagagaucaacaaugauuacaa

SEQ ID NO: 1213616 - RNA, 19 nt, Human
aucaacaaugauuacaaaa

SEQ ID NO: 1213617 - RNA, 19 nt, Human
cagugcaagagaucaacaa

SEQ ID NO: 1213618 - RNA, 20 nt, Human
cccggccaagaaaccucccc

SEQ ID NO: 1213619 - RNA, 24 nt, Human
cggccaagaaaccucccccgcugg

SEQ ID NO: 1213620 - RNA, 21 nt, Human
ggacagcgagguggcagguua

SEQ ID NO: 1213621 - RNA, 19 nt, Human
ggggacagcgagguggcag

SEQ ID NO: 1213622 - RNA, 21 nt, Human
guuugaggacacucaggggac

SEQ ID NO: 1213623 - RNA, 22 nt, Human
ucaggggacagcgagguggcag

SEQ ID NO: 1213624 - RNA, 26 nt, Human
ugcaagagaucaacaaugauuacaaa

SEQ ID NO: 1213625 - RNA, 20 nt, Human
ugguuugaggacacucaggg

SEQ ID NO: 1213626 - RNA, 22 nt, Human
uucccacccuucgugguuugag

SEQ ID NO: 1213627 - RNA, 21 nt, Human
uugaggacacucaggggacag

SEQ ID NO: 1213628 - RNA, 23 nt, Human
uuucccggccaagaaaccucccc

SEQ ID NO: 1213629 - RNA, 28 nt, Human
acccgcugucgcugcagugggggagccc

SEQ ID NO: 1213630 - RNA, 23 nt, Human
agugugcgcgcggcgcgugcgug

SEQ ID NO: 1213631 - RNA, 20 nt, Human
augcaucuuuaauuuguaaa

SEQ ID NO: 1213632 - RNA, 22 nt, Human
auggaacgcgcggaguggcgcc

SEQ ID NO: 1213633 - RNA, 23 nt, Human
cacggcccgggcauccgccucuu

SEQ ID NO: 1213634 - RNA, 18 nt, Human
cagagcugggcgcuccuc

SEQ ID NO: 1213635 - RNA, 19 nt, Human
caguggcugcccgggaccg

SEQ ID NO: 1213636 - RNA, 23 nt, Human
ccgccgcggcuacgcgccgcugc

SEQ ID NO: 1213637 - RNA, 25 nt, Human
ccgccgcggcuacgcgccgcugcuc

SEQ ID NO: 1213638 - RNA, 26 nt, Human
ccgccgcggcuacgcgccgcugcucu

SEQ ID NO: 1213639 - RNA, 18 nt, Human
ccgcugccgcgccuggcg

SEQ ID NO: 1213640 - RNA, 19 nt, Human
ccgcugccgcgccuggcgc

SEQ ID NO: 1213641 - RNA, 24 nt, Human
ccuucagucgccacucggauuacc

SEQ ID NO: 1213642 - RNA, 22 nt, Human
cgcggcgcgugcguggcguccc

SEQ ID NO: 1213643 - RNA, 20 nt, Human
cggcgcgugcguggcguccc

SEQ ID NO: 1213644 - RNA, 18 nt, Human
cugagccacggcccgggc

SEQ ID NO: 1213645 - RNA, 21 nt, Human
cuucuugcugagccacggccc

SEQ ID NO: 1213646 - RNA, 19 nt, Human
gcaguggcugcccgggacc

SEQ ID NO: 1213647 - RNA, 22 nt, Human
gcgcgucggccgccccgcugcc

SEQ ID NO: 1213648 - RNA, 25 nt, Human
ggcgcuccuccacgaggagucgccc

SEQ ID NO: 1213649 - RNA, 21 nt, Human
uaauuuguaaagaaauaaaau

SEQ ID NO: 1213650 - RNA, 21 nt, Human
uacggcacagacuuccgcgcg

SEQ ID NO: 1213651 - RNA, 26 nt, Human
ucaaucuuaccuccaccuucagucgc

SEQ ID NO: 1213652 - RNA, 24 nt, Human
uccaccuucagucgccacucggau

SEQ ID NO: 1213653 - RNA, 23 nt, Human
ucuucaaucuuaccuccaccuuc

SEQ ID NO: 1213654 - RNA, 19 nt, Human
ugagggacucgcggacgcg

SEQ ID NO: 1213655 - RNA, 18 nt, Human
uggcgcaccagagcuggg

SEQ ID NO: 1213656 - RNA, 18 nt, Human
ugugcgcgcggcgcgugc

SEQ ID NO: 1213657 - RNA, 18 nt, Human
caccaccugugccucugc

SEQ ID NO: 1213658 - RNA, 18 nt, Human
caccaccugugccucugc

SEQ ID NO: 1213659 - RNA, 22 nt, Human
ccucgccugcccaccucacagc

SEQ ID NO: 1213660 - RNA, 19 nt, Human
cuacugucugccaccaccu

SEQ ID NO: 1213661 - RNA, 24 nt, Human
cucacagcuuuggccacgcacucc

SEQ ID NO: 1213662 - RNA, 25 nt, Human
gccucuacugucugccaccaccugu

SEQ ID NO: 1213663 - RNA, 22 nt, Human
ucccgcuccucgccugcccacc

SEQ ID NO: 1213664 - RNA, 18 nt, Human
uccuaggccgaggcuaug

SEQ ID NO: 1213665 - RNA, 19 nt, Human
ugccaccaccugugccucu

SEQ ID NO: 1213666 - RNA, 18 nt, Human
uguccuaggccgaggcua

SEQ ID NO: 1213667 - RNA, 25 nt, Human
aaagcccccaggauccccacuggcc

SEQ ID NO: 1213668 - RNA, 24 nt, Human
aagacagaccugugggugcagaaa

SEQ ID NO: 1213669 - RNA, 23 nt, Human
acacacauccuggaaaacucaca

SEQ ID NO: 1213670 - RNA, 20 nt, Human
accaggaagagaauuccuca

SEQ ID NO: 1213671 - RNA, 25 nt, Human
acucugagacccacucaugagcaag

SEQ ID NO: 1213672 - RNA, 24 nt, Human
agaaaacccuggcccaggugaccc

SEQ ID NO: 1213673 - RNA, 24 nt, Human
agcuagcccaucacagcuagcccc

SEQ ID NO: 1213674 - RNA, 18 nt, Human
agcugcauucugcucucu

SEQ ID NO: 1213675 - RNA, 20 nt, Human
agcugugugaccucaggcac

SEQ ID NO: 1213676 - RNA, 18 nt, Human
aggggccuuucaaagcag

SEQ ID NO: 1213677 - RNA, 22 nt, Human
agggugcagggagaggcagcug

SEQ ID NO: 1213678 - RNA, 20 nt, Human
caaagcaacucaaaacuacc

SEQ ID NO: 1213679 - RNA, 21 nt, Human
caaggcucagggaggccgagg

SEQ ID NO: 1213680 - RNA, 18 nt, Human
cacaaggcucagggaggc

SEQ ID NO: 1213681 - RNA, 18 nt, Human
cacgccagccagcccagg

SEQ ID NO: 1213682 - RNA, 19 nt, Human
cagacaacucacgccagcc

SEQ ID NO: 1213683 - RNA, 22 nt, Human
cagacacagugcccagcaccua

SEQ ID NO: 1213684 - RNA, 19 nt, Human
cagcccagggcaggggcaa

SEQ ID NO: 1213685 - RNA, 22 nt, Human
cagcugaacuucaaagcaacuc

SEQ ID NO: 1213686 - RNA, 18 nt, Human
cagcugagacuugcccgc

SEQ ID NO: 1213687 - RNA, 23 nt, Human
caugagcaagacagaccuguggg

SEQ ID NO: 1213688 - RNA, 22 nt, Human
cauucugcucucuuucugggga

SEQ ID NO: 1213689 - RNA, 18 nt, Human
cauuugaaauggagggga

SEQ ID NO: 1213690 - RNA, 20 nt, Human
ccacucagggcucacccucu

SEQ ID NO: 1213691 - RNA, 19 nt, Human
ccacugugggagaggaggc

SEQ ID NO: 1213692 - RNA, 24 nt, Human
ccagacacagugcccagcaccuau

SEQ ID NO: 1213693 - RNA, 21 nt, Human
cccaaaaaccacuggccuucc

SEQ ID NO: 1213694 - RNA, 22 nt, Human
cccacucaugagcaagacagac

SEQ ID NO: 1213695 - RNA, 24 nt, Human
ccccaaaaaccacuggccuucccu

SEQ ID NO: 1213696 - RNA, 21 nt, Human
ccccacuggcccucaggccug

SEQ ID NO: 1213697 - RNA, 21 nt, Human
ccccagaaagcccccaggacc

SEQ ID NO: 1213698 - RNA, 21 nt, Human
ccccaggauccccacuggccc

SEQ ID NO: 1213699 - RNA, 21 nt, Human
cccccaccuuucucugccgua

SEQ ID NO: 1213700 - RNA, 21 nt, Human
cccccuagaaaucccagucau

SEQ ID NO: 1213701 - RNA, 24 nt, Human
ccccugaagucugccuucagggag

SEQ ID NO: 1213702 - RNA, 24 nt, Human
cccugcaugaacccggccuccucc

SEQ ID NO: 1213703 - RNA, 21 nt, Human
cccugggcaaggccgagcccu

SEQ ID NO: 1213704 - RNA, 24 nt, Human
cccuuguuucccccuagaaauccc

SEQ ID NO: 1213705 - RNA, 21 nt, Human
ccucaggccugccaaggaccc

SEQ ID NO: 1213706 - RNA, 23 nt, Human
ccucaugcugcuggcagcucucc

SEQ ID NO: 1213707 - RNA, 27 nt, Human
ccuggcccaggugaccccaaaaaccac

SEQ ID NO: 1213708 - RNA, 24 nt, Human
ccuggcccccaccuuucucugccg

SEQ ID NO: 1213709 - RNA, 24 nt, Human
cgagcccugggguggagcaauuac

SEQ ID NO: 1213710 - RNA, 23 nt, Human
cgcagcuagcccaucacagcuag

SEQ ID NO: 1213711 - RNA, 19 nt, Human
cuagaccccugauggguug

SEQ ID NO: 1213712 - RNA, 20 nt, Human
cucccaggcucucugcugcg

SEQ ID NO: 1213713 - RNA, 21 nt, Human
cugaggauggaagccuggggc

SEQ ID NO: 1213714 - RNA, 18 nt, Human
cuggcccccaccuuucuc

SEQ ID NO: 1213715 - RNA, 18 nt, Human
cuggcccucaggccugcc

SEQ ID NO: 1213716 - RNA, 30 nt, Human
cuugcccgcuucuagaucugaccaggaccc

SEQ ID NO: 1213717 - RNA, 23 nt, Human
gaaaacagucgaagggggauggc

SEQ ID NO: 1213718 - RNA, 19 nt, Human
gaaagcccccaggaucccc

SEQ ID NO: 1213719 - RNA, 18 nt, Human
gaacuugaaaggggggca

SEQ ID NO: 1213720 - RNA, 22 nt, Human
gaccugugggugcagaaagggc

SEQ ID NO: 1213721 - RNA, 22 nt, Human
gagauggcucucccaggcucuc

SEQ ID NO: 1213722 - RNA, 20 nt, Human
gaggaggccuuucacagucu

SEQ ID NO: 1213723 - RNA, 18 nt, Human
gaggauggaagccugggg

SEQ ID NO: 1213724 - RNA, 18 nt, Human
gagggaacuugaaagggg

SEQ ID NO: 1213725 - RNA, 19 nt, Human
gauggcucaugaccugggg

SEQ ID NO: 1213726 - RNA, 19 nt, Human
gcacuaugguuaaaagcac

SEQ ID NO: 1213727 - RNA, 21 nt, Human
ggcccccaccuuucucugccg

SEQ ID NO: 1213728 - RNA, 22 nt, Human
gggccagggugcagggagaggc

SEQ ID NO: 1213729 - RNA, 22 nt, Human
gggugcagggagaggcagcugg

SEQ ID NO: 1213730 - RNA, 24 nt, Human
gguugagcugcagaaaacccuggc

SEQ ID NO: 1213731 - RNA, 24 nt, Human
gugaccccaaaaaccacuggccuu

SEQ ID NO: 1213732 - RNA, 21 nt, Human
uaccaggaagagaauuccuca

SEQ ID NO: 1213733 - RNA, 19 nt, Human
uagccccugaagucugccu

SEQ ID NO: 1213734 - RNA, 25 nt, Human
uauauuuguaaacucugagacccac

SEQ ID NO: 1213735 - RNA, 19 nt, Human
ucaaagcaugcagagcuga

SEQ ID NO: 1213736 - RNA, 21 nt, Human
ucacaaggcucagggaggccc

SEQ ID NO: 1213737 - RNA, 22 nt, Human
ucucccaggcucucugcugcgg

SEQ ID NO: 1213738 - RNA, 23 nt, Human
ucuggggaucugagcugugugac

SEQ ID NO: 1213739 - RNA, 19 nt, Human
ugaaauggaggggaaggag

SEQ ID NO: 1213740 - RNA, 24 nt, Human
ugaagucaacaacagcugaacuuc

SEQ ID NO: 1213741 - RNA, 19 nt, Human
ugaccugggggagaugggc

SEQ ID NO: 1213742 - RNA, 20 nt, Human
ugacucagggcucaggggac

SEQ ID NO: 1213743 - RNA, 21 nt, Human
ugagacuugcccgcuucuaga

SEQ ID NO: 1213744 - RNA, 18 nt, Human
ugagagagccuuuuggca

SEQ ID NO: 1213745 - RNA, 23 nt, Human
ugagcugcagaaaacccuggccc

SEQ ID NO: 1213746 - RNA, 19 nt, Human
ugauggguugagcugcaga

SEQ ID NO: 1213747 - RNA, 22 nt, Human
ugcagggagaggcagcugggau

SEQ ID NO: 1213748 - RNA, 23 nt, Human
ugcauucugcucucuuucugggg

SEQ ID NO: 1213749 - RNA, 23 nt, Human
ugccaaggacccugcaugaaccc

SEQ ID NO: 1213750 - RNA, 22 nt, Human
uggaagccuggggcuggugcug

SEQ ID NO: 1213751 - RNA, 21 nt, Human
uggcccaggugaccccaaaaa

SEQ ID NO: 1213752 - RNA, 18 nt, Human
ugggcaaggccgagcccu

SEQ ID NO: 1213753 - RNA, 21 nt, Human
ugggccuccgacccugggcaa

SEQ ID NO: 1213754 - RNA, 24 nt, Human
ugugugaccucaggcacgcaugca

SEQ ID NO: 1213755 - RNA, 23 nt, Human
uucacagucucugugucccagac

SEQ ID NO: 1213756 - RNA, 24 nt, Human
uuccccacccugauucccuggccc

SEQ ID NO: 1213757 - RNA, 19 nt, Human
uuccucagggggcguuggg

SEQ ID NO: 1213758 - RNA, 20 nt, Human
uugguagauguaaaucauag

SEQ ID NO: 1213759 - RNA, 20 nt, Human
uuuguaaacucugagaccca

SEQ ID NO: 1213760 - RNA, 20 nt, Human
aagcacuuugugcaaagauc

SEQ ID NO: 1213761 - RNA, 18 nt, Human
aagcaggcaaccaucaaa

SEQ ID NO: 1213762 - RNA, 21 nt, Human
aaguuggagcaguaaagaaau

SEQ ID NO: 1213763 - RNA, 21 nt, Human
accgagcucaggagaccgggg

SEQ ID NO: 1213764 - RNA, 18 nt, Human
agagggcacagcauugca

SEQ ID NO: 1213765 - RNA, 18 nt, Human
agcacugcagacaugcag

SEQ ID NO: 1213766 - RNA, 19 nt, Human
aggaagcugaggugccagg

SEQ ID NO: 1213767 - RNA, 20 nt, Human
aggagguucccuuccaggag

SEQ ID NO: 1213768 - RNA, 21 nt, Human
aggccccugcccggcaccccu

SEQ ID NO: 1213769 - RNA, 22 nt, Human
agggcuucaggaagggauuggg

SEQ ID NO: 1213770 - RNA, 26 nt, Human
agguucccuuccaggaggccccugcc

SEQ ID NO: 1213771 - RNA, 24 nt, Human
agucagcaggaauccugccucucu

SEQ ID NO: 1213772 - RNA, 19 nt, Human
augcagccuggagaagugg

SEQ ID NO: 1213773 - RNA, 21 nt, Human
augcagccuggagaaguggga

SEQ ID NO: 1213774 - RNA, 19 nt, Human
caagcagagucggucagac

SEQ ID NO: 1213775 - RNA, 26 nt, Human
caagcugaagugacauuuacuccccg

SEQ ID NO: 1213776 - RNA, 20 nt, Human
cacagcauugcaagcagggc

SEQ ID NO: 1213777 - RNA, 23 nt, Human
caccuuaccgagcucaggagacc

SEQ ID NO: 1213778 - RNA, 19 nt, Human
cagcauugcaagcagggca

SEQ ID NO: 1213779 - RNA, 20 nt, Human
caggaggcagacgaguggug

SEQ ID NO: 1213780 - RNA, 25 nt, Human
caggagguucccuuccaggaggccc

SEQ ID NO: 1213781 - RNA, 25 nt, Human
caggcaaccaucaaagcacuuugug

SEQ ID NO: 1213782 - RNA, 19 nt, Human
caggggcugccccaaguuc

SEQ ID NO: 1213783 - RNA, 21 nt, Human
ccccccaacucuggguuccug

SEQ ID NO: 1213784 - RNA, 20 nt, Human
cccccccaacucuggguucc

SEQ ID NO: 1213785 - RNA, 19 nt, Human
cccugcccggcaccccucc

SEQ ID NO: 1213786 - RNA, 19 nt, Human
ccugcccggcaccccucca

SEQ ID NO: 1213787 - RNA, 21 nt, Human
gaggugccaggugucccccug

SEQ ID NO: 1213788 - RNA, 21 nt, Human
gauggcuauuucaacagaaga

SEQ ID NO: 1213789 - RNA, 20 nt, Human
gcaaccaucaaagcacuuug

SEQ ID NO: 1213790 - RNA, 18 nt, Human
ggaggcagacgaguggug

SEQ ID NO: 1213791 - RNA, 20 nt, Human
ggcaagcagagucggucaga

SEQ ID NO: 1213792 - RNA, 21 nt, Human
ggcaccccuccaugcagccuu

SEQ ID NO: 1213793 - RNA, 23 nt, Human
ggcugcaggagguucccuuccag

SEQ ID NO: 1213794 - RNA, 25 nt, Human
ggggggaugggggggcuugccagag

SEQ ID NO: 1213795 - RNA, 19 nt, Human
ggggggcuugccagagggc

SEQ ID NO: 1213796 - RNA, 23 nt, Human
ggugcuugaggcugcaggagguu

SEQ ID NO: 1213797 - RNA, 19 nt, Human
uaugauagaagcagcugga

SEQ ID NO: 1213798 - RNA, 18 nt, Human
ucaggaagggauugggag

SEQ ID NO: 1213799 - RNA, 22 nt, Human
ucccccuggagucagcaggaau

SEQ ID NO: 1213800 - RNA, 18 nt, Human
ucuggguuccugguaugg

SEQ ID NO: 1213801 - RNA, 19 nt, Human
ugacccaguucuaagacag

SEQ ID NO: 1213802 - RNA, 18 nt, Human
ugacucaagcaggcaacc

SEQ ID NO: 1213803 - RNA, 24 nt, Human
ugauagaagcagcuggagcaccuu

SEQ ID NO: 1213804 - RNA, 19 nt, Human
ugccccaaguucgccacac

SEQ ID NO: 1213805 - RNA, 22 nt, Human
uggagcaguaaagaaauguuac

SEQ ID NO: 1213806 - RNA, 19 nt, Human
ugggagugacucaagcagg

SEQ ID NO: 1213807 - RNA, 19 nt, Human
ugggggggcuugccagagg

SEQ ID NO: 1213808 - RNA, 25 nt, Human
uggguuccugguaugggguaaguuu

SEQ ID NO: 1213809 - RNA, 24 nt, Human
uggucaaagaacaagacuuccagg

SEQ ID NO: 1213810 - RNA, 23 nt, Human
uuacacagcacugcagacaugca

SEQ ID NO: 1213811 - RNA, 18 nt, Human
uucaggaagggauuggga

SEQ ID NO: 1213812 - RNA, 21 nt, Human
uugcaagcagggcaaugaccc

SEQ ID NO: 1213813 - RNA, 22 nt, Human
uugcaagcagggcaaugaccca

SEQ ID NO: 1213814 - RNA, 22 nt, Human
cagagcccaguguccacaccgu

SEQ ID NO: 1213815 - RNA, 22 nt, Human
cugauauuggagggcucucccu

SEQ ID NO: 1213816 - RNA, 24 nt, Human
gacauguuauaaaugaugugguuu

SEQ ID NO: 1213817 - RNA, 24 nt, Human
gcacagccacuucugaccccuugg

SEQ ID NO: 1213818 - RNA, 21 nt, Human
ggcagcugcuguugugccgac

SEQ ID NO: 1213819 - RNA, 23 nt, Human
guggcacagccacuucugccugc

SEQ ID NO: 1213820 - RNA, 19 nt, Human
uaaaugaugugguuuuuau

SEQ ID NO: 1213821 - RNA, 20 nt, Human
uccacaccguggcacagcca

SEQ ID NO: 1213822 - RNA, 19 nt, Human
ugagaugccuguuccauga

SEQ ID NO: 1213823 - RNA, 21 nt, Human
ugauauuggagggcucucccu

SEQ ID NO: 1213824 - RNA, 21 nt, Human
ugcuguugugccgacuugaga

SEQ ID NO: 1213825 - RNA, 21 nt, Human
uggagggcucucccuaugggu

SEQ ID NO: 1213826 - RNA, 19 nt, Human
uggcacagccacuucugcc

SEQ ID NO: 1213827 - RNA, 22 nt, Human
uggcuggggcagcugcuguugu

SEQ ID NO: 1213828 - RNA, 24 nt, Human
ugugcagccaggugacaauccuga

SEQ ID NO: 1213829 - RNA, 25 nt, Human
uuggagggcucucccuauggguuga

SEQ ID NO: 1213830 - RNA, 20 nt, Human
aaccagaggacccucauuaa

SEQ ID NO: 1213831 - RNA, 18 nt, Human
agggucccagccuacccc

SEQ ID NO: 1213832 - RNA, 24 nt, Human
caacccuggccagacuccaauaac

SEQ ID NO: 1213833 - RNA, 19 nt, Human
cauccccaaauuucaagcc

SEQ ID NO: 1213834 - RNA, 25 nt, Human
ccaaauuucaagccagacugaaauc

SEQ ID NO: 1213835 - RNA, 21 nt, Human
cgguccgggcaguccgagggc

SEQ ID NO: 1213836 - RNA, 22 nt, Human
cucagcucaagucaacccuggc

SEQ ID NO: 1213837 - RNA, 25 nt, Human
cuccaauaacagacacaagguaccc

SEQ ID NO: 1213838 - RNA, 19 nt, Human
cugucagaagaaaugaggg

SEQ ID NO: 1213839 - RNA, 18 nt, Human
gacacggguggaacagag

SEQ ID NO: 1213840 - RNA, 21 nt, Human
guggcccugguuaccaaaaac

SEQ ID NO: 1213841 - RNA, 19 nt, Human
uaacagacacaagaacuga

SEQ ID NO: 1213842 - RNA, 21 nt, Human
uaccaaaaaccagaggacccu

SEQ ID NO: 1213843 - RNA, 23 nt, Human
uaccaaaaaccagaggacccuca

SEQ ID NO: 1213844 - RNA, 21 nt, Human
uccccaaauuucaagccagac

SEQ ID NO: 1213845 - RNA, 20 nt, Human
ucugaguagccgggaggucu

SEQ ID NO: 1213846 - RNA, 21 nt, Human
ucugucagaagaaaugagggu

SEQ ID NO: 1213847 - RNA, 21 nt, Human
uggaacagaguaggcugggcc

SEQ ID NO: 1213848 - RNA, 18 nt, Human
ugucagaagaaaugaggg

SEQ ID NO: 1213849 - RNA, 21 nt, Human
ugucagaagaaaugagggucc

SEQ ID NO: 1213850 - RNA, 22 nt, Human
ugucagaagaaaugaggguccc

SEQ ID NO: 1213851 - RNA, 23 nt, Human
aacccaggcuggcucagaaaccu

SEQ ID NO: 1213852 - RNA, 19 nt, Human
aagaaccugagcaagggca

SEQ ID NO: 1213853 - RNA, 20 nt, Human
agagcgguucugggucuggg

SEQ ID NO: 1213854 - RNA, 18 nt, Human
agccugagcccagugcug

SEQ ID NO: 1213855 - RNA, 20 nt, Human
agggaaggggagagcgguuc

SEQ ID NO: 1213856 - RNA, 23 nt, Human
agggaaggggagagcgguucugg

SEQ ID NO: 1213857 - RNA, 23 nt, Human
caaaacauaauccauauaaaagc

SEQ ID NO: 1213858 - RNA, 22 nt, Human
caagaaccugagcaagggcaag

SEQ ID NO: 1213859 - RNA, 22 nt, Human
caagggcaaggggccguggagg

SEQ ID NO: 1213860 - RNA, 22 nt, Human
caaucucugcagccacccaggu

SEQ ID NO: 1213861 - RNA, 18 nt, Human
cacagagccucugucuug

SEQ ID NO: 1213862 - RNA, 18 nt, Human
caccuccugguccagcuc

SEQ ID NO: 1213863 - RNA, 24 nt, Human
cacgcaaaccuccaagacucuugu

SEQ ID NO: 1213864 - RNA, 19 nt, Human
cagaaacacgcaaaccucc

SEQ ID NO: 1213865 - RNA, 21 nt, Human
cagaaacacgcaaaccuccaa

SEQ ID NO: 1213866 - RNA, 19 nt, Human
cagaaauuggugccaggac

SEQ ID NO: 1213867 - RNA, 21 nt, Human
cagcaaguucaccugcagcuu

SEQ ID NO: 1213868 - RNA, 19 nt, Human
cagcuccccaggguucggg

SEQ ID NO: 1213869 - RNA, 22 nt, Human
caggcuggcucagaaaccugcu

SEQ ID NO: 1213870 - RNA, 24 nt, Human
caguuggccacucagaggucagcu

SEQ ID NO: 1213871 - RNA, 19 nt, Human
caugcauggcugcuggagg

SEQ ID NO: 1213872 - RNA, 25 nt, Human
cauuaaaaaugcagcgauuugucac

SEQ ID NO: 1213873 - RNA, 21 nt, Human
ccaccucccagcccgcccccc

SEQ ID NO: 1213874 - RNA, 19 nt, Human
ccaggacgggagggagcca

SEQ ID NO: 1213875 - RNA, 22 nt, Human
ccaugcggacagucgcgcugaa

SEQ ID NO: 1213876 - RNA, 22 nt, Human
cccaccucccagcccgcccccc

SEQ ID NO: 1213877 - RNA, 19 nt, Human
ccccugagccuccaccucc

SEQ ID NO: 1213878 - RNA, 26 nt, Human
cccguccuggcuccgucugcugggag

SEQ ID NO: 1213879 - RNA, 20 nt, Human
cccugggagcugcaguuggc

SEQ ID NO: 1213880 - RNA, 25 nt, Human
cccugggcccugggggagcaggccc

SEQ ID NO: 1213881 - RNA, 19 nt, Human
cccuggggcaugagauggg

SEQ ID NO: 1213882 - RNA, 22 nt, Human
ccuccaccuccugguccagcuc

SEQ ID NO: 1213883 - RNA, 21 nt, Human
ccugggcccugggggagcagg

SEQ ID NO: 1213884 - RNA, 22 nt, Human
ccuguccccaugggguccccug

SEQ ID NO: 1213885 - RNA, 24 nt, Human
ccuuugcccgggcaugaccaccuc

SEQ ID NO: 1213886 - RNA, 20 nt, Human
cgccacagagccucugucuu

SEQ ID NO: 1213887 - RNA, 24 nt, Human
cgccacagagccucugucuuggag

SEQ ID NO: 1213888 - RNA, 27 nt, Human
cggcucccaccucccagcccgcccccc

SEQ ID NO: 1213889 - RNA, 20 nt, Human
cgggagggagccaugcggac

SEQ ID NO: 1213890 - RNA, 18 nt, Human
cggggucaguccugaccg

SEQ ID NO: 1213891 - RNA, 20 nt, Human
cgugaguguguggcgagcug

SEQ ID NO: 1213892 - RNA, 21 nt, Human
cugagccuccaccuccugguc

SEQ ID NO: 1213893 - RNA, 24 nt, Human
cuggggcaugagaugggugggggc

SEQ ID NO: 1213894 - RNA, 18 nt, Human
gacugcgcgggacuccca

SEQ ID NO: 1213895 - RNA, 21 nt, Human
gccaaggggcuccacaccagc

SEQ ID NO: 1213896 - RNA, 19 nt, Human
gccacagagccucugucuu

SEQ ID NO: 1213897 - RNA, 19 nt, Human
gcgcagacaggcacaaaag

SEQ ID NO: 1213898 - RNA, 21 nt, Human
gcgugaguguguggcgagcug

SEQ ID NO: 1213899 - RNA, 27 nt, Human
gcucccaccucccagcccgccccccac

SEQ ID NO: 1213900 - RNA, 21 nt, Human
gcuguucuaagcuggggggcc

SEQ ID NO: 1213901 - RNA, 21 nt, Human
ggcagggaaggggagagcggu

SEQ ID NO: 1213902 - RNA, 19 nt, Human
ggccacucagaggucagcu

SEQ ID NO: 1213903 - RNA, 21 nt, Human
ggccaggacgccgacuuccuc

SEQ ID NO: 1213904 - RNA, 27 nt, Human
ggcggugggcaguggcggucccugggg

SEQ ID NO: 1213905 - RNA, 19 nt, Human
gggagccaugcggacaguc

SEQ ID NO: 1213906 - RNA, 22 nt, Human
gggaggaggggcacugggcagg

SEQ ID NO: 1213907 - RNA, 23 nt, Human
gggagggagccaugcggacaguc

SEQ ID NO: 1213908 - RNA, 21 nt, Human
gggcaccugggggucugggcu

SEQ ID NO: 1213909 - RNA, 20 nt, Human
gggcagggaaggggagagcg

SEQ ID NO: 1213910 - RNA, 23 nt, Human
ggggaggaggggcacugggcagg

SEQ ID NO: 1213911 - RNA, 20 nt, Human
ggggggugaacccaggcagg

SEQ ID NO: 1213912 - RNA, 21 nt, Human
ggguccccugagccuccaccu

SEQ ID NO: 1213913 - RNA, 23 nt, Human
ggucugggcuggggaggaggggc

SEQ ID NO: 1213914 - RNA, 23 nt, Human
ggucugggcuggggaggaggggc

SEQ ID NO: 1213915 - RNA, 25 nt, Human
guggcgagcuguggaggcagggcug

SEQ ID NO: 1213916 - RNA, 20 nt, Human
uaagcuggggggcccugggc

SEQ ID NO: 1213917 - RNA, 21 nt, Human
uacucugaaguuuguugaguu

SEQ ID NO: 1213918 - RNA, 23 nt, Human
uagaaaugccacuagcuggcugc

SEQ ID NO: 1213919 - RNA, 18 nt, Human
uaugugggaaaacacauc

SEQ ID NO: 1213920 - RNA, 22 nt, Human
uccaagaaccugagcaagggca

SEQ ID NO: 1213921 - RNA, 23 nt, Human
uccacaccagcugccuggggucc

SEQ ID NO: 1213922 - RNA, 21 nt, Human
ucccaccucccagcccgcccc

SEQ ID NO: 1213923 - RNA, 20 nt, Human
ucccagcccgccccccacag

SEQ ID NO: 1213924 - RNA, 19 nt, Human
ucccauggcccuggccaag

SEQ ID NO: 1213925 - RNA, 21 nt, Human
uccccaggguucgggggcgga

SEQ ID NO: 1213926 - RNA, 19 nt, Human
ucccugggagcugcaguug

SEQ ID NO: 1213927 - RNA, 24 nt, Human
ucguugcucagccaacccaggcug

SEQ ID NO: 1213928 - RNA, 21 nt, Human
ucuaagcuggggggcccuggg

SEQ ID NO: 1213929 - RNA, 18 nt, Human
ucucagggacccccgcca

SEQ ID NO: 1213930 - RNA, 23 nt, Human
ucucggagucccugggagcugca

SEQ ID NO: 1213931 - RNA, 19 nt, Human
ucugaaguuuguugaguug

SEQ ID NO: 1213932 - RNA, 21 nt, Human
ucugggcuggggaggaggggc

SEQ ID NO: 1213933 - RNA, 26 nt, Human
ugaacccaggcagggucucggaccgg

SEQ ID NO: 1213934 - RNA, 21 nt, Human
ugaagccugagcccagugcug

SEQ ID NO: 1213935 - RNA, 18 nt, Human
ugaccaccucaccaaggg

SEQ ID NO: 1213936 - RNA, 19 nt, Human
ugagaugggugggggcacu

SEQ ID NO: 1213937 - RNA, 20 nt, Human
ugagaugggugggggcacuc

SEQ ID NO: 1213938 - RNA, 21 nt, Human
ugagaugggugggggcacucu

SEQ ID NO: 1213939 - RNA, 23 nt, Human
ugagaugggugggggcacucuca

SEQ ID NO: 1213940 - RNA, 24 nt, Human
ugagaugggugggggcacucucag

SEQ ID NO: 1213941 - RNA, 19 nt, Human
ugagccuccaccuccuggu

SEQ ID NO: 1213942 - RNA, 18 nt, Human
ugaguguguggcgagcug

SEQ ID NO: 1213943 - RNA, 23 nt, Human
ugccaggacgggagggagccaug

SEQ ID NO: 1213944 - RNA, 25 nt, Human
ugcccggggcucuggucacccagcu

SEQ ID NO: 1213945 - RNA, 27 nt, Human
ugccugggguccaagaaccggggguuc

SEQ ID NO: 1213946 - RNA, 18 nt, Human
ugcgggcgcacaugcaug

SEQ ID NO: 1213947 - RNA, 27 nt, Human
ugcugccccggggucaguuggucaacc

SEQ ID NO: 1213948 - RNA, 19 nt, Human
ugcuggaggcggugggcag

SEQ ID NO: 1213949 - RNA, 21 nt, Human
uggcccuggccaaggggcucc

SEQ ID NO: 1213950 - RNA, 18 nt, Human
uggcgagcuguggaggca

SEQ ID NO: 1213951 - RNA, 20 nt, Human
ugggaagcugucuuucauuu

SEQ ID NO: 1213952 - RNA, 19 nt, Human
ugggcagggaaggggagag

SEQ ID NO: 1213953 - RNA, 20 nt, Human
ugggcuggggaggaggggca

SEQ ID NO: 1213954 - RNA, 22 nt, Human
uggggggcccugggcccugggg

SEQ ID NO: 1213955 - RNA, 19 nt, Human
uggugccaggacgggaggg

SEQ ID NO: 1213956 - RNA, 22 nt, Human
ugucuuggagcugcucugagug

SEQ ID NO: 1213957 - RNA, 18 nt, Human
uguggggggugaacccag

SEQ ID NO: 1213958 - RNA, 26 nt, Human
uucaccugcagcuuggagguguggcu

SEQ ID NO: 1213959 - RNA, 23 nt, Human
uuggcgguggaggcuguugcugu

SEQ ID NO: 1213960 - RNA, 21 nt, Human
uuguugaguuggcgguggagg

SEQ ID NO: 1213961 - RNA, 24 nt, Human
uuuguugaguuggcgguggaggcu

SEQ ID NO: 1213962 - RNA, 18 nt, Human
agacggaggcaggcagaa

SEQ ID NO: 1213963 - RNA, 20 nt, Human
agagacggaggcaggcagaa

SEQ ID NO: 1213964 - RNA, 23 nt, Human
aggcaggcagaacacggccuagg

SEQ ID NO: 1213965 - RNA, 20 nt, Human
ccccggggccgggucccccc

SEQ ID NO: 1213966 - RNA, 21 nt, Human
gaucugagggagaaagagacg

SEQ ID NO: 1213967 - RNA, 20 nt, Human
uggaggccugggccuaacag

SEQ ID NO: 1213968 - RNA, 24 nt, Human
acuaguaagauuuucaacacaagg

SEQ ID NO: 1213969 - RNA, 21 nt, Human
aguaagauuuucaacacaagg

SEQ ID NO: 1213970 - RNA, 23 nt, Human
auuaggaggagacagcaaaaugc

SEQ ID NO: 1213971 - RNA, 20 nt, Human
caaaaugccuaggcagauac

SEQ ID NO: 1213972 - RNA, 23 nt, Human
cagccccacaaguguuuacacca

SEQ ID NO: 1213973 - RNA, 18 nt, Human
ccccggagaaucuccaac

SEQ ID NO: 1213974 - RNA, 19 nt, Human
ugccuaggcagauacggaa

SEQ ID NO: 1213975 - RNA, 20 nt, Human
uucuuacgggcauuugggga

SEQ ID NO: 1213976 - RNA, 18 nt, Human
aaacagcuuccacugugu

SEQ ID NO: 1213977 - RNA, 21 nt, Human
aaacuuggagaugcaggaacu

SEQ ID NO: 1213978 - RNA, 22 nt, Human
aaaggaacuuaauugagcaaug

SEQ ID NO: 1213979 - RNA, 20 nt, Human
aagaaggcaucacagcccug

SEQ ID NO: 1213980 - RNA, 18 nt, Human
aaguagaaggugagcaag

SEQ ID NO: 1213981 - RNA, 24 nt, Human
agcgcacagccccagccacuccuc

SEQ ID NO: 1213982 - RNA, 22 nt, Human
agggaaugcaguggcgcccaga

SEQ ID NO: 1213983 - RNA, 25 nt, Human
caaccucccucuugugcucgucacc

SEQ ID NO: 1213984 - RNA, 22 nt, Human
caacgcugcucaccacacuaua

SEQ ID NO: 1213985 - RNA, 19 nt, Human
caauaaaggcaacgugaug

SEQ ID NO: 1213986 - RNA, 21 nt, Human
cacagccccagccacuccucc

SEQ ID NO: 1213987 - RNA, 19 nt, Human
caccccuuccuggcuccca

SEQ ID NO: 1213988 - RNA, 22 nt, Human
cacuccuccccacugcagccag

SEQ ID NO: 1213989 - RNA, 20 nt, Human
cacugcugccaucacagagc

SEQ ID NO: 1213990 - RNA, 21 nt, Human
cagagccccaaagaaggcauc

SEQ ID NO: 1213991 - RNA, 22 nt, Human
cagagccccaaagaagggggag

SEQ ID NO: 1213992 - RNA, 19 nt, Human
cagcugugccugggagggc

SEQ ID NO: 1213993 - RNA, 21 nt, Human
caggucccgaguucuuguccu

SEQ ID NO: 1213994 - RNA, 19 nt, Human
ccagaaacuuggagaugca

SEQ ID NO: 1213995 - RNA, 19 nt, Human
ccagccacuccuccccacu

SEQ ID NO: 1213996 - RNA, 22 nt, Human
ccccaccucaaccucccucuug

SEQ ID NO: 1213997 - RNA, 22 nt, Human
cccugcuaguuugcaggucccg

SEQ ID NO: 1213998 - RNA, 21 nt, Human
ccggaggcccuagcaguccug

SEQ ID NO: 1213999 - RNA, 19 nt, Human
ccuucucucuucucuucuu

SEQ ID NO: 1214000 - RNA, 19 nt, Human
ccuugcaggugccuuucuu

SEQ ID NO: 1214001 - RNA, 20 nt, Human
cgcccagaaacuuggagaug

SEQ ID NO: 1214002 - RNA, 18 nt, Human
cggaggcccuagcagucc

SEQ ID NO: 1214003 - RNA, 20 nt, Human
cucccaccccuuccuggcuc

SEQ ID NO: 1214004 - RNA, 26 nt, Human
cucccaccccuuccuggcucccacca

SEQ ID NO: 1214005 - RNA, 18 nt, Human
cuccugccugccaauuua

SEQ ID NO: 1214006 - RNA, 23 nt, Human
cucuugucuccuucucucuucuc

SEQ ID NO: 1214007 - RNA, 24 nt, Human
cugcaguggguaacuccuuucugc

SEQ ID NO: 1214008 - RNA, 20 nt, Human
cugcugccaucacagagcag

SEQ ID NO: 1214009 - RNA, 18 nt, Human
cugugccugggagggcag

SEQ ID NO: 1214010 - RNA, 22 nt, Human
cuuagccccaccucaaccuccc

SEQ ID NO: 1214011 - RNA, 20 nt, Human
cuuguccugaguccaggaag

SEQ ID NO: 1214012 - RNA, 19 nt, Human
gacaauaaaggcaacguga

SEQ ID NO: 1214013 - RNA, 23 nt, Human
gagcaguccuugcaggugccuuu

SEQ ID NO: 1214014 - RNA, 22 nt, Human
gagcuccuaggucugggcuccc

SEQ ID NO: 1214015 - RNA, 20 nt, Human
gcacagccccagccacuccu

SEQ ID NO: 1214016 - RNA, 20 nt, Human
gcacaggugccagcucccug

SEQ ID NO: 1214017 - RNA, 26 nt, Human
gcagagccccaaagaagggggaacgc

SEQ ID NO: 1214018 - RNA, 26 nt, Human
gcccuguuuauguuacaccucuuuca

SEQ ID NO: 1214019 - RNA, 23 nt, Human
gcucccugaagggccacagcucu

SEQ ID NO: 1214020 - RNA, 23 nt, Human
gcugcagcuggaccagaccgacu

SEQ ID NO: 1214021 - RNA, 20 nt, Human
gcugcagcugugccugggag

SEQ ID NO: 1214022 - RNA, 24 nt, Human
ggcagggcuccugccugccaauuu

SEQ ID NO: 1214023 - RNA, 19 nt, Human
ggcuggauggcugcagcug

SEQ ID NO: 1214024 - RNA, 20 nt, Human
gggagcuccuaggucugggc

SEQ ID NO: 1214025 - RNA, 21 nt, Human
ggggagcuccuaggucugggc

SEQ ID NO: 1214026 - RNA, 19 nt, Human
ggucugggcucccugaagg

SEQ ID NO: 1214027 - RNA, 19 nt, Human
gucuccuucucucuucucu

SEQ ID NO: 1214028 - RNA, 20 nt, Human
ucccugaagggccacagcuc

SEQ ID NO: 1214029 - RNA, 18 nt, Human
uccugaguccaggaagaa

SEQ ID NO: 1214030 - RNA, 18 nt, Human
uccuggcucccaccagcu

SEQ ID NO: 1214031 - RNA, 20 nt, Human
uccuggcucccaccagcuuc

SEQ ID NO: 1214032 - RNA, 18 nt, Human
uccuugcaggugccuuuc

SEQ ID NO: 1214033 - RNA, 22 nt, Human
uccuugcaggugccuuucuugu

SEQ ID NO: 1214034 - RNA, 18 nt, Human
ucuccguagcaacugcuc

SEQ ID NO: 1214035 - RNA, 18 nt, Human
ucuccuucucucuucucu

SEQ ID NO: 1214036 - RNA, 19 nt, Human
ucucucuucucuucuucuc

SEQ ID NO: 1214037 - RNA, 22 nt, Human
ucucucuucucuucuucuugcc

SEQ ID NO: 1214038 - RNA, 25 nt, Human
ucuuucagcccugcuaguuugcagg

SEQ ID NO: 1214039 - RNA, 19 nt, Human
ugaagugaggagugagguc

SEQ ID NO: 1214040 - RNA, 21 nt, Human
ugagcaaggugaagaggugcu

SEQ ID NO: 1214041 - RNA, 21 nt, Human
ugaguccaggaagaaugaggu

SEQ ID NO: 1214042 - RNA, 24 nt, Human
ugauucacgaaucaggcagccccc

SEQ ID NO: 1214043 - RNA, 26 nt, Human
ugcaggucccgaguucuuguccugag

SEQ ID NO: 1214044 - RNA, 19 nt, Human
ugccuuucuuguaccucag

SEQ ID NO: 1214045 - RNA, 20 nt, Human
uggagggggccgagguggca

SEQ ID NO: 1214046 - RNA, 25 nt, Human
uggagggggccgagguggcaggggg

SEQ ID NO: 1214047 - RNA, 18 nt, Human
uggcugcagcugugccug

SEQ ID NO: 1214048 - RNA, 24 nt, Human
uggcugcagcugugccugggaggg

SEQ ID NO: 1214049 - RNA, 21 nt, Human
uggcuuggggagcuccuaggu

SEQ ID NO: 1214050 - RNA, 22 nt, Human
ugugccugggagggcagggcuc

SEQ ID NO: 1214051 - RNA, 22 nt, Human
uuagaagcccuagcaacgcugc

SEQ ID NO: 1214052 - RNA, 24 nt, Human
uuauguuacaccucuuucagcccu

SEQ ID NO: 1214053 - RNA, 21 nt, Human
uucuggagggggccgaggugg

SEQ ID NO: 1214054 - RNA, 22 nt, Human
aaacaaaagcaaaacagagcuc

SEQ ID NO: 1214055 - RNA, 23 nt, Human
aaacaaaagcaaaacagagcucc

SEQ ID NO: 1214056 - RNA, 25 nt, Human
aaacgacuaaaacaaaagcaaaaca

SEQ ID NO: 1214057 - RNA, 19 nt, Human
aaacuugaaaaugugggcg

SEQ ID NO: 1214058 - RNA, 19 nt, Human
aaaguacugggauuacagg

SEQ ID NO: 1214059 - RNA, 24 nt, Human
aaaguacugggauuacaggcuuga

SEQ ID NO: 1214060 - RNA, 24 nt, Human
aaauuuuuguauuuuuaguagaga

SEQ ID NO: 1214061 - RNA, 22 nt, Human
aacagagcuccacugcccaaaa

SEQ ID NO: 1214062 - RNA, 20 nt, Human
aaccccgccuccucaacccg

SEQ ID NO: 1214063 - RNA, 22 nt, Human
aagcagacacauuugaaaagau

SEQ ID NO: 1214064 - RNA, 22 nt, Human
aagcagcggugcugcuggcugc

SEQ ID NO: 1214065 - RNA, 24 nt, Human
aagcagguagucuaagggucaacg

SEQ ID NO: 1214066 - RNA, 19 nt, Human
aagggacaaaaaggccuuc

SEQ ID NO: 1214067 - RNA, 19 nt, Human
aaguacugggauuacaggc

SEQ ID NO: 1214068 - RNA, 26 nt, Human
aaguacugggauuacaggcuugagcc

SEQ ID NO: 1214069 - RNA, 24 nt, Human
aagugauccacccgccgcggccuc

SEQ ID NO: 1214070 - RNA, 27 nt, Human
aagugauucuccugccuuagcuuccca

SEQ ID NO: 1214071 - RNA, 22 nt, Human
aauccucaacuggccccgcccc

SEQ ID NO: 1214072 - RNA, 27 nt, Human
aaugaaaaaaccaucuagaaaaaaucu

SEQ ID NO: 1214073 - RNA, 23 nt, Human
aauuuuuguauuuuuaguagaga

SEQ ID NO: 1214074 - RNA, 27 nt, Human
acaaagcaaugaaaaaaccaucuagaa

SEQ ID NO: 1214075 - RNA, 20 nt, Human
acaaagcaaugaaaaaaccc

SEQ ID NO: 1214076 - RNA, 21 nt, Human
acagagcuccacugcccaaaa

SEQ ID NO: 1214077 - RNA, 25 nt, Human
accaggcacccaaacucaucaaugc

SEQ ID NO: 1214078 - RNA, 22 nt, Human
acccaaacucaucaaugcucac

SEQ ID NO: 1214079 - RNA, 21 nt, Human
acguuggccaggcuggucucg

SEQ ID NO: 1214080 - RNA, 19 nt, Human
acugcgaggcgaaggugac

SEQ ID NO: 1214081 - RNA, 25 nt, Human
agagauccacacuccucacaagguc

SEQ ID NO: 1214082 - RNA, 19 nt, Human
agagcuccacugcccaaaa

SEQ ID NO: 1214083 - RNA, 26 nt, Human
agcaaugaaaaaaccaucuagaaaaa

SEQ ID NO: 1214084 - RNA, 27 nt, Human
agcggugcugcuggcugcgucagggcc

SEQ ID NO: 1214085 - RNA, 21 nt, Human
aggcaccaaucacgccuggca

SEQ ID NO: 1214086 - RNA, 20 nt, Human
aggccguacagccgcugcgc

SEQ ID NO: 1214087 - RNA, 25 nt, Human
aggcuggagugcaguugcgggaucu

SEQ ID NO: 1214088 - RNA, 23 nt, Human
aggugcugagucauccuugcggc

SEQ ID NO: 1214089 - RNA, 19 nt, Human
agguguuguggguugacag

SEQ ID NO: 1214090 - RNA, 24 nt, Human
aguacugggauuacaggcuugagc

SEQ ID NO: 1214091 - RNA, 21 nt, Human
auagcaacgacaucugagucu

SEQ ID NO: 1214092 - RNA, 24 nt, Human
auuuuuguauuuuuaguagagaca

SEQ ID NO: 1214093 - RNA, 21 nt, Human
caaaacagagcuccacugccc

SEQ ID NO: 1214094 - RNA, 24 nt, Human
caaaguacugggauuacaggcuug

SEQ ID NO: 1214095 - RNA, 24 nt, Human
caaauuuuuguauuuuuaguagag

SEQ ID NO: 1214096 - RNA, 26 nt, Human
caagcagguagucuaagggucaacgc

SEQ ID NO: 1214097 - RNA, 22 nt, Human
caagugauucuccugccuuagc

SEQ ID NO: 1214098 - RNA, 23 nt, Human
caccaaucacgccuggcaaauuu

SEQ ID NO: 1214099 - RNA, 23 nt, Human
cacccgccgcggccucccaaagu

SEQ ID NO: 1214100 - RNA, 24 nt, Human
cacguuggccaggcuggucucgaa

SEQ ID NO: 1214101 - RNA, 21 nt, Human
cacuccucacaaggucacuuc

SEQ ID NO: 1214102 - RNA, 20 nt, Human
cagagcuccacugcccaaaa

SEQ ID NO: 1214103 - RNA, 24 nt, Human
caggguuuccccacguuggccagg

SEQ ID NO: 1214104 - RNA, 21 nt, Human
caugagaccccagaaaccgga

SEQ ID NO: 1214105 - RNA, 20 nt, Human
ccaaacucaucaaugcucac

SEQ ID NO: 1214106 - RNA, 20 nt, Human
ccaaaguacugggauuacag

SEQ ID NO: 1214107 - RNA, 22 nt, Human
ccaaaguacugggauuacaggc

SEQ ID NO: 1214108 - RNA, 18 nt, Human
ccaauuuggaaccccgcc

SEQ ID NO: 1214109 - RNA, 19 nt, Human
ccacguuggccaggcuggu

SEQ ID NO: 1214110 - RNA, 22 nt, Human
ccacguuggccaggcuggucuc

SEQ ID NO: 1214111 - RNA, 24 nt, Human
cccaaaguacugggauuacaggcu

SEQ ID NO: 1214112 - RNA, 24 nt, Human
cccaaguagcuuagauuacaggca

SEQ ID NO: 1214113 - RNA, 20 nt, Human
cccacacgcaaaauggacgc

SEQ ID NO: 1214114 - RNA, 24 nt, Human
ccccgccccaccaauuuggaaccc

SEQ ID NO: 1214115 - RNA, 20 nt, Human
cccgccccaccaauuuggaa

SEQ ID NO: 1214116 - RNA, 24 nt, Human
cccucuaucgcccaggcuggagug

SEQ ID NO: 1214117 - RNA, 24 nt, Human
ccgccuccuggguucaagugauuc

SEQ ID NO: 1214118 - RNA, 23 nt, Human
ccuaaccucaagugauccacccg

SEQ ID NO: 1214119 - RNA, 22 nt, Human
ccucacaaggucacuucuaacc

SEQ ID NO: 1214120 - RNA, 22 nt, Human
ccuccgccuccuggguucaagu

SEQ ID NO: 1214121 - RNA, 24 nt, Human
ccuccuggguucaagugauucucc

SEQ ID NO: 1214122 - RNA, 25 nt, Human
ccucuaucgcccaggcuggagugca

SEQ ID NO: 1214123 - RNA, 23 nt, Human
ccuggguucaagugauucuccuc

SEQ ID NO: 1214124 - RNA, 23 nt, Human
ccuggguucaagugauucuccug

SEQ ID NO: 1214125 - RNA, 23 nt, Human
ccugugggugaccugguggagag

SEQ ID NO: 1214126 - RNA, 22 nt, Human
cgcccgggauccccgguggucc

SEQ ID NO: 1214127 - RNA, 24 nt, Human
cgccuggcaaauuuuuguauuuuu

SEQ ID NO: 1214128 - RNA, 24 nt, Human
cgcugacuaugacguucccugcaa

SEQ ID NO: 1214129 - RNA, 19 nt, Human
cucaacccggaaccccgcc

SEQ ID NO: 1214130 - RNA, 21 nt, Human
cucaagugauccacccgccgc

SEQ ID NO: 1214131 - RNA, 22 nt, Human
cucacuggaaccuccgccuccu

SEQ ID NO: 1214132 - RNA, 24 nt, Human
cucacuggaaccuccgccuccugg

SEQ ID NO: 1214133 - RNA, 20 nt, Human
cuccuggguucaagugauuc

SEQ ID NO: 1214134 - RNA, 21 nt, Human
cuccuggguucaagugauucu

SEQ ID NO: 1214135 - RNA, 18 nt, Human
cucgcguauuccacaacu

SEQ ID NO: 1214136 - RNA, 23 nt, Human
cugccuuagcuucccaaguagcu

SEQ ID NO: 1214137 - RNA, 19 nt, Human
cuggccccgccccaccaau

SEQ ID NO: 1214138 - RNA, 20 nt, Human
cugugcuucuguccucgggc

SEQ ID NO: 1214139 - RNA, 21 nt, Human
cuuagauuacaggcaccaauc

SEQ ID NO: 1214140 - RNA, 20 nt, Human
gaaaaaaccaucuagaaaaa

SEQ ID NO: 1214141 - RNA, 22 nt, Human
gacuaaaacaaaagcaaaacag

SEQ ID NO: 1214142 - RNA, 20 nt, Human
gagacaggguuuccccacgu

SEQ ID NO: 1214143 - RNA, 18 nt, Human
gauuacaggcuugagcca

SEQ ID NO: 1214144 - RNA, 21 nt, Human
gauuacaggcuugagccacca

SEQ ID NO: 1214145 - RNA, 24 nt, Human
gcaaaacagagcuccacugcccaa

SEQ ID NO: 1214146 - RNA, 26 nt, Human
gcaaaacagagcuccacugcccaaag

SEQ ID NO: 1214147 - RNA, 18 nt, Human
gcaccuggggcaggggca

SEQ ID NO: 1214148 - RNA, 19 nt, Human
gcccacacgcaaaauggac

SEQ ID NO: 1214149 - RNA, 19 nt, Human
gcccaggcuggagugcagu

SEQ ID NO: 1214150 - RNA, 23 nt, Human
gccgcuuuuccgacagaggccug

SEQ ID NO: 1214151 - RNA, 19 nt, Human
gccuuagcuucccaaguag

SEQ ID NO: 1214152 - RNA, 20 nt, Human
gcggcggcacaaggcccugg

SEQ ID NO: 1214153 - RNA, 21 nt, Human
gcggggggaagggcuggaagc

SEQ ID NO: 1214154 - RNA, 23 nt, Human
gcuggucucgaacuccuaaccuc

SEQ ID NO: 1214155 - RNA, 22 nt, Human
ggaaagucacaaagcaaugaaa

SEQ ID NO: 1214156 - RNA, 21 nt, Human
ggagagugaaaaagaaaguaa

SEQ ID NO: 1214157 - RNA, 19 nt, Human
ggauuacaggcuugagcca

SEQ ID NO: 1214158 - RNA, 23 nt, Human
ggcaggggcagagguguuguggg

SEQ ID NO: 1214159 - RNA, 18 nt, Human
ggcucaguguagcugugc

SEQ ID NO: 1214160 - RNA, 21 nt, Human
ggcuggaagcagcggugcugc

SEQ ID NO: 1214161 - RNA, 18 nt, Human
ggcuggccggcgggcgcc

SEQ ID NO: 1214162 - RNA, 18 nt, Human
gggaagggcuggaagcag

SEQ ID NO: 1214163 - RNA, 19 nt, Human
gggaagggcuggaagcagc

SEQ ID NO: 1214164 - RNA, 25 nt, Human
gggacaaaaaggccuucaaaaagga

SEQ ID NO: 1214165 - RNA, 19 nt, Human
ggggaagggcuggaagcag

SEQ ID NO: 1214166 - RNA, 21 nt, Human
ggggaagggcuggaagcagcg

SEQ ID NO: 1214167 - RNA, 19 nt, Human
ggguuuccccacguuggcc

SEQ ID NO: 1214168 - RNA, 21 nt, Human
guagcugugcuucuguccucg

SEQ ID NO: 1214169 - RNA, 24 nt, Human
gugauccacccgccgcggccuccc

SEQ ID NO: 1214170 - RNA, 24 nt, Human
guggccgcuuuuccgacagaggcc

SEQ ID NO: 1214171 - RNA, 26 nt, Human
guuggggucgcaguccugugggugac

SEQ ID NO: 1214172 - RNA, 18 nt, Human
uaaaacaaaagcaaaaca

SEQ ID NO: 1214173 - RNA, 19 nt, Human
uacaggcaccaaucacgcc

SEQ ID NO: 1214174 - RNA, 23 nt, Human
uacaggcuugagccaccacgccc

SEQ ID NO: 1214175 - RNA, 19 nt, Human
uaguagagacaggguuucc

SEQ ID NO: 1214176 - RNA, 24 nt, Human
uaguagagacaggguuuccccacg

SEQ ID NO: 1214177 - RNA, 21 nt, Human
uauaucacuugccuagaauuc

SEQ ID NO: 1214178 - RNA, 19 nt, Human
uaucgcccaggcuggagug

SEQ ID NO: 1214179 - RNA, 19 nt, Human
ucaagugauucuccugccu

SEQ ID NO: 1214180 - RNA, 19 nt, Human
ucacaaagcaaugaaaaaa

SEQ ID NO: 1214181 - RNA, 24 nt, Human
ucacuggaaccuccgccuccuggg

SEQ ID NO: 1214182 - RNA, 25 nt, Human
ucacuggaaccuccgccuccugggu

SEQ ID NO: 1214183 - RNA, 27 nt, Human
ucacuggaaccuccgccuccuggguuc

SEQ ID NO: 1214184 - RNA, 21 nt, Human
ucagagcaauccugggugcaa

SEQ ID NO: 1214185 - RNA, 22 nt, Human
ucagagcaauccugggugcaag

SEQ ID NO: 1214186 - RNA, 19 nt, Human
uccacccgccgcggccucc

SEQ ID NO: 1214187 - RNA, 24 nt, Human
ucccaaaguacugggauuacaggc

SEQ ID NO: 1214188 - RNA, 24 nt, Human
ucccaaguagcuuagauuacaggc

SEQ ID NO: 1214189 - RNA, 20 nt, Human
ucccccaguguggccgcuuu

SEQ ID NO: 1214190 - RNA, 20 nt, Human
ucccccaguguggccgcuuu

SEQ ID NO: 1214191 - RNA, 24 nt, Human
ucccucuaucgcccaggcuggagu

SEQ ID NO: 1214192 - RNA, 26 nt, Human
ucccugcaacaauccucaacuggccc

SEQ ID NO: 1214193 - RNA, 21 nt, Human
uccugggugcaaggcagaggc

SEQ ID NO: 1214194 - RNA, 21 nt, Human
uccuggguucaagugauucuc

SEQ ID NO: 1214195 - RNA, 24 nt, Human
uccuggguucaagugauucuccug

SEQ ID NO: 1214196 - RNA, 21 nt, Human
ucgcccaggcuggagugcagu

SEQ ID NO: 1214197 - RNA, 24 nt, Human
ucuaucgcccaggcuggagugcag

SEQ ID NO: 1214198 - RNA, 23 nt, Human
ucucccucuaucgcccaggcugg

SEQ ID NO: 1214199 - RNA, 24 nt, Human
ucucccucuaucgcccaggcugga

SEQ ID NO: 1214200 - RNA, 20 nt, Human
ugaaaaaaccaucuagaaaa

SEQ ID NO: 1214201 - RNA, 21 nt, Human
ugaaaaaaccaucuagaaaaa

SEQ ID NO: 1214202 - RNA, 23 nt, Human
ugaaaaagaaaguaacucucucg

SEQ ID NO: 1214203 - RNA, 20 nt, Human
ugaaaagauauuuaucucac

SEQ ID NO: 1214204 - RNA, 19 nt, Human
ugacucggcucagaagcag

SEQ ID NO: 1214205 - RNA, 19 nt, Human
ugagaccccagaaaccgga

SEQ ID NO: 1214206 - RNA, 20 nt, Human
ugccuuagcuucccaaguag

SEQ ID NO: 1214207 - RNA, 24 nt, Human
uggccaggcuggucucgaacuccu

SEQ ID NO: 1214208 - RNA, 18 nt, Human
ugggauuacaggcuugag

SEQ ID NO: 1214209 - RNA, 19 nt, Human
ugggauuacaggcuugagc

SEQ ID NO: 1214210 - RNA, 21 nt, Human
ugggauuacaggcuugagcca

SEQ ID NO: 1214211 - RNA, 22 nt, Human
ugggauuacaggcuugagccac

SEQ ID NO: 1214212 - RNA, 24 nt, Human
ugggauuacaggcuugagccacca

SEQ ID NO: 1214213 - RNA, 23 nt, Human
uggguucaagugauucuccugcc

SEQ ID NO: 1214214 - RNA, 18 nt, Human
uuaguagagacaggguuu

SEQ ID NO: 1214215 - RNA, 23 nt, Human
uucaagugauucuccugccuuag

SEQ ID NO: 1214216 - RNA, 24 nt, Human
uucaagugauucuccugccuuagc

SEQ ID NO: 1214217 - RNA, 21 nt, Human
uugcugccggguucucaucug

SEQ ID NO: 1214218 - RNA, 21 nt, Human
uuuuauagcaacgacaucuga

SEQ ID NO: 1214219 - RNA, 24 nt, Human
uuuucuggaugucaccaucuaaca

SEQ ID NO: 1214220 - RNA, 25 nt, Human
aaacacuagaacuugauuugaauaa

SEQ ID NO: 1214221 - RNA, 19 nt, Human
aacugcagcuucccaucuc

SEQ ID NO: 1214222 - RNA, 21 nt, Human
aagaaacauuucaaaaagagc

SEQ ID NO: 1214223 - RNA, 19 nt, Human
aagaaguauugcucaugaa

SEQ ID NO: 1214224 - RNA, 20 nt, Human
aaucuacuaagaaguauugc

SEQ ID NO: 1214225 - RNA, 21 nt, Human
acaaaacaaucuacuaagaag

SEQ ID NO: 1214226 - RNA, 22 nt, Human
acaaaacaaucuacuaagaagu

SEQ ID NO: 1214227 - RNA, 18 nt, Human
caacugaccauagacgcu

SEQ ID NO: 1214228 - RNA, 19 nt, Human
cagcaaccgugguccaugc

SEQ ID NO: 1214229 - RNA, 18 nt, Human
cauagacgcuccccaucc

SEQ ID NO: 1214230 - RNA, 19 nt, Human
caugcugccugcguccacc

SEQ ID NO: 1214231 - RNA, 21 nt, Human
cccauccgcccagcaaccgug

SEQ ID NO: 1214232 - RNA, 19 nt, Human
cccaucucaccacuucuaa

SEQ ID NO: 1214233 - RNA, 18 nt, Human
cccgcgcacagugcaccg

SEQ ID NO: 1214234 - RNA, 19 nt, Human
cccgcgcacagugcaccgc

SEQ ID NO: 1214235 - RNA, 26 nt, Human
cgcgcacagugcaccgcgccugcgca

SEQ ID NO: 1214236 - RNA, 28 nt, Human
cgcgcacagugcaccgcgccugcgcaug

SEQ ID NO: 1214237 - RNA, 26 nt, Human
cugccugcguccaccgccagcgucga

SEQ ID NO: 1214238 - RNA, 24 nt, Human
uccaccgccagcgucgaaaaaccg

SEQ ID NO: 1214239 - RNA, 19 nt, Human
ucgaaaaaccgccguggug

SEQ ID NO: 1214240 - RNA, 19 nt, Human
ugcugccugcguccaccgc

SEQ ID NO: 1214241 - RNA, 23 nt, Human
uuuuuuuuuuuuuuuuuauuuuu

SEQ ID NO: 1214242 - RNA, 22 nt, Human
agaaacacaaacucugucacca

SEQ ID NO: 1214243 - RNA, 18 nt, Human
caccacaguauugcugga

SEQ ID NO: 1214244 - RNA, 21 nt, Human
caccacaguauugcuggaauu

SEQ ID NO: 1214245 - RNA, 18 nt, Human
ggaauuguacguggcccu

SEQ ID NO: 1214246 - RNA, 19 nt, Human
gggaagcucagaaacacaa

SEQ ID NO: 1214247 - RNA, 21 nt, Human
uagcagcccuugaagauggug

SEQ ID NO: 1214248 - RNA, 24 nt, Human
ucagaaacacaaacucugucacca

SEQ ID NO: 1214249 - RNA, 25 nt, Human
ucagaaacacaaacucugucaccac

SEQ ID NO: 1214250 - RNA, 19 nt, Human
ugaccaaauagcagcccuu

SEQ ID NO: 1214251 - RNA, 19 nt, Human
ugaccaaauagcagcccuu

SEQ ID NO: 1214252 - RNA, 22 nt, Human
aagagauuacuuuuagaauccc

SEQ ID NO: 1214253 - RNA, 20 nt, Human
cagccacucuuccagugacu

SEQ ID NO: 1214254 - RNA, 23 nt, Human
uaagagauuacuuuuagaauccc

SEQ ID NO: 1214255 - RNA, 21 nt, Human
ucagccacucuuccagugacu

SEQ ID NO: 1214256 - RNA, 19 nt, Human
ucuccuaugagcuaaugag

SEQ ID NO: 1214257 - RNA, 21 nt, Human
uuuuagaaucccugaagccuu

SEQ ID NO: 1214258 - RNA, 23 nt, Human
aaagugauuugauuccuuguuuu

SEQ ID NO: 1214259 - RNA, 19 nt, Human
ugauggccucuuggcuuuu

SEQ ID NO: 1214260 - RNA, 21 nt, Human
uggcuuuuuuguuguauccaa

SEQ ID NO: 1214261 - RNA, 23 nt, Human
uuuuugauggccucuuggcuuuu

SEQ ID NO: 1214262 - RNA, 21 nt, Human
cuagcaacuuucuuuuguccu

SEQ ID NO: 1214263 - RNA, 21 nt, Human
gcaccuucucuuccuccucaa

SEQ ID NO: 1214264 - RNA, 18 nt, Human
uacccaaaugaaaugauu

SEQ ID NO: 1214265 - RNA, 18 nt, Human
ucagaggacaugcuacuu

SEQ ID NO: 1214266 - RNA, 24 nt, Human
ucaugcaggacaaaaauuuguaua

SEQ ID NO: 1214267 - RNA, 21 nt, Human
ucuccuguugcaccuucucuu

SEQ ID NO: 1214268 - RNA, 24 nt, Human
ucucucaaucuccuguugcaccuu

SEQ ID NO: 1214269 - RNA, 20 nt, Human
ucucuuccuccucaacucuc

SEQ ID NO: 1214270 - RNA, 21 nt, Human
ugcaucagaauacuccaguac

SEQ ID NO: 1214271 - RNA, 26 nt, Human
uuaaggcuaaaauuaaacaauuuuuu

SEQ ID NO: 1214272 - RNA, 19 nt, Human
uucccaguaagaaagaaaa

SEQ ID NO: 1214273 - RNA, 18 nt, Human
uuuggccuuguguuuucc

SEQ ID NO: 1214274 - RNA, 23 nt, Human
aaaagcaucacuacaagccacgg

SEQ ID NO: 1214275 - RNA, 18 nt, Human
aaaaugcucuucccaaaa

SEQ ID NO: 1214276 - RNA, 24 nt, Human
aaacagggugccacagcuuuccaa

SEQ ID NO: 1214277 - RNA, 23 nt, Human
aaaccugcacuuguacccccuga

SEQ ID NO: 1214278 - RNA, 25 nt, Human
aaaggacaaaaugcucuucccaaaa

SEQ ID NO: 1214279 - RNA, 22 nt, Human
aaauaguauauggaaaccaaga

SEQ ID NO: 1214280 - RNA, 24 nt, Human
aacagagucuuaacaacuccccaa

SEQ ID NO: 1214281 - RNA, 21 nt, Human
aaccucagcaucacucaauau

SEQ ID NO: 1214282 - RNA, 18 nt, Human
aacuuggcacuauuucug

SEQ ID NO: 1214283 - RNA, 20 nt, Human
aagcaguagaaaaaacagag

SEQ ID NO: 1214284 - RNA, 24 nt, Human
aauaguauauggaaaccaagauga

SEQ ID NO: 1214285 - RNA, 18 nt, Human
aaugauuaucuuaggguu

SEQ ID NO: 1214286 - RNA, 24 nt, Human
acacccaaacagggugccacagcu

SEQ ID NO: 1214287 - RNA, 21 nt, Human
acagcaaaaaggacaauuaga

SEQ ID NO: 1214288 - RNA, 24 nt, Human
acugaaacacuagaaaccaaagua

SEQ ID NO: 1214289 - RNA, 23 nt, Human
acugguguguuauuccuuccucg

SEQ ID NO: 1214290 - RNA, 18 nt, Human
agaaaacaggguagaugg

SEQ ID NO: 1214291 - RNA, 23 nt, Human
agaaaacaggguagaugggacac

SEQ ID NO: 1214292 - RNA, 22 nt, Human
agaagcuuuaaaacucuucuga

SEQ ID NO: 1214293 - RNA, 18 nt, Human
agagcaaaagagaaaugu

SEQ ID NO: 1214294 - RNA, 23 nt, Human
agagcagggagggagagaggagg

SEQ ID NO: 1214295 - RNA, 18 nt, Human
agcaacucccuaaagcaa

SEQ ID NO: 1214296 - RNA, 19 nt, Human
agcagacaugucuuuaugc

SEQ ID NO: 1214297 - RNA, 22 nt, Human
agcagggagggagagaggaggg

SEQ ID NO: 1214298 - RNA, 20 nt, Human
agccaagaacacaaccuaaa

SEQ ID NO: 1214299 - RNA, 26 nt, Human
aggaggcucuuuugggcagccugguu

SEQ ID NO: 1214300 - RNA, 19 nt, Human
agggagggagagaggaggg

SEQ ID NO: 1214301 - RNA, 19 nt, Human
agugaaugcaugaauggaa

SEQ ID NO: 1214302 - RNA, 21 nt, Human
auagauguagugaaaacuugg

SEQ ID NO: 1214303 - RNA, 23 nt, Human
auggggcaugguuaguuguggcc

SEQ ID NO: 1214304 - RNA, 19 nt, Human
auguuugucagugagaauu

SEQ ID NO: 1214305 - RNA, 18 nt, Human
auuagauacuaguuuuga

SEQ ID NO: 1214306 - RNA, 20 nt, Human
caaaacauaaaacugugagg

SEQ ID NO: 1214307 - RNA, 19 nt, Human
caaacagggugccacagcu

SEQ ID NO: 1214308 - RNA, 20 nt, Human
caaagcaauguaauacaggc

SEQ ID NO: 1214309 - RNA, 22 nt, Human
caaaguaguugggcuaggaggc

SEQ ID NO: 1214310 - RNA, 18 nt, Human
caacaaaaagaaacagcc

SEQ ID NO: 1214311 - RNA, 19 nt, Human
caagaacacaaccuaaaag

SEQ ID NO: 1214312 - RNA, 21 nt, Human
caccaggaaaauccucacaag

SEQ ID NO: 1214313 - RNA, 22 nt, Human
cacuacaagccacggacuccua

SEQ ID NO: 1214314 - RNA, 22 nt, Human
cagaagcuuuaaaacucuucug

SEQ ID NO: 1214315 - RNA, 20 nt, Human
cagaccagaauagacacugu

SEQ ID NO: 1214316 - RNA, 22 nt, Human
cagaggccauugaucaagguag

SEQ ID NO: 1214317 - RNA, 21 nt, Human
cagauugauguuccaaauacc

SEQ ID NO: 1214318 - RNA, 22 nt, Human
cagccuggucuucuaaaccaaa

SEQ ID NO: 1214319 - RNA, 23 nt, Human
cagccuggucuucuaaaccaaag

SEQ ID NO: 1214320 - RNA, 19 nt, Human
cagggguuauggauaaaau

SEQ ID NO: 1214321 - RNA, 20 nt, Human
caguuuaucuacagcuaccc

SEQ ID NO: 1214322 - RNA, 24 nt, Human
cauaguaacugaaacacuagaaac

SEQ ID NO: 1214323 - RNA, 19 nt, Human
cauauguaacacauauacc

SEQ ID NO: 1214324 - RNA, 18 nt, Human
ccaagaugagagcaaaag

SEQ ID NO: 1214325 - RNA, 18 nt, Human
ccacagcuuuccaacuua

SEQ ID NO: 1214326 - RNA, 22 nt, Human
ccacauaccacagcaaaaagga

SEQ ID NO: 1214327 - RNA, 20 nt, Human
ccaccuggugaugggaucug

SEQ ID NO: 1214328 - RNA, 21 nt, Human
ccuuggugugggaacaaaagu

SEQ ID NO: 1214329 - RNA, 22 nt, Human
cuaguaaaugacaaagccagaa

SEQ ID NO: 1214330 - RNA, 23 nt, Human
cucuuuugggcagccuggucuuc

SEQ ID NO: 1214331 - RNA, 25 nt, Human
cugcagaaacagaaaacaggguaga

SEQ ID NO: 1214332 - RNA, 18 nt, Human
cuguaccccaaaccucag

SEQ ID NO: 1214333 - RNA, 19 nt, Human
gagaauuugaaacaucugc

SEQ ID NO: 1214334 - RNA, 23 nt, Human
gagcagggagggagagaggaggg

SEQ ID NO: 1214335 - RNA, 21 nt, Human
gagccaagaacacaaccuaaa

SEQ ID NO: 1214336 - RNA, 19 nt, Human
gaugagagcaaaagaaaac

SEQ ID NO: 1214337 - RNA, 18 nt, Human
ggagaauaaauagaagau

SEQ ID NO: 1214338 - RNA, 18 nt, Human
gggugccacagcuuucca

SEQ ID NO: 1214339 - RNA, 20 nt, Human
gguuauggauaaaauaggag

SEQ ID NO: 1214340 - RNA, 21 nt, Human
guagaaauaaagggggaguac

SEQ ID NO: 1214341 - RNA, 23 nt, Human
gugaagcaguagaaaaaacagag

SEQ ID NO: 1214342 - RNA, 22 nt, Human
uaaaccaaaggacaaaaugcuc

SEQ ID NO: 1214343 - RNA, 22 nt, Human
uaacaacuccccaaagcaaugu

SEQ ID NO: 1214344 - RNA, 20 nt, Human
uaacaagaguccuaaaacag

SEQ ID NO: 1214345 - RNA, 18 nt, Human
uaacgguacugacaaacu

SEQ ID NO: 1214346 - RNA, 23 nt, Human
uaacugaaacacuagaaaccaaa

SEQ ID NO: 1214347 - RNA, 20 nt, Human
uaagugaaugaaaugccaca

SEQ ID NO: 1214348 - RNA, 20 nt, Human
uaccacagcaaaaaggacaa

SEQ ID NO: 1214349 - RNA, 21 nt, Human
uaccccaaaccucagcaucac

SEQ ID NO: 1214350 - RNA, 20 nt, Human
uacccccugaauuuguuccu

SEQ ID NO: 1214351 - RNA, 18 nt, Human
uagaugggacacccaaac

SEQ ID NO: 1214352 - RNA, 22 nt, Human
uagauguagugaaaacuuggca

SEQ ID NO: 1214353 - RNA, 22 nt, Human
uagcaacucccuaaagcaaugu

SEQ ID NO: 1214354 - RNA, 22 nt, Human
uagcaagugcauggcagacauu

SEQ ID NO: 1214355 - RNA, 24 nt, Human
uauacaagugguugcccuuuaaaa

SEQ ID NO: 1214356 - RNA, 18 nt, Human
uauuacagaugaugagua

SEQ ID NO: 1214357 - RNA, 20 nt, Human
ucacuacacuccgcagaggc

SEQ ID NO: 1214358 - RNA, 21 nt, Human
ucagcaucacucaauauacuc

SEQ ID NO: 1214359 - RNA, 23 nt, Human
ucaguaauaacaagaguccuaaa

SEQ ID NO: 1214360 - RNA, 24 nt, Human
ucaucccugacaaaaaacaaaaca

SEQ ID NO: 1214361 - RNA, 19 nt, Human
ucccagacacauaucaaau

SEQ ID NO: 1214362 - RNA, 25 nt, Human
ucccugacaaaaaacaaaacauaaa

SEQ ID NO: 1214363 - RNA, 19 nt, Human
ucuguaacagagucuggaa

SEQ ID NO: 1214364 - RNA, 23 nt, Human
ugaaugcaugaauggaaaaugga

SEQ ID NO: 1214365 - RNA, 21 nt, Human
ugacaaaaaacaaaacauaaa

SEQ ID NO: 1214366 - RNA, 22 nt, Human
ugacaaaaaacaaaacauaaaa

SEQ ID NO: 1214367 - RNA, 23 nt, Human
ugacaagaauuuuggggaaagug

SEQ ID NO: 1214368 - RNA, 23 nt, Human
ugaccuaaaauguuugucaguga

SEQ ID NO: 1214369 - RNA, 24 nt, Human
ugacuggccugggguaccagagcu

SEQ ID NO: 1214370 - RNA, 21 nt, Human
ugagagaaugagccaagaaca

SEQ ID NO: 1214371 - RNA, 19 nt, Human
ugaggaggggguggggcag

SEQ ID NO: 1214372 - RNA, 20 nt, Human
ugaggaggggguggggcagg

SEQ ID NO: 1214373 - RNA, 27 nt, Human
ugaggaggggguggggcaggauacuuu

SEQ ID NO: 1214374 - RNA, 22 nt, Human
ugagguauauucacuguugcua

SEQ ID NO: 1214375 - RNA, 18 nt, Human
ugauguuugugaccuguc

SEQ ID NO: 1214376 - RNA, 19 nt, Human
ugauuacuauuagaaacuc

SEQ ID NO: 1214377 - RNA, 26 nt, Human
ugauuagaucucacaaaaaaccaaaa

SEQ ID NO: 1214378 - RNA, 18 nt, Human
ugcauguguggcuauaca

SEQ ID NO: 1214379 - RNA, 26 nt, Human
ugcuauuucuaccauaauucuuauuc

SEQ ID NO: 1214380 - RNA, 23 nt, Human
ugcucuaggccucaguuuuauca

SEQ ID NO: 1214381 - RNA, 20 nt, Human
uggaaaauaaugaaauauua

SEQ ID NO: 1214382 - RNA, 21 nt, Human
uggaaaauaaugaaauauuag

SEQ ID NO: 1214383 - RNA, 20 nt, Human
uggagaaggaggaguggcca

SEQ ID NO: 1214384 - RNA, 18 nt, Human
uggaguggagaaggagga

SEQ ID NO: 1214385 - RNA, 25 nt, Human
uggcaagcaaugauggauuacauuu

SEQ ID NO: 1214386 - RNA, 20 nt, Human
ugggagaaccaccaaagugc

SEQ ID NO: 1214387 - RNA, 22 nt, Human
ugggaucuguaccccaaaccuc

SEQ ID NO: 1214388 - RNA, 19 nt, Human
ugguaagugacuggccugg

SEQ ID NO: 1214389 - RNA, 18 nt, Human
uggugugggaacaaaagu

SEQ ID NO: 1214390 - RNA, 20 nt, Human
uggugugggaacaaaaguuu

SEQ ID NO: 1214391 - RNA, 18 nt, Human
ugguuuucauaaaaaugg

SEQ ID NO: 1214392 - RNA, 23 nt, Human
uguaacacauauacccauguccc

SEQ ID NO: 1214393 - RNA, 27 nt, Human
uguaauacaggcagccuuugguuuuuu

SEQ ID NO: 1214394 - RNA, 19 nt, Human
uuagguacuaugcucaccu

SEQ ID NO: 1214395 - RNA, 21 nt, Human
uuaguuguggccagcuguuuu

SEQ ID NO: 1214396 - RNA, 20 nt, Human
uucaauuugagguauauucc

SEQ ID NO: 1214397 - RNA, 19 nt, Human
uucaucccugacaaaaaac

SEQ ID NO: 1214398 - RNA, 21 nt, Human
uucccuuaagugauaccacuc

SEQ ID NO: 1214399 - RNA, 21 nt, Human
uugaacaagccaucugcagaa

SEQ ID NO: 1214400 - RNA, 23 nt, Human
uugauuagaucucacaaaaaacc

SEQ ID NO: 1214401 - RNA, 21 nt, Human
uuguauuuauguuauucccag

SEQ ID NO: 1214402 - RNA, 20 nt, Human
uuuaaguaauuggcucucag

SEQ ID NO: 1214403 - RNA, 18 nt, Human
uuuaucuacagcuacccu

SEQ ID NO: 1214404 - RNA, 26 nt, Human
uuucagcaaucacuggauaugaucuu

SEQ ID NO: 1214405 - RNA, 20 nt, Human
uuuguuccuuggugugggaa

SEQ ID NO: 1214406 - RNA, 19 nt, Human
uuuucauuauguucuauga

SEQ ID NO: 1214407 - RNA, 22 nt, Human
aaccaccagagauggguuuuga

SEQ ID NO: 1214408 - RNA, 20 nt, Human
aggaacaggaagugaaagga

SEQ ID NO: 1214409 - RNA, 24 nt, Human
cacagcgcuuucugaaggaacagg

SEQ ID NO: 1214410 - RNA, 21 nt, Human
cccagucccggccccuccagc

SEQ ID NO: 1214411 - RNA, 19 nt, Human
ccccuccagcccggggccc

SEQ ID NO: 1214412 - RNA, 20 nt, Human
ccccuguggcuccacgucuu

SEQ ID NO: 1214413 - RNA, 25 nt, Human
ccgggcccacguagagaggggcugg

SEQ ID NO: 1214414 - RNA, 22 nt, Human
cucccgggcccacguagagagg

SEQ ID NO: 1214415 - RNA, 23 nt, Human
cuugcugucauucaaagccaaac

SEQ ID NO: 1214416 - RNA, 21 nt, Human
gaacaggaagugaaaggaagg

SEQ ID NO: 1214417 - RNA, 21 nt, Human
gaaggaacaggaagugaaagg

SEQ ID NO: 1214418 - RNA, 20 nt, Human
gaguauaggguaccacacag

SEQ ID NO: 1214419 - RNA, 21 nt, Human
gcuggggcacgcccugcaggg

SEQ ID NO: 1214420 - RNA, 20 nt, Human
ggagagaagcauguggcucu

SEQ ID NO: 1214421 - RNA, 18 nt, Human
gggcuggggcacgcccug

SEQ ID NO: 1214422 - RNA, 18 nt, Human
guagagaggggcuggggc

SEQ ID NO: 1214423 - RNA, 21 nt, Human
guggagagaagcauguggcuc

SEQ ID NO: 1214424 - RNA, 20 nt, Human
guggcuccacgucuuuaccc

SEQ ID NO: 1214425 - RNA, 21 nt, Human
uagaaaggacuggacaccacu

SEQ ID NO: 1214426 - RNA, 21 nt, Human
uauccauagaaguggagagaa

SEQ ID NO: 1214427 - RNA, 24 nt, Human
uaugagagaccgcguuaagcggca

SEQ ID NO: 1214428 - RNA, 19 nt, Human
ucaaagccaaaccaccaga

SEQ ID NO: 1214429 - RNA, 20 nt, Human
ucaauaguaagaaguaaggu

SEQ ID NO: 1214430 - RNA, 18 nt, Human
ucccggccccuccagccc

SEQ ID NO: 1214431 - RNA, 23 nt, Human
ucccggccccuccagcccggggc

SEQ ID NO: 1214432 - RNA, 20 nt, Human
ugaaggaacaggaagugaaa

SEQ ID NO: 1214433 - RNA, 19 nt, Human
ugacagggccccuguggcc

SEQ ID NO: 1214434 - RNA, 18 nt, Human
uggaaaagcacuuuccgg

SEQ ID NO: 1214435 - RNA, 21 nt, Human
uggcugaauaaacucagacac

SEQ ID NO: 1214436 - RNA, 20 nt, Human
ugucuuagucuucugggagu

SEQ ID NO: 1214437 - RNA, 22 nt, Human
uguggcucuuagaaaggacugg

SEQ ID NO: 1214438 - RNA, 22 nt, Human
uuuccggggaacugugguuucu

SEQ ID NO: 1214439 - RNA, 22 nt, Human
cccgugauugaugcagauaaac

SEQ ID NO: 1214440 - RNA, 20 nt, Human
aagcaggaggccuaacagac

SEQ ID NO: 1214441 - RNA, 19 nt, Human
aagcaggcagagcacacgg

SEQ ID NO: 1214442 - RNA, 22 nt, Human
aagcauucccugcagaggaggg

SEQ ID NO: 1214443 - RNA, 21 nt, Human
aaguggcugaggccacaggca

SEQ ID NO: 1214444 - RNA, 23 nt, Human
acccccaccagacccuuccagca

SEQ ID NO: 1214445 - RNA, 18 nt, Human
aggaagcaggcagagcac

SEQ ID NO: 1214446 - RNA, 19 nt, Human
agggaagggagggccugga

SEQ ID NO: 1214447 - RNA, 22 nt, Human
aggugccugguagagaccccag

SEQ ID NO: 1214448 - RNA, 18 nt, Human
cacuggucucacuccacg

SEQ ID NO: 1214449 - RNA, 19 nt, Human
cacuggucucacuccacgc

SEQ ID NO: 1214450 - RNA, 20 nt, Human
cagcaccacugguugcgcac

SEQ ID NO: 1214451 - RNA, 24 nt, Human
cagccuaagcguggcagagggaga

SEQ ID NO: 1214452 - RNA, 20 nt, Human
ccaacagcgaggaugguguc

SEQ ID NO: 1214453 - RNA, 18 nt, Human
ccaccagacccuuccagc

SEQ ID NO: 1214454 - RNA, 19 nt, Human
ccacgcccuucaccuagaa

SEQ ID NO: 1214455 - RNA, 22 nt, Human
cccacagacagagcugugaggc

SEQ ID NO: 1214456 - RNA, 20 nt, Human
cccccuguggggagggcagc

SEQ ID NO: 1214457 - RNA, 21 nt, Human
ccuaacccccagggccucaga

SEQ ID NO: 1214458 - RNA, 28 nt, Human
ccuauucacccccaccagacccuuccaa

SEQ ID NO: 1214459 - RNA, 19 nt, Human
ccucagaaugugaccuugu

SEQ ID NO: 1214460 - RNA, 22 nt, Human
cgagagccaguccuugcaggga

SEQ ID NO: 1214461 - RNA, 22 nt, Human
cgaggugccugguagagacccc

SEQ ID NO: 1214462 - RNA, 19 nt, Human
cgcccaucuuuccaacagc

SEQ ID NO: 1214463 - RNA, 22 nt, Human
cuaaccugggaccgaccuagga

SEQ ID NO: 1214464 - RNA, 18 nt, Human
cucacuccacgcccuuca

SEQ ID NO: 1214465 - RNA, 20 nt, Human
cucuguggacuggggagggg

SEQ ID NO: 1214466 - RNA, 21 nt, Human
cugcaguccuuacacagagug

SEQ ID NO: 1214467 - RNA, 23 nt, Human
gaagcaggcagagcacacggcgu

SEQ ID NO: 1214468 - RNA, 24 nt, Human
gagaugcaggccuguggggggcag

SEQ ID NO: 1214469 - RNA, 21 nt, Human
gauggcucuguggacugggga

SEQ ID NO: 1214470 - RNA, 19 nt, Human
gccagucacggccuugcca

SEQ ID NO: 1214471 - RNA, 25 nt, Human
gcucccacagacagagcugugaggc

SEQ ID NO: 1214472 - RNA, 19 nt, Human
ggaaugguugcagcgggga

SEQ ID NO: 1214473 - RNA, 19 nt, Human
ggacuggggaggggagcua

SEQ ID NO: 1214474 - RNA, 18 nt, Human
ggagacagaagcuguuac

SEQ ID NO: 1214475 - RNA, 19 nt, Human
ggagacugcaccccuuaac

SEQ ID NO: 1214476 - RNA, 20 nt, Human
ggcagccagccuccaggaag

SEQ ID NO: 1214477 - RNA, 21 nt, Human
ggccacacaggcuccguagcc

SEQ ID NO: 1214478 - RNA, 24 nt, Human
gggcuucuguggacggacgccagu

SEQ ID NO: 1214479 - RNA, 19 nt, Human
ggggaggggagcuaaggaa

SEQ ID NO: 1214480 - RNA, 20 nt, Human
uaaagguccguggaaaacua

SEQ ID NO: 1214481 - RNA, 19 nt, Human
uaggaggccguuuccccac

SEQ ID NO: 1214482 - RNA, 19 nt, Human
uccaugaaaaugcuggaag

SEQ ID NO: 1214483 - RNA, 21 nt, Human
uccguggaaaacuagggcagc

SEQ ID NO: 1214484 - RNA, 18 nt, Human
uccuuugcacaaaguggc

SEQ ID NO: 1214485 - RNA, 25 nt, Human
ucucacuccacgcccuucaccuaga

SEQ ID NO: 1214486 - RNA, 23 nt, Human
ugaaggccuaacccccagggccu

SEQ ID NO: 1214487 - RNA, 19 nt, Human
ugagagggcuucuguggac

SEQ ID NO: 1214488 - RNA, 23 nt, Human
ugaggccacaggcaugguggcca

SEQ ID NO: 1214489 - RNA, 24 nt, Human
ugcuggaagcauucccugcagagg

SEQ ID NO: 1214490 - RNA, 23 nt, Human
uggaagcauucccugcagaggag

SEQ ID NO: 1214491 - RNA, 22 nt, Human
uggaaugguugcagcggggaga

SEQ ID NO: 1214492 - RNA, 18 nt, Human
uggagggaagggagggcc

SEQ ID NO: 1214493 - RNA, 24 nt, Human
uggagguggccaugccugugagag

SEQ ID NO: 1214494 - RNA, 23 nt, Human
uggcucuguggacuggggagggg

SEQ ID NO: 1214495 - RNA, 19 nt, Human
uggggagggcagccagccu

SEQ ID NO: 1214496 - RNA, 22 nt, Human
uggggagggcagccagccucca

SEQ ID NO: 1214497 - RNA, 23 nt, Human
uggggaggggagcuaaggaacug

SEQ ID NO: 1214498 - RNA, 18 nt, Human
uggggggcagaacaggcu

SEQ ID NO: 1214499 - RNA, 20 nt, Human
uggggggcagaacaggcuuc

SEQ ID NO: 1214500 - RNA, 18 nt, Human
uguggggagggcagccag

SEQ ID NO: 1214501 - RNA, 19 nt, Human
uuaacacugagaugcaggc

SEQ ID NO: 1214502 - RNA, 18 nt, Human
uucaaacguccagcagca

SEQ ID NO: 1214503 - RNA, 23 nt, Human
uucacccccaccagacccuucca

SEQ ID NO: 1214504 - RNA, 21 nt, Human
uuccaacagcgaggauggugu

SEQ ID NO: 1214505 - RNA, 21 nt, Human
uuccacuggucucacuccacg

SEQ ID NO: 1214506 - RNA, 20 nt, Human
aggaggccgccgggccaggc

SEQ ID NO: 1214507 - RNA, 19 nt, Human
aggcagggcgccggcucuc

SEQ ID NO: 1214508 - RNA, 19 nt, Human
agggcaaaaggagccggcc

SEQ ID NO: 1214509 - RNA, 23 nt, Human
aggggaacaaaggggccagcggg

SEQ ID NO: 1214510 - RNA, 18 nt, Human
ccccgccgccggcagggc

SEQ ID NO: 1214511 - RNA, 22 nt, Human
ccccgggaggggaacaaagggg

SEQ ID NO: 1214512 - RNA, 21 nt, Human
cccgggagcugcgcccggaac

SEQ ID NO: 1214513 - RNA, 22 nt, Human
cgaaggccuggcagcgaacccu

SEQ ID NO: 1214514 - RNA, 20 nt, Human
cggcagcagccuggccgacu

SEQ ID NO: 1214515 - RNA, 22 nt, Human
gaacucgaaggccuggcagcga

SEQ ID NO: 1214516 - RNA, 20 nt, Human
gcagcagcaagccuucgugc

SEQ ID NO: 1214517 - RNA, 23 nt, Human
gccccgggaggggaacaaagggg

SEQ ID NO: 1214518 - RNA, 22 nt, Human
ggagcugcgcccggaacucgaa

SEQ ID NO: 1214519 - RNA, 22 nt, Human
ggccaggcagggcgccggcucu

SEQ ID NO: 1214520 - RNA, 18 nt, Human
gggaacaaaggggccagc

SEQ ID NO: 1214521 - RNA, 18 nt, Human
gggaagucggcagcagcc

SEQ ID NO: 1214522 - RNA, 21 nt, Human
guucuggagaagcagcagcaa

SEQ ID NO: 1214523 - RNA, 23 nt, Human
uggagaagcagcagcaagccuuc

SEQ ID NO: 1214524 - RNA, 19 nt, Human
uggcagcgaacccuucuca

SEQ ID NO: 1214525 - RNA, 19 nt, Human
uggccgaccucacucggcg

SEQ ID NO: 1214526 - RNA, 21 nt, Human
uuugcugugucuacgaggaag

SEQ ID NO: 1214527 - RNA, 24 nt, Human
aaccaccagccucaaagacugcuc

SEQ ID NO: 1214528 - RNA, 24 nt, Human
aagguaagcacacaauucaaacca

SEQ ID NO: 1214529 - RNA, 19 nt, Human
aauucaaaccaccagccuc

SEQ ID NO: 1214530 - RNA, 21 nt, Human
cacaauucaaaccaccagccu

SEQ ID NO: 1214531 - RNA, 20 nt, Human
cacacaauucaaaccaccag

SEQ ID NO: 1214532 - RNA, 21 nt, Human
ccucaaagacugcuccugacu

SEQ ID NO: 1214533 - RNA, 23 nt, Human
cuuuacacacuguucggcuaagu

SEQ ID NO: 1214534 - RNA, 22 nt, Human
gccucaaagacugcuccugacu

SEQ ID NO: 1214535 - RNA, 21 nt, Human
gucacgaaugaagguaagcac

SEQ ID NO: 1214536 - RNA, 22 nt, Human
uaagaguacuguccgaaaacua

SEQ ID NO: 1214537 - RNA, 21 nt, Human
uaagcacacaauucaaaccac

SEQ ID NO: 1214538 - RNA, 23 nt, Human
uaagcacacaauucaaaccacca

SEQ ID NO: 1214539 - RNA, 21 nt, Human
uccacugucacgaaugaaggu

SEQ ID NO: 1214540 - RNA, 22 nt, Human
ugaagguaagcacacaauucaa

SEQ ID NO: 1214541 - RNA, 23 nt, Human
ugaagguaagcacacaauucaaa

SEQ ID NO: 1214542 - RNA, 19 nt, Human
augaauagcaauuucuccu

SEQ ID NO: 1214543 - RNA, 23 nt, Human
caaaaccagguaaaucuucuuuc

SEQ ID NO: 1214544 - RNA, 24 nt, Human
caaaaccagguaaaucuucuuuca

SEQ ID NO: 1214545 - RNA, 21 nt, Human
cccuuaugaucugcaaagcca

SEQ ID NO: 1214546 - RNA, 19 nt, Human
ucaaauacaaaaccaggua

SEQ ID NO: 1214547 - RNA, 21 nt, Human
ucuggcuagcugauccaaaaa

SEQ ID NO: 1214548 - RNA, 19 nt, Human
ugaauuaugaauagcaauu

SEQ ID NO: 1214549 - RNA, 24 nt, Human
uguuugguuccucuauuagauuca

SEQ ID NO: 1214550 - RNA, 18 nt, Human
uuggccucgagcucuuug

SEQ ID NO: 1214551 - RNA, 24 nt, Human
aaaaaacacaugaagggcauucau

SEQ ID NO: 1214552 - RNA, 18 nt, Human
aaaaaaccagcuccugga

SEQ ID NO: 1214553 - RNA, 21 nt, Human
aaaaauguauauucuguugau

SEQ ID NO: 1214554 - RNA, 20 nt, Human
aaagcagcacccagagcuug

SEQ ID NO: 1214555 - RNA, 20 nt, Human
aaaugugucccagagauucu

SEQ ID NO: 1214556 - RNA, 20 nt, Human
aacaaagcagcacccagagc

SEQ ID NO: 1214557 - RNA, 21 nt, Human
aagaaaaaaacacaugaaggg

SEQ ID NO: 1214558 - RNA, 22 nt, Human
aagaaaaaaacacaugaagggc

SEQ ID NO: 1214559 - RNA, 18 nt, Human
acaaagcagcacccagag

SEQ ID NO: 1214560 - RNA, 19 nt, Human
acuguggucugagagacag

SEQ ID NO: 1214561 - RNA, 19 nt, Human
agagaaccuggcucugucc

SEQ ID NO: 1214562 - RNA, 21 nt, Human
agcagucugaaggggccaugg

SEQ ID NO: 1214563 - RNA, 19 nt, Human
agcuguggaaaccaggacc

SEQ ID NO: 1214564 - RNA, 22 nt, Human
aggcagggccuggcucucugug

SEQ ID NO: 1214565 - RNA, 22 nt, Human
aggccuccagccccgccgguuu

SEQ ID NO: 1214566 - RNA, 21 nt, Human
agggcaggugagcccuggggc

SEQ ID NO: 1214567 - RNA, 22 nt, Human
aggucccauggaggagcagccu

SEQ ID NO: 1214568 - RNA, 22 nt, Human
auggaggagcagccugagaaca

SEQ ID NO: 1214569 - RNA, 22 nt, Human
auucugggccuuuuccugggca

SEQ ID NO: 1214570 - RNA, 19 nt, Human
caaaaaaccagcuccugga

SEQ ID NO: 1214571 - RNA, 18 nt, Human
caaagcagcacccagagc

SEQ ID NO: 1214572 - RNA, 23 nt, Human
caaagcagcacccagagcuuguu

SEQ ID NO: 1214573 - RNA, 19 nt, Human
caauacugaaaaucaagca

SEQ ID NO: 1214574 - RNA, 18 nt, Human
cacaccaugguccaggug

SEQ ID NO: 1214575 - RNA, 18 nt, Human
cacugcacugccaggggc

SEQ ID NO: 1214576 - RNA, 21 nt, Human
cacugcuuuaaauguguccca

SEQ ID NO: 1214577 - RNA, 18 nt, Human
cagagcucagguccaugc

SEQ ID NO: 1214578 - RNA, 21 nt, Human
caggagcagguuguucgguuu

SEQ ID NO: 1214579 - RNA, 23 nt, Human
caggcagcacagcccugcuccug

SEQ ID NO: 1214580 - RNA, 18 nt, Human
cagggccuggcucucugu

SEQ ID NO: 1214581 - RNA, 18 nt, Human
caggggugccccaggggg

SEQ ID NO: 1214582 - RNA, 24 nt, Human
cagguaccaucaaaugcuguguac

SEQ ID NO: 1214583 - RNA, 20 nt, Human
cagguccaugcucaggcucu

SEQ ID NO: 1214584 - RNA, 18 nt, Human
cagugcuugcucacauuc

SEQ ID NO: 1214585 - RNA, 21 nt, Human
caucugugcuccugaugcagg

SEQ ID NO: 1214586 - RNA, 21 nt, Human
ccaacacugcacugccagggg

SEQ ID NO: 1214587 - RNA, 22 nt, Human
ccacuagaccccuaaaaauggg

SEQ ID NO: 1214588 - RNA, 25 nt, Human
ccagagcucagguccaugcucaggc

SEQ ID NO: 1214589 - RNA, 25 nt, Human
ccagccccgccgguuucccccaucu

SEQ ID NO: 1214590 - RNA, 27 nt, Human
ccagccccgccgguuucccccaucugu

SEQ ID NO: 1214591 - RNA, 18 nt, Human
ccaugcucaggcucuggg

SEQ ID NO: 1214592 - RNA, 20 nt, Human
cccaaguaaaugaauccaau

SEQ ID NO: 1214593 - RNA, 22 nt, Human
ccccaggcagcacagcccugcu

SEQ ID NO: 1214594 - RNA, 20 nt, Human
cccugggggagggucagggg

SEQ ID NO: 1214595 - RNA, 20 nt, Human
ccgguuucccccaucugugc

SEQ ID NO: 1214596 - RNA, 20 nt, Human
ccuagcucaugacccuggcc

SEQ ID NO: 1214597 - RNA, 20 nt, Human
ccuucaccuucugcugaggg

SEQ ID NO: 1214598 - RNA, 21 nt, Human
ccuucugcuagcuuuugaaug

SEQ ID NO: 1214599 - RNA, 27 nt, Human
cggggcccggggaagguguaggugcug

SEQ ID NO: 1214600 - RNA, 23 nt, Human
cgugcagccucuugauggccccg

SEQ ID NO: 1214601 - RNA, 24 nt, Human
cuagucaaagaaaaaaacacauga

SEQ ID NO: 1214602 - RNA, 18 nt, Human
cuggagcucacgugcagc

SEQ ID NO: 1214603 - RNA, 21 nt, Human
cugucuagaagccccacagcu

SEQ ID NO: 1214604 - RNA, 18 nt, Human
cuugcuucucuaguucuu

SEQ ID NO: 1214605 - RNA, 23 nt, Human
cuuuauuuguuucuuuguucagu

SEQ ID NO: 1214606 - RNA, 21 nt, Human
gaaaaaaacacaugaagggca

SEQ ID NO: 1214607 - RNA, 24 nt, Human
gaaaggcaagcucaucccugcagg

SEQ ID NO: 1214608 - RNA, 28 nt, Human
gaauaggugugguguggugacgaccucg

SEQ ID NO: 1214609 - RNA, 22 nt, Human
gagcagucugaaggggccaugg

SEQ ID NO: 1214610 - RNA, 23 nt, Human
gagcuuguuuuuuuuagagaacc

SEQ ID NO: 1214611 - RNA, 22 nt, Human
gaugcagggggaggacuguauu

SEQ ID NO: 1214612 - RNA, 20 nt, Human
gcaauacugaaaaucaagcc

SEQ ID NO: 1214613 - RNA, 20 nt, Human
gcagaacuuucuauaaacca

SEQ ID NO: 1214614 - RNA, 23 nt, Human
gcaggugagcccuggggcugacc

SEQ ID NO: 1214615 - RNA, 21 nt, Human
gccccuucuuccccaggcagc

SEQ ID NO: 1214616 - RNA, 21 nt, Human
gcccggggaagguguaggugc

SEQ ID NO: 1214617 - RNA, 21 nt, Human
gccugaagcugccaguguuug

SEQ ID NO: 1214618 - RNA, 19 nt, Human
gcugugcagcucuggagcu

SEQ ID NO: 1214619 - RNA, 21 nt, Human
gcuugcucacauucuucaauu

SEQ ID NO: 1214620 - RNA, 22 nt, Human
ggagcuguugcggggcccgggg

SEQ ID NO: 1214621 - RNA, 25 nt, Human
ggcccugggggagggucaggggugc

SEQ ID NO: 1214622 - RNA, 21 nt, Human
ggccuccagccccgccgguuu

SEQ ID NO: 1214623 - RNA, 21 nt, Human
gggagcagcugugcagcucug

SEQ ID NO: 1214624 - RNA, 18 nt, Human
ggggaagguguaggugcu

SEQ ID NO: 1214625 - RNA, 19 nt, Human
guacugagaggcgcuugcg

SEQ ID NO: 1214626 - RNA, 20 nt, Human
gucauucaggagcagguugu

SEQ ID NO: 1214627 - RNA, 27 nt, Human
guccuguggcugccacccauuucaggg

SEQ ID NO: 1214628 - RNA, 21 nt, Human
gugcaguugucccagccuggc

SEQ ID NO: 1214629 - RNA, 21 nt, Human
guggagcgcgcagccugggcc

SEQ ID NO: 1214630 - RNA, 19 nt, Human
gugguguaacccaggcccu

SEQ ID NO: 1214631 - RNA, 25 nt, Human
guucuuuuccauuugcugaggagug

SEQ ID NO: 1214632 - RNA, 21 nt, Human
uaaaccacauguggagagcuu

SEQ ID NO: 1214633 - RNA, 20 nt, Human
uaaaccaucccguggccccu

SEQ ID NO: 1214634 - RNA, 18 nt, Human
uaacccaggcccucgccc

SEQ ID NO: 1214635 - RNA, 23 nt, Human
uagagccccuucuuccccaggca

SEQ ID NO: 1214636 - RNA, 21 nt, Human
uagggcucccgcacuugucca

SEQ ID NO: 1214637 - RNA, 18 nt, Human
uagggugucaauuuuaga

SEQ ID NO: 1214638 - RNA, 24 nt, Human
uagugcuauaaauuucccucuaca

SEQ ID NO: 1214639 - RNA, 19 nt, Human
uauaaucaaagcucagagc

SEQ ID NO: 1214640 - RNA, 23 nt, Human
uauaaucaaagcucagagccaag

SEQ ID NO: 1214641 - RNA, 18 nt, Human
ucaaagaaaaaaacacau

SEQ ID NO: 1214642 - RNA, 21 nt, Human
ucaaagcucagagccaaggcc

SEQ ID NO: 1214643 - RNA, 25 nt, Human
ucacgugcagccucuugauggcccc

SEQ ID NO: 1214644 - RNA, 19 nt, Human
ucagggccuggugcaguug

SEQ ID NO: 1214645 - RNA, 23 nt, Human
ucaugacccuggcaaagggcagg

SEQ ID NO: 1214646 - RNA, 21 nt, Human
ucauucaggagcagguuguuc

SEQ ID NO: 1214647 - RNA, 21 nt, Human
uccaagcaccugugacuccca

SEQ ID NO: 1214648 - RNA, 24 nt, Human
uccacaguaaaccacauguggaga

SEQ ID NO: 1214649 - RNA, 28 nt, Human
uccagguaccaucaaaugcuguguacug

SEQ ID NO: 1214650 - RNA, 24 nt, Human
ucccagagauucugguauguugug

SEQ ID NO: 1214651 - RNA, 19 nt, Human
ucccagccuggcaggcagu

SEQ ID NO: 1214652 - RNA, 21 nt, Human
uccccaggcagcacagcccug

SEQ ID NO: 1214653 - RNA, 24 nt, Human
uccccaggcagcacagcccugcuc

SEQ ID NO: 1214654 - RNA, 27 nt, Human
uccccaggcagcacagcccugcuccug

SEQ ID NO: 1214655 - RNA, 21 nt, Human
ucccucuacacacugcuuuaa

SEQ ID NO: 1214656 - RNA, 27 nt, Human
ucccugcagguuuaguuguuucuguua

SEQ ID NO: 1214657 - RNA, 26 nt, Human
uccuuggucuagggcucccgcacuug

SEQ ID NO: 1214658 - RNA, 20 nt, Human
ucuguucuuuuccauuugcu

SEQ ID NO: 1214659 - RNA, 20 nt, Human
ucuugcuucucuaguucuuu

SEQ ID NO: 1214660 - RNA, 21 nt, Human
ucuuuguucucauugguuuca

SEQ ID NO: 1214661 - RNA, 18 nt, Human
ugaagggagcagucugaa

SEQ ID NO: 1214662 - RNA, 18 nt, Human
ugaaggguuuuuuguguc

SEQ ID NO: 1214663 - RNA, 24 nt, Human
ugacccccuggugguguaacccag

SEQ ID NO: 1214664 - RNA, 22 nt, Human
ugacucccaggccuccagcccc

SEQ ID NO: 1214665 - RNA, 21 nt, Human
ugagauccaugagccagagcu

SEQ ID NO: 1214666 - RNA, 21 nt, Human
ugagugaguuucuuaauccug

SEQ ID NO: 1214667 - RNA, 20 nt, Human
ugaugcagggggaggacugu

SEQ ID NO: 1214668 - RNA, 23 nt, Human
ugaugcagggggaggacuguauu

SEQ ID NO: 1214669 - RNA, 21 nt, Human
ugauuuggagcaggggcgggg

SEQ ID NO: 1214670 - RNA, 20 nt, Human
ugcacagaccacuagacccc

SEQ ID NO: 1214671 - RNA, 24 nt, Human
ugccccagggggugcgccccaucc

SEQ ID NO: 1214672 - RNA, 24 nt, Human
ugcucacuguguuaaaggcuuuau

SEQ ID NO: 1214673 - RNA, 18 nt, Human
ugcuccugcucacaccau

SEQ ID NO: 1214674 - RNA, 18 nt, Human
ugcuuuucucuccccucc

SEQ ID NO: 1214675 - RNA, 20 nt, Human
uggaaaccaggaccuccugc

SEQ ID NO: 1214676 - RNA, 22 nt, Human
uggaaaccaggaccuccugcuu

SEQ ID NO: 1214677 - RNA, 18 nt, Human
uggaggagcagccugaga

SEQ ID NO: 1214678 - RNA, 23 nt, Human
ugggauuuguaggcagggccugg

SEQ ID NO: 1214679 - RNA, 25 nt, Human
ugggcagaacuuucuauaaaccauc

SEQ ID NO: 1214680 - RNA, 23 nt, Human
ugggccuagcucaugacccuggc

SEQ ID NO: 1214681 - RNA, 19 nt, Human
ugguauguugugucuuugu

SEQ ID NO: 1214682 - RNA, 23 nt, Human
ugguauguugugucuuuguucuc

SEQ ID NO: 1214683 - RNA, 18 nt, Human
uguaggcagggccuggcu

SEQ ID NO: 1214684 - RNA, 23 nt, Human
uguaggugcugugucuuugcuca

SEQ ID NO: 1214685 - RNA, 21 nt, Human
ugucuagaagccccacagcug

SEQ ID NO: 1214686 - RNA, 25 nt, Human
ugucugguuuuucaaaggugaaggg

SEQ ID NO: 1214687 - RNA, 22 nt, Human
uguggagcgcgcagccugggcc

SEQ ID NO: 1214688 - RNA, 24 nt, Human
uguguacugagaggcgcuugcgua

SEQ ID NO: 1214689 - RNA, 19 nt, Human
uguugauuuugguggagag

SEQ ID NO: 1214690 - RNA, 23 nt, Human
uuacacaguucugggacaaaacu

SEQ ID NO: 1214691 - RNA, 21 nt, Human
uuagagaaccuggcucugucc

SEQ ID NO: 1214692 - RNA, 21 nt, Human
uucaaaaaaccagcuccugga

SEQ ID NO: 1214693 - RNA, 20 nt, Human
uuccaggaacagaagcaucc

SEQ ID NO: 1214694 - RNA, 24 nt, Human
uugcacuguggucugagagacagu

SEQ ID NO: 1214695 - RNA, 21 nt, Human
uugcuagcggucuaucaauau

SEQ ID NO: 1214696 - RNA, 24 nt, Human
uugcugaggagugcuuuacuucca

SEQ ID NO: 1214697 - RNA, 19 nt, Human
uuuccaggaacagaagcau

SEQ ID NO: 1214698 - RNA, 23 nt, Human
uuucuguucuuuuccauuugcuc

SEQ ID NO: 1214699 - RNA, 24 nt, Human
aaaaggagaaaaacgacgaaaaaa

SEQ ID NO: 1214700 - RNA, 18 nt, Human
aaacaccgccgacuucua

SEQ ID NO: 1214701 - RNA, 21 nt, Human
aaaggagaaaaacgacgaaaa

SEQ ID NO: 1214702 - RNA, 21 nt, Human
aauugucauccccugcaucuc

SEQ ID NO: 1214703 - RNA, 18 nt, Human
agacgugaaaucugugac

SEQ ID NO: 1214704 - RNA, 21 nt, Human
aggaaaaacaaauggaaaaag

SEQ ID NO: 1214705 - RNA, 23 nt, Human
aggaaaaacaaauggaaaaagga

SEQ ID NO: 1214706 - RNA, 21 nt, Human
aggagaaaaacgacgaaaaaa

SEQ ID NO: 1214707 - RNA, 22 nt, Human
aggagaaaaacgacgaaaaaag

SEQ ID NO: 1214708 - RNA, 18 nt, Human
agguuacucaggacucug

SEQ ID NO: 1214709 - RNA, 22 nt, Human
caaaagaagcaccagaucggug

SEQ ID NO: 1214710 - RNA, 24 nt, Human
cagcuucagcucuuucugagacuu

SEQ ID NO: 1214711 - RNA, 23 nt, Human
ccagccaucucccaaaauuguca

SEQ ID NO: 1214712 - RNA, 22 nt, Human
cccugcaucucacagggaaaac

SEQ ID NO: 1214713 - RNA, 19 nt, Human
cugacccugguucagccuc

SEQ ID NO: 1214714 - RNA, 22 nt, Human
cugaucaccgaauggaaacacu

SEQ ID NO: 1214715 - RNA, 20 nt, Human
gaccaugguugaggaauuuu

SEQ ID NO: 1214716 - RNA, 21 nt, Human
guaaauggauuaggaacaaaa

SEQ ID NO: 1214717 - RNA, 18 nt, Human
gucagcgucaaucugcau

SEQ ID NO: 1214718 - RNA, 18 nt, Human
ucacggaggucccugucc

SEQ ID NO: 1214719 - RNA, 20 nt, Human
uccccugcaucucacagggg

SEQ ID NO: 1214720 - RNA, 24 nt, Human
ucugugaccaggauccauaaagac

SEQ ID NO: 1214721 - RNA, 22 nt, Human
ugagacuucuagccugcacuua

SEQ ID NO: 1214722 - RNA, 21 nt, Human
uggaaaaaggagaaaaacgac

SEQ ID NO: 1214723 - RNA, 22 nt, Human
uggauuaggaacaaaagaagca

SEQ ID NO: 1214724 - RNA, 22 nt, Human
uuaagcagcuucagcucuuucu

SEQ ID NO: 1214725 - RNA, 19 nt, Human
acaaaguauuugguagguu

SEQ ID NO: 1214726 - RNA, 18 nt, Human
acccaaugguuugaugau

SEQ ID NO: 1214727 - RNA, 20 nt, Human
caccgcggccccgcccgggc

SEQ ID NO: 1214728 - RNA, 25 nt, Human
ccgccgggagguugguuagugcccg

SEQ ID NO: 1214729 - RNA, 21 nt, Human
cgggauuauucugaaagucac

SEQ ID NO: 1214730 - RNA, 21 nt, Human
gacgcgaaggcaucccaggga

SEQ ID NO: 1214731 - RNA, 21 nt, Human
ggccgaauaacgagcucaccg

SEQ ID NO: 1214732 - RNA, 23 nt, Human
uaaaaacaaaguuaguuacaaag

SEQ ID NO: 1214733 - RNA, 20 nt, Human
uaaaaggaaagcucucuuac

SEQ ID NO: 1214734 - RNA, 19 nt, Human
ugcggaggcagaaaagcug

SEQ ID NO: 1214735 - RNA, 18 nt, Human
uuaauccauggauucauu

SEQ ID NO: 1214736 - RNA, 24 nt, Human
cacccacacagguagaaaccagcg

SEQ ID NO: 1214737 - RNA, 20 nt, Human
uauccaaaccuucuucaccc

SEQ ID NO: 1214738 - RNA, 22 nt, Human
ucaaaacauauuauaagaucaa

SEQ ID NO: 1214739 - RNA, 19 nt, Human
ugggcucuucugggaauca

SEQ ID NO: 1214740 - RNA, 19 nt, Human
aaucaaugugucuguggug

SEQ ID NO: 1214741 - RNA, 21 nt, Human
accgccauccaccggcugguc

SEQ ID NO: 1214742 - RNA, 23 nt, Human
cacugggacccgguccgccccga

SEQ ID NO: 1214743 - RNA, 21 nt, Human
caggagugaccacugggaccc

SEQ ID NO: 1214744 - RNA, 19 nt, Human
cagggacaggagugaccac

SEQ ID NO: 1214745 - RNA, 19 nt, Human
ccacugggacccgguccgc

SEQ ID NO: 1214746 - RNA, 21 nt, Human
ccacugggacccgguccgccc

SEQ ID NO: 1214747 - RNA, 20 nt, Human
ccccagggacaggagugacc

SEQ ID NO: 1214748 - RNA, 18 nt, Human
cgccccccauuccccacc

SEQ ID NO: 1214749 - RNA, 25 nt, Human
cgggaguggcuaaaccccagggaca

SEQ ID NO: 1214750 - RNA, 20 nt, Human
cugaaaccuaagauuagcaa

SEQ ID NO: 1214751 - RNA, 21 nt, Human
cugauugauggcuaucuuucc

SEQ ID NO: 1214752 - RNA, 20 nt, Human
cuggucucagggauucagaa

SEQ ID NO: 1214753 - RNA, 22 nt, Human
gccauccaccggcuggucucag

SEQ ID NO: 1214754 - RNA, 21 nt, Human
ggcgccccccauuccccaccc

SEQ ID NO: 1214755 - RNA, 24 nt, Human
gggaguggcuaaaccccagggaca

SEQ ID NO: 1214756 - RNA, 21 nt, Human
ucagaaaaacuacaugagaua

SEQ ID NO: 1214757 - RNA, 23 nt, Human
uccccacccgucaccgccaucca

SEQ ID NO: 1214758 - RNA, 19 nt, Human
uugguugggaagaaugggg

SEQ ID NO: 1214759 - RNA, 18 nt, Human
acuagacuuaucucuauu

SEQ ID NO: 1214760 - RNA, 22 nt, Human
acuuugcagaaaugaagagaaa

SEQ ID NO: 1214761 - RNA, 19 nt, Human
aggaaacugggugaaaggg

SEQ ID NO: 1214762 - RNA, 20 nt, Human
cagcaagaaucgggaggaaa

SEQ ID NO: 1214763 - RNA, 20 nt, Human
gaaaggcugcgaggcuugag

SEQ ID NO: 1214764 - RNA, 24 nt, Human
guaacuuugcagaaaugaagagaa

SEQ ID NO: 1214765 - RNA, 24 nt, Human
ucgagaaccgcuucccaauuuugu

SEQ ID NO: 1214766 - RNA, 21 nt, Human
ugaggugggcaaaaugcaaac

SEQ ID NO: 1214767 - RNA, 22 nt, Human
ugaggugggcaaaaugcaaacu

SEQ ID NO: 1214768 - RNA, 21 nt, Human
ugcaaacuuuucucugggauc

SEQ ID NO: 1214769 - RNA, 19 nt, Human
uguacuagacuuaucucua

SEQ ID NO: 1214770 - RNA, 21 nt, Human
uuucuucacaacucacugcaa

SEQ ID NO: 1214771 - RNA, 19 nt, Human
uuuguacuagacuuaucuc

SEQ ID NO: 1214772 - RNA, 21 nt, Human
aacacagccagcagaagacac

SEQ ID NO: 1214773 - RNA, 21 nt, Human
aacagcucagcucccaaccuc

SEQ ID NO: 1214774 - RNA, 22 nt, Human
aaccagggaugagaacagcuca

SEQ ID NO: 1214775 - RNA, 24 nt, Human
aacccgaugccauaauuucugguc

SEQ ID NO: 1214776 - RNA, 22 nt, Human
aagaaccuggaguccgauguua

SEQ ID NO: 1214777 - RNA, 19 nt, Human
aagaagaaaggaagagaaa

SEQ ID NO: 1214778 - RNA, 24 nt, Human
aagaagaaaggaagagaaaugcaa

SEQ ID NO: 1214779 - RNA, 18 nt, Human
aagacaggagguagcccu

SEQ ID NO: 1214780 - RNA, 24 nt, Human
aagaggcaaauacugaaaaucagg

SEQ ID NO: 1214781 - RNA, 21 nt, Human
aagcccaagagcugggccccg

SEQ ID NO: 1214782 - RNA, 19 nt, Human
aagccccacagcccccuca

SEQ ID NO: 1214783 - RNA, 23 nt, Human
aagcuccaccccucacuccaggu

SEQ ID NO: 1214784 - RNA, 23 nt, Human
aagcuccucccugccgugccccg

SEQ ID NO: 1214785 - RNA, 22 nt, Human
aaggaaccagggaugagaacag

SEQ ID NO: 1214786 - RNA, 22 nt, Human
aaggccccacauccauugagaa

SEQ ID NO: 1214787 - RNA, 23 nt, Human
aaucaaguaagccccgcagacca

SEQ ID NO: 1214788 - RNA, 19 nt, Human
aaucaaguugacacucagu

SEQ ID NO: 1214789 - RNA, 24 nt, Human
aaucaggguucccucuccccaaga

SEQ ID NO: 1214790 - RNA, 21 nt, Human
aaugcccucacagacacuucc

SEQ ID NO: 1214791 - RNA, 26 nt, Human
aauggaggauggaggacagcgagaag

SEQ ID NO: 1214792 - RNA, 21 nt, Human
acaagacuccacaaggacagc

SEQ ID NO: 1214793 - RNA, 24 nt, Human
acacugaggucuuccaugcagcca

SEQ ID NO: 1214794 - RNA, 22 nt, Human
acagccccugccucuagccauu

SEQ ID NO: 1214795 - RNA, 21 nt, Human
acaguacccuggcccuucuca

SEQ ID NO: 1214796 - RNA, 24 nt, Human
accagcuggccacgcaacaggucu

SEQ ID NO: 1214797 - RNA, 18 nt, Human
acccagaaauucccagca

SEQ ID NO: 1214798 - RNA, 20 nt, Human
accuaucccugcuucucccu

SEQ ID NO: 1214799 - RNA, 26 nt, Human
acggugacugauucccaaugcuagag

SEQ ID NO: 1214800 - RNA, 22 nt, Human
acucaccuccccugggccccag

SEQ ID NO: 1214801 - RNA, 23 nt, Human
acucgccucuuccugaggccccu

SEQ ID NO: 1214802 - RNA, 20 nt, Human
acucugacagcgcugcuucc

SEQ ID NO: 1214803 - RNA, 20 nt, Human
acugauucccaaugcuagag

SEQ ID NO: 1214804 - RNA, 21 nt, Human
acuuuccggagcgcugggguc

SEQ ID NO: 1214805 - RNA, 22 nt, Human
acuuuggggcuguggggggcag

SEQ ID NO: 1214806 - RNA, 22 nt, Human
agaaaacucuucagcacagccc

SEQ ID NO: 1214807 - RNA, 20 nt, Human
agaagaagaaaggaagagaa

SEQ ID NO: 1214808 - RNA, 23 nt, Human
agacaagccccacagcccccuca

SEQ ID NO: 1214809 - RNA, 23 nt, Human
agaccagggaacugcagguggug

SEQ ID NO: 1214810 - RNA, 21 nt, Human
agacccagaaauucccagcaa

SEQ ID NO: 1214811 - RNA, 20 nt, Human
agauucuugccuggaggagg

SEQ ID NO: 1214812 - RNA, 18 nt, Human
agcaagagacagaccagg

SEQ ID NO: 1214813 - RNA, 21 nt, Human
agcaagagacagaccagggaa

SEQ ID NO: 1214814 - RNA, 19 nt, Human
agcaauacaguacccuggc

SEQ ID NO: 1214815 - RNA, 19 nt, Human
agcacaaggggugggggca

SEQ ID NO: 1214816 - RNA, 22 nt, Human
agcacccacggggaagggggca

SEQ ID NO: 1214817 - RNA, 20 nt, Human
agcaggagguggucagcugg

SEQ ID NO: 1214818 - RNA, 19 nt, Human
agccccuggugucaggccu

SEQ ID NO: 1214819 - RNA, 21 nt, Human
agcuguggucaaggcucagau

SEQ ID NO: 1214820 - RNA, 25 nt, Human
agcugugugagagagggagcugugg

SEQ ID NO: 1214821 - RNA, 21 nt, Human
agcuucagccauuggaggagu

SEQ ID NO: 1214822 - RNA, 24 nt, Human
aggaaaagaggcaaauacugaaaa

SEQ ID NO: 1214823 - RNA, 20 nt, Human
aggaagcagagguacuuucc

SEQ ID NO: 1214824 - RNA, 23 nt, Human
aggaagcugugugagagagggag

SEQ ID NO: 1214825 - RNA, 19 nt, Human
aggcagccagagaguggga

SEQ ID NO: 1214826 - RNA, 21 nt, Human
aggcaguuuccccaaauuagc

SEQ ID NO: 1214827 - RNA, 19 nt, Human
aggcauugucuaccuccuc

SEQ ID NO: 1214828 - RNA, 21 nt, Human
aggcccuggcaccuuuguucc

SEQ ID NO: 1214829 - RNA, 24 nt, Human
aggcugugccacccucggucacca

SEQ ID NO: 1214830 - RNA, 24 nt, Human
agggaagagcuuccucuuguuggg

SEQ ID NO: 1214831 - RNA, 21 nt, Human
aggggggcucccaggacuaca

SEQ ID NO: 1214832 - RNA, 22 nt, Human
aguagaauuucugcuggggucu

SEQ ID NO: 1214833 - RNA, 23 nt, Human
agucgcccaagcuuaagcccaga

SEQ ID NO: 1214834 - RNA, 24 nt, Human
aguggcgcacuuuggaggggcaau

SEQ ID NO: 1214835 - RNA, 24 nt, Human
auagacagauauagauauagauaa

SEQ ID NO: 1214836 - RNA, 21 nt, Human
aucccagcuccaccccgcccc

SEQ ID NO: 1214837 - RNA, 21 nt, Human
aucgaucccugcucagauucc

SEQ ID NO: 1214838 - RNA, 19 nt, Human
augcagggccuguucuguc

SEQ ID NO: 1214839 - RNA, 19 nt, Human
augcucugcaccugcaccc

SEQ ID NO: 1214840 - RNA, 20 nt, Human
augcucugcaccugcaccca

SEQ ID NO: 1214841 - RNA, 23 nt, Human
augguggcaggaagcagagguac

SEQ ID NO: 1214842 - RNA, 23 nt, Human
caaaccccaagaacaagcacagg

SEQ ID NO: 1214843 - RNA, 19 nt, Human
caaagcccgaaucagcauu

SEQ ID NO: 1214844 - RNA, 24 nt, Human
caaagugggcccacacuuccucca

SEQ ID NO: 1214845 - RNA, 18 nt, Human
caacaccagcaccuuggc

SEQ ID NO: 1214846 - RNA, 18 nt, Human
caagagacagaccaggga

SEQ ID NO: 1214847 - RNA, 19 nt, Human
caagaggaagcccaagagc

SEQ ID NO: 1214848 - RNA, 20 nt, Human
caagaggaagcccaagagcu

SEQ ID NO: 1214849 - RNA, 24 nt, Human
caagccccacagcccccucaaaaa

SEQ ID NO: 1214850 - RNA, 19 nt, Human
caagcuuaagcccagaccc

SEQ ID NO: 1214851 - RNA, 21 nt, Human
caaggccaagugagagacugg

SEQ ID NO: 1214852 - RNA, 21 nt, Human
caauaggcugucugcaaguuu

SEQ ID NO: 1214853 - RNA, 22 nt, Human
cacacuuccuccacuaccccug

SEQ ID NO: 1214854 - RNA, 18 nt, Human
cacagccccgaggaaugg

SEQ ID NO: 1214855 - RNA, 20 nt, Human
cacagccucaccuugugucc

SEQ ID NO: 1214856 - RNA, 19 nt, Human
cacagcuaccuacagagca

SEQ ID NO: 1214857 - RNA, 24 nt, Human
caccauguugugcgucagcaaggc

SEQ ID NO: 1214858 - RNA, 19 nt, Human
cacccauggucccaaugcc

SEQ ID NO: 1214859 - RNA, 22 nt, Human
cacccccaugcuuggucggggg

SEQ ID NO: 1214860 - RNA, 18 nt, Human
caccccgccccgcagcca

SEQ ID NO: 1214861 - RNA, 23 nt, Human
caccuuggcugggaagcuaaggg

SEQ ID NO: 1214862 - RNA, 18 nt, Human
cacuaccccugcuguugc

SEQ ID NO: 1214863 - RNA, 19 nt, Human
cacuaccccugcuguugcu

SEQ ID NO: 1214864 - RNA, 22 nt, Human
cagaaagggguccgugcuggug

SEQ ID NO: 1214865 - RNA, 23 nt, Human
cagaaauggguuugauucucagc

SEQ ID NO: 1214866 - RNA, 24 nt, Human
cagaauggaggauggaggacagcg

SEQ ID NO: 1214867 - RNA, 18 nt, Human
cagaggccucugccagcu

SEQ ID NO: 1214868 - RNA, 23 nt, Human
cagauguccagggcuggggggca

SEQ ID NO: 1214869 - RNA, 22 nt, Human
cagcacccuagaaauagcuugg

SEQ ID NO: 1214870 - RNA, 24 nt, Human
cagcaccgaccucacaugcacugg

SEQ ID NO: 1214871 - RNA, 19 nt, Human
cagcaccugggauuuacgc

SEQ ID NO: 1214872 - RNA, 18 nt, Human
cagcaggauccagcugua

SEQ ID NO: 1214873 - RNA, 23 nt, Human
cagcccccucaaaaacgaccacc

SEQ ID NO: 1214874 - RNA, 22 nt, Human
cagccucagcuccuccuggccc

SEQ ID NO: 1214875 - RNA, 25 nt, Human
cagcuccccaagaaggagacuguca

SEQ ID NO: 1214876 - RNA, 21 nt, Human
cagcucugacucaccuccccu

SEQ ID NO: 1214877 - RNA, 18 nt, Human
cagcugccaccuacccca

SEQ ID NO: 1214878 - RNA, 21 nt, Human
cagcugggcauccacaaagcc

SEQ ID NO: 1214879 - RNA, 24 nt, Human
cagcuuggugccagcaagagacag

SEQ ID NO: 1214880 - RNA, 25 nt, Human
caggccaaagagggccuccccaggc

SEQ ID NO: 1214881 - RNA, 19 nt, Human
cagggcagccagccccacc

SEQ ID NO: 1214882 - RNA, 21 nt, Human
caggguuagggauagaggggg

SEQ ID NO: 1214883 - RNA, 19 nt, Human
caggguuccuucauccuga

SEQ ID NO: 1214884 - RNA, 22 nt, Human
caguagaaccauuuuccuuaga

SEQ ID NO: 1214885 - RNA, 21 nt, Human
cagugggacuccuccucuuuu

SEQ ID NO: 1214886 - RNA, 22 nt, Human
cagugggacuccuccucuuuug

SEQ ID NO: 1214887 - RNA, 20 nt, Human
cagugucaaaccaaaguggg

SEQ ID NO: 1214888 - RNA, 19 nt, Human
caugcugacggugguccug

SEQ ID NO: 1214889 - RNA, 21 nt, Human
caugcuuggucggggguggga

SEQ ID NO: 1214890 - RNA, 21 nt, Human
cauggaccacagguggcccuc

SEQ ID NO: 1214891 - RNA, 18 nt, Human
cauggcucagcuagcucc

SEQ ID NO: 1214892 - RNA, 19 nt, Human
cauguguaggugugugugu

SEQ ID NO: 1214893 - RNA, 25 nt, Human
cauguguaggugugugugugugugu

SEQ ID NO: 1214894 - RNA, 21 nt, Human
cauuguuuccaccguggccaa

SEQ ID NO: 1214895 - RNA, 23 nt, Human
cauuuaccuacccagcacccacg

SEQ ID NO: 1214896 - RNA, 22 nt, Human
ccaagagcugggccccgccacc

SEQ ID NO: 1214897 - RNA, 22 nt, Human
ccacacacccagacucucagac

SEQ ID NO: 1214898 - RNA, 18 nt, Human
ccacagugggacuccucc

SEQ ID NO: 1214899 - RNA, 23 nt, Human
ccacauggaagacgcagcugaug

SEQ ID NO: 1214900 - RNA, 18 nt, Human
ccaccccgccccgcagcc

SEQ ID NO: 1214901 - RNA, 18 nt, Human
ccaccuaccccaggccac

SEQ ID NO: 1214902 - RNA, 22 nt, Human
ccacggggaagggggcacaucu

SEQ ID NO: 1214903 - RNA, 28 nt, Human
ccacugugccuacucugcccacuccucc

SEQ ID NO: 1214904 - RNA, 20 nt, Human
ccagaaggcacagccucacc

SEQ ID NO: 1214905 - RNA, 21 nt, Human
ccagacaggaacugaaguaga

SEQ ID NO: 1214906 - RNA, 23 nt, Human
ccagaggccucugccagcucuga

SEQ ID NO: 1214907 - RNA, 22 nt, Human
ccagcacccacggggaaggggg

SEQ ID NO: 1214908 - RNA, 19 nt, Human
ccagcuccaccccgccccg

SEQ ID NO: 1214909 - RNA, 21 nt, Human
ccagcucugacucaccucccc

SEQ ID NO: 1214910 - RNA, 20 nt, Human
ccaggagccaacuguugaau

SEQ ID NO: 1214911 - RNA, 23 nt, Human
ccaggcaggcaaggcagccagag

SEQ ID NO: 1214912 - RNA, 22 nt, Human
ccaggccacauggaagacgcag

SEQ ID NO: 1214913 - RNA, 18 nt, Human
ccaggccagaucgauccc

SEQ ID NO: 1214914 - RNA, 21 nt, Human
ccaggccgggcuagggacaug

SEQ ID NO: 1214915 - RNA, 21 nt, Human
ccaguggugagaacaucccag

SEQ ID NO: 1214916 - RNA, 22 nt, Human
ccauuguuuccaccguggccaa

SEQ ID NO: 1214917 - RNA, 23 nt, Human
cccaagagcugggccccgccacc

SEQ ID NO: 1214918 - RNA, 25 nt, Human
cccacagccccugccucuagccuug

SEQ ID NO: 1214919 - RNA, 23 nt, Human
cccacagugggaauauuuauacc

SEQ ID NO: 1214920 - RNA, 21 nt, Human
cccaccaguauuaaagguggg

SEQ ID NO: 1214921 - RNA, 25 nt, Human
cccaccuaucccugcuucucccuca

SEQ ID NO: 1214922 - RNA, 25 nt, Human
cccagaccuugacuuggcaggaggu

SEQ ID NO: 1214923 - RNA, 21 nt, Human
cccagcuccaccccgccccgc

SEQ ID NO: 1214924 - RNA, 22 nt, Human
cccaggccagaucgaucccugc

SEQ ID NO: 1214925 - RNA, 19 nt, Human
cccaggggcugggauagga

SEQ ID NO: 1214926 - RNA, 22 nt, Human
cccaugcuuggucggggguggg

SEQ ID NO: 1214927 - RNA, 23 nt, Human
ccccagagccucuggcuuaucac

SEQ ID NO: 1214928 - RNA, 25 nt, Human
ccccagagccucuggcuuaucacag

SEQ ID NO: 1214929 - RNA, 25 nt, Human
ccccagagccucuggcuuaucacag

SEQ ID NO: 1214930 - RNA, 23 nt, Human
ccccauuguuuccaccguggcca

SEQ ID NO: 1214931 - RNA, 21 nt, Human
cccccagagccucuggcuuau

SEQ ID NO: 1214932 - RNA, 23 nt, Human
cccccaggccagaucgaucccug

SEQ ID NO: 1214933 - RNA, 21 nt, Human
ccccgaggaauggaguuucug

SEQ ID NO: 1214934 - RNA, 23 nt, Human
ccccgccacccaggccgggcuag

SEQ ID NO: 1214935 - RNA, 19 nt, Human
ccccguaccuccucccagg

SEQ ID NO: 1214936 - RNA, 21 nt, Human
ccccguaccuccucccaggcc

SEQ ID NO: 1214937 - RNA, 21 nt, Human
ccccucaaaaacgaccaccuc

SEQ ID NO: 1214938 - RNA, 22 nt, Human
ccccucaggucacacugaacag

SEQ ID NO: 1214939 - RNA, 21 nt, Human
ccccugggccccagaggaguc

SEQ ID NO: 1214940 - RNA, 21 nt, Human
cccguaccuccucccaggcca

SEQ ID NO: 1214941 - RNA, 19 nt, Human
cccucaaaaacgaccaccu

SEQ ID NO: 1214942 - RNA, 20 nt, Human
cccucaaaaacgaccaccuc

SEQ ID NO: 1214943 - RNA, 21 nt, Human
cccucaaaccccaagaacaag

SEQ ID NO: 1214944 - RNA, 19 nt, Human
cccucacagacacuuccag

SEQ ID NO: 1214945 - RNA, 18 nt, Human
cccucagccacacguggc

SEQ ID NO: 1214946 - RNA, 23 nt, Human
cccucaggucacacugaacagca

SEQ ID NO: 1214947 - RNA, 18 nt, Human
cccuccuccugccagcac

SEQ ID NO: 1214948 - RNA, 23 nt, Human
cccugcucagauuccuucuccua

SEQ ID NO: 1214949 - RNA, 19 nt, Human
cccugcuguugcuuccugc

SEQ ID NO: 1214950 - RNA, 22 nt, Human
cccugggccccagaggagucuc

SEQ ID NO: 1214951 - RNA, 18 nt, Human
ccgagucucaaaacugaa

SEQ ID NO: 1214952 - RNA, 20 nt, Human
ccggccccauuguuuccacc

SEQ ID NO: 1214953 - RNA, 21 nt, Human
ccgggcgggggguacuuuggg

SEQ ID NO: 1214954 - RNA, 24 nt, Human
ccguccagcagccucuuuggcugc

SEQ ID NO: 1214955 - RNA, 24 nt, Human
ccuacagagcacccccaugcuugg

SEQ ID NO: 1214956 - RNA, 20 nt, Human
ccucaaaaacgaccaccucc

SEQ ID NO: 1214957 - RNA, 24 nt, Human
ccucaaaaacgaccaccuccagga

SEQ ID NO: 1214958 - RNA, 18 nt, Human
ccucagggcagccagccc

SEQ ID NO: 1214959 - RNA, 18 nt, Human
ccucaggucacacugaac

SEQ ID NO: 1214960 - RNA, 28 nt, Human
ccucaugguucugccauacggugcugcc

SEQ ID NO: 1214961 - RNA, 24 nt, Human
ccuccacuaccccugcuguugcuu

SEQ ID NO: 1214962 - RNA, 23 nt, Human
ccuccauggguuggcuggggcca

SEQ ID NO: 1214963 - RNA, 18 nt, Human
ccuccccaggcagaaggc

SEQ ID NO: 1214964 - RNA, 21 nt, Human
ccuccccugggccccagagga

SEQ ID NO: 1214965 - RNA, 22 nt, Human
ccucugcaaccagcuccccaag

SEQ ID NO: 1214966 - RNA, 24 nt, Human
ccugaggccccgccccggccacac

SEQ ID NO: 1214967 - RNA, 21 nt, Human
ccugcagauguccagggcugg

SEQ ID NO: 1214968 - RNA, 21 nt, Human
ccugcagcaggauccagcugu

SEQ ID NO: 1214969 - RNA, 18 nt, Human
ccugccgugccccgaggc

SEQ ID NO: 1214970 - RNA, 20 nt, Human
ccuguagggcugagugggag

SEQ ID NO: 1214971 - RNA, 21 nt, Human
ccuuggcaagcuccaccccuc

SEQ ID NO: 1214972 - RNA, 19 nt, Human
ccuuuuguggugauaagag

SEQ ID NO: 1214973 - RNA, 22 nt, Human
cgaaacauuuaccuacccagca

SEQ ID NO: 1214974 - RNA, 19 nt, Human
cgccacccaggccgggcua

SEQ ID NO: 1214975 - RNA, 24 nt, Human
cgccccggccacacccaugcacgg

SEQ ID NO: 1214976 - RNA, 21 nt, Human
cgcuaagaaccucccauggca

SEQ ID NO: 1214977 - RNA, 24 nt, Human
cgcuaagaaccucccauggcaggg

SEQ ID NO: 1214978 - RNA, 18 nt, Human
cggcuggaacggcucaca

SEQ ID NO: 1214979 - RNA, 21 nt, Human
cgggagcugaggcugccauug

SEQ ID NO: 1214980 - RNA, 18 nt, Human
cgucagagaucugggcca

SEQ ID NO: 1214981 - RNA, 23 nt, Human
cuaagcuccaggggcuuuccagg

SEQ ID NO: 1214982 - RNA, 22 nt, Human
cuagaaggggcugauggucugc

SEQ ID NO: 1214983 - RNA, 20 nt, Human
cucaaaaacgaccaccucca

SEQ ID NO: 1214984 - RNA, 21 nt, Human
cucaaaacugaagaaccugga

SEQ ID NO: 1214985 - RNA, 23 nt, Human
cucaccccccagagccucuggcu

SEQ ID NO: 1214986 - RNA, 21 nt, Human
cucagauucuugccuggagga

SEQ ID NO: 1214987 - RNA, 21 nt, Human
cucaggucacacugaacagca

SEQ ID NO: 1214988 - RNA, 19 nt, Human
cuccaaggccugcaccucc

SEQ ID NO: 1214989 - RNA, 21 nt, Human
cuccacuaccccugcuguugc

SEQ ID NO: 1214990 - RNA, 20 nt, Human
cuccaggaaucagugcuccc

SEQ ID NO: 1214991 - RNA, 20 nt, Human
cuccagguagcugaggacuc

SEQ ID NO: 1214992 - RNA, 18 nt, Human
cucccaaccuccccaggc

SEQ ID NO: 1214993 - RNA, 21 nt, Human
cucccaggccacgucaccacu

SEQ ID NO: 1214994 - RNA, 23 nt, Human
cuccgggugguucuaaccaaaga

SEQ ID NO: 1214995 - RNA, 19 nt, Human
cuccuccuggcccaggaca

SEQ ID NO: 1214996 - RNA, 27 nt, Human
cucuccccaagaaagcccuuugcgaaa

SEQ ID NO: 1214997 - RNA, 22 nt, Human
cucugcaaccagcuccccaaga

SEQ ID NO: 1214998 - RNA, 21 nt, Human
cucugccagcucugacucacc

SEQ ID NO: 1214999 - RNA, 20 nt, Human
cucugcccacuccuccauca

SEQ ID NO: 1215000 - RNA, 21 nt, Human
cugaggacuccucaguucgug

SEQ ID NO: 1215001 - RNA, 19 nt, Human
cugcaccugcacccaggug

SEQ ID NO: 1215002 - RNA, 24 nt, Human
cugcaccugcacccaggugucguc

SEQ ID NO: 1215003 - RNA, 24 nt, Human
cugcagccagccaccauguugugc

SEQ ID NO: 1215004 - RNA, 23 nt, Human
cugcagccucagcuccuccuggc

SEQ ID NO: 1215005 - RNA, 19 nt, Human
cugccucugagcacugccc

SEQ ID NO: 1215006 - RNA, 19 nt, Human
cugcuagaccagcuggcca

SEQ ID NO: 1215007 - RNA, 22 nt, Human
cugcuagaccagcuggccacgc

SEQ ID NO: 1215008 - RNA, 20 nt, Human
cugcuggggucugcagccuc

SEQ ID NO: 1215009 - RNA, 22 nt, Human
cugcuuccuccaggcaguuucc

SEQ ID NO: 1215010 - RNA, 22 nt, Human
cuggcaacaccagcaccuuggc

SEQ ID NO: 1215011 - RNA, 22 nt, Human
cuggcaagaggaagcccaagag

SEQ ID NO: 1215012 - RNA, 27 nt, Human
cuggcaccuuuguuccucagagaugcu

SEQ ID NO: 1215013 - RNA, 22 nt, Human
cugggccccgccacccaggccg

SEQ ID NO: 1215014 - RNA, 18 nt, Human
cugguccuggcggcagca

SEQ ID NO: 1215015 - RNA, 19 nt, Human
cuggucuaugccuuuugug

SEQ ID NO: 1215016 - RNA, 25 nt, Human
cugucugcaaguuugaggagcaagg

SEQ ID NO: 1215017 - RNA, 19 nt, Human
cugugcggcccgggcgggg

SEQ ID NO: 1215018 - RNA, 22 nt, Human
cuucccggccacgcccguccag

SEQ ID NO: 1215019 - RNA, 21 nt, Human
cuuccugaggccccuccugga

SEQ ID NO: 1215020 - RNA, 21 nt, Human
cuuggagguaguggggggggg

SEQ ID NO: 1215021 - RNA, 21 nt, Human
cuuuauauucgcuagcagcug

SEQ ID NO: 1215022 - RNA, 22 nt, Human
gaaaagaggcaaauacugaaaa

SEQ ID NO: 1215023 - RNA, 22 nt, Human
gaacacagccagcagaagacac

SEQ ID NO: 1215024 - RNA, 24 nt, Human
gaagacacauucccugucauccag

SEQ ID NO: 1215025 - RNA, 19 nt, Human
gaagaggggcuuugaaugg

SEQ ID NO: 1215026 - RNA, 22 nt, Human
gaagccucuagccuggagggua

SEQ ID NO: 1215027 - RNA, 22 nt, Human
gaagcuccucccugccgugccc

SEQ ID NO: 1215028 - RNA, 18 nt, Human
gaagugccaugcaagugc

SEQ ID NO: 1215029 - RNA, 18 nt, Human
gacagccaagccuuggga

SEQ ID NO: 1215030 - RNA, 22 nt, Human
gacucaccuccccugggcccca

SEQ ID NO: 1215031 - RNA, 20 nt, Human
gagaaaaaaucagauugccu

SEQ ID NO: 1215032 - RNA, 19 nt, Human
gagaagaagaaaggaagag

SEQ ID NO: 1215033 - RNA, 22 nt, Human
gagaaggagggcuucggguugg

SEQ ID NO: 1215034 - RNA, 19 nt, Human
gagagauggguggcucugc

SEQ ID NO: 1215035 - RNA, 19 nt, Human
gagaggcaggugauacugc

SEQ ID NO: 1215036 - RNA, 22 nt, Human
gagagugggacccagagaagcc

SEQ ID NO: 1215037 - RNA, 25 nt, Human
gagccaauccgagucucaaaacuga

SEQ ID NO: 1215038 - RNA, 21 nt, Human
gagccaccccgaugcaggggc

SEQ ID NO: 1215039 - RNA, 20 nt, Human
gagccauggccacagucacc

SEQ ID NO: 1215040 - RNA, 21 nt, Human
gaggaggcgaggugcugcagg

SEQ ID NO: 1215041 - RNA, 18 nt, Human
gaggauggaggacagcga

SEQ ID NO: 1215042 - RNA, 23 nt, Human
gagggacagcaggacugguagag

SEQ ID NO: 1215043 - RNA, 19 nt, Human
gaggucuuccaugcagccg

SEQ ID NO: 1215044 - RNA, 19 nt, Human
gaguacauauuggccagug

SEQ ID NO: 1215045 - RNA, 18 nt, Human
gagucucaaaacugaaga

SEQ ID NO: 1215046 - RNA, 24 nt, Human
gagugggagaggcucacagaggcc

SEQ ID NO: 1215047 - RNA, 19 nt, Human
gauagcagcuggaugaaau

SEQ ID NO: 1215048 - RNA, 18 nt, Human
gauggcagggucuggcug

SEQ ID NO: 1215049 - RNA, 21 nt, Human
gcaaagacaggagguagcccu

SEQ ID NO: 1215050 - RNA, 20 nt, Human
gcaccugcacccaggugucg

SEQ ID NO: 1215051 - RNA, 21 nt, Human
gcagaaaacucuucagcacag

SEQ ID NO: 1215052 - RNA, 18 nt, Human
gcagcaggagguggucag

SEQ ID NO: 1215053 - RNA, 22 nt, Human
gcaggccaagucucccagugcu

SEQ ID NO: 1215054 - RNA, 21 nt, Human
gccaaagagggccuccccagg

SEQ ID NO: 1215055 - RNA, 18 nt, Human
gccacacagagguaaggc

SEQ ID NO: 1215056 - RNA, 20 nt, Human
gccaccacucaagccaggcu

SEQ ID NO: 1215057 - RNA, 20 nt, Human
gccaccacucagucugaggc

SEQ ID NO: 1215058 - RNA, 20 nt, Human
gccagcuucaguggggcuag

SEQ ID NO: 1215059 - RNA, 22 nt, Human
gccaggccagcuucaguggggc

SEQ ID NO: 1215060 - RNA, 25 nt, Human
gcccaagcuuaagcccagaccccag

SEQ ID NO: 1215061 - RNA, 19 nt, Human
gccugcaccuccagcacca

SEQ ID NO: 1215062 - RNA, 23 nt, Human
gccuuaucugcaaagacauugau

SEQ ID NO: 1215063 - RNA, 21 nt, Human
gccuugggagccaggguggag

SEQ ID NO: 1215064 - RNA, 24 nt, Human
gcucagcucccaaccuccccaggc

SEQ ID NO: 1215065 - RNA, 18 nt, Human
gcugcauggaggcaaccc

SEQ ID NO: 1215066 - RNA, 18 nt, Human
ggaaccagggaugagaac

SEQ ID NO: 1215067 - RNA, 23 nt, Human
ggacccagagaagcccagggcca

SEQ ID NO: 1215068 - RNA, 20 nt, Human
ggacuucuaggggggcuccc

SEQ ID NO: 1215069 - RNA, 23 nt, Human
ggagagccaauccgagucucaaa

SEQ ID NO: 1215070 - RNA, 21 nt, Human
ggagagggucugcacaauaaa

SEQ ID NO: 1215071 - RNA, 19 nt, Human
ggagcuguggucaaggcuc

SEQ ID NO: 1215072 - RNA, 24 nt, Human
ggaggagucugcggccauugagag

SEQ ID NO: 1215073 - RNA, 21 nt, Human
ggaggcauucagaaacccauu

SEQ ID NO: 1215074 - RNA, 24 nt, Human
ggcaaauacugaaaaucaggguuc

SEQ ID NO: 1215075 - RNA, 18 nt, Human
ggcagccccuggugucag

SEQ ID NO: 1215076 - RNA, 27 nt, Human
ggcagggucuggcuguccacaggccgg

SEQ ID NO: 1215077 - RNA, 18 nt, Human
ggcauagggaggggagag

SEQ ID NO: 1215078 - RNA, 22 nt, Human
ggcaugacaguggggcgcacug

SEQ ID NO: 1215079 - RNA, 23 nt, Human
ggccacacccaugcacggaagcu

SEQ ID NO: 1215080 - RNA, 19 nt, Human
ggccuagaaggggcugaug

SEQ ID NO: 1215081 - RNA, 18 nt, Human
ggcugauggccuugaugg

SEQ ID NO: 1215082 - RNA, 24 nt, Human
gggacuucuaggggggcucccagg

SEQ ID NO: 1215083 - RNA, 19 nt, Human
gggagagauggguggcucu

SEQ ID NO: 1215084 - RNA, 21 nt, Human
gggagcaggcuccgccagccc

SEQ ID NO: 1215085 - RNA, 20 nt, Human
gggagcugaggcugccauug

SEQ ID NO: 1215086 - RNA, 18 nt, Human
gggagggauggguggguu

SEQ ID NO: 1215087 - RNA, 20 nt, Human
gggcaaugucagggaagagc

SEQ ID NO: 1215088 - RNA, 22 nt, Human
gggcaggagcuuauuggccuga

SEQ ID NO: 1215089 - RNA, 20 nt, Human
gggccccgccacccaggccg

SEQ ID NO: 1215090 - RNA, 22 nt, Human
gggccccgccacccaggccggg

SEQ ID NO: 1215091 - RNA, 24 nt, Human
gggggggggcaguugaagaggggc

SEQ ID NO: 1215092 - RNA, 22 nt, Human
ggggggggggcaguugaagagg

SEQ ID NO: 1215093 - RNA, 19 nt, Human
gggggucagaggcuggagg

SEQ ID NO: 1215094 - RNA, 18 nt, Human
gggucugggcauccuggg

SEQ ID NO: 1215095 - RNA, 20 nt, Human
ggguggcaucugugugcacu

SEQ ID NO: 1215096 - RNA, 24 nt, Human
ggguuagggauagagggggagggg

SEQ ID NO: 1215097 - RNA, 25 nt, Human
gguaguggggggggggcaguugaag

SEQ ID NO: 1215098 - RNA, 19 nt, Human
ggucugggcauccuggggc

SEQ ID NO: 1215099 - RNA, 19 nt, Human
ggugagaacaucccagcuc

SEQ ID NO: 1215100 - RNA, 19 nt, Human
ggugauggugguguagagu

SEQ ID NO: 1215101 - RNA, 18 nt, Human
ggugggagggauggcagg

SEQ ID NO: 1215102 - RNA, 21 nt, Human
ggugguggccagcuacugggg

SEQ ID NO: 1215103 - RNA, 21 nt, Human
ggugugugugugugugugugu

SEQ ID NO: 1215104 - RNA, 21 nt, Human
gguugcagaaagggguccgug

SEQ ID NO: 1215105 - RNA, 22 nt, Human
guaagacaagccccacagcccc

SEQ ID NO: 1215106 - RNA, 18 nt, Human
gucacuuguaggguggca

SEQ ID NO: 1215107 - RNA, 20 nt, Human
guccgugcuggugcacccuc

SEQ ID NO: 1215108 - RNA, 21 nt, Human
gucugcagccagccaccaugu

SEQ ID NO: 1215109 - RNA, 18 nt, Human
gugccaggccagcuucag

SEQ ID NO: 1215110 - RNA, 24 nt, Human
gugcuggacagaagggggcaggua

SEQ ID NO: 1215111 - RNA, 20 nt, Human
guggccauagcacaaggggu

SEQ ID NO: 1215112 - RNA, 19 nt, Human
gugggucugccuuccccag

SEQ ID NO: 1215113 - RNA, 21 nt, Human
gugguucuuaugcagggccug

SEQ ID NO: 1215114 - RNA, 23 nt, Human
gugugagagagggagcugugguc

SEQ ID NO: 1215115 - RNA, 21 nt, Human
gugugugugugugugugugug

SEQ ID NO: 1215116 - RNA, 20 nt, Human
guuagugguucuuaugcagg

SEQ ID NO: 1215117 - RNA, 22 nt, Human
guucugccauacggugcugccu

SEQ ID NO: 1215118 - RNA, 18 nt, Human
guugggccacaagacucc

SEQ ID NO: 1215119 - RNA, 21 nt, Human
uaagagcaaaacacagcacac

SEQ ID NO: 1215120 - RNA, 22 nt, Human
uaagagcaaaacacagcacacu

SEQ ID NO: 1215121 - RNA, 18 nt, Human
uaaggcuccaaggccugc

SEQ ID NO: 1215122 - RNA, 21 nt, Human
uacacaaucacaaggucccac

SEQ ID NO: 1215123 - RNA, 24 nt, Human
uacauacacccacuagggcauggu

SEQ ID NO: 1215124 - RNA, 23 nt, Human
uaccccaggccacauggaagacu

SEQ ID NO: 1215125 - RNA, 19 nt, Human
uacccuggcccuucucaac

SEQ ID NO: 1215126 - RNA, 21 nt, Human
uaccuccucccaggccacguc

SEQ ID NO: 1215127 - RNA, 21 nt, Human
uacugguccauggagauuucu

SEQ ID NO: 1215128 - RNA, 18 nt, Human
uagaaggggcugaugguc

SEQ ID NO: 1215129 - RNA, 21 nt, Human
uagaaggggcugauggucugc

SEQ ID NO: 1215130 - RNA, 23 nt, Human
uagaauuucugcuggggucugca

SEQ ID NO: 1215131 - RNA, 24 nt, Human
uagaauuucugcuggggucugcag

SEQ ID NO: 1215132 - RNA, 20 nt, Human
uagccagccugagccagcug

SEQ ID NO: 1215133 - RNA, 20 nt, Human
uaggugugugugugugugug

SEQ ID NO: 1215134 - RNA, 19 nt, Human
ucaaaccaaagugggccca

SEQ ID NO: 1215135 - RNA, 23 nt, Human
ucagaggacagcagcaaggccaa

SEQ ID NO: 1215136 - RNA, 21 nt, Human
ucagcaaggcuucccacagcc

SEQ ID NO: 1215137 - RNA, 24 nt, Human
ucagcaccagcugggcauccacaa

SEQ ID NO: 1215138 - RNA, 19 nt, Human
ucagcagcugccaccuacc

SEQ ID NO: 1215139 - RNA, 19 nt, Human
ucagcaggcacagcacagc

SEQ ID NO: 1215140 - RNA, 20 nt, Human
ucaggguucccucuccccaa

SEQ ID NO: 1215141 - RNA, 20 nt, Human
ucaucgguccugacagcacc

SEQ ID NO: 1215142 - RNA, 19 nt, Human
uccaacagaggccucugag

SEQ ID NO: 1215143 - RNA, 19 nt, Human
uccaacccgaugccauaau

SEQ ID NO: 1215144 - RNA, 21 nt, Human
uccacaaagcccgaaucagca

SEQ ID NO: 1215145 - RNA, 23 nt, Human
uccacaaagcccgaaucagcauu

SEQ ID NO: 1215146 - RNA, 23 nt, Human
uccacacacccagacucucagac

SEQ ID NO: 1215147 - RNA, 23 nt, Human
uccacagacagccaagccuuggg

SEQ ID NO: 1215148 - RNA, 19 nt, Human
uccacagagaacacagcca

SEQ ID NO: 1215149 - RNA, 19 nt, Human
uccaccccucacuccaggu

SEQ ID NO: 1215150 - RNA, 19 nt, Human
uccagggcuggggggcaga

SEQ ID NO: 1215151 - RNA, 27 nt, Human
ucccaacaaagagcccauaggguaccc

SEQ ID NO: 1215152 - RNA, 22 nt, Human
ucccacagccccugccucuagc

SEQ ID NO: 1215153 - RNA, 24 nt, Human
uccccaaauuagccucccugacuu

SEQ ID NO: 1215154 - RNA, 22 nt, Human
uccccaggccaccacucagucu

SEQ ID NO: 1215155 - RNA, 22 nt, Human
uccccaugccagccugcugccu

SEQ ID NO: 1215156 - RNA, 20 nt, Human
uccccucuaguuauccccuc

SEQ ID NO: 1215157 - RNA, 23 nt, Human
uccccugagcuccacagagaaca

SEQ ID NO: 1215158 - RNA, 21 nt, Human
ucccucaaaccccaagaacaa

SEQ ID NO: 1215159 - RNA, 24 nt, Human
ucccucaggccauucuuccagcug

SEQ ID NO: 1215160 - RNA, 21 nt, Human
ucccucuccccaagaaagccc

SEQ ID NO: 1215161 - RNA, 18 nt, Human
ucccugacuuccaacccg

SEQ ID NO: 1215162 - RNA, 21 nt, Human
ucccugcuucucccucaggcc

SEQ ID NO: 1215163 - RNA, 18 nt, Human
uccguggucuccagcugg

SEQ ID NO: 1215164 - RNA, 23 nt, Human
uccuugguccuggcaccagaagg

SEQ ID NO: 1215165 - RNA, 22 nt, Human
uccuugugggucagcaccagcu

SEQ ID NO: 1215166 - RNA, 18 nt, Human
uccuuuuucugccccucu

SEQ ID NO: 1215167 - RNA, 21 nt, Human
ucgcuguagugugccccucag

SEQ ID NO: 1215168 - RNA, 23 nt, Human
ucggacaccugcagcaggaucca

SEQ ID NO: 1215169 - RNA, 22 nt, Human
ucgggggugggagggauggcag

SEQ ID NO: 1215170 - RNA, 20 nt, Human
ucugccccucuuacacucuc

SEQ ID NO: 1215171 - RNA, 22 nt, Human
ucugcucgaggaaguagcuuca

SEQ ID NO: 1215172 - RNA, 18 nt, Human
ucugucuuggagguaguc

SEQ ID NO: 1215173 - RNA, 23 nt, Human
ucugucuuggagguagugggggg

SEQ ID NO: 1215174 - RNA, 22 nt, Human
ucuugugccaggccagcuucag

SEQ ID NO: 1215175 - RNA, 23 nt, Human
ugaaaaucaggguucccucuccc

SEQ ID NO: 1215176 - RNA, 20 nt, Human
ugaaggaaauccacacaccc

SEQ ID NO: 1215177 - RNA, 19 nt, Human
ugaaguccccaugccagcc

SEQ ID NO: 1215178 - RNA, 21 nt, Human
ugaauguugauguggaugcug

SEQ ID NO: 1215179 - RNA, 20 nt, Human
ugaauuuucaggaauuuuga

SEQ ID NO: 1215180 - RNA, 23 nt, Human
ugacagcacccuagaaauagcuu

SEQ ID NO: 1215181 - RNA, 26 nt, Human
ugacagcacccuagaaauagcuuggc

SEQ ID NO: 1215182 - RNA, 18 nt, Human
ugacuuccaacccgaugc

SEQ ID NO: 1215183 - RNA, 21 nt, Human
ugagaacagcucagcucccaa

SEQ ID NO: 1215184 - RNA, 23 nt, Human
ugagaacaucccagcuccacccc

SEQ ID NO: 1215185 - RNA, 19 nt, Human
ugagagacuggcagaggua

SEQ ID NO: 1215186 - RNA, 20 nt, Human
ugagaggcaggugauacugc

SEQ ID NO: 1215187 - RNA, 18 nt, Human
ugagcacugcccagaucc

SEQ ID NO: 1215188 - RNA, 23 nt, Human
ugagcuccacagagaacacagcc

SEQ ID NO: 1215189 - RNA, 22 nt, Human
ugaggacuccucaguucgugug

SEQ ID NO: 1215190 - RNA, 21 nt, Human
ugaggccuugcuggccggggc

SEQ ID NO: 1215191 - RNA, 18 nt, Human
ugagggacagcaggacug

SEQ ID NO: 1215192 - RNA, 20 nt, Human
ugaggggcugcaguugcaag

SEQ ID NO: 1215193 - RNA, 21 nt, Human
ugauccagcaccgaccucaca

SEQ ID NO: 1215194 - RNA, 20 nt, Human
ugauuagaaagaugguaccc

SEQ ID NO: 1215195 - RNA, 28 nt, Human
ugcaagugcuggacagaagggggcaggu

SEQ ID NO: 1215196 - RNA, 19 nt, Human
ugcaccugcacccaggugu

SEQ ID NO: 1215197 - RNA, 22 nt, Human
ugcagaaagggguccgugcugg

SEQ ID NO: 1215198 - RNA, 20 nt, Human
ugcagcaggauccagcugua

SEQ ID NO: 1215199 - RNA, 19 nt, Human
ugcagggagggaugggugg

SEQ ID NO: 1215200 - RNA, 18 nt, Human
ugcauucagccccuacuc

SEQ ID NO: 1215201 - RNA, 23 nt, Human
ugccaaggaguaaaggcucucag

SEQ ID NO: 1215202 - RNA, 19 nt, Human
ugccaccuaccccaggcca

SEQ ID NO: 1215203 - RNA, 25 nt, Human
ugccagagaggagguccuugugggu

SEQ ID NO: 1215204 - RNA, 24 nt, Human
ugccagcaugggcugcacaugccc

SEQ ID NO: 1215205 - RNA, 21 nt, Human
ugccaggagaaggagggcuuc

SEQ ID NO: 1215206 - RNA, 20 nt, Human
ugccccucuuacacucucug

SEQ ID NO: 1215207 - RNA, 27 nt, Human
ugccucuagccauugacacugaggucu

SEQ ID NO: 1215208 - RNA, 25 nt, Human
ugccuggaaggccaagggugccugc

SEQ ID NO: 1215209 - RNA, 18 nt, Human
ugccuggaggaggcgagg

SEQ ID NO: 1215210 - RNA, 23 nt, Human
ugccuggaggaggcgaggugcca

SEQ ID NO: 1215211 - RNA, 19 nt, Human
ugccuguggggacauccgg

SEQ ID NO: 1215212 - RNA, 20 nt, Human
ugcgggagcugaggcugcca

SEQ ID NO: 1215213 - RNA, 23 nt, Human
ugcgugaacaggacucgccucuu

SEQ ID NO: 1215214 - RNA, 21 nt, Human
ugcuagaccagcuggccacgc

SEQ ID NO: 1215215 - RNA, 20 nt, Human
ugcugaccuuguggggcugu

SEQ ID NO: 1215216 - RNA, 22 nt, Human
ugcugagcaggccaaagagggc

SEQ ID NO: 1215217 - RNA, 23 nt, Human
ugcugcagggagggauggguggg

SEQ ID NO: 1215218 - RNA, 18 nt, Human
ugcugccugucggacacc

SEQ ID NO: 1215219 - RNA, 19 nt, Human
ugcugcuuccuccaggcag

SEQ ID NO: 1215220 - RNA, 20 nt, Human
ugcuggacagaagggggcag

SEQ ID NO: 1215221 - RNA, 22 nt, Human
uggaaguggcgcacuuuggagg

SEQ ID NO: 1215222 - RNA, 20 nt, Human
uggagaacugcagcugcagg

SEQ ID NO: 1215223 - RNA, 20 nt, Human
uggagagggucugcacaaua

SEQ ID NO: 1215224 - RNA, 21 nt, Human
uggaggaggcgaggugcugca

SEQ ID NO: 1215225 - RNA, 18 nt, Human
uggagguagugggggggg

SEQ ID NO: 1215226 - RNA, 19 nt, Human
uggaggugaugagaggccu

SEQ ID NO: 1215227 - RNA, 23 nt, Human
uggagguuccuggagccagaggc

SEQ ID NO: 1215228 - RNA, 21 nt, Human
uggaugaagcagcagaugggc

SEQ ID NO: 1215229 - RNA, 22 nt, Human
uggauggccccguaccuccucc

SEQ ID NO: 1215230 - RNA, 25 nt, Human
uggcaagcuccaccccucacuccag

SEQ ID NO: 1215231 - RNA, 23 nt, Human
uggcaucugugugcacuggcccc

SEQ ID NO: 1215232 - RNA, 18 nt, Human
uggccaguggcuccgaga

SEQ ID NO: 1215233 - RNA, 25 nt, Human
uggcccaggacaagccugaccugca

SEQ ID NO: 1215234 - RNA, 18 nt, Human
uggccggggcuuuggaaa

SEQ ID NO: 1215235 - RNA, 18 nt, Human
uggccuggugcugccugu

SEQ ID NO: 1215236 - RNA, 22 nt, Human
uggcgcacuuuggaggggcaau

SEQ ID NO: 1215237 - RNA, 23 nt, Human
uggcggcagcagcaaauggcaua

SEQ ID NO: 1215238 - RNA, 18 nt, Human
uggcucaggcacgcaugg

SEQ ID NO: 1215239 - RNA, 19 nt, Human
uggcuccccgaccuggccc

SEQ ID NO: 1215240 - RNA, 20 nt, Human
uggcuggggccacggcuggg

SEQ ID NO: 1215241 - RNA, 18 nt, Human
uggcuugguggucacagc

SEQ ID NO: 1215242 - RNA, 19 nt, Human
ugggaucugggggugaugu

SEQ ID NO: 1215243 - RNA, 18 nt, Human
ugggccagacaggaacug

SEQ ID NO: 1215244 - RNA, 19 nt, Human
ugggcccugcugcuuccug

SEQ ID NO: 1215245 - RNA, 19 nt, Human
uggggcuagugggcccucu

SEQ ID NO: 1215246 - RNA, 18 nt, Human
uggggcuguggggggcag

SEQ ID NO: 1215247 - RNA, 24 nt, Human
uggggggggggcaguugaagaggg

SEQ ID NO: 1215248 - RNA, 18 nt, Human
uggggucugaaugggucc

SEQ ID NO: 1215249 - RNA, 19 nt, Human
ugggucagcaccagcuggg

SEQ ID NO: 1215250 - RNA, 20 nt, Human
uggugaguguaaacuccagg

SEQ ID NO: 1215251 - RNA, 21 nt, Human
uggugcugccugucggacacc

SEQ ID NO: 1215252 - RNA, 26 nt, Human
uggugcugccugucggacaccugauc

SEQ ID NO: 1215253 - RNA, 25 nt, Human
uguggucaaggcucagauucuugcc

SEQ ID NO: 1215254 - RNA, 23 nt, Human
uguguaggugugugugugugugu

SEQ ID NO: 1215255 - RNA, 28 nt, Human
uguguaggugugugugugugugugugug

SEQ ID NO: 1215256 - RNA, 18 nt, Human
ugugugugugugugugug

SEQ ID NO: 1215257 - RNA, 18 nt, Human
ugugugugugugugugug

SEQ ID NO: 1215258 - RNA, 18 nt, Human
ugugugugugugugugug

SEQ ID NO: 1215259 - RNA, 18 nt, Human
ugugugugugugugugug

SEQ ID NO: 1215260 - RNA, 21 nt, Human
ugugugugugugugugugugu

SEQ ID NO: 1215261 - RNA, 21 nt, Human
ugugugugugugugugugugu

SEQ ID NO: 1215262 - RNA, 21 nt, Human
ugugugugugugugugugugu

SEQ ID NO: 1215263 - RNA, 21 nt, Human
ugugugugugugugugugugu

SEQ ID NO: 1215264 - RNA, 21 nt, Human
ugugugugugugugugugugu

SEQ ID NO: 1215265 - RNA, 22 nt, Human
ugugugugugugugugugugug

SEQ ID NO: 1215266 - RNA, 22 nt, Human
ugugugugugugugugugugug

SEQ ID NO: 1215267 - RNA, 22 nt, Human
uguguguguguguguguguguu

SEQ ID NO: 1215268 - RNA, 23 nt, Human
uguugcgggagcugaggcugcca

SEQ ID NO: 1215269 - RNA, 18 nt, Human
uuaacuuacacaaucaca

SEQ ID NO: 1215270 - RNA, 22 nt, Human
uucacaggcuggauggccccgu

SEQ ID NO: 1215271 - RNA, 20 nt, Human
uucagccauuggaggaguug

SEQ ID NO: 1215272 - RNA, 22 nt, Human
uucaguggggcuagugggcccu

SEQ ID NO: 1215273 - RNA, 22 nt, Human
uucccucaaaccccaagaacaa

SEQ ID NO: 1215274 - RNA, 22 nt, Human
uuccuccaggcaguuuccccaa

SEQ ID NO: 1215275 - RNA, 23 nt, Human
uuccuccaggcaguuuccccaaa

SEQ ID NO: 1215276 - RNA, 20 nt, Human
uuccucuuguugggccacaa

SEQ ID NO: 1215277 - RNA, 22 nt, Human
uuccuggagccagaggccucug

SEQ ID NO: 1215278 - RNA, 23 nt, Human
uucuuaugcagggccuguucugu

SEQ ID NO: 1215279 - RNA, 23 nt, Human
uugauguggaugcugaccuugug

SEQ ID NO: 1215280 - RNA, 18 nt, Human
uugcugcuuccuccaggc

SEQ ID NO: 1215281 - RNA, 19 nt, Human
uugcuuccugcuagagagc

SEQ ID NO: 1215282 - RNA, 19 nt, Human
uuggaagagggucacgggu

SEQ ID NO: 1215283 - RNA, 19 nt, Human
uuggagguuccuggagcca

SEQ ID NO: 1215284 - RNA, 19 nt, Human
uuggcuggggugaggaggg

SEQ ID NO: 1215285 - RNA, 18 nt, Human
uugguccuggcaccagaa

SEQ ID NO: 1215286 - RNA, 19 nt, Human
uugugcgucagcaaggcuu

SEQ ID NO: 1215287 - RNA, 23 nt, Human
uuuccaccguggccaaggaacca

SEQ ID NO: 1215288 - RNA, 23 nt, Human
uuucccuccccugagcuccacag

SEQ ID NO: 1215289 - RNA, 18 nt, Human
uuugaggagcaaggagag

SEQ ID NO: 1215290 - RNA, 19 nt, Human
uuuggccagaguggaaugg

SEQ ID NO: 1215291 - RNA, 20 nt, Human
uuuggggcuguggggggcag

SEQ ID NO: 1215292 - RNA, 21 nt, Human
uuuucaggaauuuugagaggc

SEQ ID NO: 1215293 - RNA, 19 nt, Human
aaaaaaaacugaguagaca

SEQ ID NO: 1215294 - RNA, 23 nt, Human
aaccuucuucccuguuugcccac

SEQ ID NO: 1215295 - RNA, 18 nt, Human
aacuccuagcccaguccc

SEQ ID NO: 1215296 - RNA, 18 nt, Human
aaggagcacuggcugcag

SEQ ID NO: 1215297 - RNA, 24 nt, Human
aaguccccucccagaucugugacc

SEQ ID NO: 1215298 - RNA, 20 nt, Human
aauggcuguggggaucaagg

SEQ ID NO: 1215299 - RNA, 22 nt, Human
acaaaaauuuuaaaaauagcug

SEQ ID NO: 1215300 - RNA, 27 nt, Human
acacagguaccagagacugccccccac

SEQ ID NO: 1215301 - RNA, 23 nt, Human
acagagggagccugggggccaca

SEQ ID NO: 1215302 - RNA, 23 nt, Human
acagggcaaguaagaggcaaaac

SEQ ID NO: 1215303 - RNA, 20 nt, Human
acagucccagaagggcccag

SEQ ID NO: 1215304 - RNA, 19 nt, Human
acccugauguccccacuuc

SEQ ID NO: 1215305 - RNA, 21 nt, Human
acguucucuaaggaagaacaa

SEQ ID NO: 1215306 - RNA, 23 nt, Human
acuguacuccagccuggugacag

SEQ ID NO: 1215307 - RNA, 25 nt, Human
acuguacuccagccuggugacagag

SEQ ID NO: 1215308 - RNA, 19 nt, Human
acugugugaccagcaaggu

SEQ ID NO: 1215309 - RNA, 22 nt, Human
agacugccccccacggccccaa

SEQ ID NO: 1215310 - RNA, 23 nt, Human
agaguggggcugugggaccagcg

SEQ ID NO: 1215311 - RNA, 24 nt, Human
agccugggccacauagugagaccu

SEQ ID NO: 1215312 - RNA, 25 nt, Human
agccugggccacauagugagaccuu

SEQ ID NO: 1215313 - RNA, 23 nt, Human
agccuggugacagagcgagaccc

SEQ ID NO: 1215314 - RNA, 26 nt, Human
agcugggcuuggugguggcaugugcc

SEQ ID NO: 1215315 - RNA, 19 nt, Human
aggagcagaggcgagucug

SEQ ID NO: 1215316 - RNA, 24 nt, Human
aggaguucgagaccagccugggcc

SEQ ID NO: 1215317 - RNA, 24 nt, Human
aggaucacuugagcccaggaguuc

SEQ ID NO: 1215318 - RNA, 23 nt, Human
aggcaagcucauuucuucuccac

SEQ ID NO: 1215319 - RNA, 18 nt, Human
aggcaggaggaucacuug

SEQ ID NO: 1215320 - RNA, 23 nt, Human
aggcaggaggaucacuugagccc

SEQ ID NO: 1215321 - RNA, 24 nt, Human
aggcaggaggaucacuugagccca

SEQ ID NO: 1215322 - RNA, 24 nt, Human
aggccgaggcaggaggaucacuug

SEQ ID NO: 1215323 - RNA, 25 nt, Human
agguaccagagacugccccccacgg

SEQ ID NO: 1215324 - RNA, 19 nt, Human
agguggaggcugcagugag

SEQ ID NO: 1215325 - RNA, 20 nt, Human
agguggaggcugcagugagc

SEQ ID NO: 1215326 - RNA, 25 nt, Human
agugacggggggagcuugacaagga

SEQ ID NO: 1215327 - RNA, 23 nt, Human
aucacuguacuccagccugguga

SEQ ID NO: 1215328 - RNA, 21 nt, Human
aucacuugagcccaggaguuc

SEQ ID NO: 1215329 - RNA, 24 nt, Human
aucacuugagcccaggaguucgag

SEQ ID NO: 1215330 - RNA, 26 nt, Human
aucucuccccucccugugccucccag

SEQ ID NO: 1215331 - RNA, 20 nt, Human
augaagcagggauuggggcu

SEQ ID NO: 1215332 - RNA, 21 nt, Human
augugggaaccagaacacacu

SEQ ID NO: 1215333 - RNA, 22 nt, Human
augugggaaccagaacacacug

SEQ ID NO: 1215334 - RNA, 18 nt, Human
auuucuucuccacacccc

SEQ ID NO: 1215335 - RNA, 19 nt, Human
caacuccaacucccacucc

SEQ ID NO: 1215336 - RNA, 19 nt, Human
caacuccuagcccaguccc

SEQ ID NO: 1215337 - RNA, 23 nt, Human
caaguccagcgccaggaugccca

SEQ ID NO: 1215338 - RNA, 21 nt, Human
cacacagguaccagagacugc

SEQ ID NO: 1215339 - RNA, 22 nt, Human
cacacugauggaggaguuggca

SEQ ID NO: 1215340 - RNA, 26 nt, Human
caccaaaaaaaaacugaguagacagu

SEQ ID NO: 1215341 - RNA, 21 nt, Human
cacccagaccugagcuaggac

SEQ ID NO: 1215342 - RNA, 22 nt, Human
caccuggagugacggggggagc

SEQ ID NO: 1215343 - RNA, 21 nt, Human
cacuccuggaggccgaggcag

SEQ ID NO: 1215344 - RNA, 19 nt, Human
cacugcgcuggggcggggc

SEQ ID NO: 1215345 - RNA, 19 nt, Human
cacuggcugcagggggggg

SEQ ID NO: 1215346 - RNA, 18 nt, Human
cacuguacuccagccugg

SEQ ID NO: 1215347 - RNA, 18 nt, Human
cacuguacuccagccugg

SEQ ID NO: 1215348 - RNA, 20 nt, Human
cacuguacuccagccuggug

SEQ ID NO: 1215349 - RNA, 22 nt, Human
cacuguacuccagccuggugac

SEQ ID NO: 1215350 - RNA, 23 nt, Human
cacuguacuccagccuggugaca

SEQ ID NO: 1215351 - RNA, 24 nt, Human
cacuguacuccagccuggugacag

SEQ ID NO: 1215352 - RNA, 24 nt, Human
cacuuugagcccaggagguggagg

SEQ ID NO: 1215353 - RNA, 19 nt, Human
cagagccucagcaucccuu

SEQ ID NO: 1215354 - RNA, 23 nt, Human
cagagcgagacccuaucaccgcc

SEQ ID NO: 1215355 - RNA, 23 nt, Human
cagcaaggcagccagggcggcac

SEQ ID NO: 1215356 - RNA, 19 nt, Human
cagccagggcggcacaggc

SEQ ID NO: 1215357 - RNA, 20 nt, Human
caggagguggaggcugcagu

SEQ ID NO: 1215358 - RNA, 23 nt, Human
caggaugcccaggcuccugggcu

SEQ ID NO: 1215359 - RNA, 25 nt, Human
caggcuccugggcuuccuccccgag

SEQ ID NO: 1215360 - RNA, 21 nt, Human
caggcuccugggcuuccuccu

SEQ ID NO: 1215361 - RNA, 24 nt, Human
cagggcggcacaggcaccaggucc

SEQ ID NO: 1215362 - RNA, 22 nt, Human
caggugcagagcaucccugacg

SEQ ID NO: 1215363 - RNA, 24 nt, Human
cagucaucacuguacuccagccug

SEQ ID NO: 1215364 - RNA, 24 nt, Human
cagugagcagucaucacuguacuc

SEQ ID NO: 1215365 - RNA, 18 nt, Human
cauccuuuggcugggccu

SEQ ID NO: 1215366 - RNA, 24 nt, Human
caucucuccccucccugugccucc

SEQ ID NO: 1215367 - RNA, 24 nt, Human
caugcaccacgcgcugaaggaggc

SEQ ID NO: 1215368 - RNA, 22 nt, Human
ccaaaaucccccacccgggaug

SEQ ID NO: 1215369 - RNA, 20 nt, Human
ccaacuccuagcccaguccc

SEQ ID NO: 1215370 - RNA, 18 nt, Human
ccacaccccuccccgccc

SEQ ID NO: 1215371 - RNA, 21 nt, Human
ccacaccccuccccgcccgac

SEQ ID NO: 1215372 - RNA, 20 nt, Human
ccacauagugagaccuuguc

SEQ ID NO: 1215373 - RNA, 24 nt, Human
ccacggccccaaaaucccccaccc

SEQ ID NO: 1215374 - RNA, 19 nt, Human
ccacuuccaaguccugacu

SEQ ID NO: 1215375 - RNA, 22 nt, Human
ccacuuccaaguccugacuccu

SEQ ID NO: 1215376 - RNA, 20 nt, Human
ccagagacugccccccacgg

SEQ ID NO: 1215377 - RNA, 25 nt, Human
ccaggaguucgagaccagccugggc

SEQ ID NO: 1215378 - RNA, 19 nt, Human
ccaugcccccgcccgugga

SEQ ID NO: 1215379 - RNA, 25 nt, Human
cccaaaaucccccacccgggaugcc

SEQ ID NO: 1215380 - RNA, 22 nt, Human
cccacccgggaugcccagagga

SEQ ID NO: 1215381 - RNA, 20 nt, Human
cccauauauaaaaaugaagc

SEQ ID NO: 1215382 - RNA, 21 nt, Human
cccauauauaaaaaugaagca

SEQ ID NO: 1215383 - RNA, 23 nt, Human
cccccacccgggaugcccagagg

SEQ ID NO: 1215384 - RNA, 21 nt, Human
ccccccacggccccaaaaucc

SEQ ID NO: 1215385 - RNA, 25 nt, Human
cccccgccccaccaaaaaaaaacug

SEQ ID NO: 1215386 - RNA, 22 nt, Human
ccccgccccaccaaaaaaaaac

SEQ ID NO: 1215387 - RNA, 18 nt, Human
ccccgcccgacccugucu

SEQ ID NO: 1215388 - RNA, 18 nt, Human
ccccucccugugccuccc

SEQ ID NO: 1215389 - RNA, 19 nt, Human
cccgccccaccaaaaaaaa

SEQ ID NO: 1215390 - RNA, 23 nt, Human
cccgccccaccaaaaaaaaacug

SEQ ID NO: 1215391 - RNA, 22 nt, Human
cccuuucccucccagagccuca

SEQ ID NO: 1215392 - RNA, 22 nt, Human
ccgcaagggcagggaugggagu

SEQ ID NO: 1215393 - RNA, 20 nt, Human
ccgccccaccaaaaaaaaac

SEQ ID NO: 1215394 - RNA, 21 nt, Human
ccgcccccccgccccaccaaa

SEQ ID NO: 1215395 - RNA, 22 nt, Human
ccgcccccccgccccaccaaaa

SEQ ID NO: 1215396 - RNA, 22 nt, Human
ccugagcuaggacagagggagc

SEQ ID NO: 1215397 - RNA, 21 nt, Human
ccugggccacauagugagacc

SEQ ID NO: 1215398 - RNA, 20 nt, Human
ccuguaguccuagcuacucg

SEQ ID NO: 1215399 - RNA, 18 nt, Human
ccugucuaaacuaauggg

SEQ ID NO: 1215400 - RNA, 24 nt, Human
cgagaccagccugggccacauagu

SEQ ID NO: 1215401 - RNA, 21 nt, Human
cgagacccuaucaccgccccc

SEQ ID NO: 1215402 - RNA, 22 nt, Human
cgagacccuaucaccgcccccc

SEQ ID NO: 1215403 - RNA, 22 nt, Human
cgagaugcugcacaugcaccac

SEQ ID NO: 1215404 - RNA, 19 nt, Human
cgagcacacgaguguaaag

SEQ ID NO: 1215405 - RNA, 20 nt, Human
cgaggcaggaggaucacuug

SEQ ID NO: 1215406 - RNA, 20 nt, Human
cgcucagcaucaucggugac

SEQ ID NO: 1215407 - RNA, 20 nt, Human
cggagccgcuggccaauaug

SEQ ID NO: 1215408 - RNA, 20 nt, Human
cggccacuggaccacaggag

SEQ ID NO: 1215409 - RNA, 20 nt, Human
cggccccaaaaucccccacc

SEQ ID NO: 1215410 - RNA, 21 nt, Human
cggccccaaaaucccccaccc

SEQ ID NO: 1215411 - RNA, 21 nt, Human
cuacugcauccuuuggcuggg

SEQ ID NO: 1215412 - RNA, 19 nt, Human
cuccacaccccuccccgcc

SEQ ID NO: 1215413 - RNA, 22 nt, Human
cuccuagcccagucccgggggc

SEQ ID NO: 1215414 - RNA, 23 nt, Human
cugaagccuacuucacucccaaa

SEQ ID NO: 1215415 - RNA, 26 nt, Human
cugacuccagucuugcuaacacacac

SEQ ID NO: 1215416 - RNA, 23 nt, Human
cuggaccucgguguccccaucug

SEQ ID NO: 1215417 - RNA, 24 nt, Human
cuggaggccgaggcaggaggauca

SEQ ID NO: 1215418 - RNA, 20 nt, Human
cugggcuuccuccugcuggg

SEQ ID NO: 1215419 - RNA, 21 nt, Human
cuuaaguccccucccagaucu

SEQ ID NO: 1215420 - RNA, 19 nt, Human
cuuugagcccaggaggugg

SEQ ID NO: 1215421 - RNA, 24 nt, Human
cuuuggcugggccuuguugacccc

SEQ ID NO: 1215422 - RNA, 18 nt, Human
gagcgagcacacgagugu

SEQ ID NO: 1215423 - RNA, 18 nt, Human
gagcuucggugcaugggu

SEQ ID NO: 1215424 - RNA, 23 nt, Human
gaggcaggaggaucacuugagcc

SEQ ID NO: 1215425 - RNA, 18 nt, Human
gaggugugacauauggga

SEQ ID NO: 1215426 - RNA, 24 nt, Human
gaucacuugagcccaggaguucga

SEQ ID NO: 1215427 - RNA, 25 nt, Human
gcacuggcugcaggggggggggggu

SEQ ID NO: 1215428 - RNA, 23 nt, Human
gccacauagugagaccuugucuc

SEQ ID NO: 1215429 - RNA, 24 nt, Human
gcccaggagguggaggcugcagug

SEQ ID NO: 1215430 - RNA, 22 nt, Human
gcccaggaguucgagaccagcc

SEQ ID NO: 1215431 - RNA, 25 nt, Human
gcccccccgccccaccaaaaaaaaa

SEQ ID NO: 1215432 - RNA, 22 nt, Human
gcgagacccuaucaccgccccc

SEQ ID NO: 1215433 - RNA, 21 nt, Human
gcugcaggggggggggggugg

SEQ ID NO: 1215434 - RNA, 19 nt, Human
ggaagugugccccauaccc

SEQ ID NO: 1215435 - RNA, 19 nt, Human
ggacaaguggcacaccccc

SEQ ID NO: 1215436 - RNA, 18 nt, Human
ggaggcugcagugagcag

SEQ ID NO: 1215437 - RNA, 23 nt, Human
ggaucacuugagcccaggaguuc

SEQ ID NO: 1215438 - RNA, 22 nt, Human
ggcaagaucacuggacugggag

SEQ ID NO: 1215439 - RNA, 18 nt, Human
ggcacccaggucuauggu

SEQ ID NO: 1215440 - RNA, 18 nt, Human
ggccgaggcaggaggauc

SEQ ID NO: 1215441 - RNA, 21 nt, Human
ggcugcaggggggggggggug

SEQ ID NO: 1215442 - RNA, 20 nt, Human
ggcuuggugguggcaugugc

SEQ ID NO: 1215443 - RNA, 20 nt, Human
gggacaaguggcacaccccc

SEQ ID NO: 1215444 - RNA, 22 nt, Human
ggggagguggaucuuccagucg

SEQ ID NO: 1215445 - RNA, 19 nt, Human
ggggcugugggaccagcgc

SEQ ID NO: 1215446 - RNA, 22 nt, Human
ggggcugugggaccagcgccca

SEQ ID NO: 1215447 - RNA, 20 nt, Human
gggguauaggcaagcagcaa

SEQ ID NO: 1215448 - RNA, 23 nt, Human
gguagccgcaagggcagggaugg

SEQ ID NO: 1215449 - RNA, 25 nt, Human
ggucccaaccuucuucccuguuugc

SEQ ID NO: 1215450 - RNA, 20 nt, Human
gguccgcccuuggggaagug

SEQ ID NO: 1215451 - RNA, 23 nt, Human
guacuccagccuggugacagagc

SEQ ID NO: 1215452 - RNA, 26 nt, Human
guagugguagccgcaagggcagggau

SEQ ID NO: 1215453 - RNA, 18 nt, Human
guccagcgccaggaugcc

SEQ ID NO: 1215454 - RNA, 23 nt, Human
gucuuuuccucuggaccucggug

SEQ ID NO: 1215455 - RNA, 22 nt, Human
uaacugccaacgugaguucaga

SEQ ID NO: 1215456 - RNA, 19 nt, Human
uaagcuccggcaaccgccu

SEQ ID NO: 1215457 - RNA, 19 nt, Human
uacuccagccuggugacag

SEQ ID NO: 1215458 - RNA, 23 nt, Human
uacuccagccuggugacagagcg

SEQ ID NO: 1215459 - RNA, 19 nt, Human
uaggacagagggagccugg

SEQ ID NO: 1215460 - RNA, 24 nt, Human
uaggcaagucccuuucccucccag

SEQ ID NO: 1215461 - RNA, 30 nt, Human; identical to SEQ ID NO: 1084712

SEQ ID NO: 1215462 - RNA, 22 nt, Human
uaggucuuaaguccccucccag

SEQ ID NO: 1215463 - RNA, 24 nt, Human
uaguccuagcuacucgagaggcug

SEQ ID NO: 1215464 - RNA, 18 nt, Human
uauugggcaagaucacug

SEQ ID NO: 1215465 - RNA, 21 nt, Human
ucaacuccaacucccacuccu

SEQ ID NO: 1215466 - RNA, 20 nt, Human
ucaccgcccccccgccccac

SEQ ID NO: 1215467 - RNA, 22 nt, Human
ucaccgcccccccgccccacca

SEQ ID NO: 1215468 - RNA, 20 nt, Human
ucacuguacuccagccuggu

SEQ ID NO: 1215469 - RNA, 23 nt, Human
ucacuguacuccagccuggugac

SEQ ID NO: 1215470 - RNA, 24 nt, Human
uccacaccccuccccgcccgaccc

SEQ ID NO: 1215471 - RNA, 22 nt, Human
uccagccuggugacagagcgag

SEQ ID NO: 1215472 - RNA, 23 nt, Human
uccagccuggugacagagcgaga

SEQ ID NO: 1215473 - RNA, 27 nt, Human
uccagcgcacagucccagaagggcccc

SEQ ID NO: 1215474 - RNA, 22 nt, Human
ucccaggucgcccaaguccagc

SEQ ID NO: 1215475 - RNA, 24 nt, Human
ucccaggucgcccaaguccagcgc

SEQ ID NO: 1215476 - RNA, 19 nt, Human
uccggccacuggaccacag

SEQ ID NO: 1215477 - RNA, 21 nt, Human
uccggccacuggaccacagga

SEQ ID NO: 1215478 - RNA, 21 nt, Human
uccuccugcuggguccgcccc

SEQ ID NO: 1215479 - RNA, 23 nt, Human
ucuccuagaauggcuguggggau

SEQ ID NO: 1215480 - RNA, 21 nt, Human
ucucgcugcugggggcggggc

SEQ ID NO: 1215481 - RNA, 20 nt, Human
ucuuucaagaacauucacuc

SEQ ID NO: 1215482 - RNA, 18 nt, Human
ugacggggggagcuugac

SEQ ID NO: 1215483 - RNA, 20 nt, Human
ugacuccuuugagccauccc

SEQ ID NO: 1215484 - RNA, 20 nt, Human
ugagaaaaggcaguggggag

SEQ ID NO: 1215485 - RNA, 21 nt, Human
ugagaaaaggcaguggggagg

SEQ ID NO: 1215486 - RNA, 23 nt, Human
ugagaaaaggcaguggggaggug

SEQ ID NO: 1215487 - RNA, 23 nt, Human
ugagcccaggaguucgagaccag

SEQ ID NO: 1215488 - RNA, 22 nt, Human
ugcccagaggagugcccugggg

SEQ ID NO: 1215489 - RNA, 24 nt, Human
ugcccagaggagugcccuggggac

SEQ ID NO: 1215490 - RNA, 18 nt, Human
ugcccuggggacaagugg

SEQ ID NO: 1215491 - RNA, 23 nt, Human
ugcccuggggacaaguggcacac

SEQ ID NO: 1215492 - RNA, 19 nt, Human
ugcccugugaugugcuguu

SEQ ID NO: 1215493 - RNA, 22 nt, Human
ugccuguaguccuagcuacucg

SEQ ID NO: 1215494 - RNA, 23 nt, Human
ugccuguaguccuagcuacucga

SEQ ID NO: 1215495 - RNA, 21 nt, Human
ugcugggggcggggcuuaagc

SEQ ID NO: 1215496 - RNA, 18 nt, Human
ugcuugguccccagaccu

SEQ ID NO: 1215497 - RNA, 20 nt, Human
uggaccacaggagcagaggc

SEQ ID NO: 1215498 - RNA, 26 nt, Human
uggauuuccuucagcuacccugaugu

SEQ ID NO: 1215499 - RNA, 24 nt, Human
uggcagggaggagcuucggugcau

SEQ ID NO: 1215500 - RNA, 24 nt, Human
uggcaugugccuguaguccuagcu

SEQ ID NO: 1215501 - RNA, 23 nt, Human
ugggauguucucgcugcuggggg

SEQ ID NO: 1215502 - RNA, 22 nt, Human
ugguggcaugugccuguagucc

SEQ ID NO: 1215503 - RNA, 20 nt, Human
uguaaagaauggcacccaga

SEQ ID NO: 1215504 - RNA, 24 nt, Human
ugugaugugugcgugagcgagcac

SEQ ID NO: 1215505 - RNA, 21 nt, Human
ugugccuguaguccuagcuac

SEQ ID NO: 1215506 - RNA, 18 nt, Human
uguggauuuccuucagcu

SEQ ID NO: 1215507 - RNA, 23 nt, Human
uguuuugccucacucccacccac

SEQ ID NO: 1215508 - RNA, 24 nt, Human
uguuuuuguuuccaaauggcugga

SEQ ID NO: 1215509 - RNA, 24 nt, Human
uucggugcauggguguggccggca

SEQ ID NO: 1215510 - RNA, 24 nt, Human
uucucgcugcugggggcggggcuu

SEQ ID NO: 1215511 - RNA, 22 nt, Human
uugagcccaggaguucgagacc

SEQ ID NO: 1215512 - RNA, 20 nt, Human
uuggugguggcaugugccug

SEQ ID NO: 1215513 - RNA, 19 nt, Human
uuucuaaggaaaaugguuc

SEQ ID NO: 1215514 - RNA, 21 nt, Human
uuugcccacucucagaccccg

SEQ ID NO: 1215515 - RNA, 19 nt, Human
aaauaaauuuaaacuauaa

SEQ ID NO: 1215516 - RNA, 19 nt, Human
aaauaaauuuaaacuauaa

SEQ ID NO: 1215517 - RNA, 19 nt, Human
aaauaaauuuaaacuauaa

SEQ ID NO: 1215518 - RNA, 21 nt, Human
cccgcagccucuccagcuccu

SEQ ID NO: 1215519 - RNA, 22 nt, Human
ccucuccagcuccugcagaguc

SEQ ID NO: 1215520 - RNA, 19 nt, Human
gccacagccucucauccug

SEQ ID NO: 1215521 - RNA, 20 nt, Human
ggauauuaaccccuuaaaug

SEQ ID NO: 1215522 - RNA, 22 nt, Human
uaaauuagaaacacaaauaaac

SEQ ID NO: 1215523 - RNA, 27 nt, Human
uaaauuagaaacacaaauaaauuuaaa

SEQ ID NO: 1215524 - RNA, 27 nt, Human
uaaauuagaaacacaaauaaauuuaaa

SEQ ID NO: 1215525 - RNA, 27 nt, Human
uaaauuagaaacacaaauaaauuuaaa

SEQ ID NO: 1215526 - RNA, 18 nt, Human
uagaaacacaaauaaaca

SEQ ID NO: 1215527 - RNA, 19 nt, Human
ucuccagcucccgcagccu

SEQ ID NO: 1215528 - RNA, 19 nt, Human
ucuccagcucccgcagccu

SEQ ID NO: 1215529 - RNA, 21 nt, Human
uuaaauguuuuguuuuuuuuu

SEQ ID NO: 1215530 - RNA, 22 nt, Human
uuuaaacuauaaauuagaaaca

SEQ ID NO: 1215531 - RNA, 22 nt, Human
uuuaaacuauaaauuagaaaca

SEQ ID NO: 1215532 - RNA, 22 nt, Human
uuuaaacuauaaauuagaaaca

SEQ ID NO: 1215533 - RNA, 19 nt, Human
aaaaaaaacugaguagaca

SEQ ID NO: 1215534 - RNA, 23 nt, Human
aaccuucuucccuguuugcccac

SEQ ID NO: 1215535 - RNA, 18 nt, Human
aacuccuagcccaguccc

SEQ ID NO: 1215536 - RNA, 18 nt, Human
aaggagcacuggcugcag

SEQ ID NO: 1215537 - RNA, 24 nt, Human
aaguccccucccagaucugugacc

SEQ ID NO: 1215538 - RNA, 20 nt, Human
aauggcuguggggaucaagg

SEQ ID NO: 1215539 - RNA, 22 nt, Human
acaaaaauuuuaaaaauagcug

SEQ ID NO: 1215540 - RNA, 23 nt, Human
acagagggagccugggggccaca

SEQ ID NO: 1215541 - RNA, 25 nt, Human
acagguaccagagacugccccccac

SEQ ID NO: 1215542 - RNA, 20 nt, Human
acagucccagaagggcccag

SEQ ID NO: 1215543 - RNA, 21 nt, Human
accuggagugacggggggagc

SEQ ID NO: 1215544 - RNA, 23 nt, Human
acuguacuccagccuggugacag

SEQ ID NO: 1215545 - RNA, 25 nt, Human
acuguacuccagccuggugacagag

SEQ ID NO: 1215546 - RNA, 19 nt, Human
acugugugaccagcaaggu

SEQ ID NO: 1215547 - RNA, 24 nt, Human
agacccuaucaccgccccccgccc

SEQ ID NO: 1215548 - RNA, 22 nt, Human
agacugccccccacggccccaa

SEQ ID NO: 1215549 - RNA, 23 nt, Human
agaguggggcugugggaccagcg

SEQ ID NO: 1215550 - RNA, 24 nt, Human
agccugggccacauagugagaccu

SEQ ID NO: 1215551 - RNA, 25 nt, Human
agccugggccacauagugagaccuu

SEQ ID NO: 1215552 - RNA, 23 nt, Human
agccuggugacagagcgagaccc

SEQ ID NO: 1215553 - RNA, 26 nt, Human
agcugggcuuggugguggcaugugcc

SEQ ID NO: 1215554 - RNA, 19 nt, Human
aggagcagaggcgagucug

SEQ ID NO: 1215555 - RNA, 24 nt, Human
aggaguucgagaccagccugggcc

SEQ ID NO: 1215556 - RNA, 24 nt, Human
aggaucacuugagcccaggaguuc

SEQ ID NO: 1215557 - RNA, 18 nt, Human
aggcaggaggaucacuug

SEQ ID NO: 1215558 - RNA, 23 nt, Human
aggcaggaggaucacuugagccc

SEQ ID NO: 1215559 - RNA, 24 nt, Human
aggcaggaggaucacuugagccca

SEQ ID NO: 1215560 - RNA, 24 nt, Human
aggccgaggcaggaggaucacuug

SEQ ID NO: 1215561 - RNA, 22 nt, Human
aggcuauuuggcacccaggucu

SEQ ID NO: 1215562 - RNA, 25 nt, Human
agguaccagagacugccccccacgg

SEQ ID NO: 1215563 - RNA, 19 nt, Human
agguggaggcugcagugag

SEQ ID NO: 1215564 - RNA, 20 nt, Human
agguggaggcugcagugagc

SEQ ID NO: 1215565 - RNA, 19 nt, Human
aguccagcgccaggaugcc

SEQ ID NO: 1215566 - RNA, 25 nt, Human
agugacggggggagcuugacaagga

SEQ ID NO: 1215567 - RNA, 25 nt, Human
aucucuccccucccugugccuccca

SEQ ID NO: 1215568 - RNA, 20 nt, Human
augaagcagggauuggggcu

SEQ ID NO: 1215569 - RNA, 21 nt, Human
augugggaaccagaacacacu

SEQ ID NO: 1215570 - RNA, 22 nt, Human
augugggaaccagaacacacug

SEQ ID NO: 1215571 - RNA, 18 nt, Human
auuucuucuccacacccc

SEQ ID NO: 1215572 - RNA, 19 nt, Human
caacuccuagcccaguccc

SEQ ID NO: 1215573 - RNA, 23 nt, Human
caaguccagcgccaggaugccca

SEQ ID NO: 1215574 - RNA, 22 nt, Human
cacacugauggaggaguuggca

SEQ ID NO: 1215575 - RNA, 19 nt, Human
cacagguaccagagacugc

SEQ ID NO: 1215576 - RNA, 26 nt, Human
caccaaaaaaaaacugaguagacagu

SEQ ID NO: 1215577 - RNA, 19 nt, Human
caccaugcccaugcccccg

SEQ ID NO: 1215578 - RNA, 20 nt, Human
caccaugcccaugcccccgc

SEQ ID NO: 1215579 - RNA, 21 nt, Human
cacccagaccugagcuaggac

SEQ ID NO: 1215580 - RNA, 21 nt, Human
cacuccuggaggccgaggcag

SEQ ID NO: 1215581 - RNA, 19 nt, Human
cacugcgcuggggcggggc

SEQ ID NO: 1215582 - RNA, 19 nt, Human
cacuggcugcagggggggg

SEQ ID NO: 1215583 - RNA, 18 nt, Human
cacuguacuccagccugg

SEQ ID NO: 1215584 - RNA, 18 nt, Human
cacuguacuccagccugg

SEQ ID NO: 1215585 - RNA, 20 nt, Human
cacuguacuccagccuggug

SEQ ID NO: 1215586 - RNA, 21 nt, Human
cacuguacuccagccugguga

SEQ ID NO: 1215587 - RNA, 22 nt, Human
cacuguacuccagccuggugac

SEQ ID NO: 1215588 - RNA, 23 nt, Human
cacuguacuccagccuggugaca

SEQ ID NO: 1215589 - RNA, 24 nt, Human
cacuguacuccagccuggugacag

SEQ ID NO: 1215590 - RNA, 24 nt, Human
cacuuugagcccaggagguggagg

SEQ ID NO: 1215591 - RNA, 19 nt, Human
cagagccucagcaucccuu

SEQ ID NO: 1215592 - RNA, 23 nt, Human
cagagcgagacccuaucaccgcc

SEQ ID NO: 1215593 - RNA, 23 nt, Human
cagcaaggcagccagggcggcac

SEQ ID NO: 1215594 - RNA, 19 nt, Human
cagccagggcggcacaggc

SEQ ID NO: 1215595 - RNA, 20 nt, Human
caggagguggaggcugcagu

SEQ ID NO: 1215596 - RNA, 23 nt, Human
caggaugcccaggcuccugggcu

SEQ ID NO: 1215597 - RNA, 19 nt, Human
caggcaucaacuccaacuc

SEQ ID NO: 1215598 - RNA, 25 nt, Human
caggcuccugggcuuccuccccgag

SEQ ID NO: 1215599 - RNA, 21 nt, Human
caggcuccugggcuuccuccu

SEQ ID NO: 1215600 - RNA, 24 nt, Human
cagggcggcacaggcaccaggucc

SEQ ID NO: 1215601 - RNA, 18 nt, Human
cagggggggggggggggg

SEQ ID NO: 1215602 - RNA, 18 nt, Human
caggucgcccaaguccag

SEQ ID NO: 1215603 - RNA, 22 nt, Human
caggugcagagcaucccugacg

SEQ ID NO: 1215604 - RNA, 24 nt, Human
cagucaucacuguacuccagccug

SEQ ID NO: 1215605 - RNA, 24 nt, Human
cagugagcagucaucacuguacuc

SEQ ID NO: 1215606 - RNA, 18 nt, Human
cauccuuuggcugggccu

SEQ ID NO: 1215607 - RNA, 24 nt, Human
caucucuccccucccugugccucc

SEQ ID NO: 1215608 - RNA, 24 nt, Human
caugcaccacgcgcugaaggaggc

SEQ ID NO: 1215609 - RNA, 22 nt, Human
ccaaaaucccccacccgggaug

SEQ ID NO: 1215610 - RNA, 21 nt, Human
ccaacuccuagcccagucccg

SEQ ID NO: 1215611 - RNA, 18 nt, Human
ccacaccccuccccgccc

SEQ ID NO: 1215612 - RNA, 20 nt, Human
ccacauagugagaccuuguc

SEQ ID NO: 1215613 - RNA, 24 nt, Human
ccacggccccaaaaucccccaccc

SEQ ID NO: 1215614 - RNA, 24 nt, Human
ccacuggaccacaggagcagaggc

SEQ ID NO: 1215615 - RNA, 19 nt, Human
ccacuuccaaguccugacu

SEQ ID NO: 1215616 - RNA, 22 nt, Human
ccacuuccaaguccugacuccu

SEQ ID NO: 1215617 - RNA, 20 nt, Human
ccagagacugccccccacgg

SEQ ID NO: 1215618 - RNA, 25 nt, Human
ccaggaguucgagaccagccugggc

SEQ ID NO: 1215619 - RNA, 19 nt, Human
ccaugcccccgcccgugga

SEQ ID NO: 1215620 - RNA, 25 nt, Human
cccaaaaucccccacccgggaugcc

SEQ ID NO: 1215621 - RNA, 25 nt, Human
cccacagagcuccuguauccaggca

SEQ ID NO: 1215622 - RNA, 22 nt, Human
cccacccgggaugcccagagga

SEQ ID NO: 1215623 - RNA, 20 nt, Human
cccauauauaaaaaugaagc

SEQ ID NO: 1215624 - RNA, 21 nt, Human
cccauauauaaaaaugaagca

SEQ ID NO: 1215625 - RNA, 23 nt, Human
cccccacccgggaugcccagagg

SEQ ID NO: 1215626 - RNA, 21 nt, Human
ccccccacggccccaaaaucc

SEQ ID NO: 1215627 - RNA, 25 nt, Human
cccccgccccaccaaaaaaaaacug

SEQ ID NO: 1215628 - RNA, 22 nt, Human
ccccgccccaccaaaaaaaaac

SEQ ID NO: 1215629 - RNA, 18 nt, Human
ccccgcccgacccugucu

SEQ ID NO: 1215630 - RNA, 18 nt, Human
ccccucccugugccuccc

SEQ ID NO: 1215631 - RNA, 19 nt, Human
cccgccccaccaaaaaaaa

SEQ ID NO: 1215632 - RNA, 23 nt, Human
cccgccccaccaaaaaaaaacug

SEQ ID NO: 1215633 - RNA, 22 nt, Human
cccuuucccucccagagccuca

SEQ ID NO: 1215634 - RNA, 20 nt, Human
ccgccccaccaaaaaaaaac

SEQ ID NO: 1215635 - RNA, 20 nt, Human
ccgccccccgccccaccaaa

SEQ ID NO: 1215636 - RNA, 20 nt, Human
ccuagcccagucccgggggc

SEQ ID NO: 1215637 - RNA, 23 nt, Human
ccuaucaccgccccccgccccac

SEQ ID NO: 1215638 - RNA, 22 nt, Human
ccugagcuaggacagagggagc

SEQ ID NO: 1215639 - RNA, 21 nt, Human
ccugggccacauagugagacc

SEQ ID NO: 1215640 - RNA, 18 nt, Human
ccugucuaaacuaauggg

SEQ ID NO: 1215641 - RNA, 24 nt, Human
cgagaccagccugggccacauagu

SEQ ID NO: 1215642 - RNA, 21 nt, Human
cgagacccuaucaccgccccc

SEQ ID NO: 1215643 - RNA, 22 nt, Human
cgagacccuaucaccgcccccc

SEQ ID NO: 1215644 - RNA, 22 nt, Human
cgagaugcugcacaugcaccac

SEQ ID NO: 1215645 - RNA, 19 nt, Human
cgagcacacgaguguaaag

SEQ ID NO: 1215646 - RNA, 20 nt, Human
cgaggcaggaggaucacuug

SEQ ID NO: 1215647 - RNA, 24 nt, Human
cgaggcaggaggaucacuugagcc

SEQ ID NO: 1215648 - RNA, 20 nt, Human
cgcucagcaucaucggugac

SEQ ID NO: 1215649 - RNA, 20 nt, Human
cggccacuggaccacaggag

SEQ ID NO: 1215650 - RNA, 20 nt, Human
cggccccaaaaucccccacc

SEQ ID NO: 1215651 - RNA, 21 nt, Human
cggccccaaaaucccccaccc

SEQ ID NO: 1215652 - RNA, 21 nt, Human
cuacugcauccuuuggcuggg

SEQ ID NO: 1215653 - RNA, 18 nt, Human
cuccacaccccuccccgc

SEQ ID NO: 1215654 - RNA, 23 nt, Human
cuccacaccccuccccgcccgac

SEQ ID NO: 1215655 - RNA, 24 nt, Human
cuccagccuggugacagagcgaga

SEQ ID NO: 1215656 - RNA, 23 nt, Human
cugaagccuacuucacucccaaa

SEQ ID NO: 1215657 - RNA, 26 nt, Human
cugacuccagucuugcuaacacacac

SEQ ID NO: 1215658 - RNA, 23 nt, Human
cuggaccucgguguccccaucug

SEQ ID NO: 1215659 - RNA, 24 nt, Human
cuggaggccgaggcaggaggauca

SEQ ID NO: 1215660 - RNA, 20 nt, Human
cugggcuuccuccugcuggg

SEQ ID NO: 1215661 - RNA, 21 nt, Human
cuuaaguccccucccagaucu

SEQ ID NO: 1215662 - RNA, 19 nt, Human
cuuugagcccaggaggugg

SEQ ID NO: 1215663 - RNA, 23 nt, Human
cuuuggcugggccuuguugaccc

SEQ ID NO: 1215664 - RNA, 18 nt, Human
gagcgagcacacgagugu

SEQ ID NO: 1215665 - RNA, 18 nt, Human
gagcuucggugcaugggu

SEQ ID NO: 1215666 - RNA, 18 nt, Human
gagugcccugggggcaag

SEQ ID NO: 1215667 - RNA, 24 nt, Human
gaucacuugagcccaggaguucga

SEQ ID NO: 1215668 - RNA, 23 nt, Human
gccacauagugagaccuugucuc

SEQ ID NO: 1215669 - RNA, 24 nt, Human
gcccaggagguggaggcugcagug

SEQ ID NO: 1215670 - RNA, 22 nt, Human
gcccaggaguucgagaccagcc

SEQ ID NO: 1215671 - RNA, 23 nt, Human
gccgcaagggcagggaugggagu

SEQ ID NO: 1215672 - RNA, 22 nt, Human
gcgagacccuaucaccgccccc

SEQ ID NO: 1215673 - RNA, 19 nt, Human
gcugcaggggggggggggg

SEQ ID NO: 1215674 - RNA, 19 nt, Human
ggaagugugccccauaccc

SEQ ID NO: 1215675 - RNA, 18 nt, Human
ggaggcugcagugagcag

SEQ ID NO: 1215676 - RNA, 23 nt, Human
ggaucacuugagcccaggaguuc

SEQ ID NO: 1215677 - RNA, 22 nt, Human
ggcaagaucacuggacugggag

SEQ ID NO: 1215678 - RNA, 22 nt, Human
ggcaagcucauuucuucuccac

SEQ ID NO: 1215679 - RNA, 18 nt, Human
ggcaaguggcacaccccc

SEQ ID NO: 1215680 - RNA, 18 nt, Human
ggcacccaggucuauggu

SEQ ID NO: 1215681 - RNA, 18 nt, Human
ggccgaggcaggaggauc

SEQ ID NO: 1215682 - RNA, 25 nt, Human
ggcugcagggggggggggggggggu

SEQ ID NO: 1215683 - RNA, 20 nt, Human
ggcuuggugguggcaugugc

SEQ ID NO: 1215684 - RNA, 19 nt, Human
gggcaaguggcacaccccc

SEQ ID NO: 1215685 - RNA, 22 nt, Human
gggcaaguggcacacccccuuc

SEQ ID NO: 1215686 - RNA, 22 nt, Human
ggggagguggaucuuccagucg

SEQ ID NO: 1215687 - RNA, 19 nt, Human
ggggcugugggaccagcgc

SEQ ID NO: 1215688 - RNA, 22 nt, Human
ggggcugugggaccagcgccca

SEQ ID NO: 1215689 - RNA, 18 nt, Human
gggggggggggggggggu

SEQ ID NO: 1215690 - RNA, 20 nt, Human
gggguauaggcaagcagcaa

SEQ ID NO: 1215691 - RNA, 23 nt, Human
gguagccgcaagggcagggaugg

SEQ ID NO: 1215692 - RNA, 25 nt, Human
ggucccaaccuucuucccuguuugc

SEQ ID NO: 1215693 - RNA, 20 nt, Human
gguccgcccuuggggaagug

SEQ ID NO: 1215694 - RNA, 23 nt, Human
guacuccagccuggugacagagc

SEQ ID NO: 1215695 - RNA, 26 nt, Human
guagugguagccgcaagggcagggau

SEQ ID NO: 1215696 - RNA, 18 nt, Human
guccagcgccaggaugcc

SEQ ID NO: 1215697 - RNA, 23 nt, Human
gucuuuuccucuggaccucggug

SEQ ID NO: 1215698 - RNA, 20 nt, Human
guggcagggaggagcuucgg

SEQ ID NO: 1215699 - RNA, 22 nt, Human
uaacugccaacgugaguucaga

SEQ ID NO: 1215700 - RNA, 19 nt, Human
uaagcuccggcaaccgccu

SEQ ID NO: 1215701 - RNA, 19 nt, Human
uacuccagccuggugacag

SEQ ID NO: 1215702 - RNA, 23 nt, Human
uacuccagccuggugacagagcg

SEQ ID NO: 1215703 - RNA, 19 nt, Human
uaggacagagggagccugg

SEQ ID NO: 1215704 - RNA, 24 nt, Human
uaggcaagucccuuucccucccag

SEQ ID NO: 1215705 - RNA, 30 nt, Human; identical to SEQ ID NO: 1084712

SEQ ID NO: 1215706 - RNA, 22 nt, Human
uaggucuuaaguccccucccag

SEQ ID NO: 1215707 - RNA, 24 nt, Human
uaguccuagcuacucgagaggcug

SEQ ID NO: 1215708 - RNA, 18 nt, Human
uauugggcaagaucacug

SEQ ID NO: 1215709 - RNA, 21 nt, Human
ucaacuccaacucccacuccu

SEQ ID NO: 1215710 - RNA, 19 nt, Human
ucacuguacuccagccugg

SEQ ID NO: 1215711 - RNA, 20 nt, Human
ucacuguacuccagccuggu

SEQ ID NO: 1215712 - RNA, 23 nt, Human
ucacuguacuccagccuggugac

SEQ ID NO: 1215713 - RNA, 20 nt, Human
ucacuugagcccaggaguuc

SEQ ID NO: 1215714 - RNA, 24 nt, Human
uccacaccccuccccgcccgaccc

SEQ ID NO: 1215715 - RNA, 22 nt, Human
uccagccuggugacagagcgag

SEQ ID NO: 1215716 - RNA, 27 nt, Human
uccagcgcacagucccagaagggcccc

SEQ ID NO: 1215717 - RNA, 22 nt, Human
ucccaggucgcccaaguccagc

SEQ ID NO: 1215718 - RNA, 24 nt, Human
ucccaggucgcccaaguccagcgc

SEQ ID NO: 1215719 - RNA, 21 nt, Human
uccccagagcucaggacccug

SEQ ID NO: 1215720 - RNA, 19 nt, Human
uccggccacuggaccacag

SEQ ID NO: 1215721 - RNA, 21 nt, Human
uccggccacuggaccacagga

SEQ ID NO: 1215722 - RNA, 21 nt, Human
uccuccugcuggguccgcccc

SEQ ID NO: 1215723 - RNA, 23 nt, Human
ucuccuagaauggcuguggggau

SEQ ID NO: 1215724 - RNA, 21 nt, Human
ucucgcugcugggggcggggc

SEQ ID NO: 1215725 - RNA, 20 nt, Human
ucuuucaagaacauucacuc

SEQ ID NO: 1215726 - RNA, 18 nt, Human
ugacggggggagcuugac

SEQ ID NO: 1215727 - RNA, 20 nt, Human
ugacuccuuugagccauccc

SEQ ID NO: 1215728 - RNA, 18 nt, Human
ugagaaaaggcagugggg

SEQ ID NO: 1215729 - RNA, 20 nt, Human
ugagaaaaggcaguggggag

SEQ ID NO: 1215730 - RNA, 21 nt, Human
ugagaaaaggcaguggggagg

SEQ ID NO: 1215731 - RNA, 23 nt, Human
ugagaaaaggcaguggggaggug

SEQ ID NO: 1215732 - RNA, 23 nt, Human
ugagcccaggaguucgagaccag

SEQ ID NO: 1215733 - RNA, 19 nt, Human
ugaggugugacauauggga

SEQ ID NO: 1215734 - RNA, 21 nt, Human
ugcaggggggggggggggggg

SEQ ID NO: 1215735 - RNA, 22 nt, Human
ugcccagaggagugcccugggg

SEQ ID NO: 1215736 - RNA, 24 nt, Human
ugcccagaggagugcccugggggc

SEQ ID NO: 1215737 - RNA, 21 nt, Human
ugcccugggggcaaguggcac

SEQ ID NO: 1215738 - RNA, 23 nt, Human
ugcccugggggcaaguggcacac

SEQ ID NO: 1215739 - RNA, 19 nt, Human
ugcccugugaugugcuguu

SEQ ID NO: 1215740 - RNA, 22 nt, Human
ugccuguaguccuagcuacucg

SEQ ID NO: 1215741 - RNA, 23 nt, Human
ugccuguaguccuagcuacucga

SEQ ID NO: 1215742 - RNA, 21 nt, Human
ugcugggggcggggcuuaagc

SEQ ID NO: 1215743 - RNA, 26 nt, Human
uggauuuccuucagcuacccugaugu

SEQ ID NO: 1215744 - RNA, 24 nt, Human
uggcagggaggagcuucggugcau

SEQ ID NO: 1215745 - RNA, 24 nt, Human
uggcaugugccuguaguccuagcu

SEQ ID NO: 1215746 - RNA, 23 nt, Human
ugggauguucucgcugcuggggg

SEQ ID NO: 1215747 - RNA, 22 nt, Human
ugguggcaugugccuguagucc

SEQ ID NO: 1215748 - RNA, 20 nt, Human
uguaaagaauggcacccaga

SEQ ID NO: 1215749 - RNA, 24 nt, Human
ugugaugugugcgugagcgagcac

SEQ ID NO: 1215750 - RNA, 21 nt, Human
ugugccuguaguccuagcuac

SEQ ID NO: 1215751 - RNA, 24 nt, Human
uguuuuuguuuccaaauggcugga

SEQ ID NO: 1215752 - RNA, 24 nt, Human
uucggugcauggguguggccggca

SEQ ID NO: 1215753 - RNA, 20 nt, Human
uucuccacaccccuccccgc

SEQ ID NO: 1215754 - RNA, 24 nt, Human
uucucgcugcugggggcggggcuu

SEQ ID NO: 1215755 - RNA, 18 nt, Human
uucucuaaggaagaacaa

SEQ ID NO: 1215756 - RNA, 22 nt, Human
uugagcccaggaguucgagacc

SEQ ID NO: 1215757 - RNA, 19 nt, Human
uuucuaaggaaaaugguuc

SEQ ID NO: 1215758 - RNA, 21 nt, Human
uuugcccacucucagaccccg

SEQ ID NO: 1215759 - RNA, 20 nt, Human
aaaguuauauuuuauggcug

SEQ ID NO: 1215760 - RNA, 18 nt, Human
aaauaaguuauugcugug

SEQ ID NO: 1215761 - RNA, 18 nt, Human
aagaaguccaguuggaaa

SEQ ID NO: 1215762 - RNA, 23 nt, Human
aagauaccagcucccccgacccc

SEQ ID NO: 1215763 - RNA, 21 nt, Human
aagcacugcggcgaaagcccg

SEQ ID NO: 1215764 - RNA, 24 nt, Human
aauaaaaagcaaagaauccacuug

SEQ ID NO: 1215765 - RNA, 22 nt, Human
acagcagggggcgccccggcgc

SEQ ID NO: 1215766 - RNA, 21 nt, Human
accagcucccccgaccccggc

SEQ ID NO: 1215767 - RNA, 18 nt, Human
acccuccagagacagccu

SEQ ID NO: 1215768 - RNA, 18 nt, Human
agaaaauaaaaagcaaag

SEQ ID NO: 1215769 - RNA, 19 nt, Human
agaaaauaaaaagcaaaga

SEQ ID NO: 1215770 - RNA, 22 nt, Human
agaacccagagucccagauagc

SEQ ID NO: 1215771 - RNA, 21 nt, Human
agagacacacccuccagagac

SEQ ID NO: 1215772 - RNA, 22 nt, Human
agagacagccuggggggcugcc

SEQ ID NO: 1215773 - RNA, 18 nt, Human
agcagagacacacccucc

SEQ ID NO: 1215774 - RNA, 19 nt, Human
agccccgggaagaagucca

SEQ ID NO: 1215775 - RNA, 20 nt, Human
aggcaggggcaggggcgcgg

SEQ ID NO: 1215776 - RNA, 22 nt, Human
aggcaggggcaggggcgcgggg

SEQ ID NO: 1215777 - RNA, 23 nt, Human
aggcaggggcaggggcgcggggc

SEQ ID NO: 1215778 - RNA, 23 nt, Human
aggccgaggaccggggcgcggga

SEQ ID NO: 1215779 - RNA, 22 nt, Human
aggggcaggggcgcggggcugg

SEQ ID NO: 1215780 - RNA, 28 nt, Human
auggaucaucugccccucgguucgcugu

SEQ ID NO: 1215781 - RNA, 20 nt, Human
cacacccuccagagacagcc

SEQ ID NO: 1215782 - RNA, 22 nt, Human
cacacccuccagagacagccug

SEQ ID NO: 1215783 - RNA, 18 nt, Human
cagaaagagccccgggaa

SEQ ID NO: 1215784 - RNA, 23 nt, Human
caggggcaggggcgcggggcugg

SEQ ID NO: 1215785 - RNA, 19 nt, Human
ccacaccgccgcuccugac

SEQ ID NO: 1215786 - RNA, 18 nt, Human
cccagagucccagauagc

SEQ ID NO: 1215787 - RNA, 18 nt, Human
ccccggcgcuggagguga

SEQ ID NO: 1215788 - RNA, 18 nt, Human
cccgagcugcccuccucu

SEQ ID NO: 1215789 - RNA, 19 nt, Human
cccgcaccccaccucugaa

SEQ ID NO: 1215790 - RNA, 21 nt, Human
cccgcaccccaccucugaaaa

SEQ ID NO: 1215791 - RNA, 25 nt, Human
cccgcaccccaccucugaaaagccc

SEQ ID NO: 1215792 - RNA, 24 nt, Human
cccgcccccacgccaggagcccac

SEQ ID NO: 1215793 - RNA, 19 nt, Human
cccucgguucgcugucccc

SEQ ID NO: 1215794 - RNA, 26 nt, Human
ccgaccccggcuaggagcacacacgu

SEQ ID NO: 1215795 - RNA, 18 nt, Human
ccgggccacuuggcuucg

SEQ ID NO: 1215796 - RNA, 23 nt, Human
ccucccagaagggccaagauacc

SEQ ID NO: 1215797 - RNA, 24 nt, Human
ccucgggcugugcgcguccuccca

SEQ ID NO: 1215798 - RNA, 24 nt, Human
ccucugcccggucacagccgcuuc

SEQ ID NO: 1215799 - RNA, 18 nt, Human
cgaaagcccgagcugccc

SEQ ID NO: 1215800 - RNA, 21 nt, Human
cgccaggagcccacucggugg

SEQ ID NO: 1215801 - RNA, 25 nt, Human
cguccagggccacacugggauguuc

SEQ ID NO: 1215802 - RNA, 28 nt, Human
cucccggaaaaaggcaggggcaggggcu

SEQ ID NO: 1215803 - RNA, 21 nt, Human
cugaaggcugggaguccggag

SEQ ID NO: 1215804 - RNA, 24 nt, Human
cugcgcgcggcuggucccgccccc

SEQ ID NO: 1215805 - RNA, 19 nt, Human
cugcggcgaaagcccgagc

SEQ ID NO: 1215806 - RNA, 22 nt, Human
cugggcccagaaagagccccgg

SEQ ID NO: 1215807 - RNA, 18 nt, Human
cuggucccgcccccacgc

SEQ ID NO: 1215808 - RNA, 20 nt, Human
gaaagcccgagcugcccucc

SEQ ID NO: 1215809 - RNA, 22 nt, Human
gcccagaaagagccccgggaag

SEQ ID NO: 1215810 - RNA, 21 nt, Human
gcccccacgccaggagcccac

SEQ ID NO: 1215811 - RNA, 21 nt, Human
ggccaagauaccagcuccccc

SEQ ID NO: 1215812 - RNA, 25 nt, Human
ggccacuuggcuucgucugaaaaua

SEQ ID NO: 1215813 - RNA, 28 nt, Human
ggcgccccggcgcuggaggugagaggcc

SEQ ID NO: 1215814 - RNA, 18 nt, Human
gggaagcagagacacacc

SEQ ID NO: 1215815 - RNA, 22 nt, Human
gggcgccccggcgcuggaggug

SEQ ID NO: 1215816 - RNA, 23 nt, Human
gggcugggcagugccggcucuuu

SEQ ID NO: 1215817 - RNA, 23 nt, Human
ggggcaggggcgcggggcugggc

SEQ ID NO: 1215818 - RNA, 18 nt, Human
ggucccagagcuuggggc

SEQ ID NO: 1215819 - RNA, 20 nt, Human
gucugaaaauaaacacgggg

SEQ ID NO: 1215820 - RNA, 22 nt, Human
uaaaaagcaaagaauccacuug

SEQ ID NO: 1215821 - RNA, 23 nt, Human
ucacaaaggcagcugggcccaga

SEQ ID NO: 1215822 - RNA, 18 nt, Human
uccccucgcccgcacccc

SEQ ID NO: 1215823 - RNA, 21 nt, Human
uccuugaugaggggcacgacg

SEQ ID NO: 1215824 - RNA, 23 nt, Human
ucugaaggcugggaguccggagg

SEQ ID NO: 1215825 - RNA, 23 nt, Human
ugaaaauaaacacggggaaaggg

SEQ ID NO: 1215826 - RNA, 24 nt, Human
ugaccuucuccuugggguccuugg

SEQ ID NO: 1215827 - RNA, 22 nt, Human
ugaugaggggcacgacgguccc

SEQ ID NO: 1215828 - RNA, 26 nt, Human
ugcaucguccccucgcccgcacccca

SEQ ID NO: 1215829 - RNA, 18 nt, Human
uggauaaagacaaauaag

SEQ ID NO: 1215830 - RNA, 20 nt, Human
ugggcccagaaagagccccg

SEQ ID NO: 1215831 - RNA, 22 nt, Human
ugggcccagaaagagccccggg

SEQ ID NO: 1215832 - RNA, 25 nt, Human
uguacuaaaacauuuucuucagccu

SEQ ID NO: 1215833 - RNA, 21 nt, Human
ugugcgcguccucccagaagg

SEQ ID NO: 1215834 - RNA, 20 nt, Human
uucuccuugggguccuuggc

SEQ ID NO: 1215835 - RNA, 18 nt, Human
aagaaguccaguuggaaa

SEQ ID NO: 1215836 - RNA, 23 nt, Human
aauaaaaagcaaagaauccacuu

SEQ ID NO: 1215837 - RNA, 22 nt, Human
acagcagggggcgccccggcgc

SEQ ID NO: 1215838 - RNA, 18 nt, Human
agaaaauaaaaagcaaag

SEQ ID NO: 1215839 - RNA, 19 nt, Human
agaaaauaaaaagcaaaga

SEQ ID NO: 1215840 - RNA, 22 nt, Human
agaacccagagucccagauagc

SEQ ID NO: 1215841 - RNA, 19 nt, Human
agccccgggaagaagucca

SEQ ID NO: 1215842 - RNA, 23 nt, Human
aggccgaggaccggggcgcggga

SEQ ID NO: 1215843 - RNA, 18 nt, Human
cccagagucccagauagc

SEQ ID NO: 1215844 - RNA, 18 nt, Human
ccccggcgcuggagguga

SEQ ID NO: 1215845 - RNA, 19 nt, Human
cccucgguucgcugucccc

SEQ ID NO: 1215846 - RNA, 24 nt, Human
ccucugcccggucacagccgcuuc

SEQ ID NO: 1215847 - RNA, 19 nt, Human
cgcuggaggugagaggccg

SEQ ID NO: 1215848 - RNA, 22 nt, Human
cugggcccagaaagagccccgg

SEQ ID NO: 1215849 - RNA, 22 nt, Human
gcccagaaagagccccgggaag

SEQ ID NO: 1215850 - RNA, 28 nt, Human
ggcgccccggcgcuggaggugagaggcc

SEQ ID NO: 1215851 - RNA, 22 nt, Human
gggcgccccggcgcuggaggug

SEQ ID NO: 1215852 - RNA, 22 nt, Human
uaaaaagcaaagaauccacuug

SEQ ID NO: 1215853 - RNA, 23 nt, Human
ucacaaaggcagcugggcccaga

SEQ ID NO: 1215854 - RNA, 18 nt, Human
uccccgggcugagaaccc

SEQ ID NO: 1215855 - RNA, 20 nt, Human
ugggcccagaaagagccccg

SEQ ID NO: 1215856 - RNA, 22 nt, Human
ugggcccagaaagagccccggg

SEQ ID NO: 1215857 - RNA, 19 nt, Human
acacccagcuccccacacg

SEQ ID NO: 1215858 - RNA, 19 nt, Human
agaaauuggaaaagaacau

SEQ ID NO: 1215859 - RNA, 22 nt, Human
agccauggaggcuggggggcuu

SEQ ID NO: 1215860 - RNA, 22 nt, Human
auccaguaggaugcucugcacc

SEQ ID NO: 1215861 - RNA, 18 nt, Human
auggaggcuggggggcuu

SEQ ID NO: 1215862 - RNA, 24 nt, Human
cacacccagcuccccacacgaucu

SEQ ID NO: 1215863 - RNA, 21 nt, Human
caggaccccagacucucccga

SEQ ID NO: 1215864 - RNA, 30 nt, Human
ccagaucacacacccagcuccccacacgag

SEQ ID NO: 1215865 - RNA, 19 nt, Human
cccacacgaucuagagggu

SEQ ID NO: 1215866 - RNA, 26 nt, Human
cucaggaccccagacucucccgauuc

SEQ ID NO: 1215867 - RNA, 20 nt, Human
cugcaccugcagucaggagu

SEQ ID NO: 1215868 - RNA, 21 nt, Human
cuggccagaucacacacccag

SEQ ID NO: 1215869 - RNA, 21 nt, Human
gccucaucuuaguucugacuc

SEQ ID NO: 1215870 - RNA, 21 nt, Human
gggagaaacaacuggccagau

SEQ ID NO: 1215871 - RNA, 24 nt, Human
ggggggcuuuggggccgugggggc

SEQ ID NO: 1215872 - RNA, 19 nt, Human
uacccagaauuugucucca

SEQ ID NO: 1215873 - RNA, 25 nt, Human
uaccuggaacauugaggcacagggg

SEQ ID NO: 1215874 - RNA, 24 nt, Human
uagaggguuucaggucucggccuc

SEQ ID NO: 1215875 - RNA, 25 nt, Human
ucacacacccagcuccccacacgau

SEQ ID NO: 1215876 - RNA, 20 nt, Human
ugcucugcaccugcagucaa

SEQ ID NO: 1215877 - RNA, 21 nt, Human
uggaaaagaacaucuccaggu

SEQ ID NO: 1215878 - RNA, 21 nt, Human
uggaggcuggggggcuuuggg

SEQ ID NO: 1215879 - RNA, 22 nt, Human
ugggggccagcccugguaccug

SEQ ID NO: 1215880 - RNA, 22 nt, Human
uggggggcuuuggggccguggg

SEQ ID NO: 1215881 - RNA, 18 nt, Human
uuuggggccgugggggcc

SEQ ID NO: 1215882 - RNA, 19 nt, Human
auauauauauauauauaua

SEQ ID NO: 1215883 - RNA, 19 nt, Human
auauauauauauauauaua

SEQ ID NO: 1215884 - RNA, 19 nt, Human
auauauauauauauauaua

SEQ ID NO: 1215885 - RNA, 19 nt, Human
auauauauauauauauaua

SEQ ID NO: 1215886 - RNA, 19 nt, Human
auauauauauauauauaua

SEQ ID NO: 1215887 - RNA, 19 nt, Human
auauauauauauauauaua

SEQ ID NO: 1215888 - RNA, 19 nt, Human
auauauauauauauauaua

SEQ ID NO: 1215889 - RNA, 19 nt, Human
auauauauauauauauaua

SEQ ID NO: 1215890 - RNA, 19 nt, Human
auauauauauauauauaua

SEQ ID NO: 1215891 - RNA, 24 nt, Human
cgcccccggcccccuccccggccc

SEQ ID NO: 1215892 - RNA, 18 nt, Human
cucuaugugcccaccgcc

SEQ ID NO: 1215893 - RNA, 21 nt, Human
gcccccggcccccuccccggc

SEQ ID NO: 1215894 - RNA, 18 nt, Human
gugcccaccgcccccggc

SEQ ID NO: 1215895 - RNA, 22 nt, Human
uaaauauauauauauauauaua

SEQ ID NO: 1215896 - RNA, 23 nt, Human
uaaauuuuauuaugacuucauuu

SEQ ID NO: 1215897 - RNA, 19 nt, Human
uauauauauauauauauau

SEQ ID NO: 1215898 - RNA, 19 nt, Human
uauauauauauauauauau

SEQ ID NO: 1215899 - RNA, 19 nt, Human
uauauauauauauauauau

SEQ ID NO: 1215900 - RNA, 19 nt, Human
uauauauauauauauauau

SEQ ID NO: 1215901 - RNA, 19 nt, Human
uauauauauauauauauau

SEQ ID NO: 1215902 - RNA, 19 nt, Human
uauauauauauauauauau

SEQ ID NO: 1215903 - RNA, 18 nt, Human
uauuaugacuucauuugu

SEQ ID NO: 1215904 - RNA, 21 nt, Human
uguuuaaauauauauauauau

SEQ ID NO: 1215905 - RNA, 30 nt, Human
uucauuuguuuaaauauauauauauauauu

SEQ ID NO: 1215906 - RNA, 18 nt, Human
uuuauuaugacuucauuu

SEQ ID NO: 1215907 - RNA, 25 nt, Human
aagaggaaaaggggaaauaaucuga

SEQ ID NO: 1215908 - RNA, 19 nt, Human
aagcagccucggauccggg

SEQ ID NO: 1215909 - RNA, 20 nt, Human
agaagaaagggaggcugugg

SEQ ID NO: 1215910 - RNA, 20 nt, Human
agcagccucggauccgggug

SEQ ID NO: 1215911 - RNA, 22 nt, Human
aggagaagcagccucggauccg

SEQ ID NO: 1215912 - RNA, 22 nt, Human
agggaggcuguggacuggaggc

SEQ ID NO: 1215913 - RNA, 20 nt, Human
agucguucauaguuggcuuc

SEQ ID NO: 1215914 - RNA, 22 nt, Human
cacuccccgcuuugccuccgcc

SEQ ID NO: 1215915 - RNA, 22 nt, Human
ccccgccuucuccuucugucug

SEQ ID NO: 1215916 - RNA, 26 nt, Human
ccccugccccaguccuucaacagguc

SEQ ID NO: 1215917 - RNA, 22 nt, Human
ccccuuugacuuugggugacuu

SEQ ID NO: 1215918 - RNA, 19 nt, Human
cccgcuuugccuccgcccc

SEQ ID NO: 1215919 - RNA, 24 nt, Human
cucuuggcugugaguauuaucauu

SEQ ID NO: 1215920 - RNA, 21 nt, Human
cuuccuuuccucuuugaaucc

SEQ ID NO: 1215921 - RNA, 18 nt, Human
gaaagugacugaucagcc

SEQ ID NO: 1215922 - RNA, 24 nt, Human
gagugugugugugaccagggcucc

SEQ ID NO: 1215923 - RNA, 24 nt, Human
gaugcccgcguccguccccugccc

SEQ ID NO: 1215924 - RNA, 20 nt, Human
gcccacuccccgcuuugccu

SEQ ID NO: 1215925 - RNA, 27 nt, Human
gcccugggcguaugccguagaucucca

SEQ ID NO: 1215926 - RNA, 22 nt, Human
gcccuuagagucaccgcccccu

SEQ ID NO: 1215927 - RNA, 21 nt, Human
gcugccagccccgccuucucc

SEQ ID NO: 1215928 - RNA, 22 nt, Human
gcugugaguauuaucauuugca

SEQ ID NO: 1215929 - RNA, 22 nt, Human
ggcuguggacuggaggcugcca

SEQ ID NO: 1215930 - RNA, 19 nt, Human
uaccagguaacaagaaccu

SEQ ID NO: 1215931 - RNA, 24 nt, Human
uccuagcaccaaggccacacucgg

SEQ ID NO: 1215932 - RNA, 22 nt, Human
ucucgcacagguuuacagcacc

SEQ ID NO: 1215933 - RNA, 21 nt, Human
ugagaagaggaggcccugggc

SEQ ID NO: 1215934 - RNA, 23 nt, Human
ugaguauuaucauuugcaaagag

SEQ ID NO: 1215935 - RNA, 21 nt, Human
ugcaaagaggaaaaggggaaa

SEQ ID NO: 1215936 - RNA, 18 nt, Human
ugcauguccuaaggagaa

SEQ ID NO: 1215937 - RNA, 26 nt, Human
ugccccaguccuucaacaggucccca

SEQ ID NO: 1215938 - RNA, 24 nt, Human
uggaggcugccagccccgccuucu

SEQ ID NO: 1215939 - RNA, 22 nt, Human
uggcuguuccaaauggaaggau

SEQ ID NO: 1215940 - RNA, 23 nt, Human
ugucugcauguccuaaggagaag

SEQ ID NO: 1215941 - RNA, 23 nt, Human
ugugaccagggcuccuuccugcc

SEQ ID NO: 1215942 - RNA, 21 nt, Human
ugugugugugaccagggcucc

SEQ ID NO: 1215943 - RNA, 21 nt, Human
uuagaauggaaaguuuucuuc

SEQ ID NO: 1215944 - RNA, 22 nt, Human
uuccaaaaguugucuuguacca

SEQ ID NO: 1215945 - RNA, 21 nt, Human
uuccuuuagucguucauaguu

SEQ ID NO: 1215946 - RNA, 22 nt, Human
uugacuuugggugacuuuucuc

SEQ ID NO: 1215947 - RNA, 18 nt, Human
uuggcuucaauaaaugaa

SEQ ID NO: 1215948 - RNA, 23 nt, Human
caggaucacaccaauaccuccaa

SEQ ID NO: 1215949 - RNA, 24 nt, Human
cccagccaggaucacaccaauacc

SEQ ID NO: 1215950 - RNA, 20 nt, Human
cuccccuauugacaccccag

SEQ ID NO: 1215951 - RNA, 22 nt, Human
aagagcugcggggaggaggagg

SEQ ID NO: 1215952 - RNA, 21 nt, Human
agagcugcggggaggaggagg

SEQ ID NO: 1215953 - RNA, 20 nt, Human
agcugcggggaggaggaggg

SEQ ID NO: 1215954 - RNA, 23 nt, Human
cagcauaaaccacagggaucauu

SEQ ID NO: 1215955 - RNA, 23 nt, Human
gagaagagcugcggggaggagga

SEQ ID NO: 1215956 - RNA, 21 nt, Human
gagcugcggggaggaggaggg

SEQ ID NO: 1215957 - RNA, 18 nt, Human
gaucauugguggagacuu

SEQ ID NO: 1215958 - RNA, 21 nt, Human
ggagacuuagcacccagaaca

SEQ ID NO: 1215959 - RNA, 19 nt, Human
ggggaggaggagggaucug

SEQ ID NO: 1215960 - RNA, 19 nt, Human
guaaacacguacuucagau

SEQ ID NO: 1215961 - RNA, 18 nt, Human
guguuugcugaagcuuug

SEQ ID NO: 1215962 - RNA, 27 nt, Human
uacuucagaucucucauagagggaaaa

SEQ ID NO: 1215963 - RNA, 19 nt, Human
ucucuaaguguuugcugaa

SEQ ID NO: 1215964 - RNA, 23 nt, Human
uguaaacacguacuucagaucuc

SEQ ID NO: 1215965 - RNA, 18 nt, Human
uguacagaauuccucagu

SEQ ID NO: 1215966 - RNA, 18 nt, Human
aaaaucauaaagcuguga

SEQ ID NO: 1215967 - RNA, 21 nt, Human
aagacuaguuuauggaagcaa

SEQ ID NO: 1215968 - RNA, 21 nt, Human
aagaggaggaaaauagcagga

SEQ ID NO: 1215969 - RNA, 21 nt, Human
aaucuuugggcuaagcagcuu

SEQ ID NO: 1215970 - RNA, 22 nt, Human
agaaggucugguugugcuuuuc

SEQ ID NO: 1215971 - RNA, 25 nt, Human
agaauucaaagucagaguucaguuu

SEQ ID NO: 1215972 - RNA, 18 nt, Human
agacaggaagcgggguag

SEQ ID NO: 1215973 - RNA, 28 nt, Human
agacaggaagcgggguagaugagccugg

SEQ ID NO: 1215974 - RNA, 20 nt, Human
agacgauauuaaccauccca

SEQ ID NO: 1215975 - RNA, 19 nt, Human
agagcugaaucauuccugg

SEQ ID NO: 1215976 - RNA, 20 nt, Human
agcaaguacagccauccaaa

SEQ ID NO: 1215977 - RNA, 24 nt, Human
agccugggcggugggugggggccu

SEQ ID NO: 1215978 - RNA, 21 nt, Human
aggcaaaaucauaaagcugug

SEQ ID NO: 1215979 - RNA, 22 nt, Human
aggcgggcugguguuggagcag

SEQ ID NO: 1215980 - RNA, 23 nt, Human
agggacaagauauacauggaagc

SEQ ID NO: 1215981 - RNA, 21 nt, Human
agggaguggagaaggggaagc

SEQ ID NO: 1215982 - RNA, 21 nt, Human
agguuuuaguuucuucaccug

SEQ ID NO: 1215983 - RNA, 24 nt, Human
agugcucugagaguugaggggagc

SEQ ID NO: 1215984 - RNA, 22 nt, Human
auaaagggcagcacucagcuca

SEQ ID NO: 1215985 - RNA, 22 nt, Human
auauccauuuuuauagcaaagu

SEQ ID NO: 1215986 - RNA, 18 nt, Human
auccaugacagcauggag

SEQ ID NO: 1215987 - RNA, 19 nt, Human
aucccauaaacagcaucca

SEQ ID NO: 1215988 - RNA, 24 nt, Human
auugggcacagaggccuucccagg

SEQ ID NO: 1215989 - RNA, 19 nt, Human
caaaauugggcacagaggc

SEQ ID NO: 1215990 - RNA, 23 nt, Human
caaaucuuuguccccagcagccu

SEQ ID NO: 1215991 - RNA, 19 nt, Human
caagaggaggaaaauagca

SEQ ID NO: 1215992 - RNA, 24 nt, Human
cacacaggcugaaauaauugaagc

SEQ ID NO: 1215993 - RNA, 18 nt, Human
cacagaggccuucccagg

SEQ ID NO: 1215994 - RNA, 19 nt, Human
cacauacaggccaggaauu

SEQ ID NO: 1215995 - RNA, 25 nt, Human
cacauacaggccaggaauucaugua

SEQ ID NO: 1215996 - RNA, 21 nt, Human
caccuggucuugaccuucacu

SEQ ID NO: 1215997 - RNA, 23 nt, Human
cagaguucaguuuagagccaccu

SEQ ID NO: 1215998 - RNA, 19 nt, Human
cagccuuucuugacagagg

SEQ ID NO: 1215999 - RNA, 25 nt, Human
caguggaaucucucucugcaugguu

SEQ ID NO: 1216000 - RNA, 23 nt, Human
cauauccauuuuuauagcaaagu

SEQ ID NO: 1216001 - RNA, 21 nt, Human
cauugcugaguggucaucagg

SEQ ID NO: 1216002 - RNA, 20 nt, Human
cauuucagacacacaggcug

SEQ ID NO: 1216003 - RNA, 21 nt, Human
ccaaaucuuuguccccagcag

SEQ ID NO: 1216004 - RNA, 22 nt, Human
ccagcagccuuucuugacagag

SEQ ID NO: 1216005 - RNA, 18 nt, Human
ccaggagacagacuagcc

SEQ ID NO: 1216006 - RNA, 19 nt, Human
ccauaaacagcauccauga

SEQ ID NO: 1216007 - RNA, 20 nt, Human
cccauaaacagcauccauga

SEQ ID NO: 1216008 - RNA, 23 nt, Human
cccggaggguucugaaacuuacc

SEQ ID NO: 1216009 - RNA, 20 nt, Human
ccuauaaagagaggggugga

SEQ ID NO: 1216010 - RNA, 21 nt, Human
ccuauugaucauauccaggga

SEQ ID NO: 1216011 - RNA, 21 nt, Human
cgggcugguguuggagcaggg

SEQ ID NO: 1216012 - RNA, 18 nt, Human
cuaggccuauaaagagag

SEQ ID NO: 1216013 - RNA, 18 nt, Human
cugggcgguggguggggg

SEQ ID NO: 1216014 - RNA, 25 nt, Human
gaaaaaucauccauuucauuaguau

SEQ ID NO: 1216015 - RNA, 20 nt, Human
gagauugagauguagacaca

SEQ ID NO: 1216016 - RNA, 22 nt, Human
gagcagggucacagcugagugc

SEQ ID NO: 1216017 - RNA, 19 nt, Human
gagccugggcggugggugg

SEQ ID NO: 1216018 - RNA, 18 nt, Human
gaggaccuggagcagagg

SEQ ID NO: 1216019 - RNA, 21 nt, Human
gcuccaaaucuuuguccccag

SEQ ID NO: 1216020 - RNA, 24 nt, Human
gcuucaguggaaucucucucugcc

SEQ ID NO: 1216021 - RNA, 19 nt, Human
ggaccuggagcagagggug

SEQ ID NO: 1216022 - RNA, 24 nt, Human
ggagcagggucacagcugagugcu

SEQ ID NO: 1216023 - RNA, 20 nt, Human
gguaacggaggaccuggagc

SEQ ID NO: 1216024 - RNA, 18 nt, Human
guagaagacagguaggga

SEQ ID NO: 1216025 - RNA, 21 nt, Human
guccuuuuuucuuacuccccu

SEQ ID NO: 1216026 - RNA, 22 nt, Human
guccuuuuuucuuacuccccug

SEQ ID NO: 1216027 - RNA, 20 nt, Human
uaacaagaggaggaaaauag

SEQ ID NO: 1216028 - RNA, 21 nt, Human
uaagcagcuugaaccugauuu

SEQ ID NO: 1216029 - RNA, 21 nt, Human
uacugcccuuucuccacugug

SEQ ID NO: 1216030 - RNA, 21 nt, Human
uagaagacagguagggagugg

SEQ ID NO: 1216031 - RNA, 21 nt, Human
uagcaaaguuuaacuggggac

SEQ ID NO: 1216032 - RNA, 21 nt, Human
uagcaaguacagccauccaaa

SEQ ID NO: 1216033 - RNA, 23 nt, Human
uagcccacggaaugaucugcauc

SEQ ID NO: 1216034 - RNA, 21 nt, Human
uaugacagugauaggcagcaa

SEQ ID NO: 1216035 - RNA, 21 nt, Human
uaugaugugccuaggagacag

SEQ ID NO: 1216036 - RNA, 26 nt, Human
ucacugacucuuaccaccagucaugc

SEQ ID NO: 1216037 - RNA, 21 nt, Human
ucagaguucaguuuagagccc

SEQ ID NO: 1216038 - RNA, 24 nt, Human
uccaagaggacugaaauguaugga

SEQ ID NO: 1216039 - RNA, 20 nt, Human
uccaugacagcauggagcuu

SEQ ID NO: 1216040 - RNA, 19 nt, Human
ucuuccacauacaggccag

SEQ ID NO: 1216041 - RNA, 23 nt, Human
ucuuguagaagacagguagggag

SEQ ID NO: 1216042 - RNA, 22 nt, Human
ugaaagguagacuccaagagga

SEQ ID NO: 1216043 - RNA, 18 nt, Human
ugagaaggucugguugug

SEQ ID NO: 1216044 - RNA, 21 nt, Human
ugagaaggucugguugugcuu

SEQ ID NO: 1216045 - RNA, 21 nt, Human
ugagaguugaggggagcagau

SEQ ID NO: 1216046 - RNA, 20 nt, Human
ugccagauauuuugaacccc

SEQ ID NO: 1216047 - RNA, 18 nt, Human
ugcugaguggucaucagg

SEQ ID NO: 1216048 - RNA, 25 nt, Human
uggagcagggucacagcugagugcu

SEQ ID NO: 1216049 - RNA, 24 nt, Human
uggauccuugcuuguuggggcagg

SEQ ID NO: 1216050 - RNA, 26 nt, Human
uggauccuugcuuguuggggcagggu

SEQ ID NO: 1216051 - RNA, 25 nt, Human
ugggaagggcagacuucacgcagca

SEQ ID NO: 1216052 - RNA, 22 nt, Human
ugggugggggccuuaaucuuug

SEQ ID NO: 1216053 - RNA, 22 nt, Human
uguggcagugugagaaggucug

SEQ ID NO: 1216054 - RNA, 18 nt, Human
uuggagcagggucacagc

SEQ ID NO: 1216055 - RNA, 18 nt, Human
uuggagcagggucacagc

SEQ ID NO: 1216056 - RNA, 20 nt, Human
uuggagcagggucacagcug

SEQ ID NO: 1216057 - RNA, 24 nt, Human
uuuuccauacauuucaaaaugcua

SEQ ID NO: 1216058 - RNA, 20 nt, Human
agaacccucccuggccucuc

SEQ ID NO: 1216059 - RNA, 23 nt, Human
agagagggaggaggggaucggag

SEQ ID NO: 1216060 - RNA, 24 nt, Human
agagagggaggaggggaucggagc

SEQ ID NO: 1216061 - RNA, 22 nt, Human
agccuccccugcuccugccugc

SEQ ID NO: 1216062 - RNA, 21 nt, Human
agccugggugcuccuggggag

SEQ ID NO: 1216063 - RNA, 23 nt, Human
agccugggugcuccuggggaguc

SEQ ID NO: 1216064 - RNA, 21 nt, Human
ccaagccugggugcuccuggg

SEQ ID NO: 1216065 - RNA, 21 nt, Human
cccugcuccugccugcucacc

SEQ ID NO: 1216066 - RNA, 18 nt, Human
ccugcuccugccugcuca

SEQ ID NO: 1216067 - RNA, 18 nt, Human
cucccuggccucuccugg

SEQ ID NO: 1216068 - RNA, 18 nt, Human
cugccugcucacccugcc

SEQ ID NO: 1216069 - RNA, 22 nt, Human
gagggaggaggggaucggagcg

SEQ ID NO: 1216070 - RNA, 19 nt, Human
gcagagauugcugcccaag

SEQ ID NO: 1216071 - RNA, 20 nt, Human
gccugggugcuccuggggag

SEQ ID NO: 1216072 - RNA, 22 nt, Human
gcuccuggggaguccugcguua

SEQ ID NO: 1216073 - RNA, 18 nt, Human
ggcacugguuccagcgga

SEQ ID NO: 1216074 - RNA, 19 nt, Human
gggcacugguuccagcgga

SEQ ID NO: 1216075 - RNA, 19 nt, Human
uccacgcugucagugaggc

SEQ ID NO: 1216076 - RNA, 24 nt, Human
ucgaaaagaaaggcaugcagagau

SEQ ID NO: 1216077 - RNA, 19 nt, Human
ucggagagagggaggaggg

SEQ ID NO: 1216078 - RNA, 21 nt, Human
ugcgagccuccccugcuccug

SEQ ID NO: 1216079 - RNA, 27 nt, Human
uuagaugauggugguguuuaucucccu

SEQ ID NO: 1216080 - RNA, 23 nt, Human
uucggagagagggaggaggggau

SEQ ID NO: 1216081 - RNA, 21 nt, Human
aagcaagucacagucagggcc

SEQ ID NO: 1216082 - RNA, 21 nt, Human
aaguagccucgaugugaaagu

SEQ ID NO: 1216083 - RNA, 18 nt, Human
acaaagaaggaccccagg

SEQ ID NO: 1216084 - RNA, 19 nt, Human
acagagagggugggugcua

SEQ ID NO: 1216085 - RNA, 21 nt, Human
accagccccucuguccuccug

SEQ ID NO: 1216086 - RNA, 23 nt, Human
agagaagccacaccugagaccag

SEQ ID NO: 1216087 - RNA, 22 nt, Human
agccacaccugagaccagcccc

SEQ ID NO: 1216088 - RNA, 18 nt, Human
cagaaggggugaaaagua

SEQ ID NO: 1216089 - RNA, 21 nt, Human
cagccccucuguccuccugcc

SEQ ID NO: 1216090 - RNA, 21 nt, Human
cggugcagacgggagcacaga

SEQ ID NO: 1216091 - RNA, 18 nt, Human
cuccugccucugcaugca

SEQ ID NO: 1216092 - RNA, 24 nt, Human
gaaauccuaucacguccucaggcc

SEQ ID NO: 1216093 - RNA, 20 nt, Human
ggggaagcaagucacaguca

SEQ ID NO: 1216094 - RNA, 18 nt, Human
ggugcaguacaaagaagg

SEQ ID NO: 1216095 - RNA, 23 nt, Human
uacaaagaaggaccccaggacag

SEQ ID NO: 1216096 - RNA, 19 nt, Human
uccauccaaccaacaaggu

SEQ ID NO: 1216097 - RNA, 20 nt, Human
ucccugaggggggaagcaag

SEQ ID NO: 1216098 - RNA, 22 nt, Human
ucccugcaggaggcagaagggg

SEQ ID NO: 1216099 - RNA, 25 nt, Human
ucugcaugcagcgucccugcaggag

SEQ ID NO: 1216100 - RNA, 20 nt, Human
ugaaauccuaucacguccuc

SEQ ID NO: 1216101 - RNA, 23 nt, Human
ugagaccagccccucuguccucc

SEQ ID NO: 1216102 - RNA, 18 nt, Human
ugagagaagccacaccug

SEQ ID NO: 1216103 - RNA, 19 nt, Human
uggggcgggaaugaaaucc

SEQ ID NO: 1216104 - RNA, 19 nt, Human
uggggugcacaggcagcuu

SEQ ID NO: 1216105 - RNA, 19 nt, Human
ugucauugggugcaguaca

SEQ ID NO: 1216106 - RNA, 20 nt, Human
aacauagacauaagcaaaga

SEQ ID NO: 1216107 - RNA, 18 nt, Human
auugccaugucgucaugg

SEQ ID NO: 1216108 - RNA, 21 nt, Human
agguagcaggugggggccugg

SEQ ID NO: 1216109 - RNA, 23 nt, Human
caacugagucgacgaucacuuga

SEQ ID NO: 1216110 - RNA, 23 nt, Human
cugcaaggggcuuugcuucuccu

SEQ ID NO: 1216111 - RNA, 19 nt, Human
cuggccgcgugcucugggg

SEQ ID NO: 1216112 - RNA, 21 nt, Human
gccgcgugcucuggggguaga

SEQ ID NO: 1216113 - RNA, 21 nt, Human
ggagaagcucuggagguagca

SEQ ID NO: 1216114 - RNA, 22 nt, Human
gggccuggcuugggcuccuggc

SEQ ID NO: 1216115 - RNA, 24 nt, Human
uagaauggagaagcucuggaggua

SEQ ID NO: 1216116 - RNA, 20 nt, Human
ugggcuccuggcccagacag

SEQ ID NO: 1216117 - RNA, 19 nt, Human
aaauaaauuuaaacuauaa

SEQ ID NO: 1216118 - RNA, 19 nt, Human
aaauaaauuuaaacuauaa

SEQ ID NO: 1216119 - RNA, 18 nt, Human
aacagcuucuccaccucu

SEQ ID NO: 1216120 - RNA, 18 nt, Human
aagaugccagagugaaca

SEQ ID NO: 1216121 - RNA, 23 nt, Human
agccucuccugcuccuccugccg

SEQ ID NO: 1216122 - RNA, 19 nt, Human
agcucccgcagagucuccu

SEQ ID NO: 1216123 - RNA, 19 nt, Human
caccucuuccagcagccuc

SEQ ID NO: 1216124 - RNA, 20 nt, Human
cacguagccucuccuccugu

SEQ ID NO: 1216125 - RNA, 20 nt, Human
cacguagccucuccuccugu

SEQ ID NO: 1216126 - RNA, 20 nt, Human
cacguagccucuccuccugu

SEQ ID NO: 1216127 - RNA, 22 nt, Human
cagcagccucucccucuccagc

SEQ ID NO: 1216128 - RNA, 26 nt, Human
cagcagccucucccucuccagcagcc

SEQ ID NO: 1216129 - RNA, 23 nt, Human
ccagcagccucuccugcuccucc

SEQ ID NO: 1216130 - RNA, 22 nt, Human
ccuccugccgccucuccuguuc

SEQ ID NO: 1216131 - RNA, 21 nt, Human
ccucuccagcagccucuccug

SEQ ID NO: 1216132 - RNA, 23 nt, Human
ccucuccagcucccgcagagucu

SEQ ID NO: 1216133 - RNA, 23 nt, Human
ccucuccuccuguucacacagcc

SEQ ID NO: 1216134 - RNA, 23 nt, Human
cuaacagcuucuccaccucuucc

SEQ ID NO: 1216135 - RNA, 19 nt, Human
cuccuccugccgccucucc

SEQ ID NO: 1216136 - RNA, 24 nt, Human
cugcuccuccugccgccucuccug

SEQ ID NO: 1216137 - RNA, 23 nt, Human
cuguucacguagccucuccuccu

SEQ ID NO: 1216138 - RNA, 23 nt, Human
cuguucacguagccucuccuccu

SEQ ID NO: 1216139 - RNA, 23 nt, Human
cuguucacguagccucuccuccu

SEQ ID NO: 1216140 - RNA, 22 nt, Human
cuuaaauguuuuguuuuuuuuu

SEQ ID NO: 1216141 - RNA, 20 nt, Human
gaagccucuccugcuccagg

SEQ ID NO: 1216142 - RNA, 18 nt, Human
gcagccucucccucucca

SEQ ID NO: 1216143 - RNA, 19 nt, Human
gccacagccucucauccug

SEQ ID NO: 1216144 - RNA, 19 nt, Human
ggagcuccuccaccucguc

SEQ ID NO: 1216145 - RNA, 20 nt, Human
ggauauuaaccccuuaaaug

SEQ ID NO: 1216146 - RNA, 22 nt, Human
uaaaagaugccagagugaacau

SEQ ID NO: 1216147 - RNA, 22 nt, Human
uaaauuagaaacacaaauaaac

SEQ ID NO: 1216148 - RNA, 27 nt, Human
uaaauuagaaacacaaauaaauuuaaa

SEQ ID NO: 1216149 - RNA, 27 nt, Human
uaaauuagaaacacaaauaaauuuaaa

SEQ ID NO: 1216150 - RNA, 27 nt, Human
uaaauuagaaacacaaauaaauuuaaa

SEQ ID NO: 1216151 - RNA, 18 nt, Human
uagaaacacaaauaaaca

SEQ ID NO: 1216152 - RNA, 21 nt, Human
ucacacagccucuccuccugu

SEQ ID NO: 1216153 - RNA, 19 nt, Human
ucccucuccagcagccucu

SEQ ID NO: 1216154 - RNA, 18 nt, Human
ucuaacagcuucuccacc

SEQ ID NO: 1216155 - RNA, 20 nt, Human
ucuaacagcuucuccaccuc

SEQ ID NO: 1216156 - RNA, 24 nt, Human
ucuccaccucuuccagcagccucu

SEQ ID NO: 1216157 - RNA, 20 nt, Human
ucuccagcucccgcagaguc

SEQ ID NO: 1216158 - RNA, 19 nt, Human
ucuccagcucccgcagccu

SEQ ID NO: 1216159 - RNA, 19 nt, Human
ucuccagcucccgcagccu

SEQ ID NO: 1216160 - RNA, 22 nt, Human
ucuccugcuccuccugccgccu

SEQ ID NO: 1216161 - RNA, 24 nt, Human
ucuccugcugccacagccucucau

SEQ ID NO: 1216162 - RNA, 26 nt, Human
ucuccuguucuaacagcuucuccacc

SEQ ID NO: 1216163 - RNA, 23 nt, Human
ucuuccagcagccucuccugccc

SEQ ID NO: 1216164 - RNA, 18 nt, Human
ugcccuggcagcuucucc

SEQ ID NO: 1216165 - RNA, 25 nt, Human
ugcccuggcagcuucuccuguucac

SEQ ID NO: 1216166 - RNA, 22 nt, Human
uguuuuguuuuuuuuuuuuuuc

SEQ ID NO: 1216167 - RNA, 22 nt, Human
uuuaaacuauaaauuagaaaca

SEQ ID NO: 1216168 - RNA, 22 nt, Human
uuuaaacuauaaauuagaaaca

SEQ ID NO: 1216169 - RNA, 22 nt, Human
aaaagccagagcuggugaggca

SEQ ID NO: 1216170 - RNA, 21 nt, Human
aaaauaaauaaaagcaggccc

SEQ ID NO: 1216171 - RNA, 20 nt, Human
aacuguagaccaggccaggg

SEQ ID NO: 1216172 - RNA, 23 nt, Human
aagcaacaggccaaggugcguga

SEQ ID NO: 1216173 - RNA, 19 nt, Human
aagcaacuuuucccucagg

SEQ ID NO: 1216174 - RNA, 20 nt, Human
aagcagaagagggagacucc

SEQ ID NO: 1216175 - RNA, 23 nt, Human
aagcagaagagggagacuccgcg

SEQ ID NO: 1216176 - RNA, 24 nt, Human
aagcagaagagggagacuccgcgg

SEQ ID NO: 1216177 - RNA, 19 nt, Human
aagcaggccccugucagca

SEQ ID NO: 1216178 - RNA, 20 nt, Human
aagcucccagccccuacacc

SEQ ID NO: 1216179 - RNA, 21 nt, Human
acacaacccccuccaagcucc

SEQ ID NO: 1216180 - RNA, 24 nt, Human
acacaacccccuccaagcucccag

SEQ ID NO: 1216181 - RNA, 19 nt, Human
acagggcagccucaacugg

SEQ ID NO: 1216182 - RNA, 20 nt, Human
accccuaaucugcaguggau

SEQ ID NO: 1216183 - RNA, 19 nt, Human
acucccaggcugggagcug

SEQ ID NO: 1216184 - RNA, 20 nt, Human
agaagggcgggagggauggc

SEQ ID NO: 1216185 - RNA, 20 nt, Human
agagagaaaacggguuagag

SEQ ID NO: 1216186 - RNA, 18 nt, Human
agagguugguggaguugg

SEQ ID NO: 1216187 - RNA, 18 nt, Human
agaugccauuggccauag

SEQ ID NO: 1216188 - RNA, 19 nt, Human
agcauaggagcgaggaagg

SEQ ID NO: 1216189 - RNA, 23 nt, Human
agccaccagaccugauagagaag

SEQ ID NO: 1216190 - RNA, 19 nt, Human
aggcaggcuuggaaaggga

SEQ ID NO: 1216191 - RNA, 19 nt, Human
aggcaggcuuggaaaggga

SEQ ID NO: 1216192 - RNA, 22 nt, Human
aggcaggcuuggaaagggaggu

SEQ ID NO: 1216193 - RNA, 20 nt, Human
aggccagggcacaggcugcu

SEQ ID NO: 1216194 - RNA, 22 nt, Human
aggccccugucagcauaagccu

SEQ ID NO: 1216195 - RNA, 24 nt, Human
aggccucuggccgccugaguccag

SEQ ID NO: 1216196 - RNA, 18 nt, Human
agggauggcuggcuggag

SEQ ID NO: 1216197 - RNA, 19 nt, Human
aggggcgaugucaggagac

SEQ ID NO: 1216198 - RNA, 19 nt, Human
agugccuggggacugcggc

SEQ ID NO: 1216199 - RNA, 18 nt, Human
agugcuucagcaggggcc

SEQ ID NO: 1216200 - RNA, 18 nt, Human
auauauauguauauaugu

SEQ ID NO: 1216201 - RNA, 22 nt, Human
auauauauguauauaugugugu

SEQ ID NO: 1216202 - RNA, 28 nt, Human
auauauguauauaugugugugugugugu

SEQ ID NO: 1216203 - RNA, 18 nt, Human
auccaacagccaccagac

SEQ ID NO: 1216204 - RNA, 22 nt, Human
augcugccuggugacaccuggu

SEQ ID NO: 1216205 - RNA, 22 nt, Human
augugugugugugugugugugg

SEQ ID NO: 1216206 - RNA, 22 nt, Human
augugugugugugugugugugu

SEQ ID NO: 1216207 - RNA, 23 nt, Human
auguguguguguguguguguguu

SEQ ID NO: 1216208 - RNA, 19 nt, Human
caaccccuccccagucagc

SEQ ID NO: 1216209 - RNA, 21 nt, Human
caagcacagcacggggacuga

SEQ ID NO: 1216210 - RNA, 24 nt, Human
caagcucccagccccuacaccaua

SEQ ID NO: 1216211 - RNA, 22 nt, Human
cacaacccccuccaagcuccca

SEQ ID NO: 1216212 - RNA, 23 nt, Human
cacaacccccuccaagcucccag

SEQ ID NO: 1216213 - RNA, 18 nt, Human
cacaagcacagcacgggg

SEQ ID NO: 1216214 - RNA, 19 nt, Human
caccaaagcaacuuuuccc

SEQ ID NO: 1216215 - RNA, 21 nt, Human
caccaaagcaacuuuucccuc

SEQ ID NO: 1216216 - RNA, 30 nt, Human; identical to SEQ ID NO: 1084132

SEQ ID NO: 1216217 - RNA, 18 nt, Human
cacccugucuuccaacuc

SEQ ID NO: 1216218 - RNA, 21 nt, Human
cacggcccagggccaccucuu

SEQ ID NO: 1216219 - RNA, 21 nt, Human
cacguauauauauguauauau

SEQ ID NO: 1216220 - RNA, 23 nt, Human
cagaagagggagacuccgcggca

SEQ ID NO: 1216221 - RNA, 22 nt, Human
cagacuaagucacagaagaagg

SEQ ID NO: 1216222 - RNA, 22 nt, Human
cagcaacggucaaaccuggacg

SEQ ID NO: 1216223 - RNA, 20 nt, Human
cagcaguagugcuucagcag

SEQ ID NO: 1216224 - RNA, 21 nt, Human
cagccauggagaccuugagca

SEQ ID NO: 1216225 - RNA, 21 nt, Human
cagcuguggagggccggggag

SEQ ID NO: 1216226 - RNA, 19 nt, Human
caggacacccacccaggca

SEQ ID NO: 1216227 - RNA, 18 nt, Human
caggaugaugugcccagg

SEQ ID NO: 1216228 - RNA, 25 nt, Human
cauaagccuggagaagugggucugg

SEQ ID NO: 1216229 - RNA, 19 nt, Human
cauccaacagccaccagac

SEQ ID NO: 1216230 - RNA, 22 nt, Human
cauggcaagguuccuggaaaag

SEQ ID NO: 1216231 - RNA, 18 nt, Human
cauggcacccaggcaguc

SEQ ID NO: 1216232 - RNA, 24 nt, Human
ccaacucacggcccagggccaccu

SEQ ID NO: 1216233 - RNA, 22 nt, Human
ccaagcucccagccccuacacc

SEQ ID NO: 1216234 - RNA, 19 nt, Human
ccacacaacccccuccaag

SEQ ID NO: 1216235 - RNA, 18 nt, Human
ccagaccugauagagaag

SEQ ID NO: 1216236 - RNA, 25 nt, Human
ccaggcaguccacccauaguucaga

SEQ ID NO: 1216237 - RNA, 23 nt, Human
ccagggccaccucuugcuuggag

SEQ ID NO: 1216238 - RNA, 27 nt, Human
cccacacaacccccuccaagcucccag

SEQ ID NO: 1216239 - RNA, 22 nt, Human
cccacugaaugaggagccccag

SEQ ID NO: 1216240 - RNA, 19 nt, Human
cccagucagcccuuuacca

SEQ ID NO: 1216241 - RNA, 22 nt, Human
cccauccaacagccaccagacc

SEQ ID NO: 1216242 - RNA, 23 nt, Human
ccccaccccacacacgcuggcca

SEQ ID NO: 1216243 - RNA, 21 nt, Human
ccccaggcucagccauggaga

SEQ ID NO: 1216244 - RNA, 23 nt, Human
cccccaccaugucccuacaaccc

SEQ ID NO: 1216245 - RNA, 19 nt, Human
ccccccacacaacccccuc

SEQ ID NO: 1216246 - RNA, 18 nt, Human
cccccucgggcuucucuc

SEQ ID NO: 1216247 - RNA, 20 nt, Human
cccuccaagcucccagcccc

SEQ ID NO: 1216248 - RNA, 24 nt, Human
cccuccccagucagcccuuuacca

SEQ ID NO: 1216249 - RNA, 21 nt, Human
cccuggugaugggacuccugu

SEQ ID NO: 1216250 - RNA, 18 nt, Human
ccuggagaagugggucug

SEQ ID NO: 1216251 - RNA, 26 nt, Human
cgaccccuagaagcaacaggccaagg

SEQ ID NO: 1216252 - RNA, 18 nt, Human
cggcccuccccaccccac

SEQ ID NO: 1216253 - RNA, 18 nt, Human
cgggauaaaaaauacugu

SEQ ID NO: 1216254 - RNA, 23 nt, Human
cggguuagagaaaagccagagcu

SEQ ID NO: 1216255 - RNA, 23 nt, Human
cguguacauacuguagcugugua

SEQ ID NO: 1216256 - RNA, 22 nt, Human
cuaacagggcagccucaacugg

SEQ ID NO: 1216257 - RNA, 19 nt, Human
cucagcccccucgggcuuc

SEQ ID NO: 1216258 - RNA, 24 nt, Human
cucccagccccuacaccauaaacc

SEQ ID NO: 1216259 - RNA, 21 nt, Human
cucugggccaucagaaagccc

SEQ ID NO: 1216260 - RNA, 21 nt, Human
cucuugcuuggagagccccau

SEQ ID NO: 1216261 - RNA, 23 nt, Human
cugcaguggauuuggcucuuggc

SEQ ID NO: 1216262 - RNA, 21 nt, Human
cuggaagggaaaggggaggaa

SEQ ID NO: 1216263 - RNA, 23 nt, Human
cuggagucuucacccccaccaug

SEQ ID NO: 1216264 - RNA, 23 nt, Human
cuggcuguccacaggccgcgcau

SEQ ID NO: 1216265 - RNA, 22 nt, Human
cuggggguggccccccuucccc

SEQ ID NO: 1216266 - RNA, 22 nt, Human
cugguuggcggggggcugcagg

SEQ ID NO: 1216267 - RNA, 21 nt, Human
cuuccucuugcugggcuacaa

SEQ ID NO: 1216268 - RNA, 22 nt, Human
gaacacugauugaaccaaaaug

SEQ ID NO: 1216269 - RNA, 20 nt, Human
gaacagggcaggggcauacc

SEQ ID NO: 1216270 - RNA, 21 nt, Human
gaagauggagggagaagccgg

SEQ ID NO: 1216271 - RNA, 18 nt, Human
gaaggaggcggggauggg

SEQ ID NO: 1216272 - RNA, 21 nt, Human
gacuccuguuuuuuuuuuuuu

SEQ ID NO: 1216273 - RNA, 21 nt, Human
gagggagaagccggagcuuca

SEQ ID NO: 1216274 - RNA, 24 nt, Human
gaggggcuggaagggaaaggggag

SEQ ID NO: 1216275 - RNA, 20 nt, Human
gaggucucugagaagaggag

SEQ ID NO: 1216276 - RNA, 21 nt, Human
gauggagggagaagccggagc

SEQ ID NO: 1216277 - RNA, 20 nt, Human
gccaaggugcgugagccugc

SEQ ID NO: 1216278 - RNA, 19 nt, Human
gccagaggccccucugggc

SEQ ID NO: 1216279 - RNA, 22 nt, Human
gcccccucgggcuucucucuuc

SEQ ID NO: 1216280 - RNA, 19 nt, Human
gcccuuuaccauuagggua

SEQ ID NO: 1216281 - RNA, 20 nt, Human
gcgaccccuagaagcaacag

SEQ ID NO: 1216282 - RNA, 20 nt, Human
gcgggggcuggcuguccaca

SEQ ID NO: 1216283 - RNA, 21 nt, Human
gcucccaucuucuuacucaga

SEQ ID NO: 1216284 - RNA, 21 nt, Human
gcuggggguggccccccuucc

SEQ ID NO: 1216285 - RNA, 19 nt, Human
gcuuuggggcugggggagc

SEQ ID NO: 1216286 - RNA, 20 nt, Human
ggacugcggcggcccucccc

SEQ ID NO: 1216287 - RNA, 24 nt, Human
ggagcuauaagggauggcuggcug

SEQ ID NO: 1216288 - RNA, 20 nt, Human
ggagggauggcgggggcugg

SEQ ID NO: 1216289 - RNA, 22 nt, Human
ggaggucucugagaagaggagg

SEQ ID NO: 1216290 - RNA, 23 nt, Human
ggcaagguuccuggaaaagaggg

SEQ ID NO: 1216291 - RNA, 20 nt, Human
ggcagccucaacugguuggc

SEQ ID NO: 1216292 - RNA, 19 nt, Human
ggcaggaaagggaagugag

SEQ ID NO: 1216293 - RNA, 22 nt, Human
ggcaggggcauaccacagaggg

SEQ ID NO: 1216294 - RNA, 23 nt, Human
ggccagcaguagugcuucagcag

SEQ ID NO: 1216295 - RNA, 20 nt, Human
ggcugggggagccacuguca

SEQ ID NO: 1216296 - RNA, 18 nt, Human
gggaaaaaaguaaaaaaa

SEQ ID NO: 1216297 - RNA, 21 nt, Human
gggaaaggggaggaagaugga

SEQ ID NO: 1216298 - RNA, 21 nt, Human
gggaggucucugagaagagga

SEQ ID NO: 1216299 - RNA, 21 nt, Human
gggccggggaggggagggcgu

SEQ ID NO: 1216300 - RNA, 18 nt, Human
ggggaggggagggcguag

SEQ ID NO: 1216301 - RNA, 22 nt, Human
gggggcuggcuuuggggcuggg

SEQ ID NO: 1216302 - RNA, 22 nt, Human
gguuacauaggugaggcugggc

SEQ ID NO: 1216303 - RNA, 23 nt, Human
guaccuagcggagguugcagcug

SEQ ID NO: 1216304 - RNA, 20 nt, Human
guauauaugugugugugugu

SEQ ID NO: 1216305 - RNA, 18 nt, Human
gucacccugucuuccaac

SEQ ID NO: 1216306 - RNA, 23 nt, Human
gucuggagucuucacccccacca

SEQ ID NO: 1216307 - RNA, 24 nt, Human
gugacuaucaccccuaaucugcag

SEQ ID NO: 1216308 - RNA, 22 nt, Human
guguacauacuguagcugugua

SEQ ID NO: 1216309 - RNA, 21 nt, Human
gugugugugugugugugugug

SEQ ID NO: 1216310 - RNA, 21 nt, Human
gugugugugugugugugugug

SEQ ID NO: 1216311 - RNA, 18 nt, Human
guuuguuuggaggagguc

SEQ ID NO: 1216312 - RNA, 22 nt, Human
uaaaaaaacaucaugggauaaa

SEQ ID NO: 1216313 - RNA, 25 nt, Human
uaaaagaacacaaacuaaaaaauua

SEQ ID NO: 1216314 - RNA, 20 nt, Human
uaagagccagagguuggugg

SEQ ID NO: 1216315 - RNA, 20 nt, Human
uaagagcccccaggcucagc

SEQ ID NO: 1216316 - RNA, 25 nt, Human
uaccacagagggggcacaaguuuca

SEQ ID NO: 1216317 - RNA, 23 nt, Human
uaccugggagggagggaaggggg

SEQ ID NO: 1216318 - RNA, 22 nt, Human
uagagaaaagccagagcuggug

SEQ ID NO: 1216319 - RNA, 19 nt, Human
uaggagcgaggaaggaggc

SEQ ID NO: 1216320 - RNA, 23 nt, Human
uauauaugugugugugugugugu

SEQ ID NO: 1216321 - RNA, 19 nt, Human
uauauguauauaugugugu

SEQ ID NO: 1216322 - RNA, 23 nt, Human
uauauguauauaugugugugugu

SEQ ID NO: 1216323 - RNA, 19 nt, Human
uauaugugugugugugugu

SEQ ID NO: 1216324 - RNA, 25 nt, Human
uauaugugugugugugugugugugu

SEQ ID NO: 1216325 - RNA, 23 nt, Human
uauccuagaucaccacuggauug

SEQ ID NO: 1216326 - RNA, 21 nt, Human
uaugcugccuggugacaccug

SEQ ID NO: 1216327 - RNA, 22 nt, Human
uauguauauaugugugugugug

SEQ ID NO: 1216328 - RNA, 18 nt, Human
uaugugugugugugugug

SEQ ID NO: 1216329 - RNA, 23 nt, Human
uaugugugugugugugugugugu

SEQ ID NO: 1216330 - RNA, 22 nt, Human
ucacaggacacccacccaggca

SEQ ID NO: 1216331 - RNA, 19 nt, Human
ucagagaggcagcugaggc

SEQ ID NO: 1216332 - RNA, 21 nt, Human
ucagcauguccagcugggcug

SEQ ID NO: 1216333 - RNA, 19 nt, Human
ucccuacaaccccucccca

SEQ ID NO: 1216334 - RNA, 21 nt, Human
ucccuggugaugggacuccug

SEQ ID NO: 1216335 - RNA, 18 nt, Human
ucucugagaagaggagga

SEQ ID NO: 1216336 - RNA, 18 nt, Human
ucugcaguggauuuggcu

SEQ ID NO: 1216337 - RNA, 18 nt, Human
ucuucacccccaccaugu

SEQ ID NO: 1216338 - RNA, 21 nt, Human
ucuucacccccaccauguccc

SEQ ID NO: 1216339 - RNA, 18 nt, Human
ugaaaaagaaguuacggg

SEQ ID NO: 1216340 - RNA, 20 nt, Human
ugacucagacugcaugacag

SEQ ID NO: 1216341 - RNA, 21 nt, Human
ugagaagaggaggaaucuguu

SEQ ID NO: 1216342 - RNA, 21 nt, Human
ugaggcugggcccuuccugcu

SEQ ID NO: 1216343 - RNA, 20 nt, Human
ugccagaggccccucugggc

SEQ ID NO: 1216344 - RNA, 23 nt, Human
ugccagaggccccucugggccau

SEQ ID NO: 1216345 - RNA, 20 nt, Human
ugcuggccagcaguagugcu

SEQ ID NO: 1216346 - RNA, 23 nt, Human
ugcugggaaaagcagaagaggga

SEQ ID NO: 1216347 - RNA, 22 nt, Human
ugcugggcuacaagacuccaca

SEQ ID NO: 1216348 - RNA, 18 nt, Human
ugcuggggguggcccccc

SEQ ID NO: 1216349 - RNA, 20 nt, Human
ugcuggggguggccccccuu

SEQ ID NO: 1216350 - RNA, 23 nt, Human
uggaagggaaaggggaggaagau

SEQ ID NO: 1216351 - RNA, 21 nt, Human
uggaauaaauggauuuagcca

SEQ ID NO: 1216352 - RNA, 19 nt, Human
uggagaagugggucuggag

SEQ ID NO: 1216353 - RNA, 22 nt, Human
uggagguggugcacuuuggagg

SEQ ID NO: 1216354 - RNA, 21 nt, Human
uggauugcugacagauagagg

SEQ ID NO: 1216355 - RNA, 22 nt, Human
uggccgccugaguccagccccc

SEQ ID NO: 1216356 - RNA, 23 nt, Human
uggccgccugaguccagcccccc

SEQ ID NO: 1216357 - RNA, 24 nt, Human
uggcucccuggugaugggacuccu

SEQ ID NO: 1216358 - RNA, 23 nt, Human
ugggaaaaaaguaaaaaaaaaaa

SEQ ID NO: 1216359 - RNA, 22 nt, Human
ugggacuccuguuuuuuuuuuu

SEQ ID NO: 1216360 - RNA, 26 nt, Human
ugggacuccuguuuuuuuuuuuuuuu

SEQ ID NO: 1216361 - RNA, 21 nt, Human
ugggagggagggaagggggcu

SEQ ID NO: 1216362 - RNA, 19 nt, Human
uggguccugcaguuugucc

SEQ ID NO: 1216363 - RNA, 20 nt, Human
uggucacccugucuuccaac

SEQ ID NO: 1216364 - RNA, 22 nt, Human
uggugaggcaagugcagaguau

SEQ ID NO: 1216365 - RNA, 19 nt, Human
uguauauaugugugugugu

SEQ ID NO: 1216366 - RNA, 24 nt, Human
ugucaggagacagcuuccucuugc

SEQ ID NO: 1216367 - RNA, 22 nt, Human
ugucccuacaaccccuccccag

SEQ ID NO: 1216368 - RNA, 18 nt, Human
uguggcaaaaaaagaugu

SEQ ID NO: 1216369 - RNA, 23 nt, Human
ugugggaugaccgcguguauagg

SEQ ID NO: 1216370 - RNA, 18 nt, Human
ugugugugugugugugug

SEQ ID NO: 1216371 - RNA, 18 nt, Human
ugugugugugugugugug

SEQ ID NO: 1216372 - RNA, 18 nt, Human
ugugugugugugugugug

SEQ ID NO: 1216373 - RNA, 18 nt, Human
ugugugugugugugugug

SEQ ID NO: 1216374 - RNA, 21 nt, Human
ugugugugugugugugugugu

SEQ ID NO: 1216375 - RNA, 21 nt, Human
ugugugugugugugugugugu

SEQ ID NO: 1216376 - RNA, 21 nt, Human
ugugugugugugugugugugu

SEQ ID NO: 1216377 - RNA, 22 nt, Human
ugugugugugugugugugugug

SEQ ID NO: 1216378 - RNA, 20 nt, Human
uguuggggaccuuccaggcc

SEQ ID NO: 1216379 - RNA, 25 nt, Human
uguuuuuuuuuuuuuuuuugcuuuu

SEQ ID NO: 1216380 - RNA, 22 nt, Human
uuaaaagaacacaaacuaaaaa

SEQ ID NO: 1216381 - RNA, 22 nt, Human
uucagcaacggucaaaccugga

SEQ ID NO: 1216382 - RNA, 29 nt, Human
uuggccacguauauauauguauauaugug

SEQ ID NO: 1216383 - RNA, 24 nt, Human
uuucccucacuggguccugcaguu

SEQ ID NO: 1216384 - RNA, 21 nt, Human
uuuguuuggaggaggucugac

SEQ ID NO: 1216385 - RNA, 20 nt, Human
uuuuuuuuuuuuuugcuuuu

SEQ ID NO: 1216386 - RNA, 18 nt, Human
uuuuuuuuuuuuuuuuug

SEQ ID NO: 1216387 - RNA, 19 nt, Human
aaauaaauuuaaacuauaa

SEQ ID NO: 1216388 - RNA, 19 nt, Human
aaauaaauuuaaacuauaa

SEQ ID NO: 1216389 - RNA, 18 nt, Human
aacagcuucuccaccucu

SEQ ID NO: 1216390 - RNA, 18 nt, Human
aagaugccagagugaaca

SEQ ID NO: 1216391 - RNA, 19 nt, Human
acacagccucuccuccugu

SEQ ID NO: 1216392 - RNA, 23 nt, Human
agccucuccugcuccuccugccg

SEQ ID NO: 1216393 - RNA, 19 nt, Human
caccucuuccagcagccuc

SEQ ID NO: 1216394 - RNA, 18 nt, Human
cacguagccucuccuccu

SEQ ID NO: 1216395 - RNA, 18 nt, Human
cacguagccucuccuccu

SEQ ID NO: 1216396 - RNA, 20 nt, Human
cacguagccucuccuccugu

SEQ ID NO: 1216397 - RNA, 22 nt, Human
cagcagccucucccucuccagc

SEQ ID NO: 1216398 - RNA, 26 nt, Human
cagcagccucucccucuccagcagcc

SEQ ID NO: 1216399 - RNA, 20 nt, Human
cagcucccgcagagucuccu

SEQ ID NO: 1216400 - RNA, 23 nt, Human
ccagcagccucuccugcuccucc

SEQ ID NO: 1216401 - RNA, 22 nt, Human
ccuccugccgccucuccuguuc

SEQ ID NO: 1216402 - RNA, 21 nt, Human
ccucuccagcagccucuccug

SEQ ID NO: 1216403 - RNA, 23 nt, Human
ccucuccagcucccgcagagucu

SEQ ID NO: 1216404 - RNA, 23 nt, Human
ccucuccuccuguucacacagcc

SEQ ID NO: 1216405 - RNA, 21 nt, Human
cgaagccucuccugcuccagg

SEQ ID NO: 1216406 - RNA, 23 nt, Human
cuaacagcuucuccaccucuucc

SEQ ID NO: 1216407 - RNA, 19 nt, Human
cuccuccugccgccucucc

SEQ ID NO: 1216408 - RNA, 23 nt, Human
cucguccagcagccucucccucu

SEQ ID NO: 1216409 - RNA, 24 nt, Human
cugcuccuccugccgccucuccug

SEQ ID NO: 1216410 - RNA, 19 nt, Human
gccacagccucucauccug

SEQ ID NO: 1216411 - RNA, 19 nt, Human
ggagcuccuccaccucguc

SEQ ID NO: 1216412 - RNA, 20 nt, Human
ggauauuaaccccuuaaaug

SEQ ID NO: 1216413 - RNA, 22 nt, Human
uaaaagaugccagagugaacau

SEQ ID NO: 1216414 - RNA, 20 nt, Human
uaaauuagaaacacaaauaa

SEQ ID NO: 1216415 - RNA, 27 nt, Human
uaaauuagaaacacaaauaaauuuaaa

SEQ ID NO: 1216416 - RNA, 27 nt, Human
uaaauuagaaacacaaauaaauuuaaa

SEQ ID NO: 1216417 - RNA, 27 nt, Human
uaaauuagaaacacaaauaaauuuaaa

SEQ ID NO: 1216418 - RNA, 18 nt, Human
uagaaacacaaauaaaca

SEQ ID NO: 1216419 - RNA, 21 nt, Human
ucacacagccucuccuccugu

SEQ ID NO: 1216420 - RNA, 21 nt, Human
ucacguagccucuccuccugu

SEQ ID NO: 1216421 - RNA, 22 nt, Human
uccagcagccucucccucucca

SEQ ID NO: 1216422 - RNA, 19 nt, Human
ucccucuccagcagccucu

SEQ ID NO: 1216423 - RNA, 18 nt, Human
ucuaacagcuucuccacc

SEQ ID NO: 1216424 - RNA, 21 nt, Human
ucuaacagcuucuccaccucu

SEQ ID NO: 1216425 - RNA, 24 nt, Human
ucuccaccucuuccagcagccucu

SEQ ID NO: 1216426 - RNA, 20 nt, Human
ucuccagcucccgcagaguc

SEQ ID NO: 1216427 - RNA, 19 nt, Human
ucuccagcucccgcagccu

SEQ ID NO: 1216428 - RNA, 19 nt, Human
ucuccagcucccgcagccu

SEQ ID NO: 1216429 - RNA, 22 nt, Human
ucuccugcuccuccugccgccu

SEQ ID NO: 1216430 - RNA, 24 nt, Human
ucuccugcugccacagccucucau

SEQ ID NO: 1216431 - RNA, 26 nt, Human
ucuccuguucuaacagcuucuccacc

SEQ ID NO: 1216432 - RNA, 23 nt, Human
ucuuccagcagccucuccugccc

SEQ ID NO: 1216433 - RNA, 27 nt, Human
ugcccuggcagcuucuccuguucacac

SEQ ID NO: 1216434 - RNA, 22 nt, Human
uguuuuguuuuuuuuuuuuuuc

SEQ ID NO: 1216435 - RNA, 21 nt, Human
uuaaauguuuuguuuuuuuuu

SEQ ID NO: 1216436 - RNA, 22 nt, Human
uuuaaacuauaaauuagaaaca

SEQ ID NO: 1216437 - RNA, 22 nt, Human
uuuaaacuauaaauuagaaaca

SEQ ID NO: 1216438 - RNA, 19 nt, Human
aaauaaauuuaaacuauaa

SEQ ID NO: 1216439 - RNA, 19 nt, Human
aaauaaauuuaaacuauaa

SEQ ID NO: 1216440 - RNA, 19 nt, Human
aaauaaauuuaaacuauaa

SEQ ID NO: 1216441 - RNA, 19 nt, Human
aaauaaauuuaaacuauaa

SEQ ID NO: 1216442 - RNA, 18 nt, Human
aagaugccagagugaaca

SEQ ID NO: 1216443 - RNA, 20 nt, Human
agaaacacaaacauaagugg

SEQ ID NO: 1216444 - RNA, 20 nt, Human
cagcucccgcagagucuccu

SEQ ID NO: 1216445 - RNA, 23 nt, Human
ccucuccagcucccgcagagucu

SEQ ID NO: 1216446 - RNA, 22 nt, Human
cuuaaauguuuuguuuuuuuuu

SEQ ID NO: 1216447 - RNA, 19 nt, Human
gccacagccucucauccug

SEQ ID NO: 1216448 - RNA, 20 nt, Human
ggauauuaaccccuuaaaug

SEQ ID NO: 1216449 - RNA, 22 nt, Human
uaaaagaugccagagugaacau

SEQ ID NO: 1216450 - RNA, 20 nt, Human
uaaauuagaaacacaaacau

SEQ ID NO: 1216451 - RNA, 25 nt, Human
uaaauuagaaacacaaacauaagug

SEQ ID NO: 1216452 - RNA, 27 nt, Human
uaaauuagaaacacaaauaaauuuaaa

SEQ ID NO: 1216453 - RNA, 27 nt, Human
uaaauuagaaacacaaauaaauuuaaa

SEQ ID NO: 1216454 - RNA, 27 nt, Human
uaaauuagaaacacaaauaaauuuaaa

SEQ ID NO: 1216455 - RNA, 18 nt, Human
uagaaacacaaacauaag

SEQ ID NO: 1216456 - RNA, 24 nt, Human
uagaaacacaaacauaaguggcuc

SEQ ID NO: 1216457 - RNA, 19 nt, Human
ucuccagcucccgcaaccu

SEQ ID NO: 1216458 - RNA, 20 nt, Human
ucuccagcucccgcagaguc

SEQ ID NO: 1216459 - RNA, 24 nt, Human
ucuccugcugccacagccucucau

SEQ ID NO: 1216460 - RNA, 20 nt, Human
uuagaaacacaaacauaagu

SEQ ID NO: 1216461 - RNA, 22 nt, Human
uuuaaacuauaaauuagaaaca

SEQ ID NO: 1216462 - RNA, 22 nt, Human
uuuaaacuauaaauuagaaaca

SEQ ID NO: 1216463 - RNA, 22 nt, Human
uuuaaacuauaaauuagaaaca

SEQ ID NO: 1216464 - RNA, 22 nt, Human
uuuaaacuauaaauuagaaaca

SEQ ID NO: 1216465 - RNA, 22 nt, Human
aaaaguuauuuuaaaaaguuau

SEQ ID NO: 1216466 - RNA, 21 nt, Human
aaaauaaauaaaagcaggccc

SEQ ID NO: 1216467 - RNA, 21 nt, Human
aacacagccagcagaggacac

SEQ ID NO: 1216468 - RNA, 20 nt, Human
aaccccuccccagucacccc

SEQ ID NO: 1216469 - RNA, 20 nt, Human
aacuguagaccaggccaggg

SEQ ID NO: 1216470 - RNA, 23 nt, Human
aagcaacaggccaaggugcguga

SEQ ID NO: 1216471 - RNA, 19 nt, Human
aagcaacuuuucccucagg

SEQ ID NO: 1216472 - RNA, 20 nt, Human
aagcagaagagggagacucc

SEQ ID NO: 1216473 - RNA, 23 nt, Human
aagcagaagagggagacuccgcg

SEQ ID NO: 1216474 - RNA, 24 nt, Human
aagcagaagagggagacuccgcgg

SEQ ID NO: 1216475 - RNA, 19 nt, Human
aagcaggccccugucagca

SEQ ID NO: 1216476 - RNA, 21 nt, Human
aagcuccagggacuuuccagg

SEQ ID NO: 1216477 - RNA, 20 nt, Human
aagcucccagccccuacacc

SEQ ID NO: 1216478 - RNA, 23 nt, Human
aagggacagcaggacugguagag

SEQ ID NO: 1216479 - RNA, 24 nt, Human
aagggggcuggcuuuggagcuggg

SEQ ID NO: 1216480 - RNA, 21 nt, Human
acacaacccccuccaagcucc

SEQ ID NO: 1216481 - RNA, 24 nt, Human
acacaacccccuccaagcucccag

SEQ ID NO: 1216482 - RNA, 19 nt, Human
acaggccaaggugcgugag

SEQ ID NO: 1216483 - RNA, 19 nt, Human
acaggggagccucaacugg

SEQ ID NO: 1216484 - RNA, 25 nt, Human
acccccuccaagcucccagccccua

SEQ ID NO: 1216485 - RNA, 21 nt, Human
accccuuuaccauuaggguag

SEQ ID NO: 1216486 - RNA, 19 nt, Human
acucccaggcugggagcug

SEQ ID NO: 1216487 - RNA, 19 nt, Human
acuccgcggcaggaaaggg

SEQ ID NO: 1216488 - RNA, 20 nt, Human
agaagggcgggagggauggc

SEQ ID NO: 1216489 - RNA, 18 nt, Human
agagguugguggaguugg

SEQ ID NO: 1216490 - RNA, 19 nt, Human
agcauaggagcgaggaagg

SEQ ID NO: 1216491 - RNA, 22 nt, Human
agccaacugguugagaagccug

SEQ ID NO: 1216492 - RNA, 19 nt, Human
aggcaggcuuggaaaggga

SEQ ID NO: 1216493 - RNA, 19 nt, Human
aggcaggcuuggaaaggga

SEQ ID NO: 1216494 - RNA, 22 nt, Human
aggcaggcuuggaaagggaggu

SEQ ID NO: 1216495 - RNA, 20 nt, Human
aggccagggcacaggcugcu

SEQ ID NO: 1216496 - RNA, 22 nt, Human
aggccucuggccgccugagucc

SEQ ID NO: 1216497 - RNA, 24 nt, Human
aggccucuggccgccugaguccag

SEQ ID NO: 1216498 - RNA, 18 nt, Human
agggauggcuggcuggag

SEQ ID NO: 1216499 - RNA, 19 nt, Human
aggggcgaugucaggagac

SEQ ID NO: 1216500 - RNA, 18 nt, Human
agugcuucagcaggggcc

SEQ ID NO: 1216501 - RNA, 22 nt, Human
augcugccuggugacaccuggu

SEQ ID NO: 1216502 - RNA, 21 nt, Human
auggcgccuacagaguacacu

SEQ ID NO: 1216503 - RNA, 21 nt, Human
augugugugugugugugugug

SEQ ID NO: 1216504 - RNA, 22 nt, Human
augugugugugugugugugugu

SEQ ID NO: 1216505 - RNA, 23 nt, Human
auguguguguguguguguguguu

SEQ ID NO: 1216506 - RNA, 19 nt, Human
caacaacacccuaaaaaug

SEQ ID NO: 1216507 - RNA, 22 nt, Human
caaccccuccccagucaccccu

SEQ ID NO: 1216508 - RNA, 21 nt, Human
caagcacagcacggggacuga

SEQ ID NO: 1216509 - RNA, 18 nt, Human
caagggacagcaggacug

SEQ ID NO: 1216510 - RNA, 21 nt, Human
caaguuucagcaauggucaca

SEQ ID NO: 1216511 - RNA, 22 nt, Human
cacaacccccuccaagcuccca

SEQ ID NO: 1216512 - RNA, 23 nt, Human
cacaacccccuccaagcucccag

SEQ ID NO: 1216513 - RNA, 18 nt, Human
cacaagcacagcacgggg

SEQ ID NO: 1216514 - RNA, 19 nt, Human
caccaaagcaacuuuuccc

SEQ ID NO: 1216515 - RNA, 21 nt, Human
caccaaagcaacuuuucccuc

SEQ ID NO: 1216516 - RNA, 22 nt, Human
caccccuaaucugcaguggauu

SEQ ID NO: 1216517 - RNA, 30 nt, Human
caccgcuacaacagacuaagucacagaagg

SEQ ID NO: 1216518 - RNA, 22 nt, Human
caccuggacgugucagcucacc

SEQ ID NO: 1216519 - RNA, 19 nt, Human
cacguguauauauguauau

SEQ ID NO: 1216520 - RNA, 19 nt, Human
cacugacuuccauccaccc

SEQ ID NO: 1216521 - RNA, 20 nt, Human
cacugcucccaacaacaccc

SEQ ID NO: 1216522 - RNA, 23 nt, Human
cagaagagggagacuccgcggca

SEQ ID NO: 1216523 - RNA, 22 nt, Human
cagacuaagucacagaagaagg

SEQ ID NO: 1216524 - RNA, 20 nt, Human
cagcaguagugcuucagcag

SEQ ID NO: 1216525 - RNA, 24 nt, Human
cagccaccagaccugauagagaag

SEQ ID NO: 1216526 - RNA, 21 nt, Human
cagccauggagaccuugagca

SEQ ID NO: 1216527 - RNA, 19 nt, Human
cagcugccugcacagcacc

SEQ ID NO: 1216528 - RNA, 21 nt, Human
cagcuuccucuugcuggucua

SEQ ID NO: 1216529 - RNA, 19 nt, Human
caggacacccgcccaggca

SEQ ID NO: 1216530 - RNA, 22 nt, Human
cagggcccugccccuaguggcc

SEQ ID NO: 1216531 - RNA, 25 nt, Human
cauaagccuggagaagugggucugg

SEQ ID NO: 1216532 - RNA, 22 nt, Human
ccaagcucccagccccuacacc

SEQ ID NO: 1216533 - RNA, 25 nt, Human
ccaagcucccagccccuacaccaua

SEQ ID NO: 1216534 - RNA, 19 nt, Human
ccacacaacccccuccaag

SEQ ID NO: 1216535 - RNA, 18 nt, Human
ccagaccugauagagaag

SEQ ID NO: 1216536 - RNA, 27 nt, Human
cccacacaacccccuccaagcucccag

SEQ ID NO: 1216537 - RNA, 22 nt, Human
cccacugaaugaggagccccag

SEQ ID NO: 1216538 - RNA, 21 nt, Human
ccccaggcucagccauggaga

SEQ ID NO: 1216539 - RNA, 23 nt, Human
cccccaccaugucccuacaaccc

SEQ ID NO: 1216540 - RNA, 19 nt, Human
ccccccacacaacccccuc

SEQ ID NO: 1216541 - RNA, 18 nt, Human
cccccugccucccucucc

SEQ ID NO: 1216542 - RNA, 23 nt, Human
ccccuaguggccagagcuggcuu

SEQ ID NO: 1216543 - RNA, 19 nt, Human
ccccugccucccucucccc

SEQ ID NO: 1216544 - RNA, 20 nt, Human
cccuccaagcucccagcccc

SEQ ID NO: 1216545 - RNA, 18 nt, Human
ccuggagaagugggucug

SEQ ID NO: 1216546 - RNA, 26 nt, Human
cgaccccuagaagcaacaggccaagg

SEQ ID NO: 1216547 - RNA, 22 nt, Human
cgcagguucccuccaggcugag

SEQ ID NO: 1216548 - RNA, 25 nt, Human
cgugacuaucaccccuaaucugcag

SEQ ID NO: 1216549 - RNA, 23 nt, Human
cguguacauacuguagcugugua

SEQ ID NO: 1216550 - RNA, 22 nt, Human
cuaacaggggagccucaacugg

SEQ ID NO: 1216551 - RNA, 24 nt, Human
cucccagccccuacaccauaaacc

SEQ ID NO: 1216552 - RNA, 19 nt, Human
cucccaucuucuuacucag

SEQ ID NO: 1216553 - RNA, 21 nt, Human
cucugggccaucagaaagccc

SEQ ID NO: 1216554 - RNA, 24 nt, Human
cugcaguggauuuggcucuuggcc

SEQ ID NO: 1216555 - RNA, 23 nt, Human
cuggcuguccacaggccgcgcau

SEQ ID NO: 1216556 - RNA, 22 nt, Human
cuggggguggccccccuucccc

SEQ ID NO: 1216557 - RNA, 22 nt, Human
cugguuggcggggggcugcagg

SEQ ID NO: 1216558 - RNA, 20 nt, Human
gaacacagccagcagaggac

SEQ ID NO: 1216559 - RNA, 22 nt, Human
gaacacagccagcagaggacac

SEQ ID NO: 1216560 - RNA, 22 nt, Human
gaacacugauugaaccaaaaug

SEQ ID NO: 1216561 - RNA, 18 nt, Human
gaaggaggcggggauggg

SEQ ID NO: 1216562 - RNA, 22 nt, Human
gacugucaggccacacagcugc

SEQ ID NO: 1216563 - RNA, 21 nt, Human
gcagguucccuccaggcugag

SEQ ID NO: 1216564 - RNA, 20 nt, Human
gccaaggugcgugagccugc

SEQ ID NO: 1216565 - RNA, 19 nt, Human
gccagaggccccucugggc

SEQ ID NO: 1216566 - RNA, 20 nt, Human
gcgaccccuagaagcaacag

SEQ ID NO: 1216567 - RNA, 20 nt, Human
gcgggggcuggcuguccaca

SEQ ID NO: 1216568 - RNA, 21 nt, Human
gcuggggguggccccccuucc

SEQ ID NO: 1216569 - RNA, 18 nt, Human
ggaaaaaaaguaaaaaaa

SEQ ID NO: 1216570 - RNA, 24 nt, Human
ggagcuauaagggauggcuggcug

SEQ ID NO: 1216571 - RNA, 20 nt, Human
ggagggauggcgggggcugg

SEQ ID NO: 1216572 - RNA, 19 nt, Human
ggcaggaaagggaagugag

SEQ ID NO: 1216573 - RNA, 22 nt, Human
ggcaggggcauaccacagaggg

SEQ ID NO: 1216574 - RNA, 24 nt, Human
ggccacacagcugccugcacagca

SEQ ID NO: 1216575 - RNA, 23 nt, Human
ggccagcaguagugcuucagcag

SEQ ID NO: 1216576 - RNA, 22 nt, Human
gguuacauaggugaggcugggc

SEQ ID NO: 1216577 - RNA, 23 nt, Human
guaccuagcggagguugcagcug

SEQ ID NO: 1216578 - RNA, 21 nt, Human
gucccccugccucccucuccu

SEQ ID NO: 1216579 - RNA, 23 nt, Human
gucuggagucuucacccccacca

SEQ ID NO: 1216580 - RNA, 20 nt, Human
gugaggcaguuggccacgug

SEQ ID NO: 1216581 - RNA, 23 nt, Human
gugccggcugccccgcagguucc

SEQ ID NO: 1216582 - RNA, 19 nt, Human
guguauauauguauaugug

SEQ ID NO: 1216583 - RNA, 21 nt, Human
gugugugugugugugugugug

SEQ ID NO: 1216584 - RNA, 18 nt, Human
guucagggcccugccccu

SEQ ID NO: 1216585 - RNA, 19 nt, Human
guucagggcccugccccua

SEQ ID NO: 1216586 - RNA, 24 nt, Human
guucagggcccugccccuaguggc

SEQ ID NO: 1216587 - RNA, 18 nt, Human
guuuguuuggaggagguc

SEQ ID NO: 1216588 - RNA, 28 nt, Human
uaaaagaacacaaacuaaaaaaguuaac

SEQ ID NO: 1216589 - RNA, 20 nt, Human
uaagagccagagguuggugg

SEQ ID NO: 1216590 - RNA, 20 nt, Human
uaagagcccccaggcucagc

SEQ ID NO: 1216591 - RNA, 25 nt, Human
uaccacagagggggcacaaguuuca

SEQ ID NO: 1216592 - RNA, 23 nt, Human
uaccugggagggagggaaggggg

SEQ ID NO: 1216593 - RNA, 19 nt, Human
uaggagcgaggaaggaggc

SEQ ID NO: 1216594 - RNA, 19 nt, Human
uauauauguauaugugugu

SEQ ID NO: 1216595 - RNA, 21 nt, Human
uauauauguauaugugugugu

SEQ ID NO: 1216596 - RNA, 19 nt, Human
uauauguauaugugugugu

SEQ ID NO: 1216597 - RNA, 19 nt, Human
uauauguauaugugugugu

SEQ ID NO: 1216598 - RNA, 19 nt, Human
uauauguauaugugugugu

SEQ ID NO: 1216599 - RNA, 23 nt, Human
uauauguauaugugugugugugu

SEQ ID NO: 1216600 - RNA, 23 nt, Human
uauauguauaugugugugugugu

SEQ ID NO: 1216601 - RNA, 23 nt, Human
uauaugugugugugugugugugu

SEQ ID NO: 1216602 - RNA, 23 nt, Human
uauccuagaucaccacuggauug

SEQ ID NO: 1216603 - RNA, 19 nt, Human
uauguauaugugugugugu

SEQ ID NO: 1216604 - RNA, 18 nt, Human
uaugugugugugugugug

SEQ ID NO: 1216605 - RNA, 23 nt, Human
uaugugugugugugugugugugu

SEQ ID NO: 1216606 - RNA, 22 nt, Human
ucacaggacacccgcccaggca

SEQ ID NO: 1216607 - RNA, 19 nt, Human
ucagagaggcagcugaggc

SEQ ID NO: 1216608 - RNA, 21 nt, Human
ucagcauguccagcugggcug

SEQ ID NO: 1216609 - RNA, 23 nt, Human
uccaggaaaagugucccuugaaa

SEQ ID NO: 1216610 - RNA, 19 nt, Human
uccauagagaacacagcca

SEQ ID NO: 1216611 - RNA, 19 nt, Human
ucccccugccucccucucc

SEQ ID NO: 1216612 - RNA, 19 nt, Human
ucccuacaaccccucccca

SEQ ID NO: 1216613 - RNA, 21 nt, Human
ucucugagaagagggaucugu

SEQ ID NO: 1216614 - RNA, 18 nt, Human
ucugcaguggauuuggcu

SEQ ID NO: 1216615 - RNA, 21 nt, Human
ucuucacccccaccauguccc

SEQ ID NO: 1216616 - RNA, 20 nt, Human
ugacucagacugcaugacag

SEQ ID NO: 1216617 - RNA, 23 nt, Human
ugagaagccugaucuagcugugg

SEQ ID NO: 1216618 - RNA, 21 nt, Human
ugaggcugggcccuuccugcu

SEQ ID NO: 1216619 - RNA, 20 nt, Human
ugccagaggccccucugggc

SEQ ID NO: 1216620 - RNA, 23 nt, Human
ugccagaggccccucugggccau

SEQ ID NO: 1216621 - RNA, 20 nt, Human
ugcuggccagcaguagugcu

SEQ ID NO: 1216622 - RNA, 23 nt, Human
ugcugggaaaagcagaagaggga

SEQ ID NO: 1216623 - RNA, 18 nt, Human
ugcuggggguggcccccc

SEQ ID NO: 1216624 - RNA, 20 nt, Human
ugcuggggguggccccccuu

SEQ ID NO: 1216625 - RNA, 19 nt, Human
uggaaaaaaaguaaaaaaa

SEQ ID NO: 1216626 - RNA, 23 nt, Human
uggaaaaaaaguaaaaaaaaacu

SEQ ID NO: 1216627 - RNA, 21 nt, Human
uggaauaaauggauuuagcca

SEQ ID NO: 1216628 - RNA, 19 nt, Human
uggagaagugggucuggag

SEQ ID NO: 1216629 - RNA, 22 nt, Human
uggagguggugcacuuuggagg

SEQ ID NO: 1216630 - RNA, 22 nt, Human
uggagucuucacccccaccaug

SEQ ID NO: 1216631 - RNA, 21 nt, Human
uggauugcugacagauagagg

SEQ ID NO: 1216632 - RNA, 22 nt, Human
uggccgccugaguccagccccc

SEQ ID NO: 1216633 - RNA, 23 nt, Human
uggccgccugaguccagcccccc

SEQ ID NO: 1216634 - RNA, 19 nt, Human
uggccuuuuccauccccug

SEQ ID NO: 1216635 - RNA, 23 nt, Human
uggcuggcuggagugaaugccag

SEQ ID NO: 1216636 - RNA, 18 nt, Human
ugggaaaagcagaagagg

SEQ ID NO: 1216637 - RNA, 24 nt, Human
ugggacuccuguuuuuuguuuuuu

SEQ ID NO: 1216638 - RNA, 21 nt, Human
ugggagggagggaagggggcu

SEQ ID NO: 1216639 - RNA, 23 nt, Human
uggggaaggcagggagggcaggu

SEQ ID NO: 1216640 - RNA, 19 nt, Human
uggguccugcaguuugucc

SEQ ID NO: 1216641 - RNA, 20 nt, Human
uggguuucucagucaaggga

SEQ ID NO: 1216642 - RNA, 19 nt, Human
uguauauauguauaugugu

SEQ ID NO: 1216643 - RNA, 20 nt, Human
uguauauauguauaugugug

SEQ ID NO: 1216644 - RNA, 23 nt, Human
uguauauauguauaugugugugu

SEQ ID NO: 1216645 - RNA, 24 nt, Human
uguauaugugugugugugugugug

SEQ ID NO: 1216646 - RNA, 24 nt, Human
ugucaggagacagcuuccucuugc

SEQ ID NO: 1216647 - RNA, 22 nt, Human
ugucccuacaaccccuccccag

SEQ ID NO: 1216648 - RNA, 23 nt, Human
ugugggaugaccacguguauagg

SEQ ID NO: 1216649 - RNA, 18 nt, Human
ugugugugugugugugug

SEQ ID NO: 1216650 - RNA, 18 nt, Human
ugugugugugugugugug

SEQ ID NO: 1216651 - RNA, 18 nt, Human
ugugugugugugugugug

SEQ ID NO: 1216652 - RNA, 21 nt, Human
ugugugugugugugugugugu

SEQ ID NO: 1216653 - RNA, 22 nt, Human
ugugugugugugugugugugug

SEQ ID NO: 1216654 - RNA, 19 nt, Human
uguguugugggaugaccac

SEQ ID NO: 1216655 - RNA, 20 nt, Human
uguuggggaccuuccaggcc

SEQ ID NO: 1216656 - RNA, 23 nt, Human
uguuuuuuguuuuuugcuuuuga

SEQ ID NO: 1216657 - RNA, 22 nt, Human
uuaaaagaacacaaacuaaaaa

SEQ ID NO: 1216658 - RNA, 25 nt, Human
uuccauccaccccacgugucuucca

SEQ ID NO: 1216659 - RNA, 24 nt, Human
uuggccacguguauauauguauau

SEQ ID NO: 1216660 - RNA, 33 nt, Human
uuggccacguguauauauguauaugugugugau

SEQ ID NO: 1216661 - RNA, 24 nt, Human
uuucccucacuggguccugcaguu

SEQ ID NO: 1216662 - RNA, 21 nt, Human
uuuguuuggaggaggucugau

SEQ ID NO: 1216663 - RNA, 22 nt, Human
uuuuuguuuuuuguuuuuugcu

SEQ ID NO: 1216664 - RNA, 21 nt, Human
ccucuaagauuauaguuauua

SEQ ID NO: 1216665 - RNA, 20 nt, Human
aagccuccacguccacccag

SEQ ID NO: 1216666 - RNA, 22 nt, Human
cugaagccuccacguccaccca

SEQ ID NO: 1216667 - RNA, 20 nt, Human
ucugaagccuccacguccac

SEQ ID NO: 1216668 - RNA, 21 nt, Human
aacccgagcucugccugcuuc

SEQ ID NO: 1216669 - RNA, 22 nt, Human
aagagaaaaacuugagcuugga

SEQ ID NO: 1216670 - RNA, 22 nt, Human
aagagaaagacacccaaaagga

SEQ ID NO: 1216671 - RNA, 21 nt, Human
aagagcucaauguuaccugcc

SEQ ID NO: 1216672 - RNA, 21 nt, Human
accagcuccucccuccuccug

SEQ ID NO: 1216673 - RNA, 18 nt, Human
agaaaaacuugagcuugg

SEQ ID NO: 1216674 - RNA, 19 nt, Human
agacaagcccuacuucccc

SEQ ID NO: 1216675 - RNA, 20 nt, Human
agacagaguccaacuccaac

SEQ ID NO: 1216676 - RNA, 18 nt, Human
agaggcuaaaauugaccc

SEQ ID NO: 1216677 - RNA, 29 nt, Human
agcuccucccuccuccugugugcccuccc

SEQ ID NO: 1216678 - RNA, 19 nt, Human
aggcaagagaaaaacuuga

SEQ ID NO: 1216679 - RNA, 19 nt, Human
aggcaagagaaaaacuuga

SEQ ID NO: 1216680 - RNA, 24 nt, Human
aggcaagagaaaaacuugagcuug

SEQ ID NO: 1216681 - RNA, 19 nt, Human
agguauguuuuccauacuc

SEQ ID NO: 1216682 - RNA, 19 nt, Human
caaaacagguaucacaagc

SEQ ID NO: 1216683 - RNA, 19 nt, Human
cacuccauggcugcuucca

SEQ ID NO: 1216684 - RNA, 19 nt, Human
cacuuccuuaucuugaaga

SEQ ID NO: 1216685 - RNA, 23 nt, Human
cagcaggagggguggcaaccauc

SEQ ID NO: 1216686 - RNA, 18 nt, Human
cagcccuucugcccagcc

SEQ ID NO: 1216687 - RNA, 19 nt, Human
cagcccuucugcccagccu

SEQ ID NO: 1216688 - RNA, 20 nt, Human
cagcuccucccuccuccugu

SEQ ID NO: 1216689 - RNA, 18 nt, Human
ccaggaagagguagaacc

SEQ ID NO: 1216690 - RNA, 21 nt, Human
ccaggcccccagcccugugcc

SEQ ID NO: 1216691 - RNA, 26 nt, Human
cccacagcccuucugcccagccuucu

SEQ ID NO: 1216692 - RNA, 26 nt, Human
cccagcccugugccugggcuccuggc

SEQ ID NO: 1216693 - RNA, 22 nt, Human
cccuccuuuuuccaggccccca

SEQ ID NO: 1216694 - RNA, 19 nt, Human
cccugugccugggcucccu

SEQ ID NO: 1216695 - RNA, 22 nt, Human
cccuucaaaacagguaucacaa

SEQ ID NO: 1216696 - RNA, 21 nt, Human
ccgccaucugucaaaaauggg

SEQ ID NO: 1216697 - RNA, 18 nt, Human
ccgucccgccaucuguca

SEQ ID NO: 1216698 - RNA, 20 nt, Human
ccuagccccguccuuuggga

SEQ ID NO: 1216699 - RNA, 25 nt, Human
ccuccuccugacauccuucuggacg

SEQ ID NO: 1216700 - RNA, 19 nt, Human
ccuccugacauccuucugg

SEQ ID NO: 1216701 - RNA, 24 nt, Human
ccucugccuauucugcccuccuug

SEQ ID NO: 1216702 - RNA, 22 nt, Human
cuauucugcccuccuuguuucg

SEQ ID NO: 1216703 - RNA, 20 nt, Human
cucugccuauucugcccucc

SEQ ID NO: 1216704 - RNA, 19 nt, Human
cugaacccgagcucugccu

SEQ ID NO: 1216705 - RNA, 20 nt, Human
cugccugaugucuccaaaau

SEQ ID NO: 1216706 - RNA, 19 nt, Human
cugucaucaaaacacaugu

SEQ ID NO: 1216707 - RNA, 18 nt, Human
cuuugccugaaccuccuc

SEQ ID NO: 1216708 - RNA, 23 nt, Human
gaagacccuccaccuuugaagag

SEQ ID NO: 1216709 - RNA, 25 nt, Human
gacaagcccuacuuccccacagccc

SEQ ID NO: 1216710 - RNA, 20 nt, Human
gcagguauguuuuccauacu

SEQ ID NO: 1216711 - RNA, 18 nt, Human
gccaagcucuguggaggg

SEQ ID NO: 1216712 - RNA, 21 nt, Human
gccagucucuguucccuccaa

SEQ ID NO: 1216713 - RNA, 24 nt, Human
gcccccagcccugugccugggcuc

SEQ ID NO: 1216714 - RNA, 20 nt, Human
gcccuccuuuuuccaggccc

SEQ ID NO: 1216715 - RNA, 20 nt, Human
gcccugugccugggcuccug

SEQ ID NO: 1216716 - RNA, 19 nt, Human
gccugggcuccuggcagcu

SEQ ID NO: 1216717 - RNA, 19 nt, Human
ggaaggcucccagccaggc

SEQ ID NO: 1216718 - RNA, 22 nt, Human
ggagacugaggcuuuuagaggc

SEQ ID NO: 1216719 - RNA, 24 nt, Human
ggcagguauguuuuccauacucuc

SEQ ID NO: 1216720 - RNA, 24 nt, Human
gguauggccguagacuauuuugga

SEQ ID NO: 1216721 - RNA, 20 nt, Human
uaaccaggccugacccugcu

SEQ ID NO: 1216722 - RNA, 22 nt, Human
uaacuccugugauauuccuccu

SEQ ID NO: 1216723 - RNA, 19 nt, Human
uaagacagaguccaacucc

SEQ ID NO: 1216724 - RNA, 27 nt, Human
uaaggagacugaggcuuuuagaggcua

SEQ ID NO: 1216725 - RNA, 21 nt, Human
uacacuaccaucuuccugcaa

SEQ ID NO: 1216726 - RNA, 19 nt, Human
uaccaccauaacuaccacu

SEQ ID NO: 1216727 - RNA, 25 nt, Human
uauggccguagacuauuuuggauac

SEQ ID NO: 1216728 - RNA, 27 nt, Human
uauucugcccuccuuguuucgagaccu

SEQ ID NO: 1216729 - RNA, 24 nt, Human
ucaaaacacaugucuuucuugcag

SEQ ID NO: 1216730 - RNA, 20 nt, Human
ucagucccauugugagggcu

SEQ ID NO: 1216731 - RNA, 19 nt, Human
uccauacucuccccaucca

SEQ ID NO: 1216732 - RNA, 21 nt, Human
uccauccuacagcaggagggg

SEQ ID NO: 1216733 - RNA, 19 nt, Human
uccccauccagguacuaac

SEQ ID NO: 1216734 - RNA, 24 nt, Human
ucccuaccagcuccucccuccucc

SEQ ID NO: 1216735 - RNA, 20 nt, Human
ucucccuaccagcuccuccc

SEQ ID NO: 1216736 - RNA, 19 nt, Human
ugaagagcagucuuuucug

SEQ ID NO: 1216737 - RNA, 21 nt, Human
ugaagagcagucuuuucuggc

SEQ ID NO: 1216738 - RNA, 22 nt, Human
ugacagauggcaggccuagggu

SEQ ID NO: 1216739 - RNA, 20 nt, Human
ugacccaggucacccggcug

SEQ ID NO: 1216740 - RNA, 20 nt, Human
ugaugccaagcucuguggag

SEQ ID NO: 1216741 - RNA, 21 nt, Human
ugcgccucccucccacuccau

SEQ ID NO: 1216742 - RNA, 22 nt, Human
ugcuuguuccacccggccacac

SEQ ID NO: 1216743 - RNA, 23 nt, Human
uggagaagagaaagacacccaaa

SEQ ID NO: 1216744 - RNA, 21 nt, Human
uggagacaagcccuacuuccc

SEQ ID NO: 1216745 - RNA, 23 nt, Human
uggcaggccuaggguucugauuc

SEQ ID NO: 1216746 - RNA, 19 nt, Human
ugggacggagaggccucug

SEQ ID NO: 1216747 - RNA, 20 nt, Human
ugucuuauugcgccucccuc

SEQ ID NO: 1216748 - RNA, 23 nt, Human
ugucuuauugcgccucccuccca

SEQ ID NO: 1216749 - RNA, 19 nt, Human
uucaugaagacccuccacc

SEQ ID NO: 1216750 - RNA, 21 nt, Human
uucccaugaugccaagcucug

SEQ ID NO: 1216751 - RNA, 20 nt, Human
uucugauucaguccauugga

SEQ ID NO: 1216752 - RNA, 18 nt, Human
uugaagaagagcucuccu

SEQ ID NO: 1216753 - RNA, 21 nt, Human
uugggagucauggauuccuag

SEQ ID NO: 1216754 - RNA, 19 nt, Human
uuugccugaaccuccucua

SEQ ID NO: 1216755 - RNA, 18 nt, Human
aaaacaaaagccaggaac

SEQ ID NO: 1216756 - RNA, 20 nt, Human
aaaaccagaguuuaugaaaa

SEQ ID NO: 1216757 - RNA, 20 nt, Human
aaaagagaaauaauaaaaaa

SEQ ID NO: 1216758 - RNA, 23 nt, Human
aaaauugcagaagaguuaaccaa

SEQ ID NO: 1216759 - RNA, 18 nt, Human
aaacaaaagccaggaacc

SEQ ID NO: 1216760 - RNA, 20 nt, Human
aaacaaaagccaggaaccaa

SEQ ID NO: 1216761 - RNA, 22 nt, Human
aaacaaaagccaggaaccaaga

SEQ ID NO: 1216762 - RNA, 23 nt, Human
aaacaaaagccaggaaccaagaa

SEQ ID NO: 1216763 - RNA, 22 nt, Human
aaacagauugaucuauguccuu

SEQ ID NO: 1216764 - RNA, 24 nt, Human
aaauuccuggaaauacuagcacau

SEQ ID NO: 1216765 - RNA, 22 nt, Human
aacaugaaacagaucuauagac

SEQ ID NO: 1216766 - RNA, 19 nt, Human
aacugaagaaggcugcaga

SEQ ID NO: 1216767 - RNA, 22 nt, Human
aagagguuucugagagucaaac

SEQ ID NO: 1216768 - RNA, 23 nt, Human
aaucucuugauacaaaaaacaaa

SEQ ID NO: 1216769 - RNA, 19 nt, Human
aaucugauuguucuaauuu

SEQ ID NO: 1216770 - RNA, 19 nt, Human
aauugaaagcaauacucca

SEQ ID NO: 1216771 - RNA, 18 nt, Human
aauugguuuaaaucugau

SEQ ID NO: 1216772 - RNA, 18 nt, Human
acagcacccaccaaaaca

SEQ ID NO: 1216773 - RNA, 25 nt, Human
acugcaagcucuuuguaccgucagg

SEQ ID NO: 1216774 - RNA, 21 nt, Human
agaaaucauccucuguccaca

SEQ ID NO: 1216775 - RNA, 23 nt, Human
agcacccaccaaaacaugaaaca

SEQ ID NO: 1216776 - RNA, 21 nt, Human
agccaggaaccaagaagucua

SEQ ID NO: 1216777 - RNA, 21 nt, Human
auaacaaauacauuacccuaa

SEQ ID NO: 1216778 - RNA, 22 nt, Human
auacaaaaaacaaaagccagga

SEQ ID NO: 1216779 - RNA, 21 nt, Human
auaggaagaacuaacugaaga

SEQ ID NO: 1216780 - RNA, 20 nt, Human
aucacaaucucuugauacaa

SEQ ID NO: 1216781 - RNA, 21 nt, Human
caaaaaacaaaagccaggaac

SEQ ID NO: 1216782 - RNA, 23 nt, Human
caaaaaacaaaagccaggaacca

SEQ ID NO: 1216783 - RNA, 25 nt, Human
caaaaaacaaaagccaggaaccaag

SEQ ID NO: 1216784 - RNA, 18 nt, Human
caaaaagaagguaggaaa

SEQ ID NO: 1216785 - RNA, 26 nt, Human
caaauacauuacccuaacuuuucuug

SEQ ID NO: 1216786 - RNA, 19 nt, Human
cacauaaaacagauugauc

SEQ ID NO: 1216787 - RNA, 23 nt, Human
cacccaccaaaacaugaaacaga

SEQ ID NO: 1216788 - RNA, 22 nt, Human
cacuaauagccaagggcaaaau

SEQ ID NO: 1216789 - RNA, 20 nt, Human
cagggucaucccaauacaaa

SEQ ID NO: 1216790 - RNA, 21 nt, Human
cccaccaaaacaugaaacaga

SEQ ID NO: 1216791 - RNA, 24 nt, Human
cccuaacuuuucuugaggccuaca

SEQ ID NO: 1216792 - RNA, 19 nt, Human
cuccaauacuuucccagcc

SEQ ID NO: 1216793 - RNA, 23 nt, Human
gaaccuggacauggagcaaaaga

SEQ ID NO: 1216794 - RNA, 18 nt, Human
gaaucuuucccaaguaua

SEQ ID NO: 1216795 - RNA, 20 nt, Human
gaauuuucucaucuucauuc

SEQ ID NO: 1216796 - RNA, 20 nt, Human
gagacacuaauagccaaggg

SEQ ID NO: 1216797 - RNA, 20 nt, Human
gauagcagcagguggcacau

SEQ ID NO: 1216798 - RNA, 24 nt, Human
gcaaaagacccuccaauacuuucc

SEQ ID NO: 1216799 - RNA, 18 nt, Human
gcgagaauuuucucaucu

SEQ ID NO: 1216800 - RNA, 22 nt, Human
ggaaauacuagcacauaaaaca

SEQ ID NO: 1216801 - RNA, 19 nt, Human
ggaagaacuaacugaagaa

SEQ ID NO: 1216802 - RNA, 18 nt, Human
ggugaucaaauggaagag

SEQ ID NO: 1216803 - RNA, 23 nt, Human
guggaugaaauaaaaugaaauga

SEQ ID NO: 1216804 - RNA, 27 nt, Human
uaaaaguaccaaaaaaaucuagcccca

SEQ ID NO: 1216805 - RNA, 18 nt, Human
uaacaaauacauuacccu

SEQ ID NO: 1216806 - RNA, 26 nt, Human
uaacacagcacccaccaaaacaugaa

SEQ ID NO: 1216807 - RNA, 20 nt, Human
uaacugaagaaggcugcaga

SEQ ID NO: 1216808 - RNA, 19 nt, Human
uaauagccaagggcaaaau

SEQ ID NO: 1216809 - RNA, 23 nt, Human
uacaaaaaacaaaagccaggaac

SEQ ID NO: 1216810 - RNA, 22 nt, Human
uaccccagaaacaacguaaguu

SEQ ID NO: 1216811 - RNA, 23 nt, Human
uacccuaacuuuucuugaggccu

SEQ ID NO: 1216812 - RNA, 23 nt, Human
uagccaagggcaaaauaagauac

SEQ ID NO: 1216813 - RNA, 24 nt, Human
uaggaagaacuaacugaagaaggc

SEQ ID NO: 1216814 - RNA, 24 nt, Human
uauaaacaagauggcucaaccaca

SEQ ID NO: 1216815 - RNA, 24 nt, Human
uauaggaagaacuaacugaagaag

SEQ ID NO: 1216816 - RNA, 23 nt, Human
uauuggcagaaaucauccucugu

SEQ ID NO: 1216817 - RNA, 22 nt, Human
uauuuuacuugcuugccuuugc

SEQ ID NO: 1216818 - RNA, 18 nt, Human
ucaaaacucaacaaagcu

SEQ ID NO: 1216819 - RNA, 24 nt, Human
ucaucccaauacaaggaugggaau

SEQ ID NO: 1216820 - RNA, 24 nt, Human
ucauugcgagaauuuucucaucuu

SEQ ID NO: 1216821 - RNA, 18 nt, Human
uccacauagagauugagu

SEQ ID NO: 1216822 - RNA, 24 nt, Human
ucucuugauacaaaaaacaaaagc

SEQ ID NO: 1216823 - RNA, 22 nt, Human
ugaaagcaauacuccauuaaga

SEQ ID NO: 1216824 - RNA, 19 nt, Human
ugaagcauauguuugcuaa

SEQ ID NO: 1216825 - RNA, 20 nt, Human
ugagaaaaaagcuuuuccau

SEQ ID NO: 1216826 - RNA, 23 nt, Human
ugagaacugcaagcucuuuguac

SEQ ID NO: 1216827 - RNA, 22 nt, Human
ugauacaaaaaacaaaagccag

SEQ ID NO: 1216828 - RNA, 19 nt, Human
ugaucacauggcuuuuuug

SEQ ID NO: 1216829 - RNA, 18 nt, Human
uggaagagauaaaggugg

SEQ ID NO: 1216830 - RNA, 19 nt, Human
uggaagagauaaagguggu

SEQ ID NO: 1216831 - RNA, 24 nt, Human
uggaagguuuccauuuaucuucug

SEQ ID NO: 1216832 - RNA, 21 nt, Human
uggcagaaaucauccucuguc

SEQ ID NO: 1216833 - RNA, 19 nt, Human
uggcucaaccacagcaugu

SEQ ID NO: 1216834 - RNA, 19 nt, Human
ugggaaugcuaacacagca

SEQ ID NO: 1216835 - RNA, 22 nt, Human
uggugauagcagcagguggcac

SEQ ID NO: 1216836 - RNA, 19 nt, Human
ugucuacaacuguuugacg

SEQ ID NO: 1216837 - RNA, 18 nt, Human
uguggugauagcagcagg

SEQ ID NO: 1216838 - RNA, 18 nt, Human
uguggugauagcagcagg

SEQ ID NO: 1216839 - RNA, 21 nt, Human
uucuucuuuaacugcaaggaa

SEQ ID NO: 1216840 - RNA, 25 nt, Human
uuggaaaaugucaaguauuauuuca

SEQ ID NO: 1216841 - RNA, 20 nt, Human
uuuccugugaagcauauguu

SEQ ID NO: 1216842 - RNA, 21 nt, Human
uuuuacuugcuugccuuugcu

SEQ ID NO: 1216843 - RNA, 18 nt, Human
agcagcuucagcuuuucu

SEQ ID NO: 1216844 - RNA, 23 nt, Human
agugcaauggcgcaaucuuggcu

SEQ ID NO: 1216845 - RNA, 24 nt, Human
agugcaauggcgcaaucuuggcuc

SEQ ID NO: 1216846 - RNA, 23 nt, Human
cacuggaaccucugccuccuggg

SEQ ID NO: 1216847 - RNA, 19 nt, Human
cccaagcuggagugcaaug

SEQ ID NO: 1216848 - RNA, 22 nt, Human
ccuagcagcuucagcuuuucuu

SEQ ID NO: 1216849 - RNA, 24 nt, Human
ccuccuggguucaagcgauucucc

SEQ ID NO: 1216850 - RNA, 19 nt, Human
ccucugccuccuggguuca

SEQ ID NO: 1216851 - RNA, 23 nt, Human
ccuggguucaagcgauucuccug

SEQ ID NO: 1216852 - RNA, 24 nt, Human
cucacuggaaccucugccuccugg

SEQ ID NO: 1216853 - RNA, 21 nt, Human
cuccuggguucaagcgauucu

SEQ ID NO: 1216854 - RNA, 19 nt, Human
gagugcaauggcgcaaucu

SEQ ID NO: 1216855 - RNA, 21 nt, Human
gcucacuggaaccucugccuc

SEQ ID NO: 1216856 - RNA, 19 nt, Human
gcuggagugcaauggcgca

SEQ ID NO: 1216857 - RNA, 24 nt, Human
ucacuggaaccucugccuccuggg

SEQ ID NO: 1216858 - RNA, 25 nt, Human
ucacuggaaccucugccuccugggu

SEQ ID NO: 1216859 - RNA, 23 nt, Human
ucccaagcuggagugcaauggcg

SEQ ID NO: 1216860 - RNA, 21 nt, Human
uccuggguucaagcgauucuc

SEQ ID NO: 1216861 - RNA, 24 nt, Human
uccuggguucaagcgauucuccug

SEQ ID NO: 1216862 - RNA, 23 nt, Human
ucgcucuugucucccaagcugga

SEQ ID NO: 1216863 - RNA, 21 nt, Human
ucuucuggcgauguagccuag

SEQ ID NO: 1216864 - RNA, 23 nt, Human
ugcaauggcgcaaucuuggcuca

SEQ ID NO: 1216865 - RNA, 24 nt, Human
uggagugcaauggcgcaaucuugg

SEQ ID NO: 1216866 - RNA, 19 nt, Human
uggcucacuggaaccucug

SEQ ID NO: 1216867 - RNA, 23 nt, Human
uggguucaagcgauucuccugcc

SEQ ID NO: 1216868 - RNA, 19 nt, Human
uguuucgcucuugucuccc

SEQ ID NO: 1216869 - RNA, 24 nt, Human
uucgcucuugucucccaagcugga

SEQ ID NO: 1216870 - RNA, 21 nt, Human
aaacacccacccucccagcuc

SEQ ID NO: 1216871 - RNA, 23 nt, Human
aaacagccauggaauccucccag

SEQ ID NO: 1216872 - RNA, 23 nt, Human
aacacccacccucccagcucggc

SEQ ID NO: 1216873 - RNA, 21 nt, Human
aaccugagacaagaaagaggc

SEQ ID NO: 1216874 - RNA, 19 nt, Human
aagaggccaagaggcacca

SEQ ID NO: 1216875 - RNA, 19 nt, Human
aagcagagcucucuucaag

SEQ ID NO: 1216876 - RNA, 25 nt, Human
aagcaggaagagaaguacuucccaa

SEQ ID NO: 1216877 - RNA, 18 nt, Human
acacagcuaccuggccca

SEQ ID NO: 1216878 - RNA, 19 nt, Human
accgcaucaauagcucggc

SEQ ID NO: 1216879 - RNA, 19 nt, Human
agaaagaggccaagaggca

SEQ ID NO: 1216880 - RNA, 18 nt, Human
agacaagaaagaggccaa

SEQ ID NO: 1216881 - RNA, 20 nt, Human
agacaagaaagaggccaaga

SEQ ID NO: 1216882 - RNA, 18 nt, Human
aggggagcuaagcagagc

SEQ ID NO: 1216883 - RNA, 24 nt, Human
aggggccuugacuccaggggagcu

SEQ ID NO: 1216884 - RNA, 26 nt, Human
caaagggacagaaaugaggcacaggc

SEQ ID NO: 1216885 - RNA, 20 nt, Human
caaccgacaucaccagucac

SEQ ID NO: 1216886 - RNA, 18 nt, Human
caagaaagaggccaagag

SEQ ID NO: 1216887 - RNA, 21 nt, Human
caagaggcaccauccucaguc

SEQ ID NO: 1216888 - RNA, 25 nt, Human
cacccacccucccagcucggcucua

SEQ ID NO: 1216889 - RNA, 18 nt, Human
cagacugccauaaacacc

SEQ ID NO: 1216890 - RNA, 18 nt, Human
cagcauugccagccucug

SEQ ID NO: 1216891 - RNA, 21 nt, Human
caggaagagaaguacuuccca

SEQ ID NO: 1216892 - RNA, 19 nt, Human
caguaaggaugacauggca

SEQ ID NO: 1216893 - RNA, 18 nt, Human
cauaaacacccacccucc

SEQ ID NO: 1216894 - RNA, 18 nt, Human
cauaaacacccacccucc

SEQ ID NO: 1216895 - RNA, 18 nt, Human
ccaaccgacaucaccagu

SEQ ID NO: 1216896 - RNA, 18 nt, Human
ccauaaacacccacccuc

SEQ ID NO: 1216897 - RNA, 20 nt, Human
ccauggucuugaggagagag

SEQ ID NO: 1216898 - RNA, 19 nt, Human
ccgguuucuucguccaagu

SEQ ID NO: 1216899 - RNA, 22 nt, Human
ccuaaaacagccauggaauccu

SEQ ID NO: 1216900 - RNA, 18 nt, Human
ccucccagcucggcucua

SEQ ID NO: 1216901 - RNA, 21 nt, Human
ccucuggaagguaaaccugag

SEQ ID NO: 1216902 - RNA, 23 nt, Human
cugguaauaguagucauccaggc

SEQ ID NO: 1216903 - RNA, 21 nt, Human
cuucuuagccguguccuccag

SEQ ID NO: 1216904 - RNA, 19 nt, Human
gcagagcucucuucaaggc

SEQ ID NO: 1216905 - RNA, 21 nt, Human
gcagagcucucuucaaggcaa

SEQ ID NO: 1216906 - RNA, 23 nt, Human
gccauggaauccucccagcaaga

SEQ ID NO: 1216907 - RNA, 22 nt, Human
gugaaacagcauugccagccuc

SEQ ID NO: 1216908 - RNA, 26 nt, Human
uaaaccugagacaagaaagaggccaa

SEQ ID NO: 1216909 - RNA, 21 nt, Human
uaaggcguuaccagcuugagg

SEQ ID NO: 1216910 - RNA, 24 nt, Human
uaccagcuugagggacucaacccg

SEQ ID NO: 1216911 - RNA, 18 nt, Human
uaccuggcccagggaacc

SEQ ID NO: 1216912 - RNA, 22 nt, Human
uagcuucugguaauauuccuuc

SEQ ID NO: 1216913 - RNA, 21 nt, Human
uccaaguagcucuucgucugc

SEQ ID NO: 1216914 - RNA, 25 nt, Human
ucucagacugccauaaacacccacc

SEQ ID NO: 1216915 - RNA, 23 nt, Human
ucugcacuuuuaucacccagucc

SEQ ID NO: 1216916 - RNA, 19 nt, Human
ucugccugcuucuucucua

SEQ ID NO: 1216917 - RNA, 21 nt, Human
ugacauggcacccuaaaacag

SEQ ID NO: 1216918 - RNA, 18 nt, Human
ugccuucggaauguaagg

SEQ ID NO: 1216919 - RNA, 21 nt, Human
uggcaggcugguggacuuccu

SEQ ID NO: 1216920 - RNA, 22 nt, Human
uggcaggcugguggacuuccuu

SEQ ID NO: 1216921 - RNA, 23 nt, Human
uggcaggcugguggacuuccuuc

SEQ ID NO: 1216922 - RNA, 19 nt, Human
uggcccagggaacccucga

SEQ ID NO: 1216923 - RNA, 19 nt, Human
uguaaggcguuaccagcuu

SEQ ID NO: 1216924 - RNA, 25 nt, Human
uucggaccacggacucauaagccuc

SEQ ID NO: 1216925 - RNA, 18 nt, Human
aagcaggcucagcuucca

SEQ ID NO: 1216926 - RNA, 21 nt, Human
accccgccgccugggugggcu

SEQ ID NO: 1216927 - RNA, 19 nt, Human
agacccgaggguagggcag

SEQ ID NO: 1216928 - RNA, 21 nt, Human
aggcaccuccucgccagccug

SEQ ID NO: 1216929 - RNA, 19 nt, Human
agggaguugugggcccaga

SEQ ID NO: 1216930 - RNA, 21 nt, Human
aggggcaccaguuaccacuga

SEQ ID NO: 1216931 - RNA, 21 nt, Human
caccuccucgccagccugugg

SEQ ID NO: 1216932 - RNA, 20 nt, Human
cacuggacccaccaagaccc

SEQ ID NO: 1216933 - RNA, 23 nt, Human
cagccugugggcugcacccacag

SEQ ID NO: 1216934 - RNA, 22 nt, Human
caguggaugcacccugcccccu

SEQ ID NO: 1216935 - RNA, 19 nt, Human
caucugguuugaggucagg

SEQ ID NO: 1216936 - RNA, 24 nt, Human
caucugguuugaggucaggucauu

SEQ ID NO: 1216937 - RNA, 28 nt, Human
ccaccaagaccccgccgccugggugggg

SEQ ID NO: 1216938 - RNA, 20 nt, Human
ccagcagcagugacgcucag

SEQ ID NO: 1216939 - RNA, 25 nt, Human
cccaaggggagggccggcguccccg

SEQ ID NO: 1216940 - RNA, 24 nt, Human
cccagcugcugugacacccaaggg

SEQ ID NO: 1216941 - RNA, 22 nt, Human
ccccgccgccugggugggcugu

SEQ ID NO: 1216942 - RNA, 19 nt, Human
ccgccgccugggugggcug

SEQ ID NO: 1216943 - RNA, 22 nt, Human
ccucgccagacccgaggguagg

SEQ ID NO: 1216944 - RNA, 21 nt, Human
ccucugaguguucuggggagg

SEQ ID NO: 1216945 - RNA, 19 nt, Human
ccugcccccucccucgcca

SEQ ID NO: 1216946 - RNA, 18 nt, Human
gaaagcaggcucagcucc

SEQ ID NO: 1216947 - RNA, 22 nt, Human
gaggaggggguggggcggaggg

SEQ ID NO: 1216948 - RNA, 21 nt, Human
gaguguucuggggaggagggg

SEQ ID NO: 1216949 - RNA, 19 nt, Human
gcagcagugacgcucaggg

SEQ ID NO: 1216950 - RNA, 20 nt, Human
ggaggggguggggcggaggg

SEQ ID NO: 1216951 - RNA, 24 nt, Human
gggaauggaggggaggggcaccag

SEQ ID NO: 1216952 - RNA, 19 nt, Human
ggggaggaggggguggggc

SEQ ID NO: 1216953 - RNA, 19 nt, Human
gucccucugaguguucugg

SEQ ID NO: 1216954 - RNA, 18 nt, Human
ucagggccuucccagcug

SEQ ID NO: 1216955 - RNA, 23 nt, Human
ucccagcugucagccagcugccc

SEQ ID NO: 1216956 - RNA, 21 nt, Human
ucccucgccagacccgagggu

SEQ ID NO: 1216957 - RNA, 21 nt, Human
ucccucugaguguucugggga

SEQ ID NO: 1216958 - RNA, 22 nt, Human
ucccucugaguguucuggggag

SEQ ID NO: 1216959 - RNA, 22 nt, Human
ugacacccaaggggagggccgg

SEQ ID NO: 1216960 - RNA, 19 nt, Human
uggaggggaggggcaccag

SEQ ID NO: 1216961 - RNA, 18 nt, Human
uggaugcacccugccccc

SEQ ID NO: 1216962 - RNA, 20 nt, Human
ugggcugcacccacagggaa

SEQ ID NO: 1216963 - RNA, 18 nt, Human
uggggaggaggggguggg

SEQ ID NO: 1216964 - RNA, 19 nt, Human
ugugacacccaaggggagg

SEQ ID NO: 1216965 - RNA, 20 nt, Human
ugugggcccagcugcuguga

SEQ ID NO: 1216966 - RNA, 19 nt, Human
ugugggcugcacccacagg

SEQ ID NO: 1216967 - RNA, 24 nt, Human
uuccugucugugggcccagcugcu

SEQ ID NO: 1216968 - RNA, 19 nt, Human
uugugggcccagaggggcu

SEQ ID NO: 1216969 - RNA, 19 nt, Human
aaaaaaaacugaguagaca

SEQ ID NO: 1216970 - RNA, 23 nt, Human
aaccuucuucccuguuugcccac

SEQ ID NO: 1216971 - RNA, 18 nt, Human
aacuccuagcccaguccc

SEQ ID NO: 1216972 - RNA, 18 nt, Human
aaggagcacuggcugcag

SEQ ID NO: 1216973 - RNA, 24 nt, Human
aaguccccucccagaucugugacc

SEQ ID NO: 1216974 - RNA, 20 nt, Human
aauggcuguggggaucaagg

SEQ ID NO: 1216975 - RNA, 24 nt, Human
acacaaaaauuuuaaaaauagcug

SEQ ID NO: 1216976 - RNA, 23 nt, Human
acagagggagccugggggccaca

SEQ ID NO: 1216977 - RNA, 25 nt, Human
acagguaccagagacugccccccac

SEQ ID NO: 1216978 - RNA, 20 nt, Human
acagucccagaagggcccag

SEQ ID NO: 1216979 - RNA, 19 nt, Human
acccagaccugagcuagga

SEQ ID NO: 1216980 - RNA, 21 nt, Human
acccugauguccccaauucca

SEQ ID NO: 1216981 - RNA, 18 nt, Human
acuccagccuggugacag

SEQ ID NO: 1216982 - RNA, 21 nt, Human
acuccagccuggugacagagc

SEQ ID NO: 1216983 - RNA, 23 nt, Human
acuguacuccagccuggugacag

SEQ ID NO: 1216984 - RNA, 25 nt, Human
acuguacuccagccuggugacagag

SEQ ID NO: 1216985 - RNA, 19 nt, Human
acugugugaccagcaaggu

SEQ ID NO: 1216986 - RNA, 24 nt, Human
agacccuaucaccgccccccgccc

SEQ ID NO: 1216987 - RNA, 22 nt, Human
agacugccccccacggccccaa

SEQ ID NO: 1216988 - RNA, 22 nt, Human
agagcgagacccuaucaccgcc

SEQ ID NO: 1216989 - RNA, 23 nt, Human
agaguggggcugugggaccagcg

SEQ ID NO: 1216990 - RNA, 24 nt, Human
agccugggccacauagugagaccu

SEQ ID NO: 1216991 - RNA, 25 nt, Human
agccugggccacauagugagaccuu

SEQ ID NO: 1216992 - RNA, 23 nt, Human
agccuggugacagagcgagaccc

SEQ ID NO: 1216993 - RNA, 26 nt, Human
agcugggcuuggugguggcaugugcc

SEQ ID NO: 1216994 - RNA, 19 nt, Human
aggagcagaggcgagucug

SEQ ID NO: 1216995 - RNA, 24 nt, Human
aggaguucgagaccagccugggcc

SEQ ID NO: 1216996 - RNA, 24 nt, Human
aggaucacuugagcccaggaguuc

SEQ ID NO: 1216997 - RNA, 23 nt, Human
aggcaagcucauuucuucuccac

SEQ ID NO: 1216998 - RNA, 18 nt, Human
aggcaggaggaucacuug

SEQ ID NO: 1216999 - RNA, 23 nt, Human
aggcaggaggaucacuugagccc

SEQ ID NO: 1217000 - RNA, 24 nt, Human
aggcaggaggaucacuugagccca

SEQ ID NO: 1217001 - RNA, 24 nt, Human
aggccgaggcaggaggaucacuug

SEQ ID NO: 1217002 - RNA, 22 nt, Human
aggcuauuuggcacccaggucu

SEQ ID NO: 1217003 - RNA, 25 nt, Human
agguaccagagacugccccccacgg

SEQ ID NO: 1217004 - RNA, 19 nt, Human
agguggaggcugcagugag

SEQ ID NO: 1217005 - RNA, 20 nt, Human
agguggaggcugcagugagc

SEQ ID NO: 1217006 - RNA, 19 nt, Human
aguccagcgccaggaugcc

SEQ ID NO: 1217007 - RNA, 25 nt, Human
agugacggggggagcuugacaagga

SEQ ID NO: 1217008 - RNA, 26 nt, Human
aucucuccccucccugugccucccag

SEQ ID NO: 1217009 - RNA, 20 nt, Human
augaagcagggauuggggcu

SEQ ID NO: 1217010 - RNA, 25 nt, Human
augcccagaggagugcccugggggc

SEQ ID NO: 1217011 - RNA, 21 nt, Human
augugggaaccagaacacacu

SEQ ID NO: 1217012 - RNA, 22 nt, Human
augugggaaccagaacacacug

SEQ ID NO: 1217013 - RNA, 18 nt, Human
auuucuucuccacacccc

SEQ ID NO: 1217014 - RNA, 23 nt, Human
caaguccagcgccaggaugccca

SEQ ID NO: 1217015 - RNA, 22 nt, Human
cacacugauggaggaguuggca

SEQ ID NO: 1217016 - RNA, 19 nt, Human
cacagguaccagagacugc

SEQ ID NO: 1217017 - RNA, 25 nt, Human
caccaaaaaaaaacugaguagacag

SEQ ID NO: 1217018 - RNA, 19 nt, Human
caccaugcccaugcccccg

SEQ ID NO: 1217019 - RNA, 20 nt, Human
caccaugcccaugcccccgc

SEQ ID NO: 1217020 - RNA, 22 nt, Human
caccuggagugacggggggagc

SEQ ID NO: 1217021 - RNA, 21 nt, Human
cacuccuggaggccgaggcag

SEQ ID NO: 1217022 - RNA, 19 nt, Human
cacugcgcuggggcggggc

SEQ ID NO: 1217023 - RNA, 25 nt, Human
cacuggcugcagggggguggggggu

SEQ ID NO: 1217024 - RNA, 18 nt, Human
cacuguacuccagccugg

SEQ ID NO: 1217025 - RNA, 18 nt, Human
cacuguacuccagccugg

SEQ ID NO: 1217026 - RNA, 18 nt, Human
cacuguacuccagccugg

SEQ ID NO: 1217027 - RNA, 21 nt, Human
cacuguacuccagccugguga

SEQ ID NO: 1217028 - RNA, 22 nt, Human
cacuguacuccagccuggugac

SEQ ID NO: 1217029 - RNA, 23 nt, Human
cacuguacuccagccuggugaca

SEQ ID NO: 1217030 - RNA, 23 nt, Human
cacuguacuccagccuggugaca

SEQ ID NO: 1217031 - RNA, 24 nt, Human
cacuuugagcccaggagguggagg

SEQ ID NO: 1217032 - RNA, 19 nt, Human
cagagccucagcaucccuu

SEQ ID NO: 1217033 - RNA, 23 nt, Human
cagcaaggcagccagggcggcac

SEQ ID NO: 1217034 - RNA, 19 nt, Human
cagccagggcggcacaggc

SEQ ID NO: 1217035 - RNA, 20 nt, Human
caggagguggaggcugcagu

SEQ ID NO: 1217036 - RNA, 23 nt, Human
caggaugcccaggcuccugggcu

SEQ ID NO: 1217037 - RNA, 19 nt, Human
caggcaucaacuccaacuc

SEQ ID NO: 1217038 - RNA, 25 nt, Human
caggcuccugggcuuccuccccgag

SEQ ID NO: 1217039 - RNA, 21 nt, Human
caggcuccugggcuuccuccu

SEQ ID NO: 1217040 - RNA, 24 nt, Human
cagggcggcacaggcaccaggucc

SEQ ID NO: 1217041 - RNA, 21 nt, Human
cagggggguggggggugggau

SEQ ID NO: 1217042 - RNA, 22 nt, Human
caggugcagagcaucccugacg

SEQ ID NO: 1217043 - RNA, 24 nt, Human
cagucaucacuguacuccagccug

SEQ ID NO: 1217044 - RNA, 24 nt, Human
cagugagcagucaucacuguacuc

SEQ ID NO: 1217045 - RNA, 18 nt, Human
cauccuuuggcugggccu

SEQ ID NO: 1217046 - RNA, 24 nt, Human
caucucuccccucccugugccucc

SEQ ID NO: 1217047 - RNA, 23 nt, Human
caugcaccacgcgcugaaggagg

SEQ ID NO: 1217048 - RNA, 22 nt, Human
ccaaaaucccccacccgggaug

SEQ ID NO: 1217049 - RNA, 21 nt, Human
ccaacuccuagcccagucccg

SEQ ID NO: 1217050 - RNA, 18 nt, Human
ccacaccccuccccgccc

SEQ ID NO: 1217051 - RNA, 20 nt, Human
ccacauagugagaccuuguc

SEQ ID NO: 1217052 - RNA, 24 nt, Human
ccacggccccaaaaucccccaccc

SEQ ID NO: 1217053 - RNA, 24 nt, Human
ccacuggaccacaggagcagaggc

SEQ ID NO: 1217054 - RNA, 20 nt, Human
ccagagacugccccccacgg

SEQ ID NO: 1217055 - RNA, 22 nt, Human
ccaggagguggaggcugcagug

SEQ ID NO: 1217056 - RNA, 25 nt, Human
ccaggaguucgagaccagccugggc

SEQ ID NO: 1217057 - RNA, 25 nt, Human
ccaucucuccccucccugugccucc

SEQ ID NO: 1217058 - RNA, 19 nt, Human
ccaugcccccgcccgugga

SEQ ID NO: 1217059 - RNA, 25 nt, Human
cccaaaaucccccacccgggaugcc

SEQ ID NO: 1217060 - RNA, 25 nt, Human
cccacagagcuccuguauccaggca

SEQ ID NO: 1217061 - RNA, 22 nt, Human
cccacccgggaugcccagagga

SEQ ID NO: 1217062 - RNA, 24 nt, Human
cccacggccccaaaaucccccacc

SEQ ID NO: 1217063 - RNA, 20 nt, Human
cccauauauaaaaaugaagc

SEQ ID NO: 1217064 - RNA, 21 nt, Human
cccauauauaaaaaugaagca

SEQ ID NO: 1217065 - RNA, 23 nt, Human
cccccacccgggaugcccagagg

SEQ ID NO: 1217066 - RNA, 21 nt, Human
ccccccacggccccaaaaucc

SEQ ID NO: 1217067 - RNA, 25 nt, Human
cccccgccccaccaaaaaaaaacug

SEQ ID NO: 1217068 - RNA, 22 nt, Human
ccccgccccaccaaaaaaaaac

SEQ ID NO: 1217069 - RNA, 18 nt, Human
ccccgcccgacccugucu

SEQ ID NO: 1217070 - RNA, 18 nt, Human
ccccucccugugccuccc

SEQ ID NO: 1217071 - RNA, 19 nt, Human
cccgccccaccaaaaaaaa

SEQ ID NO: 1217072 - RNA, 23 nt, Human
cccgccccaccaaaaaaaaacug

SEQ ID NO: 1217073 - RNA, 22 nt, Human
cccuuucccucccagagccuca

SEQ ID NO: 1217074 - RNA, 20 nt, Human
ccgccccccgccccaccaaa

SEQ ID NO: 1217075 - RNA, 23 nt, Human
ccuaucaccgccccccgccccac

SEQ ID NO: 1217076 - RNA, 22 nt, Human
ccugagcuaggacagagggagc

SEQ ID NO: 1217077 - RNA, 21 nt, Human
ccugggccacauagugagacc

SEQ ID NO: 1217078 - RNA, 19 nt, Human
ccuguaguccuagcuacuc

SEQ ID NO: 1217079 - RNA, 18 nt, Human
ccugucuaaacuaauggg

SEQ ID NO: 1217080 - RNA, 24 nt, Human
cgagaccagccugggccacauagu

SEQ ID NO: 1217081 - RNA, 21 nt, Human
cgagacccuaucaccgccccc

SEQ ID NO: 1217082 - RNA, 22 nt, Human
cgagacccuaucaccgcccccc

SEQ ID NO: 1217083 - RNA, 22 nt, Human
cgagaugcugcacaugcaccac

SEQ ID NO: 1217084 - RNA, 19 nt, Human
cgagcacacgaguguaaag

SEQ ID NO: 1217085 - RNA, 20 nt, Human
cgaggcaggaggaucacuug

SEQ ID NO: 1217086 - RNA, 20 nt, Human
cgcucagcaucaucggugac

SEQ ID NO: 1217087 - RNA, 20 nt, Human
cggccacuggaccacaggag

SEQ ID NO: 1217088 - RNA, 21 nt, Human
cggccccaaaaucccccaccc

SEQ ID NO: 1217089 - RNA, 21 nt, Human
cuacugcauccuuuggcuggg

SEQ ID NO: 1217090 - RNA, 18 nt, Human
cuccacaccccuccccgc

SEQ ID NO: 1217091 - RNA, 23 nt, Human
cuccacaccccuccccgcccgac

SEQ ID NO: 1217092 - RNA, 24 nt, Human
cuccagccuggugacagagcgaga

SEQ ID NO: 1217093 - RNA, 22 nt, Human
cuccuagcccagucccgggggc

SEQ ID NO: 1217094 - RNA, 26 nt, Human
cugacuccagucuugcuaacacacac

SEQ ID NO: 1217095 - RNA, 23 nt, Human
cuggaccucgguguccccaucug

SEQ ID NO: 1217096 - RNA, 24 nt, Human
cuggaggccgaggcaggaggauca

SEQ ID NO: 1217097 - RNA, 20 nt, Human
cugggcuuccuccugcuggg

SEQ ID NO: 1217098 - RNA, 21 nt, Human
cuuaaguccccucccagaucu

SEQ ID NO: 1217099 - RNA, 19 nt, Human
cuuugagcccaggaggugg

SEQ ID NO: 1217100 - RNA, 24 nt, Human
cuuuggcugggccuuguugacccc

SEQ ID NO: 1217101 - RNA, 18 nt, Human
gagcgagcacacgagugu

SEQ ID NO: 1217102 - RNA, 18 nt, Human
gagcuucggugcaugggu

SEQ ID NO: 1217103 - RNA, 23 nt, Human
gaggcaggaggaucacuugagcc

SEQ ID NO: 1217104 - RNA, 18 nt, Human
gagugcccugggggcaag

SEQ ID NO: 1217105 - RNA, 24 nt, Human
gaucacuugagcccaggaguucga

SEQ ID NO: 1217106 - RNA, 22 nt, Human
gcaugugccuguaguccuagcu

SEQ ID NO: 1217107 - RNA, 23 nt, Human
gccacauagugagaccuugucuc

SEQ ID NO: 1217108 - RNA, 22 nt, Human
gcccaggaguucgagaccagcc

SEQ ID NO: 1217109 - RNA, 23 nt, Human
gccgcaagggcagggaugggagu

SEQ ID NO: 1217110 - RNA, 22 nt, Human
gcgagacccuaucaccgccccc

SEQ ID NO: 1217111 - RNA, 20 nt, Human
gcugcagggggguggggggu

SEQ ID NO: 1217112 - RNA, 19 nt, Human
ggaagugugccccauaccc

SEQ ID NO: 1217113 - RNA, 18 nt, Human
ggaggcugcagugagcag

SEQ ID NO: 1217114 - RNA, 23 nt, Human
ggaucacuugagcccaggaguuc

SEQ ID NO: 1217115 - RNA, 22 nt, Human
ggcaagaucacuggacugggag

SEQ ID NO: 1217116 - RNA, 18 nt, Human
ggcaaguggcacaccccc

SEQ ID NO: 1217117 - RNA, 18 nt, Human
ggcaaguggcacaccccc

SEQ ID NO: 1217118 - RNA, 18 nt, Human
ggcacccaggucuauggu

SEQ ID NO: 1217119 - RNA, 18 nt, Human
ggccgaggcaggaggauc

SEQ ID NO: 1217120 - RNA, 20 nt, Human
ggcugcaggggggugggggg

SEQ ID NO: 1217121 - RNA, 20 nt, Human
ggcuuggugguggcaugugc

SEQ ID NO: 1217122 - RNA, 19 nt, Human
gggcaaguggcacaccccc

SEQ ID NO: 1217123 - RNA, 22 nt, Human
ggggagguggaucuuccagucg

SEQ ID NO: 1217124 - RNA, 19 nt, Human
ggggcugugggaccagcgc

SEQ ID NO: 1217125 - RNA, 22 nt, Human
ggggcugugggaccagcgccca

SEQ ID NO: 1217126 - RNA, 20 nt, Human
gggguauaggcaagcagcaa

SEQ ID NO: 1217127 - RNA, 23 nt, Human
gguagccgcaagggcagggaugg

SEQ ID NO: 1217128 - RNA, 25 nt, Human
ggucccaaccuucuucccuguuugc

SEQ ID NO: 1217129 - RNA, 26 nt, Human
guagugguagccgcaagggcagggau

SEQ ID NO: 1217130 - RNA, 19 nt, Human
guccgcccuuggggaagug

SEQ ID NO: 1217131 - RNA, 23 nt, Human
gucuuuuccucuggaccucggug

SEQ ID NO: 1217132 - RNA, 22 nt, Human
uaacugccaacgugaguucaga

SEQ ID NO: 1217133 - RNA, 19 nt, Human
uaagcuccggcaaccgccu

SEQ ID NO: 1217134 - RNA, 19 nt, Human
uacuccagccuggugacag

SEQ ID NO: 1217135 - RNA, 23 nt, Human
uacuccagccuggugacagagcg

SEQ ID NO: 1217136 - RNA, 19 nt, Human
uaggacagagggagccugg

SEQ ID NO: 1217137 - RNA, 24 nt, Human
uaggcaagucccuuucccucccag

SEQ ID NO: 1217138 - RNA, 30 nt, Human; identical to SEQ ID NO: 1084712

SEQ ID NO: 1217139 - RNA, 22 nt, Human
uaggucuuaaguccccucccag

SEQ ID NO: 1217140 - RNA, 24 nt, Human
uaguccuagcuacucgagaggcug

SEQ ID NO: 1217141 - RNA, 18 nt, Human
uauugggcaagaucacug

SEQ ID NO: 1217142 - RNA, 21 nt, Human
ucaacuccaacucccacuccu

SEQ ID NO: 1217143 - RNA, 20 nt, Human
ucacuguacuccagccuggu

SEQ ID NO: 1217144 - RNA, 23 nt, Human
ucacuguacuccagccuggugac

SEQ ID NO: 1217145 - RNA, 20 nt, Human
ucacuugagcccaggaguuc

SEQ ID NO: 1217146 - RNA, 22 nt, Human
ucagcuacccugauguccccaa

SEQ ID NO: 1217147 - RNA, 24 nt, Human
uccacaccccuccccgcccgaccc

SEQ ID NO: 1217148 - RNA, 22 nt, Human
uccagccuggugacagagcgag

SEQ ID NO: 1217149 - RNA, 27 nt, Human
uccagcgcacagucccagaagggcccc

SEQ ID NO: 1217150 - RNA, 22 nt, Human
ucccaggucgcccaaguccagc

SEQ ID NO: 1217151 - RNA, 24 nt, Human
ucccaggucgcccaaguccagcgc

SEQ ID NO: 1217152 - RNA, 21 nt, Human
uccccagagcucaggacccug

SEQ ID NO: 1217153 - RNA, 19 nt, Human
uccggccacuggaccacag

SEQ ID NO: 1217154 - RNA, 21 nt, Human
uccggccacuggaccacagga

SEQ ID NO: 1217155 - RNA, 21 nt, Human
uccuccugcuggguccgcccc

SEQ ID NO: 1217156 - RNA, 22 nt, Human
ucggagccgcuggccaauaugu

SEQ ID NO: 1217157 - RNA, 23 nt, Human
ucuccuagaauggcuguggggau

SEQ ID NO: 1217158 - RNA, 21 nt, Human
ucucgcugcugggggcggggc

SEQ ID NO: 1217159 - RNA, 20 nt, Human
ucuuucaagaacauucacuc

SEQ ID NO: 1217160 - RNA, 22 nt, Human
ugaagccuacuucacucccaaa

SEQ ID NO: 1217161 - RNA, 18 nt, Human
ugacggggggagcuugac

SEQ ID NO: 1217162 - RNA, 20 nt, Human
ugacuccuuugagccauccc

SEQ ID NO: 1217163 - RNA, 20 nt, Human
ugagaaaaggcaguggggag

SEQ ID NO: 1217164 - RNA, 21 nt, Human
ugagaaaaggcaguggggagg

SEQ ID NO: 1217165 - RNA, 23 nt, Human
ugagaaaaggcaguggggaggug

SEQ ID NO: 1217166 - RNA, 23 nt, Human
ugagcccaggaguucgagaccag

SEQ ID NO: 1217167 - RNA, 19 nt, Human
ugaggugugacauauggga

SEQ ID NO: 1217168 - RNA, 22 nt, Human
ugcccagaggagugcccugggg

SEQ ID NO: 1217169 - RNA, 21 nt, Human
ugcccugggggcaaguggcac

SEQ ID NO: 1217170 - RNA, 23 nt, Human
ugcccugggggcaaguggcacac

SEQ ID NO: 1217171 - RNA, 19 nt, Human
ugcccugugaugugcuguu

SEQ ID NO: 1217172 - RNA, 22 nt, Human
ugccuguaguccuagcuacucg

SEQ ID NO: 1217173 - RNA, 21 nt, Human
ugcugggggcggggcuuaagc

SEQ ID NO: 1217174 - RNA, 26 nt, Human
uggauuuccuucagcuacccugaugu

SEQ ID NO: 1217175 - RNA, 24 nt, Human
uggcagggaggagcuucggugcau

SEQ ID NO: 1217176 - RNA, 18 nt, Human
uggcugcagggggguggg

SEQ ID NO: 1217177 - RNA, 21 nt, Human
uggcugcaggggggugggggg

SEQ ID NO: 1217178 - RNA, 22 nt, Human
uggcugcagggggguggggggu

SEQ ID NO: 1217179 - RNA, 23 nt, Human
ugggauguucucgcugcuggggg

SEQ ID NO: 1217180 - RNA, 22 nt, Human
ugguggcaugugccuguagucc

SEQ ID NO: 1217181 - RNA, 20 nt, Human
uguaaagaauggcacccaga

SEQ ID NO: 1217182 - RNA, 24 nt, Human
uguacuccagccuggugacagagc

SEQ ID NO: 1217183 - RNA, 24 nt, Human
ugugaugugugcgugagcgagcac

SEQ ID NO: 1217184 - RNA, 21 nt, Human
ugugccuguaguccuagcuac

SEQ ID NO: 1217185 - RNA, 24 nt, Human
uguuuuuguuuccaaauggcugga

SEQ ID NO: 1217186 - RNA, 24 nt, Human
uucggugcauggguguggccggca

SEQ ID NO: 1217187 - RNA, 20 nt, Human
uucuccacaccccuccccgc

SEQ ID NO: 1217188 - RNA, 24 nt, Human
uucucgcugcugggggcggggcuu

SEQ ID NO: 1217189 - RNA, 18 nt, Human
uucucuaaggaagaacaa

SEQ ID NO: 1217190 - RNA, 22 nt, Human
uugagcccaggaguucgagacc

SEQ ID NO: 1217191 - RNA, 20 nt, Human
uuggugguggcaugugccug

SEQ ID NO: 1217192 - RNA, 19 nt, Human
uuucuaaggaaaaugguuc

SEQ ID NO: 1217193 - RNA, 21 nt, Human
uuugcccacucucagaccccg

SEQ ID NO: 1217194 - RNA, 19 nt, Human
aaauaaauuuaaacuauaa

SEQ ID NO: 1217195 - RNA, 19 nt, Human
aaauaaauuuaaacuauaa

SEQ ID NO: 1217196 - RNA, 19 nt, Human
aaauaaauuuaaacuauaa

SEQ ID NO: 1217197 - RNA, 19 nt, Human
aaauaaauuuaaacuauaa

SEQ ID NO: 1217198 - RNA, 19 nt, Human
aaauaaauuuaaacuauaa

SEQ ID NO: 1217199 - RNA, 18 nt, Human
aagaugccagagugaaca

SEQ ID NO: 1217200 - RNA, 21 nt, Human
agaaagacccacugucauuug

SEQ ID NO: 1217201 - RNA, 20 nt, Human
cagcuccugcagagucuccu

SEQ ID NO: 1217202 - RNA, 21 nt, Human
cccgcagccucuccagcuccu

SEQ ID NO: 1217203 - RNA, 23 nt, Human
ccucuccagcuccugcagagucu

SEQ ID NO: 1217204 - RNA, 22 nt, Human
cguuuuguuguuuuuuuuuaau

SEQ ID NO: 1217205 - RNA, 19 nt, Human
gccacagccucucauccug

SEQ ID NO: 1217206 - RNA, 22 nt, Human
uaaaagaugccagagugaacau

SEQ ID NO: 1217207 - RNA, 22 nt, Human
uaaauuagaaacacaaauaaac

SEQ ID NO: 1217208 - RNA, 27 nt, Human
uaaauuagaaacacaaauaaauuuaaa

SEQ ID NO: 1217209 - RNA, 27 nt, Human
uaaauuagaaacacaaauaaauuuaaa

SEQ ID NO: 1217210 - RNA, 27 nt, Human
uaaauuagaaacacaaauaaauuuaaa

SEQ ID NO: 1217211 - RNA, 18 nt, Human
uagaaacacaaauaaaca

SEQ ID NO: 1217212 - RNA, 19 nt, Human
ucuccagcucccgcagccu

SEQ ID NO: 1217213 - RNA, 24 nt, Human
ucuccugcugccacagccucucau

SEQ ID NO: 1217214 - RNA, 23 nt, Human
ugcagagucuccugcugccacag

SEQ ID NO: 1217215 - RNA, 22 nt, Human
uuuaaacuauaaauuagaaaca

SEQ ID NO: 1217216 - RNA, 22 nt, Human
uuuaaacuauaaauuagaaaca

SEQ ID NO: 1217217 - RNA, 22 nt, Human
uuuaaacuauaaauuagaaaca

SEQ ID NO: 1217218 - RNA, 22 nt, Human
uuuaaacuauaaauuagaaaca

SEQ ID NO: 1217219 - RNA, 22 nt, Human
uuuaaacuauaaauuagaaaca

SEQ ID NO: 1217220 - RNA, 18 nt, Human
auugccaugucgucaugg

SEQ ID NO: 1217221 - RNA, 21 nt, Human
agaggggcagggcuaaggagg

SEQ ID NO: 1217222 - RNA, 23 nt, Human
caccucuguccugguccugggaa

SEQ ID NO: 1217223 - RNA, 21 nt, Human
ccugguccugggaaccccaac

SEQ ID NO: 1217224 - RNA, 19 nt, Human
cugguccugggaaccccaa

SEQ ID NO: 1217225 - RNA, 22 nt, Human
ggagguggggucagagaggggc

SEQ ID NO: 1217226 - RNA, 24 nt, Human
gggaaacucggugacucgcaaucc

SEQ ID NO: 1217227 - RNA, 18 nt, Human
uaaggagggagcgcgccc

SEQ ID NO: 1217228 - RNA, 27 nt, Human
ucacuaccaccucuguccugguccugg

SEQ ID NO: 1217229 - RNA, 19 nt, Human
uggaucgcaggugcaggca

SEQ ID NO: 1217230 - RNA, 19 nt, Human
ccuccuggcucucugcugu

SEQ ID NO: 1217231 - RNA, 22 nt, Human
ccuccuggcucucugcuguaca

SEQ ID NO: 1217232 - RNA, 22 nt, Human
ugagacgggaagauagucuuca

SEQ ID NO: 1217233 - RNA, 22 nt, Human
ugagacgggaagauagucuuca

SEQ ID NO: 1217234 - RNA, 23 nt, Human
ugagacgggaagauagucuucag

SEQ ID NO: 1217235 - RNA, 21 nt, Human
ugcuguacauccguggaucca

SEQ ID NO: 1217236 - RNA, 19 nt, Human
gaaccucugacacuuagaa

SEQ ID NO: 1217237 - RNA, 20 nt, Human
uccacaugucuccguagagu

SEQ ID NO: 1217238 - RNA, 21 nt, Human
uuagcucuaccuuuuguuucc

SEQ ID NO: 1217239 - RNA, 20 nt, Human
augccaggguucaauguaca

SEQ ID NO: 1217240 - RNA, 22 nt, Human
cgacuucuagccacuguauccu

SEQ ID NO: 1217241 - RNA, 21 nt, Human
cuucuuagcacuguuucccag

SEQ ID NO: 1217242 - RNA, 24 nt, Human
uaguuccaaagacgaagaugccaa

SEQ ID NO: 1217243 - RNA, 19 nt, Human
uuaguuccaaagacgaaga

SEQ ID NO: 1217244 - RNA, 21 nt, Human
uuugccugguuggcuuucagg

SEQ ID NO: 1217245 - RNA, 19 nt, Human
aaacgaugcaaaucgccgu

SEQ ID NO: 1217246 - RNA, 18 nt, Human
aaagugcuaggauuacaa

SEQ ID NO: 1217247 - RNA, 24 nt, Human
aaagugcuaggauuacaaacauga

SEQ ID NO: 1217248 - RNA, 24 nt, Human
aaccucaggugauccgccuaccuc

SEQ ID NO: 1217249 - RNA, 23 nt, Human
aagcagaucccccugcccgaccc

SEQ ID NO: 1217250 - RNA, 19 nt, Human
aagcagccuugugcagagg

SEQ ID NO: 1217251 - RNA, 25 nt, Human
aagugauucuccugccucagccucc

SEQ ID NO: 1217252 - RNA, 26 nt, Human
aagugcuaggauuacaaacaugagcc

SEQ ID NO: 1217253 - RNA, 19 nt, Human
aagugcugggauuacaggc

SEQ ID NO: 1217254 - RNA, 19 nt, Human
aagugcugggauuacaggc

SEQ ID NO: 1217255 - RNA, 22 nt, Human
aagugcugggauuacaggcgug

SEQ ID NO: 1217256 - RNA, 23 nt, Human
aagugcugggauuacaggcguga

SEQ ID NO: 1217257 - RNA, 26 nt, Human
aagugcugggauuacaggcgugagcc

SEQ ID NO: 1217258 - RNA, 18 nt, Human
acaaacaugagccaccau

SEQ ID NO: 1217259 - RNA, 21 nt, Human
acaggcacccaucaccacgcc

SEQ ID NO: 1217260 - RNA, 23 nt, Human
accucagccucccaaagugcuag

SEQ ID NO: 1217261 - RNA, 18 nt, Human
accuggccauuguccccu

SEQ ID NO: 1217262 - RNA, 18 nt, Human
acgggguuucaucauguu

SEQ ID NO: 1217263 - RNA, 23 nt, Human
acgggguuucaucauguuggcca

SEQ ID NO: 1217264 - RNA, 24 nt, Human
acgggguuucaucauguuggccag

SEQ ID NO: 1217265 - RNA, 23 nt, Human
agcagaucccccugcccgacccc

SEQ ID NO: 1217266 - RNA, 20 nt, Human
agccuugugcagaggcccac

SEQ ID NO: 1217267 - RNA, 25 nt, Human
aggcuggagugcaguggcacgaucu

SEQ ID NO: 1217268 - RNA, 22 nt, Human
aggcuucaccuggccauugucc

SEQ ID NO: 1217269 - RNA, 24 nt, Human
aggugauccgccuaccucggccuc

SEQ ID NO: 1217270 - RNA, 22 nt, Human
agguuucaucauguuggccagg

SEQ ID NO: 1217271 - RNA, 23 nt, Human
aguagagauaagguuucaucaug

SEQ ID NO: 1217272 - RNA, 21 nt, Human
agugcaguggcacgaucucag

SEQ ID NO: 1217273 - RNA, 23 nt, Human
agugcaguggcacgaucucagcu

SEQ ID NO: 1217274 - RNA, 18 nt, Human
aguugcuuuggcuugucu

SEQ ID NO: 1217275 - RNA, 23 nt, Human
auaagguuucaucauguuggcca

SEQ ID NO: 1217276 - RNA, 24 nt, Human
auaagguuucaucauguuggccag

SEQ ID NO: 1217277 - RNA, 24 nt, Human
augauccacccaccucagccuccc

SEQ ID NO: 1217278 - RNA, 24 nt, Human
caaagugcuaggauuacaaacaug

SEQ ID NO: 1217279 - RNA, 24 nt, Human
caagcagccuugugcagaggccca

SEQ ID NO: 1217280 - RNA, 22 nt, Human
caagugauucuccugccucagc

SEQ ID NO: 1217281 - RNA, 24 nt, Human
caccacgccuggcuaauuuuugua

SEQ ID NO: 1217282 - RNA, 22 nt, Human
caccaugcuuggcugugcuuuc

SEQ ID NO: 1217283 - RNA, 23 nt, Human
caccaugcuuggcugugcuuucu

SEQ ID NO: 1217284 - RNA, 22 nt, Human
cacccaccucagccucccaaag

SEQ ID NO: 1217285 - RNA, 23 nt, Human
cacccaccucagccucccaaagu

SEQ ID NO: 1217286 - RNA, 20 nt, Human
caccgugucacccuggagau

SEQ ID NO: 1217287 - RNA, 23 nt, Human
cacugcaaccugcaccuucuggg

SEQ ID NO: 1217288 - RNA, 19 nt, Human
cagacaaauggcaucaaag

SEQ ID NO: 1217289 - RNA, 18 nt, Human
cagccugaugcccacagu

SEQ ID NO: 1217290 - RNA, 23 nt, Human
caggaagaaccccagaaaugaca

SEQ ID NO: 1217291 - RNA, 21 nt, Human
caggcacccaucaccacgccu

SEQ ID NO: 1217292 - RNA, 24 nt, Human
caggcgugagccaccgugcccggc

SEQ ID NO: 1217293 - RNA, 20 nt, Human
cagggcacgccacgaagucc

SEQ ID NO: 1217294 - RNA, 25 nt, Human
cauacagaaucagcuacaucgacaa

SEQ ID NO: 1217295 - RNA, 24 nt, Human
caucauguuggccaggcuggucuc

SEQ ID NO: 1217296 - RNA, 27 nt, Human
caucauguuggccaggcuggucucaaa

SEQ ID NO: 1217297 - RNA, 27 nt, Human
caucauguuggccaggcuggucucgaa

SEQ ID NO: 1217298 - RNA, 18 nt, Human
cauguuggccaggcuggu

SEQ ID NO: 1217299 - RNA, 18 nt, Human
cauguuggccaggcuggu

SEQ ID NO: 1217300 - RNA, 21 nt, Human
cauguuggccaggcuggucuc

SEQ ID NO: 1217301 - RNA, 21 nt, Human
cauguuggccaggcuggucuc

SEQ ID NO: 1217302 - RNA, 24 nt, Human
cauguuggccaggcuggucucaaa

SEQ ID NO: 1217303 - RNA, 22 nt, Human
cauguuggccaggcuggucucg

SEQ ID NO: 1217304 - RNA, 24 nt, Human
cauguuggccaggcuggucucgaa

SEQ ID NO: 1217305 - RNA, 19 nt, Human
ccaaagugcuaggauuaca

SEQ ID NO: 1217306 - RNA, 24 nt, Human
ccaaagugcuaggauuacaaacau

SEQ ID NO: 1217307 - RNA, 22 nt, Human
ccaagcagccuugugcagaggc

SEQ ID NO: 1217308 - RNA, 21 nt, Human
ccacaagcucugggaggcgga

SEQ ID NO: 1217309 - RNA, 26 nt, Human
ccacccaccucagccucccaaagugc

SEQ ID NO: 1217310 - RNA, 23 nt, Human
ccacguagcugggauuacaggca

SEQ ID NO: 1217311 - RNA, 25 nt, Human
cccacaguugcuuuggcuugucugc

SEQ ID NO: 1217312 - RNA, 19 nt, Human
cccacguagcugggauuac

SEQ ID NO: 1217313 - RNA, 21 nt, Human
cccaggccagccugcagguga

SEQ ID NO: 1217314 - RNA, 18 nt, Human
ccccacagccugaugccc

SEQ ID NO: 1217315 - RNA, 24 nt, Human
cccgaagugcugggauuacaggcg

SEQ ID NO: 1217316 - RNA, 26 nt, Human
cccgaccccaggccagccugcaggug

SEQ ID NO: 1217317 - RNA, 24 nt, Human
cccgagacucuuaauuucuuucuu

SEQ ID NO: 1217318 - RNA, 28 nt, Human
cccugcccgaccccaggccagccugcag

SEQ ID NO: 1217319 - RNA, 24 nt, Human
ccgaagugcugggauuacaggcgu

SEQ ID NO: 1217320 - RNA, 21 nt, Human
ccgccccacagccugaugccc

SEQ ID NO: 1217321 - RNA, 24 nt, Human
ccuaaccucaggugauccgccuac

SEQ ID NO: 1217322 - RNA, 26 nt, Human
ccucuggggccuucgccaacuacucc

SEQ ID NO: 1217323 - RNA, 24 nt, Human
ccugaccucagaugauccacccac

SEQ ID NO: 1217324 - RNA, 19 nt, Human
ccugcaggugacuccagcc

SEQ ID NO: 1217325 - RNA, 20 nt, Human
ccugcaggugacuccagccc

SEQ ID NO: 1217326 - RNA, 27 nt, Human
ccugcaggugacuccagccccagcuga

SEQ ID NO: 1217327 - RNA, 22 nt, Human
ccuuccacaaauacuuccgugc

SEQ ID NO: 1217328 - RNA, 24 nt, Human
ccuucuggguucaagugauucucc

SEQ ID NO: 1217329 - RNA, 22 nt, Human
cgacaagcacacacucucguga

SEQ ID NO: 1217330 - RNA, 24 nt, Human
cgcucuugucgcccaggcuggagu

SEQ ID NO: 1217331 - RNA, 24 nt, Human
cgggguuucaucauguuggccagg

SEQ ID NO: 1217332 - RNA, 25 nt, Human
cguagcugggauuacaggcacccau

SEQ ID NO: 1217333 - RNA, 19 nt, Human
cucacugcaaccugcaccu

SEQ ID NO: 1217334 - RNA, 24 nt, Human
cucagccucccacguagcugggau

SEQ ID NO: 1217335 - RNA, 25 nt, Human
cuccugccucagccucccacguagc

SEQ ID NO: 1217336 - RNA, 19 nt, Human
cucuugucgcccaggcugg

SEQ ID NO: 1217337 - RNA, 21 nt, Human
cucuugucgcccaggcuggag

SEQ ID NO: 1217338 - RNA, 23 nt, Human
cugccucagccucccacguagcu

SEQ ID NO: 1217339 - RNA, 21 nt, Human
cuggggcagggcccgagacuc

SEQ ID NO: 1217340 - RNA, 24 nt, Human
cuggggccuucgccaacuacucug

SEQ ID NO: 1217341 - RNA, 22 nt, Human
cuggguucaagugauucuccug

SEQ ID NO: 1217342 - RNA, 24 nt, Human
cuugucgcccaggcuggagugcag

SEQ ID NO: 1217343 - RNA, 24 nt, Human
gaagugcugggauuacaggcguga

SEQ ID NO: 1217344 - RNA, 18 nt, Human
gacauuggguuccccuug

SEQ ID NO: 1217345 - RNA, 24 nt, Human
gaccucagaugauccacccaccuc

SEQ ID NO: 1217346 - RNA, 20 nt, Human
gagauacuuugaaacgaugc

SEQ ID NO: 1217347 - RNA, 18 nt, Human
gauuacaaacaugagcca

SEQ ID NO: 1217348 - RNA, 18 nt, Human
gauuacaggcgugagcca

SEQ ID NO: 1217349 - RNA, 20 nt, Human
gauuacaggcgugagccacc

SEQ ID NO: 1217350 - RNA, 21 nt, Human
gauuacaggcgugagccaccg

SEQ ID NO: 1217351 - RNA, 21 nt, Human
gauucuccugccucagccucc

SEQ ID NO: 1217352 - RNA, 19 nt, Human
gcccaggcuggagugcagu

SEQ ID NO: 1217353 - RNA, 23 nt, Human
gcccaggcuggagugcaguggca

SEQ ID NO: 1217354 - RNA, 20 nt, Human
gccucagccucccacguagc

SEQ ID NO: 1217355 - RNA, 19 nt, Human
gcuggagugcaguggcacg

SEQ ID NO: 1217356 - RNA, 23 nt, Human
gcuggucucaaacuccugaccuc

SEQ ID NO: 1217357 - RNA, 23 nt, Human
gcuggucucgaacuccuaaccuc

SEQ ID NO: 1217358 - RNA, 22 nt, Human
ggauuacaaacaugagccacca

SEQ ID NO: 1217359 - RNA, 18 nt, Human
ggcagggcccgagacucu

SEQ ID NO: 1217360 - RNA, 24 nt, Human
ggcuggucucaaacuccugaccuc

SEQ ID NO: 1217361 - RNA, 23 nt, Human
gggguuucaucauguuggccagg

SEQ ID NO: 1217362 - RNA, 20 nt, Human
ggguucaagugauucuccug

SEQ ID NO: 1217363 - RNA, 24 nt, Human
gugauucuccugccucagccuccc

SEQ ID NO: 1217364 - RNA, 18 nt, Human
uaaccucaggugauccgc

SEQ ID NO: 1217365 - RNA, 23 nt, Human
uaagguuucaucauguuggccag

SEQ ID NO: 1217366 - RNA, 24 nt, Human
uaagguuucaucauguuggccagg

SEQ ID NO: 1217367 - RNA, 22 nt, Human
uaauuuuuguauuuuuaguaga

SEQ ID NO: 1217368 - RNA, 24 nt, Human
uacaaacaugagccaccaugcuug

SEQ ID NO: 1217369 - RNA, 23 nt, Human
uacagaaucagcuacaucgacaa

SEQ ID NO: 1217370 - RNA, 23 nt, Human
uacaggcgugagccaccgugccc

SEQ ID NO: 1217371 - RNA, 24 nt, Human
uaccucggccucccgaagugcugg

SEQ ID NO: 1217372 - RNA, 22 nt, Human
uaggauuacaaacaugagccac

SEQ ID NO: 1217373 - RNA, 24 nt, Human
uaggauuacaaacaugagccacca

SEQ ID NO: 1217374 - RNA, 24 nt, Human
uaguagaaacgggguuucaucaug

SEQ ID NO: 1217375 - RNA, 19 nt, Human
ucaagugauucuccugccu

SEQ ID NO: 1217376 - RNA, 24 nt, Human
ucacugcaaccugcaccuucuggg

SEQ ID NO: 1217377 - RNA, 23 nt, Human
ucagacaaauggcaucaaagcca

SEQ ID NO: 1217378 - RNA, 20 nt, Human
ucagaugauccacccaccuc

SEQ ID NO: 1217379 - RNA, 18 nt, Human
ucagccucccaaagugcu

SEQ ID NO: 1217380 - RNA, 22 nt, Human
ucagcucacugcaaccugcacc

SEQ ID NO: 1217381 - RNA, 21 nt, Human
uccacccaccucagccuccca

SEQ ID NO: 1217382 - RNA, 18 nt, Human
ucccaaagugcuaggauu

SEQ ID NO: 1217383 - RNA, 24 nt, Human
ucccacguagcugggauuacaggc

SEQ ID NO: 1217384 - RNA, 21 nt, Human
ucccccugcccgaccccaggc

SEQ ID NO: 1217385 - RNA, 19 nt, Human
ucccgaagugcugggauua

SEQ ID NO: 1217386 - RNA, 24 nt, Human
ucccgaagugcugggauuacaggc

SEQ ID NO: 1217387 - RNA, 22 nt, Human
ucgcccaggcuggagugcagug

SEQ ID NO: 1217388 - RNA, 22 nt, Human
ucgcucuugucgcccaggcugg

SEQ ID NO: 1217389 - RNA, 23 nt, Human
ucgcucuugucgcccaggcugga

SEQ ID NO: 1217390 - RNA, 18 nt, Human
ucggccucccgaagugcu

SEQ ID NO: 1217391 - RNA, 18 nt, Human
ucugccaggcuucaccug

SEQ ID NO: 1217392 - RNA, 22 nt, Human
ucuuucuuucuuucuuucuuuu

SEQ ID NO: 1217393 - RNA, 18 nt, Human
ucuuuuuuuuuuuuuuuu

SEQ ID NO: 1217394 - RNA, 22 nt, Human
ugaagcagagccuuggaagcag

SEQ ID NO: 1217395 - RNA, 24 nt, Human
ugauccacccaccucagccuccca

SEQ ID NO: 1217396 - RNA, 20 nt, Human
ugauucuccugccucagccu

SEQ ID NO: 1217397 - RNA, 24 nt, Human
ugcaccuucuggguucaagugauu

SEQ ID NO: 1217398 - RNA, 22 nt, Human
ugcaguggcacgaucucagcuc

SEQ ID NO: 1217399 - RNA, 18 nt, Human
ugcccgaccccaggccag

SEQ ID NO: 1217400 - RNA, 24 nt, Human
ugccucagccucccacguagcugg

SEQ ID NO: 1217401 - RNA, 26 nt, Human
ugcuaggauuacaaacaugagccacc

SEQ ID NO: 1217402 - RNA, 28 nt, Human
ugcugcugguguacagaccccacuuuuu

SEQ ID NO: 1217403 - RNA, 24 nt, Human
ugcugggauuacaggcgugagcca

SEQ ID NO: 1217404 - RNA, 23 nt, Human
uggagugcaguggcacgaucuca

SEQ ID NO: 1217405 - RNA, 24 nt, Human
uggagugcaguggcacgaucucag

SEQ ID NO: 1217406 - RNA, 24 nt, Human
uggcacgaucucagcucacugcaa

SEQ ID NO: 1217407 - RNA, 24 nt, Human
uggccaggcuggucucaaacuccu

SEQ ID NO: 1217408 - RNA, 24 nt, Human
uggccaggcuggucucgaacuccu

SEQ ID NO: 1217409 - RNA, 18 nt, Human
ugggauuacaggcaccca

SEQ ID NO: 1217410 - RNA, 21 nt, Human
ugggauuacaggcacccauca

SEQ ID NO: 1217411 - RNA, 24 nt, Human
ugggauuacaggcacccaucacca

SEQ ID NO: 1217412 - RNA, 18 nt, Human
ugggauuacaggcgugag

SEQ ID NO: 1217413 - RNA, 21 nt, Human
ugggauuacaggcgugagcca

SEQ ID NO: 1217414 - RNA, 22 nt, Human
ugggauuacaggcgugagccac

SEQ ID NO: 1217415 - RNA, 23 nt, Human
ugggauuacaggcgugagccacc

SEQ ID NO: 1217416 - RNA, 23 nt, Human
ugggauuacaggcgugagccacc

SEQ ID NO: 1217417 - RNA, 24 nt, Human
ugggauuacaggcgugagccaccg

SEQ ID NO: 1217418 - RNA, 19 nt, Human
uggggcagggcccgagacu

SEQ ID NO: 1217419 - RNA, 23 nt, Human
uggguucaagugauucuccugcc

SEQ ID NO: 1217420 - RNA, 24 nt, Human
uggguucaagugauucuccugccu

SEQ ID NO: 1217421 - RNA, 21 nt, Human
uguaagugacaucugccaggc

SEQ ID NO: 1217422 - RNA, 21 nt, Human
uguauuuuuaguagaaacggg

SEQ ID NO: 1217423 - RNA, 19 nt, Human
uguuaacaugcagguccug

SEQ ID NO: 1217424 - RNA, 24 nt, Human
uuaguagaaacgggguuucaucau

SEQ ID NO: 1217425 - RNA, 21 nt, Human
uucaagugauucuccugccuc

SEQ ID NO: 1217426 - RNA, 23 nt, Human
uucaagugauucuccugccucag

SEQ ID NO: 1217427 - RNA, 24 nt, Human
uucaagugauucuccugccucagc

SEQ ID NO: 1217428 - RNA, 24 nt, Human
uucgcucuugucgcccaggcugga

SEQ ID NO: 1217429 - RNA, 22 nt, Human
uucuaggucuggggcagggccc

SEQ ID NO: 1217430 - RNA, 24 nt, Human
uucuggguucaagugauucuccug

SEQ ID NO: 1217431 - RNA, 19 nt, Human
uugaaauuaguaaguaucu

SEQ ID NO: 1217432 - RNA, 20 nt, Human
uuggauuaagcauucucagc

SEQ ID NO: 1217433 - RNA, 23 nt, Human
uuguauuuuuaguagaaacgggg

SEQ ID NO: 1217434 - RNA, 30 nt, Human
uuuacuguggacagggaucacagauguggg

SEQ ID NO: 1217435 - RNA, 24 nt, Human
uuucaucauguuggccaggcuggu

SEQ ID NO: 1217436 - RNA, 24 nt, Human
uuucaucauguuggccaggcuggu

SEQ ID NO: 1217437 - RNA, 24 nt, Human
uuucgcucuugucgcccaggcugg

SEQ ID NO: 1217438 - RNA, 21 nt, Human
uuuggauuaagcauucucagc

SEQ ID NO: 1217439 - RNA, 23 nt, Human
uuuggggcaggaagaaccccaga

SEQ ID NO: 1217440 - RNA, 23 nt, Human
uuuuuaguagaaacgggguuuca

SEQ ID NO: 1217441 - RNA, 18 nt, Human
uuuuuguauuuuuaguag

SEQ ID NO: 1217442 - RNA, 20 nt, Human
uuuuuuuuuuugagacagag

SEQ ID NO: 1217443 - RNA, 18 nt, Human
uuuuuuuuuuuuuuuuug

SEQ ID NO: 1217444 - RNA, 24 nt, Human
aaaaugcugggauuacaggcguga

SEQ ID NO: 1217445 - RNA, 21 nt, Human
aaacaaagugacaauagggac

SEQ ID NO: 1217446 - RNA, 24 nt, Human
aaagugcugggauuacaggcguga

SEQ ID NO: 1217447 - RNA, 24 nt, Human
aaccaaguucccaaacuuagggug

SEQ ID NO: 1217448 - RNA, 20 nt, Human
aaccucugccucccugguuc

SEQ ID NO: 1217449 - RNA, 18 nt, Human
aagcucacagcaccuuua

SEQ ID NO: 1217450 - RNA, 22 nt, Human
aaggcacagacacugacggaca

SEQ ID NO: 1217451 - RNA, 24 nt, Human
aaguagcuaggaccacaggcaugu

SEQ ID NO: 1217452 - RNA, 27 nt, Human
aaguagcuaggaccacaggcauguguu

SEQ ID NO: 1217453 - RNA, 22 nt, Human
aagucagucuacacugcugaau

SEQ ID NO: 1217454 - RNA, 19 nt, Human
aagugcugggauuacaggc

SEQ ID NO: 1217455 - RNA, 19 nt, Human
aagugcugggauuacaggc

SEQ ID NO: 1217456 - RNA, 24 nt, Human
aauuuuguauuuuuaguagagaug

SEQ ID NO: 1217457 - RNA, 19 nt, Human
acaaaguccuaaccuuugc

SEQ ID NO: 1217458 - RNA, 20 nt, Human
acauugcaaaacaaagugac

SEQ ID NO: 1217459 - RNA, 23 nt, Human
acccaugagucaggacauggcuu

SEQ ID NO: 1217460 - RNA, 22 nt, Human
accccuuccuccuagcacuuuc

SEQ ID NO: 1217461 - RNA, 19 nt, Human
accucaaagucuccugccu

SEQ ID NO: 1217462 - RNA, 23 nt, Human
accucagccucccaaguagcuag

SEQ ID NO: 1217463 - RNA, 19 nt, Human
acuaaguccuugucugcau

SEQ ID NO: 1217464 - RNA, 24 nt, Human
acuaccucagccuccugaguagcu

SEQ ID NO: 1217465 - RNA, 20 nt, Human
acucaugccaccaccagacc

SEQ ID NO: 1217466 - RNA, 23 nt, Human
acucccaugccauuggaagcugu

SEQ ID NO: 1217467 - RNA, 24 nt, Human
acucuuguugcccaggcuagagug

SEQ ID NO: 1217468 - RNA, 23 nt, Human
acuggccccagcccugcacacgc

SEQ ID NO: 1217469 - RNA, 20 nt, Human
acuggcuaaggaaaaucagu

SEQ ID NO: 1217470 - RNA, 25 nt, Human
agaacaaacuauucauuugugcaaa

SEQ ID NO: 1217471 - RNA, 20 nt, Human
agacaagcucacagcaccuu

SEQ ID NO: 1217472 - RNA, 19 nt, Human
agagauccugagggugacc

SEQ ID NO: 1217473 - RNA, 22 nt, Human
agaggucuagaacccaggccag

SEQ ID NO: 1217474 - RNA, 19 nt, Human
agauuacaggcaugugcca

SEQ ID NO: 1217475 - RNA, 20 nt, Human
agccaccgcacccggcccca

SEQ ID NO: 1217476 - RNA, 20 nt, Human
aggaacccccuccucaauag

SEQ ID NO: 1217477 - RNA, 24 nt, Human
aggcaaacuauacaauaagagguu

SEQ ID NO: 1217478 - RNA, 23 nt, Human
aggcagaaccgugcaccaagaga

SEQ ID NO: 1217479 - RNA, 19 nt, Human
aggcuggagugcaguggca

SEQ ID NO: 1217480 - RNA, 23 nt, Human
agggucuugcuguguugcccagg

SEQ ID NO: 1217481 - RNA, 23 nt, Human
aggucaaagcuuacagcaaaaga

SEQ ID NO: 1217482 - RNA, 24 nt, Human
aggugauccgccuaccucggccuc

SEQ ID NO: 1217483 - RNA, 23 nt, Human
aguagcugagauuacaggcaugu

SEQ ID NO: 1217484 - RNA, 24 nt, Human
agugcaauggcacgaucucggcuc

SEQ ID NO: 1217485 - RNA, 21 nt, Human
agugcaguggcacaaucacag

SEQ ID NO: 1217486 - RNA, 23 nt, Human
agugcaguggcacaaucacagcu

SEQ ID NO: 1217487 - RNA, 23 nt, Human
auggaccauauacguauuuauca

SEQ ID NO: 1217488 - RNA, 21 nt, Human
augggguuucuccauguuggu

SEQ ID NO: 1217489 - RNA, 24 nt, Human
augggguuucuccauguuggucag

SEQ ID NO: 1217490 - RNA, 19 nt, Human
auggguuuucgccauguug

SEQ ID NO: 1217491 - RNA, 24 nt, Human
auggguuuucgccauguugcccag

SEQ ID NO: 1217492 - RNA, 24 nt, Human
caaaaugcugggauuacaggcgug

SEQ ID NO: 1217493 - RNA, 19 nt, Human
caaaguauaagacugaguu

SEQ ID NO: 1217494 - RNA, 24 nt, Human
caaagugcugggauuacaggcgug

SEQ ID NO: 1217495 - RNA, 18 nt, Human
caacgcggacaaauuuuu

SEQ ID NO: 1217496 - RNA, 23 nt, Human
cacagagagagcugcauccccca

SEQ ID NO: 1217497 - RNA, 18 nt, Human
cacagcaccuuuaagugg

SEQ ID NO: 1217498 - RNA, 22 nt, Human
cacaggcauguguuaccaugcc

SEQ ID NO: 1217499 - RNA, 22 nt, Human
caccacaaccucugccucccug

SEQ ID NO: 1217500 - RNA, 19 nt, Human
caccgcacccggccccaga

SEQ ID NO: 1217501 - RNA, 23 nt, Human
cacugacagcugugacucaggca

SEQ ID NO: 1217502 - RNA, 27 nt, Human
cacuggccccagcccugcaccgguucc

SEQ ID NO: 1217503 - RNA, 18 nt, Human
cagaugccucugucccuc

SEQ ID NO: 1217504 - RNA, 23 nt, Human
cagauggcagcucugcugacccc

SEQ ID NO: 1217505 - RNA, 29 nt, Human
cagcaaaagacaaaaggaagagggacccc

SEQ ID NO: 1217506 - RNA, 20 nt, Human
cagcaccgaggccuagacag

SEQ ID NO: 1217507 - RNA, 24 nt, Human
cagccucaaccuuccaggccuaaa

SEQ ID NO: 1217508 - RNA, 20 nt, Human
cagccuccugaguagcugag

SEQ ID NO: 1217509 - RNA, 24 nt, Human
cagcggccugggcagaagcagcaa

SEQ ID NO: 1217510 - RNA, 19 nt, Human
caucacgcuccugccccuc

SEQ ID NO: 1217511 - RNA, 23 nt, Human
cauguugcccaggcuggucuuga

SEQ ID NO: 1217512 - RNA, 24 nt, Human
cauguugcccaggcuggucuugaa

SEQ ID NO: 1217513 - RNA, 23 nt, Human
cauuucaggaucaccggagcuug

SEQ ID NO: 1217514 - RNA, 20 nt, Human
ccaaaaugcugggauuacag

SEQ ID NO: 1217515 - RNA, 22 nt, Human
ccaaaaugcugggauuacaggc

SEQ ID NO: 1217516 - RNA, 22 nt, Human
ccaaaaugcugggauuacaggc

SEQ ID NO: 1217517 - RNA, 24 nt, Human
ccaaaaugcugggauuacaggcgu

SEQ ID NO: 1217518 - RNA, 22 nt, Human
ccaaagugcugggauuacaggc

SEQ ID NO: 1217519 - RNA, 22 nt, Human
ccaaagugcugggauuacaggc

SEQ ID NO: 1217520 - RNA, 24 nt, Human
ccaaagugcugggauuacaggcgu

SEQ ID NO: 1217521 - RNA, 24 nt, Human
ccacaaccucugccucccugguuc

SEQ ID NO: 1217522 - RNA, 22 nt, Human
ccacagagagagcugcaucccc

SEQ ID NO: 1217523 - RNA, 19 nt, Human
ccaccgcacccggccccag

SEQ ID NO: 1217524 - RNA, 23 nt, Human
ccagcaaugcuaaugccagcgga

SEQ ID NO: 1217525 - RNA, 18 nt, Human
ccaggaaggcucaggcgg

SEQ ID NO: 1217526 - RNA, 22 nt, Human
ccaggccagcaccgaggccuag

SEQ ID NO: 1217527 - RNA, 24 nt, Human
ccaggcuggucuugaacuccuggg

SEQ ID NO: 1217528 - RNA, 21 nt, Human
ccauguugcccaggcuggucu

SEQ ID NO: 1217529 - RNA, 19 nt, Human
ccauguuggucaggcuggu

SEQ ID NO: 1217530 - RNA, 22 nt, Human
ccauguuggucaggcuggucuc

SEQ ID NO: 1217531 - RNA, 21 nt, Human
cccaccuacacgaucuucagc

SEQ ID NO: 1217532 - RNA, 23 nt, Human
ccgaccucaggugauccgccuac

SEQ ID NO: 1217533 - RNA, 20 nt, Human
ccucaagcucccaaaaugcu

SEQ ID NO: 1217534 - RNA, 26 nt, Human
ccucacaccucagccucccaaguagc

SEQ ID NO: 1217535 - RNA, 19 nt, Human
ccugaguagcugagauuac

SEQ ID NO: 1217536 - RNA, 23 nt, Human
ccugaguagcugagauuacaggc

SEQ ID NO: 1217537 - RNA, 24 nt, Human
ccugaguagcugagauuacaggca

SEQ ID NO: 1217538 - RNA, 23 nt, Human
ccugggcucaagcaaucggccug

SEQ ID NO: 1217539 - RNA, 18 nt, Human
cgaccucaggugauccgc

SEQ ID NO: 1217540 - RNA, 24 nt, Human
cgccauguugcccaggcuggucuu

SEQ ID NO: 1217541 - RNA, 27 nt, Human
cgccauguugcccaggcuggucuugaa

SEQ ID NO: 1217542 - RNA, 19 nt, Human
cgggaggaacccccuccuc

SEQ ID NO: 1217543 - RNA, 23 nt, Human
cuaaaaagguuugaguguccaga

SEQ ID NO: 1217544 - RNA, 21 nt, Human
cuaaaugauccucacaccuca

SEQ ID NO: 1217545 - RNA, 19 nt, Human
cuaaugccagcggaauucc

SEQ ID NO: 1217546 - RNA, 19 nt, Human
cuaaugccagcggaauucc

SEQ ID NO: 1217547 - RNA, 19 nt, Human
cuaaugccagcggaauucc

SEQ ID NO: 1217548 - RNA, 19 nt, Human
cuaaugccagcggaauucc

SEQ ID NO: 1217549 - RNA, 19 nt, Human
cuaaugccagcggaauucc

SEQ ID NO: 1217550 - RNA, 19 nt, Human
cuaaugccagcggaauucc

SEQ ID NO: 1217551 - RNA, 19 nt, Human
cuaaugccagcggaauucc

SEQ ID NO: 1217552 - RNA, 19 nt, Human
cuaaugccagcggaauucc

SEQ ID NO: 1217553 - RNA, 19 nt, Human
cuaaugccagcggaauucc

SEQ ID NO: 1217554 - RNA, 24 nt, Human
cuaauuuuguauuuuuaguagaga

SEQ ID NO: 1217555 - RNA, 21 nt, Human
cuaccaggcugugacccgugc

SEQ ID NO: 1217556 - RNA, 18 nt, Human
cuagaacccaggccagca

SEQ ID NO: 1217557 - RNA, 19 nt, Human
cuagaacccaggccagcac

SEQ ID NO: 1217558 - RNA, 21 nt, Human
cuagaacccaggccagcaccg

SEQ ID NO: 1217559 - RNA, 27 nt, Human
cuagaacccaggccagucacucaccac

SEQ ID NO: 1217560 - RNA, 24 nt, Human
cucaaagucuccugccuccauuuc

SEQ ID NO: 1217561 - RNA, 25 nt, Human
cucacaccucagccucccaaguagc

SEQ ID NO: 1217562 - RNA, 19 nt, Human
cucaugccaccaccagacc

SEQ ID NO: 1217563 - RNA, 24 nt, Human
cucauggccaaccggugacucacc

SEQ ID NO: 1217564 - RNA, 19 nt, Human
cuccacacacugucugagc

SEQ ID NO: 1217565 - RNA, 24 nt, Human
cuccauguuggucaggcuggucuc

SEQ ID NO: 1217566 - RNA, 24 nt, Human
cucccaaguagcuaggaccacagg

SEQ ID NO: 1217567 - RNA, 18 nt, Human
cugaguagcugagauuac

SEQ ID NO: 1217568 - RNA, 23 nt, Human
cugaguagcugagauuacaggca

SEQ ID NO: 1217569 - RNA, 24 nt, Human
cugaguagcugagauuacaggcau

SEQ ID NO: 1217570 - RNA, 24 nt, Human
cugccucaagcucccaaaaugcug

SEQ ID NO: 1217571 - RNA, 19 nt, Human
cuggucuugaacuccuggg

SEQ ID NO: 1217572 - RNA, 20 nt, Human
cuguguugcccaggcuggag

SEQ ID NO: 1217573 - RNA, 21 nt, Human
cuugcuguguugcccaggcug

SEQ ID NO: 1217574 - RNA, 22 nt, Human
cuugcuguguugcccaggcugg

SEQ ID NO: 1217575 - RNA, 20 nt, Human
gacacugacggacauuuaau

SEQ ID NO: 1217576 - RNA, 25 nt, Human
gaccccacaacccaccuacacgauc

SEQ ID NO: 1217577 - RNA, 24 nt, Human
gaccucaggugauccgccuaccuc

SEQ ID NO: 1217578 - RNA, 20 nt, Human
gacgugggcagauggcagcu

SEQ ID NO: 1217579 - RNA, 19 nt, Human
gagaccucuaguccuuaga

SEQ ID NO: 1217580 - RNA, 24 nt, Human
gagaugggguuucuccauguuggu

SEQ ID NO: 1217581 - RNA, 21 nt, Human
gagggaagaggggcugcaggc

SEQ ID NO: 1217582 - RNA, 22 nt, Human
gaguagcugagauuacaggcau

SEQ ID NO: 1217583 - RNA, 25 nt, Human
gaguagcugagauuacaggcaugug

SEQ ID NO: 1217584 - RNA, 20 nt, Human
gauggcagcucugcugaccc

SEQ ID NO: 1217585 - RNA, 18 nt, Human
gauuacaggcaugugcca

SEQ ID NO: 1217586 - RNA, 24 nt, Human
gauuacaggcaugugccaccaugc

SEQ ID NO: 1217587 - RNA, 18 nt, Human
gauuacaggcgugagcca

SEQ ID NO: 1217588 - RNA, 18 nt, Human
gauuacaggcgugagcca

SEQ ID NO: 1217589 - RNA, 18 nt, Human
gauuacaggcgugagcca

SEQ ID NO: 1217590 - RNA, 22 nt, Human
gauuacaggcgugagccaccgc

SEQ ID NO: 1217591 - RNA, 23 nt, Human
gauuacaggcgugagccaccgca

SEQ ID NO: 1217592 - RNA, 22 nt, Human
gauuacaggcgugagccaucac

SEQ ID NO: 1217593 - RNA, 20 nt, Human
gcaaggccugcaaaaaugcg

SEQ ID NO: 1217594 - RNA, 28 nt, Human
gcagauggcagcucugcugaccccacaa

SEQ ID NO: 1217595 - RNA, 18 nt, Human
gcagccucaaccuuccag

SEQ ID NO: 1217596 - RNA, 19 nt, Human
gcccaggcuggagugcagu

SEQ ID NO: 1217597 - RNA, 22 nt, Human
gccugguuaauuuucguauuuu

SEQ ID NO: 1217598 - RNA, 21 nt, Human
gcuaaggaaaaucagucauga

SEQ ID NO: 1217599 - RNA, 19 nt, Human
gcuagagugcaauggcacg

SEQ ID NO: 1217600 - RNA, 19 nt, Human
gcuggagugcaguggcaca

SEQ ID NO: 1217601 - RNA, 22 nt, Human
ggaaaaaaagaaaacuuaaaaa

SEQ ID NO: 1217602 - RNA, 26 nt, Human
ggaaaaaaagaaaacuuaaaaaacau

SEQ ID NO: 1217603 - RNA, 22 nt, Human
ggaccacaggcauguguuacca

SEQ ID NO: 1217604 - RNA, 23 nt, Human
ggauuacaggcgugagccaucac

SEQ ID NO: 1217605 - RNA, 18 nt, Human
ggcuggucuugaacuccu

SEQ ID NO: 1217606 - RNA, 20 nt, Human
gggaagaggggcugcaggcg

SEQ ID NO: 1217607 - RNA, 18 nt, Human
gggguuucuccauguugg

SEQ ID NO: 1217608 - RNA, 22 nt, Human
gggguuucuccauguuggucag

SEQ ID NO: 1217609 - RNA, 19 nt, Human
ggguuuucgccauguugcc

SEQ ID NO: 1217610 - RNA, 22 nt, Human
ggguuuucgccauguugcccag

SEQ ID NO: 1217611 - RNA, 23 nt, Human
ggguuuucgccauguugcccagg

SEQ ID NO: 1217612 - RNA, 19 nt, Human
ggucucgaacuuccgaccu

SEQ ID NO: 1217613 - RNA, 21 nt, Human
guagagauggguuuucgccau

SEQ ID NO: 1217614 - RNA, 20 nt, Human
guagcugagauuacaggcau

SEQ ID NO: 1217615 - RNA, 18 nt, Human
gucccucacccgucagaa

SEQ ID NO: 1217616 - RNA, 24 nt, Human
gucuugcuguguugcccaggcugg

SEQ ID NO: 1217617 - RNA, 24 nt, Human
gugagccaucacacccagccuuuu

SEQ ID NO: 1217618 - RNA, 19 nt, Human
gugggagggaagaggggcu

SEQ ID NO: 1217619 - RNA, 22 nt, Human
uaaaaaagaacaaaguauaaga

SEQ ID NO: 1217620 - RNA, 27 nt, Human
uaaaugauccucacaccucagccuccc

SEQ ID NO: 1217621 - RNA, 27 nt, Human
uaauuuucguauuuuuuuuuguagaga

SEQ ID NO: 1217622 - RNA, 19 nt, Human
uacaaauaccuucugagga

SEQ ID NO: 1217623 - RNA, 24 nt, Human
uacaggcaugugccaccaugccca

SEQ ID NO: 1217624 - RNA, 23 nt, Human
uacaggcgugagccaccgcaccc

SEQ ID NO: 1217625 - RNA, 24 nt, Human
uacaggcgugagccaucacaccca

SEQ ID NO: 1217626 - RNA, 21 nt, Human
uaccucagccuccugaguagc

SEQ ID NO: 1217627 - RNA, 24 nt, Human
uaccucagccuccugaguagcuga

SEQ ID NO: 1217628 - RNA, 24 nt, Human
uaccucggccucccaaagugcugg

SEQ ID NO: 1217629 - RNA, 24 nt, Human
uagaacaagcucaggguggaaagc

SEQ ID NO: 1217630 - RNA, 19 nt, Human
uagaacccaggccagucac

SEQ ID NO: 1217631 - RNA, 19 nt, Human
uagacagcugugacucagg

SEQ ID NO: 1217632 - RNA, 22 nt, Human
uagagauggguuuucgccaugu

SEQ ID NO: 1217633 - RNA, 23 nt, Human
uagagugcaauggcacgaucucg

SEQ ID NO: 1217634 - RNA, 24 nt, Human
uagagugcaauggcacgaucucgg

SEQ ID NO: 1217635 - RNA, 24 nt, Human
uaggaccacaggcauguguuacca

SEQ ID NO: 1217636 - RNA, 24 nt, Human
uagggucuugcuguguugcccagg

SEQ ID NO: 1217637 - RNA, 24 nt, Human
uaguagagaugggguuucuccaug

SEQ ID NO: 1217638 - RNA, 18 nt, Human
uauggugggagaaaauaa

SEQ ID NO: 1217639 - RNA, 19 nt, Human
ucaagcucccaaaaugcug

SEQ ID NO: 1217640 - RNA, 19 nt, Human
ucacaaaagaacaaacuau

SEQ ID NO: 1217641 - RNA, 22 nt, Human
ucacaccucagccucccaagua

SEQ ID NO: 1217642 - RNA, 25 nt, Human
ucaccacaaccucugccucccuggu

SEQ ID NO: 1217643 - RNA, 28 nt, Human
ucaccacaaccucugccucccugguuca

SEQ ID NO: 1217644 - RNA, 23 nt, Human
ucacucuuguugcccaggcuaga

SEQ ID NO: 1217645 - RNA, 18 nt, Human
ucagccucccaaguagcu

SEQ ID NO: 1217646 - RNA, 20 nt, Human
ucagccucccaaguagcuag

SEQ ID NO: 1217647 - RNA, 24 nt, Human
uccauguuggucaggcuggucucg

SEQ ID NO: 1217648 - RNA, 24 nt, Human
ucccaaaaugcugggauuacaggc

SEQ ID NO: 1217649 - RNA, 22 nt, Human
ucccaaacuuagggugcccaau

SEQ ID NO: 1217650 - RNA, 24 nt, Human
ucccaaagugcugggauuacaggc

SEQ ID NO: 1217651 - RNA, 24 nt, Human
ucccagagaucuagaacccaggcc

SEQ ID NO: 1217652 - RNA, 26 nt, Human
ucccagagaucuagaacccaggccag

SEQ ID NO: 1217653 - RNA, 18 nt, Human
ucccagaggucuagaacc

SEQ ID NO: 1217654 - RNA, 24 nt, Human
ucccagaggucuagaacccaggcc

SEQ ID NO: 1217655 - RNA, 18 nt, Human
ucccccaggcucccaagc

SEQ ID NO: 1217656 - RNA, 20 nt, Human
ucccccaggcucccaagccc

SEQ ID NO: 1217657 - RNA, 19 nt, Human
ucccugguucaagcaauuc

SEQ ID NO: 1217658 - RNA, 24 nt, Human
uccugaguagcugagauuacaggc

SEQ ID NO: 1217659 - RNA, 18 nt, Human
uccugggcucaagcaauc

SEQ ID NO: 1217660 - RNA, 24 nt, Human
uccugggcucaagcaaucggccug

SEQ ID NO: 1217661 - RNA, 22 nt, Human
ucgccauguugcccaggcuggu

SEQ ID NO: 1217662 - RNA, 18 nt, Human
ucggccucccaaagugcu

SEQ ID NO: 1217663 - RNA, 18 nt, Human
ucggccugccucaagcuc

SEQ ID NO: 1217664 - RNA, 22 nt, Human
ucuagaacccaggccagcaccg

SEQ ID NO: 1217665 - RNA, 20 nt, Human
ucuagaacccaggccaguca

SEQ ID NO: 1217666 - RNA, 21 nt, Human
ucucccaacuuucccaucugu

SEQ ID NO: 1217667 - RNA, 24 nt, Human
ucugccucccugguucaagcaauu

SEQ ID NO: 1217668 - RNA, 21 nt, Human
ucugucccucacccgucagaa

SEQ ID NO: 1217669 - RNA, 19 nt, Human
ucuugaacuccugggcuca

SEQ ID NO: 1217670 - RNA, 23 nt, Human
ucuugaacuccugggcucaagca

SEQ ID NO: 1217671 - RNA, 22 nt, Human
ucuugcuguguugcccaggcug

SEQ ID NO: 1217672 - RNA, 23 nt, Human
ucuugcuguguugcccaggcugg

SEQ ID NO: 1217673 - RNA, 24 nt, Human
ucuugcuguguugcccaggcugga

SEQ ID NO: 1217674 - RNA, 18 nt, Human
ucuuguugcccaggcuag

SEQ ID NO: 1217675 - RNA, 23 nt, Human
ugaaccccagcgggaggaacccc

SEQ ID NO: 1217676 - RNA, 22 nt, Human
ugacucaggcacugguucccag

SEQ ID NO: 1217677 - RNA, 18 nt, Human
ugagauuacaggcaugug

SEQ ID NO: 1217678 - RNA, 21 nt, Human
ugagauuacaggcaugugcca

SEQ ID NO: 1217679 - RNA, 22 nt, Human
ugagauuacaggcaugugccac

SEQ ID NO: 1217680 - RNA, 24 nt, Human
ugagauuacaggcaugugccacca

SEQ ID NO: 1217681 - RNA, 24 nt, Human
ugauccgccuaccucggccuccca

SEQ ID NO: 1217682 - RNA, 24 nt, Human
ugcccaggcuagagugcaauggca

SEQ ID NO: 1217683 - RNA, 18 nt, Human
ugcccaggcuggagugca

SEQ ID NO: 1217684 - RNA, 21 nt, Human
ugcccaggcuggagugcagug

SEQ ID NO: 1217685 - RNA, 22 nt, Human
ugcccaggcuggagugcagugg

SEQ ID NO: 1217686 - RNA, 24 nt, Human
ugcccaggcuggagugcaguggca

SEQ ID NO: 1217687 - RNA, 24 nt, Human
ugcccaggcuggucuugaacuccu

SEQ ID NO: 1217688 - RNA, 28 nt, Human
ugcccaggcuggucuugaacuccugggc

SEQ ID NO: 1217689 - RNA, 24 nt, Human
ugccucaagcucccaaaaugcugg

SEQ ID NO: 1217690 - RNA, 24 nt, Human
ugccugguuaauuuucguauuuuu

SEQ ID NO: 1217691 - RNA, 24 nt, Human
ugcugggauuacaggcgugagcca

SEQ ID NO: 1217692 - RNA, 24 nt, Human
ugcugggauuacaggcgugagcca

SEQ ID NO: 1217693 - RNA, 18 nt, Human
uggaaagcaugugagugg

SEQ ID NO: 1217694 - RNA, 18 nt, Human
uggagugcaguggcacaa

SEQ ID NO: 1217695 - RNA, 19 nt, Human
uggagugcaguggcacaau

SEQ ID NO: 1217696 - RNA, 21 nt, Human
uggagugcaguggcacaauca

SEQ ID NO: 1217697 - RNA, 21 nt, Human
uggcaaucauuuauaauaguu

SEQ ID NO: 1217698 - RNA, 21 nt, Human
uggcacaaucacagcuuauag

SEQ ID NO: 1217699 - RNA, 24 nt, Human
uggcacgaucucggcucaccacaa

SEQ ID NO: 1217700 - RNA, 21 nt, Human
uggcagcucugcugaccccac

SEQ ID NO: 1217701 - RNA, 18 nt, Human
ugggauuacaggcgugag

SEQ ID NO: 1217702 - RNA, 19 nt, Human
ugggauuacaggcgugagc

SEQ ID NO: 1217703 - RNA, 19 nt, Human
ugggauuacaggcgugagc

SEQ ID NO: 1217704 - RNA, 21 nt, Human
ugggauuacaggcgugagcca

SEQ ID NO: 1217705 - RNA, 21 nt, Human
ugggauuacaggcgugagcca

SEQ ID NO: 1217706 - RNA, 21 nt, Human
ugggauuacaggcgugagcca

SEQ ID NO: 1217707 - RNA, 22 nt, Human
ugggauuacaggcgugagccac

SEQ ID NO: 1217708 - RNA, 23 nt, Human
ugggauuacaggcgugagccacc

SEQ ID NO: 1217709 - RNA, 24 nt, Human
ugggauuacaggcgugagccaccg

SEQ ID NO: 1217710 - RNA, 22 nt, Human
ugggauuacaggcgugagccau

SEQ ID NO: 1217711 - RNA, 23 nt, Human
ugggauuacaggcgugagccauc

SEQ ID NO: 1217712 - RNA, 24 nt, Human
ugggauuacaggcgugagccauca

SEQ ID NO: 1217713 - RNA, 26 nt, Human
ugggauuacaggcgugagccaucaca

SEQ ID NO: 1217714 - RNA, 27 nt, Human
ugggauuacaggcgugagccaucacac

SEQ ID NO: 1217715 - RNA, 24 nt, Human
ugggguuucuccauguuggucagg

SEQ ID NO: 1217716 - RNA, 24 nt, Human
uggguuuucgccauguugcccagg

SEQ ID NO: 1217717 - RNA, 22 nt, Human
uggucaggcuggucucgaacuu

SEQ ID NO: 1217718 - RNA, 24 nt, Human
uguagagauggguuuucgccaugu

SEQ ID NO: 1217719 - RNA, 21 nt, Human
uguauuuuuaguagagauggg

SEQ ID NO: 1217720 - RNA, 22 nt, Human
ugugacucaggcacugguuccc

SEQ ID NO: 1217721 - RNA, 20 nt, Human
ugugacucaggugcugguuc

SEQ ID NO: 1217722 - RNA, 18 nt, Human
uguguugcccaggcugga

SEQ ID NO: 1217723 - RNA, 22 nt, Human
uguguugcccaggcuggagugc

SEQ ID NO: 1217724 - RNA, 24 nt, Human
uguguugcccaggcuggagugcag

SEQ ID NO: 1217725 - RNA, 20 nt, Human
uguugcccaggcuagagugc

SEQ ID NO: 1217726 - RNA, 22 nt, Human
uguugcccaggcuagagugcaa

SEQ ID NO: 1217727 - RNA, 20 nt, Human
uuaaagucagucuacacugc

SEQ ID NO: 1217728 - RNA, 18 nt, Human
uuaguagagaugggguuu

SEQ ID NO: 1217729 - RNA, 24 nt, Human
uuaguagagaugggguuucuccau

SEQ ID NO: 1217730 - RNA, 23 nt, Human
uuauagcagccucaaccuuccag

SEQ ID NO: 1217731 - RNA, 24 nt, Human
uucaagcaauucuacuaccucagc

SEQ ID NO: 1217732 - RNA, 24 nt, Human
uucacucuuguugcccaggcuaga

SEQ ID NO: 1217733 - RNA, 21 nt, Human
uuccccauaagccauuacaaa

SEQ ID NO: 1217734 - RNA, 22 nt, Human
uucgaaggcuaauuuaugaggc

SEQ ID NO: 1217735 - RNA, 18 nt, Human
uugcccaggcuagagugc

SEQ ID NO: 1217736 - RNA, 24 nt, Human
uugcccaggcuggagugcaguggc

SEQ ID NO: 1217737 - RNA, 24 nt, Human
uugcuguguugcccaggcuggagu

SEQ ID NO: 1217738 - RNA, 24 nt, Human
uuguagagauggguuuucgccaug

SEQ ID NO: 1217739 - RNA, 23 nt, Human
uuguauuuuuaguagagaugggg

SEQ ID NO: 1217740 - RNA, 23 nt, Human
uuguugcccaggcuagagugcaa

SEQ ID NO: 1217741 - RNA, 22 nt, Human
uuucaggaucaccggagcuugu

SEQ ID NO: 1217742 - RNA, 23 nt, Human
uuucgccauguugcccaggcugu

SEQ ID NO: 1217743 - RNA, 21 nt, Human
uuucuccauguuggucaggcu

SEQ ID NO: 1217744 - RNA, 23 nt, Human
uuuucgccauguugcccaggcug

SEQ ID NO: 1217745 - RNA, 24 nt, Human
uuuucgccauguugcccaggcugg

SEQ ID NO: 1217746 - RNA, 24 nt, Human
uuuucuugaaacggaguuucacuc

SEQ ID NO: 1217747 - RNA, 19 nt, Human
uuuuguauuuuuaguagag

SEQ ID NO: 1217748 - RNA, 20 nt, Human
uuuuguauuuuuaguagaga

SEQ ID NO: 1217749 - RNA, 22 nt, Human
uuuuuaguagagaugggguuuc

SEQ ID NO: 1217750 - RNA, 24 nt, Human
uuuuuuguagagauggguuuucgc

SEQ ID NO: 1217751 - RNA, 20 nt, Human
uuuuuuuucuugaaacggag

SEQ ID NO: 1217752 - RNA, 23 nt, Human
aacacugcucgucggguccagca

SEQ ID NO: 1217753 - RNA, 18 nt, Human
aacgcaguacuuccgccc

SEQ ID NO: 1217754 - RNA, 22 nt, Human
aagcacccugcagcccuagcga

SEQ ID NO: 1217755 - RNA, 25 nt, Human
accccaaggcccgaugggucccgcg

SEQ ID NO: 1217756 - RNA, 20 nt, Human
agacaggagaggggcacgua

SEQ ID NO: 1217757 - RNA, 24 nt, Human
agacaggagaggggcacguaccgg

SEQ ID NO: 1217758 - RNA, 25 nt, Human
agagcuuguuccgaagcaagcacua

SEQ ID NO: 1217759 - RNA, 19 nt, Human
agcccagcagggacacaac

SEQ ID NO: 1217760 - RNA, 22 nt, Human
agccgaugcugaaugguacgcg

SEQ ID NO: 1217761 - RNA, 21 nt, Human
agccugaggaaggugggacuc

SEQ ID NO: 1217762 - RNA, 21 nt, Human
aggugggacucgggcggagcc

SEQ ID NO: 1217763 - RNA, 22 nt, Human
aguacuuccgcccucaagcagc

SEQ ID NO: 1217764 - RNA, 18 nt, Human
auccagcccuccccugga

SEQ ID NO: 1217765 - RNA, 23 nt, Human
caagcagccgggcuuuccagcgg

SEQ ID NO: 1217766 - RNA, 23 nt, Human
cagcccagcagggacacaacccc

SEQ ID NO: 1217767 - RNA, 25 nt, Human
cagcccagcagggacacaaccccag

SEQ ID NO: 1217768 - RNA, 21 nt, Human
cagggacacaaccccagcucg

SEQ ID NO: 1217769 - RNA, 22 nt, Human
cccccugcugugguucccgaac

SEQ ID NO: 1217770 - RNA, 23 nt, Human
ccccgguaccggggccgcgucua

SEQ ID NO: 1217771 - RNA, 21 nt, Human
ccccuggacccuaggucacgg

SEQ ID NO: 1217772 - RNA, 23 nt, Human
cccuaggucacggcaaucaaccc

SEQ ID NO: 1217773 - RNA, 22 nt, Human
ccgaagcaagcacccugcagcc

SEQ ID NO: 1217774 - RNA, 22 nt, Human
ccgcccucaagcagccgggcuu

SEQ ID NO: 1217775 - RNA, 25 nt, Human
ccuccggauaguccccgagagcuuu

SEQ ID NO: 1217776 - RNA, 22 nt, Human
cgaagcaagcacccugcagccc

SEQ ID NO: 1217777 - RNA, 23 nt, Human
cgaagcaagcacccugcagcccu

SEQ ID NO: 1217778 - RNA, 24 nt, Human
cgcggucggacuucuacacccgcc

SEQ ID NO: 1217779 - RNA, 23 nt, Human
cggaccagcgggcgagggcccug

SEQ ID NO: 1217780 - RNA, 25 nt, Human
cgggcggagccgaugcugaauggua

SEQ ID NO: 1217781 - RNA, 21 nt, Human
cuacacccgccuccagacagg

SEQ ID NO: 1217782 - RNA, 18 nt, Human
cucacuuccgcccuuacu

SEQ ID NO: 1217783 - RNA, 18 nt, Human
gaggaaggugggacucgg

SEQ ID NO: 1217784 - RNA, 19 nt, Human
gagggcccuggugagaggg

SEQ ID NO: 1217785 - RNA, 22 nt, Human
gauccagcccuccccuggaccc

SEQ ID NO: 1217786 - RNA, 22 nt, Human
gcacaaugggggccgcaaaaaa

SEQ ID NO: 1217787 - RNA, 24 nt, Human
gcagcacaaugggggccgcaaaaa

SEQ ID NO: 1217788 - RNA, 18 nt, Human
gcccuagcgauccagccc

SEQ ID NO: 1217789 - RNA, 23 nt, Human
gcggucggacuucuacacccgcc

SEQ ID NO: 1217790 - RNA, 23 nt, Human
ggaaggugggacucgggcggagc

SEQ ID NO: 1217791 - RNA, 20 nt, Human
ggacucgggcggagccgaug

SEQ ID NO: 1217792 - RNA, 20 nt, Human
ggaggccuucugugccggga

SEQ ID NO: 1217793 - RNA, 19 nt, Human
ggggcacaggccuguugag

SEQ ID NO: 1217794 - RNA, 20 nt, Human
ggggccgcgucuacgugggg

SEQ ID NO: 1217795 - RNA, 23 nt, Human
gguccagcagcacaaugggggcc

SEQ ID NO: 1217796 - RNA, 18 nt, Human
ucagccaaucagagccug

SEQ ID NO: 1217797 - RNA, 18 nt, Human
ucccgaaccccaaggccc

SEQ ID NO: 1217798 - RNA, 19 nt, Human
ucuacacccgccuccagac

SEQ ID NO: 1217799 - RNA, 22 nt, Human
ugaggaaggugggacucgggcg

SEQ ID NO: 1217800 - RNA, 26 nt, Human
ugccugaacccccgguaccggggccg

SEQ ID NO: 1217801 - RNA, 19 nt, Human
uggcuuccgcggucggacu

SEQ ID NO: 1217802 - RNA, 19 nt, Human
ugggucccgcgggggucgc

SEQ ID NO: 1217803 - RNA, 22 nt, Human
ugguucccgaaccccaaggccc

SEQ ID NO: 1217804 - RNA, 18 nt, Human
uucccgaaccccaaggcc

SEQ ID NO: 1217805 - RNA, 18 nt, Human
aacuaaaugcagcucugc

SEQ ID NO: 1217806 - RNA, 22 nt, Human
acaacgcuuccuuccuucaaag

SEQ ID NO: 1217807 - RNA, 20 nt, Human
ccccaguggaagugaaauug

SEQ ID NO: 1217808 - RNA, 21 nt, Human
cgcuuccuuccuucaaaguca

SEQ ID NO: 1217809 - RNA, 20 nt, Human
cuccccaguggaagugaaau

SEQ ID NO: 1217810 - RNA, 22 nt, Human
cucugagccccccucauucacu

SEQ ID NO: 1217811 - RNA, 19 nt, Human
uaacaacgcuuccuuccuu

SEQ ID NO: 1217812 - RNA, 20 nt, Human
ugagccccccucauucacug

SEQ ID NO: 1217813 - RNA, 24 nt, Human
ugagccccccucauucacugcucc

SEQ ID NO: 1217814 - RNA, 25 nt, Human
uuccaagggcccgccacuaauuccu

SEQ ID NO: 1217815 - RNA, 22 nt, Human
acagcucccagguugcagaccu

SEQ ID NO: 1217816 - RNA, 21 nt, Human
cagagcucucccuuugccuuc

SEQ ID NO: 1217817 - RNA, 20 nt, Human
cccuccaggggaacagcucc

SEQ ID NO: 1217818 - RNA, 23 nt, Human
ccugcagagcucucccuuugccu

SEQ ID NO: 1217819 - RNA, 23 nt, Human
cgugcugcucucggaccaccgcg

SEQ ID NO: 1217820 - RNA, 18 nt, Human
cucggaccaccgcggcag

SEQ ID NO: 1217821 - RNA, 20 nt, Human
cugggagcaguagccccucc

SEQ ID NO: 1217822 - RNA, 19 nt, Human
gagcaguagccccuccagg

SEQ ID NO: 1217823 - RNA, 23 nt, Human
gcagaccugagcagucgggccau

SEQ ID NO: 1217824 - RNA, 26 nt, Human
gccuucagagccucuacgaagucccu

SEQ ID NO: 1217825 - RNA, 22 nt, Human
gcggcaguggacacgugggaaa

SEQ ID NO: 1217826 - RNA, 18 nt, Human
ucccugcagagcucuccc

SEQ ID NO: 1217827 - RNA, 20 nt, Human
aaaaagcucgcucuuccacc

SEQ ID NO: 1217828 - RNA, 22 nt, Human
aaggcgccccgaucccuaccug

SEQ ID NO: 1217829 - RNA, 23 nt, Human
aaugccgaaggauaugagagaga

SEQ ID NO: 1217830 - RNA, 19 nt, Human
acagucacuucuuccacau

SEQ ID NO: 1217831 - RNA, 21 nt, Human
acccaaugccgaaggauauga

SEQ ID NO: 1217832 - RNA, 19 nt, Human
accgccuccugcccaggcg

SEQ ID NO: 1217833 - RNA, 21 nt, Human
acuccuugguuuagauuuuga

SEQ ID NO: 1217834 - RNA, 20 nt, Human
auacagucacuucuuccaca

SEQ ID NO: 1217835 - RNA, 21 nt, Human
aucaagucacagugccagccc

SEQ ID NO: 1217836 - RNA, 25 nt, Human
caaaaagcucgcucuuccaccuucu

SEQ ID NO: 1217837 - RNA, 19 nt, Human
caaaugguggggaaagaga

SEQ ID NO: 1217838 - RNA, 18 nt, Human
caaggcgccccgaucccu

SEQ ID NO: 1217839 - RNA, 19 nt, Human
caaugccgaaggauaugag

SEQ ID NO: 1217840 - RNA, 20 nt, Human
cacuccuugcacccauagau

SEQ ID NO: 1217841 - RNA, 18 nt, Human
cagauucaaauggugggg

SEQ ID NO: 1217842 - RNA, 18 nt, Human
ccauguugguugggcuag

SEQ ID NO: 1217843 - RNA, 19 nt, Human
ccauguugguugggcuagu

SEQ ID NO: 1217844 - RNA, 19 nt, Human
cccagcuucuuguccagag

SEQ ID NO: 1217845 - RNA, 18 nt, Human
cccugcgcccccuuuccu

SEQ ID NO: 1217846 - RNA, 18 nt, Human
ccgcacccugcacucugc

SEQ ID NO: 1217847 - RNA, 19 nt, Human
ccuccggaggccacugccu

SEQ ID NO: 1217848 - RNA, 19 nt, Human
ccucuugaaaccuaggcuu

SEQ ID NO: 1217849 - RNA, 25 nt, Human
ccugcacucugcugacuguaccgga

SEQ ID NO: 1217850 - RNA, 19 nt, Human
cgacaaggcgccccgaucc

SEQ ID NO: 1217851 - RNA, 20 nt, Human
cgcccccuuuccuggugccc

SEQ ID NO: 1217852 - RNA, 22 nt, Human
cucgcucuuccaccuucuuucc

SEQ ID NO: 1217853 - RNA, 18 nt, Human
cugcgcccccuuuccugg

SEQ ID NO: 1217854 - RNA, 18 nt, Human
cuuccaccuucuuuccca

SEQ ID NO: 1217855 - RNA, 24 nt, Human
cuucuggucuugauuggccucauu

SEQ ID NO: 1217856 - RNA, 23 nt, Human
gaacuggcauacagucacuucuu

SEQ ID NO: 1217857 - RNA, 21 nt, Human
gacuucauuuauggaagggag

SEQ ID NO: 1217858 - RNA, 26 nt, Human
gagcugcaaauuucauugccaagagg

SEQ ID NO: 1217859 - RNA, 19 nt, Human
gcccccuuuccuggugccc

SEQ ID NO: 1217860 - RNA, 18 nt, Human
gcucuuccaccuucuuuc

SEQ ID NO: 1217861 - RNA, 19 nt, Human
gggaaaccccggccacugc

SEQ ID NO: 1217862 - RNA, 22 nt, Human
gggucccuccacucagccacuu

SEQ ID NO: 1217863 - RNA, 22 nt, Human
guccaguuugugccucucccag

SEQ ID NO: 1217864 - RNA, 23 nt, Human
guguuagcugccauguugguugg

SEQ ID NO: 1217865 - RNA, 24 nt, Human
guuuuuggaaauaucauuuggagu

SEQ ID NO: 1217866 - RNA, 19 nt, Human
uaacccaaugccgaaggau

SEQ ID NO: 1217867 - RNA, 21 nt, Human
uagauaacccaaugccgaagg

SEQ ID NO: 1217868 - RNA, 19 nt, Human
ucauuuggagugggaugug

SEQ ID NO: 1217869 - RNA, 20 nt, Human
uccaaaaagcucgcucuucc

SEQ ID NO: 1217870 - RNA, 23 nt, Human
uccaaaaagcucgcucuuccacc

SEQ ID NO: 1217871 - RNA, 24 nt, Human
uccaaaaagcucgcucuuccaccu

SEQ ID NO: 1217872 - RNA, 19 nt, Human
uccaccuucuuucccacga

SEQ ID NO: 1217873 - RNA, 23 nt, Human
uccaccuucuuucccacgaccga

SEQ ID NO: 1217874 - RNA, 25 nt, Human
ucccacgaccgccuccugcccaggg

SEQ ID NO: 1217875 - RNA, 24 nt, Human
ucccuaccugagggaaaccccggc

SEQ ID NO: 1217876 - RNA, 19 nt, Human
uccggaggccacugccuca

SEQ ID NO: 1217877 - RNA, 22 nt, Human
ucuguccagugcccuccggagg

SEQ ID NO: 1217878 - RNA, 19 nt, Human
ugagagagagagaugucca

SEQ ID NO: 1217879 - RNA, 18 nt, Human
ugcccgcacccugcacuc

SEQ ID NO: 1217880 - RNA, 21 nt, Human
ugcugacuguaccggacgcca

SEQ ID NO: 1217881 - RNA, 20 nt, Human
uggcuggcggcgacaaggcg

SEQ ID NO: 1217882 - RNA, 20 nt, Human
ugggcugggaucugcuugag

SEQ ID NO: 1217883 - RNA, 21 nt, Human
ugguggggaaagagacuucau

SEQ ID NO: 1217884 - RNA, 22 nt, Human
uguccaguuugugccucuccca

SEQ ID NO: 1217885 - RNA, 22 nt, Human
ugugaaugggcaauuugggcug

SEQ ID NO: 1217886 - RNA, 22 nt, Human
ugugugaaugggcaauuugggc

SEQ ID NO: 1217887 - RNA, 20 nt, Human
uguuucuguccagugcccuc

SEQ ID NO: 1217888 - RNA, 20 nt, Human
uuuauaaggccucuugaaac

SEQ ID NO: 1217889 - RNA, 23 nt, Human
aagaguuuucuauaucuuucuca

SEQ ID NO: 1217890 - RNA, 18 nt, Human
aaguggcccucagugaag

SEQ ID NO: 1217891 - RNA, 22 nt, Human
agaccaaagcuggagucgagga

SEQ ID NO: 1217892 - RNA, 21 nt, Human
agagccugggggacagggcac

SEQ ID NO: 1217893 - RNA, 21 nt, Human
agcuauuuuuggauguuucuc

SEQ ID NO: 1217894 - RNA, 23 nt, Human
aggagacaauguccuccaaaagc

SEQ ID NO: 1217895 - RNA, 19 nt, Human
aggggcucugcgcucccac

SEQ ID NO: 1217896 - RNA, 20 nt, Human
agguuccugcugcccuaggg

SEQ ID NO: 1217897 - RNA, 22 nt, Human
caaaggucaccgacuucugaaa

SEQ ID NO: 1217898 - RNA, 22 nt, Human
caaauuuccuuuguaaaguggc

SEQ ID NO: 1217899 - RNA, 19 nt, Human
caaggcuucucucucucuc

SEQ ID NO: 1217900 - RNA, 18 nt, Human
caauagguuccugcugcc

SEQ ID NO: 1217901 - RNA, 22 nt, Human
caauuccauagcucaggcccug

SEQ ID NO: 1217902 - RNA, 20 nt, Human
caccucgggccgcuucacgc

SEQ ID NO: 1217903 - RNA, 23 nt, Human
caccucgggccgcuucacgcccg

SEQ ID NO: 1217904 - RNA, 23 nt, Human
cacgguccauacucgggaugcac

SEQ ID NO: 1217905 - RNA, 18 nt, Human
ccagagccugggggacag

SEQ ID NO: 1217906 - RNA, 20 nt, Human
ccagagccugggggacaggg

SEQ ID NO: 1217907 - RNA, 19 nt, Human
ccauagcucaggcccuggg

SEQ ID NO: 1217908 - RNA, 21 nt, Human
ccccgggccgccgcccugcuc

SEQ ID NO: 1217909 - RNA, 22 nt, Human
cccgggccgccgcccugcuccc

SEQ ID NO: 1217910 - RNA, 22 nt, Human
ccuaugucaggagccugggagc

SEQ ID NO: 1217911 - RNA, 21 nt, Human
ccucaaaggucaccgacuucu

SEQ ID NO: 1217912 - RNA, 19 nt, Human
ccugcucccucucccagcc

SEQ ID NO: 1217913 - RNA, 18 nt, Human
ccugcugcccuagggcca

SEQ ID NO: 1217914 - RNA, 20 nt, Human
ccuuuguaaaguggcccuca

SEQ ID NO: 1217915 - RNA, 18 nt, Human
cgcccugcucccucuccc

SEQ ID NO: 1217916 - RNA, 27 nt, Human
cgggcugcuucugcugccgggugaaac

SEQ ID NO: 1217917 - RNA, 22 nt, Human
cuccaaaagccgggcugcuucu

SEQ ID NO: 1217918 - RNA, 23 nt, Human
cugcagcacccagggugggagug

SEQ ID NO: 1217919 - RNA, 19 nt, Human
cuggagcuuuugggacuga

SEQ ID NO: 1217920 - RNA, 20 nt, Human
gaagagcaccccgggccgcc

SEQ ID NO: 1217921 - RNA, 21 nt, Human
gacagcaacgugcguuucccc

SEQ ID NO: 1217922 - RNA, 22 nt, Human
gagcaccccgggccgccgcccu

SEQ ID NO: 1217923 - RNA, 22 nt, Human
gagccacaaagaccaaagcugg

SEQ ID NO: 1217924 - RNA, 18 nt, Human
gcacggcacacagcgccc

SEQ ID NO: 1217925 - RNA, 18 nt, Human
gcaggggacaggccaucc

SEQ ID NO: 1217926 - RNA, 20 nt, Human
gcccugcucccucucccagc

SEQ ID NO: 1217927 - RNA, 24 nt, Human
gcgcaagcuauugagccacaaaga

SEQ ID NO: 1217928 - RNA, 22 nt, Human
gcuucacgcccgcaaauauucc

SEQ ID NO: 1217929 - RNA, 18 nt, Human
ggucaccgacuucugaaa

SEQ ID NO: 1217930 - RNA, 20 nt, Human
gugcauggcugccauccccu

SEQ ID NO: 1217931 - RNA, 18 nt, Human
guugguacaaaacaaagc

SEQ ID NO: 1217932 - RNA, 21 nt, Human
uagaauaaaaacuguuuccau

SEQ ID NO: 1217933 - RNA, 27 nt, Human
uauucaugcccucuuggagguuuuuca

SEQ ID NO: 1217934 - RNA, 19 nt, Human
uauuccaucuuuuagcugc

SEQ ID NO: 1217935 - RNA, 24 nt, Human
uccaggagacaauguccuccaaaa

SEQ ID NO: 1217936 - RNA, 22 nt, Human
uccauagcucaggcccuggggc

SEQ ID NO: 1217937 - RNA, 20 nt, Human
uccccgucucagagaagggc

SEQ ID NO: 1217938 - RNA, 25 nt, Human
ucuccauacaaguccuccauaacug

SEQ ID NO: 1217939 - RNA, 20 nt, Human
ucucccagccugggccuccu

SEQ ID NO: 1217940 - RNA, 18 nt, Human
ugaaacaauagguuccug

SEQ ID NO: 1217941 - RNA, 19 nt, Human
ugaagacuuaaauuucucc

SEQ ID NO: 1217942 - RNA, 19 nt, Human
ugcagcacccaggguggga

SEQ ID NO: 1217943 - RNA, 23 nt, Human
ugccagaccucagcaugucaaaa

SEQ ID NO: 1217944 - RNA, 19 nt, Human
ugccgggugacugggaggg

SEQ ID NO: 1217945 - RNA, 25 nt, Human
uggcugggacagcaacgugcguuuc

SEQ ID NO: 1217946 - RNA, 20 nt, Human
uggggccaggcugucaggug

SEQ ID NO: 1217947 - RNA, 24 nt, Human
ugucaaaagacuugugguaucacc

SEQ ID NO: 1217948 - RNA, 25 nt, Human
uuaaacaaauaaauuaauguaggua

SEQ ID NO: 1217949 - RNA, 18 nt, Human
uucaugcccucuuggagg

SEQ ID NO: 1217950 - RNA, 24 nt, Human
uugagccacaaagaccaaagcugg

SEQ ID NO: 1217951 - RNA, 24 nt, Human
uuuccauaugaagacucugccaua

SEQ ID NO: 1217952 - RNA, 21 nt, Human
uuucuugaugcugcugggaac

SEQ ID NO: 1217953 - RNA, 21 nt, Human
aacaaugugcacagggccccc

SEQ ID NO: 1217954 - RNA, 19 nt, Human
aagccccaggccugcucag

SEQ ID NO: 1217955 - RNA, 19 nt, Human
acacugcgaucauacccag

SEQ ID NO: 1217956 - RNA, 20 nt, Human
accggggugcaggggaccca

SEQ ID NO: 1217957 - RNA, 19 nt, Human
accugaacugggcugcuuc

SEQ ID NO: 1217958 - RNA, 21 nt, Human
accugggacugccucagaggc

SEQ ID NO: 1217959 - RNA, 19 nt, Human
acucuuggggaccucccag

SEQ ID NO: 1217960 - RNA, 25 nt, Human
agaacccccauccuugguggucacc

SEQ ID NO: 1217961 - RNA, 24 nt, Human
aggacggcccaucuaugccuguag

SEQ ID NO: 1217962 - RNA, 19 nt, Human
aggagcuuccucccgggaa

SEQ ID NO: 1217963 - RNA, 18 nt, Human
aggcauccguuaacaagg

SEQ ID NO: 1217964 - RNA, 19 nt, Human
aggcccccgacccaugacc

SEQ ID NO: 1217965 - RNA, 22 nt, Human
aggcccccgacccaugaccugc

SEQ ID NO: 1217966 - RNA, 27 nt, Human
aggcccccgacccaugaccugcccagg

SEQ ID NO: 1217967 - RNA, 19 nt, Human
agggacauagaaccaagcc

SEQ ID NO: 1217968 - RNA, 23 nt, Human
aggggaacaaugugcacagggcc

SEQ ID NO: 1217969 - RNA, 21 nt, Human
aggugguaaaggccaugcuuc

SEQ ID NO: 1217970 - RNA, 19 nt, Human
caagccccaggccugcuca

SEQ ID NO: 1217971 - RNA, 23 nt, Human
caagggaaacaaaaggacggccc

SEQ ID NO: 1217972 - RNA, 19 nt, Human
caaucucgacccugacagg

SEQ ID NO: 1217973 - RNA, 18 nt, Human
cacugguagccagccagc

SEQ ID NO: 1217974 - RNA, 19 nt, Human
cagaaggggccaccaggca

SEQ ID NO: 1217975 - RNA, 25 nt, Human
cagagcccugccugccaggccagga

SEQ ID NO: 1217976 - RNA, 21 nt, Human
cagcacccucaaggcagcagg

SEQ ID NO: 1217977 - RNA, 24 nt, Human
cagcagggaauggcccucucuggc

SEQ ID NO: 1217978 - RNA, 21 nt, Human
cagcuccugccuccauccucc

SEQ ID NO: 1217979 - RNA, 19 nt, Human
ccaugcugaggcccuagag

SEQ ID NO: 1217980 - RNA, 19 nt, Human
cccaugaccugcccagugu

SEQ ID NO: 1217981 - RNA, 20 nt, Human
cccccgacccaugaccugcc

SEQ ID NO: 1217982 - RNA, 18 nt, Human
ccgcgugcaaucucgacc

SEQ ID NO: 1217983 - RNA, 19 nt, Human
ccgcgugcaaucucgaccc

SEQ ID NO: 1217984 - RNA, 19 nt, Human
ccuccccacagcuccuccu

SEQ ID NO: 1217985 - RNA, 19 nt, Human
ccuccuucagugccaccac

SEQ ID NO: 1217986 - RNA, 19 nt, Human
ccugccuccauccucccca

SEQ ID NO: 1217987 - RNA, 20 nt, Human
ccuggcacuggaaggccccc

SEQ ID NO: 1217988 - RNA, 20 nt, Human
ccuucuagaagcuucuccca

SEQ ID NO: 1217989 - RNA, 18 nt, Human
cgggaagaugagguagca

SEQ ID NO: 1217990 - RNA, 23 nt, Human
cucaaggcagcagggaauggccc

SEQ ID NO: 1217991 - RNA, 23 nt, Human
cuccaggcucauguggauguccu

SEQ ID NO: 1217992 - RNA, 20 nt, Human
cuccuccaccucacucacca

SEQ ID NO: 1217993 - RNA, 19 nt, Human
cucgacccugacaggacag

SEQ ID NO: 1217994 - RNA, 19 nt, Human
cuggggcuguguccagagg

SEQ ID NO: 1217995 - RNA, 20 nt, Human
cugugcccccaugcccgggc

SEQ ID NO: 1217996 - RNA, 24 nt, Human
cuuggggaccucccaggcagucaa

SEQ ID NO: 1217997 - RNA, 21 nt, Human
gaccagucugguccuacccag

SEQ ID NO: 1217998 - RNA, 20 nt, Human
gagcuggcaggagguccugg

SEQ ID NO: 1217999 - RNA, 18 nt, Human
gaggggcagggaaggaag

SEQ ID NO: 1218000 - RNA, 19 nt, Human
gcaaacucucccuccccuc

SEQ ID NO: 1218001 - RNA, 23 nt, Human
gcagcagggaauggcccucucug

SEQ ID NO: 1218002 - RNA, 20 nt, Human
gcauccguuaacaagggaaa

SEQ ID NO: 1218003 - RNA, 23 nt, Human
gccaccacguuguguuccugauc

SEQ ID NO: 1218004 - RNA, 18 nt, Human
gccccaggccugcucagc

SEQ ID NO: 1218005 - RNA, 23 nt, Human
gcugugauggacauguucagcuc

SEQ ID NO: 1218006 - RNA, 18 nt, Human
ggaaacaaaaggacggcc

SEQ ID NO: 1218007 - RNA, 23 nt, Human
ggaggcacccaguuccuugaagg

SEQ ID NO: 1218008 - RNA, 18 nt, Human
ggcacaggucccuggcac

SEQ ID NO: 1218009 - RNA, 20 nt, Human
ggcagaaguaugcaccuacc

SEQ ID NO: 1218010 - RNA, 20 nt, Human
ggcagggaaggaagaaaggu

SEQ ID NO: 1218011 - RNA, 23 nt, Human
gggcucuggagagucaggcagcc

SEQ ID NO: 1218012 - RNA, 24 nt, Human
ggggugcaggggacccaaaacucc

SEQ ID NO: 1218013 - RNA, 18 nt, Human
gguguugggugugugagc

SEQ ID NO: 1218014 - RNA, 22 nt, Human
gugagcuggggcuggggagggc

SEQ ID NO: 1218015 - RNA, 22 nt, Human
gugcacagggcccccagcgggc

SEQ ID NO: 1218016 - RNA, 22 nt, Human
gugcagagguuccuccuugucc

SEQ ID NO: 1218017 - RNA, 20 nt, Human
guguagcaaguacgaugggc

SEQ ID NO: 1218018 - RNA, 22 nt, Human
guuaacaagggaaacaaaagga

SEQ ID NO: 1218019 - RNA, 19 nt, Human
uaacaagggaaacaaaagg

SEQ ID NO: 1218020 - RNA, 18 nt, Human
uacgaugggccaugcacu

SEQ ID NO: 1218021 - RNA, 23 nt, Human
uagaaccaagccccaggccugcu

SEQ ID NO: 1218022 - RNA, 22 nt, Human
uagagucagagcccugccugcc

SEQ ID NO: 1218023 - RNA, 21 nt, Human
uaggcucagaaggggccacca

SEQ ID NO: 1218024 - RNA, 18 nt, Human
ucacucaccagcuugggg

SEQ ID NO: 1218025 - RNA, 21 nt, Human
ucagagcccugccugccaggc

SEQ ID NO: 1218026 - RNA, 24 nt, Human
ucagugccaccacguuguguuccu

SEQ ID NO: 1218027 - RNA, 20 nt, Human
ucccuggcacuggaaggccc

SEQ ID NO: 1218028 - RNA, 23 nt, Human
ucccuggcacuggaaggcccccg

SEQ ID NO: 1218029 - RNA, 25 nt, Human
uccuggggcuguguccagagggugg

SEQ ID NO: 1218030 - RNA, 24 nt, Human
uccuugaaggaacugaggggcagg

SEQ ID NO: 1218031 - RNA, 21 nt, Human
ucuguccccguggccuccagg

SEQ ID NO: 1218032 - RNA, 23 nt, Human
ucuguguguuuaaggcgugcuug

SEQ ID NO: 1218033 - RNA, 18 nt, Human
ugaacugggcugcuucgc

SEQ ID NO: 1218034 - RNA, 23 nt, Human
ugaagagacuguuggucauggcg

SEQ ID NO: 1218035 - RNA, 18 nt, Human
ugaaggaacugaggggca

SEQ ID NO: 1218036 - RNA, 19 nt, Human
ugaaggagcuuccucccgg

SEQ ID NO: 1218037 - RNA, 21 nt, Human
ugaccaguggcucuggggagg

SEQ ID NO: 1218038 - RNA, 21 nt, Human
ugaccugcccagugucauguc

SEQ ID NO: 1218039 - RNA, 26 nt, Human
ugaggggaacaaugugcacagggccc

SEQ ID NO: 1218040 - RNA, 24 nt, Human
ugcaacacacugcgaucauaccca

SEQ ID NO: 1218041 - RNA, 24 nt, Human
ugcagagguuccuccuuguccuug

SEQ ID NO: 1218042 - RNA, 20 nt, Human
ugcaggggacccaaaacucc

SEQ ID NO: 1218043 - RNA, 24 nt, Human
ugccaggccaggacucuuggggac

SEQ ID NO: 1218044 - RNA, 25 nt, Human
ugcccgggcauauggaauguggagg

SEQ ID NO: 1218045 - RNA, 20 nt, Human
ugccucagaggcccaggcag

SEQ ID NO: 1218046 - RNA, 23 nt, Human
ugccuccauccuccccacagcuc

SEQ ID NO: 1218047 - RNA, 21 nt, Human
ugccuguagcccaggcguagg

SEQ ID NO: 1218048 - RNA, 24 nt, Human
uggagauuggaguguuuaugagag

SEQ ID NO: 1218049 - RNA, 24 nt, Human
ugggagcuggcaggagguccuggg

SEQ ID NO: 1218050 - RNA, 25 nt, Human
ugggagcuggcaggagguccuggga

SEQ ID NO: 1218051 - RNA, 19 nt, Human
uggggcuguguccagaggg

SEQ ID NO: 1218052 - RNA, 21 nt, Human
uguggagaccagucugguccu

SEQ ID NO: 1218053 - RNA, 19 nt, Human
uguggauguccucgagguu

SEQ ID NO: 1218054 - RNA, 26 nt, Human
uguucagcuccuccaccucacucacc

SEQ ID NO: 1218055 - RNA, 18 nt, Human
uguugggccggugugaga

SEQ ID NO: 1218056 - RNA, 19 nt, Human
uugaaggaacugaggggca

SEQ ID NO: 1218057 - RNA, 22 nt, Human
uugacggaaggaggcacccagu

SEQ ID NO: 1218058 - RNA, 22 nt, Human
aaaauaaagcuauauaaauuga

SEQ ID NO: 1218059 - RNA, 23 nt, Human
aaagauuuucauuccaguucacc

SEQ ID NO: 1218060 - RNA, 20 nt, Human
aacucaggggaguccccaca

SEQ ID NO: 1218061 - RNA, 24 nt, Human
aaguaaaaaauaaagcuauauaaa

SEQ ID NO: 1218062 - RNA, 25 nt, Human
acacaugcuuuggugcauguacacg

SEQ ID NO: 1218063 - RNA, 23 nt, Human
acagccugucuaaacauuuguuu

SEQ ID NO: 1218064 - RNA, 20 nt, Human
agauugcauuugccaacuga

SEQ ID NO: 1218065 - RNA, 19 nt, Human
agcaccggaccccuggcca

SEQ ID NO: 1218066 - RNA, 21 nt, Human
agcggauggucacccuguugg

SEQ ID NO: 1218067 - RNA, 18 nt, Human
agcuggcucguggcggaa

SEQ ID NO: 1218068 - RNA, 20 nt, Human
agggcugagccgaggggagg

SEQ ID NO: 1218069 - RNA, 21 nt, Human
aggggaagggccuuguccagg

SEQ ID NO: 1218070 - RNA, 22 nt, Human
auguacacguguguguguguau

SEQ ID NO: 1218071 - RNA, 22 nt, Human
caacucaggggaguccccacag

SEQ ID NO: 1218072 - RNA, 21 nt, Human
caaggcucaacucaggggagu

SEQ ID NO: 1218073 - RNA, 23 nt, Human
caccggaccccuggccaaggcuc

SEQ ID NO: 1218074 - RNA, 18 nt, Human
caccuuuagcuuaaaaaa

SEQ ID NO: 1218075 - RNA, 20 nt, Human
cagacacaggcuggguugac

SEQ ID NO: 1218076 - RNA, 19 nt, Human
cagcaccggaccccuggcc

SEQ ID NO: 1218077 - RNA, 20 nt, Human
caggcuggguugacuggggc

SEQ ID NO: 1218078 - RNA, 24 nt, Human
cauaaugaacagacauuuuaaaug

SEQ ID NO: 1218079 - RNA, 23 nt, Human
caugcacacgcgugucuguggua

SEQ ID NO: 1218080 - RNA, 22 nt, Human
cauguacacgugugugugugua

SEQ ID NO: 1218081 - RNA, 23 nt, Human
cauguacacguguguguguguau

SEQ ID NO: 1218082 - RNA, 18 nt, Human
ccagguaacacgcaugca

SEQ ID NO: 1218083 - RNA, 18 nt, Human
ccccauguggacauggcu

SEQ ID NO: 1218084 - RNA, 19 nt, Human
ccccuggccaaggcucaac

SEQ ID NO: 1218085 - RNA, 21 nt, Human
ccccuggccaaggcucaacuc

SEQ ID NO: 1218086 - RNA, 21 nt, Human
ccgugcuccgacgcgugcacg

SEQ ID NO: 1218087 - RNA, 21 nt, Human
cgcgugcacggaugaggugcg

SEQ ID NO: 1218088 - RNA, 24 nt, Human
cgcgugcacggaugaggugcggcg

SEQ ID NO: 1218089 - RNA, 18 nt, Human
cggcguggguguggccag

SEQ ID NO: 1218090 - RNA, 23 nt, Human
cgguguggccugcuuguucgccc

SEQ ID NO: 1218091 - RNA, 25 nt, Human
cucccucgagacgguguggccugcu

SEQ ID NO: 1218092 - RNA, 18 nt, Human
cugcuuguucgcccuguc

SEQ ID NO: 1218093 - RNA, 26 nt, Human
cuggagguuucccgcgacagcaccgg

SEQ ID NO: 1218094 - RNA, 24 nt, Human
gaaucacacuuucaugacacuucu

SEQ ID NO: 1218095 - RNA, 20 nt, Human
gacagcaccggaccccuggc

SEQ ID NO: 1218096 - RNA, 23 nt, Human
gagcuugcacguuuguggugggu

SEQ ID NO: 1218097 - RNA, 23 nt, Human
gaugcaaggaccugcauaucaag

SEQ ID NO: 1218098 - RNA, 19 nt, Human
gcauguacacgugugugug

SEQ ID NO: 1218099 - RNA, 22 nt, Human
gcccacugugcgugucugagac

SEQ ID NO: 1218100 - RNA, 22 nt, Human
gcccacugugcgugucugagac

SEQ ID NO: 1218101 - RNA, 22 nt, Human
gcccacugugcgugucugagac

SEQ ID NO: 1218102 - RNA, 18 nt, Human
ggagacgcuggccgcauc

SEQ ID NO: 1218103 - RNA, 22 nt, Human
ggcguggguguggccaguccug

SEQ ID NO: 1218104 - RNA, 21 nt, Human
gguggguacauguacauaugu

SEQ ID NO: 1218105 - RNA, 21 nt, Human
guacacgugcauguucugcau

SEQ ID NO: 1218106 - RNA, 21 nt, Human
guggagccaaaagccagguaa

SEQ ID NO: 1218107 - RNA, 21 nt, Human
guguguguguguaugcgugua

SEQ ID NO: 1218108 - RNA, 24 nt, Human
uaacuuccuaaagaaauguaggau

SEQ ID NO: 1218109 - RNA, 18 nt, Human
uacuagucagugcaaaac

SEQ ID NO: 1218110 - RNA, 23 nt, Human
uacuguguggagacugauuuaug

SEQ ID NO: 1218111 - RNA, 18 nt, Human
uagcuuaaaaaaaaaaaa

SEQ ID NO: 1218112 - RNA, 19 nt, Human
uaucccaucaaggcugcuu

SEQ ID NO: 1218113 - RNA, 24 nt, Human
uaugaugaugacaacuauggauac

SEQ ID NO: 1218114 - RNA, 21 nt, Human
uaugugcauauguauugugua

SEQ ID NO: 1218115 - RNA, 21 nt, Human
ucccgcgacagcaccggaccc

SEQ ID NO: 1218116 - RNA, 19 nt, Human
ucccucgagacgguguggc

SEQ ID NO: 1218117 - RNA, 19 nt, Human
ugagacggucuguggcagg

SEQ ID NO: 1218118 - RNA, 19 nt, Human
ugagacggucuguggcagg

SEQ ID NO: 1218119 - RNA, 19 nt, Human
ugagacggucuguggcagg

SEQ ID NO: 1218120 - RNA, 22 nt, Human
ugagcguggagccaaaagccag

SEQ ID NO: 1218121 - RNA, 25 nt, Human
ugagugauccugugugcaagccccc

SEQ ID NO: 1218122 - RNA, 18 nt, Human
ugaugaugacaacuaugg

SEQ ID NO: 1218123 - RNA, 19 nt, Human
ugcauguacacgugugugu

SEQ ID NO: 1218124 - RNA, 21 nt, Human
ugcaugucuguaggucacaca

SEQ ID NO: 1218125 - RNA, 26 nt, Human
ugcaugugugcaggagcuugcacguu

SEQ ID NO: 1218126 - RNA, 18 nt, Human
ugcauguguguaucacac

SEQ ID NO: 1218127 - RNA, 21 nt, Human
uggcuaugagugagcguggag

SEQ ID NO: 1218128 - RNA, 20 nt, Human
uggguacauguacauaugug

SEQ ID NO: 1218129 - RNA, 19 nt, Human
ugggugugaaucagugacc

SEQ ID NO: 1218130 - RNA, 23 nt, Human
uggugcauguacacgugugugug

SEQ ID NO: 1218131 - RNA, 25 nt, Human
uggugcauguacacgugugugugug

SEQ ID NO: 1218132 - RNA, 23 nt, Human
uguacacgugcauguucugcaug

SEQ ID NO: 1218133 - RNA, 19 nt, Human
uguacacgugugugugugu

SEQ ID NO: 1218134 - RNA, 18 nt, Human
uguacacguuugugugca

SEQ ID NO: 1218135 - RNA, 22 nt, Human
ugucaaauaaauaauacuaaca

SEQ ID NO: 1218136 - RNA, 18 nt, Human
ugucugagacggucugug

SEQ ID NO: 1218137 - RNA, 18 nt, Human
ugucugagacggucugug

SEQ ID NO: 1218138 - RNA, 18 nt, Human
ugucugagacggucugug

SEQ ID NO: 1218139 - RNA, 28 nt, Human
ugugcuuaccuguacaugcaugugugua

SEQ ID NO: 1218140 - RNA, 21 nt, Human
uguguacacgugcauguucug

SEQ ID NO: 1218141 - RNA, 25 nt, Human
uguguacacgugcauguucugcaug

SEQ ID NO: 1218142 - RNA, 26 nt, Human
uguguaggagcaugcacacgcguggu

SEQ ID NO: 1218143 - RNA, 21 nt, Human
uguguaucacacguccgugug

SEQ ID NO: 1218144 - RNA, 21 nt, Human
uguguaucacacguccgugug

SEQ ID NO: 1218145 - RNA, 19 nt, Human
ugugugcaggagcuugcac

SEQ ID NO: 1218146 - RNA, 18 nt, Human
ugugugcaugcaugugug

SEQ ID NO: 1218147 - RNA, 20 nt, Human
ugugugcaugcaugugugca

SEQ ID NO: 1218148 - RNA, 27 nt, Human
ugugugcaugcaugugugcaggagcuu

SEQ ID NO: 1218149 - RNA, 18 nt, Human
uguguguguguaugcgug

SEQ ID NO: 1218150 - RNA, 19 nt, Human
uguguguguguaugcgugu

SEQ ID NO: 1218151 - RNA, 20 nt, Human
uguguguguguaugcgugua

SEQ ID NO: 1218152 - RNA, 21 nt, Human
uucgcccugucugcucagaca

SEQ ID NO: 1218153 - RNA, 20 nt, Human
uuugaagaccuucuuuuauu

SEQ ID NO: 1218154 - RNA, 23 nt, Human
uuugccaacugauauuuuuccug

SEQ ID NO: 1218155 - RNA, 23 nt, Human
uuugugguggguacauguacaua

SEQ ID NO: 1218156 - RNA, 23 nt, Human
aucauuugauauuuucccacagu

SEQ ID NO: 1218157 - RNA, 20 nt, Human
ggcccggggugcuccagggu

SEQ ID NO: 1218158 - RNA, 26 nt, Human
gggaaaauuauugguaauuuucucuu

SEQ ID NO: 1218159 - RNA, 24 nt, Human
ucuuucuucuucuuuugggagucc

SEQ ID NO: 1218160 - RNA, 18 nt, Human
ugauuuguucuuucuucu

SEQ ID NO: 1218161 - RNA, 22 nt, Human
aaaagaacaaagaucaaacaaa

SEQ ID NO: 1218162 - RNA, 19 nt, Human
aaacaaaccaggaaaaaac

SEQ ID NO: 1218163 - RNA, 21 nt, Human
aaacaaaccaggaaaaaacaa

SEQ ID NO: 1218164 - RNA, 22 nt, Human
aaacaggugaaguggaaaccac

SEQ ID NO: 1218165 - RNA, 24 nt, Human
aaagugcugggauuacagguguga

SEQ ID NO: 1218166 - RNA, 21 nt, Human
aaaguggaaacaggugaagug

SEQ ID NO: 1218167 - RNA, 24 nt, Human
aaaguguugggauuacaggccuga

SEQ ID NO: 1218168 - RNA, 22 nt, Human
aaauagccagcguaagcaaaac

SEQ ID NO: 1218169 - RNA, 18 nt, Human
aaaucaacuccaaaugga

SEQ ID NO: 1218170 - RNA, 18 nt, Human
aacaaaaaucaacuccaa

SEQ ID NO: 1218171 - RNA, 21 nt, Human
aaccacugcaaucuucuaagu

SEQ ID NO: 1218172 - RNA, 22 nt, Human
aagcaacuugggauaaaacaua

SEQ ID NO: 1218173 - RNA, 25 nt, Human
aagcaauucuccugccucagccucc

SEQ ID NO: 1218174 - RNA, 24 nt, Human
aaggagaugcuguuucacaaccac

SEQ ID NO: 1218175 - RNA, 22 nt, Human
aaggagcugggauuacaggcgu

SEQ ID NO: 1218176 - RNA, 18 nt, Human
aagugcugggauuacagg

SEQ ID NO: 1218177 - RNA, 19 nt, Human
aagugcugggauuacaggu

SEQ ID NO: 1218178 - RNA, 26 nt, Human
aagugcugggauuacaggugugagcc

SEQ ID NO: 1218179 - RNA, 21 nt, Human
aaguguugggauuacaggccu

SEQ ID NO: 1218180 - RNA, 26 nt, Human
aaguguugggauuacaggccugagcc

SEQ ID NO: 1218181 - RNA, 22 nt, Human
acaucacacuuucuccuuuucu

SEQ ID NO: 1218182 - RNA, 20 nt, Human
accaacaccccaaggagaug

SEQ ID NO: 1218183 - RNA, 24 nt, Human
accauguuggccaggauggucuug

SEQ ID NO: 1218184 - RNA, 20 nt, Human
accucacaacagccucacua

SEQ ID NO: 1218185 - RNA, 24 nt, Human
accuugugauccacccaccucggc

SEQ ID NO: 1218186 - RNA, 24 nt, Human
accuugugauccgcccaccucggc

SEQ ID NO: 1218187 - RNA, 18 nt, Human
acgagguuucacuguguu

SEQ ID NO: 1218188 - RNA, 20 nt, Human
acgagguuucacuguguugg

SEQ ID NO: 1218189 - RNA, 24 nt, Human
acgagguuucacuguguuggccag

SEQ ID NO: 1218190 - RNA, 24 nt, Human
acucuguugccaggcuggagugca

SEQ ID NO: 1218191 - RNA, 26 nt, Human
agaccagguacuucauccaaaaagga

SEQ ID NO: 1218192 - RNA, 22 nt, Human
agagaagugcaaaccaacaccc

SEQ ID NO: 1218193 - RNA, 21 nt, Human
aggaaaaaacaagaccaggua

SEQ ID NO: 1218194 - RNA, 19 nt, Human
aggagaaaagaaauuucug

SEQ ID NO: 1218195 - RNA, 24 nt, Human
aggagaaaagaaauuucugaugaa

SEQ ID NO: 1218196 - RNA, 23 nt, Human
aggccagggcaagcgaaugggaa

SEQ ID NO: 1218197 - RNA, 25 nt, Human
aggccuugcaaaaauuuuuaugucc

SEQ ID NO: 1218198 - RNA, 25 nt, Human
aggcuggagugcaguggcgcgaucu

SEQ ID NO: 1218199 - RNA, 24 nt, Human
agucuacacuucugaauuuuaggu

SEQ ID NO: 1218200 - RNA, 20 nt, Human
agugcaguggcgcgaucucg

SEQ ID NO: 1218201 - RNA, 23 nt, Human
agugcaguggcgcgaucucgguu

SEQ ID NO: 1218202 - RNA, 24 nt, Human
agugcaguggcgcgaucucgguuc

SEQ ID NO: 1218203 - RNA, 24 nt, Human
aucacaaaaguggaaacaggugaa

SEQ ID NO: 1218204 - RNA, 19 nt, Human
augcuguuucacaaccacu

SEQ ID NO: 1218205 - RNA, 18 nt, Human
auggaaccucuucaaacu

SEQ ID NO: 1218206 - RNA, 18 nt, Human
auggcguuucaccauguu

SEQ ID NO: 1218207 - RNA, 24 nt, Human
auggcguuucaccauguuggccag

SEQ ID NO: 1218208 - RNA, 21 nt, Human
auucuccugccucagccuccc

SEQ ID NO: 1218209 - RNA, 24 nt, Human
auuuuucuauuuuuaguagagaug

SEQ ID NO: 1218210 - RNA, 23 nt, Human
caaaccaggaaaaaacaagacca

SEQ ID NO: 1218211 - RNA, 24 nt, Human
caaagugcugggauuacaggugug

SEQ ID NO: 1218212 - RNA, 18 nt, Human
caaaguguugggauuaca

SEQ ID NO: 1218213 - RNA, 22 nt, Human
caagcaauucuccugccucagc

SEQ ID NO: 1218214 - RNA, 23 nt, Human
caagcgaaugggaaaaacuaaac

SEQ ID NO: 1218215 - RNA, 22 nt, Human
caaguggugacucaccucacaa

SEQ ID NO: 1218216 - RNA, 23 nt, Human
caauuuuucuauuuuuaguagag

SEQ ID NO: 1218217 - RNA, 24 nt, Human
caauuuuucuauuuuuaguagaga

SEQ ID NO: 1218218 - RNA, 18 nt, Human
caccauguuggccaggau

SEQ ID NO: 1218219 - RNA, 22 nt, Human
caccauguuggccaggaugguc

SEQ ID NO: 1218220 - RNA, 24 nt, Human
caccauguuggccaggauggucuu

SEQ ID NO: 1218221 - RNA, 22 nt, Human
cacccaccucggccucccaaag

SEQ ID NO: 1218222 - RNA, 23 nt, Human
cacccaccucggccucccaaagu

SEQ ID NO: 1218223 - RNA, 23 nt, Human
caccccaaggagaugcuguuuca

SEQ ID NO: 1218224 - RNA, 24 nt, Human
caccucggccucccaaagugcugg

SEQ ID NO: 1218225 - RNA, 24 nt, Human
caccucggccucccaaaguguugg

SEQ ID NO: 1218226 - RNA, 23 nt, Human
cacucuguugccaggcuggagug

SEQ ID NO: 1218227 - RNA, 18 nt, Human
cacuguguuggccaggau

SEQ ID NO: 1218228 - RNA, 21 nt, Human
cacuguguuggccaggauggu

SEQ ID NO: 1218229 - RNA, 22 nt, Human
cacuguguuggccaggaugguc

SEQ ID NO: 1218230 - RNA, 28 nt, Human
cacuuuggaaaaaacgucacucccuaag

SEQ ID NO: 1218231 - RNA, 20 nt, Human
caggaaaaaacaagaccagg

SEQ ID NO: 1218232 - RNA, 22 nt, Human
caggaaaaaacaagaccaggua

SEQ ID NO: 1218233 - RNA, 21 nt, Human
caggccagcuccuaaggcuga

SEQ ID NO: 1218234 - RNA, 20 nt, Human
ccaaagugcugggauuacag

SEQ ID NO: 1218235 - RNA, 21 nt, Human
ccaaagugcugggauuacagg

SEQ ID NO: 1218236 - RNA, 21 nt, Human
ccaaagugcugggauuacagg

SEQ ID NO: 1218237 - RNA, 24 nt, Human
ccaaagugcugggauuacaggugu

SEQ ID NO: 1218238 - RNA, 19 nt, Human
ccaaaguguugggauuaca

SEQ ID NO: 1218239 - RNA, 22 nt, Human
ccaaaguguugggauuacaggc

SEQ ID NO: 1218240 - RNA, 24 nt, Human
ccaaaguguugggauuacaggccu

SEQ ID NO: 1218241 - RNA, 23 nt, Human
ccaagcuucugggacccuccagg

SEQ ID NO: 1218242 - RNA, 24 nt, Human
ccaaggagcugggauuacaggcgu

SEQ ID NO: 1218243 - RNA, 19 nt, Human
cccaaggagcugggauuac

SEQ ID NO: 1218244 - RNA, 23 nt, Human
cccaaggagcugggauuacaggc

SEQ ID NO: 1218245 - RNA, 21 nt, Human
cccccggccugggcuugguuu

SEQ ID NO: 1218246 - RNA, 22 nt, Human
ccugaccuugugauccacccac

SEQ ID NO: 1218247 - RNA, 22 nt, Human
ccuuuuuuuuugagacagaguc

SEQ ID NO: 1218248 - RNA, 24 nt, Human
cgagguuucacuguguuggccagg

SEQ ID NO: 1218249 - RNA, 23 nt, Human
cgcccccggccugggcuugguuu

SEQ ID NO: 1218250 - RNA, 23 nt, Human
cgugcaccaccacaucuagccaa

SEQ ID NO: 1218251 - RNA, 24 nt, Human
cguuucaccauguuggccaggaug

SEQ ID NO: 1218252 - RNA, 18 nt, Human
cucacucuguugccaggc

SEQ ID NO: 1218253 - RNA, 23 nt, Human
cucacucuguugccaggcuggag

SEQ ID NO: 1218254 - RNA, 19 nt, Human
cucauggaaccucuucaaa

SEQ ID NO: 1218255 - RNA, 18 nt, Human
cuccugaccuugugaucc

SEQ ID NO: 1218256 - RNA, 20 nt, Human
cuccugaccuugugauccgc

SEQ ID NO: 1218257 - RNA, 22 nt, Human
cuccugaccuugugauccgccc

SEQ ID NO: 1218258 - RNA, 25 nt, Human
cuccugccucagccucccaaggagc

SEQ ID NO: 1218259 - RNA, 23 nt, Human
cugccucagccucccaaggagcu

SEQ ID NO: 1218260 - RNA, 19 nt, Human
cuuaaagccuacgcagaac

SEQ ID NO: 1218261 - RNA, 20 nt, Human
cuucugggacccuccaggcc

SEQ ID NO: 1218262 - RNA, 19 nt, Human
gaaaauagccagcguaagc

SEQ ID NO: 1218263 - RNA, 22 nt, Human
gaaaccacugcaaucuucuaag

SEQ ID NO: 1218264 - RNA, 18 nt, Human
gaagugcaaaccaacacc

SEQ ID NO: 1218265 - RNA, 21 nt, Human
gaagugcaaaccaacacccca

SEQ ID NO: 1218266 - RNA, 24 nt, Human
gacagagucucacucuguugccag

SEQ ID NO: 1218267 - RNA, 22 nt, Human
gaccuugugauccacccaccuc

SEQ ID NO: 1218268 - RNA, 22 nt, Human
gaccuugugauccacccaccuc

SEQ ID NO: 1218269 - RNA, 24 nt, Human
gaccuugugauccacccaccucgg

SEQ ID NO: 1218270 - RNA, 22 nt, Human
gaccuugugauccgcccaccuc

SEQ ID NO: 1218271 - RNA, 22 nt, Human
gaccuugugauccgcccaccuc

SEQ ID NO: 1218272 - RNA, 22 nt, Human
gagaagugcaaaccaacacccc

SEQ ID NO: 1218273 - RNA, 23 nt, Human
gagguuucacuguguuggccagg

SEQ ID NO: 1218274 - RNA, 18 nt, Human
gauuacaggccugagcca

SEQ ID NO: 1218275 - RNA, 21 nt, Human
gauuacaggccugagccacca

SEQ ID NO: 1218276 - RNA, 18 nt, Human
gauuacaggugugagcca

SEQ ID NO: 1218277 - RNA, 21 nt, Human
gauuacaggugugagccaccg

SEQ ID NO: 1218278 - RNA, 22 nt, Human
gauuacaggugugagccaccgc

SEQ ID NO: 1218279 - RNA, 20 nt, Human
gcgaggcucguccaccuaca

SEQ ID NO: 1218280 - RNA, 19 nt, Human
gcuggagugcaguggcgcg

SEQ ID NO: 1218281 - RNA, 21 nt, Human
ggacugccuggaggccagggc

SEQ ID NO: 1218282 - RNA, 23 nt, Human
ggauaaaacauagaaacugugga

SEQ ID NO: 1218283 - RNA, 24 nt, Human
ggauggucaugaucuccugaccuu

SEQ ID NO: 1218284 - RNA, 24 nt, Human
ggauggucuugaucuccugaccuu

SEQ ID NO: 1218285 - RNA, 19 nt, Human
ggauuacaggccugagcca

SEQ ID NO: 1218286 - RNA, 22 nt, Human
ggcguuucaccauguuggccag

SEQ ID NO: 1218287 - RNA, 23 nt, Human
ggcguuucaccauguuggccagg

SEQ ID NO: 1218288 - RNA, 20 nt, Human
ggucuugaucuccugaccuu

SEQ ID NO: 1218289 - RNA, 24 nt, Human
gucucacucuguugccaggcugga

SEQ ID NO: 1218290 - RNA, 24 nt, Human
gugauccacccaccucggccuccc

SEQ ID NO: 1218291 - RNA, 24 nt, Human
gugauccgcccaccucggccuccc

SEQ ID NO: 1218292 - RNA, 19 nt, Human
uaaaacauagaaacugugg

SEQ ID NO: 1218293 - RNA, 26 nt, Human
uaaacuuucggauuuuuucucucaca

SEQ ID NO: 1218294 - RNA, 22 nt, Human
uacaggccugagccaccacacc

SEQ ID NO: 1218295 - RNA, 20 nt, Human
uacaggcgugcaccaccaca

SEQ ID NO: 1218296 - RNA, 23 nt, Human
uacaggugugagccaccgccccc

SEQ ID NO: 1218297 - RNA, 18 nt, Human
uacuacaucacacuuucu

SEQ ID NO: 1218298 - RNA, 20 nt, Human
uagagacgagguuucacugu

SEQ ID NO: 1218299 - RNA, 22 nt, Human
uagagauggcguuucaccaugu

SEQ ID NO: 1218300 - RNA, 18 nt, Human
uagguagagagacuauga

SEQ ID NO: 1218301 - RNA, 24 nt, Human
uaguagagauggcguuucaccaug

SEQ ID NO: 1218302 - RNA, 22 nt, Human
uaucauaacacugcuccccaag

SEQ ID NO: 1218303 - RNA, 26 nt, Human
ucaaacaaaccaggaaaaaacaagac

SEQ ID NO: 1218304 - RNA, 20 nt, Human
ucacaaaaguggaaacaggu

SEQ ID NO: 1218305 - RNA, 24 nt, Human
ucaccauguuggccaggauggucu

SEQ ID NO: 1218306 - RNA, 19 nt, Human
ucacugcaaucugugcuuc

SEQ ID NO: 1218307 - RNA, 23 nt, Human
ucacugcaaucugugcuucccau

SEQ ID NO: 1218308 - RNA, 28 nt, Human
ucacugcaaucugugcuucgggcccucc

SEQ ID NO: 1218309 - RNA, 23 nt, Human
ucagcaugaggccccgaucugga

SEQ ID NO: 1218310 - RNA, 20 nt, Human
ucagccucccaaggagcugg

SEQ ID NO: 1218311 - RNA, 23 nt, Human
ucccaaagugcugggauuacagg

SEQ ID NO: 1218312 - RNA, 24 nt, Human
ucccaaaguguugggauuacaggc

SEQ ID NO: 1218313 - RNA, 24 nt, Human
ucccaaggagcugggauuacaggc

SEQ ID NO: 1218314 - RNA, 24 nt, Human
ucccaucuucaagcaauucuccug

SEQ ID NO: 1218315 - RNA, 20 nt, Human
ucccugggcuggguaagacc

SEQ ID NO: 1218316 - RNA, 18 nt, Human
ucggccucccaaagugcu

SEQ ID NO: 1218317 - RNA, 22 nt, Human
ucgguucacugcaaucugugcu

SEQ ID NO: 1218318 - RNA, 28 nt, Human
ucuaaaaaagaacaaagaucaaacaaac

SEQ ID NO: 1218319 - RNA, 22 nt, Human
ucuaagucacaaguggugacuc

SEQ ID NO: 1218320 - RNA, 23 nt, Human
ucucacucuguugccaggcugga

SEQ ID NO: 1218321 - RNA, 26 nt, Human
ucuccugaccuugugauccacccacc

SEQ ID NO: 1218322 - RNA, 18 nt, Human
ucuguugccaggcuggag

SEQ ID NO: 1218323 - RNA, 23 nt, Human
ucuguugccaggcuggagugcag

SEQ ID NO: 1218324 - RNA, 23 nt, Human
ugaagauaaaggaaagguuguau

SEQ ID NO: 1218325 - RNA, 23 nt, Human
ugaccuugugauccacccaccuc

SEQ ID NO: 1218326 - RNA, 25 nt, Human
ugaccuugugauccgcccaccucgg

SEQ ID NO: 1218327 - RNA, 18 nt, Human
ugagacagagucucacuc

SEQ ID NO: 1218328 - RNA, 22 nt, Human
ugagacagagucucacucuguu

SEQ ID NO: 1218329 - RNA, 23 nt, Human
ugaggaaaaccacaccacuggug

SEQ ID NO: 1218330 - RNA, 24 nt, Human
ugauccacccaccucggccuccca

SEQ ID NO: 1218331 - RNA, 24 nt, Human
ugauccgcccaccucggccuccca

SEQ ID NO: 1218332 - RNA, 19 nt, Human
ugcaaaccaacaccccaag

SEQ ID NO: 1218333 - RNA, 21 nt, Human
ugccaggcuggagugcagugg

SEQ ID NO: 1218334 - RNA, 23 nt, Human
ugccaggcuggagugcaguggcg

SEQ ID NO: 1218335 - RNA, 19 nt, Human
ugcccaggagucaacaugg

SEQ ID NO: 1218336 - RNA, 21 nt, Human
ugcccaggagucaacauggca

SEQ ID NO: 1218337 - RNA, 24 nt, Human
ugccucagccucccaaggagcugg

SEQ ID NO: 1218338 - RNA, 24 nt, Human
ugcugggauuacaggugugagcca

SEQ ID NO: 1218339 - RNA, 18 nt, Human
uggaaacaggugaagugg

SEQ ID NO: 1218340 - RNA, 20 nt, Human
uggaaacaggugaaguggaa

SEQ ID NO: 1218341 - RNA, 23 nt, Human
uggagugcaguggcgcgaucucg

SEQ ID NO: 1218342 - RNA, 24 nt, Human
uggagugcaguggcgcgaucucgg

SEQ ID NO: 1218343 - RNA, 24 nt, Human
uggccaggauggucaugaucuccu

SEQ ID NO: 1218344 - RNA, 24 nt, Human
uggccaggauggucuugaucuccu

SEQ ID NO: 1218345 - RNA, 21 nt, Human
uggcguuucaccauguuggcc

SEQ ID NO: 1218346 - RNA, 24 nt, Human
uggcguuucaccauguuggccagg

SEQ ID NO: 1218347 - RNA, 20 nt, Human
ugggaaaaacuaaacuuucg

SEQ ID NO: 1218348 - RNA, 18 nt, Human
ugggauuacaggccugag

SEQ ID NO: 1218349 - RNA, 19 nt, Human
ugggauuacaggccugagc

SEQ ID NO: 1218350 - RNA, 21 nt, Human
ugggauuacaggccugagcca

SEQ ID NO: 1218351 - RNA, 22 nt, Human
ugggauuacaggccugagccac

SEQ ID NO: 1218352 - RNA, 24 nt, Human
ugggauuacaggccugagccacca

SEQ ID NO: 1218353 - RNA, 21 nt, Human
ugggauuacaggcgugcacca

SEQ ID NO: 1218354 - RNA, 22 nt, Human
ugggauuacaggcgugcaccac

SEQ ID NO: 1218355 - RNA, 24 nt, Human
ugggauuacaggcgugcaccacca

SEQ ID NO: 1218356 - RNA, 25 nt, Human
ugggauuacaggcgugcaccaccac

SEQ ID NO: 1218357 - RNA, 18 nt, Human
ugggauuacaggugugag

SEQ ID NO: 1218358 - RNA, 19 nt, Human
ugggauuacaggugugagc

SEQ ID NO: 1218359 - RNA, 21 nt, Human
ugggauuacaggugugagcca

SEQ ID NO: 1218360 - RNA, 22 nt, Human
ugggauuacaggugugagccac

SEQ ID NO: 1218361 - RNA, 23 nt, Human
ugggauuacaggugugagccacc

SEQ ID NO: 1218362 - RNA, 24 nt, Human
ugggauuacaggugugagccaccg

SEQ ID NO: 1218363 - RNA, 21 nt, Human
uggguaagaccuugucacaga

SEQ ID NO: 1218364 - RNA, 24 nt, Human
ugggugcuggugccaagcuucugg

SEQ ID NO: 1218365 - RNA, 23 nt, Human
ugugaaaacggaagucagcauga

SEQ ID NO: 1218366 - RNA, 18 nt, Human
uuaguagagauggcguuu

SEQ ID NO: 1218367 - RNA, 24 nt, Human
uuaguagagauggcguuucaccau

SEQ ID NO: 1218368 - RNA, 21 nt, Human
uucaagcaauucuccugccuc

SEQ ID NO: 1218369 - RNA, 24 nt, Human
uucaagcaauucuccugccucagc

SEQ ID NO: 1218370 - RNA, 24 nt, Human
uucuuuagguuuauccugucuggg

SEQ ID NO: 1218371 - RNA, 24 nt, Human
uugauucugucuuaaagccuacgc

SEQ ID NO: 1218372 - RNA, 21 nt, Human
uugccaggcuggagugcagug

SEQ ID NO: 1218373 - RNA, 24 nt, Human
uugccaggcuggagugcaguggcg

SEQ ID NO: 1218374 - RNA, 19 nt, Human
uuucaccauguuggccagg

SEQ ID NO: 1218375 - RNA, 20 nt, Human
uuucaccauguuggccagga

SEQ ID NO: 1218376 - RNA, 19 nt, Human
uuucacuguguuggccagg

SEQ ID NO: 1218377 - RNA, 24 nt, Human
uuuuuaguagagauggcguuucac

SEQ ID NO: 1218378 - RNA, 25 nt, Human
acccuccuaagguuuuucuucauug

SEQ ID NO: 1218379 - RNA, 20 nt, Human
accuuagagaacacugaggg

SEQ ID NO: 1218380 - RNA, 22 nt, Human
accuuagagaacacugagggcu

SEQ ID NO: 1218381 - RNA, 20 nt, Human
agaacacugagggcuuucuc

SEQ ID NO: 1218382 - RNA, 18 nt, Human
agaggucuuucaugucuu

SEQ ID NO: 1218383 - RNA, 19 nt, Human
agggcuuucucugugucug

SEQ ID NO: 1218384 - RNA, 21 nt, Human
auaccauccauauucagcaag

SEQ ID NO: 1218385 - RNA, 26 nt, Human
caacaauucucacccuccuaagguuu

SEQ ID NO: 1218386 - RNA, 25 nt, Human
caagggaucaucaaaguacugagca

SEQ ID NO: 1218387 - RNA, 20 nt, Human
cagcccgaggacacgcgcgg

SEQ ID NO: 1218388 - RNA, 21 nt, Human
cagggugaguuccugccugcc

SEQ ID NO: 1218389 - RNA, 21 nt, Human
ccacucccggaccagcuuccc

SEQ ID NO: 1218390 - RNA, 25 nt, Human
ccagcacgcaccgccgcaagaaccg

SEQ ID NO: 1218391 - RNA, 21 nt, Human
ccauccauauucagcaagacc

SEQ ID NO: 1218392 - RNA, 22 nt, Human
cccacggauggcuggaucccua

SEQ ID NO: 1218393 - RNA, 21 nt, Human
ccggcgccagcacgcaccgcc

SEQ ID NO: 1218394 - RNA, 25 nt, Human
ccugaagccaaggccacugcagggc

SEQ ID NO: 1218395 - RNA, 27 nt, Human
cuaccgcgagcggcggcgacuuucccu

SEQ ID NO: 1218396 - RNA, 18 nt, Human
cugaagccaaggccacug

SEQ ID NO: 1218397 - RNA, 22 nt, Human
gaagcgucugaaugcuccuuuc

SEQ ID NO: 1218398 - RNA, 20 nt, Human
gaggcaggcgggcgggcgcc

SEQ ID NO: 1218399 - RNA, 18 nt, Human
ggaagcggugccgggggc

SEQ ID NO: 1218400 - RNA, 18 nt, Human
gggcgggcgcccacuccc

SEQ ID NO: 1218401 - RNA, 19 nt, Human
ucccaacaauucucacccu

SEQ ID NO: 1218402 - RNA, 22 nt, Human
ucccaacaauucucacccuccu

SEQ ID NO: 1218403 - RNA, 21 nt, Human
uccccgcggacagcccgagga

SEQ ID NO: 1218404 - RNA, 18 nt, Human
ucuacuggauaccaucca

SEQ ID NO: 1218405 - RNA, 24 nt, Human
ugaaugcuccuuuccugaagccaa

SEQ ID NO: 1218406 - RNA, 24 nt, Human
ugacccacggauggcuggaucccu

SEQ ID NO: 1218407 - RNA, 24 nt, Human
ugacuucccaacaauucucacccu

SEQ ID NO: 1218408 - RNA, 21 nt, Human
ugagcagaacagcaacaaugc

SEQ ID NO: 1218409 - RNA, 21 nt, Human
ugccuagccacauuccucaag

SEQ ID NO: 1218410 - RNA, 23 nt, Human
ugccuagccacauuccucaaguc

SEQ ID NO: 1218411 - RNA, 20 nt, Human
ugcugauugccuagccacau

SEQ ID NO: 1218412 - RNA, 23 nt, Human
uggcuggaucccuauuuccagcu

SEQ ID NO: 1218413 - RNA, 19 nt, Human
uuccucaagucauggacau

SEQ ID NO: 1218414 - RNA, 18 nt, Human
uucucugugucugcugca

SEQ ID NO: 1218415 - RNA, 25 nt, Human
aaacaccacgguguccccugucuua

SEQ ID NO: 1218416 - RNA, 21 nt, Human
cacagcagugacccgcuggcc

SEQ ID NO: 1218417 - RNA, 23 nt, Human
cacagcagugacccgcuggcccc

SEQ ID NO: 1218418 - RNA, 18 nt, Human
cagcagugacccgcuggc

SEQ ID NO: 1218419 - RNA, 20 nt, Human
caggugccacuccaccuccu

SEQ ID NO: 1218420 - RNA, 25 nt, Human
ccccugucuuaaaccagccauccag

SEQ ID NO: 1218421 - RNA, 24 nt, Human
cccuccuuuucuucaaacccuggg

SEQ ID NO: 1218422 - RNA, 18 nt, Human
ccuccagggcgcugaccu

SEQ ID NO: 1218423 - RNA, 24 nt, Human
ccuccagucuugaugauguccacu

SEQ ID NO: 1218424 - RNA, 20 nt, Human
ccuucucggagggucaccac

SEQ ID NO: 1218425 - RNA, 23 nt, Human
cucuuugagcucccugugggaca

SEQ ID NO: 1218426 - RNA, 24 nt, Human
cuggcccacucuuugguccccugg

SEQ ID NO: 1218427 - RNA, 20 nt, Human
cugggaccugcccuggagag

SEQ ID NO: 1218428 - RNA, 22 nt, Human
gaggguccccucaccagcagcu

SEQ ID NO: 1218429 - RNA, 26 nt, Human
gcagggcacuguggggcgggaggugc

SEQ ID NO: 1218430 - RNA, 20 nt, Human
gggcacuguggggcgggagg

SEQ ID NO: 1218431 - RNA, 21 nt, Human
ggguccccucaccagcagcuc

SEQ ID NO: 1218432 - RNA, 22 nt, Human
ucucggagggucaccacagcag

SEQ ID NO: 1218433 - RNA, 21 nt, Human
ugcagggcacuguggggcggg

SEQ ID NO: 1218434 - RNA, 21 nt, Human
ugcccuggagagccuggcaac

SEQ ID NO: 1218435 - RNA, 19 nt, Human
ugcuggggugggccagcag

SEQ ID NO: 1218436 - RNA, 20 nt, Human
uggagucuuuguuuuuuguu

SEQ ID NO: 1218437 - RNA, 18 nt, Human
uuccuccaguggagucuu

SEQ ID NO: 1218438 - RNA, 18 nt, Human
agcggccucucggcggag

SEQ ID NO: 1218439 - RNA, 18 nt, Human
gccugcacuuggggaaga

SEQ ID NO: 1218440 - RNA, 22 nt, Human
ggcucugccugcacuuggggaa

SEQ ID NO: 1218441 - RNA, 18 nt, Human
uggggaagaggaaggacc

SEQ ID NO: 1218442 - RNA, 24 nt, Human
cucucggccucggugaauuccauc

SEQ ID NO: 1218443 - RNA, 21 nt, Human
ucauguugcucucggccucgg

SEQ ID NO: 1218444 - RNA, 22 nt, Human
ugcucucggccucggugaauuc

SEQ ID NO: 1218445 - RNA, 23 nt, Human
acagaacuggaccuggcgccuga

SEQ ID NO: 1218446 - RNA, 20 nt, Human
accucagcuccgacacagcc

SEQ ID NO: 1218447 - RNA, 21 nt, Human
accucagcuccgacacagccc

SEQ ID NO: 1218448 - RNA, 20 nt, Human
agaccuggccagagcuggug

SEQ ID NO: 1218449 - RNA, 18 nt, Human
agaggccaggaccugggc

SEQ ID NO: 1218450 - RNA, 24 nt, Human
agagugcugggaucacaggcauga

SEQ ID NO: 1218451 - RNA, 20 nt, Human
agaugcuggcagaggccgcc

SEQ ID NO: 1218452 - RNA, 19 nt, Human
aggcaugaaccaccacgcc

SEQ ID NO: 1218453 - RNA, 25 nt, Human
agggguugaaggccacaccaugcac

SEQ ID NO: 1218454 - RNA, 22 nt, Human
agugcugggaucacaggcauga

SEQ ID NO: 1218455 - RNA, 18 nt, Human
auccaccugccuuggccu

SEQ ID NO: 1218456 - RNA, 24 nt, Human
caagaagccugucaucuggugaga

SEQ ID NO: 1218457 - RNA, 18 nt, Human
caaugggcggucgugcug

SEQ ID NO: 1218458 - RNA, 23 nt, Human
caccaugcaccggcuccgggagg

SEQ ID NO: 1218459 - RNA, 22 nt, Human
caccucagcuccgacacagccc

SEQ ID NO: 1218460 - RNA, 20 nt, Human
caccugccuuggccucccag

SEQ ID NO: 1218461 - RNA, 23 nt, Human
caccugccuuggccucccagagu

SEQ ID NO: 1218462 - RNA, 24 nt, Human
caccugccuuggccucccagagug

SEQ ID NO: 1218463 - RNA, 24 nt, Human
cagagugcugggaucacaggcaug

SEQ ID NO: 1218464 - RNA, 21 nt, Human
ccaccgucauccgccucccag

SEQ ID NO: 1218465 - RNA, 22 nt, Human
ccaccgucauccgccucccagg

SEQ ID NO: 1218466 - RNA, 18 nt, Human
ccacugccucugggacug

SEQ ID NO: 1218467 - RNA, 19 nt, Human
ccacugccucugggacugg

SEQ ID NO: 1218468 - RNA, 24 nt, Human
ccagagugcugggaucacaggcau

SEQ ID NO: 1218469 - RNA, 18 nt, Human
ccaggacaagaagcagcg

SEQ ID NO: 1218470 - RNA, 22 nt, Human
cccacaggcgcagccgccccgu

SEQ ID NO: 1218471 - RNA, 21 nt, Human
cccccacugccucugggacug

SEQ ID NO: 1218472 - RNA, 24 nt, Human
cccccagugugacaagaagccugu

SEQ ID NO: 1218473 - RNA, 22 nt, Human
ccccgugcugcugccgcugacc

SEQ ID NO: 1218474 - RNA, 18 nt, Human
cccgagaacagcaacagc

SEQ ID NO: 1218475 - RNA, 21 nt, Human
ccgagaacagcaacagcccaa

SEQ ID NO: 1218476 - RNA, 25 nt, Human
ccgaggcagaggccaggaccugggc

SEQ ID NO: 1218477 - RNA, 21 nt, Human
ccucccaggacaagaagcagc

SEQ ID NO: 1218478 - RNA, 24 nt, Human
ccugccuuggccucccagagugcu

SEQ ID NO: 1218479 - RNA, 19 nt, Human
ccuggccagagcuggugcc

SEQ ID NO: 1218480 - RNA, 18 nt, Human
cgagaacagcaacagccc

SEQ ID NO: 1218481 - RNA, 23 nt, Human
cgagaacagcaacagcccaaugc

SEQ ID NO: 1218482 - RNA, 30 nt, Human
cgagaacccgagaacagcaacagcccaauu

SEQ ID NO: 1218483 - RNA, 25 nt, Human
cgaggcagaggccaggaccugggca

SEQ ID NO: 1218484 - RNA, 20 nt, Human
cgaggucagcucuccagccc

SEQ ID NO: 1218485 - RNA, 18 nt, Human
cggcccgaggcagaggcc

SEQ ID NO: 1218486 - RNA, 22 nt, Human
cugaaggagccagaaggugaca

SEQ ID NO: 1218487 - RNA, 21 nt, Human
cuggugagaaggccagggcca

SEQ ID NO: 1218488 - RNA, 24 nt, Human
gaacccgagaacagcaacagccca

SEQ ID NO: 1218489 - RNA, 21 nt, Human
gaggucagcucuccagccccc

SEQ ID NO: 1218490 - RNA, 25 nt, Human
gccagcacgguggugcuauggggga

SEQ ID NO: 1218491 - RNA, 21 nt, Human
gcccaaugccaccgucauccg

SEQ ID NO: 1218492 - RNA, 23 nt, Human
gccggcacgcgugucccagacac

SEQ ID NO: 1218493 - RNA, 20 nt, Human
ggacaagaagcagcggccgg

SEQ ID NO: 1218494 - RNA, 20 nt, Human
ggaggcggguggaggacacg

SEQ ID NO: 1218495 - RNA, 23 nt, Human
gggcacuguggcugagggccagc

SEQ ID NO: 1218496 - RNA, 21 nt, Human
gggccagcguggagaucuccg

SEQ ID NO: 1218497 - RNA, 19 nt, Human
ggggaaaaugagaugcugg

SEQ ID NO: 1218498 - RNA, 18 nt, Human
gucagcucuccagccccc

SEQ ID NO: 1218499 - RNA, 20 nt, Human
gucccagacgcggaucugac

SEQ ID NO: 1218500 - RNA, 18 nt, Human
uagguggccgugccccac

SEQ ID NO: 1218501 - RNA, 21 nt, Human
ucagcuccgacacagccccca

SEQ ID NO: 1218502 - RNA, 22 nt, Human
uccaccugccuuggccucccag

SEQ ID NO: 1218503 - RNA, 24 nt, Human
ucccagagugcugggaucacaggc

SEQ ID NO: 1218504 - RNA, 23 nt, Human
ucccagggguugaaggccacacc

SEQ ID NO: 1218505 - RNA, 18 nt, Human
ucuccagcccccacugcc

SEQ ID NO: 1218506 - RNA, 21 nt, Human
ugaaggcugaugucugcccca

SEQ ID NO: 1218507 - RNA, 21 nt, Human
ugagcccuugcaccucagcuc

SEQ ID NO: 1218508 - RNA, 21 nt, Human
ugagcucgccggcgucccagg

SEQ ID NO: 1218509 - RNA, 23 nt, Human
ugcaccucagcuccgacacagcc

SEQ ID NO: 1218510 - RNA, 19 nt, Human
ugcugggaucacaggcaug

SEQ ID NO: 1218511 - RNA, 23 nt, Human
ugcugggaucacaggcaugaacc

SEQ ID NO: 1218512 - RNA, 22 nt, Human
uggcgccugagcccuugcaccu

SEQ ID NO: 1218513 - RNA, 24 nt, Human
ugggaucacaggcaugaaccacca

SEQ ID NO: 1218514 - RNA, 24 nt, Human
ugggaucacaggcaugaaccacca

SEQ ID NO: 1218515 - RNA, 21 nt, Human
ugggcacuguggcugagggcc

SEQ ID NO: 1218516 - RNA, 22 nt, Human
ugggcacuguggcugagggcca

SEQ ID NO: 1218517 - RNA, 21 nt, Human
uggugcuaugggggaaaauga

SEQ ID NO: 1218518 - RNA, 23 nt, Human
ugucccagacacagaccuggcca

SEQ ID NO: 1218519 - RNA, 22 nt, Human
uguggcugagggccagcgugga

SEQ ID NO: 1218520 - RNA, 24 nt, Human
aaaagggcaacagguaugaaagua

SEQ ID NO: 1218521 - RNA, 18 nt, Human
accacagucccugcugca

SEQ ID NO: 1218522 - RNA, 19 nt, Human
accacagucccugcugcau

SEQ ID NO: 1218523 - RNA, 18 nt, Human
accaggcgugaugcccac

SEQ ID NO: 1218524 - RNA, 21 nt, Human
acuccacauggcggaaaggag

SEQ ID NO: 1218525 - RNA, 19 nt, Human
caacagguaugaaaguauu

SEQ ID NO: 1218526 - RNA, 27 nt, Human
caacuccacauggcggaaaggagcaau

SEQ ID NO: 1218527 - RNA, 20 nt, Human
caagauagaaacauuaaaga

SEQ ID NO: 1218528 - RNA, 22 nt, Human
ccaggugccuggcaugaccagg

SEQ ID NO: 1218529 - RNA, 21 nt, Human
ccccgugugugucccugcacu

SEQ ID NO: 1218530 - RNA, 20 nt, Human
ccuggcgccucugccaagcc

SEQ ID NO: 1218531 - RNA, 18 nt, Human
cuggccccggccaacucc

SEQ ID NO: 1218532 - RNA, 27 nt, Human
cuggcgccucugccaagccugugucca

SEQ ID NO: 1218533 - RNA, 21 nt, Human
gccaaauuuacaacagcuugc

SEQ ID NO: 1218534 - RNA, 24 nt, Human
uaaaugcccauguuuauuacaaga

SEQ ID NO: 1218535 - RNA, 18 nt, Human
uccaaaaaaauauggaac

SEQ ID NO: 1218536 - RNA, 20 nt, Human
uccacauggcggaaaggagc

SEQ ID NO: 1218537 - RNA, 18 nt, Human
ugccucuggccccggcca

SEQ ID NO: 1218538 - RNA, 20 nt, Human
ugccucuggccccggccaac

SEQ ID NO: 1218539 - RNA, 18 nt, Human
ugccuggcaugaccaggc

SEQ ID NO: 1218540 - RNA, 22 nt, Human
uggcaugaccaggcgugaugcc

SEQ ID NO: 1218541 - RNA, 24 nt, Human
uguguccaggugccuggcaugacc

SEQ ID NO: 1218542 - RNA, 24 nt, Human
uuuuuuuuuuuugaaauaaaugcc

SEQ ID NO: 1218543 - RNA, 20 nt, Human
uuuuuuuuuuuuuuuuuugg

SEQ ID NO: 1218544 - RNA, 18 nt, Human
aaaacccugauccuugaa

SEQ ID NO: 1218545 - RNA, 18 nt, Human
aaaagaagaaaaauggaa

SEQ ID NO: 1218546 - RNA, 19 nt, Human
aaaccacuuggaggccagg

SEQ ID NO: 1218547 - RNA, 22 nt, Human
aaacuuccccugcaaccaccca

SEQ ID NO: 1218548 - RNA, 20 nt, Human
aaccacuuggaggccaggca

SEQ ID NO: 1218549 - RNA, 22 nt, Human
aaccugcaccaggaggggcggg

SEQ ID NO: 1218550 - RNA, 18 nt, Human
aagaagaaaaauggaaca

SEQ ID NO: 1218551 - RNA, 21 nt, Human
aagguaaaaauuucugcacuu

SEQ ID NO: 1218552 - RNA, 18 nt, Human
aauaagucaucagccacc

SEQ ID NO: 1218553 - RNA, 23 nt, Human
acagccccuuuccucugucccuu

SEQ ID NO: 1218554 - RNA, 18 nt, Human
acaggggugaaggggcug

SEQ ID NO: 1218555 - RNA, 23 nt, Human
acaguguccugcccugaagcugg

SEQ ID NO: 1218556 - RNA, 23 nt, Human
acaucaucucucuggaccagccc

SEQ ID NO: 1218557 - RNA, 18 nt, Human
accacccacccucccccu

SEQ ID NO: 1218558 - RNA, 20 nt, Human
accccaagccuccagguggc

SEQ ID NO: 1218559 - RNA, 23 nt, Human
acccucacugucacaaggccucu

SEQ ID NO: 1218560 - RNA, 18 nt, Human
acccugccuugccucagc

SEQ ID NO: 1218561 - RNA, 23 nt, Human
acccuggcugcccccaggccucc

SEQ ID NO: 1218562 - RNA, 19 nt, Human
accuggugcugcucucugc

SEQ ID NO: 1218563 - RNA, 26 nt, Human
accuuggcagacccugagggcagcug

SEQ ID NO: 1218564 - RNA, 22 nt, Human
acucgcagcccagggccuccag

SEQ ID NO: 1218565 - RNA, 18 nt, Human
acugcucuguggcugggc

SEQ ID NO: 1218566 - RNA, 26 nt, Human
acuuagcacucucccugcugaccccc

SEQ ID NO: 1218567 - RNA, 26 nt, Human
agaagaaaaauggaacaggggugaag

SEQ ID NO: 1218568 - RNA, 18 nt, Human
agagggcaagggugagag

SEQ ID NO: 1218569 - RNA, 18 nt, Human
agcaggaguguggcugcg

SEQ ID NO: 1218570 - RNA, 24 nt, Human
agccggcccuucucucccagcaca

SEQ ID NO: 1218571 - RNA, 20 nt, Human
agccuggagcucccgggcuc

SEQ ID NO: 1218572 - RNA, 20 nt, Human
agccugggccucucuugcag

SEQ ID NO: 1218573 - RNA, 19 nt, Human
agcuaccuaaaacuucccc

SEQ ID NO: 1218574 - RNA, 21 nt, Human
agcuaccuaaaacuuccccug

SEQ ID NO: 1218575 - RNA, 23 nt, Human
agcuccucucagcugucaccccg

SEQ ID NO: 1218576 - RNA, 21 nt, Human
agcugggcuggguccugagca

SEQ ID NO: 1218577 - RNA, 23 nt, Human
aggaagcgcugccgccggaccug

SEQ ID NO: 1218578 - RNA, 24 nt, Human
aggacccuguggugagccaggucu

SEQ ID NO: 1218579 - RNA, 18 nt, Human
aggacucccuaagcccgg

SEQ ID NO: 1218580 - RNA, 23 nt, Human
aggccccagggucccagggggug

SEQ ID NO: 1218581 - RNA, 24 nt, Human
aggcugaggguccacauguggcug

SEQ ID NO: 1218582 - RNA, 19 nt, Human
agggaacccggcccugggc

SEQ ID NO: 1218583 - RNA, 19 nt, Human
agggcagcugccuggccug

SEQ ID NO: 1218584 - RNA, 18 nt, Human
agggccccucugcugcug

SEQ ID NO: 1218585 - RNA, 19 nt, Human
aggggcggggccuguagug

SEQ ID NO: 1218586 - RNA, 24 nt, Human
aguaggacccuguggugagccagg

SEQ ID NO: 1218587 - RNA, 18 nt, Human
aguggguugggccagaga

SEQ ID NO: 1218588 - RNA, 21 nt, Human
aguguccgauccccaggcagc

SEQ ID NO: 1218589 - RNA, 24 nt, Human
augaggacagcuggggccucuccu

SEQ ID NO: 1218590 - RNA, 21 nt, Human
caaccacccacccucccccug

SEQ ID NO: 1218591 - RNA, 24 nt, Human
caaccacccacccucccccugagg

SEQ ID NO: 1218592 - RNA, 23 nt, Human
cacaggacuugagcuccucucag

SEQ ID NO: 1218593 - RNA, 20 nt, Human
cacaggcucguggcuguggg

SEQ ID NO: 1218594 - RNA, 24 nt, Human
cacaucaucucucuggaccagccc

SEQ ID NO: 1218595 - RNA, 22 nt, Human
caccccgccccagcccagggga

SEQ ID NO: 1218596 - RNA, 23 nt, Human
caccccgccccagcccaggggac

SEQ ID NO: 1218597 - RNA, 23 nt, Human
cacccugcugagcugugacaacc

SEQ ID NO: 1218598 - RNA, 20 nt, Human
caccgacaugguaaguugcu

SEQ ID NO: 1218599 - RNA, 23 nt, Human
caccgcaggcugcgggccgggcg

SEQ ID NO: 1218600 - RNA, 21 nt, Human
caccuggcacggcacacucac

SEQ ID NO: 1218601 - RNA, 18 nt, Human
caccuuggcagacccuga

SEQ ID NO: 1218602 - RNA, 21 nt, Human
cagaaaaacccugauccuuga

SEQ ID NO: 1218603 - RNA, 20 nt, Human
cagaacaagagauucuaccc

SEQ ID NO: 1218604 - RNA, 23 nt, Human
cagaagccugaggccccaggguc

SEQ ID NO: 1218605 - RNA, 25 nt, Human
cagaagccugaggccccaggguccc

SEQ ID NO: 1218606 - RNA, 18 nt, Human
cagcacaggaaccgccag

SEQ ID NO: 1218607 - RNA, 24 nt, Human
cagccaucugccagccagaagccc

SEQ ID NO: 1218608 - RNA, 21 nt, Human
cagcccagggccuccagggcc

SEQ ID NO: 1218609 - RNA, 18 nt, Human
cagcgaccuccgcccacc

SEQ ID NO: 1218610 - RNA, 22 nt, Human
cagggacagggugggacaggga

SEQ ID NO: 1218611 - RNA, 23 nt, Human
cagggcagagccccauggagcuc

SEQ ID NO: 1218612 - RNA, 20 nt, Human
cagggccagcgcgugcaccc

SEQ ID NO: 1218613 - RNA, 18 nt, Human
cagggccucgguuuuucc

SEQ ID NO: 1218614 - RNA, 23 nt, Human
caguggaacugccuucuugggcu

SEQ ID NO: 1218615 - RNA, 19 nt, Human
caguggguugggccagaga

SEQ ID NO: 1218616 - RNA, 20 nt, Human
cagugugguggggacugccc

SEQ ID NO: 1218617 - RNA, 21 nt, Human
cagugugguggggacugcccu

SEQ ID NO: 1218618 - RNA, 20 nt, Human
cauccggggcaccaaggagc

SEQ ID NO: 1218619 - RNA, 21 nt, Human
caugggccguguccuuccggg

SEQ ID NO: 1218620 - RNA, 22 nt, Human
ccacaccccaagccuccaggug

SEQ ID NO: 1218621 - RNA, 23 nt, Human
ccacaccccaagccuccaggugg

SEQ ID NO: 1218622 - RNA, 25 nt, Human
ccacccaggcugaggguccacaugu

SEQ ID NO: 1218623 - RNA, 19 nt, Human
ccacuucccuccaguaccc

SEQ ID NO: 1218624 - RNA, 21 nt, Human
ccagaagccccucuucuccca

SEQ ID NO: 1218625 - RNA, 23 nt, Human
ccagaagccugaggccccagggu

SEQ ID NO: 1218626 - RNA, 19 nt, Human
ccagcgcgugcacccugcc

SEQ ID NO: 1218627 - RNA, 23 nt, Human
ccagguggggccgggcggugguc

SEQ ID NO: 1218628 - RNA, 21 nt, Human
ccagugucugacacacgcaug

SEQ ID NO: 1218629 - RNA, 23 nt, Human
ccaucauuggcgugcaccuggac

SEQ ID NO: 1218630 - RNA, 23 nt, Human
cccacaaggagcucacguucugg

SEQ ID NO: 1218631 - RNA, 22 nt, Human
cccaccugccuucccgcccgcc

SEQ ID NO: 1218632 - RNA, 23 nt, Human
cccagccccugcugggacugcac

SEQ ID NO: 1218633 - RNA, 19 nt, Human
ccccaagccuccagguggc

SEQ ID NO: 1218634 - RNA, 21 nt, Human
ccccaccugccuucccgcccg

SEQ ID NO: 1218635 - RNA, 18 nt, Human
ccccagcagucgcgagcc

SEQ ID NO: 1218636 - RNA, 20 nt, Human
ccccagcagucgcgagccuc

SEQ ID NO: 1218637 - RNA, 19 nt, Human
cccccaggccuccuccacc

SEQ ID NO: 1218638 - RNA, 21 nt, Human
cccccaggccuccuccaccac

SEQ ID NO: 1218639 - RNA, 21 nt, Human
cccccugguccauucagcccc

SEQ ID NO: 1218640 - RNA, 19 nt, Human
ccccugaggucagaccugc

SEQ ID NO: 1218641 - RNA, 21 nt, Human
ccccugaggucagaccugcuc

SEQ ID NO: 1218642 - RNA, 22 nt, Human
ccccugcaaccacccacccucc

SEQ ID NO: 1218643 - RNA, 25 nt, Human
ccccugcaaccacccacccuccccc

SEQ ID NO: 1218644 - RNA, 25 nt, Human
ccccuggguggcccccacacagucu

SEQ ID NO: 1218645 - RNA, 24 nt, Human
ccccuucccugccugggguucagg

SEQ ID NO: 1218646 - RNA, 20 nt, Human
cccgcacuucuaggcagugg

SEQ ID NO: 1218647 - RNA, 19 nt, Human
cccgccccagcccagggga

SEQ ID NO: 1218648 - RNA, 19 nt, Human
cccucaacccucacuguca

SEQ ID NO: 1218649 - RNA, 18 nt, Human
cccugagggcagcugccu

SEQ ID NO: 1218650 - RNA, 19 nt, Human
cccugcuccagccagggag

SEQ ID NO: 1218651 - RNA, 18 nt, Human
cccuggagcugccuucug

SEQ ID NO: 1218652 - RNA, 18 nt, Human
cccuguggcuucuccugg

SEQ ID NO: 1218653 - RNA, 18 nt, Human
cccuucuuucucuguccc

SEQ ID NO: 1218654 - RNA, 26 nt, Human
cccuuuccucugucccuucuuucucu

SEQ ID NO: 1218655 - RNA, 24 nt, Human
ccgcccaccccagcagucgcgagc

SEQ ID NO: 1218656 - RNA, 20 nt, Human
ccgcgcccucugccuggccc

SEQ ID NO: 1218657 - RNA, 21 nt, Human
ccggcagcccagccccgcgcc

SEQ ID NO: 1218658 - RNA, 19 nt, Human
ccggcccuucucucccagc

SEQ ID NO: 1218659 - RNA, 21 nt, Human
ccgggcuccugacucaggggg

SEQ ID NO: 1218660 - RNA, 20 nt, Human
ccuaacuugcucugcaugcu

SEQ ID NO: 1218661 - RNA, 22 nt, Human
ccucacaggcucguggcugugg

SEQ ID NO: 1218662 - RNA, 23 nt, Human
ccuccagaaaggacaguguccug

SEQ ID NO: 1218663 - RNA, 22 nt, Human
ccuccagguggcaguggggccc

SEQ ID NO: 1218664 - RNA, 21 nt, Human
ccucccuuccagguguggcag

SEQ ID NO: 1218665 - RNA, 18 nt, Human
ccucucagcugucacccc

SEQ ID NO: 1218666 - RNA, 23 nt, Human
ccugagccccaggucuuguggga

SEQ ID NO: 1218667 - RNA, 24 nt, Human
ccugcagggcuggccuagcaggga

SEQ ID NO: 1218668 - RNA, 20 nt, Human
ccugcagugcaggugcucag

SEQ ID NO: 1218669 - RNA, 20 nt, Human
ccugccuugucuguggggug

SEQ ID NO: 1218670 - RNA, 19 nt, Human
ccugcgccagcugcggcca

SEQ ID NO: 1218671 - RNA, 23 nt, Human
ccuggccccuguuccuagauggu

SEQ ID NO: 1218672 - RNA, 24 nt, Human
ccugggaggggugggcuccucucc

SEQ ID NO: 1218673 - RNA, 19 nt, Human
ccugggggccccugcaggg

SEQ ID NO: 1218674 - RNA, 20 nt, Human
ccugguccauucagccccug

SEQ ID NO: 1218675 - RNA, 22 nt, Human
ccuugggaguccccuacugcuu

SEQ ID NO: 1218676 - RNA, 19 nt, Human
cgaggccaggaaccugaag

SEQ ID NO: 1218677 - RNA, 19 nt, Human
cgccagcugcggccagacu

SEQ ID NO: 1218678 - RNA, 24 nt, Human
cgcgggcguguccacaggccaggc

SEQ ID NO: 1218679 - RNA, 19 nt, Human
cgggcuccagcagcagcag

SEQ ID NO: 1218680 - RNA, 19 nt, Human
cggggcaccaaggagcugg

SEQ ID NO: 1218681 - RNA, 22 nt, Human
cggggccuguagugggcacugg

SEQ ID NO: 1218682 - RNA, 20 nt, Human
cgggggagauccagggcacc

SEQ ID NO: 1218683 - RNA, 20 nt, Human
cuaacuugcucugcaugcug

SEQ ID NO: 1218684 - RNA, 19 nt, Human
cuccaguaccugugcugcc

SEQ ID NO: 1218685 - RNA, 21 nt, Human
cucccagaagccugaggcccc

SEQ ID NO: 1218686 - RNA, 22 nt, Human
cucccaggccucacugccccuc

SEQ ID NO: 1218687 - RNA, 24 nt, Human
cucccugccccacuuccagcuacc

SEQ ID NO: 1218688 - RNA, 24 nt, Human
cuccgcccaccccagcagucgcga

SEQ ID NO: 1218689 - RNA, 18 nt, Human
cuccggcagcccagcccc

SEQ ID NO: 1218690 - RNA, 20 nt, Human
cuccucugagugaggacucc

SEQ ID NO: 1218691 - RNA, 20 nt, Human
cucucagggcugccccagcc

SEQ ID NO: 1218692 - RNA, 22 nt, Human
cucucugcugucacagcucccc

SEQ ID NO: 1218693 - RNA, 22 nt, Human
cucugagugaggacucccuaag

SEQ ID NO: 1218694 - RNA, 25 nt, Human
cucuggaccagcccucaacccucac

SEQ ID NO: 1218695 - RNA, 23 nt, Human
cucugggcaggugggguggaccu

SEQ ID NO: 1218696 - RNA, 21 nt, Human
cugcaaccacccacccucccc

SEQ ID NO: 1218697 - RNA, 24 nt, Human
cugccccagccugggccucucuug

SEQ ID NO: 1218698 - RNA, 22 nt, Human
cugccuugucuguggggugggg

SEQ ID NO: 1218699 - RNA, 20 nt, Human
cugcucucugcugucacagc

SEQ ID NO: 1218700 - RNA, 23 nt, Human
cugcucucugcugucacagcucc

SEQ ID NO: 1218701 - RNA, 24 nt, Human
cuggacaccuggcacggcacacuc

SEQ ID NO: 1218702 - RNA, 19 nt, Human
cuggaccagcccucaaccc

SEQ ID NO: 1218703 - RNA, 21 nt, Human
cuggccccuucccugccuggg

SEQ ID NO: 1218704 - RNA, 21 nt, Human
cuggccccuucccugccuggg

SEQ ID NO: 1218705 - RNA, 23 nt, Human
cuggccucgcagggucauggcug

SEQ ID NO: 1218706 - RNA, 18 nt, Human
cuggucuguccccaaggc

SEQ ID NO: 1218707 - RNA, 22 nt, Human
cugucccuucuuucucuguccc

SEQ ID NO: 1218708 - RNA, 19 nt, Human
cuguggcugggccuccagg

SEQ ID NO: 1218709 - RNA, 18 nt, Human
gacagggaggaggcuggg

SEQ ID NO: 1218710 - RNA, 24 nt, Human
gagcgguaccacagguaggcaucc

SEQ ID NO: 1218711 - RNA, 18 nt, Human
gagcucacguucuggugg

SEQ ID NO: 1218712 - RNA, 20 nt, Human
gaggacucccuaagcccggu

SEQ ID NO: 1218713 - RNA, 18 nt, Human
gaggaggccaagaaucag

SEQ ID NO: 1218714 - RNA, 19 nt, Human
gcaccggcgucuuccagga

SEQ ID NO: 1218715 - RNA, 23 nt, Human
gcagccaccaagcugcagaacaa

SEQ ID NO: 1218716 - RNA, 19 nt, Human
gcagcccaggugaucugac

SEQ ID NO: 1218717 - RNA, 18 nt, Human
gcaggagguaggcagugg

SEQ ID NO: 1218718 - RNA, 19 nt, Human
gcaggcugcgggccgggcg

SEQ ID NO: 1218719 - RNA, 24 nt, Human
gccacaccccaagccuccaggugg

SEQ ID NO: 1218720 - RNA, 23 nt, Human
gccacacuccagggcggaguugg

SEQ ID NO: 1218721 - RNA, 18 nt, Human
gccacaggccccccgcca

SEQ ID NO: 1218722 - RNA, 18 nt, Human
gcccagggccuccagggc

SEQ ID NO: 1218723 - RNA, 18 nt, Human
gcccagggccuccagggc

SEQ ID NO: 1218724 - RNA, 27 nt, Human
gcccagggugcuucuggggaaccuggc

SEQ ID NO: 1218725 - RNA, 19 nt, Human
gcccuugacccccaccuug

SEQ ID NO: 1218726 - RNA, 24 nt, Human
gcgaggcgcuucagcaccugcucc

SEQ ID NO: 1218727 - RNA, 19 nt, Human
gcucagguaacaggaaggu

SEQ ID NO: 1218728 - RNA, 20 nt, Human
gcucaguucugugcccgggc

SEQ ID NO: 1218729 - RNA, 21 nt, Human
gcuccggccgcagcagccgca

SEQ ID NO: 1218730 - RNA, 22 nt, Human
gcugcugagcuccccuggggcc

SEQ ID NO: 1218731 - RNA, 23 nt, Human
gcuggccccuucccugccugggg

SEQ ID NO: 1218732 - RNA, 25 nt, Human
gcugggacagccccuuuccucuguu

SEQ ID NO: 1218733 - RNA, 22 nt, Human
gcugggccccucccuuccaggu

SEQ ID NO: 1218734 - RNA, 18 nt, Human
gcugggccuccagggccc

SEQ ID NO: 1218735 - RNA, 21 nt, Human
ggacagagggcaagggugaga

SEQ ID NO: 1218736 - RNA, 22 nt, Human
ggacagugaggccaggcuggag

SEQ ID NO: 1218737 - RNA, 19 nt, Human
ggcaguggcuucagucuuu

SEQ ID NO: 1218738 - RNA, 23 nt, Human
ggccaggcuggaguggcagggcc

SEQ ID NO: 1218739 - RNA, 22 nt, Human
ggcccuggagcugccuucuggu

SEQ ID NO: 1218740 - RNA, 23 nt, Human
ggccgggcgcuggggcucgaugc

SEQ ID NO: 1218741 - RNA, 20 nt, Human
ggcgcagugaggcugggagg

SEQ ID NO: 1218742 - RNA, 21 nt, Human
ggcggggccgagccuggagcu

SEQ ID NO: 1218743 - RNA, 19 nt, Human
ggcucacugcgacccuggc

SEQ ID NO: 1218744 - RNA, 23 nt, Human
ggcugaggguccacauguggcug

SEQ ID NO: 1218745 - RNA, 18 nt, Human
ggcugcagcugggccugg

SEQ ID NO: 1218746 - RNA, 23 nt, Human
ggcugcccugagccccaggucuu

SEQ ID NO: 1218747 - RNA, 18 nt, Human
ggcuggaguggcagggcc

SEQ ID NO: 1218748 - RNA, 18 nt, Human
gggcaccaaggagcuggg

SEQ ID NO: 1218749 - RNA, 33 nt, Human
gggcaggagguaggcaguggcuucagucuuucu

SEQ ID NO: 1218750 - RNA, 20 nt, Human
gggcagggaugaggacagcu

SEQ ID NO: 1218751 - RNA, 19 nt, Human
gggccuccagggcccuccu

SEQ ID NO: 1218752 - RNA, 21 nt, Human
gggcuccagcagcagcagcaa

SEQ ID NO: 1218753 - RNA, 20 nt, Human
gggcugccccagccugggcc

SEQ ID NO: 1218754 - RNA, 18 nt, Human
ggggcacagcccugcugc

SEQ ID NO: 1218755 - RNA, 21 nt, Human
ggggcaccaaggagcuggggg

SEQ ID NO: 1218756 - RNA, 24 nt, Human
ggggccgagccuggagcucccggg

SEQ ID NO: 1218757 - RNA, 18 nt, Human
ggggugggcagggcagag

SEQ ID NO: 1218758 - RNA, 23 nt, Human
ggguggcugcagcugggccuggu

SEQ ID NO: 1218759 - RNA, 24 nt, Human
gggugguggccuugccugggggcc

SEQ ID NO: 1218760 - RNA, 22 nt, Human
gguccauucagccccugggugg

SEQ ID NO: 1218761 - RNA, 19 nt, Human
gucugcagcccaggugauc

SEQ ID NO: 1218762 - RNA, 20 nt, Human
gucugugggguggggccauc

SEQ ID NO: 1218763 - RNA, 23 nt, Human
gugaagcaaaagaagaaaaaugg

SEQ ID NO: 1218764 - RNA, 24 nt, Human
gugaagcaaaagaagaaaaaugga

SEQ ID NO: 1218765 - RNA, 18 nt, Human
gugaaggggcuggagaag

SEQ ID NO: 1218766 - RNA, 24 nt, Human
gugacagggaggaggcugggaggg

SEQ ID NO: 1218767 - RNA, 19 nt, Human
gugaucugacaugcuugug

SEQ ID NO: 1218768 - RNA, 19 nt, Human
gugcucaguucugugcccg

SEQ ID NO: 1218769 - RNA, 23 nt, Human
gugguggggacugcccugaggcc

SEQ ID NO: 1218770 - RNA, 21 nt, Human
guugggagggagccugggcug

SEQ ID NO: 1218771 - RNA, 21 nt, Human
uaacaggaaggucguugggcc

SEQ ID NO: 1218772 - RNA, 19 nt, Human
uacacaacaagcugggcug

SEQ ID NO: 1218773 - RNA, 21 nt, Human
uacacaacaagcugggcuggg

SEQ ID NO: 1218774 - RNA, 21 nt, Human
uaccuaaaacuuccccugcaa

SEQ ID NO: 1218775 - RNA, 23 nt, Human
ucacugccccuccacauccuugg

SEQ ID NO: 1218776 - RNA, 21 nt, Human
ucagcaccugcuccggccgca

SEQ ID NO: 1218777 - RNA, 20 nt, Human
ucagccccuggguggccccc

SEQ ID NO: 1218778 - RNA, 21 nt, Human
ucagcgaggccaggaaccuga

SEQ ID NO: 1218779 - RNA, 21 nt, Human
ucagguguuugucugucugca

SEQ ID NO: 1218780 - RNA, 23 nt, Human
ucagucuuucuccuucuccaggg

SEQ ID NO: 1218781 - RNA, 20 nt, Human
ucagugaagcaaaagaagaa

SEQ ID NO: 1218782 - RNA, 19 nt, Human
ucauggcugugggacgcgg

SEQ ID NO: 1218783 - RNA, 24 nt, Human
uccacaccaucucagcucugggca

SEQ ID NO: 1218784 - RNA, 20 nt, Human
uccaccgucuagaaaccacu

SEQ ID NO: 1218785 - RNA, 19 nt, Human
uccacgcacaccgcgaggc

SEQ ID NO: 1218786 - RNA, 20 nt, Human
uccacgcacaccgcgaggcg

SEQ ID NO: 1218787 - RNA, 24 nt, Human
uccacgcacaccgcgaggcgcuuc

SEQ ID NO: 1218788 - RNA, 23 nt, Human
uccacgcugccgccauccauccc

SEQ ID NO: 1218789 - RNA, 23 nt, Human
uccagaaaggacaguguccugcc

SEQ ID NO: 1218790 - RNA, 22 nt, Human
uccagggcggaguuggaugagg

SEQ ID NO: 1218791 - RNA, 19 nt, Human
ucccagaagccugaggccu

SEQ ID NO: 1218792 - RNA, 23 nt, Human
uccccaggcagcgaccuccgccc

SEQ ID NO: 1218793 - RNA, 23 nt, Human
uccccugcaaccacccacccucc

SEQ ID NO: 1218794 - RNA, 23 nt, Human
ucccgaggcugggacaguccuuu

SEQ ID NO: 1218795 - RNA, 23 nt, Human
ucccgggcucucgcggcggccuc

SEQ ID NO: 1218796 - RNA, 18 nt, Human
ucccuggaggccuggacc

SEQ ID NO: 1218797 - RNA, 19 nt, Human
ucccuggaggccuggaccc

SEQ ID NO: 1218798 - RNA, 21 nt, Human
ucccuggaggccuggaccccc

SEQ ID NO: 1218799 - RNA, 21 nt, Human
uccgcccaccccagcagucgg

SEQ ID NO: 1218800 - RNA, 20 nt, Human
uccgugcagaggccgggcuu

SEQ ID NO: 1218801 - RNA, 19 nt, Human
uccuuccagccacacucca

SEQ ID NO: 1218802 - RNA, 22 nt, Human
ucggcaccggcgucuuccagga

SEQ ID NO: 1218803 - RNA, 28 nt, Human
ucguugggccacagugugguggggacug

SEQ ID NO: 1218804 - RNA, 21 nt, Human
ucucuccuggccucgcagggu

SEQ ID NO: 1218805 - RNA, 21 nt, Human
ucucuggaccagcccucaacc

SEQ ID NO: 1218806 - RNA, 22 nt, Human
ucucuggaccagcccucaaccc

SEQ ID NO: 1218807 - RNA, 24 nt, Human
ucuguccccaaggcugcaugcugu

SEQ ID NO: 1218808 - RNA, 22 nt, Human
ucugucccuucuuucucuguug

SEQ ID NO: 1218809 - RNA, 23 nt, Human
ucuguggcugggccuccagggcc

SEQ ID NO: 1218810 - RNA, 20 nt, Human
ucuguugugggcaggagguu

SEQ ID NO: 1218811 - RNA, 21 nt, Human
ucuuccaggauggcugugucc

SEQ ID NO: 1218812 - RNA, 24 nt, Human
ucuuucuccuucuccagggaaccc

SEQ ID NO: 1218813 - RNA, 22 nt, Human
ugacagccagguggggccgggc

SEQ ID NO: 1218814 - RNA, 21 nt, Human
ugacagggaggaggcugggag

SEQ ID NO: 1218815 - RNA, 20 nt, Human
ugacccccugguccauucag

SEQ ID NO: 1218816 - RNA, 25 nt, Human
ugacccccugguccauucagccccu

SEQ ID NO: 1218817 - RNA, 21 nt, Human
ugaggccccagggucccagaa

SEQ ID NO: 1218818 - RNA, 21 nt, Human
ugaggcugggagggguggggg

SEQ ID NO: 1218819 - RNA, 23 nt, Human
ugaggcugggagggguggggguc

SEQ ID NO: 1218820 - RNA, 21 nt, Human
ugcaggugcucaguucugugc

SEQ ID NO: 1218821 - RNA, 24 nt, Human
ugcaugcugucagcggcugccccg

SEQ ID NO: 1218822 - RNA, 19 nt, Human
ugccacaggccccccgcca

SEQ ID NO: 1218823 - RNA, 25 nt, Human
ugccccagccugggccucucuugca

SEQ ID NO: 1218824 - RNA, 19 nt, Human
ugcccccaggccuccucca

SEQ ID NO: 1218825 - RNA, 20 nt, Human
ugcccccaggccuccuccac

SEQ ID NO: 1218826 - RNA, 22 nt, Human
ugcccugagccccaggucuugu

SEQ ID NO: 1218827 - RNA, 20 nt, Human
ugccugagccucacaggcuc

SEQ ID NO: 1218828 - RNA, 18 nt, Human
ugccugggggccccugca

SEQ ID NO: 1218829 - RNA, 19 nt, Human
ugccugggggccccugcag

SEQ ID NO: 1218830 - RNA, 22 nt, Human
ugccuucccgcccgccuccagc

SEQ ID NO: 1218831 - RNA, 23 nt, Human
ugccuugccucagcugugccagc

SEQ ID NO: 1218832 - RNA, 20 nt, Human
ugcgggccgggcgcuggggc

SEQ ID NO: 1218833 - RNA, 27 nt, Human
ugcgugaggcccaggguggggcggggc

SEQ ID NO: 1218834 - RNA, 22 nt, Human
ugcucagcgaggccaggaaccu

SEQ ID NO: 1218835 - RNA, 19 nt, Human
ugcugggacugcacugcgg

SEQ ID NO: 1218836 - RNA, 20 nt, Human
ugcugggcagagcgaggccu

SEQ ID NO: 1218837 - RNA, 19 nt, Human
uggaacaggggugaagggg

SEQ ID NO: 1218838 - RNA, 20 nt, Human
uggaacaggggugaaggggc

SEQ ID NO: 1218839 - RNA, 19 nt, Human
uggacaaauaccgccacac

SEQ ID NO: 1218840 - RNA, 22 nt, Human
uggaggccuggacccccauccu

SEQ ID NO: 1218841 - RNA, 19 nt, Human
uggcuucagucuuucuccu

SEQ ID NO: 1218842 - RNA, 23 nt, Human
ugggacagccccuuuccucuguc

SEQ ID NO: 1218843 - RNA, 18 nt, Human
ugggacagggacagaggg

SEQ ID NO: 1218844 - RNA, 20 nt, Human
ugggcagagcgaggccuccu

SEQ ID NO: 1218845 - RNA, 27 nt, Human
ugggcaggugggguggaccuggggcuu

SEQ ID NO: 1218846 - RNA, 18 nt, Human
ugggggccccugcagggc

SEQ ID NO: 1218847 - RNA, 22 nt, Human
ugggggccccugcagggcuggc

SEQ ID NO: 1218848 - RNA, 24 nt, Human
ugggggccccugcaggggggacac

SEQ ID NO: 1218849 - RNA, 21 nt, Human
uggggggugauuucccagucg

SEQ ID NO: 1218850 - RNA, 22 nt, Human
ugggguggggccauccccucca

SEQ ID NO: 1218851 - RNA, 23 nt, Human
ugggguggggccauccccuccag

SEQ ID NO: 1218852 - RNA, 19 nt, Human
ugguggcgcccaugucaug

SEQ ID NO: 1218853 - RNA, 20 nt, Human
uggugggaggaggccaagaa

SEQ ID NO: 1218854 - RNA, 23 nt, Human
uggugugcuccacggcggcccgg

SEQ ID NO: 1218855 - RNA, 18 nt, Human
ugucacaaggccucugcc

SEQ ID NO: 1218856 - RNA, 18 nt, Human
uguggcuggggguccucc

SEQ ID NO: 1218857 - RNA, 22 nt, Human
ugugguggggacugcccugagg

SEQ ID NO: 1218858 - RNA, 24 nt, Human
ugugguggggacugcccugaggcc

SEQ ID NO: 1218859 - RNA, 20 nt, Human
uguguuaaaaaacaaacaaa

SEQ ID NO: 1218860 - RNA, 18 nt, Human
uuaaaggacugcaauaaa

SEQ ID NO: 1218861 - RNA, 20 nt, Human
uuagcacucucccugcugac

SEQ ID NO: 1218862 - RNA, 21 nt, Human
uuccaggauggcuguguccac

SEQ ID NO: 1218863 - RNA, 26 nt, Human
uuccugggugggucagggacagggug

SEQ ID NO: 1218864 - RNA, 19 nt, Human
uuccuguucaccugcagcc

SEQ ID NO: 1218865 - RNA, 22 nt, Human
uucggcccagggugcuucuggg

SEQ ID NO: 1218866 - RNA, 20 nt, Human
uucuccagggaacccggccc

SEQ ID NO: 1218867 - RNA, 23 nt, Human
uuggaugaggcccguccggaggg

SEQ ID NO: 1218868 - RNA, 22 nt, Human
uuuccugagaucucccucggac

SEQ ID NO: 1218869 - RNA, 18 nt, Human
uuuccugggugggucagg

SEQ ID NO: 1218870 - RNA, 18 nt, Human
aagcccagggcccagcac

SEQ ID NO: 1218871 - RNA, 21 nt, Human
accccacagggcgcccguggg

SEQ ID NO: 1218872 - RNA, 24 nt, Human
aggaagcccuggaccgggaccucc

SEQ ID NO: 1218873 - RNA, 24 nt, Human
aggcaagaauggcgcugggaucug

SEQ ID NO: 1218874 - RNA, 20 nt, Human
agggaggacccaggaccacu

SEQ ID NO: 1218875 - RNA, 21 nt, Human
aggucauacugugugcuggga

SEQ ID NO: 1218876 - RNA, 23 nt, Human
agguguccaguugcucccggaac

SEQ ID NO: 1218877 - RNA, 19 nt, Human
aguugcucccggaacuggg

SEQ ID NO: 1218878 - RNA, 19 nt, Human
augcugggccccaggccgg

SEQ ID NO: 1218879 - RNA, 21 nt, Human
caaagcccagggcccagcaca

SEQ ID NO: 1218880 - RNA, 25 nt, Human
caaagcccagggcccagcacaggcc

SEQ ID NO: 1218881 - RNA, 22 nt, Human
caaagcccagggccuggaacac

SEQ ID NO: 1218882 - RNA, 21 nt, Human
cacacagcucucucaggccag

SEQ ID NO: 1218883 - RNA, 23 nt, Human
cacaccccacagggcgcccgugg

SEQ ID NO: 1218884 - RNA, 19 nt, Human
cacagcucacagggccccu

SEQ ID NO: 1218885 - RNA, 18 nt, Human
cagcagcgcccccguggc

SEQ ID NO: 1218886 - RNA, 22 nt, Human
cagccacccugcggaagagcuu

SEQ ID NO: 1218887 - RNA, 24 nt, Human
cagcugcccucugggggcaucaag

SEQ ID NO: 1218888 - RNA, 19 nt, Human
cagcugcuccuggaaccaa

SEQ ID NO: 1218889 - RNA, 22 nt, Human
cauacugugugcugggaccggg

SEQ ID NO: 1218890 - RNA, 23 nt, Human
ccaggaccacuugagagcagcag

SEQ ID NO: 1218891 - RNA, 23 nt, Human
ccaggaggagggcagcccuggcc

SEQ ID NO: 1218892 - RNA, 23 nt, Human
ccagggccuggaacacguccucc

SEQ ID NO: 1218893 - RNA, 21 nt, Human
ccaguugcucccggaacuggg

SEQ ID NO: 1218894 - RNA, 22 nt, Human
cccagggcccagcacaggcccc

SEQ ID NO: 1218895 - RNA, 24 nt, Human
ccccagcgccuccacgucaugcug

SEQ ID NO: 1218896 - RNA, 22 nt, Human
cccccacgcugccacgccucgc

SEQ ID NO: 1218897 - RNA, 21 nt, Human
cccccagcgccuccacgucau

SEQ ID NO: 1218898 - RNA, 23 nt, Human
cccccugcggacucuucagccac

SEQ ID NO: 1218899 - RNA, 19 nt, Human
cccgcagggcccggcagcc

SEQ ID NO: 1218900 - RNA, 26 nt, Human
cccgugggcauccagcugcuccugga

SEQ ID NO: 1218901 - RNA, 19 nt, Human
ccggcagccgcucagcucc

SEQ ID NO: 1218902 - RNA, 20 nt, Human
ccucaaggagcuccgaagga

SEQ ID NO: 1218903 - RNA, 19 nt, Human
cgcucagcucccggaccag

SEQ ID NO: 1218904 - RNA, 19 nt, Human
cggccacacagcucucuca

SEQ ID NO: 1218905 - RNA, 24 nt, Human
cggggggaugggggguggauggag

SEQ ID NO: 1218906 - RNA, 20 nt, Human
cuccucucgcagcucucaaa

SEQ ID NO: 1218907 - RNA, 18 nt, Human
cucucagaugaggaaacc

SEQ ID NO: 1218908 - RNA, 23 nt, Human
cucucgcagcucucaaagcccag

SEQ ID NO: 1218909 - RNA, 18 nt, Human
cugggggcaucaaggcca

SEQ ID NO: 1218910 - RNA, 24 nt, Human
gaaccaagccaguuccucgaggaa

SEQ ID NO: 1218911 - RNA, 20 nt, Human
gaccacuugagagcagcagg

SEQ ID NO: 1218912 - RNA, 18 nt, Human
gaccagcugcuguggcug

SEQ ID NO: 1218913 - RNA, 20 nt, Human
gaccucccuccucucgcagc

SEQ ID NO: 1218914 - RNA, 25 nt, Human
gacuuuggggcagccccgcagggcc

SEQ ID NO: 1218915 - RNA, 25 nt, Human
gagagcagcaggaagacuuuggggc

SEQ ID NO: 1218916 - RNA, 20 nt, Human
gagcagcaggaagacuuugg

SEQ ID NO: 1218917 - RNA, 18 nt, Human
gauggaggcaagaauggc

SEQ ID NO: 1218918 - RNA, 27 nt, Human
gcccuggaccgggaccucccuccucuc

SEQ ID NO: 1218919 - RNA, 23 nt, Human
ggccaccgucucagcagcgcccc

SEQ ID NO: 1218920 - RNA, 21 nt, Human
gggaccagugaggagagcggc

SEQ ID NO: 1218921 - RNA, 23 nt, Human
gggcgcccgugggcauccagcug

SEQ ID NO: 1218922 - RNA, 18 nt, Human
ggggaugggggguggaug

SEQ ID NO: 1218923 - RNA, 20 nt, Human
gggggaugggggguggaugg

SEQ ID NO: 1218924 - RNA, 20 nt, Human
gguggauggaggcaagaaug

SEQ ID NO: 1218925 - RNA, 21 nt, Human
gucagcagcugcaccagggac

SEQ ID NO: 1218926 - RNA, 18 nt, Human
uaaggcacaccccacagg

SEQ ID NO: 1218927 - RNA, 18 nt, Human
uacugugugcugggaccg

SEQ ID NO: 1218928 - RNA, 23 nt, Human
ucacgguggucucaaagcccagg

SEQ ID NO: 1218929 - RNA, 23 nt, Human
ucagcagcgcccccguggccgcc

SEQ ID NO: 1218930 - RNA, 18 nt, Human
ucaggccagcaaggaagg

SEQ ID NO: 1218931 - RNA, 21 nt, Human
uccgggcuccagggaggaccc

SEQ ID NO: 1218932 - RNA, 18 nt, Human
ugaggaaaccggggggau

SEQ ID NO: 1218933 - RNA, 23 nt, Human
ugcaccagggaccagugaggaga

SEQ ID NO: 1218934 - RNA, 23 nt, Human
ugccucagcugcccucugggggc

SEQ ID NO: 1218935 - RNA, 23 nt, Human
uggaccgggaccucccuccucuc

SEQ ID NO: 1218936 - RNA, 21 nt, Human
uggaggcaagaauggcgcugg

SEQ ID NO: 1218937 - RNA, 20 nt, Human
uggauggaggcaagaauggc

SEQ ID NO: 1218938 - RNA, 20 nt, Human
ugggcauccagcugcuccug

SEQ ID NO: 1218939 - RNA, 19 nt, Human
ugggggguggauggaggca

SEQ ID NO: 1218940 - RNA, 23 nt, Human
uugcacggccacccccacgcuuu

SEQ ID NO: 1218941 - RNA, 19 nt, Human
uugcucccggaacugggcc

SEQ ID NO: 1218942 - RNA, 19 nt, Human
aaaaacaaacaaaaaaggc

SEQ ID NO: 1218943 - RNA, 24 nt, Human
aaacagcugucaaucuagaaaucu

SEQ ID NO: 1218944 - RNA, 20 nt, Human
aacagaguacccgucacccc

SEQ ID NO: 1218945 - RNA, 18 nt, Human
aacagcugcaggaauugg

SEQ ID NO: 1218946 - RNA, 19 nt, Human
aacaugaugaaaccccguc

SEQ ID NO: 1218947 - RNA, 20 nt, Human
aacaugaugaaaccccgucu

SEQ ID NO: 1218948 - RNA, 21 nt, Human
aacaugaugaaaccccgucuc

SEQ ID NO: 1218949 - RNA, 19 nt, Human
aacauggugaaaccccauc

SEQ ID NO: 1218950 - RNA, 20 nt, Human
aacauggugaaaccccaucu

SEQ ID NO: 1218951 - RNA, 21 nt, Human
aacauggugaaaccccaucuc

SEQ ID NO: 1218952 - RNA, 21 nt, Human
aacauggugaaaccccaucuc

SEQ ID NO: 1218953 - RNA, 19 nt, Human
aaccauuucagacagcuug

SEQ ID NO: 1218954 - RNA, 23 nt, Human
aagagcgagacuccaucucaaaa

SEQ ID NO: 1218955 - RNA, 26 nt, Human
aagagcgagacuccaucucaaaaaca

SEQ ID NO: 1218956 - RNA, 19 nt, Human
aagcugaucuucugaaugc

SEQ ID NO: 1218957 - RNA, 24 nt, Human
aagcuguugauguccauuuggauu

SEQ ID NO: 1218958 - RNA, 24 nt, Human
acaagaagaaauagaucccucuca

SEQ ID NO: 1218959 - RNA, 24 nt, Human
accccaucucuacuaaaaauacaa

SEQ ID NO: 1218960 - RNA, 24 nt, Human
accccgucucuacuaaaacuacaa

SEQ ID NO: 1218961 - RNA, 19 nt, Human
acccugaaaucuucuucuu

SEQ ID NO: 1218962 - RNA, 24 nt, Human
accugaggucaggaguucgagacc

SEQ ID NO: 1218963 - RNA, 19 nt, Human
accuugaaaguacuaaaac

SEQ ID NO: 1218964 - RNA, 21 nt, Human
acuaaaacagcugucaaucua

SEQ ID NO: 1218965 - RNA, 18 nt, Human
acugcacuccagccuggg

SEQ ID NO: 1218966 - RNA, 18 nt, Human
acugcacuccagccuggg

SEQ ID NO: 1218967 - RNA, 19 nt, Human
acugcacuccagccugggc

SEQ ID NO: 1218968 - RNA, 24 nt, Human
acugcacuccagccugggcgacaa

SEQ ID NO: 1218969 - RNA, 24 nt, Human
acugcacuccagccugggugacag

SEQ ID NO: 1218970 - RNA, 19 nt, Human
agacccaggggacucucag

SEQ ID NO: 1218971 - RNA, 24 nt, Human
agagccuacagugagcugagauca

SEQ ID NO: 1218972 - RNA, 23 nt, Human
agaguacccgucacccccugccu

SEQ ID NO: 1218973 - RNA, 22 nt, Human
agcacgcugcccagcagcucca

SEQ ID NO: 1218974 - RNA, 24 nt, Human
agcacuuugggaggcugagguggg

SEQ ID NO: 1218975 - RNA, 23 nt, Human
agccgggcaugguggcgggugcc

SEQ ID NO: 1218976 - RNA, 24 nt, Human
agccugaucaacauggugaaaccc

SEQ ID NO: 1218977 - RNA, 24 nt, Human
agccuggccaacaugaugaaaccc

SEQ ID NO: 1218978 - RNA, 25 nt, Human
agccugggcgacaagagcgagacuc

SEQ ID NO: 1218979 - RNA, 20 nt, Human
agcuggcucuggugugugcc

SEQ ID NO: 1218980 - RNA, 18 nt, Human
agcugggugugguggugc

SEQ ID NO: 1218981 - RNA, 23 nt, Human
agcugggugugguggugcgugcc

SEQ ID NO: 1218982 - RNA, 23 nt, Human
agcuugccugucuccauggaagc

SEQ ID NO: 1218983 - RNA, 19 nt, Human
aggcaggagaaucacauga

SEQ ID NO: 1218984 - RNA, 24 nt, Human
aggcaggagaaucacaugaacccg

SEQ ID NO: 1218985 - RNA, 23 nt, Human
aggcaggagaaucacuggaaccc

SEQ ID NO: 1218986 - RNA, 24 nt, Human
aggcggagguugcagggagcugag

SEQ ID NO: 1218987 - RNA, 24 nt, Human
aggcugaggcaggagaaucacaug

SEQ ID NO: 1218988 - RNA, 24 nt, Human
aggcugagguggguggaucacuug

SEQ ID NO: 1218989 - RNA, 22 nt, Human
aggcugauggaucaccugaggu

SEQ ID NO: 1218990 - RNA, 26 nt, Human
aggcugauggaucaccugaggucagg

SEQ ID NO: 1218991 - RNA, 19 nt, Human
aggggacucucaggugcca

SEQ ID NO: 1218992 - RNA, 24 nt, Human
agguagagccuacagugagcugag

SEQ ID NO: 1218993 - RNA, 24 nt, Human
aggugcaguggcucacaccuguaa

SEQ ID NO: 1218994 - RNA, 21 nt, Human
agguggcagcucaucucagag

SEQ ID NO: 1218995 - RNA, 23 nt, Human
agguggguggaucacuugagguc

SEQ ID NO: 1218996 - RNA, 24 nt, Human
aggugugguggcucaugccuguaa

SEQ ID NO: 1218997 - RNA, 24 nt, Human
aguggcucacaccuguaaucccag

SEQ ID NO: 1218998 - RNA, 24 nt, Human
aucaccugaggucaggaguucgag

SEQ ID NO: 1218999 - RNA, 24 nt, Human
aucaugccacugcacuccagccug

SEQ ID NO: 1219000 - RNA, 24 nt, Human
aucgugccacugcacuccagccug

SEQ ID NO: 1219001 - RNA, 24 nt, Human
aucuucaaagcgucugccagcgcc

SEQ ID NO: 1219002 - RNA, 21 nt, Human
augccacugcacuccagccug

SEQ ID NO: 1219003 - RNA, 19 nt, Human
augccuguaaucccaguac

SEQ ID NO: 1219004 - RNA, 24 nt, Human
caacaugaugaaaccccgucucua

SEQ ID NO: 1219005 - RNA, 22 nt, Human
caacauggugaaaccccaucuc

SEQ ID NO: 1219006 - RNA, 24 nt, Human
caacauggugaaaccccaucucua

SEQ ID NO: 1219007 - RNA, 24 nt, Human
caacuacuugggaggccgaggcag

SEQ ID NO: 1219008 - RNA, 20 nt, Human
caagaacaaaguccucggac

SEQ ID NO: 1219009 - RNA, 19 nt, Human
caagugauccaaauguucu

SEQ ID NO: 1219010 - RNA, 19 nt, Human
caaucuagaaaucucugcc

SEQ ID NO: 1219011 - RNA, 24 nt, Human
cacaccuguaaucccagcacuuug

SEQ ID NO: 1219012 - RNA, 20 nt, Human
cacaugaaguccucagggug

SEQ ID NO: 1219013 - RNA, 19 nt, Human
caccaguuuggcuccugag

SEQ ID NO: 1219014 - RNA, 23 nt, Human
caccugaggucaggaguucgaga

SEQ ID NO: 1219015 - RNA, 19 nt, Human
caccuguaaucccagcacu

SEQ ID NO: 1219016 - RNA, 24 nt, Human
caccuguaaucccagcacuuuggg

SEQ ID NO: 1219017 - RNA, 19 nt, Human
cacgcugcccagcagcucc

SEQ ID NO: 1219018 - RNA, 24 nt, Human
cacuccagccugggcgacaagagc

SEQ ID NO: 1219019 - RNA, 25 nt, Human
cacuccagccugggcgacaagagcg

SEQ ID NO: 1219020 - RNA, 18 nt, Human
cacuccagccugggugac

SEQ ID NO: 1219021 - RNA, 20 nt, Human
cacuccagccugggugacag

SEQ ID NO: 1219022 - RNA, 19 nt, Human
cacugcacuccagccuggg

SEQ ID NO: 1219023 - RNA, 19 nt, Human
cacugcacuccagccuggg

SEQ ID NO: 1219024 - RNA, 19 nt, Human
cacugcacuccagccuggg

SEQ ID NO: 1219025 - RNA, 19 nt, Human
cacugcacuccagccuggg

SEQ ID NO: 1219026 - RNA, 21 nt, Human
cacugcacuccagccugggcg

SEQ ID NO: 1219027 - RNA, 22 nt, Human
cacugcacuccagccugggcga

SEQ ID NO: 1219028 - RNA, 23 nt, Human
cacugcacuccagccugggcgac

SEQ ID NO: 1219029 - RNA, 24 nt, Human
cacugcacuccagccugggcgaca

SEQ ID NO: 1219030 - RNA, 22 nt, Human
cacugcacuccagccuggguga

SEQ ID NO: 1219031 - RNA, 24 nt, Human
cacugcacuccagccugggugaca

SEQ ID NO: 1219032 - RNA, 25 nt, Human
cacugcacuccagccugggugacag

SEQ ID NO: 1219033 - RNA, 20 nt, Human
cagaauaucugucaauuugg

SEQ ID NO: 1219034 - RNA, 23 nt, Human
cagacagagcaucaccuugaaag

SEQ ID NO: 1219035 - RNA, 21 nt, Human
cagacaggccccccagaaguc

SEQ ID NO: 1219036 - RNA, 22 nt, Human
cagcacgcugcccagcagcucc

SEQ ID NO: 1219037 - RNA, 24 nt, Human
cagcacuuugggaggcugaggugg

SEQ ID NO: 1219038 - RNA, 21 nt, Human
cagcaguggcuuuggaagccu

SEQ ID NO: 1219039 - RNA, 29 nt, Human
caggccuuuggccccuagucccuuggggg

SEQ ID NO: 1219040 - RNA, 20 nt, Human
caguacuuugggaggcccag

SEQ ID NO: 1219041 - RNA, 21 nt, Human
caguacuuugggaggcccagg

SEQ ID NO: 1219042 - RNA, 23 nt, Human
caucucaaaaacaaacaaaaaag

SEQ ID NO: 1219043 - RNA, 19 nt, Human
caugaaguccucagggugu

SEQ ID NO: 1219044 - RNA, 20 nt, Human
caugccuguaaucccaguac

SEQ ID NO: 1219045 - RNA, 24 nt, Human
caugccuguaaucccaguacuuug

SEQ ID NO: 1219046 - RNA, 20 nt, Human
cauuucaaauaauagugauc

SEQ ID NO: 1219047 - RNA, 19 nt, Human
ccaaacggaugcuccucac

SEQ ID NO: 1219048 - RNA, 20 nt, Human
ccacugcacuccagccuggg

SEQ ID NO: 1219049 - RNA, 20 nt, Human
ccacugcacuccagccuggg

SEQ ID NO: 1219050 - RNA, 20 nt, Human
ccacugcacuccagccuggg

SEQ ID NO: 1219051 - RNA, 21 nt, Human
ccacugcacuccagccugggc

SEQ ID NO: 1219052 - RNA, 21 nt, Human
ccacugcacuccagccugggc

SEQ ID NO: 1219053 - RNA, 24 nt, Human
ccacugcacuccagccugggcgac

SEQ ID NO: 1219054 - RNA, 21 nt, Human
ccacugcacuccagccugggu

SEQ ID NO: 1219055 - RNA, 21 nt, Human
ccacugcacuccagccugggu

SEQ ID NO: 1219056 - RNA, 24 nt, Human
ccacugcacuccagccugggugac

SEQ ID NO: 1219057 - RNA, 18 nt, Human
ccagacaacaugugccag

SEQ ID NO: 1219058 - RNA, 23 nt, Human
ccccuaccaaacggaugcuccuc

SEQ ID NO: 1219059 - RNA, 20 nt, Human
ccccucccuucucugugcca

SEQ ID NO: 1219060 - RNA, 18 nt, Human
ccccucuguuaccccuac

SEQ ID NO: 1219061 - RNA, 21 nt, Human
ccccucuguuaccccuaccaa

SEQ ID NO: 1219062 - RNA, 21 nt, Human
cccuggcugaggcucagggac

SEQ ID NO: 1219063 - RNA, 24 nt, Human
ccgccaagcugaucuucugaaugc

SEQ ID NO: 1219064 - RNA, 18 nt, Human
ccuccggcagcaccucuc

SEQ ID NO: 1219065 - RNA, 22 nt, Human
ccugaggucaggaguucgagac

SEQ ID NO: 1219066 - RNA, 24 nt, Human
ccugaucaacauggugaaacccca

SEQ ID NO: 1219067 - RNA, 24 nt, Human
ccuggaccacuccugcagcagaag

SEQ ID NO: 1219068 - RNA, 23 nt, Human
ccuggccaacaugaugaaacccc

SEQ ID NO: 1219069 - RNA, 24 nt, Human
ccuggccaacaugaugaaaccccg

SEQ ID NO: 1219070 - RNA, 23 nt, Human
ccugggcgacaagagcgagacuc

SEQ ID NO: 1219071 - RNA, 18 nt, Human
ccuguagacccaacuacu

SEQ ID NO: 1219072 - RNA, 22 nt, Human
ccuguagacccaacuacuuggg

SEQ ID NO: 1219073 - RNA, 18 nt, Human
ccuguauucccagcuacu

SEQ ID NO: 1219074 - RNA, 22 nt, Human
ccuguauucccagcuacugggg

SEQ ID NO: 1219075 - RNA, 18 nt, Human
ccuuuaauuggaagggag

SEQ ID NO: 1219076 - RNA, 21 nt, Human
cgagaccagccuggccaacau

SEQ ID NO: 1219077 - RNA, 19 nt, Human
cgaggcaggagaaucacug

SEQ ID NO: 1219078 - RNA, 21 nt, Human
cgaggcaggagaaucacugga

SEQ ID NO: 1219079 - RNA, 24 nt, Human
cgaggcaggagaaucacuggaacc

SEQ ID NO: 1219080 - RNA, 23 nt, Human
cgcccuggcugaggcucagggac

SEQ ID NO: 1219081 - RNA, 21 nt, Human
cgccuuggccccuuguggucc

SEQ ID NO: 1219082 - RNA, 20 nt, Human
cggagguccagagaggucag

SEQ ID NO: 1219083 - RNA, 24 nt, Human
cggagguccagagaggucagacuu

SEQ ID NO: 1219084 - RNA, 21 nt, Human
cggcaguagagcagcuggggc

SEQ ID NO: 1219085 - RNA, 21 nt, Human
cgggaccagucagccuggcca

SEQ ID NO: 1219086 - RNA, 23 nt, Human
cgggaccagucagccuggccagg

SEQ ID NO: 1219087 - RNA, 22 nt, Human
cguacaagaagaaauagauccc

SEQ ID NO: 1219088 - RNA, 23 nt, Human
cuaaaacuacaaaaauuagcccu

SEQ ID NO: 1219089 - RNA, 21 nt, Human
cuagcuggcucuggugugugc

SEQ ID NO: 1219090 - RNA, 22 nt, Human
cucacaccuguaaucccagcac

SEQ ID NO: 1219091 - RNA, 24 nt, Human
cucacaccuguaaucccagcacuu

SEQ ID NO: 1219092 - RNA, 24 nt, Human
cucaugccuguaaucccaguacuu

SEQ ID NO: 1219093 - RNA, 21 nt, Human
cucccagacaggccccccaga

SEQ ID NO: 1219094 - RNA, 24 nt, Human
cucccagacaggccccccagaagu

SEQ ID NO: 1219095 - RNA, 21 nt, Human
cuccggcagcaccucuccuuc

SEQ ID NO: 1219096 - RNA, 20 nt, Human
cucuccuuccucccugcaga

SEQ ID NO: 1219097 - RNA, 24 nt, Human
cucugaaggacgcccuggcugagg

SEQ ID NO: 1219098 - RNA, 18 nt, Human
cucugccccgcaaaaacu

SEQ ID NO: 1219099 - RNA, 19 nt, Human
cucugugccauaacagagu

SEQ ID NO: 1219100 - RNA, 19 nt, Human
cugggugacagauucuguc

SEQ ID NO: 1219101 - RNA, 18 nt, Human
cuguccggaugcucacuu

SEQ ID NO: 1219102 - RNA, 21 nt, Human
gacaagaauacaucagagacg

SEQ ID NO: 1219103 - RNA, 22 nt, Human
gacccauguucagauuuccccc

SEQ ID NO: 1219104 - RNA, 21 nt, Human
gaccuccuccggcagcaccuc

SEQ ID NO: 1219105 - RNA, 23 nt, Human
gagaucgugccacugcacuccag

SEQ ID NO: 1219106 - RNA, 21 nt, Human
gagcugagaucgugccacugc

SEQ ID NO: 1219107 - RNA, 23 nt, Human
gagguugcagggagcugagaucg

SEQ ID NO: 1219108 - RNA, 24 nt, Human
gaucaccugaggucaggaguucga

SEQ ID NO: 1219109 - RNA, 21 nt, Human
gaucacuugaggucaggaguu

SEQ ID NO: 1219110 - RNA, 21 nt, Human
gaucacuugaggucaggaguu

SEQ ID NO: 1219111 - RNA, 22 nt, Human
gaucacuugaggucaggaguua

SEQ ID NO: 1219112 - RNA, 23 nt, Human
gaucacuugaggucaggaguuaa

SEQ ID NO: 1219113 - RNA, 18 nt, Human
gcagaagaggagcucacg

SEQ ID NO: 1219114 - RNA, 18 nt, Human
gcagcguucccagcuccc

SEQ ID NO: 1219115 - RNA, 22 nt, Human
gcaggagaaucacuggaaccca

SEQ ID NO: 1219116 - RNA, 24 nt, Human
gccaacaugaugaaaccccgucuc

SEQ ID NO: 1219117 - RNA, 19 nt, Human
gccacugcacuccagccug

SEQ ID NO: 1219118 - RNA, 22 nt, Human
gccacugcacuccagccugggc

SEQ ID NO: 1219119 - RNA, 24 nt, Human
gccacugcacuccagccugggcga

SEQ ID NO: 1219120 - RNA, 24 nt, Human
gccacugcacuccagccuggguga

SEQ ID NO: 1219121 - RNA, 20 nt, Human
gccaggugcaguggcucaca

SEQ ID NO: 1219122 - RNA, 23 nt, Human
gcccuggaggcucagggagguca

SEQ ID NO: 1219123 - RNA, 19 nt, Human
gcgcggugcgcgggaccag

SEQ ID NO: 1219124 - RNA, 21 nt, Human
gcucuccauggccuccuccac

SEQ ID NO: 1219125 - RNA, 20 nt, Human
gcugagaucaugccacugca

SEQ ID NO: 1219126 - RNA, 19 nt, Human
gcugagaucgugccacugc

SEQ ID NO: 1219127 - RNA, 22 nt, Human
gcuuccagcugagcaucugccc

SEQ ID NO: 1219128 - RNA, 22 nt, Human
gcuugccugucuccauggaagc

SEQ ID NO: 1219129 - RNA, 21 nt, Human
ggagcucacgaccuccuccgg

SEQ ID NO: 1219130 - RNA, 24 nt, Human
ggaggacucuuuguuuucuccacc

SEQ ID NO: 1219131 - RNA, 18 nt, Human
ggagguugcagggagcug

SEQ ID NO: 1219132 - RNA, 24 nt, Human
ggagguugcagggagcugagaucg

SEQ ID NO: 1219133 - RNA, 22 nt, Human
ggaucaccugaggucaggaguu

SEQ ID NO: 1219134 - RNA, 18 nt, Human
ggaugauacccugaaauc

SEQ ID NO: 1219135 - RNA, 20 nt, Human
ggccagagcuuuggccccuu

SEQ ID NO: 1219136 - RNA, 19 nt, Human
ggccaggugugguggcuca

SEQ ID NO: 1219137 - RNA, 21 nt, Human
ggccaggugugguggcucaug

SEQ ID NO: 1219138 - RNA, 23 nt, Human
gggaggcugaggcaggagaauca

SEQ ID NO: 1219139 - RNA, 19 nt, Human
gggcagcaggcucugaagg

SEQ ID NO: 1219140 - RNA, 24 nt, Human
gggccaggugugguggcucaugcc

SEQ ID NO: 1219141 - RNA, 24 nt, Human
ggggaggcugaggcaggagaauca

SEQ ID NO: 1219142 - RNA, 24 nt, Human
gggguccuggaacugguugguguc

SEQ ID NO: 1219143 - RNA, 24 nt, Human
gggucuaccuccuaccuagaaguc

SEQ ID NO: 1219144 - RNA, 19 nt, Human
ggugcaucagacugggggc

SEQ ID NO: 1219145 - RNA, 21 nt, Human
gguggaucacuugaggucagg

SEQ ID NO: 1219146 - RNA, 24 nt, Human
gguggcucaugccuguaaucccag

SEQ ID NO: 1219147 - RNA, 18 nt, Human
gugcaguggcucacaccu

SEQ ID NO: 1219148 - RNA, 23 nt, Human
guggcucaugccuguaaucccag

SEQ ID NO: 1219149 - RNA, 20 nt, Human
uaaaacuacaaaaauuagcc

SEQ ID NO: 1219150 - RNA, 21 nt, Human
uaaagaaggguccccucuguu

SEQ ID NO: 1219151 - RNA, 21 nt, Human
uaaggaugauacccugaaauc

SEQ ID NO: 1219152 - RNA, 21 nt, Human
uaauaaauaaaaaauggggcc

SEQ ID NO: 1219153 - RNA, 20 nt, Human
uacuaaaacuacaaaaauua

SEQ ID NO: 1219154 - RNA, 22 nt, Human
uagacccaacuacuugggaggc

SEQ ID NO: 1219155 - RNA, 24 nt, Human
uagaggcucagcuugccugucucc

SEQ ID NO: 1219156 - RNA, 21 nt, Human
uagaucccucucauuagcacu

SEQ ID NO: 1219157 - RNA, 21 nt, Human
uagccgggcaugguggcgggu

SEQ ID NO: 1219158 - RNA, 25 nt, Human
uaguuaucaagaacaaaguccucgg

SEQ ID NO: 1219159 - RNA, 26 nt, Human
uaucaagaacaaaguccucggacuuc

SEQ ID NO: 1219160 - RNA, 22 nt, Human
ucaaaaacaaacaaaaaaggca

SEQ ID NO: 1219161 - RNA, 18 nt, Human
ucaauucugucacuucug

SEQ ID NO: 1219162 - RNA, 24 nt, Human
ucacaugaacccgggaggcggagg

SEQ ID NO: 1219163 - RNA, 18 nt, Human
ucagacagaaacaaugca

SEQ ID NO: 1219164 - RNA, 19 nt, Human
ucaggccauuuauucugca

SEQ ID NO: 1219165 - RNA, 20 nt, Human
ucagggaggucagggugcgg

SEQ ID NO: 1219166 - RNA, 19 nt, Human
ucaucuucccgaguaggcc

SEQ ID NO: 1219167 - RNA, 23 nt, Human
ucaugccacugcacuccagccug

SEQ ID NO: 1219168 - RNA, 22 nt, Human
ucaugccuguaaucccaguacu

SEQ ID NO: 1219169 - RNA, 24 nt, Human
uccagccugggcgacaagagcgag

SEQ ID NO: 1219170 - RNA, 25 nt, Human
uccagccugggcgacaagagcgaga

SEQ ID NO: 1219171 - RNA, 18 nt, Human
uccagccugggugacaga

SEQ ID NO: 1219172 - RNA, 20 nt, Human
ucccacucagcacgcugccc

SEQ ID NO: 1219173 - RNA, 19 nt, Human
ucccagcucccagacaggc

SEQ ID NO: 1219174 - RNA, 22 nt, Human
ucccagcucccagacaggcccc

SEQ ID NO: 1219175 - RNA, 23 nt, Human
uccccucuguuaccccuaccaaa

SEQ ID NO: 1219176 - RNA, 21 nt, Human
uccgccaagcugaucuucuga

SEQ ID NO: 1219177 - RNA, 23 nt, Human
ucgugccacugcacuccagccug

SEQ ID NO: 1219178 - RNA, 22 nt, Human
ucucaaaaauaaauaaagaaug

SEQ ID NO: 1219179 - RNA, 25 nt, Human
ucucauuagcacuuuaauaucagug

SEQ ID NO: 1219180 - RNA, 21 nt, Human
ucucuacuaaaaauacaaaaa

SEQ ID NO: 1219181 - RNA, 23 nt, Human
ucucuacuaaaacuacaaaaauu

SEQ ID NO: 1219182 - RNA, 22 nt, Human
ucuguaaggaugauacccugaa

SEQ ID NO: 1219183 - RNA, 19 nt, Human
ucuuacugucucuguuucc

SEQ ID NO: 1219184 - RNA, 23 nt, Human
ucuuacugucucuguuuccagaa

SEQ ID NO: 1219185 - RNA, 19 nt, Human
ugaaaccccaucucuacua

SEQ ID NO: 1219186 - RNA, 23 nt, Human
ugaacccgggaggcggagguugc

SEQ ID NO: 1219187 - RNA, 20 nt, Human
ugaaugcgacaguccuuccc

SEQ ID NO: 1219188 - RNA, 24 nt, Human
ugagaucaugccacugcacuccag

SEQ ID NO: 1219189 - RNA, 21 nt, Human
ugagcaucugcccauucuccu

SEQ ID NO: 1219190 - RNA, 22 nt, Human
ugagcugagaucaugccacugc

SEQ ID NO: 1219191 - RNA, 24 nt, Human
ugagcuuccggcaguagagcagcu

SEQ ID NO: 1219192 - RNA, 18 nt, Human
ugaggcaggagaaucaca

SEQ ID NO: 1219193 - RNA, 20 nt, Human
ugaggcaggagaaucacaug

SEQ ID NO: 1219194 - RNA, 24 nt, Human
ugaggcaggagaaucacaugaacc

SEQ ID NO: 1219195 - RNA, 25 nt, Human
ugaggcaggagaaucacaugaaccc

SEQ ID NO: 1219196 - RNA, 21 nt, Human
ugagguagagccuacagugag

SEQ ID NO: 1219197 - RNA, 24 nt, Human
ugagguggguggaucacuugaggu

SEQ ID NO: 1219198 - RNA, 26 nt, Human
ugagguggguggaucacuugagguca

SEQ ID NO: 1219199 - RNA, 24 nt, Human
ugaucaacauggugaaaccccauc

SEQ ID NO: 1219200 - RNA, 23 nt, Human
ugauggaucaccugaggucagga

SEQ ID NO: 1219201 - RNA, 19 nt, Human
ugcaaaccagcagacagag

SEQ ID NO: 1219202 - RNA, 22 nt, Human
ugcaggagguaggccagggcag

SEQ ID NO: 1219203 - RNA, 19 nt, Human
ugccagaauuggggacucc

SEQ ID NO: 1219204 - RNA, 23 nt, Human
ugccauaacagaguacccgucac

SEQ ID NO: 1219205 - RNA, 22 nt, Human
ugccugacgacagacugaacuc

SEQ ID NO: 1219206 - RNA, 20 nt, Human
ugccuggaccacuccugcag

SEQ ID NO: 1219207 - RNA, 23 nt, Human
ugccuguaaucccaguacuuugg

SEQ ID NO: 1219208 - RNA, 24 nt, Human
ugccuguaaucccaguacuuuggg

SEQ ID NO: 1219209 - RNA, 24 nt, Human
ugccuguagacccaacuacuuggg

SEQ ID NO: 1219210 - RNA, 20 nt, Human
ugccuguauucccagcuacu

SEQ ID NO: 1219211 - RNA, 23 nt, Human
ugccuguauucccagcuacuggg

SEQ ID NO: 1219212 - RNA, 24 nt, Human
uggaucaccugaggucaggaguuc

SEQ ID NO: 1219213 - RNA, 27 nt, Human
uggaucaccugaggucaggaguucgag

SEQ ID NO: 1219214 - RNA, 23 nt, Human
uggaucacuugaggucaggaguu

SEQ ID NO: 1219215 - RNA, 27 nt, Human
uggaucacuugaggucaggaguuaaag

SEQ ID NO: 1219216 - RNA, 19 nt, Human
uggcgggugccuguauucc

SEQ ID NO: 1219217 - RNA, 24 nt, Human
uggcgggugccuguauucccagcu

SEQ ID NO: 1219218 - RNA, 19 nt, Human
uggcuacugcaacucugug

SEQ ID NO: 1219219 - RNA, 21 nt, Human
uggcucacaccuguaauccca

SEQ ID NO: 1219220 - RNA, 24 nt, Human
uggcucacaccuguaaucccagca

SEQ ID NO: 1219221 - RNA, 22 nt, Human
uggcucaugccuguaaucccag

SEQ ID NO: 1219222 - RNA, 22 nt, Human
uggcucaugccuguaaucccag

SEQ ID NO: 1219223 - RNA, 24 nt, Human
ugggaggcccaggcugauggauca

SEQ ID NO: 1219224 - RNA, 19 nt, Human
ugggaggccgaggcaggag

SEQ ID NO: 1219225 - RNA, 20 nt, Human
ugggaggccgaggcaggaga

SEQ ID NO: 1219226 - RNA, 24 nt, Human
ugggaggccgaggcaggagaauca

SEQ ID NO: 1219227 - RNA, 20 nt, Human
ugggaggcugaggugggugg

SEQ ID NO: 1219228 - RNA, 23 nt, Human
ugggaggcugagguggguggauc

SEQ ID NO: 1219229 - RNA, 24 nt, Human
ugggaggcugagguggguggauca

SEQ ID NO: 1219230 - RNA, 22 nt, Human
uggggccaggugugguggcuca

SEQ ID NO: 1219231 - RNA, 24 nt, Human
uggggccaggugugguggcucaug

SEQ ID NO: 1219232 - RNA, 23 nt, Human
uggggguggccccucccuucaaa

SEQ ID NO: 1219233 - RNA, 23 nt, Human
ugggugacagauucugucucaaa

SEQ ID NO: 1219234 - RNA, 24 nt, Human
ugggugacagauucugucucaaaa

SEQ ID NO: 1219235 - RNA, 24 nt, Human
uggguggaucacuugaggucagga

SEQ ID NO: 1219236 - RNA, 18 nt, Human
ugggugugguggugcgug

SEQ ID NO: 1219237 - RNA, 24 nt, Human
ugguggcucaugccuguaauccca

SEQ ID NO: 1219238 - RNA, 24 nt, Human
ugguggugcgugccuguagaccca

SEQ ID NO: 1219239 - RNA, 20 nt, Human
ugguuccuguccggaugcuc

SEQ ID NO: 1219240 - RNA, 20 nt, Human
ugucuguuuugcucugaugg

SEQ ID NO: 1219241 - RNA, 21 nt, Human
ugugccauaacagaguacccg

SEQ ID NO: 1219242 - RNA, 19 nt, Human
uguucuuuauagcagacuu

SEQ ID NO: 1219243 - RNA, 23 nt, Human
uuaaagaccagccugaucaacau

SEQ ID NO: 1219244 - RNA, 24 nt, Human
uuagccgggcaugguggcgggugc

SEQ ID NO: 1219245 - RNA, 20 nt, Human
uuagcugggugugguggugc

SEQ ID NO: 1219246 - RNA, 22 nt, Human
uuagcugggugugguggugcgu

SEQ ID NO: 1219247 - RNA, 24 nt, Human
uuagcugggugugguggugcgugc

SEQ ID NO: 1219248 - RNA, 18 nt, Human
uucuguugaggcugcauu

SEQ ID NO: 1219249 - RNA, 21 nt, Human
uugcagggagcugagaucgug

SEQ ID NO: 1219250 - RNA, 21 nt, Human
uuggccuccugggcacaggcg

SEQ ID NO: 1219251 - RNA, 25 nt, Human
uugggaggccgaggcaggagaauca

SEQ ID NO: 1219252 - RNA, 25 nt, Human
uugggaggcugagguggguggauca

SEQ ID NO: 1219253 - RNA, 25 nt, Human
uuuauagucuucauaaauauuuucu

SEQ ID NO: 1219254 - RNA, 20 nt, Human
uuugcucugauggggucugu

SEQ ID NO: 1219255 - RNA, 22 nt, Human
uuugggaggcccaggcugaugg

SEQ ID NO: 1219256 - RNA, 18 nt, Human
uuuuguuuuauuucccag

SEQ ID NO: 1219257 - RNA, 23 nt, Human
aaaaaaaaaaaaaaaagcccuag

SEQ ID NO: 1219258 - RNA, 19 nt, Human
aaaaaaaaaaagcccuaga

SEQ ID NO: 1219259 - RNA, 22 nt, Human
aaaagaaaaaaaaaaaaaaaag

SEQ ID NO: 1219260 - RNA, 22 nt, Human
aaguaaguggggguugaaguca

SEQ ID NO: 1219261 - RNA, 24 nt, Human
aaguaaguggggguugaagucaga

SEQ ID NO: 1219262 - RNA, 18 nt, Human
acucugucacccaggcug

SEQ ID NO: 1219263 - RNA, 24 nt, Human
acucugucacccaggcuggaauga

SEQ ID NO: 1219264 - RNA, 22 nt, Human
cacucugucacccaggcuggaa

SEQ ID NO: 1219265 - RNA, 23 nt, Human
cacucugucacccaggcuggaau

SEQ ID NO: 1219266 - RNA, 21 nt, Human
cucaaaaagaaaaaaaaaaaa

SEQ ID NO: 1219267 - RNA, 23 nt, Human
cucaaaaagaaaaaaaaaaaaaa

SEQ ID NO: 1219268 - RNA, 22 nt, Human
cuggaaugagacucugucucaa

SEQ ID NO: 1219269 - RNA, 24 nt, Human
cuggaaugagacucugucucaaaa

SEQ ID NO: 1219270 - RNA, 21 nt, Human
gaaaaaaaaaaaaaaaagccc

SEQ ID NO: 1219271 - RNA, 19 nt, Human
gacucugucucaaaaagaa

SEQ ID NO: 1219272 - RNA, 24 nt, Human
gcuggaaugagacucugucucaaa

SEQ ID NO: 1219273 - RNA, 20 nt, Human
ucacccaggcuggaaugaga

SEQ ID NO: 1219274 - RNA, 23 nt, Human
ucucacucugucacccaggcugg

SEQ ID NO: 1219275 - RNA, 24 nt, Human
ucucacucugucacccaggcugga

SEQ ID NO: 1219276 - RNA, 25 nt, Human
ucucacucugucacccaggcuggaa

SEQ ID NO: 1219277 - RNA, 26 nt, Human
ucucacucugucacccaggcuggaau

SEQ ID NO: 1219278 - RNA, 18 nt, Human
ucugucacccaggcugga

SEQ ID NO: 1219279 - RNA, 23 nt, Human
ucugucucaaaaagaaaaaaaaa

SEQ ID NO: 1219280 - RNA, 24 nt, Human
ucugucucaaaaagaaaaaaaaaa

SEQ ID NO: 1219281 - RNA, 25 nt, Human
ucugucucaaaaagaaaaaaaaaaa

SEQ ID NO: 1219282 - RNA, 22 nt, Human
ugagauggggucucacucuguc

SEQ ID NO: 1219283 - RNA, 24 nt, Human
uggggucucacucugucacccagg

SEQ ID NO: 1219284 - RNA, 22 nt, Human
ugguuguaaaaggagagaccaa

SEQ ID NO: 1219285 - RNA, 22 nt, Human
uuugagauggggucucacucug

SEQ ID NO: 1219286 - RNA, 24 nt, Human
aacacacccaaaccccuccaauua

SEQ ID NO: 1219287 - RNA, 22 nt, Human
aaccccuccaauuacccuccca

SEQ ID NO: 1219288 - RNA, 26 nt, Human
acccucccaccuccuuggcauccccu

SEQ ID NO: 1219289 - RNA, 22 nt, Human
caaaccccuccaauuacccucc

SEQ ID NO: 1219290 - RNA, 23 nt, Human
caaaccccuccaauuacccuccc

SEQ ID NO: 1219291 - RNA, 30 nt, Human
cacacccaaaccccuccaauuacccucccc

SEQ ID NO: 1219292 - RNA, 19 nt, Human
ccaaaccccuccaauuacc

SEQ ID NO: 1219293 - RNA, 19 nt, Human
cccucccaccuccuuggca

SEQ ID NO: 1219294 - RNA, 24 nt, Human
cccuucccugcccucuuccucaaa

SEQ ID NO: 1219295 - RNA, 19 nt, Human
ccuucccugcccucuuccu

SEQ ID NO: 1219296 - RNA, 20 nt, Human
ccuucccugcccucuuccuc

SEQ ID NO: 1219297 - RNA, 21 nt, Human
ccuuggcauccccuucccugc

SEQ ID NO: 1219298 - RNA, 21 nt, Human
cugccgauggcggcugccccc

SEQ ID NO: 1219299 - RNA, 30 nt, Human
gccgauggcggcugcccccggccucuccuu

SEQ ID NO: 1219300 - RNA, 21 nt, Human
gcgucauuccaacacacccaa

SEQ ID NO: 1219301 - RNA, 22 nt, Human
uccaacacacccaaaccccucc

SEQ ID NO: 1219302 - RNA, 19 nt, Human
ucccugcccucuuccucaa

SEQ ID NO: 1219303 - RNA, 23 nt, Human
uccugugcucuguccccuggcgc

SEQ ID NO: 1219304 - RNA, 20 nt, Human
ucuccugguguugcugcggc

SEQ ID NO: 1219305 - RNA, 19 nt, Human
ugcucuguccccuggcgcu

SEQ ID NO: 1219306 - RNA, 27 nt, Human
uggcauccccuucccugcccucuuccu

SEQ ID NO: 1219307 - RNA, 22 nt, Human
ugugggggucccuuuccugugc

SEQ ID NO: 1219308 - RNA, 18 nt, Human
uuguuguagacgccuuca

SEQ ID NO: 1219309 - RNA, 21 nt, Human
aagcaggagaggaaaguaggg

SEQ ID NO: 1219310 - RNA, 24 nt, Human
acgccaagaccccgcccgccuggu

SEQ ID NO: 1219311 - RNA, 19 nt, Human
aggaaaguagggcuccacc

SEQ ID NO: 1219312 - RNA, 27 nt, Human
aggcagaaagcaggagaggagggaccc

SEQ ID NO: 1219313 - RNA, 23 nt, Human
aggcccuggcacaaaguaagcuc

SEQ ID NO: 1219314 - RNA, 18 nt, Human
auccccaccaaccagccc

SEQ ID NO: 1219315 - RNA, 22 nt, Human
cagcguuuagcuccgagaacgc

SEQ ID NO: 1219316 - RNA, 22 nt, Human
cauuacugaauccccaccaacc

SEQ ID NO: 1219317 - RNA, 18 nt, Human
cccaccaaccagcccaaa

SEQ ID NO: 1219318 - RNA, 26 nt, Human
cccacccucaccaucacaaccccuag

SEQ ID NO: 1219319 - RNA, 22 nt, Human
ccccacccucaccaucacaccc

SEQ ID NO: 1219320 - RNA, 23 nt, Human
ccccacccucaccaucacacccu

SEQ ID NO: 1219321 - RNA, 20 nt, Human
ccuggcucagcuggcgcggc

SEQ ID NO: 1219322 - RNA, 22 nt, Human
cgagaacgccaagaccccgccc

SEQ ID NO: 1219323 - RNA, 22 nt, Human
cgagaacgccaagaccccgccc

SEQ ID NO: 1219324 - RNA, 21 nt, Human
gagaacgccaagaccccgccc

SEQ ID NO: 1219325 - RNA, 18 nt, Human
gcagaaagcaggagagga

SEQ ID NO: 1219326 - RNA, 24 nt, Human
ggaaaguagggcuccaccuggcuc

SEQ ID NO: 1219327 - RNA, 18 nt, Human
gucacaggcagaaagcag

SEQ ID NO: 1219328 - RNA, 18 nt, Human
guggcccuagacagguca

SEQ ID NO: 1219329 - RNA, 20 nt, Human
uaaaagagagagaaccucca

SEQ ID NO: 1219330 - RNA, 19 nt, Human
uacugaauccccaccaacc

SEQ ID NO: 1219331 - RNA, 23 nt, Human
uacugaauccccaccaaccagcc

SEQ ID NO: 1219332 - RNA, 23 nt, Human
uagaaugaaugagugaauaaaug

SEQ ID NO: 1219333 - RNA, 23 nt, Human
ucauaccuaaaagagagagaacc

SEQ ID NO: 1219334 - RNA, 21 nt, Human
ugaauccccaccaaccagccc

SEQ ID NO: 1219335 - RNA, 19 nt, Human
ugucuggcagcacgucugu

SEQ ID NO: 1219336 - RNA, 21 nt, Human
uuagugugguacuggcuuuuc

SEQ ID NO: 1219337 - RNA, 24 nt, Human
uuuuguagaaugaaugagugaaua

SEQ ID NO: 1219338 - RNA, 21 nt, Human
agggggcuucucccuuggaga

SEQ ID NO: 1219339 - RNA, 21 nt, Human
cucccgcgcaggccauaagag

SEQ ID NO: 1219340 - RNA, 19 nt, Human
cuggcaagggggcuucucc

SEQ ID NO: 1219341 - RNA, 21 nt, Human
ugagaacugccagguccgcgg

SEQ ID NO: 1219342 - RNA, 20 nt, Human
ugucugaaagggaacuagaa

SEQ ID NO: 1219343 - RNA, 24 nt, Human
caagguccugacucagcccagcca

SEQ ID NO: 1219344 - RNA, 23 nt, Human
caggacaguuuccugagcuucaa

SEQ ID NO: 1219345 - RNA, 21 nt, Human
ccaguuuauuuauucaacaag

SEQ ID NO: 1219346 - RNA, 18 nt, Human
ccccuuucuucccuuccu

SEQ ID NO: 1219347 - RNA, 24 nt, Human
ccccuuucuucccuuccuucuccc

SEQ ID NO: 1219348 - RNA, 19 nt, Human
cccuuccuucucccuccca

SEQ ID NO: 1219349 - RNA, 18 nt, Human
ccguccuggcaagguccu

SEQ ID NO: 1219350 - RNA, 18 nt, Human
ccuacugugugcuaggca

SEQ ID NO: 1219351 - RNA, 20 nt, Human
ccucccaccaccucccaggc

SEQ ID NO: 1219352 - RNA, 21 nt, Human
ccucccaccaccucccaggcc

SEQ ID NO: 1219353 - RNA, 22 nt, Human
ccuuucuucccuuccuucuccc

SEQ ID NO: 1219354 - RNA, 21 nt, Human
cggcagagccccucccuuugg

SEQ ID NO: 1219355 - RNA, 19 nt, Human
cguccuggcaagguccuga

SEQ ID NO: 1219356 - RNA, 21 nt, Human
cuaagcggcagagccccuccc

SEQ ID NO: 1219357 - RNA, 19 nt, Human
cucccaccaccucccaggc

SEQ ID NO: 1219358 - RNA, 19 nt, Human
cucccucccaccaccuccc

SEQ ID NO: 1219359 - RNA, 25 nt, Human
cucccucccaccaccucccaggccc

SEQ ID NO: 1219360 - RNA, 19 nt, Human
cuccugggccuccgcccuc

SEQ ID NO: 1219361 - RNA, 19 nt, Human
cucugcuaagcggcagagc

SEQ ID NO: 1219362 - RNA, 18 nt, Human
cugggccuccgcccuccc

SEQ ID NO: 1219363 - RNA, 20 nt, Human
cugugugcuaggcagucuuc

SEQ ID NO: 1219364 - RNA, 21 nt, Human
cuucccuuccuucucccuccc

SEQ ID NO: 1219365 - RNA, 19 nt, Human
gagcaaggggacagacagc

SEQ ID NO: 1219366 - RNA, 24 nt, Human
gcuucaagguuacugucuccaauc

SEQ ID NO: 1219367 - RNA, 23 nt, Human
gggacagacagcaucccgcgguc

SEQ ID NO: 1219368 - RNA, 29 nt, Human
uccccuuucuucccuuccuucucccuccc

SEQ ID NO: 1219369 - RNA, 19 nt, Human
ucccgcggucacgcagcca

SEQ ID NO: 1219370 - RNA, 21 nt, Human
ucccgcggucacgcagccaug

SEQ ID NO: 1219371 - RNA, 24 nt, Human
uccugggccuccgccccucgggag

SEQ ID NO: 1219372 - RNA, 22 nt, Human
ucuucccuuccuucucccuccc

SEQ ID NO: 1219373 - RNA, 18 nt, Human
ugcuaagcggcagagccc

SEQ ID NO: 1219374 - RNA, 22 nt, Human
ugcuaagcggcagagccccucc

SEQ ID NO: 1219375 - RNA, 21 nt, Human
aaaacccuugccacacucugc

SEQ ID NO: 1219376 - RNA, 25 nt, Human
aaaacccuugccacacucugcacac

SEQ ID NO: 1219377 - RNA, 20 nt, Human
aaacugcugggauuacaggu

SEQ ID NO: 1219378 - RNA, 23 nt, Human
aaacugcugggauuacaggugug

SEQ ID NO: 1219379 - RNA, 20 nt, Human
aagauaccccugccucaucc

SEQ ID NO: 1219380 - RNA, 21 nt, Human
aagauaccccugccucauccu

SEQ ID NO: 1219381 - RNA, 21 nt, Human
aagggcgucaggaccaggugc

SEQ ID NO: 1219382 - RNA, 20 nt, Human
aagguaaacaaacccugguu

SEQ ID NO: 1219383 - RNA, 25 nt, Human
aagugauucucccaccucagccucc

SEQ ID NO: 1219384 - RNA, 19 nt, Human
accccucuccaccuuuuuc

SEQ ID NO: 1219385 - RNA, 19 nt, Human
accccucuccaccuuuuuc

SEQ ID NO: 1219386 - RNA, 23 nt, Human
accucagccucccaaacugcugg

SEQ ID NO: 1219387 - RNA, 18 nt, Human
acugcugggauuacaggu

SEQ ID NO: 1219388 - RNA, 19 nt, Human
acuuguauggcuucucccc

SEQ ID NO: 1219389 - RNA, 24 nt, Human
acuuuugggcucaagugauucucc

SEQ ID NO: 1219390 - RNA, 20 nt, Human
agagaccccucuccaccuuu

SEQ ID NO: 1219391 - RNA, 23 nt, Human
agagaccccucuccaccuuuuuc

SEQ ID NO: 1219392 - RNA, 18 nt, Human
auucucccaccucagccu

SEQ ID NO: 1219393 - RNA, 19 nt, Human
caaacccugguucaggcau

SEQ ID NO: 1219394 - RNA, 24 nt, Human
caaacugcugggauuacaggugug

SEQ ID NO: 1219395 - RNA, 22 nt, Human
caagauaccccugccucauccu

SEQ ID NO: 1219396 - RNA, 24 nt, Human
caagguccugacucagcccagcca

SEQ ID NO: 1219397 - RNA, 22 nt, Human
caagugauucucccaccucagc

SEQ ID NO: 1219398 - RNA, 27 nt, Human
caagugauucucccaccucagccuccc

SEQ ID NO: 1219399 - RNA, 19 nt, Human
caccacggugggugcggag

SEQ ID NO: 1219400 - RNA, 21 nt, Human
cacguggggcuggcugggucc

SEQ ID NO: 1219401 - RNA, 22 nt, Human
cagaagccacacacguggggcu

SEQ ID NO: 1219402 - RNA, 23 nt, Human
caggacaguuuccugagcuucaa

SEQ ID NO: 1219403 - RNA, 21 nt, Human
ccaaacugcugggauuacagg

SEQ ID NO: 1219404 - RNA, 21 nt, Human
ccaaacugcugggauuacagg

SEQ ID NO: 1219405 - RNA, 24 nt, Human
ccaaacugcugggauuacaggugu

SEQ ID NO: 1219406 - RNA, 21 nt, Human
ccaguuuauuuauucaacaag

SEQ ID NO: 1219407 - RNA, 22 nt, Human
cccaaagggcgucaggaccagg

SEQ ID NO: 1219408 - RNA, 21 nt, Human
cccaucucugcagcucagaag

SEQ ID NO: 1219409 - RNA, 23 nt, Human
ccccucuccaccuuuuucaugcc

SEQ ID NO: 1219410 - RNA, 18 nt, Human
ccccuuucuucccuuccu

SEQ ID NO: 1219411 - RNA, 24 nt, Human
ccccuuucuucccuuccuucuccc

SEQ ID NO: 1219412 - RNA, 21 nt, Human
cccuaccauccccuaucccaa

SEQ ID NO: 1219413 - RNA, 21 nt, Human
cccucccaccaccucccaggc

SEQ ID NO: 1219414 - RNA, 19 nt, Human
cccuuccuucucccuccca

SEQ ID NO: 1219415 - RNA, 27 nt, Human
cccuuucuucccuuccuucucccuccc

SEQ ID NO: 1219416 - RNA, 18 nt, Human
ccguccuggcaagguccu

SEQ ID NO: 1219417 - RNA, 18 nt, Human
ccuacugugugcuaggca

SEQ ID NO: 1219418 - RNA, 21 nt, Human
ccucccaccaccucccaggcc

SEQ ID NO: 1219419 - RNA, 22 nt, Human
ccuuucuucccuuccuucuccc

SEQ ID NO: 1219420 - RNA, 19 nt, Human
cgcgcagagaccccucucc

SEQ ID NO: 1219421 - RNA, 21 nt, Human
cggcagagccccucccuuugg

SEQ ID NO: 1219422 - RNA, 20 nt, Human
cggcggaagcccuugccaca

SEQ ID NO: 1219423 - RNA, 19 nt, Human
cguccuggcaagguccuga

SEQ ID NO: 1219424 - RNA, 23 nt, Human
cuaucccaaagggcgucaggacc

SEQ ID NO: 1219425 - RNA, 23 nt, Human
cucaagugauucucccaccucag

SEQ ID NO: 1219426 - RNA, 24 nt, Human
cucaagugauucucccaccucagc

SEQ ID NO: 1219427 - RNA, 18 nt, Human
cucacugcagccucaaac

SEQ ID NO: 1219428 - RNA, 21 nt, Human
cucccaaacugcugggauuac

SEQ ID NO: 1219429 - RNA, 19 nt, Human
cucccaccaccucccaggc

SEQ ID NO: 1219430 - RNA, 23 nt, Human
cucccaccucagccucccaaacu

SEQ ID NO: 1219431 - RNA, 19 nt, Human
cucccucccaccaccuccc

SEQ ID NO: 1219432 - RNA, 25 nt, Human
cucccucccaccaccucccaggccc

SEQ ID NO: 1219433 - RNA, 19 nt, Human
cuccugggccuccgcccuc

SEQ ID NO: 1219434 - RNA, 20 nt, Human
cuccugggccuccgcccucc

SEQ ID NO: 1219435 - RNA, 19 nt, Human
cucugcuaagcggcagagc

SEQ ID NO: 1219436 - RNA, 18 nt, Human
cugggccuccgcccuccc

SEQ ID NO: 1219437 - RNA, 18 nt, Human
cuggugcuugaugcgggc

SEQ ID NO: 1219438 - RNA, 20 nt, Human
cugugugcacacgauggugu

SEQ ID NO: 1219439 - RNA, 20 nt, Human
cugugugcuaggcagucuuc

SEQ ID NO: 1219440 - RNA, 21 nt, Human
cuucccuuccuucucccuccc

SEQ ID NO: 1219441 - RNA, 23 nt, Human
cuuuugggcucaagugauucucc

SEQ ID NO: 1219442 - RNA, 22 nt, Human
gaccccucuccaccuuuuucau

SEQ ID NO: 1219443 - RNA, 21 nt, Human
gagguaggguuucuccccugu

SEQ ID NO: 1219444 - RNA, 21 nt, Human
gauucucccaccucagccucc

SEQ ID NO: 1219445 - RNA, 22 nt, Human
gccuguguguacacacacacug

SEQ ID NO: 1219446 - RNA, 19 nt, Human
gcugggauuacaggugugu

SEQ ID NO: 1219447 - RNA, 24 nt, Human
gcuucaagguuacugucuccaauc

SEQ ID NO: 1219448 - RNA, 18 nt, Human
ggcucaagugauucuccc

SEQ ID NO: 1219449 - RNA, 23 nt, Human
gggaacuccuucccacagaagcc

SEQ ID NO: 1219450 - RNA, 19 nt, Human
gggcucaagugauucuccc

SEQ ID NO: 1219451 - RNA, 22 nt, Human
gggcucaagugauucucccacc

SEQ ID NO: 1219452 - RNA, 18 nt, Human
gggcucagagagcaaggg

SEQ ID NO: 1219453 - RNA, 18 nt, Human
ggugggugcggaggugcu

SEQ ID NO: 1219454 - RNA, 23 nt, Human
guacugggccagguggguuaugu

SEQ ID NO: 1219455 - RNA, 24 nt, Human
gugauucucccaccucagccuccc

SEQ ID NO: 1219456 - RNA, 19 nt, Human
uaccuuaaauuccagaagc

SEQ ID NO: 1219457 - RNA, 24 nt, Human
ucacugcagccucaaacuuuuggg

SEQ ID NO: 1219458 - RNA, 21 nt, Human
ucaggaccaggugcccacgcu

SEQ ID NO: 1219459 - RNA, 23 nt, Human
ucccaaacugcugggauuacagg

SEQ ID NO: 1219460 - RNA, 24 nt, Human
ucccaaacugcugggauuacaggu

SEQ ID NO: 1219461 - RNA, 18 nt, Human
ucccagagcaagguuggg

SEQ ID NO: 1219462 - RNA, 20 nt, Human
ucccagagcaagguugggag

SEQ ID NO: 1219463 - RNA, 20 nt, Human
uccccuuucuucccuuccuc

SEQ ID NO: 1219464 - RNA, 25 nt, Human
ucccuggaccgcgucauuccagucc

SEQ ID NO: 1219465 - RNA, 24 nt, Human
uccugggccuccgccccucgggag

SEQ ID NO: 1219466 - RNA, 19 nt, Human
uccuguugcugccuccugc

SEQ ID NO: 1219467 - RNA, 23 nt, Human
ucucccaccucagccucccaaac

SEQ ID NO: 1219468 - RNA, 24 nt, Human
ucucccagagcaagguugggaggc

SEQ ID NO: 1219469 - RNA, 22 nt, Human
ucuucccuuccuucucccuccc

SEQ ID NO: 1219470 - RNA, 19 nt, Human
ucuuccuccccuuucuucc

SEQ ID NO: 1219471 - RNA, 20 nt, Human
ugagcuccgggggaacuccu

SEQ ID NO: 1219472 - RNA, 24 nt, Human
ugcccuaccauccccuaucccaaa

SEQ ID NO: 1219473 - RNA, 18 nt, Human
ugcuaagcggcagagccc

SEQ ID NO: 1219474 - RNA, 22 nt, Human
ugcuaagcggcagagccccucc

SEQ ID NO: 1219475 - RNA, 18 nt, Human
ugcugggauuacaggugu

SEQ ID NO: 1219476 - RNA, 23 nt, Human
uggcuggguccagaaggcugggc

SEQ ID NO: 1219477 - RNA, 19 nt, Human
ugggauuacagguguguac

SEQ ID NO: 1219478 - RNA, 19 nt, Human
ugggauuacagguguguac

SEQ ID NO: 1219479 - RNA, 21 nt, Human
ugggauuacagguguguacua

SEQ ID NO: 1219480 - RNA, 22 nt, Human
ugggauuacagguguguacuac

SEQ ID NO: 1219481 - RNA, 23 nt, Human
ugggauuacagguguguacuacc

SEQ ID NO: 1219482 - RNA, 25 nt, Human
ugggauuacagguguguacuaccug

SEQ ID NO: 1219483 - RNA, 18 nt, Human
ugggcucaagugauucuc

SEQ ID NO: 1219484 - RNA, 21 nt, Human
uggugcaaucagcucacugca

SEQ ID NO: 1219485 - RNA, 22 nt, Human
uggugcaaucagcucacugcag

SEQ ID NO: 1219486 - RNA, 20 nt, Human
ugguggugguggccgggccc

SEQ ID NO: 1219487 - RNA, 22 nt, Human
ugguggugguggccgggcccgu

SEQ ID NO: 1219488 - RNA, 18 nt, Human
uguguacacacacacugu

SEQ ID NO: 1219489 - RNA, 23 nt, Human
uguguacacacacacuguccaag

SEQ ID NO: 1219490 - RNA, 21 nt, Human
ugugugcacacgaugguguuu

SEQ ID NO: 1219491 - RNA, 19 nt, Human
uuccaguccuguugcugcc

SEQ ID NO: 1219492 - RNA, 22 nt, Human
uugaugcgggcagaacugucac

SEQ ID NO: 1219493 - RNA, 20 nt, Human
aaacagguagacagcacccc

SEQ ID NO: 1219494 - RNA, 20 nt, Human
aagaagccaagcuuguacag

SEQ ID NO: 1219495 - RNA, 24 nt, Human
aaugcugauggccagaucucgcug

SEQ ID NO: 1219496 - RNA, 21 nt, Human
acagaggccaucuugcccaca

SEQ ID NO: 1219497 - RNA, 20 nt, Human
accacggagaacagcgucac

SEQ ID NO: 1219498 - RNA, 18 nt, Human
accuagcugguccaguga

SEQ ID NO: 1219499 - RNA, 18 nt, Human
acugcagccugggggaga

SEQ ID NO: 1219500 - RNA, 20 nt, Human
acugcagccugggggagagc

SEQ ID NO: 1219501 - RNA, 22 nt, Human
agagcccccacagagcugccca

SEQ ID NO: 1219502 - RNA, 24 nt, Human
agagcccccacagagcugcccuuc

SEQ ID NO: 1219503 - RNA, 19 nt, Human
agauggggccuccaugacc

SEQ ID NO: 1219504 - RNA, 22 nt, Human
agcacaggacgcagguucuggg

SEQ ID NO: 1219505 - RNA, 24 nt, Human
agcagagcccccacagagcugccc

SEQ ID NO: 1219506 - RNA, 22 nt, Human
agcuccagggagcuccccacgg

SEQ ID NO: 1219507 - RNA, 20 nt, Human
agcuggaagguggccuugcu

SEQ ID NO: 1219508 - RNA, 20 nt, Human
agcuuuggaugucaccuagc

SEQ ID NO: 1219509 - RNA, 23 nt, Human
agggagcuccccacggucagggu

SEQ ID NO: 1219510 - RNA, 18 nt, Human
aucuccaucugagcucuc

SEQ ID NO: 1219511 - RNA, 23 nt, Human
auguggcagugucuucaggcuug

SEQ ID NO: 1219512 - RNA, 26 nt, Human
cacacagucacaaucacguugagcuc

SEQ ID NO: 1219513 - RNA, 19 nt, Human
cacacugccacugcacccu

SEQ ID NO: 1219514 - RNA, 21 nt, Human
cacagagcugcccaugaugau

SEQ ID NO: 1219515 - RNA, 24 nt, Human
cacagaggccaucuugcccacagu

SEQ ID NO: 1219516 - RNA, 20 nt, Human
cacaucccacacagccaccc

SEQ ID NO: 1219517 - RNA, 18 nt, Human
caccacauccuccacaca

SEQ ID NO: 1219518 - RNA, 20 nt, Human
caccacggagaacagcguca

SEQ ID NO: 1219519 - RNA, 22 nt, Human
cacccucugcccccuaggcaag

SEQ ID NO: 1219520 - RNA, 24 nt, Human
cacgaccaacaccuucuucugcaa

SEQ ID NO: 1219521 - RNA, 21 nt, Human
cacggucagggucugcaggcc

SEQ ID NO: 1219522 - RNA, 20 nt, Human
cacugcacccucugcccccu

SEQ ID NO: 1219523 - RNA, 21 nt, Human
cagagcagagggaggccccga

SEQ ID NO: 1219524 - RNA, 22 nt, Human
cagcacaggacgcagguucugg

SEQ ID NO: 1219525 - RNA, 24 nt, Human
cagcaggacaggaacccagaaguu

SEQ ID NO: 1219526 - RNA, 23 nt, Human
cagcaguagcagagcccccacag

SEQ ID NO: 1219527 - RNA, 23 nt, Human
caggaacccagaaguuaaugcug

SEQ ID NO: 1219528 - RNA, 21 nt, Human
caggcagucagcaauggagca

SEQ ID NO: 1219529 - RNA, 23 nt, Human
cauugccuggacaccugggugaa

SEQ ID NO: 1219530 - RNA, 30 nt, Human
cauuuggggccacacagcugaaaucguccc

SEQ ID NO: 1219531 - RNA, 21 nt, Human
ccacagagcugcccaugauga

SEQ ID NO: 1219532 - RNA, 20 nt, Human
ccagcaccgguacacagccu

SEQ ID NO: 1219533 - RNA, 18 nt, Human
ccagcauuuccuuguagu

SEQ ID NO: 1219534 - RNA, 20 nt, Human
ccaggaccagguucuguacc

SEQ ID NO: 1219535 - RNA, 22 nt, Human
ccagggcacugggcuucucuuc

SEQ ID NO: 1219536 - RNA, 26 nt, Human
ccaugaccacaucccacacagccacc

SEQ ID NO: 1219537 - RNA, 22 nt, Human
cccacggucagggucugcaggc

SEQ ID NO: 1219538 - RNA, 22 nt, Human
ccccaacacugucagggcugcc

SEQ ID NO: 1219539 - RNA, 22 nt, Human
ccccaggaccagguucuguacc

SEQ ID NO: 1219540 - RNA, 18 nt, Human
ccccgggcccccacggcc

SEQ ID NO: 1219541 - RNA, 22 nt, Human
ccccuuccacagggcuagcucg

SEQ ID NO: 1219542 - RNA, 18 nt, Human
cccggggccccaauggcc

SEQ ID NO: 1219543 - RNA, 19 nt, Human
ccuggccccgggcccccac

SEQ ID NO: 1219544 - RNA, 22 nt, Human
ccuggccccgggcccccacggc

SEQ ID NO: 1219545 - RNA, 18 nt, Human
ccuugcugcuugaagccu

SEQ ID NO: 1219546 - RNA, 19 nt, Human
cgccagcaguagcagagcc

SEQ ID NO: 1219547 - RNA, 22 nt, Human
cgccagcaguagcagagccccc

SEQ ID NO: 1219548 - RNA, 19 nt, Human
cggagaacagcgucacacu

SEQ ID NO: 1219549 - RNA, 18 nt, Human
cggucagggucugcaggc

SEQ ID NO: 1219550 - RNA, 21 nt, Human
cgucacacugccacugcaccc

SEQ ID NO: 1219551 - RNA, 24 nt, Human
cguuagagcccucauggaagaugg

SEQ ID NO: 1219552 - RNA, 20 nt, Human
cucagccucuuucauuuucu

SEQ ID NO: 1219553 - RNA, 20 nt, Human
cuccagggagcuccccacgg

SEQ ID NO: 1219554 - RNA, 21 nt, Human
cugcacccucugcccccuagg

SEQ ID NO: 1219555 - RNA, 21 nt, Human
cugccacugcacccucugccc

SEQ ID NO: 1219556 - RNA, 23 nt, Human
cugcuucugggcuccugacaccc

SEQ ID NO: 1219557 - RNA, 19 nt, Human
cuucuagcaccaucuccau

SEQ ID NO: 1219558 - RNA, 21 nt, Human
cuucuugaaaucugggucagg

SEQ ID NO: 1219559 - RNA, 18 nt, Human
cuugugagcccacggcca

SEQ ID NO: 1219560 - RNA, 18 nt, Human
cuuuggaugucaccuagc

SEQ ID NO: 1219561 - RNA, 24 nt, Human
gaacccagaaguuaaugcugaugg

SEQ ID NO: 1219562 - RNA, 23 nt, Human
gaaggugccguuagagcccucau

SEQ ID NO: 1219563 - RNA, 23 nt, Human
gaccagguucuguacccccuucc

SEQ ID NO: 1219564 - RNA, 19 nt, Human
gaccucgucuucuucuagc

SEQ ID NO: 1219565 - RNA, 21 nt, Human
gagaagcugagggugacaccc

SEQ ID NO: 1219566 - RNA, 19 nt, Human
gaggccccgaaguaggagg

SEQ ID NO: 1219567 - RNA, 20 nt, Human
gaucugcgucccugugacuu

SEQ ID NO: 1219568 - RNA, 18 nt, Human
gaugggaauggcauugua

SEQ ID NO: 1219569 - RNA, 24 nt, Human
gcagagcccccacagagcugccca

SEQ ID NO: 1219570 - RNA, 18 nt, Human
gcagguucuggggggagg

SEQ ID NO: 1219571 - RNA, 20 nt, Human
gccaggcgcagggcacucug

SEQ ID NO: 1219572 - RNA, 20 nt, Human
gccccagggguggcccugcu

SEQ ID NO: 1219573 - RNA, 21 nt, Human
gccgaucugcgucccugugac

SEQ ID NO: 1219574 - RNA, 19 nt, Human
gcgucccugugacuucggc

SEQ ID NO: 1219575 - RNA, 19 nt, Human
gcuugaagccuuauuguuc

SEQ ID NO: 1219576 - RNA, 26 nt, Human
gcuuguacaguguggcugggguuugc

SEQ ID NO: 1219577 - RNA, 20 nt, Human
ggaacugcaggcagucagca

SEQ ID NO: 1219578 - RNA, 20 nt, Human
ggaagauggggugguugaaa

SEQ ID NO: 1219579 - RNA, 23 nt, Human
ggacacacggacaccuggccccc

SEQ ID NO: 1219580 - RNA, 18 nt, Human
ggagaacagcgucacacu

SEQ ID NO: 1219581 - RNA, 20 nt, Human
gggcacucugauggggcugc

SEQ ID NO: 1219582 - RNA, 20 nt, Human
gggcacucugauggggcugc

SEQ ID NO: 1219583 - RNA, 22 nt, Human
gggcccccacggccaggacccu

SEQ ID NO: 1219584 - RNA, 18 nt, Human
ggugcagaaugauggggc

SEQ ID NO: 1219585 - RNA, 23 nt, Human
gugaaacagguagacagcacccc

SEQ ID NO: 1219586 - RNA, 21 nt, Human
uacuucaccgggagcuccagc

SEQ ID NO: 1219587 - RNA, 24 nt, Human
uaguggcguuugaagaagccaagc

SEQ ID NO: 1219588 - RNA, 22 nt, Human
ucaaaccugacagagcuuugga

SEQ ID NO: 1219589 - RNA, 22 nt, Human
ucacaaucacguugagcuccag

SEQ ID NO: 1219590 - RNA, 23 nt, Human
ucacagcggaacugcaggcaguc

SEQ ID NO: 1219591 - RNA, 20 nt, Human
ucacaucccccaacacuguc

SEQ ID NO: 1219592 - RNA, 27 nt, Human
ucaccacauccuccacacaagggcccu

SEQ ID NO: 1219593 - RNA, 19 nt, Human
ucaccagugagaaguugag

SEQ ID NO: 1219594 - RNA, 22 nt, Human
ucaugguguagacugcauacuu

SEQ ID NO: 1219595 - RNA, 21 nt, Human
uccacauccacagagcagagg

SEQ ID NO: 1219596 - RNA, 29 nt, Human
uccagggagcuccccacggucagggucug

SEQ ID NO: 1219597 - RNA, 21 nt, Human
ucccacacagccaccccguuc

SEQ ID NO: 1219598 - RNA, 19 nt, Human
uccccacggucagggucug

SEQ ID NO: 1219599 - RNA, 22 nt, Human
uccccagcuuccagggcacugg

SEQ ID NO: 1219600 - RNA, 20 nt, Human
uccgcuggcugugggagggg

SEQ ID NO: 1219601 - RNA, 23 nt, Human
uccugagcaggagcaccuggccc

SEQ ID NO: 1219602 - RNA, 23 nt, Human
ucgcggacccagccgaaacugag

SEQ ID NO: 1219603 - RNA, 23 nt, Human
ucugaaacacaggggagacucug

SEQ ID NO: 1219604 - RNA, 18 nt, Human
ucugcaggccugagaagc

SEQ ID NO: 1219605 - RNA, 19 nt, Human
ucuggggggaggggauggg

SEQ ID NO: 1219606 - RNA, 22 nt, Human
ucuucuagcaccaucuccaucu

SEQ ID NO: 1219607 - RNA, 24 nt, Human
ucuucuagcaccaucuccaucuga

SEQ ID NO: 1219608 - RNA, 21 nt, Human
ucuugcccacaguucuucucg

SEQ ID NO: 1219609 - RNA, 22 nt, Human
ugacacccagguccccuucaca

SEQ ID NO: 1219610 - RNA, 20 nt, Human
ugacuucggccuucuuccuc

SEQ ID NO: 1219611 - RNA, 20 nt, Human
ugagacagacgguggcgucc

SEQ ID NO: 1219612 - RNA, 20 nt, Human
ugcagccugggggagagcug

SEQ ID NO: 1219613 - RNA, 20 nt, Human
ugcauacuucaccgggagcu

SEQ ID NO: 1219614 - RNA, 19 nt, Human
ugccacugcacccucugcc

SEQ ID NO: 1219615 - RNA, 19 nt, Human
ugccccaaagcggccccag

SEQ ID NO: 1219616 - RNA, 18 nt, Human
ugcugguagcggggggcc

SEQ ID NO: 1219617 - RNA, 21 nt, Human
uggaugucaccuagcuggucc

SEQ ID NO: 1219618 - RNA, 24 nt, Human
uggaugucaccuagcugguccagu

SEQ ID NO: 1219619 - RNA, 21 nt, Human
uggccccgggcccccacggcc

SEQ ID NO: 1219620 - RNA, 22 nt, Human
ugggugaagaugacagccuucc

SEQ ID NO: 1219621 - RNA, 19 nt, Human
ugugaugagcgccagcagu

SEQ ID NO: 1219622 - RNA, 19 nt, Human
uguggcagugucuucaggc

SEQ ID NO: 1219623 - RNA, 21 nt, Human
uucacagaggccaucuugccc

SEQ ID NO: 1219624 - RNA, 20 nt, Human
acagagucccccuggagcca

SEQ ID NO: 1219625 - RNA, 24 nt, Human
aggccuaaaguuuacucucaugag

SEQ ID NO: 1219626 - RNA, 18 nt, Human
aggcugaugccuguccac

SEQ ID NO: 1219627 - RNA, 22 nt, Human
auacauugccaaaaugacaguc

SEQ ID NO: 1219628 - RNA, 22 nt, Human
caagaauagaucuguccuagau

SEQ ID NO: 1219629 - RNA, 23 nt, Human
ccagggcccaauacauugccaaa

SEQ ID NO: 1219630 - RNA, 19 nt, Human
ccccuggagccagggugag

SEQ ID NO: 1219631 - RNA, 20 nt, Human
cccggugugggccucugggg

SEQ ID NO: 1219632 - RNA, 18 nt, Human
ccuguccacaauccaaga

SEQ ID NO: 1219633 - RNA, 19 nt, Human
cugaaguggcagugggugg

SEQ ID NO: 1219634 - RNA, 25 nt, Human
cugaaguggcaguggguggucuccu

SEQ ID NO: 1219635 - RNA, 19 nt, Human
cuuccacauggcaaagguu

SEQ ID NO: 1219636 - RNA, 22 nt, Human
gcacagagucccccuggagcca

SEQ ID NO: 1219637 - RNA, 19 nt, Human
gggccucuggggguccccc

SEQ ID NO: 1219638 - RNA, 19 nt, Human
gugcagagaggucaccagg

SEQ ID NO: 1219639 - RNA, 20 nt, Human
gugcagagaggucaccaggc

SEQ ID NO: 1219640 - RNA, 23 nt, Human
uaccauagcacagagucccccug

SEQ ID NO: 1219641 - RNA, 21 nt, Human
uagcacagagucccccuggag

SEQ ID NO: 1219642 - RNA, 22 nt, Human
uaguaggcugaugccuguccac

SEQ ID NO: 1219643 - RNA, 24 nt, Human
ucaccaggcuuuucugaaguggca

SEQ ID NO: 1219644 - RNA, 22 nt, Human
uccacaauccaagaauagaucu

SEQ ID NO: 1219645 - RNA, 18 nt, Human
ucccaucaagacaugaac

SEQ ID NO: 1219646 - RNA, 18 nt, Human
ugaaguggcagugggugg

SEQ ID NO: 1219647 - RNA, 19 nt, Human
ugagcucagacagcugcuc

SEQ ID NO: 1219648 - RNA, 20 nt, Human
ugcauccaagcacuuuggcc

SEQ ID NO: 1219649 - RNA, 18 nt, Human
ugcccggugugggccucu

SEQ ID NO: 1219650 - RNA, 18 nt, Human
uggcaguggguggucucc

SEQ ID NO: 1219651 - RNA, 18 nt, Human
uggccaggaaaagcaugg

SEQ ID NO: 1219652 - RNA, 23 nt, Human
ugggggauggauuuauugauugg

SEQ ID NO: 1219653 - RNA, 18 nt, Human
uguguugugauaaauggc

SEQ ID NO: 1219654 - RNA, 21 nt, Human
uugugauaaauggcuucagau

SEQ ID NO: 1219655 - RNA, 21 nt, Human
aacccuucuccuguggcccca

SEQ ID NO: 1219656 - RNA, 22 nt, Human
aaugggacucugagggcuaaca

SEQ ID NO: 1219657 - RNA, 22 nt, Human
aaugggacucugagggcuaaca

SEQ ID NO: 1219658 - RNA, 22 nt, Human
acaugcagggaggaaggggggg

SEQ ID NO: 1219659 - RNA, 20 nt, Human
acucugagggcuaacagaaa

SEQ ID NO: 1219660 - RNA, 24 nt, Human
acucugagggcuaacagaaauggg

SEQ ID NO: 1219661 - RNA, 23 nt, Human
acucugagggcuaacaggagagg

SEQ ID NO: 1219662 - RNA, 19 nt, Human
acugggggcuggggccugc

SEQ ID NO: 1219663 - RNA, 18 nt, Human
agaaacagagaagggggc

SEQ ID NO: 1219664 - RNA, 22 nt, Human
agaagggggcaggggcucaugu

SEQ ID NO: 1219665 - RNA, 24 nt, Human
agagagcucuagaaaccaacggag

SEQ ID NO: 1219666 - RNA, 22 nt, Human
agagaugggcagcugugggccc

SEQ ID NO: 1219667 - RNA, 18 nt, Human
agcccgagaugggagcag

SEQ ID NO: 1219668 - RNA, 21 nt, Human
agggaggaaggggggggcagg

SEQ ID NO: 1219669 - RNA, 22 nt, Human
agggaggaaggggggggcagga

SEQ ID NO: 1219670 - RNA, 21 nt, Human
agggcggccuggcucugggcc

SEQ ID NO: 1219671 - RNA, 18 nt, Human
agggcuaacaggagaggg

SEQ ID NO: 1219672 - RNA, 23 nt, Human
agggcuaacaggagagggcggcc

SEQ ID NO: 1219673 - RNA, 21 nt, Human
agggggcaggggcucauguca

SEQ ID NO: 1219674 - RNA, 22 nt, Human
augcagggaggaaggggggggc

SEQ ID NO: 1219675 - RNA, 19 nt, Human
caauagaaaugggacucug

SEQ ID NO: 1219676 - RNA, 23 nt, Human
caggggcucaugucagcaaacac

SEQ ID NO: 1219677 - RNA, 22 nt, Human
ccaccugaggcccagagauggg

SEQ ID NO: 1219678 - RNA, 18 nt, Human
ccaggguggggugggggg

SEQ ID NO: 1219679 - RNA, 18 nt, Human
ccaggguggggugggggg

SEQ ID NO: 1219680 - RNA, 18 nt, Human
cccagccaggccccagga

SEQ ID NO: 1219681 - RNA, 22 nt, Human
ccccaaggccgugggacuuccg

SEQ ID NO: 1219682 - RNA, 19 nt, Human
ccccaggaguccugucccc

SEQ ID NO: 1219683 - RNA, 22 nt, Human
ccccaggaguccuguccccucu

SEQ ID NO: 1219684 - RNA, 19 nt, Human
ccggaaacaccugggcuga

SEQ ID NO: 1219685 - RNA, 18 nt, Human
ccguggccagacuugggg

SEQ ID NO: 1219686 - RNA, 19 nt, Human
ccuggcucugggccccagc

SEQ ID NO: 1219687 - RNA, 25 nt, Human
ccugguccaccugaggguccccugg

SEQ ID NO: 1219688 - RNA, 21 nt, Human
cucugggccccagccaggccc

SEQ ID NO: 1219689 - RNA, 23 nt, Human
cuuagagauccccugguccaccu

SEQ ID NO: 1219690 - RNA, 18 nt, Human
gaaaccaacggagaaaca

SEQ ID NO: 1219691 - RNA, 20 nt, Human
gaagaggggacugggggcug

SEQ ID NO: 1219692 - RNA, 20 nt, Human
gaaggggggggcaggauuuu

SEQ ID NO: 1219693 - RNA, 18 nt, Human
gagaaggggagggagaga

SEQ ID NO: 1219694 - RNA, 20 nt, Human
gaggaaggggggggcaggau

SEQ ID NO: 1219695 - RNA, 21 nt, Human
gccccaggaguccuguccccu

SEQ ID NO: 1219696 - RNA, 19 nt, Human
gcuauuucucccguccaca

SEQ ID NO: 1219697 - RNA, 20 nt, Human
gcuggggccugcucugaugu

SEQ ID NO: 1219698 - RNA, 19 nt, Human
ggacugggggcuggggccu

SEQ ID NO: 1219699 - RNA, 23 nt, Human
ggccggaagaggggacugggggc

SEQ ID NO: 1219700 - RNA, 18 nt, Human
ggccugaccuggcccagg

SEQ ID NO: 1219701 - RNA, 25 nt, Human
gggccguggccagacuugggggggg

SEQ ID NO: 1219702 - RNA, 18 nt, Human
ggggacugggggcugggg

SEQ ID NO: 1219703 - RNA, 20 nt, Human
ggggacugggggcuggggcc

SEQ ID NO: 1219704 - RNA, 19 nt, Human
ggguggggggcucugggga

SEQ ID NO: 1219705 - RNA, 23 nt, Human
ggguggggggcucuggggacagg

SEQ ID NO: 1219706 - RNA, 19 nt, Human
uaacagaaaugggacucug

SEQ ID NO: 1219707 - RNA, 21 nt, Human
ucaacccuucuccuguggccc

SEQ ID NO: 1219708 - RNA, 21 nt, Human
uccacaggccugaccuggccc

SEQ ID NO: 1219709 - RNA, 18 nt, Human
uccaccugaggcccagag

SEQ ID NO: 1219710 - RNA, 23 nt, Human
uccaggcggccggaagaggggac

SEQ ID NO: 1219711 - RNA, 23 nt, Human
uccccucugagaaggggagggag

SEQ ID NO: 1219712 - RNA, 21 nt, Human
uccggaaacaccugggcugaa

SEQ ID NO: 1219713 - RNA, 20 nt, Human
ucucccaagcagcccgagau

SEQ ID NO: 1219714 - RNA, 18 nt, Human
ugaccuggcccagggugg

SEQ ID NO: 1219715 - RNA, 19 nt, Human
ugccccagccacgcuucaa

SEQ ID NO: 1219716 - RNA, 19 nt, Human
uggcccagggugggguggg

SEQ ID NO: 1219717 - RNA, 25 nt, Human
uggcucugggccccagccaggcccc

SEQ ID NO: 1219718 - RNA, 21 nt, Human
ugggacucugagggcuaacag

SEQ ID NO: 1219719 - RNA, 21 nt, Human
ugggacucugagggcuaacag

SEQ ID NO: 1219720 - RNA, 18 nt, Human
ugggagcaggagggccgg

SEQ ID NO: 1219721 - RNA, 24 nt, Human
uuagagauccccugguccaccuga

SEQ ID NO: 1219722 - RNA, 25 nt, Human
uucaacccuucuccuguggccccaa

SEQ ID NO: 1219723 - RNA, 22 nt, Human
aaaaacaccugguuugcagccg

SEQ ID NO: 1219724 - RNA, 19 nt, Human
aacccucagcucuugcccc

SEQ ID NO: 1219725 - RNA, 23 nt, Human
aagaucuucucagccucauagcu

SEQ ID NO: 1219726 - RNA, 20 nt, Human
aagcagacgagcaauacagc

SEQ ID NO: 1219727 - RNA, 24 nt, Human
aagccucauguuuuauuucagaac

SEQ ID NO: 1219728 - RNA, 22 nt, Human
aagcugcagacugugcaggagg

SEQ ID NO: 1219729 - RNA, 20 nt, Human
acaaagaaggccgagacagc

SEQ ID NO: 1219730 - RNA, 28 nt, Human
acacagccucagaaaaaaagggaacgcc

SEQ ID NO: 1219731 - RNA, 28 nt, Human
acacauuugcaaagcaauucccguaccg

SEQ ID NO: 1219732 - RNA, 22 nt, Human
acaccccgcuccggcccggggc

SEQ ID NO: 1219733 - RNA, 21 nt, Human
acagaacuucuuaacaaugga

SEQ ID NO: 1219734 - RNA, 18 nt, Human
acagaugaaaaggcuuuc

SEQ ID NO: 1219735 - RNA, 25 nt, Human
acagcaacaaccucuuuuucuuuau

SEQ ID NO: 1219736 - RNA, 23 nt, Human
acaggaauauucuucaagcugag

SEQ ID NO: 1219737 - RNA, 18 nt, Human
accaacacgcucauuagc

SEQ ID NO: 1219738 - RNA, 19 nt, Human
accccgcuccggcccgggg

SEQ ID NO: 1219739 - RNA, 20 nt, Human
agaacaggacucaggaagcu

SEQ ID NO: 1219740 - RNA, 21 nt, Human
agaacuggcaaagacugugaa

SEQ ID NO: 1219741 - RNA, 18 nt, Human
agaaggaggaggaggagg

SEQ ID NO: 1219742 - RNA, 18 nt, Human
agccaccaaaagaaugca

SEQ ID NO: 1219743 - RNA, 23 nt, Human
agcuccgcgaauaguuggugccg

SEQ ID NO: 1219744 - RNA, 24 nt, Human
aggacgacgaggaacaggcggugg

SEQ ID NO: 1219745 - RNA, 20 nt, Human
aggacucaggaagcugcaga

SEQ ID NO: 1219746 - RNA, 19 nt, Human
aggaggcggcggcgggcgg

SEQ ID NO: 1219747 - RNA, 23 nt, Human
auggauuucugagguucccuugg

SEQ ID NO: 1219748 - RNA, 23 nt, Human
caaaacaccaacacgcucauuag

SEQ ID NO: 1219749 - RNA, 23 nt, Human
caaaacaggaauauucuucaagc

SEQ ID NO: 1219750 - RNA, 22 nt, Human
caaaauggcuccaaacucugca

SEQ ID NO: 1219751 - RNA, 20 nt, Human
caaacucugcaaccacccag

SEQ ID NO: 1219752 - RNA, 20 nt, Human
caaagaaggccgagacagca

SEQ ID NO: 1219753 - RNA, 21 nt, Human
caacacagccucagaaaaaaa

SEQ ID NO: 1219754 - RNA, 23 nt, Human
caacacagccucagaaaaaaaca

SEQ ID NO: 1219755 - RNA, 24 nt, Human
caacacagccucagaaaaaaacac

SEQ ID NO: 1219756 - RNA, 26 nt, Human
caacuccugaagcaauuugcuacuuu

SEQ ID NO: 1219757 - RNA, 23 nt, Human
caacugccaugcugaacacuggu

SEQ ID NO: 1219758 - RNA, 24 nt, Human
caauuguuuaacuaguaccagcuu

SEQ ID NO: 1219759 - RNA, 19 nt, Human
cacagccucagaaaaaaac

SEQ ID NO: 1219760 - RNA, 20 nt, Human
cacauuguuaacccucagcu

SEQ ID NO: 1219761 - RNA, 21 nt, Human
caccacaguacuaaauacccg

SEQ ID NO: 1219762 - RNA, 21 nt, Human
cacugauggaggagggacguc

SEQ ID NO: 1219763 - RNA, 18 nt, Human
cagaugaaaaggcuuucu

SEQ ID NO: 1219764 - RNA, 21 nt, Human
cagcacgggcuacagcaacaa

SEQ ID NO: 1219765 - RNA, 22 nt, Human
cagcgugaguaaauucaagacu

SEQ ID NO: 1219766 - RNA, 18 nt, Human
caggagguuguuuagggc

SEQ ID NO: 1219767 - RNA, 21 nt, Human
cagggcccugcgcggcccacg

SEQ ID NO: 1219768 - RNA, 21 nt, Human
caguccguaagaggaagaacc

SEQ ID NO: 1219769 - RNA, 23 nt, Human
ccaaacaaacagaacuucuuaac

SEQ ID NO: 1219770 - RNA, 23 nt, Human
ccaccucuaucucuggaugaaga

SEQ ID NO: 1219771 - RNA, 19 nt, Human
ccccagaggccacauggcu

SEQ ID NO: 1219772 - RNA, 23 nt, Human
cccgcagcacaggacgaggaggc

SEQ ID NO: 1219773 - RNA, 23 nt, Human
ccgccaacaccccgcuccggccc

SEQ ID NO: 1219774 - RNA, 23 nt, Human
ccgccgccaacaccccgcuccgg

SEQ ID NO: 1219775 - RNA, 28 nt, Human
ccuacagucucuagugcuuuguaggugg

SEQ ID NO: 1219776 - RNA, 23 nt, Human
ccucagaaaaaaacaccugguuu

SEQ ID NO: 1219777 - RNA, 20 nt, Human
ccucaguaauuggagggccc

SEQ ID NO: 1219778 - RNA, 23 nt, Human
ccuccugucucaacuccugaagc

SEQ ID NO: 1219779 - RNA, 19 nt, Human
cgagcaaaacaccaacacg

SEQ ID NO: 1219780 - RNA, 21 nt, Human
cgaggaacaggcgguggcggc

SEQ ID NO: 1219781 - RNA, 19 nt, Human
cgcccgaaccggccgccgc

SEQ ID NO: 1219782 - RNA, 25 nt, Human
cgccggggcccccgaggaggaggac

SEQ ID NO: 1219783 - RNA, 22 nt, Human
cggcggcgggcgggggaagagg

SEQ ID NO: 1219784 - RNA, 18 nt, Human
cggggcucugcggcucau

SEQ ID NO: 1219785 - RNA, 24 nt, Human
cguagaaaaugcaagaucagcuag

SEQ ID NO: 1219786 - RNA, 22 nt, Human
cuaauccauauguaaugaccau

SEQ ID NO: 1219787 - RNA, 24 nt, Human
cuacagcaacaaccucuuuuucuu

SEQ ID NO: 1219788 - RNA, 21 nt, Human
cucaucacaauaagacauuga

SEQ ID NO: 1219789 - RNA, 25 nt, Human
cucuaugccauccaacuaauauacc

SEQ ID NO: 1219790 - RNA, 21 nt, Human
cuuaacacauuugcaaagcaa

SEQ ID NO: 1219791 - RNA, 22 nt, Human
cuucggucucggucguuuuccc

SEQ ID NO: 1219792 - RNA, 25 nt, Human
cuucuuaacaauggaacuucaaugg

SEQ ID NO: 1219793 - RNA, 24 nt, Human
cuuucaacugcuuuacaguagcca

SEQ ID NO: 1219794 - RNA, 21 nt, Human
gaagguugcaguccguaagag

SEQ ID NO: 1219795 - RNA, 22 nt, Human
gaauugggcugaggcuuucccc

SEQ ID NO: 1219796 - RNA, 19 nt, Human
gagaaggaggaggaggagg

SEQ ID NO: 1219797 - RNA, 21 nt, Human
gagaccccggggcucugcggc

SEQ ID NO: 1219798 - RNA, 20 nt, Human
gagagagaggcggaugaagg

SEQ ID NO: 1219799 - RNA, 19 nt, Human
gaggaggaggaggaggcgg

SEQ ID NO: 1219800 - RNA, 23 nt, Human
gaggaggaggaggaggcggcggc

SEQ ID NO: 1219801 - RNA, 18 nt, Human
gaggaggaggaggcggcg

SEQ ID NO: 1219802 - RNA, 21 nt, Human
gaggcggcggcgggcggggga

SEQ ID NO: 1219803 - RNA, 18 nt, Human
gcaaccacccagauaccc

SEQ ID NO: 1219804 - RNA, 18 nt, Human
gcaagaucagcuacccaa

SEQ ID NO: 1219805 - RNA, 22 nt, Human
gcccccgaggaggaggacgacg

SEQ ID NO: 1219806 - RNA, 18 nt, Human
gcccugcgcggcccacgu

SEQ ID NO: 1219807 - RNA, 22 nt, Human
gccgccaacaccccgcuccggc

SEQ ID NO: 1219808 - RNA, 18 nt, Human
gcggcucauuaccuuccc

SEQ ID NO: 1219809 - RNA, 18 nt, Human
gcuacagcaacaaccucu

SEQ ID NO: 1219810 - RNA, 19 nt, Human
gcugcauuacagaugaaaa

SEQ ID NO: 1219811 - RNA, 19 nt, Human
ggguugccagucauuccag

SEQ ID NO: 1219812 - RNA, 22 nt, Human
guacagcagccaagauauccaa

SEQ ID NO: 1219813 - RNA, 22 nt, Human
gucagcguggacucugguauca

SEQ ID NO: 1219814 - RNA, 18 nt, Human
gugaacucagggcugguc

SEQ ID NO: 1219815 - RNA, 24 nt, Human
uaaaguagaaagucucagaggucc

SEQ ID NO: 1219816 - RNA, 23 nt, Human
uaaauucuuucaacugcuuuaca

SEQ ID NO: 1219817 - RNA, 19 nt, Human
uaacccucagcucuugccc

SEQ ID NO: 1219818 - RNA, 20 nt, Human
uacccaaaauggcuccaaac

SEQ ID NO: 1219819 - RNA, 20 nt, Human
uagaacuggcaaagacugug

SEQ ID NO: 1219820 - RNA, 19 nt, Human
uagugcuuuguagguggca

SEQ ID NO: 1219821 - RNA, 18 nt, Human
uauagacugccacuucug

SEQ ID NO: 1219822 - RNA, 20 nt, Human
uauggccaagcgccgccgcc

SEQ ID NO: 1219823 - RNA, 20 nt, Human
uaugucagcguggacucugg

SEQ ID NO: 1219824 - RNA, 23 nt, Human
ucaacacagccucagaaaaaaac

SEQ ID NO: 1219825 - RNA, 19 nt, Human
ucagccucauagcucagag

SEQ ID NO: 1219826 - RNA, 19 nt, Human
uccaaaacaggaauauucu

SEQ ID NO: 1219827 - RNA, 20 nt, Human
uccccagugcuccucaccac

SEQ ID NO: 1219828 - RNA, 22 nt, Human
ucccuaaaauuagugcugaaaa

SEQ ID NO: 1219829 - RNA, 20 nt, Human
uccucacgcucacacggcca

SEQ ID NO: 1219830 - RNA, 23 nt, Human
ugaaacuguuaaaguagaaaguc

SEQ ID NO: 1219831 - RNA, 18 nt, Human
ugacaccguagccacccc

SEQ ID NO: 1219832 - RNA, 21 nt, Human
ugagcgaagguuucugaguau

SEQ ID NO: 1219833 - RNA, 21 nt, Human
ugaguaaauucaagacugaga

SEQ ID NO: 1219834 - RNA, 20 nt, Human
ugccgagcaaaacaccaaca

SEQ ID NO: 1219835 - RNA, 30 nt, Human; identical to SEQ ID NO: 829449

SEQ ID NO: 1219836 - RNA, 20 nt, Human
ugcuuuacaguagccaaucu

SEQ ID NO: 1219837 - RNA, 22 nt, Human
uggaauaagacaguccucuguu

SEQ ID NO: 1219838 - RNA, 21 nt, Human
uggcuaaagcacaacugccau

SEQ ID NO: 1219839 - RNA, 20 nt, Human
ugguaaugacacugauggag

SEQ ID NO: 1219840 - RNA, 18 nt, Human
ugucuuugguggcuaaag

SEQ ID NO: 1219841 - RNA, 22 nt, Human
uuccagggcccugcgcggccca

SEQ ID NO: 1219842 - RNA, 21 nt, Human
uucuccaacaacugauucugg

SEQ ID NO: 1219843 - RNA, 25 nt, Human
uugcugaauaaauucuuucaacugc

SEQ ID NO: 1219844 - RNA, 23 nt, Human
uuggcauuuccaauuguagucaa

SEQ ID NO: 1219845 - RNA, 24 nt, Human
uugguaaugacacugauggaggag

SEQ ID NO: 1219846 - RNA, 24 nt, Human
uuugcuaaaaauccacuugaagau

SEQ ID NO: 1219847 - RNA, 28 nt, Human
uuuucaguuauagacugccacuucugau

SEQ ID NO: 1219848 - RNA, 22 nt, Human
uuuucuccaacaacugauucug

SEQ ID NO: 1219849 - RNA, 23 nt, Human
aagggucccgcgggaaucggggc

SEQ ID NO: 1219850 - RNA, 22 nt, Human
acggcagcacaccaggcaccca

SEQ ID NO: 1219851 - RNA, 18 nt, Human
agcccgagggcacagcag

SEQ ID NO: 1219852 - RNA, 23 nt, Human
aggcacccaggggaaggaaccag

SEQ ID NO: 1219853 - RNA, 19 nt, Human
aggugcuggugagguucuc

SEQ ID NO: 1219854 - RNA, 20 nt, Human
caagucauuguagagacccg

SEQ ID NO: 1219855 - RNA, 20 nt, Human
caccugggagcccccagcuc

SEQ ID NO: 1219856 - RNA, 26 nt, Human
cacugucaacccuguucguccagcag

SEQ ID NO: 1219857 - RNA, 26 nt, Human
cagcaugcugaacugagcugcuggag

SEQ ID NO: 1219858 - RNA, 20 nt, Human
ccagcagcacaaugguggcc

SEQ ID NO: 1219859 - RNA, 18 nt, Human
ccaggggaaggaaccagg

SEQ ID NO: 1219860 - RNA, 23 nt, Human
ccugggagcccccagcucccgag

SEQ ID NO: 1219861 - RNA, 18 nt, Human
ccuguuaagagggggagg

SEQ ID NO: 1219862 - RNA, 24 nt, Human
cgggcagcgucacuuuuucuuggg

SEQ ID NO: 1219863 - RNA, 23 nt, Human
cuacaggggcugcugcgcucaac

SEQ ID NO: 1219864 - RNA, 21 nt, Human
cuucuugaugucggugcugac

SEQ ID NO: 1219865 - RNA, 21 nt, Human
gcacaaugguggccgcaaaaa

SEQ ID NO: 1219866 - RNA, 20 nt, Human
gcacccaggggaaggaacca

SEQ ID NO: 1219867 - RNA, 24 nt, Human
gccacugugggaagaaagggaggc

SEQ ID NO: 1219868 - RNA, 19 nt, Human
gcuggcccugaccccccag

SEQ ID NO: 1219869 - RNA, 20 nt, Human
ggaggccugaggccccaggg

SEQ ID NO: 1219870 - RNA, 22 nt, Human
ggaggccugaggccccagggac

SEQ ID NO: 1219871 - RNA, 19 nt, Human
ggagggacaaagcggguuc

SEQ ID NO: 1219872 - RNA, 22 nt, Human
ggagggacaaagcggguucuga

SEQ ID NO: 1219873 - RNA, 20 nt, Human
ggcacagcaggacugugacc

SEQ ID NO: 1219874 - RNA, 23 nt, Human
ggcuuggcggaccauuggccgag

SEQ ID NO: 1219875 - RNA, 18 nt, Human
gugccucuucagcgucca

SEQ ID NO: 1219876 - RNA, 22 nt, Human
uagugaaaaguuccuaaaauuc

SEQ ID NO: 1219877 - RNA, 24 nt, Human
uccucugcuguccugccccaagau

SEQ ID NO: 1219878 - RNA, 18 nt, Human
ucugugcccggaggaagg

SEQ ID NO: 1219879 - RNA, 19 nt, Human
ugaccugaucugccaggug

SEQ ID NO: 1219880 - RNA, 21 nt, Human
ugagacggcagcacaccaggc

SEQ ID NO: 1219881 - RNA, 25 nt, Human
ugagacggcagcacaccaggcaccc

SEQ ID NO: 1219882 - RNA, 24 nt, Human
ugaggccccagggacaggggcugg

SEQ ID NO: 1219883 - RNA, 22 nt, Human
ugccagguguccuacaggggcu

SEQ ID NO: 1219884 - RNA, 21 nt, Human
ugcuggugagguucucuucuu

SEQ ID NO: 1219885 - RNA, 20 nt, Human
ugucggugcugacacagaag

SEQ ID NO: 1219886 - RNA, 25 nt, Human
aaacaacgugggguugaacagccau

SEQ ID NO: 1219887 - RNA, 19 nt, Human
aacaccucuuccacuggcu

SEQ ID NO: 1219888 - RNA, 22 nt, Human
aacuuccgggccuucugcuccc

SEQ ID NO: 1219889 - RNA, 21 nt, Human
acgugggguugaacagccaug

SEQ ID NO: 1219890 - RNA, 21 nt, Human
acucugccacccgggagacag

SEQ ID NO: 1219891 - RNA, 20 nt, Human
agagcaaccccuccucuucc

SEQ ID NO: 1219892 - RNA, 18 nt, Human
aguaauucaagaucagaa

SEQ ID NO: 1219893 - RNA, 20 nt, Human
aguugaccccgaaacaacgu

SEQ ID NO: 1219894 - RNA, 18 nt, Human
caagagcaaccccuccuc

SEQ ID NO: 1219895 - RNA, 21 nt, Human
caccacagcgccauucuccug

SEQ ID NO: 1219896 - RNA, 18 nt, Human
cagcaaagugggguuacg

SEQ ID NO: 1219897 - RNA, 19 nt, Human
cagcaagagcaaccccucc

SEQ ID NO: 1219898 - RNA, 22 nt, Human
cagcgccauucuccugucucuc

SEQ ID NO: 1219899 - RNA, 22 nt, Human
cauuuuuaaauucaucccaaaa

SEQ ID NO: 1219900 - RNA, 21 nt, Human
ccccgaaacaacgugggguug

SEQ ID NO: 1219901 - RNA, 19 nt, Human
ccccuccucuuccuccucc

SEQ ID NO: 1219902 - RNA, 19 nt, Human
ccgcuggacucucagcagg

SEQ ID NO: 1219903 - RNA, 20 nt, Human
ccuccucuuccuccuccucu

SEQ ID NO: 1219904 - RNA, 21 nt, Human
ccuccucuuccuccuccucuu

SEQ ID NO: 1219905 - RNA, 19 nt, Human
ccucuuccuccuccucuuc

SEQ ID NO: 1219906 - RNA, 18 nt, Human
cgacauuuuuaaauucau

SEQ ID NO: 1219907 - RNA, 22 nt, Human
cugaaggcugcccgucuggcug

SEQ ID NO: 1219908 - RNA, 23 nt, Human
cugaaggcugcccgucuggcugg

SEQ ID NO: 1219909 - RNA, 21 nt, Human
gucuggcugggacaccacagc

SEQ ID NO: 1219910 - RNA, 23 nt, Human
guuugguccacucuugcucuuuc

SEQ ID NO: 1219911 - RNA, 22 nt, Human
uaacaccucuuccacuggcugg

SEQ ID NO: 1219912 - RNA, 19 nt, Human
uaguuuaucuauuucccca

SEQ ID NO: 1219913 - RNA, 22 nt, Human
ucagaaaauguuugaaauacag

SEQ ID NO: 1219914 - RNA, 19 nt, Human
ucagcagggauuccaggug

SEQ ID NO: 1219915 - RNA, 21 nt, Human
uccagcuccccuuggguccac

SEQ ID NO: 1219916 - RNA, 23 nt, Human
uccccauaaaguuugguccacuc

SEQ ID NO: 1219917 - RNA, 18 nt, Human
ucccucugggcuuccagc

SEQ ID NO: 1219918 - RNA, 19 nt, Human
ucccucugggcuuccagcu

SEQ ID NO: 1219919 - RNA, 21 nt, Human
ucccucugggcuuccagcucc

SEQ ID NO: 1219920 - RNA, 20 nt, Human
uccgacucugccacccggga

SEQ ID NO: 1219921 - RNA, 30 nt, Human
uccuucgcucugcuggugacuuccuugacu

SEQ ID NO: 1219922 - RNA, 19 nt, Human
ucuccgccucccucugggc

SEQ ID NO: 1219923 - RNA, 21 nt, Human
ucuuccuccuccucuucagcc

SEQ ID NO: 1219924 - RNA, 24 nt, Human
ugaaauacaguugaccccgaaaca

SEQ ID NO: 1219925 - RNA, 19 nt, Human
ugaccccgaaacaacgugg

SEQ ID NO: 1219926 - RNA, 21 nt, Human
ugcuuucgagcuucucuucca

SEQ ID NO: 1219927 - RNA, 21 nt, Human
ugcuuucgagcuucucuucca

SEQ ID NO: 1219928 - RNA, 23 nt, Human
ugggcuuccagcuccccuugggu

SEQ ID NO: 1219929 - RNA, 18 nt, Human
uugaccccgaaacaacgu

SEQ ID NO: 1219930 - RNA, 22 nt, Human
uugaccccgaaacaacgugggg

SEQ ID NO: 1219931 - RNA, 23 nt, Human
uugcauccuuccuuauccccaug

SEQ ID NO: 1219932 - RNA, 20 nt, Human
uuuaucuauuuccccauaaa

SEQ ID NO: 1219933 - RNA, 23 nt, Human
cccugcugggcuggcccucccug

SEQ ID NO: 1219934 - RNA, 22 nt, Human
cugcugggcuggcccucccugc

SEQ ID NO: 1219935 - RNA, 21 nt, Human
cuggcccucccugccccuuca

SEQ ID NO: 1219936 - RNA, 22 nt, Human
ucccugcugggcuggcccuccc

SEQ ID NO: 1219937 - RNA, 22 nt, Human
uccuccuucccugcugggcugg

SEQ ID NO: 1219938 - RNA, 18 nt, Human
ugcugggcuggcccuccc

SEQ ID NO: 1219939 - RNA, 23 nt, Human
aaaaaaaaaaaaaaaggaaagaa

SEQ ID NO: 1219940 - RNA, 22 nt, Human
aaaagcaguaaaaaacuacagu

SEQ ID NO: 1219941 - RNA, 21 nt, Human
aaagccaaacaagaaugaccc

SEQ ID NO: 1219942 - RNA, 22 nt, Human
aagauaaaaauauauaugaaaa

SEQ ID NO: 1219943 - RNA, 23 nt, Human
aagcagcacaacgaacaggaaac

SEQ ID NO: 1219944 - RNA, 24 nt, Human
acaaaaaaaaaaaaaaaggaaaga

SEQ ID NO: 1219945 - RNA, 23 nt, Human
acccagaaucaauuaaaaaaagg

SEQ ID NO: 1219946 - RNA, 27 nt, Human
aggaaacaaaauauaagaaaaaaauac

SEQ ID NO: 1219947 - RNA, 22 nt, Human
caaaaaaaaaaaaaaaggaaag

SEQ ID NO: 1219948 - RNA, 23 nt, Human
cagaaucaauuaaaaaaagggaa

SEQ ID NO: 1219949 - RNA, 19 nt, Human
cagcacaacgaacaggaaa

SEQ ID NO: 1219950 - RNA, 19 nt, Human
cuaaagccaaacaagaaug

SEQ ID NO: 1219951 - RNA, 23 nt, Human
cuaaagccaaacaagaaugaccc

SEQ ID NO: 1219952 - RNA, 24 nt, Human
cuaaagccaaacaagaaugacccc

SEQ ID NO: 1219953 - RNA, 20 nt, Human
gcagagaggagcauaacaaa

SEQ ID NO: 1219954 - RNA, 21 nt, Human
uaaaaaaagggaagugacagu

SEQ ID NO: 1219955 - RNA, 18 nt, Human
uaaaaggcagagaggagc

SEQ ID NO: 1219956 - RNA, 27 nt, Human
uaaggaacuucuaaauuacaaaaaaaa

SEQ ID NO: 1219957 - RNA, 22 nt, Human
uacaguugcugaaaaugaaaau

SEQ ID NO: 1219958 - RNA, 19 nt, Human
ucaauuaaaaaaagggaag

SEQ ID NO: 1219959 - RNA, 25 nt, Human
ucuaaauuacaaaaaaaaaaaaaaa

SEQ ID NO: 1219960 - RNA, 21 nt, Human
ugagaaaacacuaaagccaaa

SEQ ID NO: 1219961 - RNA, 22 nt, Human
uuacaaaaaaaaaaaaaaagga

SEQ ID NO: 1219962 - RNA, 24 nt, Human
uucuugacaauaaggaacuucuaa

SEQ ID NO: 1219963 - RNA, 22 nt, Human
aaaagaaaaaaaaaucaaaauc

SEQ ID NO: 1219964 - RNA, 20 nt, Human
aaacgagauauaauucugaa

SEQ ID NO: 1219965 - RNA, 24 nt, Human
aaauaaacaacaacaaaaaaaaca

SEQ ID NO: 1219966 - RNA, 22 nt, Human
aacaaaaccacacaguaauaca

SEQ ID NO: 1219967 - RNA, 19 nt, Human
aacaacaaaaaaaacaaaa

SEQ ID NO: 1219968 - RNA, 22 nt, Human
aacaagggaauaaaaugagaga

SEQ ID NO: 1219969 - RNA, 25 nt, Human
aagaucacauaaaagaaaaaaaaau

SEQ ID NO: 1219970 - RNA, 18 nt, Human
aagauggacaacauacca

SEQ ID NO: 1219971 - RNA, 21 nt, Human
acaacaaaaaaaacaaaacca

SEQ ID NO: 1219972 - RNA, 21 nt, Human
acaacaacaaaaaaaacaaaa

SEQ ID NO: 1219973 - RNA, 20 nt, Human
acauaaaagaaaaaaaaauc

SEQ ID NO: 1219974 - RNA, 21 nt, Human
acauaaaagaaaaaaaaauca

SEQ ID NO: 1219975 - RNA, 21 nt, Human
acauuuaaguagaaacgagau

SEQ ID NO: 1219976 - RNA, 20 nt, Human
accacgcacccgaccacgcc

SEQ ID NO: 1219977 - RNA, 24 nt, Human
acgcaccacgcacccgaccacgcc

SEQ ID NO: 1219978 - RNA, 22 nt, Human
agaaacgagauauaauucugaa

SEQ ID NO: 1219979 - RNA, 19 nt, Human
agaaaucaacaagggaaua

SEQ ID NO: 1219980 - RNA, 23 nt, Human
agagagcgugggagagaggaagg

SEQ ID NO: 1219981 - RNA, 21 nt, Human
agagaggaaggggggcaggaa

SEQ ID NO: 1219982 - RNA, 18 nt, Human
agagauaaaagagagcgu

SEQ ID NO: 1219983 - RNA, 18 nt, Human
agaggaaggggggcagga

SEQ ID NO: 1219984 - RNA, 18 nt, Human
agccggacccacgcacca

SEQ ID NO: 1219985 - RNA, 24 nt, Human
agggagacuggggaggccccaggg

SEQ ID NO: 1219986 - RNA, 21 nt, Human
aguagcaugcacccaccaaga

SEQ ID NO: 1219987 - RNA, 23 nt, Human
auaaacaacaacaaaaaaaacaa

SEQ ID NO: 1219988 - RNA, 18 nt, Human
aucacaaaaugguuccaa

SEQ ID NO: 1219989 - RNA, 19 nt, Human
aucagccacagugauuuau

SEQ ID NO: 1219990 - RNA, 19 nt, Human
caaaaaaaacaaaaccaca

SEQ ID NO: 1219991 - RNA, 21 nt, Human
caaaaaauuaacccuaagcac

SEQ ID NO: 1219992 - RNA, 23 nt, Human
caacaaaaaaaacaaaaccacac

SEQ ID NO: 1219993 - RNA, 24 nt, Human
caacaaaaaaaacaaaaccacaca

SEQ ID NO: 1219994 - RNA, 23 nt, Human
caacaacaaaaaaaacaaaacca

SEQ ID NO: 1219995 - RNA, 18 nt, Human
caacaagggaauaaaaug

SEQ ID NO: 1219996 - RNA, 21 nt, Human
caaguguacaucaacugaucc

SEQ ID NO: 1219997 - RNA, 24 nt, Human
cacugaaaacaaaaguucccaucu

SEQ ID NO: 1219998 - RNA, 20 nt, Human
cagcuccaacauuguuugca

SEQ ID NO: 1219999 - RNA, 21 nt, Human
cagcuccaacauuguuugcac

SEQ ID NO: 1220000 - RNA, 21 nt, Human
caggucgcaggcucgagccga

SEQ ID NO: 1220001 - RNA, 18 nt, Human
caguacaaaaaauuaacc

SEQ ID NO: 1220002 - RNA, 23 nt, Human
cauaaaagaaaaaaaaaucaaaa

SEQ ID NO: 1220003 - RNA, 22 nt, Human
cccacgcaccacgcacccgacc

SEQ ID NO: 1220004 - RNA, 23 nt, Human
cccacgcaccacgcacccgacca

SEQ ID NO: 1220005 - RNA, 25 nt, Human
cccacgcaccacgcacccgaccacg

SEQ ID NO: 1220006 - RNA, 19 nt, Human
ccggacccacgcaccacgc

SEQ ID NO: 1220007 - RNA, 20 nt, Human
cgggagggacagaaggcuag

SEQ ID NO: 1220008 - RNA, 29 nt, Human
cuaagcacuacauuuaaguagaaacgagg

SEQ ID NO: 1220009 - RNA, 21 nt, Human
cucuuacuauuacagcuccaa

SEQ ID NO: 1220010 - RNA, 20 nt, Human
gaaacgagauauaauucuga

SEQ ID NO: 1220011 - RNA, 23 nt, Human
gauaaaagagagcgugggagaga

SEQ ID NO: 1220012 - RNA, 19 nt, Human
gcaggucccuaagaaauuu

SEQ ID NO: 1220013 - RNA, 19 nt, Human
ggcagggcuaccgaugcac

SEQ ID NO: 1220014 - RNA, 19 nt, Human
ggcagggcuaccgaugcac

SEQ ID NO: 1220015 - RNA, 22 nt, Human
gggagggacagaaggcuaguga

SEQ ID NO: 1220016 - RNA, 20 nt, Human
ggucuggaggggugggcagg

SEQ ID NO: 1220017 - RNA, 30 nt, Human
uaaacaacaacaaaaaaaacaaaaccacaa

SEQ ID NO: 1220018 - RNA, 18 nt, Human
uaagaaccgaggucugga

SEQ ID NO: 1220019 - RNA, 21 nt, Human
ucaaauaaacaacaacaaaaa

SEQ ID NO: 1220020 - RNA, 22 nt, Human
ucacauaaaagaaaaaaaaauc

SEQ ID NO: 1220021 - RNA, 22 nt, Human
ucaguaaugcacagugauucug

SEQ ID NO: 1220022 - RNA, 20 nt, Human
ucccaaagaucacauaaaag

SEQ ID NO: 1220023 - RNA, 22 nt, Human
ucgcaggcucgagccgaagccc

SEQ ID NO: 1220024 - RNA, 24 nt, Human
ugaggugggaaaaaaucccaaauc

SEQ ID NO: 1220025 - RNA, 24 nt, Human
ugauaaacagagucucaguaaugc

SEQ ID NO: 1220026 - RNA, 24 nt, Human
ugcacugaaaacaaaaguucccaa

SEQ ID NO: 1220027 - RNA, 26 nt, Human
ugcccaggcgcgagggggagggagac

SEQ ID NO: 1220028 - RNA, 22 nt, Human
uggacaacauaccaucacaaaa

SEQ ID NO: 1220029 - RNA, 21 nt, Human
ugggagagagcugcccaggcg

SEQ ID NO: 1220030 - RNA, 22 nt, Human
uugaagcuuuuguacaaaaacu

SEQ ID NO: 1220031 - RNA, 21 nt, Human
aacacccacacucagagugac

SEQ ID NO: 1220032 - RNA, 24 nt, Human
acacacgcacgcagguguacacac

SEQ ID NO: 1220033 - RNA, 27 nt, Human
acacgcacacacacgcacgcaggugua

SEQ ID NO: 1220034 - RNA, 27 nt, Human
acacgcacacacacgcacgcaggugua

SEQ ID NO: 1220035 - RNA, 31 nt, Human
acacgcacauacacgaacacacgcgcacaca

SEQ ID NO: 1220036 - RNA, 21 nt, Human
acccacacucagagugacauc

SEQ ID NO: 1220037 - RNA, 21 nt, Human
acccagccacagauagugaca

SEQ ID NO: 1220038 - RNA, 20 nt, Human
acgcacauacacgaacacaa

SEQ ID NO: 1220039 - RNA, 23 nt, Human
acucucaguccuauucauucauc

SEQ ID NO: 1220040 - RNA, 23 nt, Human
agacacagccacccaccgugaca

SEQ ID NO: 1220041 - RNA, 21 nt, Human
agacagaaaacacgccgcagu

SEQ ID NO: 1220042 - RNA, 20 nt, Human
agacaggcccgugcaaugca

SEQ ID NO: 1220043 - RNA, 20 nt, Human
agccguucacccagccacag

SEQ ID NO: 1220044 - RNA, 20 nt, Human
auaagucacaaaaugugagu

SEQ ID NO: 1220045 - RNA, 25 nt, Human
augcacacacacgcgcacgcacaca

SEQ ID NO: 1220046 - RNA, 21 nt, Human
cacaaacagggagacaggccc

SEQ ID NO: 1220047 - RNA, 31 nt, Human
cacacacacgcgcacgcacacacgcacauag

SEQ ID NO: 1220048 - RNA, 31 nt, Human
cacacacgcacauacacgaacacacgcgcag

SEQ ID NO: 1220049 - RNA, 18 nt, Human
cacacauggcgacaccca

SEQ ID NO: 1220050 - RNA, 24 nt, Human
cacacgagcaacuccgagacacuc

SEQ ID NO: 1220051 - RNA, 21 nt, Human
cacacgcacauacacgaacac

SEQ ID NO: 1220052 - RNA, 31 nt, Human
cacgaacacacgcgcacacacgcacacagug

SEQ ID NO: 1220053 - RNA, 25 nt, Human
cacgcacacacgcacauacacgaac

SEQ ID NO: 1220054 - RNA, 18 nt, Human
cacuaggcuggggggggg

SEQ ID NO: 1220055 - RNA, 20 nt, Human
cacugugacucucaguccua

SEQ ID NO: 1220056 - RNA, 19 nt, Human
caugacacaggcaugcaug

SEQ ID NO: 1220057 - RNA, 24 nt, Human
caugcaugccacauucacugugac

SEQ ID NO: 1220058 - RNA, 22 nt, Human
ccaacacccacacucagaguga

SEQ ID NO: 1220059 - RNA, 20 nt, Human
cccugagcacacaggguggc

SEQ ID NO: 1220060 - RNA, 31 nt, Human
cgaacacacgcgcacacacgcacacacacgg

SEQ ID NO: 1220061 - RNA, 25 nt, Human
cgcacacacacgcacgcagguguac

SEQ ID NO: 1220062 - RNA, 25 nt, Human
cgcacacacgcacacacacgcacgc

SEQ ID NO: 1220063 - RNA, 26 nt, Human
cgcacgcacacacgcacauacacgaa

SEQ ID NO: 1220064 - RNA, 22 nt, Human
cgccgcaguauacucuaguaug

SEQ ID NO: 1220065 - RNA, 20 nt, Human
cugaaauguccacccuuugc

SEQ ID NO: 1220066 - RNA, 22 nt, Human
cuggugcuuguagauuuccucc

SEQ ID NO: 1220067 - RNA, 19 nt, Human
cuugacuuuauuuaucuuc

SEQ ID NO: 1220068 - RNA, 31 nt, Human
cuuugcaaaaugcacacacacgcgcacgcag

SEQ ID NO: 1220069 - RNA, 21 nt, Human
gacacagccacccaccgugac

SEQ ID NO: 1220070 - RNA, 20 nt, Human
gagacacucauucaccauga

SEQ ID NO: 1220071 - RNA, 18 nt, Human
gagugacaucugcuggag

SEQ ID NO: 1220072 - RNA, 23 nt, Human
gcacacacgcacacacacgcacg

SEQ ID NO: 1220073 - RNA, 30 nt, Human
gcacauacacgaacacacgcgcacacacgg

SEQ ID NO: 1220074 - RNA, 23 nt, Human
gcacgcacacacgcacauacacg

SEQ ID NO: 1220075 - RNA, 19 nt, Human
ggcugggggggggggguca

SEQ ID NO: 1220076 - RNA, 19 nt, Human
guguacacacacacgagca

SEQ ID NO: 1220077 - RNA, 22 nt, Human
uaaaucucccccaccaugacau

SEQ ID NO: 1220078 - RNA, 20 nt, Human
uacgugggacgaggggcagg

SEQ ID NO: 1220079 - RNA, 19 nt, Human
uaggcuggggggggggggu

SEQ ID NO: 1220080 - RNA, 21 nt, Human
uaguauguuuacacaaacagg

SEQ ID NO: 1220081 - RNA, 20 nt, Human
ugcucagacacagccaccca

SEQ ID NO: 1220082 - RNA, 23 nt, Human
uggcaggugcagccccaucuucc

SEQ ID NO: 1220083 - RNA, 19 nt, Human
uggcugccacaauguccuc

SEQ ID NO: 1220084 - RNA, 22 nt, Human
uguacacacacacgagcaacuc

SEQ ID NO: 1220085 - RNA, 20 nt, Human
ugucacaugacacaggcaug

SEQ ID NO: 1220086 - RNA, 24 nt, Human
ugucacaugacacaggcaugcaug

SEQ ID NO: 1220087 - RNA, 33 nt, Human
uuugcaaaaugcacacacacgcgcacgcacagu

SEQ ID NO: 1220088 - RNA, 26 nt, Human
aagugauucucgugccucagcaucca

SEQ ID NO: 1220089 - RNA, 24 nt, Human
acagcucggugcugacguccucgc

SEQ ID NO: 1220090 - RNA, 20 nt, Human
accaggacagccauggccag

SEQ ID NO: 1220091 - RNA, 18 nt, Human
acccacgaguagcccuga

SEQ ID NO: 1220092 - RNA, 18 nt, Human
acccuuggacaauaggau

SEQ ID NO: 1220093 - RNA, 21 nt, Human
acucugucucccaggcuggag

SEQ ID NO: 1220094 - RNA, 24 nt, Human
acucugucucccaggcuggagugc

SEQ ID NO: 1220095 - RNA, 30 nt, Human
agaaauaguagcaggagcccccgaagggcc

SEQ ID NO: 1220096 - RNA, 19 nt, Human
aggaaacugaguuucagag

SEQ ID NO: 1220097 - RNA, 24 nt, Human
aggcgugugccaccacgcccggcu

SEQ ID NO: 1220098 - RNA, 25 nt, Human
aggcuggagugcaguggcgcaaucu

SEQ ID NO: 1220099 - RNA, 20 nt, Human
agugcaguggcgcaaucucg

SEQ ID NO: 1220100 - RNA, 24 nt, Human
agugcaguggcgcaaucucggcuc

SEQ ID NO: 1220101 - RNA, 18 nt, Human
augcuggucuugaacucc

SEQ ID NO: 1220102 - RNA, 18 nt, Human
augggguuucgccacguu

SEQ ID NO: 1220103 - RNA, 19 nt, Human
augggguuucgccacguuu

SEQ ID NO: 1220104 - RNA, 19 nt, Human
auuacaggcgugugccacc

SEQ ID NO: 1220105 - RNA, 22 nt, Human
caagugauucucgugccucagc

SEQ ID NO: 1220106 - RNA, 24 nt, Human
caccccguggccagacucagggac

SEQ ID NO: 1220107 - RNA, 23 nt, Human
caccucggccucaaaacaugucc

SEQ ID NO: 1220108 - RNA, 21 nt, Human
cacugcaaccucugccuccug

SEQ ID NO: 1220109 - RNA, 23 nt, Human
cacugcaaccucugccuccuggg

SEQ ID NO: 1220110 - RNA, 24 nt, Human
cagaaucacagcccacaguacugg

SEQ ID NO: 1220111 - RNA, 25 nt, Human
cagcagcgccugcguccccgagccu

SEQ ID NO: 1220112 - RNA, 22 nt, Human
cagcagcgccugcgucggcguc

SEQ ID NO: 1220113 - RNA, 19 nt, Human
cagcccacaguacuggcga

SEQ ID NO: 1220114 - RNA, 20 nt, Human
caggagcccuuccccuaccu

SEQ ID NO: 1220115 - RNA, 19 nt, Human
cagggcucucuccugcucc

SEQ ID NO: 1220116 - RNA, 22 nt, Human
caggggacucccuuccacaccc

SEQ ID NO: 1220117 - RNA, 20 nt, Human
ccaccacgcccggcuaauuu

SEQ ID NO: 1220118 - RNA, 19 nt, Human
ccacgcacccaggacucca

SEQ ID NO: 1220119 - RNA, 20 nt, Human
ccaguauucacgggcacuag

SEQ ID NO: 1220120 - RNA, 21 nt, Human
cccacgaguagcccugaaccu

SEQ ID NO: 1220121 - RNA, 25 nt, Human
cccacgcacccaggacuccaucucc

SEQ ID NO: 1220122 - RNA, 19 nt, Human
cccaggcuggagugcagug

SEQ ID NO: 1220123 - RNA, 23 nt, Human
cccaugcuggucuugaacuccug

SEQ ID NO: 1220124 - RNA, 20 nt, Human
ccccagugcccuggcagaac

SEQ ID NO: 1220125 - RNA, 23 nt, Human
ccccaucccaaaacgcaugcccg

SEQ ID NO: 1220126 - RNA, 19 nt, Human
cccccaggacugagcccua

SEQ ID NO: 1220127 - RNA, 24 nt, Human
cccccaggacugagcccuagaggc

SEQ ID NO: 1220128 - RNA, 24 nt, Human
cccccaucccaaaacgcaugcccg

SEQ ID NO: 1220129 - RNA, 21 nt, Human
cccguggccagacucagggac

SEQ ID NO: 1220130 - RNA, 18 nt, Human
ccgccgggucacuuggga

SEQ ID NO: 1220131 - RNA, 18 nt, Human
ccuauggucacacagcuu

SEQ ID NO: 1220132 - RNA, 19 nt, Human
ccucgcggucccugccggc

SEQ ID NO: 1220133 - RNA, 22 nt, Human
ccucugccuccuggguucaagu

SEQ ID NO: 1220134 - RNA, 24 nt, Human
ccugaccucaggugauccgcccac

SEQ ID NO: 1220135 - RNA, 21 nt, Human
ccugcgccuccccaagcuccg

SEQ ID NO: 1220136 - RNA, 20 nt, Human
ccuggguucaagugauucuc

SEQ ID NO: 1220137 - RNA, 22 nt, Human
cgcagguguugcacggcccugc

SEQ ID NO: 1220138 - RNA, 19 nt, Human
cgccucugcccacgugguc

SEQ ID NO: 1220139 - RNA, 19 nt, Human
cguggucugcagcagcgcc

SEQ ID NO: 1220140 - RNA, 24 nt, Human
cucacugcaaccucugccuccugg

SEQ ID NO: 1220141 - RNA, 18 nt, Human
cucagaaucacagcccac

SEQ ID NO: 1220142 - RNA, 21 nt, Human
cucagggaccacagggccccc

SEQ ID NO: 1220143 - RNA, 19 nt, Human
cuccagcgcccgguacagc

SEQ ID NO: 1220144 - RNA, 22 nt, Human
cuccaucagcuucgccugcgcc

SEQ ID NO: 1220145 - RNA, 19 nt, Human
cucccccaggcccccuaca

SEQ ID NO: 1220146 - RNA, 20 nt, Human
cuccuggguucaagugauuc

SEQ ID NO: 1220147 - RNA, 21 nt, Human
cuccuggguucaagugauucu

SEQ ID NO: 1220148 - RNA, 23 nt, Human
cugagugggacucaguccacccc

SEQ ID NO: 1220149 - RNA, 23 nt, Human
cugcaaccucugccuccuggguu

SEQ ID NO: 1220150 - RNA, 24 nt, Human
cugcaaccucugccuccuggguuc

SEQ ID NO: 1220151 - RNA, 23 nt, Human
cugccuccuggguucaagugauu

SEQ ID NO: 1220152 - RNA, 18 nt, Human
cuggcgaccaggacagcu

SEQ ID NO: 1220153 - RNA, 24 nt, Human
gaccucaggugauccgcccaccuc

SEQ ID NO: 1220154 - RNA, 22 nt, Human
gacucaguccacccacgaguag

SEQ ID NO: 1220155 - RNA, 18 nt, Human
gacucccuuccacacccc

SEQ ID NO: 1220156 - RNA, 18 nt, Human
gagaugggguuucgccac

SEQ ID NO: 1220157 - RNA, 20 nt, Human
gagaugggguuucgccacgu

SEQ ID NO: 1220158 - RNA, 18 nt, Human
gauuacaggcgugugcca

SEQ ID NO: 1220159 - RNA, 21 nt, Human
gauucucgugccucagcaucc

SEQ ID NO: 1220160 - RNA, 25 nt, Human
gccaggaagaggggucucgggcucc

SEQ ID NO: 1220161 - RNA, 24 nt, Human
gcccccacgcacccaggacuccau

SEQ ID NO: 1220162 - RNA, 23 nt, Human
gcccggcuaauuuuuuguauuuu

SEQ ID NO: 1220163 - RNA, 19 nt, Human
gcuggagugcaguggcgca

SEQ ID NO: 1220164 - RNA, 23 nt, Human
gcuggucuugaacuccugaccuc

SEQ ID NO: 1220165 - RNA, 24 nt, Human
ggacucaggggacucccuuccaca

SEQ ID NO: 1220166 - RNA, 27 nt, Human
ggcgaccaggacagccauggccaggaa

SEQ ID NO: 1220167 - RNA, 19 nt, Human
ggcucacaggaacccucac

SEQ ID NO: 1220168 - RNA, 18 nt, Human
gggcacccagcgccgccg

SEQ ID NO: 1220169 - RNA, 18 nt, Human
gggcccccacgcacccag

SEQ ID NO: 1220170 - RNA, 23 nt, Human
gggucacuugggaggacucaggg

SEQ ID NO: 1220171 - RNA, 19 nt, Human
ggguuagcugggauuacag

SEQ ID NO: 1220172 - RNA, 19 nt, Human
ggucuugaacuccugaccu

SEQ ID NO: 1220173 - RNA, 20 nt, Human
guccugcucccccaggcccc

SEQ ID NO: 1220174 - RNA, 21 nt, Human
gugauccgcccaccucggccu

SEQ ID NO: 1220175 - RNA, 20 nt, Human
guggcccugcgccucugccc

SEQ ID NO: 1220176 - RNA, 19 nt, Human
guuagcugggauuacaggc

SEQ ID NO: 1220177 - RNA, 21 nt, Human
guuagcugggauuacaggcgu

SEQ ID NO: 1220178 - RNA, 24 nt, Human
uaaguaacuugccuauggucacac

SEQ ID NO: 1220179 - RNA, 24 nt, Human
uaauuuuuuguauuuuuaguagag

SEQ ID NO: 1220180 - RNA, 25 nt, Human
uaauuuuuuguauuuuuaguagaga

SEQ ID NO: 1220181 - RNA, 23 nt, Human
uacaggcgugugccaccacgccc

SEQ ID NO: 1220182 - RNA, 19 nt, Human
uaccugaagcugaguggga

SEQ ID NO: 1220183 - RNA, 22 nt, Human
uagagaugggguuucgccacgu

SEQ ID NO: 1220184 - RNA, 20 nt, Human
uagaggccuggguuccucuc

SEQ ID NO: 1220185 - RNA, 21 nt, Human
uagcugggauuacaggcgugu

SEQ ID NO: 1220186 - RNA, 18 nt, Human
uaguagagaugggguuuc

SEQ ID NO: 1220187 - RNA, 24 nt, Human
uaguagagaugggguuucgccacg

SEQ ID NO: 1220188 - RNA, 24 nt, Human
ucacugcaaccucugccuccuggg

SEQ ID NO: 1220189 - RNA, 25 nt, Human
ucacugcaaccucugccuccugggu

SEQ ID NO: 1220190 - RNA, 27 nt, Human
ucacugcaaccucugccuccuggguuc

SEQ ID NO: 1220191 - RNA, 24 nt, Human
ucagcaguucccgcagggcucucu

SEQ ID NO: 1220192 - RNA, 22 nt, Human
ucaguccacccacgaguagccc

SEQ ID NO: 1220193 - RNA, 23 nt, Human
ucccaggcuggagugcaguggcg

SEQ ID NO: 1220194 - RNA, 19 nt, Human
ucccaugcuggucuugaac

SEQ ID NO: 1220195 - RNA, 21 nt, Human
uccccagugcccuggcagaac

SEQ ID NO: 1220196 - RNA, 19 nt, Human
ucccgcagggcucucuccu

SEQ ID NO: 1220197 - RNA, 21 nt, Human
uccuggguucaagugauucuc

SEQ ID NO: 1220198 - RNA, 24 nt, Human
uccuggguucaagugauucucgug

SEQ ID NO: 1220199 - RNA, 24 nt, Human
ucuaacucugucucccaggcugga

SEQ ID NO: 1220200 - RNA, 24 nt, Human
ucucccaggcuggagugcaguggc

SEQ ID NO: 1220201 - RNA, 18 nt, Human
ucugcagccucacggccu

SEQ ID NO: 1220202 - RNA, 19 nt, Human
ucugucucccaggcuggag

SEQ ID NO: 1220203 - RNA, 24 nt, Human
ucugucucccaggcuggagugcag

SEQ ID NO: 1220204 - RNA, 23 nt, Human
ucuugaacuccugaccucaggug

SEQ ID NO: 1220205 - RNA, 18 nt, Human
ugaccucaggugauccgc

SEQ ID NO: 1220206 - RNA, 21 nt, Human
ugaccucaggugauccgccca

SEQ ID NO: 1220207 - RNA, 24 nt, Human
ugaccucaggugauccgcccaccu

SEQ ID NO: 1220208 - RNA, 22 nt, Human
ugauccgcccaccucggccuca

SEQ ID NO: 1220209 - RNA, 22 nt, Human
ugcaguggcgcaaucucggcuc

SEQ ID NO: 1220210 - RNA, 23 nt, Human
ugcaguggcgcaaucucggcuca

SEQ ID NO: 1220211 - RNA, 19 nt, Human
ugcccuggcagaacaagga

SEQ ID NO: 1220212 - RNA, 25 nt, Human
ugccucagcauccaggguuagcugg

SEQ ID NO: 1220213 - RNA, 19 nt, Human
ugcgccuccccaagcuccg

SEQ ID NO: 1220214 - RNA, 23 nt, Human
uggagugcaguggcgcaaucucg

SEQ ID NO: 1220215 - RNA, 24 nt, Human
uggagugcaguggcgcaaucucgg

SEQ ID NO: 1220216 - RNA, 23 nt, Human
uggcagaacaaggacggcaugcu

SEQ ID NO: 1220217 - RNA, 18 nt, Human
uggcccccagguuucacc

SEQ ID NO: 1220218 - RNA, 19 nt, Human
uggcccccagguuucacca

SEQ ID NO: 1220219 - RNA, 18 nt, Human
ugggauuacaggcgugug

SEQ ID NO: 1220220 - RNA, 19 nt, Human
ugggauuacaggcgugugc

SEQ ID NO: 1220221 - RNA, 21 nt, Human
ugggauuacaggcgugugcca

SEQ ID NO: 1220222 - RNA, 22 nt, Human
ugggauuacaggcgugugccac

SEQ ID NO: 1220223 - RNA, 24 nt, Human
ugggauuacaggcgugugccacca

SEQ ID NO: 1220224 - RNA, 23 nt, Human
uggguucaagugauucucgugcc

SEQ ID NO: 1220225 - RNA, 18 nt, Human
uuaguagagaugggguuu

SEQ ID NO: 1220226 - RNA, 22 nt, Human
uuaguagagaugggguuucgcc

SEQ ID NO: 1220227 - RNA, 25 nt, Human
uuaguagagaugggguuucgccacg

SEQ ID NO: 1220228 - RNA, 23 nt, Human
uucaagugauucucgugccucag

SEQ ID NO: 1220229 - RNA, 23 nt, Human
uuccacaccccguggccagacuc

SEQ ID NO: 1220230 - RNA, 20 nt, Human
uucccgcagggcucucuccu

SEQ ID NO: 1220231 - RNA, 23 nt, Human
uuguauuuuuaguagagaugggg

SEQ ID NO: 1220232 - RNA, 23 nt, Human
uuuuuaguagagaugggguuucg

SEQ ID NO: 1220233 - RNA, 24 nt, Human
uuuuuaguagagaugggguuucgc

SEQ ID NO: 1220234 - RNA, 21 nt, Human
uuuuuguauuuuuaguagaga

SEQ ID NO: 1220235 - RNA, 24 nt, Human
uuuuuuguauuuuuaguagagaug

SEQ ID NO: 1220236 - RNA, 22 nt, Human
aaaaauacgauuuuuugagagc

SEQ ID NO: 1220237 - RNA, 24 nt, Human
aaaaugucuacacagcuaugaaca

SEQ ID NO: 1220238 - RNA, 22 nt, Human
aaacagcggagaccacauacaa

SEQ ID NO: 1220239 - RNA, 23 nt, Human
aagaaaagggaucuccccuuugc

SEQ ID NO: 1220240 - RNA, 24 nt, Human
aagaaaccugaacgaugucacuga

SEQ ID NO: 1220241 - RNA, 22 nt, Human
aagcgggaaucccgccuuccau

SEQ ID NO: 1220242 - RNA, 24 nt, Human
aagcuugcaagcuaagacucccaa

SEQ ID NO: 1220243 - RNA, 20 nt, Human
aauaacuuaaaacacacuaa

SEQ ID NO: 1220244 - RNA, 20 nt, Human
aaugaaaaauggcaccugaa

SEQ ID NO: 1220245 - RNA, 20 nt, Human
aauugauaggauucagauaa

SEQ ID NO: 1220246 - RNA, 22 nt, Human
acaaaucaauaacuuaaaacac

SEQ ID NO: 1220247 - RNA, 18 nt, Human
acaguugaagcuuaagac

SEQ ID NO: 1220248 - RNA, 18 nt, Human
accugcgggcgggccccc

SEQ ID NO: 1220249 - RNA, 20 nt, Human
acuaauauacaaaaggucua

SEQ ID NO: 1220250 - RNA, 22 nt, Human
acucugaaaauggugcaaaagu

SEQ ID NO: 1220251 - RNA, 20 nt, Human
agaaaccugaacgaugucag

SEQ ID NO: 1220252 - RNA, 23 nt, Human
agaaagaacugaguaucgggaca

SEQ ID NO: 1220253 - RNA, 19 nt, Human
agaagcugaggugcuacaa

SEQ ID NO: 1220254 - RNA, 23 nt, Human
agagagccuccccucccccaaag

SEQ ID NO: 1220255 - RNA, 21 nt, Human
agagccuccccucccccaaag

SEQ ID NO: 1220256 - RNA, 18 nt, Human
agagcugcgacuagaggc

SEQ ID NO: 1220257 - RNA, 18 nt, Human
agcaacuagaaccuugau

SEQ ID NO: 1220258 - RNA, 24 nt, Human
agcugccuggggucuaacuaccag

SEQ ID NO: 1220259 - RNA, 24 nt, Human
aggcagcugcccuuggccaggaaa

SEQ ID NO: 1220260 - RNA, 21 nt, Human
aggggacucagcacccgggag

SEQ ID NO: 1220261 - RNA, 18 nt, Human
agggggcgaggaaagaag

SEQ ID NO: 1220262 - RNA, 21 nt, Human
agggugggguggagggacagg

SEQ ID NO: 1220263 - RNA, 18 nt, Human
agguccuaguaggugagg

SEQ ID NO: 1220264 - RNA, 22 nt, Human
agguggagggugggguggaggg

SEQ ID NO: 1220265 - RNA, 24 nt, Human
auaucacagaauuccagucauagu

SEQ ID NO: 1220266 - RNA, 20 nt, Human
aucagaaggguguuggcucc

SEQ ID NO: 1220267 - RNA, 23 nt, Human
aucugaagucuucuggguuauca

SEQ ID NO: 1220268 - RNA, 29 nt, Human
auggugcaaaaguuucauucucuuugaga

SEQ ID NO: 1220269 - RNA, 18 nt, Human
auucagauucuacugcca

SEQ ID NO: 1220270 - RNA, 18 nt, Human
caagaaagaaaccugaac

SEQ ID NO: 1220271 - RNA, 27 nt, Human
cacagagcugcgacuagaggcacagcc

SEQ ID NO: 1220272 - RNA, 21 nt, Human
caccugucccagcaucagaau

SEQ ID NO: 1220273 - RNA, 23 nt, Human
cagaagcgggaaucccgccuucc

SEQ ID NO: 1220274 - RNA, 18 nt, Human
cagcaacuagaaccuuga

SEQ ID NO: 1220275 - RNA, 25 nt, Human
cagcacagaaaacugcggcuuggca

SEQ ID NO: 1220276 - RNA, 19 nt, Human
cagcaccaccugcgggcgg

SEQ ID NO: 1220277 - RNA, 24 nt, Human
cagccaucaucucaugagagcaau

SEQ ID NO: 1220278 - RNA, 18 nt, Human
caggaaccccugaccccc

SEQ ID NO: 1220279 - RNA, 24 nt, Human
caggagaagguggcggaacccacc

SEQ ID NO: 1220280 - RNA, 19 nt, Human
caggauagaggccuccugu

SEQ ID NO: 1220281 - RNA, 22 nt, Human
cauacaaugagaauguuccuga

SEQ ID NO: 1220282 - RNA, 21 nt, Human
caucagaaggguguuggcucc

SEQ ID NO: 1220283 - RNA, 21 nt, Human
caucagaaggguguuggcucc

SEQ ID NO: 1220284 - RNA, 21 nt, Human
caucagaaggguguuggcucc

SEQ ID NO: 1220285 - RNA, 21 nt, Human
caucagaaggguguuggcucc

SEQ ID NO: 1220286 - RNA, 19 nt, Human
cauuuauucacaaggauua

SEQ ID NO: 1220287 - RNA, 18 nt, Human
ccaagcgcagacucucag

SEQ ID NO: 1220288 - RNA, 19 nt, Human
cccaaaccaacggaaaagg

SEQ ID NO: 1220289 - RNA, 28 nt, Human
cccacuucauuuauuaccaaaauaucac

SEQ ID NO: 1220290 - RNA, 18 nt, Human
cccauguaaaaacaaagu

SEQ ID NO: 1220291 - RNA, 19 nt, Human
ccccaaaccgcaucacucc

SEQ ID NO: 1220292 - RNA, 18 nt, Human
cccccgaggaagcccaug

SEQ ID NO: 1220293 - RNA, 18 nt, Human
ccccugggcugccggcuc

SEQ ID NO: 1220294 - RNA, 21 nt, Human
cccuuggccaggaaaaggcuc

SEQ ID NO: 1220295 - RNA, 22 nt, Human
ccugggcugccggcuccaaagg

SEQ ID NO: 1220296 - RNA, 27 nt, Human
cgaaauucccaaauaaaagcagagcac

SEQ ID NO: 1220297 - RNA, 22 nt, Human
cgggcgggcccccgaggaagcc

SEQ ID NO: 1220298 - RNA, 22 nt, Human
cuaaaccccaggggucucugcu

SEQ ID NO: 1220299 - RNA, 23 nt, Human
cuccaggacuaaggccaagcgca

SEQ ID NO: 1220300 - RNA, 22 nt, Human
cuucagggcugucuugcgaagu

SEQ ID NO: 1220301 - RNA, 22 nt, Human
cuuggccaggaaaaggcucacc

SEQ ID NO: 1220302 - RNA, 18 nt, Human
gaaaccugaacgauguca

SEQ ID NO: 1220303 - RNA, 22 nt, Human
gaaaccugaacgaugucacuga

SEQ ID NO: 1220304 - RNA, 22 nt, Human
gaaggcuguucaaacagcggag

SEQ ID NO: 1220305 - RNA, 19 nt, Human
gagugagacuccaggggga

SEQ ID NO: 1220306 - RNA, 24 nt, Human
gauccgagauucagauucuacugc

SEQ ID NO: 1220307 - RNA, 22 nt, Human
gcaacuagaaccuugauggaac

SEQ ID NO: 1220308 - RNA, 19 nt, Human
gcgaaaagcacauggaaau

SEQ ID NO: 1220309 - RNA, 19 nt, Human
gcggaacccacccagcacc

SEQ ID NO: 1220310 - RNA, 21 nt, Human
gcuaaauagaaauacaacuga

SEQ ID NO: 1220311 - RNA, 19 nt, Human
ggaaagaagcugaggugcu

SEQ ID NO: 1220312 - RNA, 22 nt, Human
ggagggaaucagucacagagcu

SEQ ID NO: 1220313 - RNA, 22 nt, Human
ggagugacaguuguuaagcuaa

SEQ ID NO: 1220314 - RNA, 18 nt, Human
ggauugagguggagggug

SEQ ID NO: 1220315 - RNA, 24 nt, Human
gggccggucuuggcucccaacagc

SEQ ID NO: 1220316 - RNA, 23 nt, Human
gggcgaggaaagaagcugaggug

SEQ ID NO: 1220317 - RNA, 20 nt, Human
gggcugauggaaaacugaua

SEQ ID NO: 1220318 - RNA, 19 nt, Human
ggggacucagcacccggga

SEQ ID NO: 1220319 - RNA, 20 nt, Human
gggugggguggagggacagg

SEQ ID NO: 1220320 - RNA, 23 nt, Human
gucaucauuuucacaguugaagc

SEQ ID NO: 1220321 - RNA, 18 nt, Human
gucuggggaagaugggag

SEQ ID NO: 1220322 - RNA, 20 nt, Human
uaaaaaacagccuacgguca

SEQ ID NO: 1220323 - RNA, 23 nt, Human
uaaaaaacagccuacggucacgu

SEQ ID NO: 1220324 - RNA, 25 nt, Human
uaaaacaaaucaauaacuuaaaaca

SEQ ID NO: 1220325 - RNA, 24 nt, Human
uaaauaaacagauaaauacagcca

SEQ ID NO: 1220326 - RNA, 19 nt, Human
uaaauccuuccacaagcuu

SEQ ID NO: 1220327 - RNA, 22 nt, Human
uaacacgaaccugauaccugua

SEQ ID NO: 1220328 - RNA, 24 nt, Human
uaacuaaaaaacagccuacgguca

SEQ ID NO: 1220329 - RNA, 21 nt, Human
uaagaaaugguuucuuuuggg

SEQ ID NO: 1220330 - RNA, 19 nt, Human
uaagacagaguucucuguu

SEQ ID NO: 1220331 - RNA, 23 nt, Human
uaagacucccaaauaaaggcuuu

SEQ ID NO: 1220332 - RNA, 18 nt, Human
uaagagagccuccccucc

SEQ ID NO: 1220333 - RNA, 22 nt, Human
uaagagagccuccccuccccca

SEQ ID NO: 1220334 - RNA, 19 nt, Human
uaaggcagcugcccuuggc

SEQ ID NO: 1220335 - RNA, 19 nt, Human
uacuguacaacaugggaau

SEQ ID NO: 1220336 - RNA, 21 nt, Human
uacuguacaacaugggaaucg

SEQ ID NO: 1220337 - RNA, 21 nt, Human
uagaaaaauaggauccagcca

SEQ ID NO: 1220338 - RNA, 19 nt, Human
uagaaagaacugaguaucg

SEQ ID NO: 1220339 - RNA, 24 nt, Human
uaguuaacauacagcguuuaacac

SEQ ID NO: 1220340 - RNA, 22 nt, Human
uaucacagaauuccagucauag

SEQ ID NO: 1220341 - RNA, 23 nt, Human
ucaaagccucuuugguauuuccc

SEQ ID NO: 1220342 - RNA, 19 nt, Human
ucacauggucauggucaaa

SEQ ID NO: 1220343 - RNA, 23 nt, Human
uccacaagcuugcaagcuaagac

SEQ ID NO: 1220344 - RNA, 24 nt, Human
uccacaagcuugcaagcuaagacc

SEQ ID NO: 1220345 - RNA, 19 nt, Human
ucccaaauaaaagcagagc

SEQ ID NO: 1220346 - RNA, 21 nt, Human
ucccuggaggcugggucucca

SEQ ID NO: 1220347 - RNA, 19 nt, Human
uccuaaaacacuaaagaac

SEQ ID NO: 1220348 - RNA, 18 nt, Human
ucuacacagcuaugaaca

SEQ ID NO: 1220349 - RNA, 24 nt, Human
ucuacucugaacgcuuuuucaucg

SEQ ID NO: 1220350 - RNA, 21 nt, Human
ucuucuggguuaucaaaaucu

SEQ ID NO: 1220351 - RNA, 20 nt, Human
ugacaaaaaauauucacacu

SEQ ID NO: 1220352 - RNA, 18 nt, Human
ugagaaaaaaaaaauuug

SEQ ID NO: 1220353 - RNA, 19 nt, Human
ugagguggaggguggggug

SEQ ID NO: 1220354 - RNA, 22 nt, Human
ugagguggagggugggguggag

SEQ ID NO: 1220355 - RNA, 21 nt, Human
ugcaaaaguuucauucucuuu

SEQ ID NO: 1220356 - RNA, 19 nt, Human
ugccaaugccacuuaaaag

SEQ ID NO: 1220357 - RNA, 18 nt, Human
ugcgaaaagcacauggaa

SEQ ID NO: 1220358 - RNA, 20 nt, Human
uggaaaacugauaagggcuu

SEQ ID NO: 1220359 - RNA, 22 nt, Human
uggagggugggguggagggaca

SEQ ID NO: 1220360 - RNA, 18 nt, Human
ugggaggggauugaggug

SEQ ID NO: 1220361 - RNA, 23 nt, Human
ugggcugauggaaaacugauaag

SEQ ID NO: 1220362 - RNA, 21 nt, Human
ugggguggagggacaggauag

SEQ ID NO: 1220363 - RNA, 21 nt, Human
ugguggccggggaggggacuc

SEQ ID NO: 1220364 - RNA, 18 nt, Human
uguagaaagaacugagua

SEQ ID NO: 1220365 - RNA, 18 nt, Human
uuaagaaaugguuucuuu

SEQ ID NO: 1220366 - RNA, 23 nt, Human
uuagucucacgucaagguuaaaa

SEQ ID NO: 1220367 - RNA, 19 nt, Human
uucaaguccgaugccggac

SEQ ID NO: 1220368 - RNA, 19 nt, Human
uuggcaucucuauaaaaac

SEQ ID NO: 1220369 - RNA, 20 nt, Human
uuuuuuaaauggccaagaaa

SEQ ID NO: 1220370 - RNA, 22 nt, Human
aacccagccaucccuugaccug

SEQ ID NO: 1220371 - RNA, 21 nt, Human
agccaucccuugaccugggag

SEQ ID NO: 1220372 - RNA, 19 nt, Human
caacacaagagcaaggccu

SEQ ID NO: 1220373 - RNA, 22 nt, Human
caacacaagagcaaggccuccu

SEQ ID NO: 1220374 - RNA, 22 nt, Human
cacccucaacccagccaucccu

SEQ ID NO: 1220375 - RNA, 20 nt, Human
ccaggccucgcacaguccac

SEQ ID NO: 1220376 - RNA, 20 nt, Human
ccccucaacacaagagcaag

SEQ ID NO: 1220377 - RNA, 23 nt, Human
ccucgcacaguccacccucaacc

SEQ ID NO: 1220378 - RNA, 18 nt, Human
cgaccaccuggaccugug

SEQ ID NO: 1220379 - RNA, 22 nt, Human
cucaacccagccaucccuugac

SEQ ID NO: 1220380 - RNA, 22 nt, Human
cuccugcaccggaagcgucugg

SEQ ID NO: 1220381 - RNA, 20 nt, Human
gaguggccucccgaccaccu

SEQ ID NO: 1220382 - RNA, 19 nt, Human
gcuacagcuccgccaggcc

SEQ ID NO: 1220383 - RNA, 20 nt, Human
gcuacagcuccgccaggccu

SEQ ID NO: 1220384 - RNA, 19 nt, Human
uaagcucaggugcuugggc

SEQ ID NO: 1220385 - RNA, 19 nt, Human
uacagcuccgccaggccuc

SEQ ID NO: 1220386 - RNA, 23 nt, Human
uccgccaggccucgcacagucca

SEQ ID NO: 1220387 - RNA, 19 nt, Human
ucgcacaguccacccucaa

SEQ ID NO: 1220388 - RNA, 19 nt, Human
ugaccugggagggucaggg

SEQ ID NO: 1220389 - RNA, 21 nt, Human
ugguguccccucaacacaaga

SEQ ID NO: 1220390 - RNA, 18 nt, Human
aguaggggaggcuggagg

SEQ ID NO: 1220391 - RNA, 21 nt, Human
aucccgaucucuccccagucc

SEQ ID NO: 1220392 - RNA, 23 nt, Human
aucccgaucucuccccaguccag

SEQ ID NO: 1220393 - RNA, 18 nt, Human
cagaacacuggcagucac

SEQ ID NO: 1220394 - RNA, 21 nt, Human
cggcuuccgguccaggcuccc

SEQ ID NO: 1220395 - RNA, 20 nt, Human
gccagcucucccgggagccg

SEQ ID NO: 1220396 - RNA, 21 nt, Human
ggccagcucucccgggagcca

SEQ ID NO: 1220397 - RNA, 21 nt, Human
ggcuggaggaggugaaacgcc

SEQ ID NO: 1220398 - RNA, 19 nt, Human
uccagaacacuggcaguca

SEQ ID NO: 1220399 - RNA, 18 nt, Human
ugagauggaguccaggcc

SEQ ID NO: 1220400 - RNA, 20 nt, Human
ugagauggaguccaggccug

SEQ ID NO: 1220401 - RNA, 22 nt, Human
aagcccaacagcucggaggaga

SEQ ID NO: 1220402 - RNA, 22 nt, Human
accgcagucccaacggcgcgcu

SEQ ID NO: 1220403 - RNA, 20 nt, Human
aggaggcccuggcccugccg

SEQ ID NO: 1220404 - RNA, 21 nt, Human
aggaggcccuggcccugccga

SEQ ID NO: 1220405 - RNA, 23 nt, Human
aggaggcccuggcccugccgaca

SEQ ID NO: 1220406 - RNA, 20 nt, Human
aggcccuggcccugccgaca

SEQ ID NO: 1220407 - RNA, 21 nt, Human
aggcccuggcccugccgacau

SEQ ID NO: 1220408 - RNA, 24 nt, Human
cuuggucuuguaggaggcccuggc

SEQ ID NO: 1220409 - RNA, 24 nt, Human
gcuagguuggcgagaugaagagga

SEQ ID NO: 1220410 - RNA, 24 nt, Human
uaaaagcccaacagcucggaggag

SEQ ID NO: 1220411 - RNA, 19 nt, Human
uaggaggcccuggcccugc

SEQ ID NO: 1220412 - RNA, 21 nt, Human
uccuccggcagaugcguuugg

SEQ ID NO: 1220413 - RNA, 20 nt, Human
ucucacauggacccuguagg

SEQ ID NO: 1220414 - RNA, 22 nt, Human
uggcuuggucuuguaggaggcc

SEQ ID NO: 1220415 - RNA, 20 nt, Human
aaagaaacagaaaggacuga

SEQ ID NO: 1220416 - RNA, 21 nt, Human
aacucuagguuuuacuguccu

SEQ ID NO: 1220417 - RNA, 19 nt, Human
aagcaaguguccauacagc

SEQ ID NO: 1220418 - RNA, 25 nt, Human
aagcaggaaaaugggauggaagcaa

SEQ ID NO: 1220419 - RNA, 24 nt, Human
aaucuaguuccuaaccuaccaaca

SEQ ID NO: 1220420 - RNA, 22 nt, Human
agaaacagaaaggacugaaggc

SEQ ID NO: 1220421 - RNA, 23 nt, Human
agaaaggacugaaggcuuuccca

SEQ ID NO: 1220422 - RNA, 21 nt, Human
agagagcacacaaaacagcau

SEQ ID NO: 1220423 - RNA, 21 nt, Human
agcaagagagcacacaaaaca

SEQ ID NO: 1220424 - RNA, 23 nt, Human
aggaaacacuugaaauuuccuga

SEQ ID NO: 1220425 - RNA, 20 nt, Human
aggaggaaaaaauuccuuaa

SEQ ID NO: 1220426 - RNA, 26 nt, Human
aggcugcggcggagacaccuugggcc

SEQ ID NO: 1220427 - RNA, 20 nt, Human
augagaaauuacuaugaaga

SEQ ID NO: 1220428 - RNA, 19 nt, Human
augguagcuaucaggcuga

SEQ ID NO: 1220429 - RNA, 18 nt, Human
auucugggaaaucuaguu

SEQ ID NO: 1220430 - RNA, 23 nt, Human
caauuccgucuacagacuagggg

SEQ ID NO: 1220431 - RNA, 21 nt, Human
cacaaaacagcaugacuuaac

SEQ ID NO: 1220432 - RNA, 22 nt, Human
cacacuacagcagaagaacaag

SEQ ID NO: 1220433 - RNA, 21 nt, Human
cacuacuaguaugaacaaagg

SEQ ID NO: 1220434 - RNA, 20 nt, Human
cagaaaggacugaaggcuuu

SEQ ID NO: 1220435 - RNA, 24 nt, Human
cagaaaggacugaaggcuuuccca

SEQ ID NO: 1220436 - RNA, 18 nt, Human
cagaauauucccaaccag

SEQ ID NO: 1220437 - RNA, 20 nt, Human
cagaggcugcggcggagaca

SEQ ID NO: 1220438 - RNA, 22 nt, Human
cagcagaagaacaagcuccccu

SEQ ID NO: 1220439 - RNA, 23 nt, Human
caucaaaguccugggugaggcca

SEQ ID NO: 1220440 - RNA, 25 nt, Human
caucacagaauauucccaaccagga

SEQ ID NO: 1220441 - RNA, 22 nt, Human
ccaacuccaacucuagguuuua

SEQ ID NO: 1220442 - RNA, 25 nt, Human
cccaaauuucuuacuuucauggggu

SEQ ID NO: 1220443 - RNA, 22 nt, Human
ccuaaccuaccaacacugacau

SEQ ID NO: 1220444 - RNA, 23 nt, Human
ccuaaccuaccaacacugacaua

SEQ ID NO: 1220445 - RNA, 18 nt, Human
ccucucggagaaacggag

SEQ ID NO: 1220446 - RNA, 22 nt, Human
ccuguguggaagccuaucaccu

SEQ ID NO: 1220447 - RNA, 19 nt, Human
cgacagaggcugcggcgga

SEQ ID NO: 1220448 - RNA, 25 nt, Human
cggcuuccaggugucccggcguccu

SEQ ID NO: 1220449 - RNA, 24 nt, Human
cuaaugccuucuuaacuuacuucc

SEQ ID NO: 1220450 - RNA, 30 nt, Human
cuaguacagacauaauaaugucugaaggaa

SEQ ID NO: 1220451 - RNA, 23 nt, Human
cuaguuccuaaccuaccaacacu

SEQ ID NO: 1220452 - RNA, 18 nt, Human
cucacaucaaaguccugg

SEQ ID NO: 1220453 - RNA, 22 nt, Human
cugaaucaagaauacagucacu

SEQ ID NO: 1220454 - RNA, 20 nt, Human
cuguauggugcuuccaaacc

SEQ ID NO: 1220455 - RNA, 21 nt, Human
gcgcgacagaggcugcggcgg

SEQ ID NO: 1220456 - RNA, 24 nt, Human
gcugcggcggagacaccuugggcc

SEQ ID NO: 1220457 - RNA, 18 nt, Human
guugaaagaaacagaaag

SEQ ID NO: 1220458 - RNA, 21 nt, Human
uaaaaaauacauauuagucac

SEQ ID NO: 1220459 - RNA, 24 nt, Human
uaucaccuccgagaaaauuaaagu

SEQ ID NO: 1220460 - RNA, 22 nt, Human
uaucauggaaucacaaauggaa

SEQ ID NO: 1220461 - RNA, 26 nt, Human
uauucacacagcugucucccuguaug

SEQ ID NO: 1220462 - RNA, 20 nt, Human
ucaaacaacugaaaaugaac

SEQ ID NO: 1220463 - RNA, 18 nt, Human
ucacagaauauucccaac

SEQ ID NO: 1220464 - RNA, 26 nt, Human
ugaaaaguaaaauuuacaugaggagg

SEQ ID NO: 1220465 - RNA, 22 nt, Human
ugaaagaaacagaaaggacuga

SEQ ID NO: 1220466 - RNA, 23 nt, Human
ugaaagaaacagaaaggacugaa

SEQ ID NO: 1220467 - RNA, 20 nt, Human
ugccuaguacagacauaaua

SEQ ID NO: 1220468 - RNA, 23 nt, Human
uggaaucacaaauggaauggauu

SEQ ID NO: 1220469 - RNA, 22 nt, Human
uguggaagccuaucaccuccga

SEQ ID NO: 1220470 - RNA, 23 nt, Human
uuacacccucuuugacaacaggu

SEQ ID NO: 1220471 - RNA, 20 nt, Human
uuacaguuuauuacacccuc

SEQ ID NO: 1220472 - RNA, 20 nt, Human
uucacagugucuuaacaauu

SEQ ID NO: 1220473 - RNA, 19 nt, Human
uuuuuuuuuuuuuuuuugu

SEQ ID NO: 1220474 - RNA, 22 nt, Human
uuuuuuuuuuuuuuuuuugugg

SEQ ID NO: 1220475 - RNA, 19 nt, Human
cccagauguccagcaaggu

SEQ ID NO: 1220476 - RNA, 20 nt, Human
ccucgggcagcccuaggcuc

SEQ ID NO: 1220477 - RNA, 21 nt, Human
gugugggaacccucgggcagc

SEQ ID NO: 1220478 - RNA, 18 nt, Human
aaaauuagcugggcaugg

SEQ ID NO: 1220479 - RNA, 19 nt, Human
aacacggugaaacccuguc

SEQ ID NO: 1220480 - RNA, 20 nt, Human
aacacggugaaacccugucu

SEQ ID NO: 1220481 - RNA, 20 nt, Human
aacacggugaaacccugucu

SEQ ID NO: 1220482 - RNA, 21 nt, Human
aacacggugaaacccugucuu

SEQ ID NO: 1220483 - RNA, 24 nt, Human
aacugcuugagccuggcaagugga

SEQ ID NO: 1220484 - RNA, 23 nt, Human
aagaucgcgccauugcacuccag

SEQ ID NO: 1220485 - RNA, 20 nt, Human
aaggcaggcagaucacgagg

SEQ ID NO: 1220486 - RNA, 23 nt, Human
aaggcaggcagaucacgagguca

SEQ ID NO: 1220487 - RNA, 18 nt, Human
aaggccaaggcaggcagu

SEQ ID NO: 1220488 - RNA, 24 nt, Human
aaguggaaguuacagugagccaag

SEQ ID NO: 1220489 - RNA, 20 nt, Human
aauauggugaaacucugucu

SEQ ID NO: 1220490 - RNA, 21 nt, Human
aauauggugaaacucugucuc

SEQ ID NO: 1220491 - RNA, 24 nt, Human
aauggcauaaacccgggaggugga

SEQ ID NO: 1220492 - RNA, 25 nt, Human
acagagagagacucuguccuuaaaa

SEQ ID NO: 1220493 - RNA, 24 nt, Human
acagagcgagacuccaucucaaaa

SEQ ID NO: 1220494 - RNA, 24 nt, Human
acccugucuuuacuaaaaauacaa

SEQ ID NO: 1220495 - RNA, 22 nt, Human
accucauucuauaagagacagu

SEQ ID NO: 1220496 - RNA, 24 nt, Human
acugcacuccagccugggcgacag

SEQ ID NO: 1220497 - RNA, 26 nt, Human
acugcacuccagccugggcgacagag

SEQ ID NO: 1220498 - RNA, 19 nt, Human
acugucuggggagcagggu

SEQ ID NO: 1220499 - RNA, 24 nt, Human
acuuugggaggccgaggugggcag

SEQ ID NO: 1220500 - RNA, 24 nt, Human
agacaggagaauggcauaaacccg

SEQ ID NO: 1220501 - RNA, 25 nt, Human
agaucaccugaggccaggaguuuga

SEQ ID NO: 1220502 - RNA, 24 nt, Human
agcacuuugggaggccgagguggg

SEQ ID NO: 1220503 - RNA, 24 nt, Human
agccaggcuaauauggugaaacuc

SEQ ID NO: 1220504 - RNA, 24 nt, Human
agccugggcgacagagcgagacuc

SEQ ID NO: 1220505 - RNA, 20 nt, Human
agccugggugacagagagag

SEQ ID NO: 1220506 - RNA, 24 nt, Human
agccugggugacagagagagacuc

SEQ ID NO: 1220507 - RNA, 23 nt, Human
agcugggcaugguggcgggugcc

SEQ ID NO: 1220508 - RNA, 18 nt, Human
aggcagaucacgagguca

SEQ ID NO: 1220509 - RNA, 24 nt, Human
aggcagaucacgaggucaggagau

SEQ ID NO: 1220510 - RNA, 22 nt, Human
aggcaggagaacugcuugagcc

SEQ ID NO: 1220511 - RNA, 24 nt, Human
aggcaggagaacugcuugagccug

SEQ ID NO: 1220512 - RNA, 26 nt, Human
aggcaggcagaucacgaggucaggag

SEQ ID NO: 1220513 - RNA, 22 nt, Human
aggcauuucuggaucagugcag

SEQ ID NO: 1220514 - RNA, 23 nt, Human
aggccaaggcaggcagaucacga

SEQ ID NO: 1220515 - RNA, 21 nt, Human
aggccgaggugggcagaucac

SEQ ID NO: 1220516 - RNA, 24 nt, Human
aggcugaggcaggagaacugcuug

SEQ ID NO: 1220517 - RNA, 24 nt, Human
agguggagcuugcagugagcugag

SEQ ID NO: 1220518 - RNA, 19 nt, Human
agugaguugucaaucauug

SEQ ID NO: 1220519 - RNA, 21 nt, Human
aucaguggugcaacuccagga

SEQ ID NO: 1220520 - RNA, 24 nt, Human
aucgcgccauugcacuccagccug

SEQ ID NO: 1220521 - RNA, 19 nt, Human
aucuccccucauuucucca

SEQ ID NO: 1220522 - RNA, 20 nt, Human
auggugaaacucugucucua

SEQ ID NO: 1220523 - RNA, 18 nt, Human
auugcacuccagccuggg

SEQ ID NO: 1220524 - RNA, 24 nt, Human
auugcacuccagccugggugacag

SEQ ID NO: 1220525 - RNA, 24 nt, Human
auugcgccacugcacuccagccug

SEQ ID NO: 1220526 - RNA, 18 nt, Human
cacccauccacgaugcuc

SEQ ID NO: 1220527 - RNA, 23 nt, Human
cacuccagccugggcgacagagc

SEQ ID NO: 1220528 - RNA, 24 nt, Human
cacuccagccugggcgacagagcg

SEQ ID NO: 1220529 - RNA, 18 nt, Human
cacuccagccugggugac

SEQ ID NO: 1220530 - RNA, 22 nt, Human
cacuccagccugggugacagag

SEQ ID NO: 1220531 - RNA, 19 nt, Human
cacugcacuccagccuggg

SEQ ID NO: 1220532 - RNA, 20 nt, Human
cacugcacuccagccugggc

SEQ ID NO: 1220533 - RNA, 20 nt, Human
cacugcacuccagccugggc

SEQ ID NO: 1220534 - RNA, 22 nt, Human
cacugcacuccagccugggcga

SEQ ID NO: 1220535 - RNA, 24 nt, Human
cacugcacuccagccugggcgaca

SEQ ID NO: 1220536 - RNA, 24 nt, Human
cagcacuuugggaggccgaggugg

SEQ ID NO: 1220537 - RNA, 22 nt, Human
cagccugggugacagagagaga

SEQ ID NO: 1220538 - RNA, 24 nt, Human
cagcuacucaggaggcugaggcag

SEQ ID NO: 1220539 - RNA, 22 nt, Human
caggcagaucacgaggucagga

SEQ ID NO: 1220540 - RNA, 19 nt, Human
caguggauuugaucccagc

SEQ ID NO: 1220541 - RNA, 18 nt, Human
caugguggauaucuucac

SEQ ID NO: 1220542 - RNA, 22 nt, Human
caugguggcgggugccuguagu

SEQ ID NO: 1220543 - RNA, 19 nt, Human
cauugcacuccagccuggg

SEQ ID NO: 1220544 - RNA, 19 nt, Human
cauugcacuccagccuggg

SEQ ID NO: 1220545 - RNA, 21 nt, Human
cauugcacuccagccugggug

SEQ ID NO: 1220546 - RNA, 22 nt, Human
cauugcacuccagccuggguga

SEQ ID NO: 1220547 - RNA, 24 nt, Human
cauugcacuccagccugggugaca

SEQ ID NO: 1220548 - RNA, 25 nt, Human
cauugcacuccagccugggugacag

SEQ ID NO: 1220549 - RNA, 24 nt, Human
ccacaggaccacgggugcccaacg

SEQ ID NO: 1220550 - RNA, 20 nt, Human
ccacugcacuccagccuggg

SEQ ID NO: 1220551 - RNA, 20 nt, Human
ccacugcacuccagccuggg

SEQ ID NO: 1220552 - RNA, 21 nt, Human
ccacugcacuccagccugggc

SEQ ID NO: 1220553 - RNA, 21 nt, Human
ccacugcacuccagccugggc

SEQ ID NO: 1220554 - RNA, 21 nt, Human
ccacugcacuccagccugggc

SEQ ID NO: 1220555 - RNA, 23 nt, Human
ccacugcacuccagccugggcga

SEQ ID NO: 1220556 - RNA, 24 nt, Human
ccacugcacuccagccugggcgac

SEQ ID NO: 1220557 - RNA, 23 nt, Human
ccagaguacaucauccaggucca

SEQ ID NO: 1220558 - RNA, 21 nt, Human
ccagccaggcuaauaugguga

SEQ ID NO: 1220559 - RNA, 24 nt, Human
ccaggcuaauauggugaaacucug

SEQ ID NO: 1220560 - RNA, 20 nt, Human
ccauugcacuccagccuggg

SEQ ID NO: 1220561 - RNA, 21 nt, Human
ccauugcacuccagccugggu

SEQ ID NO: 1220562 - RNA, 21 nt, Human
ccauugcacuccagccugggu

SEQ ID NO: 1220563 - RNA, 22 nt, Human
ccauugcacuccagccugggug

SEQ ID NO: 1220564 - RNA, 23 nt, Human
ccauugcacuccagccuggguga

SEQ ID NO: 1220565 - RNA, 24 nt, Human
ccauugcacuccagccugggugac

SEQ ID NO: 1220566 - RNA, 22 nt, Human
ccugaggccaggaguuugagac

SEQ ID NO: 1220567 - RNA, 25 nt, Human
ccugcaacugggagugucuuugacc

SEQ ID NO: 1220568 - RNA, 22 nt, Human
ccuggcuaacacggugaaaccc

SEQ ID NO: 1220569 - RNA, 24 nt, Human
ccuggcuaacacggugaaacccug

SEQ ID NO: 1220570 - RNA, 22 nt, Human
ccugggcgacagagcgagacuc

SEQ ID NO: 1220571 - RNA, 22 nt, Human
ccugggugacagagagagacuc

SEQ ID NO: 1220572 - RNA, 21 nt, Human
ccuguagucccagcuacucag

SEQ ID NO: 1220573 - RNA, 21 nt, Human
ccuguagucccagcuacucgg

SEQ ID NO: 1220574 - RNA, 22 nt, Human
ccuguagucccagcuacucggg

SEQ ID NO: 1220575 - RNA, 23 nt, Human
cgagacuccaucucaaaaaaaaa

SEQ ID NO: 1220576 - RNA, 19 nt, Human
cgaggugggcagaucaccu

SEQ ID NO: 1220577 - RNA, 26 nt, Human
cgccacugcacuccagccugggcgac

SEQ ID NO: 1220578 - RNA, 29 nt, Human
cgggagguggagcuugcagugacaacggu

SEQ ID NO: 1220579 - RNA, 24 nt, Human
cgggagguggagcuugcagugagc

SEQ ID NO: 1220580 - RNA, 18 nt, Human
cucaaaaaaaaaaaaaaa

SEQ ID NO: 1220581 - RNA, 19 nt, Human
cuccaggacgggcacugug

SEQ ID NO: 1220582 - RNA, 19 nt, Human
cuccaucucaaaaaaaaaa

SEQ ID NO: 1220583 - RNA, 19 nt, Human
cucucggucuggguggggc

SEQ ID NO: 1220584 - RNA, 18 nt, Human
cuggcuaacacggugaaa

SEQ ID NO: 1220585 - RNA, 24 nt, Human
cuggcuaacacggugaaacccugu

SEQ ID NO: 1220586 - RNA, 18 nt, Human
cuggguggggccaucuac

SEQ ID NO: 1220587 - RNA, 19 nt, Human
cuugcagugagcugagauu

SEQ ID NO: 1220588 - RNA, 21 nt, Human
cuugcagugagcugagauugc

SEQ ID NO: 1220589 - RNA, 19 nt, Human
gaaacccugucuuuacuaa

SEQ ID NO: 1220590 - RNA, 21 nt, Human
gacuaguggggugggguccga

SEQ ID NO: 1220591 - RNA, 23 nt, Human
gagaccauccuggcuaacacggu

SEQ ID NO: 1220592 - RNA, 23 nt, Human
gagcaggcauacagcuguugcac

SEQ ID NO: 1220593 - RNA, 23 nt, Human
gagcuugcagugagcugagauug

SEQ ID NO: 1220594 - RNA, 19 nt, Human
gaggugggcagaucaccug

SEQ ID NO: 1220595 - RNA, 25 nt, Human
gaggugggcagaucaccugaggcca

SEQ ID NO: 1220596 - RNA, 24 nt, Human
gaucaccugaggccaggaguuuga

SEQ ID NO: 1220597 - RNA, 24 nt, Human
gcacuccagccugggcgacagagc

SEQ ID NO: 1220598 - RNA, 22 nt, Human
gccacugcacuccagccugggc

SEQ ID NO: 1220599 - RNA, 24 nt, Human
gccacugcacuccagccugggcga

SEQ ID NO: 1220600 - RNA, 19 nt, Human
gccauugcacuccagccug

SEQ ID NO: 1220601 - RNA, 24 nt, Human
gccauugcacuccagccuggguga

SEQ ID NO: 1220602 - RNA, 18 nt, Human
gccccuccuggauagccu

SEQ ID NO: 1220603 - RNA, 22 nt, Human
gcgggugccuguagucccagcu

SEQ ID NO: 1220604 - RNA, 22 nt, Human
gcgggugccuguagucccagcu

SEQ ID NO: 1220605 - RNA, 24 nt, Human
gcuaacacggugaaacccugucuu

SEQ ID NO: 1220606 - RNA, 24 nt, Human
gcuaauauggugaaacucugucuc

SEQ ID NO: 1220607 - RNA, 20 nt, Human
ggagcagggugaggacucug

SEQ ID NO: 1220608 - RNA, 24 nt, Human
ggagcuugcagugagcugagauug

SEQ ID NO: 1220609 - RNA, 19 nt, Human
ggccaggaguuugagacca

SEQ ID NO: 1220610 - RNA, 21 nt, Human
ggccaucuacccucccugcaa

SEQ ID NO: 1220611 - RNA, 18 nt, Human
gggccgggagaacaccua

SEQ ID NO: 1220612 - RNA, 22 nt, Human
gggugggguccgagccagggau

SEQ ID NO: 1220613 - RNA, 19 nt, Human
gucucuacuaaaaauacaa

SEQ ID NO: 1220614 - RNA, 21 nt, Human
gugaaacucugucucuacuaa

SEQ ID NO: 1220615 - RNA, 20 nt, Human
guggagcuugcagugagcug

SEQ ID NO: 1220616 - RNA, 21 nt, Human
uaacacggugaaacccugucu

SEQ ID NO: 1220617 - RNA, 21 nt, Human
uaacacggugaaacccugucu

SEQ ID NO: 1220618 - RNA, 24 nt, Human
uaacacggugaaacccugucuuua

SEQ ID NO: 1220619 - RNA, 22 nt, Human
uaauauggugaaacucugucuc

SEQ ID NO: 1220620 - RNA, 24 nt, Human
uaauauggugaaacucugucucua

SEQ ID NO: 1220621 - RNA, 18 nt, Human
uacuaaaaauacaaaaaa

SEQ ID NO: 1220622 - RNA, 21 nt, Human
uagcugggcaugguggcgggu

SEQ ID NO: 1220623 - RNA, 18 nt, Human
uaggcugaggucaucacu

SEQ ID NO: 1220624 - RNA, 18 nt, Human
ucaccugaggccaggagu

SEQ ID NO: 1220625 - RNA, 24 nt, Human
ucacgaggucaggagauagagacc

SEQ ID NO: 1220626 - RNA, 23 nt, Human
uccagccugggcgacagagcgag

SEQ ID NO: 1220627 - RNA, 24 nt, Human
uccagccugggcgacagagcgaga

SEQ ID NO: 1220628 - RNA, 19 nt, Human
uccagccugggugacagag

SEQ ID NO: 1220629 - RNA, 20 nt, Human
uccagccugggugacagaga

SEQ ID NO: 1220630 - RNA, 20 nt, Human
uccaggacgggcacuguguc

SEQ ID NO: 1220631 - RNA, 23 nt, Human
uccaucucaaaaaaaaaaaaaaa

SEQ ID NO: 1220632 - RNA, 25 nt, Human
uccaucucaaaaaaaaaaaaaaaaa

SEQ ID NO: 1220633 - RNA, 30 nt, Human
uccuuaaaaaaaaaaaauaauaaggccaaa

SEQ ID NO: 1220634 - RNA, 23 nt, Human
ucgcgccauugcacuccagccug

SEQ ID NO: 1220635 - RNA, 23 nt, Human
ucucuacuaaaaauacaaaaauu

SEQ ID NO: 1220636 - RNA, 18 nt, Human
ucucuuggccccuccugg

SEQ ID NO: 1220637 - RNA, 25 nt, Human
ugaccaaagcacagaugauuucgga

SEQ ID NO: 1220638 - RNA, 21 nt, Human
ugagacaccacaggaccacgg

SEQ ID NO: 1220639 - RNA, 18 nt, Human
ugagacaggagaauggca

SEQ ID NO: 1220640 - RNA, 24 nt, Human
ugagacaggagaauggcauaaacc

SEQ ID NO: 1220641 - RNA, 24 nt, Human
ugagauugcgccacugcacuccag

SEQ ID NO: 1220642 - RNA, 22 nt, Human
ugagccaagaucgcgccauugc

SEQ ID NO: 1220643 - RNA, 22 nt, Human
ugagcugagauugcgccacugc

SEQ ID NO: 1220644 - RNA, 24 nt, Human
ugaggcaggagaacugcuugagcc

SEQ ID NO: 1220645 - RNA, 25 nt, Human
ugaggcaggagaacugcuugagccu

SEQ ID NO: 1220646 - RNA, 22 nt, Human
ugcacaggacuagugggguggg

SEQ ID NO: 1220647 - RNA, 24 nt, Human
ugcacuccagccugggugacagag

SEQ ID NO: 1220648 - RNA, 24 nt, Human
ugccuguagucccagcuacucagg

SEQ ID NO: 1220649 - RNA, 23 nt, Human
ugccuguagucccagcuacucgg

SEQ ID NO: 1220650 - RNA, 24 nt, Human
ugccuguagucccagcuacucggg

SEQ ID NO: 1220651 - RNA, 18 nt, Human
uggauaucuucacccguc

SEQ ID NO: 1220652 - RNA, 21 nt, Human
uggcgggugccuguaguccca

SEQ ID NO: 1220653 - RNA, 20 nt, Human
ugggaggccgaggugggcag

SEQ ID NO: 1220654 - RNA, 24 nt, Human
ugggaggccgaggugggcagauca

SEQ ID NO: 1220655 - RNA, 24 nt, Human
ugggcagaucaccugaggccagga

SEQ ID NO: 1220656 - RNA, 19 nt, Human
uggggaccugucugccuaa

SEQ ID NO: 1220657 - RNA, 24 nt, Human
ugguggcgggugccuguaguccca

SEQ ID NO: 1220658 - RNA, 20 nt, Human
ugucuggggagcagggugag

SEQ ID NO: 1220659 - RNA, 24 nt, Human
uguuggcgggugccuguaguccca

SEQ ID NO: 1220660 - RNA, 22 nt, Human
uuacagugagccaagaucgcgc

SEQ ID NO: 1220661 - RNA, 24 nt, Human
uuagcugggcaugguggcgggugc

SEQ ID NO: 1220662 - RNA, 23 nt, Human
uucuugguccaucuccccucauu

SEQ ID NO: 1220663 - RNA, 19 nt, Human
uugcagugagcugagauug

SEQ ID NO: 1220664 - RNA, 22 nt, Human
uugcagugagcugagauugcgc

SEQ ID NO: 1220665 - RNA, 23 nt, Human
uugcgccacugcacuccagccug

SEQ ID NO: 1220666 - RNA, 25 nt, Human
uugggaggccgaggugggcagauca

SEQ ID NO: 1220667 - RNA, 21 nt, Human
aaaaaaaaaaaggcaacugag

SEQ ID NO: 1220668 - RNA, 20 nt, Human
aaaaagccuuggaagaccac

SEQ ID NO: 1220669 - RNA, 20 nt, Human
aaaaaucaauaaggaggauc

SEQ ID NO: 1220670 - RNA, 22 nt, Human
aaaaaucaauaaggaggaucac

SEQ ID NO: 1220671 - RNA, 18 nt, Human
aaaauacuccugacacca

SEQ ID NO: 1220672 - RNA, 25 nt, Human
aaacacccaggagucuguuacacaa

SEQ ID NO: 1220673 - RNA, 21 nt, Human
aacaacucacauaacuuagga

SEQ ID NO: 1220674 - RNA, 19 nt, Human
aacucacauaacuuaggau

SEQ ID NO: 1220675 - RNA, 20 nt, Human
aagaccacuuccacuuccgg

SEQ ID NO: 1220676 - RNA, 21 nt, Human
aaggggacagaagaggcucca

SEQ ID NO: 1220677 - RNA, 21 nt, Human
aaguaucaggagauagaaacc

SEQ ID NO: 1220678 - RNA, 19 nt, Human
aagucuugguagaugacag

SEQ ID NO: 1220679 - RNA, 18 nt, Human
acaagacauccugcuaga

SEQ ID NO: 1220680 - RNA, 20 nt, Human
accaugcuggagugagguga

SEQ ID NO: 1220681 - RNA, 20 nt, Human
agaacuaugacagcagaagg

SEQ ID NO: 1220682 - RNA, 19 nt, Human
agaguaagguaaaacagga

SEQ ID NO: 1220683 - RNA, 19 nt, Human
aggcaucaagguuaacacu

SEQ ID NO: 1220684 - RNA, 22 nt, Human
agggcugaggauuucugaggug

SEQ ID NO: 1220685 - RNA, 18 nt, Human
aggggacagaagaggcuc

SEQ ID NO: 1220686 - RNA, 22 nt, Human
auugcagggggcacaccacugu

SEQ ID NO: 1220687 - RNA, 22 nt, Human
auuguuuucuucuacucuucaa

SEQ ID NO: 1220688 - RNA, 20 nt, Human
caagcagagcugcucugaag

SEQ ID NO: 1220689 - RNA, 18 nt, Human
cacacauaagaguaaggu

SEQ ID NO: 1220690 - RNA, 18 nt, Human
caccagcggcaaaaaagc

SEQ ID NO: 1220691 - RNA, 19 nt, Human
caccaugcuggagugaggu

SEQ ID NO: 1220692 - RNA, 25 nt, Human
cacccagaaaccucaaagauuuauc

SEQ ID NO: 1220693 - RNA, 22 nt, Human
cagaagaggcuccaaaauacag

SEQ ID NO: 1220694 - RNA, 23 nt, Human
cagacccaacccucagggggguu

SEQ ID NO: 1220695 - RNA, 22 nt, Human
cagagacacccagaaaccucaa

SEQ ID NO: 1220696 - RNA, 26 nt, Human
cagcggcaaaaaagccuuggaagacc

SEQ ID NO: 1220697 - RNA, 21 nt, Human
cagugccuucucagaggcccc

SEQ ID NO: 1220698 - RNA, 25 nt, Human
caucaagguuaacacucauaggagc

SEQ ID NO: 1220699 - RNA, 20 nt, Human
caugguagauaaugaggggg

SEQ ID NO: 1220700 - RNA, 24 nt, Human
cauucccacaugcuguguuaggga

SEQ ID NO: 1220701 - RNA, 19 nt, Human
cauuguauugcagggggca

SEQ ID NO: 1220702 - RNA, 22 nt, Human
cccaggggcuccccagagacac

SEQ ID NO: 1220703 - RNA, 23 nt, Human
cccugaaggacacugauccuagg

SEQ ID NO: 1220704 - RNA, 24 nt, Human
cggcaaaaaagccuuggaagacca

SEQ ID NO: 1220705 - RNA, 23 nt, Human
cgugaggcugagagacagucaug

SEQ ID NO: 1220706 - RNA, 23 nt, Human
cucaagcagagcugcucugaaga

SEQ ID NO: 1220707 - RNA, 22 nt, Human
cugccaugauccucuggagcca

SEQ ID NO: 1220708 - RNA, 22 nt, Human
cugcugaaaucgauagccacau

SEQ ID NO: 1220709 - RNA, 21 nt, Human
cuuggaagaccacuuccacuu

SEQ ID NO: 1220710 - RNA, 18 nt, Human
gaaaaaaaaaaaaaggca

SEQ ID NO: 1220711 - RNA, 21 nt, Human
gaaagaaggggacagaagagg

SEQ ID NO: 1220712 - RNA, 21 nt, Human
gaaaucgauagccacaucccu

SEQ ID NO: 1220713 - RNA, 19 nt, Human
gaaauguggacauuauggu

SEQ ID NO: 1220714 - RNA, 26 nt, Human
gagaaagaaaaacacccaggagucug

SEQ ID NO: 1220715 - RNA, 22 nt, Human
gagacacccagaaaccucaaag

SEQ ID NO: 1220716 - RNA, 18 nt, Human
gagcugcucugaagagau

SEQ ID NO: 1220717 - RNA, 25 nt, Human
gaggaaaaucuggcccaggggcucc

SEQ ID NO: 1220718 - RNA, 18 nt, Human
gccaugugugacauucug

SEQ ID NO: 1220719 - RNA, 21 nt, Human
gcccaggggcuccccagagac

SEQ ID NO: 1220720 - RNA, 19 nt, Human
gcggcaaaaaagccuugga

SEQ ID NO: 1220721 - RNA, 23 nt, Human
gcucugaagagaugggcuggagu

SEQ ID NO: 1220722 - RNA, 24 nt, Human
ggcuccccagagacacccagaaac

SEQ ID NO: 1220723 - RNA, 22 nt, Human
gguaaaacaggaaaaauggcca

SEQ ID NO: 1220724 - RNA, 20 nt, Human
uaacaguauucuauuguagu

SEQ ID NO: 1220725 - RNA, 26 nt, Human
uaacugggguccuagaaagaagggga

SEQ ID NO: 1220726 - RNA, 18 nt, Human
uaagguaaaacaggaaaa

SEQ ID NO: 1220727 - RNA, 21 nt, Human
uagaaagaaggggacagaaga

SEQ ID NO: 1220728 - RNA, 25 nt, Human
ucagacccaacccucagggggguuu

SEQ ID NO: 1220729 - RNA, 22 nt, Human
ucagaggcccucuccagaacag

SEQ ID NO: 1220730 - RNA, 24 nt, Human
ucagugccuucucagaggcccucu

SEQ ID NO: 1220731 - RNA, 20 nt, Human
ucauggcccuuuccagcccu

SEQ ID NO: 1220732 - RNA, 24 nt, Human
ucccagaugaccauaaaauucuua

SEQ ID NO: 1220733 - RNA, 21 nt, Human
uccccagagacacccagaaac

SEQ ID NO: 1220734 - RNA, 19 nt, Human
ucccugaaggacacugauc

SEQ ID NO: 1220735 - RNA, 22 nt, Human
ucccugaaggacacugauccua

SEQ ID NO: 1220736 - RNA, 23 nt, Human
ucggaagcuuucuugaaggugau

SEQ ID NO: 1220737 - RNA, 21 nt, Human
ucuccagaaacuguuuccgga

SEQ ID NO: 1220738 - RNA, 18 nt, Human
ucucugagaaggguccag

SEQ ID NO: 1220739 - RNA, 20 nt, Human
ugacaccagcggcaaaaaag

SEQ ID NO: 1220740 - RNA, 24 nt, Human
ugacaccagcggcaaaaaagccuu

SEQ ID NO: 1220741 - RNA, 19 nt, Human
ugacucgguuccuugucag

SEQ ID NO: 1220742 - RNA, 22 nt, Human
ugagaaggguccaggugccgcc

SEQ ID NO: 1220743 - RNA, 23 nt, Human
ugaggguuguaauaaguggucau

SEQ ID NO: 1220744 - RNA, 21 nt, Human
ugaggugagguccaauuagcu

SEQ ID NO: 1220745 - RNA, 20 nt, Human
ugaggugauuguaaaagagg

SEQ ID NO: 1220746 - RNA, 21 nt, Human
ugaguacgaaaaaaaaaaaaa

SEQ ID NO: 1220747 - RNA, 21 nt, Human
ugaguuggaagaacuaugaca

SEQ ID NO: 1220748 - RNA, 19 nt, Human
ugcuguguuagggacaguu

SEQ ID NO: 1220749 - RNA, 23 nt, Human
uggcccuuuccagcccuaaacau

SEQ ID NO: 1220750 - RNA, 23 nt, Human
ugggaagagguaacagacaccau

SEQ ID NO: 1220751 - RNA, 21 nt, Human
ugggguccuagaaagaagggg

SEQ ID NO: 1220752 - RNA, 19 nt, Human
ugguagauaaugagggggg

SEQ ID NO: 1220753 - RNA, 23 nt, Human
uggucaucacacagaauggagag

SEQ ID NO: 1220754 - RNA, 24 nt, Human
uguuacacaauguguuccacaacg

SEQ ID NO: 1220755 - RNA, 19 nt, Human
uuggaauaugaaaauacuc

SEQ ID NO: 1220756 - RNA, 24 nt, Human
uuguuuuuuuuuuuuuuaacuggg

SEQ ID NO: 1220757 - RNA, 20 nt, Human
uuucuugaaggugaugggag

SEQ ID NO: 1220758 - RNA, 20 nt, Human
uuuuuucuuuuuuuuuuugg

SEQ ID NO: 1220759 - RNA, 20 nt, Human
uuuuuucuuuuuuuuuuugu

SEQ ID NO: 1220760 - RNA, 21 nt, Human
uuuuuuuuuuuuuuaacuggg

SEQ ID NO: 1220761 - RNA, 27 nt, Human
aaacaaggaacaauuucucagaagcaa

SEQ ID NO: 1220762 - RNA, 18 nt, Human
aacaauuucucagaagca

SEQ ID NO: 1220763 - RNA, 21 nt, Human
uaaggaguuucucuucuaauc

SEQ ID NO: 1220764 - RNA, 23 nt, Human
uauccaaaaaacaaggaacaauu

SEQ ID NO: 1220765 - RNA, 19 nt, Human
uucucagaagcaacaaucc

SEQ ID NO: 1220766 - RNA, 23 nt, Human
aagcaagagagaggcauguucag

SEQ ID NO: 1220767 - RNA, 27 nt, Human
acuuuggaucugcgcucagcauuugga

SEQ ID NO: 1220768 - RNA, 22 nt, Human
gcaagagagaggcauguucaga

SEQ ID NO: 1220769 - RNA, 24 nt, Human
ucacgccuucagaguccagcugcu

SEQ ID NO: 1220770 - RNA, 23 nt, Human
ucucuccagcaggcaguggggac

SEQ ID NO: 1220771 - RNA, 19 nt, Human
ucugcgcucagcauuugga

SEQ ID NO: 1220772 - RNA, 20 nt, Human
acagagcguggagaugcccc

SEQ ID NO: 1220773 - RNA, 22 nt, Human
agaacccaggcgugcaggccuc

SEQ ID NO: 1220774 - RNA, 18 nt, Human
aggaagcccaccucguug

SEQ ID NO: 1220775 - RNA, 24 nt, Human
aggccucccagccccggcccacca

SEQ ID NO: 1220776 - RNA, 19 nt, Human
aggcgugcaggccucccag

SEQ ID NO: 1220777 - RNA, 18 nt, Human
aggggcguccagggccag

SEQ ID NO: 1220778 - RNA, 19 nt, Human
agguggaggcaggcgcuuc

SEQ ID NO: 1220779 - RNA, 24 nt, Human
cagaacccaggcgugcaggccucc

SEQ ID NO: 1220780 - RNA, 19 nt, Human
cagccccggcccaccagcc

SEQ ID NO: 1220781 - RNA, 19 nt, Human
caggggcguccagggccag

SEQ ID NO: 1220782 - RNA, 19 nt, Human
caggugccagguggaggca

SEQ ID NO: 1220783 - RNA, 23 nt, Human
cccaccagccuugacccgugggg

SEQ ID NO: 1220784 - RNA, 21 nt, Human
cccagaacccaggcgugcagg

SEQ ID NO: 1220785 - RNA, 26 nt, Human
cccagccccggcccaccagccuugac

SEQ ID NO: 1220786 - RNA, 21 nt, Human
ccggcccaccagccuugaccc

SEQ ID NO: 1220787 - RNA, 26 nt, Human
ccucccagccccggcccaguccgagg

SEQ ID NO: 1220788 - RNA, 23 nt, Human
ccuugacccguggggcuucacgg

SEQ ID NO: 1220789 - RNA, 20 nt, Human
cggcccgagaccaggcgcag

SEQ ID NO: 1220790 - RNA, 19 nt, Human
cgggugccuggagcucagc

SEQ ID NO: 1220791 - RNA, 23 nt, Human
cgugcgcgugguccugggggucc

SEQ ID NO: 1220792 - RNA, 18 nt, Human
cguggagaugccccaggc

SEQ ID NO: 1220793 - RNA, 22 nt, Human
gcgugcaggccucccagccccg

SEQ ID NO: 1220794 - RNA, 23 nt, Human
ggacccagaacccaggcgugcag

SEQ ID NO: 1220795 - RNA, 20 nt, Human
ggccgugcgcgugguccugg

SEQ ID NO: 1220796 - RNA, 21 nt, Human
gggccgugcgcgugguccugg

SEQ ID NO: 1220797 - RNA, 23 nt, Human
gggccgugcgcgugguccugggg

SEQ ID NO: 1220798 - RNA, 20 nt, Human
gucaggggcguccagggcca

SEQ ID NO: 1220799 - RNA, 22 nt, Human
gugguccuggggguccaggugg

SEQ ID NO: 1220800 - RNA, 22 nt, Human
ucccagccccggcccaccagcc

SEQ ID NO: 1220801 - RNA, 24 nt, Human
uccugcaggugccagguggaggca

SEQ ID NO: 1220802 - RNA, 20 nt, Human
ugccagguggaggcaggcgc

SEQ ID NO: 1220803 - RNA, 24 nt, Human
ugccuggagcucagcguuacagag

SEQ ID NO: 1220804 - RNA, 23 nt, Human
ugggagacucgggccuccgccau

SEQ ID NO: 1220805 - RNA, 23 nt, Human
uggggcuucacgggugccuggag

SEQ ID NO: 1220806 - RNA, 24 nt, Human
uucggccagcggcauauccagggg

SEQ ID NO: 1220807 - RNA, 18 nt, Human
aaaaagaucugacaccua

SEQ ID NO: 1220808 - RNA, 24 nt, Human
aacacugagaaacugcuccugauu

SEQ ID NO: 1220809 - RNA, 24 nt, Human
aagcacauaagggcagaggugcaa

SEQ ID NO: 1220810 - RNA, 24 nt, Human
cagggcacccagagaacucaguaa

SEQ ID NO: 1220811 - RNA, 21 nt, Human
caguaaauuuguuuucuaacc

SEQ ID NO: 1220812 - RNA, 18 nt, Human
cauccauccccgcuguca

SEQ ID NO: 1220813 - RNA, 18 nt, Human
cauggaagaugaacacug

SEQ ID NO: 1220814 - RNA, 22 nt, Human
caugggaaagauucuggagaaa

SEQ ID NO: 1220815 - RNA, 21 nt, Human
ccagcaagguggcaggaucca

SEQ ID NO: 1220816 - RNA, 19 nt, Human
cuagagagcccucccgucc

SEQ ID NO: 1220817 - RNA, 20 nt, Human
gagaaaaacacucagauaug

SEQ ID NO: 1220818 - RNA, 22 nt, Human
gagaaaaacacucagauauggg

SEQ ID NO: 1220819 - RNA, 24 nt, Human
gagccgagaaaaacacucagauau

SEQ ID NO: 1220820 - RNA, 20 nt, Human
gaugaacacugagaaacugc

SEQ ID NO: 1220821 - RNA, 20 nt, Human
ggagacuaaagggauguguc

SEQ ID NO: 1220822 - RNA, 20 nt, Human
ggcggugggguugcauggag

SEQ ID NO: 1220823 - RNA, 20 nt, Human
uaaaggagacuaaagggaug

SEQ ID NO: 1220824 - RNA, 22 nt, Human
uagaagcuuuuauuuguaagaa

SEQ ID NO: 1220825 - RNA, 23 nt, Human
uagaucacuuagcugcagggccu

SEQ ID NO: 1220826 - RNA, 24 nt, Human
uagcugcagggccuucuguagaug

SEQ ID NO: 1220827 - RNA, 19 nt, Human
uauacucuucaaaaauguc

SEQ ID NO: 1220828 - RNA, 24 nt, Human
uccagcaagguggcaggauccaaa

SEQ ID NO: 1220829 - RNA, 19 nt, Human
ucuaagggcuggcaggagc

SEQ ID NO: 1220830 - RNA, 22 nt, Human
ucuucaaaaaugucgacuucau

SEQ ID NO: 1220831 - RNA, 22 nt, Human
ugcaaucaaguagagccgagaa

SEQ ID NO: 1220832 - RNA, 18 nt, Human
ugcaugggaaagauucug

SEQ ID NO: 1220833 - RNA, 21 nt, Human
uggaagaugaacacugagaaa

SEQ ID NO: 1220834 - RNA, 22 nt, Human
uggauuuccagaaaccagccuc

SEQ ID NO: 1220835 - RNA, 19 nt, Human
uggcaggauccaaaggucu

SEQ ID NO: 1220836 - RNA, 19 nt, Human
uggcaggauccaaaggucu

SEQ ID NO: 1220837 - RNA, 23 nt, Human
uggcaggauccaaaggucugcag

SEQ ID NO: 1220838 - RNA, 18 nt, Human
ugggaugcuggcacagau

SEQ ID NO: 1220839 - RNA, 24 nt, Human
ugugucaccuaaaggcagcauaug

SEQ ID NO: 1220840 - RNA, 19 nt, Human
acacuugcagggacaggag

SEQ ID NO: 1220841 - RNA, 18 nt, Human
agugcuccagcuuggcca

SEQ ID NO: 1220842 - RNA, 22 nt, Human
auggcguggcuggugguggcag

SEQ ID NO: 1220843 - RNA, 20 nt, Human
cagggaacuaggucuccccu

SEQ ID NO: 1220844 - RNA, 18 nt, Human
cauggaggggaaggugga

SEQ ID NO: 1220845 - RNA, 18 nt, Human
cccugggcccggggcagg

SEQ ID NO: 1220846 - RNA, 24 nt, Human
cgagcagaguucagaccgcggcgc

SEQ ID NO: 1220847 - RNA, 21 nt, Human
cgcccccaggccuucugguuc

SEQ ID NO: 1220848 - RNA, 22 nt, Human
cuggugguggcaguaacacuug

SEQ ID NO: 1220849 - RNA, 23 nt, Human
cuggugguggcaguaacacuugc

SEQ ID NO: 1220850 - RNA, 18 nt, Human
cuuggccaccagagagcc

SEQ ID NO: 1220851 - RNA, 18 nt, Human
ggaauggguggccugcaa

SEQ ID NO: 1220852 - RNA, 22 nt, Human
gggcccggggcagggcagggaa

SEQ ID NO: 1220853 - RNA, 19 nt, Human
gguugguggaugugcucag

SEQ ID NO: 1220854 - RNA, 22 nt, Human
gucguagugcuccagcuuggcc

SEQ ID NO: 1220855 - RNA, 19 nt, Human
guggcaggcggcgauggcg

SEQ ID NO: 1220856 - RNA, 18 nt, Human
uacacucaguuggaaugg

SEQ ID NO: 1220857 - RNA, 20 nt, Human
uauuuuauuggcauggaggg

SEQ ID NO: 1220858 - RNA, 18 nt, Human
ucgcccaggugguuggug

SEQ ID NO: 1220859 - RNA, 19 nt, Human
uggaggggaagguggaggg

SEQ ID NO: 1220860 - RNA, 18 nt, Human
uggcaggcggcgauggcg

SEQ ID NO: 1220861 - RNA, 21 nt, Human
uggcaggcggcgauggcgugg

SEQ ID NO: 1220862 - RNA, 21 nt, Human
uggcguggcuggugguggcag

SEQ ID NO: 1220863 - RNA, 20 nt, Human
uggcucgcccaggugguugg

SEQ ID NO: 1220864 - RNA, 18 nt, Human
ugguggcaacccagggug

SEQ ID NO: 1220865 - RNA, 21 nt, Human
ugugcucagccaggcagagac

SEQ ID NO: 1220866 - RNA, 19 nt, Human
uugagccgacuacacucag

SEQ ID NO: 1220867 - RNA, 23 nt, Human
uugaugguggcaacccagggugg

SEQ ID NO: 1220868 - RNA, 22 nt, Human
uuggcauggaggggaaggugga

SEQ ID NO: 1220869 - RNA, 21 nt, Human
uuguuccucgcccccaggccu

SEQ ID NO: 1220870 - RNA, 18 nt, Human
aaaaugcccaccaaguug

SEQ ID NO: 1220871 - RNA, 20 nt, Human
aacauggugaaaucccgucu

SEQ ID NO: 1220872 - RNA, 21 nt, Human
aacauggugaaaucccgucuc

SEQ ID NO: 1220873 - RNA, 19 nt, Human
aacugugaggacuucccuc

SEQ ID NO: 1220874 - RNA, 24 nt, Human
aagcgugguggugugcaccuguaa

SEQ ID NO: 1220875 - RNA, 23 nt, Human
aagguugcaguaagaaaagauug

SEQ ID NO: 1220876 - RNA, 24 nt, Human
aaguugccugucugacacuuaaag

SEQ ID NO: 1220877 - RNA, 22 nt, Human
acaccuuggcuuccugaguagc

SEQ ID NO: 1220878 - RNA, 18 nt, Human
acagagugacuccgucuc

SEQ ID NO: 1220879 - RNA, 22 nt, Human
acagagugacuccgucucaaaa

SEQ ID NO: 1220880 - RNA, 21 nt, Human
acaugguggaaguggaugggc

SEQ ID NO: 1220881 - RNA, 24 nt, Human
accaacauggugaaaucccgucuc

SEQ ID NO: 1220882 - RNA, 18 nt, Human
agaaccaauggacgagga

SEQ ID NO: 1220883 - RNA, 24 nt, Human
agagaucaugcuguuagcaggcuc

SEQ ID NO: 1220884 - RNA, 18 nt, Human
agauccauaccugaacuc

SEQ ID NO: 1220885 - RNA, 21 nt, Human
agaugcccgccaaggcugggu

SEQ ID NO: 1220886 - RNA, 23 nt, Human
agccaagcgugguggugugcacc

SEQ ID NO: 1220887 - RNA, 22 nt, Human
agccuaggugacagagugacuc

SEQ ID NO: 1220888 - RNA, 24 nt, Human
agccugaccaacauggugaaaucc

SEQ ID NO: 1220889 - RNA, 24 nt, Human
aggaaggucgaucacgaggucagg

SEQ ID NO: 1220890 - RNA, 23 nt, Human
aggaggcugaggcaggagaauca

SEQ ID NO: 1220891 - RNA, 18 nt, Human
aggcaggagaaucacuug

SEQ ID NO: 1220892 - RNA, 24 nt, Human
aggcaggagaaucacuugaacucg

SEQ ID NO: 1220893 - RNA, 19 nt, Human
aggcgaagguugcaguaag

SEQ ID NO: 1220894 - RNA, 24 nt, Human
aggcugaggcaggagaaucacuug

SEQ ID NO: 1220895 - RNA, 22 nt, Human
aggcugggugcaguggcucaug

SEQ ID NO: 1220896 - RNA, 18 nt, Human
agggaaaagggugaggag

SEQ ID NO: 1220897 - RNA, 24 nt, Human
agggguccucacaccuuggcuucc

SEQ ID NO: 1220898 - RNA, 24 nt, Human
aggucgaucacgaggucaggaguu

SEQ ID NO: 1220899 - RNA, 23 nt, Human
aguggcucaugccuguaauccca

SEQ ID NO: 1220900 - RNA, 24 nt, Human
aguggcucaugccuguaaucccag

SEQ ID NO: 1220901 - RNA, 19 nt, Human
aucacgaggucaggaguuc

SEQ ID NO: 1220902 - RNA, 21 nt, Human
aucacgaggucaggaguucga

SEQ ID NO: 1220903 - RNA, 21 nt, Human
aucaugcuguuagcaggcucu

SEQ ID NO: 1220904 - RNA, 19 nt, Human
augccuguaaucccagcac

SEQ ID NO: 1220905 - RNA, 22 nt, Human
auuagagaucaacaggcaaacu

SEQ ID NO: 1220906 - RNA, 24 nt, Human
caacauggugaaaucccgucucua

SEQ ID NO: 1220907 - RNA, 26 nt, Human
caaguugccugucugacacuuaaagu

SEQ ID NO: 1220908 - RNA, 30 nt, Human
caaguugccugucugacacuuaaaguuuuu

SEQ ID NO: 1220909 - RNA, 23 nt, Human
caauccagccuaggugacagagu

SEQ ID NO: 1220910 - RNA, 23 nt, Human
caauggacgaggacacgccuucu

SEQ ID NO: 1220911 - RNA, 24 nt, Human
cacaccuuggcuuccugaguagcu

SEQ ID NO: 1220912 - RNA, 24 nt, Human
caccuguaaucccagguacucagg

SEQ ID NO: 1220913 - RNA, 23 nt, Human
caccuuggcuuccugaguagcuu

SEQ ID NO: 1220914 - RNA, 21 nt, Human
cagacagacauugaggucagg

SEQ ID NO: 1220915 - RNA, 20 nt, Human
cagcacuuugggaggccaag

SEQ ID NO: 1220916 - RNA, 25 nt, Human
cagcacuuugggaggccaaggaagg

SEQ ID NO: 1220917 - RNA, 20 nt, Human
caggccccacacacauggcu

SEQ ID NO: 1220918 - RNA, 24 nt, Human
cagguacucaggaggcugaggcag

SEQ ID NO: 1220919 - RNA, 19 nt, Human
caguaagaaaagauugcac

SEQ ID NO: 1220920 - RNA, 24 nt, Human
caucuccccucacacuuccaggcc

SEQ ID NO: 1220921 - RNA, 21 nt, Human
caucuuagauccauaccugaa

SEQ ID NO: 1220922 - RNA, 20 nt, Human
caugccuguaaucccagcac

SEQ ID NO: 1220923 - RNA, 21 nt, Human
cauggaaagagggauuccuca

SEQ ID NO: 1220924 - RNA, 19 nt, Human
cauugcaauccagccuagg

SEQ ID NO: 1220925 - RNA, 19 nt, Human
cauugcaauccagccuagg

SEQ ID NO: 1220926 - RNA, 21 nt, Human
cauugcaauccagccuaggug

SEQ ID NO: 1220927 - RNA, 24 nt, Human
cauugcaauccagccuaggugaca

SEQ ID NO: 1220928 - RNA, 24 nt, Human
cauugcaauccagccuaggugaca

SEQ ID NO: 1220929 - RNA, 22 nt, Human
ccaaggcugggugcaguggcuc

SEQ ID NO: 1220930 - RNA, 24 nt, Human
ccaauggacgaggacacgccuucu

SEQ ID NO: 1220931 - RNA, 20 nt, Human
ccacacacauggcugucaau

SEQ ID NO: 1220932 - RNA, 20 nt, Human
ccauugcaauccagccuagg

SEQ ID NO: 1220933 - RNA, 21 nt, Human
ccauugcaauccagccuaggu

SEQ ID NO: 1220934 - RNA, 24 nt, Human
ccauugcaauccagccuaggugac

SEQ ID NO: 1220935 - RNA, 22 nt, Human
cccacacacauggcugucaaug

SEQ ID NO: 1220936 - RNA, 26 nt, Human
cccacacacauggcugucaaugacca

SEQ ID NO: 1220937 - RNA, 22 nt, Human
cccgucucuacuaaaaauacaa

SEQ ID NO: 1220938 - RNA, 19 nt, Human
ccucaaguuauuuucccau

SEQ ID NO: 1220939 - RNA, 23 nt, Human
ccugaccaacauggugaaauccc

SEQ ID NO: 1220940 - RNA, 24 nt, Human
ccugaccaacauggugaaaucccg

SEQ ID NO: 1220941 - RNA, 20 nt, Human
ccuguaaucccagcacuuug

SEQ ID NO: 1220942 - RNA, 22 nt, Human
ccuguaaucccagcacuuuggg

SEQ ID NO: 1220943 - RNA, 24 nt, Human
cgagaccagccugaccaacauggu

SEQ ID NO: 1220944 - RNA, 21 nt, Human
cgccaaggcugggugcagugg

SEQ ID NO: 1220945 - RNA, 24 nt, Human
cucaaguuauuuucccauuuuugc

SEQ ID NO: 1220946 - RNA, 24 nt, Human
cucaugccuguaaucccagcacuu

SEQ ID NO: 1220947 - RNA, 24 nt, Human
cuccgucucaaaaaaaaaaugccc

SEQ ID NO: 1220948 - RNA, 24 nt, Human
cugccuggacuccaguccugauuc

SEQ ID NO: 1220949 - RNA, 23 nt, Human
gagaaucacuugaacucgggagg

SEQ ID NO: 1220950 - RNA, 20 nt, Human
gagugggugaaaggggcugg

SEQ ID NO: 1220951 - RNA, 20 nt, Human
gaucacgaggucaggaguuc

SEQ ID NO: 1220952 - RNA, 22 nt, Human
gaucacgaggucaggaguucga

SEQ ID NO: 1220953 - RNA, 24 nt, Human
gaucacgaggucaggaguucgaga

SEQ ID NO: 1220954 - RNA, 18 nt, Human
gaugggcaaagauguaug

SEQ ID NO: 1220955 - RNA, 22 nt, Human
gcaggagaaucacuugaacucg

SEQ ID NO: 1220956 - RNA, 20 nt, Human
gcaguaagaaaagauugcac

SEQ ID NO: 1220957 - RNA, 24 nt, Human
gccaaggcugggugcaguggcuca

SEQ ID NO: 1220958 - RNA, 22 nt, Human
gcuaggauucaggagccaggcu

SEQ ID NO: 1220959 - RNA, 22 nt, Human
gcugcagggguccucacaccuu

SEQ ID NO: 1220960 - RNA, 19 nt, Human
gcuguuagcaggcucuggg

SEQ ID NO: 1220961 - RNA, 24 nt, Human
ggaagauuauuuaaaauucuuuuu

SEQ ID NO: 1220962 - RNA, 18 nt, Human
ggaaguggaugggcaaag

SEQ ID NO: 1220963 - RNA, 18 nt, Human
ggaggccaaggaaggucg

SEQ ID NO: 1220964 - RNA, 23 nt, Human
ggcugggugcaguggcucaugcc

SEQ ID NO: 1220965 - RNA, 23 nt, Human
ggugcaguggcucaugccuguaa

SEQ ID NO: 1220966 - RNA, 24 nt, Human
gguggugugcaccuguaaucccag

SEQ ID NO: 1220967 - RNA, 21 nt, Human
ggugugcaccuguaaucccag

SEQ ID NO: 1220968 - RNA, 22 nt, Human
gugacagagugacuccgucuca

SEQ ID NO: 1220969 - RNA, 23 nt, Human
gugauguuuuaaugaccaagugu

SEQ ID NO: 1220970 - RNA, 21 nt, Human
uaaaaauacaaaaauuagcca

SEQ ID NO: 1220971 - RNA, 21 nt, Human
uaaauugcagacagacauuga

SEQ ID NO: 1220972 - RNA, 24 nt, Human
uagagaaauuaauaucugugaaaa

SEQ ID NO: 1220973 - RNA, 18 nt, Human
uagagaucaacaggcaaa

SEQ ID NO: 1220974 - RNA, 20 nt, Human
uagcaccaagaugcucagau

SEQ ID NO: 1220975 - RNA, 23 nt, Human
uagcaccaagaugcucagaucaa

SEQ ID NO: 1220976 - RNA, 23 nt, Human
ucaaugaccaaacaauggccaaa

SEQ ID NO: 1220977 - RNA, 21 nt, Human
ucacauggaaagagggauucc

SEQ ID NO: 1220978 - RNA, 19 nt, Human
ucacccuaucacagucaga

SEQ ID NO: 1220979 - RNA, 18 nt, Human
ucacgaggucaggaguuc

SEQ ID NO: 1220980 - RNA, 24 nt, Human
ucacgaggucaggaguucgagacc

SEQ ID NO: 1220981 - RNA, 22 nt, Human
ucacugaagccuugaacuccug

SEQ ID NO: 1220982 - RNA, 19 nt, Human
ucagaaauggaaggcgaug

SEQ ID NO: 1220983 - RNA, 22 nt, Human
ucaugccuguaaucccagcacu

SEQ ID NO: 1220984 - RNA, 24 nt, Human
uccccucacacuuccaggccccac

SEQ ID NO: 1220985 - RNA, 19 nt, Human
uccuaaagacaugaggguc

SEQ ID NO: 1220986 - RNA, 23 nt, Human
uccuaaagacaugagggucucau

SEQ ID NO: 1220987 - RNA, 19 nt, Human
uccugugcugcaggggucc

SEQ ID NO: 1220988 - RNA, 22 nt, Human
ucgaucacgaggucaggaguuc

SEQ ID NO: 1220989 - RNA, 24 nt, Human
ucucaaaaaaaaaaugcccaccaa

SEQ ID NO: 1220990 - RNA, 21 nt, Human
ucucauaguuaggagcuagga

SEQ ID NO: 1220991 - RNA, 21 nt, Human
ucucuacuaaaaauacaaaaa

SEQ ID NO: 1220992 - RNA, 23 nt, Human
ucuucauagaacaugguggaagu

SEQ ID NO: 1220993 - RNA, 22 nt, Human
ucuucccacacuugcaaaaucu

SEQ ID NO: 1220994 - RNA, 19 nt, Human
ugaaaggggcugggccagg

SEQ ID NO: 1220995 - RNA, 23 nt, Human
ugacagagugacuccgucucaaa

SEQ ID NO: 1220996 - RNA, 24 nt, Human
ugaccaacauggugaaaucccguc

SEQ ID NO: 1220997 - RNA, 24 nt, Human
ugagagugggugaaaggggcuggg

SEQ ID NO: 1220998 - RNA, 23 nt, Human
ugaggcaggagaaucacuugaac

SEQ ID NO: 1220999 - RNA, 24 nt, Human
ugaggcaggagaaucacuugaacu

SEQ ID NO: 1221000 - RNA, 25 nt, Human
ugaggcaggagaaucacuugaacuc

SEQ ID NO: 1221001 - RNA, 23 nt, Human
ugagggucucauaguuaggagcu

SEQ ID NO: 1221002 - RNA, 22 nt, Human
ugaggucagggagacaucuucc

SEQ ID NO: 1221003 - RNA, 22 nt, Human
ugcaauccagccuaggugacag

SEQ ID NO: 1221004 - RNA, 21 nt, Human
ugcaccauugcaauccagccu

SEQ ID NO: 1221005 - RNA, 18 nt, Human
ugcaccuguaaucccagg

SEQ ID NO: 1221006 - RNA, 23 nt, Human
ugccuguaaucccagcacuuugg

SEQ ID NO: 1221007 - RNA, 23 nt, Human
ugccuguaaucccagcacuuugg

SEQ ID NO: 1221008 - RNA, 20 nt, Human
uggccucaaguuauuuuccc

SEQ ID NO: 1221009 - RNA, 22 nt, Human
uggcucaugccuguaaucccag

SEQ ID NO: 1221010 - RNA, 24 nt, Human
uggcucaugccuguaaucccagca

SEQ ID NO: 1221011 - RNA, 21 nt, Human
uggcuuccugaguagcuuugg

SEQ ID NO: 1221012 - RNA, 19 nt, Human
ugggaggccaaggaagguc

SEQ ID NO: 1221013 - RNA, 24 nt, Human
ugggaggccaaggaaggucgauca

SEQ ID NO: 1221014 - RNA, 24 nt, Human
ugguggugugcaccuguaauccca

SEQ ID NO: 1221015 - RNA, 22 nt, Human
uggugugcaccuguaaucccag

SEQ ID NO: 1221016 - RNA, 27 nt, Human
ugucaaugaccaaacaauggccaaagu

SEQ ID NO: 1221017 - RNA, 20 nt, Human
uguggccuccccuuuuguga

SEQ ID NO: 1221018 - RNA, 18 nt, Human
uucacccuaucacaguca

SEQ ID NO: 1221019 - RNA, 23 nt, Human
uucacccuaucacagucagaacc

SEQ ID NO: 1221020 - RNA, 18 nt, Human
uucccagguacuaggaag

SEQ ID NO: 1221021 - RNA, 19 nt, Human
aaauaucacacuguacccc

SEQ ID NO: 1221022 - RNA, 18 nt, Human
aauggcucaaacuacccc

SEQ ID NO: 1221023 - RNA, 22 nt, Human
acaaaaaagagauaauugaggu

SEQ ID NO: 1221024 - RNA, 22 nt, Human
accauaggucagugcagccuca

SEQ ID NO: 1221025 - RNA, 25 nt, Human
acucuguugcccuggcuggagugca

SEQ ID NO: 1221026 - RNA, 21 nt, Human
agaauugugccucuaaaccuc

SEQ ID NO: 1221027 - RNA, 19 nt, Human
agcaaaaauacaaagacac

SEQ ID NO: 1221028 - RNA, 25 nt, Human
aggcagggaaggguaagggauaggu

SEQ ID NO: 1221029 - RNA, 19 nt, Human
agguagauaagaggaagaa

SEQ ID NO: 1221030 - RNA, 22 nt, Human
auuuuuuuuuuuggagacaggg

SEQ ID NO: 1221031 - RNA, 26 nt, Human
caaaaauacaaagacacauguggcug

SEQ ID NO: 1221032 - RNA, 20 nt, Human
caagacgcagaaauggcuca

SEQ ID NO: 1221033 - RNA, 20 nt, Human
caagacgcagaaauggcuca

SEQ ID NO: 1221034 - RNA, 23 nt, Human
caagacgcagaaauggcucaaac

SEQ ID NO: 1221035 - RNA, 21 nt, Human
cacaguuccagggaaagcaga

SEQ ID NO: 1221036 - RNA, 24 nt, Human
cacucuguugcccuggcuggagug

SEQ ID NO: 1221037 - RNA, 20 nt, Human
cagcaaaaauacaaagacac

SEQ ID NO: 1221038 - RNA, 24 nt, Human
cagccucaaucuuccagacucaag

SEQ ID NO: 1221039 - RNA, 19 nt, Human
caggaaccucagacuagga

SEQ ID NO: 1221040 - RNA, 20 nt, Human
cagguagauaagaggaagaa

SEQ ID NO: 1221041 - RNA, 22 nt, Human
cagugcagccucaaucuuccag

SEQ ID NO: 1221042 - RNA, 21 nt, Human
ccaaggcuucuuuuccccuga

SEQ ID NO: 1221043 - RNA, 20 nt, Human
ccucuaaaccucugcucuuc

SEQ ID NO: 1221044 - RNA, 22 nt, Human
ccucuaaaccucugcucuucgc

SEQ ID NO: 1221045 - RNA, 20 nt, Human
cuaggagaccggaagugucc

SEQ ID NO: 1221046 - RNA, 27 nt, Human
cuauggcugaaacacuaaccggggucc

SEQ ID NO: 1221047 - RNA, 24 nt, Human
cucacucuguugcccuggcuggag

SEQ ID NO: 1221048 - RNA, 19 nt, Human
cucuaaaccucugcucuuc

SEQ ID NO: 1221049 - RNA, 19 nt, Human
cucugcucugacaguccca

SEQ ID NO: 1221050 - RNA, 18 nt, Human
cugcagcauucucugcuc

SEQ ID NO: 1221051 - RNA, 22 nt, Human
gaacaaacucuuauacuaagac

SEQ ID NO: 1221052 - RNA, 19 nt, Human
gcaaaaauacaaagacaca

SEQ ID NO: 1221053 - RNA, 18 nt, Human
gcagccucaaucuuccag

SEQ ID NO: 1221054 - RNA, 19 nt, Human
gcuggagugcaguagcacu

SEQ ID NO: 1221055 - RNA, 21 nt, Human
gggauaggugggauggccaaa

SEQ ID NO: 1221056 - RNA, 22 nt, Human
gugaacaaacucuuauacuaag

SEQ ID NO: 1221057 - RNA, 21 nt, Human
uaaaccucugcucuucgccaa

SEQ ID NO: 1221058 - RNA, 21 nt, Human
uagaggcagggaaggguaagg

SEQ ID NO: 1221059 - RNA, 19 nt, Human
uaggugggauggccaaagg

SEQ ID NO: 1221060 - RNA, 23 nt, Human
ucagugcagccucaaucuuccag

SEQ ID NO: 1221061 - RNA, 23 nt, Human
ucaucaauuuugacauguucauc

SEQ ID NO: 1221062 - RNA, 19 nt, Human
ucucacucuguugcccugg

SEQ ID NO: 1221063 - RNA, 22 nt, Human
ucucacucuguugcccuggcug

SEQ ID NO: 1221064 - RNA, 24 nt, Human
ucucacucuguugcccuggcugga

SEQ ID NO: 1221065 - RNA, 24 nt, Human
ucuguugcccuggcuggagugcag

SEQ ID NO: 1221066 - RNA, 19 nt, Human
ugcccuggcuggagugcag

SEQ ID NO: 1221067 - RNA, 23 nt, Human
ugcccuggcuggagugcaguagc

SEQ ID NO: 1221068 - RNA, 21 nt, Human
ugcuaauuacacugauuugau

SEQ ID NO: 1221069 - RNA, 19 nt, Human
ugcuggaacaaugaauuuu

SEQ ID NO: 1221070 - RNA, 22 nt, Human
uggagacagggucucacucugu

SEQ ID NO: 1221071 - RNA, 24 nt, Human
uggaugcaaaaguacagguagaua

SEQ ID NO: 1221072 - RNA, 18 nt, Human
uggcuaauggaugcaaaa

SEQ ID NO: 1221073 - RNA, 20 nt, Human
ugggauggccaaagguuggc

SEQ ID NO: 1221074 - RNA, 18 nt, Human
uggggaagcuuaaaaagc

SEQ ID NO: 1221075 - RNA, 23 nt, Human
uucaaacugcuggaacaaugaau

SEQ ID NO: 1221076 - RNA, 24 nt, Human
uugcccuggcuggagugcaguagc

SEQ ID NO: 1221077 - RNA, 26 nt, Human
uuuuuuuuuuuggagacagggucuca

SEQ ID NO: 1221078 - RNA, 19 nt, Human
aaagugcugggauuacagg

SEQ ID NO: 1221079 - RNA, 19 nt, Human
aaagugcugggauuacagg

SEQ ID NO: 1221080 - RNA, 24 nt, Human
aaagugcugggauuacaggaguga

SEQ ID NO: 1221081 - RNA, 25 nt, Human
aagcgauccucccaccucagccucu

SEQ ID NO: 1221082 - RNA, 18 nt, Human
aagugcugggauuacagg

SEQ ID NO: 1221083 - RNA, 22 nt, Human
aagugcugggauuacaggaguc

SEQ ID NO: 1221084 - RNA, 26 nt, Human
aagugcugggauuacaggagugagcc

SEQ ID NO: 1221085 - RNA, 23 nt, Human
accucagccucuucaguagcugg

SEQ ID NO: 1221086 - RNA, 19 nt, Human
acuacaggugcgugccacc

SEQ ID NO: 1221087 - RNA, 23 nt, Human
agccauccuccugccuuggccuc

SEQ ID NO: 1221088 - RNA, 18 nt, Human
aggcugaucucaaacucc

SEQ ID NO: 1221089 - RNA, 21 nt, Human
agggagcuguucucacagacc

SEQ ID NO: 1221090 - RNA, 18 nt, Human
agguuggagugcaguggu

SEQ ID NO: 1221091 - RNA, 18 nt, Human
aguagcugggauuucagg

SEQ ID NO: 1221092 - RNA, 19 nt, Human
agugcaguggugcaaucau

SEQ ID NO: 1221093 - RNA, 21 nt, Human
agugcaguggugcaaucauag

SEQ ID NO: 1221094 - RNA, 18 nt, Human
auagcccacugcagccuc

SEQ ID NO: 1221095 - RNA, 19 nt, Human
auagcccacugcagccucg

SEQ ID NO: 1221096 - RNA, 18 nt, Human
aucauagcccacugcagc

SEQ ID NO: 1221097 - RNA, 18 nt, Human
augggguuucaccauguu

SEQ ID NO: 1221098 - RNA, 18 nt, Human
augggguuucaccauguu

SEQ ID NO: 1221099 - RNA, 20 nt, Human
augggguuucaccauguuag

SEQ ID NO: 1221100 - RNA, 24 nt, Human
augggguuucaccauguugccugg

SEQ ID NO: 1221101 - RNA, 24 nt, Human
caaagugcugggauuacaggagug

SEQ ID NO: 1221102 - RNA, 22 nt, Human
caagccauccuccugccuuggc

SEQ ID NO: 1221103 - RNA, 23 nt, Human
cacagacccccaccaugggacac

SEQ ID NO: 1221104 - RNA, 18 nt, Human
cacagccugccugccagg

SEQ ID NO: 1221105 - RNA, 22 nt, Human
caccaccacgccuggcuaauuu

SEQ ID NO: 1221106 - RNA, 18 nt, Human
caccauguuagccaggau

SEQ ID NO: 1221107 - RNA, 22 nt, Human
caccauguuagccaggaugguc

SEQ ID NO: 1221108 - RNA, 24 nt, Human
caccauguuagccaggauggucuc

SEQ ID NO: 1221109 - RNA, 24 nt, Human
caccauguugccugggcuggucuc

SEQ ID NO: 1221110 - RNA, 24 nt, Human
caccucgaccucccaaagugcugg

SEQ ID NO: 1221111 - RNA, 24 nt, Human
cagccucgaccuccggggcucaag

SEQ ID NO: 1221112 - RNA, 24 nt, Human
cagggucuggcucuguugcccagg

SEQ ID NO: 1221113 - RNA, 20 nt, Human
caggugugcaccaccacgcc

SEQ ID NO: 1221114 - RNA, 24 nt, Human
caguagcugggauuucaggugugc

SEQ ID NO: 1221115 - RNA, 24 nt, Human
cauguugccugggcuggucucaaa

SEQ ID NO: 1221116 - RNA, 19 nt, Human
ccaaagugcugggauuaca

SEQ ID NO: 1221117 - RNA, 21 nt, Human
ccaaagugcugggauuacagg

SEQ ID NO: 1221118 - RNA, 24 nt, Human
ccaaagugcugggauuacaggagu

SEQ ID NO: 1221119 - RNA, 19 nt, Human
ccaccgcgccuggcccuac

SEQ ID NO: 1221120 - RNA, 22 nt, Human
ccaccucagccucuucaguagc

SEQ ID NO: 1221121 - RNA, 23 nt, Human
ccacugcagccucgaccuccggg

SEQ ID NO: 1221122 - RNA, 22 nt, Human
cccaccagcccacagccugccu

SEQ ID NO: 1221123 - RNA, 19 nt, Human
cccagguuggagugcagug

SEQ ID NO: 1221124 - RNA, 25 nt, Human
ccccccacuagcagggacuacaggu

SEQ ID NO: 1221125 - RNA, 21 nt, Human
cccggcuccgucggcaccgga

SEQ ID NO: 1221126 - RNA, 20 nt, Human
ccggggcucaagcgauccuc

SEQ ID NO: 1221127 - RNA, 24 nt, Human
ccuacauccaccagugcccaaaga

SEQ ID NO: 1221128 - RNA, 26 nt, Human
ccucccaccucagccucuucaguagc

SEQ ID NO: 1221129 - RNA, 23 nt, Human
ccuccggggcucaagcgauccuc

SEQ ID NO: 1221130 - RNA, 18 nt, Human
ccucgaccuccggggcuc

SEQ ID NO: 1221131 - RNA, 24 nt, Human
ccugaccucaggugauccgcccac

SEQ ID NO: 1221132 - RNA, 20 nt, Human
ccugggcucaagccauccuc

SEQ ID NO: 1221133 - RNA, 23 nt, Human
ccugggcucaagccauccuccug

SEQ ID NO: 1221134 - RNA, 22 nt, Human
ccugucuaauuuucuguagagu

SEQ ID NO: 1221135 - RNA, 24 nt, Human
cgauccuccccacuucagcccccc

SEQ ID NO: 1221136 - RNA, 21 nt, Human
cgcccaccucgaccucccaaa

SEQ ID NO: 1221137 - RNA, 24 nt, Human
cgcgccuggcccuacguuagacuu

SEQ ID NO: 1221138 - RNA, 25 nt, Human
cucaaacgauccuccccacuucagc

SEQ ID NO: 1221139 - RNA, 18 nt, Human
cucaagccauccuccugc

SEQ ID NO: 1221140 - RNA, 24 nt, Human
cucaagcgauccucccaccucagc

SEQ ID NO: 1221141 - RNA, 24 nt, Human
cucagccucuucaguagcugggau

SEQ ID NO: 1221142 - RNA, 20 nt, Human
cucaggcucaaacgauccuc

SEQ ID NO: 1221143 - RNA, 23 nt, Human
cuccugggcucaagccauccucc

SEQ ID NO: 1221144 - RNA, 22 nt, Human
cugcagccucgaccuccggggc

SEQ ID NO: 1221145 - RNA, 24 nt, Human
gaccucaggugauccgcccaccuc

SEQ ID NO: 1221146 - RNA, 24 nt, Human
gaccuccggggcucaagcgauccu

SEQ ID NO: 1221147 - RNA, 18 nt, Human
gagaugggguuucaccau

SEQ ID NO: 1221148 - RNA, 18 nt, Human
gagaugggguuucaccau

SEQ ID NO: 1221149 - RNA, 24 nt, Human
gagaugggguuucaccauguuagc

SEQ ID NO: 1221150 - RNA, 23 nt, Human
gagaugggguuucaccauguugc

SEQ ID NO: 1221151 - RNA, 28 nt, Human
gauccuccccacuucagccccccacuag

SEQ ID NO: 1221152 - RNA, 20 nt, Human
gaucuagcagcuccgaucca

SEQ ID NO: 1221153 - RNA, 22 nt, Human
gaugggguuucaccauguugcc

SEQ ID NO: 1221154 - RNA, 18 nt, Human
gauuacaggagugagcca

SEQ ID NO: 1221155 - RNA, 20 nt, Human
gccauccuccugccuuggcc

SEQ ID NO: 1221156 - RNA, 23 nt, Human
gcccaaagaggaucuagcagcuc

SEQ ID NO: 1221157 - RNA, 20 nt, Human
gccugggcuggucucaaacu

SEQ ID NO: 1221158 - RNA, 22 nt, Human
gcucaagcgauccucccaccuc

SEQ ID NO: 1221159 - RNA, 19 nt, Human
gcucuguugcccagguugg

SEQ ID NO: 1221160 - RNA, 21 nt, Human
ggcaccggaaaugcaaagucc

SEQ ID NO: 1221161 - RNA, 23 nt, Human
gggacuacaggugcgugccacca

SEQ ID NO: 1221162 - RNA, 22 nt, Human
gggcucaagccauccuccugcc

SEQ ID NO: 1221163 - RNA, 22 nt, Human
gggguuucaccauguuagccag

SEQ ID NO: 1221164 - RNA, 19 nt, Human
gggguuucaccauguugcc

SEQ ID NO: 1221165 - RNA, 23 nt, Human
gggguuucaccauguugccuggg

SEQ ID NO: 1221166 - RNA, 22 nt, Human
ggguuucaccauguuagccagg

SEQ ID NO: 1221167 - RNA, 20 nt, Human
ggucucaaacuccugaccuc

SEQ ID NO: 1221168 - RNA, 24 nt, Human
gguuucaccauguuagccaggaug

SEQ ID NO: 1221169 - RNA, 19 nt, Human
guagagaugggguuucacc

SEQ ID NO: 1221170 - RNA, 21 nt, Human
guagagaugggguuucaccau

SEQ ID NO: 1221171 - RNA, 22 nt, Human
guagagaugggguuucaccaug

SEQ ID NO: 1221172 - RNA, 23 nt, Human
guagagaugggguuucaccaugu

SEQ ID NO: 1221173 - RNA, 19 nt, Human
guauuuuuuguagagaugg

SEQ ID NO: 1221174 - RNA, 24 nt, Human
gugauccgcccaccucgaccuccc

SEQ ID NO: 1221175 - RNA, 24 nt, Human
uaauuucuguauuuuuuguagaga

SEQ ID NO: 1221176 - RNA, 22 nt, Human
uacaggagugagccaccgcgcc

SEQ ID NO: 1221177 - RNA, 23 nt, Human
uacaggagugagccaccgcgccu

SEQ ID NO: 1221178 - RNA, 23 nt, Human
uacaggagugagccaccgcgccu

SEQ ID NO: 1221179 - RNA, 22 nt, Human
uagagaugggguuucaccaugu

SEQ ID NO: 1221180 - RNA, 22 nt, Human
uagagaugggguuucaccaugu

SEQ ID NO: 1221181 - RNA, 18 nt, Human
uagcagggacuacaggug

SEQ ID NO: 1221182 - RNA, 20 nt, Human
uagcccacugcagccucgac

SEQ ID NO: 1221183 - RNA, 24 nt, Human
uagcccacugcagccucgaccucc

SEQ ID NO: 1221184 - RNA, 24 nt, Human
uaguagagaugggguuucaccaug

SEQ ID NO: 1221185 - RNA, 26 nt, Human
uaguagagaugggguuucaccauguu

SEQ ID NO: 1221186 - RNA, 24 nt, Human
ucaccauguuagccaggauggucu

SEQ ID NO: 1221187 - RNA, 19 nt, Human
uccaccagugcccaaagag

SEQ ID NO: 1221188 - RNA, 18 nt, Human
ucccaaagugcugggauu

SEQ ID NO: 1221189 - RNA, 23 nt, Human
ucccaaagugcugggauuacagg

SEQ ID NO: 1221190 - RNA, 23 nt, Human
uccgggcucugcacaccuuccag

SEQ ID NO: 1221191 - RNA, 18 nt, Human
uccugggcucaagccauc

SEQ ID NO: 1221192 - RNA, 22 nt, Human
uccugggcucaagccauccucc

SEQ ID NO: 1221193 - RNA, 24 nt, Human
uccugggcucaagccauccuccug

SEQ ID NO: 1221194 - RNA, 23 nt, Human
ucucaaacuccugggcucaagcc

SEQ ID NO: 1221195 - RNA, 23 nt, Human
ucuggcucuguugcccagguugg

SEQ ID NO: 1221196 - RNA, 24 nt, Human
ucuggcucuguugcccagguugga

SEQ ID NO: 1221197 - RNA, 24 nt, Human
ucuguugcccagguuggagugcag

SEQ ID NO: 1221198 - RNA, 23 nt, Human
ucuguuuuuuagacagggucugg

SEQ ID NO: 1221199 - RNA, 24 nt, Human
ucuucaguagcugggauuucaggu

SEQ ID NO: 1221200 - RNA, 18 nt, Human
ugaccucaggugauccgc

SEQ ID NO: 1221201 - RNA, 21 nt, Human
ugaccucaggugauccgccca

SEQ ID NO: 1221202 - RNA, 24 nt, Human
ugaccucaggugauccgcccaccu

SEQ ID NO: 1221203 - RNA, 24 nt, Human
ugauccgcccaccucgaccuccca

SEQ ID NO: 1221204 - RNA, 26 nt, Human
ugccaccauaccugucuaauuuucug

SEQ ID NO: 1221205 - RNA, 18 nt, Human
ugcccagguuggagugca

SEQ ID NO: 1221206 - RNA, 24 nt, Human
ugcccagguuggagugcaguggug

SEQ ID NO: 1221207 - RNA, 24 nt, Human
ugccuacauccaccagugcccaaa

SEQ ID NO: 1221208 - RNA, 19 nt, Human
uggagaacgaugaccccau

SEQ ID NO: 1221209 - RNA, 18 nt, Human
uggagugcaguggugcaa

SEQ ID NO: 1221210 - RNA, 19 nt, Human
uggagugcaguggugcaau

SEQ ID NO: 1221211 - RNA, 21 nt, Human
uggagugcaguggugcaauca

SEQ ID NO: 1221212 - RNA, 19 nt, Human
ugggauuacaggagugagc

SEQ ID NO: 1221213 - RNA, 22 nt, Human
ugggauuacaggagugagccac

SEQ ID NO: 1221214 - RNA, 23 nt, Human
ugggauuacaggagugagccacc

SEQ ID NO: 1221215 - RNA, 24 nt, Human
ugggauuacaggagugagccaccg

SEQ ID NO: 1221216 - RNA, 24 nt, Human
ugggguuucaccauguuagccagg

SEQ ID NO: 1221217 - RNA, 23 nt, Human
ugggguuucaccauguugccugg

SEQ ID NO: 1221218 - RNA, 24 nt, Human
ugggguuucaccauguugccuggg

SEQ ID NO: 1221219 - RNA, 24 nt, Human
uggugcaaucauagcccacugcag

SEQ ID NO: 1221220 - RNA, 24 nt, Human
uguagagaugggguuucaccaugu

SEQ ID NO: 1221221 - RNA, 21 nt, Human
uguauuuuuaguagagauggg

SEQ ID NO: 1221222 - RNA, 22 nt, Human
uuagacagggucuggcucuguu

SEQ ID NO: 1221223 - RNA, 18 nt, Human
uuaguagagaugggguuu

SEQ ID NO: 1221224 - RNA, 22 nt, Human
uuaguagagaugggguuucacc

SEQ ID NO: 1221225 - RNA, 24 nt, Human
uuaguagagaugggguuucaccau

SEQ ID NO: 1221226 - RNA, 24 nt, Human
uugcccagguuggagugcaguggu

SEQ ID NO: 1221227 - RNA, 24 nt, Human
uuguagagaugggguuucaccaug

SEQ ID NO: 1221228 - RNA, 23 nt, Human
uuguauuuuuaguagagaugggg

SEQ ID NO: 1221229 - RNA, 19 nt, Human
uuucaccauguuagccagg

SEQ ID NO: 1221230 - RNA, 20 nt, Human
uuucaccauguuagccagga

SEQ ID NO: 1221231 - RNA, 24 nt, Human
uuucaccauguugccugggcuggu

SEQ ID NO: 1221232 - RNA, 23 nt, Human
uuucuguuuuuuagacagggucu

SEQ ID NO: 1221233 - RNA, 24 nt, Human
uuuguagagaugggguuucaccau

SEQ ID NO: 1221234 - RNA, 24 nt, Human
uuuuuaguagagaugggguuucac

SEQ ID NO: 1221235 - RNA, 21 nt, Human
uuuuuguauuuuuaguagaga

SEQ ID NO: 1221236 - RNA, 22 nt, Human
uuuuuuguagagaugggguuuc

SEQ ID NO: 1221237 - RNA, 24 nt, Human
uuuuuuguagagaugggguuucac

SEQ ID NO: 1221238 - RNA, 21 nt, Human
uuuuuuguauuuuuaguagag

SEQ ID NO: 1221239 - RNA, 24 nt, Human
uuuuuuguauuuuuaguagagaug

SEQ ID NO: 1221240 - RNA, 24 nt, Human
uuuuuuuuguauuuuuaguagaga

SEQ ID NO: 1221241 - RNA, 22 nt, Human
cccccgagacacagagcccccg

SEQ ID NO: 1221242 - RNA, 19 nt, Human
ccugggagcccccgagaca

SEQ ID NO: 1221243 - RNA, 25 nt, Human
cgagacacagagcccccggggcuga

SEQ ID NO: 1221244 - RNA, 22 nt, Human
cugaccagguccaggggguagg

SEQ ID NO: 1221245 - RNA, 23 nt, Human
gaccugggagcccccgagacaca

SEQ ID NO: 1221246 - RNA, 23 nt, Human
aaacaacccuugcucugcucuga

SEQ ID NO: 1221247 - RNA, 19 nt, Human
aaccccgccccacccgcgc

SEQ ID NO: 1221248 - RNA, 26 nt, Human
agcccacguauaaugucuuuccuccu

SEQ ID NO: 1221249 - RNA, 22 nt, Human
agccggggguggcagaagccug

SEQ ID NO: 1221250 - RNA, 19 nt, Human
agggaggcacugcuacuac

SEQ ID NO: 1221251 - RNA, 22 nt, Human
caccugcgcaaagccggccaac

SEQ ID NO: 1221252 - RNA, 19 nt, Human
cauagcgaguacugugcac

SEQ ID NO: 1221253 - RNA, 20 nt, Human
ccacguauaaugucuuuccu

SEQ ID NO: 1221254 - RNA, 21 nt, Human
cccaaacaacccuugcucugc

SEQ ID NO: 1221255 - RNA, 26 nt, Human
cccaggucaccccuaagguucaagag

SEQ ID NO: 1221256 - RNA, 21 nt, Human
ccccacccgcgcucgccgccu

SEQ ID NO: 1221257 - RNA, 21 nt, Human
ccccgccccacccgcgcucgc

SEQ ID NO: 1221258 - RNA, 24 nt, Human
ccccuaagguucaagagaucccua

SEQ ID NO: 1221259 - RNA, 18 nt, Human
ccgccuaaccccgccccc

SEQ ID NO: 1221260 - RNA, 18 nt, Human
ccgcgcucgccgccugcc

SEQ ID NO: 1221261 - RNA, 20 nt, Human
ccuccacagugccacagucc

SEQ ID NO: 1221262 - RNA, 24 nt, Human
ccuccaucuucuaucuuuuguccc

SEQ ID NO: 1221263 - RNA, 18 nt, Human
ccugccuacuaggcgccc

SEQ ID NO: 1221264 - RNA, 24 nt, Human
cgccccuccacagugccacagucc

SEQ ID NO: 1221265 - RNA, 22 nt, Human
cgccuaaccccgccccacccgc

SEQ ID NO: 1221266 - RNA, 18 nt, Human
cggagcgccgccuaaccc

SEQ ID NO: 1221267 - RNA, 21 nt, Human
cuaaccccgccccacccgcgc

SEQ ID NO: 1221268 - RNA, 23 nt, Human
cucgucacguaccggggagagag

SEQ ID NO: 1221269 - RNA, 19 nt, Human
gcccacguauaaugucuuu

SEQ ID NO: 1221270 - RNA, 24 nt, Human
gccccacccgcgcucgccgccugc

SEQ ID NO: 1221271 - RNA, 20 nt, Human
gccuacuaggcgccccucca

SEQ ID NO: 1221272 - RNA, 24 nt, Human
gcgcaaagccggccaaccguuggg

SEQ ID NO: 1221273 - RNA, 18 nt, Human
ggagucucgucacguacc

SEQ ID NO: 1221274 - RNA, 21 nt, Human
gggugguagaacccaggcccu

SEQ ID NO: 1221275 - RNA, 23 nt, Human
ggucagcggcugcacuuugguuc

SEQ ID NO: 1221276 - RNA, 25 nt, Human
gugacgaaugggccauagcgaguac

SEQ ID NO: 1221277 - RNA, 22 nt, Human
uacccaggcgugggcggugggg

SEQ ID NO: 1221278 - RNA, 21 nt, Human
uacugugcaccugcgcaaagc

SEQ ID NO: 1221279 - RNA, 18 nt, Human
uagaaugagcaccaugag

SEQ ID NO: 1221280 - RNA, 19 nt, Human
uauaaugucuuuccuccuc

SEQ ID NO: 1221281 - RNA, 23 nt, Human
ucccgcccucgucacgugacgaa

SEQ ID NO: 1221282 - RNA, 18 nt, Human
ucccuaggaguggggugg

SEQ ID NO: 1221283 - RNA, 24 nt, Human
ucccucgacauugucugucuugau

SEQ ID NO: 1221284 - RNA, 23 nt, Human
ucucgcggagcgccgccuaaccc

SEQ ID NO: 1221285 - RNA, 21 nt, Human
ugagggcagggauuuucucag

SEQ ID NO: 1221286 - RNA, 24 nt, Human
ugagggcagggauuuucucagcug

SEQ ID NO: 1221287 - RNA, 21 nt, Human
ugauuugcaaagaucugagcc

SEQ ID NO: 1221288 - RNA, 18 nt, Human
ugggcgguggggcugggc

SEQ ID NO: 1221289 - RNA, 21 nt, Human
ugggggcugaugagagacuug

SEQ ID NO: 1221290 - RNA, 21 nt, Human
uugccgggucagcggcugcac

SEQ ID NO: 1221291 - RNA, 24 nt, Human
aaccugucccccacccccaacccc

SEQ ID NO: 1221292 - RNA, 28 nt, Human
aaccugucccccacccccaaccccucca

SEQ ID NO: 1221293 - RNA, 21 nt, Human
accugucccccacccccaacc

SEQ ID NO: 1221294 - RNA, 24 nt, Human
cacaaaucccaguacaaccccccc

SEQ ID NO: 1221295 - RNA, 23 nt, Human
cacaaaucccaguacaacccccu

SEQ ID NO: 1221296 - RNA, 21 nt, Human
cagggauuucagaaaccuguc

SEQ ID NO: 1221297 - RNA, 19 nt, Human
ccaguacaacccccuucag

SEQ ID NO: 1221298 - RNA, 23 nt, Human
cccaguacaacccccuucaggga

SEQ ID NO: 1221299 - RNA, 24 nt, Human
ccccacccccaaccccuccagguc

SEQ ID NO: 1221300 - RNA, 20 nt, Human
cccccacccccaaccccucc

SEQ ID NO: 1221301 - RNA, 22 nt, Human
cccccacccccaaccccuccag

SEQ ID NO: 1221302 - RNA, 23 nt, Human
gcguguugaccgaggccccagag

SEQ ID NO: 1221303 - RNA, 21 nt, Human
ucacaaaucccaguacaaccc

SEQ ID NO: 1221304 - RNA, 20 nt, Human
ugucccccacccccaacccc

SEQ ID NO: 1221305 - RNA, 23 nt, Human
uucaaugaccuucucaauggggu

SEQ ID NO: 1221306 - RNA, 23 nt, Human
uucagaaaccugucccccacccc

SEQ ID NO: 1221307 - RNA, 22 nt, Human
aacagacgggcuccggaaagga

SEQ ID NO: 1221308 - RNA, 21 nt, Human
cuugaguucuccggaagcggg

SEQ ID NO: 1221309 - RNA, 21 nt, Human
gaggcggggucucccuucggg

SEQ ID NO: 1221310 - RNA, 18 nt, Human
ggggaacagacgggcucc

SEQ ID NO: 1221311 - RNA, 24 nt, Human
uccuucgggcacaaucgggagcuu

SEQ ID NO: 1221312 - RNA, 18 nt, Human
accuuaccuccugagguc

SEQ ID NO: 1221313 - RNA, 20 nt, Human
ccuccugaggucaggacagg

SEQ ID NO: 1221314 - RNA, 24 nt, Human
ccugaggucaggacagggcugggc

SEQ ID NO: 1221315 - RNA, 21 nt, Human
cuuggaacuguccaucggacu

SEQ ID NO: 1221316 - RNA, 25 nt, Human
gggcugggcugagcugagagggugg

SEQ ID NO: 1221317 - RNA, 27 nt, Human
guccaucggacuguuuuucggggucca

SEQ ID NO: 1221318 - RNA, 23 nt, Human
uccacggucagaaugaaccuguc

SEQ ID NO: 1221319 - RNA, 18 nt, Human
uccaggagacagaauagc

SEQ ID NO: 1221320 - RNA, 20 nt, Human
ugaggucaggacagggcugg

SEQ ID NO: 1221321 - RNA, 23 nt, Human
aaaaacuuacucuguuuucuaag

SEQ ID NO: 1221322 - RNA, 18 nt, Human
aaaggcuuugugacauga

SEQ ID NO: 1221323 - RNA, 19 nt, Human
aagaaauacucuucaccau

SEQ ID NO: 1221324 - RNA, 22 nt, Human
aauucuccaaaaaaucaccucc

SEQ ID NO: 1221325 - RNA, 18 nt, Human
acagacuuaacaugucaa

SEQ ID NO: 1221326 - RNA, 24 nt, Human
acuacauuacauaaaagcacaacu

SEQ ID NO: 1221327 - RNA, 18 nt, Human
agaaucccucauuuaccc

SEQ ID NO: 1221328 - RNA, 23 nt, Human
agaucaccagaggucgggaguuc

SEQ ID NO: 1221329 - RNA, 24 nt, Human
agcacuuugggaggccgaggcggg

SEQ ID NO: 1221330 - RNA, 25 nt, Human
aggccgaggcgggcagaucaccaga

SEQ ID NO: 1221331 - RNA, 19 nt, Human
aggcgggcagaucaccaga

SEQ ID NO: 1221332 - RNA, 22 nt, Human
aggcgggcagaucaccagaggu

SEQ ID NO: 1221333 - RNA, 26 nt, Human
aggcgggcagaucaccagaggucggg

SEQ ID NO: 1221334 - RNA, 22 nt, Human
aggcugggcacgguggcucacg

SEQ ID NO: 1221335 - RNA, 21 nt, Human
aguggcauaauaacacuucau

SEQ ID NO: 1221336 - RNA, 21 nt, Human
auauuuugccacauucuucau

SEQ ID NO: 1221337 - RNA, 19 nt, Human
augaagagcaugaaguaac

SEQ ID NO: 1221338 - RNA, 21 nt, Human
caaaagaaauacucuucacca

SEQ ID NO: 1221339 - RNA, 22 nt, Human
caacagacuuaacaugucaaaa

SEQ ID NO: 1221340 - RNA, 23 nt, Human
caacagacuuaacaugucaaaaa

SEQ ID NO: 1221341 - RNA, 18 nt, Human
caacauucuucacguuug

SEQ ID NO: 1221342 - RNA, 19 nt, Human
cacaacuaauauaauacau

SEQ ID NO: 1221343 - RNA, 24 nt, Human
cacgccuuuaaucccagcacuuug

SEQ ID NO: 1221344 - RNA, 20 nt, Human
cacuauguacccauaaaagu

SEQ ID NO: 1221345 - RNA, 19 nt, Human
cagagucuguaauuuuuuu

SEQ ID NO: 1221346 - RNA, 24 nt, Human
cagcacuuugggaggccgaggcgg

SEQ ID NO: 1221347 - RNA, 22 nt, Human
cauguaaauaaaguaggaauga

SEQ ID NO: 1221348 - RNA, 18 nt, Human
ccaaaaaaucaccuccuc

SEQ ID NO: 1221349 - RNA, 23 nt, Human
cgccuuuaaucccagcacuuugg

SEQ ID NO: 1221350 - RNA, 24 nt, Human
cgccuuuaaucccagcacuuuggg

SEQ ID NO: 1221351 - RNA, 22 nt, Human
cucacgccuuuaaucccagcac

SEQ ID NO: 1221352 - RNA, 24 nt, Human
cucacgccuuuaaucccagcacuu

SEQ ID NO: 1221353 - RNA, 25 nt, Human
gagcagauauuaauggcuuuuccac

SEQ ID NO: 1221354 - RNA, 20 nt, Human
gaggacguuaaaagcuuugc

SEQ ID NO: 1221355 - RNA, 20 nt, Human
gaggcgggcagaucaccaga

SEQ ID NO: 1221356 - RNA, 24 nt, Human
gaucaccagaggucgggaguucga

SEQ ID NO: 1221357 - RNA, 26 nt, Human
gaucaccagaggucgggaguucgaga

SEQ ID NO: 1221358 - RNA, 20 nt, Human
ggaauaaauguugaagguga

SEQ ID NO: 1221359 - RNA, 25 nt, Human
ggcagaucaccagaggucgggaguu

SEQ ID NO: 1221360 - RNA, 24 nt, Human
gggcacgguggcucacgccuuuaa

SEQ ID NO: 1221361 - RNA, 24 nt, Human
gguggcucacgccuuuaaucccag

SEQ ID NO: 1221362 - RNA, 23 nt, Human
guggcucacgccuuuaaucccag

SEQ ID NO: 1221363 - RNA, 23 nt, Human
uaaaaaagaaucuuucauaucuc

SEQ ID NO: 1221364 - RNA, 21 nt, Human
uaaaagcuuugcaacauucuu

SEQ ID NO: 1221365 - RNA, 22 nt, Human
uaaagccacugaaaaaaagaga

SEQ ID NO: 1221366 - RNA, 24 nt, Human
uaacacuucauugaauguacaaca

SEQ ID NO: 1221367 - RNA, 22 nt, Human
uaacaugucaaaaaauguuuaa

SEQ ID NO: 1221368 - RNA, 23 nt, Human
uaaccuacgagaacaauauucuu

SEQ ID NO: 1221369 - RNA, 24 nt, Human
uacauaaaagcacaacuaauauaa

SEQ ID NO: 1221370 - RNA, 21 nt, Human
uacccauaaaaguuaagaaaa

SEQ ID NO: 1221371 - RNA, 21 nt, Human
uacugcaucuacaaaaaaaac

SEQ ID NO: 1221372 - RNA, 23 nt, Human
uauaaacucugugauguuaagau

SEQ ID NO: 1221373 - RNA, 23 nt, Human
uauaugcaaauaacuuaucuaaa

SEQ ID NO: 1221374 - RNA, 19 nt, Human
uaucaaaauaugcuauaua

SEQ ID NO: 1221375 - RNA, 18 nt, Human
ucaaggcaaaaaaaaaaa

SEQ ID NO: 1221376 - RNA, 21 nt, Human
ucaaggcaaaaaaaaaaagaa

SEQ ID NO: 1221377 - RNA, 20 nt, Human
ucaccagaggucgggaguuc

SEQ ID NO: 1221378 - RNA, 20 nt, Human
ucacuauaaugcacaaaaau

SEQ ID NO: 1221379 - RNA, 25 nt, Human
ucagaacaccuaccucauacaucac

SEQ ID NO: 1221380 - RNA, 18 nt, Human
ucagagucuguaauuuuu

SEQ ID NO: 1221381 - RNA, 23 nt, Human
ucucacuauaaugcacaaaaaua

SEQ ID NO: 1221382 - RNA, 22 nt, Human
ucucuaggauaaauuagcuuau

SEQ ID NO: 1221383 - RNA, 21 nt, Human
ugacaaccauuuaaaggcuuu

SEQ ID NO: 1221384 - RNA, 19 nt, Human
ugauacaaauauaguacua

SEQ ID NO: 1221385 - RNA, 26 nt, Human
ugcacaaaaauauauuccucagaaca

SEQ ID NO: 1221386 - RNA, 21 nt, Human
ugccagugccuuaucauuucu

SEQ ID NO: 1221387 - RNA, 21 nt, Human
uggcucacgccuuuaauccca

SEQ ID NO: 1221388 - RNA, 22 nt, Human
uggcucacgccuuuaaucccag

SEQ ID NO: 1221389 - RNA, 24 nt, Human
uggcucacgccuuuaaucccagca

SEQ ID NO: 1221390 - RNA, 20 nt, Human
ugggaggccgaggcgggcag

SEQ ID NO: 1221391 - RNA, 24 nt, Human
ugggaggccgaggcgggcagauca

SEQ ID NO: 1221392 - RNA, 22 nt, Human
ugguaucaaaauaugcuauaua

SEQ ID NO: 1221393 - RNA, 18 nt, Human
uguagggcuaguuuccau

SEQ ID NO: 1221394 - RNA, 21 nt, Human
uguagggcuaguuuccauuau

SEQ ID NO: 1221395 - RNA, 20 nt, Human
uguaggguuucucuucagua

SEQ ID NO: 1221396 - RNA, 22 nt, Human
uguagucugaagugccagugcc

SEQ ID NO: 1221397 - RNA, 18 nt, Human
ugucaaggcaaaaaaaaa

SEQ ID NO: 1221398 - RNA, 23 nt, Human
ugucaaggcaaaaaaaaaaagaa

SEQ ID NO: 1221399 - RNA, 23 nt, Human
ugugauacaaauauaguacuaca

SEQ ID NO: 1221400 - RNA, 21 nt, Human
uuaauggcuuuuccacauucu

SEQ ID NO: 1221401 - RNA, 20 nt, Human
uuacauaaaagcacaacuaa

SEQ ID NO: 1221402 - RNA, 24 nt, Human
uucacauguaaauaaaguaggaau

SEQ ID NO: 1221403 - RNA, 25 nt, Human
uugggaggccgaggcgggcagauca

SEQ ID NO: 1221404 - RNA, 21 nt, Human
aaaaacagaauggacugugca

SEQ ID NO: 1221405 - RNA, 19 nt, Human
aaaaauuauggaaaagcag

SEQ ID NO: 1221406 - RNA, 22 nt, Human
acaaaaaaaaauucaacagaaa

SEQ ID NO: 1221407 - RNA, 20 nt, Human
agaccuggagcucugacugc

SEQ ID NO: 1221408 - RNA, 23 nt, Human
aggagaaguaagaaccagaccug

SEQ ID NO: 1221409 - RNA, 23 nt, Human
auaguaauaaaaacagaauggac

SEQ ID NO: 1221410 - RNA, 22 nt, Human
augaacaaaaaaaaauucaaca

SEQ ID NO: 1221411 - RNA, 24 nt, Human
caacagaaacuauuacucucagac

SEQ ID NO: 1221412 - RNA, 21 nt, Human
ccaauaccugcaggacacggg

SEQ ID NO: 1221413 - RNA, 18 nt, Human
ccuuuaggagaaguaaga

SEQ ID NO: 1221414 - RNA, 21 nt, Human
cuggagcucugacugcagcga

SEQ ID NO: 1221415 - RNA, 18 nt, Human
ggagaaguaagaaccaga

SEQ ID NO: 1221416 - RNA, 19 nt, Human
uaggagaaguaagaaccag

SEQ ID NO: 1221417 - RNA, 27 nt, Human
ucccggugucuuagcuguggaucuccc

SEQ ID NO: 1221418 - RNA, 19 nt, Human
ugcaaagagaacuuugaga

SEQ ID NO: 1221419 - RNA, 23 nt, Human
ugcagaaaaaugaacaaaaaaaa

SEQ ID NO: 1221420 - RNA, 20 nt, Human
uggcuuccaggaggucccuc

SEQ ID NO: 1221421 - RNA, 30 nt, Human
ugugcagaaaaaugaacaaaaaaaaauucc

SEQ ID NO: 1221422 - RNA, 18 nt, Human
uuuuuuuuuuuuuuuucg

SEQ ID NO: 1221423 - RNA, 23 nt, Human
uuuuuuuuuuuuuuuuucgaacu

SEQ ID NO: 1221424 - RNA, 18 nt, Human
acccgccucucccuuccc

SEQ ID NO: 1221425 - RNA, 22 nt, Human
acccugcccacccgccucuccc

SEQ ID NO: 1221426 - RNA, 21 nt, Human
acucacccugcccacccgccu

SEQ ID NO: 1221427 - RNA, 20 nt, Human
aggggucucugagggaggac

SEQ ID NO: 1221428 - RNA, 23 nt, Human
aggggucucugagggaggacuuu

SEQ ID NO: 1221429 - RNA, 22 nt, Human
cccgccccgaugcguuugggag

SEQ ID NO: 1221430 - RNA, 23 nt, Human
cccugcccacccgccucucccuu

SEQ ID NO: 1221431 - RNA, 21 nt, Human
ccucgaggggucucugaggga

SEQ ID NO: 1221432 - RNA, 23 nt, Human
ccugcccacccgccucucccuuc

SEQ ID NO: 1221433 - RNA, 19 nt, Human
cucaagcgccuuuugucug

SEQ ID NO: 1221434 - RNA, 19 nt, Human
uccacguugaaguuggagc

SEQ ID NO: 1221435 - RNA, 19 nt, Human
ucucugagggaggacuuug

SEQ ID NO: 1221436 - RNA, 18 nt, Human
acagacccugcccugggg

SEQ ID NO: 1221437 - RNA, 18 nt, Human
agggggccccgggggggc

SEQ ID NO: 1221438 - RNA, 21 nt, Human
cagacccugcccuggggccca

SEQ ID NO: 1221439 - RNA, 26 nt, Human
cagacccugcccuggggcccacacac

SEQ ID NO: 1221440 - RNA, 24 nt, Human
cagcgggccggccagagggggccc

SEQ ID NO: 1221441 - RNA, 18 nt, Human
ccacacacuccugccagg

SEQ ID NO: 1221442 - RNA, 22 nt, Human
ccccgggggggcgggaacuggg

SEQ ID NO: 1221443 - RNA, 27 nt, Human
ccggagccacagcuggcggggucuccg

SEQ ID NO: 1221444 - RNA, 21 nt, Human
ccgggggggcgggaacuggga

SEQ ID NO: 1221445 - RNA, 23 nt, Human
gaagggugagacggagccggaag

SEQ ID NO: 1221446 - RNA, 22 nt, Human
ggagggaagggugagacggagc

SEQ ID NO: 1221447 - RNA, 24 nt, Human
ggccagagggggccccgggggggc

SEQ ID NO: 1221448 - RNA, 19 nt, Human
uacagacccugcccugggg

SEQ ID NO: 1221449 - RNA, 19 nt, Human
ucuccgccgccagcccugc

SEQ ID NO: 1221450 - RNA, 18 nt, Human
ugcaaggaugugaacaag

SEQ ID NO: 1221451 - RNA, 22 nt, Human
ugcuacagacccugcccugggg

SEQ ID NO: 1221452 - RNA, 21 nt, Human
uggggcccacacacuccugcc

SEQ ID NO: 1221453 - RNA, 20 nt, Human
aaaaaaaaaaaaacuacaaa

SEQ ID NO: 1221454 - RNA, 18 nt, Human
aaaauuagcugggcgugg

SEQ ID NO: 1221455 - RNA, 22 nt, Human
aaacaaacccaaaaggcucaca

SEQ ID NO: 1221456 - RNA, 22 nt, Human
aaacccaaaaggcucacagcaa

SEQ ID NO: 1221457 - RNA, 24 nt, Human
aaagugcugggaugacaggcguga

SEQ ID NO: 1221458 - RNA, 19 nt, Human
aaagugcugggauuacagg

SEQ ID NO: 1221459 - RNA, 19 nt, Human
aaagugcugggauuacagg

SEQ ID NO: 1221460 - RNA, 23 nt, Human
aaagugcugggauuacaggugug

SEQ ID NO: 1221461 - RNA, 24 nt, Human
aacacuccugaaaaguagaaaaaa

SEQ ID NO: 1221462 - RNA, 20 nt, Human
aacauggugaaaccaccguc

SEQ ID NO: 1221463 - RNA, 21 nt, Human
aacauggugaaaccaccgucu

SEQ ID NO: 1221464 - RNA, 22 nt, Human
aacauggugaaaccaccgucuc

SEQ ID NO: 1221465 - RNA, 19 nt, Human
aacauggugaaaccccauc

SEQ ID NO: 1221466 - RNA, 20 nt, Human
aacauggugaaaccccaucu

SEQ ID NO: 1221467 - RNA, 20 nt, Human
aacauggugaaaccccaucu

SEQ ID NO: 1221468 - RNA, 21 nt, Human
aacauggugaaaccccaucuc

SEQ ID NO: 1221469 - RNA, 23 nt, Human
aaccaggcaugguggcgggugcc

SEQ ID NO: 1221470 - RNA, 24 nt, Human
aagcaauccaccugucucagccuc

SEQ ID NO: 1221471 - RNA, 18 nt, Human
aagccccuccuucccgcu

SEQ ID NO: 1221472 - RNA, 19 nt, Human
aagcggagaaaaaaacccc

SEQ ID NO: 1221473 - RNA, 21 nt, Human
aagcggagaaaaaaaccccaa

SEQ ID NO: 1221474 - RNA, 23 nt, Human
aagcggagaaaaaaaccccaaaa

SEQ ID NO: 1221475 - RNA, 20 nt, Human
aaggacaggaguucgagacc

SEQ ID NO: 1221476 - RNA, 24 nt, Human
aagugaucugcccgccucagccuc

SEQ ID NO: 1221477 - RNA, 18 nt, Human
aagugcugggauuacagg

SEQ ID NO: 1221478 - RNA, 19 nt, Human
aagugcugggauuacaggu

SEQ ID NO: 1221479 - RNA, 24 nt, Human
aaucgcuugaacccgggaggcgga

SEQ ID NO: 1221480 - RNA, 23 nt, Human
acacgggaaucccuguggaaccc

SEQ ID NO: 1221481 - RNA, 24 nt, Human
acagagcaagacucagucucaaaa

SEQ ID NO: 1221482 - RNA, 22 nt, Human
acagcaagcggagaaaaaaacc

SEQ ID NO: 1221483 - RNA, 20 nt, Human
acauggugaaaccaccgucu

SEQ ID NO: 1221484 - RNA, 25 nt, Human
accaacauggugaaaccaccgucuc

SEQ ID NO: 1221485 - RNA, 25 nt, Human
accacauugcccaagcuggccucaa

SEQ ID NO: 1221486 - RNA, 23 nt, Human
accaggcaugguggcgggugccu

SEQ ID NO: 1221487 - RNA, 19 nt, Human
acccaggcuggagugcagu

SEQ ID NO: 1221488 - RNA, 23 nt, Human
acccaggcuggagugcaguggug

SEQ ID NO: 1221489 - RNA, 24 nt, Human
accccaucucuacuaaaaacacaa

SEQ ID NO: 1221490 - RNA, 20 nt, Human
accggucuccgcaacuuggu

SEQ ID NO: 1221491 - RNA, 24 nt, Human
acgugugguggcucacaccuguaa

SEQ ID NO: 1221492 - RNA, 24 nt, Human
acuauguucgccaggcuggucuug

SEQ ID NO: 1221493 - RNA, 19 nt, Human
acucccaucacccaggcug

SEQ ID NO: 1221494 - RNA, 23 nt, Human
acucccaucacccaggcuggagu

SEQ ID NO: 1221495 - RNA, 24 nt, Human
acugcacuccagcccgggugacag

SEQ ID NO: 1221496 - RNA, 26 nt, Human
acugcacuccagcccgggugacagag

SEQ ID NO: 1221497 - RNA, 18 nt, Human
agaaacaagauagaugug

SEQ ID NO: 1221498 - RNA, 18 nt, Human
agaaggcggugggcagag

SEQ ID NO: 1221499 - RNA, 19 nt, Human
agaggagggccccucuaga

SEQ ID NO: 1221500 - RNA, 19 nt, Human
agaucacuuaaggacagga

SEQ ID NO: 1221501 - RNA, 23 nt, Human
agaucacuuaaggacaggaguuc

SEQ ID NO: 1221502 - RNA, 24 nt, Human
agcaagcggagaaaaaaaccccaa

SEQ ID NO: 1221503 - RNA, 22 nt, Human
agcacuuugggaggcugagggg

SEQ ID NO: 1221504 - RNA, 24 nt, Human
agcacuuugguuggcugagguggg

SEQ ID NO: 1221505 - RNA, 21 nt, Human
agccagacauucggggccacu

SEQ ID NO: 1221506 - RNA, 19 nt, Human
agcccgggugacagagcaa

SEQ ID NO: 1221507 - RNA, 24 nt, Human
agcccgggugacagagcaagacuc

SEQ ID NO: 1221508 - RNA, 22 nt, Human
agccuggccaacauggugaaac

SEQ ID NO: 1221509 - RNA, 24 nt, Human
agccuggccaacauggugaaaccc

SEQ ID NO: 1221510 - RNA, 23 nt, Human
agccugggcagcauagcgagacc

SEQ ID NO: 1221511 - RNA, 23 nt, Human
agccugggcagcauagcgagacc

SEQ ID NO: 1221512 - RNA, 24 nt, Human
agccugggcagcauagcgagaccu

SEQ ID NO: 1221513 - RNA, 25 nt, Human
agcuggccucaaaacuccuuggcuc

SEQ ID NO: 1221514 - RNA, 20 nt, Human
agcugggcgugguggcgggu

SEQ ID NO: 1221515 - RNA, 22 nt, Human
aggaaacaaacccaaaaggcuc

SEQ ID NO: 1221516 - RNA, 25 nt, Human
aggaaacaaacccaaaaggcucaca

SEQ ID NO: 1221517 - RNA, 24 nt, Human
aggauugcuugaguccaggaguuu

SEQ ID NO: 1221518 - RNA, 22 nt, Human
aggauuuggaggcuggacauag

SEQ ID NO: 1221519 - RNA, 24 nt, Human
aggcaggagaaucgcuugaacccg

SEQ ID NO: 1221520 - RNA, 23 nt, Human
aggcaggaggauugcuugagucc

SEQ ID NO: 1221521 - RNA, 24 nt, Human
aggccaaggcaggaggauugcuug

SEQ ID NO: 1221522 - RNA, 21 nt, Human
aggcggagguugcagugagcc

SEQ ID NO: 1221523 - RNA, 24 nt, Human
aggcggagguugcagugagccgag

SEQ ID NO: 1221524 - RNA, 20 nt, Human
aggcugaggcaggagaaucg

SEQ ID NO: 1221525 - RNA, 24 nt, Human
aggcugaggcaggagaaucgcuug

SEQ ID NO: 1221526 - RNA, 21 nt, Human
aggcugaggggggcagaucac

SEQ ID NO: 1221527 - RNA, 21 nt, Human
agggccugauaucagucaggc

SEQ ID NO: 1221528 - RNA, 21 nt, Human
aggggcucggauggagaggag

SEQ ID NO: 1221529 - RNA, 22 nt, Human
aggggggcagaucacuuaaggg

SEQ ID NO: 1221530 - RNA, 22 nt, Human
aggucucacuauguucgccagg

SEQ ID NO: 1221531 - RNA, 24 nt, Human
aggugggcggaucaugaggucagg

SEQ ID NO: 1221532 - RNA, 24 nt, Human
agugcaguggugcaaucaccacuc

SEQ ID NO: 1221533 - RNA, 24 nt, Human
aguggaucacuccuauaauccuag

SEQ ID NO: 1221534 - RNA, 21 nt, Human
aucaugaggucaggaguucaa

SEQ ID NO: 1221535 - RNA, 22 nt, Human
aucaugaggucaggaguucaag

SEQ ID NO: 1221536 - RNA, 22 nt, Human
auccaguuagcagaugacuuug

SEQ ID NO: 1221537 - RNA, 22 nt, Human
auccuagcacuuugggaggcca

SEQ ID NO: 1221538 - RNA, 20 nt, Human
auccugccacugcacuccag

SEQ ID NO: 1221539 - RNA, 19 nt, Human
augccuguaaucccagcac

SEQ ID NO: 1221540 - RNA, 21 nt, Human
auuuuguauuuuuuguagaga

SEQ ID NO: 1221541 - RNA, 19 nt, Human
caaacccaaaaggcucaca

SEQ ID NO: 1221542 - RNA, 23 nt, Human
caaacccaaaaggcucacagcaa

SEQ ID NO: 1221543 - RNA, 24 nt, Human
caaagugcugggaugacaggcgug

SEQ ID NO: 1221544 - RNA, 24 nt, Human
caaagugcugggauuacaggugug

SEQ ID NO: 1221545 - RNA, 20 nt, Human
caacauggugaaaccaccgu

SEQ ID NO: 1221546 - RNA, 25 nt, Human
caacauggugaaaccaccgucucua

SEQ ID NO: 1221547 - RNA, 24 nt, Human
caacauggugaaaccccaucucua

SEQ ID NO: 1221548 - RNA, 21 nt, Human
caagacucagucucaaaaaaa

SEQ ID NO: 1221549 - RNA, 19 nt, Human
caagagaccgaggacauga

SEQ ID NO: 1221550 - RNA, 20 nt, Human
caaggaaaaacaccggcuac

SEQ ID NO: 1221551 - RNA, 22 nt, Human
caauaagaaaaaugcaaacacu

SEQ ID NO: 1221552 - RNA, 24 nt, Human
cacaccuguaaucccagcacuuug

SEQ ID NO: 1221553 - RNA, 22 nt, Human
cacacucuuuacccugccccuu

SEQ ID NO: 1221554 - RNA, 20 nt, Human
cacagcaagcggagaaaaaa

SEQ ID NO: 1221555 - RNA, 21 nt, Human
cacauugcccaagcuggccuc

SEQ ID NO: 1221556 - RNA, 22 nt, Human
cacauugcccaagcuggccuca

SEQ ID NO: 1221557 - RNA, 24 nt, Human
caccacauugcccaagcuggccuc

SEQ ID NO: 1221558 - RNA, 21 nt, Human
cacccaggcuggagugcagug

SEQ ID NO: 1221559 - RNA, 19 nt, Human
cacccccggaugacguccu

SEQ ID NO: 1221560 - RNA, 19 nt, Human
caccuguaaucccagcacu

SEQ ID NO: 1221561 - RNA, 24 nt, Human
caccuguaaucccagcacuuuggg

SEQ ID NO: 1221562 - RNA, 23 nt, Human
caccugucucagccucccaaagu

SEQ ID NO: 1221563 - RNA, 24 nt, Human
cacuauguucgccaggcuggucuu

SEQ ID NO: 1221564 - RNA, 22 nt, Human
cacuccagcccgggugacagag

SEQ ID NO: 1221565 - RNA, 23 nt, Human
cacuccagcccgggugacagagc

SEQ ID NO: 1221566 - RNA, 24 nt, Human
cacuccuauaauccuagcacuuug

SEQ ID NO: 1221567 - RNA, 22 nt, Human
cacucuacaaucauaaccuagg

SEQ ID NO: 1221568 - RNA, 19 nt, Human
cacugcacuccagcccggg

SEQ ID NO: 1221569 - RNA, 21 nt, Human
cacugcacuccagcccgggug

SEQ ID NO: 1221570 - RNA, 23 nt, Human
cacugcacuccagcccgggugac

SEQ ID NO: 1221571 - RNA, 24 nt, Human
cacugcacuccagcccgggugaca

SEQ ID NO: 1221572 - RNA, 25 nt, Human
cacugcacuccagcccgggugacag

SEQ ID NO: 1221573 - RNA, 21 nt, Human
cagagaccuaaccgucucccu

SEQ ID NO: 1221574 - RNA, 21 nt, Human
cagagauaggagcugaggggg

SEQ ID NO: 1221575 - RNA, 18 nt, Human
cagagccuggcugcccac

SEQ ID NO: 1221576 - RNA, 26 nt, Human
cagcaagcacccccggaugacguccu

SEQ ID NO: 1221577 - RNA, 22 nt, Human
cagcacuuugggaggcugaggg

SEQ ID NO: 1221578 - RNA, 28 nt, Human
cagcacuuugggaggcugaggggggcag

SEQ ID NO: 1221579 - RNA, 21 nt, Human
cagcacuuugguuggcugagg

SEQ ID NO: 1221580 - RNA, 24 nt, Human
cagcacuuugguuggcugaggugg

SEQ ID NO: 1221581 - RNA, 19 nt, Human
cagcgucugggaagaugcc

SEQ ID NO: 1221582 - RNA, 24 nt, Human
cagcuacucgggaggcugaggcag

SEQ ID NO: 1221583 - RNA, 18 nt, Human
cagcugcaagacagcaga

SEQ ID NO: 1221584 - RNA, 18 nt, Human
cagcugccaggcagggag

SEQ ID NO: 1221585 - RNA, 23 nt, Human
caggccgggugcgguggcucaug

SEQ ID NO: 1221586 - RNA, 20 nt, Human
cagugagccgagauccugcc

SEQ ID NO: 1221587 - RNA, 19 nt, Human
cauaaccuaggaaaaacca

SEQ ID NO: 1221588 - RNA, 21 nt, Human
cauagcgagaccuugucucua

SEQ ID NO: 1221589 - RNA, 18 nt, Human
caucugcucccuccuguu

SEQ ID NO: 1221590 - RNA, 24 nt, Human
caugccuguaaucccagcacuuug

SEQ ID NO: 1221591 - RNA, 23 nt, Human
ccaaaaggcucacagcaagcgga

SEQ ID NO: 1221592 - RNA, 22 nt, Human
ccaaagugcugggaugacaggc

SEQ ID NO: 1221593 - RNA, 24 nt, Human
ccaaagugcugggaugacaggcgu

SEQ ID NO: 1221594 - RNA, 21 nt, Human
ccaaagugcugggauuacagg

SEQ ID NO: 1221595 - RNA, 21 nt, Human
ccaaagugcugggauuacagg

SEQ ID NO: 1221596 - RNA, 24 nt, Human
ccaaagugcugggauuacaggugu

SEQ ID NO: 1221597 - RNA, 20 nt, Human
ccaagcagccguccagagug

SEQ ID NO: 1221598 - RNA, 24 nt, Human
ccaauaaauaacagcgcagccaga

SEQ ID NO: 1221599 - RNA, 21 nt, Human
ccacaguuauccagagaccua

SEQ ID NO: 1221600 - RNA, 26 nt, Human
ccaccugucucagccucccaaagugc

SEQ ID NO: 1221601 - RNA, 20 nt, Human
ccacugcacuccagcccggg

SEQ ID NO: 1221602 - RNA, 20 nt, Human
ccacugcacuccagcccggg

SEQ ID NO: 1221603 - RNA, 21 nt, Human
ccacugcacuccagcccgggu

SEQ ID NO: 1221604 - RNA, 24 nt, Human
ccacugcacuccagcccgggugac

SEQ ID NO: 1221605 - RNA, 19 nt, Human
ccagagaccuaaccgucuc

SEQ ID NO: 1221606 - RNA, 22 nt, Human
ccagagaccuaaccgucucccu

SEQ ID NO: 1221607 - RNA, 22 nt, Human
ccauccuguacaccuggcucug

SEQ ID NO: 1221608 - RNA, 21 nt, Human
cccaggcucagguaaaucucc

SEQ ID NO: 1221609 - RNA, 23 nt, Human
cccaggcucagguaaaucuccca

SEQ ID NO: 1221610 - RNA, 24 nt, Human
cccaucacccaggcuggagugcag

SEQ ID NO: 1221611 - RNA, 19 nt, Human
cccccgggcccagcugucu

SEQ ID NO: 1221612 - RNA, 27 nt, Human
cccccuguccaguggaccggguccuuc

SEQ ID NO: 1221613 - RNA, 18 nt, Human
ccccuccuucccgcucag

SEQ ID NO: 1221614 - RNA, 21 nt, Human
ccccuuuugcuuuguauccaa

SEQ ID NO: 1221615 - RNA, 25 nt, Human
cccgcucagccucaguuuccucauc

SEQ ID NO: 1221616 - RNA, 24 nt, Human
cccggggcuccucuucccuucccc

SEQ ID NO: 1221617 - RNA, 22 nt, Human
cccgggugacagagcaagacuc

SEQ ID NO: 1221618 - RNA, 23 nt, Human
cccuccuucccgcucagccucag

SEQ ID NO: 1221619 - RNA, 22 nt, Human
cccucugcaagcugaaccaaga

SEQ ID NO: 1221620 - RNA, 24 nt, Human
ccgccucagccucccaaagugcug

SEQ ID NO: 1221621 - RNA, 22 nt, Human
ccuagcccugggccugauuagc

SEQ ID NO: 1221622 - RNA, 22 nt, Human
ccugaaaucucagcuacucggg

SEQ ID NO: 1221623 - RNA, 21 nt, Human
ccugaccaacauggugaaacc

SEQ ID NO: 1221624 - RNA, 22 nt, Human
ccugaccaacauggugaaacca

SEQ ID NO: 1221625 - RNA, 22 nt, Human
ccugagcucaagugaucugccc

SEQ ID NO: 1221626 - RNA, 22 nt, Human
ccugagcucaagugaucugccc

SEQ ID NO: 1221627 - RNA, 23 nt, Human
ccuggccaacauggugaaacccc

SEQ ID NO: 1221628 - RNA, 24 nt, Human
ccuggccaacauggugaaacccca

SEQ ID NO: 1221629 - RNA, 21 nt, Human
ccugggcagcauagcgagacc

SEQ ID NO: 1221630 - RNA, 20 nt, Human
ccuguacaccuggcucugcc

SEQ ID NO: 1221631 - RNA, 24 nt, Human
cgagaccagccuggccaacauggu

SEQ ID NO: 1221632 - RNA, 27 nt, Human
cgcagccagacauucggggccacuacc

SEQ ID NO: 1221633 - RNA, 22 nt, Human
cggaucaugaggucaggaguuc

SEQ ID NO: 1221634 - RNA, 21 nt, Human
cgggaaucccuguggaaccca

SEQ ID NO: 1221635 - RNA, 24 nt, Human
cgggaggcggagguugcagugagc

SEQ ID NO: 1221636 - RNA, 20 nt, Human
cgggaggcugaggcaggaga

SEQ ID NO: 1221637 - RNA, 24 nt, Human
cguccagagugcaggauacaucau

SEQ ID NO: 1221638 - RNA, 18 nt, Human
cucaagugaucugcccgc

SEQ ID NO: 1221639 - RNA, 22 nt, Human
cucacaccuguaaucccagcac

SEQ ID NO: 1221640 - RNA, 24 nt, Human
cucacaccuguaaucccagcacuu

SEQ ID NO: 1221641 - RNA, 21 nt, Human
cucacagcaagcggagaaaaa

SEQ ID NO: 1221642 - RNA, 20 nt, Human
cucacucccaucacccaggc

SEQ ID NO: 1221643 - RNA, 24 nt, Human
cucagucucaaaaaaaaaaaaaaa

SEQ ID NO: 1221644 - RNA, 23 nt, Human
cucaugccuguaaucccagcacu

SEQ ID NO: 1221645 - RNA, 24 nt, Human
cucaugccuguaaucccagcacuu

SEQ ID NO: 1221646 - RNA, 22 nt, Human
cuccgcaacuugguaguagugg

SEQ ID NO: 1221647 - RNA, 18 nt, Human
cuccucucucucucugcc

SEQ ID NO: 1221648 - RNA, 24 nt, Human
cuccucuucccuuccccacgacca

SEQ ID NO: 1221649 - RNA, 24 nt, Human
cuccuucccgcucagccucaguuu

SEQ ID NO: 1221650 - RNA, 20 nt, Human
cuccuuggcucaagcaaucc

SEQ ID NO: 1221651 - RNA, 23 nt, Human
cugcaagcugaaccaagaacaca

SEQ ID NO: 1221652 - RNA, 23 nt, Human
cugcagccuugaguucccaggcu

SEQ ID NO: 1221653 - RNA, 23 nt, Human
cuggccaacauggugaaacccca

SEQ ID NO: 1221654 - RNA, 23 nt, Human
cugucucagccucccaaagugcu

SEQ ID NO: 1221655 - RNA, 24 nt, Human
cugucucagccucccaaagugcug

SEQ ID NO: 1221656 - RNA, 24 nt, Human
cuugcccacaguuauccagagacc

SEQ ID NO: 1221657 - RNA, 19 nt, Human
cuugugucuuuauuucuac

SEQ ID NO: 1221658 - RNA, 21 nt, Human
gaagacucugcuccuccaccu

SEQ ID NO: 1221659 - RNA, 19 nt, Human
gaauaucucauugucuugg

SEQ ID NO: 1221660 - RNA, 18 nt, Human
gacagagcaagacucagu

SEQ ID NO: 1221661 - RNA, 23 nt, Human
gagaaucgcuugaacccgggagg

SEQ ID NO: 1221662 - RNA, 21 nt, Human
gagauccugccacugcacucc

SEQ ID NO: 1221663 - RNA, 23 nt, Human
gagauccugccacugcacuccag

SEQ ID NO: 1221664 - RNA, 20 nt, Human
gagcaagacucagucucaaa

SEQ ID NO: 1221665 - RNA, 24 nt, Human
gagcucaagugaucugcccgccuc

SEQ ID NO: 1221666 - RNA, 19 nt, Human
gaggacaugagcuguucca

SEQ ID NO: 1221667 - RNA, 18 nt, Human
gagggaaauagguggaaa

SEQ ID NO: 1221668 - RNA, 22 nt, Human
gagguugcagugagccgagauc

SEQ ID NO: 1221669 - RNA, 19 nt, Human
gaucacuuaaggacaggag

SEQ ID NO: 1221670 - RNA, 24 nt, Human
gaucacuuaaggacaggaguucga

SEQ ID NO: 1221671 - RNA, 24 nt, Human
gaucaugaggucaggaguucaaga

SEQ ID NO: 1221672 - RNA, 18 nt, Human
gaugacaggcgugagcca

SEQ ID NO: 1221673 - RNA, 22 nt, Human
gauugcuugaguccaggaguuu

SEQ ID NO: 1221674 - RNA, 24 nt, Human
gauugcuugaguccaggaguuuga

SEQ ID NO: 1221675 - RNA, 25 nt, Human
gauuuuguuuuuugagacagggucu

SEQ ID NO: 1221676 - RNA, 18 nt, Human
gcaauccaccugucucag

SEQ ID NO: 1221677 - RNA, 24 nt, Human
gcaauccaccugucucagccuccc

SEQ ID NO: 1221678 - RNA, 24 nt, Human
gcacuccagcccgggugacagagc

SEQ ID NO: 1221679 - RNA, 23 nt, Human
gcagcauagcgagaccuugucuc

SEQ ID NO: 1221680 - RNA, 24 nt, Human
gcagggguuacaaaagccuaaaga

SEQ ID NO: 1221681 - RNA, 24 nt, Human
gccaacauggugaaaccccaucuc

SEQ ID NO: 1221682 - RNA, 22 nt, Human
gccaggcuggucuugaacuccu

SEQ ID NO: 1221683 - RNA, 23 nt, Human
gccucagccucccaaagugcugg

SEQ ID NO: 1221684 - RNA, 24 nt, Human
gcucaagcaauccaccugucucag

SEQ ID NO: 1221685 - RNA, 22 nt, Human
gcuggccucaaaacuccuuggc

SEQ ID NO: 1221686 - RNA, 21 nt, Human
ggaaaaaccaggccauacaga

SEQ ID NO: 1221687 - RNA, 18 nt, Human
ggagguugcagugagccg

SEQ ID NO: 1221688 - RNA, 20 nt, Human
ggagguugcagugagccgag

SEQ ID NO: 1221689 - RNA, 22 nt, Human
ggagguugcagugagccgagau

SEQ ID NO: 1221690 - RNA, 23 nt, Human
ggagguugcagugagccgagauc

SEQ ID NO: 1221691 - RNA, 21 nt, Human
ggaucaugaggucaggaguuc

SEQ ID NO: 1221692 - RNA, 22 nt, Human
ggauugcuugaguccaggaguu

SEQ ID NO: 1221693 - RNA, 22 nt, Human
ggauuuggaggcuggacauagu

SEQ ID NO: 1221694 - RNA, 18 nt, Human
ggcaaggacaucccccuc

SEQ ID NO: 1221695 - RNA, 23 nt, Human
ggccgggugcgguggcucaugcc

SEQ ID NO: 1221696 - RNA, 19 nt, Human
ggcggggcuugggccuuag

SEQ ID NO: 1221697 - RNA, 23 nt, Human
ggcucaagcaauccaccugucuc

SEQ ID NO: 1221698 - RNA, 24 nt, Human
ggcuggucuugaacuccugagcuc

SEQ ID NO: 1221699 - RNA, 20 nt, Human
gggcauagugagguaugacc

SEQ ID NO: 1221700 - RNA, 24 nt, Human
gggcggaucaugaggucaggaguu

SEQ ID NO: 1221701 - RNA, 24 nt, Human
gggugcgguggcucaugccuguaa

SEQ ID NO: 1221702 - RNA, 19 nt, Human
ggucagagccuggcugccc

SEQ ID NO: 1221703 - RNA, 24 nt, Human
gguggcucacaccuguaaucccag

SEQ ID NO: 1221704 - RNA, 23 nt, Human
gguggcucaugccuguaauccca

SEQ ID NO: 1221705 - RNA, 24 nt, Human
gguggcucaugccuguaaucccag

SEQ ID NO: 1221706 - RNA, 23 nt, Human
ggugggcggaucaugaggucagg

SEQ ID NO: 1221707 - RNA, 24 nt, Human
guaaucccagcacuuugguuggcu

SEQ ID NO: 1221708 - RNA, 22 nt, Human
guacaguuuucugaaguugcag

SEQ ID NO: 1221709 - RNA, 24 nt, Human
guagcaguuacucuuuauuccaau

SEQ ID NO: 1221710 - RNA, 18 nt, Human
gucuccucucucucucug

SEQ ID NO: 1221711 - RNA, 24 nt, Human
gugaucugcccgccucagccuccc

SEQ ID NO: 1221712 - RNA, 23 nt, Human
guggcucaugccuguaaucccag

SEQ ID NO: 1221713 - RNA, 18 nt, Human
gugugguggcucacaccu

SEQ ID NO: 1221714 - RNA, 24 nt, Human
guugcagugagccgagauccugcc

SEQ ID NO: 1221715 - RNA, 23 nt, Human
guuuccucaucugcucccuccug

SEQ ID NO: 1221716 - RNA, 22 nt, Human
uaaaaaaaaaaaaacuacaaac

SEQ ID NO: 1221717 - RNA, 24 nt, Human
uaaaaaaaaaaaauuaggccacgu

SEQ ID NO: 1221718 - RNA, 21 nt, Human
uaaaaacacaaaaauuaacca

SEQ ID NO: 1221719 - RNA, 23 nt, Human
uaaccaggcaugguggcgggugc

SEQ ID NO: 1221720 - RNA, 23 nt, Human
uaauuuuguauuuuuuguagaga

SEQ ID NO: 1221721 - RNA, 21 nt, Human
uacagagauaggagcugaggg

SEQ ID NO: 1221722 - RNA, 21 nt, Human
uaccggucuccgcaacuuggu

SEQ ID NO: 1221723 - RNA, 22 nt, Human
uagagaugaggucucacuaugu

SEQ ID NO: 1221724 - RNA, 24 nt, Human
uagcacuuugggaggccaaggcag

SEQ ID NO: 1221725 - RNA, 25 nt, Human
uagcacuuugggaggccaaggcagg

SEQ ID NO: 1221726 - RNA, 23 nt, Human
uauaaaaugguacaguuuucuga

SEQ ID NO: 1221727 - RNA, 24 nt, Human
uauguucgccaggcuggucuugaa

SEQ ID NO: 1221728 - RNA, 18 nt, Human
ucaaggaaaaacaccggc

SEQ ID NO: 1221729 - RNA, 24 nt, Human
ucacccaggcuggagugcaguggu

SEQ ID NO: 1221730 - RNA, 24 nt, Human
ucacugcagccuugaguucccagg

SEQ ID NO: 1221731 - RNA, 23 nt, Human
ucacuuaaggacaggaguucgag

SEQ ID NO: 1221732 - RNA, 24 nt, Human
ucagucucaaaaaaaaaaaaaaaa

SEQ ID NO: 1221733 - RNA, 24 nt, Human
ucaugaggucaggaguucaagacc

SEQ ID NO: 1221734 - RNA, 18 nt, Human
uccaccucuuguggaggg

SEQ ID NO: 1221735 - RNA, 24 nt, Human
ucccaaagugcugggaugacaggc

SEQ ID NO: 1221736 - RNA, 23 nt, Human
ucccaaagugcugggauuacagg

SEQ ID NO: 1221737 - RNA, 21 nt, Human
ucccaggcucagguaaaucuc

SEQ ID NO: 1221738 - RNA, 22 nt, Human
ucccucugcaagcugaaccaag

SEQ ID NO: 1221739 - RNA, 24 nt, Human
ucccucugcaagcugaaccaagaa

SEQ ID NO: 1221740 - RNA, 21 nt, Human
uccggaauguuccuggagaag

SEQ ID NO: 1221741 - RNA, 18 nt, Human
uccucuucccuuccccac

SEQ ID NO: 1221742 - RNA, 20 nt, Human
uccuuggcucaagcaaucca

SEQ ID NO: 1221743 - RNA, 24 nt, Human
ucgcuugaacccgggaggcggagg

SEQ ID NO: 1221744 - RNA, 24 nt, Human
ucgggaggcugaggcaggagaauc

SEQ ID NO: 1221745 - RNA, 22 nt, Human
ucuacaaucauaaccuaggaaa

SEQ ID NO: 1221746 - RNA, 21 nt, Human
ucuacacucucuugucucugc

SEQ ID NO: 1221747 - RNA, 24 nt, Human
ucucacuauguucgccaggcuggu

SEQ ID NO: 1221748 - RNA, 25 nt, Human
ucucacucccaucacccaggcugga

SEQ ID NO: 1221749 - RNA, 19 nt, Human
ucucccaucucagcccagc

SEQ ID NO: 1221750 - RNA, 21 nt, Human
ucucuacuaaaaacacaaaaa

SEQ ID NO: 1221751 - RNA, 21 nt, Human
ucucuacuaaaaguacaaaaa

SEQ ID NO: 1221752 - RNA, 24 nt, Human
ucugcacacagggagagacccacc

SEQ ID NO: 1221753 - RNA, 21 nt, Human
ucugcccgccucagccuccca

SEQ ID NO: 1221754 - RNA, 23 nt, Human
ucuugaacuccugagcucaagug

SEQ ID NO: 1221755 - RNA, 19 nt, Human
ucuuucucuuugucuccuc

SEQ ID NO: 1221756 - RNA, 24 nt, Human
ugaaaaguagaaaaaagcuaugaa

SEQ ID NO: 1221757 - RNA, 19 nt, Human
ugaaaccccaucucuacua

SEQ ID NO: 1221758 - RNA, 21 nt, Human
ugaaaguacuaaaagucucug

SEQ ID NO: 1221759 - RNA, 18 nt, Human
ugaccaacauggugaaac

SEQ ID NO: 1221760 - RNA, 21 nt, Human
ugacguccucauagaugcccu

SEQ ID NO: 1221761 - RNA, 25 nt, Human
ugacucacacucuuuacccugcccc

SEQ ID NO: 1221762 - RNA, 19 nt, Human
ugagauuucuguguguguc

SEQ ID NO: 1221763 - RNA, 22 nt, Human
ugagccgagauccugccacugc

SEQ ID NO: 1221764 - RNA, 18 nt, Human
ugagcucaagugaucugc

SEQ ID NO: 1221765 - RNA, 24 nt, Human
ugaggcaagagaccgaggacauga

SEQ ID NO: 1221766 - RNA, 20 nt, Human
ugaggcaggagaaucgcuug

SEQ ID NO: 1221767 - RNA, 24 nt, Human
ugaggcaggagaaucgcuugaacc

SEQ ID NO: 1221768 - RNA, 25 nt, Human
ugaggcaggagaaucgcuugaaccc

SEQ ID NO: 1221769 - RNA, 21 nt, Human
ugaggugggcggaucaugagg

SEQ ID NO: 1221770 - RNA, 24 nt, Human
ugaggugggcggaucaugagguca

SEQ ID NO: 1221771 - RNA, 23 nt, Human
ugaggugggcggaucaugagguu

SEQ ID NO: 1221772 - RNA, 21 nt, Human
ugcagcaagcacccccggaug

SEQ ID NO: 1221773 - RNA, 25 nt, Human
ugccucagcugccaggcagggaggg

SEQ ID NO: 1221774 - RNA, 23 nt, Human
ugccugaaaucucagcuacucgg

SEQ ID NO: 1221775 - RNA, 24 nt, Human
ugccugaaaucucagcuacucggg

SEQ ID NO: 1221776 - RNA, 19 nt, Human
ugccugggacaagccccuc

SEQ ID NO: 1221777 - RNA, 21 nt, Human
ugcugggauuacaggugugca

SEQ ID NO: 1221778 - RNA, 21 nt, Human
uggagggaaauagguggaaag

SEQ ID NO: 1221779 - RNA, 18 nt, Human
uggagugcaguggugcaa

SEQ ID NO: 1221780 - RNA, 19 nt, Human
uggagugcaguggugcaau

SEQ ID NO: 1221781 - RNA, 21 nt, Human
uggagugcaguggugcaauca

SEQ ID NO: 1221782 - RNA, 20 nt, Human
uggcacauccguuuuggccc

SEQ ID NO: 1221783 - RNA, 24 nt, Human
uggccaacauggugaaaccccauc

SEQ ID NO: 1221784 - RNA, 18 nt, Human
uggcucaagcaauccacc

SEQ ID NO: 1221785 - RNA, 21 nt, Human
uggcucacaccuguaauccca

SEQ ID NO: 1221786 - RNA, 22 nt, Human
uggcucacaccuguaaucccag

SEQ ID NO: 1221787 - RNA, 24 nt, Human
uggcucacaccuguaaucccagca

SEQ ID NO: 1221788 - RNA, 22 nt, Human
uggcucaugccuguaaucccag

SEQ ID NO: 1221789 - RNA, 24 nt, Human
uggcucaugccuguaaucccagca

SEQ ID NO: 1221790 - RNA, 22 nt, Human
uggcuggaucugggcaccagag

SEQ ID NO: 1221791 - RNA, 19 nt, Human
ugggaagaugccuguugcc

SEQ ID NO: 1221792 - RNA, 24 nt, Human
ugggaggcugaggggggcagauca

SEQ ID NO: 1221793 - RNA, 18 nt, Human
ugggaugacaggcgugag

SEQ ID NO: 1221794 - RNA, 19 nt, Human
ugggaugacaggcgugagc

SEQ ID NO: 1221795 - RNA, 22 nt, Human
ugggaugacaggcgugagccac

SEQ ID NO: 1221796 - RNA, 23 nt, Human
ugggaugacaggcgugagccacc

SEQ ID NO: 1221797 - RNA, 24 nt, Human
ugggaugacaggcgugagccacca

SEQ ID NO: 1221798 - RNA, 19 nt, Human
ugggauuacaggugugcac

SEQ ID NO: 1221799 - RNA, 21 nt, Human
ugggauuacaggugugcacug

SEQ ID NO: 1221800 - RNA, 22 nt, Human
ugggauuacaggugugcacuga

SEQ ID NO: 1221801 - RNA, 22 nt, Human
ugggauuacaggugugcacugc

SEQ ID NO: 1221802 - RNA, 24 nt, Human
ugggauuacaggugugcacugcca

SEQ ID NO: 1221803 - RNA, 24 nt, Human
ugggcagaguggcuggaucugggc

SEQ ID NO: 1221804 - RNA, 24 nt, Human
ugggcagcauagcgagaccuuguc

SEQ ID NO: 1221805 - RNA, 21 nt, Human
ugggccugauuagcugugggg

SEQ ID NO: 1221806 - RNA, 19 nt, Human
ugggugaagauucagcucc

SEQ ID NO: 1221807 - RNA, 19 nt, Human
ugguggcgggugccugaaa

SEQ ID NO: 1221808 - RNA, 24 nt, Human
ugguggcucacaccuguaauccca

SEQ ID NO: 1221809 - RNA, 24 nt, Human
uguagagaugaggucucacuaugu

SEQ ID NO: 1221810 - RNA, 20 nt, Human
ugucaaggaaaaacaccggc

SEQ ID NO: 1221811 - RNA, 24 nt, Human
ugucucagccucccaaagugcugg

SEQ ID NO: 1221812 - RNA, 24 nt, Human
ugugaaagucccucugcaagcugg

SEQ ID NO: 1221813 - RNA, 24 nt, Human
ugugucuuuauuucuacacucucu

SEQ ID NO: 1221814 - RNA, 24 nt, Human
uuagcagaugacuuugcuggcaag

SEQ ID NO: 1221815 - RNA, 18 nt, Human
uuagcugggcgugguggc

SEQ ID NO: 1221816 - RNA, 24 nt, Human
uuaggccacgugugguggcucaca

SEQ ID NO: 1221817 - RNA, 18 nt, Human
uuauuuauuuauuuauuu

SEQ ID NO: 1221818 - RNA, 19 nt, Human
uuauuuauuuauuuauuua

SEQ ID NO: 1221819 - RNA, 19 nt, Human
uuauuuauuuauuuauuua

SEQ ID NO: 1221820 - RNA, 19 nt, Human
uuauuuauuuauuuauuua

SEQ ID NO: 1221821 - RNA, 19 nt, Human
uuauuuauuuauuuauuua

SEQ ID NO: 1221822 - RNA, 25 nt, Human
uuauuuauuuauuuauuuauuuauu

SEQ ID NO: 1221823 - RNA, 25 nt, Human
uuauuuauuuauuuauuuauuuauu

SEQ ID NO: 1221824 - RNA, 25 nt, Human
uuauuuauuuauuuauuuauuuauu

SEQ ID NO: 1221825 - RNA, 25 nt, Human
uuauuuauuuauuuauuuauuuauu

SEQ ID NO: 1221826 - RNA, 25 nt, Human
uuauuuauuuauuuauuuauuuauu

SEQ ID NO: 1221827 - RNA, 19 nt, Human
uuauuuauuuauuuauuuu

SEQ ID NO: 1221828 - RNA, 24 nt, Human
uuauuuuauuuuuuaguagagaca

SEQ ID NO: 1221829 - RNA, 24 nt, Human
uucagcuccggaauguuccuggag

SEQ ID NO: 1221830 - RNA, 25 nt, Human
uucccaggcucagguaaaucuccca

SEQ ID NO: 1221831 - RNA, 24 nt, Human
uugaacccgggaggcggagguugc

SEQ ID NO: 1221832 - RNA, 22 nt, Human
uugcagggguuacaaaagccua

SEQ ID NO: 1221833 - RNA, 19 nt, Human
uugcagugagccgagaucc

SEQ ID NO: 1221834 - RNA, 21 nt, Human
uugcagugagccgagaucccc

SEQ ID NO: 1221835 - RNA, 21 nt, Human
uugcagugagccgagauccug

SEQ ID NO: 1221836 - RNA, 22 nt, Human
uugcagugagccgagauccugc

SEQ ID NO: 1221837 - RNA, 23 nt, Human
uugcccacaguuauccagagacc

SEQ ID NO: 1221838 - RNA, 20 nt, Human
uugcuugaguccaggaguuu

SEQ ID NO: 1221839 - RNA, 21 nt, Human
uugcuugaguccaggaguuug

SEQ ID NO: 1221840 - RNA, 25 nt, Human
uugggaggcugaggggggcagauca

SEQ ID NO: 1221841 - RNA, 23 nt, Human
uuuauuuauuuauuuauuuauuu

SEQ ID NO: 1221842 - RNA, 18 nt, Human
uuugguuggcugaggugg

SEQ ID NO: 1221843 - RNA, 19 nt, Human
uuuuauuuuuuaguagaga

SEQ ID NO: 1221844 - RNA, 20 nt, Human
uuuuguauuuuuuguagaga

SEQ ID NO: 1221845 - RNA, 18 nt, Human
uuuuuuaguagagacagg

SEQ ID NO: 1221846 - RNA, 24 nt, Human
uuuuuuaguagagacagguuucac

SEQ ID NO: 1221847 - RNA, 19 nt, Human
aaaaggcuuugaccccaaa

SEQ ID NO: 1221848 - RNA, 18 nt, Human
agacuuggagggaaagug

SEQ ID NO: 1221849 - RNA, 23 nt, Human
ccagcgacaugguccucaccgag

SEQ ID NO: 1221850 - RNA, 22 nt, Human
cccaugcagacugcaugggcca

SEQ ID NO: 1221851 - RNA, 20 nt, Human
gcggccucugagaugcucgg

SEQ ID NO: 1221852 - RNA, 22 nt, Human
gggcaggucaugugcggccucu

SEQ ID NO: 1221853 - RNA, 24 nt, Human
uacauuuguguaacuuucccaaaa

SEQ ID NO: 1221854 - RNA, 19 nt, Human
ucagucucucuguguccau

SEQ ID NO: 1221855 - RNA, 21 nt, Human
ucccaugcagacugcaugggc

SEQ ID NO: 1221856 - RNA, 22 nt, Human
uccucaccgagggccccgggca

SEQ ID NO: 1221857 - RNA, 21 nt, Human
ugaagacuuggagggaaagug

SEQ ID NO: 1221858 - RNA, 18 nt, Human
ugaaguagagaaaucauu

SEQ ID NO: 1221859 - RNA, 21 nt, Human
uguggacuuuuucaugcgucu

SEQ ID NO: 1221860 - RNA, 24 nt, Human
uguucuacauuuguguaacuuucc

SEQ ID NO: 1221861 - RNA, 23 nt, Human
uuuuucaugcgucucucagucuc

SEQ ID NO: 1221862 - RNA, 24 nt, Human
aaaaggccggaguacguguagaug

SEQ ID NO: 1221863 - RNA, 23 nt, Human
aagcugcuuguacggguugauga

SEQ ID NO: 1221864 - RNA, 26 nt, Human
accuucuccagcugcagcuucugccg

SEQ ID NO: 1221865 - RNA, 18 nt, Human
agagcugucccacugucc

SEQ ID NO: 1221866 - RNA, 23 nt, Human
agaugcggaugcccuccaggacc

SEQ ID NO: 1221867 - RNA, 22 nt, Human
agauguggaagcugcacucguc

SEQ ID NO: 1221868 - RNA, 19 nt, Human
agcugguccagcaccagcc

SEQ ID NO: 1221869 - RNA, 23 nt, Human
aggucgaggccaaagucgaggaa

SEQ ID NO: 1221870 - RNA, 21 nt, Human
auccgucacccccagucccaa

SEQ ID NO: 1221871 - RNA, 23 nt, Human
augaggucgaugcagggcugcag

SEQ ID NO: 1221872 - RNA, 19 nt, Human
caaaacugggguugguguu

SEQ ID NO: 1221873 - RNA, 19 nt, Human
caccagccguggcuccagc

SEQ ID NO: 1221874 - RNA, 19 nt, Human
caccugcagcaguggcuuc

SEQ ID NO: 1221875 - RNA, 20 nt, Human
cacgcgguagagguuggggu

SEQ ID NO: 1221876 - RNA, 19 nt, Human
cacugcguacacguggggu

SEQ ID NO: 1221877 - RNA, 21 nt, Human
cacuguccggaacauaccccg

SEQ ID NO: 1221878 - RNA, 20 nt, Human
cagcaguggcuucaccuugg

SEQ ID NO: 1221879 - RNA, 21 nt, Human
cagcucaccggggacacccgg

SEQ ID NO: 1221880 - RNA, 19 nt, Human
cagcugcagcuucugccgc

SEQ ID NO: 1221881 - RNA, 23 nt, Human
caggaccccagcccggaagaaga

SEQ ID NO: 1221882 - RNA, 18 nt, Human
caggacccgcagcgacuc

SEQ ID NO: 1221883 - RNA, 21 nt, Human
cagggccaggaguccaggggg

SEQ ID NO: 1221884 - RNA, 24 nt, Human
cagucgcagccgccucccgcucuc

SEQ ID NO: 1221885 - RNA, 26 nt, Human
cauggugugguugaagagcugcugca

SEQ ID NO: 1221886 - RNA, 20 nt, Human
cauucagaggguccauguuu

SEQ ID NO: 1221887 - RNA, 19 nt, Human
cauucuucacugucuuggc

SEQ ID NO: 1221888 - RNA, 20 nt, Human
ccaaacuggagaacugcuga

SEQ ID NO: 1221889 - RNA, 18 nt, Human
ccacacagaaaaggccgg

SEQ ID NO: 1221890 - RNA, 23 nt, Human
ccagcuucccggcccucuucucg

SEQ ID NO: 1221891 - RNA, 20 nt, Human
ccaggaccccguugcagcga

SEQ ID NO: 1221892 - RNA, 20 nt, Human
cccacuguccggaacauacc

SEQ ID NO: 1221893 - RNA, 18 nt, Human
cccccagucccaagaggc

SEQ ID NO: 1221894 - RNA, 20 nt, Human
cccgcagcgacuccagcguc

SEQ ID NO: 1221895 - RNA, 23 nt, Human
cccgcaggugccucggccgcugg

SEQ ID NO: 1221896 - RNA, 26 nt, Human
cccgcgauguccaggaugcccaggaa

SEQ ID NO: 1221897 - RNA, 19 nt, Human
cccgcggcagucgcagccg

SEQ ID NO: 1221898 - RNA, 24 nt, Human
ccuccaggaccccguugcagcgaa

SEQ ID NO: 1221899 - RNA, 19 nt, Human
ccuccugcuccagcacgaa

SEQ ID NO: 1221900 - RNA, 19 nt, Human
ccucguggcugaaucccag

SEQ ID NO: 1221901 - RNA, 22 nt, Human
ccucguggcugaaucccaggac

SEQ ID NO: 1221902 - RNA, 21 nt, Human
ccucuaggaugggguuggccu

SEQ ID NO: 1221903 - RNA, 18 nt, Human
ccucuuccagcugggccg

SEQ ID NO: 1221904 - RNA, 22 nt, Human
cgaggaagguccaggggaugcc

SEQ ID NO: 1221905 - RNA, 22 nt, Human
cggaagaagaucuugcucuguc

SEQ ID NO: 1221906 - RNA, 20 nt, Human
cggcagucgcagccgccucc

SEQ ID NO: 1221907 - RNA, 22 nt, Human
cggcagucgcagccgccucccu

SEQ ID NO: 1221908 - RNA, 18 nt, Human
cggccauguccucggccu

SEQ ID NO: 1221909 - RNA, 22 nt, Human
cucaccggggacacccggcucc

SEQ ID NO: 1221910 - RNA, 20 nt, Human
cuccagcgccccccagcagc

SEQ ID NO: 1221911 - RNA, 21 nt, Human
cuccagcgccccccagcagcu

SEQ ID NO: 1221912 - RNA, 19 nt, Human
cucccggagguugugcagg

SEQ ID NO: 1221913 - RNA, 23 nt, Human
cuccgccagcuccaccuccgccu

SEQ ID NO: 1221914 - RNA, 21 nt, Human
cuccucuuccagcugggccag

SEQ ID NO: 1221915 - RNA, 20 nt, Human
cucgcuccucuuccagcugg

SEQ ID NO: 1221916 - RNA, 24 nt, Human
cucgcuccucuuccagcugggcca

SEQ ID NO: 1221917 - RNA, 23 nt, Human
cucggccgcuggaacuuggggug

SEQ ID NO: 1221918 - RNA, 24 nt, Human
cugcagcaguggcuucaccuuggu

SEQ ID NO: 1221919 - RNA, 24 nt, Human
cugcagcaugcuccgauaggcccc

SEQ ID NO: 1221920 - RNA, 18 nt, Human
cugccgcgcacccuccuc

SEQ ID NO: 1221921 - RNA, 24 nt, Human
cuguuccuuagucugggcuuucug

SEQ ID NO: 1221922 - RNA, 21 nt, Human
cuucuccagcugcagcuucug

SEQ ID NO: 1221923 - RNA, 19 nt, Human
cuucugccgcgcacccucc

SEQ ID NO: 1221924 - RNA, 20 nt, Human
cuuggcgggggcugcggucc

SEQ ID NO: 1221925 - RNA, 22 nt, Human
cuugguaaacagccgccaccac

SEQ ID NO: 1221926 - RNA, 23 nt, Human
cuugucuguggccuucgggaacc

SEQ ID NO: 1221927 - RNA, 18 nt, Human
gaacugcugagaccaucc

SEQ ID NO: 1221928 - RNA, 19 nt, Human
gacagaugcggaugcccuc

SEQ ID NO: 1221929 - RNA, 24 nt, Human
gagcugcugcagcuucucguuggu

SEQ ID NO: 1221930 - RNA, 18 nt, Human
gaggaugcgguuggggaa

SEQ ID NO: 1221931 - RNA, 24 nt, Human
gagguacuggaugaccuucuuggu

SEQ ID NO: 1221932 - RNA, 18 nt, Human
gauccugcagcaugcucc

SEQ ID NO: 1221933 - RNA, 20 nt, Human
gaucuugcucugucccacgc

SEQ ID NO: 1221934 - RNA, 19 nt, Human
gccagggccuccagcgcga

SEQ ID NO: 1221935 - RNA, 20 nt, Human
gccagguauccccgggcagc

SEQ ID NO: 1221936 - RNA, 21 nt, Human
gcgacagaugcggaugcccuc

SEQ ID NO: 1221937 - RNA, 22 nt, Human
ggaacuugggguggccgcccug

SEQ ID NO: 1221938 - RNA, 26 nt, Human
ggaacuugggguggccgcccugcucc

SEQ ID NO: 1221939 - RNA, 24 nt, Human
ggaugaccuucuugguguuuuccg

SEQ ID NO: 1221940 - RNA, 19 nt, Human
ggccuuggccagggccucc

SEQ ID NO: 1221941 - RNA, 19 nt, Human
ggccuuggccagggccucc

SEQ ID NO: 1221942 - RNA, 20 nt, Human
gggccaggaguccagggggg

SEQ ID NO: 1221943 - RNA, 24 nt, Human
gguagugggagcagggcucgagga

SEQ ID NO: 1221944 - RNA, 21 nt, Human
ggugagcaaggcucgggagaa

SEQ ID NO: 1221945 - RNA, 18 nt, Human
guaggucucaauguuggc

SEQ ID NO: 1221946 - RNA, 18 nt, Human
gucggcuuugagcugcuc

SEQ ID NO: 1221947 - RNA, 21 nt, Human
gugagcaaggcucgggagaaa

SEQ ID NO: 1221948 - RNA, 18 nt, Human
uacaucuccacaauggcu

SEQ ID NO: 1221949 - RNA, 18 nt, Human
uacuggaugaccuucuug

SEQ ID NO: 1221950 - RNA, 21 nt, Human
uccaggaugcccaggaaggag

SEQ ID NO: 1221951 - RNA, 21 nt, Human
ucccaggacccgcagcgacuc

SEQ ID NO: 1221952 - RNA, 19 nt, Human
uccucgccuucgucccgca

SEQ ID NO: 1221953 - RNA, 19 nt, Human
ucgaggccaaagucgagga

SEQ ID NO: 1221954 - RNA, 19 nt, Human
ucuccgccagcuccaccuc

SEQ ID NO: 1221955 - RNA, 19 nt, Human
ucucgcuccucuuccagcu

SEQ ID NO: 1221956 - RNA, 20 nt, Human
ucucugccgucagccggucu

SEQ ID NO: 1221957 - RNA, 18 nt, Human
ucuugcucugucccacgc

SEQ ID NO: 1221958 - RNA, 21 nt, Human
ugagaccauccgcagcaugga

SEQ ID NO: 1221959 - RNA, 21 nt, Human
ugagaccauccgcagcaugga

SEQ ID NO: 1221960 - RNA, 26 nt, Human
ugagcaaggcucgggagaaauccguc

SEQ ID NO: 1221961 - RNA, 18 nt, Human
ugaggcgcagaaccagcc

SEQ ID NO: 1221962 - RNA, 21 nt, Human
ugagguaggccgcgcaguucc

SEQ ID NO: 1221963 - RNA, 24 nt, Human
ugaggucgaugcagggcugcaggu

SEQ ID NO: 1221964 - RNA, 20 nt, Human
ugaugucggugaccuucagg

SEQ ID NO: 1221965 - RNA, 23 nt, Human
ugcagcaguggcuucaccuuggu

SEQ ID NO: 1221966 - RNA, 22 nt, Human
ugcaggaccgaggccucguuga

SEQ ID NO: 1221967 - RNA, 23 nt, Human
ugccaaaggccucuaggaugggg

SEQ ID NO: 1221968 - RNA, 21 nt, Human
ugccccgguacaucuccacaa

SEQ ID NO: 1221969 - RNA, 18 nt, Human
ugccgcgcacccuccuca

SEQ ID NO: 1221970 - RNA, 19 nt, Human
ugccgucagccggucugug

SEQ ID NO: 1221971 - RNA, 22 nt, Human
ugcucugguggagcaaggcugc

SEQ ID NO: 1221972 - RNA, 21 nt, Human
ugcugcugcuggcgcuucugg

SEQ ID NO: 1221973 - RNA, 27 nt, Human
uggaagaucucaaagcccgcgaugucc

SEQ ID NO: 1221974 - RNA, 23 nt, Human
uggaagcugcacucguccuuggc

SEQ ID NO: 1221975 - RNA, 23 nt, Human
uggacugguccucacgauccugc

SEQ ID NO: 1221976 - RNA, 23 nt, Human
uggagaacacugaagucggccug

SEQ ID NO: 1221977 - RNA, 25 nt, Human
uggccagggccuccagcgcgaaguc

SEQ ID NO: 1221978 - RNA, 20 nt, Human
ugggaagcugcuuguacggg

SEQ ID NO: 1221979 - RNA, 19 nt, Human
uggggacaaugcagcggac

SEQ ID NO: 1221980 - RNA, 21 nt, Human
ugggguccaguuccagcgccu

SEQ ID NO: 1221981 - RNA, 20 nt, Human
ugguguaguugaugcagagc

SEQ ID NO: 1221982 - RNA, 24 nt, Human
uggugugguugaagagcugcugca

SEQ ID NO: 1221983 - RNA, 18 nt, Human
uuccgucuucccagcucc

SEQ ID NO: 1221984 - RNA, 22 nt, Human
uucuccacaaacgacuugucug

SEQ ID NO: 1221985 - RNA, 18 nt, Human
uuggccugaagcagcugc

SEQ ID NO: 1221986 - RNA, 24 nt, Human
uuuucaucagccacucguuggccu

SEQ ID NO: 1221987 - RNA, 19 nt, Human
cagccccacccucacccug

SEQ ID NO: 1221988 - RNA, 21 nt, Human
cagguggacuuaauccuccuc

SEQ ID NO: 1221989 - RNA, 19 nt, Human
ccucacccuggcccuucuu

SEQ ID NO: 1221990 - RNA, 22 nt, Human
ccucacccuggcccuucuuggc

SEQ ID NO: 1221991 - RNA, 25 nt, Human
cuccagccccacccucacccuggcc

SEQ ID NO: 1221992 - RNA, 22 nt, Human
gacagguggacuuaauccuccu

SEQ ID NO: 1221993 - RNA, 18 nt, Human
gcagcccaggagggacag

SEQ ID NO: 1221994 - RNA, 22 nt, Human
gcuccgcuuccccgucugcgcc

SEQ ID NO: 1221995 - RNA, 21 nt, Human
ggacagguggacuuaauccuc

SEQ ID NO: 1221996 - RNA, 19 nt, Human
ggacuuaauccuccuccuc

SEQ ID NO: 1221997 - RNA, 23 nt, Human
ggcaggaaaacgagacaauccag

SEQ ID NO: 1221998 - RNA, 19 nt, Human
uccagccccacccucaccc

SEQ ID NO: 1221999 - RNA, 21 nt, Human
ucuccagccccacccucaccc

SEQ ID NO: 1222000 - RNA, 21 nt, Human
ucuccagccccacccucaccc

SEQ ID NO: 1222001 - RNA, 21 nt, Human
aaaaggccgaggugucaggca

SEQ ID NO: 1222002 - RNA, 23 nt, Human
aaacacacugaggagcgccccuc

SEQ ID NO: 1222003 - RNA, 24 nt, Human
aagcguggggaaauggggcggggc

SEQ ID NO: 1222004 - RNA, 31 nt, Human
acacugaggagcgccccuccggaagagaaag

SEQ ID NO: 1222005 - RNA, 21 nt, Human
accccaaacacacugaggagc

SEQ ID NO: 1222006 - RNA, 18 nt, Human
agaggggcaggauucaac

SEQ ID NO: 1222007 - RNA, 22 nt, Human
aggggcaggauucaaacccggg

SEQ ID NO: 1222008 - RNA, 22 nt, Human
cacaugcggcccccuggagggc

SEQ ID NO: 1222009 - RNA, 22 nt, Human
caccacaccagaggggcaggau

SEQ ID NO: 1222010 - RNA, 22 nt, Human
caccagcugcugucuauccccc

SEQ ID NO: 1222011 - RNA, 18 nt, Human
cacccugucgggaagccg

SEQ ID NO: 1222012 - RNA, 22 nt, Human
cagcugcugucuaucccccuag

SEQ ID NO: 1222013 - RNA, 20 nt, Human
cccccuggagggcguggagc

SEQ ID NO: 1222014 - RNA, 18 nt, Human
ccccuggagggcguggag

SEQ ID NO: 1222015 - RNA, 22 nt, Human
cccuggagggcguggagcgagg

SEQ ID NO: 1222016 - RNA, 24 nt, Human
cgccggugagggcuccaguugcac

SEQ ID NO: 1222017 - RNA, 24 nt, Human
cggcggggaagcgcuggcucuggu

SEQ ID NO: 1222018 - RNA, 19 nt, Human
cucgccggugagggcucca

SEQ ID NO: 1222019 - RNA, 21 nt, Human
cuucaaagcguggggaaaugg

SEQ ID NO: 1222020 - RNA, 19 nt, Human
gcaagugcacaugcggccc

SEQ ID NO: 1222021 - RNA, 24 nt, Human
gcagggcgggucaggauccguggc

SEQ ID NO: 1222022 - RNA, 18 nt, Human
gccucugggugcagcucu

SEQ ID NO: 1222023 - RNA, 22 nt, Human
gcguggggaaauggggcggggc

SEQ ID NO: 1222024 - RNA, 22 nt, Human
ggaacacugaggccaaaagucu

SEQ ID NO: 1222025 - RNA, 22 nt, Human
ggcaagugcacaugcggccccc

SEQ ID NO: 1222026 - RNA, 21 nt, Human
gggagaccccaaacacacuga

SEQ ID NO: 1222027 - RNA, 18 nt, Human
gggcguggagcgagggag

SEQ ID NO: 1222028 - RNA, 21 nt, Human
guggggaaauggggcggggcc

SEQ ID NO: 1222029 - RNA, 19 nt, Human
ucccaggcggggaacacug

SEQ ID NO: 1222030 - RNA, 24 nt, Human
ucccaggcggggaacacugaggcc

SEQ ID NO: 1222031 - RNA, 23 nt, Human
ucccccuaggaggucuguggaga

SEQ ID NO: 1222032 - RNA, 18 nt, Human
ucuguggagacucgcccc

SEQ ID NO: 1222033 - RNA, 22 nt, Human
uggcccguaguugcggccaccc

SEQ ID NO: 1222034 - RNA, 27 nt, Human
ugggaagaggccgcaccacaccagagg

SEQ ID NO: 1222035 - RNA, 18 nt, Human
uggggaaauggggcgggg

SEQ ID NO: 1222036 - RNA, 21 nt, Human
uggggcggggccaaugacacc

SEQ ID NO: 1222037 - RNA, 23 nt, Human
uguguggggucacaccagcugcu

SEQ ID NO: 1222038 - RNA, 23 nt, Human
uuccaagaaaagggguggcggcg

SEQ ID NO: 1222039 - RNA, 21 nt, Human
uugggacccuggaaccucggg

SEQ ID NO: 1222040 - RNA, 19 nt, Human
cagccaggcuccagcugug

SEQ ID NO: 1222041 - RNA, 24 nt, Human
ccagauuuccaaguagcuuucucu

SEQ ID NO: 1222042 - RNA, 24 nt, Human
ccagugugggguggagccuucugg

SEQ ID NO: 1222043 - RNA, 24 nt, Human
ugggguggagccuucugggugugg

SEQ ID NO: 1222044 - RNA, 18 nt, Human
uuccuggcuugugagugc

SEQ ID NO: 1222045 - RNA, 19 nt, Human
uuucucuuccuggcuugug

SEQ ID NO: 1222046 - RNA, 23 nt, Human
aauugauggggcuacagaaagga

SEQ ID NO: 1222047 - RNA, 25 nt, Human
caauggguccuucgcccacuaauuc

SEQ ID NO: 1222048 - RNA, 21 nt, Human
ccuucgcccacuaauuccuuu

SEQ ID NO: 1222049 - RNA, 23 nt, Human
gaaaggcaagagagugaaggagg

SEQ ID NO: 1222050 - RNA, 21 nt, Human
ucuuccugagcuggaugauga

SEQ ID NO: 1222051 - RNA, 21 nt, Human
uggugcugcuccugguccagg

SEQ ID NO: 1222052 - RNA, 23 nt, Human
aagugauccaugaagacaucaac

SEQ ID NO: 1222053 - RNA, 18 nt, Human
acuuagccucuuccuauu

SEQ ID NO: 1222054 - RNA, 22 nt, Human
auuguuucuucuuuccagacuu

SEQ ID NO: 1222055 - RNA, 24 nt, Human
caagucuuucacuuagccucuucc

SEQ ID NO: 1222056 - RNA, 22 nt, Human
cagaagaaacucagugaaguca

SEQ ID NO: 1222057 - RNA, 19 nt, Human
ccaagugauccaugaagac

SEQ ID NO: 1222058 - RNA, 18 nt, Human
ccccuguuucucuugggc

SEQ ID NO: 1222059 - RNA, 19 nt, Human
cccuuauucccuuuucuau

SEQ ID NO: 1222060 - RNA, 19 nt, Human
ccgcgcccaguggcugagu

SEQ ID NO: 1222061 - RNA, 27 nt, Human
cgguaaauucucuuuucugguagacuc

SEQ ID NO: 1222062 - RNA, 22 nt, Human
cugauaucgguaaauucucuuu

SEQ ID NO: 1222063 - RNA, 22 nt, Human
cuuuucuuucuuuuuuuucaga

SEQ ID NO: 1222064 - RNA, 26 nt, Human
gaugguuuuuuccauauucuucuucu

SEQ ID NO: 1222065 - RNA, 23 nt, Human
gcccaguggcugagugucuggag

SEQ ID NO: 1222066 - RNA, 21 nt, Human
gcugacugcagaugaagcuug

SEQ ID NO: 1222067 - RNA, 18 nt, Human
gugcuuguguccugauau

SEQ ID NO: 1222068 - RNA, 19 nt, Human
guggcugagugucuggagc

SEQ ID NO: 1222069 - RNA, 22 nt, Human
uaaauucucuuuucugguagac

SEQ ID NO: 1222070 - RNA, 22 nt, Human
uaggugaauauccuuuucuuuc

SEQ ID NO: 1222071 - RNA, 23 nt, Human
uaucuucauguuuaucaugauga

SEQ ID NO: 1222072 - RNA, 18 nt, Human
uauucuucuucucuauga

SEQ ID NO: 1222073 - RNA, 18 nt, Human
ucagaacuagauucaugc

SEQ ID NO: 1222074 - RNA, 23 nt, Human
ucuucuuucucuucaagucuuuc

SEQ ID NO: 1222075 - RNA, 20 nt, Human
uuauuaucuucauguuuauc

SEQ ID NO: 1222076 - RNA, 19 nt, Human
uucauaaucauauacuccu

SEQ ID NO: 1222077 - RNA, 22 nt, Human
uugaguuaugaugguuuuuucc

SEQ ID NO: 1222078 - RNA, 24 nt, Human
uuuucagucuuguuuuucucuuuu

SEQ ID NO: 1222079 - RNA, 20 nt, Human
uuuuccccccuguuucucuu

SEQ ID NO: 1222080 - RNA, 21 nt, Human
uuuuuuccauauucuucuucu

SEQ ID NO: 1222081 - RNA, 18 nt, Human
acuuagccucuuccuauu

SEQ ID NO: 1222082 - RNA, 24 nt, Human
caagucuuucacuuagccucuucc

SEQ ID NO: 1222083 - RNA, 23 nt, Human
ucuucuuucucuucaagucuuuc

SEQ ID NO: 1222084 - RNA, 19 nt, Human
uucauaaucauauacuccu

SEQ ID NO: 1222085 - RNA, 22 nt, Human
accacuggguuucuccccucca

SEQ ID NO: 1222086 - RNA, 24 nt, Human
accacuggguuucuccccuccaaa

SEQ ID NO: 1222087 - RNA, 18 nt, Human
cacagcuccugcacagcc

SEQ ID NO: 1222088 - RNA, 20 nt, Human
caccaaaaacuuaacuguac

SEQ ID NO: 1222089 - RNA, 18 nt, Human
caccgucacagcucccgc

SEQ ID NO: 1222090 - RNA, 18 nt, Human
caccgucccccgccgggg

SEQ ID NO: 1222091 - RNA, 21 nt, Human
cagcuccugcacagccgguca

SEQ ID NO: 1222092 - RNA, 22 nt, Human
caucuggcugugcuucuggggc

SEQ ID NO: 1222093 - RNA, 21 nt, Human
ccagcccuccuaagcccuggg

SEQ ID NO: 1222094 - RNA, 23 nt, Human
ccuaagcccuggguguggcggga

SEQ ID NO: 1222095 - RNA, 22 nt, Human
cgagagcugccagaugaaacac

SEQ ID NO: 1222096 - RNA, 24 nt, Human
cgaggccccugcgucuugccagcc

SEQ ID NO: 1222097 - RNA, 22 nt, Human
cgucuugccagcccuccuaagc

SEQ ID NO: 1222098 - RNA, 25 nt, Human
gaacaaagagguggcaguaacaaga

SEQ ID NO: 1222099 - RNA, 26 nt, Human
gucaguuaaucuucucuccgaagcuc

SEQ ID NO: 1222100 - RNA, 20 nt, Human
uaacuacuggagagaacccu

SEQ ID NO: 1222101 - RNA, 25 nt, Human
uaacuguacccgucccuagugcaga

SEQ ID NO: 1222102 - RNA, 21 nt, Human
ucuccgaagcucuggacucau

SEQ ID NO: 1222103 - RNA, 19 nt, Human
ucuugccagcccuccuaag

SEQ ID NO: 1222104 - RNA, 22 nt, Human
ugagugcgagagcugccagaug

SEQ ID NO: 1222105 - RNA, 22 nt, Human
ugcgagagcugccagaugaaac

SEQ ID NO: 1222106 - RNA, 22 nt, Human
aaacugcugggauuauaggugg

SEQ ID NO: 1222107 - RNA, 24 nt, Human
aaacugcugggauuauagguggga

SEQ ID NO: 1222108 - RNA, 22 nt, Human
aaagcccaguaacaggccaaga

SEQ ID NO: 1222109 - RNA, 23 nt, Human
aaauauucaguuuccaccaaagc

SEQ ID NO: 1222110 - RNA, 20 nt, Human
aaaugaagaugaaggaauuu

SEQ ID NO: 1222111 - RNA, 22 nt, Human
aacacccucacagacacagcca

SEQ ID NO: 1222112 - RNA, 23 nt, Human
aagcaucccgcacgggacaaaga

SEQ ID NO: 1222113 - RNA, 22 nt, Human
aagcaucccuaucugccacuga

SEQ ID NO: 1222114 - RNA, 21 nt, Human
aaggaggaaauacucaugaca

SEQ ID NO: 1222115 - RNA, 19 nt, Human
aaucaaguugacacucagu

SEQ ID NO: 1222116 - RNA, 20 nt, Human
acaauaggaugucugcaagc

SEQ ID NO: 1222117 - RNA, 21 nt, Human
acacccucacagacacagcca

SEQ ID NO: 1222118 - RNA, 21 nt, Human
acaggccccacaccacuggac

SEQ ID NO: 1222119 - RNA, 21 nt, Human
accaauccccaacccaaacac

SEQ ID NO: 1222120 - RNA, 24 nt, Human
accagguagcuugcugaucacccc

SEQ ID NO: 1222121 - RNA, 24 nt, Human
acuagaaugaaaaaauacagucug

SEQ ID NO: 1222122 - RNA, 20 nt, Human
acugcaagcuccgccucccg

SEQ ID NO: 1222123 - RNA, 20 nt, Human
acugcaauugaagucaccac

SEQ ID NO: 1222124 - RNA, 18 nt, Human
acugcugggauuauaggu

SEQ ID NO: 1222125 - RNA, 25 nt, Human
agcaaaagaaggaggaaauacucau

SEQ ID NO: 1222126 - RNA, 23 nt, Human
agcagaacguaaugucgcgggaa

SEQ ID NO: 1222127 - RNA, 21 nt, Human
agcaugagcccacugccacuc

SEQ ID NO: 1222128 - RNA, 20 nt, Human
agccaccacacccagccaaa

SEQ ID NO: 1222129 - RNA, 23 nt, Human
agccuugccagcugaaggcaaau

SEQ ID NO: 1222130 - RNA, 21 nt, Human
agcugggacuacaggagcccg

SEQ ID NO: 1222131 - RNA, 18 nt, Human
aggcaaugcuguguggaa

SEQ ID NO: 1222132 - RNA, 25 nt, Human
aggcuggagugcaguggcgcgaucu

SEQ ID NO: 1222133 - RNA, 21 nt, Human
aggugggagccaccacaccca

SEQ ID NO: 1222134 - RNA, 18 nt, Human
aguagcugggacuacagg

SEQ ID NO: 1222135 - RNA, 25 nt, Human
aguagcugggacuacaggagcccgc

SEQ ID NO: 1222136 - RNA, 20 nt, Human
agugcaguggcgcgaucucg

SEQ ID NO: 1222137 - RNA, 23 nt, Human
agugcaguggcgcgaucucggcu

SEQ ID NO: 1222138 - RNA, 24 nt, Human
agugcaguggcgcgaucucggcuc

SEQ ID NO: 1222139 - RNA, 20 nt, Human
aucaccccaaggaauggggc

SEQ ID NO: 1222140 - RNA, 22 nt, Human
aucucaacaggccccacaccac

SEQ ID NO: 1222141 - RNA, 23 nt, Human
aucuccauaagccccuacuuuaa

SEQ ID NO: 1222142 - RNA, 19 nt, Human
augaugguggguaaggcau

SEQ ID NO: 1222143 - RNA, 20 nt, Human
auggcguuucgccguguuag

SEQ ID NO: 1222144 - RNA, 21 nt, Human
auggcguuucgccguguuagc

SEQ ID NO: 1222145 - RNA, 24 nt, Human
auggcguuucgccguguuagccag

SEQ ID NO: 1222146 - RNA, 24 nt, Human
augucugcaagcugaggagcaagg

SEQ ID NO: 1222147 - RNA, 24 nt, Human
auguugcugagcccaugcguaacc

SEQ ID NO: 1222148 - RNA, 23 nt, Human
auucuaucaauccagcuacuuca

SEQ ID NO: 1222149 - RNA, 22 nt, Human
caaacugcugggauuauaggug

SEQ ID NO: 1222150 - RNA, 24 nt, Human
caacaggccccacaccacuggacc

SEQ ID NO: 1222151 - RNA, 19 nt, Human
caagugcauacauucacaa

SEQ ID NO: 1222152 - RNA, 19 nt, Human
caaguucuugauggcagca

SEQ ID NO: 1222153 - RNA, 21 nt, Human
caauccccaacccaaacacua

SEQ ID NO: 1222154 - RNA, 22 nt, Human
caaucugagucucaaaacugaa

SEQ ID NO: 1222155 - RNA, 21 nt, Human
cacaauaggaugucugcaagc

SEQ ID NO: 1222156 - RNA, 25 nt, Human
cacaggccaaaugagaaaguugaac

SEQ ID NO: 1222157 - RNA, 21 nt, Human
caccaauccccaacccaaaca

SEQ ID NO: 1222158 - RNA, 22 nt, Human
caccaauccccaacccaaacac

SEQ ID NO: 1222159 - RNA, 24 nt, Human
caccaauccccaacccaaacacua

SEQ ID NO: 1222160 - RNA, 19 nt, Human
caccuauggcagccugcca

SEQ ID NO: 1222161 - RNA, 23 nt, Human
caccugaguugaagucuuaccac

SEQ ID NO: 1222162 - RNA, 22 nt, Human
cacucaguaguggcguagccag

SEQ ID NO: 1222163 - RNA, 22 nt, Human
cagggccuugcuccaaaauccu

SEQ ID NO: 1222164 - RNA, 22 nt, Human
caguagagauggcguuucgccg

SEQ ID NO: 1222165 - RNA, 24 nt, Human
caguagagauggcguuucgccgug

SEQ ID NO: 1222166 - RNA, 22 nt, Human
caguuuccaccaaagcccagua

SEQ ID NO: 1222167 - RNA, 19 nt, Human
cauucuauccacuugauua

SEQ ID NO: 1222168 - RNA, 21 nt, Human
ccaaacugcugggauuauagg

SEQ ID NO: 1222169 - RNA, 20 nt, Human
ccaacccaaacacuauuaca

SEQ ID NO: 1222170 - RNA, 24 nt, Human
ccacacccagccaaaauaaagaua

SEQ ID NO: 1222171 - RNA, 26 nt, Human
ccacacccagccaaaauaguggaccc

SEQ ID NO: 1222172 - RNA, 22 nt, Human
ccacucagagagguccauccac

SEQ ID NO: 1222173 - RNA, 20 nt, Human
ccacuugcacuuccaccccu

SEQ ID NO: 1222174 - RNA, 21 nt, Human
ccagcccugcaaaguauuguc

SEQ ID NO: 1222175 - RNA, 24 nt, Human
ccauauauuggaugcugauucaga

SEQ ID NO: 1222176 - RNA, 22 nt, Human
cccaagugggacagcagcuucc

SEQ ID NO: 1222177 - RNA, 24 nt, Human
cccacaauaggaugucugcaagcu

SEQ ID NO: 1222178 - RNA, 24 nt, Human
cccacaccacuggaccccuagaaa

SEQ ID NO: 1222179 - RNA, 18 nt, Human
ccccacaccacuggaccc

SEQ ID NO: 1222180 - RNA, 24 nt, Human
cccuggaaucaaugucagcucaga

SEQ ID NO: 1222181 - RNA, 23 nt, Human
ccgcccgccucagccucccaaac

SEQ ID NO: 1222182 - RNA, 20 nt, Human
ccugaccuggugauccgccc

SEQ ID NO: 1222183 - RNA, 23 nt, Human
ccugaguagcugggacuacagga

SEQ ID NO: 1222184 - RNA, 24 nt, Human
cgcccaggcuggagugcaguggcg

SEQ ID NO: 1222185 - RNA, 24 nt, Human
cgccguguuagccaggauggucuu

SEQ ID NO: 1222186 - RNA, 24 nt, Human
cgccucagccucccaaacugcugg

SEQ ID NO: 1222187 - RNA, 19 nt, Human
cgccucccggguucaugcc

SEQ ID NO: 1222188 - RNA, 24 nt, Human
cgcucugucgcccaggcuggagug

SEQ ID NO: 1222189 - RNA, 24 nt, Human
cuacugcuugucaacuugaaccca

SEQ ID NO: 1222190 - RNA, 21 nt, Human
cucaguguuggucucugcugc

SEQ ID NO: 1222191 - RNA, 21 nt, Human
cucccggguucaugccauucu

SEQ ID NO: 1222192 - RNA, 24 nt, Human
cuccugaccuggugauccgcccgc

SEQ ID NO: 1222193 - RNA, 22 nt, Human
cuccuuuucacauuuuucugcc

SEQ ID NO: 1222194 - RNA, 24 nt, Human
cucgcucugucgcccaggcuggag

SEQ ID NO: 1222195 - RNA, 23 nt, Human
cugccucagaauccugaguagcu

SEQ ID NO: 1222196 - RNA, 26 nt, Human
cugcuaaaugucuaugccaauugugc

SEQ ID NO: 1222197 - RNA, 18 nt, Human
cuggaggaccacaugacg

SEQ ID NO: 1222198 - RNA, 21 nt, Human
cuguugcagauccuucuucug

SEQ ID NO: 1222199 - RNA, 19 nt, Human
cuuacaauaauccacuguc

SEQ ID NO: 1222200 - RNA, 25 nt, Human
cuuuccuuuccaugauggaagaggu

SEQ ID NO: 1222201 - RNA, 25 nt, Human
cuuuuccagcccacugacucaaaua

SEQ ID NO: 1222202 - RNA, 25 nt, Human
gaaaagaaaucuaggucucugugaa

SEQ ID NO: 1222203 - RNA, 19 nt, Human
gaagauggcagggccuugc

SEQ ID NO: 1222204 - RNA, 21 nt, Human
gacaccucaaguaccagugga

SEQ ID NO: 1222205 - RNA, 24 nt, Human
gaccuggugauccgcccgccucag

SEQ ID NO: 1222206 - RNA, 21 nt, Human
gacugagugguauccacagaa

SEQ ID NO: 1222207 - RNA, 25 nt, Human
gagccaaucugagucucaaaacuga

SEQ ID NO: 1222208 - RNA, 24 nt, Human
gagcccacugccacucuucuuuag

SEQ ID NO: 1222209 - RNA, 18 nt, Human
gagcccgccaccaugccu

SEQ ID NO: 1222210 - RNA, 21 nt, Human
gaggcuaggccaaucucuccu

SEQ ID NO: 1222211 - RNA, 23 nt, Human
gaguagcugggacuacaggagcc

SEQ ID NO: 1222212 - RNA, 18 nt, Human
gauccaaucagcauaaug

SEQ ID NO: 1222213 - RNA, 25 nt, Human
gaugagagggguggcuggggaaaga

SEQ ID NO: 1222214 - RNA, 19 nt, Human
gcccaggcuggagugcagu

SEQ ID NO: 1222215 - RNA, 20 nt, Human
gcccaggcuggagugcagug

SEQ ID NO: 1222216 - RNA, 25 nt, Human
gccucccggguucaugccauucucc

SEQ ID NO: 1222217 - RNA, 24 nt, Human
gccuggcuaauuuuuuuguauuuu

SEQ ID NO: 1222218 - RNA, 24 nt, Human
gccuugcuccaaaauccuagaggc

SEQ ID NO: 1222219 - RNA, 25 nt, Human
gcucugucgcccaggcuggagugca

SEQ ID NO: 1222220 - RNA, 19 nt, Human
ggagaacuuugccccagcc

SEQ ID NO: 1222221 - RNA, 23 nt, Human
ggagagccaaucugagucucaaa

SEQ ID NO: 1222222 - RNA, 18 nt, Human
ggcaaugcuguguggaau

SEQ ID NO: 1222223 - RNA, 22 nt, Human
ggcguuucgccguguuagccag

SEQ ID NO: 1222224 - RNA, 23 nt, Human
ggcguuucgccguguuagccagg

SEQ ID NO: 1222225 - RNA, 22 nt, Human
gggagaaagauucacugcauaa

SEQ ID NO: 1222226 - RNA, 19 nt, Human
gggccuugcuccaaaaucc

SEQ ID NO: 1222227 - RNA, 23 nt, Human
ggguucugccagcugcuaaaugu

SEQ ID NO: 1222228 - RNA, 23 nt, Human
ggucugccuuuuccagcccacug

SEQ ID NO: 1222229 - RNA, 20 nt, Human
gguuuuuggccacucagaga

SEQ ID NO: 1222230 - RNA, 24 nt, Human
gugauccgcccgccucagccuccc

SEQ ID NO: 1222231 - RNA, 20 nt, Human
guggugccacuugcacuuuc

SEQ ID NO: 1222232 - RNA, 19 nt, Human
uaaaaggccagagaucucu

SEQ ID NO: 1222233 - RNA, 19 nt, Human
uaaaucuucugucacauga

SEQ ID NO: 1222234 - RNA, 18 nt, Human
uaaauguccuaccaauaa

SEQ ID NO: 1222235 - RNA, 24 nt, Human
uaaccuccaucccugccaccaugg

SEQ ID NO: 1222236 - RNA, 23 nt, Human
uacagaauuuauaauaaagacac

SEQ ID NO: 1222237 - RNA, 23 nt, Human
uaccagucagggagccaacacgg

SEQ ID NO: 1222238 - RNA, 21 nt, Human
uaggcaaacccauaucuggag

SEQ ID NO: 1222239 - RNA, 20 nt, Human
uauaauaaagacaccugagu

SEQ ID NO: 1222240 - RNA, 20 nt, Human
uauuuuguauccuucaaucc

SEQ ID NO: 1222241 - RNA, 21 nt, Human
uauuuuguauccuucaaucca

SEQ ID NO: 1222242 - RNA, 20 nt, Human
ucacauggucauagcugaug

SEQ ID NO: 1222243 - RNA, 18 nt, Human
ucacugcaagcuccgccu

SEQ ID NO: 1222244 - RNA, 19 nt, Human
ucacugcaagcuccgccuc

SEQ ID NO: 1222245 - RNA, 24 nt, Human
ucacugcaagcuccgccucccggg

SEQ ID NO: 1222246 - RNA, 19 nt, Human
ucaguaaugugguguccuu

SEQ ID NO: 1222247 - RNA, 22 nt, Human
ucaguagagauggcguuucgcc

SEQ ID NO: 1222248 - RNA, 24 nt, Human
ucaguagagauggcguuucgccgu

SEQ ID NO: 1222249 - RNA, 19 nt, Human
ucaguauuaaccaucacaa

SEQ ID NO: 1222250 - RNA, 23 nt, Human
ucauagcugaugacucuuuuucu

SEQ ID NO: 1222251 - RNA, 21 nt, Human
ucauucuaucaauccagcuac

SEQ ID NO: 1222252 - RNA, 21 nt, Human
uccacagcagccuggaccugu

SEQ ID NO: 1222253 - RNA, 19 nt, Human
uccacauuccucuuccuca

SEQ ID NO: 1222254 - RNA, 25 nt, Human
uccauaagccccuacuuuaacugga

SEQ ID NO: 1222255 - RNA, 23 nt, Human
ucccaaacugcugggauuauagg

SEQ ID NO: 1222256 - RNA, 24 nt, Human
ucccaaacugcugggauuauaggu

SEQ ID NO: 1222257 - RNA, 19 nt, Human
ucccgcacgggacaaagau

SEQ ID NO: 1222258 - RNA, 21 nt, Human
ucccggguucaugccauucuc

SEQ ID NO: 1222259 - RNA, 24 nt, Human
ucccggguucaugccauucuccug

SEQ ID NO: 1222260 - RNA, 21 nt, Human
uccgcccgccucagccuccca

SEQ ID NO: 1222261 - RNA, 19 nt, Human
uccuaccagucagggagcc

SEQ ID NO: 1222262 - RNA, 18 nt, Human
uccugaguagcugggacu

SEQ ID NO: 1222263 - RNA, 23 nt, Human
uccuuuggcaacacccucacaga

SEQ ID NO: 1222264 - RNA, 23 nt, Human
ucgagggcucaguguuggucucu

SEQ ID NO: 1222265 - RNA, 22 nt, Human
ucgcccaggcuggagugcagug

SEQ ID NO: 1222266 - RNA, 24 nt, Human
ucgccguguuagccaggauggucu

SEQ ID NO: 1222267 - RNA, 24 nt, Human
ucgcucugucgcccaggcuggagu

SEQ ID NO: 1222268 - RNA, 22 nt, Human
ucggaccugagcuaaaauucca

SEQ ID NO: 1222269 - RNA, 23 nt, Human
ucuccugagaucauacauaauau

SEQ ID NO: 1222270 - RNA, 21 nt, Human
ucuccugccucagaauccuga

SEQ ID NO: 1222271 - RNA, 19 nt, Human
ucucgcucugucgcccagg

SEQ ID NO: 1222272 - RNA, 23 nt, Human
ucucgcucugucgcccaggcugg

SEQ ID NO: 1222273 - RNA, 24 nt, Human
ucucgcucugucgcccaggcugga

SEQ ID NO: 1222274 - RNA, 26 nt, Human
ucucgcucugucgcccaggcuggagu

SEQ ID NO: 1222275 - RNA, 21 nt, Human
ucugcuggaucauauggccca

SEQ ID NO: 1222276 - RNA, 24 nt, Human
ucugucgcccaggcuggagugcag

SEQ ID NO: 1222277 - RNA, 23 nt, Human
ugaaaaaauacagucugaaagua

SEQ ID NO: 1222278 - RNA, 23 nt, Human
ugaagucaauaaaucuucuguca

SEQ ID NO: 1222279 - RNA, 18 nt, Human
ugaccuauaguaaguuau

SEQ ID NO: 1222280 - RNA, 23 nt, Human
ugaccuggugauccgcccgccuc

SEQ ID NO: 1222281 - RNA, 22 nt, Human
ugagacggagucucgcucuguc

SEQ ID NO: 1222282 - RNA, 23 nt, Human
ugagagggguggcuggggaaaga

SEQ ID NO: 1222283 - RNA, 21 nt, Human
ugaggaauguguugccucuaa

SEQ ID NO: 1222284 - RNA, 18 nt, Human
ugaggacaaaccucuuuc

SEQ ID NO: 1222285 - RNA, 23 nt, Human
ugaguagcugggacuacaggagc

SEQ ID NO: 1222286 - RNA, 19 nt, Human
ugauggugaguggugccac

SEQ ID NO: 1222287 - RNA, 19 nt, Human
ugauucagagcacacacgg

SEQ ID NO: 1222288 - RNA, 22 nt, Human
ugcaguggcgcgaucucggcuc

SEQ ID NO: 1222289 - RNA, 21 nt, Human
ugcauaaauugucaguaaugu

SEQ ID NO: 1222290 - RNA, 20 nt, Human
ugcauacauucacaaacaug

SEQ ID NO: 1222291 - RNA, 18 nt, Human
ugcauucuggcacugggg

SEQ ID NO: 1222292 - RNA, 22 nt, Human
ugccagcugaaggcaaauugcu

SEQ ID NO: 1222293 - RNA, 21 nt, Human
ugccucagaauccugaguagc

SEQ ID NO: 1222294 - RNA, 22 nt, Human
ugccucuaaaauccaaauaggc

SEQ ID NO: 1222295 - RNA, 21 nt, Human
uggaagagguccaauauaauc

SEQ ID NO: 1222296 - RNA, 19 nt, Human
uggagaaaaaggcauuugc

SEQ ID NO: 1222297 - RNA, 24 nt, Human
uggagucugauguucgagagcagg

SEQ ID NO: 1222298 - RNA, 23 nt, Human
uggagugcaguggcgcgaucucg

SEQ ID NO: 1222299 - RNA, 24 nt, Human
uggagugcaguggcgcgaucucgg

SEQ ID NO: 1222300 - RNA, 19 nt, Human
uggcaacacccucacagac

SEQ ID NO: 1222301 - RNA, 24 nt, Human
uggcaacacccucacagacacagc

SEQ ID NO: 1222302 - RNA, 21 nt, Human
uggcacauaaauguccuacca

SEQ ID NO: 1222303 - RNA, 19 nt, Human
uggcagaguacugcaugca

SEQ ID NO: 1222304 - RNA, 20 nt, Human
uggcccaagugggacagcag

SEQ ID NO: 1222305 - RNA, 24 nt, Human
uggcguuucgccguguuagccagg

SEQ ID NO: 1222306 - RNA, 22 nt, Human
ugggacuacaggagcccgccac

SEQ ID NO: 1222307 - RNA, 24 nt, Human
ugggacuacaggagcccgccacca

SEQ ID NO: 1222308 - RNA, 22 nt, Human
ugggagccaccacacccagcca

SEQ ID NO: 1222309 - RNA, 19 nt, Human
ugggauuauaggugggagc

SEQ ID NO: 1222310 - RNA, 21 nt, Human
ugggauuauaggugggagcca

SEQ ID NO: 1222311 - RNA, 22 nt, Human
ugggauuauaggugggagccac

SEQ ID NO: 1222312 - RNA, 24 nt, Human
ugggauuauaggugggagccacca

SEQ ID NO: 1222313 - RNA, 20 nt, Human
uggggcugaucaucgagggc

SEQ ID NO: 1222314 - RNA, 21 nt, Human
ugggucacuaggggugauggu

SEQ ID NO: 1222315 - RNA, 22 nt, Human
ugucugauccuuuccuuuuccc

SEQ ID NO: 1222316 - RNA, 18 nt, Human
uguugggcgaugagaggg

SEQ ID NO: 1222317 - RNA, 23 nt, Human
uguuugcuacuucuugcccacug

SEQ ID NO: 1222318 - RNA, 20 nt, Human
uuaaaugcugauaugaaguc

SEQ ID NO: 1222319 - RNA, 18 nt, Human
uuaacuuacacaaucaca

SEQ ID NO: 1222320 - RNA, 21 nt, Human
uucacauaauacaacuauccu

SEQ ID NO: 1222321 - RNA, 19 nt, Human
uucaugccauucuccugcc

SEQ ID NO: 1222322 - RNA, 23 nt, Human
uuccaccccuugauuccuggacc

SEQ ID NO: 1222323 - RNA, 21 nt, Human
uuccacgaguucacagauagu

SEQ ID NO: 1222324 - RNA, 26 nt, Human
uucucuggcacauaaauguccuacca

SEQ ID NO: 1222325 - RNA, 21 nt, Human
uucuugauggcagcacuaauc

SEQ ID NO: 1222326 - RNA, 21 nt, Human
uugccaagucaauggcugcau

SEQ ID NO: 1222327 - RNA, 22 nt, Human
uugcugagcccaugcguaaccu

SEQ ID NO: 1222328 - RNA, 22 nt, Human
uuucccauucucuggcacauaa

SEQ ID NO: 1222329 - RNA, 21 nt, Human
uuucgccguguuagccaggau

SEQ ID NO: 1222330 - RNA, 20 nt, Human
uuugcuugucugaaaaaggc

SEQ ID NO: 1222331 - RNA, 24 nt, Human
uuuucaguagagauggcguuucgc

SEQ ID NO: 1222332 - RNA, 19 nt, Human
uuuuuguuuguuuguuuuu

SEQ ID NO: 1222333 - RNA, 20 nt, Human
uuuuuguuuguuuguuuuuu

SEQ ID NO: 1222334 - RNA, 21 nt, Human
uuuuuuguauuuucaguagag

SEQ ID NO: 1222335 - RNA, 24 nt, Human
uuuuuuguauuuucaguagagaug

SEQ ID NO: 1222336 - RNA, 23 nt, Human
aaccuuacuggcuuaaaccagga

SEQ ID NO: 1222337 - RNA, 21 nt, Human
aagaggcccaggcagaagcug

SEQ ID NO: 1222338 - RNA, 22 nt, Human
aagcauaguaggaaccugcagc

SEQ ID NO: 1222339 - RNA, 23 nt, Human
acccagcccucucuuuguggcca

SEQ ID NO: 1222340 - RNA, 24 nt, Human
aggagggaggugcugcccugcagg

SEQ ID NO: 1222341 - RNA, 24 nt, Human
caagguucuacuugugaucucuca

SEQ ID NO: 1222342 - RNA, 23 nt, Human
ccagaaggacucuaguggcuggg

SEQ ID NO: 1222343 - RNA, 23 nt, Human
cccucucuuuguggccagcacgg

SEQ ID NO: 1222344 - RNA, 27 nt, Human
ccucuugaugagaagcauaguaggaac

SEQ ID NO: 1222345 - RNA, 22 nt, Human
ccuggucucaucuguaaggacu

SEQ ID NO: 1222346 - RNA, 22 nt, Human
cucccuggucucaucuguaagg

SEQ ID NO: 1222347 - RNA, 21 nt, Human
cugccacacuguccagucgua

SEQ ID NO: 1222348 - RNA, 19 nt, Human
gagaaugguguuugugucc

SEQ ID NO: 1222349 - RNA, 18 nt, Human
gaggcaggagggaggugc

SEQ ID NO: 1222350 - RNA, 21 nt, Human
gcacccagaaggacucuagug

SEQ ID NO: 1222351 - RNA, 18 nt, Human
gcuguugaccaacuuucc

SEQ ID NO: 1222352 - RNA, 20 nt, Human
ggacagggugguguggguuu

SEQ ID NO: 1222353 - RNA, 18 nt, Human
ggacauggagcaggcacc

SEQ ID NO: 1222354 - RNA, 22 nt, Human
ggacgugaagcaggcacccaga

SEQ ID NO: 1222355 - RNA, 25 nt, Human
ggcuucuuuuucauuuuuuuuuccu

SEQ ID NO: 1222356 - RNA, 18 nt, Human
gugaagcaggcacccaga

SEQ ID NO: 1222357 - RNA, 23 nt, Human
gugaagcaggcacccagaaggac

SEQ ID NO: 1222358 - RNA, 22 nt, Human
uaacaguuggucauucccaugg

SEQ ID NO: 1222359 - RNA, 24 nt, Human
uacaugucacaauuuucuuuguca

SEQ ID NO: 1222360 - RNA, 23 nt, Human
uaggguauucaauggcuucuuuu

SEQ ID NO: 1222361 - RNA, 21 nt, Human
ucccagagcaucucuccugcc

SEQ ID NO: 1222362 - RNA, 18 nt, Human
ucccugagaacggcgccc

SEQ ID NO: 1222363 - RNA, 23 nt, Human
ucccugagaacggcgcccagucc

SEQ ID NO: 1222364 - RNA, 20 nt, Human
ucguacucaucacugagauc

SEQ ID NO: 1222365 - RNA, 25 nt, Human
ucuccauguucuuuuuccuucagug

SEQ ID NO: 1222366 - RNA, 25 nt, Human
ucucucaugaucaucccucagaagu

SEQ ID NO: 1222367 - RNA, 24 nt, Human
ucuuuuucauuuuuuuuuccuuuu

SEQ ID NO: 1222368 - RNA, 18 nt, Human
ucuuuuuuuuuuuuuuuu

SEQ ID NO: 1222369 - RNA, 23 nt, Human
ucuuuuuuuuuuuuuuuuacuuu

SEQ ID NO: 1222370 - RNA, 25 nt, Human
ucuuuuuuuuuuuuuuuuacuuugg

SEQ ID NO: 1222371 - RNA, 22 nt, Human
ugaagcaggcacccagaaggac

SEQ ID NO: 1222372 - RNA, 23 nt, Human
ugaagcaggcacccagaaggacu

SEQ ID NO: 1222373 - RNA, 23 nt, Human
ugccacacuguccagucguacuc

SEQ ID NO: 1222374 - RNA, 24 nt, Human
ugcccaguccuggucccugagaac

SEQ ID NO: 1222375 - RNA, 20 nt, Human
uggcuggggacgugaagcag

SEQ ID NO: 1222376 - RNA, 18 nt, Human
uggcuuaaaccaggaauu

SEQ ID NO: 1222377 - RNA, 23 nt, Human
ugguuaagaacaaaaagugacaa

SEQ ID NO: 1222378 - RNA, 25 nt, Human
uguauacaauaugcuaacauauaca

SEQ ID NO: 1222379 - RNA, 24 nt, Human
ugucaagacacuggacaggguggu

SEQ ID NO: 1222380 - RNA, 18 nt, Human
ugucauucuccauguucu

SEQ ID NO: 1222381 - RNA, 23 nt, Human
uucauuuuuuuuuccuuuucuuu

SEQ ID NO: 1222382 - RNA, 23 nt, Human
uucuuugucaagacacuggacag

SEQ ID NO: 1222383 - RNA, 25 nt, Human
uucuuuuucauuuuuuuuuccuuuu

SEQ ID NO: 1222384 - RNA, 29 nt, Human
uuucuuuucuuuucuuuuuuuuuuuuuuu

SEQ ID NO: 1222385 - RNA, 18 nt, Human
uuuucaagguuuuaauua

SEQ ID NO: 1222386 - RNA, 22 nt, Human
uuuucuuuucuuuucuuuuuuu

SEQ ID NO: 1222387 - RNA, 22 nt, Human
aaaggaacuuaauugagcaaug

SEQ ID NO: 1222388 - RNA, 21 nt, Human
aacacugcucaccacacuaua

SEQ ID NO: 1222389 - RNA, 21 nt, Human
aagcuuagagaugcaggaacu

SEQ ID NO: 1222390 - RNA, 18 nt, Human
aaguagaaggugagcaag

SEQ ID NO: 1222391 - RNA, 24 nt, Human
agcgcacagccccagccacuccuc

SEQ ID NO: 1222392 - RNA, 19 nt, Human
aggagugagguccagaagc

SEQ ID NO: 1222393 - RNA, 21 nt, Human
aggcugcagcuggaccaggcc

SEQ ID NO: 1222394 - RNA, 22 nt, Human
agggaaugcaguggugcccaga

SEQ ID NO: 1222395 - RNA, 21 nt, Human
cacagccccagccacuccucc

SEQ ID NO: 1222396 - RNA, 22 nt, Human
cacuauaacuccggaggcccua

SEQ ID NO: 1222397 - RNA, 20 nt, Human
cacugcugccaucacagagc

SEQ ID NO: 1222398 - RNA, 22 nt, Human
cagagccccaaagaagggggag

SEQ ID NO: 1222399 - RNA, 21 nt, Human
cagcucagaggagaccugcag

SEQ ID NO: 1222400 - RNA, 19 nt, Human
cagcugugccugggagggc

SEQ ID NO: 1222401 - RNA, 21 nt, Human
cagcugugccugggagggcgg

SEQ ID NO: 1222402 - RNA, 21 nt, Human
caggucccgaguucuuguccu

SEQ ID NO: 1222403 - RNA, 18 nt, Human
ccaaagaaggugucacag

SEQ ID NO: 1222404 - RNA, 21 nt, Human
ccaggcaccggcacaggugcc

SEQ ID NO: 1222405 - RNA, 21 nt, Human
cccagccacuccuccccacag

SEQ ID NO: 1222406 - RNA, 23 nt, Human
cccccccguuccuggcucccacc

SEQ ID NO: 1222407 - RNA, 21 nt, Human
ccggaggcccuagcaguccug

SEQ ID NO: 1222408 - RNA, 19 nt, Human
ccugggagggcggggcucc

SEQ ID NO: 1222409 - RNA, 19 nt, Human
ccuucucucuucucuucuu

SEQ ID NO: 1222410 - RNA, 19 nt, Human
ccuugcaggugccuuucuu

SEQ ID NO: 1222411 - RNA, 18 nt, Human
cggaggcccuagcagucc

SEQ ID NO: 1222412 - RNA, 20 nt, Human
cugcugccaucacagagcag

SEQ ID NO: 1222413 - RNA, 20 nt, Human
cuuguccugaguccaggaag

SEQ ID NO: 1222414 - RNA, 23 nt, Human
gagcaguccuugcaggugccuuu

SEQ ID NO: 1222415 - RNA, 22 nt, Human
gagcuccuaggucugggcuccc

SEQ ID NO: 1222416 - RNA, 20 nt, Human
gcacagccccagccacuccu

SEQ ID NO: 1222417 - RNA, 20 nt, Human
gcacaggugccagcucccug

SEQ ID NO: 1222418 - RNA, 26 nt, Human
gcagagccccaaagaagggggaacgc

SEQ ID NO: 1222419 - RNA, 23 nt, Human
gcucccugaagggccacagcucu

SEQ ID NO: 1222420 - RNA, 23 nt, Human
gcugcagcuggaccaggccgacu

SEQ ID NO: 1222421 - RNA, 20 nt, Human
gcugcagcugugccugggag

SEQ ID NO: 1222422 - RNA, 19 nt, Human
ggcuggauggcugcagcug

SEQ ID NO: 1222423 - RNA, 20 nt, Human
gggagcuccuaggucugggc

SEQ ID NO: 1222424 - RNA, 22 nt, Human
ggguaucagggaaugcaguggu

SEQ ID NO: 1222425 - RNA, 18 nt, Human
ggguggggcucccccccg

SEQ ID NO: 1222426 - RNA, 19 nt, Human
ggucugggcucccugaagg

SEQ ID NO: 1222427 - RNA, 24 nt, Human
uacagcucagaggagaccugcagu

SEQ ID NO: 1222428 - RNA, 21 nt, Human
uagcugugcacacgaugccca

SEQ ID NO: 1222429 - RNA, 20 nt, Human
uccccacagcagccaguguc

SEQ ID NO: 1222430 - RNA, 20 nt, Human
ucccugaagggccacagcuc

SEQ ID NO: 1222431 - RNA, 18 nt, Human
uccugaguccaggaagaa

SEQ ID NO: 1222432 - RNA, 18 nt, Human
uccuggcucccaccagcu

SEQ ID NO: 1222433 - RNA, 18 nt, Human
uccuugcaggugccuuuc

SEQ ID NO: 1222434 - RNA, 22 nt, Human
uccuugcaggugccuuucuugu

SEQ ID NO: 1222435 - RNA, 18 nt, Human
ucuccuucucucuucucu

SEQ ID NO: 1222436 - RNA, 19 nt, Human
ucucucuucucuucuucuc

SEQ ID NO: 1222437 - RNA, 22 nt, Human
ucucucuucucuucuucuugcc

SEQ ID NO: 1222438 - RNA, 22 nt, Human
ucuucucuccuucucucuucuc

SEQ ID NO: 1222439 - RNA, 19 nt, Human
ugaagugaggagugagguc

SEQ ID NO: 1222440 - RNA, 18 nt, Human
ugagagagacgcacggug

SEQ ID NO: 1222441 - RNA, 21 nt, Human
ugagcaaggugaagaggugcu

SEQ ID NO: 1222442 - RNA, 21 nt, Human
ugaguccaggaagaaugaggu

SEQ ID NO: 1222443 - RNA, 24 nt, Human
ugauucacgaaucaggcagccccc

SEQ ID NO: 1222444 - RNA, 20 nt, Human
ugcaguggugcccagaagcu

SEQ ID NO: 1222445 - RNA, 26 nt, Human
ugcccagaagcuuagagaugcaggag

SEQ ID NO: 1222446 - RNA, 19 nt, Human
ugccuuucuuguaccucag

SEQ ID NO: 1222447 - RNA, 20 nt, Human
ugcucaccacacuauaacuc

SEQ ID NO: 1222448 - RNA, 18 nt, Human
uggcugcagcugugccug

SEQ ID NO: 1222449 - RNA, 24 nt, Human
uggcugcagcugugccugggaggg

SEQ ID NO: 1222450 - RNA, 21 nt, Human
uggcuuggggagcuccuaggu

SEQ ID NO: 1222451 - RNA, 21 nt, Human
uggguaucagggaaugcagug

SEQ ID NO: 1222452 - RNA, 19 nt, Human
ugugccugggagggcgggg

SEQ ID NO: 1222453 - RNA, 22 nt, Human
ugugccugggagggcggggcuc

SEQ ID NO: 1222454 - RNA, 18 nt, Human
uuagaagcccuagcaaca

SEQ ID NO: 1222455 - RNA, 22 nt, Human
uuagaagcccuagcaacacugc

SEQ ID NO: 1222456 - RNA, 21 nt, Human
uuccuggcucccaccagcuuc

SEQ ID NO: 1222457 - RNA, 24 nt, Human
aaaaaaaaaaaaaaaaacaaaaaa

SEQ ID NO: 1222458 - RNA, 19 nt, Human
aaaaaaaaaaaaaagaaaa

SEQ ID NO: 1222459 - RNA, 27 nt, Human
aaaaaaacaaaaaacaaaucauucugc

SEQ ID NO: 1222460 - RNA, 27 nt, Human
aaaaaagaauagaaccaaaauagagag

SEQ ID NO: 1222461 - RNA, 18 nt, Human
aaaaagaaaaaagaaaaa

SEQ ID NO: 1222462 - RNA, 19 nt, Human
aaaaagacagacgguucaa

SEQ ID NO: 1222463 - RNA, 20 nt, Human
aaaaagacagacgguucaaa

SEQ ID NO: 1222464 - RNA, 18 nt, Human
aaaauagagagaagagga

SEQ ID NO: 1222465 - RNA, 20 nt, Human
aaagaaggauaacuguaaua

SEQ ID NO: 1222466 - RNA, 24 nt, Human
aaagaauagaaccaaaauagagag

SEQ ID NO: 1222467 - RNA, 22 nt, Human
aaagccucuuccauuauaccaa

SEQ ID NO: 1222468 - RNA, 21 nt, Human
aacaagaaagaaaagaucuga

SEQ ID NO: 1222469 - RNA, 18 nt, Human
aagaaaaaaaaagaauag

SEQ ID NO: 1222470 - RNA, 19 nt, Human
aagaggaagaagaaaaaga

SEQ ID NO: 1222471 - RNA, 27 nt, Human
aagaggaagaagaaaaagaaaagucaa

SEQ ID NO: 1222472 - RNA, 24 nt, Human
aaguaucuccauaaaugcucuucc

SEQ ID NO: 1222473 - RNA, 22 nt, Human
acaacccggcggcggcugcagg

SEQ ID NO: 1222474 - RNA, 25 nt, Human
accaaaauagagagaagaggaagaa

SEQ ID NO: 1222475 - RNA, 21 nt, Human
agaaaaaaaaagaauagaacc

SEQ ID NO: 1222476 - RNA, 19 nt, Human
agaaaaaagaaaaaaaaag

SEQ ID NO: 1222477 - RNA, 27 nt, Human
agaaagagagcgagcuugaaaucccaa

SEQ ID NO: 1222478 - RNA, 24 nt, Human
agagaaguguccaguacaaccugg

SEQ ID NO: 1222479 - RNA, 18 nt, Human
agcuagaccaccauuauu

SEQ ID NO: 1222480 - RNA, 18 nt, Human
aggaagaagaaaaagaaa

SEQ ID NO: 1222481 - RNA, 24 nt, Human
aguguccaguacaaccuggacaac

SEQ ID NO: 1222482 - RNA, 24 nt, Human
caaaaaaaaaaaaaaaaacaaaaa

SEQ ID NO: 1222483 - RNA, 18 nt, Human
caaacacucaagcaugcg

SEQ ID NO: 1222484 - RNA, 20 nt, Human
caacccggcggcggcugcag

SEQ ID NO: 1222485 - RNA, 22 nt, Human
caagaaagaaaagaucugauuc

SEQ ID NO: 1222486 - RNA, 21 nt, Human
caagaaauccuccaaaaggca

SEQ ID NO: 1222487 - RNA, 19 nt, Human
caaucacauaaaacaauca

SEQ ID NO: 1222488 - RNA, 24 nt, Human
cacaaaaaaaaaaaaaaaaaaaaa

SEQ ID NO: 1222489 - RNA, 18 nt, Human
cacagcacaaaccaggug

SEQ ID NO: 1222490 - RNA, 23 nt, Human
cacauuacacugagcagugacca

SEQ ID NO: 1222491 - RNA, 22 nt, Human
cacugcaaucgcacaaagaagg

SEQ ID NO: 1222492 - RNA, 24 nt, Human
cagcacaaaccagguguuuccauu

SEQ ID NO: 1222493 - RNA, 18 nt, Human
cagcccacugcaaucgca

SEQ ID NO: 1222494 - RNA, 20 nt, Human
cagguguuuccauucagccc

SEQ ID NO: 1222495 - RNA, 18 nt, Human
cauaaaacaaucaggaaa

SEQ ID NO: 1222496 - RNA, 19 nt, Human
cauaaaacaaucaggaaag

SEQ ID NO: 1222497 - RNA, 22 nt, Human
cauaauacaucuggaaaaaaac

SEQ ID NO: 1222498 - RNA, 22 nt, Human
cauucugcacauuacacugagc

SEQ ID NO: 1222499 - RNA, 24 nt, Human
ccaaaauagagagaagaggaagaa

SEQ ID NO: 1222500 - RNA, 21 nt, Human
ccaagguaacaagaaagaaaa

SEQ ID NO: 1222501 - RNA, 22 nt, Human
ccaccacaaaaaaaaaaaaaaa

SEQ ID NO: 1222502 - RNA, 19 nt, Human
cccacagaacagccagguc

SEQ ID NO: 1222503 - RNA, 23 nt, Human
cccacagaacagccaggucucca

SEQ ID NO: 1222504 - RNA, 21 nt, Human
cccacugcaaucgcacaaaga

SEQ ID NO: 1222505 - RNA, 20 nt, Human
ccggcggcggcugcaggcuu

SEQ ID NO: 1222506 - RNA, 21 nt, Human
ccuccaaaaggcacuuagcuc

SEQ ID NO: 1222507 - RNA, 25 nt, Human
cuauacauaguacaaaguucauaca

SEQ ID NO: 1222508 - RNA, 21 nt, Human
cuccaaaaggcacuuagcucc

SEQ ID NO: 1222509 - RNA, 21 nt, Human
cuccaacccuaacccuggaca

SEQ ID NO: 1222510 - RNA, 20 nt, Human
cuccaagguaacaagaaaga

SEQ ID NO: 1222511 - RNA, 22 nt, Human
cucuuccaagaaauccuccaaa

SEQ ID NO: 1222512 - RNA, 18 nt, Human
gaaaaaaaccgaagagua

SEQ ID NO: 1222513 - RNA, 19 nt, Human
gaagaaaaagaaaaguccu

SEQ ID NO: 1222514 - RNA, 22 nt, Human
gacagucugaggcacaacccgg

SEQ ID NO: 1222515 - RNA, 22 nt, Human
gagcagugaccaccacaaaaaa

SEQ ID NO: 1222516 - RNA, 19 nt, Human
gaggaagaagaaaaagaaa

SEQ ID NO: 1222517 - RNA, 23 nt, Human
ggacuguuuuuuuuucaagaggc

SEQ ID NO: 1222518 - RNA, 24 nt, Human
ggauuuuauuuuuuaaagaagugg

SEQ ID NO: 1222519 - RNA, 22 nt, Human
uaaaacaaucaggaaaggggug

SEQ ID NO: 1222520 - RNA, 20 nt, Human
uaacaagaaagaaaagaucu

SEQ ID NO: 1222521 - RNA, 18 nt, Human
uacaucuggaaaaaaacc

SEQ ID NO: 1222522 - RNA, 20 nt, Human
ucaaaguucagaggguggca

SEQ ID NO: 1222523 - RNA, 19 nt, Human
uccaacccuaacccuggac

SEQ ID NO: 1222524 - RNA, 22 nt, Human
uccaacccuaacccuggacaac

SEQ ID NO: 1222525 - RNA, 18 nt, Human
uccaagaaauccuccaaa

SEQ ID NO: 1222526 - RNA, 20 nt, Human
uccaagguaacaagaaagaa

SEQ ID NO: 1222527 - RNA, 23 nt, Human
ucugaggcacaacccggcggcgg

SEQ ID NO: 1222528 - RNA, 21 nt, Human
ugaaggaccaaaaaaaaaaaa

SEQ ID NO: 1222529 - RNA, 28 nt, Human
ugaccaccacaaaaaaaaaaaaaaaaaa

SEQ ID NO: 1222530 - RNA, 23 nt, Human
ugagcagugaccaccacaaaaaa

SEQ ID NO: 1222531 - RNA, 24 nt, Human
ugcacauuacacugagcagugacc

SEQ ID NO: 1222532 - RNA, 19 nt, Human
ugcauugaauuguuucacc

SEQ ID NO: 1222533 - RNA, 21 nt, Human
ugcccuuacuuaaaaagacag

SEQ ID NO: 1222534 - RNA, 21 nt, Human
ugcuagggagccuccuugagg

SEQ ID NO: 1222535 - RNA, 24 nt, Human
uggaaaaaaaccgaagaguauacc

SEQ ID NO: 1222536 - RNA, 27 nt, Human
uggaaaaaaaccgaagaguauacccug

SEQ ID NO: 1222537 - RNA, 21 nt, Human
uugcuagggagccuccuugag

SEQ ID NO: 1222538 - RNA, 23 nt, Human
cauuuaaagauaauauccaaugc

SEQ ID NO: 1222539 - RNA, 22 nt, Human
ggcuggaaaaguucuggagaac

SEQ ID NO: 1222540 - RNA, 23 nt, Human
ucuuccagacucucuaggcauca

SEQ ID NO: 1222541 - RNA, 19 nt, Human
ugccuccaaguucccaccc

SEQ ID NO: 1222542 - RNA, 21 nt, Human
uggaaaaguucuggagaacau

SEQ ID NO: 1222543 - RNA, 19 nt, Human
aagcagggacacaaaggca

SEQ ID NO: 1222544 - RNA, 22 nt, Human
acgugucuuuccgggccugggc

SEQ ID NO: 1222545 - RNA, 18 nt, Human
acuguccagaaccagccc

SEQ ID NO: 1222546 - RNA, 18 nt, Human
agaaccagcccacggcca

SEQ ID NO: 1222547 - RNA, 24 nt, Human
aguccucugcacaaguucagagag

SEQ ID NO: 1222548 - RNA, 24 nt, Human
cacaaaggcaaucaagugcauagc

SEQ ID NO: 1222549 - RNA, 19 nt, Human
cagaaccagcccacggcca

SEQ ID NO: 1222550 - RNA, 19 nt, Human
ccgggccugggcgucucag

SEQ ID NO: 1222551 - RNA, 21 nt, Human
ccuuccggacaggacagaagu

SEQ ID NO: 1222552 - RNA, 18 nt, Human
cgagcuggauccacccuu

SEQ ID NO: 1222553 - RNA, 27 nt, Human
cgucagaaagggauccccuuugggcga

SEQ ID NO: 1222554 - RNA, 18 nt, Human
cucgagcuggauccaccc

SEQ ID NO: 1222555 - RNA, 21 nt, Human
cuucaaaaggugaagcaggga

SEQ ID NO: 1222556 - RNA, 23 nt, Human
cuuucuuucccgucagaaaggga

SEQ ID NO: 1222557 - RNA, 20 nt, Human
gaccuccagaggagguuagg

SEQ ID NO: 1222558 - RNA, 20 nt, Human
ggacaggacucaccgccuuu

SEQ ID NO: 1222559 - RNA, 19 nt, Human
ggccugggcgucucaggag

SEQ ID NO: 1222560 - RNA, 19 nt, Human
ggccugggcgucucaggag

SEQ ID NO: 1222561 - RNA, 24 nt, Human
guagggagggcucagucaguuuuu

SEQ ID NO: 1222562 - RNA, 22 nt, Human
gucaguuuuugguaauagguga

SEQ ID NO: 1222563 - RNA, 21 nt, Human
uaaacuguccagaaccagccc

SEQ ID NO: 1222564 - RNA, 22 nt, Human
uaaacuguccagaaccagccca

SEQ ID NO: 1222565 - RNA, 21 nt, Human
ucaaaaggugaagcagggaca

SEQ ID NO: 1222566 - RNA, 19 nt, Human
ucacaggauuuuucuuguc

SEQ ID NO: 1222567 - RNA, 23 nt, Human
ucccuuccggacaggacagaagu

SEQ ID NO: 1222568 - RNA, 19 nt, Human
ucuguaaacuguccagaac

SEQ ID NO: 1222569 - RNA, 21 nt, Human
ucuuaccaagagaaaacuacu

SEQ ID NO: 1222570 - RNA, 18 nt, Human
ugagcagaugguuucccc

SEQ ID NO: 1222571 - RNA, 23 nt, Human
uggcuuguguagggagggcucag

SEQ ID NO: 1222572 - RNA, 18 nt, Human
uguccagaaccagcccac

SEQ ID NO: 1222573 - RNA, 21 nt, Human
aagugcuuagagaucugaagc

SEQ ID NO: 1222574 - RNA, 19 nt, Human
accagacacaggagcauca

SEQ ID NO: 1222575 - RNA, 21 nt, Human
agagcacuaccagaagccucc

SEQ ID NO: 1222576 - RNA, 21 nt, Human
agcccaggaaggagggggaag

SEQ ID NO: 1222577 - RNA, 22 nt, Human
aggaaggagggggaaggugagg

SEQ ID NO: 1222578 - RNA, 20 nt, Human
aggagggggaaggugagggc

SEQ ID NO: 1222579 - RNA, 20 nt, Human
aggcaucaagaccaggggug

SEQ ID NO: 1222580 - RNA, 18 nt, Human
caagagcacuaccagaag

SEQ ID NO: 1222581 - RNA, 23 nt, Human
caagccagguaaacagaaggaag

SEQ ID NO: 1222582 - RNA, 22 nt, Human
cacaacaucccugugagguagg

SEQ ID NO: 1222583 - RNA, 20 nt, Human
cagacacaggagcaucaaga

SEQ ID NO: 1222584 - RNA, 25 nt, Human
cagaggggacccagaaaugcugggc

SEQ ID NO: 1222585 - RNA, 19 nt, Human
caggcucaacagccacccc

SEQ ID NO: 1222586 - RNA, 19 nt, Human
caucaagaccaggggugcc

SEQ ID NO: 1222587 - RNA, 23 nt, Human
ccagaagccucccugcucucuga

SEQ ID NO: 1222588 - RNA, 18 nt, Human
ccaggaaggagggggaag

SEQ ID NO: 1222589 - RNA, 21 nt, Human
ccagguaaacagaaggaaggg

SEQ ID NO: 1222590 - RNA, 23 nt, Human
cccacagugccuucccauucugu

SEQ ID NO: 1222591 - RNA, 22 nt, Human
cccccuguaggccaagccaggu

SEQ ID NO: 1222592 - RNA, 21 nt, Human
ccuucccacagugccuuccca

SEQ ID NO: 1222593 - RNA, 24 nt, Human
cguggcccgcgggcccguacacuc

SEQ ID NO: 1222594 - RNA, 18 nt, Human
cucagugcccacucccag

SEQ ID NO: 1222595 - RNA, 19 nt, Human
cugacugacucagccugca

SEQ ID NO: 1222596 - RNA, 23 nt, Human
cugagcuugcagaggggacccag

SEQ ID NO: 1222597 - RNA, 22 nt, Human
cugcagcccaggaaggaggggg

SEQ ID NO: 1222598 - RNA, 22 nt, Human
gagcaucaagagcacuaccaga

SEQ ID NO: 1222599 - RNA, 23 nt, Human
gcccguacacuccagcugcccga

SEQ ID NO: 1222600 - RNA, 18 nt, Human
ggaagggcaggaguacug

SEQ ID NO: 1222601 - RNA, 19 nt, Human
ggacucagugcccacuccc

SEQ ID NO: 1222602 - RNA, 21 nt, Human
ggccguggcccgcgggcccgg

SEQ ID NO: 1222603 - RNA, 20 nt, Human
gggacccagaaaugcugggc

SEQ ID NO: 1222604 - RNA, 19 nt, Human
uaaacagaaggaagggcag

SEQ ID NO: 1222605 - RNA, 20 nt, Human
ucaagagcacuaccagaagc

SEQ ID NO: 1222606 - RNA, 22 nt, Human
ucucugagcuugcagaggggac

SEQ ID NO: 1222607 - RNA, 21 nt, Human
ugcaaggcguggcuagcagca

SEQ ID NO: 1222608 - RNA, 23 nt, Human
uggcuagcagcaagauuccugac

SEQ ID NO: 1222609 - RNA, 24 nt, Human
uguucccuacauaucuugaccuuu

SEQ ID NO: 1222610 - RNA, 20 nt, Human
uuccugacuuccuucccaca

SEQ ID NO: 1222611 - RNA, 18 nt, Human
uugaccuuugucaggugc

SEQ ID NO: 1222612 - RNA, 21 nt, Human
uugugccaaccagacacagga

SEQ ID NO: 1222613 - RNA, 25 nt, Human
uuuccaauuccuauuaacauucauu

SEQ ID NO: 1222614 - RNA, 23 nt, Human
aaacaacaacuuuaucuucacug

SEQ ID NO: 1222615 - RNA, 21 nt, Human
acgaacauaagaaaagcuacc

SEQ ID NO: 1222616 - RNA, 21 nt, Human
cagcacgaacauaagaaaagc

SEQ ID NO: 1222617 - RNA, 19 nt, Human
uauggcaccagcagcacga

SEQ ID NO: 1222618 - RNA, 23 nt, Human
aaacacacuggugauauagacaa

SEQ ID NO: 1222619 - RNA, 18 nt, Human
aaagaacuuguuccacug

SEQ ID NO: 1222620 - RNA, 19 nt, Human
aaagaacuuguuccacugg

SEQ ID NO: 1222621 - RNA, 23 nt, Human
aacaagacggaagggcugggcgc

SEQ ID NO: 1222622 - RNA, 22 nt, Human
accgaagcgccggaggacccgg

SEQ ID NO: 1222623 - RNA, 22 nt, Human
acggaagggcugggcgcugagg

SEQ ID NO: 1222624 - RNA, 19 nt, Human
acuccagccugagacacag

SEQ ID NO: 1222625 - RNA, 24 nt, Human
acuccagccugagacacagaguga

SEQ ID NO: 1222626 - RNA, 25 nt, Human
acuggugauauagacaauucuccuc

SEQ ID NO: 1222627 - RNA, 18 nt, Human
acuguacuccagccugag

SEQ ID NO: 1222628 - RNA, 24 nt, Human
acuguacuccagccugagacacag

SEQ ID NO: 1222629 - RNA, 24 nt, Human
acuuugagaaagacuguucuagag

SEQ ID NO: 1222630 - RNA, 19 nt, Human
agaaagacuguucuagagu

SEQ ID NO: 1222631 - RNA, 18 nt, Human
agaccgaagcgccggagg

SEQ ID NO: 1222632 - RNA, 23 nt, Human
agacuuuuaucuguaaucuccuu

SEQ ID NO: 1222633 - RNA, 21 nt, Human
agcgccagaggaggacaagcc

SEQ ID NO: 1222634 - RNA, 24 nt, Human
aggaggacaagccgaacccuucag

SEQ ID NO: 1222635 - RNA, 21 nt, Human
aggaggucgagggcugcagcc

SEQ ID NO: 1222636 - RNA, 22 nt, Human
aggaucacuugagcccaggagg

SEQ ID NO: 1222637 - RNA, 18 nt, Human
aggcaggaggaucacuug

SEQ ID NO: 1222638 - RNA, 23 nt, Human
aggcaggaggaucacuugagccc

SEQ ID NO: 1222639 - RNA, 24 nt, Human
aggcaggaggaucacuugagccca

SEQ ID NO: 1222640 - RNA, 24 nt, Human
aggcuaaggcaggaggaucacuug

SEQ ID NO: 1222641 - RNA, 18 nt, Human
auucacaggcuccucuua

SEQ ID NO: 1222642 - RNA, 26 nt, Human
caauggacuuuucaucacagguagcu

SEQ ID NO: 1222643 - RNA, 19 nt, Human
cacacuggugauauagaca

SEQ ID NO: 1222644 - RNA, 22 nt, Human
cacagguagcuugaggcaugag

SEQ ID NO: 1222645 - RNA, 20 nt, Human
caccacuguacuccagccug

SEQ ID NO: 1222646 - RNA, 18 nt, Human
cacuguacuccagccuga

SEQ ID NO: 1222647 - RNA, 19 nt, Human
cacuguacuccagccugag

SEQ ID NO: 1222648 - RNA, 19 nt, Human
cacuguacuccagccugag

SEQ ID NO: 1222649 - RNA, 22 nt, Human
cacuguacuccagccugagaca

SEQ ID NO: 1222650 - RNA, 18 nt, Human
ccaaaggcuucacauggc

SEQ ID NO: 1222651 - RNA, 25 nt, Human
ccaaaggcuucacauggcucuccag

SEQ ID NO: 1222652 - RNA, 19 nt, Human
ccacuguacuccagccuga

SEQ ID NO: 1222653 - RNA, 20 nt, Human
ccacuguacuccagccugag

SEQ ID NO: 1222654 - RNA, 20 nt, Human
ccacuguacuccagccugag

SEQ ID NO: 1222655 - RNA, 22 nt, Human
ccacuguacuccagccugagac

SEQ ID NO: 1222656 - RNA, 24 nt, Human
cgagaggcuaaggcaggaggauca

SEQ ID NO: 1222657 - RNA, 20 nt, Human
cuaggcugggugugguggug

SEQ ID NO: 1222658 - RNA, 23 nt, Human
cucugaauucacaggcuccucuu

SEQ ID NO: 1222659 - RNA, 18 nt, Human
cuguacucccagcuacuc

SEQ ID NO: 1222660 - RNA, 19 nt, Human
cuguacucccagcuacucg

SEQ ID NO: 1222661 - RNA, 22 nt, Human
cuucaggaggccgggcgucucc

SEQ ID NO: 1222662 - RNA, 18 nt, Human
cuuugagaaagacuguuc

SEQ ID NO: 1222663 - RNA, 24 nt, Human
gaucacuugagcccaggaggucga

SEQ ID NO: 1222664 - RNA, 20 nt, Human
gcccaggaggucgagggcug

SEQ ID NO: 1222665 - RNA, 20 nt, Human
gcugggugugguggugugca

SEQ ID NO: 1222666 - RNA, 22 nt, Human
ggacaagccgaacccuucagga

SEQ ID NO: 1222667 - RNA, 21 nt, Human
ggagcugagcgccagaggagg

SEQ ID NO: 1222668 - RNA, 26 nt, Human
ggcugcagccaucuacaauugcacca

SEQ ID NO: 1222669 - RNA, 24 nt, Human
guacuccagccugagacacagagu

SEQ ID NO: 1222670 - RNA, 20 nt, Human
uaaggcaggaggaucacuug

SEQ ID NO: 1222671 - RNA, 22 nt, Human
uaaggcaggaggaucacuugag

SEQ ID NO: 1222672 - RNA, 24 nt, Human
uaaggcaggaggaucacuugagcc

SEQ ID NO: 1222673 - RNA, 27 nt, Human
uaauccucaggacagaucuaccagaca

SEQ ID NO: 1222674 - RNA, 22 nt, Human
uacuccagccugagacacagag

SEQ ID NO: 1222675 - RNA, 23 nt, Human
uacuccagccugagacacagagu

SEQ ID NO: 1222676 - RNA, 24 nt, Human
uacuccagccugagacacagagug

SEQ ID NO: 1222677 - RNA, 23 nt, Human
uagcuguaaccaaauaucaacaa

SEQ ID NO: 1222678 - RNA, 22 nt, Human
uaggcugggugugguggugugc

SEQ ID NO: 1222679 - RNA, 19 nt, Human
ucagggaccucagaaagaa

SEQ ID NO: 1222680 - RNA, 18 nt, Human
ucaguaccuggauggguc

SEQ ID NO: 1222681 - RNA, 23 nt, Human
uccagccugagacacagagugag

SEQ ID NO: 1222682 - RNA, 24 nt, Human
uccagccugagacacagagugaga

SEQ ID NO: 1222683 - RNA, 23 nt, Human
ucccagaagaccgcaucaguacc

SEQ ID NO: 1222684 - RNA, 20 nt, Human
ugauauagacaauucuccuc

SEQ ID NO: 1222685 - RNA, 21 nt, Human
ugcaccacuguacuccagccu

SEQ ID NO: 1222686 - RNA, 22 nt, Human
ugcaccacuguacuccagccug

SEQ ID NO: 1222687 - RNA, 20 nt, Human
ugcaucuguacucccagcua

SEQ ID NO: 1222688 - RNA, 21 nt, Human
ugccucugaauucacaggcuc

SEQ ID NO: 1222689 - RNA, 23 nt, Human
uggcagacaauggacuuuucauc

SEQ ID NO: 1222690 - RNA, 24 nt, Human
ugucuaaaaguagcuguaaccaaa

SEQ ID NO: 1222691 - RNA, 21 nt, Human
uucauucuaggcugggugugg

SEQ ID NO: 1222692 - RNA, 23 nt, Human
uugaauugucucaguaaaccagu

SEQ ID NO: 1222693 - RNA, 24 nt, Human
uugccucugaauucacaggcuccu

SEQ ID NO: 1222694 - RNA, 23 nt, Human
aaaacaaaacaaaacaaaaaaaa

SEQ ID NO: 1222695 - RNA, 23 nt, Human
aaacaaaaaaaaggguaacaggg

SEQ ID NO: 1222696 - RNA, 19 nt, Human
aaacaaaacaaaacaaaaa

SEQ ID NO: 1222697 - RNA, 24 nt, Human
aaaccggucucucccaagguugcc

SEQ ID NO: 1222698 - RNA, 25 nt, Human
aacaaaacaaaaaaaaggguaacag

SEQ ID NO: 1222699 - RNA, 22 nt, Human
aacaaagcggggaaugcccaga

SEQ ID NO: 1222700 - RNA, 21 nt, Human
aacacagcgagacucccucuc

SEQ ID NO: 1222701 - RNA, 20 nt, Human
aacaugaugaaacccugucu

SEQ ID NO: 1222702 - RNA, 21 nt, Human
aacaugaugaaacccugucuu

SEQ ID NO: 1222703 - RNA, 21 nt, Human
aacgugaagccuucauagagc

SEQ ID NO: 1222704 - RNA, 20 nt, Human
aagggucacuucacaaauca

SEQ ID NO: 1222705 - RNA, 24 nt, Human
aaucacuugaacccaguaggcgga

SEQ ID NO: 1222706 - RNA, 25 nt, Human
acaaaacaaaaaaaaggguaacaac

SEQ ID NO: 1222707 - RNA, 24 nt, Human
acaaaacaaaacaaaaaaaagggu

SEQ ID NO: 1222708 - RNA, 25 nt, Human
acaaaacaaaacaaaaaaaagggua

SEQ ID NO: 1222709 - RNA, 19 nt, Human
acaagcaguucaccaagaa

SEQ ID NO: 1222710 - RNA, 24 nt, Human
acacagcgagacucccucucaaaa

SEQ ID NO: 1222711 - RNA, 20 nt, Human
acaccacugcacuccagccu

SEQ ID NO: 1222712 - RNA, 24 nt, Human
acaccacugcacuccagccuggac

SEQ ID NO: 1222713 - RNA, 27 nt, Human
acaccacugcacuccagccuggacaac

SEQ ID NO: 1222714 - RNA, 21 nt, Human
acaugggccauggcugaaggc

SEQ ID NO: 1222715 - RNA, 24 nt, Human
acccugucuuuacuaaaaauacaa

SEQ ID NO: 1222716 - RNA, 21 nt, Human
acccuuuccagcucucugcuc

SEQ ID NO: 1222717 - RNA, 23 nt, Human
acugcacuccagccuggacaaca

SEQ ID NO: 1222718 - RNA, 26 nt, Human
acugcacuccagccuggacaacacag

SEQ ID NO: 1222719 - RNA, 19 nt, Human
agaaaggggugggccacuu

SEQ ID NO: 1222720 - RNA, 20 nt, Human
agaacuuugggaggcugagg

SEQ ID NO: 1222721 - RNA, 20 nt, Human
agacagaaagagaaugggua

SEQ ID NO: 1222722 - RNA, 18 nt, Human
agccaggcgugauggugu

SEQ ID NO: 1222723 - RNA, 22 nt, Human
agccuggacaacacagcgagac

SEQ ID NO: 1222724 - RNA, 24 nt, Human
agccuggacaacacagcgagacuc

SEQ ID NO: 1222725 - RNA, 23 nt, Human
aggagagugaggaaagaccuggg

SEQ ID NO: 1222726 - RNA, 18 nt, Human
aggcaagagaaucacuug

SEQ ID NO: 1222727 - RNA, 24 nt, Human
aggcaagagaaucacuugaaccca

SEQ ID NO: 1222728 - RNA, 22 nt, Human
aggcacccaccacaaucccccc

SEQ ID NO: 1222729 - RNA, 24 nt, Human
aggcggagguugcaguaagccgag

SEQ ID NO: 1222730 - RNA, 22 nt, Human
aggcgggcggaucgccugaggu

SEQ ID NO: 1222731 - RNA, 26 nt, Human
aggcgggcggaucgccugaggucagg

SEQ ID NO: 1222732 - RNA, 20 nt, Human
aggcugaggcgggcggaucg

SEQ ID NO: 1222733 - RNA, 24 nt, Human
aggcugaggcgggcggaucgccug

SEQ ID NO: 1222734 - RNA, 22 nt, Human
agggugugugagugugugugug

SEQ ID NO: 1222735 - RNA, 23 nt, Human
agugaggaaagaccugggagagg

SEQ ID NO: 1222736 - RNA, 22 nt, Human
auaaacccgcauugcaucccuc

SEQ ID NO: 1222737 - RNA, 24 nt, Human
aucacaccacugcacuccagccug

SEQ ID NO: 1222738 - RNA, 24 nt, Human
aucgccugaggucaggaguuugag

SEQ ID NO: 1222739 - RNA, 21 nt, Human
augaaacccugucuuuacuaa

SEQ ID NO: 1222740 - RNA, 19 nt, Human
augaaagacauuuggggac

SEQ ID NO: 1222741 - RNA, 24 nt, Human
auuaaccacaaaacaugacccacg

SEQ ID NO: 1222742 - RNA, 22 nt, Human
caaaacaaaaaaaaggguaaca

SEQ ID NO: 1222743 - RNA, 21 nt, Human
caaaacaaaacaaaacaaaaa

SEQ ID NO: 1222744 - RNA, 24 nt, Human
caacaugaugaaacccugucuuua

SEQ ID NO: 1222745 - RNA, 22 nt, Human
caacgauauccaaagucucuga

SEQ ID NO: 1222746 - RNA, 19 nt, Human
caagcaguucaccaagaac

SEQ ID NO: 1222747 - RNA, 22 nt, Human
caagucucgaaugccccaggaa

SEQ ID NO: 1222748 - RNA, 21 nt, Human
cacaccacugcacuccagccu

SEQ ID NO: 1222749 - RNA, 24 nt, Human
cacacuuguaaucccagaacuuug

SEQ ID NO: 1222750 - RNA, 19 nt, Human
caccaagaacagggcaacg

SEQ ID NO: 1222751 - RNA, 19 nt, Human
caccaagaacagggcaacu

SEQ ID NO: 1222752 - RNA, 25 nt, Human
caccacaauccccccagggaguaaa

SEQ ID NO: 1222753 - RNA, 25 nt, Human
caccaggaaaaguuuggaagccucc

SEQ ID NO: 1222754 - RNA, 18 nt, Human
cacugcacuccagccugg

SEQ ID NO: 1222755 - RNA, 19 nt, Human
cacugcacuccagccugga

SEQ ID NO: 1222756 - RNA, 21 nt, Human
cacugcacuccagccuggaca

SEQ ID NO: 1222757 - RNA, 24 nt, Human
cacugcacuccagccuggacaaca

SEQ ID NO: 1222758 - RNA, 25 nt, Human
cacugcacuccagccuggacaacaa

SEQ ID NO: 1222759 - RNA, 23 nt, Human
cacuuguaaucccagaacuuugg

SEQ ID NO: 1222760 - RNA, 24 nt, Human
cacuuguaaucccagaacuuuggg

SEQ ID NO: 1222761 - RNA, 21 nt, Human
cagaaagagaauggguagagg

SEQ ID NO: 1222762 - RNA, 24 nt, Human
cagaacuuugggaggcugaggcgg

SEQ ID NO: 1222763 - RNA, 20 nt, Human
caggcacccaccacaauccc

SEQ ID NO: 1222764 - RNA, 18 nt, Human
caguaggcggagguugca

SEQ ID NO: 1222765 - RNA, 22 nt, Human
caguucaccaagaacagggcaa

SEQ ID NO: 1222766 - RNA, 23 nt, Human
caguucaccaagaacagggcaac

SEQ ID NO: 1222767 - RNA, 21 nt, Human
ccaacaugaugaaacccuguc

SEQ ID NO: 1222768 - RNA, 22 nt, Human
ccacagccaacuauaaacccgc

SEQ ID NO: 1222769 - RNA, 19 nt, Human
ccacugcacuccagccugg

SEQ ID NO: 1222770 - RNA, 19 nt, Human
ccacugcacuccagccugg

SEQ ID NO: 1222771 - RNA, 20 nt, Human
ccacugcacuccagccugga

SEQ ID NO: 1222772 - RNA, 21 nt, Human
ccacugcacuccagccuggac

SEQ ID NO: 1222773 - RNA, 22 nt, Human
ccacugcacuccagccuggaca

SEQ ID NO: 1222774 - RNA, 18 nt, Human
ccagccaggccaacauga

SEQ ID NO: 1222775 - RNA, 24 nt, Human
ccaggccaacaugaugaaacccug

SEQ ID NO: 1222776 - RNA, 24 nt, Human
ccaggccaacaugaugaaacccug

SEQ ID NO: 1222777 - RNA, 21 nt, Human
cccacagccaacuauaaaccc

SEQ ID NO: 1222778 - RNA, 19 nt, Human
cccaccacaauccccccag

SEQ ID NO: 1222779 - RNA, 23 nt, Human
ccccacagccaacuauaaacccg

SEQ ID NO: 1222780 - RNA, 22 nt, Human
ccccggugcucugcacuguccc

SEQ ID NO: 1222781 - RNA, 21 nt, Human
cccgcauugcaucccucaccc

SEQ ID NO: 1222782 - RNA, 22 nt, Human
ccugaggucaggaguuugagac

SEQ ID NO: 1222783 - RNA, 24 nt, Human
cgagaucacaccacugcacuccag

SEQ ID NO: 1222784 - RNA, 24 nt, Human
cgcaugcacuuucucucucuaccu

SEQ ID NO: 1222785 - RNA, 20 nt, Human
cgcauugcaucccucacccc

SEQ ID NO: 1222786 - RNA, 23 nt, Human
cgccugaggucaggaguuugaga

SEQ ID NO: 1222787 - RNA, 23 nt, Human
cgcgcacaccagcaaucagugug

SEQ ID NO: 1222788 - RNA, 24 nt, Human
cggaucgccugaggucaggaguuu

SEQ ID NO: 1222789 - RNA, 24 nt, Human
cgggcggaucgccugaggucagga

SEQ ID NO: 1222790 - RNA, 25 nt, Human
cucaaaacaaaacaaaacaaaaaaa

SEQ ID NO: 1222791 - RNA, 23 nt, Human
cucccaagguugccuaauuuucu

SEQ ID NO: 1222792 - RNA, 20 nt, Human
cugucuggugcggggggggg

SEQ ID NO: 1222793 - RNA, 24 nt, Human
cuuggggcagugcgcuggugggag

SEQ ID NO: 1222794 - RNA, 26 nt, Human
cuuuugguccuaacaagcaguucacc

SEQ ID NO: 1222795 - RNA, 23 nt, Human
gaaaauaauuucucugcaacaaa

SEQ ID NO: 1222796 - RNA, 24 nt, Human
gaacagggcaacggcuaaaagaag

SEQ ID NO: 1222797 - RNA, 22 nt, Human
gaccugcagcuuacuccuucga

SEQ ID NO: 1222798 - RNA, 22 nt, Human
gacgaaggagagugaggaaaga

SEQ ID NO: 1222799 - RNA, 22 nt, Human
gagguugcaguaagccgagauc

SEQ ID NO: 1222800 - RNA, 24 nt, Human
gaucgccugaggucaggaguuuga

SEQ ID NO: 1222801 - RNA, 24 nt, Human
gauggugucuaccuguaaucccag

SEQ ID NO: 1222802 - RNA, 22 nt, Human
gcaagagaaucacuugaaccca

SEQ ID NO: 1222803 - RNA, 23 nt, Human
gcacuccagccuggacaacacag

SEQ ID NO: 1222804 - RNA, 23 nt, Human
gccaacaugaugaaacccugucu

SEQ ID NO: 1222805 - RNA, 23 nt, Human
gcccagagaagagaaggcgccuc

SEQ ID NO: 1222806 - RNA, 20 nt, Human
gccgagaucacaccacugca

SEQ ID NO: 1222807 - RNA, 24 nt, Human
gccugaggucaggaguuugagacc

SEQ ID NO: 1222808 - RNA, 20 nt, Human
gccuggacaacacagcgaga

SEQ ID NO: 1222809 - RNA, 18 nt, Human
ggaauuaaccacaaaaca

SEQ ID NO: 1222810 - RNA, 18 nt, Human
ggacacccuuuccagcuc

SEQ ID NO: 1222811 - RNA, 25 nt, Human
ggagaaagagggaaagacgaaggag

SEQ ID NO: 1222812 - RNA, 18 nt, Human
ggagguugcaguaagccg

SEQ ID NO: 1222813 - RNA, 24 nt, Human
ggagguugcaguaagccgagauca

SEQ ID NO: 1222814 - RNA, 22 nt, Human
ggaucgccugaggucaggaguu

SEQ ID NO: 1222815 - RNA, 27 nt, Human
ggccaggcacccaccacaaucccccca

SEQ ID NO: 1222816 - RNA, 18 nt, Human
gggacaaaggucaaaaac

SEQ ID NO: 1222817 - RNA, 19 nt, Human
gggagauugaggcaagaga

SEQ ID NO: 1222818 - RNA, 20 nt, Human
gggagguugggcacgguggu

SEQ ID NO: 1222819 - RNA, 21 nt, Human
gggcagugcgcuggugggaga

SEQ ID NO: 1222820 - RNA, 25 nt, Human
ggggaaugcccagagaagagaaggc

SEQ ID NO: 1222821 - RNA, 20 nt, Human
ggggucugcguccaggaugu

SEQ ID NO: 1222822 - RNA, 18 nt, Human
gggguugggcugcugggg

SEQ ID NO: 1222823 - RNA, 19 nt, Human
ggucaggaguuugagacca

SEQ ID NO: 1222824 - RNA, 21 nt, Human
ggugacugcauccaggaagga

SEQ ID NO: 1222825 - RNA, 19 nt, Human
ggugcggggggggguuggg

SEQ ID NO: 1222826 - RNA, 20 nt, Human
ggugcggggggggguugggc

SEQ ID NO: 1222827 - RNA, 23 nt, Human
ggugguucacacuuguaauccca

SEQ ID NO: 1222828 - RNA, 24 nt, Human
ggugguucacacuuguaaucccag

SEQ ID NO: 1222829 - RNA, 21 nt, Human
ggugucuaccuguaaucccag

SEQ ID NO: 1222830 - RNA, 21 nt, Human
gguucacacuuguaaucccag

SEQ ID NO: 1222831 - RNA, 24 nt, Human
guagaaaauaauuucucugcaaca

SEQ ID NO: 1222832 - RNA, 21 nt, Human
guggagcggguuugcaaaucu

SEQ ID NO: 1222833 - RNA, 23 nt, Human
gugguucacacuuguaaucccag

SEQ ID NO: 1222834 - RNA, 19 nt, Human
gugugugagugugugugug

SEQ ID NO: 1222835 - RNA, 21 nt, Human
uaaaaauacaaaaauuagcca

SEQ ID NO: 1222836 - RNA, 23 nt, Human
uaacaagcaguucaccaagaaca

SEQ ID NO: 1222837 - RNA, 22 nt, Human
uaacaggguggauccaaaguug

SEQ ID NO: 1222838 - RNA, 25 nt, Human
uaacuggaugaaagacauuugggga

SEQ ID NO: 1222839 - RNA, 26 nt, Human
uaagccgagaucacaccaaucaacgg

SEQ ID NO: 1222840 - RNA, 21 nt, Human
uaauaauaagccugauccacc

SEQ ID NO: 1222841 - RNA, 21 nt, Human
uaauaauaauaagccugaucc

SEQ ID NO: 1222842 - RNA, 24 nt, Human
uacaaaaauuagccaggcgugaug

SEQ ID NO: 1222843 - RNA, 19 nt, Human
uaccuaggcaagcuugggg

SEQ ID NO: 1222844 - RNA, 22 nt, Human
uaccuguaaucccagguacugg

SEQ ID NO: 1222845 - RNA, 23 nt, Human
uaccuguaaucccagguacuggg

SEQ ID NO: 1222846 - RNA, 20 nt, Human
uaggaccgccacagaugcca

SEQ ID NO: 1222847 - RNA, 24 nt, Human
uaguaggaccgccacagaugccac

SEQ ID NO: 1222848 - RNA, 23 nt, Human
ucacaccacugcacuccagccug

SEQ ID NO: 1222849 - RNA, 23 nt, Human
ucacacuuguaaucccagaacuu

SEQ ID NO: 1222850 - RNA, 18 nt, Human
ucacauccuucauaccgc

SEQ ID NO: 1222851 - RNA, 22 nt, Human
ucacugaaacacugaguuccug

SEQ ID NO: 1222852 - RNA, 19 nt, Human
ucacuugaacccaguaggc

SEQ ID NO: 1222853 - RNA, 20 nt, Human
ucacuugaacccaguaggcg

SEQ ID NO: 1222854 - RNA, 19 nt, Human
ucauaccgcaugcacuuuc

SEQ ID NO: 1222855 - RNA, 24 nt, Human
uccagccuggacaacacagcgaga

SEQ ID NO: 1222856 - RNA, 19 nt, Human
uccaggauguggagcgggu

SEQ ID NO: 1222857 - RNA, 19 nt, Human
ucccucucaaaacaaaaca

SEQ ID NO: 1222858 - RNA, 18 nt, Human
uccgugcgugucugcugg

SEQ ID NO: 1222859 - RNA, 18 nt, Human
uccgugcgugucugcugg

SEQ ID NO: 1222860 - RNA, 25 nt, Human
uccgugcgugucugcuggaaaccgg

SEQ ID NO: 1222861 - RNA, 23 nt, Human
uccguguuucuucugcaaaucug

SEQ ID NO: 1222862 - RNA, 18 nt, Human
ucguuuaucaucuauggg

SEQ ID NO: 1222863 - RNA, 23 nt, Human
ucuaccuguaaucccagguacug

SEQ ID NO: 1222864 - RNA, 27 nt, Human
ucucaaaacaaaacaaaacaaaaaaaa

SEQ ID NO: 1222865 - RNA, 21 nt, Human
ucucccaagguugccuaauuu

SEQ ID NO: 1222866 - RNA, 23 nt, Human
ugaacccaguaggcggagguugg

SEQ ID NO: 1222867 - RNA, 22 nt, Human
ugacccacgacgucaagcccuc

SEQ ID NO: 1222868 - RNA, 20 nt, Human
ugagccucuggccccggugc

SEQ ID NO: 1222869 - RNA, 18 nt, Human
ugaggcaagagaaucacu

SEQ ID NO: 1222870 - RNA, 20 nt, Human
ugaggcaagagaaucacuug

SEQ ID NO: 1222871 - RNA, 24 nt, Human
ugaggcaagagaaucacuugaacc

SEQ ID NO: 1222872 - RNA, 25 nt, Human
ugaggcaagagaaucacuugaaccc

SEQ ID NO: 1222873 - RNA, 24 nt, Human
ugaggcgggcggaucgccugaggu

SEQ ID NO: 1222874 - RNA, 26 nt, Human
ugaggcgggcggaucgccugagguca

SEQ ID NO: 1222875 - RNA, 18 nt, Human
ugaggucaggaguuugag

SEQ ID NO: 1222876 - RNA, 24 nt, Human
ugauggugucuaccuguaauccca

SEQ ID NO: 1222877 - RNA, 21 nt, Human
ugcaaaucugggaagcuacac

SEQ ID NO: 1222878 - RNA, 18 nt, Human
ugccccaggaacgugaag

SEQ ID NO: 1222879 - RNA, 21 nt, Human
ugcucuggaaagucaagucuc

SEQ ID NO: 1222880 - RNA, 18 nt, Human
ugcuggaaaccggucucu

SEQ ID NO: 1222881 - RNA, 24 nt, Human
uggaucaacgauauccaaagucuc

SEQ ID NO: 1222882 - RNA, 22 nt, Human
ugggagaggaggccaggcaccc

SEQ ID NO: 1222883 - RNA, 19 nt, Human
ugggaggcugaggcgggcg

SEQ ID NO: 1222884 - RNA, 23 nt, Human
ugggaggcugaggcgggcggauc

SEQ ID NO: 1222885 - RNA, 24 nt, Human
ugggaggcugaggcgggcggaucg

SEQ ID NO: 1222886 - RNA, 21 nt, Human
uggggacaaaggucaaaaacg

SEQ ID NO: 1222887 - RNA, 19 nt, Human
uggggcagugcgcuggugg

SEQ ID NO: 1222888 - RNA, 21 nt, Human
ugguucacacuuguaauccca

SEQ ID NO: 1222889 - RNA, 21 nt, Human
ugucuggugcggggggggguu

SEQ ID NO: 1222890 - RNA, 19 nt, Human
ugugugagugugugugugc

SEQ ID NO: 1222891 - RNA, 24 nt, Human
uugaacccaguaggcggagguugc

SEQ ID NO: 1222892 - RNA, 20 nt, Human
uugcaguaagccgagaucac

SEQ ID NO: 1222893 - RNA, 23 nt, Human
uuggggcagugcgcuggugggag

SEQ ID NO: 1222894 - RNA, 22 nt, Human
uuugagaccagccaggccaaca

SEQ ID NO: 1222895 - RNA, 20 nt, Human
uuuggaagccucuggaucaa

SEQ ID NO: 1222896 - RNA, 21 nt, Human
aaaaaaaaacaaaaaacccca

SEQ ID NO: 1222897 - RNA, 23 nt, Human
aaaaaaaacaaaaaaccccaaaa

SEQ ID NO: 1222898 - RNA, 22 nt, Human
aaaaaaacaaaaaaccccaaaa

SEQ ID NO: 1222899 - RNA, 24 nt, Human
aaaaaaacaaaaaaccccaaaaga

SEQ ID NO: 1222900 - RNA, 20 nt, Human
aaaaaacaaaaaaccccaaa

SEQ ID NO: 1222901 - RNA, 21 nt, Human
aaaaaacaaaaaaccccaaaa

SEQ ID NO: 1222902 - RNA, 20 nt, Human
aaaaaagcagcgcaagucac

SEQ ID NO: 1222903 - RNA, 20 nt, Human
aaaaccccaaaagaccacac

SEQ ID NO: 1222904 - RNA, 22 nt, Human
aaaagcagcgcaagucacagcc

SEQ ID NO: 1222905 - RNA, 22 nt, Human
aaacaaaacaaaacagaaacaa

SEQ ID NO: 1222906 - RNA, 23 nt, Human
aaacaaaacagaaacaaaaccaa

SEQ ID NO: 1222907 - RNA, 19 nt, Human
aaacagaaacaaaaccaau

SEQ ID NO: 1222908 - RNA, 20 nt, Human
aaacccaugucccgauguua

SEQ ID NO: 1222909 - RNA, 18 nt, Human
aaaccccaaaagaccaca

SEQ ID NO: 1222910 - RNA, 22 nt, Human
aaagaaugccagaaaacccaga

SEQ ID NO: 1222911 - RNA, 19 nt, Human
aaaggccacccaaaggcca

SEQ ID NO: 1222912 - RNA, 23 nt, Human
aaaguaucaccuucaacuuaaaa

SEQ ID NO: 1222913 - RNA, 24 nt, Human
aaaguugguaaaaaucuguauuuu

SEQ ID NO: 1222914 - RNA, 23 nt, Human
aaaugucuuuauaaguacauacc

SEQ ID NO: 1222915 - RNA, 21 nt, Human
aacaaaaaaccccaaaagacc

SEQ ID NO: 1222916 - RNA, 26 nt, Human
aacaaaacaaaacagaaacaaaacca

SEQ ID NO: 1222917 - RNA, 19 nt, Human
aacagaccauaagagcuga

SEQ ID NO: 1222918 - RNA, 25 nt, Human
aacagcaacaacaaacagaccucua

SEQ ID NO: 1222919 - RNA, 20 nt, Human
aacagcggucaacuuugucu

SEQ ID NO: 1222920 - RNA, 22 nt, Human
aacauacagauagcuaccacaa

SEQ ID NO: 1222921 - RNA, 18 nt, Human
aacuugaaaaaguaagug

SEQ ID NO: 1222922 - RNA, 22 nt, Human
aagcaaaaaagggaaagcuuca

SEQ ID NO: 1222923 - RNA, 20 nt, Human
aaggccaaguuacaaacacc

SEQ ID NO: 1222924 - RNA, 18 nt, Human
aaucuuacaaugucagaa

SEQ ID NO: 1222925 - RNA, 22 nt, Human
acaaaaagacuucuaaaaauau

SEQ ID NO: 1222926 - RNA, 20 nt, Human
acaaaacaaaacagaaacaa

SEQ ID NO: 1222927 - RNA, 22 nt, Human
acaaaagaaaaaccaguaucac

SEQ ID NO: 1222928 - RNA, 20 nt, Human
acaaaggccacccaaaggcc

SEQ ID NO: 1222929 - RNA, 19 nt, Human
acaacaaacagaccucuag

SEQ ID NO: 1222930 - RNA, 24 nt, Human
acaacagcaacaacaaacagaccu

SEQ ID NO: 1222931 - RNA, 23 nt, Human
acagcaacaacaaacagaccucu

SEQ ID NO: 1222932 - RNA, 21 nt, Human
acaguaaggcaaucuuacaau

SEQ ID NO: 1222933 - RNA, 24 nt, Human
acaguauuauucacuugguauuuc

SEQ ID NO: 1222934 - RNA, 22 nt, Human
accaccauccauuauaaccgcc

SEQ ID NO: 1222935 - RNA, 25 nt, Human
accauuaaaaaauaguuuugaacaa

SEQ ID NO: 1222936 - RNA, 18 nt, Human
agacaacuauuucuaaua

SEQ ID NO: 1222937 - RNA, 22 nt, Human
agagaccagucugcacugaguc

SEQ ID NO: 1222938 - RNA, 22 nt, Human
agagagaccagucugcacugag

SEQ ID NO: 1222939 - RNA, 18 nt, Human
aggugcacucauuaaaaa

SEQ ID NO: 1222940 - RNA, 19 nt, Human
auaaaggacaacagcaaca

SEQ ID NO: 1222941 - RNA, 21 nt, Human
auagaacgguaacugucacca

SEQ ID NO: 1222942 - RNA, 23 nt, Human
aucaaaagaaauuaguuuacaaa

SEQ ID NO: 1222943 - RNA, 21 nt, Human
auuugaaaucugauacugccc

SEQ ID NO: 1222944 - RNA, 21 nt, Human
caaaaaaccccaaaagaccac

SEQ ID NO: 1222945 - RNA, 25 nt, Human
caaaaaaccccaaaagaccacacaa

SEQ ID NO: 1222946 - RNA, 23 nt, Human
caaaacaaaacagaaacaaaacc

SEQ ID NO: 1222947 - RNA, 26 nt, Human
caaaacaaaacagaaacaaaaccaau

SEQ ID NO: 1222948 - RNA, 24 nt, Human
caaaacagaaacaaaaccaauccc

SEQ ID NO: 1222949 - RNA, 24 nt, Human
caaaauagagauucaaaauccacu

SEQ ID NO: 1222950 - RNA, 19 nt, Human
caaagugccuagauacaca

SEQ ID NO: 1222951 - RNA, 24 nt, Human
caacaaaagaucaaacccaugucc

SEQ ID NO: 1222952 - RNA, 25 nt, Human
caacaacaaacagaccucuagggug

SEQ ID NO: 1222953 - RNA, 23 nt, Human
caacagcaauagcacuacaggua

SEQ ID NO: 1222954 - RNA, 20 nt, Human
cacacuuuuaaaauacuugg

SEQ ID NO: 1222955 - RNA, 25 nt, Human
caccaguacagagaaaccacaggaa

SEQ ID NO: 1222956 - RNA, 19 nt, Human
cacucacuagaaacagggu

SEQ ID NO: 1222957 - RNA, 19 nt, Human
cacugagucauauauacuc

SEQ ID NO: 1222958 - RNA, 21 nt, Human
cagaaacaaaaccaaucccac

SEQ ID NO: 1222959 - RNA, 18 nt, Human
cagcacaaaagaaaaacc

SEQ ID NO: 1222960 - RNA, 24 nt, Human
cagcuggauagacuuauccaaaac

SEQ ID NO: 1222961 - RNA, 22 nt, Human
cagguuuccuccacccacauuu

SEQ ID NO: 1222962 - RNA, 24 nt, Human
caucagguacaacaaaagaucaaa

SEQ ID NO: 1222963 - RNA, 20 nt, Human
cccacaaucuccaaguucac

SEQ ID NO: 1222964 - RNA, 21 nt, Human
ccccaaaagaccacacaaucc

SEQ ID NO: 1222965 - RNA, 21 nt, Human
ccuccggccugagaaaggggc

SEQ ID NO: 1222966 - RNA, 21 nt, Human
ccugaaaauuucccagcagca

SEQ ID NO: 1222967 - RNA, 20 nt, Human
cucaaagauggcagugccau

SEQ ID NO: 1222968 - RNA, 18 nt, Human
cucaggaacugaacuuuu

SEQ ID NO: 1222969 - RNA, 18 nt, Human
cuccacccacauuugggc

SEQ ID NO: 1222970 - RNA, 19 nt, Human
cucucagucaucaguaucu

SEQ ID NO: 1222971 - RNA, 19 nt, Human
cugauacugcccauguaca

SEQ ID NO: 1222972 - RNA, 23 nt, Human
cugucaccaggauaauaaagcac

SEQ ID NO: 1222973 - RNA, 22 nt, Human
cuucucuugcaacucuuucaaa

SEQ ID NO: 1222974 - RNA, 20 nt, Human
gaguauuaaaagcacagcug

SEQ ID NO: 1222975 - RNA, 18 nt, Human
gaguuucaucauauauag

SEQ ID NO: 1222976 - RNA, 20 nt, Human
gcaaucuuacaaugucagaa

SEQ ID NO: 1222977 - RNA, 21 nt, Human
gcagcgcaagucacagccuac

SEQ ID NO: 1222978 - RNA, 19 nt, Human
gccaagugcucuaaaaaag

SEQ ID NO: 1222979 - RNA, 23 nt, Human
gcugucacugauaugcccaaggg

SEQ ID NO: 1222980 - RNA, 26 nt, Human
ggaaaaacacuguauuuggugcagcg

SEQ ID NO: 1222981 - RNA, 19 nt, Human
ggacaacagcaacaacaaa

SEQ ID NO: 1222982 - RNA, 19 nt, Human
guauuucccaguggcaugc

SEQ ID NO: 1222983 - RNA, 21 nt, Human
guuucaggguaaacugguggu

SEQ ID NO: 1222984 - RNA, 21 nt, Human
uaaaaaaaaaaaaacaaaaaa

SEQ ID NO: 1222985 - RNA, 23 nt, Human
uaaaaaagaauccaaaguuggua

SEQ ID NO: 1222986 - RNA, 21 nt, Human
uaaaagaaugccagaaaaccc

SEQ ID NO: 1222987 - RNA, 23 nt, Human
uaaaagguggcacacuuuuaaaa

SEQ ID NO: 1222988 - RNA, 21 nt, Human
uaaacaaaacaaaacagaaac

SEQ ID NO: 1222989 - RNA, 23 nt, Human
uaaaugauaaacaaaacaaaaca

SEQ ID NO: 1222990 - RNA, 23 nt, Human
uaaauucuauaaauuguuaaaag

SEQ ID NO: 1222991 - RNA, 19 nt, Human
uaacagcacaaaagaaaaa

SEQ ID NO: 1222992 - RNA, 20 nt, Human
uaacuuaaaagaaugccaga

SEQ ID NO: 1222993 - RNA, 18 nt, Human
uaagagagaccagucugc

SEQ ID NO: 1222994 - RNA, 25 nt, Human
uaauucagccuaauuauaaggccaa

SEQ ID NO: 1222995 - RNA, 19 nt, Human
uacggaaaaacacuguauu

SEQ ID NO: 1222996 - RNA, 21 nt, Human
uagcacuacagguaaaugaac

SEQ ID NO: 1222997 - RNA, 18 nt, Human
uaguaguaaccacaauac

SEQ ID NO: 1222998 - RNA, 21 nt, Human
uauauagaaaaaguaucaccu

SEQ ID NO: 1222999 - RNA, 24 nt, Human
uauauauauggagauauauauaca

SEQ ID NO: 1223000 - RNA, 19 nt, Human
uaugcuaauaacguuaaca

SEQ ID NO: 1223001 - RNA, 20 nt, Human
ucaaaaaaaauauagaaaca

SEQ ID NO: 1223002 - RNA, 18 nt, Human
ucaaaauuauacagccau

SEQ ID NO: 1223003 - RNA, 22 nt, Human
ucaaacccaugucccgauguua

SEQ ID NO: 1223004 - RNA, 21 nt, Human
ucauauauacuccaacuugaa

SEQ ID NO: 1223005 - RNA, 23 nt, Human
uccacaaaggccacccaaaggcc

SEQ ID NO: 1223006 - RNA, 24 nt, Human
uccacuaguuuaucauuuuuuucc

SEQ ID NO: 1223007 - RNA, 21 nt, Human
ucuaggguguuuaaaaagaug

SEQ ID NO: 1223008 - RNA, 23 nt, Human
ucugacaaaugacagaauucagg

SEQ ID NO: 1223009 - RNA, 18 nt, Human
ucugugaggucaaauucc

SEQ ID NO: 1223010 - RNA, 23 nt, Human
ucuuaaaaaaaaaaaaacaaaaa

SEQ ID NO: 1223011 - RNA, 30 nt, Human
ucuuaaaaaaaaaaaaacaaaaaaccccaa

SEQ ID NO: 1223012 - RNA, 18 nt, Human
ugaaagacaguacaucug

SEQ ID NO: 1223013 - RNA, 21 nt, Human
ugaacagcggucaacuuuguc

SEQ ID NO: 1223014 - RNA, 23 nt, Human
ugaagucuacauuucccuugucu

SEQ ID NO: 1223015 - RNA, 22 nt, Human
ugaguauuaaaagcacagcuga

SEQ ID NO: 1223016 - RNA, 21 nt, Human
ugcaaaacauacagauagcua

SEQ ID NO: 1223017 - RNA, 20 nt, Human
ugcauuucugcaugugugca

SEQ ID NO: 1223018 - RNA, 21 nt, Human
ugccaagugcucuaaaaaagc

SEQ ID NO: 1223019 - RNA, 27 nt, Human
ugccagaaaacccagaucaacacuuuc

SEQ ID NO: 1223020 - RNA, 22 nt, Human
ugcucuaaaaaagcagcgcaag

SEQ ID NO: 1223021 - RNA, 18 nt, Human
uggcgcugcagagcuggg

SEQ ID NO: 1223022 - RNA, 21 nt, Human
uggcgcugcagagcugggcuc

SEQ ID NO: 1223023 - RNA, 19 nt, Human
uguaaccaacuagcaugca

SEQ ID NO: 1223024 - RNA, 19 nt, Human
uguauuaagauugcaaaac

SEQ ID NO: 1223025 - RNA, 22 nt, Human
uguauuuggugcaguaucugau

SEQ ID NO: 1223026 - RNA, 25 nt, Human
uguuaagaaggaaauuacagguuuc

SEQ ID NO: 1223027 - RNA, 25 nt, Human
uguuaguaacuugaccauuaaaaaa

SEQ ID NO: 1223028 - RNA, 25 nt, Human
uguuuaugaagucuacauuucccuu

SEQ ID NO: 1223029 - RNA, 26 nt, Human
uuaaaaacacuacggaaaaacacugu

SEQ ID NO: 1223030 - RNA, 24 nt, Human
uuaaaagaaugccagaaaacccag

SEQ ID NO: 1223031 - RNA, 19 nt, Human
uuaaggguaaucauugggu

SEQ ID NO: 1223032 - RNA, 23 nt, Human
uucaaaauccacuuuccuacucc

SEQ ID NO: 1223033 - RNA, 19 nt, Human
uucaaauguaaauagaagc

SEQ ID NO: 1223034 - RNA, 18 nt, Human
uuccuacuccucugagga

SEQ ID NO: 1223035 - RNA, 22 nt, Human
uugacucugcauuucugcaugu

SEQ ID NO: 1223036 - RNA, 27 nt, Human
uuuaaaaagaugaaguggcgcugcaga

SEQ ID NO: 1223037 - RNA, 20 nt, Human
aaagagucaaaacagagaaa

SEQ ID NO: 1223038 - RNA, 18 nt, Human
acaggcuguuugaagggu

SEQ ID NO: 1223039 - RNA, 22 nt, Human
acaucuuuaacauauaugaaua

SEQ ID NO: 1223040 - RNA, 23 nt, Human
caaaacagagaaaaugaaugaac

SEQ ID NO: 1223041 - RNA, 23 nt, Human
cacaacaauuucauaccagcauu

SEQ ID NO: 1223042 - RNA, 22 nt, Human
caggacuuuuuugggugaaaag

SEQ ID NO: 1223043 - RNA, 20 nt, Human
cauccucagaggcucugguu

SEQ ID NO: 1223044 - RNA, 22 nt, Human
cgcaggacuuuuccuuaguuca

SEQ ID NO: 1223045 - RNA, 22 nt, Human
gaaacaauauuauaaaugugca

SEQ ID NO: 1223046 - RNA, 22 nt, Human
gaagacgggguccuugucuguc

SEQ ID NO: 1223047 - RNA, 21 nt, Human
gauauacacaacaauuucaua

SEQ ID NO: 1223048 - RNA, 18 nt, Human
gggugaaaaggaaaaaug

SEQ ID NO: 1223049 - RNA, 19 nt, Human
gggugaaaaggaaaaaugg

SEQ ID NO: 1223050 - RNA, 22 nt, Human
uacaagguuuaaaacagagaaa

SEQ ID NO: 1223051 - RNA, 24 nt, Human
uacaagguuuaaaacagagaaaca

SEQ ID NO: 1223052 - RNA, 25 nt, Human
uacaucuuuaacauauaugaauacu

SEQ ID NO: 1223053 - RNA, 22 nt, Human
uaccagcauuguuaguaauuag

SEQ ID NO: 1223054 - RNA, 20 nt, Human
uagagagcuucucacccaca

SEQ ID NO: 1223055 - RNA, 21 nt, Human
uaggaaaauggauaaaugagc

SEQ ID NO: 1223056 - RNA, 24 nt, Human
uauacaagguuuaaaacagagaaa

SEQ ID NO: 1223057 - RNA, 19 nt, Human
uccacagugcguaccaaag

SEQ ID NO: 1223058 - RNA, 21 nt, Human
uccauaaggucagagucccug

SEQ ID NO: 1223059 - RNA, 23 nt, Human
ucccugcuagagagcuucucacc

SEQ ID NO: 1223060 - RNA, 18 nt, Human
uccucagaggcucugguu

SEQ ID NO: 1223061 - RNA, 19 nt, Human
uccucagaggcucugguug

SEQ ID NO: 1223062 - RNA, 23 nt, Human
ugcaacaguaggaaaauggauaa

SEQ ID NO: 1223063 - RNA, 20 nt, Human
uggauaaaugagcuguagua

SEQ ID NO: 1223064 - RNA, 18 nt, Human
uucauaccagcauuguua

SEQ ID NO: 1223065 - RNA, 22 nt, Human
uuuuccuauuuauacaagguuu

SEQ ID NO: 1223066 - RNA, 18 nt, Human
aaaugcuaacacauacug

SEQ ID NO: 1223067 - RNA, 22 nt, Human
aaauguggaacaguauucauau

SEQ ID NO: 1223068 - RNA, 23 nt, Human
aacaaauguggaacaguauucau

SEQ ID NO: 1223069 - RNA, 20 nt, Human
aaggcaugauuucuaacuuu

SEQ ID NO: 1223070 - RNA, 20 nt, Human
aaguaaaaggacauuuauac

SEQ ID NO: 1223071 - RNA, 20 nt, Human
acagugaaguagauacugaa

SEQ ID NO: 1223072 - RNA, 23 nt, Human
auaaaugaaaguacauaugaaug

SEQ ID NO: 1223073 - RNA, 21 nt, Human
auaagcacugacuuuccaaau

SEQ ID NO: 1223074 - RNA, 18 nt, Human
auaagugcucaaaugcua

SEQ ID NO: 1223075 - RNA, 22 nt, Human
caaaagaaacaaauguggaaca

SEQ ID NO: 1223076 - RNA, 23 nt, Human
cauaugaaugcuauuauuugaau

SEQ ID NO: 1223077 - RNA, 21 nt, Human
ccaucugcacaacugacuagg

SEQ ID NO: 1223078 - RNA, 25 nt, Human
cccaaaagaaacaaauguggaaccc

SEQ ID NO: 1223079 - RNA, 24 nt, Human
cuagaauagugagaggucuuuucu

SEQ ID NO: 1223080 - RNA, 19 nt, Human
cugaaauagacauugaaag

SEQ ID NO: 1223081 - RNA, 24 nt, Human
cuguuucacauucucuugaacuga

SEQ ID NO: 1223082 - RNA, 24 nt, Human
gaaauuacaaaugcucauauacua

SEQ ID NO: 1223083 - RNA, 18 nt, Human
gagucauuuuuagacuaa

SEQ ID NO: 1223084 - RNA, 21 nt, Human
ggaguaaaaccaacaucuaaa

SEQ ID NO: 1223085 - RNA, 22 nt, Human
ggauuuguuuuuauuuuucucu

SEQ ID NO: 1223086 - RNA, 22 nt, Human
uaaaaccaacaucuaaauguug

SEQ ID NO: 1223087 - RNA, 20 nt, Human
uaaaguaaaaggacauuuau

SEQ ID NO: 1223088 - RNA, 18 nt, Human
uaauuccauauaaaugaa

SEQ ID NO: 1223089 - RNA, 19 nt, Human
uaauuugcuuuuacauaga

SEQ ID NO: 1223090 - RNA, 19 nt, Human
uauuucaaaucauuggcaa

SEQ ID NO: 1223091 - RNA, 21 nt, Human
ucaacugaaagauuaaaaaaa

SEQ ID NO: 1223092 - RNA, 23 nt, Human
ucccaaaagaaacaaauguggaa

SEQ ID NO: 1223093 - RNA, 22 nt, Human
ugggaagaaauucaacugaaag

SEQ ID NO: 1223094 - RNA, 30 nt, Human
uuaauagaacaguaauguugauuuuucuuu

SEQ ID NO: 1223095 - RNA, 19 nt, Human
uucacauucucuugaacug

SEQ ID NO: 1223096 - RNA, 26 nt, Human
uucauaugaguuuauuuuugugauaa

SEQ ID NO: 1223097 - RNA, 22 nt, Human
uuccauauaaaugaaaguacau

SEQ ID NO: 1223098 - RNA, 23 nt, Human
uucucuauuugggaagaaauuca

SEQ ID NO: 1223099 - RNA, 21 nt, Human
uuugggcacuucuuaaaauga

SEQ ID NO: 1223100 - RNA, 25 nt, Human
aaaaaaauacuuucacagcaacacu

SEQ ID NO: 1223101 - RNA, 27 nt, Human
aaaaacuaugacuugccacuaaaucuu

SEQ ID NO: 1223102 - RNA, 19 nt, Human
aaagcgcugggacugcagg

SEQ ID NO: 1223103 - RNA, 20 nt, Human
aaaggcaggcgccacuagcc

SEQ ID NO: 1223104 - RNA, 27 nt, Human
aacacauuucacacacacauauacaca

SEQ ID NO: 1223105 - RNA, 18 nt, Human
aacuaaguaguucaugga

SEQ ID NO: 1223106 - RNA, 25 nt, Human
aagcaaagauacaaagucugagacc

SEQ ID NO: 1223107 - RNA, 18 nt, Human
aagcagucauuaucugcc

SEQ ID NO: 1223108 - RNA, 25 nt, Human
aagcgauccucccgcuucagccucc

SEQ ID NO: 1223109 - RNA, 22 nt, Human
aagcgaucugcccgccuuggcc

SEQ ID NO: 1223110 - RNA, 19 nt, Human
aagcgcugggacugcaggc

SEQ ID NO: 1223111 - RNA, 20 nt, Human
aagugacauauaaccugaaa

SEQ ID NO: 1223112 - RNA, 19 nt, Human
aaguguaccccagaaaaca

SEQ ID NO: 1223113 - RNA, 22 nt, Human
acaguaaucagagaagcgcacc

SEQ ID NO: 1223114 - RNA, 22 nt, Human
accacagacacacacgugcguu

SEQ ID NO: 1223115 - RNA, 20 nt, Human
accccagaaaacacucacca

SEQ ID NO: 1223116 - RNA, 24 nt, Human
accccagaaaacacucaccacaga

SEQ ID NO: 1223117 - RNA, 22 nt, Human
accugcaagcaaagauacaaag

SEQ ID NO: 1223118 - RNA, 19 nt, Human
acuacagccuagucacguu

SEQ ID NO: 1223119 - RNA, 18 nt, Human
acugacucacuaccaugc

SEQ ID NO: 1223120 - RNA, 23 nt, Human
agaaaugucaaaaggugaaaaug

SEQ ID NO: 1223121 - RNA, 26 nt, Human
agaagaugugugugugugugugugug

SEQ ID NO: 1223122 - RNA, 25 nt, Human
agagaaaaagcuucgcggaccacac

SEQ ID NO: 1223123 - RNA, 23 nt, Human
agagaaacagaaucaacagaaga

SEQ ID NO: 1223124 - RNA, 24 nt, Human
agaugugugugugugugugugugu

SEQ ID NO: 1223125 - RNA, 20 nt, Human
agcagcaucuaucuuuccac

SEQ ID NO: 1223126 - RNA, 21 nt, Human
agcaucuaucuuuccaccagc

SEQ ID NO: 1223127 - RNA, 25 nt, Human
aggcuggagugcaguggcacaaucu

SEQ ID NO: 1223128 - RNA, 23 nt, Human
aggguuuugcucaguugcccagg

SEQ ID NO: 1223129 - RNA, 20 nt, Human
agugcaguggcacaaucucg

SEQ ID NO: 1223130 - RNA, 19 nt, Human
agugcaguggugugauuag

SEQ ID NO: 1223131 - RNA, 23 nt, Human
agugcaguggugugauuagagcu

SEQ ID NO: 1223132 - RNA, 24 nt, Human
agugcaguggugugauuagagcuc

SEQ ID NO: 1223133 - RNA, 18 nt, Human
agugggagggagaggagg

SEQ ID NO: 1223134 - RNA, 20 nt, Human
aucagagaagcgcaccuuuu

SEQ ID NO: 1223135 - RNA, 22 nt, Human
aucaggcccauccacaucaugg

SEQ ID NO: 1223136 - RNA, 21 nt, Human
aucaucucuugcaaugaacuc

SEQ ID NO: 1223137 - RNA, 18 nt, Human
auccuggcaaacucuccc

SEQ ID NO: 1223138 - RNA, 22 nt, Human
augugugugugugugugugugu

SEQ ID NO: 1223139 - RNA, 22 nt, Human
augugugugugugugugugugu

SEQ ID NO: 1223140 - RNA, 21 nt, Human
auguuuccuuaaagugauauu

SEQ ID NO: 1223141 - RNA, 24 nt, Human
auuacaggaacuaaguaguucaug

SEQ ID NO: 1223142 - RNA, 25 nt, Human
caaagcgcugggacugcaggcgagc

SEQ ID NO: 1223143 - RNA, 27 nt, Human
caagcgauccucccgcuucagccuccc

SEQ ID NO: 1223144 - RNA, 18 nt, Human
cacacacacauauacaca

SEQ ID NO: 1223145 - RNA, 23 nt, Human
caccccgcgagcucucauugacc

SEQ ID NO: 1223146 - RNA, 21 nt, Human
cagaaaacacucaccacagac

SEQ ID NO: 1223147 - RNA, 23 nt, Human
cagaaaacacucaccacagacac

SEQ ID NO: 1223148 - RNA, 21 nt, Human
cagagaaacagaaucaacaga

SEQ ID NO: 1223149 - RNA, 23 nt, Human
cagccucccaaguaacuaggacu

SEQ ID NO: 1223150 - RNA, 26 nt, Human
cagcguggggaugagggaauucagcg

SEQ ID NO: 1223151 - RNA, 21 nt, Human
cagcuguagcuugaaagcaga

SEQ ID NO: 1223152 - RNA, 20 nt, Human
ccaaauaucuggguacuaca

SEQ ID NO: 1223153 - RNA, 21 nt, Human
ccaacagaaacucucuaaagc

SEQ ID NO: 1223154 - RNA, 22 nt, Human
ccaaguaacuaggacuaaaggc

SEQ ID NO: 1223155 - RNA, 24 nt, Human
ccaccugcaagcaaagauacaaag

SEQ ID NO: 1223156 - RNA, 23 nt, Human
ccagagaaacagaaucaacagaa

SEQ ID NO: 1223157 - RNA, 21 nt, Human
ccaggcuggagugcaguggca

SEQ ID NO: 1223158 - RNA, 22 nt, Human
ccauaucuucccauacacgacc

SEQ ID NO: 1223159 - RNA, 19 nt, Human
cccaggcuggagugcagug

SEQ ID NO: 1223160 - RNA, 18 nt, Human
ccccgcgguuaacuagca

SEQ ID NO: 1223161 - RNA, 19 nt, Human
ccuccauguccucccgcgu

SEQ ID NO: 1223162 - RNA, 24 nt, Human
ccucccgcuucagccucccaagua

SEQ ID NO: 1223163 - RNA, 19 nt, Human
ccugcaagcaaagauacaa

SEQ ID NO: 1223164 - RNA, 18 nt, Human
ccuggucucaagcgaucc

SEQ ID NO: 1223165 - RNA, 25 nt, Human
ccugugggaacaaguguaccccaga

SEQ ID NO: 1223166 - RNA, 23 nt, Human
ccuuccccagggcgccuuucucg

SEQ ID NO: 1223167 - RNA, 20 nt, Human
cuacuuuacucaaagucuaa

SEQ ID NO: 1223168 - RNA, 24 nt, Human
cucaagcgauccucccgcuucagc

SEQ ID NO: 1223169 - RNA, 18 nt, Human
cucaagcgaucugcccgc

SEQ ID NO: 1223170 - RNA, 19 nt, Human
cucaguugcccaggcugga

SEQ ID NO: 1223171 - RNA, 22 nt, Human
cucccgcguccagcggcugcgg

SEQ ID NO: 1223172 - RNA, 19 nt, Human
cugaagccucaaacuccug

SEQ ID NO: 1223173 - RNA, 21 nt, Human
cuguggcaggagguggagaag

SEQ ID NO: 1223174 - RNA, 21 nt, Human
cuugcucugucguccaggcug

SEQ ID NO: 1223175 - RNA, 24 nt, Human
cuugcucugucguccaggcuggag

SEQ ID NO: 1223176 - RNA, 18 nt, Human
cuuugaguccauaucuuc

SEQ ID NO: 1223177 - RNA, 24 nt, Human
gagcucaagcgaucugcccgccuu

SEQ ID NO: 1223178 - RNA, 19 nt, Human
gagcucucauugacccucc

SEQ ID NO: 1223179 - RNA, 26 nt, Human
gagggagaggaggacguuggugcagu

SEQ ID NO: 1223180 - RNA, 18 nt, Human
gcagaauggcgucacccc

SEQ ID NO: 1223181 - RNA, 20 nt, Human
gccaaagcgcugggacugca

SEQ ID NO: 1223182 - RNA, 24 nt, Human
gccaaagcgcugggacugcaggcg

SEQ ID NO: 1223183 - RNA, 24 nt, Human
gcccaggcuggagugcaguggugu

SEQ ID NO: 1223184 - RNA, 20 nt, Human
gccgcggcccccguucccca

SEQ ID NO: 1223185 - RNA, 24 nt, Human
gcgauccucccgcuucagccuccc

SEQ ID NO: 1223186 - RNA, 19 nt, Human
gcucaguugcccaggcugg

SEQ ID NO: 1223187 - RNA, 20 nt, Human
gcucaguugcccaggcugga

SEQ ID NO: 1223188 - RNA, 18 nt, Human
gcucucauugacccucca

SEQ ID NO: 1223189 - RNA, 19 nt, Human
gcuggagugcaguggcaca

SEQ ID NO: 1223190 - RNA, 23 nt, Human
gcuucagccucccaaguaacuag

SEQ ID NO: 1223191 - RNA, 23 nt, Human
ggaaaauucagaacaaaaaggcc

SEQ ID NO: 1223192 - RNA, 22 nt, Human
ggaacaaguguaccccagaaaa

SEQ ID NO: 1223193 - RNA, 20 nt, Human
ggagguggagaagggcccgg

SEQ ID NO: 1223194 - RNA, 19 nt, Human
ggagugugcagugggaggg

SEQ ID NO: 1223195 - RNA, 18 nt, Human
ggcaggagguggagaagg

SEQ ID NO: 1223196 - RNA, 24 nt, Human
ggcaggagguggagaagggggacc

SEQ ID NO: 1223197 - RNA, 22 nt, Human
ggcuggagugcaguggugugau

SEQ ID NO: 1223198 - RNA, 19 nt, Human
gguaggcuggagacucuga

SEQ ID NO: 1223199 - RNA, 24 nt, Human
gugugcagugggagggagaggagg

SEQ ID NO: 1223200 - RNA, 23 nt, Human
gugugugugugugugaagaggug

SEQ ID NO: 1223201 - RNA, 24 nt, Human
guuuugcucaguugcccaggcugg

SEQ ID NO: 1223202 - RNA, 25 nt, Human
uaaaaggccgugcugaccacaaacg

SEQ ID NO: 1223203 - RNA, 19 nt, Human
uaaaucuuaaaauauuccu

SEQ ID NO: 1223204 - RNA, 24 nt, Human
uaaccugaaauguaaaggaaacac

SEQ ID NO: 1223205 - RNA, 19 nt, Human
uaaggaaagaaguagcagc

SEQ ID NO: 1223206 - RNA, 23 nt, Human
uaaucagagaagcgcaccuuuuu

SEQ ID NO: 1223207 - RNA, 18 nt, Human
uagcaugauuaacauaau

SEQ ID NO: 1223208 - RNA, 24 nt, Human
uaggguuuugcucaguugcccagg

SEQ ID NO: 1223209 - RNA, 22 nt, Human
uauuccuacuucagaaauguca

SEQ ID NO: 1223210 - RNA, 18 nt, Human
uauugcccaggcuggucu

SEQ ID NO: 1223211 - RNA, 19 nt, Human
uauugcccaggcuggucug

SEQ ID NO: 1223212 - RNA, 19 nt, Human
uauugcccaggcuggucug

SEQ ID NO: 1223213 - RNA, 22 nt, Human
uauugcccaggcuggucuggaa

SEQ ID NO: 1223214 - RNA, 24 nt, Human
uauuuuauauaacuucugggaagu

SEQ ID NO: 1223215 - RNA, 22 nt, Human
ucacugaagccucaaacuccug

SEQ ID NO: 1223216 - RNA, 18 nt, Human
ucagaacaaaaaggccug

SEQ ID NO: 1223217 - RNA, 24 nt, Human
ucaguugcccaggcuggagugcag

SEQ ID NO: 1223218 - RNA, 22 nt, Human
ucauuuauuuuuacaguaauca

SEQ ID NO: 1223219 - RNA, 21 nt, Human
uccaacagaaacucucuaaag

SEQ ID NO: 1223220 - RNA, 28 nt, Human
uccaccagcacaucaucucuugcaauga

SEQ ID NO: 1223221 - RNA, 21 nt, Human
uccuuacucuuguaucugauc

SEQ ID NO: 1223222 - RNA, 24 nt, Human
ucguccaggcuggagugcaguggc

SEQ ID NO: 1223223 - RNA, 22 nt, Human
ucuacaaacucuuugaguccau

SEQ ID NO: 1223224 - RNA, 23 nt, Human
ucucgcuguauugcccaggcugg

SEQ ID NO: 1223225 - RNA, 23 nt, Human
ucucgcuguauugcccaggcugg

SEQ ID NO: 1223226 - RNA, 24 nt, Human
ucucgcuguauugcccaggcuggu

SEQ ID NO: 1223227 - RNA, 26 nt, Human
ucucgcuguauugcccaggcuggucu

SEQ ID NO: 1223228 - RNA, 22 nt, Human
ucucuugcaaugaacucuuuug

SEQ ID NO: 1223229 - RNA, 22 nt, Human
ucugaagaaacuggcuaacuca

SEQ ID NO: 1223230 - RNA, 24 nt, Human
ucugucguccaggcuggagugcag

SEQ ID NO: 1223231 - RNA, 22 nt, Human
ucuuaggcagauacauguuacc

SEQ ID NO: 1223232 - RNA, 23 nt, Human
ucuugcucugucguccaggcugg

SEQ ID NO: 1223233 - RNA, 24 nt, Human
ucuugcucugucguccaggcugga

SEQ ID NO: 1223234 - RNA, 19 nt, Human
ugacacaaaacuagccauu

SEQ ID NO: 1223235 - RNA, 21 nt, Human
ugaccacaaacgggaccgucu

SEQ ID NO: 1223236 - RNA, 21 nt, Human
ugagcugcaaagcagucauua

SEQ ID NO: 1223237 - RNA, 24 nt, Human
ugaguugaaaaaaguuucauuuuu

SEQ ID NO: 1223238 - RNA, 20 nt, Human
ugcaagcaaagauacaaagu

SEQ ID NO: 1223239 - RNA, 18 nt, Human
ugcccaggcuggagugca

SEQ ID NO: 1223240 - RNA, 21 nt, Human
ugcccaggcuggagugcagug

SEQ ID NO: 1223241 - RNA, 24 nt, Human
ugcccaggcuggagugcaguggug

SEQ ID NO: 1223242 - RNA, 22 nt, Human
ugccugagcccccgcgguuaac

SEQ ID NO: 1223243 - RNA, 21 nt, Human
ugcucaguugcccaggcugga

SEQ ID NO: 1223244 - RNA, 24 nt, Human
ugcucaguugcccaggcuggagug

SEQ ID NO: 1223245 - RNA, 24 nt, Human
ugcucugucguccaggcuggagug

SEQ ID NO: 1223246 - RNA, 23 nt, Human
uggagugcaguggcacaaucucg

SEQ ID NO: 1223247 - RNA, 24 nt, Human
uggagugcaguggcacaaucucgg

SEQ ID NO: 1223248 - RNA, 19 nt, Human
uggagugcaguggugugau

SEQ ID NO: 1223249 - RNA, 28 nt, Human
uggagugcaguggugugauggcucuagc

SEQ ID NO: 1223250 - RNA, 21 nt, Human
uggagugcaguggugugauua

SEQ ID NO: 1223251 - RNA, 18 nt, Human
uggcaggagguggagaag

SEQ ID NO: 1223252 - RNA, 19 nt, Human
uggcuaacucaauaugggg

SEQ ID NO: 1223253 - RNA, 18 nt, Human
ugggagaagcugcgagug

SEQ ID NO: 1223254 - RNA, 19 nt, Human
ugggagaagcugcgagugc

SEQ ID NO: 1223255 - RNA, 21 nt, Human
ugggagaagcugcgagugcug

SEQ ID NO: 1223256 - RNA, 21 nt, Human
ugggagggagaggaggacguu

SEQ ID NO: 1223257 - RNA, 24 nt, Human
uggguucucgcuguauugcccagg

SEQ ID NO: 1223258 - RNA, 22 nt, Human
uggucucaagcgauccucccgc

SEQ ID NO: 1223259 - RNA, 22 nt, Human
uggugugauuagagcucacuga

SEQ ID NO: 1223260 - RNA, 20 nt, Human
uguauuaggggucuccagag

SEQ ID NO: 1223261 - RNA, 23 nt, Human
uguauugcccaggcuggucugga

SEQ ID NO: 1223262 - RNA, 19 nt, Human
uguccugaagagaaaaagc

SEQ ID NO: 1223263 - RNA, 19 nt, Human
ugucguccaggcuggagug

SEQ ID NO: 1223264 - RNA, 25 nt, Human
uguggcaggagguggagaagggccc

SEQ ID NO: 1223265 - RNA, 18 nt, Human
ugugugugugugugugug

SEQ ID NO: 1223266 - RNA, 18 nt, Human
ugugugugugugugugug

SEQ ID NO: 1223267 - RNA, 23 nt, Human
uguuacagcuguagcuugaaagc

SEQ ID NO: 1223268 - RNA, 19 nt, Human
uucucgcuguauugcccag

SEQ ID NO: 1223269 - RNA, 27 nt, Human
uugacacaaaacuagccauuacaggaa

SEQ ID NO: 1223270 - RNA, 24 nt, Human
uugcccaggcuggagugcaguggu

SEQ ID NO: 1223271 - RNA, 21 nt, Human
uugcucaguugcccaggcugg

SEQ ID NO: 1223272 - RNA, 22 nt, Human
uugcucaguugcccaggcugga

SEQ ID NO: 1223273 - RNA, 24 nt, Human
uugcucaguugcccaggcuggagu

SEQ ID NO: 1223274 - RNA, 24 nt, Human
uugcucugucguccaggcuggagu

SEQ ID NO: 1223275 - RNA, 20 nt, Human
uuguuuguuuguuuguuuuu

SEQ ID NO: 1223276 - RNA, 22 nt, Human
uuguuuguuuguuuuuguuuuu

SEQ ID NO: 1223277 - RNA, 18 nt, Human
uuucugccaugcugucuc

SEQ ID NO: 1223278 - RNA, 23 nt, Human
uuuucuuuuuuuagagauagggu

SEQ ID NO: 1223279 - RNA, 24 nt, Human
uuuugcucaguugcccaggcugga

SEQ ID NO: 1223280 - RNA, 19 nt, Human
uuuuuuagagauaggguuu

SEQ ID NO: 1223281 - RNA, 24 nt, Human
uuuuuucuuuuuuuagagauaggg

SEQ ID NO: 1223282 - RNA, 20 nt, Human
acucuacuuacuggagagaa

SEQ ID NO: 1223283 - RNA, 18 nt, Human
aggaggaggaagggcuga

SEQ ID NO: 1223284 - RNA, 18 nt, Human
aggauacaaugcuugaaa

SEQ ID NO: 1223285 - RNA, 20 nt, Human
aguaguauccuuaugaguac

SEQ ID NO: 1223286 - RNA, 18 nt, Human
cugacccaaaaaaugccu

SEQ ID NO: 1223287 - RNA, 21 nt, Human
ggaccagaggugagcagagaa

SEQ ID NO: 1223288 - RNA, 18 nt, Human
ggagagaaagaaauggua

SEQ ID NO: 1223289 - RNA, 22 nt, Human
ggauuaggaggaggaagggcug

SEQ ID NO: 1223290 - RNA, 23 nt, Human
uaaaaaggacuucuaccaagaac

SEQ ID NO: 1223291 - RNA, 24 nt, Human
uaaaucacuuaauauuuucaguuc

SEQ ID NO: 1223292 - RNA, 21 nt, Human
uaccaagaacaugaaaguaac

SEQ ID NO: 1223293 - RNA, 25 nt, Human
uaugauaacuaccuuguuacugcag

SEQ ID NO: 1223294 - RNA, 21 nt, Human
ucucuuauauacaagugugau

SEQ ID NO: 1223295 - RNA, 22 nt, Human
ugaaaaggaaccuuaaaagcau

SEQ ID NO: 1223296 - RNA, 22 nt, Human
ugaaauuaggacugacccaaaa

SEQ ID NO: 1223297 - RNA, 21 nt, Human
ugaauagugaagauaggguac

SEQ ID NO: 1223298 - RNA, 18 nt, Human
ugacuauaaauaaaaagg

SEQ ID NO: 1223299 - RNA, 18 nt, Human
ugauuaacguuuuucccc

SEQ ID NO: 1223300 - RNA, 25 nt, Human
uguuacugcagaaauguagaaguuu

SEQ ID NO: 1223301 - RNA, 21 nt, Human
uuccugaacuaauauaggaac

SEQ ID NO: 1223302 - RNA, 21 nt, Human
uugcuuagcuguggaccagag

SEQ ID NO: 1223303 - RNA, 20 nt, Human
agagaagggauuccucggau

SEQ ID NO: 1223304 - RNA, 22 nt, Human
aggcugggagccccagggaguc

SEQ ID NO: 1223305 - RNA, 23 nt, Human
agggauuccucggauucccaagg

SEQ ID NO: 1223306 - RNA, 23 nt, Human
caaggcacccagcgccccugccu

SEQ ID NO: 1223307 - RNA, 24 nt, Human
cacaagacuauaauuccuuuagaa

SEQ ID NO: 1223308 - RNA, 22 nt, Human
cccaaggcacccagcgccccug

SEQ ID NO: 1223309 - RNA, 22 nt, Human
ccccuucggcucccucuagucc

SEQ ID NO: 1223310 - RNA, 20 nt, Human
cccucccagccacuccgguu

SEQ ID NO: 1223311 - RNA, 21 nt, Human
cggcucccucuaguccccucc

SEQ ID NO: 1223312 - RNA, 20 nt, Human
gaaggcugggagccccaggg

SEQ ID NO: 1223313 - RNA, 19 nt, Human
ggagucuucacgaccgcuc

SEQ ID NO: 1223314 - RNA, 25 nt, Human
ggccccuucggcucccucuaguccc

SEQ ID NO: 1223315 - RNA, 21 nt, Human
ggcgcggagagggaaggcugg

SEQ ID NO: 1223316 - RNA, 22 nt, Human
gggaaggcugggagccccaggg

SEQ ID NO: 1223317 - RNA, 20 nt, Human
ggggaggggcgcggagaggg

SEQ ID NO: 1223318 - RNA, 21 nt, Human
guuuggguuugccacaagacu

SEQ ID NO: 1223319 - RNA, 21 nt, Human
ucccagccacuccgguuuggg

SEQ ID NO: 1223320 - RNA, 22 nt, Human
uccggccccuucggcucccucu

SEQ ID NO: 1223321 - RNA, 21 nt, Human
ugggagccccagggagucuuc

SEQ ID NO: 1223322 - RNA, 19 nt, Human
uggggggaggggcgcggag

SEQ ID NO: 1223323 - RNA, 20 nt, Human
uuccucggauucccaaggca

SEQ ID NO: 1223324 - RNA, 23 nt, Human
uucggcucccucuaguccccucc

SEQ ID NO: 1223325 - RNA, 24 nt, Human
uuuaaagauuuucuuuuccccccu

SEQ ID NO: 1223326 - RNA, 24 nt, Human
acagagcgagacuccaucacaaaa

SEQ ID NO: 1223327 - RNA, 18 nt, Human
acccccagagagccucaa

SEQ ID NO: 1223328 - RNA, 22 nt, Human
agccucaaccauggagccccgu

SEQ ID NO: 1223329 - RNA, 24 nt, Human
agccugggugacagagcgagacuc

SEQ ID NO: 1223330 - RNA, 18 nt, Human
auucuggccacccccaga

SEQ ID NO: 1223331 - RNA, 22 nt, Human
caccuggcuggcuucaggugug

SEQ ID NO: 1223332 - RNA, 22 nt, Human
cacuccagccugggugacagag

SEQ ID NO: 1223333 - RNA, 24 nt, Human
cacuccagccugggugacagagcg

SEQ ID NO: 1223334 - RNA, 19 nt, Human
cacuccuccaucccacugc

SEQ ID NO: 1223335 - RNA, 19 nt, Human
caugggcugcaggccugug

SEQ ID NO: 1223336 - RNA, 23 nt, Human
ccacugccuccgggugguaucug

SEQ ID NO: 1223337 - RNA, 21 nt, Human
ccauggagccccgugcugggg

SEQ ID NO: 1223338 - RNA, 22 nt, Human
ccauggagccccgugcugggga

SEQ ID NO: 1223339 - RNA, 24 nt, Human
cccacugccuccgggugguaucug

SEQ ID NO: 1223340 - RNA, 20 nt, Human
ccccacagaauggggacagg

SEQ ID NO: 1223341 - RNA, 19 nt, Human
ccccgugcuggggaacccc

SEQ ID NO: 1223342 - RNA, 22 nt, Human
ccucggcucagcacaccccacc

SEQ ID NO: 1223343 - RNA, 22 nt, Human
ccugggugacagagcgagacuc

SEQ ID NO: 1223344 - RNA, 18 nt, Human
ccuugcuugcagcucucc

SEQ ID NO: 1223345 - RNA, 20 nt, Human
cuccaucccacugccuccgg

SEQ ID NO: 1223346 - RNA, 25 nt, Human
cugugggcuccccucccccuugcuu

SEQ ID NO: 1223347 - RNA, 18 nt, Human
gagacuccaucacaaaaa

SEQ ID NO: 1223348 - RNA, 21 nt, Human
gagcgagacuccaucacaaaa

SEQ ID NO: 1223349 - RNA, 24 nt, Human
gcacuccagccugggugacagagc

SEQ ID NO: 1223350 - RNA, 22 nt, Human
gccacccccagagagccucaac

SEQ ID NO: 1223351 - RNA, 19 nt, Human
gcgaguccccgagaggucu

SEQ ID NO: 1223352 - RNA, 18 nt, Human
gcucagcacaccccaccu

SEQ ID NO: 1223353 - RNA, 21 nt, Human
ucaaccauggagccccgugcu

SEQ ID NO: 1223354 - RNA, 21 nt, Human
ucagcacaccccaccuggcug

SEQ ID NO: 1223355 - RNA, 23 nt, Human
uccagccugggugacagagcgag

SEQ ID NO: 1223356 - RNA, 24 nt, Human
uccagccugggugacagagcgaga

SEQ ID NO: 1223357 - RNA, 26 nt, Human
uccuccaucccacugccuccgggugg

SEQ ID NO: 1223358 - RNA, 18 nt, Human
ucuggccacccccagaga

SEQ ID NO: 1223359 - RNA, 19 nt, Human
ugcacuccagccuggguga

SEQ ID NO: 1223360 - RNA, 22 nt, Human
ugcacuccagccugggugacag

SEQ ID NO: 1223361 - RNA, 22 nt, Human
uggcuucaggugugaaacucac

SEQ ID NO: 1223362 - RNA, 24 nt, Human
uggggacagggaccccucggcuca

SEQ ID NO: 1223363 - RNA, 21 nt, Human
aaagggccauuggccagagag

SEQ ID NO: 1223364 - RNA, 19 nt, Human
aagaggcaggacagagagg

SEQ ID NO: 1223365 - RNA, 25 nt, Human
aagaggcaggacagagaggggcccg

SEQ ID NO: 1223366 - RNA, 22 nt, Human
acagagaggggcccgcuucgga

SEQ ID NO: 1223367 - RNA, 18 nt, Human
accaggacccucacccaa

SEQ ID NO: 1223368 - RNA, 22 nt, Human
agaggcaggacagagaggggcc

SEQ ID NO: 1223369 - RNA, 18 nt, Human
agaggggggugccuggag

SEQ ID NO: 1223370 - RNA, 24 nt, Human
agaggggggugccuggagcugcca

SEQ ID NO: 1223371 - RNA, 21 nt, Human
agccuguagccacugucacca

SEQ ID NO: 1223372 - RNA, 20 nt, Human
aggacagagaggggcccgcu

SEQ ID NO: 1223373 - RNA, 25 nt, Human
aggaccuggggcuguaggguggggg

SEQ ID NO: 1223374 - RNA, 18 nt, Human
aggcaggacagagagggg

SEQ ID NO: 1223375 - RNA, 22 nt, Human
aggcaggacagagaggggcccg

SEQ ID NO: 1223376 - RNA, 19 nt, Human
aggcggugacgccgggggc

SEQ ID NO: 1223377 - RNA, 23 nt, Human
agggacugggccaggaccugggg

SEQ ID NO: 1223378 - RNA, 20 nt, Human
augggccagagccugugugg

SEQ ID NO: 1223379 - RNA, 22 nt, Human
caaggggacagaccacaggugc

SEQ ID NO: 1223380 - RNA, 23 nt, Human
caccaccuccugcagggccgguc

SEQ ID NO: 1223381 - RNA, 23 nt, Human
caccccugugcagaggccagaag

SEQ ID NO: 1223382 - RNA, 23 nt, Human
cagugaaagggccauuggccaga

SEQ ID NO: 1223383 - RNA, 21 nt, Human
ccaacagugucagagccagca

SEQ ID NO: 1223384 - RNA, 25 nt, Human
ccagagccugugugggcgcugccca

SEQ ID NO: 1223385 - RNA, 21 nt, Human
ccaugggccagagccugugug

SEQ ID NO: 1223386 - RNA, 24 nt, Human
ccuggggcuguagggugggggugg

SEQ ID NO: 1223387 - RNA, 19 nt, Human
cgaggcaguggagggacug

SEQ ID NO: 1223388 - RNA, 25 nt, Human
cgcuucggaccuggcaaagccuggg

SEQ ID NO: 1223389 - RNA, 21 nt, Human
cggucagggcacgccaggggc

SEQ ID NO: 1223390 - RNA, 20 nt, Human
cguggaaggacggcaggccg

SEQ ID NO: 1223391 - RNA, 21 nt, Human
cuccucaggggugaggcuggg

SEQ ID NO: 1223392 - RNA, 21 nt, Human
cuggggcucucugcugcccca

SEQ ID NO: 1223393 - RNA, 22 nt, Human
cuggggcuguagggugggggug

SEQ ID NO: 1223394 - RNA, 20 nt, Human
cuguagggugggggugggag

SEQ ID NO: 1223395 - RNA, 19 nt, Human
gaccaggacccucacccaa

SEQ ID NO: 1223396 - RNA, 19 nt, Human
gagcaggugaaaagaggca

SEQ ID NO: 1223397 - RNA, 19 nt, Human
gaggggcccgcuucggacc

SEQ ID NO: 1223398 - RNA, 23 nt, Human
gagguggcagcaguggugagugg

SEQ ID NO: 1223399 - RNA, 19 nt, Human
gcaggccggcaggggggua

SEQ ID NO: 1223400 - RNA, 19 nt, Human
gcgcgggccgcaggcggga

SEQ ID NO: 1223401 - RNA, 25 nt, Human
gcgggccgcaggcgggacgcggggc

SEQ ID NO: 1223402 - RNA, 21 nt, Human
ggacagaccacaggugcuccu

SEQ ID NO: 1223403 - RNA, 27 nt, Human
ggaccuggcaaagccugggccugagca

SEQ ID NO: 1223404 - RNA, 21 nt, Human
ggaccuggggcuguagggugg

SEQ ID NO: 1223405 - RNA, 22 nt, Human
ggacugggccaggaccuggggc

SEQ ID NO: 1223406 - RNA, 22 nt, Human
ggacugggccaggaccuggggc

SEQ ID NO: 1223407 - RNA, 18 nt, Human
ggcaaagccugggccuga

SEQ ID NO: 1223408 - RNA, 22 nt, Human
ggcaggcgggcaggaggcggug

SEQ ID NO: 1223409 - RNA, 23 nt, Human
ggcccagccuguagccacuguca

SEQ ID NO: 1223410 - RNA, 21 nt, Human
gggcuguaggguggggguggg

SEQ ID NO: 1223411 - RNA, 18 nt, Human
ggggcccagccuguagcc

SEQ ID NO: 1223412 - RNA, 22 nt, Human
ggggcuguaggguggggguggg

SEQ ID NO: 1223413 - RNA, 19 nt, Human
ggggggugccuggagcugc

SEQ ID NO: 1223414 - RNA, 22 nt, Human
gggggugggagggcgugagcag

SEQ ID NO: 1223415 - RNA, 22 nt, Human
gggggugggagggcgugagcag

SEQ ID NO: 1223416 - RNA, 24 nt, Human
gugaaagggccauuggccagagag

SEQ ID NO: 1223417 - RNA, 22 nt, Human
guggugagaggggggugccugg

SEQ ID NO: 1223418 - RNA, 20 nt, Human
uagccacugucaccaccccu

SEQ ID NO: 1223419 - RNA, 21 nt, Human
uaggcgggcaggcgggcaggc

SEQ ID NO: 1223420 - RNA, 21 nt, Human
uaggcggguaggcgggcaggc

SEQ ID NO: 1223421 - RNA, 21 nt, Human
uaggcggguaggcggguaggc

SEQ ID NO: 1223422 - RNA, 21 nt, Human
uaggcggguaggcggguaggc

SEQ ID NO: 1223423 - RNA, 21 nt, Human
uagggugggggugggagggcg

SEQ ID NO: 1223424 - RNA, 19 nt, Human
ucaccaggccagugaaagg

SEQ ID NO: 1223425 - RNA, 20 nt, Human
ucaccaggccagugaaaggg

SEQ ID NO: 1223426 - RNA, 24 nt, Human
uccagccauaagcaggaccaaggg

SEQ ID NO: 1223427 - RNA, 22 nt, Human
ucggaccuggcaaagccugggc

SEQ ID NO: 1223428 - RNA, 18 nt, Human
ugagaggggggugccugg

SEQ ID NO: 1223429 - RNA, 19 nt, Human
ugccccagccucacucugc

SEQ ID NO: 1223430 - RNA, 22 nt, Human
ugcccgaaaggaaaaggcaggg

SEQ ID NO: 1223431 - RNA, 19 nt, Human
ugccuggagcugccaguag

SEQ ID NO: 1223432 - RNA, 21 nt, Human
ugccuggagcugccaguagga

SEQ ID NO: 1223433 - RNA, 20 nt, Human
uggcagcaguggugaguggc

SEQ ID NO: 1223434 - RNA, 20 nt, Human
uggcuacagggcacucgggg

SEQ ID NO: 1223435 - RNA, 19 nt, Human
ugggagggcgugagcaggu

SEQ ID NO: 1223436 - RNA, 23 nt, Human
uggggcuguaggguggggguggg

SEQ ID NO: 1223437 - RNA, 18 nt, Human
aaaacaagcauaaauucc

SEQ ID NO: 1223438 - RNA, 18 nt, Human
aaacaagcauaaauuccu

SEQ ID NO: 1223439 - RNA, 23 nt, Human
aauguuucuuaaguuaacaugau

SEQ ID NO: 1223440 - RNA, 21 nt, Human
acaaaucaggguggugaccuu

SEQ ID NO: 1223441 - RNA, 21 nt, Human
acgcaacaucaacgccaacca

SEQ ID NO: 1223442 - RNA, 21 nt, Human
acuccagagagcauugcaaaa

SEQ ID NO: 1223443 - RNA, 25 nt, Human
agaacucuuccaagggugcaugcuu

SEQ ID NO: 1223444 - RNA, 24 nt, Human
agccugucugaucuggugcuuguu

SEQ ID NO: 1223445 - RNA, 19 nt, Human
aucaacgccaaccacuccu

SEQ ID NO: 1223446 - RNA, 18 nt, Human
aucaggguggugaccuug

SEQ ID NO: 1223447 - RNA, 19 nt, Human
caaaccuaucacuugcauc

SEQ ID NO: 1223448 - RNA, 21 nt, Human
cauuuaugaaauccucuaaaa

SEQ ID NO: 1223449 - RNA, 19 nt, Human
cgcaacaucaacgccaacc

SEQ ID NO: 1223450 - RNA, 25 nt, Human
cgccaaagcuguagaacucuuccaa

SEQ ID NO: 1223451 - RNA, 19 nt, Human
cuucuggaaauugcaguuc

SEQ ID NO: 1223452 - RNA, 18 nt, Human
gguggugaccuuggccac

SEQ ID NO: 1223453 - RNA, 22 nt, Human
uaaaacaagcauaaauuccuau

SEQ ID NO: 1223454 - RNA, 24 nt, Human
uaaauaaauauucaccaaacuccu

SEQ ID NO: 1223455 - RNA, 19 nt, Human
uaauguauguuauguauau

SEQ ID NO: 1223456 - RNA, 18 nt, Human
uaucaggacaaaucaggg

SEQ ID NO: 1223457 - RNA, 22 nt, Human
uauguuauguauaugugauauu

SEQ ID NO: 1223458 - RNA, 22 nt, Human
ucauuauugaauauaaaacaag

SEQ ID NO: 1223459 - RNA, 20 nt, Human
ucuggaaauugcaguucauc

SEQ ID NO: 1223460 - RNA, 18 nt, Human
ugccuuguucucuuuauc

SEQ ID NO: 1223461 - RNA, 24 nt, Human
ugucauagagcuucuucacagccu

SEQ ID NO: 1223462 - RNA, 23 nt, Human
ugugauauuuucugaacuccaga

SEQ ID NO: 1223463 - RNA, 24 nt, Human
uuugauucuaauuaaguugucauu

SEQ ID NO: 1223464 - RNA, 23 nt, Human
aagagucugagguccagagugga

SEQ ID NO: 1223465 - RNA, 20 nt, Human
aagcagagccugagcccgcg

SEQ ID NO: 1223466 - RNA, 20 nt, Human
aaggggcguugccagagacu

SEQ ID NO: 1223467 - RNA, 25 nt, Human
acucuguugcccagccuggccucaa

SEQ ID NO: 1223468 - RNA, 23 nt, Human
acuucagccuccugaguagcugg

SEQ ID NO: 1223469 - RNA, 22 nt, Human
agagagugguccacagcaagcc

SEQ ID NO: 1223470 - RNA, 23 nt, Human
aggcuuucuggugucauugcugc

SEQ ID NO: 1223471 - RNA, 24 nt, Human
agggauccucccacuucagccucc

SEQ ID NO: 1223472 - RNA, 18 nt, Human
aguuaggcaggcuuucug

SEQ ID NO: 1223473 - RNA, 18 nt, Human
augaaaaauuugagagga

SEQ ID NO: 1223474 - RNA, 25 nt, Human
caaacuccugagcucaagggauccu

SEQ ID NO: 1223475 - RNA, 24 nt, Human
caagggauccucccacuucagccu

SEQ ID NO: 1223476 - RNA, 19 nt, Human
cacucuguugcccagccug

SEQ ID NO: 1223477 - RNA, 24 nt, Human
cacucuguugcccagccuggccuc

SEQ ID NO: 1223478 - RNA, 19 nt, Human
cacuguaccuggacaaaga

SEQ ID NO: 1223479 - RNA, 19 nt, Human
cagccuccugaguagcugg

SEQ ID NO: 1223480 - RNA, 24 nt, Human
ccacagcaagccacggaguggcau

SEQ ID NO: 1223481 - RNA, 22 nt, Human
ccagaaccccuggccccuucuc

SEQ ID NO: 1223482 - RNA, 22 nt, Human
ccagugguaguuccaaggcugg

SEQ ID NO: 1223483 - RNA, 24 nt, Human
cccacuucagccuccugaguagcu

SEQ ID NO: 1223484 - RNA, 19 nt, Human
cccagaaccccuggccccu

SEQ ID NO: 1223485 - RNA, 23 nt, Human
cccuccacaugcuacuucaugcc

SEQ ID NO: 1223486 - RNA, 21 nt, Human
cccuggccccuucuccacucc

SEQ ID NO: 1223487 - RNA, 23 nt, Human
ccgaggagcuggaacuguaaagg

SEQ ID NO: 1223488 - RNA, 18 nt, Human
ccucacucuguugcccag

SEQ ID NO: 1223489 - RNA, 26 nt, Human
ccucacucuguugcccagccuggccu

SEQ ID NO: 1223490 - RNA, 27 nt, Human
ccucacucuguugcccagccuggccuc

SEQ ID NO: 1223491 - RNA, 23 nt, Human
ccucccacuucagccuccugagu

SEQ ID NO: 1223492 - RNA, 20 nt, Human
ccugagcucaagggauccuc

SEQ ID NO: 1223493 - RNA, 29 nt, Human
ccuggccucaaacuccugagccgguuccg

SEQ ID NO: 1223494 - RNA, 19 nt, Human
ccuggggcucccuacguga

SEQ ID NO: 1223495 - RNA, 24 nt, Human
cucaagggauccucccacuucagc

SEQ ID NO: 1223496 - RNA, 21 nt, Human
cuccacaugcuacuucaugcc

SEQ ID NO: 1223497 - RNA, 21 nt, Human
cuggacagugaagcagagccu

SEQ ID NO: 1223498 - RNA, 20 nt, Human
cuguaccuggacaaagacua

SEQ ID NO: 1223499 - RNA, 18 nt, Human
gaaguuucccauguuccc

SEQ ID NO: 1223500 - RNA, 25 nt, Human
gaggagcuggaacuguaaagguugu

SEQ ID NO: 1223501 - RNA, 25 nt, Human
gaguagcuggaacuacaggcacaug

SEQ ID NO: 1223502 - RNA, 18 nt, Human
gcccagaaccccuggccc

SEQ ID NO: 1223503 - RNA, 18 nt, Human
gcccgcggggagaaugcc

SEQ ID NO: 1223504 - RNA, 22 nt, Human
gcugcccagaaccccuggcccc

SEQ ID NO: 1223505 - RNA, 22 nt, Human
gcugggggugggcaggagucac

SEQ ID NO: 1223506 - RNA, 21 nt, Human
ggcgugguggagaacagccag

SEQ ID NO: 1223507 - RNA, 21 nt, Human
ggggugggcaggagucacuuc

SEQ ID NO: 1223508 - RNA, 18 nt, Human
guccacagcaagccacgg

SEQ ID NO: 1223509 - RNA, 22 nt, Human
gugcuuuuccuuguccugcccu

SEQ ID NO: 1223510 - RNA, 18 nt, Human
gugguaguuccaaggcug

SEQ ID NO: 1223511 - RNA, 21 nt, Human
uaaaggggcguugccagagac

SEQ ID NO: 1223512 - RNA, 24 nt, Human
uaauugcccuuaguaaagggcugg

SEQ ID NO: 1223513 - RNA, 22 nt, Human
uacaggcacaugccacuguacc

SEQ ID NO: 1223514 - RNA, 23 nt, Human
uacaucauuuucacccaaagucc

SEQ ID NO: 1223515 - RNA, 20 nt, Human
uaccuggacaaagacuaauu

SEQ ID NO: 1223516 - RNA, 23 nt, Human
uagaaguuucccauguuccccga

SEQ ID NO: 1223517 - RNA, 23 nt, Human
uaggcucaugaaaaauuugagag

SEQ ID NO: 1223518 - RNA, 23 nt, Human
uauaaaugaagagucugaggucc

SEQ ID NO: 1223519 - RNA, 18 nt, Human
ucacugccaccaggcaga

SEQ ID NO: 1223520 - RNA, 20 nt, Human
ucacugccaccaggcagagu

SEQ ID NO: 1223521 - RNA, 19 nt, Human
ucagaacgugugcaucccc

SEQ ID NO: 1223522 - RNA, 23 nt, Human
ucagccuccugaguagcuggaac

SEQ ID NO: 1223523 - RNA, 18 nt, Human
uccaggguguggggcccg

SEQ ID NO: 1223524 - RNA, 24 nt, Human
uccugaguagcuggaacuacaggc

SEQ ID NO: 1223525 - RNA, 21 nt, Human
uccugcccugggaagagcaca

SEQ ID NO: 1223526 - RNA, 22 nt, Human
ucuuugagaaguugccaagugg

SEQ ID NO: 1223527 - RNA, 19 nt, Human
ugauguggugcuuuuccuu

SEQ ID NO: 1223528 - RNA, 21 nt, Human
ugcccagaaccccuggccccu

SEQ ID NO: 1223529 - RNA, 18 nt, Human
ugcugccccucacucagc

SEQ ID NO: 1223530 - RNA, 21 nt, Human
uggaacuacaggcacaugcca

SEQ ID NO: 1223531 - RNA, 23 nt, Human
uggaacuacaggcacaugccacu

SEQ ID NO: 1223532 - RNA, 24 nt, Human
uggaacuacaggcacaugccacug

SEQ ID NO: 1223533 - RNA, 22 nt, Human
uggaccucacucuguugcccag

SEQ ID NO: 1223534 - RNA, 24 nt, Human
ugggaagagcacaucuuugagaag

SEQ ID NO: 1223535 - RNA, 19 nt, Human
ugggcaggagucacuucug

SEQ ID NO: 1223536 - RNA, 24 nt, Human
uguaauuccugaggcccuccacau

SEQ ID NO: 1223537 - RNA, 20 nt, Human
uguggggauaauugagacca

SEQ ID NO: 1223538 - RNA, 19 nt, Human
uuagagcaguuuuaggcuc

SEQ ID NO: 1223539 - RNA, 20 nt, Human
uuaggcucaugaaaaauuug

SEQ ID NO: 1223540 - RNA, 19 nt, Human
uuccuggggcucccuacgu

SEQ ID NO: 1223541 - RNA, 19 nt, Human
uugaaugcugauguggugc

SEQ ID NO: 1223542 - RNA, 18 nt, Human
uugcccagccuggccuca

SEQ ID NO: 1223543 - RNA, 21 nt, Human
caccagccgcgcccucuccgc

SEQ ID NO: 1223544 - RNA, 24 nt, Human
caccccggcgcccgccccgagggc

SEQ ID NO: 1223545 - RNA, 20 nt, Human
cagccgcgcccucuccgccg

SEQ ID NO: 1223546 - RNA, 23 nt, Human
cagccgcgcccucuccgccgccc

SEQ ID NO: 1223547 - RNA, 18 nt, Human
cagggaccgagccaggcc

SEQ ID NO: 1223548 - RNA, 19 nt, Human
cccccgagcccugcucccc

SEQ ID NO: 1223549 - RNA, 22 nt, Human
cccccgagcccugcuccccagc

SEQ ID NO: 1223550 - RNA, 23 nt, Human
ccccgagcccugcuccccagccc

SEQ ID NO: 1223551 - RNA, 22 nt, Human
cccucgggucugcaggaggcgc

SEQ ID NO: 1223552 - RNA, 18 nt, Human
cgacccuaccagcggcga

SEQ ID NO: 1223553 - RNA, 23 nt, Human
cgcacccggugcgcagggaccga

SEQ ID NO: 1223554 - RNA, 21 nt, Human
cgcggguguuaggggcggagg

SEQ ID NO: 1223555 - RNA, 22 nt, Human
cucaccagccgcgcccucuccg

SEQ ID NO: 1223556 - RNA, 21 nt, Human
cugagugccuacuguguccca

SEQ ID NO: 1223557 - RNA, 21 nt, Human
cugcccccgagcccugcuccc

SEQ ID NO: 1223558 - RNA, 19 nt, Human
gaggacgccagggcugagc

SEQ ID NO: 1223559 - RNA, 19 nt, Human
gccccgagggcugcgcgcu

SEQ ID NO: 1223560 - RNA, 21 nt, Human
gccgcgcccucuccgccgccc

SEQ ID NO: 1223561 - RNA, 25 nt, Human
gccuucaacaacgaacguuugcuga

SEQ ID NO: 1223562 - RNA, 21 nt, Human
gggacccgggccucgcccucc

SEQ ID NO: 1223563 - RNA, 20 nt, Human
gguggaggacgccagggcug

SEQ ID NO: 1223564 - RNA, 19 nt, Human
guggaggacgccagggcug

SEQ ID NO: 1223565 - RNA, 23 nt, Human
guggugguggaggacgccagggc

SEQ ID NO: 1223566 - RNA, 22 nt, Human
uaauaaaaugggauuuauuuua

SEQ ID NO: 1223567 - RNA, 20 nt, Human
uacagcaauagauaaauaga

SEQ ID NO: 1223568 - RNA, 22 nt, Human
uaccagcggcgacccucggguc

SEQ ID NO: 1223569 - RNA, 19 nt, Human
uccaggcgcgcagggagcc

SEQ ID NO: 1223570 - RNA, 20 nt, Human
ucccagggcucaccagccgc

SEQ ID NO: 1223571 - RNA, 21 nt, Human
uccugggcccucccagggcuc

SEQ ID NO: 1223572 - RNA, 22 nt, Human
ucgggucugcaggaggcgcggg

SEQ ID NO: 1223573 - RNA, 18 nt, Human
ucugaggcugccgugggg

SEQ ID NO: 1223574 - RNA, 23 nt, Human
ucuggcuccugggcccucccagg

SEQ ID NO: 1223575 - RNA, 24 nt, Human
ugaggcugccguggggcgcccagg

SEQ ID NO: 1223576 - RNA, 26 nt, Human
ugcccccgagcccugcuccccagccc

SEQ ID NO: 1223577 - RNA, 22 nt, Human
uggaggacgccagggcugagcg

SEQ ID NO: 1223578 - RNA, 20 nt, Human
ugggauuuauuuuaagccac

SEQ ID NO: 1223579 - RNA, 21 nt, Human
ugguggaggacgccagggcug

SEQ ID NO: 1223580 - RNA, 25 nt, Human
uguggugguggaggacgccagggcu

SEQ ID NO: 1223581 - RNA, 19 nt, Human
uguuaggggcggaggggcc

SEQ ID NO: 1223582 - RNA, 19 nt, Human
uguuauacagcaauagaua

SEQ ID NO: 1223583 - RNA, 18 nt, Human
cacaaaccaauaauuucc

SEQ ID NO: 1223584 - RNA, 26 nt, Human
uaacugagaauaaagcuaucaugcag

SEQ ID NO: 1223585 - RNA, 20 nt, Human
uaauggaugucaaaaccagu

SEQ ID NO: 1223586 - RNA, 21 nt, Human
uauuauggggaaagauaacuu

SEQ ID NO: 1223587 - RNA, 22 nt, Human
ucaaaaccagucagaaguaucc

SEQ ID NO: 1223588 - RNA, 22 nt, Human
ucagguguuuuuguggguuuca

SEQ ID NO: 1223589 - RNA, 26 nt, Human
ugcagagauaaaaguaaugcagauac

SEQ ID NO: 1223590 - RNA, 22 nt, Human
uugaaagccacucuaccacuag

SEQ ID NO: 1223591 - RNA, 21 nt, Human
aaaagcagguaauaaaaguca

SEQ ID NO: 1223592 - RNA, 26 nt, Human
aagcaggaaauauauaaaagggaccc

SEQ ID NO: 1223593 - RNA, 30 nt, Human
aagucaacuuuaaguuaaauuaugaccaag

SEQ ID NO: 1223594 - RNA, 21 nt, Human
cacauguauaccaaacagggc

SEQ ID NO: 1223595 - RNA, 22 nt, Human
cagaaaaaccuaaauuagcuua

SEQ ID NO: 1223596 - RNA, 23 nt, Human
cagaggugcuaagucaacuuuaa

SEQ ID NO: 1223597 - RNA, 20 nt, Human
cauaggaugugaucuggcau

SEQ ID NO: 1223598 - RNA, 19 nt, Human
cauguauaccaaacagggc

SEQ ID NO: 1223599 - RNA, 18 nt, Human
ccaaacagggcaaaccca

SEQ ID NO: 1223600 - RNA, 19 nt, Human
ccaaacagggcaaacccau

SEQ ID NO: 1223601 - RNA, 21 nt, Human
cuucacauguauaccaaacag

SEQ ID NO: 1223602 - RNA, 18 nt, Human
cuugcuucucuccucugu

SEQ ID NO: 1223603 - RNA, 21 nt, Human
cuuuggaugaguaguauagau

SEQ ID NO: 1223604 - RNA, 20 nt, Human
gaaaaaccuaaauuagcuua

SEQ ID NO: 1223605 - RNA, 19 nt, Human
gaucauaggaugugaucug

SEQ ID NO: 1223606 - RNA, 22 nt, Human
uaaaagucagcaguuggaguag

SEQ ID NO: 1223607 - RNA, 25 nt, Human
uacacagugucuuaauaaaagucag

SEQ ID NO: 1223608 - RNA, 23 nt, Human
uagaaauuacuauucuaagguuu

SEQ ID NO: 1223609 - RNA, 21 nt, Human
uauauaauuauauggguuguc

SEQ ID NO: 1223610 - RNA, 22 nt, Human
uaucacugacaaaauauugaaa

SEQ ID NO: 1223611 - RNA, 19 nt, Human
uaugcaggaaaaaaauguu

SEQ ID NO: 1223612 - RNA, 18 nt, Human
uauggguugucucuugcu

SEQ ID NO: 1223613 - RNA, 27 nt, Human
ucaaaaguaaauauacaaaaaucuuac

SEQ ID NO: 1223614 - RNA, 21 nt, Human
ucagaggugcuaagucaacuu

SEQ ID NO: 1223615 - RNA, 23 nt, Human
ucucaauacugcauuauucuuca

SEQ ID NO: 1223616 - RNA, 20 nt, Human
ucugucuuuucccugucuuc

SEQ ID NO: 1223617 - RNA, 24 nt, Human
ucuugcuucucuccucugucuuuu

SEQ ID NO: 1223618 - RNA, 22 nt, Human
ugaaacagaauaucagcaaugu

SEQ ID NO: 1223619 - RNA, 21 nt, Human
ugucauugcaacauugucugc

SEQ ID NO: 1223620 - RNA, 23 nt, Human
ugucauugcaacauugucugcaa

SEQ ID NO: 1223621 - RNA, 18 nt, Human
ugucucuugcuucucucc

SEQ ID NO: 1223622 - RNA, 22 nt, Human
ugucuuuuuuaaugauuggcuu

SEQ ID NO: 1223623 - RNA, 24 nt, Human
ugugauguagaguauuucuugcuu

SEQ ID NO: 1223624 - RNA, 20 nt, Human
uguuuuaacaaaauaagcag

SEQ ID NO: 1223625 - RNA, 19 nt, Human
uucaaggaaggugauaaga

SEQ ID NO: 1223626 - RNA, 23 nt, Human
uuccagaaaaaccuaaauuagcu

SEQ ID NO: 1223627 - RNA, 22 nt, Human
uuuuauaacagcauauaucacu

SEQ ID NO: 1223628 - RNA, 19 nt, Human
aaaaugaaaauuacccucu

SEQ ID NO: 1223629 - RNA, 23 nt, Human
aaauaccuuccuagaagaagccc

SEQ ID NO: 1223630 - RNA, 21 nt, Human
aagaagcccagacacucagca

SEQ ID NO: 1223631 - RNA, 19 nt, Human
aagaggccagagcgcccuc

SEQ ID NO: 1223632 - RNA, 25 nt, Human
aagaggccagagcgcccucugggug

SEQ ID NO: 1223633 - RNA, 18 nt, Human
aagcuccaggucugaugg

SEQ ID NO: 1223634 - RNA, 19 nt, Human
aaggucaggagggcagggc

SEQ ID NO: 1223635 - RNA, 23 nt, Human
acaacgugccacgaacaauuacc

SEQ ID NO: 1223636 - RNA, 20 nt, Human
acccaaagugugggggugag

SEQ ID NO: 1223637 - RNA, 23 nt, Human
accucugccacccugcacacccc

SEQ ID NO: 1223638 - RNA, 20 nt, Human
accugugggggcugcagggg

SEQ ID NO: 1223639 - RNA, 23 nt, Human
acuccaguggcugagucuuucug

SEQ ID NO: 1223640 - RNA, 21 nt, Human
acugaaggguggagaggggag

SEQ ID NO: 1223641 - RNA, 19 nt, Human
acugccuguggaaacccca

SEQ ID NO: 1223642 - RNA, 19 nt, Human
agaagggcucccugccucu

SEQ ID NO: 1223643 - RNA, 28 nt, Human
agacaggaggcagaagcugaggggaccc

SEQ ID NO: 1223644 - RNA, 20 nt, Human
agacaucuccacccgacugg

SEQ ID NO: 1223645 - RNA, 21 nt, Human
agcagacacccuccuguagau

SEQ ID NO: 1223646 - RNA, 18 nt, Human
agcagguggcuccugggg

SEQ ID NO: 1223647 - RNA, 26 nt, Human
agccaggaggugguuaccuucuaggg

SEQ ID NO: 1223648 - RNA, 23 nt, Human
agcccagccuugggccaggugcu

SEQ ID NO: 1223649 - RNA, 18 nt, Human
agcuaggggccccugagc

SEQ ID NO: 1223650 - RNA, 18 nt, Human
aggaagcuggaggggcug

SEQ ID NO: 1223651 - RNA, 22 nt, Human
aggaggacgcccgagugauucc

SEQ ID NO: 1223652 - RNA, 23 nt, Human
aggagggcagggcuugacuggga

SEQ ID NO: 1223653 - RNA, 19 nt, Human
aggcagcucuuucccagga

SEQ ID NO: 1223654 - RNA, 20 nt, Human
aggcagggaucucucugcag

SEQ ID NO: 1223655 - RNA, 27 nt, Human
aggcggaggugaagcugaggugauuau

SEQ ID NO: 1223656 - RNA, 20 nt, Human
agggacccaaaguguggggg

SEQ ID NO: 1223657 - RNA, 25 nt, Human
agugcaagagggcaggcaggaggga

SEQ ID NO: 1223658 - RNA, 21 nt, Human
cacacaugaugcugggguuuc

SEQ ID NO: 1223659 - RNA, 26 nt, Human
cacacucccagcaccagaagagcccc

SEQ ID NO: 1223660 - RNA, 21 nt, Human
cacagcacagcccuggagagc

SEQ ID NO: 1223661 - RNA, 19 nt, Human
cacagcccagccuugggcc

SEQ ID NO: 1223662 - RNA, 22 nt, Human
cacccugcacaccccggagagc

SEQ ID NO: 1223663 - RNA, 20 nt, Human
cacgggugaccaagaggcca

SEQ ID NO: 1223664 - RNA, 19 nt, Human
cagcaccagaagagcccca

SEQ ID NO: 1223665 - RNA, 19 nt, Human
cagcacugaaggguggaga

SEQ ID NO: 1223666 - RNA, 21 nt, Human
cagcagccacagcacagcccu

SEQ ID NO: 1223667 - RNA, 19 nt, Human
cagggaucucucugcagag

SEQ ID NO: 1223668 - RNA, 19 nt, Human
cagggcaggacaaggucag

SEQ ID NO: 1223669 - RNA, 21 nt, Human
cagggcuccaggaacugcaag

SEQ ID NO: 1223670 - RNA, 18 nt, Human
caguugccaggagaccag

SEQ ID NO: 1223671 - RNA, 21 nt, Human
caguugccaggagaccagcug

SEQ ID NO: 1223672 - RNA, 18 nt, Human
ccaacaaccugcagggcu

SEQ ID NO: 1223673 - RNA, 23 nt, Human
ccaccuagguccucaaagaggug

SEQ ID NO: 1223674 - RNA, 20 nt, Human
ccagcuggccccuagacauc

SEQ ID NO: 1223675 - RNA, 23 nt, Human
cccagcugucuaugggcccuggg

SEQ ID NO: 1223676 - RNA, 20 nt, Human
ccccaaagacccuggcugga

SEQ ID NO: 1223677 - RNA, 25 nt, Human
ccccaaagacccuggcuggagcaug

SEQ ID NO: 1223678 - RNA, 21 nt, Human
ccccacucccccagcugucua

SEQ ID NO: 1223679 - RNA, 22 nt, Human
cccccagcugucuaugggcccu

SEQ ID NO: 1223680 - RNA, 19 nt, Human
cccccggggcaugggcgcc

SEQ ID NO: 1223681 - RNA, 23 nt, Human
ccccuagacaucuccacccgacu

SEQ ID NO: 1223682 - RNA, 18 nt, Human
ccccugagccaguuaagg

SEQ ID NO: 1223683 - RNA, 27 nt, Human
ccccugagccaguuaaggccuuugugg

SEQ ID NO: 1223684 - RNA, 28 nt, Human
ccccugggcugaaacugccuguggaaac

SEQ ID NO: 1223685 - RNA, 21 nt, Human
cccugagccaguuaaggccuu

SEQ ID NO: 1223686 - RNA, 18 nt, Human
cccugcacaccccggaga

SEQ ID NO: 1223687 - RNA, 19 nt, Human
cccugcaguguaagucacc

SEQ ID NO: 1223688 - RNA, 23 nt, Human
cccugccccaggcugcugccucc

SEQ ID NO: 1223689 - RNA, 18 nt, Human
cccugccucuccaacaac

SEQ ID NO: 1223690 - RNA, 19 nt, Human
cccuggcuggagcaugcga

SEQ ID NO: 1223691 - RNA, 27 nt, Human
cccuggggucccagcacugaagggugg

SEQ ID NO: 1223692 - RNA, 21 nt, Human
ccuccugucuccccacucccc

SEQ ID NO: 1223693 - RNA, 23 nt, Human
ccuccugucuccccacuccccca

SEQ ID NO: 1223694 - RNA, 23 nt, Human
ccucugccacaacgugccacgaa

SEQ ID NO: 1223695 - RNA, 18 nt, Human
ccucuggguggcaugacu

SEQ ID NO: 1223696 - RNA, 24 nt, Human
ccugcaguguaagucaccuggggc

SEQ ID NO: 1223697 - RNA, 26 nt, Human
ccuggggucccagcacugaagggugg

SEQ ID NO: 1223698 - RNA, 20 nt, Human
ccuguccucacgccuggccc

SEQ ID NO: 1223699 - RNA, 24 nt, Human
ccuguccucacgccuggccccaac

SEQ ID NO: 1223700 - RNA, 23 nt, Human
ccuguggaaaccccagggaaacc

SEQ ID NO: 1223701 - RNA, 21 nt, Human
cucccagcaccagaagagccc

SEQ ID NO: 1223702 - RNA, 23 nt, Human
cuccccacucccccagcugucua

SEQ ID NO: 1223703 - RNA, 21 nt, Human
cuccuggggcaccuguccuca

SEQ ID NO: 1223704 - RNA, 19 nt, Human
cucuauucuugccggcucu

SEQ ID NO: 1223705 - RNA, 21 nt, Human
cucugccacccugcacacccc

SEQ ID NO: 1223706 - RNA, 19 nt, Human
cucuggguggcaugacugu

SEQ ID NO: 1223707 - RNA, 20 nt, Human
cugaaggguggagaggggag

SEQ ID NO: 1223708 - RNA, 18 nt, Human
cugaccgcagcagccaca

SEQ ID NO: 1223709 - RNA, 23 nt, Human
cugcucucuccagcccccggggc

SEQ ID NO: 1223710 - RNA, 21 nt, Human
cugcugccuccacaccacagc

SEQ ID NO: 1223711 - RNA, 19 nt, Human
cuggccccuagacaucucc

SEQ ID NO: 1223712 - RNA, 21 nt, Human
cuggguucugggagaggaagu

SEQ ID NO: 1223713 - RNA, 22 nt, Human
cuuauucguguuuauuggaacc

SEQ ID NO: 1223714 - RNA, 23 nt, Human
gaaacugccuguggaaaccccag

SEQ ID NO: 1223715 - RNA, 19 nt, Human
gaaggcuggaccugcccuc

SEQ ID NO: 1223716 - RNA, 24 nt, Human
gaccgcagcagccacagcacagcc

SEQ ID NO: 1223717 - RNA, 22 nt, Human
gagaggaagugcaagagggcag

SEQ ID NO: 1223718 - RNA, 20 nt, Human
gaggcagaagcugagcuuga

SEQ ID NO: 1223719 - RNA, 23 nt, Human
gaguuccuccugucuccccacuc

SEQ ID NO: 1223720 - RNA, 23 nt, Human
gcaagguggcccucaucucccug

SEQ ID NO: 1223721 - RNA, 22 nt, Human
gcacauuugaugauuggaaaua

SEQ ID NO: 1223722 - RNA, 20 nt, Human
gcaccagaagagccccagga

SEQ ID NO: 1223723 - RNA, 18 nt, Human
gcagcugccccaccacag

SEQ ID NO: 1223724 - RNA, 22 nt, Human
gcagcugccccaccacagggcc

SEQ ID NO: 1223725 - RNA, 21 nt, Human
gccccaccacagggccaggcu

SEQ ID NO: 1223726 - RNA, 22 nt, Human
gccccugagccaguuaaggccu

SEQ ID NO: 1223727 - RNA, 24 nt, Human
gcccgagggucccaggagacagga

SEQ ID NO: 1223728 - RNA, 18 nt, Human
gcccucuucaccccaguc

SEQ ID NO: 1223729 - RNA, 23 nt, Human
gccuggcugcucucuccagcccc

SEQ ID NO: 1223730 - RNA, 19 nt, Human
gccuguggaaaccccaggg

SEQ ID NO: 1223731 - RNA, 20 nt, Human
gcgacucaggaaauacagac

SEQ ID NO: 1223732 - RNA, 20 nt, Human
gcggcggcgggggagcaggc

SEQ ID NO: 1223733 - RNA, 18 nt, Human
ggagaggggagggaggcu

SEQ ID NO: 1223734 - RNA, 20 nt, Human
ggaggggcugcugaaggcug

SEQ ID NO: 1223735 - RNA, 21 nt, Human
ggaggugguuaccuucuaggg

SEQ ID NO: 1223736 - RNA, 18 nt, Human
ggcaggcaggagggagaa

SEQ ID NO: 1223737 - RNA, 20 nt, Human
ggcagggcuugacugggagc

SEQ ID NO: 1223738 - RNA, 19 nt, Human
gggaaggaacggggcucag

SEQ ID NO: 1223739 - RNA, 20 nt, Human
gggaaggaacggggcucagg

SEQ ID NO: 1223740 - RNA, 23 nt, Human
gggagggaggcugacgguguggg

SEQ ID NO: 1223741 - RNA, 24 nt, Human
gggcaggccccaccuagguccuca

SEQ ID NO: 1223742 - RNA, 18 nt, Human
ggggagggaggcugacgg

SEQ ID NO: 1223743 - RNA, 20 nt, Human
ggggaggggcugcugaaggc

SEQ ID NO: 1223744 - RNA, 18 nt, Human
gggggaggggcugcugaa

SEQ ID NO: 1223745 - RNA, 20 nt, Human
ggggugcagcugccccacca

SEQ ID NO: 1223746 - RNA, 24 nt, Human
ggugaccugugggggcugcagggg

SEQ ID NO: 1223747 - RNA, 18 nt, Human
guccccaaagacccuggc

SEQ ID NO: 1223748 - RNA, 24 nt, Human
gugccuggcugcucucuccagccc

SEQ ID NO: 1223749 - RNA, 18 nt, Human
guggagcagguggcuccu

SEQ ID NO: 1223750 - RNA, 20 nt, Human
gugggaggggugggucacug

SEQ ID NO: 1223751 - RNA, 18 nt, Human
guuuauuaauuaaccucu

SEQ ID NO: 1223752 - RNA, 20 nt, Human
uaaggccuuuguggaugagu

SEQ ID NO: 1223753 - RNA, 19 nt, Human
uagaagaagcccagacacu

SEQ ID NO: 1223754 - RNA, 24 nt, Human
uagaagaagcccagacacucagca

SEQ ID NO: 1223755 - RNA, 19 nt, Human
uagaagcccuccccucuuc

SEQ ID NO: 1223756 - RNA, 22 nt, Human
uagagguuacagagggguggcu

SEQ ID NO: 1223757 - RNA, 18 nt, Human
uagugcuggguucuggga

SEQ ID NO: 1223758 - RNA, 19 nt, Human
ucacacucccagcaccaga

SEQ ID NO: 1223759 - RNA, 20 nt, Human
ucacucuacagaacugguca

SEQ ID NO: 1223760 - RNA, 24 nt, Human
ucauucagcugugacucauccauu

SEQ ID NO: 1223761 - RNA, 20 nt, Human
uccacacaugaugcuggggu

SEQ ID NO: 1223762 - RNA, 24 nt, Human
uccacaccacagcguccugcaagg

SEQ ID NO: 1223763 - RNA, 28 nt, Human
ucccagcacugaaggguggggcggacgc

SEQ ID NO: 1223764 - RNA, 24 nt, Human
ucccaggaagcuggaggggcugcc

SEQ ID NO: 1223765 - RNA, 19 nt, Human
ucccaggaggacgcccgag

SEQ ID NO: 1223766 - RNA, 22 nt, Human
uccccugggcugaaacugccug

SEQ ID NO: 1223767 - RNA, 23 nt, Human
ucccugccucuccaacaaccugc

SEQ ID NO: 1223768 - RNA, 19 nt, Human
ucccugggucuuccccugg

SEQ ID NO: 1223769 - RNA, 23 nt, Human
ucccuugugcagccuacgggagc

SEQ ID NO: 1223770 - RNA, 21 nt, Human
uccugccacucaggccccugc

SEQ ID NO: 1223771 - RNA, 21 nt, Human
uccuggucucugcucuauucu

SEQ ID NO: 1223772 - RNA, 21 nt, Human
ucuccaacaaccugcagggcu

SEQ ID NO: 1223773 - RNA, 26 nt, Human
ucucugcagaggcaccucugccaccc

SEQ ID NO: 1223774 - RNA, 24 nt, Human
ucugcagaggcaccucugccaccc

SEQ ID NO: 1223775 - RNA, 19 nt, Human
ucugccgccaccguucuac

SEQ ID NO: 1223776 - RNA, 28 nt, Human
ucuggguggcaugacuguaguggggcuu

SEQ ID NO: 1223777 - RNA, 18 nt, Human
ucuuccccugggcugaaa

SEQ ID NO: 1223778 - RNA, 22 nt, Human
ugaaaggcggaggugaagcuga

SEQ ID NO: 1223779 - RNA, 24 nt, Human
ugaaaggcggaggugaagcugagg

SEQ ID NO: 1223780 - RNA, 22 nt, Human
ugagcuugaguuccuccugucu

SEQ ID NO: 1223781 - RNA, 21 nt, Human
ugccagaaggacacgggugac

SEQ ID NO: 1223782 - RNA, 19 nt, Human
ugccaggagaccagcuggc

SEQ ID NO: 1223783 - RNA, 21 nt, Human
ugccaggagaccagcuggccc

SEQ ID NO: 1223784 - RNA, 23 nt, Human
ugcccucuucaccccagucccca

SEQ ID NO: 1223785 - RNA, 18 nt, Human
ugcccuggguguuccccu

SEQ ID NO: 1223786 - RNA, 18 nt, Human
ugccuuggaagcuccagg

SEQ ID NO: 1223787 - RNA, 23 nt, Human
ugcugaaggcuggaccugcccuc

SEQ ID NO: 1223788 - RNA, 19 nt, Human
ugcugggguuucaauggcu

SEQ ID NO: 1223789 - RNA, 19 nt, Human
uggcagcaccagggcagga

SEQ ID NO: 1223790 - RNA, 22 nt, Human
uggccccuagacaucuccaccc

SEQ ID NO: 1223791 - RNA, 22 nt, Human
uggcuccuggggcaccuguccu

SEQ ID NO: 1223792 - RNA, 21 nt, Human
uggcugcucucuccagccccc

SEQ ID NO: 1223793 - RNA, 18 nt, Human
ugggaggggugggucacu

SEQ ID NO: 1223794 - RNA, 20 nt, Human
ugggccaggugcuggagcuu

SEQ ID NO: 1223795 - RNA, 18 nt, Human
ugggcccuggggucccag

SEQ ID NO: 1223796 - RNA, 28 nt, Human
ugggcugaaacugccuguggaaacccca

SEQ ID NO: 1223797 - RNA, 21 nt, Human
ugggggaggggcugcugaagg

SEQ ID NO: 1223798 - RNA, 24 nt, Human
ugggggaggggcugcugaaggcug

SEQ ID NO: 1223799 - RNA, 18 nt, Human
uguccagccaggaggugg

SEQ ID NO: 1223800 - RNA, 18 nt, Human
uguuccccuuguaauucc

SEQ ID NO: 1223801 - RNA, 23 nt, Human
uucaguugccaggagaccagcug

SEQ ID NO: 1223802 - RNA, 22 nt, Human
uugccggcucuuugagccgugu

SEQ ID NO: 1223803 - RNA, 22 nt, Human
aaagaggauccuuuccuuugga

SEQ ID NO: 1223804 - RNA, 21 nt, Human
agaggggaggcagcuugggaa

SEQ ID NO: 1223805 - RNA, 23 nt, Human
agccuggaagucggagccgacgg

SEQ ID NO: 1223806 - RNA, 21 nt, Human
aggaaggagaggggaggcagc

SEQ ID NO: 1223807 - RNA, 25 nt, Human
aggagaggggaggcagcuugggucu

SEQ ID NO: 1223808 - RNA, 24 nt, Human
caagcccagcacuagggcagcucc

SEQ ID NO: 1223809 - RNA, 19 nt, Human
cacaggaaggagaggggag

SEQ ID NO: 1223810 - RNA, 18 nt, Human
caccauguagaaaagggu

SEQ ID NO: 1223811 - RNA, 23 nt, Human
cacgccggggcaguggcagggcu

SEQ ID NO: 1223812 - RNA, 19 nt, Human
cagcccccgccccacaagc

SEQ ID NO: 1223813 - RNA, 22 nt, Human
cagcccgaagguccugccuccu

SEQ ID NO: 1223814 - RNA, 20 nt, Human
ccaccauguagaaaagggua

SEQ ID NO: 1223815 - RNA, 23 nt, Human
cccacaagcccagcacuagggca

SEQ ID NO: 1223816 - RNA, 18 nt, Human
cccacccacgccugccau

SEQ ID NO: 1223817 - RNA, 24 nt, Human
cccgaagguccugccuccugaggc

SEQ ID NO: 1223818 - RNA, 19 nt, Human
cccgccccacaagcccagc

SEQ ID NO: 1223819 - RNA, 20 nt, Human
ccuggggccugugaggugcc

SEQ ID NO: 1223820 - RNA, 21 nt, Human
cgccggggcaguggcagggcu

SEQ ID NO: 1223821 - RNA, 23 nt, Human
cugcaggugacucaggcugucca

SEQ ID NO: 1223822 - RNA, 22 nt, Human
gaccuugccuuuccccgggcac

SEQ ID NO: 1223823 - RNA, 23 nt, Human
gaggcagcuugggucucugggcg

SEQ ID NO: 1223824 - RNA, 22 nt, Human
ggcgguggcgcaggcugcagcc

SEQ ID NO: 1223825 - RNA, 19 nt, Human
gggcacagcccgaaggucc

SEQ ID NO: 1223826 - RNA, 24 nt, Human
gggccugugaggugccuggggaug

SEQ ID NO: 1223827 - RNA, 25 nt, Human
gggccugugaggugccuggggaugg

SEQ ID NO: 1223828 - RNA, 19 nt, Human
uccccgggcacagcccgaa

SEQ ID NO: 1223829 - RNA, 19 nt, Human
uccuggggccugugaggug

SEQ ID NO: 1223830 - RNA, 25 nt, Human
ucgguggcugggccuuuccuggggc

SEQ ID NO: 1223831 - RNA, 23 nt, Human
ugaagccuggaagucggagccga

SEQ ID NO: 1223832 - RNA, 19 nt, Human
ugacucaggcuguccacag

SEQ ID NO: 1223833 - RNA, 23 nt, Human
ugcagccaggcgaggcccucagu

SEQ ID NO: 1223834 - RNA, 19 nt, Human
ugccauggagcacgccggg

SEQ ID NO: 1223835 - RNA, 23 nt, Human
ugccauggagcacgccggggcag

SEQ ID NO: 1223836 - RNA, 19 nt, Human
ugccuuuccccgggcacag

SEQ ID NO: 1223837 - RNA, 23 nt, Human
ugugaggugccuggggaugggcc

SEQ ID NO: 1223838 - RNA, 21 nt, Human
uucgguggcugggccuuuccu

SEQ ID NO: 1223839 - RNA, 18 nt, Human
cagcgggaggggcggggc

SEQ ID NO: 1223840 - RNA, 21 nt, Human
cgcaccugcccacugcggccg

SEQ ID NO: 1223841 - RNA, 21 nt, Human
cugcaugcuguggggcugcag

SEQ ID NO: 1223842 - RNA, 25 nt, Human
ggagaucaagacagguggccaggcu

SEQ ID NO: 1223843 - RNA, 21 nt, Human
uccuggggcugcaugcugugg

SEQ ID NO: 1223844 - RNA, 19 nt, Human
ugcagcgggaggggcgggg

SEQ ID NO: 1223845 - RNA, 21 nt, Human
uggggcugcagcgggaggggc

SEQ ID NO: 1223846 - RNA, 22 nt, Human
uggggcugcagcgggaggggcg

SEQ ID NO: 1223847 - RNA, 18 nt, Human
aagcaggcgcucccucca

SEQ ID NO: 1223848 - RNA, 23 nt, Human
aagcuccucugaugccuuuuuuc

SEQ ID NO: 1223849 - RNA, 23 nt, Human
acacacggucaccccccuccccc

SEQ ID NO: 1223850 - RNA, 20 nt, Human
acacaggugggggcgggagu

SEQ ID NO: 1223851 - RNA, 20 nt, Human
acagcuguccagagcugagg

SEQ ID NO: 1223852 - RNA, 20 nt, Human
acaucucagacgcaacccac

SEQ ID NO: 1223853 - RNA, 23 nt, Human
agcgagcccgugcagcugacccc

SEQ ID NO: 1223854 - RNA, 18 nt, Human
agcgggacacaggugggg

SEQ ID NO: 1223855 - RNA, 20 nt, Human
aggcagggcugccagcugcc

SEQ ID NO: 1223856 - RNA, 24 nt, Human
agguguggaaauugccacgcagcc

SEQ ID NO: 1223857 - RNA, 22 nt, Human
caagggaaugaacacacgguca

SEQ ID NO: 1223858 - RNA, 24 nt, Human
cacagaucacagacgacuacgguc

SEQ ID NO: 1223859 - RNA, 18 nt, Human
caccccccuccccccugc

SEQ ID NO: 1223860 - RNA, 21 nt, Human
caccccccuccccccugccac

SEQ ID NO: 1223861 - RNA, 21 nt, Human
caccgcauaugcaugccaggc

SEQ ID NO: 1223862 - RNA, 21 nt, Human
cacugggugcgggucccugga

SEQ ID NO: 1223863 - RNA, 22 nt, Human
cagcugaccccagacgaugagu

SEQ ID NO: 1223864 - RNA, 23 nt, Human
cagcugccaggugucaggugugg

SEQ ID NO: 1223865 - RNA, 21 nt, Human
cagggaugccauaaagaggau

SEQ ID NO: 1223866 - RNA, 18 nt, Human
cauugugcggcugguggc

SEQ ID NO: 1223867 - RNA, 26 nt, Human
ccaagggaaugaacacacggucaccc

SEQ ID NO: 1223868 - RNA, 19 nt, Human
ccaggcugggcacggcucc

SEQ ID NO: 1223869 - RNA, 20 nt, Human
ccaguagcgugccgguuacc

SEQ ID NO: 1223870 - RNA, 20 nt, Human
ccagugggcguugggggagg

SEQ ID NO: 1223871 - RNA, 27 nt, Human
cccaagggaaugaacacacggucaccc

SEQ ID NO: 1223872 - RNA, 21 nt, Human
cccacugggugcgggucccug

SEQ ID NO: 1223873 - RNA, 20 nt, Human
ccccacaucucagacgcaac

SEQ ID NO: 1223874 - RNA, 19 nt, Human
ccccaggccuccaugacuc

SEQ ID NO: 1223875 - RNA, 21 nt, Human
ccccaggccuccaugacucag

SEQ ID NO: 1223876 - RNA, 18 nt, Human
cccgugcagcugacccca

SEQ ID NO: 1223877 - RNA, 22 nt, Human
cccucacaccugggcccgggca

SEQ ID NO: 1223878 - RNA, 19 nt, Human
cccugccgagggggcuguc

SEQ ID NO: 1223879 - RNA, 21 nt, Human
cccuggagcaccccucgggca

SEQ ID NO: 1223880 - RNA, 23 nt, Human
ccgcggggacccugccgaggggg

SEQ ID NO: 1223881 - RNA, 20 nt, Human
ccgcuucccccaagggaaug

SEQ ID NO: 1223882 - RNA, 18 nt, Human
ccucugagugaggccugg

SEQ ID NO: 1223883 - RNA, 22 nt, Human
ccucugagugaggccuggugca

SEQ ID NO: 1223884 - RNA, 25 nt, Human
ccuugggcagcuggugacccagccu

SEQ ID NO: 1223885 - RNA, 19 nt, Human
cgggacacaggugggggcg

SEQ ID NO: 1223886 - RNA, 23 nt, Human
cgggacacaggugggggcgggag

SEQ ID NO: 1223887 - RNA, 20 nt, Human
cucaggggccgcuccacccc

SEQ ID NO: 1223888 - RNA, 22 nt, Human
cuccccccugccaccuuugccc

SEQ ID NO: 1223889 - RNA, 18 nt, Human
cugaccugcuccgccagg

SEQ ID NO: 1223890 - RNA, 26 nt, Human
cugccgagggggcugucaugcgguuu

SEQ ID NO: 1223891 - RNA, 19 nt, Human
cuggugcacagguguggaa

SEQ ID NO: 1223892 - RNA, 21 nt, Human
gaacgugacuccgcuuccccc

SEQ ID NO: 1223893 - RNA, 24 nt, Human
gaagcuccucugaugccuuuuuuc

SEQ ID NO: 1223894 - RNA, 20 nt, Human
gagcucccugggagaggggg

SEQ ID NO: 1223895 - RNA, 22 nt, Human
gaguugaaguaccccucaggug

SEQ ID NO: 1223896 - RNA, 21 nt, Human
gcagccccauggcaggccggc

SEQ ID NO: 1223897 - RNA, 27 nt, Human
gccaggcgcagagaccccaggccucca

SEQ ID NO: 1223898 - RNA, 22 nt, Human
gcccacagggaugccauaaaga

SEQ ID NO: 1223899 - RNA, 20 nt, Human
gcgccgagaccgcagaggga

SEQ ID NO: 1223900 - RNA, 19 nt, Human
gcggauccgcggggacccu

SEQ ID NO: 1223901 - RNA, 20 nt, Human
gcgggacacaggugggggcg

SEQ ID NO: 1223902 - RNA, 19 nt, Human
ggaggaacuugcugcugug

SEQ ID NO: 1223903 - RNA, 18 nt, Human
gggcccgggcaggccagc

SEQ ID NO: 1223904 - RNA, 25 nt, Human
ggugcacauuuuccacggaaacaga

SEQ ID NO: 1223905 - RNA, 18 nt, Human
gugguucucgaaaacucu

SEQ ID NO: 1223906 - RNA, 25 nt, Human
uaaccaccgcauaugcaugccaggc

SEQ ID NO: 1223907 - RNA, 18 nt, Human
uagcgugccgguuaccag

SEQ ID NO: 1223908 - RNA, 20 nt, Human
ucaccccccuccccccugcc

SEQ ID NO: 1223909 - RNA, 22 nt, Human
ucaucagaggggagacuuuuuu

SEQ ID NO: 1223910 - RNA, 18 nt, Human
uccaagcuggagaagaag

SEQ ID NO: 1223911 - RNA, 20 nt, Human
ucccuccauuccagccacag

SEQ ID NO: 1223912 - RNA, 21 nt, Human
uccgcggggacccugccgagg

SEQ ID NO: 1223913 - RNA, 21 nt, Human
uccuagaggcagggcugccag

SEQ ID NO: 1223914 - RNA, 23 nt, Human
ucugaugccuuuuuuccgugagu

SEQ ID NO: 1223915 - RNA, 18 nt, Human
ucuucugagcucccuggg

SEQ ID NO: 1223916 - RNA, 27 nt, Human
ugaacacacggucaccccccucccccc

SEQ ID NO: 1223917 - RNA, 18 nt, Human
ugcacugaccugcuccgc

SEQ ID NO: 1223918 - RNA, 19 nt, Human
ugccaggcugggcacggcu

SEQ ID NO: 1223919 - RNA, 18 nt, Human
ugccauaaagaggaucga

SEQ ID NO: 1223920 - RNA, 20 nt, Human
ugcgugggcguggugcgggg

SEQ ID NO: 1223921 - RNA, 22 nt, Human
uggcaggccggcaccuugggca

SEQ ID NO: 1223922 - RNA, 23 nt, Human
uggcaggccggcaccuugggcag

SEQ ID NO: 1223923 - RNA, 21 nt, Human
uggccaggcgcagagacccca

SEQ ID NO: 1223924 - RNA, 20 nt, Human
ugggcagcuggugacccagc

SEQ ID NO: 1223925 - RNA, 19 nt, Human
uguccagagcugaggcuuc

SEQ ID NO: 1223926 - RNA, 18 nt, Human
ugugaguaaugcugugcu

SEQ ID NO: 1223927 - RNA, 21 nt, Human
ugugauugaagugcgugcaaa

SEQ ID NO: 1223928 - RNA, 19 nt, Human
uuuauauucaguaauuugu

SEQ ID NO: 1223929 - RNA, 23 nt, Human
aagcaccaggaccugggucccac

SEQ ID NO: 1223930 - RNA, 21 nt, Human
agggcuuugaggguggacagg

SEQ ID NO: 1223931 - RNA, 25 nt, Human
aguccagggccagauccucgggaga

SEQ ID NO: 1223932 - RNA, 21 nt, Human
caacacagggaacuacaaaug

SEQ ID NO: 1223933 - RNA, 20 nt, Human
cacuggcaacaacacaggga

SEQ ID NO: 1223934 - RNA, 21 nt, Human
cagggguucugaccccuuccu

SEQ ID NO: 1223935 - RNA, 25 nt, Human
ccaccgucgggcaccacagcuccag

SEQ ID NO: 1223936 - RNA, 19 nt, Human
ccacuggcaacaacacagg

SEQ ID NO: 1223937 - RNA, 20 nt, Human
ccagggccagauccucggga

SEQ ID NO: 1223938 - RNA, 21 nt, Human
ccucagccuggggagggcuuu

SEQ ID NO: 1223939 - RNA, 22 nt, Human
cgccacuggcaacaacacaggg

SEQ ID NO: 1223940 - RNA, 21 nt, Human
cgccgaaguuaaagauggucu

SEQ ID NO: 1223941 - RNA, 20 nt, Human
cgggagagacguucuggaug

SEQ ID NO: 1223942 - RNA, 22 nt, Human
cgggcaccacagcuccagguac

SEQ ID NO: 1223943 - RNA, 22 nt, Human
cgugccucucuuggugaugaug

SEQ ID NO: 1223944 - RNA, 25 nt, Human
cuaggauggcugagggcuggccugg

SEQ ID NO: 1223945 - RNA, 18 nt, Human
cuggcaacaacacaggga

SEQ ID NO: 1223946 - RNA, 25 nt, Human
cuggcaacaacacagggaacuacaa

SEQ ID NO: 1223947 - RNA, 19 nt, Human
cuggcagaggauggccagg

SEQ ID NO: 1223948 - RNA, 19 nt, Human
cugggggcugggggcucug

SEQ ID NO: 1223949 - RNA, 23 nt, Human
gaaggaaagcaccaggaccuggg

SEQ ID NO: 1223950 - RNA, 21 nt, Human
gagcaggguggcucgggcggc

SEQ ID NO: 1223951 - RNA, 21 nt, Human
gccaccgucgggcaccacagc

SEQ ID NO: 1223952 - RNA, 18 nt, Human
gccguggcgccaugugga

SEQ ID NO: 1223953 - RNA, 20 nt, Human
gcugaagcucagggguucug

SEQ ID NO: 1223954 - RNA, 21 nt, Human
gcuggccuggccuucucgcug

SEQ ID NO: 1223955 - RNA, 19 nt, Human
ggcuaggauggcugagggc

SEQ ID NO: 1223956 - RNA, 24 nt, Human
gggagggcuuugaggguggacagg

SEQ ID NO: 1223957 - RNA, 18 nt, Human
gggcucugagggggucug

SEQ ID NO: 1223958 - RNA, 22 nt, Human
ggggagagaaggaaagcaccag

SEQ ID NO: 1223959 - RNA, 23 nt, Human
ggggcugggggcucugagggggu

SEQ ID NO: 1223960 - RNA, 21 nt, Human
gggggcugaagcucagggguu

SEQ ID NO: 1223961 - RNA, 18 nt, Human
gggguccagggcagcagg

SEQ ID NO: 1223962 - RNA, 21 nt, Human
gugcucuuggaugucccuggg

SEQ ID NO: 1223963 - RNA, 18 nt, Human
guggagggcucuccuggg

SEQ ID NO: 1223964 - RNA, 24 nt, Human
guggagggcucuccugggggcugg

SEQ ID NO: 1223965 - RNA, 18 nt, Human
ucagcaggacaaaggggc

SEQ ID NO: 1223966 - RNA, 28 nt, Human
ucagggguucugaccccuuccugucuuu

SEQ ID NO: 1223967 - RNA, 20 nt, Human
ucggaacuagaaggaaguca

SEQ ID NO: 1223968 - RNA, 19 nt, Human
ugagggggucuggcuagga

SEQ ID NO: 1223969 - RNA, 18 nt, Human
ugauguccaguguuucuu

SEQ ID NO: 1223970 - RNA, 21 nt, Human
ugaugucgccacuggcaacaa

SEQ ID NO: 1223971 - RNA, 19 nt, Human
ugccucucuuggugaugau

SEQ ID NO: 1223972 - RNA, 21 nt, Human
ugcgggguccagggcagcagg

SEQ ID NO: 1223973 - RNA, 18 nt, Human
uggauggagaucuucuug

SEQ ID NO: 1223974 - RNA, 18 nt, Human
uggccguggcgccaugug

SEQ ID NO: 1223975 - RNA, 19 nt, Human
uggccuggccuucucgcuu

SEQ ID NO: 1223976 - RNA, 21 nt, Human
uggcgccauguggagggcggc

SEQ ID NO: 1223977 - RNA, 22 nt, Human
uggcugagggcuggccuggccu

SEQ ID NO: 1223978 - RNA, 19 nt, Human
ugggggcugggggcucuga

SEQ ID NO: 1223979 - RNA, 20 nt, Human
uguccaguguuucuugagcc

SEQ ID NO: 1223980 - RNA, 19 nt, Human
uguggagggcucuccuggg

SEQ ID NO: 1223981 - RNA, 25 nt, Human
uuggugaugauguccaguguuucuu

SEQ ID NO: 1223982 - RNA, 22 nt, Human
aagcagcagccugccuaguggg

SEQ ID NO: 1223983 - RNA, 20 nt, Human
acccgaggcuuaggcccaag

SEQ ID NO: 1223984 - RNA, 24 nt, Human
agacgucacagguggcccugagcu

SEQ ID NO: 1223985 - RNA, 20 nt, Human
agcaggaugagccccacgug

SEQ ID NO: 1223986 - RNA, 20 nt, Human
agcgggccuggggcgggcac

SEQ ID NO: 1223987 - RNA, 18 nt, Human
agguggcccugagcuccc

SEQ ID NO: 1223988 - RNA, 21 nt, Human
agugggugacgccaggggccg

SEQ ID NO: 1223989 - RNA, 20 nt, Human
caagcauuaguucuccaagc

SEQ ID NO: 1223990 - RNA, 19 nt, Human
cagcaggaugagccccacg

SEQ ID NO: 1223991 - RNA, 21 nt, Human
cagcggcaggagcggcaggag

SEQ ID NO: 1223992 - RNA, 21 nt, Human
cagcgggccuggggcgggcac

SEQ ID NO: 1223993 - RNA, 20 nt, Human
caguccgcgggcggccagcg

SEQ ID NO: 1223994 - RNA, 23 nt, Human
ccaccugcggcagcggcaggagc

SEQ ID NO: 1223995 - RNA, 23 nt, Human
ccgcgggcggccagcggcccccg

SEQ ID NO: 1223996 - RNA, 24 nt, Human
ccgguguaacauggcaccgagguu

SEQ ID NO: 1223997 - RNA, 20 nt, Human
cggcagcggcaggagcggcg

SEQ ID NO: 1223998 - RNA, 20 nt, Human
cggcaggagcggcaggagcg

SEQ ID NO: 1223999 - RNA, 20 nt, Human
cggcaggagcggcaggagcg

SEQ ID NO: 1224000 - RNA, 21 nt, Human
cgguggggugggcuggggccc

SEQ ID NO: 1224001 - RNA, 18 nt, Human
cuccagcgggccuggggc

SEQ ID NO: 1224002 - RNA, 20 nt, Human
cugcuuccggaggcagcaga

SEQ ID NO: 1224003 - RNA, 22 nt, Human
cugguccgaggggucgcagcug

SEQ ID NO: 1224004 - RNA, 20 nt, Human
gacgguggggugggcugggg

SEQ ID NO: 1224005 - RNA, 21 nt, Human
gaggcuuaggcccaaggggcc

SEQ ID NO: 1224006 - RNA, 19 nt, Human
gagggccugcuggggcugg

SEQ ID NO: 1224007 - RNA, 22 nt, Human
gcagcagccgcaguccgcgggc

SEQ ID NO: 1224008 - RNA, 22 nt, Human
gcaggagcggcaggagcggcag

SEQ ID NO: 1224009 - RNA, 22 nt, Human
gcaggagcggcaggagcggcag

SEQ ID NO: 1224010 - RNA, 23 nt, Human
ggacacaaccagcugugacacca

SEQ ID NO: 1224011 - RNA, 21 nt, Human
ggcaggagcggcagcagcagc

SEQ ID NO: 1224012 - RNA, 25 nt, Human
ggcccuuggcuccaagcauuaguuc

SEQ ID NO: 1224013 - RNA, 24 nt, Human
ggccucuuccaggcugagggccug

SEQ ID NO: 1224014 - RNA, 18 nt, Human
gggcggccagcggccccc

SEQ ID NO: 1224015 - RNA, 22 nt, Human
gggcggccagcggcccccgggc

SEQ ID NO: 1224016 - RNA, 20 nt, Human
guggcccugagcucccaccc

SEQ ID NO: 1224017 - RNA, 22 nt, Human
uaggcccaaggggccucuucca

SEQ ID NO: 1224018 - RNA, 24 nt, Human
uccaggcugagggccugcuggggc

SEQ ID NO: 1224019 - RNA, 26 nt, Human
ucuccaagcucugguccguucuccua

SEQ ID NO: 1224020 - RNA, 21 nt, Human
ugagggccugcuggggcuggg

SEQ ID NO: 1224021 - RNA, 19 nt, Human
ugccacaggcugcuccagc

SEQ ID NO: 1224022 - RNA, 24 nt, Human
ugccacaggcugcuccagcgggcc

SEQ ID NO: 1224023 - RNA, 19 nt, Human
uggcccugagcucccaccc

SEQ ID NO: 1224024 - RNA, 22 nt, Human
uggcugggccugugccugcuuc

SEQ ID NO: 1224025 - RNA, 20 nt, Human
ugugggacgguggggugggc

SEQ ID NO: 1224026 - RNA, 20 nt, Human
uuauucucucuccaagaaga

SEQ ID NO: 1224027 - RNA, 26 nt, Human
uuccaggcugagggccugcuggggcu

SEQ ID NO: 1224028 - RNA, 20 nt, Human
aagcagacgcgagagccuga

SEQ ID NO: 1224029 - RNA, 22 nt, Human
agaaaaagugagagagagcggc

SEQ ID NO: 1224030 - RNA, 20 nt, Human
agaacccugcaucgggcucc

SEQ ID NO: 1224031 - RNA, 19 nt, Human
agcggccacuuuuccuguc

SEQ ID NO: 1224032 - RNA, 21 nt, Human
auaauuccugaccgcacaaag

SEQ ID NO: 1224033 - RNA, 19 nt, Human
caccagggccucucccagg

SEQ ID NO: 1224034 - RNA, 19 nt, Human
caccagggccucucccagg

SEQ ID NO: 1224035 - RNA, 23 nt, Human
cagaacccugcaucgggcuccuc

SEQ ID NO: 1224036 - RNA, 28 nt, Human
cagugccccagagccacggagccgggga

SEQ ID NO: 1224037 - RNA, 24 nt, Human
ccacagccacgaacgauuuuaccu

SEQ ID NO: 1224038 - RNA, 23 nt, Human
cccacaacgcccccgcggcugcc

SEQ ID NO: 1224039 - RNA, 26 nt, Human
cccacaacgcccccgcggcugcccgu

SEQ ID NO: 1224040 - RNA, 24 nt, Human
cccaggcaaagcguagaagcagac

SEQ ID NO: 1224041 - RNA, 21 nt, Human
ccccagagccacggagccggg

SEQ ID NO: 1224042 - RNA, 20 nt, Human
ccccgcgggcgccgcuccuc

SEQ ID NO: 1224043 - RNA, 19 nt, Human
ccccggcgccuucacaaca

SEQ ID NO: 1224044 - RNA, 25 nt, Human
ccucucccaggcaaagcguagaagc

SEQ ID NO: 1224045 - RNA, 21 nt, Human
cgagagccugaugcagucucc

SEQ ID NO: 1224046 - RNA, 21 nt, Human
cgccaggaacgaggccaccag

SEQ ID NO: 1224047 - RNA, 18 nt, Human
cgccgcaggcauagcgcu

SEQ ID NO: 1224048 - RNA, 23 nt, Human
cgcugccccgcgggcgccgcucc

SEQ ID NO: 1224049 - RNA, 20 nt, Human
gcacagcgcuggcggaucca

SEQ ID NO: 1224050 - RNA, 23 nt, Human
gcacagcgcuggcggauccaggu

SEQ ID NO: 1224051 - RNA, 26 nt, Human
gccaggaacgaggccaccagggccuc

SEQ ID NO: 1224052 - RNA, 21 nt, Human
gccccgcgggcgccgcuccuc

SEQ ID NO: 1224053 - RNA, 22 nt, Human
gccgcagcagggacuccgggcg

SEQ ID NO: 1224054 - RNA, 18 nt, Human
gccgcggagacagcucgg

SEQ ID NO: 1224055 - RNA, 21 nt, Human
gccgcggcccacaacgccccc

SEQ ID NO: 1224056 - RNA, 23 nt, Human
ggaaacgcgccgcggcccacaac

SEQ ID NO: 1224057 - RNA, 19 nt, Human
gggaaacgcgccgcggccc

SEQ ID NO: 1224058 - RNA, 21 nt, Human
gggcagcaugggucaccguga

SEQ ID NO: 1224059 - RNA, 23 nt, Human
gggcgcccgcgggaccggaaaug

SEQ ID NO: 1224060 - RNA, 24 nt, Human
guuccagaaaaagugagagagagc

SEQ ID NO: 1224061 - RNA, 22 nt, Human
uagaagcagacgcgagagccug

SEQ ID NO: 1224062 - RNA, 18 nt, Human
uccagaaaaagugagaga

SEQ ID NO: 1224063 - RNA, 24 nt, Human
ucuccgccgcaggcauagcgcuag

SEQ ID NO: 1224064 - RNA, 19 nt, Human
ugagagacagugaccaagc

SEQ ID NO: 1224065 - RNA, 19 nt, Human
ugccccagagccacggagc

SEQ ID NO: 1224066 - RNA, 24 nt, Human
acccgcggcagcggaggcggagga

SEQ ID NO: 1224067 - RNA, 18 nt, Human
cacugggccgcugcccug

SEQ ID NO: 1224068 - RNA, 19 nt, Human
ccgcggcagcggaggcgga

SEQ ID NO: 1224069 - RNA, 23 nt, Human
cgcgcgcggcuggacggcggcgc

SEQ ID NO: 1224070 - RNA, 18 nt, Human
cgcggggccucggcggcg

SEQ ID NO: 1224071 - RNA, 19 nt, Human
cugcacugggccgcugccc

SEQ ID NO: 1224072 - RNA, 19 nt, Human
cugcuggaggcuccgggcc

SEQ ID NO: 1224073 - RNA, 21 nt, Human
cuggccgcgcgccugcuggag

SEQ ID NO: 1224074 - RNA, 20 nt, Human
gcccugggccacacgcugcu

SEQ ID NO: 1224075 - RNA, 19 nt, Human
gcugcacugggccgcugcc

SEQ ID NO: 1224076 - RNA, 18 nt, Human
ggccucacgccgcugcac

SEQ ID NO: 1224077 - RNA, 20 nt, Human
gggcccgggacccgcggcag

SEQ ID NO: 1224078 - RNA, 18 nt, Human
ugcacugggccgcugccc

SEQ ID NO: 1224079 - RNA, 24 nt, Human
ugcacugggccgcugcccugggcc

SEQ ID NO: 1224080 - RNA, 24 nt, Human
aaagaauuuaacucagaugaagac

SEQ ID NO: 1224081 - RNA, 23 nt, Human
acagcagagggggcagcccugcc

SEQ ID NO: 1224082 - RNA, 18 nt, Human
agcagagggggcagcccu

SEQ ID NO: 1224083 - RNA, 19 nt, Human
aggagagggagccucagag

SEQ ID NO: 1224084 - RNA, 18 nt, Human
agggagccucagaguuuc

SEQ ID NO: 1224085 - RNA, 24 nt, Human
caacucuaccacagagucugagau

SEQ ID NO: 1224086 - RNA, 27 nt, Human
ccucccauagaaggaaccacucggggu

SEQ ID NO: 1224087 - RNA, 19 nt, Human
cucugcaggagagggagcc

SEQ ID NO: 1224088 - RNA, 22 nt, Human
gagccucagaguuuccccucag

SEQ ID NO: 1224089 - RNA, 22 nt, Human
gcacagcagagggggcagcccu

SEQ ID NO: 1224090 - RNA, 18 nt, Human
gcccugccucugccuccc

SEQ ID NO: 1224091 - RNA, 19 nt, Human
gcccugccucugccuccca

SEQ ID NO: 1224092 - RNA, 20 nt, Human
gggcagcccugccucugccu

SEQ ID NO: 1224093 - RNA, 21 nt, Human
uagaaggaaccacucggggug

SEQ ID NO: 1224094 - RNA, 23 nt, Human
ugaagaccccaggaauugcacag

SEQ ID NO: 1224095 - RNA, 18 nt, Human
ugagaucucugcaggaga

SEQ ID NO: 1224096 - RNA, 21 nt, Human
accacugaaacucugaggagu

SEQ ID NO: 1224097 - RNA, 18 nt, Human
auggccuguaccuggaac

SEQ ID NO: 1224098 - RNA, 20 nt, Human
caaauagauaaagcccucuu

SEQ ID NO: 1224099 - RNA, 19 nt, Human
caaccucgaucucaugggc

SEQ ID NO: 1224100 - RNA, 18 nt, Human
cagugggcccuuguaguc

SEQ ID NO: 1224101 - RNA, 21 nt, Human
cauggccuguaccuggaacac

SEQ ID NO: 1224102 - RNA, 24 nt, Human
ccacugaaacucugaggagucggg

SEQ ID NO: 1224103 - RNA, 21 nt, Human
ccccagaccagcugaauucau

SEQ ID NO: 1224104 - RNA, 21 nt, Human
cuuguuaacuuuauccucgau

SEQ ID NO: 1224105 - RNA, 24 nt, Human
gagcacgggaucagugggcaugga

SEQ ID NO: 1224106 - RNA, 19 nt, Human
uccucgaucuugacccucu

SEQ ID NO: 1224107 - RNA, 19 nt, Human
ucgaucuugacccucuggg

SEQ ID NO: 1224108 - RNA, 18 nt, Human
ugggcauggacgguugcc

SEQ ID NO: 1224109 - RNA, 23 nt, Human
uuuggaccacugaaacucugagg

SEQ ID NO: 1224110 - RNA, 21 nt, Human
aaacagaacugacacugaacu

SEQ ID NO: 1224111 - RNA, 18 nt, Human
uaaacagaacugacacug

SEQ ID NO: 1224112 - RNA, 21 nt, Human
uaauacauacuuguuaaacag

SEQ ID NO: 1224113 - RNA, 23 nt, Human
ugacacugaacuuuuguccuucc

SEQ ID NO: 1224114 - RNA, 22 nt, Human
uguuaaacagaacugacacuga

SEQ ID NO: 1224115 - RNA, 20 nt, Human
uuaaacagaacugacacuga

SEQ ID NO: 1224116 - RNA, 25 nt, Human
aaaaggacagcauugauguugcaga

SEQ ID NO: 1224117 - RNA, 19 nt, Human
aaaauaccaucugucacca

SEQ ID NO: 1224118 - RNA, 19 nt, Human
aacccagugcucucucugg

SEQ ID NO: 1224119 - RNA, 19 nt, Human
aacugcuucucaaggccau

SEQ ID NO: 1224120 - RNA, 20 nt, Human
acuugucaagugugcagguu

SEQ ID NO: 1224121 - RNA, 27 nt, Human
agaaagaguggggaaaccccgugugac

SEQ ID NO: 1224122 - RNA, 27 nt, Human
agaagcacaggcacaguggcucccagg

SEQ ID NO: 1224123 - RNA, 21 nt, Human
agaaggacagagaagcacagg

SEQ ID NO: 1224124 - RNA, 22 nt, Human
agaggagagccuguuucugugg

SEQ ID NO: 1224125 - RNA, 18 nt, Human
agccuguuucuguggcug

SEQ ID NO: 1224126 - RNA, 22 nt, Human
agcuugcagucuugacuucugu

SEQ ID NO: 1224127 - RNA, 20 nt, Human
aggaagaggcagaauuuaaa

SEQ ID NO: 1224128 - RNA, 19 nt, Human
aggagagccuguuucugug

SEQ ID NO: 1224129 - RNA, 18 nt, Human
aggcacaguggcucccag

SEQ ID NO: 1224130 - RNA, 23 nt, Human
auuauccaugauguccacucagu

SEQ ID NO: 1224131 - RNA, 20 nt, Human
auuuggguuagagaguagga

SEQ ID NO: 1224132 - RNA, 18 nt, Human
caaaauagccccagagga

SEQ ID NO: 1224133 - RNA, 19 nt, Human
caagaagaggguggaaaca

SEQ ID NO: 1224134 - RNA, 21 nt, Human
caagaagaggguggaaacagu

SEQ ID NO: 1224135 - RNA, 21 nt, Human
cacccuuggcuccccaccccu

SEQ ID NO: 1224136 - RNA, 18 nt, Human
cagccuucucugcugggc

SEQ ID NO: 1224137 - RNA, 23 nt, Human
cagcuccagagcaacuuucccca

SEQ ID NO: 1224138 - RNA, 21 nt, Human
cauggcaagcaaagggagaag

SEQ ID NO: 1224139 - RNA, 22 nt, Human
ccagugcucucucugggcuucu

SEQ ID NO: 1224140 - RNA, 24 nt, Human
ccaucugucaccaugcuuaaaguc

SEQ ID NO: 1224141 - RNA, 23 nt, Human
cccacagaaccagcuccagagca

SEQ ID NO: 1224142 - RNA, 19 nt, Human
ccccaggaccugcuugggg

SEQ ID NO: 1224143 - RNA, 21 nt, Human
ccuucgggucugacagccacc

SEQ ID NO: 1224144 - RNA, 22 nt, Human
cgaaguccuaaccgccaguacc

SEQ ID NO: 1224145 - RNA, 25 nt, Human
cucaagacacacauucaguaaaggc

SEQ ID NO: 1224146 - RNA, 23 nt, Human
cugcuuggggcuucaggcugcuc

SEQ ID NO: 1224147 - RNA, 22 nt, Human
cuggagucuuccaucucagugu

SEQ ID NO: 1224148 - RNA, 21 nt, Human
cuggguacaaagucacuuggg

SEQ ID NO: 1224149 - RNA, 23 nt, Human
cuuccagcaugggcucuguuaug

SEQ ID NO: 1224150 - RNA, 18 nt, Human
cuuccugcuccuuuucuu

SEQ ID NO: 1224151 - RNA, 22 nt, Human
cuugucagcuucuguucuagcg

SEQ ID NO: 1224152 - RNA, 24 nt, Human
gaaccagcuccagagcaacuuucc

SEQ ID NO: 1224153 - RNA, 18 nt, Human
gacaccuucugggugguc

SEQ ID NO: 1224154 - RNA, 24 nt, Human
gacagccaccacuguggagccacc

SEQ ID NO: 1224155 - RNA, 21 nt, Human
gaguucucugccgcuccaccu

SEQ ID NO: 1224156 - RNA, 20 nt, Human
gauggccagcaaaaggacag

SEQ ID NO: 1224157 - RNA, 21 nt, Human
gcccaaaauaccaucugucac

SEQ ID NO: 1224158 - RNA, 19 nt, Human
gccuguuucuguggcugac

SEQ ID NO: 1224159 - RNA, 23 nt, Human
gcuaugggagcaggagugggaac

SEQ ID NO: 1224160 - RNA, 21 nt, Human
gcuccagagcaacuuucccca

SEQ ID NO: 1224161 - RNA, 24 nt, Human
gcugugacagaagcaggucaaggc

SEQ ID NO: 1224162 - RNA, 24 nt, Human
ggaacuagaaaggggaagaggaag

SEQ ID NO: 1224163 - RNA, 23 nt, Human
ggauaagggggagcaaaggugcu

SEQ ID NO: 1224164 - RNA, 21 nt, Human
ggcucuguuaugggcugaauu

SEQ ID NO: 1224165 - RNA, 25 nt, Human
gggaagaggaaggaggauaaggggg

SEQ ID NO: 1224166 - RNA, 22 nt, Human
gggcuuacccuuaaauacagag

SEQ ID NO: 1224167 - RNA, 22 nt, Human
ggggagcaaaggugcucuugga

SEQ ID NO: 1224168 - RNA, 18 nt, Human
gugacagaagcaggucaa

SEQ ID NO: 1224169 - RNA, 20 nt, Human
guggaaacaguguguuugag

SEQ ID NO: 1224170 - RNA, 21 nt, Human
guuuaaucugucuacacugaa

SEQ ID NO: 1224171 - RNA, 22 nt, Human
uaaaguccacccuuggcucccc

SEQ ID NO: 1224172 - RNA, 19 nt, Human
uagacagcaaaguaagagg

SEQ ID NO: 1224173 - RNA, 25 nt, Human
uaucagaaagaguggggaaaccccc

SEQ ID NO: 1224174 - RNA, 18 nt, Human
uauuuggguuagagagua

SEQ ID NO: 1224175 - RNA, 24 nt, Human
ucaaaagaguauuauccaugaugu

SEQ ID NO: 1224176 - RNA, 25 nt, Human
ucaaugcuugucagcuucuguucua

SEQ ID NO: 1224177 - RNA, 23 nt, Human
ucagugcugugacagaagcaggu

SEQ ID NO: 1224178 - RNA, 21 nt, Human
ucccaggcuguuugugcugcc

SEQ ID NO: 1224179 - RNA, 18 nt, Human
uccuaaccgccaguaccu

SEQ ID NO: 1224180 - RNA, 22 nt, Human
uccuuuucuuguauccuccauu

SEQ ID NO: 1224181 - RNA, 21 nt, Human
ucgaaguccuaaccgccagua

SEQ ID NO: 1224182 - RNA, 24 nt, Human
ucgggucugacagccaccacugug

SEQ ID NO: 1224183 - RNA, 20 nt, Human
ucugccgcuccaccuccugc

SEQ ID NO: 1224184 - RNA, 19 nt, Human
ucugggcuucuguuucucc

SEQ ID NO: 1224185 - RNA, 25 nt, Human
ugaauacauucaagaagagggugga

SEQ ID NO: 1224186 - RNA, 24 nt, Human
ugcccaaaauaccaucugucacca

SEQ ID NO: 1224187 - RNA, 19 nt, Human
uggccagcaaaaggacagc

SEQ ID NO: 1224188 - RNA, 27 nt, Human
uggcgaagggacacuuaacugggguca

SEQ ID NO: 1224189 - RNA, 21 nt, Human
uggguuagagaguaggaagag

SEQ ID NO: 1224190 - RNA, 24 nt, Human
uucucugccgcuccaccuccugca

SEQ ID NO: 1224191 - RNA, 18 nt, Human
uugcccccuggagucuuc

SEQ ID NO: 1224192 - RNA, 19 nt, Human
uuucagggacugucuucca

SEQ ID NO: 1224193 - RNA, 22 nt, Human
uuucugcccaaaauaccaucug

SEQ ID NO: 1224194 - RNA, 26 nt, Human
uuucuuguauccuccauuuuucuacc

SEQ ID NO: 1224195 - RNA, 24 nt, Human
aaaaaaaaaaaaaaucggccagag

SEQ ID NO: 1224196 - RNA, 24 nt, Human
aaaaaaaaaaaaucggccagaggg

SEQ ID NO: 1224197 - RNA, 19 nt, Human
aaaaggacacauacaaagc

SEQ ID NO: 1224198 - RNA, 22 nt, Human
aaaggagggggcaaagguucug

SEQ ID NO: 1224199 - RNA, 20 nt, Human
aaaggcuucugaagccagca

SEQ ID NO: 1224200 - RNA, 24 nt, Human
aaaguggugggauuacaggcguga

SEQ ID NO: 1224201 - RNA, 20 nt, Human
aacaaaggccuuuuaagaac

SEQ ID NO: 1224202 - RNA, 21 nt, Human
aacaacuuucccccuccacua

SEQ ID NO: 1224203 - RNA, 20 nt, Human
aacauggugaaacaccgucu

SEQ ID NO: 1224204 - RNA, 21 nt, Human
aacauggugaaacaccgucuc

SEQ ID NO: 1224205 - RNA, 24 nt, Human
aagcacaagaagucagucuaaacu

SEQ ID NO: 1224206 - RNA, 22 nt, Human
aaggagggggcaaagguucuga

SEQ ID NO: 1224207 - RNA, 18 nt, Human
aagggggugggggaagau

SEQ ID NO: 1224208 - RNA, 21 nt, Human
aaguggugggauuacaggcgu

SEQ ID NO: 1224209 - RNA, 20 nt, Human
aauacuauagugaucaguaa

SEQ ID NO: 1224210 - RNA, 23 nt, Human
aaucgcuugaaccugggaggugg

SEQ ID NO: 1224211 - RNA, 24 nt, Human
acacaggagaaucgcuugaaccug

SEQ ID NO: 1224212 - RNA, 22 nt, Human
acaccgucucuacuaaaaauaa

SEQ ID NO: 1224213 - RNA, 20 nt, Human
acaggagaaucgcuugaacc

SEQ ID NO: 1224214 - RNA, 18 nt, Human
accaaaaacaacuuuccc

SEQ ID NO: 1224215 - RNA, 25 nt, Human
accaaaaacaacuuucccccuccac

SEQ ID NO: 1224216 - RNA, 24 nt, Human
accaacauggugaaacaccgucuc

SEQ ID NO: 1224217 - RNA, 18 nt, Human
accaaguaguaccaaaaa

SEQ ID NO: 1224218 - RNA, 24 nt, Human
accauguuggccaggcuggucuug

SEQ ID NO: 1224219 - RNA, 21 nt, Human
acccaagauccaaccuucccc

SEQ ID NO: 1224220 - RNA, 18 nt, Human
acgggguuucaccauguu

SEQ ID NO: 1224221 - RNA, 23 nt, Human
acgggguuucaccauguuggcca

SEQ ID NO: 1224222 - RNA, 24 nt, Human
acgggguuucaccauguuggccag

SEQ ID NO: 1224223 - RNA, 19 nt, Human
acuacaaaccccuucauag

SEQ ID NO: 1224224 - RNA, 18 nt, Human
acuccaaggucuucaggc

SEQ ID NO: 1224225 - RNA, 21 nt, Human
acugcacuccagccuggcugg

SEQ ID NO: 1224226 - RNA, 24 nt, Human
acugcacuccagccuggcuggcag

SEQ ID NO: 1224227 - RNA, 21 nt, Human
acugcagugaaaacacaaaga

SEQ ID NO: 1224228 - RNA, 22 nt, Human
acuucuaaccuuuuuuaaaagu

SEQ ID NO: 1224229 - RNA, 21 nt, Human
agaaaccuuuagagcuauaga

SEQ ID NO: 1224230 - RNA, 23 nt, Human
agagagcuacucugucucaaaaa

SEQ ID NO: 1224231 - RNA, 18 nt, Human
agagcuggggugacggag

SEQ ID NO: 1224232 - RNA, 24 nt, Human
agcacuuugggaggcugagguggg

SEQ ID NO: 1224233 - RNA, 20 nt, Human
agcccauaagcccuacccag

SEQ ID NO: 1224234 - RNA, 23 nt, Human
agcugggcauaguggugggugcc

SEQ ID NO: 1224235 - RNA, 22 nt, Human
aggaaggcuagugcagcagcug

SEQ ID NO: 1224236 - RNA, 19 nt, Human
aggaauggaaguguccuug

SEQ ID NO: 1224237 - RNA, 18 nt, Human
aggcacaggcagagcugg

SEQ ID NO: 1224238 - RNA, 19 nt, Human
aggcagggggagcuggagg

SEQ ID NO: 1224239 - RNA, 18 nt, Human
aggccacuggagguggga

SEQ ID NO: 1224240 - RNA, 22 nt, Human
aggcugagguggguggaucaug

SEQ ID NO: 1224241 - RNA, 24 nt, Human
agggauucgugugucucagccucc

SEQ ID NO: 1224242 - RNA, 18 nt, Human
agggggugggggaagaug

SEQ ID NO: 1224243 - RNA, 23 nt, Human
agggggugggggaagauggggag

SEQ ID NO: 1224244 - RNA, 24 nt, Human
aggugauccaccugccucagcuuu

SEQ ID NO: 1224245 - RNA, 24 nt, Human
agguggggguugcagcgagcugag

SEQ ID NO: 1224246 - RNA, 24 nt, Human
agguggguggaucaugaggucagg

SEQ ID NO: 1224247 - RNA, 23 nt, Human
agguucugaaggcccagagagcu

SEQ ID NO: 1224248 - RNA, 18 nt, Human
aguagcugggauuacagg

SEQ ID NO: 1224249 - RNA, 22 nt, Human
aguggagacgggguuucaccau

SEQ ID NO: 1224250 - RNA, 24 nt, Human
aguggugggugccuguaaucccag

SEQ ID NO: 1224251 - RNA, 24 nt, Human
aucaugccacugcacuccagccug

SEQ ID NO: 1224252 - RNA, 22 nt, Human
augccacugcacuccagccugg

SEQ ID NO: 1224253 - RNA, 21 nt, Human
auggaaguguccuugcccucu

SEQ ID NO: 1224254 - RNA, 22 nt, Human
caaagcucaguucuugagcugu

SEQ ID NO: 1224255 - RNA, 24 nt, Human
caaaguggugggauuacaggcgug

SEQ ID NO: 1224256 - RNA, 24 nt, Human
caacauggugaaacaccgucucua

SEQ ID NO: 1224257 - RNA, 23 nt, Human
caaccucugcuuccugggcucaa

SEQ ID NO: 1224258 - RNA, 21 nt, Human
caagaggaagccacagcagcc

SEQ ID NO: 1224259 - RNA, 23 nt, Human
caagauccaaccuuccccuuacu

SEQ ID NO: 1224260 - RNA, 24 nt, Human
cacaccuguaaucccagcacuuug

SEQ ID NO: 1224261 - RNA, 21 nt, Human
caccauguuggccaggcuggu

SEQ ID NO: 1224262 - RNA, 22 nt, Human
caccauguuggccaggcugguc

SEQ ID NO: 1224263 - RNA, 23 nt, Human
caccauguuggccaggcuggucu

SEQ ID NO: 1224264 - RNA, 24 nt, Human
caccauguuggccaggcuggucuu

SEQ ID NO: 1224265 - RNA, 23 nt, Human
caccugccucagcuuuccaaagu

SEQ ID NO: 1224266 - RNA, 23 nt, Human
caccuguaaucccagcacuuugg

SEQ ID NO: 1224267 - RNA, 24 nt, Human
caccuguaaucccagcacuuuggg

SEQ ID NO: 1224268 - RNA, 19 nt, Human
cacuccagccuggcuggca

SEQ ID NO: 1224269 - RNA, 24 nt, Human
cacuccagccuggcuggcagagag

SEQ ID NO: 1224270 - RNA, 23 nt, Human
cacugcaaccucugcuuccuggg

SEQ ID NO: 1224271 - RNA, 18 nt, Human
cacugcacuccagccugg

SEQ ID NO: 1224272 - RNA, 24 nt, Human
cacugcacuccagccuggcuggca

SEQ ID NO: 1224273 - RNA, 25 nt, Human
cacugcacuccagccuggcuggcag

SEQ ID NO: 1224274 - RNA, 20 nt, Human
cagaaaaacaaagccaaagg

SEQ ID NO: 1224275 - RNA, 20 nt, Human
cagaaacucagcccauaagc

SEQ ID NO: 1224276 - RNA, 23 nt, Human
cagagagcuacucugucucaaaa

SEQ ID NO: 1224277 - RNA, 24 nt, Human
cagagucuugcucugucgcccagg

SEQ ID NO: 1224278 - RNA, 24 nt, Human
cagcacuuugggaggcugaggugg

SEQ ID NO: 1224279 - RNA, 19 nt, Human
cagcccuguuaucccccaa

SEQ ID NO: 1224280 - RNA, 22 nt, Human
caggugauccaccugccucagc

SEQ ID NO: 1224281 - RNA, 19 nt, Human
caguucuugagcugugcuu

SEQ ID NO: 1224282 - RNA, 18 nt, Human
cauggggaaaaaagucac

SEQ ID NO: 1224283 - RNA, 24 nt, Human
cauguuggccaggcuggucuugaa

SEQ ID NO: 1224284 - RNA, 22 nt, Human
cauucagaaaaacaaagccaaa

SEQ ID NO: 1224285 - RNA, 23 nt, Human
cauucuagauuauugcuguguug

SEQ ID NO: 1224286 - RNA, 22 nt, Human
ccaaaguggugggauuacaggc

SEQ ID NO: 1224287 - RNA, 22 nt, Human
ccaaaguggugggauuacaggc

SEQ ID NO: 1224288 - RNA, 24 nt, Human
ccaaaguggugggauuacaggcgu

SEQ ID NO: 1224289 - RNA, 19 nt, Human
ccacugcacuccagccugg

SEQ ID NO: 1224290 - RNA, 20 nt, Human
ccacugcacuccagccuggc

SEQ ID NO: 1224291 - RNA, 22 nt, Human
ccacugcacuccagccuggcug

SEQ ID NO: 1224292 - RNA, 24 nt, Human
ccacugcacuccagccuggcuggc

SEQ ID NO: 1224293 - RNA, 18 nt, Human
ccagcaaagcugggaaag

SEQ ID NO: 1224294 - RNA, 18 nt, Human
ccagcccuguuauccccc

SEQ ID NO: 1224295 - RNA, 18 nt, Human
cccaccaaguaguaccaa

SEQ ID NO: 1224296 - RNA, 24 nt, Human
cccacuggagucacggaacccuga

SEQ ID NO: 1224297 - RNA, 24 nt, Human
cccauaguuagaucuuuuaaaggc

SEQ ID NO: 1224298 - RNA, 20 nt, Human
ccccugagaugcuccggccu

SEQ ID NO: 1224299 - RNA, 23 nt, Human
cccuaguagcugggauuacaggc

SEQ ID NO: 1224300 - RNA, 23 nt, Human
cccuccacuaaguccuuagggaa

SEQ ID NO: 1224301 - RNA, 20 nt, Human
ccuacaaugaguuagacuua

SEQ ID NO: 1224302 - RNA, 22 nt, Human
ccuaguagcugggauuacaggc

SEQ ID NO: 1224303 - RNA, 23 nt, Human
ccugaccaacauggugaaacacc

SEQ ID NO: 1224304 - RNA, 24 nt, Human
ccugaccaacauggugaaacaccg

SEQ ID NO: 1224305 - RNA, 21 nt, Human
ccugaccucaggugauccacc

SEQ ID NO: 1224306 - RNA, 23 nt, Human
ccugaccucaggugauccaccug

SEQ ID NO: 1224307 - RNA, 23 nt, Human
ccugaccucaggugauccaccug

SEQ ID NO: 1224308 - RNA, 24 nt, Human
ccugagcugcuggggcugaagcug

SEQ ID NO: 1224309 - RNA, 21 nt, Human
ccugggagguggggguugcag

SEQ ID NO: 1224310 - RNA, 21 nt, Human
ccuguaaucccagcuacucag

SEQ ID NO: 1224311 - RNA, 23 nt, Human
ccuguuggcugguuccugggggg

SEQ ID NO: 1224312 - RNA, 24 nt, Human
cgagaccagccugaccaacauggu

SEQ ID NO: 1224313 - RNA, 23 nt, Human
cgagcugagaucaugccacugca

SEQ ID NO: 1224314 - RNA, 20 nt, Human
cgcggccugacuccucuccu

SEQ ID NO: 1224315 - RNA, 24 nt, Human
cgggguuucaccauguuggccagg

SEQ ID NO: 1224316 - RNA, 21 nt, Human
cuaguagcugggauuacaggc

SEQ ID NO: 1224317 - RNA, 25 nt, Human
cucaaaaaaaaaaaaaaaaaaaaaa

SEQ ID NO: 1224318 - RNA, 22 nt, Human
cucacaccuguaaucccagcac

SEQ ID NO: 1224319 - RNA, 24 nt, Human
cucacaccuguaaucccagcacuu

SEQ ID NO: 1224320 - RNA, 24 nt, Human
cucacugcaaccucugcuuccugg

SEQ ID NO: 1224321 - RNA, 24 nt, Human
cucagccucccuaguagcugggau

SEQ ID NO: 1224322 - RNA, 23 nt, Human
cucaggugauccaccugccucag

SEQ ID NO: 1224323 - RNA, 20 nt, Human
cuccuggaacccagccuguu

SEQ ID NO: 1224324 - RNA, 22 nt, Human
cucgcagcgccuggcuuuggcu

SEQ ID NO: 1224325 - RNA, 19 nt, Human
cucugucucaaaaaaaaaa

SEQ ID NO: 1224326 - RNA, 18 nt, Human
cugaagccagcaaagcug

SEQ ID NO: 1224327 - RNA, 23 nt, Human
cugcaaccucugcuuccugggcu

SEQ ID NO: 1224328 - RNA, 24 nt, Human
cugcaaccucugcuuccugggcuc

SEQ ID NO: 1224329 - RNA, 22 nt, Human
cugcgacuccaaggucuucagg

SEQ ID NO: 1224330 - RNA, 21 nt, Human
cugcuuccugggcucaaggga

SEQ ID NO: 1224331 - RNA, 20 nt, Human
cugcuucgccugccuccuug

SEQ ID NO: 1224332 - RNA, 21 nt, Human
cuggaacccagccuguuucug

SEQ ID NO: 1224333 - RNA, 19 nt, Human
cugggacaggcuaccacug

SEQ ID NO: 1224334 - RNA, 18 nt, Human
cuugaaccugggaggugg

SEQ ID NO: 1224335 - RNA, 22 nt, Human
cuugccucgucagccuggaggu

SEQ ID NO: 1224336 - RNA, 21 nt, Human
cuugcucugucgcccaggcug

SEQ ID NO: 1224337 - RNA, 21 nt, Human
cuuggcacugagggcagccac

SEQ ID NO: 1224338 - RNA, 20 nt, Human
cuuggcacuggccgcagccu

SEQ ID NO: 1224339 - RNA, 22 nt, Human
cuuguggaaaaaaacuaaggaa

SEQ ID NO: 1224340 - RNA, 23 nt, Human
cuuucccuguccucucucaagag

SEQ ID NO: 1224341 - RNA, 21 nt, Human
gaaaacacaaagauuuuagaa

SEQ ID NO: 1224342 - RNA, 19 nt, Human
gaacccagccuguuucugu

SEQ ID NO: 1224343 - RNA, 19 nt, Human
gaagucagucuaaacugca

SEQ ID NO: 1224344 - RNA, 21 nt, Human
gacaagaugaagcugggacag

SEQ ID NO: 1224345 - RNA, 24 nt, Human
gaccucaggugauccaccugccuc

SEQ ID NO: 1224346 - RNA, 23 nt, Human
gagaaucgcuugaaccugggagg

SEQ ID NO: 1224347 - RNA, 24 nt, Human
gagacgggguuucaccauguuggc

SEQ ID NO: 1224348 - RNA, 19 nt, Human
gagcugcuggggcugaagc

SEQ ID NO: 1224349 - RNA, 20 nt, Human
gagcugcuggggcugaagcu

SEQ ID NO: 1224350 - RNA, 21 nt, Human
gagguggguggaucaugaggu

SEQ ID NO: 1224351 - RNA, 24 nt, Human
gaucaugaggucaggaguucgaga

SEQ ID NO: 1224352 - RNA, 26 nt, Human
gauccaaccuuccccuuacuucccac

SEQ ID NO: 1224353 - RNA, 18 nt, Human
gauuacaggcgccggcca

SEQ ID NO: 1224354 - RNA, 18 nt, Human
gauuacaggcgugagcca

SEQ ID NO: 1224355 - RNA, 21 nt, Human
gauuacaggcgugagccacug

SEQ ID NO: 1224356 - RNA, 24 nt, Human
gauuacaggcgugagccacugugu

SEQ ID NO: 1224357 - RNA, 23 nt, Human
gcaaagcacaagaagucagucua

SEQ ID NO: 1224358 - RNA, 25 nt, Human
gcaauacuauagugaucaguaagcu

SEQ ID NO: 1224359 - RNA, 21 nt, Human
gcagagagcuacucugucuca

SEQ ID NO: 1224360 - RNA, 24 nt, Human
gccagccgggugcgguggcucaca

SEQ ID NO: 1224361 - RNA, 21 nt, Human
gccauuuccaacagaggccug

SEQ ID NO: 1224362 - RNA, 20 nt, Human
gcccaggcuggagugcagug

SEQ ID NO: 1224363 - RNA, 19 nt, Human
gccucagcuuuccaaagug

SEQ ID NO: 1224364 - RNA, 21 nt, Human
gcgccuggcuuuggcugcuuc

SEQ ID NO: 1224365 - RNA, 20 nt, Human
gcgguggcucacaccuguaa

SEQ ID NO: 1224366 - RNA, 25 nt, Human
gcucugucgcccaggcuggagugca

SEQ ID NO: 1224367 - RNA, 19 nt, Human
gcugcuucgccugccuccu

SEQ ID NO: 1224368 - RNA, 19 nt, Human
ggaacccuuccagucaccu

SEQ ID NO: 1224369 - RNA, 18 nt, Human
ggagaugggcuccuggaa

SEQ ID NO: 1224370 - RNA, 18 nt, Human
ggcacaggcagagcuggg

SEQ ID NO: 1224371 - RNA, 24 nt, Human
ggcagagagcuacucugucucaaa

SEQ ID NO: 1224372 - RNA, 24 nt, Human
ggcagccacuuuguacucucucug

SEQ ID NO: 1224373 - RNA, 24 nt, Human
ggcuggucuugaauuccugaccuc

SEQ ID NO: 1224374 - RNA, 20 nt, Human
gggaaaaaagucacuugugu

SEQ ID NO: 1224375 - RNA, 25 nt, Human
gggaggcuggucucagguugggagg

SEQ ID NO: 1224376 - RNA, 18 nt, Human
gggcaaagguucugaagg

SEQ ID NO: 1224377 - RNA, 21 nt, Human
gggcagggaagcaugguccag

SEQ ID NO: 1224378 - RNA, 24 nt, Human
gggcauaguggugggugccuguaa

SEQ ID NO: 1224379 - RNA, 20 nt, Human
ggggccaggggccgcuuucc

SEQ ID NO: 1224380 - RNA, 22 nt, Human
gggguugcagcgagcugagauc

SEQ ID NO: 1224381 - RNA, 23 nt, Human
gggguugcagcgagcugagauca

SEQ ID NO: 1224382 - RNA, 23 nt, Human
gggguuucaccauguuggccagg

SEQ ID NO: 1224383 - RNA, 19 nt, Human
ggucuugaauuccugaccu

SEQ ID NO: 1224384 - RNA, 23 nt, Human
gguggaucaugaggucaggaguu

SEQ ID NO: 1224385 - RNA, 23 nt, Human
gguggcucacaccuguaauccca

SEQ ID NO: 1224386 - RNA, 24 nt, Human
gguggcucacaccuguaaucccag

SEQ ID NO: 1224387 - RNA, 23 nt, Human
gguggguggaucaugaggucagg

SEQ ID NO: 1224388 - RNA, 20 nt, Human
gguugcagcgagcugagauc

SEQ ID NO: 1224389 - RNA, 18 nt, Human
guagcugggauuacaggc

SEQ ID NO: 1224390 - RNA, 19 nt, Human
guccuugcccucuuccagg

SEQ ID NO: 1224391 - RNA, 18 nt, Human
gugauccaccugccucag

SEQ ID NO: 1224392 - RNA, 24 nt, Human
gugauccaccugccucagcuuucc

SEQ ID NO: 1224393 - RNA, 24 nt, Human
gugcaacuggaggcagggguaagc

SEQ ID NO: 1224394 - RNA, 20 nt, Human
gugcagcagcugucagggau

SEQ ID NO: 1224395 - RNA, 23 nt, Human
guggagacgggguuucaccaugu

SEQ ID NO: 1224396 - RNA, 23 nt, Human
guggaucaugaggucaggaguuc

SEQ ID NO: 1224397 - RNA, 23 nt, Human
guggcucacaccuguaaucccag

SEQ ID NO: 1224398 - RNA, 20 nt, Human
guggggguugcagcgagcug

SEQ ID NO: 1224399 - RNA, 23 nt, Human
gugucucagccucccuaguagcu

SEQ ID NO: 1224400 - RNA, 19 nt, Human
uaaaaauaaaaaaauuagc

SEQ ID NO: 1224401 - RNA, 20 nt, Human
uaaaaauaaaaaaauuagcu

SEQ ID NO: 1224402 - RNA, 18 nt, Human
uaaacugcagugaaaaca

SEQ ID NO: 1224403 - RNA, 26 nt, Human
uaaaggcacaggcagagcuggagacc

SEQ ID NO: 1224404 - RNA, 21 nt, Human
uaaaggcacaucuagaagugg

SEQ ID NO: 1224405 - RNA, 23 nt, Human
uacaaucgaggcucacugcaacc

SEQ ID NO: 1224406 - RNA, 23 nt, Human
uacaggcgugagccacugugucc

SEQ ID NO: 1224407 - RNA, 24 nt, Human
uacaggcgugagccacuguguccc

SEQ ID NO: 1224408 - RNA, 18 nt, Human
uagcuggcucccaacugc

SEQ ID NO: 1224409 - RNA, 18 nt, Human
uagcugggcauaguggug

SEQ ID NO: 1224410 - RNA, 27 nt, Human
uaguagcugggauuacaggcgccggcc

SEQ ID NO: 1224411 - RNA, 24 nt, Human
uaguggagacgggguuucaccaug

SEQ ID NO: 1224412 - RNA, 24 nt, Human
uauuucaguuuugaauauuaaauc

SEQ ID NO: 1224413 - RNA, 21 nt, Human
ucaaaaaaaaaaaaaaaaaaa

SEQ ID NO: 1224414 - RNA, 22 nt, Human
ucaaaaaaaaaaaaaaaaaaaa

SEQ ID NO: 1224415 - RNA, 23 nt, Human
ucaaaaaaaaaaaaaaaaaaaaa

SEQ ID NO: 1224416 - RNA, 23 nt, Human
ucaaaaaaaaaaaaaaaaaaaaa

SEQ ID NO: 1224417 - RNA, 24 nt, Human
ucacugcaaccucugcuuccuggg

SEQ ID NO: 1224418 - RNA, 21 nt, Human
ucagaaaaacaaagccaaagg

SEQ ID NO: 1224419 - RNA, 22 nt, Human
ucagcuaccucaucaccaucca

SEQ ID NO: 1224420 - RNA, 28 nt, Human
ucaggacaagaugaagcugggacaacac

SEQ ID NO: 1224421 - RNA, 22 nt, Human
ucaggugauccaccugccucag

SEQ ID NO: 1224422 - RNA, 24 nt, Human
ucagugucuucuaggccguucucc

SEQ ID NO: 1224423 - RNA, 24 nt, Human
ucaugaggucaggaguucgagacc

SEQ ID NO: 1224424 - RNA, 23 nt, Human
ucaugccacugcacuccagccug

SEQ ID NO: 1224425 - RNA, 21 nt, Human
uccaaggcagggggagcugga

SEQ ID NO: 1224426 - RNA, 22 nt, Human
uccagcccuguuaucccccaaa

SEQ ID NO: 1224427 - RNA, 19 nt, Human
uccauccauucagaaaaac

SEQ ID NO: 1224428 - RNA, 23 nt, Human
uccauccauucagaaaaacaaag

SEQ ID NO: 1224429 - RNA, 22 nt, Human
ucccgcucugugacccacuaaa

SEQ ID NO: 1224430 - RNA, 24 nt, Human
ucccuaguagcugggauuacaggc

SEQ ID NO: 1224431 - RNA, 19 nt, Human
uccugggcucaagggauuc

SEQ ID NO: 1224432 - RNA, 24 nt, Human
ucgcccaggcuggagugcaguggu

SEQ ID NO: 1224433 - RNA, 23 nt, Human
ucgcuugaaccugggaggugggg

SEQ ID NO: 1224434 - RNA, 18 nt, Human
ucuccauccauucagaaa

SEQ ID NO: 1224435 - RNA, 21 nt, Human
ucucuacuaaaaauaaaaaaa

SEQ ID NO: 1224436 - RNA, 20 nt, Human
ucugaagccagcaaagcugg

SEQ ID NO: 1224437 - RNA, 22 nt, Human
ucugcuuccugggcucaaggga

SEQ ID NO: 1224438 - RNA, 23 nt, Human
ucugucucaaaaaaaaaaaaaaa

SEQ ID NO: 1224439 - RNA, 21 nt, Human
ucuucaggccgcgcucgcagc

SEQ ID NO: 1224440 - RNA, 23 nt, Human
ucuugcucugucgcccaggcugg

SEQ ID NO: 1224441 - RNA, 24 nt, Human
ucuugcucugucgcccaggcugga

SEQ ID NO: 1224442 - RNA, 24 nt, Human
ugaaaauuuuaaaaugauuugggu

SEQ ID NO: 1224443 - RNA, 18 nt, Human
ugaaagagcaaagcagca

SEQ ID NO: 1224444 - RNA, 22 nt, Human
ugaaagagcaaagcagcagacu

SEQ ID NO: 1224445 - RNA, 19 nt, Human
ugaaccugggagguggggg

SEQ ID NO: 1224446 - RNA, 24 nt, Human
ugaaccugggagguggggguugca

SEQ ID NO: 1224447 - RNA, 24 nt, Human
ugaagauagauagauagauagaua

SEQ ID NO: 1224448 - RNA, 24 nt, Human
ugacacaggagaaucgcuugaacc

SEQ ID NO: 1224449 - RNA, 18 nt, Human
ugaccaacauggugaaac

SEQ ID NO: 1224450 - RNA, 24 nt, Human
ugaccucaggugauccaccugccu

SEQ ID NO: 1224451 - RNA, 19 nt, Human
ugacggaguugucugggac

SEQ ID NO: 1224452 - RNA, 20 nt, Human
ugacugcaauuaaguguuaa

SEQ ID NO: 1224453 - RNA, 22 nt, Human
ugagacagagucuugcucuguc

SEQ ID NO: 1224454 - RNA, 24 nt, Human
ugagaucaugccacugcacuccag

SEQ ID NO: 1224455 - RNA, 25 nt, Human
ugaggaacaucagaaacucagccca

SEQ ID NO: 1224456 - RNA, 21 nt, Human
ugagguggguggaucaugagg

SEQ ID NO: 1224457 - RNA, 24 nt, Human
ugagguggguggaucaugagguca

SEQ ID NO: 1224458 - RNA, 21 nt, Human
ugaguaaaaggagggggcaaa

SEQ ID NO: 1224459 - RNA, 27 nt, Human
ugaguaguuaguugaguaaaaggaggg

SEQ ID NO: 1224460 - RNA, 19 nt, Human
ugcaaccucugcuuccugg

SEQ ID NO: 1224461 - RNA, 18 nt, Human
ugcacuggagguucagug

SEQ ID NO: 1224462 - RNA, 19 nt, Human
ugcacuggagguucagugu

SEQ ID NO: 1224463 - RNA, 18 nt, Human
ugcagugguacaaucgag

SEQ ID NO: 1224464 - RNA, 21 nt, Human
ugccucagcuuuccaaagugg

SEQ ID NO: 1224465 - RNA, 24 nt, Human
ugccuguaaucccagcuacucagg

SEQ ID NO: 1224466 - RNA, 20 nt, Human
ugcuccggccugagcugcuu

SEQ ID NO: 1224467 - RNA, 24 nt, Human
ugcucugucgcccaggcuggagug

SEQ ID NO: 1224468 - RNA, 18 nt, Human
ugcuggccaucggcuaca

SEQ ID NO: 1224469 - RNA, 23 nt, Human
uggaaaaaaacuaaggaaguucc

SEQ ID NO: 1224470 - RNA, 26 nt, Human
uggaaaaaaacuaaggaaguucccca

SEQ ID NO: 1224471 - RNA, 18 nt, Human
uggaacccagccuguuuc

SEQ ID NO: 1224472 - RNA, 19 nt, Human
uggaaguguccuugcccuc

SEQ ID NO: 1224473 - RNA, 18 nt, Human
uggagugcagugguacaa

SEQ ID NO: 1224474 - RNA, 21 nt, Human
uggagugcagugguacaaucg

SEQ ID NO: 1224475 - RNA, 24 nt, Human
uggagugcagugguacaaucgagg

SEQ ID NO: 1224476 - RNA, 21 nt, Human
uggauacacacccuaagggga

SEQ ID NO: 1224477 - RNA, 22 nt, Human
uggaucaugaggucaggaguuc

SEQ ID NO: 1224478 - RNA, 24 nt, Human
uggaucaugaggucaggaguucga

SEQ ID NO: 1224479 - RNA, 22 nt, Human
uggccagccgggugcgguggcu

SEQ ID NO: 1224480 - RNA, 24 nt, Human
uggccaggcuggucuugaauuccu

SEQ ID NO: 1224481 - RNA, 22 nt, Human
uggcccacuggagucacggaac

SEQ ID NO: 1224482 - RNA, 21 nt, Human
uggcucacaccuguaauccca

SEQ ID NO: 1224483 - RNA, 22 nt, Human
uggcucacaccuguaaucccag

SEQ ID NO: 1224484 - RNA, 24 nt, Human
uggcucacaccuguaaucccagca

SEQ ID NO: 1224485 - RNA, 20 nt, Human
uggcucccaacugcagguga

SEQ ID NO: 1224486 - RNA, 21 nt, Human
uggcuggcagagagcuacucu

SEQ ID NO: 1224487 - RNA, 20 nt, Human
ugggacaggcuccuccuacu

SEQ ID NO: 1224488 - RNA, 20 nt, Human
ugggaggcugaggugggugg

SEQ ID NO: 1224489 - RNA, 23 nt, Human
ugggaggcugagguggguggauc

SEQ ID NO: 1224490 - RNA, 24 nt, Human
ugggaggcugagguggguggauca

SEQ ID NO: 1224491 - RNA, 18 nt, Human
ugggaggcuuugucuugc

SEQ ID NO: 1224492 - RNA, 18 nt, Human
ugggagguggggguugca

SEQ ID NO: 1224493 - RNA, 24 nt, Human
ugggagguggggguugcagcgagc

SEQ ID NO: 1224494 - RNA, 21 nt, Human
ugggauuacaggcgccggcca

SEQ ID NO: 1224495 - RNA, 22 nt, Human
ugggauuacaggcgccggccac

SEQ ID NO: 1224496 - RNA, 24 nt, Human
ugggauuacaggcgccggccacca

SEQ ID NO: 1224497 - RNA, 25 nt, Human
ugggauuacaggcgccggccaccau

SEQ ID NO: 1224498 - RNA, 21 nt, Human
ugggauuacaggcgugagcca

SEQ ID NO: 1224499 - RNA, 22 nt, Human
ugggauuacaggcgugagccac

SEQ ID NO: 1224500 - RNA, 22 nt, Human
ugggauuacaggcgugagccac

SEQ ID NO: 1224501 - RNA, 22 nt, Human
ugggauuacaggcgugagccac

SEQ ID NO: 1224502 - RNA, 23 nt, Human
ugggauuacaggcgugagccacu

SEQ ID NO: 1224503 - RNA, 24 nt, Human
ugggauuacaggcgugagccacug

SEQ ID NO: 1224504 - RNA, 24 nt, Human
ugggcucaagggauucgugugucu

SEQ ID NO: 1224505 - RNA, 19 nt, Human
uggguggguagaccaaacc

SEQ ID NO: 1224506 - RNA, 21 nt, Human
uggguggguagaccaaaccca

SEQ ID NO: 1224507 - RNA, 21 nt, Human
uggugggugccuguaauccca

SEQ ID NO: 1224508 - RNA, 22 nt, Human
uggugggugccuguaaucccag

SEQ ID NO: 1224509 - RNA, 24 nt, Human
uggugggugccuguaaucccagcu

SEQ ID NO: 1224510 - RNA, 21 nt, Human
ugucgcccaggcuggagugca

SEQ ID NO: 1224511 - RNA, 24 nt, Human
ugucucagccucccuaguagcugg

SEQ ID NO: 1224512 - RNA, 21 nt, Human
ugucuucuaggccguucuccu

SEQ ID NO: 1224513 - RNA, 23 nt, Human
uguguguaguucccgcucuguga

SEQ ID NO: 1224514 - RNA, 23 nt, Human
uguguugcauacacgugacugca

SEQ ID NO: 1224515 - RNA, 24 nt, Human
uuagcugggcauaguggugggugc

SEQ ID NO: 1224516 - RNA, 18 nt, Human
uuaguggagacgggguuu

SEQ ID NO: 1224517 - RNA, 22 nt, Human
uuaguggagacgggguuucacc

SEQ ID NO: 1224518 - RNA, 24 nt, Human
uuaguggagacgggguuucaccau

SEQ ID NO: 1224519 - RNA, 24 nt, Human
uugaaccugggagguggggguugc

SEQ ID NO: 1224520 - RNA, 19 nt, Human
uugcagcgagcugagauca

SEQ ID NO: 1224521 - RNA, 20 nt, Human
uugcagcgagcugagaucau

SEQ ID NO: 1224522 - RNA, 24 nt, Human
uugcucugucgcccaggcuggagu

SEQ ID NO: 1224523 - RNA, 22 nt, Human
uuggcuacaacaaaggccuuuu

SEQ ID NO: 1224524 - RNA, 19 nt, Human
uuggcugguuccugggggg

SEQ ID NO: 1224525 - RNA, 20 nt, Human
uuggcugguuccuggggggc

SEQ ID NO: 1224526 - RNA, 25 nt, Human
uugggaggcugagguggguggauca

SEQ ID NO: 1224527 - RNA, 25 nt, Human
uuggugcuuggguagcagcaucucu

SEQ ID NO: 1224528 - RNA, 18 nt, Human
uuguguguaguucccgcu

SEQ ID NO: 1224529 - RNA, 24 nt, Human
uuguguuuguuuugagacagaguc

SEQ ID NO: 1224530 - RNA, 24 nt, Human
uuguuuuuguuuuuaguggagacg

SEQ ID NO: 1224531 - RNA, 24 nt, Human
uuucaccauguuggccaggcuggu

SEQ ID NO: 1224532 - RNA, 25 nt, Human
uuuccuaaggccacuggagguggga

SEQ ID NO: 1224533 - RNA, 24 nt, Human
uuuuuaguggagacgggguuucac

SEQ ID NO: 1224534 - RNA, 19 nt, Human
uuuuuguuuuuaguggaga

SEQ ID NO: 1224535 - RNA, 23 nt, Human
uuuuuucuuccaguuaacagucu

SEQ ID NO: 1224536 - RNA, 23 nt, Human
cauuuaaagauaauauccaaugc

SEQ ID NO: 1224537 - RNA, 22 nt, Human
ggcuggaaaaguucuggagaac

SEQ ID NO: 1224538 - RNA, 23 nt, Human
ucuuccagacucucuaggcauca

SEQ ID NO: 1224539 - RNA, 19 nt, Human
ugccuccaaguucccaccc

SEQ ID NO: 1224540 - RNA, 21 nt, Human
uggaaaaguucuggagaacau

SEQ ID NO: 1224541 - RNA, 19 nt, Human
aagcagggacacaaaggca

SEQ ID NO: 1224542 - RNA, 22 nt, Human
acgugucuuuccgggccugggc

SEQ ID NO: 1224543 - RNA, 24 nt, Human
aguccucugcacaaguucagagag

SEQ ID NO: 1224544 - RNA, 24 nt, Human
cacaaaggcaaucaagugcauagc

SEQ ID NO: 1224545 - RNA, 19 nt, Human
ccgggccugggcgucucag

SEQ ID NO: 1224546 - RNA, 20 nt, Human
ccucugcacaaguucagaga

SEQ ID NO: 1224547 - RNA, 21 nt, Human
ccuuccggacaggacagaagu

SEQ ID NO: 1224548 - RNA, 27 nt, Human
cgucagaaagggauccccuuugggcga

SEQ ID NO: 1224549 - RNA, 18 nt, Human
cucgagcuggauccaccc

SEQ ID NO: 1224550 - RNA, 21 nt, Human
cuucaaaaggugaagcaggga

SEQ ID NO: 1224551 - RNA, 23 nt, Human
cuuucuuucccgucagaaaggga

SEQ ID NO: 1224552 - RNA, 20 nt, Human
gaccuccagaggagguuagg

SEQ ID NO: 1224553 - RNA, 20 nt, Human
gcaguaguuacggcuugugu

SEQ ID NO: 1224554 - RNA, 18 nt, Human
gccugggcgucucaggag

SEQ ID NO: 1224555 - RNA, 20 nt, Human
ggacaggacucaccgccuuu

SEQ ID NO: 1224556 - RNA, 19 nt, Human
ggccugggcgucucaggag

SEQ ID NO: 1224557 - RNA, 21 nt, Human
ucaaaaggugaagcagggaca

SEQ ID NO: 1224558 - RNA, 19 nt, Human
ucacaggauuuuucuuguc

SEQ ID NO: 1224559 - RNA, 23 nt, Human
ucccuuccggacaggacagaagu

SEQ ID NO: 1224560 - RNA, 23 nt, Human
ucuguaaacuguccagaacccgc

SEQ ID NO: 1224561 - RNA, 21 nt, Human
ucuuaucaagagaaaacuacu

SEQ ID NO: 1224562 - RNA, 18 nt, Human
ugagcagaugguuucccc

SEQ ID NO: 1224563 - RNA, 23 nt, Human
caagagaaaagccaacauguuuu

SEQ ID NO: 1224564 - RNA, 23 nt, Human
caagagaaaagccaacauguuuu

SEQ ID NO: 1224565 - RNA, 20 nt, Human
cagcagcucccugcugagcc

SEQ ID NO: 1224566 - RNA, 22 nt, Human
cagcagcucccugcugagccuc

SEQ ID NO: 1224567 - RNA, 22 nt, Human
cagcagcucccugcugagccuc

SEQ ID NO: 1224568 - RNA, 22 nt, Human
cagcagcucccugcugagccuc

SEQ ID NO: 1224569 - RNA, 22 nt, Human
cagcagcucccugcugagccuc

SEQ ID NO: 1224570 - RNA, 19 nt, Human
cagccagcagcucccugcu

SEQ ID NO: 1224571 - RNA, 19 nt, Human
cagccagcagcucccugcu

SEQ ID NO: 1224572 - RNA, 19 nt, Human
cagccagcagcucccugcu

SEQ ID NO: 1224573 - RNA, 19 nt, Human
cagccagcagcucccugcu

SEQ ID NO: 1224574 - RNA, 19 nt, Human
cagccagcagcucccugcu

SEQ ID NO: 1224575 - RNA, 22 nt, Human
ccccuucuucuuuucuucuuug

SEQ ID NO: 1224576 - RNA, 22 nt, Human
ccccuucuucuuuucuucuuug

SEQ ID NO: 1224577 - RNA, 22 nt, Human
ccccuucuuuucuuccccuucc

SEQ ID NO: 1224578 - RNA, 22 nt, Human
ccccuucuuuucuuccccuucc

SEQ ID NO: 1224579 - RNA, 22 nt, Human
ccccuucuuuucuuccccuucu

SEQ ID NO: 1224580 - RNA, 22 nt, Human
ccccuucuuuucuuccccuucu

SEQ ID NO: 1224581 - RNA, 20 nt, Human
ccugcaagacuucaggcucu

SEQ ID NO: 1224582 - RNA, 20 nt, Human
ccugcaagacuucaggcucu

SEQ ID NO: 1224583 - RNA, 20 nt, Human
ccugcaagacuucaggcucu

SEQ ID NO: 1224584 - RNA, 20 nt, Human
ccugcaagacuucaggcucu

SEQ ID NO: 1224585 - RNA, 20 nt, Human
ccugcaagacuucaggcucu

SEQ ID NO: 1224586 - RNA, 20 nt, Human
ccugcaagacuucaggcucu

SEQ ID NO: 1224587 - RNA, 21 nt, Human
ccuuccccuucuuuucaauuu

SEQ ID NO: 1224588 - RNA, 21 nt, Human
ccuuggucuucuuccucuucu

SEQ ID NO: 1224589 - RNA, 21 nt, Human
ccuuggucuucuuccucuucu

SEQ ID NO: 1224590 - RNA, 20 nt, Human
cucccugcugagccuggggc

SEQ ID NO: 1224591 - RNA, 20 nt, Human
cucccugcugagccuggggc

SEQ ID NO: 1224592 - RNA, 20 nt, Human
cucccugcugagccuggggc

SEQ ID NO: 1224593 - RNA, 20 nt, Human
cucccugcugagccuggggc

SEQ ID NO: 1224594 - RNA, 20 nt, Human
cucccugcugagccuggggc

SEQ ID NO: 1224595 - RNA, 20 nt, Human
cucccugcugagccuggggc

SEQ ID NO: 1224596 - RNA, 20 nt, Human
cucccugcugagccuggggc

SEQ ID NO: 1224597 - RNA, 19 nt, Human
cugagccuggggcauggug

SEQ ID NO: 1224598 - RNA, 19 nt, Human
cugagccuggggcauggug

SEQ ID NO: 1224599 - RNA, 19 nt, Human
cugagccuggggcauggug

SEQ ID NO: 1224600 - RNA, 19 nt, Human
cugagccuggggcauggug

SEQ ID NO: 1224601 - RNA, 18 nt, Human
cugcagggcuggcauggg

SEQ ID NO: 1224602 - RNA, 23 nt, Human
cuucaggcucuacuaccuccagc

SEQ ID NO: 1224603 - RNA, 23 nt, Human
cuucaggcucuacuaccuccagc

SEQ ID NO: 1224604 - RNA, 20 nt, Human
cuuccccuuccccuucuuuu

SEQ ID NO: 1224605 - RNA, 20 nt, Human
cuuccccuuccccuucuuuu

SEQ ID NO: 1224606 - RNA, 19 nt, Human
cuuccccuucuuuucuucc

SEQ ID NO: 1224607 - RNA, 19 nt, Human
cuuccccuucuuuucuucc

SEQ ID NO: 1224608 - RNA, 19 nt, Human
cuuccccuucuuuucuucc

SEQ ID NO: 1224609 - RNA, 19 nt, Human
cuuccccuucuuuucuucc

SEQ ID NO: 1224610 - RNA, 20 nt, Human
cuucuuccccuucuuuucuu

SEQ ID NO: 1224611 - RNA, 20 nt, Human
cuucuuccccuucuuuucuu

SEQ ID NO: 1224612 - RNA, 21 nt, Human
cuugguccuuuuuaauucugu

SEQ ID NO: 1224613 - RNA, 21 nt, Human
cuugguccuuuuuaauucugu

SEQ ID NO: 1224614 - RNA, 24 nt, Human
cuuggucuucuuccacuucuuggu

SEQ ID NO: 1224615 - RNA, 24 nt, Human
cuuggucuucuuccacuucuuggu

SEQ ID NO: 1224616 - RNA, 24 nt, Human
cuuggucuucuuccacuucuuggu

SEQ ID NO: 1224617 - RNA, 24 nt, Human
cuuggucuucuuccucuucuuggu

SEQ ID NO: 1224618 - RNA, 24 nt, Human
cuuggucuucuuccucuucuuggu

SEQ ID NO: 1224619 - RNA, 25 nt, Human
cuuuucuuccccuuccccuucuuuu

SEQ ID NO: 1224620 - RNA, 21 nt, Human
ggcacuucuguagggcuggca

SEQ ID NO: 1224621 - RNA, 21 nt, Human
ggcacuucuguagggcuggca

SEQ ID NO: 1224622 - RNA, 21 nt, Human
ggcacuucuguagggcuggca

SEQ ID NO: 1224623 - RNA, 21 nt, Human
ggucuucuuccacuucuuggu

SEQ ID NO: 1224624 - RNA, 21 nt, Human
ggucuucuuccacuucuuggu

SEQ ID NO: 1224625 - RNA, 21 nt, Human
ggucuucuuccacuucuuggu

SEQ ID NO: 1224626 - RNA, 21 nt, Human
ggucuucuuccucuucuuggu

SEQ ID NO: 1224627 - RNA, 21 nt, Human
ggucuucuuccucuucuuggu

SEQ ID NO: 1224628 - RNA, 27 nt, Human
gguuuugaucuucuuccccuucuuuuc

SEQ ID NO: 1224629 - RNA, 27 nt, Human
gguuuugaucuucuuccccuucuuuuc

SEQ ID NO: 1224630 - RNA, 22 nt, Human
ucaagagaaaagccaacauguu

SEQ ID NO: 1224631 - RNA, 22 nt, Human
ucaagagaaaagccaacauguu

SEQ ID NO: 1224632 - RNA, 27 nt, Human
uccccuucuuuucuuccccuucccccu

SEQ ID NO: 1224633 - RNA, 27 nt, Human
uccccuucuuuucuuccccuucucccu

SEQ ID NO: 1224634 - RNA, 19 nt, Human
ucugcagggcuggcauggg

SEQ ID NO: 1224635 - RNA, 18 nt, Human
ucuuccacuucuugguac

SEQ ID NO: 1224636 - RNA, 18 nt, Human
ucuuccacuucuugguac

SEQ ID NO: 1224637 - RNA, 18 nt, Human
ucuuccacuucuugguac

SEQ ID NO: 1224638 - RNA, 19 nt, Human
ucuucuuccccuucuuuuc

SEQ ID NO: 1224639 - RNA, 19 nt, Human
ucuucuuccccuucuuuuc

SEQ ID NO: 1224640 - RNA, 19 nt, Human
ucuucuuccccuucuuuuc

SEQ ID NO: 1224641 - RNA, 19 nt, Human
ucuucuuccccuucuuuuc

SEQ ID NO: 1224642 - RNA, 19 nt, Human
ucuuuucuuccccuucccc

SEQ ID NO: 1224643 - RNA, 19 nt, Human
ucuuuucuuccccuucccc

SEQ ID NO: 1224644 - RNA, 21 nt, Human
ucuuuucuuccccuucuucuu

SEQ ID NO: 1224645 - RNA, 21 nt, Human
ucuuuucuuccccuucuucuu

SEQ ID NO: 1224646 - RNA, 20 nt, Human
uguagggcuggcaggaguca

SEQ ID NO: 1224647 - RNA, 20 nt, Human
uguagggcuggcaggaguca

SEQ ID NO: 1224648 - RNA, 18 nt, Human
uucaagacaacuggaagg

SEQ ID NO: 1224649 - RNA, 18 nt, Human
uucaagacaacuggaagg

SEQ ID NO: 1224650 - RNA, 18 nt, Human
uucaagauaaccugaagg

SEQ ID NO: 1224651 - RNA, 18 nt, Human
uucaagauaaccugaagg

SEQ ID NO: 1224652 - RNA, 19 nt, Human
uucuuccucuucuuggucc

SEQ ID NO: 1224653 - RNA, 19 nt, Human
uucuuccucuucuuggucc

SEQ ID NO: 1224654 - RNA, 27 nt, Human
uucuuugaucuucuuccccuucuuuuc

SEQ ID NO: 1224655 - RNA, 27 nt, Human
uucuuugaucuucuuccccuucuuuuc

SEQ ID NO: 1224656 - RNA, 21 nt, Human
uuggucuucuuccacuucuug

SEQ ID NO: 1224657 - RNA, 21 nt, Human
uuggucuucuuccacuucuug

SEQ ID NO: 1224658 - RNA, 21 nt, Human
uuggucuucuuccacuucuug

SEQ ID NO: 1224659 - RNA, 19 nt, Human
uuuucaauuucauccaugu

SEQ ID NO: 1224660 - RNA, 19 nt, Human
uuuucaauuucauccaugu

SEQ ID NO: 1224661 - RNA, 19 nt, Human
uuuucaauuucauccaugu

SEQ ID NO: 1224662 - RNA, 25 nt, Human
uuuucaauuucauccaugucaacag

SEQ ID NO: 1224663 - RNA, 26 nt, Human
uuuucaauuucauccaugucaacagc

SEQ ID NO: 1224664 - RNA, 26 nt, Human
uuuucaauuucauccaugucaacagc

SEQ ID NO: 1224665 - RNA, 19 nt, Human
uuuucaauuucucccacgu

SEQ ID NO: 1224666 - RNA, 20 nt, Human
uuuucaauuucucccacguc

SEQ ID NO: 1224667 - RNA, 24 nt, Human
aaggagcugcagggugacagaugu

SEQ ID NO: 1224668 - RNA, 21 nt, Human
agaauuuuuuuuuccacaagg

SEQ ID NO: 1224669 - RNA, 26 nt, Human
agggagggugaucaggucaaggaggu

SEQ ID NO: 1224670 - RNA, 23 nt, Human
caaggagguaggaacuuagagaa

SEQ ID NO: 1224671 - RNA, 21 nt, Human
caagggagaaagggaagggau

SEQ ID NO: 1224672 - RNA, 21 nt, Human
cagaauuuuuuuuuccacaag

SEQ ID NO: 1224673 - RNA, 19 nt, Human
cagggugacagauguuggc

SEQ ID NO: 1224674 - RNA, 19 nt, Human
cagggugacagauguuggc

SEQ ID NO: 1224675 - RNA, 25 nt, Human
ccuucagggaauggcugggugaaca

SEQ ID NO: 1224676 - RNA, 21 nt, Human
cuuuguuuuaacaaggccugg

SEQ ID NO: 1224677 - RNA, 24 nt, Human
gaacuuagagaacgcauuugguag

SEQ ID NO: 1224678 - RNA, 24 nt, Human
gcagggugacagauguuggcuggg

SEQ ID NO: 1224679 - RNA, 22 nt, Human
ggaggagggagggugaucaggu

SEQ ID NO: 1224680 - RNA, 23 nt, Human
gggaaucugagagguacaaugcu

SEQ ID NO: 1224681 - RNA, 21 nt, Human
uggaggagggagggugaucag

SEQ ID NO: 1224682 - RNA, 20 nt, Human
uggcugaugaucuggucagg

SEQ ID NO: 1224683 - RNA, 21 nt, Human
uggcugaugaucuggucaggg

SEQ ID NO: 1224684 - RNA, 18 nt, Human
uggggaaauuccacuggc

SEQ ID NO: 1224685 - RNA, 19 nt, Human
uggucaggguucgagaggg

SEQ ID NO: 1224686 - RNA, 23 nt, Human
uucgagaggggacaacagcuucu

SEQ ID NO: 1224687 - RNA, 18 nt, Human
aaaagggcagaaaggggg

SEQ ID NO: 1224688 - RNA, 26 nt, Human
aaacagacagguggaaaaacugagac

SEQ ID NO: 1224689 - RNA, 19 nt, Human
aaacccagagggacccaag

SEQ ID NO: 1224690 - RNA, 18 nt, Human
aaauaagaaaaaccaaaa

SEQ ID NO: 1224691 - RNA, 23 nt, Human
aacccucagccuugacuaugucu

SEQ ID NO: 1224692 - RNA, 24 nt, Human
aagaaaaaccaaaauacuccaaag

SEQ ID NO: 1224693 - RNA, 18 nt, Human
aagcuucuagaggcucau

SEQ ID NO: 1224694 - RNA, 21 nt, Human
aaguccuuuugcuugccccuc

SEQ ID NO: 1224695 - RNA, 24 nt, Human
accaaaauacuccaaagaugacuu

SEQ ID NO: 1224696 - RNA, 25 nt, Human
acccugugcccuccuucccaaucuu

SEQ ID NO: 1224697 - RNA, 22 nt, Human
acgaguagauacagaacaaugu

SEQ ID NO: 1224698 - RNA, 19 nt, Human
agaagggcugaacccucag

SEQ ID NO: 1224699 - RNA, 20 nt, Human
aggcagacucccauaaaccc

SEQ ID NO: 1224700 - RNA, 24 nt, Human
aggcagugggaggcaaauggggga

SEQ ID NO: 1224701 - RNA, 21 nt, Human
agggacccaagagaacuggcc

SEQ ID NO: 1224702 - RNA, 19 nt, Human
agggagguggaaggacccu

SEQ ID NO: 1224703 - RNA, 19 nt, Human
auuccauucccuucggcca

SEQ ID NO: 1224704 - RNA, 25 nt, Human
caaaauacuccaaagaugacuuccc

SEQ ID NO: 1224705 - RNA, 20 nt, Human
cacccggggguacccagagg

SEQ ID NO: 1224706 - RNA, 19 nt, Human
cagccuaggaggguaggca

SEQ ID NO: 1224707 - RNA, 20 nt, Human
cagcucagccccagggaccc

SEQ ID NO: 1224708 - RNA, 19 nt, Human
cauggcccuguaguuaggc

SEQ ID NO: 1224709 - RNA, 18 nt, Human
ccaaaauacuccaaagau

SEQ ID NO: 1224710 - RNA, 21 nt, Human
ccaaagaugacuuccccugcu

SEQ ID NO: 1224711 - RNA, 20 nt, Human
ccaaaugcucucucuucuua

SEQ ID NO: 1224712 - RNA, 22 nt, Human
ccaaaugcucucucuucuuauu

SEQ ID NO: 1224713 - RNA, 24 nt, Human
ccacacccaagauggucccaggca

SEQ ID NO: 1224714 - RNA, 23 nt, Human
cccaaaugcucucucuucuuauu

SEQ ID NO: 1224715 - RNA, 22 nt, Human
cccacccggggguacccagagg

SEQ ID NO: 1224716 - RNA, 25 nt, Human
cccauaaacccagagggacccaagg

SEQ ID NO: 1224717 - RNA, 22 nt, Human
ccccagggacccugggccgcuc

SEQ ID NO: 1224718 - RNA, 26 nt, Human
ccccagggacccugggccgcuccucc

SEQ ID NO: 1224719 - RNA, 24 nt, Human
ccccuaagcuucuagaggcucaug

SEQ ID NO: 1224720 - RNA, 25 nt, Human
cccgagcccugguccggcucccagg

SEQ ID NO: 1224721 - RNA, 21 nt, Human
cccucagcccacacccaagau

SEQ ID NO: 1224722 - RNA, 22 nt, Human
cccuccguccagcagcugggag

SEQ ID NO: 1224723 - RNA, 18 nt, Human
cccuccuucccaaucuuc

SEQ ID NO: 1224724 - RNA, 18 nt, Human
ccugcaacugcugcugug

SEQ ID NO: 1224725 - RNA, 23 nt, Human
cucagccccagggacccugggcc

SEQ ID NO: 1224726 - RNA, 28 nt, Human
cucccucagcccacacccaagauggucc

SEQ ID NO: 1224727 - RNA, 22 nt, Human
cucgaagcccuccguccagcag

SEQ ID NO: 1224728 - RNA, 22 nt, Human
cucucuugaaccccaaaugcuc

SEQ ID NO: 1224729 - RNA, 22 nt, Human
cugcugcugugauuccugggag

SEQ ID NO: 1224730 - RNA, 20 nt, Human
cuucccaaucuucuuuuuca

SEQ ID NO: 1224731 - RNA, 23 nt, Human
gaagcccuccguccagcagcugg

SEQ ID NO: 1224732 - RNA, 23 nt, Human
gacacuggggucuguuucuggaa

SEQ ID NO: 1224733 - RNA, 23 nt, Human
gacagguggaaaaacugagacag

SEQ ID NO: 1224734 - RNA, 18 nt, Human
gacccugugcccuccuuc

SEQ ID NO: 1224735 - RNA, 21 nt, Human
gagcccugguccggcucccag

SEQ ID NO: 1224736 - RNA, 19 nt, Human
gaugguaugugagcuagga

SEQ ID NO: 1224737 - RNA, 20 nt, Human
gcagaaagggggucgcugga

SEQ ID NO: 1224738 - RNA, 21 nt, Human
gcaguuucagagauggacaga

SEQ ID NO: 1224739 - RNA, 18 nt, Human
gccugcaacugcugcugu

SEQ ID NO: 1224740 - RNA, 18 nt, Human
gccugggaagggccugcu

SEQ ID NO: 1224741 - RNA, 22 nt, Human
gcucagccccagggacccuggg

SEQ ID NO: 1224742 - RNA, 22 nt, Human
gcuucuagaggcucauggcccu

SEQ ID NO: 1224743 - RNA, 20 nt, Human
gcuugccccucccucagccc

SEQ ID NO: 1224744 - RNA, 20 nt, Human
ggcagaaagggggucgcugg

SEQ ID NO: 1224745 - RNA, 20 nt, Human
ggcagguguaguccacucuc

SEQ ID NO: 1224746 - RNA, 21 nt, Human
ggcagguguaguccacucucc

SEQ ID NO: 1224747 - RNA, 19 nt, Human
ggcagugggaggcaaaugg

SEQ ID NO: 1224748 - RNA, 19 nt, Human
ggccaaacagacaggugga

SEQ ID NO: 1224749 - RNA, 19 nt, Human
ggcucauucugcaccuugc

SEQ ID NO: 1224750 - RNA, 21 nt, Human
gggcagguguaguccacucuc

SEQ ID NO: 1224751 - RNA, 25 nt, Human
guaguccacucuccucccaaaguuc

SEQ ID NO: 1224752 - RNA, 22 nt, Human
guccuuuugcuugccccucccu

SEQ ID NO: 1224753 - RNA, 27 nt, Human
gugccugacucuuccaaguccuuuugc

SEQ ID NO: 1224754 - RNA, 28 nt, Human
uaaacccagagggacccaagagaacugg

SEQ ID NO: 1224755 - RNA, 24 nt, Human
uaagaaaaaccaaaauacuccaaa

SEQ ID NO: 1224756 - RNA, 20 nt, Human
uagaugguggcacauuccuu

SEQ ID NO: 1224757 - RNA, 21 nt, Human
uaggaggguaggcagacuccc

SEQ ID NO: 1224758 - RNA, 20 nt, Human
uauuccauucccuucggcca

SEQ ID NO: 1224759 - RNA, 23 nt, Human
ucaccgacuccggacgccgggac

SEQ ID NO: 1224760 - RNA, 18 nt, Human
ucaggcccggccuauugc

SEQ ID NO: 1224761 - RNA, 19 nt, Human
uccccugccuccuacucca

SEQ ID NO: 1224762 - RNA, 21 nt, Human
ucccgagcccugguccggcuc

SEQ ID NO: 1224763 - RNA, 18 nt, Human
ucccuucggccaaacaga

SEQ ID NO: 1224764 - RNA, 19 nt, Human
ucugugggcagcucagccc

SEQ ID NO: 1224765 - RNA, 19 nt, Human
ucuugaaccccaaaugcuc

SEQ ID NO: 1224766 - RNA, 22 nt, Human
ugaaugggccacgucccgagcc

SEQ ID NO: 1224767 - RNA, 20 nt, Human
ugacugguuaccuccuccuc

SEQ ID NO: 1224768 - RNA, 19 nt, Human
ugagcuaggagaagggcug

SEQ ID NO: 1224769 - RNA, 22 nt, Human
ugcagaaugacggccacaccca

SEQ ID NO: 1224770 - RNA, 18 nt, Human
ugcccuccuucccaaucu

SEQ ID NO: 1224771 - RNA, 20 nt, Human
ugggaggcaaaugggauggu

SEQ ID NO: 1224772 - RNA, 23 nt, Human
ugggaugguaugugagcuaggag

SEQ ID NO: 1224773 - RNA, 18 nt, Human
ugguuggauccgggccug

SEQ ID NO: 1224774 - RNA, 18 nt, Human
ugucuagagccucuuggg

SEQ ID NO: 1224775 - RNA, 19 nt, Human
uuccccugccuccuacucc

SEQ ID NO: 1224776 - RNA, 23 nt, Human
uugcuugccccucccucagccca

SEQ ID NO: 1224777 - RNA, 22 nt, Human
uuucaggcucgccaaggccuag

SEQ ID NO: 1224778 - RNA, 25 nt, Human
uuucuuauuccccccuaagcuucua

SEQ ID NO: 1224779 - RNA, 19 nt, Human
uuuugcuugccccucccuc

SEQ ID NO: 1224780 - RNA, 23 nt, Human
uuuuucaggcucgccaaggccua

SEQ ID NO: 1224781 - RNA, 25 nt, Human
aaguguccccccauucccggguccc

SEQ ID NO: 1224782 - RNA, 26 nt, Human
aguguccccccauucccgggucccgg

SEQ ID NO: 1224783 - RNA, 21 nt, Human
ccuccucucucucagucucca

SEQ ID NO: 1224784 - RNA, 24 nt, Human
gucacagccacccaguuccuuuac

SEQ ID NO: 1224785 - RNA, 20 nt, Human
gucccggugcagaugaugcu

SEQ ID NO: 1224786 - RNA, 20 nt, Human
uaaggucuucuuuuccuggc

SEQ ID NO: 1224787 - RNA, 19 nt, Human
ucaguccauucaaaaggcu

SEQ ID NO: 1224788 - RNA, 20 nt, Human
ucaguccauucaaaaggcuc

SEQ ID NO: 1224789 - RNA, 21 nt, Human
uccaaguauucuacuggaucu

SEQ ID NO: 1224790 - RNA, 22 nt, Human
uccuccauuuaguggagguaag

SEQ ID NO: 1224791 - RNA, 20 nt, Human
ucuccaaguguccccccauu

SEQ ID NO: 1224792 - RNA, 19 nt, Human
ugacuguccuccauuuagu

SEQ ID NO: 1224793 - RNA, 19 nt, Human
uggcuuacaaauguauccc

SEQ ID NO: 1224794 - RNA, 23 nt, Human
uuaguggagguaaggucuucuuu

SEQ ID NO: 1224795 - RNA, 22 nt, Human
aaguaaccucuuucugcuucag

SEQ ID NO: 1224796 - RNA, 21 nt, Human
accuugagcccauuaaguaac

SEQ ID NO: 1224797 - RNA, 20 nt, Human
cgugcagccgcuccgcccgg

SEQ ID NO: 1224798 - RNA, 19 nt, Human
cucuuguccgugcagccgc

SEQ ID NO: 1224799 - RNA, 22 nt, Human
cuuccaggccuccgcucuuguc

SEQ ID NO: 1224800 - RNA, 22 nt, Human
uucugcuucaguuuccccuucc

SEQ ID NO: 1224801 - RNA, 19 nt, Human
aaagaggucgagggaaaca

SEQ ID NO: 1224802 - RNA, 24 nt, Human
acacaccaaugcuugccuuaacaa

SEQ ID NO: 1224803 - RNA, 20 nt, Human
acacuaggucuccaaguagc

SEQ ID NO: 1224804 - RNA, 19 nt, Human
acagaaauccccagcacuu

SEQ ID NO: 1224805 - RNA, 22 nt, Human
acagccagugaguguuggaagc

SEQ ID NO: 1224806 - RNA, 20 nt, Human
agaacccucaucacaaccuu

SEQ ID NO: 1224807 - RNA, 26 nt, Human
agacugccaucccuccccagccccag

SEQ ID NO: 1224808 - RNA, 28 nt, Human
agagaagccaucuagaagggcauucaag

SEQ ID NO: 1224809 - RNA, 29 nt, Human
agagcacaaccaggaggauggagccaguc

SEQ ID NO: 1224810 - RNA, 25 nt, Human
agaguccauucucuuccuccucugg

SEQ ID NO: 1224811 - RNA, 24 nt, Human
agaugucaaagagaaaaccaaauc

SEQ ID NO: 1224812 - RNA, 19 nt, Human
agccuggacccccaccccu

SEQ ID NO: 1224813 - RNA, 21 nt, Human
aggagccuggcccaagguggc

SEQ ID NO: 1224814 - RNA, 21 nt, Human
agggaaacaugcagggagacu

SEQ ID NO: 1224815 - RNA, 18 nt, Human
agggagcagggggugcag

SEQ ID NO: 1224816 - RNA, 19 nt, Human
caacccaggagcccagcaa

SEQ ID NO: 1224817 - RNA, 20 nt, Human
cacccccaccccauaccaag

SEQ ID NO: 1224818 - RNA, 20 nt, Human
cacccccaccccauaccaag

SEQ ID NO: 1224819 - RNA, 21 nt, Human
caccuacucgucuuucaaagc

SEQ ID NO: 1224820 - RNA, 19 nt, Human
cacuccguggaccuggagg

SEQ ID NO: 1224821 - RNA, 21 nt, Human
cagagagggaguccaacccag

SEQ ID NO: 1224822 - RNA, 18 nt, Human
cagaggcagcugugaggu

SEQ ID NO: 1224823 - RNA, 18 nt, Human
cagcagggaccacguauc

SEQ ID NO: 1224824 - RNA, 22 nt, Human
cagccagggccagcccaaggga

SEQ ID NO: 1224825 - RNA, 21 nt, Human
cagcccaagggagcagggggu

SEQ ID NO: 1224826 - RNA, 21 nt, Human
cagcccgggcugcugcgacag

SEQ ID NO: 1224827 - RNA, 18 nt, Human
cagccuggacccccaccc

SEQ ID NO: 1224828 - RNA, 21 nt, Human
cagccuggacccccaccccuc

SEQ ID NO: 1224829 - RNA, 26 nt, Human
cagccuggacccccaccccucccacu

SEQ ID NO: 1224830 - RNA, 20 nt, Human
cagggcccagauuugagggc

SEQ ID NO: 1224831 - RNA, 22 nt, Human
cagugggcuaccauuauuaagc

SEQ ID NO: 1224832 - RNA, 24 nt, Human
cagugggcuaccauuauuaagcac

SEQ ID NO: 1224833 - RNA, 22 nt, Human
cauucaagacucagcaagcucc

SEQ ID NO: 1224834 - RNA, 20 nt, Human
ccacccccacacccagagga

SEQ ID NO: 1224835 - RNA, 22 nt, Human
ccagccuggacccccaccccuc

SEQ ID NO: 1224836 - RNA, 20 nt, Human
ccaucuagaagggcauucaa

SEQ ID NO: 1224837 - RNA, 18 nt, Human
cccaagguggcgcugccc

SEQ ID NO: 1224838 - RNA, 19 nt, Human
cccaccccucccacuuccu

SEQ ID NO: 1224839 - RNA, 21 nt, Human
cccaggagcccagcaaggcgc

SEQ ID NO: 1224840 - RNA, 21 nt, Human
ccccaccccauaccaaggcug

SEQ ID NO: 1224841 - RNA, 23 nt, Human
ccccaccccauaccaaggcugcu

SEQ ID NO: 1224842 - RNA, 24 nt, Human
ccccaccccauaccaaggcugcug

SEQ ID NO: 1224843 - RNA, 19 nt, Human
cccccaccccucccacuuc

SEQ ID NO: 1224844 - RNA, 19 nt, Human
cccccguuccuccuuauuu

SEQ ID NO: 1224845 - RNA, 25 nt, Human
ccccuggagcccucuccuccacccc

SEQ ID NO: 1224846 - RNA, 20 nt, Human
cccuccagccuggaccccca

SEQ ID NO: 1224847 - RNA, 21 nt, Human
ccucagggcuguagucccucu

SEQ ID NO: 1224848 - RNA, 22 nt, Human
ccuccacccccaccacccgagg

SEQ ID NO: 1224849 - RNA, 20 nt, Human
ccuccagccuggacccccac

SEQ ID NO: 1224850 - RNA, 22 nt, Human
ccuccagccuggacccccaccc

SEQ ID NO: 1224851 - RNA, 18 nt, Human
ccugauuguggguuccug

SEQ ID NO: 1224852 - RNA, 23 nt, Human
ccuggagcccucuccuccacccc

SEQ ID NO: 1224853 - RNA, 20 nt, Human
cgccccagacaaggagccuu

SEQ ID NO: 1224854 - RNA, 18 nt, Human
cgcugccccucuuggacc

SEQ ID NO: 1224855 - RNA, 19 nt, Human
cuaaagaggucgagggaaa

SEQ ID NO: 1224856 - RNA, 19 nt, Human
cuagguaacuaaguuuggc

SEQ ID NO: 1224857 - RNA, 24 nt, Human
cuccagccuggacccccaccccuc

SEQ ID NO: 1224858 - RNA, 18 nt, Human
cuccaugccacugucucc

SEQ ID NO: 1224859 - RNA, 21 nt, Human
cucccacuuccuggcuuccca

SEQ ID NO: 1224860 - RNA, 21 nt, Human
cuccccagccccagcugcccc

SEQ ID NO: 1224861 - RNA, 21 nt, Human
cuccuccacccccacacccag

SEQ ID NO: 1224862 - RNA, 25 nt, Human
cucuacaccuacauugggccccucc

SEQ ID NO: 1224863 - RNA, 22 nt, Human
cuggagcaggggcacagagagg

SEQ ID NO: 1224864 - RNA, 19 nt, Human
cuggggccgggcgaaaaga

SEQ ID NO: 1224865 - RNA, 24 nt, Human
cuugaccccacccugacccagggc

SEQ ID NO: 1224866 - RNA, 21 nt, Human
cuuugcugacuuggcaugugc

SEQ ID NO: 1224867 - RNA, 23 nt, Human
gaagggcauucaagacucagcaa

SEQ ID NO: 1224868 - RNA, 18 nt, Human
gacacauggggacaaggg

SEQ ID NO: 1224869 - RNA, 21 nt, Human
gacccccaccccucccacuuc

SEQ ID NO: 1224870 - RNA, 23 nt, Human
gacugccaucccuccccagcccc

SEQ ID NO: 1224871 - RNA, 19 nt, Human
gagcccagcaaggcgcugc

SEQ ID NO: 1224872 - RNA, 20 nt, Human
gagcccucuccuccaccccc

SEQ ID NO: 1224873 - RNA, 24 nt, Human
gaggagccuggcccaagguggcgc

SEQ ID NO: 1224874 - RNA, 25 nt, Human
gaguguuggaagcuggauucaaacc

SEQ ID NO: 1224875 - RNA, 24 nt, Human
gcagaagccuccucaacacccucc

SEQ ID NO: 1224876 - RNA, 24 nt, Human
gcagcccgggcugcugcgacagug

SEQ ID NO: 1224877 - RNA, 20 nt, Human
gcagggcuccccuugggacc

SEQ ID NO: 1224878 - RNA, 19 nt, Human
gcccucuccuccaccccca

SEQ ID NO: 1224879 - RNA, 23 nt, Human
gcccucuccuccacccccacacc

SEQ ID NO: 1224880 - RNA, 25 nt, Human
gcccugggagccucugucuuccucu

SEQ ID NO: 1224881 - RNA, 21 nt, Human
gccuggagcaggggcacagag

SEQ ID NO: 1224882 - RNA, 21 nt, Human
gcuguagucccucuacaccua

SEQ ID NO: 1224883 - RNA, 21 nt, Human
gcuguagucccucuacaccuu

SEQ ID NO: 1224884 - RNA, 18 nt, Human
ggaaacaugcagggagac

SEQ ID NO: 1224885 - RNA, 19 nt, Human
ggcccaagguggcgcugcc

SEQ ID NO: 1224886 - RNA, 29 nt, Human
ggcccagcuggugggcgaggcuggggcca

SEQ ID NO: 1224887 - RNA, 22 nt, Human
gggccccuccagccuggacccc

SEQ ID NO: 1224888 - RNA, 20 nt, Human
gggcucucucugagcccacc

SEQ ID NO: 1224889 - RNA, 22 nt, Human
gggcuggggccgggcgaaaaga

SEQ ID NO: 1224890 - RNA, 18 nt, Human
gggugggggagggcccag

SEQ ID NO: 1224891 - RNA, 22 nt, Human
gguuccugucugucucucaggc

SEQ ID NO: 1224892 - RNA, 21 nt, Human
gucaaggcuggcugggucccc

SEQ ID NO: 1224893 - RNA, 19 nt, Human
gugaagggcaggcuuauuc

SEQ ID NO: 1224894 - RNA, 19 nt, Human
gugcuuucuccucugcccg

SEQ ID NO: 1224895 - RNA, 24 nt, Human
uacauugggccccuccagccugga

SEQ ID NO: 1224896 - RNA, 24 nt, Human
uagaaauaccgucacuggagccac

SEQ ID NO: 1224897 - RNA, 19 nt, Human
ucaaagcuccaugccacug

SEQ ID NO: 1224898 - RNA, 19 nt, Human
ucaaccagaggggcugggg

SEQ ID NO: 1224899 - RNA, 21 nt, Human
ucaaccagaggggcuggggcc

SEQ ID NO: 1224900 - RNA, 20 nt, Human
ucaggggucuucccaccccc

SEQ ID NO: 1224901 - RNA, 22 nt, Human
ucaggggucuucccacccccac

SEQ ID NO: 1224902 - RNA, 20 nt, Human
uccacccccacacccagagg

SEQ ID NO: 1224903 - RNA, 22 nt, Human
uccacccccacacccagaggac

SEQ ID NO: 1224904 - RNA, 19 nt, Human
uccagacuggacacuaggu

SEQ ID NO: 1224905 - RNA, 24 nt, Human
ucccacuuccuggcuucccauccu

SEQ ID NO: 1224906 - RNA, 19 nt, Human
uccccagccccagcugccc

SEQ ID NO: 1224907 - RNA, 19 nt, Human
ucccugcuuggucucuauc

SEQ ID NO: 1224908 - RNA, 22 nt, Human
uccuuauuuccuugcuaacacc

SEQ ID NO: 1224909 - RNA, 21 nt, Human
uccuucaggucucgcagaagc

SEQ ID NO: 1224910 - RNA, 21 nt, Human
ucuacaccuacauugggcccc

SEQ ID NO: 1224911 - RNA, 20 nt, Human
ucuccuccacccccacaccc

SEQ ID NO: 1224912 - RNA, 20 nt, Human
ucucugagcccaccugacuu

SEQ ID NO: 1224913 - RNA, 21 nt, Human
ucuuggaccuccaagaaugcc

SEQ ID NO: 1224914 - RNA, 24 nt, Human
ugaagaugucaaagagaaaaccaa

SEQ ID NO: 1224915 - RNA, 25 nt, Human
ugagcccaccugacuuuccuccagg

SEQ ID NO: 1224916 - RNA, 19 nt, Human
ugauuguggguuccugucu

SEQ ID NO: 1224917 - RNA, 21 nt, Human
ugccagaggcagcugugaggu

SEQ ID NO: 1224918 - RNA, 24 nt, Human
ugccagaggcagcugugagguggg

SEQ ID NO: 1224919 - RNA, 21 nt, Human
ugccgcauggagcagccccuc

SEQ ID NO: 1224920 - RNA, 22 nt, Human
ugccuggagcaggggcacagag

SEQ ID NO: 1224921 - RNA, 22 nt, Human
ugccuggagcaggggcacagag

SEQ ID NO: 1224922 - RNA, 19 nt, Human
uggacccccaccccuccca

SEQ ID NO: 1224923 - RNA, 21 nt, Human
uggagccaaugggugccugga

SEQ ID NO: 1224924 - RNA, 19 nt, Human
uggagcccucuccuccacc

SEQ ID NO: 1224925 - RNA, 21 nt, Human
ugggacccucucuugccagga

SEQ ID NO: 1224926 - RNA, 27 nt, Human
ugggcaaggagcccuuagggggugaag

SEQ ID NO: 1224927 - RNA, 19 nt, Human
uggguuccugucugucucu

SEQ ID NO: 1224928 - RNA, 19 nt, Human
uguagucccucuacaccua

SEQ ID NO: 1224929 - RNA, 25 nt, Human
ugucaaagagaaaaccaaaucggau

SEQ ID NO: 1224930 - RNA, 18 nt, Human
uuccuccagggucaaggc

SEQ ID NO: 1224931 - RNA, 23 nt, Human
uugaccccacccugacccagggc

SEQ ID NO: 1224932 - RNA, 19 nt, Human
uuggcaugugcuuucuccu

SEQ ID NO: 1224933 - RNA, 21 nt, Human
uuugcugacuuggcaugugcu

SEQ ID NO: 1224934 - RNA, 23 nt, Human
aaaaaaaagcgucuggcaaauga

SEQ ID NO: 1224935 - RNA, 21 nt, Human
aaaaaauucuccccucaucca

SEQ ID NO: 1224936 - RNA, 26 nt, Human
aaaagaaaugcaaauuagcuacgauc

SEQ ID NO: 1224937 - RNA, 19 nt, Human
aaacaaaacaaacaccccc

SEQ ID NO: 1224938 - RNA, 22 nt, Human
aaacaaaacaaacacccccacc

SEQ ID NO: 1224939 - RNA, 18 nt, Human
aaacaaacacccccaccc

SEQ ID NO: 1224940 - RNA, 25 nt, Human
aaacaaacacccccacccaauccca

SEQ ID NO: 1224941 - RNA, 22 nt, Human
aaacaaccauguuuucuggaac

SEQ ID NO: 1224942 - RNA, 21 nt, Human
aaacacccccacccaauccca

SEQ ID NO: 1224943 - RNA, 23 nt, Human
aaacacccccacccaaucccaaa

SEQ ID NO: 1224944 - RNA, 24 nt, Human
aaacuuuaacccuaguuagaaaca

SEQ ID NO: 1224945 - RNA, 22 nt, Human
aacaaaacaaacacccccaccc

SEQ ID NO: 1224946 - RNA, 27 nt, Human
aacaaacacccccacccaaucccaaac

SEQ ID NO: 1224947 - RNA, 20 nt, Human
acaaacccaagaacucacaa

SEQ ID NO: 1224948 - RNA, 18 nt, Human
acacagccuuuguaccuc

SEQ ID NO: 1224949 - RNA, 24 nt, Human
agagagaaaaugaauaauaaaaaa

SEQ ID NO: 1224950 - RNA, 24 nt, Human
auucuccccucauccaaaacaaaa

SEQ ID NO: 1224951 - RNA, 19 nt, Human
caaaacaaaacaaacaccc

SEQ ID NO: 1224952 - RNA, 22 nt, Human
caaaacaaaacaaacaccccca

SEQ ID NO: 1224953 - RNA, 25 nt, Human
caaaacaaaacaaacacccccaccc

SEQ ID NO: 1224954 - RNA, 22 nt, Human
caaacaaacccaagaacucaca

SEQ ID NO: 1224955 - RNA, 20 nt, Human
caaaugaacacacagccuuu

SEQ ID NO: 1224956 - RNA, 28 nt, Human
cacccaaucccaaacaaacccaagaacu

SEQ ID NO: 1224957 - RNA, 21 nt, Human
cacccccacccaaucccaaac

SEQ ID NO: 1224958 - RNA, 19 nt, Human
cagaaaaguuuagguuggg

SEQ ID NO: 1224959 - RNA, 18 nt, Human
cagccuuuguaccuccug

SEQ ID NO: 1224960 - RNA, 23 nt, Human
cauccaaaacaaaacaaacaccc

SEQ ID NO: 1224961 - RNA, 19 nt, Human
ccaaaacaaaacaaacacc

SEQ ID NO: 1224962 - RNA, 23 nt, Human
ccaaaacaaaacaaacaccccca

SEQ ID NO: 1224963 - RNA, 24 nt, Human
ccaaacaaacccaagaacucacau

SEQ ID NO: 1224964 - RNA, 23 nt, Human
ccaaucccaaacaaacccaagaa

SEQ ID NO: 1224965 - RNA, 22 nt, Human
ccacccaaucccaaacaaaccc

SEQ ID NO: 1224966 - RNA, 24 nt, Human
ccacccaaucccaaacaaacccaa

SEQ ID NO: 1224967 - RNA, 22 nt, Human
ccagcuccugauggaauccaca

SEQ ID NO: 1224968 - RNA, 18 nt, Human
ccccacccaaucccaaac

SEQ ID NO: 1224969 - RNA, 22 nt, Human
cccccacccaaucccaaacaaa

SEQ ID NO: 1224970 - RNA, 20 nt, Human
ccuaugacugggagaaggga

SEQ ID NO: 1224971 - RNA, 18 nt, Human
ccuccugcaggaaauaau

SEQ ID NO: 1224972 - RNA, 24 nt, Human
cucauccaaaacaaaacaaacacc

SEQ ID NO: 1224973 - RNA, 18 nt, Human
cuggcgcucuuuuaucag

SEQ ID NO: 1224974 - RNA, 23 nt, Human
gaaaaagaucuaauuauuguaaa

SEQ ID NO: 1224975 - RNA, 20 nt, Human
gaaaugcaaauuagcuacga

SEQ ID NO: 1224976 - RNA, 19 nt, Human
gagccucugggcucuuccu

SEQ ID NO: 1224977 - RNA, 21 nt, Human
gagugucauuuuucauuaaaa

SEQ ID NO: 1224978 - RNA, 19 nt, Human
gcaaaugaacacacagccu

SEQ ID NO: 1224979 - RNA, 21 nt, Human
gcaccgccagaagauucacac

SEQ ID NO: 1224980 - RNA, 24 nt, Human
gcgcucuuuuaucagguccucaug

SEQ ID NO: 1224981 - RNA, 18 nt, Human
ggaaaacccaauuaacuu

SEQ ID NO: 1224982 - RNA, 21 nt, Human
ggaaaacccaauuaacuugga

SEQ ID NO: 1224983 - RNA, 18 nt, Human
ggagaacaaaccuugcag

SEQ ID NO: 1224984 - RNA, 27 nt, Human
guaaaagaaaauauccugacaaaauau

SEQ ID NO: 1224985 - RNA, 22 nt, Human
uaaaaaaggcaauuccccccuc

SEQ ID NO: 1224986 - RNA, 21 nt, Human
uaaaauucuaaggcaucuuac

SEQ ID NO: 1224987 - RNA, 21 nt, Human
uaaggcaucuuaccuucaaac

SEQ ID NO: 1224988 - RNA, 21 nt, Human
uaauaaaaaaauaacucuggc

SEQ ID NO: 1224989 - RNA, 23 nt, Human
uacaauagucaucaaguagguac

SEQ ID NO: 1224990 - RNA, 20 nt, Human
uaccuccugcaggaaauaau

SEQ ID NO: 1224991 - RNA, 28 nt, Human
uaccuucaaacuuuuuuuuuaauaauuc

SEQ ID NO: 1224992 - RNA, 24 nt, Human
uacuuuagaaauuaaaugcaucau

SEQ ID NO: 1224993 - RNA, 25 nt, Human
uagauacuuaaaauuuccagaaucu

SEQ ID NO: 1224994 - RNA, 22 nt, Human
uauauacauacaucucuaugug

SEQ ID NO: 1224995 - RNA, 19 nt, Human
uaucucaaaucauucccug

SEQ ID NO: 1224996 - RNA, 27 nt, Human
ucaaaaccagcuccugauggaauccac

SEQ ID NO: 1224997 - RNA, 18 nt, Human
ucauccaaaacaaaacaa

SEQ ID NO: 1224998 - RNA, 25 nt, Human
uccaaaacaaaacaaacacccccac

SEQ ID NO: 1224999 - RNA, 24 nt, Human
uccaacaaugaauucauauagaaa

SEQ ID NO: 1225000 - RNA, 22 nt, Human
uccaagcacagcaccgccagaa

SEQ ID NO: 1225001 - RNA, 21 nt, Human
ucccugcuaagucucuucacc

SEQ ID NO: 1225002 - RNA, 22 nt, Human
uccugaaucucauauugaacaa

SEQ ID NO: 1225003 - RNA, 18 nt, Human
uccuuuuuaaagcauauc

SEQ ID NO: 1225004 - RNA, 24 nt, Human
ucuggaaccuauuuaaaaaaaaag

SEQ ID NO: 1225005 - RNA, 20 nt, Human
ugacaaaauaucagucuguc

SEQ ID NO: 1225006 - RNA, 21 nt, Human
ugagaacuccaacgacugaga

SEQ ID NO: 1225007 - RNA, 25 nt, Human
ugagacagagccucugggcucuucc

SEQ ID NO: 1225008 - RNA, 26 nt, Human
ugauauuuucaccuuuaucccucuua

SEQ ID NO: 1225009 - RNA, 20 nt, Human
ugcucacguagaagcaacag

SEQ ID NO: 1225010 - RNA, 19 nt, Human
uggaaaaagaucuaauuau

SEQ ID NO: 1225011 - RNA, 23 nt, Human
uggaaccuauuuaaaaaaaaagc

SEQ ID NO: 1225012 - RNA, 18 nt, Human
ugggcugcugguacaauc

SEQ ID NO: 1225013 - RNA, 21 nt, Human
uguuucauguugguuuuccuu

SEQ ID NO: 1225014 - RNA, 19 nt, Human
uugcaggugggcugcuggu

SEQ ID NO: 1225015 - RNA, 21 nt, Human
uuuuuugguugagaacuccaa

SEQ ID NO: 1225016 - RNA, 18 nt, Human
aaggcacuacgacuagaa

SEQ ID NO: 1225017 - RNA, 25 nt, Human
acccugaaggcacuacgacuagaag

SEQ ID NO: 1225018 - RNA, 21 nt, Human
acucaguaaggcacgaagucc

SEQ ID NO: 1225019 - RNA, 22 nt, Human
acuguggugggaguuccccgcu

SEQ ID NO: 1225020 - RNA, 22 nt, Human
agccgagaggcaccagguggca

SEQ ID NO: 1225021 - RNA, 21 nt, Human
agccugaggacaagggagccc

SEQ ID NO: 1225022 - RNA, 24 nt, Human
aggcagcuccaccgugugggugug

SEQ ID NO: 1225023 - RNA, 22 nt, Human
aggggugggggcucagccuggc

SEQ ID NO: 1225024 - RNA, 18 nt, Human
caccagguggcaggaggc

SEQ ID NO: 1225025 - RNA, 18 nt, Human
caccagguggcaggaggc

SEQ ID NO: 1225026 - RNA, 20 nt, Human
caccagguggcaggaggcac

SEQ ID NO: 1225027 - RNA, 27 nt, Human
cagccuggcugauugguguggggaggg

SEQ ID NO: 1225028 - RNA, 22 nt, Human
caggggugggggcucagccugg

SEQ ID NO: 1225029 - RNA, 21 nt, Human
cccguggagccugaggacaag

SEQ ID NO: 1225030 - RNA, 19 nt, Human
ccguguggguguggcgggg

SEQ ID NO: 1225031 - RNA, 26 nt, Human
ccuggagcuggggcaggggugggggc

SEQ ID NO: 1225032 - RNA, 19 nt, Human
ccuggcugauugguguggg

SEQ ID NO: 1225033 - RNA, 19 nt, Human
cgggcgcccggcgccgggc

SEQ ID NO: 1225034 - RNA, 21 nt, Human
cguggagccugaggacaaggg

SEQ ID NO: 1225035 - RNA, 22 nt, Human
cucccggcuucgggcgcccggc

SEQ ID NO: 1225036 - RNA, 19 nt, Human
cucccguggagccugagga

SEQ ID NO: 1225037 - RNA, 18 nt, Human
cuggggcagggguggggg

SEQ ID NO: 1225038 - RNA, 23 nt, Human
cuggggcaggggugggggcucag

SEQ ID NO: 1225039 - RNA, 21 nt, Human
gagccugaggacaagggagcc

SEQ ID NO: 1225040 - RNA, 22 nt, Human
gcggcggcucccggcuucgggc

SEQ ID NO: 1225041 - RNA, 22 nt, Human
gcuuguuuauuagaaaaagucu

SEQ ID NO: 1225042 - RNA, 24 nt, Human
gcuuguuuauuagaaaaagucuua

SEQ ID NO: 1225043 - RNA, 24 nt, Human
ggaagugggcaggguccccugggg

SEQ ID NO: 1225044 - RNA, 23 nt, Human
ggagcccuuucauccgagaugcu

SEQ ID NO: 1225045 - RNA, 19 nt, Human
ggagcuggggcaggggugg

SEQ ID NO: 1225046 - RNA, 20 nt, Human
ggaggaggggaaggaagagg

SEQ ID NO: 1225047 - RNA, 23 nt, Human
ggcaacagggaggaggggaagga

SEQ ID NO: 1225048 - RNA, 24 nt, Human
ggcaccagguggcaggaggcacca

SEQ ID NO: 1225049 - RNA, 21 nt, Human
gggauggggcucugcaggagc

SEQ ID NO: 1225050 - RNA, 21 nt, Human
gggcaggggugggggcucagc

SEQ ID NO: 1225051 - RNA, 21 nt, Human
gggcagguccuggagcugggg

SEQ ID NO: 1225052 - RNA, 21 nt, Human
gggcucagccuggcugauugg

SEQ ID NO: 1225053 - RNA, 18 nt, Human
ggggagggggcagguugg

SEQ ID NO: 1225054 - RNA, 19 nt, Human
ggggagggggcagguuggc

SEQ ID NO: 1225055 - RNA, 23 nt, Human
ggggugggggcucagccuggcug

SEQ ID NO: 1225056 - RNA, 18 nt, Human
gguccuggagcuggggca

SEQ ID NO: 1225057 - RNA, 18 nt, Human
gguguggggagggggcag

SEQ ID NO: 1225058 - RNA, 26 nt, Human
guccuggagcuggggcaggggugggg

SEQ ID NO: 1225059 - RNA, 21 nt, Human
uccuggagcuggggcaggggu

SEQ ID NO: 1225060 - RNA, 23 nt, Human
uccuggagcuggggcaggggugg

SEQ ID NO: 1225061 - RNA, 19 nt, Human
ugaccaggaacaccagggc

SEQ ID NO: 1225062 - RNA, 21 nt, Human
ugaggacaagggagcccuuuc

SEQ ID NO: 1225063 - RNA, 25 nt, Human
ugaggacaagggagcccuuucaucc

SEQ ID NO: 1225064 - RNA, 21 nt, Human
uggagccugaggacaagggag

SEQ ID NO: 1225065 - RNA, 23 nt, Human
uggcggggggauggggcucugca

SEQ ID NO: 1225066 - RNA, 24 nt, Human
uggcggggggauggggcucugcag

SEQ ID NO: 1225067 - RNA, 18 nt, Human
uggcugauuggugugggg

SEQ ID NO: 1225068 - RNA, 21 nt, Human
uguggggagggggcagguugg

SEQ ID NO: 1225069 - RNA, 22 nt, Human
uguggggagggggcagguuggc

SEQ ID NO: 1225070 - RNA, 25 nt, Human
uucagugccggaugccccacugugg

SEQ ID NO: 1225071 - RNA, 21 nt, Human
uuccccgcucucuccagcagc

SEQ ID NO: 1225072 - RNA, 18 nt, Human
aaaaaaaaaaaaaaagaa

SEQ ID NO: 1225073 - RNA, 19 nt, Human
aaaaaaaaaaaaaagaaaa

SEQ ID NO: 1225074 - RNA, 23 nt, Human
aaaaaaaaaagaaaaagaaaaaa

SEQ ID NO: 1225075 - RNA, 24 nt, Human
aaaaaagaaaaagaaauaaagaag

SEQ ID NO: 1225076 - RNA, 26 nt, Human
aaaaagaaaaagaaauaaagaaaaaa

SEQ ID NO: 1225077 - RNA, 24 nt, Human
aaaaagaaauaaagaaaaaaacac

SEQ ID NO: 1225078 - RNA, 23 nt, Human
aaaagaaaaaaaaaaaaaaagaa

SEQ ID NO: 1225079 - RNA, 24 nt, Human
aagaaaaaaacaccuucagaaaua

SEQ ID NO: 1225080 - RNA, 21 nt, Human
aagaaaaacagcaagaagcaa

SEQ ID NO: 1225081 - RNA, 23 nt, Human
aagaaaaacagcaagaagcaaag

SEQ ID NO: 1225082 - RNA, 24 nt, Human
aagaaaaagaaauaaagaaaaaaa

SEQ ID NO: 1225083 - RNA, 23 nt, Human
aagaaaaagguagggaaccucau

SEQ ID NO: 1225084 - RNA, 18 nt, Human
aagacucuucagcucaca

SEQ ID NO: 1225085 - RNA, 18 nt, Human
aagccacugacuucaucu

SEQ ID NO: 1225086 - RNA, 20 nt, Human
aagcccacuguacacuuaca

SEQ ID NO: 1225087 - RNA, 24 nt, Human
aagcccuuuccuuucuuuggaguc

SEQ ID NO: 1225088 - RNA, 25 nt, Human
aaggaaagcaguuacagggacagaa

SEQ ID NO: 1225089 - RNA, 21 nt, Human
aaggagacaaaaaagcugcca

SEQ ID NO: 1225090 - RNA, 18 nt, Human
aauggugugccauucauu

SEQ ID NO: 1225091 - RNA, 22 nt, Human
acaaacacuggcuaauacccug

SEQ ID NO: 1225092 - RNA, 18 nt, Human
acacugggauccagcagc

SEQ ID NO: 1225093 - RNA, 24 nt, Human
acagaaggcagcucccuuccccca

SEQ ID NO: 1225094 - RNA, 20 nt, Human
acagaugacagccccucuca

SEQ ID NO: 1225095 - RNA, 25 nt, Human
acaggcauuaagagguagcugaagu

SEQ ID NO: 1225096 - RNA, 21 nt, Human
acaguacauaguaguuaugua

SEQ ID NO: 1225097 - RNA, 21 nt, Human
acagugcugaugggaacuggu

SEQ ID NO: 1225098 - RNA, 20 nt, Human
accaagcaagcccugcucac

SEQ ID NO: 1225099 - RNA, 21 nt, Human
accacacugggauccagcagc

SEQ ID NO: 1225100 - RNA, 25 nt, Human
acccccauccccaaugcaagcccac

SEQ ID NO: 1225101 - RNA, 20 nt, Human
accuccccugcaucuggccc

SEQ ID NO: 1225102 - RNA, 24 nt, Human
accucugccucuucccugcaccuc

SEQ ID NO: 1225103 - RNA, 23 nt, Human
acucauggauaggcaccuccccu

SEQ ID NO: 1225104 - RNA, 21 nt, Human
acugacuucaucuguacacac

SEQ ID NO: 1225105 - RNA, 24 nt, Human
agaaaaaaaaaaaaaaagaaaaag

SEQ ID NO: 1225106 - RNA, 21 nt, Human
agaaaaacagcaagaagcaaa

SEQ ID NO: 1225107 - RNA, 26 nt, Human
agaaaaagaaauaaagaaaaaaacac

SEQ ID NO: 1225108 - RNA, 26 nt, Human
agaaaccaacacagaucuugguccua

SEQ ID NO: 1225109 - RNA, 19 nt, Human
agaacaggacacagaaaca

SEQ ID NO: 1225110 - RNA, 19 nt, Human
agaagcccuuuccuuucuu

SEQ ID NO: 1225111 - RNA, 18 nt, Human
agaaggagaaauggugug

SEQ ID NO: 1225112 - RNA, 18 nt, Human
agagaagaaaaagguagg

SEQ ID NO: 1225113 - RNA, 18 nt, Human
agagaagaaaaagguagg

SEQ ID NO: 1225114 - RNA, 22 nt, Human
agagcagcuaggagggccugag

SEQ ID NO: 1225115 - RNA, 23 nt, Human
agaggcagcuggacaugggaccc

SEQ ID NO: 1225116 - RNA, 19 nt, Human
agcagaagcagagcagcug

SEQ ID NO: 1225117 - RNA, 18 nt, Human
agccuccagagcagcuag

SEQ ID NO: 1225118 - RNA, 22 nt, Human
agcgcccugccagggcucugcc

SEQ ID NO: 1225119 - RNA, 23 nt, Human
aggaagaaguagaauccccaagg

SEQ ID NO: 1225120 - RNA, 20 nt, Human
aggacacagaaacaacuguc

SEQ ID NO: 1225121 - RNA, 22 nt, Human
aggacaggcagggaggugccag

SEQ ID NO: 1225122 - RNA, 19 nt, Human
aggagaaggagaaauggug

SEQ ID NO: 1225123 - RNA, 19 nt, Human
aggagcaggugccuggcug

SEQ ID NO: 1225124 - RNA, 24 nt, Human
aggcagcucccuucccccaggaag

SEQ ID NO: 1225125 - RNA, 27 nt, Human
aggcagcucccuucccccaggaagggc

SEQ ID NO: 1225126 - RNA, 22 nt, Human
aggccuugcaaaaugcccuaug

SEQ ID NO: 1225127 - RNA, 20 nt, Human
agguccucaauacaaacacu

SEQ ID NO: 1225128 - RNA, 21 nt, Human
agugcagcuucaaacaagucu

SEQ ID NO: 1225129 - RNA, 23 nt, Human
aguggccgggcugggccauaagg

SEQ ID NO: 1225130 - RNA, 24 nt, Human
auaaagaaaaaaacaccuucagaa

SEQ ID NO: 1225131 - RNA, 24 nt, Human
aucagaagcccuuuccuuucuuuu

SEQ ID NO: 1225132 - RNA, 19 nt, Human
auggagacagugcugaugg

SEQ ID NO: 1225133 - RNA, 21 nt, Human
auggagacagugcugauggga

SEQ ID NO: 1225134 - RNA, 18 nt, Human
auuggccugguccuggca

SEQ ID NO: 1225135 - RNA, 23 nt, Human
caaaaaaaaaagaaaaagaaaaa

SEQ ID NO: 1225136 - RNA, 19 nt, Human
caaaaacauucuccagguc

SEQ ID NO: 1225137 - RNA, 21 nt, Human
caaaauccaaaauugcaagug

SEQ ID NO: 1225138 - RNA, 24 nt, Human
caaaauugcaagugccagaugcca

SEQ ID NO: 1225139 - RNA, 22 nt, Human
caaaggagacaaaaaagcugcc

SEQ ID NO: 1225140 - RNA, 31 nt, Human
caaauaaaaaaaaaaagugcugcugacaccu

SEQ ID NO: 1225141 - RNA, 21 nt, Human
caaccugaucucaccaaacag

SEQ ID NO: 1225142 - RNA, 21 nt, Human
caagaagcaaagcccuaacca

SEQ ID NO: 1225143 - RNA, 24 nt, Human
caagacaaaugcagucaagaccug

SEQ ID NO: 1225144 - RNA, 24 nt, Human
caagcaagcccugcucacaagaca

SEQ ID NO: 1225145 - RNA, 22 nt, Human
caagcccugcucacaagacaaa

SEQ ID NO: 1225146 - RNA, 21 nt, Human
caaggcccugaaaacaauuua

SEQ ID NO: 1225147 - RNA, 19 nt, Human
caaggggcuccugaccagc

SEQ ID NO: 1225148 - RNA, 23 nt, Human
cacacugggauccagcagcucca

SEQ ID NO: 1225149 - RNA, 19 nt, Human
cacagaaacaacugucugc

SEQ ID NO: 1225150 - RNA, 21 nt, Human
cacaggaagaaguagaauccc

SEQ ID NO: 1225151 - RNA, 19 nt, Human
caccacacugggauccagc

SEQ ID NO: 1225152 - RNA, 24 nt, Human
caccaggcagcuccacuggccucc

SEQ ID NO: 1225153 - RNA, 19 nt, Human
caccuccccugcaucuggc

SEQ ID NO: 1225154 - RNA, 18 nt, Human
cacuaccaaagggcaggg

SEQ ID NO: 1225155 - RNA, 24 nt, Human
cagaaaacugcuuggcacaaacac

SEQ ID NO: 1225156 - RNA, 19 nt, Human
cagaaggcagcucccuucc

SEQ ID NO: 1225157 - RNA, 22 nt, Human
cagaaggcagcucccuuccccc

SEQ ID NO: 1225158 - RNA, 23 nt, Human
cagcaagaagcaaagcccuaacc

SEQ ID NO: 1225159 - RNA, 21 nt, Human
cagcagaacauucagcauaua

SEQ ID NO: 1225160 - RNA, 22 nt, Human
cagcaggccuuggcccuccccc

SEQ ID NO: 1225161 - RNA, 22 nt, Human
cagcaugggagccuuuuauggg

SEQ ID NO: 1225162 - RNA, 23 nt, Human
cagcuggacaaggcccugaaaac

SEQ ID NO: 1225163 - RNA, 20 nt, Human
caggaaauccccagcucuga

SEQ ID NO: 1225164 - RNA, 19 nt, Human
caggacacagaaacaacug

SEQ ID NO: 1225165 - RNA, 23 nt, Human
caggucccuuguuccaggcagga

SEQ ID NO: 1225166 - RNA, 20 nt, Human
caucaucccacgcaaaaaca

SEQ ID NO: 1225167 - RNA, 18 nt, Human
cauggauaggcaccuccc

SEQ ID NO: 1225168 - RNA, 19 nt, Human
ccaagcaagcccugcucac

SEQ ID NO: 1225169 - RNA, 21 nt, Human
ccagaaaacugcuuggcacaa

SEQ ID NO: 1225170 - RNA, 20 nt, Human
cccacaaaauccaaaauugc

SEQ ID NO: 1225171 - RNA, 22 nt, Human
cccacacaggaagaaguagaau

SEQ ID NO: 1225172 - RNA, 24 nt, Human
cccacagguaagcuuguggcaaag

SEQ ID NO: 1225173 - RNA, 26 nt, Human
cccaggcaccacugcuacagcauccc

SEQ ID NO: 1225174 - RNA, 21 nt, Human
cccugcaccucucucgccuag

SEQ ID NO: 1225175 - RNA, 23 nt, Human
ccgauaaccucauggaaaacaaa

SEQ ID NO: 1225176 - RNA, 21 nt, Human
ccuggcuguugugaauaccca

SEQ ID NO: 1225177 - RNA, 20 nt, Human
ccuggggcaggagaaggaga

SEQ ID NO: 1225178 - RNA, 21 nt, Human
cgcucccuucccagcaugacc

SEQ ID NO: 1225179 - RNA, 18 nt, Human
cuacagcaucccucuucc

SEQ ID NO: 1225180 - RNA, 22 nt, Human
cucacacagcugcuugagggca

SEQ ID NO: 1225181 - RNA, 19 nt, Human
cuccgggucagcccucagg

SEQ ID NO: 1225182 - RNA, 19 nt, Human
cuccuacaccaccacacug

SEQ ID NO: 1225183 - RNA, 25 nt, Human
cuccuacaccaccacacugggaucc

SEQ ID NO: 1225184 - RNA, 20 nt, Human
cugagccucaaaucagacag

SEQ ID NO: 1225185 - RNA, 20 nt, Human
cuguacacacccccaucccc

SEQ ID NO: 1225186 - RNA, 21 nt, Human
cuguacacacccccaucccca

SEQ ID NO: 1225187 - RNA, 25 nt, Human
cuugagcuucaccugcugugguccc

SEQ ID NO: 1225188 - RNA, 19 nt, Human
cuugaggauugcacaugug

SEQ ID NO: 1225189 - RNA, 21 nt, Human
gaaauaacagucuccuacaga

SEQ ID NO: 1225190 - RNA, 25 nt, Human
gaccaagcaagcccugcucacaaga

SEQ ID NO: 1225191 - RNA, 22 nt, Human
gagcucugaagggcagggaggg

SEQ ID NO: 1225192 - RNA, 23 nt, Human
gcaaagcccuaaccauccuaucc

SEQ ID NO: 1225193 - RNA, 22 nt, Human
gcacaugugggggugggggcag

SEQ ID NO: 1225194 - RNA, 21 nt, Human
gcaggacaaugaacuagcuuc

SEQ ID NO: 1225195 - RNA, 20 nt, Human
gccucuucccugcaccucuc

SEQ ID NO: 1225196 - RNA, 21 nt, Human
gcuacagcaucccucuuccuu

SEQ ID NO: 1225197 - RNA, 19 nt, Human
gcugacaccucucagaauc

SEQ ID NO: 1225198 - RNA, 19 nt, Human
ggcaggaagcagaaaaagg

SEQ ID NO: 1225199 - RNA, 19 nt, Human
gguauggaagaugaaggga

SEQ ID NO: 1225200 - RNA, 23 nt, Human
ggucuagagaaucaaaggagccu

SEQ ID NO: 1225201 - RNA, 18 nt, Human
ggugggggcaggaagcag

SEQ ID NO: 1225202 - RNA, 28 nt, Human
gucaugugcaaaaaaaaaagaaaaagaa

SEQ ID NO: 1225203 - RNA, 21 nt, Human
gucugaguggccgggcugggc

SEQ ID NO: 1225204 - RNA, 22 nt, Human
gugaaggaggugggacacugga

SEQ ID NO: 1225205 - RNA, 23 nt, Human
gugaauacccaaaggagacaaaa

SEQ ID NO: 1225206 - RNA, 22 nt, Human
guuccaggcaggaaauccccag

SEQ ID NO: 1225207 - RNA, 21 nt, Human
uaaaaaaaaaaagugcugcug

SEQ ID NO: 1225208 - RNA, 21 nt, Human
uaaauaaccaucuuuacagaa

SEQ ID NO: 1225209 - RNA, 20 nt, Human
uaaccauccuauccaucuug

SEQ ID NO: 1225210 - RNA, 24 nt, Human
uacaucaaaaucaagucccuggcu

SEQ ID NO: 1225211 - RNA, 26 nt, Human
uagaacaggacacagaaacaacuguc

SEQ ID NO: 1225212 - RNA, 18 nt, Human
uagaauccccaaggacag

SEQ ID NO: 1225213 - RNA, 20 nt, Human
uagaauccccaaggacaggc

SEQ ID NO: 1225214 - RNA, 22 nt, Human
uagcaaucuaagaaaccaacac

SEQ ID NO: 1225215 - RNA, 18 nt, Human
uagcagagccaugcgcuc

SEQ ID NO: 1225216 - RNA, 22 nt, Human
uagcuucaaagaaaaacagcaa

SEQ ID NO: 1225217 - RNA, 22 nt, Human
uaggagggccugagcugaccaa

SEQ ID NO: 1225218 - RNA, 21 nt, Human
uauggaagaugaagggaccug

SEQ ID NO: 1225219 - RNA, 22 nt, Human
uauguacguaaaacugacccac

SEQ ID NO: 1225220 - RNA, 23 nt, Human
ucaaagaaaaacagcaagaagca

SEQ ID NO: 1225221 - RNA, 23 nt, Human
ucaucuguacacacccccauccc

SEQ ID NO: 1225222 - RNA, 21 nt, Human
uccagacagagggauucaaag

SEQ ID NO: 1225223 - RNA, 25 nt, Human
uccccaaggacaggcagggaggugc

SEQ ID NO: 1225224 - RNA, 22 nt, Human
uccccaaugcaagcccacugua

SEQ ID NO: 1225225 - RNA, 18 nt, Human
ucccugcaccucucucgc

SEQ ID NO: 1225226 - RNA, 26 nt, Human
ucccugcaccucucucgccuagcaaa

SEQ ID NO: 1225227 - RNA, 19 nt, Human
ucccuggggugaccaccuc

SEQ ID NO: 1225228 - RNA, 22 nt, Human
uccuuggaagguccucaauaca

SEQ ID NO: 1225229 - RNA, 23 nt, Human
ucgccuagcaaacacucugugag

SEQ ID NO: 1225230 - RNA, 24 nt, Human
ucucaacacucacacagcugcuug

SEQ ID NO: 1225231 - RNA, 22 nt, Human
ucugccucuucccugcaccucu

SEQ ID NO: 1225232 - RNA, 24 nt, Human
ucugccucuucccugcaccucucc

SEQ ID NO: 1225233 - RNA, 21 nt, Human
ugaaggaggugggacacugga

SEQ ID NO: 1225234 - RNA, 19 nt, Human
ugaccaagcaagcccugcu

SEQ ID NO: 1225235 - RNA, 21 nt, Human
ugaccagcacaucaucccacg

SEQ ID NO: 1225236 - RNA, 19 nt, Human
ugagaagcaucauuggccu

SEQ ID NO: 1225237 - RNA, 25 nt, Human
ugagcgcccugccagggcucugccu

SEQ ID NO: 1225238 - RNA, 26 nt, Human
ugcaaggcggaaaggcuggggcagca

SEQ ID NO: 1225239 - RNA, 24 nt, Human
ugcauggagacagugcugauggga

SEQ ID NO: 1225240 - RNA, 22 nt, Human
ugccagggcucugccuagggac

SEQ ID NO: 1225241 - RNA, 19 nt, Human
ugccuggcugucccugggg

SEQ ID NO: 1225242 - RNA, 23 nt, Human
ugcugaugggaacuggugguggc

SEQ ID NO: 1225243 - RNA, 19 nt, Human
uggaguggggguagaacag

SEQ ID NO: 1225244 - RNA, 19 nt, Human
uggcaaagccaucagaagc

SEQ ID NO: 1225245 - RNA, 19 nt, Human
uggcaaaggagccaagugg

SEQ ID NO: 1225246 - RNA, 21 nt, Human
uggcaaaggagccaagugggg

SEQ ID NO: 1225247 - RNA, 18 nt, Human
uggcacaggggcuggggu

SEQ ID NO: 1225248 - RNA, 20 nt, Human
uggcagagaucucaacacuc

SEQ ID NO: 1225249 - RNA, 21 nt, Human
uggccgggcugggccauaagg

SEQ ID NO: 1225250 - RNA, 19 nt, Human
uggccuccgggucagcccu

SEQ ID NO: 1225251 - RNA, 19 nt, Human
uggccugaaggucuagaca

SEQ ID NO: 1225252 - RNA, 22 nt, Human
ugggauccagcagcuccagucc

SEQ ID NO: 1225253 - RNA, 24 nt, Human
ugggauccagcagcuccagucccu

SEQ ID NO: 1225254 - RNA, 22 nt, Human
ugggcugccgcucccuucccag

SEQ ID NO: 1225255 - RNA, 23 nt, Human
uggggcccacauuccugaccugg

SEQ ID NO: 1225256 - RNA, 22 nt, Human
ugggguggugaaggagguggga

SEQ ID NO: 1225257 - RNA, 22 nt, Human
ugguccgauaaccucauggaaa

SEQ ID NO: 1225258 - RNA, 21 nt, Human
ugugcaaaaaaaaaagaaaaa

SEQ ID NO: 1225259 - RNA, 19 nt, Human
uguggccuccuacaccacc

SEQ ID NO: 1225260 - RNA, 19 nt, Human
uguggccuccuacaccacc

SEQ ID NO: 1225261 - RNA, 18 nt, Human
uucaaaggggaagaaaaa

SEQ ID NO: 1225262 - RNA, 20 nt, Human
uucccagcaugacccaacac

SEQ ID NO: 1225263 - RNA, 18 nt, Human
uucuggggcccagucaau

SEQ ID NO: 1225264 - RNA, 22 nt, Human
uuuggucaaugaagagaagaaa

SEQ ID NO: 1225265 - RNA, 21 nt, Human
aaacguggaggccaccuugcu

SEQ ID NO: 1225266 - RNA, 20 nt, Human
aacguggaggccaccuugcu

SEQ ID NO: 1225267 - RNA, 20 nt, Human
aggcaaaagcgaagaagacg

SEQ ID NO: 1225268 - RNA, 23 nt, Human
aggcaaaagcgaagaagacgcuc

SEQ ID NO: 1225269 - RNA, 23 nt, Human
aggcaaaagcgaagaagagggac

SEQ ID NO: 1225270 - RNA, 19 nt, Human
guggaggccaccuugcuuc

SEQ ID NO: 1225271 - RNA, 18 nt, Human
ucgaggcaaaagcgaaga

SEQ ID NO: 1225272 - RNA, 21 nt, Human
ucgaggcaaaagcgaagaaga

SEQ ID NO: 1225273 - RNA, 25 nt, Human
ucuguggucaaggggcggucgaggc

SEQ ID NO: 1225274 - RNA, 18 nt, Human
uggcggaugacacaggcg

SEQ ID NO: 1225275 - RNA, 19 nt, Human
aaaauccacccgagugcac

SEQ ID NO: 1225276 - RNA, 18 nt, Human
aaaggcugcucaggcagg

SEQ ID NO: 1225277 - RNA, 18 nt, Human
aaaguccuucagcuucuc

SEQ ID NO: 1225278 - RNA, 18 nt, Human
aaauggagggacugccca

SEQ ID NO: 1225279 - RNA, 21 nt, Human
aaccaggaaggagccauagcc

SEQ ID NO: 1225280 - RNA, 23 nt, Human
aaccaggaaggagccauagccca

SEQ ID NO: 1225281 - RNA, 28 nt, Human
aagagcagcaaggagcugaccgguaccc

SEQ ID NO: 1225282 - RNA, 19 nt, Human
aagccucuuaagaacacag

SEQ ID NO: 1225283 - RNA, 22 nt, Human
aagcugacacccgcuguccuga

SEQ ID NO: 1225284 - RNA, 21 nt, Human
aagcuggucuccacacagugc

SEQ ID NO: 1225285 - RNA, 19 nt, Human
aaggagacgcgcugcugcu

SEQ ID NO: 1225286 - RNA, 21 nt, Human
aaggagacgcgcugcugcugc

SEQ ID NO: 1225287 - RNA, 20 nt, Human
aaggagccauagcccaggcc

SEQ ID NO: 1225288 - RNA, 18 nt, Human
aaggugcuggcccagggc

SEQ ID NO: 1225289 - RNA, 22 nt, Human
acaaacccacagaaaauccacc

SEQ ID NO: 1225290 - RNA, 23 nt, Human
acacagcagugaagcugaaauga

SEQ ID NO: 1225291 - RNA, 19 nt, Human
acacaugcacacauggcua

SEQ ID NO: 1225292 - RNA, 21 nt, Human
acccacagaaaauccacccga

SEQ ID NO: 1225293 - RNA, 24 nt, Human
acccccaugacacuccccagcccu

SEQ ID NO: 1225294 - RNA, 18 nt, Human
acccccucccaaggaagu

SEQ ID NO: 1225295 - RNA, 23 nt, Human
acccgagugcacugagcacgcca

SEQ ID NO: 1225296 - RNA, 20 nt, Human
acccugguucccccagcccc

SEQ ID NO: 1225297 - RNA, 21 nt, Human
acccugguucccccagccccc

SEQ ID NO: 1225298 - RNA, 21 nt, Human
accuugauggccuucuugcug

SEQ ID NO: 1225299 - RNA, 24 nt, Human
acucccugcuuccucucuagcccc

SEQ ID NO: 1225300 - RNA, 20 nt, Human
acugcaacgggaaagccacg

SEQ ID NO: 1225301 - RNA, 20 nt, Human
acugcaagcuccagggcccg

SEQ ID NO: 1225302 - RNA, 20 nt, Human
acuggagaacaccuguggac

SEQ ID NO: 1225303 - RNA, 19 nt, Human
agaaguccagagcucuaca

SEQ ID NO: 1225304 - RNA, 22 nt, Human
agaauuacaaggugcuggccca

SEQ ID NO: 1225305 - RNA, 22 nt, Human
agacagaaguccccgccccagc

SEQ ID NO: 1225306 - RNA, 20 nt, Human
agaggcacggggaaauggag

SEQ ID NO: 1225307 - RNA, 19 nt, Human
agcaaggagcugacagagc

SEQ ID NO: 1225308 - RNA, 21 nt, Human
agcacaggcagacagaagucc

SEQ ID NO: 1225309 - RNA, 18 nt, Human
agcagaccugcagggccc

SEQ ID NO: 1225310 - RNA, 20 nt, Human
agcagcgcuggguacaagcu

SEQ ID NO: 1225311 - RNA, 18 nt, Human
agcagcuuguccuggcug

SEQ ID NO: 1225312 - RNA, 18 nt, Human
agccaccucccagccacc

SEQ ID NO: 1225313 - RNA, 22 nt, Human
agccgggagguggggaacaggg

SEQ ID NO: 1225314 - RNA, 23 nt, Human
agcgugcacuguggggucccagg

SEQ ID NO: 1225315 - RNA, 19 nt, Human
agcuggaccccugagcuag

SEQ ID NO: 1225316 - RNA, 25 nt, Human
agcuguguggccucaagccagccuu

SEQ ID NO: 1225317 - RNA, 21 nt, Human
aggaagaaaaaggcaggacag

SEQ ID NO: 1225318 - RNA, 23 nt, Human
aggaagaaaaaggcaggacagaa

SEQ ID NO: 1225319 - RNA, 26 nt, Human
aggaaggagccauagcccaggcagga

SEQ ID NO: 1225320 - RNA, 18 nt, Human
aggaauggggaacccaga

SEQ ID NO: 1225321 - RNA, 20 nt, Human
aggacacagggguaugggga

SEQ ID NO: 1225322 - RNA, 18 nt, Human
aggagaggguggaguugg

SEQ ID NO: 1225323 - RNA, 21 nt, Human
aggagccaccucccagccacc

SEQ ID NO: 1225324 - RNA, 24 nt, Human
aggagcuggggguggugguggggg

SEQ ID NO: 1225325 - RNA, 18 nt, Human
aggcaaaagcagcgcugg

SEQ ID NO: 1225326 - RNA, 22 nt, Human
aggcaagggcucugaagucagg

SEQ ID NO: 1225327 - RNA, 22 nt, Human
aggcaggagggcugaggaccuc

SEQ ID NO: 1225328 - RNA, 19 nt, Human
agggcugaggaccucuggu

SEQ ID NO: 1225329 - RNA, 22 nt, Human
aucagcugccaucccaucccag

SEQ ID NO: 1225330 - RNA, 18 nt, Human
augacacuccccagcccu

SEQ ID NO: 1225331 - RNA, 21 nt, Human
auggagcacaggcagacagaa

SEQ ID NO: 1225332 - RNA, 20 nt, Human
caagcacuucacaaccccuc

SEQ ID NO: 1225333 - RNA, 24 nt, Human
caauggccugcaccuggcuccggc

SEQ ID NO: 1225334 - RNA, 20 nt, Human
cacaccccucggcccugccc

SEQ ID NO: 1225335 - RNA, 23 nt, Human
cacagcagugaagcugaaaugaa

SEQ ID NO: 1225336 - RNA, 24 nt, Human
cacagcagugaagcugaaaugaaa

SEQ ID NO: 1225337 - RNA, 19 nt, Human
cacaugcacacauggcuac

SEQ ID NO: 1225338 - RNA, 21 nt, Human
caccccucggcccugcccucu

SEQ ID NO: 1225339 - RNA, 19 nt, Human
cacccugcagagcuggacc

SEQ ID NO: 1225340 - RNA, 23 nt, Human
caccuccccucaaacgaggagcc

SEQ ID NO: 1225341 - RNA, 25 nt, Human
cacuccccagcccuccaaggccacu

SEQ ID NO: 1225342 - RNA, 20 nt, Human
cacugagcacgccagaaauc

SEQ ID NO: 1225343 - RNA, 18 nt, Human
cacuguacaauggggaaa

SEQ ID NO: 1225344 - RNA, 24 nt, Human
cacuuaacaaacccacagaaaauc

SEQ ID NO: 1225345 - RNA, 20 nt, Human
cagagaugccuggagggaaa

SEQ ID NO: 1225346 - RNA, 24 nt, Human
cagagcaacggcccaagucugggu

SEQ ID NO: 1225347 - RNA, 22 nt, Human
cagagcugccaggccaggcccu

SEQ ID NO: 1225348 - RNA, 18 nt, Human
cagccucagaggcacggg

SEQ ID NO: 1225349 - RNA, 19 nt, Human
cagccuccucugggggaca

SEQ ID NO: 1225350 - RNA, 19 nt, Human
cagcggcuguuugaggagc

SEQ ID NO: 1225351 - RNA, 20 nt, Human
cagggcuggaggggaggagg

SEQ ID NO: 1225352 - RNA, 21 nt, Human
caggggccagcuggcaagagc

SEQ ID NO: 1225353 - RNA, 20 nt, Human
cagggucgaggaguugacgg

SEQ ID NO: 1225354 - RNA, 19 nt, Human
caucccagucagccuccuc

SEQ ID NO: 1225355 - RNA, 21 nt, Human
caugacacuccccagcccucc

SEQ ID NO: 1225356 - RNA, 22 nt, Human
caugugcccuaggggaagcagg

SEQ ID NO: 1225357 - RNA, 21 nt, Human
ccagagccucacuuguucagg

SEQ ID NO: 1225358 - RNA, 22 nt, Human
ccagcuuucgcuccuucaugcu

SEQ ID NO: 1225359 - RNA, 19 nt, Human
ccaggauggccaagggaug

SEQ ID NO: 1225360 - RNA, 23 nt, Human
ccaggccgggccucccgcccaca

SEQ ID NO: 1225361 - RNA, 22 nt, Human
ccagggcccgcucaccuugcuc

SEQ ID NO: 1225362 - RNA, 21 nt, Human
ccagucguccucguccuccuc

SEQ ID NO: 1225363 - RNA, 21 nt, Human
cccacagaaaauccacccgag

SEQ ID NO: 1225364 - RNA, 22 nt, Human
cccacccccaugacacucccca

SEQ ID NO: 1225365 - RNA, 19 nt, Human
cccagagccucacuuguuc

SEQ ID NO: 1225366 - RNA, 21 nt, Human
cccagagccucacuuguucag

SEQ ID NO: 1225367 - RNA, 19 nt, Human
cccauggagcacaggcaga

SEQ ID NO: 1225368 - RNA, 20 nt, Human
ccccaagaggcucagagggc

SEQ ID NO: 1225369 - RNA, 25 nt, Human
ccccacccccaugacacuccccagc

SEQ ID NO: 1225370 - RNA, 19 nt, Human
ccccacccugcagagcugg

SEQ ID NO: 1225371 - RNA, 18 nt, Human
ccccaugacacuccccag

SEQ ID NO: 1225372 - RNA, 19 nt, Human
cccccaagucccucuucug

SEQ ID NO: 1225373 - RNA, 22 nt, Human
cccccaugacacuccccagccc

SEQ ID NO: 1225374 - RNA, 21 nt, Human
cccccuacgauucccagucgu

SEQ ID NO: 1225375 - RNA, 21 nt, Human
ccccucggcccugcccucugg

SEQ ID NO: 1225376 - RNA, 20 nt, Human
ccccugagcuagccaugcuc

SEQ ID NO: 1225377 - RNA, 30 nt, Human; identical to SEQ ID NO: 504575

SEQ ID NO: 1225378 - RNA, 24 nt, Human
cccgcccacaccccucggcccugc

SEQ ID NO: 1225379 - RNA, 19 nt, Human
cccucggcccugcccucug

SEQ ID NO: 1225380 - RNA, 20 nt, Human
cccuggacuggagccgggag

SEQ ID NO: 1225381 - RNA, 19 nt, Human
ccucccgcccacaccccuc

SEQ ID NO: 1225382 - RNA, 24 nt, Human
ccugcaccuggcuccggcucugcu

SEQ ID NO: 1225383 - RNA, 18 nt, Human
ccugcaggcgcccuggag

SEQ ID NO: 1225384 - RNA, 25 nt, Human
ccuggagggaaaaggcugagugagg

SEQ ID NO: 1225385 - RNA, 20 nt, Human
ccuucugcugcugcuucucc

SEQ ID NO: 1225386 - RNA, 23 nt, Human
cgcagcuuggccuugccgaugcc

SEQ ID NO: 1225387 - RNA, 19 nt, Human
cgcgguugagggugggagu

SEQ ID NO: 1225388 - RNA, 25 nt, Human
cuacaggggccgcgguuggccaggg

SEQ ID NO: 1225389 - RNA, 21 nt, Human
cuacaguuugaaaaccacuau

SEQ ID NO: 1225390 - RNA, 21 nt, Human
cucaaaaccauagugcccagg

SEQ ID NO: 1225391 - RNA, 21 nt, Human
cucagaggcacggggaaaugg

SEQ ID NO: 1225392 - RNA, 18 nt, Human
cuccacuauggcucccaa

SEQ ID NO: 1225393 - RNA, 19 nt, Human
cuccacuauggcucccaaa

SEQ ID NO: 1225394 - RNA, 20 nt, Human
cucggcccugcccucuggcc

SEQ ID NO: 1225395 - RNA, 23 nt, Human
cucucaguagggacaggcccuau

SEQ ID NO: 1225396 - RNA, 23 nt, Human
cucucccacaucaucaggggcac

SEQ ID NO: 1225397 - RNA, 18 nt, Human
cugagcccauguuccucu

SEQ ID NO: 1225398 - RNA, 18 nt, Human
cugcaaccaccugagcgc

SEQ ID NO: 1225399 - RNA, 20 nt, Human
cugcuccuucugcugcugcu

SEQ ID NO: 1225400 - RNA, 20 nt, Human
cugcucuaccugcugggaga

SEQ ID NO: 1225401 - RNA, 18 nt, Human
cuggauccuguggcgggg

SEQ ID NO: 1225402 - RNA, 21 nt, Human
cuguaccugugucugaugccc

SEQ ID NO: 1225403 - RNA, 22 nt, Human
cuguaccugugucugaugcccu

SEQ ID NO: 1225404 - RNA, 24 nt, Human
cuuccucucuagcccccacccugc

SEQ ID NO: 1225405 - RNA, 19 nt, Human
cuugcuccugcuccuucug

SEQ ID NO: 1225406 - RNA, 20 nt, Human
cuuggcacuggagaacaccu

SEQ ID NO: 1225407 - RNA, 24 nt, Human
cuuggccuugccgaugcccccagc

SEQ ID NO: 1225408 - RNA, 24 nt, Human
gaaacccugguucccccagccccc

SEQ ID NO: 1225409 - RNA, 20 nt, Human
gaagacauacuucuucuacc

SEQ ID NO: 1225410 - RNA, 22 nt, Human
gaauggggaacccagagccuca

SEQ ID NO: 1225411 - RNA, 24 nt, Human
gagaacaccuguggacacagggac

SEQ ID NO: 1225412 - RNA, 24 nt, Human
gagcagcaaggagcugacagagcu

SEQ ID NO: 1225413 - RNA, 21 nt, Human
gagccacccgucacccccugg

SEQ ID NO: 1225414 - RNA, 19 nt, Human
gagccugcugggagggaag

SEQ ID NO: 1225415 - RNA, 18 nt, Human
gagcugggggugguggug

SEQ ID NO: 1225416 - RNA, 18 nt, Human
gagggugguuggugggaa

SEQ ID NO: 1225417 - RNA, 21 nt, Human
gcaagagcagggggugggcag

SEQ ID NO: 1225418 - RNA, 24 nt, Human
gcagcgcuggguacaagcucaaaa

SEQ ID NO: 1225419 - RNA, 19 nt, Human
gcaggggccagcuggcaag

SEQ ID NO: 1225420 - RNA, 21 nt, Human
gccaaggagaccuucucucca

SEQ ID NO: 1225421 - RNA, 20 nt, Human
gcccaagucugggucugggg

SEQ ID NO: 1225422 - RNA, 23 nt, Human
gcccacaccccucggcccugccc

SEQ ID NO: 1225423 - RNA, 21 nt, Human
gcccaguagccucaggacaca

SEQ ID NO: 1225424 - RNA, 21 nt, Human
gccugggcgagaagaaagcuc

SEQ ID NO: 1225425 - RNA, 18 nt, Human
gcgcgggcauccugugug

SEQ ID NO: 1225426 - RNA, 20 nt, Human
gcucaggcagggcuggggaa

SEQ ID NO: 1225427 - RNA, 20 nt, Human
gcuguguggccucaagccag

SEQ ID NO: 1225428 - RNA, 25 nt, Human
ggaaacccugguucccccagccccc

SEQ ID NO: 1225429 - RNA, 21 nt, Human
ggaccucugguggcggcccag

SEQ ID NO: 1225430 - RNA, 18 nt, Human
ggacuggagccgggaggu

SEQ ID NO: 1225431 - RNA, 24 nt, Human
ggacuggagccgggagguggggaa

SEQ ID NO: 1225432 - RNA, 18 nt, Human
ggagaccuucucuccaau

SEQ ID NO: 1225433 - RNA, 19 nt, Human
ggagcugacagagcugaug

SEQ ID NO: 1225434 - RNA, 22 nt, Human
ggagcugggggugguggugggg

SEQ ID NO: 1225435 - RNA, 21 nt, Human
ggagggcugaggaccucuggu

SEQ ID NO: 1225436 - RNA, 21 nt, Human
ggaggggaggaggcgaucuug

SEQ ID NO: 1225437 - RNA, 23 nt, Human
ggauccuguggcgggggcgucuc

SEQ ID NO: 1225438 - RNA, 19 nt, Human
ggcacggggaaauggaggg

SEQ ID NO: 1225439 - RNA, 19 nt, Human
ggccugggccaaggagacc

SEQ ID NO: 1225440 - RNA, 19 nt, Human
ggcggcccagggcuuccag

SEQ ID NO: 1225441 - RNA, 25 nt, Human
ggcugaccauugccuuggaccgcuc

SEQ ID NO: 1225442 - RNA, 18 nt, Human
ggcugcugcgguggcggc

SEQ ID NO: 1225443 - RNA, 19 nt, Human
gggaaauggagggacugcc

SEQ ID NO: 1225444 - RNA, 24 nt, Human
gggcaagcacuucacaaccccuca

SEQ ID NO: 1225445 - RNA, 22 nt, Human
gggcacugaugagacagcggcu

SEQ ID NO: 1225446 - RNA, 21 nt, Human
gggcagccucagaggcacggg

SEQ ID NO: 1225447 - RNA, 21 nt, Human
gggccccaagaggcucagagg

SEQ ID NO: 1225448 - RNA, 18 nt, Human
gggccccucaccagcccc

SEQ ID NO: 1225449 - RNA, 18 nt, Human
ggggaacagggcaaggag

SEQ ID NO: 1225450 - RNA, 23 nt, Human
ggggucaaccacuucccugggag

SEQ ID NO: 1225451 - RNA, 22 nt, Human
ggguacuuggcacuggagaaca

SEQ ID NO: 1225452 - RNA, 23 nt, Human
gggugggagugggggugcacugg

SEQ ID NO: 1225453 - RNA, 19 nt, Human
gggugguggugggggcggu

SEQ ID NO: 1225454 - RNA, 22 nt, Human
ggugggggcgguggggguggug

SEQ ID NO: 1225455 - RNA, 20 nt, Human
gguggugggggcgguggggg

SEQ ID NO: 1225456 - RNA, 23 nt, Human
guaccugugucugaugcccuggg

SEQ ID NO: 1225457 - RNA, 25 nt, Human
gucaccuccccucaaacgaggagcc

SEQ ID NO: 1225458 - RNA, 23 nt, Human
guccagggggcggugcuugcucu

SEQ ID NO: 1225459 - RNA, 21 nt, Human
gugcacuguggggucccaggc

SEQ ID NO: 1225460 - RNA, 19 nt, Human
guggcgcaggcugggugga

SEQ ID NO: 1225461 - RNA, 21 nt, Human
guggcugcugcgguggcggca

SEQ ID NO: 1225462 - RNA, 18 nt, Human
guuccgucacccccuccc

SEQ ID NO: 1225463 - RNA, 19 nt, Human
guugcugggaagaccccca

SEQ ID NO: 1225464 - RNA, 18 nt, Human
uacacaugcacacauggc

SEQ ID NO: 1225465 - RNA, 20 nt, Human
uaggauugcuuggcaggaga

SEQ ID NO: 1225466 - RNA, 23 nt, Human
uaggggaagcaggggccagcugg

SEQ ID NO: 1225467 - RNA, 24 nt, Human
uauccaguccuccuggugugugac

SEQ ID NO: 1225468 - RNA, 18 nt, Human
ucacccccucccaaggaa

SEQ ID NO: 1225469 - RNA, 18 nt, Human
ucacccccucccaaggaa

SEQ ID NO: 1225470 - RNA, 18 nt, Human
ucagagcaacggcccaag

SEQ ID NO: 1225471 - RNA, 24 nt, Human
ucagagcaacggcccaagucuggg

SEQ ID NO: 1225472 - RNA, 24 nt, Human
ucagagccucagucgaucccugac

SEQ ID NO: 1225473 - RNA, 22 nt, Human
ucagaggcacggggaaauggag

SEQ ID NO: 1225474 - RNA, 23 nt, Human
ucaggagcugggggugguggugg

SEQ ID NO: 1225475 - RNA, 19 nt, Human
ucagggcuggaggggagga

SEQ ID NO: 1225476 - RNA, 18 nt, Human
ucaguagggacaggcccu

SEQ ID NO: 1225477 - RNA, 18 nt, Human
uccaaggccacuguguuu

SEQ ID NO: 1225478 - RNA, 25 nt, Human
uccaggaagacauacuucuucuacc

SEQ ID NO: 1225479 - RNA, 21 nt, Human
ucccaaaccaggaaggagcca

SEQ ID NO: 1225480 - RNA, 22 nt, Human
ucccaaaccaggaaggagccau

SEQ ID NO: 1225481 - RNA, 22 nt, Human
ucccagucguccucguccuccu

SEQ ID NO: 1225482 - RNA, 21 nt, Human
uccccacccccaugacacucc

SEQ ID NO: 1225483 - RNA, 24 nt, Human
uccccagcccuccaaggccacugu

SEQ ID NO: 1225484 - RNA, 21 nt, Human
ucccugcacucucaguaggga

SEQ ID NO: 1225485 - RNA, 21 nt, Human
ucccugcuuccucucuagccc

SEQ ID NO: 1225486 - RNA, 21 nt, Human
uccucugccuguggcugcugc

SEQ ID NO: 1225487 - RNA, 21 nt, Human
uccugcuccuucugcugcugc

SEQ ID NO: 1225488 - RNA, 26 nt, Human
ucgcuccuucaugcugcgcagcuugg

SEQ ID NO: 1225489 - RNA, 23 nt, Human
ucggcccugcccucuggccauac

SEQ ID NO: 1225490 - RNA, 19 nt, Human
ucggugguguugaagagca

SEQ ID NO: 1225491 - RNA, 19 nt, Human
ucuaccuacagaggcgaca

SEQ ID NO: 1225492 - RNA, 23 nt, Human
ucuagcccccacccugcagagcu

SEQ ID NO: 1225493 - RNA, 25 nt, Human
ucucacugcaacgggaaagccacag

SEQ ID NO: 1225494 - RNA, 21 nt, Human
ucuccaauggccugcaccugg

SEQ ID NO: 1225495 - RNA, 24 nt, Human
ucuccaauggccugcaccuggcuc

SEQ ID NO: 1225496 - RNA, 25 nt, Human
ucuccaauggccugcaccuggcucc

SEQ ID NO: 1225497 - RNA, 28 nt, Human
ucuccacacagugcugguuccgucaccc

SEQ ID NO: 1225498 - RNA, 26 nt, Human
ucucuaaaaauaucucaggaggcugc

SEQ ID NO: 1225499 - RNA, 21 nt, Human
ucugcugcugcuucuccagcu

SEQ ID NO: 1225500 - RNA, 19 nt, Human
ucugguggcggcccagggc

SEQ ID NO: 1225501 - RNA, 23 nt, Human
ucuugcccaaggcccuccgacug

SEQ ID NO: 1225502 - RNA, 23 nt, Human
ugaaauggaaacuauucaaaaaa

SEQ ID NO: 1225503 - RNA, 20 nt, Human
ugaagagauccgacaucaag

SEQ ID NO: 1225504 - RNA, 21 nt, Human
ugaagagcagcaaggagcuga

SEQ ID NO: 1225505 - RNA, 21 nt, Human
ugacacgcgggcaaaggcucc

SEQ ID NO: 1225506 - RNA, 18 nt, Human
ugacacuccccagcccuc

SEQ ID NO: 1225507 - RNA, 22 nt, Human
ugacacuccccagcccuccaag

SEQ ID NO: 1225508 - RNA, 21 nt, Human
ugacccagcaccgggcacuga

SEQ ID NO: 1225509 - RNA, 21 nt, Human
ugacucccuguccccaccccc

SEQ ID NO: 1225510 - RNA, 19 nt, Human
ugagcuuagagaggaaagc

SEQ ID NO: 1225511 - RNA, 18 nt, Human
ugagggugguugguggga

SEQ ID NO: 1225512 - RNA, 23 nt, Human
ugaugagacagcggcuguuugag

SEQ ID NO: 1225513 - RNA, 23 nt, Human
ugcaccuggcuccggcucugcuc

SEQ ID NO: 1225514 - RNA, 20 nt, Human
ugcacuguggggucccaggc

SEQ ID NO: 1225515 - RNA, 19 nt, Human
ugcagauacucccugcuuc

SEQ ID NO: 1225516 - RNA, 18 nt, Human
ugcaggcgcccuggagca

SEQ ID NO: 1225517 - RNA, 23 nt, Human
ugccagggccgaucuuggugcca

SEQ ID NO: 1225518 - RNA, 21 nt, Human
ugccauggagaagaucacaga

SEQ ID NO: 1225519 - RNA, 20 nt, Human
ugcccuaggggaagcagggg

SEQ ID NO: 1225520 - RNA, 21 nt, Human
ugcccuggguccccacuaagc

SEQ ID NO: 1225521 - RNA, 21 nt, Human
ugcccuugaucuucucaaucu

SEQ ID NO: 1225522 - RNA, 21 nt, Human
ugccuccuacccuugcgccuc

SEQ ID NO: 1225523 - RNA, 18 nt, Human
ugccuggggucacagagc

SEQ ID NO: 1225524 - RNA, 20 nt, Human
ugccuuggaccgcucuuggc

SEQ ID NO: 1225525 - RNA, 20 nt, Human
ugcgguggcggcagaggagg

SEQ ID NO: 1225526 - RNA, 24 nt, Human
ugcuccccacccucugcacaccuc

SEQ ID NO: 1225527 - RNA, 20 nt, Human
ugcucugacagucucaguug

SEQ ID NO: 1225528 - RNA, 20 nt, Human
ugcugcugcugucguccugc

SEQ ID NO: 1225529 - RNA, 18 nt, Human
ugcugggaagacccccaa

SEQ ID NO: 1225530 - RNA, 20 nt, Human
uggaccccugagcuagccuc

SEQ ID NO: 1225531 - RNA, 25 nt, Human
uggauccuguggcgggggcgucucu

SEQ ID NO: 1225532 - RNA, 19 nt, Human
uggcaagagcagggggugg

SEQ ID NO: 1225533 - RNA, 21 nt, Human
uggcaagagcagggggugggc

SEQ ID NO: 1225534 - RNA, 21 nt, Human
uggcacuggagaacaccugug

SEQ ID NO: 1225535 - RNA, 23 nt, Human
uggcacuggagaacaccugugga

SEQ ID NO: 1225536 - RNA, 22 nt, Human
uggccaagggauggugaauauu

SEQ ID NO: 1225537 - RNA, 22 nt, Human
uggccagccaccggagggguca

SEQ ID NO: 1225538 - RNA, 20 nt, Human
uggcccagggcgggcagcgg

SEQ ID NO: 1225539 - RNA, 21 nt, Human
uggccuucuugcugcccuuga

SEQ ID NO: 1225540 - RNA, 21 nt, Human
uggcgcaggcuggguggagcc

SEQ ID NO: 1225541 - RNA, 24 nt, Human
uggcggcagaggagggauggaguc

SEQ ID NO: 1225542 - RNA, 18 nt, Human
uggcgggggcgucucugc

SEQ ID NO: 1225543 - RNA, 18 nt, Human
ugggcagcagggcagaga

SEQ ID NO: 1225544 - RNA, 22 nt, Human
uggggcaagcacuucacaaccc

SEQ ID NO: 1225545 - RNA, 18 nt, Human
uggguacaagcucaaaac

SEQ ID NO: 1225546 - RNA, 19 nt, Human
ugguggcggcccagggcuu

SEQ ID NO: 1225547 - RNA, 23 nt, Human
ugguggcggcccagggcuuccag

SEQ ID NO: 1225548 - RNA, 22 nt, Human
uggugggggcgguggggguggu

SEQ ID NO: 1225549 - RNA, 21 nt, Human
ugguuggugggaaacccuggu

SEQ ID NO: 1225550 - RNA, 20 nt, Human
ugucauggagcccccuacga

SEQ ID NO: 1225551 - RNA, 18 nt, Human
uguccaagagccugcugg

SEQ ID NO: 1225552 - RNA, 24 nt, Human
uguccaagagccugcugggaggga

SEQ ID NO: 1225553 - RNA, 24 nt, Human
uguccccacccccaugacacuccc

SEQ ID NO: 1225554 - RNA, 22 nt, Human
ugugugacaggcuauaugcgcg

SEQ ID NO: 1225555 - RNA, 21 nt, Human
ugugugggggccugggcacug

SEQ ID NO: 1225556 - RNA, 18 nt, Human
ugugugugggggccuggg

SEQ ID NO: 1225557 - RNA, 23 nt, Human
uuacacaugcacacauggcuacu

SEQ ID NO: 1225558 - RNA, 23 nt, Human
uucaaaaaauugagaauuucuga

SEQ ID NO: 1225559 - RNA, 22 nt, Human
uucuccugagagggccaggaug

SEQ ID NO: 1225560 - RNA, 22 nt, Human
uugauggccuucuugcugcccu

SEQ ID NO: 1225561 - RNA, 22 nt, Human
uugccagggccgaucuuggugc

SEQ ID NO: 1225562 - RNA, 22 nt, Human
uuggugugccguuuucucugga

SEQ ID NO: 1225563 - RNA, 19 nt, Human
uugugccacuucuggaugc

SEQ ID NO: 1225564 - RNA, 22 nt, Human
agggaccaaaaugggccagguu

SEQ ID NO: 1225565 - RNA, 23 nt, Human
ccaaaaugggccagguuuucuuu

SEQ ID NO: 1225566 - RNA, 18 nt, Human
ccuggacccagcugccgu

SEQ ID NO: 1225567 - RNA, 20 nt, Human
gcccuggacccagcugccgu

SEQ ID NO: 1225568 - RNA, 25 nt, Human
uagggaccaaaaugggccagguuuu

SEQ ID NO: 1225569 - RNA, 21 nt, Human
ugaguuagacccugacucugg

SEQ ID NO: 1225570 - RNA, 20 nt, Human
aaaaaaagaaaagacaauuu

SEQ ID NO: 1225571 - RNA, 23 nt, Human
aaaaaagaaaagacaauuuagga

SEQ ID NO: 1225572 - RNA, 22 nt, Human
aaaaagaaaagacaauuuagga

SEQ ID NO: 1225573 - RNA, 24 nt, Human
aaaacaaauuucagacuauaugaa

SEQ ID NO: 1225574 - RNA, 26 nt, Human
aaaacccuuaacccuuuuaagcgccg

SEQ ID NO: 1225575 - RNA, 25 nt, Human
aaaaucuuuguuucuuagaccaguu

SEQ ID NO: 1225576 - RNA, 23 nt, Human
aaaccaugucacugcuaaaaaua

SEQ ID NO: 1225577 - RNA, 18 nt, Human
aaaccggauccagcagaa

SEQ ID NO: 1225578 - RNA, 23 nt, Human
aaaggaagagugugugcccaaaa

SEQ ID NO: 1225579 - RNA, 23 nt, Human
aaauaucaaaagguuaaaaacac

SEQ ID NO: 1225580 - RNA, 19 nt, Human
aacacgaugaaaccggauc

SEQ ID NO: 1225581 - RNA, 18 nt, Human
aacccagaagaggagguu

SEQ ID NO: 1225582 - RNA, 25 nt, Human
aagaaaaaccgaguucagaaucaaa

SEQ ID NO: 1225583 - RNA, 19 nt, Human
aagaaaagacaauuuagga

SEQ ID NO: 1225584 - RNA, 21 nt, Human
aagaaagaaagaaagaaagaa

SEQ ID NO: 1225585 - RNA, 21 nt, Human
aagaaagaaagagagagagga

SEQ ID NO: 1225586 - RNA, 21 nt, Human
aagaaagagagaaaaaacaaa

SEQ ID NO: 1225587 - RNA, 23 nt, Human
aagaaagagagagaggaagagaa

SEQ ID NO: 1225588 - RNA, 22 nt, Human
aagaaagagagagaggaaggaa

SEQ ID NO: 1225589 - RNA, 21 nt, Human
aagagagaaaaaacaaauuuc

SEQ ID NO: 1225590 - RNA, 24 nt, Human
aagaggagguugcggugagccgag

SEQ ID NO: 1225591 - RNA, 23 nt, Human
aagaggccgaggcaggcaguggg

SEQ ID NO: 1225592 - RNA, 26 nt, Human
aagcaacaggaaccacagauaauuau

SEQ ID NO: 1225593 - RNA, 19 nt, Human
aauaggaagaaacagaucu

SEQ ID NO: 1225594 - RNA, 19 nt, Human
aaugugacucugucucaaa

SEQ ID NO: 1225595 - RNA, 24 nt, Human
acaaaggaagagugugugcccaaa

SEQ ID NO: 1225596 - RNA, 19 nt, Human
acacgaugaaaccggaucc

SEQ ID NO: 1225597 - RNA, 19 nt, Human
acacugcacuccagccugg

SEQ ID NO: 1225598 - RNA, 20 nt, Human
acacugcacuccagccuggc

SEQ ID NO: 1225599 - RNA, 21 nt, Human
acacugcacuccagccuggcc

SEQ ID NO: 1225600 - RNA, 20 nt, Human
accaggagacgcaggcuugu

SEQ ID NO: 1225601 - RNA, 18 nt, Human
accuaguauuuuaagagg

SEQ ID NO: 1225602 - RNA, 24 nt, Human
acugcacuccagccuggccaacag

SEQ ID NO: 1225603 - RNA, 24 nt, Human
acugcacuccagccuggccaacag

SEQ ID NO: 1225604 - RNA, 22 nt, Human
agaaaaaccgaguucagaauca

SEQ ID NO: 1225605 - RNA, 23 nt, Human
agaaauugacaagaaacugguua

SEQ ID NO: 1225606 - RNA, 22 nt, Human
agaagaggagguugcggugagc

SEQ ID NO: 1225607 - RNA, 20 nt, Human
agacaggacuggccaacgug

SEQ ID NO: 1225608 - RNA, 23 nt, Human
agacaggacuggccaacgugcag

SEQ ID NO: 1225609 - RNA, 24 nt, Human
agcaauaugauugcuucagccucc

SEQ ID NO: 1225610 - RNA, 21 nt, Human
agccaggcaacaacaucacaa

SEQ ID NO: 1225611 - RNA, 22 nt, Human
agccuccagaaagcacauuuag

SEQ ID NO: 1225612 - RNA, 19 nt, Human
agccuggccaacagagcga

SEQ ID NO: 1225613 - RNA, 25 nt, Human
aggaagaaacagaucucuaguagaa

SEQ ID NO: 1225614 - RNA, 19 nt, Human
aggcaggcagaucacccga

SEQ ID NO: 1225615 - RNA, 22 nt, Human
aggcaggcagaucacccgaggg

SEQ ID NO: 1225616 - RNA, 22 nt, Human
aggcaggcagaucacccgaggu

SEQ ID NO: 1225617 - RNA, 26 nt, Human
agguaaagaaauaucuccagcaauau

SEQ ID NO: 1225618 - RNA, 24 nt, Human
aguggcucacaccuguaaaccuag

SEQ ID NO: 1225619 - RNA, 26 nt, Human
caacauaagcagaauuacaacugaug

SEQ ID NO: 1225620 - RNA, 19 nt, Human
cacacaacagcccgggacc

SEQ ID NO: 1225621 - RNA, 23 nt, Human
cacaccuguaaaccuaguauuuu

SEQ ID NO: 1225622 - RNA, 24 nt, Human
cacacgcccaagcccacacaacag

SEQ ID NO: 1225623 - RNA, 24 nt, Human
cacuccagccuggccaacagagcg

SEQ ID NO: 1225624 - RNA, 18 nt, Human
cacugcacuccagccugg

SEQ ID NO: 1225625 - RNA, 18 nt, Human
cacugcacuccagccugg

SEQ ID NO: 1225626 - RNA, 21 nt, Human
cacugcacuccagccuggcca

SEQ ID NO: 1225627 - RNA, 24 nt, Human
cacugcacuccagccuggccaaca

SEQ ID NO: 1225628 - RNA, 28 nt, Human
cacugcuaaaaauacaaaaacuagccag

SEQ ID NO: 1225629 - RNA, 21 nt, Human
cacuuuaucaaaacagcauca

SEQ ID NO: 1225630 - RNA, 21 nt, Human
cagaaacaccacgccucagau

SEQ ID NO: 1225631 - RNA, 22 nt, Human
cagaaagaaagaaagaaagaaa

SEQ ID NO: 1225632 - RNA, 20 nt, Human
cagaagaggagguugcggug

SEQ ID NO: 1225633 - RNA, 24 nt, Human
cagaucacccgaggucuggaguuu

SEQ ID NO: 1225634 - RNA, 23 nt, Human
cagcacagccaggcaacaacauc

SEQ ID NO: 1225635 - RNA, 24 nt, Human
cagccaggcaacaacaucacaacu

SEQ ID NO: 1225636 - RNA, 22 nt, Human
cccgggaaagcuugccaaaaua

SEQ ID NO: 1225637 - RNA, 20 nt, Human
cccucuuuucacacgcccaa

SEQ ID NO: 1225638 - RNA, 23 nt, Human
cccuuuuaagcgcuguuuuguca

SEQ ID NO: 1225639 - RNA, 22 nt, Human
ccgaaggcguccggucuccucu

SEQ ID NO: 1225640 - RNA, 20 nt, Human
ccgcaccguaaaucugcucc

SEQ ID NO: 1225641 - RNA, 20 nt, Human
ccgcucccggauccaccagg

SEQ ID NO: 1225642 - RNA, 23 nt, Human
cgagaucgaacacugcacuccag

SEQ ID NO: 1225643 - RNA, 22 nt, Human
cguacuucucaaccgcaccgua

SEQ ID NO: 1225644 - RNA, 21 nt, Human
cgucagaaagaaagaaagaaa

SEQ ID NO: 1225645 - RNA, 20 nt, Human
cguccggucuccucugaucu

SEQ ID NO: 1225646 - RNA, 19 nt, Human
cucacaccuguaaaccuag

SEQ ID NO: 1225647 - RNA, 23 nt, Human
cucccggauccaccaggcaauuc

SEQ ID NO: 1225648 - RNA, 21 nt, Human
cucuaguagaaguaauagauu

SEQ ID NO: 1225649 - RNA, 25 nt, Human
cuucucaaccgcaccguaaaucugc

SEQ ID NO: 1225650 - RNA, 21 nt, Human
gaaaaaacaaauuucagacua

SEQ ID NO: 1225651 - RNA, 21 nt, Human
gaacaucaaguuaauucaaga

SEQ ID NO: 1225652 - RNA, 24 nt, Human
gaagaaacagaucucuaguagaag

SEQ ID NO: 1225653 - RNA, 20 nt, Human
gagaaagaaagagagaaaag

SEQ ID NO: 1225654 - RNA, 24 nt, Human
gagacaggacuggccaacgugcag

SEQ ID NO: 1225655 - RNA, 23 nt, Human
gagguugcggugagccgagaucg

SEQ ID NO: 1225656 - RNA, 24 nt, Human
gaucacccgaggucuggaguuuga

SEQ ID NO: 1225657 - RNA, 24 nt, Human
gaucgaacacugcacuccagccug

SEQ ID NO: 1225658 - RNA, 24 nt, Human
gcacuccagccuggccaacagagc

SEQ ID NO: 1225659 - RNA, 21 nt, Human
gcagaucacccgaggucugga

SEQ ID NO: 1225660 - RNA, 26 nt, Human
gccaacgugcagaaaccaugucacug

SEQ ID NO: 1225661 - RNA, 25 nt, Human
gccaggcgagguuggugcgcgccuu

SEQ ID NO: 1225662 - RNA, 20 nt, Human
gcccaagcccacacaacagc

SEQ ID NO: 1225663 - RNA, 21 nt, Human
gcugcaguucagaacaugguu

SEQ ID NO: 1225664 - RNA, 23 nt, Human
gcuggugggcacaguggcucaca

SEQ ID NO: 1225665 - RNA, 20 nt, Human
ggagguugcggugagccgag

SEQ ID NO: 1225666 - RNA, 22 nt, Human
ggagguugcggugagccgagau

SEQ ID NO: 1225667 - RNA, 24 nt, Human
ggagguugcggugagccgagaucg

SEQ ID NO: 1225668 - RNA, 24 nt, Human
gggcacaguggcucacaccuguaa

SEQ ID NO: 1225669 - RNA, 19 nt, Human
guucagaaucaaauuauuc

SEQ ID NO: 1225670 - RNA, 19 nt, Human
guugcggugagccgagauc

SEQ ID NO: 1225671 - RNA, 20 nt, Human
uaaaaacacuuuaucaaaac

SEQ ID NO: 1225672 - RNA, 21 nt, Human
uaaaaauacaaaaacuagcca

SEQ ID NO: 1225673 - RNA, 25 nt, Human
uaaaccuaguauuuuaagaggccga

SEQ ID NO: 1225674 - RNA, 23 nt, Human
uaaagaaauaucuccagcaauau

SEQ ID NO: 1225675 - RNA, 24 nt, Human
uaagaggccgaggcaggcagauca

SEQ ID NO: 1225676 - RNA, 22 nt, Human
uaagcagaauuacaacugauga

SEQ ID NO: 1225677 - RNA, 25 nt, Human
uacaagguacucgggaggcugaggc

SEQ ID NO: 1225678 - RNA, 21 nt, Human
uagaaaaaguaaaagcuggug

SEQ ID NO: 1225679 - RNA, 22 nt, Human
uagauuucuaggaguuuuacac

SEQ ID NO: 1225680 - RNA, 18 nt, Human
uaguaccuugaacagggu

SEQ ID NO: 1225681 - RNA, 24 nt, Human
uaguauuuuaagaggccgaggcag

SEQ ID NO: 1225682 - RNA, 23 nt, Human
uauaaugugacucugucucaaaa

SEQ ID NO: 1225683 - RNA, 25 nt, Human
uaucaaaaagguaaagaaauaucuc

SEQ ID NO: 1225684 - RNA, 18 nt, Human
uaucuccagcaauaugau

SEQ ID NO: 1225685 - RNA, 26 nt, Human
ucaaaauacuucaaaaugaaauacag

SEQ ID NO: 1225686 - RNA, 18 nt, Human
ucaaaccugacgaaaagg

SEQ ID NO: 1225687 - RNA, 18 nt, Human
ucagaucacuaaggugca

SEQ ID NO: 1225688 - RNA, 23 nt, Human
uccagccuggccaacagagcgag

SEQ ID NO: 1225689 - RNA, 24 nt, Human
uccagccuggccaacagagcgaga

SEQ ID NO: 1225690 - RNA, 22 nt, Human
ucuccucugaucucgugaagau

SEQ ID NO: 1225691 - RNA, 22 nt, Human
ucuuuuauaaacauuugaaaag

SEQ ID NO: 1225692 - RNA, 22 nt, Human
ugaaaagcaauaauucauuaaa

SEQ ID NO: 1225693 - RNA, 21 nt, Human
ugaaaaguuucagggcccucu

SEQ ID NO: 1225694 - RNA, 24 nt, Human
ugaaagaaaauauucaacuguaaa

SEQ ID NO: 1225695 - RNA, 23 nt, Human
ugaaauacagacaguuacaugaa

SEQ ID NO: 1225696 - RNA, 26 nt, Human
ugacaagaaacugguuauuuuguguc

SEQ ID NO: 1225697 - RNA, 23 nt, Human
ugagaaaaccaggagacgcaggc

SEQ ID NO: 1225698 - RNA, 22 nt, Human
ugccaaaauaucaaaagguuaa

SEQ ID NO: 1225699 - RNA, 19 nt, Human
uggcucacaccuguaaacc

SEQ ID NO: 1225700 - RNA, 24 nt, Human
uggcucacaccuguaaaccuagua

SEQ ID NO: 1225701 - RNA, 19 nt, Human
ugggcggcgcaacacgaug

SEQ ID NO: 1225702 - RNA, 22 nt, Human
uguaaacagguacucuaguacc

SEQ ID NO: 1225703 - RNA, 23 nt, Human
uguaaacagguacucuaguaccu

SEQ ID NO: 1225704 - RNA, 21 nt, Human
uguaacuuauuugacaauguu

SEQ ID NO: 1225705 - RNA, 24 nt, Human
ugucaaguaaucaaaaaccuaaua

SEQ ID NO: 1225706 - RNA, 23 nt, Human
ugugaauuaauagucauuuauuu

SEQ ID NO: 1225707 - RNA, 19 nt, Human
ugugucaaacaacauaagc

SEQ ID NO: 1225708 - RNA, 18 nt, Human
uuagugugggcuaaccug

SEQ ID NO: 1225709 - RNA, 19 nt, Human
uucaaguuccucccucuuu

SEQ ID NO: 1225710 - RNA, 22 nt, Human
uucaaguuccucccucuuuacc

SEQ ID NO: 1225711 - RNA, 22 nt, Human
uucagguaugucaagaaaaacc

SEQ ID NO: 1225712 - RNA, 18 nt, Human
uugcggugagccgagauc

SEQ ID NO: 1225713 - RNA, 19 nt, Human
uugcggugagccgagaucg

SEQ ID NO: 1225714 - RNA, 24 nt, Human
uugcggugagccgagaucgaacac

SEQ ID NO: 1225715 - RNA, 21 nt, Human
aauguacauccuugagacagc

SEQ ID NO: 1225716 - RNA, 19 nt, Human
acuccuguguuaucuccaa

SEQ ID NO: 1225717 - RNA, 25 nt, Human
cccucccagaaagacuccuguguua

SEQ ID NO: 1225718 - RNA, 21 nt, Human
gaggaugguauaacuucgcgg

SEQ ID NO: 1225719 - RNA, 23 nt, Human
gaucauuaguuguaguuacuucc

SEQ ID NO: 1225720 - RNA, 18 nt, Human
uggccaaaagccugaugc

SEQ ID NO: 1225721 - RNA, 23 nt, Human
uucaggauggcagaggaaccugu

SEQ ID NO: 1225722 - RNA, 23 nt, Human
uuuauuuauuuuaaaguuggguc

SEQ ID NO: 1225723 - RNA, 21 nt, Human
uuuggccaaaagccugaugcc

SEQ ID NO: 1225724 - RNA, 20 nt, Human
aaaaagccuuuauucacuuu

SEQ ID NO: 1225725 - RNA, 19 nt, Human
aaaaccaagaucaaguucc

SEQ ID NO: 1225726 - RNA, 18 nt, Human
aaaauagcagaagggaag

SEQ ID NO: 1225727 - RNA, 26 nt, Human
aaaauugacaaauucauuuugaauaa

SEQ ID NO: 1225728 - RNA, 19 nt, Human
aaauguccucuaggcaguc

SEQ ID NO: 1225729 - RNA, 21 nt, Human
aaugcaggaaauuguaacacu

SEQ ID NO: 1225730 - RNA, 18 nt, Human
acaaaaugaaaaccagua

SEQ ID NO: 1225731 - RNA, 25 nt, Human
accaaaacaaauauuuaauaagaau

SEQ ID NO: 1225732 - RNA, 25 nt, Human
acuaaugcacuaacagaaaaaaaaa

SEQ ID NO: 1225733 - RNA, 21 nt, Human
agacauauucccacuaaugca

SEQ ID NO: 1225734 - RNA, 19 nt, Human
agaccuccggcacugcaga

SEQ ID NO: 1225735 - RNA, 23 nt, Human
agaccuccggcacugcagacacu

SEQ ID NO: 1225736 - RNA, 24 nt, Human
auaaucacuuuaaaagccagaaag

SEQ ID NO: 1225737 - RNA, 24 nt, Human
caaaauuagugauaugauuacccc

SEQ ID NO: 1225738 - RNA, 23 nt, Human
caagaacaacgccacaacaucau

SEQ ID NO: 1225739 - RNA, 22 nt, Human
caaugucuacuucaguguccca

SEQ ID NO: 1225740 - RNA, 25 nt, Human
caaugucuacuucagugucccaaaa

SEQ ID NO: 1225741 - RNA, 18 nt, Human
caggcuucauucagccgg

SEQ ID NO: 1225742 - RNA, 23 nt, Human
caucauguauauuuaauaucaca

SEQ ID NO: 1225743 - RNA, 22 nt, Human
cauccaagaacaacgccacaac

SEQ ID NO: 1225744 - RNA, 18 nt, Human
ccaagaacaacgccacaa

SEQ ID NO: 1225745 - RNA, 18 nt, Human
cccuccccuccccaaauc

SEQ ID NO: 1225746 - RNA, 19 nt, Human
ccgcgucccaggcuucauu

SEQ ID NO: 1225747 - RNA, 25 nt, Human
ccucuaggcaguccacuuaccaucc

SEQ ID NO: 1225748 - RNA, 28 nt, Human
ccugcagcagggaggcuucgcccggagc

SEQ ID NO: 1225749 - RNA, 22 nt, Human
cuaauccagauugaaaacuguu

SEQ ID NO: 1225750 - RNA, 22 nt, Human
cuaaugcacuaacagaaaaaaa

SEQ ID NO: 1225751 - RNA, 19 nt, Human
cuacccuccccuccccaaa

SEQ ID NO: 1225752 - RNA, 21 nt, Human
cuacccuccccuccccaaauc

SEQ ID NO: 1225753 - RNA, 21 nt, Human
cucccgcgucccaggcuucau

SEQ ID NO: 1225754 - RNA, 22 nt, Human
cuugcagcccgugggaccacga

SEQ ID NO: 1225755 - RNA, 24 nt, Human
gaaagcaauccagcaaaaccaaga

SEQ ID NO: 1225756 - RNA, 21 nt, Human
gcaguccacuuaccauccaag

SEQ ID NO: 1225757 - RNA, 21 nt, Human
gcauuaacugguuuuccauuu

SEQ ID NO: 1225758 - RNA, 18 nt, Human
gccacaacaucauuuuac

SEQ ID NO: 1225759 - RNA, 21 nt, Human
gcccggagccucccagaccuc

SEQ ID NO: 1225760 - RNA, 19 nt, Human
gcgcggcgcggcucccgcg

SEQ ID NO: 1225761 - RNA, 19 nt, Human
uacaauuugucuuugaccu

SEQ ID NO: 1225762 - RNA, 18 nt, Human
uacagccugccucagaau

SEQ ID NO: 1225763 - RNA, 18 nt, Human
uacagccugccucagaau

SEQ ID NO: 1225764 - RNA, 23 nt, Human
uaccaaaacaaauauuuaauaag

SEQ ID NO: 1225765 - RNA, 21 nt, Human
uauaugcagcacugaggcaca

SEQ ID NO: 1225766 - RNA, 18 nt, Human
uauuucagcccuguaaau

SEQ ID NO: 1225767 - RNA, 20 nt, Human
ucacugggucacuuuaguau

SEQ ID NO: 1225768 - RNA, 19 nt, Human
ucagugucccaaaaagccu

SEQ ID NO: 1225769 - RNA, 25 nt, Human
ucgcccggagccucccagaccuccg

SEQ ID NO: 1225770 - RNA, 24 nt, Human
ucgguucucccacaauuguguaaa

SEQ ID NO: 1225771 - RNA, 24 nt, Human
ucuguggcuacccuccccucccca

SEQ ID NO: 1225772 - RNA, 22 nt, Human
ugaaaaaauucaaaagcuucca

SEQ ID NO: 1225773 - RNA, 19 nt, Human
ugcagacacugcgcgcggc

SEQ ID NO: 1225774 - RNA, 25 nt, Human
ugccucagaauuuucaaaaguaaga

SEQ ID NO: 1225775 - RNA, 20 nt, Human
uggaaagcaauccagcaaaa

SEQ ID NO: 1225776 - RNA, 19 nt, Human
uggcuacccuccccucccc

SEQ ID NO: 1225777 - RNA, 21 nt, Human
uggcuacccuccccuccccaa

SEQ ID NO: 1225778 - RNA, 21 nt, Human
ugugauaaauuauuacauaga

SEQ ID NO: 1225779 - RNA, 21 nt, Human
uguguacagacauacagccug

SEQ ID NO: 1225780 - RNA, 20 nt, Human
uguuacagacacauuuagua

SEQ ID NO: 1225781 - RNA, 23 nt, Human
uguuguuucuuucucaaaguuuu

SEQ ID NO: 1225782 - RNA, 19 nt, Human
uuaauucuaccucagcagu

SEQ ID NO: 1225783 - RNA, 20 nt, Human
uuggcaguaaaacuuuugug

SEQ ID NO: 1225784 - RNA, 22 nt, Human
uuugaccuuuaacaaauguccu

SEQ ID NO: 1225785 - RNA, 21 nt, Human
aacuggucuggaauggggccc

SEQ ID NO: 1225786 - RNA, 23 nt, Human
aagcaauacuuuguaacccuagc

SEQ ID NO: 1225787 - RNA, 24 nt, Human
acauaccacuuucuggguaucucu

SEQ ID NO: 1225788 - RNA, 24 nt, Human
accacuuucuggguaucucuccca

SEQ ID NO: 1225789 - RNA, 23 nt, Human
acugcuauaucccagccgggugc

SEQ ID NO: 1225790 - RNA, 24 nt, Human
acuuuguaacccuagcacuugcua

SEQ ID NO: 1225791 - RNA, 23 nt, Human
agaaaacaccaaauggcggauga

SEQ ID NO: 1225792 - RNA, 23 nt, Human
agaccggagccggccagcgaacc

SEQ ID NO: 1225793 - RNA, 18 nt, Human
agccacggagcucgcgga

SEQ ID NO: 1225794 - RNA, 23 nt, Human
agccauguuaugucaggagaacc

SEQ ID NO: 1225795 - RNA, 24 nt, Human
aggaagccacccuggaagcacaug

SEQ ID NO: 1225796 - RNA, 21 nt, Human
aggagucuucgcuucugggag

SEQ ID NO: 1225797 - RNA, 21 nt, Human
agguuuugaagauuaugccuc

SEQ ID NO: 1225798 - RNA, 23 nt, Human
agugccaggauucuagcaaagga

SEQ ID NO: 1225799 - RNA, 22 nt, Human
aguggcauccgaggccgggguc

SEQ ID NO: 1225800 - RNA, 21 nt, Human
aucauccuggccuagcucucc

SEQ ID NO: 1225801 - RNA, 23 nt, Human
caaaaagcaauacuuuguaaccc

SEQ ID NO: 1225802 - RNA, 23 nt, Human
caagauaacaucccagagcugga

SEQ ID NO: 1225803 - RNA, 22 nt, Human
caagugaauccaaagugggcac

SEQ ID NO: 1225804 - RNA, 18 nt, Human
cacagccaggaagccacc

SEQ ID NO: 1225805 - RNA, 19 nt, Human
cagcaagauaacaucccag

SEQ ID NO: 1225806 - RNA, 24 nt, Human
cagcaagauaacaucccagagcug

SEQ ID NO: 1225807 - RNA, 25 nt, Human
cagcaagauaacaucccagagcugg

SEQ ID NO: 1225808 - RNA, 23 nt, Human
cagccaggaagccacccuggaag

SEQ ID NO: 1225809 - RNA, 22 nt, Human
caggaagccacccuggaagcac

SEQ ID NO: 1225810 - RNA, 20 nt, Human
caggauucuagcaaaggaag

SEQ ID NO: 1225811 - RNA, 18 nt, Human
cauagugucaccaaaagc

SEQ ID NO: 1225812 - RNA, 20 nt, Human
cauugauuuuuuccuggggg

SEQ ID NO: 1225813 - RNA, 23 nt, Human
ccaaagugggcacaagcugagaa

SEQ ID NO: 1225814 - RNA, 23 nt, Human
ccaacaaccauggguuccccaaa

SEQ ID NO: 1225815 - RNA, 19 nt, Human
ccaagugaauccaaagugg

SEQ ID NO: 1225816 - RNA, 24 nt, Human
ccauccacagggccaucauccugg

SEQ ID NO: 1225817 - RNA, 24 nt, Human
cccagaaccugaacaaaccacaag

SEQ ID NO: 1225818 - RNA, 21 nt, Human
cccauagugucaccaaaagcu

SEQ ID NO: 1225819 - RNA, 19 nt, Human
ccccaaaaagcaauacuuu

SEQ ID NO: 1225820 - RNA, 23 nt, Human
ccccaacaaccauggguucccca

SEQ ID NO: 1225821 - RNA, 20 nt, Human
ccccggggcccugggauggg

SEQ ID NO: 1225822 - RNA, 23 nt, Human
ccccuuaugagacauuguggggu

SEQ ID NO: 1225823 - RNA, 22 nt, Human
cccuagcacuugcuaucaugcc

SEQ ID NO: 1225824 - RNA, 20 nt, Human
cccuuaugagacauuguggg

SEQ ID NO: 1225825 - RNA, 21 nt, Human
cgaguccauguuggccucaca

SEQ ID NO: 1225826 - RNA, 24 nt, Human
cggaaucugagaucauugauuuuu

SEQ ID NO: 1225827 - RNA, 24 nt, Human
cggggcccugggauggggaaccau

SEQ ID NO: 1225828 - RNA, 23 nt, Human
cuagcacuugcuaucaugccuaa

SEQ ID NO: 1225829 - RNA, 18 nt, Human
cucaucuuccuuuggcuc

SEQ ID NO: 1225830 - RNA, 18 nt, Human
cugaacaaaccacaaguc

SEQ ID NO: 1225831 - RNA, 21 nt, Human
cugaacaaaccacaagucuga

SEQ ID NO: 1225832 - RNA, 23 nt, Human
cuggcugaaccaccaguguaaaa

SEQ ID NO: 1225833 - RNA, 19 nt, Human
cuggguaucucucccagau

SEQ ID NO: 1225834 - RNA, 19 nt, Human
cugugccucugacauuuug

SEQ ID NO: 1225835 - RNA, 18 nt, Human
gaaauaugcugugccucu

SEQ ID NO: 1225836 - RNA, 20 nt, Human
gaacaagaucggcaagcccc

SEQ ID NO: 1225837 - RNA, 22 nt, Human
gaagccacccuggaagcacaug

SEQ ID NO: 1225838 - RNA, 21 nt, Human
gaagugcugauucuuauuuca

SEQ ID NO: 1225839 - RNA, 21 nt, Human
gagaaaacaccaaauggcgga

SEQ ID NO: 1225840 - RNA, 23 nt, Human
gagccggccagcgaaccagguuc

SEQ ID NO: 1225841 - RNA, 22 nt, Human
gaggcaaggccaaggauaagga

SEQ ID NO: 1225842 - RNA, 18 nt, Human
gaucugucucuucucccu

SEQ ID NO: 1225843 - RNA, 22 nt, Human
gaugcccgucagcaagcugggc

SEQ ID NO: 1225844 - RNA, 21 nt, Human
gcagaagcagaccggagccgg

SEQ ID NO: 1225845 - RNA, 20 nt, Human
gcaguggcauccgaggccgg

SEQ ID NO: 1225846 - RNA, 19 nt, Human
gcauuuauuaagagucagg

SEQ ID NO: 1225847 - RNA, 18 nt, Human
gcccugggauggggaacc

SEQ ID NO: 1225848 - RNA, 18 nt, Human
gccuagcucuccauuguc

SEQ ID NO: 1225849 - RNA, 26 nt, Human
gcgcagccggcauuggguugcggggg

SEQ ID NO: 1225850 - RNA, 21 nt, Human
ggaaucugagaucauugauuu

SEQ ID NO: 1225851 - RNA, 20 nt, Human
ggagcuccuccagccauguu

SEQ ID NO: 1225852 - RNA, 22 nt, Human
ggagcuccuccagccauguuau

SEQ ID NO: 1225853 - RNA, 23 nt, Human
ggagguuucggcaguggcauccg

SEQ ID NO: 1225854 - RNA, 26 nt, Human
ggccuagcucuccauuguccccaacc

SEQ ID NO: 1225855 - RNA, 24 nt, Human
ggcuggggccgaagccacggagcu

SEQ ID NO: 1225856 - RNA, 21 nt, Human
gggcuacaacggucacgucgg

SEQ ID NO: 1225857 - RNA, 27 nt, Human
guaaaacagcaagauaacaucccagag

SEQ ID NO: 1225858 - RNA, 24 nt, Human
uaaaaaaucuaaagcagcuuuaaa

SEQ ID NO: 1225859 - RNA, 23 nt, Human
uaaaacagcaagauaacauccca

SEQ ID NO: 1225860 - RNA, 20 nt, Human
uaacugcuauaucccagcag

SEQ ID NO: 1225861 - RNA, 24 nt, Human
uaagugcuccaaggagguggccac

SEQ ID NO: 1225862 - RNA, 23 nt, Human
uaggccuugggcccacauuuguu

SEQ ID NO: 1225863 - RNA, 22 nt, Human
uaggggaacaagaucggcaagc

SEQ ID NO: 1225864 - RNA, 24 nt, Human
uaucaugccuaaugucuagcaagu

SEQ ID NO: 1225865 - RNA, 23 nt, Human
ucaaguuaaaaaaucuaaagcag

SEQ ID NO: 1225866 - RNA, 18 nt, Human
ucaauagcccuucccaua

SEQ ID NO: 1225867 - RNA, 23 nt, Human
ucagcucucaucuuccuuuggcu

SEQ ID NO: 1225868 - RNA, 21 nt, Human
ucaggagucuucgcuucuggg

SEQ ID NO: 1225869 - RNA, 18 nt, Human
ucauccuggccuagcucu

SEQ ID NO: 1225870 - RNA, 24 nt, Human
uccaaagugggcacaagcugagaa

SEQ ID NO: 1225871 - RNA, 23 nt, Human
ucccagaaccugaacaaaccaca

SEQ ID NO: 1225872 - RNA, 18 nt, Human
ucccagagcuggagcucc

SEQ ID NO: 1225873 - RNA, 20 nt, Human
ucccggaggccccggggccc

SEQ ID NO: 1225874 - RNA, 22 nt, Human
ucccggaggccccggggcccug

SEQ ID NO: 1225875 - RNA, 22 nt, Human
ucccugcccaucacggaaucug

SEQ ID NO: 1225876 - RNA, 23 nt, Human
ucccuggaggagaucugucucuu

SEQ ID NO: 1225877 - RNA, 24 nt, Human
uccugagaagauacucaauagccc

SEQ ID NO: 1225878 - RNA, 24 nt, Human
uccuuucagcucucaucuuccuuu

SEQ ID NO: 1225879 - RNA, 19 nt, Human
ucgaaauaugcugugccuc

SEQ ID NO: 1225880 - RNA, 18 nt, Human
ucucucgaggccuagguu

SEQ ID NO: 1225881 - RNA, 19 nt, Human
ucugucucuucucccugcc

SEQ ID NO: 1225882 - RNA, 19 nt, Human
ugagaucauugauuuuuuu

SEQ ID NO: 1225883 - RNA, 20 nt, Human
ugaucuucugguuucucccc

SEQ ID NO: 1225884 - RNA, 20 nt, Human
ugccguggaccaggcugggg

SEQ ID NO: 1225885 - RNA, 21 nt, Human
ugccuggucaagcacaugaag

SEQ ID NO: 1225886 - RNA, 25 nt, Human
uggaauggggcccaggcaucaguau

SEQ ID NO: 1225887 - RNA, 22 nt, Human
uggauggauggcuccagcauuu

SEQ ID NO: 1225888 - RNA, 18 nt, Human
uggcauccgaggccgggg

SEQ ID NO: 1225889 - RNA, 20 nt, Human
uggccuagcucuccauuguc

SEQ ID NO: 1225890 - RNA, 21 nt, Human
ugggauggggaaccauggugg

SEQ ID NO: 1225891 - RNA, 20 nt, Human
ugguugaucagcagaauccc

SEQ ID NO: 1225892 - RNA, 21 nt, Human
uguaaaaugagucuaguuuga

SEQ ID NO: 1225893 - RNA, 18 nt, Human
ugucucuucucccugccc

SEQ ID NO: 1225894 - RNA, 24 nt, Human
uuccaagugaauccaaagugggca

SEQ ID NO: 1225895 - RNA, 22 nt, Human
uuccguggagguuucggcagug

SEQ ID NO: 1225896 - RNA, 24 nt, Human
uucucccugcccaucacggaaucu

SEQ ID NO: 1225897 - RNA, 19 nt, Human
uuuaaaaaaugaauauauc

SEQ ID NO: 1225898 - RNA, 20 nt, Human
aaaacaauuuggaaucuggg

SEQ ID NO: 1225899 - RNA, 18 nt, Human
aagaaaccuggccauuag

SEQ ID NO: 1225900 - RNA, 21 nt, Human
aagcccauuuuucuaagaucc

SEQ ID NO: 1225901 - RNA, 22 nt, Human
aauuucuugcuuucugcaccuc

SEQ ID NO: 1225902 - RNA, 23 nt, Human
agacacuaauggagcuccaagcc

SEQ ID NO: 1225903 - RNA, 18 nt, Human
agguguuugugucuuauc

SEQ ID NO: 1225904 - RNA, 21 nt, Human
cagagcaauuucuugcuuucu

SEQ ID NO: 1225905 - RNA, 23 nt, Human
ccaagaaaccuggccauuagcuc

SEQ ID NO: 1225906 - RNA, 20 nt, Human
cccauuuuucuaagauccag

SEQ ID NO: 1225907 - RNA, 21 nt, Human
gcagacacuaauggagcucca

SEQ ID NO: 1225908 - RNA, 22 nt, Human
ucccaagaaaccuggccauuag

SEQ ID NO: 1225909 - RNA, 19 nt, Human
ucuuaucccuggggaugaa

SEQ ID NO: 1225910 - RNA, 24 nt, Human
ugccuugucuccuuucaugaguca

SEQ ID NO: 1225911 - RNA, 20 nt, Human
uggggaugaaaaaagauguu

SEQ ID NO: 1225912 - RNA, 21 nt, Human
uggggaugaaaaaagauguuc

SEQ ID NO: 1225913 - RNA, 25 nt, Human
uguacucccaagaaaccuggccauu

SEQ ID NO: 1225914 - RNA, 23 nt, Human
uguucugacaccaauaacucuaa

SEQ ID NO: 1225915 - RNA, 24 nt, Human
aaaaaaagagacauauuaaagugu

SEQ ID NO: 1225916 - RNA, 20 nt, Human
aaaaaagagacauauuaaag

SEQ ID NO: 1225917 - RNA, 21 nt, Human
aaaaaagagacauauuaaagu

SEQ ID NO: 1225918 - RNA, 23 nt, Human
aaacuagaaaggagcaggaauga

SEQ ID NO: 1225919 - RNA, 18 nt, Human
aaagagacauauuaaagu

SEQ ID NO: 1225920 - RNA, 18 nt, Human
aaagagcccaccucaugc

SEQ ID NO: 1225921 - RNA, 23 nt, Human
aaagagcccaccucaugcuaagc

SEQ ID NO: 1225922 - RNA, 19 nt, Human
aagaagaaaaugagcaaga

SEQ ID NO: 1225923 - RNA, 22 nt, Human
aagagcccaccucaugcuaagc

SEQ ID NO: 1225924 - RNA, 20 nt, Human
aaugguguuaaagagcccac

SEQ ID NO: 1225925 - RNA, 19 nt, Human
acaagcauucucucuuucc

SEQ ID NO: 1225926 - RNA, 23 nt, Human
agaagaaaaugagcaagacagaa

SEQ ID NO: 1225927 - RNA, 23 nt, Human
agacagaaaaggauauuuuucaa

SEQ ID NO: 1225928 - RNA, 19 nt, Human
aggcaaaauccucaccuuc

SEQ ID NO: 1225929 - RNA, 21 nt, Human
augaaauacagagcuguccug

SEQ ID NO: 1225930 - RNA, 25 nt, Human
caaggcaaaauccucaccuuccucu

SEQ ID NO: 1225931 - RNA, 23 nt, Human
cuaggaaaggugugauucuuuug

SEQ ID NO: 1225932 - RNA, 18 nt, Human
cucagaaugguguuaaag

SEQ ID NO: 1225933 - RNA, 19 nt, Human
cucuaaaucaacaguucuc

SEQ ID NO: 1225934 - RNA, 25 nt, Human
uaacaaauacaaaagucuuaauuuu

SEQ ID NO: 1225935 - RNA, 27 nt, Human
uagaaaggagcaggaaugaaagucuua

SEQ ID NO: 1225936 - RNA, 21 nt, Human
uagcacaagcauucucucuuu

SEQ ID NO: 1225937 - RNA, 19 nt, Human
ucaaggguguugaaggcug

SEQ ID NO: 1225938 - RNA, 24 nt, Human
ucccuaaaaaaagagacauauuaa

SEQ ID NO: 1225939 - RNA, 22 nt, Human
ucucuucuccaaggcaaaaucc

SEQ ID NO: 1225940 - RNA, 22 nt, Human
ugacuguguaggucuuggagac

SEQ ID NO: 1225941 - RNA, 18 nt, Human
ugagcaagacagaaaagg

SEQ ID NO: 1225942 - RNA, 19 nt, Human
ugagcaagacagaaaagga

SEQ ID NO: 1225943 - RNA, 24 nt, Human
ugcaaaucgcuuuaagagaugaaa

SEQ ID NO: 1225944 - RNA, 20 nt, Human
uguagcacaagcauucucuc

SEQ ID NO: 1225945 - RNA, 22 nt, Human
ugugcuuuuucccuaaaaaaag

SEQ ID NO: 1225946 - RNA, 22 nt, Human
uguguaggucuuggagacgauu

SEQ ID NO: 1225947 - RNA, 25 nt, Human
uguuaaagagcccaccucaugcuaa

SEQ ID NO: 1225948 - RNA, 25 nt, Human
uguuuuuucucuccucaaguccuuu

SEQ ID NO: 1225949 - RNA, 21 nt, Human
gauggaugggaaucugcuugg

SEQ ID NO: 1225950 - RNA, 21 nt, Human
gggcagagaccuccuuguucu

SEQ ID NO: 1225951 - RNA, 23 nt, Human
ucucuguuuugcugauuccuuug

SEQ ID NO: 1225952 - RNA, 22 nt, Human
uuggcauuagcagaagauuuca

SEQ ID NO: 1225953 - RNA, 24 nt, Human
uuucuugaucugauaucucuguuu

SEQ ID NO: 1225954 - RNA, 23 nt, Human
uuuggcauuagcagaagauuuca

SEQ ID NO: 1225955 - RNA, 23 nt, Human
uuuucuugaucugauaucucugu

SEQ ID NO: 1225956 - RNA, 21 nt, Human
aaugaaauuuaaaaauggcua

SEQ ID NO: 1225957 - RNA, 21 nt, Human
uucaccaucaggaacaaauau

SEQ ID NO: 1225958 - RNA, 22 nt, Human
aaaaacaaaaaaagaagaggca

SEQ ID NO: 1225959 - RNA, 23 nt, Human
aaaaacaaaaacaaaaacaaaaa

SEQ ID NO: 1225960 - RNA, 23 nt, Human
aaaacaaaaacaaaaaaagaaga

SEQ ID NO: 1225961 - RNA, 22 nt, Human
aaaacaaaaacaaaaacaaaaa

SEQ ID NO: 1225962 - RNA, 24 nt, Human
aaaacaaaaacaaaaacaaaaaaa

SEQ ID NO: 1225963 - RNA, 21 nt, Human
aaaaggaaaaggagagagaac

SEQ ID NO: 1225964 - RNA, 25 nt, Human
aaacaaaaaaagaagaggcagcugg

SEQ ID NO: 1225965 - RNA, 22 nt, Human
aaacaaaaacaaaaaaagaaga

SEQ ID NO: 1225966 - RNA, 28 nt, Human
aaacaaaaacaaaaacaaaaaaagaaga

SEQ ID NO: 1225967 - RNA, 22 nt, Human
aaaggagagagaacaaaacgga

SEQ ID NO: 1225968 - RNA, 24 nt, Human
aacaaaaacaaaaacaaaaaaaga

SEQ ID NO: 1225969 - RNA, 23 nt, Human
aacagaacaccccagaagcacca

SEQ ID NO: 1225970 - RNA, 20 nt, Human
aacauggugaaacuccgucu

SEQ ID NO: 1225971 - RNA, 21 nt, Human
aacauggugaaacuccgucuc

SEQ ID NO: 1225972 - RNA, 19 nt, Human
aagagacucugucucaaaa

SEQ ID NO: 1225973 - RNA, 22 nt, Human
aagagggaacuaggccaggcgc

SEQ ID NO: 1225974 - RNA, 22 nt, Human
aagcacagaauaaagagauccu

SEQ ID NO: 1225975 - RNA, 21 nt, Human
aagcacccagguaaccggcaa

SEQ ID NO: 1225976 - RNA, 22 nt, Human
aaggaagagaggaggaaaagga

SEQ ID NO: 1225977 - RNA, 24 nt, Human
aaucgcuugaacccaggaggcaga

SEQ ID NO: 1225978 - RNA, 23 nt, Human
aauugacagaaaacuagaaggga

SEQ ID NO: 1225979 - RNA, 19 nt, Human
acaaaaacaaaaaaagaag

SEQ ID NO: 1225980 - RNA, 20 nt, Human
acaaaaacaaaaaaagaaga

SEQ ID NO: 1225981 - RNA, 18 nt, Human
acagaaaacuagaaggga

SEQ ID NO: 1225982 - RNA, 24 nt, Human
acagaaagagacucugucucaaaa

SEQ ID NO: 1225983 - RNA, 19 nt, Human
acauggugaaacuccgucu

SEQ ID NO: 1225984 - RNA, 24 nt, Human
acccaggaggcagagguugcagug

SEQ ID NO: 1225985 - RNA, 20 nt, Human
acuaucaaaggaucugaggu

SEQ ID NO: 1225986 - RNA, 24 nt, Human
acuccgucucuacuaaaaauacaa

SEQ ID NO: 1225987 - RNA, 18 nt, Human
acugcacuccagccugga

SEQ ID NO: 1225988 - RNA, 19 nt, Human
acugcacuccagccuggac

SEQ ID NO: 1225989 - RNA, 22 nt, Human
acugcacuccagccuggacgac

SEQ ID NO: 1225990 - RNA, 24 nt, Human
acugcacuccagccuggacgacag

SEQ ID NO: 1225991 - RNA, 18 nt, Human
agaaagagacucugucuc

SEQ ID NO: 1225992 - RNA, 22 nt, Human
agaaagagacucugucucaaaa

SEQ ID NO: 1225993 - RNA, 18 nt, Human
agaacaaaacggaggcug

SEQ ID NO: 1225994 - RNA, 19 nt, Human
agagaacaaaacggaggcu

SEQ ID NO: 1225995 - RNA, 22 nt, Human
agagaacaaaacggaggcugaa

SEQ ID NO: 1225996 - RNA, 19 nt, Human
agaggaggaaaaggaaaag

SEQ ID NO: 1225997 - RNA, 20 nt, Human
agaggaggaaaaggaaaagg

SEQ ID NO: 1225998 - RNA, 22 nt, Human
agagguugcagugagccaagau

SEQ ID NO: 1225999 - RNA, 24 nt, Human
agagguugcagugagccaagauug

SEQ ID NO: 1226000 - RNA, 19 nt, Human
agaguguuuuugugaagau

SEQ ID NO: 1226001 - RNA, 24 nt, Human
agccuggacgacagaaagagacuc

SEQ ID NO: 1226002 - RNA, 24 nt, Human
agcguggccaacauggugaaacuc

SEQ ID NO: 1226003 - RNA, 23 nt, Human
agcuccaagaauguucacaaacg

SEQ ID NO: 1226004 - RNA, 22 nt, Human
aggaaaaggagagagaacaaaa

SEQ ID NO: 1226005 - RNA, 21 nt, Human
aggaagagaggaggaaaagga

SEQ ID NO: 1226006 - RNA, 24 nt, Human
aggcagagguugcagugagccaag

SEQ ID NO: 1226007 - RNA, 21 nt, Human
aggcagcuggauucaggauca

SEQ ID NO: 1226008 - RNA, 21 nt, Human
aggccaaggcgggcggaucac

SEQ ID NO: 1226009 - RNA, 22 nt, Human
aggccaggcgcgguggcucaug

SEQ ID NO: 1226010 - RNA, 24 nt, Human
aggcgcgguggcucaugccuguaa

SEQ ID NO: 1226011 - RNA, 21 nt, Human
aggcgggcggaucacuugagg

SEQ ID NO: 1226012 - RNA, 23 nt, Human
aggcgggcggaucacuugagguc

SEQ ID NO: 1226013 - RNA, 24 nt, Human
agguugaggcacaagaaucgcuug

SEQ ID NO: 1226014 - RNA, 19 nt, Human
augccuguaaucccagcac

SEQ ID NO: 1226015 - RNA, 24 nt, Human
auugcgcuacugcacuccagccug

SEQ ID NO: 1226016 - RNA, 24 nt, Human
caaaaacaaaaaaagaagaggcag

SEQ ID NO: 1226017 - RNA, 24 nt, Human
caacauggugaaacuccgucucua

SEQ ID NO: 1226018 - RNA, 24 nt, Human
caagaccagcguggccaacauggu

SEQ ID NO: 1226019 - RNA, 24 nt, Human
caagauugcgcuacugcacuccag

SEQ ID NO: 1226020 - RNA, 21 nt, Human
caaggcgggcggaucacuuga

SEQ ID NO: 1226021 - RNA, 24 nt, Human
caaggcgggcggaucacuugaggu

SEQ ID NO: 1226022 - RNA, 21 nt, Human
cacacagaaaagugcccagau

SEQ ID NO: 1226023 - RNA, 22 nt, Human
cacagcucaugugcagaaaucu

SEQ ID NO: 1226024 - RNA, 21 nt, Human
caccccagaagcaccaccuca

SEQ ID NO: 1226025 - RNA, 20 nt, Human
cacuccaaguugggggugga

SEQ ID NO: 1226026 - RNA, 21 nt, Human
cacuccaaguuggggguggag

SEQ ID NO: 1226027 - RNA, 18 nt, Human
cagaacaccccagaagca

SEQ ID NO: 1226028 - RNA, 20 nt, Human
cagaacaccccagaagcacc

SEQ ID NO: 1226029 - RNA, 21 nt, Human
cagaacaccccagaagcacca

SEQ ID NO: 1226030 - RNA, 23 nt, Human
cagaacaccccagaagcaccacc

SEQ ID NO: 1226031 - RNA, 21 nt, Human
cagaagcaccaccucaugccc

SEQ ID NO: 1226032 - RNA, 19 nt, Human
cagaauaaagagauccugg

SEQ ID NO: 1226033 - RNA, 22 nt, Human
cagcacuuugggaggccaaggc

SEQ ID NO: 1226034 - RNA, 24 nt, Human
cagcacuuugggaggccaaggcgg

SEQ ID NO: 1226035 - RNA, 22 nt, Human
cagccuggacgacagaaagaga

SEQ ID NO: 1226036 - RNA, 18 nt, Human
cauacacacagaaaagug

SEQ ID NO: 1226037 - RNA, 23 nt, Human
caucgugugaauauacccuaaug

SEQ ID NO: 1226038 - RNA, 20 nt, Human
caugccuguaaucccagcac

SEQ ID NO: 1226039 - RNA, 24 nt, Human
caugccuguaaucccagcacuuug

SEQ ID NO: 1226040 - RNA, 21 nt, Human
cccagaucaaaaguguacagc

SEQ ID NO: 1226041 - RNA, 23 nt, Human
ccccagaagcaccaccucaugcc

SEQ ID NO: 1226042 - RNA, 19 nt, Human
ccugcaaucccagcuccuc

SEQ ID NO: 1226043 - RNA, 20 nt, Human
ccugcaaucccagcuccucg

SEQ ID NO: 1226044 - RNA, 22 nt, Human
cgacagaaagagacucugucuc

SEQ ID NO: 1226045 - RNA, 25 nt, Human
cgccugcaaucccagcuccucguga

SEQ ID NO: 1226046 - RNA, 24 nt, Human
cggagacagcucagcgaguccaag

SEQ ID NO: 1226047 - RNA, 23 nt, Human
cggaucacuugaggucugggcuu

SEQ ID NO: 1226048 - RNA, 18 nt, Human
cgggcggaucacuugagg

SEQ ID NO: 1226049 - RNA, 24 nt, Human
cguggccaacauggugaaacuccg

SEQ ID NO: 1226050 - RNA, 19 nt, Human
cuacugcacuccagccugg

SEQ ID NO: 1226051 - RNA, 21 nt, Human
cuacugcacuccagccuggac

SEQ ID NO: 1226052 - RNA, 22 nt, Human
cucaaaaacaaaaacaaaaaca

SEQ ID NO: 1226053 - RNA, 25 nt, Human
cucaaagaauugacagaaaacuaga

SEQ ID NO: 1226054 - RNA, 23 nt, Human
cucaugccuguaaucccagcacu

SEQ ID NO: 1226055 - RNA, 24 nt, Human
cucaugccuguaaucccagcacuu

SEQ ID NO: 1226056 - RNA, 23 nt, Human
cuccucgugagguugaggcacaa

SEQ ID NO: 1226057 - RNA, 22 nt, Human
cugauaaugaaacuaagaauga

SEQ ID NO: 1226058 - RNA, 23 nt, Human
cugucucaaaaacaaaaacaaaa

SEQ ID NO: 1226059 - RNA, 27 nt, Human
cugucucaaaaacaaaaacaaaaacaa

SEQ ID NO: 1226060 - RNA, 19 nt, Human
cuucaagaccagcguggcc

SEQ ID NO: 1226061 - RNA, 21 nt, Human
cuuuaugacuugugcuucgcu

SEQ ID NO: 1226062 - RNA, 18 nt, Human
gaaagcagcauuuuucug

SEQ ID NO: 1226063 - RNA, 21 nt, Human
gaaagcagcauuuuucugacc

SEQ ID NO: 1226064 - RNA, 18 nt, Human
gaagagaggaggaaaagg

SEQ ID NO: 1226065 - RNA, 24 nt, Human
gacagaaagagacucugucucaaa

SEQ ID NO: 1226066 - RNA, 18 nt, Human
gagguugcagugagccaa

SEQ ID NO: 1226067 - RNA, 23 nt, Human
gaucacuugaggucugggcuuca

SEQ ID NO: 1226068 - RNA, 24 nt, Human
gaugcucucuguacggccccgcuu

SEQ ID NO: 1226069 - RNA, 24 nt, Human
gccaacauggugaaacuccgucuc

SEQ ID NO: 1226070 - RNA, 24 nt, Human
gcugaaucuggagggacggggcau

SEQ ID NO: 1226071 - RNA, 20 nt, Human
gcugauaaugaaacuaagaa

SEQ ID NO: 1226072 - RNA, 22 nt, Human
ggaagguaaggaagagaggagg

SEQ ID NO: 1226073 - RNA, 22 nt, Human
ggaggcagagguugcagugagc

SEQ ID NO: 1226074 - RNA, 25 nt, Human
ggcugaaucuggagggacggggcau

SEQ ID NO: 1226075 - RNA, 22 nt, Human
gggcgccugcaaucccagcucc

SEQ ID NO: 1226076 - RNA, 23 nt, Human
gggugugguggcgggcgccugca

SEQ ID NO: 1226077 - RNA, 23 nt, Human
gguggcucaugccuguaauccca

SEQ ID NO: 1226078 - RNA, 24 nt, Human
gguggcucaugccuguaaucccag

SEQ ID NO: 1226079 - RNA, 21 nt, Human
ggugugguggcgggcgccugc

SEQ ID NO: 1226080 - RNA, 21 nt, Human
gugaaacuccgucucuacuaa

SEQ ID NO: 1226081 - RNA, 18 nt, Human
gugaagcacagaauaaag

SEQ ID NO: 1226082 - RNA, 19 nt, Human
guggaagaggaaagcagca

SEQ ID NO: 1226083 - RNA, 19 nt, Human
guggccaacauggugaaac

SEQ ID NO: 1226084 - RNA, 22 nt, Human
uaacauacacacagaaaagugc

SEQ ID NO: 1226085 - RNA, 21 nt, Human
uacugcacuccagccuggacg

SEQ ID NO: 1226086 - RNA, 22 nt, Human
uacugcacuccagccuggacga

SEQ ID NO: 1226087 - RNA, 24 nt, Human
uacugcacuccagccuggacgaca

SEQ ID NO: 1226088 - RNA, 23 nt, Human
uagaagggaggucuguaggaaga

SEQ ID NO: 1226089 - RNA, 18 nt, Human
uaggaagauagguggagg

SEQ ID NO: 1226090 - RNA, 19 nt, Human
uaggaagauagguggaggc

SEQ ID NO: 1226091 - RNA, 25 nt, Human
uaggaagggugacccguccccaaau

SEQ ID NO: 1226092 - RNA, 21 nt, Human
ucaaaaacaaaaacaaaaaca

SEQ ID NO: 1226093 - RNA, 19 nt, Human
uccaaggaguggagcagaa

SEQ ID NO: 1226094 - RNA, 24 nt, Human
uccagccuggacgacagaaagaga

SEQ ID NO: 1226095 - RNA, 19 nt, Human
uccuauggugcauuuuugc

SEQ ID NO: 1226096 - RNA, 21 nt, Human
ucgcuucaucggguuaaugau

SEQ ID NO: 1226097 - RNA, 23 nt, Human
ucucacaggggaagguaaggaag

SEQ ID NO: 1226098 - RNA, 21 nt, Human
ucucuacuaaaaauacaaaaa

SEQ ID NO: 1226099 - RNA, 23 nt, Human
ugaaguauaacauacacacagaa

SEQ ID NO: 1226100 - RNA, 23 nt, Human
ugacauucccaggacgcugccau

SEQ ID NO: 1226101 - RNA, 22 nt, Human
ugagccaagauugcgcuacugc

SEQ ID NO: 1226102 - RNA, 24 nt, Human
ugaggcacaagaaucgcuugaacc

SEQ ID NO: 1226103 - RNA, 23 nt, Human
ugccuguaaucccagcacuuugg

SEQ ID NO: 1226104 - RNA, 24 nt, Human
ugccuguaaucccagcacuuuggg

SEQ ID NO: 1226105 - RNA, 21 nt, Human
uggagaguguuuuugugaaga

SEQ ID NO: 1226106 - RNA, 25 nt, Human
uggaugaauuuugcuggguuuuaaa

SEQ ID NO: 1226107 - RNA, 21 nt, Human
uggccaacauggugaaacucc

SEQ ID NO: 1226108 - RNA, 24 nt, Human
uggccaacauggugaaacuccguc

SEQ ID NO: 1226109 - RNA, 19 nt, Human
uggcucaaagaauugacag

SEQ ID NO: 1226110 - RNA, 24 nt, Human
uggcucaugccuguaaucccagca

SEQ ID NO: 1226111 - RNA, 24 nt, Human
ugggaggccaaggcgggcggauca

SEQ ID NO: 1226112 - RNA, 21 nt, Human
uggugaauacacuccaaguug

SEQ ID NO: 1226113 - RNA, 18 nt, Human
ugguggaagaggaaagca

SEQ ID NO: 1226114 - RNA, 22 nt, Human
ugugaauauacccuaaugugcu

SEQ ID NO: 1226115 - RNA, 19 nt, Human
ugugguggcgggcgccugc

SEQ ID NO: 1226116 - RNA, 18 nt, Human
uuagccgggugugguggc

SEQ ID NO: 1226117 - RNA, 22 nt, Human
uuagccgggugugguggcgggc

SEQ ID NO: 1226118 - RNA, 24 nt, Human
uuagccgggugugguggcgggcgc

SEQ ID NO: 1226119 - RNA, 18 nt, Human
uucacaaacggaaagcac

SEQ ID NO: 1226120 - RNA, 22 nt, Human
uucacaaacggaaagcacccag

SEQ ID NO: 1226121 - RNA, 18 nt, Human
uucaggaucacucuagga

SEQ ID NO: 1226122 - RNA, 27 nt, Human
uugagcaucuuaacaacacugguauua

SEQ ID NO: 1226123 - RNA, 22 nt, Human
uugcagugagccaagauugcgc

SEQ ID NO: 1226124 - RNA, 23 nt, Human
uugcgcuacugcacuccagccug

SEQ ID NO: 1226125 - RNA, 22 nt, Human
gccuguggccaccccggagaug

SEQ ID NO: 1226126 - RNA, 24 nt, Human
ugauuugggccaauuacaugacug

SEQ ID NO: 1226127 - RNA, 21 nt, Human
uggccaccccggagaugacac

SEQ ID NO: 1226128 - RNA, 25 nt, Human
uugccuguggccaccccggagauga

SEQ ID NO: 1226129 - RNA, 22 nt, Human
agcccaacccucacccggaaac

SEQ ID NO: 1226130 - RNA, 18 nt, Human
cccaacccucacccggaa

SEQ ID NO: 1226131 - RNA, 24 nt, Human
cggaguuuuaaugacacgggcugg

SEQ ID NO: 1226132 - RNA, 22 nt, Human
ucccacaugguaccaaggagcc

SEQ ID NO: 1226133 - RNA, 22 nt, Human
ugacacgggcuggaacugggaa

SEQ ID NO: 1226134 - RNA, 21 nt, Human
aaacaaacuugagaaauccau

SEQ ID NO: 1226135 - RNA, 20 nt, Human
aacccuacaugugcucugcu

SEQ ID NO: 1226136 - RNA, 22 nt, Human
accuuuuguccaggcuuuaaau

SEQ ID NO: 1226137 - RNA, 24 nt, Human
aggaacugacucauccucaugcug

SEQ ID NO: 1226138 - RNA, 19 nt, Human
auacccaugauaaugggaa

SEQ ID NO: 1226139 - RNA, 19 nt, Human
augauaaugggaaagaaug

SEQ ID NO: 1226140 - RNA, 22 nt, Human
auuaccacuuuuguucaguaua

SEQ ID NO: 1226141 - RNA, 23 nt, Human
cacuuuuguucaguauagcuuua

SEQ ID NO: 1226142 - RNA, 21 nt, Human
gcucugcugaagagaaaccua

SEQ ID NO: 1226143 - RNA, 19 nt, Human
guuucuuuguuggagggag

SEQ ID NO: 1226144 - RNA, 18 nt, Human
ucagaaaagauacccaug

SEQ ID NO: 1226145 - RNA, 20 nt, Human
ucaggaacugacucauccuc

SEQ ID NO: 1226146 - RNA, 21 nt, Human
ucagugcuguauauuucuuuc

SEQ ID NO: 1226147 - RNA, 23 nt, Human
ugaagagaaaccuaaauaaauca

SEQ ID NO: 1226148 - RNA, 23 nt, Human
ugcauuguugcuggugaagaccu

SEQ ID NO: 1226149 - RNA, 22 nt, Human
ugucaugguccaccuuuugucc

SEQ ID NO: 1226150 - RNA, 21 nt, Human
uucugcauuguugcuggugaa

SEQ ID NO: 1226151 - RNA, 22 nt, Human
uugccucuaugccaccauuuug

SEQ ID NO: 1226152 - RNA, 24 nt, Human
uugggaucugugguaacucuucuc

SEQ ID NO: 1226153 - RNA, 21 nt, Human
uuucuguuucuuuguuggagg

SEQ ID NO: 1226154 - RNA, 23 nt, Human
uuucuuucuguuucuuuguugga

SEQ ID NO: 1226155 - RNA, 19 nt, Human
uuuggaacaggaaacuccu

SEQ ID NO: 1226156 - RNA, 20 nt, Human
uuuggaacaggaaacuccuu

SEQ ID NO: 1226157 - RNA, 20 nt, Human
aaccccuugcuuuuucucau

SEQ ID NO: 1226158 - RNA, 20 nt, Human
aagagggauggugaugaggu

SEQ ID NO: 1226159 - RNA, 21 nt, Human
acccggccccagccuagcccu

SEQ ID NO: 1226160 - RNA, 21 nt, Human
accgcgaacccggccccagcc

SEQ ID NO: 1226161 - RNA, 24 nt, Human
agaauucaggggccaccuggacaa

SEQ ID NO: 1226162 - RNA, 21 nt, Human
agaguggugaggaggggcugg

SEQ ID NO: 1226163 - RNA, 19 nt, Human
agggaggaaaggaauggug

SEQ ID NO: 1226164 - RNA, 23 nt, Human
augguggugggggauggggcccc

SEQ ID NO: 1226165 - RNA, 22 nt, Human
caacaggcucugaccuccagac

SEQ ID NO: 1226166 - RNA, 21 nt, Human
caccgcgaacccggccccagc

SEQ ID NO: 1226167 - RNA, 21 nt, Human
ccaccuggacaaaccccuugc

SEQ ID NO: 1226168 - RNA, 25 nt, Human
ccaggcccaucccuugguccccugg

SEQ ID NO: 1226169 - RNA, 18 nt, Human
ccagggggaagggaggaa

SEQ ID NO: 1226170 - RNA, 21 nt, Human
cccaccccuaggcauccggaa

SEQ ID NO: 1226171 - RNA, 19 nt, Human
cccagccuagcccugaccu

SEQ ID NO: 1226172 - RNA, 24 nt, Human
cccagccuagcccugaccuguugc

SEQ ID NO: 1226173 - RNA, 22 nt, Human
cccaucccuugcgcagaauuca

SEQ ID NO: 1226174 - RNA, 20 nt, Human
ccccagccuagcccugaccu

SEQ ID NO: 1226175 - RNA, 23 nt, Human
cccggccccagccuagcccugac

SEQ ID NO: 1226176 - RNA, 23 nt, Human
cccgucccucccugccacccucc

SEQ ID NO: 1226177 - RNA, 22 nt, Human
cccuaggcauccggaaaagccc

SEQ ID NO: 1226178 - RNA, 19 nt, Human
cccucccugccacccuccc

SEQ ID NO: 1226179 - RNA, 20 nt, Human
cccucccugccacccuccca

SEQ ID NO: 1226180 - RNA, 18 nt, Human
ccgccgcggccucggccc

SEQ ID NO: 1226181 - RNA, 26 nt, Human
ccgccgcggccucggcccggcuccuc

SEQ ID NO: 1226182 - RNA, 24 nt, Human
ccggccccagccuagcccugaccu

SEQ ID NO: 1226183 - RNA, 24 nt, Human
ccucccugccacccucccaguacc

SEQ ID NO: 1226184 - RNA, 22 nt, Human
cuagcccugaccuguugcgcgc

SEQ ID NO: 1226185 - RNA, 19 nt, Human
cuccagccguagccaccgc

SEQ ID NO: 1226186 - RNA, 22 nt, Human
cuccccucuaccccugcuuucc

SEQ ID NO: 1226187 - RNA, 23 nt, Human
cucuccuccacugcaaggggaag

SEQ ID NO: 1226188 - RNA, 22 nt, Human
cuucauucaugcuagaaagagg

SEQ ID NO: 1226189 - RNA, 22 nt, Human
gagaguagagucucuaccugcc

SEQ ID NO: 1226190 - RNA, 23 nt, Human
gcccaccccuaggcauccggaaa

SEQ ID NO: 1226191 - RNA, 18 nt, Human
ggaaugguggugggggau

SEQ ID NO: 1226192 - RNA, 19 nt, Human
ggauggggccaagaagagg

SEQ ID NO: 1226193 - RNA, 20 nt, Human
gggaagaguggugaggaggg

SEQ ID NO: 1226194 - RNA, 19 nt, Human
gggacagagaguagagucu

SEQ ID NO: 1226195 - RNA, 22 nt, Human
gggcuccccucuaccccugcuu

SEQ ID NO: 1226196 - RNA, 21 nt, Human
ggggauggggccaagaagagg

SEQ ID NO: 1226197 - RNA, 18 nt, Human
gggggauggggccaagaa

SEQ ID NO: 1226198 - RNA, 19 nt, Human
uaaaaaauaguauccacuc

SEQ ID NO: 1226199 - RNA, 21 nt, Human
uaccugccagggggaagggag

SEQ ID NO: 1226200 - RNA, 18 nt, Human
uaggcauccggaaaagcc

SEQ ID NO: 1226201 - RNA, 22 nt, Human
uccacucuggcucucuccucca

SEQ ID NO: 1226202 - RNA, 21 nt, Human
uccacugcaaggggaagagug

SEQ ID NO: 1226203 - RNA, 19 nt, Human
uccagacagacgguucaaa

SEQ ID NO: 1226204 - RNA, 24 nt, Human
uccagggcuccccucuaccccugc

SEQ ID NO: 1226205 - RNA, 19 nt, Human
ucccucccugccacccucc

SEQ ID NO: 1226206 - RNA, 19 nt, Human
ucccuugcgcagaauucag

SEQ ID NO: 1226207 - RNA, 23 nt, Human
uccuuccccgucccucccugcca

SEQ ID NO: 1226208 - RNA, 22 nt, Human
ucggcccggcuccuccagccgu

SEQ ID NO: 1226209 - RNA, 21 nt, Human
ugaccuccagacagacgguuc

SEQ ID NO: 1226210 - RNA, 22 nt, Human
ugaggaggggcuggcacugccc

SEQ ID NO: 1226211 - RNA, 19 nt, Human
ugccagggggaagggagga

SEQ ID NO: 1226212 - RNA, 20 nt, Human
ugcgcagaauucaggggcca

SEQ ID NO: 1226213 - RNA, 22 nt, Human
uggggacagagaguagagucuc

SEQ ID NO: 1226214 - RNA, 22 nt, Human
uggugggggauggggccaagaa

SEQ ID NO: 1226215 - RNA, 19 nt, Human
ugguggugggggauggggc

SEQ ID NO: 1226216 - RNA, 20 nt, Human
ugguggugggggauggggcc

SEQ ID NO: 1226217 - RNA, 21 nt, Human
ugguggugggggauggggcca

SEQ ID NO: 1226218 - RNA, 20 nt, Human
uugcgcgcgggggccgccgg

SEQ ID NO: 1226219 - RNA, 21 nt, Human
uuggcauccuucauucaugcu

SEQ ID NO: 1226220 - RNA, 19 nt, Human
aaaaaccugaaacgucaac

SEQ ID NO: 1226221 - RNA, 20 nt, Human
aaacagcccugauggagccc

SEQ ID NO: 1226222 - RNA, 22 nt, Human
aaacagcccugauggagcccca

SEQ ID NO: 1226223 - RNA, 21 nt, Human
aagaaaagaaauguuuaaugu

SEQ ID NO: 1226224 - RNA, 21 nt, Human
aagaagaacagaaggcggaga

SEQ ID NO: 1226225 - RNA, 18 nt, Human
aaguaucucuuuuaaucc

SEQ ID NO: 1226226 - RNA, 18 nt, Human
acagggacccaaaagcuu

SEQ ID NO: 1226227 - RNA, 22 nt, Human
acccagguauccaaacagcccu

SEQ ID NO: 1226228 - RNA, 20 nt, Human
accuggggagaagaaggccc

SEQ ID NO: 1226229 - RNA, 24 nt, Human
agaaggcggagacuuggcagagag

SEQ ID NO: 1226230 - RNA, 22 nt, Human
agaucagcauuuccaacaagcu

SEQ ID NO: 1226231 - RNA, 24 nt, Human
agcacagugcccuucagaccgccc

SEQ ID NO: 1226232 - RNA, 18 nt, Human
agcauuuggagcugguuu

SEQ ID NO: 1226233 - RNA, 19 nt, Human
agccaggugagcauuugga

SEQ ID NO: 1226234 - RNA, 19 nt, Human
agcccaugcguccugggca

SEQ ID NO: 1226235 - RNA, 20 nt, Human
agcccgaguguggucuuggu

SEQ ID NO: 1226236 - RNA, 21 nt, Human
agcugguuucucaacaugagg

SEQ ID NO: 1226237 - RNA, 24 nt, Human
aggcagcaacagcaacgugcccag

SEQ ID NO: 1226238 - RNA, 20 nt, Human
aggcaguuauucccacagag

SEQ ID NO: 1226239 - RNA, 21 nt, Human
aggccagcaggccugaggcaa

SEQ ID NO: 1226240 - RNA, 23 nt, Human
aggccagcaggccugaggcaaca

SEQ ID NO: 1226241 - RNA, 21 nt, Human
aggcggagacuuggcagagag

SEQ ID NO: 1226242 - RNA, 18 nt, Human
aggcuuugcacaaguauc

SEQ ID NO: 1226243 - RNA, 25 nt, Human
aggggccagcuccagaacagugacc

SEQ ID NO: 1226244 - RNA, 18 nt, Human
auugccuucugcccuggg

SEQ ID NO: 1226245 - RNA, 23 nt, Human
auuucuaguggugggacgcccca

SEQ ID NO: 1226246 - RNA, 19 nt, Human
caacaugaggauggguugg

SEQ ID NO: 1226247 - RNA, 23 nt, Human
caacuugucagaaauggcacuua

SEQ ID NO: 1226248 - RNA, 22 nt, Human
caagaagaacagaaggcggaga

SEQ ID NO: 1226249 - RNA, 19 nt, Human
caagagccuccaacagggc

SEQ ID NO: 1226250 - RNA, 21 nt, Human
caagauucacaacagguguca

SEQ ID NO: 1226251 - RNA, 21 nt, Human
cacaguaucagauugagugag

SEQ ID NO: 1226252 - RNA, 23 nt, Human
cacagugcccuucagaccgcccc

SEQ ID NO: 1226253 - RNA, 22 nt, Human
cacccaugaggcuccccauccc

SEQ ID NO: 1226254 - RNA, 23 nt, Human
cacccaugaggcuccccaucccu

SEQ ID NO: 1226255 - RNA, 25 nt, Human
cacucaaaaugcaauucaggugcac

SEQ ID NO: 1226256 - RNA, 19 nt, Human
cacuuccacucugcuuuuc

SEQ ID NO: 1226257 - RNA, 21 nt, Human
cagaaggcggagacuuggcag

SEQ ID NO: 1226258 - RNA, 19 nt, Human
cagaccccaggcugcagag

SEQ ID NO: 1226259 - RNA, 21 nt, Human
cagcaacagcaacgugcccag

SEQ ID NO: 1226260 - RNA, 23 nt, Human
cagcuuucugacccccaggagcc

SEQ ID NO: 1226261 - RNA, 20 nt, Human
caggaagauuuggccagagg

SEQ ID NO: 1226262 - RNA, 20 nt, Human
cagggacccaaaagcuugac

SEQ ID NO: 1226263 - RNA, 24 nt, Human
caucccugacagccaggugagcau

SEQ ID NO: 1226264 - RNA, 18 nt, Human
caugcguccugggcacca

SEQ ID NO: 1226265 - RNA, 18 nt, Human
cauugccuucugcccugg

SEQ ID NO: 1226266 - RNA, 29 nt, Human
ccaaaauguucacagcaggaggccagcaa

SEQ ID NO: 1226267 - RNA, 20 nt, Human
ccaaacagcccugauggagc

SEQ ID NO: 1226268 - RNA, 26 nt, Human
ccaaaccaggcugugugcuucucaug

SEQ ID NO: 1226269 - RNA, 24 nt, Human
ccacaggucucucccaagccacau

SEQ ID NO: 1226270 - RNA, 19 nt, Human
ccagaugacagccacguga

SEQ ID NO: 1226271 - RNA, 24 nt, Human
ccaggugcugcugccgguccaggg

SEQ ID NO: 1226272 - RNA, 18 nt, Human
cccaugcguccugggcac

SEQ ID NO: 1226273 - RNA, 25 nt, Human
ccccaggagccucugcgaggccccu

SEQ ID NO: 1226274 - RNA, 20 nt, Human
ccccagguggugaaucucug

SEQ ID NO: 1226275 - RNA, 24 nt, Human
ccccauggccucggaucaccuggu

SEQ ID NO: 1226276 - RNA, 23 nt, Human
cccggccagcguggagggcccca

SEQ ID NO: 1226277 - RNA, 21 nt, Human
cccucuucccaucagagccca

SEQ ID NO: 1226278 - RNA, 20 nt, Human
cgaggcuccggagggcucuu

SEQ ID NO: 1226279 - RNA, 24 nt, Human
cucagaaaggagaggugagaccuc

SEQ ID NO: 1226280 - RNA, 24 nt, Human
cuccaggggcauccaggccccucu

SEQ ID NO: 1226281 - RNA, 19 nt, Human
cucccaagccacauccagc

SEQ ID NO: 1226282 - RNA, 22 nt, Human
cucccucuucccaucagagccc

SEQ ID NO: 1226283 - RNA, 21 nt, Human
cucuacacagcccggccagcg

SEQ ID NO: 1226284 - RNA, 23 nt, Human
cucucccaagccacauccagccu

SEQ ID NO: 1226285 - RNA, 19 nt, Human
cugacccccaggagccucu

SEQ ID NO: 1226286 - RNA, 25 nt, Human
cugggccccagguggugaaucucug

SEQ ID NO: 1226287 - RNA, 19 nt, Human
cuucaaggucggcaagaag

SEQ ID NO: 1226288 - RNA, 20 nt, Human
cuuuuaauccuaaaaccauc

SEQ ID NO: 1226289 - RNA, 19 nt, Human
gaccuggggagaagaaggc

SEQ ID NO: 1226290 - RNA, 18 nt, Human
gagccuccaacagggcuc

SEQ ID NO: 1226291 - RNA, 25 nt, Human
gaugauuugaaaccaacguucaccc

SEQ ID NO: 1226292 - RNA, 25 nt, Human
gcacuuacaucuucaggaccuuugg

SEQ ID NO: 1226293 - RNA, 25 nt, Human
gcagaacaggaagauuuggccagag

SEQ ID NO: 1226294 - RNA, 19 nt, Human
gccacauccagccuggaug

SEQ ID NO: 1226295 - RNA, 20 nt, Human
gccuccuaagggcacacuuc

SEQ ID NO: 1226296 - RNA, 23 nt, Human
gccuucugcccugggaacuugca

SEQ ID NO: 1226297 - RNA, 25 nt, Human
gcguccugggcaccaccacuuccac

SEQ ID NO: 1226298 - RNA, 23 nt, Human
gcuacagaggggccagcuccaga

SEQ ID NO: 1226299 - RNA, 19 nt, Human
gcucaggcccaccucccuc

SEQ ID NO: 1226300 - RNA, 20 nt, Human
gcuggacgcgcugcccauug

SEQ ID NO: 1226301 - RNA, 22 nt, Human
gcuugugccuguggguggagaa

SEQ ID NO: 1226302 - RNA, 22 nt, Human
ggaaccaugaugcucgaccucc

SEQ ID NO: 1226303 - RNA, 19 nt, Human
ggaauucuggagucccacc

SEQ ID NO: 1226304 - RNA, 24 nt, Human
ggacuggauuucuaguggugggac

SEQ ID NO: 1226305 - RNA, 23 nt, Human
ggagacaaguggacaauuggggg

SEQ ID NO: 1226306 - RNA, 31 nt, Human
ggagugucuggaaaagucccugugggggcaa

SEQ ID NO: 1226307 - RNA, 21 nt, Human
ggcaacacgggcaaccgcgaa

SEQ ID NO: 1226308 - RNA, 21 nt, Human
gggcaaccgcgaaugccucuu

SEQ ID NO: 1226309 - RNA, 20 nt, Human
ggggagaagccacacaacaa

SEQ ID NO: 1226310 - RNA, 20 nt, Human
ggggagguauuuugggagug

SEQ ID NO: 1226311 - RNA, 19 nt, Human
ggggcaggaacccagcugg

SEQ ID NO: 1226312 - RNA, 19 nt, Human
uaacaaccuccacaguauc

SEQ ID NO: 1226313 - RNA, 23 nt, Human
uagcaggcagcaucacucaaaau

SEQ ID NO: 1226314 - RNA, 22 nt, Human
uauccaaacagcccugauggag

SEQ ID NO: 1226315 - RNA, 19 nt, Human
ucagaccccaggcugcaga

SEQ ID NO: 1226316 - RNA, 20 nt, Human
ucccugcagggcaauguggg

SEQ ID NO: 1226317 - RNA, 23 nt, Human
uccuagcaaagcccuaaccacac

SEQ ID NO: 1226318 - RNA, 23 nt, Human
uccugggccccagguggugaauc

SEQ ID NO: 1226319 - RNA, 20 nt, Human
uccuguccaagcagcccgag

SEQ ID NO: 1226320 - RNA, 21 nt, Human
uccuuggcugagccggaccuu

SEQ ID NO: 1226321 - RNA, 22 nt, Human
ucucuggcauguggcuuggcuu

SEQ ID NO: 1226322 - RNA, 22 nt, Human
ucugaccuggggagaagaaggc

SEQ ID NO: 1226323 - RNA, 20 nt, Human
ucugcuuacacaucggguua

SEQ ID NO: 1226324 - RNA, 19 nt, Human
ucugugggcuccacccagg

SEQ ID NO: 1226325 - RNA, 22 nt, Human
ugaaaaccaguuugacucaagc

SEQ ID NO: 1226326 - RNA, 25 nt, Human
ugaaaccaacguucacccaacuugu

SEQ ID NO: 1226327 - RNA, 21 nt, Human
ugaccagcuacauccugucca

SEQ ID NO: 1226328 - RNA, 20 nt, Human
ugaccucaguguucccucca

SEQ ID NO: 1226329 - RNA, 23 nt, Human
ugagcacagccuugaaaaccagu

SEQ ID NO: 1226330 - RNA, 18 nt, Human
ugauccugggccccaggu

SEQ ID NO: 1226331 - RNA, 22 nt, Human
ugaugagagucggugagugaag

SEQ ID NO: 1226332 - RNA, 18 nt, Human
ugcagggcaaugugggca

SEQ ID NO: 1226333 - RNA, 20 nt, Human
ugcagggcaaugugggcauc

SEQ ID NO: 1226334 - RNA, 19 nt, Human
ugcaggugcagaugcggga

SEQ ID NO: 1226335 - RNA, 23 nt, Human
ugccaagagccuccaacagggcu

SEQ ID NO: 1226336 - RNA, 24 nt, Human
ugccaagagccuccaacagggcuc

SEQ ID NO: 1226337 - RNA, 21 nt, Human
ugccaucacaacccucuuuca

SEQ ID NO: 1226338 - RNA, 19 nt, Human
uggacaccugacaaguccu

SEQ ID NO: 1226339 - RNA, 22 nt, Human
uggagacaaguggacaauuggg

SEQ ID NO: 1226340 - RNA, 22 nt, Human
uggagacaaguggacaauuggg

SEQ ID NO: 1226341 - RNA, 26 nt, Human
uggcagaacaggaagauuuggccaga

SEQ ID NO: 1226342 - RNA, 20 nt, Human
uggccagaggugaccucagu

SEQ ID NO: 1226343 - RNA, 21 nt, Human
uggcgcacagaugggccuucc

SEQ ID NO: 1226344 - RNA, 20 nt, Human
uggcugagccggaccuuucu

SEQ ID NO: 1226345 - RNA, 19 nt, Human
uggggcaggaacccagcug

SEQ ID NO: 1226346 - RNA, 19 nt, Human
uggggcaggaacccagcug

SEQ ID NO: 1226347 - RNA, 21 nt, Human
uggguggagaaggcaccugcc

SEQ ID NO: 1226348 - RNA, 21 nt, Human
ugguguucccccuaaugacau

SEQ ID NO: 1226349 - RNA, 22 nt, Human
ugucacaggcuacagaggggcc

SEQ ID NO: 1226350 - RNA, 22 nt, Human
ugucacaggcuacagaggggcc

SEQ ID NO: 1226351 - RNA, 20 nt, Human
ugucuggaaaagucccugug

SEQ ID NO: 1226352 - RNA, 23 nt, Human
ugucuggaaaagucccugugggg

SEQ ID NO: 1226353 - RNA, 24 nt, Human
uguggguggagaaggcaccugccu

SEQ ID NO: 1226354 - RNA, 21 nt, Human
uugaccagaugacagccacgu

SEQ ID NO: 1226355 - RNA, 25 nt, Human
uugcacaaguaucucuuuuaauccu

SEQ ID NO: 1226356 - RNA, 18 nt, Human
uugcucaugucggcaggg

SEQ ID NO: 1226357 - RNA, 19 nt, Human
uugucagaaauggcacuua

SEQ ID NO: 1226358 - RNA, 21 nt, Human
uuugacucaagccuucgggcc

SEQ ID NO: 1226359 - RNA, 21 nt, Human
uuuggagcugguuucucaaca

SEQ ID NO: 1226360 - RNA, 22 nt, Human
uuugggagugcaggugcagaug

SEQ ID NO: 1226361 - RNA, 24 nt, Human
uuugggagugcaggugcagaugcg

SEQ ID NO: 1226362 - RNA, 20 nt, Human
aaaccagggcucccacccag

SEQ ID NO: 1226363 - RNA, 19 nt, Human
aagcaagcacagugaaaca

SEQ ID NO: 1226364 - RNA, 20 nt, Human
aagccagugggugaacagga

SEQ ID NO: 1226365 - RNA, 18 nt, Human
aaguccagggagaaaaca

SEQ ID NO: 1226366 - RNA, 22 nt, Human
acaacucccaaagcccgagccc

SEQ ID NO: 1226367 - RNA, 26 nt, Human
acagcaagucacucucacugcaaaca

SEQ ID NO: 1226368 - RNA, 23 nt, Human
acaggcuaugccaaaacccagca

SEQ ID NO: 1226369 - RNA, 20 nt, Human
acagugaaacaacucccaaa

SEQ ID NO: 1226370 - RNA, 24 nt, Human
acagugaaacaacucccaaagccc

SEQ ID NO: 1226371 - RNA, 26 nt, Human
acaugcuggaagcaagcacagugaaa

SEQ ID NO: 1226372 - RNA, 24 nt, Human
acccugagacaugcuggaagcaag

SEQ ID NO: 1226373 - RNA, 18 nt, Human
accuaguggcucaucccu

SEQ ID NO: 1226374 - RNA, 18 nt, Human
agacaccgucccguccuc

SEQ ID NO: 1226375 - RNA, 18 nt, Human
aggcagaacucugcccug

SEQ ID NO: 1226376 - RNA, 22 nt, Human
aggcccggaagcugccagugcu

SEQ ID NO: 1226377 - RNA, 21 nt, Human
agggcucugaggaggaacaga

SEQ ID NO: 1226378 - RNA, 21 nt, Human
caaaacccagcacacacaggc

SEQ ID NO: 1226379 - RNA, 20 nt, Human
cacacacaggcagaacucug

SEQ ID NO: 1226380 - RNA, 24 nt, Human
cacacggugggcuccucuggggcc

SEQ ID NO: 1226381 - RNA, 23 nt, Human
cacagccuuccacaagccuccag

SEQ ID NO: 1226382 - RNA, 25 nt, Human
cacccugagacaugcuggaagcaag

SEQ ID NO: 1226383 - RNA, 19 nt, Human
cagacccuggacaccaccc

SEQ ID NO: 1226384 - RNA, 20 nt, Human
cagacccuggacaccacccc

SEQ ID NO: 1226385 - RNA, 18 nt, Human
cagagguggggaaacaug

SEQ ID NO: 1226386 - RNA, 18 nt, Human
cagcacacacaggcagaa

SEQ ID NO: 1226387 - RNA, 21 nt, Human
cagccugcagacccuggacac

SEQ ID NO: 1226388 - RNA, 31 nt, Human
ccaaagcccgagccccagccugcagacccuu

SEQ ID NO: 1226389 - RNA, 21 nt, Human
ccagaccccucuagaccacgc

SEQ ID NO: 1226390 - RNA, 24 nt, Human
ccagcaugggauaccuaguggcuc

SEQ ID NO: 1226391 - RNA, 24 nt, Human
ccaggccccagccuccccaucagc

SEQ ID NO: 1226392 - RNA, 20 nt, Human
cccaaagcccgagccccagc

SEQ ID NO: 1226393 - RNA, 21 nt, Human
cccaccccacgcuccuggagg

SEQ ID NO: 1226394 - RNA, 21 nt, Human
cccagacaacccuguguggag

SEQ ID NO: 1226395 - RNA, 19 nt, Human
ccccaccccacgcuccugg

SEQ ID NO: 1226396 - RNA, 21 nt, Human
ccccacgcuccuggagggcuc

SEQ ID NO: 1226397 - RNA, 23 nt, Human
ccccaggccccagccuccccauc

SEQ ID NO: 1226398 - RNA, 19 nt, Human
ccccgugacugacagcaag

SEQ ID NO: 1226399 - RNA, 23 nt, Human
cccgagccccagccugcagaccc

SEQ ID NO: 1226400 - RNA, 21 nt, Human
cccugcgcuggcccccacccc

SEQ ID NO: 1226401 - RNA, 19 nt, Human
ccgagccccagccugcaga

SEQ ID NO: 1226402 - RNA, 18 nt, Human
ccgucccguccucccaga

SEQ ID NO: 1226403 - RNA, 25 nt, Human
ccgucccguccucccagacaacccu

SEQ ID NO: 1226404 - RNA, 21 nt, Human
ccucuagaccacgcauagccc

SEQ ID NO: 1226405 - RNA, 20 nt, Human
ccugagcccugcgcuggccc

SEQ ID NO: 1226406 - RNA, 22 nt, Human
ccugcagacccuggacaccacc

SEQ ID NO: 1226407 - RNA, 21 nt, Human
ccugcgcuggcccccaccccc

SEQ ID NO: 1226408 - RNA, 19 nt, Human
cgcuggcccccaccccacg

SEQ ID NO: 1226409 - RNA, 25 nt, Human
cgucccguccucccagacaacccug

SEQ ID NO: 1226410 - RNA, 22 nt, Human
cucacucuuuaauagaugcccu

SEQ ID NO: 1226411 - RNA, 24 nt, Human
cucuagaccacgcauagccccacc

SEQ ID NO: 1226412 - RNA, 28 nt, Human
cucuagaccacgcauagccccacccuga

SEQ ID NO: 1226413 - RNA, 18 nt, Human
cucugcccugcuggcucc

SEQ ID NO: 1226414 - RNA, 27 nt, Human
cuggagcccagcacucacacggugggc

SEQ ID NO: 1226415 - RNA, 20 nt, Human
cuggggccacaggaagucca

SEQ ID NO: 1226416 - RNA, 22 nt, Human
gaaacaacucccaaagcccgag

SEQ ID NO: 1226417 - RNA, 27 nt, Human
gacagcaagucacucucacugcaaaca

SEQ ID NO: 1226418 - RNA, 28 nt, Human
gacagcaagucacucucacugcaaacac

SEQ ID NO: 1226419 - RNA, 20 nt, Human
gccccagaccccucuagacc

SEQ ID NO: 1226420 - RNA, 20 nt, Human
gccugcagacccuggacacc

SEQ ID NO: 1226421 - RNA, 24 nt, Human
gcucugaggaggaacagagguggg

SEQ ID NO: 1226422 - RNA, 24 nt, Human
ggaaacaugggagaugggcacagc

SEQ ID NO: 1226423 - RNA, 20 nt, Human
ggaagacccuggacagaggc

SEQ ID NO: 1226424 - RNA, 21 nt, Human
ggacagaggccaaaggcccca

SEQ ID NO: 1226425 - RNA, 23 nt, Human
ggaggaacagagguggggaaaca

SEQ ID NO: 1226426 - RNA, 24 nt, Human
ggccacaggaaguccagggagaaa

SEQ ID NO: 1226427 - RNA, 19 nt, Human
ggcccggaagcugccagug

SEQ ID NO: 1226428 - RNA, 19 nt, Human
gggaagccagugggugaac

SEQ ID NO: 1226429 - RNA, 22 nt, Human
ggggccaggcagggcaccuaca

SEQ ID NO: 1226430 - RNA, 24 nt, Human
guggggccaggcagggcaccuaca

SEQ ID NO: 1226431 - RNA, 19 nt, Human
gugggugaacaggaggcug

SEQ ID NO: 1226432 - RNA, 18 nt, Human
ucaucccugugugcuucu

SEQ ID NO: 1226433 - RNA, 19 nt, Human
ucccaaagcccgagcccca

SEQ ID NO: 1226434 - RNA, 23 nt, Human
ucccagacaacccuguguggagc

SEQ ID NO: 1226435 - RNA, 26 nt, Human
ucccugugugcuucucgauguguaga

SEQ ID NO: 1226436 - RNA, 21 nt, Human
uccugagcccugcgcuggccc

SEQ ID NO: 1226437 - RNA, 23 nt, Human
ucugaggaggaacagaggugggg

SEQ ID NO: 1226438 - RNA, 22 nt, Human
ugaaacaacucccaaagcccga

SEQ ID NO: 1226439 - RNA, 18 nt, Human
ugacugacagcaagucac

SEQ ID NO: 1226440 - RNA, 22 nt, Human
ugcaaacacaggcuaugccaaa

SEQ ID NO: 1226441 - RNA, 20 nt, Human
ugccagugcuggccagagac

SEQ ID NO: 1226442 - RNA, 21 nt, Human
ugccccagaccccucuagacc

SEQ ID NO: 1226443 - RNA, 23 nt, Human
ugccccagaccccucuagaccac

SEQ ID NO: 1226444 - RNA, 18 nt, Human
ugccuggggccccugagc

SEQ ID NO: 1226445 - RNA, 22 nt, Human
uggaagcaagcacagugaaaca

SEQ ID NO: 1226446 - RNA, 18 nt, Human
uggacagaggccaaaggc

SEQ ID NO: 1226447 - RNA, 20 nt, Human
uggacagaggccaaaggccc

SEQ ID NO: 1226448 - RNA, 22 nt, Human
uggacagaggccaaaggcccca

SEQ ID NO: 1226449 - RNA, 24 nt, Human
uggacagaggccaaaggccccagg

SEQ ID NO: 1226450 - RNA, 22 nt, Human
ugggagaugggcacagccuucc

SEQ ID NO: 1226451 - RNA, 18 nt, Human
ugggcuccucuggggcca

SEQ ID NO: 1226452 - RNA, 20 nt, Human
uggggccaggcagggcaccu

SEQ ID NO: 1226453 - RNA, 19 nt, Human
uggggccccugagcauggg

SEQ ID NO: 1226454 - RNA, 22 nt, Human
aaacuggcagcgggacucccca

SEQ ID NO: 1226455 - RNA, 19 nt, Human
aagcagagggagcaaagca

SEQ ID NO: 1226456 - RNA, 20 nt, Human
aagcagagggagcaaagcag

SEQ ID NO: 1226457 - RNA, 18 nt, Human
acacagguccaccagggc

SEQ ID NO: 1226458 - RNA, 23 nt, Human
acagcgccugaagcagagggagc

SEQ ID NO: 1226459 - RNA, 25 nt, Human
acccuauuggccaggcugaucucga

SEQ ID NO: 1226460 - RNA, 24 nt, Human
acggaguuucacccuauuggccag

SEQ ID NO: 1226461 - RNA, 23 nt, Human
acgugggccaggagggaggggca

SEQ ID NO: 1226462 - RNA, 19 nt, Human
agaccagggccuccucgcg

SEQ ID NO: 1226463 - RNA, 18 nt, Human
agcacaggggccuuggga

SEQ ID NO: 1226464 - RNA, 21 nt, Human
agcacaggggccuugggaagg

SEQ ID NO: 1226465 - RNA, 21 nt, Human
agcaggguggacccuggaggc

SEQ ID NO: 1226466 - RNA, 18 nt, Human
agccugcccaggagcucu

SEQ ID NO: 1226467 - RNA, 20 nt, Human
agcugccugcccugccgagc

SEQ ID NO: 1226468 - RNA, 22 nt, Human
aggaggcuggccggcccggggc

SEQ ID NO: 1226469 - RNA, 22 nt, Human
aggcaggaggcuggccggcccg

SEQ ID NO: 1226470 - RNA, 25 nt, Human
aggcaggaggcuggccggcccgggg

SEQ ID NO: 1226471 - RNA, 19 nt, Human
aggcgcuggagguugugcu

SEQ ID NO: 1226472 - RNA, 22 nt, Human
aggcuccugagcucacgggucc

SEQ ID NO: 1226473 - RNA, 28 nt, Human
aggggcaggcuccgugcuccccaagggg

SEQ ID NO: 1226474 - RNA, 21 nt, Human
aggggccuugggaaggugggc

SEQ ID NO: 1226475 - RNA, 18 nt, Human
cacagccgggccagggac

SEQ ID NO: 1226476 - RNA, 24 nt, Human
caccagggcacacagccgggccag

SEQ ID NO: 1226477 - RNA, 22 nt, Human
caccuccgccuucagccauagg

SEQ ID NO: 1226478 - RNA, 19 nt, Human
cacugccccuggggguccc

SEQ ID NO: 1226479 - RNA, 23 nt, Human
cagcgggagcagcccagacacag

SEQ ID NO: 1226480 - RNA, 20 nt, Human
caggguggacccuggaggcg

SEQ ID NO: 1226481 - RNA, 25 nt, Human
caguagagacggaguuucacccuau

SEQ ID NO: 1226482 - RNA, 22 nt, Human
ccacgccccacaaaccugcagu

SEQ ID NO: 1226483 - RNA, 20 nt, Human
ccacgccccacaaaccugcg

SEQ ID NO: 1226484 - RNA, 20 nt, Human
ccacgcgccagaccuugcuc

SEQ ID NO: 1226485 - RNA, 20 nt, Human
ccagcacggcugcccacgcc

SEQ ID NO: 1226486 - RNA, 21 nt, Human
cccacaaaccugcaguaggca

SEQ ID NO: 1226487 - RNA, 22 nt, Human
ccccacgccagcacggcugccc

SEQ ID NO: 1226488 - RNA, 21 nt, Human
ccccgcugcccugcaccuccg

SEQ ID NO: 1226489 - RNA, 22 nt, Human
cccugccgagccugcccaggag

SEQ ID NO: 1226490 - RNA, 18 nt, Human
cccugggccccgcugccc

SEQ ID NO: 1226491 - RNA, 24 nt, Human
ccgcccggccugccccucccuggg

SEQ ID NO: 1226492 - RNA, 24 nt, Human
ccucgcgacugcgggcaaagguug

SEQ ID NO: 1226493 - RNA, 22 nt, Human
ccugcaccuccgccuucagcca

SEQ ID NO: 1226494 - RNA, 26 nt, Human
ccugcccugccgagccugcccaggag

SEQ ID NO: 1226495 - RNA, 23 nt, Human
cgccagaccuugcucuugguggc

SEQ ID NO: 1226496 - RNA, 22 nt, Human
cgccagcacggcugcccacgcc

SEQ ID NO: 1226497 - RNA, 24 nt, Human
cggaguuucacccuauuggccagg

SEQ ID NO: 1226498 - RNA, 19 nt, Human
cggcugcccacgccccaca

SEQ ID NO: 1226499 - RNA, 18 nt, Human
cggggcuguugggcagca

SEQ ID NO: 1226500 - RNA, 23 nt, Human
cgguggcgccggcagccgagccc

SEQ ID NO: 1226501 - RNA, 20 nt, Human
cgucugaggcuccugagcuc

SEQ ID NO: 1226502 - RNA, 21 nt, Human
cucacggguccacgcagucca

SEQ ID NO: 1226503 - RNA, 19 nt, Human
cuccuggagcugccugccc

SEQ ID NO: 1226504 - RNA, 20 nt, Human
cucgaacaccagcuuggcuc

SEQ ID NO: 1226505 - RNA, 20 nt, Human
cugagcucacggguccacgc

SEQ ID NO: 1226506 - RNA, 26 nt, Human
cugcaguaggcaggaggcuggccggc

SEQ ID NO: 1226507 - RNA, 19 nt, Human
cuggagguugugcugacgc

SEQ ID NO: 1226508 - RNA, 25 nt, Human
cugggccccgcugcccugcaccucc

SEQ ID NO: 1226509 - RNA, 19 nt, Human
cugguggccgcggggcugu

SEQ ID NO: 1226510 - RNA, 20 nt, Human
cugugugcaaacuggcagcg

SEQ ID NO: 1226511 - RNA, 21 nt, Human
gcagcucgaagcggccgccaa

SEQ ID NO: 1226512 - RNA, 20 nt, Human
gcaguccacuggaacuguug

SEQ ID NO: 1226513 - RNA, 20 nt, Human
gcgggagcagcccagacaca

SEQ ID NO: 1226514 - RNA, 20 nt, Human
gcugcccacgccccacaaac

SEQ ID NO: 1226515 - RNA, 23 nt, Human
ggcacacagccgggccagggacg

SEQ ID NO: 1226516 - RNA, 22 nt, Human
ggcgcuggagguugugcugacg

SEQ ID NO: 1226517 - RNA, 22 nt, Human
gggcagcaggguggacccugga

SEQ ID NO: 1226518 - RNA, 19 nt, Human
gguucgaagcccuccugga

SEQ ID NO: 1226519 - RNA, 24 nt, Human
gucggccgcccggccugccccucc

SEQ ID NO: 1226520 - RNA, 20 nt, Human
uccaccagggcacacagccg

SEQ ID NO: 1226521 - RNA, 23 nt, Human
uccccacgccagcacggcugccc

SEQ ID NO: 1226522 - RNA, 18 nt, Human
ucggcgcucacgugggcc

SEQ ID NO: 1226523 - RNA, 21 nt, Human
ucgguggcgccggcagccgag

SEQ ID NO: 1226524 - RNA, 23 nt, Human
ugcagcgggagcagcccagacac

SEQ ID NO: 1226525 - RNA, 22 nt, Human
ugcaugggggacagcgccugaa

SEQ ID NO: 1226526 - RNA, 19 nt, Human
ugccgagccugcccaggag

SEQ ID NO: 1226527 - RNA, 22 nt, Human
ugccgagccugcccaggagcuc

SEQ ID NO: 1226528 - RNA, 21 nt, Human
uggcagcgggacuccccacgc

SEQ ID NO: 1226529 - RNA, 23 nt, Human
uggccaggcugaucucgaacucc

SEQ ID NO: 1226530 - RNA, 18 nt, Human
uggccugcuuaaagcggg

SEQ ID NO: 1226531 - RNA, 19 nt, Human
ugggccaggagggaggggc

SEQ ID NO: 1226532 - RNA, 20 nt, Human
uucacccuauuggccaggcc

SEQ ID NO: 1226533 - RNA, 22 nt, Human
uuucacccuauuggccaggcug

SEQ ID NO: 1226534 - RNA, 25 nt, Human
aaaaagcuguaaccagacugagucc

SEQ ID NO: 1226535 - RNA, 20 nt, Human
aaagcucuucacaugccucu

SEQ ID NO: 1226536 - RNA, 20 nt, Human
aacccagccuaaccccguuu

SEQ ID NO: 1226537 - RNA, 21 nt, Human
aagaaaaauaaucuuuccuca

SEQ ID NO: 1226538 - RNA, 18 nt, Human
aagcaaaagcaggacagg

SEQ ID NO: 1226539 - RNA, 21 nt, Human
aagcaaaagcaggacagguga

SEQ ID NO: 1226540 - RNA, 19 nt, Human
aaugaccagguagcugugg

SEQ ID NO: 1226541 - RNA, 21 nt, Human
acacccacuuccuuccuccuu

SEQ ID NO: 1226542 - RNA, 21 nt, Human
acagaggagagaacaucccag

SEQ ID NO: 1226543 - RNA, 18 nt, Human
acccaaggcaagauuuca

SEQ ID NO: 1226544 - RNA, 19 nt, Human
accucuuagauccuguggu

SEQ ID NO: 1226545 - RNA, 24 nt, Human
acugagagguuaacauuucucuca

SEQ ID NO: 1226546 - RNA, 22 nt, Human
acuggaaaaauucauccccuca

SEQ ID NO: 1226547 - RNA, 19 nt, Human
agauaaccgggaaaaaagg

SEQ ID NO: 1226548 - RNA, 24 nt, Human
aggaaaaaauaaaaauaaaaaugu

SEQ ID NO: 1226549 - RNA, 20 nt, Human
aggcauggcaucugaauacc

SEQ ID NO: 1226550 - RNA, 21 nt, Human
aggugagaaggaaaggugagg

SEQ ID NO: 1226551 - RNA, 24 nt, Human
aguugcuggccuuaacggggagau

SEQ ID NO: 1226552 - RNA, 24 nt, Human
aucaccagauaaccgggaaaaaag

SEQ ID NO: 1226553 - RNA, 24 nt, Human
aucguucccucauuuacccaaaau

SEQ ID NO: 1226554 - RNA, 20 nt, Human
caacagugcccaucuccccu

SEQ ID NO: 1226555 - RNA, 22 nt, Human
caagccuucagcuuuucucaca

SEQ ID NO: 1226556 - RNA, 21 nt, Human
caccaaucgcuuaacacccac

SEQ ID NO: 1226557 - RNA, 26 nt, Human
caccagauaaccgggaaaaaaggguu

SEQ ID NO: 1226558 - RNA, 19 nt, Human
cacccuguaugaaaaaccc

SEQ ID NO: 1226559 - RNA, 19 nt, Human
caccuggaugaagaugaga

SEQ ID NO: 1226560 - RNA, 21 nt, Human
cacuugcuucccuugcuccca

SEQ ID NO: 1226561 - RNA, 22 nt, Human
cagcauuccccaaaaccuucuc

SEQ ID NO: 1226562 - RNA, 22 nt, Human
caggggucggcucgccucccuc

SEQ ID NO: 1226563 - RNA, 23 nt, Human
cauugucaaggucaggugcugac

SEQ ID NO: 1226564 - RNA, 25 nt, Human
ccaaacacccuguaugaaaaacccu

SEQ ID NO: 1226565 - RNA, 19 nt, Human
ccacaacagugcccaucuc

SEQ ID NO: 1226566 - RNA, 18 nt, Human
ccacaucacuccgguccu

SEQ ID NO: 1226567 - RNA, 24 nt, Human
ccaccacaacagugcccaucuccc

SEQ ID NO: 1226568 - RNA, 24 nt, Human
ccagauaaccgggaaaaaaggguu

SEQ ID NO: 1226569 - RNA, 20 nt, Human
ccaguacagaggagagaaca

SEQ ID NO: 1226570 - RNA, 18 nt, Human
cccacaucacuccugcuu

SEQ ID NO: 1226571 - RNA, 22 nt, Human
cccagacuuaaugcaccuggau

SEQ ID NO: 1226572 - RNA, 18 nt, Human
cccaucuccccuccccgc

SEQ ID NO: 1226573 - RNA, 19 nt, Human
ccccaguccuacucuuccu

SEQ ID NO: 1226574 - RNA, 19 nt, Human
ccccgucucucccucacac

SEQ ID NO: 1226575 - RNA, 21 nt, Human
ccccucuaccccaguccuacu

SEQ ID NO: 1226576 - RNA, 21 nt, Human
ccgccgccgccugcgcccugc

SEQ ID NO: 1226577 - RNA, 24 nt, Human
ccucacacccacuugcuucccuug

SEQ ID NO: 1226578 - RNA, 23 nt, Human
cgccgccugcgcccugccugcgc

SEQ ID NO: 1226579 - RNA, 24 nt, Human
cgccucccucucccaccggcccaa

SEQ ID NO: 1226580 - RNA, 21 nt, Human
cgccugcgcccugccugcgcc

SEQ ID NO: 1226581 - RNA, 26 nt, Human
cggccaaacacccuguaugaaaaacc

SEQ ID NO: 1226582 - RNA, 28 nt, Human
cggccuccuggauuccccucuaccccuc

SEQ ID NO: 1226583 - RNA, 23 nt, Human
cuaaccccguuuaaaugcuguca

SEQ ID NO: 1226584 - RNA, 20 nt, Human
cuccagcauuccccaaaacc

SEQ ID NO: 1226585 - RNA, 18 nt, Human
cucccucucccaccggcc

SEQ ID NO: 1226586 - RNA, 19 nt, Human
cucgaacuucaacccagcc

SEQ ID NO: 1226587 - RNA, 22 nt, Human
cucuaccccaguccuacucuuc

SEQ ID NO: 1226588 - RNA, 23 nt, Human
cucuacuucccccuccccauucc

SEQ ID NO: 1226589 - RNA, 23 nt, Human
cugcgcccugccugcgccugggg

SEQ ID NO: 1226590 - RNA, 18 nt, Human
cuucccccuccccauucc

SEQ ID NO: 1226591 - RNA, 20 nt, Human
cuucuuggccacacagugcc

SEQ ID NO: 1226592 - RNA, 24 nt, Human
gacaccaaaagucaugaggagaga

SEQ ID NO: 1226593 - RNA, 24 nt, Human
gagaaaggagacaccaaaagucau

SEQ ID NO: 1226594 - RNA, 19 nt, Human
gagccacuccuagcugugg

SEQ ID NO: 1226595 - RNA, 22 nt, Human
gcaaauacuuuuacuacccaaa

SEQ ID NO: 1226596 - RNA, 26 nt, Human
gccaaacacccuguaugaaaaacccu

SEQ ID NO: 1226597 - RNA, 18 nt, Human
gccauggcuaugucuuug

SEQ ID NO: 1226598 - RNA, 23 nt, Human
gcuccagcauuccccaaaaccuu

SEQ ID NO: 1226599 - RNA, 21 nt, Human
gcucuacuucccccuccccau

SEQ ID NO: 1226600 - RNA, 18 nt, Human
ggaagcaaaagcaggaca

SEQ ID NO: 1226601 - RNA, 21 nt, Human
ggacccaaggcaagauuucag

SEQ ID NO: 1226602 - RNA, 18 nt, Human
ggccccagccuuuuuaaa

SEQ ID NO: 1226603 - RNA, 20 nt, Human
ggcgccuucaggccacauca

SEQ ID NO: 1226604 - RNA, 25 nt, Human
gggcauugagggaaaacugacuuuc

SEQ ID NO: 1226605 - RNA, 24 nt, Human
ggguguccaaucaggucagagaag

SEQ ID NO: 1226606 - RNA, 20 nt, Human
ggguuuugagggaguugggg

SEQ ID NO: 1226607 - RNA, 25 nt, Human
guccccgucucucccucacacccac

SEQ ID NO: 1226608 - RNA, 20 nt, Human
uaaagcucuucacaugccuc

SEQ ID NO: 1226609 - RNA, 20 nt, Human
uaaccagacugaguccucaa

SEQ ID NO: 1226610 - RNA, 20 nt, Human
uaaccagacugaguccucaa

SEQ ID NO: 1226611 - RNA, 21 nt, Human
uacagcaaauauucacaagua

SEQ ID NO: 1226612 - RNA, 23 nt, Human
uacccaaaaucuccuuugcacac

SEQ ID NO: 1226613 - RNA, 20 nt, Human
uacuacccaaacuuccuucc

SEQ ID NO: 1226614 - RNA, 19 nt, Human
uagacuccuacgcacccaa

SEQ ID NO: 1226615 - RNA, 21 nt, Human
uagcuguggcucccacuucac

SEQ ID NO: 1226616 - RNA, 27 nt, Human
uagcuguggcugcccucagggaagggg

SEQ ID NO: 1226617 - RNA, 18 nt, Human
uaguucuccaucacuugc

SEQ ID NO: 1226618 - RNA, 22 nt, Human
uccagcucccuugguuucccac

SEQ ID NO: 1226619 - RNA, 27 nt, Human
ucccaccacaacagugcccaucucccc

SEQ ID NO: 1226620 - RNA, 19 nt, Human
ucccaccggcccagccucc

SEQ ID NO: 1226621 - RNA, 23 nt, Human
ucccaggauucuuagcaggaccc

SEQ ID NO: 1226622 - RNA, 21 nt, Human
uccccaaaaccuucucaagca

SEQ ID NO: 1226623 - RNA, 20 nt, Human
uccccggccuccuggauucc

SEQ ID NO: 1226624 - RNA, 19 nt, Human
uccccgucucucccucaca

SEQ ID NO: 1226625 - RNA, 19 nt, Human
ucccuaaaugagccacucc

SEQ ID NO: 1226626 - RNA, 18 nt, Human
uccuaaaucccaggauuc

SEQ ID NO: 1226627 - RNA, 20 nt, Human
uccuggauuccccucuaccc

SEQ ID NO: 1226628 - RNA, 19 nt, Human
uccuuuagacuccuacgca

SEQ ID NO: 1226629 - RNA, 23 nt, Human
ucuccaugcaaauacuuuuacua

SEQ ID NO: 1226630 - RNA, 18 nt, Human
ucugccaacuguccccca

SEQ ID NO: 1226631 - RNA, 23 nt, Human
ugaagaaagagcuugaaguucua

SEQ ID NO: 1226632 - RNA, 24 nt, Human
ugaagagaugcaaagaaaguggag

SEQ ID NO: 1226633 - RNA, 23 nt, Human
ugaaggccauggcuaugucuuug

SEQ ID NO: 1226634 - RNA, 21 nt, Human
ugaauaccaacuccaucugcc

SEQ ID NO: 1226635 - RNA, 24 nt, Human
ugaaucaaauguuuuaagucugcc

SEQ ID NO: 1226636 - RNA, 22 nt, Human
ugagcuacccugcccuaaccca

SEQ ID NO: 1226637 - RNA, 22 nt, Human
ugagggaaaacugacuuucugc

SEQ ID NO: 1226638 - RNA, 23 nt, Human
ugcaaauacuuuuacuacccaaa

SEQ ID NO: 1226639 - RNA, 22 nt, Human
ugccuccagcucccuugguuuc

SEQ ID NO: 1226640 - RNA, 26 nt, Human
ugcucccaccacaacagugcccauug

SEQ ID NO: 1226641 - RNA, 19 nt, Human
uggcugcccucagggaagg

SEQ ID NO: 1226642 - RNA, 19 nt, Human
uguaucaccauugucaagg

SEQ ID NO: 1226643 - RNA, 22 nt, Human
uucauggaccuccugagugaag

SEQ ID NO: 1226644 - RNA, 18 nt, Human
uuccccucuaccccaguc

SEQ ID NO: 1226645 - RNA, 19 nt, Human
uuccucugccuccagcucc

SEQ ID NO: 1226646 - RNA, 23 nt, Human
uugaaguucuaggaacugagagg

SEQ ID NO: 1226647 - RNA, 21 nt, Human
uugcugagccuugggcauuga

SEQ ID NO: 1226648 - RNA, 21 nt, Human
uugggguagaaaacuguaucu

SEQ ID NO: 1226649 - RNA, 25 nt, Human
uuuacuacccaaacuuccuuccaaa

SEQ ID NO: 1226650 - RNA, 21 nt, Human
uuucaacaacggccaaacacc

SEQ ID NO: 1226651 - RNA, 22 nt, Human
uuuguccccggccuccuggauu

SEQ ID NO: 1226652 - RNA, 18 nt, Human
uuuugcuccagcauuccc

SEQ ID NO: 1226653 - RNA, 23 nt, Human
uuuugcuccagcauuccccaaaa

SEQ ID NO: 1226654 - RNA, 20 nt, Human
aggaggagccagccagggca

SEQ ID NO: 1226655 - RNA, 26 nt, Human
agggaggaggagccagccagggcagg

SEQ ID NO: 1226656 - RNA, 21 nt, Human
cugguguguccagucuuuccc

SEQ ID NO: 1226657 - RNA, 19 nt, Human
gcccugguguguccagucu

SEQ ID NO: 1226658 - RNA, 24 nt, Human
uccccagcuggggcaggauauggc

SEQ ID NO: 1226659 - RNA, 20 nt, Human
uugugauagagacuggugau

SEQ ID NO: 1226660 - RNA, 23 nt, Human
acggugcucucgagggacaacug

SEQ ID NO: 1226661 - RNA, 19 nt, Human
agaggggcaggcaggaggg

SEQ ID NO: 1226662 - RNA, 19 nt, Human
agccaccagaagaggggca

SEQ ID NO: 1226663 - RNA, 19 nt, Human
agcgacuuuggucuucuuc

SEQ ID NO: 1226664 - RNA, 20 nt, Human
aggcaggaggggacggacgg

SEQ ID NO: 1226665 - RNA, 20 nt, Human
agugucuuggagccuggcuu

SEQ ID NO: 1226666 - RNA, 20 nt, Human
aguucccccacacgaucacc

SEQ ID NO: 1226667 - RNA, 21 nt, Human
aguucccccacacgaucaccu

SEQ ID NO: 1226668 - RNA, 26 nt, Human
caccuggaggacuuugcccuggggac

SEQ ID NO: 1226669 - RNA, 22 nt, Human
cagcagcaccugguuauacagu

SEQ ID NO: 1226670 - RNA, 23 nt, Human
caggguggucaaguccagcuccu

SEQ ID NO: 1226671 - RNA, 19 nt, Human
caguggguccagcgacuug

SEQ ID NO: 1226672 - RNA, 26 nt, Human
ccuuccacgggcaggcagagggaagc

SEQ ID NO: 1226673 - RNA, 21 nt, Human
cgagcgacuuuggucuucuuc

SEQ ID NO: 1226674 - RNA, 24 nt, Human
cgcuccauccgcccguaguucccc

SEQ ID NO: 1226675 - RNA, 18 nt, Human
cggacggauggacucgga

SEQ ID NO: 1226676 - RNA, 22 nt, Human
cuggcagugucuuggagccugg

SEQ ID NO: 1226677 - RNA, 25 nt, Human
gcuccauccgcccguaguuccccca

SEQ ID NO: 1226678 - RNA, 22 nt, Human
gcuuguaccagcccacggccag

SEQ ID NO: 1226679 - RNA, 22 nt, Human
ggacucggacaggcugcggcaa

SEQ ID NO: 1226680 - RNA, 20 nt, Human
ggaggagguggggaagagcu

SEQ ID NO: 1226681 - RNA, 18 nt, Human
ggggccuguggcuggguc

SEQ ID NO: 1226682 - RNA, 20 nt, Human
ucaccuggaggacuuugccc

SEQ ID NO: 1226683 - RNA, 20 nt, Human
ucucuagcagguaggccuug

SEQ ID NO: 1226684 - RNA, 20 nt, Human
ugggaugccugccggagcag

SEQ ID NO: 1226685 - RNA, 23 nt, Human
ugggaugccugccggagcagggg

SEQ ID NO: 1226686 - RNA, 21 nt, Human
uggggagccccuccccauucc

SEQ ID NO: 1226687 - RNA, 24 nt, Human
uggucccugcugaaccccaauucc

SEQ ID NO: 1226688 - RNA, 19 nt, Human
uguggcuggguccaccaug

SEQ ID NO: 1226689 - RNA, 21 nt, Human
aagcaaguuagaaaccuccau

SEQ ID NO: 1226690 - RNA, 22 nt, Human
acucuagucuucaugcucugcc

SEQ ID NO: 1226691 - RNA, 24 nt, Human
agaaaccuccauuucccuagaacu

SEQ ID NO: 1226692 - RNA, 18 nt, Human
agagggaaacaaagacuu

SEQ ID NO: 1226693 - RNA, 23 nt, Human
aggaagggaggaaggaaaaaugu

SEQ ID NO: 1226694 - RNA, 25 nt, Human
aggagcccaggaggggguugcucag

SEQ ID NO: 1226695 - RNA, 19 nt, Human
aggccgucaccuggggcau

SEQ ID NO: 1226696 - RNA, 19 nt, Human
cacccgggcggaagcccuc

SEQ ID NO: 1226697 - RNA, 24 nt, Human
cacuaucucucccuuuuauagaga

SEQ ID NO: 1226698 - RNA, 22 nt, Human
cagcacaacauucacgagcuuc

SEQ ID NO: 1226699 - RNA, 20 nt, Human
caggggggaaggcugcggug

SEQ ID NO: 1226700 - RNA, 22 nt, Human
ccacgaugcgcccguucaucuc

SEQ ID NO: 1226701 - RNA, 24 nt, Human
ccgggucacccagcagccccgcgc

SEQ ID NO: 1226702 - RNA, 19 nt, Human
ccuuccgcuccucuuugcg

SEQ ID NO: 1226703 - RNA, 23 nt, Human
cugguuggucaagauggccuucc

SEQ ID NO: 1226704 - RNA, 20 nt, Human
cuuugcgcugggccagugcc

SEQ ID NO: 1226705 - RNA, 20 nt, Human
gcggggcaagcaggagccgg

SEQ ID NO: 1226706 - RNA, 19 nt, Human
gcugcggggcaagcaggag

SEQ ID NO: 1226707 - RNA, 24 nt, Human
gcuuggugcccacgaugcgcccgu

SEQ ID NO: 1226708 - RNA, 19 nt, Human
ggcaggccgucaccugggg

SEQ ID NO: 1226709 - RNA, 18 nt, Human
ggcagggggccggggcug

SEQ ID NO: 1226710 - RNA, 22 nt, Human
ggccggggcugcggggcaagca

SEQ ID NO: 1226711 - RNA, 18 nt, Human
gggaagggaaggaaggga

SEQ ID NO: 1226712 - RNA, 20 nt, Human
gggcaagcaggagccggguc

SEQ ID NO: 1226713 - RNA, 24 nt, Human
gucaagauggccuuccgcuccucu

SEQ ID NO: 1226714 - RNA, 21 nt, Human
ucaccuggggcauggcaggca

SEQ ID NO: 1226715 - RNA, 18 nt, Human
ugaaaggagcccaggagg

SEQ ID NO: 1226716 - RNA, 23 nt, Human
ugaaaggagcccaggagggggaa

SEQ ID NO: 1226717 - RNA, 23 nt, Human
uggagggcugcugaaaggagccc

SEQ ID NO: 1226718 - RNA, 18 nt, Human
uggaucauuaagagucuu

SEQ ID NO: 1226719 - RNA, 21 nt, Human
ugguggagaggcgcugcaugu

SEQ ID NO: 1226720 - RNA, 28 nt, Human
aaaaaaaaaaaaaacacaaacaaaaaag

SEQ ID NO: 1226721 - RNA, 28 nt, Human
aaaaaaaaaaaacacaaacaaaaaaaga

SEQ ID NO: 1226722 - RNA, 20 nt, Human
aaaaaaaaaaacacaaacaa

SEQ ID NO: 1226723 - RNA, 20 nt, Human
aaaaaaaaaacacaaacaaa

SEQ ID NO: 1226724 - RNA, 21 nt, Human
aaaaaaaaaacacaaacaaaa

SEQ ID NO: 1226725 - RNA, 26 nt, Human
aaaaaaaaaacacaaacaaaaaaaga

SEQ ID NO: 1226726 - RNA, 20 nt, Human
aaaauggagauaaaguaguu

SEQ ID NO: 1226727 - RNA, 24 nt, Human
aaacaaaacaaacuccagaucaaa

SEQ ID NO: 1226728 - RNA, 24 nt, Human
aaacaaacuccagaucaaaguuca

SEQ ID NO: 1226729 - RNA, 21 nt, Human
aaacaaauauaccuugucagg

SEQ ID NO: 1226730 - RNA, 23 nt, Human
aaacaaauugacuucuggccaaa

SEQ ID NO: 1226731 - RNA, 18 nt, Human
aaagcccucugaucugcu

SEQ ID NO: 1226732 - RNA, 20 nt, Human
aacuuauuucuucaacuaca

SEQ ID NO: 1226733 - RNA, 18 nt, Human
aagagccaaggcaagagc

SEQ ID NO: 1226734 - RNA, 18 nt, Human
aagcaauaacagaagccc

SEQ ID NO: 1226735 - RNA, 21 nt, Human
aagcccugaagacuaacaacu

SEQ ID NO: 1226736 - RNA, 21 nt, Human
aaggcagagaacaagcgagga

SEQ ID NO: 1226737 - RNA, 19 nt, Human
acaaaacaaacuccagauc

SEQ ID NO: 1226738 - RNA, 24 nt, Human
acaaaauggagauaaaguaguuaa

SEQ ID NO: 1226739 - RNA, 22 nt, Human
acaaacaaaaaaagaauucuga

SEQ ID NO: 1226740 - RNA, 19 nt, Human
acaacaacaacaacaacua

SEQ ID NO: 1226741 - RNA, 26 nt, Human
acacaaacaaaaaaagaauucugaga

SEQ ID NO: 1226742 - RNA, 22 nt, Human
agagugagacucugucucaaaa

SEQ ID NO: 1226743 - RNA, 19 nt, Human
aggcacauucccugccuuu

SEQ ID NO: 1226744 - RNA, 24 nt, Human
aggcuagagugagacucugucuca

SEQ ID NO: 1226745 - RNA, 18 nt, Human
agguaaaguugcaggaag

SEQ ID NO: 1226746 - RNA, 23 nt, Human
agucauggcuccccaucugaggg

SEQ ID NO: 1226747 - RNA, 18 nt, Human
auccugaggugcaaccca

SEQ ID NO: 1226748 - RNA, 20 nt, Human
augcuuugguuuuuaaaacu

SEQ ID NO: 1226749 - RNA, 24 nt, Human
auucugucacccaggcuagaguga

SEQ ID NO: 1226750 - RNA, 21 nt, Human
caaagcccucugaucugcuuc

SEQ ID NO: 1226751 - RNA, 22 nt, Human
caacaacaacaacaacaacuag

SEQ ID NO: 1226752 - RNA, 24 nt, Human
caagcaauaacagaagcccaaggc

SEQ ID NO: 1226753 - RNA, 25 nt, Human
caauagacuuuacuucucugagccu

SEQ ID NO: 1226754 - RNA, 24 nt, Human
cacaaacaaaaaaagaauucugag

SEQ ID NO: 1226755 - RNA, 18 nt, Human
cagcugucuuuccaaccu

SEQ ID NO: 1226756 - RNA, 24 nt, Human
cauucugucacccaggcuagagug

SEQ ID NO: 1226757 - RNA, 22 nt, Human
ccacauagcuauuucaguugcc

SEQ ID NO: 1226758 - RNA, 22 nt, Human
ccaucugagggaaagagguaaa

SEQ ID NO: 1226759 - RNA, 21 nt, Human
cccugaagacuaacaacugcc

SEQ ID NO: 1226760 - RNA, 23 nt, Human
ccugaaacaaaacaaacuccaga

SEQ ID NO: 1226761 - RNA, 22 nt, Human
cucaaaaaaaaaaaaaaacaca

SEQ ID NO: 1226762 - RNA, 23 nt, Human
cucccagcacuauuaaguuucua

SEQ ID NO: 1226763 - RNA, 19 nt, Human
cucugucucaaaaaaaaaa

SEQ ID NO: 1226764 - RNA, 20 nt, Human
cugccauauucuagccacau

SEQ ID NO: 1226765 - RNA, 24 nt, Human
cuggccacagaagaggcacauucc

SEQ ID NO: 1226766 - RNA, 23 nt, Human
gaagaggcacauucccugccuuu

SEQ ID NO: 1226767 - RNA, 25 nt, Human
gagcaaguuucuguuagcaagguuc

SEQ ID NO: 1226768 - RNA, 21 nt, Human
gccucuugcauuuuuuaaaaa

SEQ ID NO: 1226769 - RNA, 24 nt, Human
gcuagagugagacucugucucaaa

SEQ ID NO: 1226770 - RNA, 18 nt, Human
guuguggagcucaaggac

SEQ ID NO: 1226771 - RNA, 27 nt, Human
uacagccaggucaucuacugaagagcc

SEQ ID NO: 1226772 - RNA, 19 nt, Human
uagaaaacaaauauaccuu

SEQ ID NO: 1226773 - RNA, 19 nt, Human
uagauguuguggagcucaa

SEQ ID NO: 1226774 - RNA, 20 nt, Human
uagccacaugaccuugagca

SEQ ID NO: 1226775 - RNA, 21 nt, Human
uauccgccacauagcuauuuc

SEQ ID NO: 1226776 - RNA, 25 nt, Human
ucaaaaaaaaaaaaaaacacaaaca

SEQ ID NO: 1226777 - RNA, 19 nt, Human
ucaacaacaacaacaacaa

SEQ ID NO: 1226778 - RNA, 20 nt, Human
ucaacaacaacaacaacaaa

SEQ ID NO: 1226779 - RNA, 18 nt, Human
ucaagcaauaacagaagc

SEQ ID NO: 1226780 - RNA, 23 nt, Human
ucaagcaauaacagaagcccaag

SEQ ID NO: 1226781 - RNA, 19 nt, Human
ucagcugucuuuccaaccu

SEQ ID NO: 1226782 - RNA, 22 nt, Human
ucagugccugauauauaauagg

SEQ ID NO: 1226783 - RNA, 21 nt, Human
ucaucaagcuagacugguaag

SEQ ID NO: 1226784 - RNA, 23 nt, Human
ucccagguuucaggagcaaaagc

SEQ ID NO: 1226785 - RNA, 26 nt, Human
uccguauccgccacauagcuauuuca

SEQ ID NO: 1226786 - RNA, 19 nt, Human
ucucauucugucacccagg

SEQ ID NO: 1226787 - RNA, 23 nt, Human
ucucauucugucacccaggcuag

SEQ ID NO: 1226788 - RNA, 24 nt, Human
ucucauucugucacccaggcuaga

SEQ ID NO: 1226789 - RNA, 18 nt, Human
ucucuggaagcucgaguu

SEQ ID NO: 1226790 - RNA, 24 nt, Human
ucugagccucaauuuucacaucug

SEQ ID NO: 1226791 - RNA, 22 nt, Human
ucugucacccaggcuagaguga

SEQ ID NO: 1226792 - RNA, 23 nt, Human
ucugucucaaaaaaaaaaaaaaa

SEQ ID NO: 1226793 - RNA, 22 nt, Human
ucuuuuuuuuugagacgggguc

SEQ ID NO: 1226794 - RNA, 24 nt, Human
ucuuuuuuuuugagacggggucuc

SEQ ID NO: 1226795 - RNA, 21 nt, Human
ugaaacaaaacaaacuccaga

SEQ ID NO: 1226796 - RNA, 24 nt, Human
ugaaacaaaacaaacuccagauca

SEQ ID NO: 1226797 - RNA, 20 nt, Human
ugacauaucuuaaauuuagu

SEQ ID NO: 1226798 - RNA, 22 nt, Human
ugagacggggucucauucuguc

SEQ ID NO: 1226799 - RNA, 18 nt, Human
ugcaagaaaaggugguca

SEQ ID NO: 1226800 - RNA, 21 nt, Human
uggccaaaaggcuucaucaag

SEQ ID NO: 1226801 - RNA, 22 nt, Human
uguaaaaugaggauaauaauac

SEQ ID NO: 1226802 - RNA, 24 nt, Human
uuaagucacaggguuauugugaag

SEQ ID NO: 1226803 - RNA, 25 nt, Human
uucaggcccgaaaccugccuccaug

SEQ ID NO: 1226804 - RNA, 18 nt, Human
uucccagguuucaggagc

SEQ ID NO: 1226805 - RNA, 20 nt, Human
uuccugaaacaaaacaaacu

SEQ ID NO: 1226806 - RNA, 21 nt, Human
uucuuuuuuuuugagacgggg

SEQ ID NO: 1226807 - RNA, 26 nt, Human
uucuuuuuuuuugagacggggucuca

SEQ ID NO: 1226808 - RNA, 22 nt, Human
uuugcaaagcccucugaucugc

SEQ ID NO: 1226809 - RNA, 20 nt, Human
aagguuuucuugagcugguu

SEQ ID NO: 1226810 - RNA, 24 nt, Human
aagugcuucuccaggucagagacc

SEQ ID NO: 1226811 - RNA, 22 nt, Human
acuggaaccagguaaugaucug

SEQ ID NO: 1226812 - RNA, 21 nt, Human
agacccugggagcccccaaac

SEQ ID NO: 1226813 - RNA, 23 nt, Human
agcaaagccuuuucccggaagcu

SEQ ID NO: 1226814 - RNA, 21 nt, Human
agccuugcgucguucucugcc

SEQ ID NO: 1226815 - RNA, 24 nt, Human
agcuccucgaugagugucacuucc

SEQ ID NO: 1226816 - RNA, 24 nt, Human
caccacagcugaccaccugcucca

SEQ ID NO: 1226817 - RNA, 25 nt, Human
cagcaaagccuuuucccggaagcuu

SEQ ID NO: 1226818 - RNA, 23 nt, Human
cagcuuccggaccaccuuggccu

SEQ ID NO: 1226819 - RNA, 23 nt, Human
caggacaggacccugccaggccc

SEQ ID NO: 1226820 - RNA, 21 nt, Human
ccaccugcuccaggagccugc

SEQ ID NO: 1226821 - RNA, 22 nt, Human
ccagguaaugaucuguucuucu

SEQ ID NO: 1226822 - RNA, 25 nt, Human
cccggaagcuucuguuccugacugc

SEQ ID NO: 1226823 - RNA, 19 nt, Human
ccugcagcuuccggaccac

SEQ ID NO: 1226824 - RNA, 28 nt, Human
ccugccaggcccugugcacccucuccaa

SEQ ID NO: 1226825 - RNA, 18 nt, Human
cggagugccguccagcug

SEQ ID NO: 1226826 - RNA, 24 nt, Human
cucugcagguagcugugaaacugg

SEQ ID NO: 1226827 - RNA, 23 nt, Human
cugaccaccugcuccaggagccu

SEQ ID NO: 1226828 - RNA, 27 nt, Human
cugcagcuuccggaccaccuuggccug

SEQ ID NO: 1226829 - RNA, 20 nt, Human
cuggaagguuuucuugagcu

SEQ ID NO: 1226830 - RNA, 19 nt, Human
cuggggcagaggcuggagc

SEQ ID NO: 1226831 - RNA, 18 nt, Human
cuguuccugacugcacca

SEQ ID NO: 1226832 - RNA, 24 nt, Human
cuuucggagacccugggagccccc

SEQ ID NO: 1226833 - RNA, 24 nt, Human
gaagcuccucgaugagugucacuu

SEQ ID NO: 1226834 - RNA, 24 nt, Human
gagccugcggcacgcuauuuccag

SEQ ID NO: 1226835 - RNA, 22 nt, Human
gagccuugcgucguucucugcc

SEQ ID NO: 1226836 - RNA, 21 nt, Human
gagcugggugaagugcuucuc

SEQ ID NO: 1226837 - RNA, 23 nt, Human
gcagcuuccggaccaccuuggcc

SEQ ID NO: 1226838 - RNA, 24 nt, Human
gcgcccaggcucuuaaggucuggg

SEQ ID NO: 1226839 - RNA, 18 nt, Human
gcuggagcuggcccagcc

SEQ ID NO: 1226840 - RNA, 19 nt, Human
ggacccugccaggcccugu

SEQ ID NO: 1226841 - RNA, 19 nt, Human
ggucuggggcagaggcugg

SEQ ID NO: 1226842 - RNA, 27 nt, Human
guagaacagcaaagccuuuucccggaa

SEQ ID NO: 1226843 - RNA, 20 nt, Human
guucuucugggagcccagcu

SEQ ID NO: 1226844 - RNA, 25 nt, Human
uagaacagcaaagccuuuucccgga

SEQ ID NO: 1226845 - RNA, 23 nt, Human
ugaucuguucuucugggagccca

SEQ ID NO: 1226846 - RNA, 20 nt, Human
ugccaggcccugugcacccu

SEQ ID NO: 1226847 - RNA, 19 nt, Human
uggaagguuuucuugagcu

SEQ ID NO: 1226848 - RNA, 18 nt, Human
uggcagggcaggacagga

SEQ ID NO: 1226849 - RNA, 23 nt, Human
uggcccagccgcuuccccugcag

SEQ ID NO: 1226850 - RNA, 21 nt, Human
ugggagcccccaaacagggac

SEQ ID NO: 1226851 - RNA, 23 nt, Human
uuuccagcuguccuggguacuuc

SEQ ID NO: 1226852 - RNA, 27 nt, Human
uuucccggaagcuucuguuggggggcc

SEQ ID NO: 1226853 - RNA, 18 nt, Human
uacaguuugucaacacuc

SEQ ID NO: 1226854 - RNA, 20 nt, Human
ucuccugacacacaaaucca

SEQ ID NO: 1226855 - RNA, 23 nt, Human
aacaaaugggcaucagcacccac

SEQ ID NO: 1226856 - RNA, 18 nt, Human
agacagaccaucuguccu

SEQ ID NO: 1226857 - RNA, 21 nt, Human
caaaugggcaucagcacccac

SEQ ID NO: 1226858 - RNA, 21 nt, Human
cuaaacacucaaugugaaacc

SEQ ID NO: 1226859 - RNA, 19 nt, Human
ggagcagccgugaccccug

SEQ ID NO: 1226860 - RNA, 21 nt, Human
uaccagccacaaagccaguuc

SEQ ID NO: 1226861 - RNA, 19 nt, Human
ucagcacccacugggagca

SEQ ID NO: 1226862 - RNA, 22 nt, Human
ugaccccuggguccucgguacc

SEQ ID NO: 1226863 - RNA, 20 nt, Human
ugggcaucagcacccacugg

SEQ ID NO: 1226864 - RNA, 23 nt, Human
ugugaaaccgcgcugcugggugu

SEQ ID NO: 1226865 - RNA, 23 nt, Human
aagaaaaagauaagguugcagaa

SEQ ID NO: 1226866 - RNA, 22 nt, Human
agaaaaagauaagguugcagaa

SEQ ID NO: 1226867 - RNA, 18 nt, Human
uggaagaaaaagauaagg

SEQ ID NO: 1226868 - RNA, 23 nt, Human
uuauauguagucuuguggaagaa

SEQ ID NO: 1226869 - RNA, 21 nt, Human
aaacagucugugcccaagaaa

SEQ ID NO: 1226870 - RNA, 23 nt, Human
aaaucauaucacgcugaagccag

SEQ ID NO: 1226871 - RNA, 19 nt, Human
aaccuccgccuccugguuc

SEQ ID NO: 1226872 - RNA, 23 nt, Human
aaccuucuggguucaagcaauuc

SEQ ID NO: 1226873 - RNA, 18 nt, Human
aagcaggccccccuccca

SEQ ID NO: 1226874 - RNA, 23 nt, Human
aagcuggucucagucgugacaca

SEQ ID NO: 1226875 - RNA, 23 nt, Human
aaguagcggagauuacaggcacu

SEQ ID NO: 1226876 - RNA, 21 nt, Human
acagcaccacagcauccagua

SEQ ID NO: 1226877 - RNA, 21 nt, Human
acaggguuucaucguguuggu

SEQ ID NO: 1226878 - RNA, 23 nt, Human
acaggguuucaucguguugguca

SEQ ID NO: 1226879 - RNA, 24 nt, Human
acaggguuucaucguguuggucag

SEQ ID NO: 1226880 - RNA, 19 nt, Human
accaugcccggcuaguuuu

SEQ ID NO: 1226881 - RNA, 23 nt, Human
accauguuggucaagcuggucuc

SEQ ID NO: 1226882 - RNA, 21 nt, Human
accccccaccaugggcuucca

SEQ ID NO: 1226883 - RNA, 23 nt, Human
agacagagagcaacacaggccug

SEQ ID NO: 1226884 - RNA, 18 nt, Human
agacagagugcaguggug

SEQ ID NO: 1226885 - RNA, 18 nt, Human
agacaggguuucaucgug

SEQ ID NO: 1226886 - RNA, 19 nt, Human
agagacaggguuucaucgu

SEQ ID NO: 1226887 - RNA, 23 nt, Human
agagugcaguggugugaucuugg

SEQ ID NO: 1226888 - RNA, 23 nt, Human
agcaccacagcauccaguacaac

SEQ ID NO: 1226889 - RNA, 24 nt, Human
agcauauuauuugucuuuuucaca

SEQ ID NO: 1226890 - RNA, 19 nt, Human
agccuugucucuccugcac

SEQ ID NO: 1226891 - RNA, 24 nt, Human
agcuggucucagucuccugaccuc

SEQ ID NO: 1226892 - RNA, 21 nt, Human
aguagcugggauuacaggugc

SEQ ID NO: 1226893 - RNA, 23 nt, Human
agugcaguggugugaucuuggcu

SEQ ID NO: 1226894 - RNA, 24 nt, Human
agugcaguggugugaucuuggcuc

SEQ ID NO: 1226895 - RNA, 24 nt, Human
aucguguuggucaggcuggucucg

SEQ ID NO: 1226896 - RNA, 21 nt, Human
augggguuucaccauguuggu

SEQ ID NO: 1226897 - RNA, 23 nt, Human
augggguuucaccauguugguca

SEQ ID NO: 1226898 - RNA, 25 nt, Human
augggguuucaccauguuggucaag

SEQ ID NO: 1226899 - RNA, 22 nt, Human
caagcaauucuccugccucagc

SEQ ID NO: 1226900 - RNA, 22 nt, Human
caagcaauucuccugccucagc

SEQ ID NO: 1226901 - RNA, 18 nt, Human
caccaugggcuuccacag

SEQ ID NO: 1226902 - RNA, 24 nt, Human
caccauguuggucaagcuggucuc

SEQ ID NO: 1226903 - RNA, 21 nt, Human
caccucuaauuuagacaucau

SEQ ID NO: 1226904 - RNA, 23 nt, Human
caccucuaauuuagacaucauuu

SEQ ID NO: 1226905 - RNA, 24 nt, Human
cacuacacccagcuaauuuuugua

SEQ ID NO: 1226906 - RNA, 21 nt, Human
cacugcaaccuccgccuccug

SEQ ID NO: 1226907 - RNA, 21 nt, Human
cagagugcaguggugugaucu

SEQ ID NO: 1226908 - RNA, 24 nt, Human
cagagugcaguggugugaucuugg

SEQ ID NO: 1226909 - RNA, 19 nt, Human
cagccuccuaaguagcgga

SEQ ID NO: 1226910 - RNA, 20 nt, Human
cagccuccugaguagcuggg

SEQ ID NO: 1226911 - RNA, 20 nt, Human
caggcacucgccaccaugcc

SEQ ID NO: 1226912 - RNA, 19 nt, Human
caggccccccucccacgac

SEQ ID NO: 1226913 - RNA, 24 nt, Human
caggguuucaucguguuggucagg

SEQ ID NO: 1226914 - RNA, 24 nt, Human
caguagagacaggguuucaucgug

SEQ ID NO: 1226915 - RNA, 22 nt, Human
cauaucacgcugaagccagaga

SEQ ID NO: 1226916 - RNA, 25 nt, Human
cauccaguacaacaaaggcaagaac

SEQ ID NO: 1226917 - RNA, 19 nt, Human
caucguguuggucaggcug

SEQ ID NO: 1226918 - RNA, 18 nt, Human
cauuucugauagcuaagg

SEQ ID NO: 1226919 - RNA, 25 nt, Human
ccaagaaagcaggccccccucccac

SEQ ID NO: 1226920 - RNA, 22 nt, Human
ccacuacaccuguugucccagg

SEQ ID NO: 1226921 - RNA, 19 nt, Human
ccaguacaacaaaggcaag

SEQ ID NO: 1226922 - RNA, 22 nt, Human
cccaagaaagcaggccccccuc

SEQ ID NO: 1226923 - RNA, 24 nt, Human
cccaagaaagcaggccccccuccu

SEQ ID NO: 1226924 - RNA, 22 nt, Human
cccccaccaugggcuuccacag

SEQ ID NO: 1226925 - RNA, 21 nt, Human
ccccucccacgacagcuacag

SEQ ID NO: 1226926 - RNA, 26 nt, Human
ccgccuccugguucaagcaauucuuu

SEQ ID NO: 1226927 - RNA, 24 nt, Human
ccuaaguagcggagauuacaggca

SEQ ID NO: 1226928 - RNA, 19 nt, Human
ccuaggcuggagugcaaug

SEQ ID NO: 1226929 - RNA, 24 nt, Human
ccucccacgacagcuacaggaggg

SEQ ID NO: 1226930 - RNA, 18 nt, Human
ccuccuaaguagcggaga

SEQ ID NO: 1226931 - RNA, 23 nt, Human
ccuccugguucaagcaauucucc

SEQ ID NO: 1226932 - RNA, 22 nt, Human
ccucuaauuuagacaucauuuc

SEQ ID NO: 1226933 - RNA, 19 nt, Human
ccucugagucccccuuagg

SEQ ID NO: 1226934 - RNA, 22 nt, Human
ccugaccucaagugauccaccc

SEQ ID NO: 1226935 - RNA, 21 nt, Human
ccugaccucaggugaucuccc

SEQ ID NO: 1226936 - RNA, 22 nt, Human
ccugaguagcugggauuacagg

SEQ ID NO: 1226937 - RNA, 23 nt, Human
ccugaguagcugggauuacaggu

SEQ ID NO: 1226938 - RNA, 24 nt, Human
ccugaguagcugggauuacaggug

SEQ ID NO: 1226939 - RNA, 23 nt, Human
ccugccucagccuccuaaguagc

SEQ ID NO: 1226940 - RNA, 23 nt, Human
ccugccucagccuccugaguagc

SEQ ID NO: 1226941 - RNA, 24 nt, Human
ccugccucagccuccugaguagcu

SEQ ID NO: 1226942 - RNA, 19 nt, Human
ccugguucaagcaauucuc

SEQ ID NO: 1226943 - RNA, 22 nt, Human
ccugguucaagcaauucuccug

SEQ ID NO: 1226944 - RNA, 24 nt, Human
ccuucuggguucaagcaauucucc

SEQ ID NO: 1226945 - RNA, 22 nt, Human
cgacagcuacaggagggcaaag

SEQ ID NO: 1226946 - RNA, 19 nt, Human
cgcugaagccagagaacuc

SEQ ID NO: 1226947 - RNA, 18 nt, Human
cguguuggucaggcuggu

SEQ ID NO: 1226948 - RNA, 23 nt, Human
cuaauuuuuguauuuucaguaga

SEQ ID NO: 1226949 - RNA, 24 nt, Human
cuaguuuuguauuuuuaguagaga

SEQ ID NO: 1226950 - RNA, 23 nt, Human
cuauaagucauacagagaaggga

SEQ ID NO: 1226951 - RNA, 24 nt, Human
cucacugcaaccuccgccuccugg

SEQ ID NO: 1226952 - RNA, 22 nt, Human
cucagcacuugaaauaggaagc

SEQ ID NO: 1226953 - RNA, 24 nt, Human
cucagccuccugaguagcugggau

SEQ ID NO: 1226954 - RNA, 20 nt, Human
cucagucuccugaccucagg

SEQ ID NO: 1226955 - RNA, 20 nt, Human
cucccugcaaccuucugggu

SEQ ID NO: 1226956 - RNA, 24 nt, Human
cuccugguucaagcaauucuccug

SEQ ID NO: 1226957 - RNA, 20 nt, Human
cucugggccucccacaugcu

SEQ ID NO: 1226958 - RNA, 20 nt, Human
cucuuguugccuaggcugga

SEQ ID NO: 1226959 - RNA, 19 nt, Human
cugaggccaagagggcuca

SEQ ID NO: 1226960 - RNA, 21 nt, Human
cugaguagcugggauuacagg

SEQ ID NO: 1226961 - RNA, 23 nt, Human
cugcaaccuccgccuccugguuc

SEQ ID NO: 1226962 - RNA, 23 nt, Human
cugucucuccaaguacccuuccu

SEQ ID NO: 1226963 - RNA, 23 nt, Human
cugugcccaagaaagcaggcccc

SEQ ID NO: 1226964 - RNA, 24 nt, Human
cuguuagacccaaccccccaccau

SEQ ID NO: 1226965 - RNA, 22 nt, Human
cuuccacagcaccacagcaucc

SEQ ID NO: 1226966 - RNA, 23 nt, Human
cuuccuauaagucauacagagaa

SEQ ID NO: 1226967 - RNA, 20 nt, Human
cuugaaauaggaagcucccu

SEQ ID NO: 1226968 - RNA, 22 nt, Human
cuuggcucccugcaaccuucug

SEQ ID NO: 1226969 - RNA, 22 nt, Human
cuuguugccuaggcuggagugc

SEQ ID NO: 1226970 - RNA, 19 nt, Human
gaaagcaggccccccuccc

SEQ ID NO: 1226971 - RNA, 25 nt, Human
gaagcucccuaacacaaggaagccu

SEQ ID NO: 1226972 - RNA, 18 nt, Human
gaccucaagugauccacc

SEQ ID NO: 1226973 - RNA, 21 nt, Human
gaccucaggugaucucccgcc

SEQ ID NO: 1226974 - RNA, 24 nt, Human
gagacaggguuucaucguguuggu

SEQ ID NO: 1226975 - RNA, 24 nt, Human
gagaugggguuucaccauguuggu

SEQ ID NO: 1226976 - RNA, 23 nt, Human
gagauuacaggcacucgccacca

SEQ ID NO: 1226977 - RNA, 23 nt, Human
gagguuuuuaaaggucuuggggg

SEQ ID NO: 1226978 - RNA, 24 nt, Human
gauuacaggcacucgccaccaugc

SEQ ID NO: 1226979 - RNA, 18 nt, Human
gauuacaggugccugcca

SEQ ID NO: 1226980 - RNA, 19 nt, Human
gccuaggcuggagugcaau

SEQ ID NO: 1226981 - RNA, 21 nt, Human
gcucuuguugccuaggcugga

SEQ ID NO: 1226982 - RNA, 19 nt, Human
gcuggagugcaauggcacg

SEQ ID NO: 1226983 - RNA, 23 nt, Human
gcuggucucgaacuccugaccuc

SEQ ID NO: 1226984 - RNA, 24 nt, Human
ggcuggucucgaacuccugaccuc

SEQ ID NO: 1226985 - RNA, 22 nt, Human
gggguuucaccauguuggucaa

SEQ ID NO: 1226986 - RNA, 20 nt, Human
ggguucaagcaauucuccug

SEQ ID NO: 1226987 - RNA, 22 nt, Human
ggguuucaccauguuggucaag

SEQ ID NO: 1226988 - RNA, 19 nt, Human
ggucucgaacuccugaccu

SEQ ID NO: 1226989 - RNA, 23 nt, Human
guagagaugggguuucaccaugu

SEQ ID NO: 1226990 - RNA, 18 nt, Human
guagcugggauuacaggu

SEQ ID NO: 1226991 - RNA, 19 nt, Human
gucucuccaaguacccuuc

SEQ ID NO: 1226992 - RNA, 23 nt, Human
uaaguagcggagauuacaggcac

SEQ ID NO: 1226993 - RNA, 24 nt, Human
uaauuuuuguauuuucaguagaga

SEQ ID NO: 1226994 - RNA, 25 nt, Human
uacagagaagggaauugagaacagc

SEQ ID NO: 1226995 - RNA, 18 nt, Human
uacaggagggcaaaggaa

SEQ ID NO: 1226996 - RNA, 23 nt, Human
uacaggcacucgccaccaugccc

SEQ ID NO: 1226997 - RNA, 22 nt, Human
uagagaugggguuucaccaugu

SEQ ID NO: 1226998 - RNA, 19 nt, Human
uagcggagauuacaggcac

SEQ ID NO: 1226999 - RNA, 24 nt, Human
uaguagagaugggguuucaccaug

SEQ ID NO: 1227000 - RNA, 26 nt, Human
uaguagagaugggguuucaccauguu

SEQ ID NO: 1227001 - RNA, 19 nt, Human
ucaagcaauucuccugccu

SEQ ID NO: 1227002 - RNA, 19 nt, Human
ucaagcaauucuccugccu

SEQ ID NO: 1227003 - RNA, 19 nt, Human
ucacugcaaccuccgccuc

SEQ ID NO: 1227004 - RNA, 23 nt, Human
ucacugcaaccuccgccuccugg

SEQ ID NO: 1227005 - RNA, 24 nt, Human
ucacugcaaccuccgccuccuggu

SEQ ID NO: 1227006 - RNA, 27 nt, Human
ucacugcaaccuccgccuccugguuca

SEQ ID NO: 1227007 - RNA, 20 nt, Human
ucagccuccugaguagcugg

SEQ ID NO: 1227008 - RNA, 21 nt, Human
ucagccuugucucuccugcac

SEQ ID NO: 1227009 - RNA, 20 nt, Human
ucaguagagacaggguuuca

SEQ ID NO: 1227010 - RNA, 24 nt, Human
ucaguagagacaggguuucaucgu

SEQ ID NO: 1227011 - RNA, 24 nt, Human
uccaaguacccuuccugaugccac

SEQ ID NO: 1227012 - RNA, 21 nt, Human
uccacagcaccacagcaucca

SEQ ID NO: 1227013 - RNA, 26 nt, Human
uccauccaccacuacaccuguugucc

SEQ ID NO: 1227014 - RNA, 24 nt, Human
ucccugcaaccuucuggggggccc

SEQ ID NO: 1227015 - RNA, 23 nt, Human
uccgccuccugguucaagcaauu

SEQ ID NO: 1227016 - RNA, 24 nt, Human
uccugaguagcugggauuacaggu

SEQ ID NO: 1227017 - RNA, 24 nt, Human
ucuccugccucagccuccuaagua

SEQ ID NO: 1227018 - RNA, 24 nt, Human
ucuccugccucagccuccugagua

SEQ ID NO: 1227019 - RNA, 21 nt, Human
ucucgaacuccugaccucaag

SEQ ID NO: 1227020 - RNA, 19 nt, Human
ucugaaaauaaacaagugg

SEQ ID NO: 1227021 - RNA, 19 nt, Human
ucugaggccaagagggcuc

SEQ ID NO: 1227022 - RNA, 21 nt, Human
ucuuggggggcucugcaaggu

SEQ ID NO: 1227023 - RNA, 19 nt, Human
ucuuguugccuaggcugga

SEQ ID NO: 1227024 - RNA, 18 nt, Human
ugaccucaggugaucucc

SEQ ID NO: 1227025 - RNA, 22 nt, Human
ugcaguggugugaucuuggcuc

SEQ ID NO: 1227026 - RNA, 20 nt, Human
ugccuaggcuggagugcaau

SEQ ID NO: 1227027 - RNA, 21 nt, Human
ugccuaggcuggagugcaaug

SEQ ID NO: 1227028 - RNA, 24 nt, Human
ugccuaggcuggagugcaauggca

SEQ ID NO: 1227029 - RNA, 23 nt, Human
ugccucagccuccuaaguagcgg

SEQ ID NO: 1227030 - RNA, 24 nt, Human
ugccucagccuccugaguagcugg

SEQ ID NO: 1227031 - RNA, 25 nt, Human
ugcuccauccaccacuacaccuguu

SEQ ID NO: 1227032 - RNA, 24 nt, Human
ugcucuuguugccuaggcuggagu

SEQ ID NO: 1227033 - RNA, 23 nt, Human
uggacacuuccucugaguccccc

SEQ ID NO: 1227034 - RNA, 23 nt, Human
uggagugcaauggcacgaucuca

SEQ ID NO: 1227035 - RNA, 24 nt, Human
uggagugcaauggcacgaucucag

SEQ ID NO: 1227036 - RNA, 24 nt, Human
uggcacgaucucagcucacugcaa

SEQ ID NO: 1227037 - RNA, 21 nt, Human
uggcucagcugaccaaacagu

SEQ ID NO: 1227038 - RNA, 22 nt, Human
uggcucccugcaaccuucuggg

SEQ ID NO: 1227039 - RNA, 21 nt, Human
ugggauuacaggugccugcca

SEQ ID NO: 1227040 - RNA, 22 nt, Human
ugggauuacaggugccugccac

SEQ ID NO: 1227041 - RNA, 22 nt, Human
ugggauuacaggugccugccac

SEQ ID NO: 1227042 - RNA, 24 nt, Human
ugggauuacaggugccugccacua

SEQ ID NO: 1227043 - RNA, 19 nt, Human
ugggccucccacaugcugc

SEQ ID NO: 1227044 - RNA, 24 nt, Human
ugggguuucaccauguuggucaag

SEQ ID NO: 1227045 - RNA, 21 nt, Human
uggguucaagcaauucuccug

SEQ ID NO: 1227046 - RNA, 23 nt, Human
uggguucaagcaauucuccugcc

SEQ ID NO: 1227047 - RNA, 24 nt, Human
uggguucaagcaauucuccugccu

SEQ ID NO: 1227048 - RNA, 21 nt, Human
uggucaagcuggucucagucu

SEQ ID NO: 1227049 - RNA, 24 nt, Human
uggucaggcuggucucgaacuccu

SEQ ID NO: 1227050 - RNA, 23 nt, Human
ugguucaagcaauucuccugccu

SEQ ID NO: 1227051 - RNA, 22 nt, Human
uguugccuaggcuggagugcaa

SEQ ID NO: 1227052 - RNA, 19 nt, Human
uguuggucaggcuggucuc

SEQ ID NO: 1227053 - RNA, 26 nt, Human
uguuuuacucacguccucaacucuca

SEQ ID NO: 1227054 - RNA, 21 nt, Human
uuaaaggucuuggggggcucu

SEQ ID NO: 1227055 - RNA, 21 nt, Human
uuacaggugccugccacuaca

SEQ ID NO: 1227056 - RNA, 18 nt, Human
uuaguagagaugggguuu

SEQ ID NO: 1227057 - RNA, 22 nt, Human
uuaguagagaugggguuucacc

SEQ ID NO: 1227058 - RNA, 24 nt, Human
uuaguagagaugggguuucaccau

SEQ ID NO: 1227059 - RNA, 21 nt, Human
uucaagcaauucuccugccuc

SEQ ID NO: 1227060 - RNA, 21 nt, Human
uucaagcaauucuccugccuc

SEQ ID NO: 1227061 - RNA, 24 nt, Human
uucaagcaauucuccugccucagc

SEQ ID NO: 1227062 - RNA, 24 nt, Human
uucaagcaauucuccugccucagc

SEQ ID NO: 1227063 - RNA, 24 nt, Human
uuccacagcaccacagcauccagu

SEQ ID NO: 1227064 - RNA, 24 nt, Human
uucuggguucaagcaauucuccug

SEQ ID NO: 1227065 - RNA, 18 nt, Human
uugccuaggcuggagugc

SEQ ID NO: 1227066 - RNA, 23 nt, Human
uugcucuuguugccuaggcugga

SEQ ID NO: 1227067 - RNA, 23 nt, Human
uuguauuuuuaguagagaugggg

SEQ ID NO: 1227068 - RNA, 21 nt, Human
uuucaccauguuggucaagcu

SEQ ID NO: 1227069 - RNA, 24 nt, Human
uuugcucuuguugccuaggcugga

SEQ ID NO: 1227070 - RNA, 23 nt, Human
uuuucaguagagacaggguuuca

SEQ ID NO: 1227071 - RNA, 24 nt, Human
uuuugcucuuguugccuaggcugg

SEQ ID NO: 1227072 - RNA, 19 nt, Human
uuuuguauuuuuaguagag

SEQ ID NO: 1227073 - RNA, 20 nt, Human
uuuuguauuuuuaguagaga

SEQ ID NO: 1227074 - RNA, 20 nt, Human
uuuuguauuuuuaguagaga

SEQ ID NO: 1227075 - RNA, 24 nt, Human
uuuuuaguagagaugggguuucac

SEQ ID NO: 1227076 - RNA, 20 nt, Human
uuuuuguauuuucaguagag

SEQ ID NO: 1227077 - RNA, 23 nt, Human
uuuuuguauuuucaguagagaca

SEQ ID NO: 1227078 - RNA, 20 nt, Human
aaaaacgcuggggaacaccc

SEQ ID NO: 1227079 - RNA, 24 nt, Human
aaaaagaaaaacucugugaucugg

SEQ ID NO: 1227080 - RNA, 22 nt, Human
aaaaaggaagucgggaagagaa

SEQ ID NO: 1227081 - RNA, 20 nt, Human
aacaggagcaaaaaaaggaa

SEQ ID NO: 1227082 - RNA, 19 nt, Human
aagagaagcacaaagccag

SEQ ID NO: 1227083 - RNA, 23 nt, Human
aagcagaucccuaaaugagccuc

SEQ ID NO: 1227084 - RNA, 19 nt, Human
aaggggccuaauauuugug

SEQ ID NO: 1227085 - RNA, 22 nt, Human
aagucagaaaaaagguucccag

SEQ ID NO: 1227086 - RNA, 19 nt, Human
acaaaaaggccaaugaccc

SEQ ID NO: 1227087 - RNA, 19 nt, Human
acaaaucccugaagacaac

SEQ ID NO: 1227088 - RNA, 21 nt, Human
acagcagugauggcuggaagc

SEQ ID NO: 1227089 - RNA, 21 nt, Human
acaggagcaaaaaaaggaagu

SEQ ID NO: 1227090 - RNA, 22 nt, Human
acucagaaggaggggaaagagg

SEQ ID NO: 1227091 - RNA, 20 nt, Human
acucuggcaggugugccugg

SEQ ID NO: 1227092 - RNA, 18 nt, Human
agaaaaaagguucccagg

SEQ ID NO: 1227093 - RNA, 18 nt, Human
agaaagcagaucccuaaa

SEQ ID NO: 1227094 - RNA, 18 nt, Human
agagcuccucccagccac

SEQ ID NO: 1227095 - RNA, 19 nt, Human
agcacccccaagggcuccc

SEQ ID NO: 1227096 - RNA, 22 nt, Human
agcuggaaguuggagugacuca

SEQ ID NO: 1227097 - RNA, 24 nt, Human
aggaaaggcucguguucugcagug

SEQ ID NO: 1227098 - RNA, 24 nt, Human
aggaaggaggcauucaggagaaaa

SEQ ID NO: 1227099 - RNA, 19 nt, Human
aggcaggacuugaguggga

SEQ ID NO: 1227100 - RNA, 18 nt, Human
agggggccaggaaggagg

SEQ ID NO: 1227101 - RNA, 18 nt, Human
agugcuccaucgccucuc

SEQ ID NO: 1227102 - RNA, 20 nt, Human
caaagggccucccucauggg

SEQ ID NO: 1227103 - RNA, 23 nt, Human
caaagggccucccucaugggucu

SEQ ID NO: 1227104 - RNA, 19 nt, Human
caacaggagcaaaaaaagg

SEQ ID NO: 1227105 - RNA, 22 nt, Human
caagucagaaaaaagguuccca

SEQ ID NO: 1227106 - RNA, 24 nt, Human
caaugaccccuccuccuggcauuc

SEQ ID NO: 1227107 - RNA, 18 nt, Human
cacacagugaucaggcca

SEQ ID NO: 1227108 - RNA, 19 nt, Human
caccaagucagaaaaaagg

SEQ ID NO: 1227109 - RNA, 24 nt, Human
cacgcagcccuggacccacauuuc

SEQ ID NO: 1227110 - RNA, 21 nt, Human
cagcagugauggcuggaagcc

SEQ ID NO: 1227111 - RNA, 22 nt, Human
caguaacaggcagugggguggg

SEQ ID NO: 1227112 - RNA, 24 nt, Human
caguaacaggcagugggguggguu

SEQ ID NO: 1227113 - RNA, 22 nt, Human
cagucuagggugacucagugga

SEQ ID NO: 1227114 - RNA, 25 nt, Human
ccacagacccacaaagggccucccu

SEQ ID NO: 1227115 - RNA, 22 nt, Human
ccacagcaccaacaauccuguc

SEQ ID NO: 1227116 - RNA, 21 nt, Human
cccaaguuaaggcacucuggc

SEQ ID NO: 1227117 - RNA, 20 nt, Human
cccagccacagacccacaaa

SEQ ID NO: 1227118 - RNA, 22 nt, Human
cccaggacuggggacgaaagac

SEQ ID NO: 1227119 - RNA, 19 nt, Human
ccccugcucugugcugagg

SEQ ID NO: 1227120 - RNA, 25 nt, Human
cccuaaaugagccucugggguccac

SEQ ID NO: 1227121 - RNA, 18 nt, Human
ccucccagccacagaccc

SEQ ID NO: 1227122 - RNA, 18 nt, Human
cgccucucagugagcugg

SEQ ID NO: 1227123 - RNA, 21 nt, Human
cggcuucugguccacgugccc

SEQ ID NO: 1227124 - RNA, 21 nt, Human
cucaaggcccaucuuccccag

SEQ ID NO: 1227125 - RNA, 21 nt, Human
cucaguccaaagagcacgcug

SEQ ID NO: 1227126 - RNA, 21 nt, Human
cuccccacagcaccaacaauc

SEQ ID NO: 1227127 - RNA, 18 nt, Human
cuccucuggugcuggaag

SEQ ID NO: 1227128 - RNA, 23 nt, Human
cuccucuggugcuggaagaugcu

SEQ ID NO: 1227129 - RNA, 18 nt, Human
cucugugcugaggccgcu

SEQ ID NO: 1227130 - RNA, 21 nt, Human
cucugugcugaggccgcugcc

SEQ ID NO: 1227131 - RNA, 21 nt, Human
cugaagacaacgaggcuggcc

SEQ ID NO: 1227132 - RNA, 22 nt, Human
cugaagacaacgaggcuggccc

SEQ ID NO: 1227133 - RNA, 22 nt, Human
cugaaguuacuucaagcuagca

SEQ ID NO: 1227134 - RNA, 23 nt, Human
cuggacacagaacgagcagcccu

SEQ ID NO: 1227135 - RNA, 21 nt, Human
cugguccacgugcccacggcu

SEQ ID NO: 1227136 - RNA, 21 nt, Human
cuguggcugguggcuccccug

SEQ ID NO: 1227137 - RNA, 21 nt, Human
cuugaggcaccagaaaugcuc

SEQ ID NO: 1227138 - RNA, 19 nt, Human
gaagaugcuggcacucagu

SEQ ID NO: 1227139 - RNA, 19 nt, Human
gaagggaagggagggggau

SEQ ID NO: 1227140 - RNA, 21 nt, Human
gacccacaaagggccucccuc

SEQ ID NO: 1227141 - RNA, 21 nt, Human
gacccagcuucccuugagcca

SEQ ID NO: 1227142 - RNA, 22 nt, Human
gacccagcuucccuugagccag

SEQ ID NO: 1227143 - RNA, 18 nt, Human
gagcuccucccagccaca

SEQ ID NO: 1227144 - RNA, 18 nt, Human
gcagugggguggguucgg

SEQ ID NO: 1227145 - RNA, 18 nt, Human
gccucucagugagcugga

SEQ ID NO: 1227146 - RNA, 20 nt, Human
gccucugggguccacggcuu

SEQ ID NO: 1227147 - RNA, 23 nt, Human
gcgggucuugggagcugggccuc

SEQ ID NO: 1227148 - RNA, 20 nt, Human
gcugccuguggcugguggcu

SEQ ID NO: 1227149 - RNA, 22 nt, Human
ggagaaaacaccaagucagaaa

SEQ ID NO: 1227150 - RNA, 20 nt, Human
ggcuggccguggaugugcag

SEQ ID NO: 1227151 - RNA, 21 nt, Human
gggacgaaagacucagaagga

SEQ ID NO: 1227152 - RNA, 20 nt, Human
gggcucaguggcugccugug

SEQ ID NO: 1227153 - RNA, 18 nt, Human
gggcuugcagcaccccca

SEQ ID NO: 1227154 - RNA, 20 nt, Human
ggggaugagaaaaacgcugg

SEQ ID NO: 1227155 - RNA, 24 nt, Human
ggggauggaugugauggggugugg

SEQ ID NO: 1227156 - RNA, 18 nt, Human
ggggccaggaaggaggca

SEQ ID NO: 1227157 - RNA, 21 nt, Human
guaggggaagggaagggaggg

SEQ ID NO: 1227158 - RNA, 21 nt, Human
gugcugagcugggcacuguau

SEQ ID NO: 1227159 - RNA, 22 nt, Human
uagaaggggccuaauauuugug

SEQ ID NO: 1227160 - RNA, 24 nt, Human
uagcaacagcagugauggcuggaa

SEQ ID NO: 1227161 - RNA, 20 nt, Human
ucaaaggugcuaagcuggga

SEQ ID NO: 1227162 - RNA, 18 nt, Human
ucagaaggaggggaaaga

SEQ ID NO: 1227163 - RNA, 27 nt, Human
ucaggccagguaacggugacugagacg

SEQ ID NO: 1227164 - RNA, 22 nt, Human
ucaguccaaagagcacgcugcc

SEQ ID NO: 1227165 - RNA, 23 nt, Human
ucaguccaaagagcacgcugccc

SEQ ID NO: 1227166 - RNA, 21 nt, Human
ucaguuacaccagcuucuccc

SEQ ID NO: 1227167 - RNA, 24 nt, Human
ucccuaaaugagccucuggggucc

SEQ ID NO: 1227168 - RNA, 24 nt, Human
ucccucaauaaaguugauaaggau

SEQ ID NO: 1227169 - RNA, 26 nt, Human
ucccugaagacaacgaggcuggccgu

SEQ ID NO: 1227170 - RNA, 21 nt, Human
ucccuugagccagcucagucc

SEQ ID NO: 1227171 - RNA, 19 nt, Human
uccucccagccacagaccc

SEQ ID NO: 1227172 - RNA, 20 nt, Human
ucugugcugaggccgcugcc

SEQ ID NO: 1227173 - RNA, 20 nt, Human
ucuuccccagagcuccuccc

SEQ ID NO: 1227174 - RNA, 21 nt, Human
ugaacaaaucccugaagacaa

SEQ ID NO: 1227175 - RNA, 21 nt, Human
ugaagacaacgaggcuggccg

SEQ ID NO: 1227176 - RNA, 22 nt, Human
ugagaaaaacgcuggggaacac

SEQ ID NO: 1227177 - RNA, 21 nt, Human
ugagugggaccgugaagggca

SEQ ID NO: 1227178 - RNA, 22 nt, Human
ugccaagggcucaguggcugcc

SEQ ID NO: 1227179 - RNA, 24 nt, Human
ugccaagggcucaguggcugccgc

SEQ ID NO: 1227180 - RNA, 22 nt, Human
ugcuaagcugggauuucucaag

SEQ ID NO: 1227181 - RNA, 23 nt, Human
ugcuggaagaugcuggcacucag

SEQ ID NO: 1227182 - RNA, 21 nt, Human
uggaaguuggagugacucacu

SEQ ID NO: 1227183 - RNA, 22 nt, Human
uggacccacauuucucaacagg

SEQ ID NO: 1227184 - RNA, 23 nt, Human
uggcuggaagccagauugugcuu

SEQ ID NO: 1227185 - RNA, 19 nt, Human
ugggagcugggccuccaga

SEQ ID NO: 1227186 - RNA, 20 nt, Human
ugggagcugggccuccagag

SEQ ID NO: 1227187 - RNA, 18 nt, Human
uggggauggaugugaugg

SEQ ID NO: 1227188 - RNA, 22 nt, Human
uggguuaucuuugcauucuaga

SEQ ID NO: 1227189 - RNA, 19 nt, Human
uguaggggaagggaaggga

SEQ ID NO: 1227190 - RNA, 23 nt, Human
ugucaaaggugcuaagcugggau

SEQ ID NO: 1227191 - RNA, 24 nt, Human
ugugaugggguguggcacacagug

SEQ ID NO: 1227192 - RNA, 18 nt, Human
ugugcugaggccgcugcc

SEQ ID NO: 1227193 - RNA, 28 nt, Human
uucaggagaaaacaccaagucagaaaaa

SEQ ID NO: 1227194 - RNA, 24 nt, Human
uuguggggauggaugugauggggu

SEQ ID NO: 1227195 - RNA, 25 nt, Human
aaaaaaaaaaaaaugucauacagaa

SEQ ID NO: 1227196 - RNA, 22 nt, Human
aaaaaaaaaaggaacagauugg

SEQ ID NO: 1227197 - RNA, 22 nt, Human
aaaaacagaggaaauuuaaggc

SEQ ID NO: 1227198 - RNA, 23 nt, Human
aaaaagcuccagauacagacuaa

SEQ ID NO: 1227199 - RNA, 20 nt, Human
aacauggcaaaaucccaucu

SEQ ID NO: 1227200 - RNA, 21 nt, Human
aacauggcaaaaucccaucuc

SEQ ID NO: 1227201 - RNA, 24 nt, Human
aagaaaaaugacuuuuagugccac

SEQ ID NO: 1227202 - RNA, 23 nt, Human
aaguggagugcccuaacuuuucu

SEQ ID NO: 1227203 - RNA, 24 nt, Human
acacccuugggaggcugagguggg

SEQ ID NO: 1227204 - RNA, 19 nt, Human
acagagaucccauuucaaa

SEQ ID NO: 1227205 - RNA, 23 nt, Human
acccugaauuagauauagaaauu

SEQ ID NO: 1227206 - RNA, 21 nt, Human
agacuaaaaggaagcuaccgg

SEQ ID NO: 1227207 - RNA, 18 nt, Human
agagguugcagugagccg

SEQ ID NO: 1227208 - RNA, 22 nt, Human
agagguugcagugagccgagau

SEQ ID NO: 1227209 - RNA, 24 nt, Human
agagguugcagugagccgagaugg

SEQ ID NO: 1227210 - RNA, 22 nt, Human
agcaaaacagccuagcucccuc

SEQ ID NO: 1227211 - RNA, 23 nt, Human
agcaaauugauucuaacauucau

SEQ ID NO: 1227212 - RNA, 18 nt, Human
agccaagauacuaaaaga

SEQ ID NO: 1227213 - RNA, 24 nt, Human
agccugggcaacauggcaaaaucc

SEQ ID NO: 1227214 - RNA, 23 nt, Human
agcugggcgugguaguguguacu

SEQ ID NO: 1227215 - RNA, 21 nt, Human
aggaagcuaccggcucacugu

SEQ ID NO: 1227216 - RNA, 24 nt, Human
aggaauucgagaccagccugggca

SEQ ID NO: 1227217 - RNA, 24 nt, Human
aggacuuuaggaggcugagguggg

SEQ ID NO: 1227218 - RNA, 24 nt, Human
aggaucacuugaauccaggaauuc

SEQ ID NO: 1227219 - RNA, 24 nt, Human
aggcacaguggcucaugccuauaa

SEQ ID NO: 1227220 - RNA, 21 nt, Human
aggcagagguugcagugagcc

SEQ ID NO: 1227221 - RNA, 24 nt, Human
aggcagagguugcagugagccgag

SEQ ID NO: 1227222 - RNA, 24 nt, Human
aggcugaggugggaggaucacuug

SEQ ID NO: 1227223 - RNA, 24 nt, Human
aggcugaggugggaggaucacuug

SEQ ID NO: 1227224 - RNA, 18 nt, Human
aggugggaggaucacuug

SEQ ID NO: 1227225 - RNA, 18 nt, Human
aggugggaggaucacuug

SEQ ID NO: 1227226 - RNA, 23 nt, Human
aggugggaggaucacuugaaucc

SEQ ID NO: 1227227 - RNA, 23 nt, Human
aggugggaggaucacuugagcuc

SEQ ID NO: 1227228 - RNA, 24 nt, Human
aguggcucaugccuauaauccuag

SEQ ID NO: 1227229 - RNA, 18 nt, Human
auacagaaaaaucagguu

SEQ ID NO: 1227230 - RNA, 23 nt, Human
aucacuugagcucaggaggcaga

SEQ ID NO: 1227231 - RNA, 22 nt, Human
auccauguguaaagcaauccug

SEQ ID NO: 1227232 - RNA, 19 nt, Human
augccuauaauccuaggac

SEQ ID NO: 1227233 - RNA, 22 nt, Human
caaaaacacacauuagcugggc

SEQ ID NO: 1227234 - RNA, 23 nt, Human
cacacccuugggaggcugaggug

SEQ ID NO: 1227235 - RNA, 24 nt, Human
cacacccuugggaggcugaggugg

SEQ ID NO: 1227236 - RNA, 22 nt, Human
caccauguguugauuuuaacag

SEQ ID NO: 1227237 - RNA, 20 nt, Human
cacuugaauccaggaauucg

SEQ ID NO: 1227238 - RNA, 22 nt, Human
caggugagaaaaugucacggua

SEQ ID NO: 1227239 - RNA, 20 nt, Human
caugccuauaauccuaggac

SEQ ID NO: 1227240 - RNA, 19 nt, Human
cauggcacuccaaccuggg

SEQ ID NO: 1227241 - RNA, 23 nt, Human
cauggcacuccaaccugggcgac

SEQ ID NO: 1227242 - RNA, 24 nt, Human
cauggcacuccaaccugggcgaca

SEQ ID NO: 1227243 - RNA, 22 nt, Human
ccacgugccuugcaauuaucuc

SEQ ID NO: 1227244 - RNA, 24 nt, Human
ccauggcacuccaaccugggcgac

SEQ ID NO: 1227245 - RNA, 18 nt, Human
ccugaauuagauauagaa

SEQ ID NO: 1227246 - RNA, 24 nt, Human
ccugggcaacauggcaaaauccca

SEQ ID NO: 1227247 - RNA, 24 nt, Human
cucaugccuauaauccuaggacuu

SEQ ID NO: 1227248 - RNA, 18 nt, Human
cucugaaaaaaaaaaaaa

SEQ ID NO: 1227249 - RNA, 18 nt, Human
cuggauuaucauaagugg

SEQ ID NO: 1227250 - RNA, 18 nt, Human
cuuucuuuuuuuucaacc

SEQ ID NO: 1227251 - RNA, 21 nt, Human
gaaaaaucagguucauaaaag

SEQ ID NO: 1227252 - RNA, 24 nt, Human
gaucacuugaauccaggaauucga

SEQ ID NO: 1227253 - RNA, 24 nt, Human
gaucacuugagcucaggaggcaga

SEQ ID NO: 1227254 - RNA, 23 nt, Human
gcaaaacagccuagcucccucaa

SEQ ID NO: 1227255 - RNA, 21 nt, Human
gcacuccaaccugggcgacag

SEQ ID NO: 1227256 - RNA, 24 nt, Human
gcucaggaggcagagguugcagug

SEQ ID NO: 1227257 - RNA, 26 nt, Human
ggaaaagacaguaaaaacauuuccuu

SEQ ID NO: 1227258 - RNA, 18 nt, Human
ggaagaccuucaaaauau

SEQ ID NO: 1227259 - RNA, 22 nt, Human
ggaggaucacuugaauccagga

SEQ ID NO: 1227260 - RNA, 22 nt, Human
ggaggcagagguugcagugagc

SEQ ID NO: 1227261 - RNA, 22 nt, Human
ggaggcugaggugggaggauca

SEQ ID NO: 1227262 - RNA, 21 nt, Human
gggaaaagacaguaaaaacau

SEQ ID NO: 1227263 - RNA, 24 nt, Human
gggggccaggcacaguggcucaug

SEQ ID NO: 1227264 - RNA, 24 nt, Human
guugcagugagccgagauggugcc

SEQ ID NO: 1227265 - RNA, 22 nt, Human
uaaaaggaagcuaccggcucac

SEQ ID NO: 1227266 - RNA, 19 nt, Human
uaacuuuucuuauuucaua

SEQ ID NO: 1227267 - RNA, 23 nt, Human
uaagccagaagauaaaccuuaca

SEQ ID NO: 1227268 - RNA, 24 nt, Human
uagcaaaacagccuagcucccuca

SEQ ID NO: 1227269 - RNA, 19 nt, Human
uagccauuaauuauuaagc

SEQ ID NO: 1227270 - RNA, 18 nt, Human
uagccuaauagucuagag

SEQ ID NO: 1227271 - RNA, 24 nt, Human
uaggacuuuaggaggcugaggugg

SEQ ID NO: 1227272 - RNA, 19 nt, Human
uaggaggcugaggugggag

SEQ ID NO: 1227273 - RNA, 24 nt, Human
uaggaggcugaggugggaggauca

SEQ ID NO: 1227274 - RNA, 24 nt, Human
uaggcaaaaacuaugguuuauguu

SEQ ID NO: 1227275 - RNA, 18 nt, Human
uaugcaaaauaauuucac

SEQ ID NO: 1227276 - RNA, 19 nt, Human
ucaaaaaaaaaaaggaaca

SEQ ID NO: 1227277 - RNA, 18 nt, Human
uccacagaagaaaaauga

SEQ ID NO: 1227278 - RNA, 24 nt, Human
ucccauuucaaaaaaaaaaaggaa

SEQ ID NO: 1227279 - RNA, 21 nt, Human
ucgagaccagccugggcaaca

SEQ ID NO: 1227280 - RNA, 23 nt, Human
ucucuagcaaaacagccuagcuc

SEQ ID NO: 1227281 - RNA, 22 nt, Human
ugagccgagauggugccauggc

SEQ ID NO: 1227282 - RNA, 18 nt, Human
ugagggggccaggcacag

SEQ ID NO: 1227283 - RNA, 19 nt, Human
ugaggugggaggaucacuu

SEQ ID NO: 1227284 - RNA, 19 nt, Human
ugaggugggaggaucacuu

SEQ ID NO: 1227285 - RNA, 20 nt, Human
ugaggugggaggaucacuug

SEQ ID NO: 1227286 - RNA, 20 nt, Human
ugaggugggaggaucacuug

SEQ ID NO: 1227287 - RNA, 21 nt, Human
ugaggugggaggaucacuuga

SEQ ID NO: 1227288 - RNA, 22 nt, Human
ugaggugggaggaucacuugaa

SEQ ID NO: 1227289 - RNA, 23 nt, Human
ugaggugggaggaucacuugaau

SEQ ID NO: 1227290 - RNA, 23 nt, Human
ugaggugggaggaucacuugagc

SEQ ID NO: 1227291 - RNA, 24 nt, Human
ugaggugggaggaucacuugagcu

SEQ ID NO: 1227292 - RNA, 19 nt, Human
ugauauauuuccaagaaug

SEQ ID NO: 1227293 - RNA, 20 nt, Human
ugauauauuuccaagaaugu

SEQ ID NO: 1227294 - RNA, 21 nt, Human
ugcauuguuaggcuacacuga

SEQ ID NO: 1227295 - RNA, 24 nt, Human
ugccacgugccuugcaauuaucuc

SEQ ID NO: 1227296 - RNA, 22 nt, Human
ugccauggcacuccaaccuggg

SEQ ID NO: 1227297 - RNA, 19 nt, Human
uggcccucaggaaauggcu

SEQ ID NO: 1227298 - RNA, 19 nt, Human
uggcucaugccuauaaucc

SEQ ID NO: 1227299 - RNA, 19 nt, Human
uggcucaugccuauaaucc

SEQ ID NO: 1227300 - RNA, 21 nt, Human
uggcucaugccuauaauccua

SEQ ID NO: 1227301 - RNA, 24 nt, Human
ugggaggaucacuugagcucagga

SEQ ID NO: 1227302 - RNA, 19 nt, Human
ugggaggcugaggugggag

SEQ ID NO: 1227303 - RNA, 24 nt, Human
ugggaggcugaggugggaggauca

SEQ ID NO: 1227304 - RNA, 25 nt, Human
ugugaaaaacagaggaaauuuaagg

SEQ ID NO: 1227305 - RNA, 21 nt, Human
ugugugucugggaaaagacag

SEQ ID NO: 1227306 - RNA, 21 nt, Human
uuaagccagaagauaaaccuu

SEQ ID NO: 1227307 - RNA, 19 nt, Human
uuagcugggcgugguagug

SEQ ID NO: 1227308 - RNA, 20 nt, Human
uuagcugggcgugguagugu

SEQ ID NO: 1227309 - RNA, 22 nt, Human
uuagcugggcgugguagugugu

SEQ ID NO: 1227310 - RNA, 23 nt, Human
uuccuuaaauuuucugggcuaua

SEQ ID NO: 1227311 - RNA, 22 nt, Human
uugcagugagccgagauggugc

SEQ ID NO: 1227312 - RNA, 25 nt, Human
uugggaggcugaggugggaggauca

SEQ ID NO: 1227313 - RNA, 19 nt, Human
uuuaaggcagaugguaacu

SEQ ID NO: 1227314 - RNA, 24 nt, Human
uuugugcauccauguguaaagcaa

SEQ ID NO: 1227315 - RNA, 21 nt, Human
uuuuaagccagaagauaaacc

SEQ ID NO: 1227316 - RNA, 23 nt, Human
uuuuaagccagaagauaaaccuu

SEQ ID NO: 1227317 - RNA, 22 nt, Human
aaaaugucuacugauuccggca

SEQ ID NO: 1227318 - RNA, 19 nt, Human
aaauaggagguagagacaa

SEQ ID NO: 1227319 - RNA, 21 nt, Human
aaauaggagguagagacaagg

SEQ ID NO: 1227320 - RNA, 18 nt, Human
aacaaaauacagcacuac

SEQ ID NO: 1227321 - RNA, 22 nt, Human
aacacuggggcuaacucuacca

SEQ ID NO: 1227322 - RNA, 18 nt, Human
aaccagcaagagcggccc

SEQ ID NO: 1227323 - RNA, 18 nt, Human
aagaaauaucugaacaaa

SEQ ID NO: 1227324 - RNA, 19 nt, Human
aagcagacccgcagggccc

SEQ ID NO: 1227325 - RNA, 19 nt, Human
aagcccacagcaacagucu

SEQ ID NO: 1227326 - RNA, 20 nt, Human
aagccgggguggacuggggc

SEQ ID NO: 1227327 - RNA, 26 nt, Human
aagcugaagguagagaaaggggaccc

SEQ ID NO: 1227328 - RNA, 19 nt, Human
aaugucuacugauuccggc

SEQ ID NO: 1227329 - RNA, 22 nt, Human
acacugcaaccaugggcuuccc

SEQ ID NO: 1227330 - RNA, 22 nt, Human
acagcaagaauuggccuaaagc

SEQ ID NO: 1227331 - RNA, 20 nt, Human
accaccaccccgccagggag

SEQ ID NO: 1227332 - RNA, 24 nt, Human
accuggagacaagcccacagcaac

SEQ ID NO: 1227333 - RNA, 19 nt, Human
agaaagccacggugaccac

SEQ ID NO: 1227334 - RNA, 21 nt, Human
agaaagccacggugaccacca

SEQ ID NO: 1227335 - RNA, 23 nt, Human
agaaguucugcggcgacaauucu

SEQ ID NO: 1227336 - RNA, 20 nt, Human
agcaggaagaauagcccaaa

SEQ ID NO: 1227337 - RNA, 21 nt, Human
aguaguaggcaccugaguugc

SEQ ID NO: 1227338 - RNA, 18 nt, Human
caaagggaggcauccuuu

SEQ ID NO: 1227339 - RNA, 21 nt, Human
caacaaguuaaaaguguggaa

SEQ ID NO: 1227340 - RNA, 19 nt, Human
cacacagguaaauauguac

SEQ ID NO: 1227341 - RNA, 22 nt, Human
cacagcaacagucuaggugaga

SEQ ID NO: 1227342 - RNA, 20 nt, Human
caccccgccagggaggccag

SEQ ID NO: 1227343 - RNA, 24 nt, Human
caccguggcagccgucacggagcc

SEQ ID NO: 1227344 - RNA, 23 nt, Human
cacugcaaccaugggcuucccaa

SEQ ID NO: 1227345 - RNA, 23 nt, Human
cacuuucagcuagguuuugggag

SEQ ID NO: 1227346 - RNA, 24 nt, Human
cagcuguaacugagacaugcacgg

SEQ ID NO: 1227347 - RNA, 23 nt, Human
caggccagggaaagcagacccgc

SEQ ID NO: 1227348 - RNA, 18 nt, Human
caugcacggggcaugugc

SEQ ID NO: 1227349 - RNA, 18 nt, Human
caugggggacacgacccu

SEQ ID NO: 1227350 - RNA, 25 nt, Human
ccaccaccccgccagggaggccaga

SEQ ID NO: 1227351 - RNA, 22 nt, Human
ccaccccgccagggaggccaga

SEQ ID NO: 1227352 - RNA, 19 nt, Human
ccagggaaagcagacccgc

SEQ ID NO: 1227353 - RNA, 19 nt, Human
cccacgggcaccuccgcca

SEQ ID NO: 1227354 - RNA, 21 nt, Human
cccagcaaccccgaaagucgc

SEQ ID NO: 1227355 - RNA, 26 nt, Human
cccgcacgcuccacagguuucaacca

SEQ ID NO: 1227356 - RNA, 21 nt, Human
cccgcgguccuagccugccug

SEQ ID NO: 1227357 - RNA, 26 nt, Human
ccgcgcccacgggcaccuccgccacc

SEQ ID NO: 1227358 - RNA, 25 nt, Human
ccuacagcaagaauuggccuaaagc

SEQ ID NO: 1227359 - RNA, 19 nt, Human
ccugagguggaggccaaca

SEQ ID NO: 1227360 - RNA, 23 nt, Human
ccugcgagcagccgcuccagggc

SEQ ID NO: 1227361 - RNA, 21 nt, Human
cggcccgcggcgccggggugg

SEQ ID NO: 1227362 - RNA, 19 nt, Human
cuccagggcucgagauugg

SEQ ID NO: 1227363 - RNA, 24 nt, Human
cuccucccagcaaccccgaaaguc

SEQ ID NO: 1227364 - RNA, 19 nt, Human
cucuaccaugucuccuccc

SEQ ID NO: 1227365 - RNA, 23 nt, Human
cucugggccuacagcaagaauug

SEQ ID NO: 1227366 - RNA, 18 nt, Human
cugacagccgugucccuu

SEQ ID NO: 1227367 - RNA, 18 nt, Human
cuggaacacgggaagguc

SEQ ID NO: 1227368 - RNA, 24 nt, Human
cuguaacugagacaugcacggggc

SEQ ID NO: 1227369 - RNA, 21 nt, Human
gacaugcacggggcaugugca

SEQ ID NO: 1227370 - RNA, 19 nt, Human
gcccaaagggaggcauccu

SEQ ID NO: 1227371 - RNA, 23 nt, Human
gcgcaggucacuguaggugaucu

SEQ ID NO: 1227372 - RNA, 20 nt, Human
gcgccuucccgccucgcgcc

SEQ ID NO: 1227373 - RNA, 24 nt, Human
gcggcgcggagacgucggcgggcc

SEQ ID NO: 1227374 - RNA, 21 nt, Human
gcuggaacacgggaaggucug

SEQ ID NO: 1227375 - RNA, 23 nt, Human
ggaaagcagacccgcagggcccg

SEQ ID NO: 1227376 - RNA, 21 nt, Human
ggacacaaaaacuaacugaug

SEQ ID NO: 1227377 - RNA, 23 nt, Human
ggacggggcgcucagguuuggau

SEQ ID NO: 1227378 - RNA, 24 nt, Human
ggagcccuuccgcgucccgagcgc

SEQ ID NO: 1227379 - RNA, 19 nt, Human
ggcuuuugcugugucacgu

SEQ ID NO: 1227380 - RNA, 19 nt, Human
gggcagugccgcggaggag

SEQ ID NO: 1227381 - RNA, 18 nt, Human
gguggccgggcgggcggc

SEQ ID NO: 1227382 - RNA, 25 nt, Human
gucugauuuuaaagcccaaacucug

SEQ ID NO: 1227383 - RNA, 21 nt, Human
uaaaaagaaaacggaugaggu

SEQ ID NO: 1227384 - RNA, 21 nt, Human
uacagcacuacuauaagugag

SEQ ID NO: 1227385 - RNA, 24 nt, Human
uauggcacaggguggcaccccuga

SEQ ID NO: 1227386 - RNA, 23 nt, Human
uauugcuguggcaagaaugugga

SEQ ID NO: 1227387 - RNA, 19 nt, Human
ucaacauuugccauguguc

SEQ ID NO: 1227388 - RNA, 20 nt, Human
ucccgagcgccaaggcaccu

SEQ ID NO: 1227389 - RNA, 18 nt, Human
ucccucccaagaagcuca

SEQ ID NO: 1227390 - RNA, 19 nt, Human
uccgccaccguggcagccg

SEQ ID NO: 1227391 - RNA, 21 nt, Human
uccgccaccguggcagccguc

SEQ ID NO: 1227392 - RNA, 23 nt, Human
ucuccgggaaaacauggcuguca

SEQ ID NO: 1227393 - RNA, 22 nt, Human
ucucgcggcuuugcugucgccu

SEQ ID NO: 1227394 - RNA, 25 nt, Human
ucugaccgggggcgggaccagcgcc

SEQ ID NO: 1227395 - RNA, 20 nt, Human
ucugauaaauccuucccuuu

SEQ ID NO: 1227396 - RNA, 18 nt, Human
ugaagauauaaggcuccg

SEQ ID NO: 1227397 - RNA, 23 nt, Human
ugaccgggggcgggaccagcgcc

SEQ ID NO: 1227398 - RNA, 24 nt, Human
ugagguaguggaagauccagggac

SEQ ID NO: 1227399 - RNA, 21 nt, Human
ugagguggaggccaacaaguu

SEQ ID NO: 1227400 - RNA, 21 nt, Human
ugaucuggggacgggggaagg

SEQ ID NO: 1227401 - RNA, 24 nt, Human
ugcacaggacucagcuuacuaaua

SEQ ID NO: 1227402 - RNA, 18 nt, Human
ugcagugguggacagaca

SEQ ID NO: 1227403 - RNA, 22 nt, Human
ugcauuaagaaauaucugaaca

SEQ ID NO: 1227404 - RNA, 24 nt, Human
uggaggcaauauggcacagggugg

SEQ ID NO: 1227405 - RNA, 21 nt, Human
uggcaagaauguggaggacac

SEQ ID NO: 1227406 - RNA, 19 nt, Human
ugucuccucccagcaaccc

SEQ ID NO: 1227407 - RNA, 28 nt, Human
uuaaagcccaaacucugggccuacuguc

SEQ ID NO: 1227408 - RNA, 22 nt, Human
uuggccuaaagcaauaauuuaa

SEQ ID NO: 1227409 - RNA, 20 nt, Human
uuguucccucccaagaagcu

SEQ ID NO: 1227410 - RNA, 19 nt, Human
uuuaaagcccaaacucugg

SEQ ID NO: 1227411 - RNA, 20 nt, Human
aggagucggaggagcccgac

SEQ ID NO: 1227412 - RNA, 21 nt, Human
ggguucguggcgcggccggug

SEQ ID NO: 1227413 - RNA, 19 nt, Human
aauucugcucugaaucugu

SEQ ID NO: 1227414 - RNA, 24 nt, Human
accauuauauacugccugucuuug

SEQ ID NO: 1227415 - RNA, 22 nt, Human
auuuucucucuucuuuucuugg

SEQ ID NO: 1227416 - RNA, 20 nt, Human
cauuugcaugaaaugcccuu

SEQ ID NO: 1227417 - RNA, 23 nt, Human
gaaagaagacauucuuugaaugu

SEQ ID NO: 1227418 - RNA, 26 nt, Human
gugaacuuagauugucuguuugugcu

SEQ ID NO: 1227419 - RNA, 24 nt, Human
guguuaauaguacccuugaauaac

SEQ ID NO: 1227420 - RNA, 19 nt, Human
uagaauucugcucugaauc

SEQ ID NO: 1227421 - RNA, 19 nt, Human
uauccaacucuucuagguu

SEQ ID NO: 1227422 - RNA, 21 nt, Human
uauguuuuguauuuguuguug

SEQ ID NO: 1227423 - RNA, 27 nt, Human
ucaguggugucaguuguaauauccccu

SEQ ID NO: 1227424 - RNA, 24 nt, Human
ucccagaggucuugauagguugug

SEQ ID NO: 1227425 - RNA, 22 nt, Human
ucugguagaauucugcucugaa

SEQ ID NO: 1227426 - RNA, 26 nt, Human
ucuuuuagcuacuguugcuuuaaagu

SEQ ID NO: 1227427 - RNA, 21 nt, Human
ugaaagaagacauucuuugaa

SEQ ID NO: 1227428 - RNA, 22 nt, Human
ugaaaggauugguaucauuucu

SEQ ID NO: 1227429 - RNA, 20 nt, Human
ugucucauaugagaauagcu

SEQ ID NO: 1227430 - RNA, 25 nt, Human
uguuguuguucuugugucaauuuca

SEQ ID NO: 1227431 - RNA, 23 nt, Human
uuaccauuucaaucuugcugcuu

SEQ ID NO: 1227432 - RNA, 21 nt, Human
uuccugcuucucugguucccu

SEQ ID NO: 1227433 - RNA, 21 nt, Human
uuggcuuguuccugcuucucu

SEQ ID NO: 1227434 - RNA, 23 nt, Human
uuguuuugucucauaugagaaua

SEQ ID NO: 1227435 - RNA, 18 nt, Human
uuuggauuuucucucuuc

SEQ ID NO: 1227436 - RNA, 23 nt, Human
uuugugcucuuucagacuuuuug

SEQ ID NO: 1227437 - RNA, 22 nt, Human
aacacaguuuuuaucuacugau

SEQ ID NO: 1227438 - RNA, 18 nt, Human
aauggaauuguacaguau

SEQ ID NO: 1227439 - RNA, 18 nt, Human
uacaguauaguaaacaca

SEQ ID NO: 1227440 - RNA, 20 nt, Human
uccuuuauuugcugcugugu

SEQ ID NO: 1227441 - RNA, 24 nt, Human
ucucacaaccaccuauauauuucu

SEQ ID NO: 1227442 - RNA, 24 nt, Human
uucuggaugcuucauguaaaugga

SEQ ID NO: 1227443 - RNA, 24 nt, Human
aaaagugcugagauuauaggcaug

SEQ ID NO: 1227444 - RNA, 21 nt, Human
aaacaaacacugccacaaaca

SEQ ID NO: 1227445 - RNA, 22 nt, Human
aaacacgguuauguccuucuac

SEQ ID NO: 1227446 - RNA, 18 nt, Human
aaacaggcucuaucucca

SEQ ID NO: 1227447 - RNA, 24 nt, Human
aaagugcugagauuauaggcauga

SEQ ID NO: 1227448 - RNA, 20 nt, Human
aagagcaauuugaggcugcu

SEQ ID NO: 1227449 - RNA, 24 nt, Human
aagugauccuccugucuuggccuc

SEQ ID NO: 1227450 - RNA, 22 nt, Human
acuaaguacaaaaaaacuccua

SEQ ID NO: 1227451 - RNA, 26 nt, Human
acugagcuccagccaugucuuaagag

SEQ ID NO: 1227452 - RNA, 21 nt, Human
acuucauucaaugaagacuga

SEQ ID NO: 1227453 - RNA, 26 nt, Human
agacagcaaacaaaauaaagggaccc

SEQ ID NO: 1227454 - RNA, 22 nt, Human
agacgcaaacguccaaagugac

SEQ ID NO: 1227455 - RNA, 23 nt, Human
agaggaaggugaggaccucaggc

SEQ ID NO: 1227456 - RNA, 22 nt, Human
agauuauaggcaugagccacug

SEQ ID NO: 1227457 - RNA, 20 nt, Human
aggaugcucaacccugggcu

SEQ ID NO: 1227458 - RNA, 19 nt, Human
aggcaugagccacugugcc

SEQ ID NO: 1227459 - RNA, 24 nt, Human
aggggagacagacagcaaacaaaa

SEQ ID NO: 1227460 - RNA, 23 nt, Human
agguugguugaucuugaacuccu

SEQ ID NO: 1227461 - RNA, 23 nt, Human
aguaaaacaaacacugccacaaa

SEQ ID NO: 1227462 - RNA, 18 nt, Human
aguagucacaugguuacu

SEQ ID NO: 1227463 - RNA, 22 nt, Human
augaauaauaaggucccuguuu

SEQ ID NO: 1227464 - RNA, 29 nt, Human
augugcagguacauauaugaauauaacac

SEQ ID NO: 1227465 - RNA, 19 nt, Human
caaaaaaacuccuagacuu

SEQ ID NO: 1227466 - RNA, 24 nt, Human
caaaagugcugagauuauaggcau

SEQ ID NO: 1227467 - RNA, 21 nt, Human
caaaauaaaucaauauaccac

SEQ ID NO: 1227468 - RNA, 23 nt, Human
caaacacugccacaaacacccuc

SEQ ID NO: 1227469 - RNA, 19 nt, Human
caaggcuuuuccaaagguc

SEQ ID NO: 1227470 - RNA, 19 nt, Human
caccuaaaccccuuaagag

SEQ ID NO: 1227471 - RNA, 20 nt, Human
caccuaaaccccuuaagagc

SEQ ID NO: 1227472 - RNA, 25 nt, Human
cagcaaacaaaauaaaucaauauac

SEQ ID NO: 1227473 - RNA, 21 nt, Human
cagcaaacaggcucuaucucc

SEQ ID NO: 1227474 - RNA, 22 nt, Human
cagcugcagcaucucuguugca

SEQ ID NO: 1227475 - RNA, 21 nt, Human
caggcucaugucagaagugac

SEQ ID NO: 1227476 - RNA, 21 nt, Human
caggcucccaguguaacuccu

SEQ ID NO: 1227477 - RNA, 20 nt, Human
caguaaaacaaacacugcca

SEQ ID NO: 1227478 - RNA, 20 nt, Human
caguaggguuuaagacaaaa

SEQ ID NO: 1227479 - RNA, 24 nt, Human
caugucuuaagagcgggaagaaaa

SEQ ID NO: 1227480 - RNA, 23 nt, Human
cauguuacccagguugguugauc

SEQ ID NO: 1227481 - RNA, 24 nt, Human
ccaaaagugcugagauuauaggca

SEQ ID NO: 1227482 - RNA, 21 nt, Human
ccaaagugacaaggcuuuucc

SEQ ID NO: 1227483 - RNA, 19 nt, Human
ccaagugcaugguauuucu

SEQ ID NO: 1227484 - RNA, 28 nt, Human
ccagcaguggggcaggggagacagacag

SEQ ID NO: 1227485 - RNA, 26 nt, Human
ccauacuaaaggaauaagaccuacau

SEQ ID NO: 1227486 - RNA, 22 nt, Human
ccccuuaagagcaauuugaggc

SEQ ID NO: 1227487 - RNA, 19 nt, Human
ccuccugucuuggccuccc

SEQ ID NO: 1227488 - RNA, 23 nt, Human
ccucuguuccagcaguggggcag

SEQ ID NO: 1227489 - RNA, 24 nt, Human
ccucuuuuaggggaagauaaaaac

SEQ ID NO: 1227490 - RNA, 23 nt, Human
ccugucuuggccucccaaaagug

SEQ ID NO: 1227491 - RNA, 18 nt, Human
cgggaagaaaaagcagca

SEQ ID NO: 1227492 - RNA, 18 nt, Human
cucacaccuguaauuuca

SEQ ID NO: 1227493 - RNA, 19 nt, Human
cucccaucgccucuucaaa

SEQ ID NO: 1227494 - RNA, 19 nt, Human
cucucuguaguuacugaga

SEQ ID NO: 1227495 - RNA, 21 nt, Human
cuugcccguauuuuuaggacc

SEQ ID NO: 1227496 - RNA, 22 nt, Human
cuuggccucccaaaagugcuga

SEQ ID NO: 1227497 - RNA, 18 nt, Human
gacagacagcaaacaaaa

SEQ ID NO: 1227498 - RNA, 24 nt, Human
gauuauaggcaugagccacugugc

SEQ ID NO: 1227499 - RNA, 22 nt, Human
gcacgguggcucacaccuguaa

SEQ ID NO: 1227500 - RNA, 20 nt, Human
gccacugugccuagcccuaa

SEQ ID NO: 1227501 - RNA, 20 nt, Human
ggaaaggaaagcuucugcac

SEQ ID NO: 1227502 - RNA, 19 nt, Human
ggccugaagugauccuccu

SEQ ID NO: 1227503 - RNA, 20 nt, Human
ggguuuaagacaaaacacaa

SEQ ID NO: 1227504 - RNA, 19 nt, Human
gguggcucacaccuguaau

SEQ ID NO: 1227505 - RNA, 22 nt, Human
guaaaacaaacacugccacaaa

SEQ ID NO: 1227506 - RNA, 21 nt, Human
gugcagguacauauaugaaua

SEQ ID NO: 1227507 - RNA, 19 nt, Human
guuuuauauauauauauau

SEQ ID NO: 1227508 - RNA, 22 nt, Human
uaaaacaaacacugccacaaac

SEQ ID NO: 1227509 - RNA, 25 nt, Human
uaaaacaaacacugccacaaacacc

SEQ ID NO: 1227510 - RNA, 25 nt, Human
uaaauagagauggggucuggccaug

SEQ ID NO: 1227511 - RNA, 21 nt, Human
uaagagcuugcccguauuuuu

SEQ ID NO: 1227512 - RNA, 19 nt, Human
uaaggucccuguuuucuug

SEQ ID NO: 1227513 - RNA, 20 nt, Human
uaaugaauaauaaggucccu

SEQ ID NO: 1227514 - RNA, 20 nt, Human
uacaggcucaugucagaagu

SEQ ID NO: 1227515 - RNA, 21 nt, Human
uaccacagcaaacuucauuca

SEQ ID NO: 1227516 - RNA, 22 nt, Human
ucaaagacgcaaacguccaaag

SEQ ID NO: 1227517 - RNA, 21 nt, Human
ucacuaaguacaaaaaaacuc

SEQ ID NO: 1227518 - RNA, 28 nt, Human
ucaggccggccgugcacgguggcucaca

SEQ ID NO: 1227519 - RNA, 22 nt, Human
ucagguggguacaugugcaggu

SEQ ID NO: 1227520 - RNA, 20 nt, Human
ucauuacuggggaugcagua

SEQ ID NO: 1227521 - RNA, 19 nt, Human
uccauagaaacacugaaaa

SEQ ID NO: 1227522 - RNA, 25 nt, Human
ucccaaaagugcugagauuauaggc

SEQ ID NO: 1227523 - RNA, 26 nt, Human
ucccaucgccucuucaaagacgcaaa

SEQ ID NO: 1227524 - RNA, 18 nt, Human
ucuccacaggcucugggg

SEQ ID NO: 1227525 - RNA, 26 nt, Human
ucuguucagaaaaaauacuugucacu

SEQ ID NO: 1227526 - RNA, 21 nt, Human
ucuugaacuccuggccugaag

SEQ ID NO: 1227527 - RNA, 18 nt, Human
ucuuggccucccaaaagu

SEQ ID NO: 1227528 - RNA, 18 nt, Human
ugaaaacacgguuauguc

SEQ ID NO: 1227529 - RNA, 24 nt, Human
ugaacuccuggccugaagugaucc

SEQ ID NO: 1227530 - RNA, 19 nt, Human
ugaagugauccuccugucu

SEQ ID NO: 1227531 - RNA, 23 nt, Human
ugaagugauccuccugucuuggc

SEQ ID NO: 1227532 - RNA, 22 nt, Human
ugacaaggcuuuuccaaagguc

SEQ ID NO: 1227533 - RNA, 19 nt, Human
ugacacaguucauuucugg

SEQ ID NO: 1227534 - RNA, 21 nt, Human
ugagauuauaggcaugagcca

SEQ ID NO: 1227535 - RNA, 22 nt, Human
ugagauuauaggcaugagccac

SEQ ID NO: 1227536 - RNA, 22 nt, Human
ugagauuauaggcaugagccac

SEQ ID NO: 1227537 - RNA, 23 nt, Human
ugagauuauaggcaugagccacu

SEQ ID NO: 1227538 - RNA, 24 nt, Human
ugagauuauaggcaugagccacug

SEQ ID NO: 1227539 - RNA, 21 nt, Human
ugcaauaccacagcaaacuuc

SEQ ID NO: 1227540 - RNA, 19 nt, Human
uggagccucuguuccagca

SEQ ID NO: 1227541 - RNA, 24 nt, Human
uggccugaagugauccuccugucu

SEQ ID NO: 1227542 - RNA, 21 nt, Human
uggcucacaccuguaauuuca

SEQ ID NO: 1227543 - RNA, 22 nt, Human
uggguacaugugcagguacaua

SEQ ID NO: 1227544 - RNA, 20 nt, Human
uggucauacaaaguccugcu

SEQ ID NO: 1227545 - RNA, 20 nt, Human
ugucuuggccucccaaaagu

SEQ ID NO: 1227546 - RNA, 23 nt, Human
ugugccuagcccuaacuuauauu

SEQ ID NO: 1227547 - RNA, 18 nt, Human
uuaagagcgggaagaaaa

SEQ ID NO: 1227548 - RNA, 19 nt, Human
uuauauauaauguuaaucu

SEQ ID NO: 1227549 - RNA, 24 nt, Human
uucacaguuuagauuucauucauu

SEQ ID NO: 1227550 - RNA, 19 nt, Human
uucacuaaguacaaaaaaa

SEQ ID NO: 1227551 - RNA, 20 nt, Human
uuggagccucuguuccagca

SEQ ID NO: 1227552 - RNA, 22 nt, Human
uuggagccucuguuccagcagu

SEQ ID NO: 1227553 - RNA, 18 nt, Human
uuuuauauauauauauau

SEQ ID NO: 1227554 - RNA, 23 nt, Human
caccagggcugggcugaggcgag

SEQ ID NO: 1227555 - RNA, 18 nt, Human
aaacacacgugcacgagc

SEQ ID NO: 1227556 - RNA, 21 nt, Human
aaauaaucuuuuaggaacugg

SEQ ID NO: 1227557 - RNA, 21 nt, Human
aagcacagucacguucugagg

SEQ ID NO: 1227558 - RNA, 19 nt, Human
acacgugcacgagcaacag

SEQ ID NO: 1227559 - RNA, 23 nt, Human
accuuaaucaccucuggaaaguc

SEQ ID NO: 1227560 - RNA, 20 nt, Human
agagcugcccccaagcccuu

SEQ ID NO: 1227561 - RNA, 23 nt, Human
agcgcaaacagggacccucccag

SEQ ID NO: 1227562 - RNA, 21 nt, Human
agggacccucccagagcugcc

SEQ ID NO: 1227563 - RNA, 23 nt, Human
auggcacuggaggcacacgcgca

SEQ ID NO: 1227564 - RNA, 22 nt, Human
auggcggcaaguuggaggucac

SEQ ID NO: 1227565 - RNA, 26 nt, Human
caaccucagcucugcacacccagccu

SEQ ID NO: 1227566 - RNA, 21 nt, Human
cacacccagccuuggacaccc

SEQ ID NO: 1227567 - RNA, 21 nt, Human
cacccagccuuggacacccac

SEQ ID NO: 1227568 - RNA, 22 nt, Human
cagcgcaaacagggacccuccc

SEQ ID NO: 1227569 - RNA, 20 nt, Human
cagcucugcacacccagccu

SEQ ID NO: 1227570 - RNA, 25 nt, Human
ccaagcacagucacguucugagguu

SEQ ID NO: 1227571 - RNA, 21 nt, Human
ccaagcccuccccuggccugu

SEQ ID NO: 1227572 - RNA, 21 nt, Human
ccacagcgcaaacagggaccc

SEQ ID NO: 1227573 - RNA, 19 nt, Human
cccacagcgcaaacaggga

SEQ ID NO: 1227574 - RNA, 20 nt, Human
cccccaagcccuccccuggc

SEQ ID NO: 1227575 - RNA, 24 nt, Human
cccccaagcccuccccuggccugu

SEQ ID NO: 1227576 - RNA, 21 nt, Human
ccuguguccaagcacagucac

SEQ ID NO: 1227577 - RNA, 19 nt, Human
ccuuaugcgagagucccuc

SEQ ID NO: 1227578 - RNA, 22 nt, Human
cgcaaacagggacccucccaga

SEQ ID NO: 1227579 - RNA, 18 nt, Human
cucacuucaccuuaauca

SEQ ID NO: 1227580 - RNA, 22 nt, Human
cucagcucugcacacccagccu

SEQ ID NO: 1227581 - RNA, 20 nt, Human
cugcccccaagcccuccccu

SEQ ID NO: 1227582 - RNA, 23 nt, Human
cugcccccaagcccuccccuggc

SEQ ID NO: 1227583 - RNA, 18 nt, Human
gagcggguggaggccagc

SEQ ID NO: 1227584 - RNA, 20 nt, Human
gcaaaaugcagggcugccca

SEQ ID NO: 1227585 - RNA, 19 nt, Human
gcaacagcacacuugcucg

SEQ ID NO: 1227586 - RNA, 21 nt, Human
gcagcgcugucucauucacug

SEQ ID NO: 1227587 - RNA, 23 nt, Human
gcccccaagcccuccccuggccu

SEQ ID NO: 1227588 - RNA, 19 nt, Human
gcgcagcaauguggaggga

SEQ ID NO: 1227589 - RNA, 22 nt, Human
ggcacuggaggcacacgcgcag

SEQ ID NO: 1227590 - RNA, 23 nt, Human
guggagggacccagcagauggag

SEQ ID NO: 1227591 - RNA, 24 nt, Human
uaaaacacacgugcacgagcaacc

SEQ ID NO: 1227592 - RNA, 20 nt, Human
uaaucaccucuggaaagucc

SEQ ID NO: 1227593 - RNA, 19 nt, Human
uacgaauuuugagagcauu

SEQ ID NO: 1227594 - RNA, 24 nt, Human
uacgaauuuugagagcauucaagu

SEQ ID NO: 1227595 - RNA, 24 nt, Human
uaggagccaguccacggcgcggag

SEQ ID NO: 1227596 - RNA, 19 nt, Human
ucacugggguuccaugguu

SEQ ID NO: 1227597 - RNA, 23 nt, Human
uccaagcacagucacguucugag

SEQ ID NO: 1227598 - RNA, 23 nt, Human
ucccagagcugcccccaagcccu

SEQ ID NO: 1227599 - RNA, 19 nt, Human
ucccugugagccagggucu

SEQ ID NO: 1227600 - RNA, 18 nt, Human
uccuuaugcgagaguccc

SEQ ID NO: 1227601 - RNA, 19 nt, Human
ucugaaauaaucuuuuagg

SEQ ID NO: 1227602 - RNA, 21 nt, Human
ugagagcauucaagucagccc

SEQ ID NO: 1227603 - RNA, 21 nt, Human
ugcacacccagccuuggacac

SEQ ID NO: 1227604 - RNA, 23 nt, Human
ugcacacccagccuuggacaccc

SEQ ID NO: 1227605 - RNA, 24 nt, Human
ugcccacaguggggaccccauggc

SEQ ID NO: 1227606 - RNA, 24 nt, Human
ugcccccaagcccuccccuggccu

SEQ ID NO: 1227607 - RNA, 21 nt, Human
uggcacuggaggcacacgcgc

SEQ ID NO: 1227608 - RNA, 21 nt, Human
ugggaggcaguugggcaaaau

SEQ ID NO: 1227609 - RNA, 23 nt, Human
uguccaagcacagucacguucug

SEQ ID NO: 1227610 - RNA, 18 nt, Human
ugucucauucacugucuc

SEQ ID NO: 1227611 - RNA, 29 nt, Human
uguggagggacccagcagauggagccggc

SEQ ID NO: 1227612 - RNA, 22 nt, Human
uuccaugguuugggaggcaguu

SEQ ID NO: 1227613 - RNA, 20 nt, Human
aagggggaaaaacacuugua

SEQ ID NO: 1227614 - RNA, 18 nt, Human
auuggacaagcuucagcc

SEQ ID NO: 1227615 - RNA, 20 nt, Human
caaaguaggggaaucaacaa

SEQ ID NO: 1227616 - RNA, 24 nt, Human
cacacaccuugcaugagugaggug

SEQ ID NO: 1227617 - RNA, 23 nt, Human
ccaaaguaggggaaucaacagaa

SEQ ID NO: 1227618 - RNA, 20 nt, Human
ccuugcaugagugaggugcc

SEQ ID NO: 1227619 - RNA, 20 nt, Human
gaacaagcguagauauucuc

SEQ ID NO: 1227620 - RNA, 23 nt, Human
gaacaagcguagauauucuccau

SEQ ID NO: 1227621 - RNA, 20 nt, Human
gaagggggaaaaacacuugu

SEQ ID NO: 1227622 - RNA, 18 nt, Human
gagcaucuauggagcacc

SEQ ID NO: 1227623 - RNA, 19 nt, Human
gauuggacaagcuucagcc

SEQ ID NO: 1227624 - RNA, 20 nt, Human
gauuggacaagcuucagccc

SEQ ID NO: 1227625 - RNA, 20 nt, Human
gcaugacaaagaaaaggagg

SEQ ID NO: 1227626 - RNA, 23 nt, Human
gcccacucuugaagguaaaggaa

SEQ ID NO: 1227627 - RNA, 19 nt, Human
ggcugugcauguuuucagc

SEQ ID NO: 1227628 - RNA, 25 nt, Human
guacagcauaaugguggcuuccucc

SEQ ID NO: 1227629 - RNA, 18 nt, Human
uaacauaaaaauucugcu

SEQ ID NO: 1227630 - RNA, 19 nt, Human
uagcugaaaaaagcauuau

SEQ ID NO: 1227631 - RNA, 21 nt, Human
uagcugaaaaaagcauuauca

SEQ ID NO: 1227632 - RNA, 23 nt, Human
ucaacagaacuuggguuucaaaa

SEQ ID NO: 1227633 - RNA, 19 nt, Human
ugcaugcaugacaaagaaa

SEQ ID NO: 1227634 - RNA, 27 nt, Human
ugccuggggcaguguuuaaccgggucg

SEQ ID NO: 1227635 - RNA, 19 nt, Human
ugcuuggcaacauagcuga

SEQ ID NO: 1227636 - RNA, 18 nt, Human
uggagcacccaaaguagg

SEQ ID NO: 1227637 - RNA, 19 nt, Human
uguugcuaucaucuuuguc

SEQ ID NO: 1227638 - RNA, 22 nt, Human
uuggcaacauagcugaaaaaag

SEQ ID NO: 1227639 - RNA, 18 nt, Human
aagggggaaaaacacuug

SEQ ID NO: 1227640 - RNA, 20 nt, Human
aagggggaaaaacacuugua

SEQ ID NO: 1227641 - RNA, 22 nt, Human
accuugcaugagcgaggugccc

SEQ ID NO: 1227642 - RNA, 18 nt, Human
auuggacaagcuucagcc

SEQ ID NO: 1227643 - RNA, 20 nt, Human
caaaguaggggaaucaacaa

SEQ ID NO: 1227644 - RNA, 24 nt, Human
cacgcaccuugcaugagcgaggug

SEQ ID NO: 1227645 - RNA, 24 nt, Human
cucaaaguaggggaaucaacagaa

SEQ ID NO: 1227646 - RNA, 21 nt, Human
cuugcaugagcgaggugcccu

SEQ ID NO: 1227647 - RNA, 20 nt, Human
gaacaagcguagauauucuc

SEQ ID NO: 1227648 - RNA, 23 nt, Human
gaacaagcguagauauucuccau

SEQ ID NO: 1227649 - RNA, 19 nt, Human
gauuggacaagcuucagcc

SEQ ID NO: 1227650 - RNA, 20 nt, Human
gauuggacaagcuucagccc

SEQ ID NO: 1227651 - RNA, 23 nt, Human
gcccacucuugaagguaaaggaa

SEQ ID NO: 1227652 - RNA, 19 nt, Human
gcgaggugcccuggugugu

SEQ ID NO: 1227653 - RNA, 25 nt, Human
guacagcauaaugguggcuuccucc

SEQ ID NO: 1227654 - RNA, 18 nt, Human
uaacauaaaaauucugcu

SEQ ID NO: 1227655 - RNA, 19 nt, Human
uagcugaaaaacgcauuau

SEQ ID NO: 1227656 - RNA, 23 nt, Human
ucaacagaacuuggguuugaaaa

SEQ ID NO: 1227657 - RNA, 23 nt, Human
ucauuguugcuaucaucuuuguc

SEQ ID NO: 1227658 - RNA, 21 nt, Human
ugaaaaacgcauuaucaguua

SEQ ID NO: 1227659 - RNA, 21 nt, Human
ugaacaagcguagauauucuc

SEQ ID NO: 1227660 - RNA, 21 nt, Human
ugcaugacaaagaaaaggagg

SEQ ID NO: 1227661 - RNA, 19 nt, Human
ugcaugcaugacaaagaaa

SEQ ID NO: 1227662 - RNA, 27 nt, Human
ugccuggggcaguguuuaaccgggucg

SEQ ID NO: 1227663 - RNA, 19 nt, Human
ugcuuggcaacauagcuga

SEQ ID NO: 1227664 - RNA, 19 nt, Human
ugucuccucucuugaagua

SEQ ID NO: 1227665 - RNA, 20 nt, Human
uuugggguggauucauucca

SEQ ID NO: 1227666 - RNA, 24 nt, Human
aaaacaaaccagcagagaaaaagc

SEQ ID NO: 1227667 - RNA, 21 nt, Human
aaaaccaaagcacaaacacua

SEQ ID NO: 1227668 - RNA, 19 nt, Human
aaaaggccaggcaaagggu

SEQ ID NO: 1227669 - RNA, 24 nt, Human
aaacaaaccagcagagaaaaagca

SEQ ID NO: 1227670 - RNA, 27 nt, Human
aaacaaaccagcagagaaaaagcaagc

SEQ ID NO: 1227671 - RNA, 18 nt, Human
aaacccaacagauguccc

SEQ ID NO: 1227672 - RNA, 25 nt, Human
aaacccaacagaugucccaccgaaa

SEQ ID NO: 1227673 - RNA, 19 nt, Human
aaagacaccaaaauaauga

SEQ ID NO: 1227674 - RNA, 19 nt, Human
aacacggugaaaccccguc

SEQ ID NO: 1227675 - RNA, 20 nt, Human
aacacggugaaaccccgucu

SEQ ID NO: 1227676 - RNA, 21 nt, Human
aacacggugaaaccccgucuc

SEQ ID NO: 1227677 - RNA, 21 nt, Human
aacagaauauuacucagccuu

SEQ ID NO: 1227678 - RNA, 24 nt, Human
aaccacgugaacaugaggacccca

SEQ ID NO: 1227679 - RNA, 23 nt, Human
aaccauguagcuaaaaaagcaaa

SEQ ID NO: 1227680 - RNA, 19 nt, Human
aacccaacagaugucccac

SEQ ID NO: 1227681 - RNA, 19 nt, Human
aacccuggggccagcagca

SEQ ID NO: 1227682 - RNA, 19 nt, Human
aaccucucagauccuuagu

SEQ ID NO: 1227683 - RNA, 21 nt, Human
aagaagcaggagaagaaugag

SEQ ID NO: 1227684 - RNA, 21 nt, Human
aagaagcaggagaagaaugag

SEQ ID NO: 1227685 - RNA, 20 nt, Human
aagaagccagagcacaggga

SEQ ID NO: 1227686 - RNA, 20 nt, Human
aagacaccaaaauaaugaca

SEQ ID NO: 1227687 - RNA, 22 nt, Human
aagcaaaaccaaagcacaaaca

SEQ ID NO: 1227688 - RNA, 23 nt, Human
aagcacuuuuucuucaggugguu

SEQ ID NO: 1227689 - RNA, 18 nt, Human
aagcaggagaagaaugag

SEQ ID NO: 1227690 - RNA, 23 nt, Human
aagcaggagaagaaugaggcugg

SEQ ID NO: 1227691 - RNA, 20 nt, Human
aagcaggagaagaaugaggg

SEQ ID NO: 1227692 - RNA, 19 nt, Human
aagccaagcacaaaaggac

SEQ ID NO: 1227693 - RNA, 19 nt, Human
aaggagauggaggacucca

SEQ ID NO: 1227694 - RNA, 22 nt, Human
aaggagcacccucugaaguuca

SEQ ID NO: 1227695 - RNA, 21 nt, Human
aaguugaacuugucaaagaug

SEQ ID NO: 1227696 - RNA, 20 nt, Human
acagagagcugggccugacg

SEQ ID NO: 1227697 - RNA, 24 nt, Human
acaggugaguggauaaacaaugcg

SEQ ID NO: 1227698 - RNA, 19 nt, Human
acagugcuguggcaaggug

SEQ ID NO: 1227699 - RNA, 22 nt, Human
acauggguccgguuccuggaca

SEQ ID NO: 1227700 - RNA, 18 nt, Human
acauuccagguacugugc

SEQ ID NO: 1227701 - RNA, 22 nt, Human
accaaaauaaugacagcucaug

SEQ ID NO: 1227702 - RNA, 22 nt, Human
accacgugacccagcaagccca

SEQ ID NO: 1227703 - RNA, 21 nt, Human
acccaaaagaacugaaagcag

SEQ ID NO: 1227704 - RNA, 18 nt, Human
accccagagccagggaag

SEQ ID NO: 1227705 - RNA, 24 nt, Human
accccgucucuacuaaaaauacaa

SEQ ID NO: 1227706 - RNA, 26 nt, Human
accggcccccugcaccgaacagccac

SEQ ID NO: 1227707 - RNA, 20 nt, Human
acgaggugugucucggcuuc

SEQ ID NO: 1227708 - RNA, 21 nt, Human
acucucgggaggcugaggcag

SEQ ID NO: 1227709 - RNA, 24 nt, Human
acucugacggugcuucugaaacag

SEQ ID NO: 1227710 - RNA, 21 nt, Human
acugcuuaaggguuggaggug

SEQ ID NO: 1227711 - RNA, 24 nt, Human
acuguacuccagccugggcgauag

SEQ ID NO: 1227712 - RNA, 22 nt, Human
agaaagaaggcacaggugcaaa

SEQ ID NO: 1227713 - RNA, 24 nt, Human
agaaagaaggcacaggugcaaaga

SEQ ID NO: 1227714 - RNA, 19 nt, Human
agaacuuggaaagcaaaga

SEQ ID NO: 1227715 - RNA, 18 nt, Human
agaauauuacucagccuu

SEQ ID NO: 1227716 - RNA, 19 nt, Human
agacagagcaacucaagua

SEQ ID NO: 1227717 - RNA, 24 nt, Human
agacagcaaaagugaaaacaaacc

SEQ ID NO: 1227718 - RNA, 21 nt, Human
agacguccaugagcaccucga

SEQ ID NO: 1227719 - RNA, 25 nt, Human
agagacagcaaaagugaaaacaaaa

SEQ ID NO: 1227720 - RNA, 23 nt, Human
agagagcuggcugcaauggaggg

SEQ ID NO: 1227721 - RNA, 20 nt, Human
agagcagcaggcucgcugcc

SEQ ID NO: 1227722 - RNA, 18 nt, Human
agauggacugcuuaaggg

SEQ ID NO: 1227723 - RNA, 19 nt, Human
agaugucgacagcaagaac

SEQ ID NO: 1227724 - RNA, 23 nt, Human
agcacuuugggaggcugaggcgg

SEQ ID NO: 1227725 - RNA, 24 nt, Human
agccugggcgauagcgugagauuc

SEQ ID NO: 1227726 - RNA, 24 nt, Human
agcuaaaaaagcaaaaccaaagca

SEQ ID NO: 1227727 - RNA, 19 nt, Human
agcuaauggcagaaacaca

SEQ ID NO: 1227728 - RNA, 21 nt, Human
aggacaguggucucugucucu

SEQ ID NO: 1227729 - RNA, 21 nt, Human
aggacuggcugagcagcccua

SEQ ID NO: 1227730 - RNA, 24 nt, Human
aggcacgguggcucacgccuguaa

SEQ ID NO: 1227731 - RNA, 21 nt, Human
aggcaggagaauggcgugaac

SEQ ID NO: 1227732 - RNA, 24 nt, Human
aggcaggagaauggcgugaacccg

SEQ ID NO: 1227733 - RNA, 24 nt, Human
aggcggagcuugcagugagcggag

SEQ ID NO: 1227734 - RNA, 19 nt, Human
aggcugaggcaggagaaug

SEQ ID NO: 1227735 - RNA, 20 nt, Human
aggcugaggcggauggaucg

SEQ ID NO: 1227736 - RNA, 24 nt, Human
agggaagugggaaauggcaggagg

SEQ ID NO: 1227737 - RNA, 21 nt, Human
agggcucaggcgggagcugcc

SEQ ID NO: 1227738 - RNA, 20 nt, Human
aggggucucggaaguggagc

SEQ ID NO: 1227739 - RNA, 24 nt, Human
agggguuccuuucuucucucuuuu

SEQ ID NO: 1227740 - RNA, 19 nt, Human
agguauagugagugcugaa

SEQ ID NO: 1227741 - RNA, 18 nt, Human
aguuccagagagagcugg

SEQ ID NO: 1227742 - RNA, 20 nt, Human
aucauaggugcaacauaaag

SEQ ID NO: 1227743 - RNA, 24 nt, Human
aucgcgccacuguacuccagccug

SEQ ID NO: 1227744 - RNA, 20 nt, Human
aucucgccuuccucugacac

SEQ ID NO: 1227745 - RNA, 25 nt, Human
aucucgccuuccucugacacuucca

SEQ ID NO: 1227746 - RNA, 26 nt, Human
caaaaccaaagcacaaacacuacugg

SEQ ID NO: 1227747 - RNA, 19 nt, Human
caaaacccaacagaugucc

SEQ ID NO: 1227748 - RNA, 21 nt, Human
caaaacccaacagauguccca

SEQ ID NO: 1227749 - RNA, 22 nt, Human
caaaagacaccaaaauaaugac

SEQ ID NO: 1227750 - RNA, 24 nt, Human
caaagaugucgacagcaagaacuc

SEQ ID NO: 1227751 - RNA, 20 nt, Human
caaagggugugcaauguucc

SEQ ID NO: 1227752 - RNA, 20 nt, Human
caacacaggugaaccuagag

SEQ ID NO: 1227753 - RNA, 24 nt, Human
caacagaauauuacucagccuuca

SEQ ID NO: 1227754 - RNA, 21 nt, Human
caacagaugucccaccgaaaa

SEQ ID NO: 1227755 - RNA, 21 nt, Human
caagcgccucuuacauuccuu

SEQ ID NO: 1227756 - RNA, 23 nt, Human
cacacaggccgaaagguggaaac

SEQ ID NO: 1227757 - RNA, 20 nt, Human
cacauaaaccauguagcuaa

SEQ ID NO: 1227758 - RNA, 22 nt, Human
cacauuuacgccagggaauggu

SEQ ID NO: 1227759 - RNA, 25 nt, Human
caccaccaccccggguucacacagc

SEQ ID NO: 1227760 - RNA, 22 nt, Human
cacccagcugcaagagcagcag

SEQ ID NO: 1227761 - RNA, 21 nt, Human
cacccucccgucccacugaca

SEQ ID NO: 1227762 - RNA, 24 nt, Human
cacgccuguaaucccagcacuuug

SEQ ID NO: 1227763 - RNA, 21 nt, Human
cacugacagggcacacaggga

SEQ ID NO: 1227764 - RNA, 19 nt, Human
cacuguacuccagccuggg

SEQ ID NO: 1227765 - RNA, 20 nt, Human
cacuguacuccagccugggc

SEQ ID NO: 1227766 - RNA, 20 nt, Human
cacuguacuccagccugggc

SEQ ID NO: 1227767 - RNA, 22 nt, Human
cacuguacuccagccugggcga

SEQ ID NO: 1227768 - RNA, 23 nt, Human
cacuguacuccagccugggcgau

SEQ ID NO: 1227769 - RNA, 24 nt, Human
cacuguacuccagccugggcgaua

SEQ ID NO: 1227770 - RNA, 18 nt, Human
cagaaacaacggugggca

SEQ ID NO: 1227771 - RNA, 18 nt, Human
cagaacacacagacaggc

SEQ ID NO: 1227772 - RNA, 19 nt, Human
cagaacacacagacaggcu

SEQ ID NO: 1227773 - RNA, 23 nt, Human
cagaauauuacucagccuucaaa

SEQ ID NO: 1227774 - RNA, 20 nt, Human
cagaccacccucccguccca

SEQ ID NO: 1227775 - RNA, 23 nt, Human
cagacccagaaccucccucccag

SEQ ID NO: 1227776 - RNA, 23 nt, Human
cagauccuccaaugagcacuucc

SEQ ID NO: 1227777 - RNA, 23 nt, Human
cagauugugcucccauccuucca

SEQ ID NO: 1227778 - RNA, 22 nt, Human
cagcacuuugggaggcugaggc

SEQ ID NO: 1227779 - RNA, 24 nt, Human
cagcacuuugggaggcugaggcgg

SEQ ID NO: 1227780 - RNA, 22 nt, Human
cagcagagaaaaagcaagcucc

SEQ ID NO: 1227781 - RNA, 18 nt, Human
cagcagauugaagccugg

SEQ ID NO: 1227782 - RNA, 22 nt, Human
cagcagcaggcacuacccauga

SEQ ID NO: 1227783 - RNA, 18 nt, Human
cagcccccaggacagccc

SEQ ID NO: 1227784 - RNA, 24 nt, Human
cagcccccaggacagcccccacuc

SEQ ID NO: 1227785 - RNA, 21 nt, Human
cagccugaggucaagaagcca

SEQ ID NO: 1227786 - RNA, 22 nt, Human
cagccugaggucaagaagccag

SEQ ID NO: 1227787 - RNA, 23 nt, Human
cagccugaggucaagaagccaga

SEQ ID NO: 1227788 - RNA, 18 nt, Human
cagcugcaagagcagcag

SEQ ID NO: 1227789 - RNA, 22 nt, Human
caggaccaugggaacagucucc

SEQ ID NO: 1227790 - RNA, 22 nt, Human
caggauuaggaugcucaaccuc

SEQ ID NO: 1227791 - RNA, 24 nt, Human
caggccccaaagcugcuuguggga

SEQ ID NO: 1227792 - RNA, 20 nt, Human
caggcgggagcugccccggg

SEQ ID NO: 1227793 - RNA, 18 nt, Human
caggggucucggaagugg

SEQ ID NO: 1227794 - RNA, 24 nt, Human
caggggucucggaaguggagcccc

SEQ ID NO: 1227795 - RNA, 20 nt, Human
cagugaggcagccugagguc

SEQ ID NO: 1227796 - RNA, 24 nt, Human
cagugaggcagccugaggucaaga

SEQ ID NO: 1227797 - RNA, 23 nt, Human
caguggcuggggaguggaguugg

SEQ ID NO: 1227798 - RNA, 22 nt, Human
cauaauagcuaauggcagaaac

SEQ ID NO: 1227799 - RNA, 20 nt, Human
cauaggggucaggcggagcg

SEQ ID NO: 1227800 - RNA, 24 nt, Human
cauguagcuaaaaaagcaaaacca

SEQ ID NO: 1227801 - RNA, 19 nt, Human
ccaaaccaaacagcaggua

SEQ ID NO: 1227802 - RNA, 25 nt, Human
ccacaccccaguucuaauguuuucu

SEQ ID NO: 1227803 - RNA, 21 nt, Human
ccaccaccaccccggguucac

SEQ ID NO: 1227804 - RNA, 22 nt, Human
ccacgugacccagcaagcccac

SEQ ID NO: 1227805 - RNA, 20 nt, Human
ccacuguacuccagccuggg

SEQ ID NO: 1227806 - RNA, 20 nt, Human
ccacuguacuccagccuggg

SEQ ID NO: 1227807 - RNA, 21 nt, Human
ccacuguacuccagccugggc

SEQ ID NO: 1227808 - RNA, 21 nt, Human
ccacuguacuccagccugggc

SEQ ID NO: 1227809 - RNA, 23 nt, Human
ccacuguacuccagccugggcga

SEQ ID NO: 1227810 - RNA, 20 nt, Human
ccacuucuggguauacaccc

SEQ ID NO: 1227811 - RNA, 23 nt, Human
ccagcagagaaaaagcaagcucc

SEQ ID NO: 1227812 - RNA, 19 nt, Human
ccaggccauccuggccaaa

SEQ ID NO: 1227813 - RNA, 22 nt, Human
ccauccuggccaaaccaaacag

SEQ ID NO: 1227814 - RNA, 22 nt, Human
cccaaaagaacugaaagcagac

SEQ ID NO: 1227815 - RNA, 18 nt, Human
cccacacguagcugggag

SEQ ID NO: 1227816 - RNA, 20 nt, Human
cccagaaccucccucccagg

SEQ ID NO: 1227817 - RNA, 24 nt, Human
ccccaagacagcucucagugccag

SEQ ID NO: 1227818 - RNA, 21 nt, Human
ccccuuccugccacucccucc

SEQ ID NO: 1227819 - RNA, 23 nt, Human
cccgcugcuggaaccaccaccac

SEQ ID NO: 1227820 - RNA, 18 nt, Human
cccgggacagagagcugg

SEQ ID NO: 1227821 - RNA, 19 nt, Human
cccucggggcacaagaugg

SEQ ID NO: 1227822 - RNA, 25 nt, Human
cccugggcguguggucugcggggug

SEQ ID NO: 1227823 - RNA, 22 nt, Human
ccgaacagccacccagcugcaa

SEQ ID NO: 1227824 - RNA, 18 nt, Human
ccgcuccggcccagcccc

SEQ ID NO: 1227825 - RNA, 18 nt, Human
ccggcccagccccgggcc

SEQ ID NO: 1227826 - RNA, 21 nt, Human
ccucaaaaaaucaaccacagg

SEQ ID NO: 1227827 - RNA, 22 nt, Human
ccuccugccuucgccacucuga

SEQ ID NO: 1227828 - RNA, 23 nt, Human
ccugcccuccgccagacugggaa

SEQ ID NO: 1227829 - RNA, 22 nt, Human
ccuguaaucccagcacuuuggg

SEQ ID NO: 1227830 - RNA, 22 nt, Human
ccuguagucccagcuacucucg

SEQ ID NO: 1227831 - RNA, 23 nt, Human
ccuguagucccagcuacucucgg

SEQ ID NO: 1227832 - RNA, 18 nt, Human
ccuguggcagacccagaa

SEQ ID NO: 1227833 - RNA, 24 nt, Human
cgaaaccauucuggcuaacacggu

SEQ ID NO: 1227834 - RNA, 19 nt, Human
cgacagcaagaacuccagu

SEQ ID NO: 1227835 - RNA, 22 nt, Human
cgacccaggcaugcgucaacag

SEQ ID NO: 1227836 - RNA, 23 nt, Human
cgccagggaaugguuccagaaca

SEQ ID NO: 1227837 - RNA, 26 nt, Human
cgccuguagucccagcuacucucggg

SEQ ID NO: 1227838 - RNA, 24 nt, Human
cgcucagugaaauaagccaagcac

SEQ ID NO: 1227839 - RNA, 20 nt, Human
cgggacagagagcugggccu

SEQ ID NO: 1227840 - RNA, 18 nt, Human
cgggguuguuugggucau

SEQ ID NO: 1227841 - RNA, 19 nt, Human
cgggucgggugugugggga

SEQ ID NO: 1227842 - RNA, 19 nt, Human
cuagagaacauuacgcuca

SEQ ID NO: 1227843 - RNA, 21 nt, Human
cucaaaaaaucaaccacagga

SEQ ID NO: 1227844 - RNA, 19 nt, Human
cucacauaaaccauguagc

SEQ ID NO: 1227845 - RNA, 22 nt, Human
cucacgccuguaaucccagcac

SEQ ID NO: 1227846 - RNA, 24 nt, Human
cucacgccuguaaucccagcacuu

SEQ ID NO: 1227847 - RNA, 18 nt, Human
cuccaucuccagcagggu

SEQ ID NO: 1227848 - RNA, 23 nt, Human
cuccuggcgugggcucacucacc

SEQ ID NO: 1227849 - RNA, 21 nt, Human
cucgugcaccaccuccugccu

SEQ ID NO: 1227850 - RNA, 23 nt, Human
cucuuacauuccagguacugugc

SEQ ID NO: 1227851 - RNA, 19 nt, Human
cugcaccgaacagccaccc

SEQ ID NO: 1227852 - RNA, 22 nt, Human
cugcaccgaacagccacccagc

SEQ ID NO: 1227853 - RNA, 20 nt, Human
cugcuggaaccaccaccacc

SEQ ID NO: 1227854 - RNA, 23 nt, Human
cuggccuuaccagggggccuucu

SEQ ID NO: 1227855 - RNA, 18 nt, Human
cuggcuaacacggugaaa

SEQ ID NO: 1227856 - RNA, 22 nt, Human
cuggcuaacacggugaaacccc

SEQ ID NO: 1227857 - RNA, 23 nt, Human
cuggcuaacacggugaaaccccg

SEQ ID NO: 1227858 - RNA, 18 nt, Human
cuggguauacacccaaaa

SEQ ID NO: 1227859 - RNA, 18 nt, Human
cuuccugccacucccucc

SEQ ID NO: 1227860 - RNA, 21 nt, Human
cuuccugccacucccuccugg

SEQ ID NO: 1227861 - RNA, 21 nt, Human
cuugcagugagcggagaucgc

SEQ ID NO: 1227862 - RNA, 18 nt, Human
gaacugaaagcagacgcc

SEQ ID NO: 1227863 - RNA, 20 nt, Human
gaagugggaaauggcaggag

SEQ ID NO: 1227864 - RNA, 21 nt, Human
gacccaggcaugcgucaacag

SEQ ID NO: 1227865 - RNA, 22 nt, Human
gaccccacaucagagucacccc

SEQ ID NO: 1227866 - RNA, 18 nt, Human
gagaagaaugaggcuggg

SEQ ID NO: 1227867 - RNA, 19 nt, Human
gaucugugggccccacggc

SEQ ID NO: 1227868 - RNA, 23 nt, Human
gcaagcucccuguaaagacagag

SEQ ID NO: 1227869 - RNA, 21 nt, Human
gccaagcgccucuuacauucc

SEQ ID NO: 1227870 - RNA, 22 nt, Human
gccacuguacuccagccugggc

SEQ ID NO: 1227871 - RNA, 24 nt, Human
gccacuguacuccagccugggcga

SEQ ID NO: 1227872 - RNA, 21 nt, Human
gccagaccccaaagcugggcu

SEQ ID NO: 1227873 - RNA, 21 nt, Human
gccagucuccggcccagcccc

SEQ ID NO: 1227874 - RNA, 19 nt, Human
gccccaaagcugcuugugg

SEQ ID NO: 1227875 - RNA, 22 nt, Human
gcccccacucauggcucuccac

SEQ ID NO: 1227876 - RNA, 26 nt, Human
gcgcagcccccaggacaggggaacgc

SEQ ID NO: 1227877 - RNA, 24 nt, Human
gcuaacacggugaaaccccgucuc

SEQ ID NO: 1227878 - RNA, 21 nt, Human
gcuacaacacaggugaaccua

SEQ ID NO: 1227879 - RNA, 19 nt, Human
gcucccauccuuccaccac

SEQ ID NO: 1227880 - RNA, 22 nt, Human
gcugaggcaggagaauggcgug

SEQ ID NO: 1227881 - RNA, 19 nt, Human
gcuggaaccaccaccaccc

SEQ ID NO: 1227882 - RNA, 23 nt, Human
ggacaugccauggauguguuucu

SEQ ID NO: 1227883 - RNA, 18 nt, Human
ggacucccaggccauccu

SEQ ID NO: 1227884 - RNA, 24 nt, Human
ggagaucgcgccacuguacuccag

SEQ ID NO: 1227885 - RNA, 18 nt, Human
ggagcuugcagugagcgg

SEQ ID NO: 1227886 - RNA, 24 nt, Human
ggagcuugcagugagcggagaucg

SEQ ID NO: 1227887 - RNA, 21 nt, Human
ggccaggcacgguggcucacg

SEQ ID NO: 1227888 - RNA, 18 nt, Human
ggcgguuggggucauagg

SEQ ID NO: 1227889 - RNA, 18 nt, Human
ggcgugguggcgggcgcc

SEQ ID NO: 1227890 - RNA, 22 nt, Human
ggcgugguggcgggcgccugua

SEQ ID NO: 1227891 - RNA, 21 nt, Human
gggugguccuccggcuggcug

SEQ ID NO: 1227892 - RNA, 22 nt, Human
ggucugcggggugguccuccgg

SEQ ID NO: 1227893 - RNA, 23 nt, Human
gguggcucacgccuguaauccca

SEQ ID NO: 1227894 - RNA, 24 nt, Human
gguggcucacgccuguaaucccag

SEQ ID NO: 1227895 - RNA, 20 nt, Human
ggugggcaccaguggcuggg

SEQ ID NO: 1227896 - RNA, 22 nt, Human
guaaaugggaugugaacguuaa

SEQ ID NO: 1227897 - RNA, 22 nt, Human
gucgcuucggggcgggcgccag

SEQ ID NO: 1227898 - RNA, 24 nt, Human
gucucugucucugggccaggguca

SEQ ID NO: 1227899 - RNA, 23 nt, Human
gugaaaugucacugugaaggccc

SEQ ID NO: 1227900 - RNA, 21 nt, Human
gugcguccucaaaaaaucaac

SEQ ID NO: 1227901 - RNA, 23 nt, Human
gugcuccauccacacaacagaau

SEQ ID NO: 1227902 - RNA, 23 nt, Human
guggcgggcgccuguagucccag

SEQ ID NO: 1227903 - RNA, 20 nt, Human
guuugcuacaacacagguga

SEQ ID NO: 1227904 - RNA, 23 nt, Human
guuuggggguaggcucagcgggc

SEQ ID NO: 1227905 - RNA, 20 nt, Human
uaaaaaagcaaaaccaaagc

SEQ ID NO: 1227906 - RNA, 21 nt, Human
uaaagccagaccccaaagcug

SEQ ID NO: 1227907 - RNA, 28 nt, Human
uaaauguccagcaaaagacaccaaaaua

SEQ ID NO: 1227908 - RNA, 22 nt, Human
uaacacggugaaaccccgucuc

SEQ ID NO: 1227909 - RNA, 24 nt, Human
uaacacggugaaaccccgucucua

SEQ ID NO: 1227910 - RNA, 19 nt, Human
uaacccuggggccagcagc

SEQ ID NO: 1227911 - RNA, 20 nt, Human
uaagccaagcacaaaaggac

SEQ ID NO: 1227912 - RNA, 21 nt, Human
uaagccaagcacaaaaggaca

SEQ ID NO: 1227913 - RNA, 23 nt, Human
uaagccaagcacaaaaggacaaa

SEQ ID NO: 1227914 - RNA, 20 nt, Human
uaccacgugacccagcaagc

SEQ ID NO: 1227915 - RNA, 21 nt, Human
uaccacgugacccagcaagcc

SEQ ID NO: 1227916 - RNA, 22 nt, Human
uaccacgugacccagcaagccc

SEQ ID NO: 1227917 - RNA, 18 nt, Human
uaccagggggccuucugc

SEQ ID NO: 1227918 - RNA, 22 nt, Human
uaccuaagcacuuuuucuucag

SEQ ID NO: 1227919 - RNA, 22 nt, Human
uacuccagccugggcgauagcg

SEQ ID NO: 1227920 - RNA, 24 nt, Human
uacuccagccugggcgauagcgug

SEQ ID NO: 1227921 - RNA, 20 nt, Human
uagaacuuggaaagcaaaga

SEQ ID NO: 1227922 - RNA, 22 nt, Human
uagcagcaaaacucaaacgggg

SEQ ID NO: 1227923 - RNA, 21 nt, Human
uagcgcagcccccaggacagc

SEQ ID NO: 1227924 - RNA, 26 nt, Human
uagcuaaaaaagcaaaaccaaagcac

SEQ ID NO: 1227925 - RNA, 21 nt, Human
uaggagccucuggaaugggcc

SEQ ID NO: 1227926 - RNA, 27 nt, Human
ucaaaacccaacagaugucccaccgaa

SEQ ID NO: 1227927 - RNA, 22 nt, Human
ucaagaagguucagauucugga

SEQ ID NO: 1227928 - RNA, 22 nt, Human
ucaaucacccagucacugagaa

SEQ ID NO: 1227929 - RNA, 22 nt, Human
ucacacagcugcgaugcacucc

SEQ ID NO: 1227930 - RNA, 21 nt, Human
ucacugugaaggccugugcuu

SEQ ID NO: 1227931 - RNA, 22 nt, Human
ucagaaauuuaaaaagaaagaa

SEQ ID NO: 1227932 - RNA, 22 nt, Human
ucagagcagcaccauucacaca

SEQ ID NO: 1227933 - RNA, 19 nt, Human
ucaggauuuugacuugugg

SEQ ID NO: 1227934 - RNA, 24 nt, Human
ucagggugucgcuuucaccugcug

SEQ ID NO: 1227935 - RNA, 21 nt, Human
ucaguuucaagcaugacccca

SEQ ID NO: 1227936 - RNA, 21 nt, Human
uccaaggagcacccucugaag

SEQ ID NO: 1227937 - RNA, 22 nt, Human
uccaccaggacgggccucucca

SEQ ID NO: 1227938 - RNA, 24 nt, Human
uccagccugggcgauagcgugaga

SEQ ID NO: 1227939 - RNA, 22 nt, Human
uccaggggucucggaaguggag

SEQ ID NO: 1227940 - RNA, 22 nt, Human
ucccagcagaugagagccacag

SEQ ID NO: 1227941 - RNA, 25 nt, Human
ucccaggccauccuggccaaaccaa

SEQ ID NO: 1227942 - RNA, 18 nt, Human
ucccagggacacugcagg

SEQ ID NO: 1227943 - RNA, 22 nt, Human
ucccauccuuccaccacacccc

SEQ ID NO: 1227944 - RNA, 21 nt, Human
ucccccaugaauggcuuggug

SEQ ID NO: 1227945 - RNA, 21 nt, Human
uccggcccagccccgggccgg

SEQ ID NO: 1227946 - RNA, 19 nt, Human
uccucaaaaaaucaaccac

SEQ ID NO: 1227947 - RNA, 22 nt, Human
uccucgggcugcucccaccaag

SEQ ID NO: 1227948 - RNA, 25 nt, Human
uccuuccaccacaccccaguucuaa

SEQ ID NO: 1227949 - RNA, 19 nt, Human
uccuuuaagugucagguug

SEQ ID NO: 1227950 - RNA, 19 nt, Human
ucgcaggcugcuccccacc

SEQ ID NO: 1227951 - RNA, 24 nt, Human
ucgcgaggugaggagaucgaaacc

SEQ ID NO: 1227952 - RNA, 23 nt, Human
ucgcgccacuguacuccagccug

SEQ ID NO: 1227953 - RNA, 19 nt, Human
ucgcuuucaccugcugauc

SEQ ID NO: 1227954 - RNA, 21 nt, Human
ucgugcaccaccuccugccuu

SEQ ID NO: 1227955 - RNA, 23 nt, Human
ucgugcaccaccuccugccuucg

SEQ ID NO: 1227956 - RNA, 25 nt, Human
ucuaaacagagacagcaaaagugaa

SEQ ID NO: 1227957 - RNA, 22 nt, Human
ucucaaaacccaacagaugucc

SEQ ID NO: 1227958 - RNA, 23 nt, Human
ucucaaaacccaacagauguccc

SEQ ID NO: 1227959 - RNA, 21 nt, Human
ucucacucuguuaguuccaga

SEQ ID NO: 1227960 - RNA, 22 nt, Human
ucucacucuguuaguuccagag

SEQ ID NO: 1227961 - RNA, 19 nt, Human
ucucaguuucaagcaugac

SEQ ID NO: 1227962 - RNA, 18 nt, Human
ucuccacugugcccagag

SEQ ID NO: 1227963 - RNA, 22 nt, Human
ucucuacuaaaaauacaaaaaa

SEQ ID NO: 1227964 - RNA, 24 nt, Human
ucuggcuaacacggugaaaccccg

SEQ ID NO: 1227965 - RNA, 26 nt, Human
ucuucagguggcacaauguuuuaugg

SEQ ID NO: 1227966 - RNA, 21 nt, Human
ucuuugcccggcccuggggac

SEQ ID NO: 1227967 - RNA, 19 nt, Human
ugaaacaggccagauaaac

SEQ ID NO: 1227968 - RNA, 20 nt, Human
ugaaagcagacgcccagaua

SEQ ID NO: 1227969 - RNA, 18 nt, Human
ugaaagcccggcgcccuc

SEQ ID NO: 1227970 - RNA, 18 nt, Human
ugaaaugucacugugaag

SEQ ID NO: 1227971 - RNA, 20 nt, Human
ugaaggugaacuagccagug

SEQ ID NO: 1227972 - RNA, 20 nt, Human
ugacagccucgggucgggug

SEQ ID NO: 1227973 - RNA, 18 nt, Human
ugacagggcacacaggga

SEQ ID NO: 1227974 - RNA, 19 nt, Human
ugacagggcccugcccucc

SEQ ID NO: 1227975 - RNA, 23 nt, Human
ugacccagcaagcccacuucugg

SEQ ID NO: 1227976 - RNA, 20 nt, Human
ugacggugcuucugaaacag

SEQ ID NO: 1227977 - RNA, 20 nt, Human
ugagagccacagcauggcuc

SEQ ID NO: 1227978 - RNA, 22 nt, Human
ugagcggagaucgcgccacugu

SEQ ID NO: 1227979 - RNA, 24 nt, Human
ugaggcaggagaauggcgugaacc

SEQ ID NO: 1227980 - RNA, 25 nt, Human
ugaggcaggagaauggcgugaaccc

SEQ ID NO: 1227981 - RNA, 19 nt, Human
ugaggcggauggaucgcga

SEQ ID NO: 1227982 - RNA, 20 nt, Human
ugaggcugggcugaacuggc

SEQ ID NO: 1227983 - RNA, 18 nt, Human
ugaggguagaugcuuuca

SEQ ID NO: 1227984 - RNA, 22 nt, Human
ugaucggggccucccccucggu

SEQ ID NO: 1227985 - RNA, 23 nt, Human
ugcacaaaugcccugaggacaug

SEQ ID NO: 1227986 - RNA, 18 nt, Human
ugcaggacaguggucucu

SEQ ID NO: 1227987 - RNA, 19 nt, Human
ugccagcaggugcuucuca

SEQ ID NO: 1227988 - RNA, 23 nt, Human
ugcccagaggaauugugaugggg

SEQ ID NO: 1227989 - RNA, 22 nt, Human
ugcccgggacagagagcugggc

SEQ ID NO: 1227990 - RNA, 25 nt, Human
ugcccugaggacaugccauggaugu

SEQ ID NO: 1227991 - RNA, 25 nt, Human
ugcucccauccuuccaccacacccc

SEQ ID NO: 1227992 - RNA, 18 nt, Human
ugcuucugaaacaggcca

SEQ ID NO: 1227993 - RNA, 23 nt, Human
uggaaagcaaagaagcaggagaa

SEQ ID NO: 1227994 - RNA, 21 nt, Human
uggaaccaccaccaccccggg

SEQ ID NO: 1227995 - RNA, 19 nt, Human
uggagacguccaugagcac

SEQ ID NO: 1227996 - RNA, 20 nt, Human
uggagagagagcaggucuuc

SEQ ID NO: 1227997 - RNA, 25 nt, Human
uggauaaacaaugcgugcuccaucc

SEQ ID NO: 1227998 - RNA, 18 nt, Human
uggcagaaacacaaggaa

SEQ ID NO: 1227999 - RNA, 19 nt, Human
uggccaaaccaaacagcag

SEQ ID NO: 1228000 - RNA, 22 nt, Human
uggcucacgccuguaaucccag

SEQ ID NO: 1228001 - RNA, 24 nt, Human
uggcucacgccuguaaucccagca

SEQ ID NO: 1228002 - RNA, 20 nt, Human
uggcuggggaguggaguugg

SEQ ID NO: 1228003 - RNA, 21 nt, Human
uggcuugguguccuccccuug

SEQ ID NO: 1228004 - RNA, 18 nt, Human
ugggaacagucucccuuc

SEQ ID NO: 1228005 - RNA, 25 nt, Human
ugggaaggagauggaggacuccagc

SEQ ID NO: 1228006 - RNA, 19 nt, Human
ugggaggcugaggcggaug

SEQ ID NO: 1228007 - RNA, 23 nt, Human
ugggaggcugaggcggauggauc

SEQ ID NO: 1228008 - RNA, 24 nt, Human
ugggaggcugaggcggauggaucg

SEQ ID NO: 1228009 - RNA, 19 nt, Human
ugggagggggcauuucuga

SEQ ID NO: 1228010 - RNA, 24 nt, Human
ugggagggggcauuucugacagaa

SEQ ID NO: 1228011 - RNA, 18 nt, Human
uggggagaguguuccugc

SEQ ID NO: 1228012 - RNA, 18 nt, Human
uggggagaguguuccugc

SEQ ID NO: 1228013 - RNA, 18 nt, Human
uggggucauagggcucag

SEQ ID NO: 1228014 - RNA, 22 nt, Human
ugguauggggacccccacacgu

SEQ ID NO: 1228015 - RNA, 19 nt, Human
uggucgggguuguuugggu

SEQ ID NO: 1228016 - RNA, 24 nt, Human
ugguggcgggcgccuguaguccca

SEQ ID NO: 1228017 - RNA, 21 nt, Human
ugucacagauccuccaaugag

SEQ ID NO: 1228018 - RNA, 24 nt, Human
ugucagguuggugcucaagaaggu

SEQ ID NO: 1228019 - RNA, 23 nt, Human
ugucucucucaucagggccucca

SEQ ID NO: 1228020 - RNA, 22 nt, Human
uguucagagcagcaccauucac

SEQ ID NO: 1228021 - RNA, 23 nt, Human
uguugggggcagucuuugcccgg

SEQ ID NO: 1228022 - RNA, 18 nt, Human
uuaauacauuugccacaa

SEQ ID NO: 1228023 - RNA, 25 nt, Human
uuaccagaggcugcggcgguugggg

SEQ ID NO: 1228024 - RNA, 18 nt, Human
uuagcugggcgugguggc

SEQ ID NO: 1228025 - RNA, 24 nt, Human
uuagcugggcgugguggcgggcgc

SEQ ID NO: 1228026 - RNA, 20 nt, Human
uucagagacagaaacaacgg

SEQ ID NO: 1228027 - RNA, 24 nt, Human
uucagcagauugaagccugggggu

SEQ ID NO: 1228028 - RNA, 22 nt, Human
uucauccccagagcagguuuca

SEQ ID NO: 1228029 - RNA, 21 nt, Human
uuccagggugugguguccugu

SEQ ID NO: 1228030 - RNA, 20 nt, Human
uuccuggacaggagcuugaa

SEQ ID NO: 1228031 - RNA, 20 nt, Human
uugaacuugucaaagauguc

SEQ ID NO: 1228032 - RNA, 23 nt, Human
uugaggaggggcagguuuggggg

SEQ ID NO: 1228033 - RNA, 22 nt, Human
uugcagugagcggagaucgcgc

SEQ ID NO: 1228034 - RNA, 23 nt, Human
uugcccggcccuggggacuccca

SEQ ID NO: 1228035 - RNA, 18 nt, Human
uuggaggugggcgugguc

SEQ ID NO: 1228036 - RNA, 24 nt, Human
uugggaggcugaggcggauggauc

SEQ ID NO: 1228037 - RNA, 18 nt, Human
uuguuugggucauggggg

SEQ ID NO: 1228038 - RNA, 22 nt, Human
uuguuugggucauggggguggg

SEQ ID NO: 1228039 - RNA, 18 nt, Human
auuggacaagcuucagcc

SEQ ID NO: 1228040 - RNA, 20 nt, Human
caaaguaggggaaucaacaa

SEQ ID NO: 1228041 - RNA, 24 nt, Human
cacgcaccuugcaugagcgaggug

SEQ ID NO: 1228042 - RNA, 21 nt, Human
ccuugcaugagcgaggugccc

SEQ ID NO: 1228043 - RNA, 24 nt, Human
cucaaaguaggggaaucaacagaa

SEQ ID NO: 1228044 - RNA, 21 nt, Human
cuugcaugagcgaggugcccu

SEQ ID NO: 1228045 - RNA, 20 nt, Human
gaacaagcguagauauucuc

SEQ ID NO: 1228046 - RNA, 23 nt, Human
gaacaagcguagauauucuccau

SEQ ID NO: 1228047 - RNA, 19 nt, Human
gauuggacaagcuucagcc

SEQ ID NO: 1228048 - RNA, 20 nt, Human
gauuggacaagcuucagccc

SEQ ID NO: 1228049 - RNA, 23 nt, Human
gcccacucuugaagguaaaggaa

SEQ ID NO: 1228050 - RNA, 25 nt, Human
guacagcauaaugguggcuuccucc

SEQ ID NO: 1228051 - RNA, 18 nt, Human
uaacauaaaaauucugcu

SEQ ID NO: 1228052 - RNA, 19 nt, Human
uagcugaaaaacgcauuau

SEQ ID NO: 1228053 - RNA, 23 nt, Human
ucaacagaacuuggguuugaaaa

SEQ ID NO: 1228054 - RNA, 21 nt, Human
ugaaaaacgcauuaucaguua

SEQ ID NO: 1228055 - RNA, 21 nt, Human
ugaacaagcguagauauucuc

SEQ ID NO: 1228056 - RNA, 21 nt, Human
ugcaugacaaagaaaaggagg

SEQ ID NO: 1228057 - RNA, 19 nt, Human
ugcaugcaugacaaagaaa

SEQ ID NO: 1228058 - RNA, 27 nt, Human
ugccuggggcaguguuuaaccgggucg

SEQ ID NO: 1228059 - RNA, 19 nt, Human
ugcuuggcaacauagcuga

SEQ ID NO: 1228060 - RNA, 18 nt, Human
ugucuccucucuugaagu

SEQ ID NO: 1228061 - RNA, 19 nt, Human
uguugcuaucaucuuuguc

SEQ ID NO: 1228062 - RNA, 20 nt, Human
uuugggguggauucauucca

SEQ ID NO: 1228063 - RNA, 18 nt, Human
aacccgugucuccucucu

SEQ ID NO: 1228064 - RNA, 18 nt, Human
auuggacaagcuucagcc

SEQ ID NO: 1228065 - RNA, 20 nt, Human
caaaguaggggaaucaacaa

SEQ ID NO: 1228066 - RNA, 24 nt, Human
cacgcaccuugcaugagcgaggug

SEQ ID NO: 1228067 - RNA, 25 nt, Human
ccuggggcaguguuuaaccgggucg

SEQ ID NO: 1228068 - RNA, 21 nt, Human
ccuugcaugagcgaggugccc

SEQ ID NO: 1228069 - RNA, 24 nt, Human
cucaaaguaggggaaucaacagaa

SEQ ID NO: 1228070 - RNA, 21 nt, Human
cuugcaugagcgaggugcccu

SEQ ID NO: 1228071 - RNA, 20 nt, Human
gaacaagcguagauauucuc

SEQ ID NO: 1228072 - RNA, 23 nt, Human
gaacaagcguagauauucuccau

SEQ ID NO: 1228073 - RNA, 19 nt, Human
gauuggacaagcuucagcc

SEQ ID NO: 1228074 - RNA, 20 nt, Human
gauuggacaagcuucagccc

SEQ ID NO: 1228075 - RNA, 23 nt, Human
gcccacucuugaagguaaaggaa

SEQ ID NO: 1228076 - RNA, 25 nt, Human
guacagcauaaugguggcuuccucc

SEQ ID NO: 1228077 - RNA, 18 nt, Human
uaacauaaaaauucugcu

SEQ ID NO: 1228078 - RNA, 19 nt, Human
uagcugaaaaacgcauuau

SEQ ID NO: 1228079 - RNA, 23 nt, Human
ucaacagaacuuggguuugaaaa

SEQ ID NO: 1228080 - RNA, 21 nt, Human
ugaaaaacgcauuaucaguua

SEQ ID NO: 1228081 - RNA, 21 nt, Human
ugaacaagcguagauauucuc

SEQ ID NO: 1228082 - RNA, 21 nt, Human
ugcaugacaaagaaaaggagg

SEQ ID NO: 1228083 - RNA, 19 nt, Human
ugcaugcaugacaaagaaa

SEQ ID NO: 1228084 - RNA, 19 nt, Human
ugcuuggcaacauagcuga

SEQ ID NO: 1228085 - RNA, 19 nt, Human
ugucuccucucuugaagua

SEQ ID NO: 1228086 - RNA, 19 nt, Human
uguugcuaucaucuuuguc

SEQ ID NO: 1228087 - RNA, 20 nt, Human
uuugggauggauucauucca

SEQ ID NO: 1228088 - RNA, 18 nt, Human
aaaaauaaagccaguaug

SEQ ID NO: 1228089 - RNA, 18 nt, Human
aaacaguauuuuuagauc

SEQ ID NO: 1228090 - RNA, 19 nt, Human
aacauggugaaaccccguc

SEQ ID NO: 1228091 - RNA, 20 nt, Human
aacauggugaaaccccgucu

SEQ ID NO: 1228092 - RNA, 21 nt, Human
aacauggugaaaccccgucuc

SEQ ID NO: 1228093 - RNA, 23 nt, Human
aagagcgagacucggucucaaaa

SEQ ID NO: 1228094 - RNA, 24 nt, Human
aagccacagugucaacuuccauac

SEQ ID NO: 1228095 - RNA, 24 nt, Human
aaucgcuuaaaccugggaggcaga

SEQ ID NO: 1228096 - RNA, 24 nt, Human
aauuaucaaguuuuuucuaaaaac

SEQ ID NO: 1228097 - RNA, 22 nt, Human
acaagcacucuggcacacccaa

SEQ ID NO: 1228098 - RNA, 23 nt, Human
acacccaagaccugggccaagcc

SEQ ID NO: 1228099 - RNA, 25 nt, Human
acacccaagaccugggccaagccac

SEQ ID NO: 1228100 - RNA, 24 nt, Human
accaacauggugaaaccccgucuc

SEQ ID NO: 1228101 - RNA, 18 nt, Human
accccgucucuacuaaaa

SEQ ID NO: 1228102 - RNA, 23 nt, Human
acucuacagagcaaggugggaac

SEQ ID NO: 1228103 - RNA, 18 nt, Human
acugcacuccagccuagg

SEQ ID NO: 1228104 - RNA, 25 nt, Human
acugcacuccagccuaggugacaag

SEQ ID NO: 1228105 - RNA, 27 nt, Human
acugcacuccagccuaggugacaagag

SEQ ID NO: 1228106 - RNA, 22 nt, Human
agagguuguagugagccgagau

SEQ ID NO: 1228107 - RNA, 24 nt, Human
agagguuguagugagccgagauug

SEQ ID NO: 1228108 - RNA, 21 nt, Human
agcacuuugggaggccgaggc

SEQ ID NO: 1228109 - RNA, 24 nt, Human
agcacuuugggaggccgaggcggg

SEQ ID NO: 1228110 - RNA, 22 nt, Human
agccaacacugaguaccucaca

SEQ ID NO: 1228111 - RNA, 23 nt, Human
agccgggcgcgguggcacaugcc

SEQ ID NO: 1228112 - RNA, 25 nt, Human
agccuaggugacaagagcgagacuc

SEQ ID NO: 1228113 - RNA, 24 nt, Human
agccugaccaacauggugaaaccc

SEQ ID NO: 1228114 - RNA, 20 nt, Human
agcucuacaccuuuggccgc

SEQ ID NO: 1228115 - RNA, 24 nt, Human
aggcacgguggcucacgccuguaa

SEQ ID NO: 1228116 - RNA, 22 nt, Human
aggcagaagaaucgcuuaaacc

SEQ ID NO: 1228117 - RNA, 24 nt, Human
aggcagaagaaucgcuuaaaccug

SEQ ID NO: 1228118 - RNA, 21 nt, Human
aggcagagguuguagugagcc

SEQ ID NO: 1228119 - RNA, 24 nt, Human
aggcagagguuguagugagccgag

SEQ ID NO: 1228120 - RNA, 22 nt, Human
aggccaggcacgguggcucacg

SEQ ID NO: 1228121 - RNA, 21 nt, Human
aggccgaggcggguagaucac

SEQ ID NO: 1228122 - RNA, 24 nt, Human
aggcggguagaucacgaggucagg

SEQ ID NO: 1228123 - RNA, 18 nt, Human
agguacuaaaagcugccu

SEQ ID NO: 1228124 - RNA, 19 nt, Human
aguuccuccauagcagccu

SEQ ID NO: 1228125 - RNA, 19 nt, Human
aucacgaggucaggaguuc

SEQ ID NO: 1228126 - RNA, 24 nt, Human
auugccuaucucacccacacggag

SEQ ID NO: 1228127 - RNA, 24 nt, Human
caacauggugaaaccccgucucua

SEQ ID NO: 1228128 - RNA, 26 nt, Human
cacacccaagaccugggccaagccac

SEQ ID NO: 1228129 - RNA, 23 nt, Human
caccuuuggccgcauugugaucu

SEQ ID NO: 1228130 - RNA, 24 nt, Human
cacgccuguaauccuagcacuuug

SEQ ID NO: 1228131 - RNA, 24 nt, Human
cacuccagccuaggugacaagagc

SEQ ID NO: 1228132 - RNA, 20 nt, Human
cacugaguaccucacaacga

SEQ ID NO: 1228133 - RNA, 19 nt, Human
cacugcacuccagccuagg

SEQ ID NO: 1228134 - RNA, 21 nt, Human
cacugcacuccagccuaggug

SEQ ID NO: 1228135 - RNA, 23 nt, Human
cacugcacuccagccuaggugac

SEQ ID NO: 1228136 - RNA, 24 nt, Human
cacugcacuccagccuaggugaca

SEQ ID NO: 1228137 - RNA, 25 nt, Human
cacugcacuccagccuaggugacaa

SEQ ID NO: 1228138 - RNA, 24 nt, Human
cagcuacuuaggaggcugaggcag

SEQ ID NO: 1228139 - RNA, 22 nt, Human
cagguccagaaccagucagaga

SEQ ID NO: 1228140 - RNA, 19 nt, Human
cagugagucacaagcacuc

SEQ ID NO: 1228141 - RNA, 22 nt, Human
ccaacacugaguaccucacaac

SEQ ID NO: 1228142 - RNA, 24 nt, Human
ccaacacugaguaccucacaacga

SEQ ID NO: 1228143 - RNA, 18 nt, Human
cccuguccuccuguaucu

SEQ ID NO: 1228144 - RNA, 22 nt, Human
ccuaggccaggcacgguggcuc

SEQ ID NO: 1228145 - RNA, 19 nt, Human
ccucaaaacaggacagcca

SEQ ID NO: 1228146 - RNA, 23 nt, Human
ccugaccaacauggugaaacccc

SEQ ID NO: 1228147 - RNA, 24 nt, Human
ccugaccaacauggugaaaccccg

SEQ ID NO: 1228148 - RNA, 22 nt, Human
ccuggaaacaccucuccucacc

SEQ ID NO: 1228149 - RNA, 21 nt, Human
ccugggaggcagagguuguag

SEQ ID NO: 1228150 - RNA, 22 nt, Human
ccuguaauccuagcacuuuggg

SEQ ID NO: 1228151 - RNA, 20 nt, Human
cgaagggaagcagcucuaca

SEQ ID NO: 1228152 - RNA, 24 nt, Human
cgagaccagccugaccaacauggu

SEQ ID NO: 1228153 - RNA, 24 nt, Human
cgagauugcaagcacugcacucca

SEQ ID NO: 1228154 - RNA, 24 nt, Human
cgaggcggguagaucacgagguca

SEQ ID NO: 1228155 - RNA, 18 nt, Human
cgccuguaauccuagcac

SEQ ID NO: 1228156 - RNA, 23 nt, Human
cgggaggcugagaacauggcuca

SEQ ID NO: 1228157 - RNA, 20 nt, Human
cuagauacuagccaggaacc

SEQ ID NO: 1228158 - RNA, 24 nt, Human
cucacgccuguaauccuagcacuu

SEQ ID NO: 1228159 - RNA, 22 nt, Human
cucggucucaaaaaaaaaaaaa

SEQ ID NO: 1228160 - RNA, 21 nt, Human
cucuguuaauguuuccagcuc

SEQ ID NO: 1228161 - RNA, 24 nt, Human
cugugcccaugaacuuuaaggacc

SEQ ID NO: 1228162 - RNA, 21 nt, Human
gaaccagucagagacuugccc

SEQ ID NO: 1228163 - RNA, 24 nt, Human
gagauugcaagcacugcacuccag

SEQ ID NO: 1228164 - RNA, 22 nt, Human
gagcacaacauugucuucaugc

SEQ ID NO: 1228165 - RNA, 22 nt, Human
gaucacgaggucaggaguucga

SEQ ID NO: 1228166 - RNA, 24 nt, Human
gaucacgaggucaggaguucgaga

SEQ ID NO: 1228167 - RNA, 21 nt, Human
gcacugcacuccagccuaggu

SEQ ID NO: 1228168 - RNA, 21 nt, Human
gcagagcugcccuucagugag

SEQ ID NO: 1228169 - RNA, 19 nt, Human
gcauugugaucuacaucga

SEQ ID NO: 1228170 - RNA, 23 nt, Human
gccuacaugcagccaggagcacc

SEQ ID NO: 1228171 - RNA, 18 nt, Human
ggaagcagcucuacaccu

SEQ ID NO: 1228172 - RNA, 21 nt, Human
ggagcuacuccacaucaggcc

SEQ ID NO: 1228173 - RNA, 21 nt, Human
ggaggcugaggcagaagaauc

SEQ ID NO: 1228174 - RNA, 19 nt, Human
ggcauuggcguggccgcua

SEQ ID NO: 1228175 - RNA, 23 nt, Human
ggcgcgguggcacaugccuguaa

SEQ ID NO: 1228176 - RNA, 24 nt, Human
gggaacagaagaguggccgguacc

SEQ ID NO: 1228177 - RNA, 20 nt, Human
gggcauuggcguggccgcua

SEQ ID NO: 1228178 - RNA, 24 nt, Human
ggguagaucacgaggucaggaguu

SEQ ID NO: 1228179 - RNA, 20 nt, Human
gguccagaaccagucagaga

SEQ ID NO: 1228180 - RNA, 24 nt, Human
gguggcacaugccuguaaugccag

SEQ ID NO: 1228181 - RNA, 21 nt, Human
gguggcucacgccuguaaucc

SEQ ID NO: 1228182 - RNA, 24 nt, Human
gguggcucacgccuguaauccuag

SEQ ID NO: 1228183 - RNA, 21 nt, Human
ggugggaacagaagaguggcu

SEQ ID NO: 1228184 - RNA, 18 nt, Human
guaguuccuccauagcag

SEQ ID NO: 1228185 - RNA, 19 nt, Human
gucucaaaaaaaaaaaaag

SEQ ID NO: 1228186 - RNA, 19 nt, Human
guuguagugagccgagauu

SEQ ID NO: 1228187 - RNA, 21 nt, Human
guuguagugagccgagauugc

SEQ ID NO: 1228188 - RNA, 18 nt, Human
uaagagggauguacugua

SEQ ID NO: 1228189 - RNA, 18 nt, Human
uacaccuggaaacaccuc

SEQ ID NO: 1228190 - RNA, 21 nt, Human
uacuagccaggaaccuucuga

SEQ ID NO: 1228191 - RNA, 18 nt, Human
uagauacuagccaggaac

SEQ ID NO: 1228192 - RNA, 22 nt, Human
uagaucacgaggucaggaguuc

SEQ ID NO: 1228193 - RNA, 24 nt, Human
uagcacuuugggaggccgaggcgg

SEQ ID NO: 1228194 - RNA, 23 nt, Human
uagcagccuucccuuuagucucu

SEQ ID NO: 1228195 - RNA, 26 nt, Human
uaggaggcugaggcagaagaaucgcu

SEQ ID NO: 1228196 - RNA, 22 nt, Human
uagguuaaaaauaaagccagua

SEQ ID NO: 1228197 - RNA, 22 nt, Human
ucaaaaaaaaaaaaagaaaaaa

SEQ ID NO: 1228198 - RNA, 18 nt, Human
ucaccuucaaaaggguaa

SEQ ID NO: 1228199 - RNA, 18 nt, Human
ucacgaggucaggaguuc

SEQ ID NO: 1228200 - RNA, 24 nt, Human
ucacgaggucaggaguucgagacc

SEQ ID NO: 1228201 - RNA, 19 nt, Human
uccauacaccuggaaacaa

SEQ ID NO: 1228202 - RNA, 21 nt, Human
uccucaccgcccuguccuccu

SEQ ID NO: 1228203 - RNA, 26 nt, Human
uccuccaaaguuguaucuuugaggca

SEQ ID NO: 1228204 - RNA, 18 nt, Human
uccugagucuuuaauucu

SEQ ID NO: 1228205 - RNA, 21 nt, Human
ucggucucaaaaaaaaaaaaa

SEQ ID NO: 1228206 - RNA, 20 nt, Human
ucguccucaaaacaggacag

SEQ ID NO: 1228207 - RNA, 23 nt, Human
ucucuacuaaaaaugcaaaaauu

SEQ ID NO: 1228208 - RNA, 21 nt, Human
ugaaaacagagauuaaguaau

SEQ ID NO: 1228209 - RNA, 24 nt, Human
ugaccaacauggugaaaccccguc

SEQ ID NO: 1228210 - RNA, 24 nt, Human
ugaggcagaagaaucgcuuaaacc

SEQ ID NO: 1228211 - RNA, 22 nt, Human
ugaucgacauggccaagugaac

SEQ ID NO: 1228212 - RNA, 24 nt, Human
ugcaaaaauuagccgggcgcggug

SEQ ID NO: 1228213 - RNA, 25 nt, Human
ugcccaugaacuuuaaggaccucau

SEQ ID NO: 1228214 - RNA, 19 nt, Human
ugccuguaaugccagcuac

SEQ ID NO: 1228215 - RNA, 24 nt, Human
ugccuguaaugccagcuacuuagg

SEQ ID NO: 1228216 - RNA, 18 nt, Human
uggcacaugccuguaaug

SEQ ID NO: 1228217 - RNA, 18 nt, Human
uggcagcuucuaccucag

SEQ ID NO: 1228218 - RNA, 19 nt, Human
uggcucacgccuguaaucc

SEQ ID NO: 1228219 - RNA, 24 nt, Human
uggcucacgccuguaauccuagca

SEQ ID NO: 1228220 - RNA, 20 nt, Human
ugggacaaugccacguaggg

SEQ ID NO: 1228221 - RNA, 24 nt, Human
ugggaggcagagguuguagugagc

SEQ ID NO: 1228222 - RNA, 20 nt, Human
ugggaggccgaggcggguag

SEQ ID NO: 1228223 - RNA, 24 nt, Human
ugggaggccgaggcggguagauca

SEQ ID NO: 1228224 - RNA, 19 nt, Human
ugggguaucguccucaaaa

SEQ ID NO: 1228225 - RNA, 22 nt, Human
ugggugcccaccucacugcaga

SEQ ID NO: 1228226 - RNA, 20 nt, Human
uguaaaaugggacaaugcca

SEQ ID NO: 1228227 - RNA, 24 nt, Human
uucucuguaguuccuccauagcag

SEQ ID NO: 1228228 - RNA, 25 nt, Human
uugggaggccgaggcggguagauca

SEQ ID NO: 1228229 - RNA, 18 nt, Human
uuguagugagccgagauu

SEQ ID NO: 1228230 - RNA, 19 nt, Human
uuguagugagccgagauug

SEQ ID NO: 1228231 - RNA, 20 nt, Human
uuguagugagccgagauugc

SEQ ID NO: 1228232 - RNA, 22 nt, Human
aaagggcccccagacccagaca

SEQ ID NO: 1228233 - RNA, 18 nt, Human
aacaggugugaagaggau

SEQ ID NO: 1228234 - RNA, 25 nt, Human
agacccagacaauagggcccagcag

SEQ ID NO: 1228235 - RNA, 19 nt, Human
agggagucacccagcgggc

SEQ ID NO: 1228236 - RNA, 18 nt, Human
aucccaacaggugugaag

SEQ ID NO: 1228237 - RNA, 23 nt, Human
cagcaggcagggcccgagcaggu

SEQ ID NO: 1228238 - RNA, 21 nt, Human
ccagacccagacaauagggcc

SEQ ID NO: 1228239 - RNA, 24 nt, Human
ccccagacccagacaauagggccc

SEQ ID NO: 1228240 - RNA, 24 nt, Human
cccccagacccagacaauagggcc

SEQ ID NO: 1228241 - RNA, 21 nt, Human
cccucauaccccuggagcugu

SEQ ID NO: 1228242 - RNA, 24 nt, Human
ccuuaaaaggugaggggagaaggg

SEQ ID NO: 1228243 - RNA, 18 nt, Human
cuucagggagucacccag

SEQ ID NO: 1228244 - RNA, 19 nt, Human
gacccagacaauagggccc

SEQ ID NO: 1228245 - RNA, 25 nt, Human
gcaggaaagggcccccagacccaga

SEQ ID NO: 1228246 - RNA, 18 nt, Human
gccuuggggaaagugugg

SEQ ID NO: 1228247 - RNA, 20 nt, Human
gcgggcuagaaaaccaccgg

SEQ ID NO: 1228248 - RNA, 23 nt, Human
gugugaagaggaugagaucuuca

SEQ ID NO: 1228249 - RNA, 21 nt, Human
uccaugggaggcuccauccca

SEQ ID NO: 1228250 - RNA, 19 nt, Human
ugaggagggaguagugggc

SEQ ID NO: 1228251 - RNA, 23 nt, Human
ugaggagggaguagugggcugcc

SEQ ID NO: 1228252 - RNA, 22 nt, Human
ugccaggccucccucauacccc

SEQ ID NO: 1228253 - RNA, 21 nt, Human
uguggucaguggggacuuggc

SEQ ID NO: 1228254 - RNA, 21 nt, Human
aaaaaaaaaaaaaaaaaagga

SEQ ID NO: 1228255 - RNA, 20 nt, Human
aaaaaaaaggaugccccugg

SEQ ID NO: 1228256 - RNA, 22 nt, Human
aaagccgcagccaaggauucca

SEQ ID NO: 1228257 - RNA, 23 nt, Human
aaauaagcacaaaaccuggccac

SEQ ID NO: 1228258 - RNA, 18 nt, Human
aagcacaaaaccuggcca

SEQ ID NO: 1228259 - RNA, 21 nt, Human
acccuggcgacagcuacacug

SEQ ID NO: 1228260 - RNA, 20 nt, Human
accggggugcaggcaggaag

SEQ ID NO: 1228261 - RNA, 22 nt, Human
agacaggccacagggagcuccc

SEQ ID NO: 1228262 - RNA, 27 nt, Human
agaccucugguccuagccaggcccagg

SEQ ID NO: 1228263 - RNA, 22 nt, Human
agcacaaaaccuggccacugua

SEQ ID NO: 1228264 - RNA, 26 nt, Human
aggaauaauggaggacgaucacuggc

SEQ ID NO: 1228265 - RNA, 18 nt, Human
aggauggcguuccacagc

SEQ ID NO: 1228266 - RNA, 21 nt, Human
aguguggacaugguggggccc

SEQ ID NO: 1228267 - RNA, 21 nt, Human
cacaggugguccacaagguca

SEQ ID NO: 1228268 - RNA, 18 nt, Human
cagaacccuggcgacagc

SEQ ID NO: 1228269 - RNA, 23 nt, Human
cagauagcucuucccucaaccca

SEQ ID NO: 1228270 - RNA, 22 nt, Human
cagcaacacaaagccgcagcca

SEQ ID NO: 1228271 - RNA, 23 nt, Human
cagcaacacaaagccgcagccaa

SEQ ID NO: 1228272 - RNA, 20 nt, Human
cagcccuagauccucagucu

SEQ ID NO: 1228273 - RNA, 18 nt, Human
caggcccaggaagggagc

SEQ ID NO: 1228274 - RNA, 21 nt, Human
caggcccaggaagggagccag

SEQ ID NO: 1228275 - RNA, 22 nt, Human
cagugcuugaggaccaaaggca

SEQ ID NO: 1228276 - RNA, 21 nt, Human
cauccuguccuguccugggag

SEQ ID NO: 1228277 - RNA, 21 nt, Human
cauuggaggaauaauggagga

SEQ ID NO: 1228278 - RNA, 23 nt, Human
ccacuguagucucagcccccagg

SEQ ID NO: 1228279 - RNA, 23 nt, Human
cccaaagugaccucucuuccuug

SEQ ID NO: 1228280 - RNA, 25 nt, Human
cccaauaaauaagcacaagguaccc

SEQ ID NO: 1228281 - RNA, 18 nt, Human
cccagcccuagauccuca

SEQ ID NO: 1228282 - RNA, 20 nt, Human
cccaggaagggagccaggcu

SEQ ID NO: 1228283 - RNA, 18 nt, Human
cccucaacccacccccca

SEQ ID NO: 1228284 - RNA, 22 nt, Human
ccgcagccaaggauuccagaac

SEQ ID NO: 1228285 - RNA, 19 nt, Human
ccgcuggugaucucagccg

SEQ ID NO: 1228286 - RNA, 18 nt, Human
ccuccuucccagugugga

SEQ ID NO: 1228287 - RNA, 27 nt, Human
ccucugcagcaaugcauccaacagcuu

SEQ ID NO: 1228288 - RNA, 21 nt, Human
ccugaaagacggucaggccag

SEQ ID NO: 1228289 - RNA, 25 nt, Human
ccuucccuacuccaacucuuuaaaa

SEQ ID NO: 1228290 - RNA, 26 nt, Human
ccuucccuacuccaacucuuuaaaaa

SEQ ID NO: 1228291 - RNA, 22 nt, Human
cucaacccaccccccaauaaau

SEQ ID NO: 1228292 - RNA, 22 nt, Human
cuccugggcacgacugccucca

SEQ ID NO: 1228293 - RNA, 22 nt, Human
cucuucccucaacccacccccc

SEQ ID NO: 1228294 - RNA, 21 nt, Human
cucuuuaaaaaaaaaaaaaaa

SEQ ID NO: 1228295 - RNA, 22 nt, Human
cugggcacgacugccuccaagg

SEQ ID NO: 1228296 - RNA, 18 nt, Human
gagcagaagcugggauau

SEQ ID NO: 1228297 - RNA, 18 nt, Human
gagcccaggcugaggacc

SEQ ID NO: 1228298 - RNA, 21 nt, Human
gcccaggaagggagccaggcu

SEQ ID NO: 1228299 - RNA, 22 nt, Human
gcccucauccuuccucccaccc

SEQ ID NO: 1228300 - RNA, 24 nt, Human
gcccucauccuuccucccacccac

SEQ ID NO: 1228301 - RNA, 25 nt, Human
ggacaggcagugggacccauggcuc

SEQ ID NO: 1228302 - RNA, 21 nt, Human
ggagcccaggcugaggaccgg

SEQ ID NO: 1228303 - RNA, 18 nt, Human
guaccccaaggccagaua

SEQ ID NO: 1228304 - RNA, 19 nt, Human
uaaauaagcacaaaaccug

SEQ ID NO: 1228305 - RNA, 23 nt, Human
uaaauaagcacaaaaccuggcca

SEQ ID NO: 1228306 - RNA, 25 nt, Human
uaaauaagcacaaaaccuggccacu

SEQ ID NO: 1228307 - RNA, 25 nt, Human
uaaauaagcacaaaaccuggccacu

SEQ ID NO: 1228308 - RNA, 22 nt, Human
uaaggagggcagacucacguca

SEQ ID NO: 1228309 - RNA, 18 nt, Human
uagcucuucccucaaccc

SEQ ID NO: 1228310 - RNA, 25 nt, Human
uagcucuucccucaacccacccccc

SEQ ID NO: 1228311 - RNA, 19 nt, Human
uagucucagcccccaggaa

SEQ ID NO: 1228312 - RNA, 21 nt, Human
ucaacccaccccccaauaaau

SEQ ID NO: 1228313 - RNA, 26 nt, Human
uccaacucuuuaaaaaaaaaaaaaaa

SEQ ID NO: 1228314 - RNA, 30 nt, Human
uccaacucuuuaaaaaaaaaaaaaaaaaaa

SEQ ID NO: 1228315 - RNA, 19 nt, Human
uccacagcugcugcagggg

SEQ ID NO: 1228316 - RNA, 19 nt, Human
ucccagaacccuggcgaca

SEQ ID NO: 1228317 - RNA, 21 nt, Human
ucccagacaggccacagggag

SEQ ID NO: 1228318 - RNA, 21 nt, Human
uccucagucugaagcuguggg

SEQ ID NO: 1228319 - RNA, 22 nt, Human
uccugggagcccaggcugagga

SEQ ID NO: 1228320 - RNA, 22 nt, Human
uccuuggagaggccacaggugg

SEQ ID NO: 1228321 - RNA, 20 nt, Human
ucuuuaaaaaaaaaaaaaaa

SEQ ID NO: 1228322 - RNA, 22 nt, Human
ugacaagaaguauccugaaaga

SEQ ID NO: 1228323 - RNA, 18 nt, Human
ugacaggucccagcccua

SEQ ID NO: 1228324 - RNA, 18 nt, Human
uggcagacagggacucuc

SEQ ID NO: 1228325 - RNA, 20 nt, Human
uggccuggguccucugcagc

SEQ ID NO: 1228326 - RNA, 21 nt, Human
ugggacccauggcucccagug

SEQ ID NO: 1228327 - RNA, 22 nt, Human
ugggagcccaggcugaggaccg

SEQ ID NO: 1228328 - RNA, 24 nt, Human
uggugaucucagccguggccuggg

SEQ ID NO: 1228329 - RNA, 25 nt, Human
uguccuguccugggagcccaggcug

SEQ ID NO: 1228330 - RNA, 24 nt, Human
uguccugucuauccugcuguccca

SEQ ID NO: 1228331 - RNA, 22 nt, Human
ugugcagaguccagcugggcag

SEQ ID NO: 1228332 - RNA, 20 nt, Human
uuaaaaaaaaaaaaaaaaaa

SEQ ID NO: 1228333 - RNA, 23 nt, Human
uuaaaccuucccuacuccaacuc

SEQ ID NO: 1228334 - RNA, 19 nt, Human
uuccucccacccacugggc

SEQ ID NO: 1228335 - RNA, 18 nt, Human
uuggagaggccacaggug

SEQ ID NO: 1228336 - RNA, 21 nt, Human
uuggagaggccacaggugguc

SEQ ID NO: 1228337 - RNA, 24 nt, Human
aaaaagcccgguuagagaaacgga

SEQ ID NO: 1228338 - RNA, 18 nt, Human
aaacggagcaagcccccc

SEQ ID NO: 1228339 - RNA, 21 nt, Human
aaaucaccugucuucugagcc

SEQ ID NO: 1228340 - RNA, 19 nt, Human
aaauuaaauaauauguauc

SEQ ID NO: 1228341 - RNA, 20 nt, Human
aacagagggagacuccaucu

SEQ ID NO: 1228342 - RNA, 20 nt, Human
aacguggugaaaccccaucu

SEQ ID NO: 1228343 - RNA, 21 nt, Human
aacguggugaaaccccaucuc

SEQ ID NO: 1228344 - RNA, 18 nt, Human
aagccccccagggucuag

SEQ ID NO: 1228345 - RNA, 24 nt, Human
aaucgcuugaacccgggaggugga

SEQ ID NO: 1228346 - RNA, 18 nt, Human
aauuagccaggcauggug

SEQ ID NO: 1228347 - RNA, 24 nt, Human
acagagggagacuccaucucaaaa

SEQ ID NO: 1228348 - RNA, 21 nt, Human
acauguuguggggcugugaaa

SEQ ID NO: 1228349 - RNA, 24 nt, Human
accugaggucaggaguucgagacc

SEQ ID NO: 1228350 - RNA, 23 nt, Human
acugcaccccagccuggcaacag

SEQ ID NO: 1228351 - RNA, 23 nt, Human
acugcaccccagccuggcaacag

SEQ ID NO: 1228352 - RNA, 18 nt, Human
agaccccuggauacccaa

SEQ ID NO: 1228353 - RNA, 21 nt, Human
agccaggcagaaagggaugac

SEQ ID NO: 1228354 - RNA, 21 nt, Human
agccuggcaacagagggagac

SEQ ID NO: 1228355 - RNA, 23 nt, Human
aggaguucgagaccaggcuggcc

SEQ ID NO: 1228356 - RNA, 20 nt, Human
aggcagaaagggaugaccuu

SEQ ID NO: 1228357 - RNA, 23 nt, Human
aggcagaaagggaugaccuugag

SEQ ID NO: 1228358 - RNA, 24 nt, Human
aggcaggagaaucgcuugaacccg

SEQ ID NO: 1228359 - RNA, 24 nt, Human
aggcauggugucgugugccuguaa

SEQ ID NO: 1228360 - RNA, 21 nt, Human
aggccaaggcggguggaucac

SEQ ID NO: 1228361 - RNA, 22 nt, Human
aggcggguggaucaccugaggu

SEQ ID NO: 1228362 - RNA, 26 nt, Human
aggcggguggaucaccugaggucagg

SEQ ID NO: 1228363 - RNA, 20 nt, Human
aggcugaggcaggagaaucg

SEQ ID NO: 1228364 - RNA, 24 nt, Human
aggcugaggcaggagaaucgcuug

SEQ ID NO: 1228365 - RNA, 24 nt, Human
aggcuggccaacguggugaaaccc

SEQ ID NO: 1228366 - RNA, 24 nt, Human
agguggagguugcagugagccaag

SEQ ID NO: 1228367 - RNA, 19 nt, Human
agguucccagcacccagac

SEQ ID NO: 1228368 - RNA, 21 nt, Human
aucaccugaggucaggaguuc

SEQ ID NO: 1228369 - RNA, 23 nt, Human
aucagagaccccuggauacccaa

SEQ ID NO: 1228370 - RNA, 21 nt, Human
aucagauuuuugaacagacau

SEQ ID NO: 1228371 - RNA, 24 nt, Human
aucgcaccacugcaccccagccug

SEQ ID NO: 1228372 - RNA, 19 nt, Human
augccuguaaucccagcac

SEQ ID NO: 1228373 - RNA, 22 nt, Human
caaaaaagcccgguuagagaaa

SEQ ID NO: 1228374 - RNA, 24 nt, Human
caacguggugaaaccccaucucua

SEQ ID NO: 1228375 - RNA, 24 nt, Human
caaggcggguggaucaccugaggu

SEQ ID NO: 1228376 - RNA, 26 nt, Human
caaggcggguggaucaccugagguca

SEQ ID NO: 1228377 - RNA, 24 nt, Human
caccacugcaccccagccgggugc

SEQ ID NO: 1228378 - RNA, 25 nt, Human
caccacugcaccccagccuggcaac

SEQ ID NO: 1228379 - RNA, 21 nt, Human
caccccugagggaguuaggag

SEQ ID NO: 1228380 - RNA, 21 nt, Human
caccccuuccuauuuuucuuc

SEQ ID NO: 1228381 - RNA, 18 nt, Human
cacccuggggagguagcu

SEQ ID NO: 1228382 - RNA, 23 nt, Human
caccugaggucaggaguucgaga

SEQ ID NO: 1228383 - RNA, 27 nt, Human
cacuuccaauuuucugugaauuggaag

SEQ ID NO: 1228384 - RNA, 22 nt, Human
cagagaccccuggauacccaau

SEQ ID NO: 1228385 - RNA, 24 nt, Human
cagcacuuugggaggccaaggcgg

SEQ ID NO: 1228386 - RNA, 24 nt, Human
cagcuacucgggaggcugaggcag

SEQ ID NO: 1228387 - RNA, 22 nt, Human
caucagagaccccuggauaccc

SEQ ID NO: 1228388 - RNA, 24 nt, Human
caucucuacuacaauuaaaaaauu

SEQ ID NO: 1228389 - RNA, 20 nt, Human
caugccuguaaucccagcac

SEQ ID NO: 1228390 - RNA, 24 nt, Human
caugccuguaaucccagcacuuug

SEQ ID NO: 1228391 - RNA, 19 nt, Human
cauggaguguucagaaugg

SEQ ID NO: 1228392 - RNA, 19 nt, Human
ccacugcaccccagccugg

SEQ ID NO: 1228393 - RNA, 19 nt, Human
ccacugcaccccagccugg

SEQ ID NO: 1228394 - RNA, 20 nt, Human
ccacugcaccccagccuggc

SEQ ID NO: 1228395 - RNA, 23 nt, Human
ccacugcaccccagccuggcaac

SEQ ID NO: 1228396 - RNA, 22 nt, Human
ccagcacccagacccccucuga

SEQ ID NO: 1228397 - RNA, 24 nt, Human
ccaguguuggcgguggaggucuuu

SEQ ID NO: 1228398 - RNA, 18 nt, Human
ccaugccuguaaucccag

SEQ ID NO: 1228399 - RNA, 24 nt, Human
cccaugccuguaaucccagcacuu

SEQ ID NO: 1228400 - RNA, 19 nt, Human
ccccaccuucaccccuucc

SEQ ID NO: 1228401 - RNA, 21 nt, Human
ccccagggucuagaaauggau

SEQ ID NO: 1228402 - RNA, 22 nt, Human
ccccccagggucuagaaaugga

SEQ ID NO: 1228403 - RNA, 22 nt, Human
ccccucugaagauggccaggga

SEQ ID NO: 1228404 - RNA, 21 nt, Human
cccgggagguggagguugcag

SEQ ID NO: 1228405 - RNA, 22 nt, Human
cccugggggccaaaccgacucg

SEQ ID NO: 1228406 - RNA, 21 nt, Human
ccuagaacaagagacagccac

SEQ ID NO: 1228407 - RNA, 22 nt, Human
ccuccucucccuaacuccccca

SEQ ID NO: 1228408 - RNA, 22 nt, Human
ccugaggucaggaguucgagac

SEQ ID NO: 1228409 - RNA, 19 nt, Human
ccuguaaucccagcuacuc

SEQ ID NO: 1228410 - RNA, 21 nt, Human
ccuguaaucccagcuacucgg

SEQ ID NO: 1228411 - RNA, 22 nt, Human
ccuguaaucccagcuacucggg

SEQ ID NO: 1228412 - RNA, 21 nt, Human
ccuucaccccuuccuauuuuu

SEQ ID NO: 1228413 - RNA, 24 nt, Human
ccuuccuauuuuucuucuaauccc

SEQ ID NO: 1228414 - RNA, 20 nt, Human
ccuugaggggggggucacag

SEQ ID NO: 1228415 - RNA, 24 nt, Human
cgagaccaggcuggccaacguggu

SEQ ID NO: 1228416 - RNA, 21 nt, Human
cgcaccacugcaccccagccu

SEQ ID NO: 1228417 - RNA, 29 nt, Human
cgggagguggagguugcagugacaacggu

SEQ ID NO: 1228418 - RNA, 24 nt, Human
cgggagguggagguugcagugagc

SEQ ID NO: 1228419 - RNA, 24 nt, Human
cggguggaucaccugaggucagga

SEQ ID NO: 1228420 - RNA, 23 nt, Human
cgguguuuguggggacagggccu

SEQ ID NO: 1228421 - RNA, 21 nt, Human
cgugugccuguaaucccagcu

SEQ ID NO: 1228422 - RNA, 24 nt, Human
cuaaugcucagacacucccaacug

SEQ ID NO: 1228423 - RNA, 21 nt, Human
cuagaacaagagacagccaca

SEQ ID NO: 1228424 - RNA, 18 nt, Human
cucugggaaauggggauu

SEQ ID NO: 1228425 - RNA, 21 nt, Human
cugagccuguuuccucaucug

SEQ ID NO: 1228426 - RNA, 23 nt, Human
cuggccaacguggugaaacccca

SEQ ID NO: 1228427 - RNA, 21 nt, Human
gacauccuccucucccuaacu

SEQ ID NO: 1228428 - RNA, 19 nt, Human
gagaaacggagcaagcccc

SEQ ID NO: 1228429 - RNA, 23 nt, Human
gagaaucgcuugaacccgggagg

SEQ ID NO: 1228430 - RNA, 23 nt, Human
gagguugcagugagccaagaucg

SEQ ID NO: 1228431 - RNA, 24 nt, Human
gaucaccugaggucaggaguucga

SEQ ID NO: 1228432 - RNA, 21 nt, Human
gauggcucugggaaaugggga

SEQ ID NO: 1228433 - RNA, 20 nt, Human
gcaccacugcaccccagccu

SEQ ID NO: 1228434 - RNA, 28 nt, Human
gcaccccagccuggcaacagagggagag

SEQ ID NO: 1228435 - RNA, 21 nt, Human
gcagaaagggaugaccuugag

SEQ ID NO: 1228436 - RNA, 24 nt, Human
gccaacguggugaaaccccaucuc

SEQ ID NO: 1228437 - RNA, 20 nt, Human
gccaagaucgcaccacugca

SEQ ID NO: 1228438 - RNA, 20 nt, Human
gcccaugccuguaaucccag

SEQ ID NO: 1228439 - RNA, 19 nt, Human
gcucagagcccuuuugcuc

SEQ ID NO: 1228440 - RNA, 24 nt, Human
gcuggccaacguggugaaacccca

SEQ ID NO: 1228441 - RNA, 20 nt, Human
ggacagggccuacauaauuu

SEQ ID NO: 1228442 - RNA, 19 nt, Human
ggaggcccaaagcacagag

SEQ ID NO: 1228443 - RNA, 20 nt, Human
ggagguugcagugagccaag

SEQ ID NO: 1228444 - RNA, 24 nt, Human
ggagguugcagugagccaagaucg

SEQ ID NO: 1228445 - RNA, 22 nt, Human
ggaucaccugaggucaggaguu

SEQ ID NO: 1228446 - RNA, 19 nt, Human
gggaugaccuugagggggg

SEQ ID NO: 1228447 - RNA, 21 nt, Human
gguggaucaccugaggucagg

SEQ ID NO: 1228448 - RNA, 24 nt, Human
ggugucgugugccuguaaucccag

SEQ ID NO: 1228449 - RNA, 24 nt, Human
gguguuuguggggacagggccuac

SEQ ID NO: 1228450 - RNA, 20 nt, Human
guagcucuauguacccacuu

SEQ ID NO: 1228451 - RNA, 21 nt, Human
guauccauuucguagaaugac

SEQ ID NO: 1228452 - RNA, 22 nt, Human
gucgcccaugccuguaauccca

SEQ ID NO: 1228453 - RNA, 23 nt, Human
gucgcccaugccuguaaucccag

SEQ ID NO: 1228454 - RNA, 23 nt, Human
guguuuguggggacagggccuac

SEQ ID NO: 1228455 - RNA, 21 nt, Human
uaagaagaugaggggccaggg

SEQ ID NO: 1228456 - RNA, 22 nt, Human
uagaacaucagagaccccugga

SEQ ID NO: 1228457 - RNA, 28 nt, Human
uagagagagcaaaggucuuuauccagau

SEQ ID NO: 1228458 - RNA, 22 nt, Human
uauucaagggaaaagcaggaca

SEQ ID NO: 1228459 - RNA, 23 nt, Human
uauucccauuucacaguugagga

SEQ ID NO: 1228460 - RNA, 20 nt, Human
ucaccugaggucaggaguuc

SEQ ID NO: 1228461 - RNA, 19 nt, Human
ucccagcacccagaccccc

SEQ ID NO: 1228462 - RNA, 23 nt, Human
ucccagcacccagacccccucug

SEQ ID NO: 1228463 - RNA, 19 nt, Human
ucccauguggaucuugaac

SEQ ID NO: 1228464 - RNA, 24 nt, Human
ucccccauccaggcauuuggugua

SEQ ID NO: 1228465 - RNA, 22 nt, Human
uccucucccuaacucccccauc

SEQ ID NO: 1228466 - RNA, 23 nt, Human
ucgcaccacugcaccccagccug

SEQ ID NO: 1228467 - RNA, 24 nt, Human
ucgcccaugccuguaaucccagca

SEQ ID NO: 1228468 - RNA, 24 nt, Human
ucgcuugaacccgggagguggagg

SEQ ID NO: 1228469 - RNA, 24 nt, Human
ucgggaggcugaggcaggagaauc

SEQ ID NO: 1228470 - RNA, 20 nt, Human
ucugaagauggccagggagu

SEQ ID NO: 1228471 - RNA, 20 nt, Human
ugaccuugagggggggguca

SEQ ID NO: 1228472 - RNA, 20 nt, Human
ugagcaggccuuucaaagug

SEQ ID NO: 1228473 - RNA, 24 nt, Human
ugaggcaggagaaucgcuugaacc

SEQ ID NO: 1228474 - RNA, 25 nt, Human
ugaggcaggagaaucgcuugaaccc

SEQ ID NO: 1228475 - RNA, 19 nt, Human
ugccuagaacaagagacag

SEQ ID NO: 1228476 - RNA, 23 nt, Human
ugccuguaaucccagcacuuugg

SEQ ID NO: 1228477 - RNA, 24 nt, Human
ugccuguaaucccagcacuuuggg

SEQ ID NO: 1228478 - RNA, 24 nt, Human
ugccuguaaucccagcuacucggg

SEQ ID NO: 1228479 - RNA, 24 nt, Human
uggaucaccugaggucaggaguuc

SEQ ID NO: 1228480 - RNA, 27 nt, Human
uggaucaccugaggucaggaguucgag

SEQ ID NO: 1228481 - RNA, 20 nt, Human
uggauggcucugggaaaugg

SEQ ID NO: 1228482 - RNA, 22 nt, Human
uggcaagccaggcagaaaggga

SEQ ID NO: 1228483 - RNA, 24 nt, Human
uggccaacguggugaaaccccauc

SEQ ID NO: 1228484 - RNA, 24 nt, Human
ugggaggccaaggcggguggauca

SEQ ID NO: 1228485 - RNA, 18 nt, Human
uggggcugugaaaguuuc

SEQ ID NO: 1228486 - RNA, 18 nt, Human
ugggggccaaaccgacuc

SEQ ID NO: 1228487 - RNA, 20 nt, Human
ugguaaguagguagcugggg

SEQ ID NO: 1228488 - RNA, 24 nt, Human
uggugucgugugccuguaauccca

SEQ ID NO: 1228489 - RNA, 24 nt, Human
ugucgcccaugccuguaaucccag

SEQ ID NO: 1228490 - RNA, 21 nt, Human
ugucuucugagccuguuuccu

SEQ ID NO: 1228491 - RNA, 20 nt, Human
ugugaauuggaagaugacug

SEQ ID NO: 1228492 - RNA, 24 nt, Human
uugaacccgggagguggagguugc

SEQ ID NO: 1228493 - RNA, 21 nt, Human
uugaggggggggucacagacc

SEQ ID NO: 1228494 - RNA, 22 nt, Human
uugcagugagccaagaucgcac

SEQ ID NO: 1228495 - RNA, 19 nt, Human
aaaaaaaaaaaaaauuagc

SEQ ID NO: 1228496 - RNA, 21 nt, Human
aaaaaaaaaaagauuugguua

SEQ ID NO: 1228497 - RNA, 22 nt, Human
aaacuacaggugcaugccacca

SEQ ID NO: 1228498 - RNA, 20 nt, Human
aacauggagaaaccccgucu

SEQ ID NO: 1228499 - RNA, 21 nt, Human
aacauggagaaaccccgucuc

SEQ ID NO: 1228500 - RNA, 18 nt, Human
aacauggugaaacccagu

SEQ ID NO: 1228501 - RNA, 19 nt, Human
aacauggugaaacccaguc

SEQ ID NO: 1228502 - RNA, 21 nt, Human
aacauggugaaacccagucac

SEQ ID NO: 1228503 - RNA, 20 nt, Human
aagcagaguuugcagugagc

SEQ ID NO: 1228504 - RNA, 24 nt, Human
aagcagaguuugcagugagcugag

SEQ ID NO: 1228505 - RNA, 18 nt, Human
aagcaguccucccacuuc

SEQ ID NO: 1228506 - RNA, 22 nt, Human
aagcaguccucccacuucaucc

SEQ ID NO: 1228507 - RNA, 27 nt, Human
aagcaguccucccacuucauccuccca

SEQ ID NO: 1228508 - RNA, 19 nt, Human
aagcgauucucccaccucu

SEQ ID NO: 1228509 - RNA, 19 nt, Human
aaucacuugaacccaguaa

SEQ ID NO: 1228510 - RNA, 24 nt, Human
aaucacuugaacccaguaagcaga

SEQ ID NO: 1228511 - RNA, 18 nt, Human
aauggcccugaggccagg

SEQ ID NO: 1228512 - RNA, 22 nt, Human
aauggcccugaggccaggaggg

SEQ ID NO: 1228513 - RNA, 19 nt, Human
acagagugaaacuccgucu

SEQ ID NO: 1228514 - RNA, 20 nt, Human
acagagugaaacuccgucuc

SEQ ID NO: 1228515 - RNA, 24 nt, Human
acagagugaaacuccgucucaaaa

SEQ ID NO: 1228516 - RNA, 22 nt, Human
acaggagaaucacuugaaccca

SEQ ID NO: 1228517 - RNA, 24 nt, Human
accccgucucuacuaaaaauacaa

SEQ ID NO: 1228518 - RNA, 24 nt, Human
accugaggucaggaguucaagacc

SEQ ID NO: 1228519 - RNA, 19 nt, Human
acuacaggugcaugccacc

SEQ ID NO: 1228520 - RNA, 18 nt, Human
acucagaagcugagacag

SEQ ID NO: 1228521 - RNA, 28 nt, Human
acuccgucucaaaaaaaaaaaaaaaaaa

SEQ ID NO: 1228522 - RNA, 24 nt, Human
acucuagucugggcgacagaguga

SEQ ID NO: 1228523 - RNA, 18 nt, Human
acucuggaggcugaggca

SEQ ID NO: 1228524 - RNA, 24 nt, Human
acuucugggcucaagcgauucucc

SEQ ID NO: 1228525 - RNA, 18 nt, Human
agacaggagaaucacuug

SEQ ID NO: 1228526 - RNA, 23 nt, Human
agacaggagaaucacuugaaccc

SEQ ID NO: 1228527 - RNA, 24 nt, Human
agacaggagaaucacuugaaccca

SEQ ID NO: 1228528 - RNA, 23 nt, Human
agagacagaccaugaggcccagg

SEQ ID NO: 1228529 - RNA, 18 nt, Human
agagaugggcagaucacc

SEQ ID NO: 1228530 - RNA, 19 nt, Human
agagcggggaggagguggu

SEQ ID NO: 1228531 - RNA, 18 nt, Human
agaguuugcagugagcug

SEQ ID NO: 1228532 - RNA, 19 nt, Human
agaguuugcagugagcuga

SEQ ID NO: 1228533 - RNA, 23 nt, Human
agaucaccugaggucaggaguuc

SEQ ID NO: 1228534 - RNA, 25 nt, Human
agaucaccugaggucaggaguucaa

SEQ ID NO: 1228535 - RNA, 22 nt, Human
agaugggcagaucaccugaggu

SEQ ID NO: 1228536 - RNA, 24 nt, Human
agcacuuugggaggccgaggcggg

SEQ ID NO: 1228537 - RNA, 23 nt, Human
agccagguguggugacgugcgcc

SEQ ID NO: 1228538 - RNA, 22 nt, Human
agccuggccaacauggugaaac

SEQ ID NO: 1228539 - RNA, 24 nt, Human
agccuggccaacauggugaaaccc

SEQ ID NO: 1228540 - RNA, 24 nt, Human
agcugggcgugguggcaggcaucu

SEQ ID NO: 1228541 - RNA, 18 nt, Human
aggagguggugaggcagg

SEQ ID NO: 1228542 - RNA, 25 nt, Human
aggcaaaagcacagcuggugcagga

SEQ ID NO: 1228543 - RNA, 21 nt, Human
aggccgaggcgggcggaucac

SEQ ID NO: 1228544 - RNA, 23 nt, Human
aggccgaggcgggcggaucacga

SEQ ID NO: 1228545 - RNA, 24 nt, Human
aggcgggcggaucacgaggucagg

SEQ ID NO: 1228546 - RNA, 18 nt, Human
aggcgugagucaccaggg

SEQ ID NO: 1228547 - RNA, 24 nt, Human
agguguggugacgugcgccuguaa

SEQ ID NO: 1228548 - RNA, 24 nt, Human
agucugggcgacagagugaaacuc

SEQ ID NO: 1228549 - RNA, 23 nt, Human
auugcacucuagucugggcgaca

SEQ ID NO: 1228550 - RNA, 24 nt, Human
auugcacucuagucugggcgacag

SEQ ID NO: 1228551 - RNA, 22 nt, Human
caaaaaaaaaaaaaaaaaaaaa

SEQ ID NO: 1228552 - RNA, 24 nt, Human
caacauggagaaaccccgucucua

SEQ ID NO: 1228553 - RNA, 24 nt, Human
caacauggugaaacccagucacua

SEQ ID NO: 1228554 - RNA, 24 nt, Human
caagaccagccuggccaacauggu

SEQ ID NO: 1228555 - RNA, 26 nt, Human
caagcaguccucccacuucauccucc

SEQ ID NO: 1228556 - RNA, 19 nt, Human
caagcgauucucccaccuc

SEQ ID NO: 1228557 - RNA, 23 nt, Human
caccugaggucaggaguucaaga

SEQ ID NO: 1228558 - RNA, 24 nt, Human
cacgcccguaaucccagcacuuug

SEQ ID NO: 1228559 - RNA, 24 nt, Human
cacgccuguaaucccagcacuuug

SEQ ID NO: 1228560 - RNA, 22 nt, Human
cacucuagucugggcgacagag

SEQ ID NO: 1228561 - RNA, 24 nt, Human
cacucuagucugggcgacagagug

SEQ ID NO: 1228562 - RNA, 28 nt, Human
cacuucauccucccaaguagcuuaaacu

SEQ ID NO: 1228563 - RNA, 27 nt, Human
cagagaugggcagaucaccugagguca

SEQ ID NO: 1228564 - RNA, 24 nt, Human
cagaucaccugaggucaggaguuc

SEQ ID NO: 1228565 - RNA, 18 nt, Human
cagcacuuugggagacag

SEQ ID NO: 1228566 - RNA, 24 nt, Human
cagcacuuugggaggccgaggcgg

SEQ ID NO: 1228567 - RNA, 24 nt, Human
cagccugaccaacauggagaaacc

SEQ ID NO: 1228568 - RNA, 22 nt, Human
caggauggaggggaggcccgug

SEQ ID NO: 1228569 - RNA, 22 nt, Human
cagucucccucuuuuuuugaag

SEQ ID NO: 1228570 - RNA, 19 nt, Human
caucuguaaucccagcuac

SEQ ID NO: 1228571 - RNA, 19 nt, Human
cauugcacucuagucuggg

SEQ ID NO: 1228572 - RNA, 22 nt, Human
cauugcacucuagucugggcga

SEQ ID NO: 1228573 - RNA, 23 nt, Human
cauugcacucuagucugggcgac

SEQ ID NO: 1228574 - RNA, 24 nt, Human
cauugcacucuagucugggcgaca

SEQ ID NO: 1228575 - RNA, 23 nt, Human
ccacuucauccucccaaguagcu

SEQ ID NO: 1228576 - RNA, 25 nt, Human
ccacuucauccucccaaguagcuua

SEQ ID NO: 1228577 - RNA, 18 nt, Human
ccaggcugggggaacagg

SEQ ID NO: 1228578 - RNA, 20 nt, Human
ccauugcacucuagucuggg

SEQ ID NO: 1228579 - RNA, 21 nt, Human
ccauugcacucuagucugggc

SEQ ID NO: 1228580 - RNA, 23 nt, Human
ccauugcacucuagucugggcga

SEQ ID NO: 1228581 - RNA, 24 nt, Human
ccauugcacucuagucugggcgac

SEQ ID NO: 1228582 - RNA, 22 nt, Human
cccaaguagcuuaaacuacagg

SEQ ID NO: 1228583 - RNA, 21 nt, Human
cccaggcugggggaacaggac

SEQ ID NO: 1228584 - RNA, 20 nt, Human
ccccggcucaagcaguccuc

SEQ ID NO: 1228585 - RNA, 24 nt, Human
cccggccgggcacgguggcucacg

SEQ ID NO: 1228586 - RNA, 21 nt, Human
cccugaggccaggaggggcuc

SEQ ID NO: 1228587 - RNA, 18 nt, Human
ccgagccggguggcucac

SEQ ID NO: 1228588 - RNA, 23 nt, Human
ccucccacuucauccucccaagu

SEQ ID NO: 1228589 - RNA, 18 nt, Human
ccucuuuuuuugaagugc

SEQ ID NO: 1228590 - RNA, 23 nt, Human
ccugaccaacauggagaaacccc

SEQ ID NO: 1228591 - RNA, 24 nt, Human
ccugaccaacauggagaaaccccg

SEQ ID NO: 1228592 - RNA, 22 nt, Human
ccuggccaacauggugaaaccc

SEQ ID NO: 1228593 - RNA, 23 nt, Human
ccuggccaacauggugaaaccca

SEQ ID NO: 1228594 - RNA, 24 nt, Human
ccuggccaacauggugaaacccag

SEQ ID NO: 1228595 - RNA, 20 nt, Human
ccugggagagcggggaggag

SEQ ID NO: 1228596 - RNA, 22 nt, Human
ccuguaaucccagcacuuuggg

SEQ ID NO: 1228597 - RNA, 21 nt, Human
ccuguaaucccagcuacucug

SEQ ID NO: 1228598 - RNA, 22 nt, Human
ccuguaaucccagcuacucugg

SEQ ID NO: 1228599 - RNA, 23 nt, Human
ccuguaaucccagcuacucugga

SEQ ID NO: 1228600 - RNA, 24 nt, Human
cgaggcgggcggaucacgagguca

SEQ ID NO: 1228601 - RNA, 24 nt, Human
cgcccguaaucccagcacuuuggg

SEQ ID NO: 1228602 - RNA, 23 nt, Human
cgccuguaaucccagcacuuugg

SEQ ID NO: 1228603 - RNA, 24 nt, Human
cgccuguaaucccagcuacucugg

SEQ ID NO: 1228604 - RNA, 22 nt, Human
cggaucacgaggucaggaguuc

SEQ ID NO: 1228605 - RNA, 24 nt, Human
cggccgagccggguggcucacgcc

SEQ ID NO: 1228606 - RNA, 18 nt, Human
cguguggcccaggcuggu

SEQ ID NO: 1228607 - RNA, 18 nt, Human
cucaaaaaaaaaaaaaaa

SEQ ID NO: 1228608 - RNA, 23 nt, Human
cucaaaaaaaaaaaaaaaaaaaa

SEQ ID NO: 1228609 - RNA, 21 nt, Human
cucaagcaguccucccacuuc

SEQ ID NO: 1228610 - RNA, 24 nt, Human
cucaagcgauucucccaccucugc

SEQ ID NO: 1228611 - RNA, 22 nt, Human
cucacgcccguaaucccagcac

SEQ ID NO: 1228612 - RNA, 24 nt, Human
cucacgcccguaaucccagcacuu

SEQ ID NO: 1228613 - RNA, 22 nt, Human
cucacgccuguaaucccagcac

SEQ ID NO: 1228614 - RNA, 24 nt, Human
cucacgccuguaaucccagcacuu

SEQ ID NO: 1228615 - RNA, 22 nt, Human
cuccccggcucaagcaguccuc

SEQ ID NO: 1228616 - RNA, 19 nt, Human
cuccgucucaaaaaaaaaa

SEQ ID NO: 1228617 - RNA, 22 nt, Human
cugggcgacagagugaaacucc

SEQ ID NO: 1228618 - RNA, 21 nt, Human
cuguaaucccagcuacucaga

SEQ ID NO: 1228619 - RNA, 23 nt, Human
cuucugggcucaagcgauucucc

SEQ ID NO: 1228620 - RNA, 22 nt, Human
gaaaggcgugagucaccagggc

SEQ ID NO: 1228621 - RNA, 24 nt, Human
gacagagugaaacuccgucucaaa

SEQ ID NO: 1228622 - RNA, 21 nt, Human
gagaaaccccgucucuacuaa

SEQ ID NO: 1228623 - RNA, 23 nt, Human
gagaccagccugaccaacaugga

SEQ ID NO: 1228624 - RNA, 23 nt, Human
gagcaggaggcuagaagagacag

SEQ ID NO: 1228625 - RNA, 18 nt, Human
gagguggugaggcagggg

SEQ ID NO: 1228626 - RNA, 23 nt, Human
gaucaccugaggucaggaguuca

SEQ ID NO: 1228627 - RNA, 24 nt, Human
gaucaccugaggucaggaguucaa

SEQ ID NO: 1228628 - RNA, 21 nt, Human
gaucacgaggucaggaguucg

SEQ ID NO: 1228629 - RNA, 22 nt, Human
gaucacgaggucaggaguucga

SEQ ID NO: 1228630 - RNA, 24 nt, Human
gaucacgaggucaggaguucgaga

SEQ ID NO: 1228631 - RNA, 24 nt, Human
gcacucuagucugggcgacagagu

SEQ ID NO: 1228632 - RNA, 22 nt, Human
gccaacauggugaaacccaguc

SEQ ID NO: 1228633 - RNA, 24 nt, Human
gccauugcacucuagucugggcga

SEQ ID NO: 1228634 - RNA, 18 nt, Human
ggagaugggaagagucaa

SEQ ID NO: 1228635 - RNA, 23 nt, Human
ggagguggugaggcaggggggca

SEQ ID NO: 1228636 - RNA, 23 nt, Human
ggcacgguggcucacgccuguaa

SEQ ID NO: 1228637 - RNA, 25 nt, Human
ggcagaucaccugaggucaggaguu

SEQ ID NO: 1228638 - RNA, 19 nt, Human
ggcaucuguaaucccagcu

SEQ ID NO: 1228639 - RNA, 23 nt, Human
ggcggaucacgaggucaggaguu

SEQ ID NO: 1228640 - RNA, 19 nt, Human
ggcucaagcgauucuccca

SEQ ID NO: 1228641 - RNA, 19 nt, Human
gggagacagagaugggcag

SEQ ID NO: 1228642 - RNA, 24 nt, Human
ggugacgugcgccuguaaucccag

SEQ ID NO: 1228643 - RNA, 23 nt, Human
ggugcaggauggaggggaggccc

SEQ ID NO: 1228644 - RNA, 24 nt, Human
gguggcaggcaucuguaaucccag

SEQ ID NO: 1228645 - RNA, 24 nt, Human
gguggcucacgcccguaaucccag

SEQ ID NO: 1228646 - RNA, 23 nt, Human
gguggcucacgccuguaauccca

SEQ ID NO: 1228647 - RNA, 24 nt, Human
gguggcucacgccuguaaucccag

SEQ ID NO: 1228648 - RNA, 20 nt, Human
guuugcagugagcugagauc

SEQ ID NO: 1228649 - RNA, 21 nt, Human
uaaaaauacaaaaauuagcca

SEQ ID NO: 1228650 - RNA, 19 nt, Human
uaaacuacaggugcaugcc

SEQ ID NO: 1228651 - RNA, 20 nt, Human
uacaggugcaugccaccaca

SEQ ID NO: 1228652 - RNA, 18 nt, Human
uagaagagacagaccaug

SEQ ID NO: 1228653 - RNA, 23 nt, Human
ucaaaaaaaaaaaaaaaaaaaaa

SEQ ID NO: 1228654 - RNA, 23 nt, Human
ucaccugaggucaggaguucaag

SEQ ID NO: 1228655 - RNA, 18 nt, Human
ucacgaggucaggaguuc

SEQ ID NO: 1228656 - RNA, 24 nt, Human
ucacgaggucaggaguucgagacc

SEQ ID NO: 1228657 - RNA, 24 nt, Human
ucagaagcugagacaggagaauca

SEQ ID NO: 1228658 - RNA, 22 nt, Human
ucaggcagggucuugaucuguu

SEQ ID NO: 1228659 - RNA, 24 nt, Human
ucccaaguagcuuaaacuacaggu

SEQ ID NO: 1228660 - RNA, 24 nt, Human
uccccggcucaagcaguccuccca

SEQ ID NO: 1228661 - RNA, 22 nt, Human
ucccucuuuuuuugaagugcug

SEQ ID NO: 1228662 - RNA, 23 nt, Human
uccgucucaaaaaaaaaaaaaaa

SEQ ID NO: 1228663 - RNA, 22 nt, Human
ucuagucugggcgacagaguga

SEQ ID NO: 1228664 - RNA, 23 nt, Human
ucucaaacuucugggcucaagcg

SEQ ID NO: 1228665 - RNA, 23 nt, Human
ucucuacuaaaaauacaaaaauu

SEQ ID NO: 1228666 - RNA, 21 nt, Human
ucuguaaucccagcuacucag

SEQ ID NO: 1228667 - RNA, 23 nt, Human
ucuugaucuguugcucaaacugg

SEQ ID NO: 1228668 - RNA, 24 nt, Human
ucuugaucuguugcucaaacugga

SEQ ID NO: 1228669 - RNA, 22 nt, Human
ugacgugcgccuguaaucccag

SEQ ID NO: 1228670 - RNA, 20 nt, Human
ugagacaggagaaucacuug

SEQ ID NO: 1228671 - RNA, 24 nt, Human
ugagacaggagaaucacuugaacc

SEQ ID NO: 1228672 - RNA, 18 nt, Human
ugaggcaggggggcacua

SEQ ID NO: 1228673 - RNA, 20 nt, Human
ugaggcaggggggcacuaug

SEQ ID NO: 1228674 - RNA, 22 nt, Human
ugaggccaggaggggcucagga

SEQ ID NO: 1228675 - RNA, 18 nt, Human
ugauuuauuuucaggcag

SEQ ID NO: 1228676 - RNA, 25 nt, Human
ugccaccacaucuggcuuuuuuuug

SEQ ID NO: 1228677 - RNA, 24 nt, Human
ugcucaaacuggaguucuguggcg

SEQ ID NO: 1228678 - RNA, 22 nt, Human
uggaauggcccugaggccagga

SEQ ID NO: 1228679 - RNA, 18 nt, Human
uggauggagagccucuac

SEQ ID NO: 1228680 - RNA, 24 nt, Human
uggccaacauggugaaacccaguc

SEQ ID NO: 1228681 - RNA, 22 nt, Human
uggcucacgcccguaaucccag

SEQ ID NO: 1228682 - RNA, 24 nt, Human
uggcucacgcccguaaucccagca

SEQ ID NO: 1228683 - RNA, 22 nt, Human
uggcucacgccuguaaucccag

SEQ ID NO: 1228684 - RNA, 24 nt, Human
uggcucacgccuguaaucccagca

SEQ ID NO: 1228685 - RNA, 22 nt, Human
ugggaagagucaaguuaggggc

SEQ ID NO: 1228686 - RNA, 19 nt, Human
ugggagacagagaugggca

SEQ ID NO: 1228687 - RNA, 24 nt, Human
ugggagacagagaugggcagauca

SEQ ID NO: 1228688 - RNA, 18 nt, Human
ugggagagcggggaggag

SEQ ID NO: 1228689 - RNA, 19 nt, Human
ugggagagcggggaggagg

SEQ ID NO: 1228690 - RNA, 23 nt, Human
ugggagagcggggaggagguggu

SEQ ID NO: 1228691 - RNA, 19 nt, Human
ugggaggccgaggcgggcg

SEQ ID NO: 1228692 - RNA, 24 nt, Human
ugggaggccgaggcgggcggauca

SEQ ID NO: 1228693 - RNA, 18 nt, Human
ugggcagaucaccugagg

SEQ ID NO: 1228694 - RNA, 24 nt, Human
ugggcagaucaccugaggucagga

SEQ ID NO: 1228695 - RNA, 20 nt, Human
uggggagguggauggagagc

SEQ ID NO: 1228696 - RNA, 20 nt, Human
ugguauuuuuuuuuguagcg

SEQ ID NO: 1228697 - RNA, 24 nt, Human
uggugacgugcgccuguaauccca

SEQ ID NO: 1228698 - RNA, 21 nt, Human
uggugcaggauggaggggagg

SEQ ID NO: 1228699 - RNA, 24 nt, Human
ugguggcaggcaucuguaauccca

SEQ ID NO: 1228700 - RNA, 24 nt, Human
uguagaaauggggcuuugucgugu

SEQ ID NO: 1228701 - RNA, 20 nt, Human
ugucccagucucccucuuuu

SEQ ID NO: 1228702 - RNA, 24 nt, Human
ugucguguggcccaggcuggucuc

SEQ ID NO: 1228703 - RNA, 22 nt, Human
ugugcggccgagccggguggcu

SEQ ID NO: 1228704 - RNA, 19 nt, Human
uuacuccagccuccaccuc

SEQ ID NO: 1228705 - RNA, 18 nt, Human
uuagcugggcgugguggc

SEQ ID NO: 1228706 - RNA, 24 nt, Human
uuagcugggcgugguggcaggcau

SEQ ID NO: 1228707 - RNA, 20 nt, Human
uucacuuccugcuugcggcu

SEQ ID NO: 1228708 - RNA, 23 nt, Human
uucugggcucaagcgauucuccc

SEQ ID NO: 1228709 - RNA, 25 nt, Human
uugggaggccgaggcgggcggauca

SEQ ID NO: 1228710 - RNA, 19 nt, Human
uuguagaaauggggcuuug

SEQ ID NO: 1228711 - RNA, 20 nt, Human
uuugcagugagcugagaucc

SEQ ID NO: 1228712 - RNA, 22 nt, Human
uuugcagugagcugagauccag

SEQ ID NO: 1228713 - RNA, 22 nt, Human
uuuuuugguauuuuuuuuugua

SEQ ID NO: 1228714 - RNA, 27 nt, Human
aaagaagccaauucagcagaccccaga

SEQ ID NO: 1228715 - RNA, 18 nt, Human
aaagugcugcgauuacaa

SEQ ID NO: 1228716 - RNA, 24 nt, Human
aaagugcugcgauuacaagcguga

SEQ ID NO: 1228717 - RNA, 23 nt, Human
aaccgggcccugcaaggccagcu

SEQ ID NO: 1228718 - RNA, 18 nt, Human
aacugccccacugacacu

SEQ ID NO: 1228719 - RNA, 20 nt, Human
aagaagccaauucagcagac

SEQ ID NO: 1228720 - RNA, 25 nt, Human
aagcaauucucuugccucagccucc

SEQ ID NO: 1228721 - RNA, 23 nt, Human
aagcgugagccacugugcccggc

SEQ ID NO: 1228722 - RNA, 20 nt, Human
aaggguaguuuuggagcugc

SEQ ID NO: 1228723 - RNA, 24 nt, Human
aaguagcugggauuacaggcgugu

SEQ ID NO: 1228724 - RNA, 25 nt, Human
aaguagcugggauuacaggcgugug

SEQ ID NO: 1228725 - RNA, 24 nt, Human
acauaucacuacccuggucaaaag

SEQ ID NO: 1228726 - RNA, 18 nt, Human
accaccuggagccaggcu

SEQ ID NO: 1228727 - RNA, 18 nt, Human
accacgccuggcuaauuu

SEQ ID NO: 1228728 - RNA, 19 nt, Human
acccuaaauuacccggcug

SEQ ID NO: 1228729 - RNA, 22 nt, Human
acucuuguugcccaggcuggag

SEQ ID NO: 1228730 - RNA, 23 nt, Human
agaaggaaguauuauugagccua

SEQ ID NO: 1228731 - RNA, 19 nt, Human
agcggugugaccucagcuc

SEQ ID NO: 1228732 - RNA, 24 nt, Human
aggugaucugccugcuucggccuc

SEQ ID NO: 1228733 - RNA, 19 nt, Human
agugcagcggugugaccuc

SEQ ID NO: 1228734 - RNA, 19 nt, Human
aucagaguccagcucugcc

SEQ ID NO: 1228735 - RNA, 19 nt, Human
aucccguuccccacucccc

SEQ ID NO: 1228736 - RNA, 21 nt, Human
aucccguuccccacuccccaa

SEQ ID NO: 1228737 - RNA, 19 nt, Human
auggggagccccauacccc

SEQ ID NO: 1228738 - RNA, 20 nt, Human
augggguuucaccaccuugg

SEQ ID NO: 1228739 - RNA, 21 nt, Human
augggguuucaccaccuuggu

SEQ ID NO: 1228740 - RNA, 24 nt, Human
augggguuucaccaccuuggucag

SEQ ID NO: 1228741 - RNA, 18 nt, Human
caaaagaaaagaagccaa

SEQ ID NO: 1228742 - RNA, 24 nt, Human
caaagugcugcgauuacaagcgug

SEQ ID NO: 1228743 - RNA, 20 nt, Human
caaccagauaccagacuaaa

SEQ ID NO: 1228744 - RNA, 22 nt, Human
caagcaauucucuugccucagc

SEQ ID NO: 1228745 - RNA, 23 nt, Human
caaggccagcucuaucaccaauc

SEQ ID NO: 1228746 - RNA, 26 nt, Human
cacauaucacuacccuggucaaaagc

SEQ ID NO: 1228747 - RNA, 18 nt, Human
caccaagccuucacaagc

SEQ ID NO: 1228748 - RNA, 25 nt, Human
caccaagccuucacaagccugcccc

SEQ ID NO: 1228749 - RNA, 21 nt, Human
caccaccuuggucaggcuggu

SEQ ID NO: 1228750 - RNA, 24 nt, Human
caccaccuuggucaggcuggucuc

SEQ ID NO: 1228751 - RNA, 26 nt, Human
cacggugcaggcaucaaccagauacc

SEQ ID NO: 1228752 - RNA, 24 nt, Human
cacucuuguugcccaggcuggagu

SEQ ID NO: 1228753 - RNA, 18 nt, Human
cacugggcuaacagcagg

SEQ ID NO: 1228754 - RNA, 23 nt, Human
cagaccccagauucugaccuccc

SEQ ID NO: 1228755 - RNA, 20 nt, Human
cagcagaccccagauucuga

SEQ ID NO: 1228756 - RNA, 19 nt, Human
cagcucccgacuccuggca

SEQ ID NO: 1228757 - RNA, 19 nt, Human
caggcaucaaccagauacc

SEQ ID NO: 1228758 - RNA, 20 nt, Human
cagggcucagucccuuccac

SEQ ID NO: 1228759 - RNA, 19 nt, Human
caucccguuccccacuccc

SEQ ID NO: 1228760 - RNA, 22 nt, Human
ccaaagugcugcgauuacaagc

SEQ ID NO: 1228761 - RNA, 24 nt, Human
ccaaagugcugcgauuacaagcgu

SEQ ID NO: 1228762 - RNA, 22 nt, Human
ccaaguagcugggauuacaggc

SEQ ID NO: 1228763 - RNA, 24 nt, Human
ccaaguagcugggauuacaggcgu

SEQ ID NO: 1228764 - RNA, 26 nt, Human
ccacgccugugcuccugcuaugcccu

SEQ ID NO: 1228765 - RNA, 22 nt, Human
ccacugggcuaacagcaggugc

SEQ ID NO: 1228766 - RNA, 20 nt, Human
cccaacaaagucccguccgc

SEQ ID NO: 1228767 - RNA, 23 nt, Human
cccaaguagcugggauuacaggc

SEQ ID NO: 1228768 - RNA, 23 nt, Human
cccaaguagcugggauuacaggc

SEQ ID NO: 1228769 - RNA, 19 nt, Human
cccaggcuggagugcagcg

SEQ ID NO: 1228770 - RNA, 23 nt, Human
cccauagucacggugcaggcauc

SEQ ID NO: 1228771 - RNA, 23 nt, Human
ccccaccacuaacugccccacug

SEQ ID NO: 1228772 - RNA, 21 nt, Human
ccccagcaguuccccggugcc

SEQ ID NO: 1228773 - RNA, 19 nt, Human
cccccugccuucaggcugu

SEQ ID NO: 1228774 - RNA, 21 nt, Human
cccgacuccuggcagugacac

SEQ ID NO: 1228775 - RNA, 23 nt, Human
cccguggccagaacacccugggc

SEQ ID NO: 1228776 - RNA, 27 nt, Human
ccgccuccugaguccaagcaauucuuu

SEQ ID NO: 1228777 - RNA, 19 nt, Human
ccuccacggaauuucugcc

SEQ ID NO: 1228778 - RNA, 23 nt, Human
ccuccacuccuaauccacacgga

SEQ ID NO: 1228779 - RNA, 21 nt, Human
ccugaccucaggugaucugcc

SEQ ID NO: 1228780 - RNA, 23 nt, Human
ccugaccucaggugaucugccug

SEQ ID NO: 1228781 - RNA, 23 nt, Human
ccuggagccaggcucugaaccuc

SEQ ID NO: 1228782 - RNA, 20 nt, Human
ccuuccacaaggucccacca

SEQ ID NO: 1228783 - RNA, 22 nt, Human
ccuuccacaaggucccaccaag

SEQ ID NO: 1228784 - RNA, 25 nt, Human
cgccuaagcaucccguuccccacuc

SEQ ID NO: 1228785 - RNA, 24 nt, Human
cggugugaccucagcucacugcaa

SEQ ID NO: 1228786 - RNA, 21 nt, Human
cuacacccucccuguuccagg

SEQ ID NO: 1228787 - RNA, 23 nt, Human
cucacugcaaacuccgccuccug

SEQ ID NO: 1228788 - RNA, 26 nt, Human
cucacugccacgccugugcuccugcu

SEQ ID NO: 1228789 - RNA, 23 nt, Human
cucagccucccaaguagcuggga

SEQ ID NO: 1228790 - RNA, 26 nt, Human
cuccugaccucaggugaucugccugc

SEQ ID NO: 1228791 - RNA, 18 nt, Human
cucuuguugcccaggcug

SEQ ID NO: 1228792 - RNA, 22 nt, Human
cugaagacccucugugaucugg

SEQ ID NO: 1228793 - RNA, 22 nt, Human
cugcagccgcugcucacccccg

SEQ ID NO: 1228794 - RNA, 20 nt, Human
cugccagcccccugccuuca

SEQ ID NO: 1228795 - RNA, 23 nt, Human
cugcuucggccucccaaagugcu

SEQ ID NO: 1228796 - RNA, 27 nt, Human
cuggcuaauuuuguacuuuuuuuuuuu

SEQ ID NO: 1228797 - RNA, 23 nt, Human
cuugccucagccucccaaguagc

SEQ ID NO: 1228798 - RNA, 24 nt, Human
cuuguugcccaggcuggagugcag

SEQ ID NO: 1228799 - RNA, 24 nt, Human
cuuugcuccuccccuacacccucc

SEQ ID NO: 1228800 - RNA, 23 nt, Human
gaccaccuggagccaggcucuga

SEQ ID NO: 1228801 - RNA, 24 nt, Human
gaccucaggugaucugccugcuuc

SEQ ID NO: 1228802 - RNA, 24 nt, Human
gagaugggguuucaccaccuuggu

SEQ ID NO: 1228803 - RNA, 21 nt, Human
gagcugcugcagccgcugcuc

SEQ ID NO: 1228804 - RNA, 18 nt, Human
gauuacaagcgugagcca

SEQ ID NO: 1228805 - RNA, 21 nt, Human
gauuacaagcgugagccacug

SEQ ID NO: 1228806 - RNA, 24 nt, Human
gauuacaagcgugagccacugugc

SEQ ID NO: 1228807 - RNA, 19 nt, Human
gauuacaggcgugugcuac

SEQ ID NO: 1228808 - RNA, 24 nt, Human
gcccaggcuggagugcagcggugu

SEQ ID NO: 1228809 - RNA, 22 nt, Human
gcgugugcuaccacgccuggcu

SEQ ID NO: 1228810 - RNA, 20 nt, Human
gcuccuccccuacacccucc

SEQ ID NO: 1228811 - RNA, 21 nt, Human
gcugcacauaucacuacccug

SEQ ID NO: 1228812 - RNA, 23 nt, Human
gcuggucucaaacuccugaccuc

SEQ ID NO: 1228813 - RNA, 23 nt, Human
ggagcccugccagcccccugccu

SEQ ID NO: 1228814 - RNA, 18 nt, Human
ggcaggaaccacugggcu

SEQ ID NO: 1228815 - RNA, 24 nt, Human
ggcuggucucaaacuccugaccuc

SEQ ID NO: 1228816 - RNA, 24 nt, Human
gggaucucucuaucuugugacacc

SEQ ID NO: 1228817 - RNA, 18 nt, Human
gggcccugcaaggccagc

SEQ ID NO: 1228818 - RNA, 18 nt, Human
gggcucagucccuuccac

SEQ ID NO: 1228819 - RNA, 22 nt, Human
gggguuucaccaccuuggucag

SEQ ID NO: 1228820 - RNA, 24 nt, Human
ggguccccccaccacuaacugccc

SEQ ID NO: 1228821 - RNA, 22 nt, Human
ggguuucaccaccuuggucagg

SEQ ID NO: 1228822 - RNA, 18 nt, Human
guagcugggauuacaggc

SEQ ID NO: 1228823 - RNA, 20 nt, Human
gucuuuuuuuuuuuuccuuu

SEQ ID NO: 1228824 - RNA, 30 nt, Human
guuuuuuuggucuuuuuuuuuuuuccuuuu

SEQ ID NO: 1228825 - RNA, 18 nt, Human
uaacugccccacugacac

SEQ ID NO: 1228826 - RNA, 24 nt, Human
uaaguucaaaagaaaagaagccaa

SEQ ID NO: 1228827 - RNA, 23 nt, Human
uacaagcgugagccacugugccc

SEQ ID NO: 1228828 - RNA, 22 nt, Human
uagaaugguggccuccucugcc

SEQ ID NO: 1228829 - RNA, 23 nt, Human
uagaaugguggccuccucugccc

SEQ ID NO: 1228830 - RNA, 24 nt, Human
uauuaaguucaaaagaaaagaagc

SEQ ID NO: 1228831 - RNA, 22 nt, Human
ucaaaagcccccagcaguuccc

SEQ ID NO: 1228832 - RNA, 22 nt, Human
ucacccuaaauuacccggcugc

SEQ ID NO: 1228833 - RNA, 22 nt, Human
ucacucuuguugcccaggcugg

SEQ ID NO: 1228834 - RNA, 23 nt, Human
ucacucuuguugcccaggcugga

SEQ ID NO: 1228835 - RNA, 18 nt, Human
ucacugcaaacuccgccu

SEQ ID NO: 1228836 - RNA, 19 nt, Human
ucacugcaaacuccgccuc

SEQ ID NO: 1228837 - RNA, 22 nt, Human
ucacugcaaacuccgccuccug

SEQ ID NO: 1228838 - RNA, 27 nt, Human
ucacugcaaacuccgccuccugagucc

SEQ ID NO: 1228839 - RNA, 18 nt, Human
ucagagcugagcuagcug

SEQ ID NO: 1228840 - RNA, 19 nt, Human
ucagagcugagcuagcugc

SEQ ID NO: 1228841 - RNA, 20 nt, Human
ucagccucccaaguagcugg

SEQ ID NO: 1228842 - RNA, 18 nt, Human
ucagucccuuccacaagg

SEQ ID NO: 1228843 - RNA, 21 nt, Human
ucagucccuuccacaaggucc

SEQ ID NO: 1228844 - RNA, 23 nt, Human
ucauuggcaggaaccacugggcu

SEQ ID NO: 1228845 - RNA, 24 nt, Human
ucccaaagugcugcgauuacaagc

SEQ ID NO: 1228846 - RNA, 24 nt, Human
ucccaaguagcugggauuacaggc

SEQ ID NO: 1228847 - RNA, 19 nt, Human
uccccaaccgggcccugca

SEQ ID NO: 1228848 - RNA, 23 nt, Human
uccccaaccgggcccugcaaggc

SEQ ID NO: 1228849 - RNA, 22 nt, Human
uccccacuccccaaccgggccc

SEQ ID NO: 1228850 - RNA, 19 nt, Human
uccuaauccacacggaggc

SEQ ID NO: 1228851 - RNA, 21 nt, Human
uccucugcccugggacccuac

SEQ ID NO: 1228852 - RNA, 21 nt, Human
uccugaguccaagcaauucuc

SEQ ID NO: 1228853 - RNA, 24 nt, Human
uccugaguccaagcaauucucuug

SEQ ID NO: 1228854 - RNA, 23 nt, Human
ucuccaggcaauggagaaagagc

SEQ ID NO: 1228855 - RNA, 26 nt, Human
ucuugccucagccucccaaguagcug

SEQ ID NO: 1228856 - RNA, 22 nt, Human
ucuuguugcccaggcuggagug

SEQ ID NO: 1228857 - RNA, 25 nt, Human
ucuuuuuuuuuuuuccuuuuucuuu

SEQ ID NO: 1228858 - RNA, 20 nt, Human
ugacaccaacuuugacuaca

SEQ ID NO: 1228859 - RNA, 21 nt, Human
ugacaccaacuuugacuacag

SEQ ID NO: 1228860 - RNA, 20 nt, Human
ugaccucaggugaucugccu

SEQ ID NO: 1228861 - RNA, 22 nt, Human
ugaccucaggugaucugccugc

SEQ ID NO: 1228862 - RNA, 24 nt, Human
ugaccucaggugaucugccugcuu

SEQ ID NO: 1228863 - RNA, 23 nt, Human
ugacuacaggugugcagaucugg

SEQ ID NO: 1228864 - RNA, 22 nt, Human
ugcaaggccagcucuaucacca

SEQ ID NO: 1228865 - RNA, 20 nt, Human
ugcagcggugugaccucagc

SEQ ID NO: 1228866 - RNA, 18 nt, Human
ugcccaggcuggagugca

SEQ ID NO: 1228867 - RNA, 24 nt, Human
ugcccaggcuggagugcagcggug

SEQ ID NO: 1228868 - RNA, 22 nt, Human
ugccucagccucccaaguagcu

SEQ ID NO: 1228869 - RNA, 24 nt, Human
ugccucagccucccaaguagcugg

SEQ ID NO: 1228870 - RNA, 23 nt, Human
ugccuucaggcuguuuggcuuuu

SEQ ID NO: 1228871 - RNA, 22 nt, Human
ugcgauuacaagcgugagccac

SEQ ID NO: 1228872 - RNA, 24 nt, Human
ugcgauuacaagcgugagccacug

SEQ ID NO: 1228873 - RNA, 24 nt, Human
ugcugcgauuacaagcgugagcca

SEQ ID NO: 1228874 - RNA, 18 nt, Human
ugcuguuuccuggugcau

SEQ ID NO: 1228875 - RNA, 19 nt, Human
uggagaaagagccaggggu

SEQ ID NO: 1228876 - RNA, 20 nt, Human
uggagcccugccagcccccc

SEQ ID NO: 1228877 - RNA, 19 nt, Human
uggagugcagcggugugac

SEQ ID NO: 1228878 - RNA, 28 nt, Human
uggagugcagcggugugacggcucuagc

SEQ ID NO: 1228879 - RNA, 20 nt, Human
uggcaggaaccacugggcua

SEQ ID NO: 1228880 - RNA, 20 nt, Human
uggccagaacacccugggcu

SEQ ID NO: 1228881 - RNA, 19 nt, Human
ugggagggaaaacgugggg

SEQ ID NO: 1228882 - RNA, 18 nt, Human
ugggauuacaggcgugug

SEQ ID NO: 1228883 - RNA, 19 nt, Human
ugggauuacaggcgugugc

SEQ ID NO: 1228884 - RNA, 22 nt, Human
ugggauuacaggcgugugcuac

SEQ ID NO: 1228885 - RNA, 24 nt, Human
ugggauuacaggcgugugcuacca

SEQ ID NO: 1228886 - RNA, 18 nt, Human
ugggccagagccuucugc

SEQ ID NO: 1228887 - RNA, 22 nt, Human
ugggccagagccuucugcugga

SEQ ID NO: 1228888 - RNA, 19 nt, Human
uggggcaucuuguccaucu

SEQ ID NO: 1228889 - RNA, 24 nt, Human
ugggguuucaccaccuuggucagg

SEQ ID NO: 1228890 - RNA, 24 nt, Human
uggucaggcuggucucaaacuccu

SEQ ID NO: 1228891 - RNA, 20 nt, Human
uggucuuuuuuuuuuuuccu

SEQ ID NO: 1228892 - RNA, 22 nt, Human
uggucuuuuuuuuuuuuccuuu

SEQ ID NO: 1228893 - RNA, 23 nt, Human
ugugaucagaguccagcucugcc

SEQ ID NO: 1228894 - RNA, 22 nt, Human
ugugcuccugcuaugcccuuga

SEQ ID NO: 1228895 - RNA, 21 nt, Human
uguguugggagggaaaacgug

SEQ ID NO: 1228896 - RNA, 23 nt, Human
uguguugggagggaaaacguggg

SEQ ID NO: 1228897 - RNA, 18 nt, Human
uucaaaagaaaagaagcc

SEQ ID NO: 1228898 - RNA, 24 nt, Human
uucacucuuguugcccaggcugga

SEQ ID NO: 1228899 - RNA, 19 nt, Human
uucggccucccaaagugcu

SEQ ID NO: 1228900 - RNA, 18 nt, Human
uuggagcugcugcagccg

SEQ ID NO: 1228901 - RNA, 24 nt, Human
uuucacucuuguugcccaggcugg

SEQ ID NO: 1228902 - RNA, 25 nt, Human
uuuuuaacuagagaugggguuucac

SEQ ID NO: 1228903 - RNA, 24 nt, Human
uuuuuuuuuuuuuuuuuuaacuag

SEQ ID NO: 1228904 - RNA, 19 nt, Human
aggcccccagagaguuccu

SEQ ID NO: 1228905 - RNA, 22 nt, Human
cucgccugcacauucuucucuu

SEQ ID NO: 1228906 - RNA, 21 nt, Human
cugaggcggcacucuuucccg

SEQ ID NO: 1228907 - RNA, 18 nt, Human
cuuugagcagucacugcc

SEQ ID NO: 1228908 - RNA, 21 nt, Human
gcccccagagaguuccuuuga

SEQ ID NO: 1228909 - RNA, 19 nt, Human
gguagcagcaagaauugca

SEQ ID NO: 1228910 - RNA, 21 nt, Human
ucgcuugcccucagcugaggc

SEQ ID NO: 1228911 - RNA, 23 nt, Human
ugaggcccccagagaguuccuuu

SEQ ID NO: 1228912 - RNA, 18 nt, Human
ugaggcggcacucuuucc

SEQ ID NO: 1228913 - RNA, 24 nt, Human
ugcugaggcccccagagaguuccu

SEQ ID NO: 1228914 - RNA, 23 nt, Human
agagcuugcgggagcgggaggug

SEQ ID NO: 1228915 - RNA, 21 nt, Human
auccugcgcuuugggggaggc

SEQ ID NO: 1228916 - RNA, 24 nt, Human
cagaacaucgccgcacucauccuc

SEQ ID NO: 1228917 - RNA, 19 nt, Human
cagcuucuugucuuucaaa

SEQ ID NO: 1228918 - RNA, 18 nt, Human
cagggaccacgaugagga

SEQ ID NO: 1228919 - RNA, 22 nt, Human
ccaaggugguguggaggcccau

SEQ ID NO: 1228920 - RNA, 18 nt, Human
cccccaggcagggccgcu

SEQ ID NO: 1228921 - RNA, 24 nt, Human
cccccaggcagggccgcucccccc

SEQ ID NO: 1228922 - RNA, 21 nt, Human
ccuccgcggaccaggccaccc

SEQ ID NO: 1228923 - RNA, 21 nt, Human
cgaugggccucucguaggucu

SEQ ID NO: 1228924 - RNA, 22 nt, Human
cuccuuggauuccugggcugug

SEQ ID NO: 1228925 - RNA, 22 nt, Human
cuggauccagagcuugcgggag

SEQ ID NO: 1228926 - RNA, 23 nt, Human
gaucagcuucuugucuucuccgg

SEQ ID NO: 1228927 - RNA, 20 nt, Human
gcagugugugacguuggugg

SEQ ID NO: 1228928 - RNA, 26 nt, Human
gccuuugccgcuguugccuucauugg

SEQ ID NO: 1228929 - RNA, 22 nt, Human
ggacaggugaugcagugguucu

SEQ ID NO: 1228930 - RNA, 18 nt, Human
ggcaggugcacccuccgc

SEQ ID NO: 1228931 - RNA, 18 nt, Human
ggccgcaggaaccgagac

SEQ ID NO: 1228932 - RNA, 21 nt, Human
ggggacucgauguagccggug

SEQ ID NO: 1228933 - RNA, 24 nt, Human
gguaguccucaucguaggugacau

SEQ ID NO: 1228934 - RNA, 20 nt, Human
guagggccgcaggaaccgag

SEQ ID NO: 1228935 - RNA, 30 nt, Human
gugguucuggccaaacucgggcugguaggu

SEQ ID NO: 1228936 - RNA, 21 nt, Human
uaggugccgacggggcagcgg

SEQ ID NO: 1228937 - RNA, 18 nt, Human
ucgccaggguaguugggg

SEQ ID NO: 1228938 - RNA, 18 nt, Human
ucucagggaccacgauga

SEQ ID NO: 1228939 - RNA, 21 nt, Human
ugaccagaacaucgccgcacu

SEQ ID NO: 1228940 - RNA, 23 nt, Human
ugaccagaacaucgccgcacuca

SEQ ID NO: 1228941 - RNA, 25 nt, Human
ugaucagcuucuugucuuucaaaau

SEQ ID NO: 1228942 - RNA, 21 nt, Human
uggauuccugggcuguguacu

SEQ ID NO: 1228943 - RNA, 18 nt, Human
uggguggugguguuguag

SEQ ID NO: 1228944 - RNA, 22 nt, Human
uuccucaugaccagaacaucgc

SEQ ID NO: 1228945 - RNA, 26 nt, Human
uugaucagcuucuugucuucuccggg

SEQ ID NO: 1228946 - RNA, 22 nt, Human
uugcugguaguccucaucguag

SEQ ID NO: 1228947 - RNA, 26 nt, Human
aaaaaaaaacaaacaaacaaaaacaa

SEQ ID NO: 1228948 - RNA, 25 nt, Human
aaaaaaaacaaacaaacaaaaacaa

SEQ ID NO: 1228949 - RNA, 18 nt, Human
aaaacaaacaaacaaaaa

SEQ ID NO: 1228950 - RNA, 23 nt, Human
aaaagagacuaagacaccaaaag

SEQ ID NO: 1228951 - RNA, 25 nt, Human
aaagaaaccagcuggaauuaauggg

SEQ ID NO: 1228952 - RNA, 18 nt, Human
aaagagacuaagacacca

SEQ ID NO: 1228953 - RNA, 21 nt, Human
aacaagggaaaaucccaucuc

SEQ ID NO: 1228954 - RNA, 25 nt, Human
aagauggguggaucgcuugaggcca

SEQ ID NO: 1228955 - RNA, 18 nt, Human
aauuagccaggcauggug

SEQ ID NO: 1228956 - RNA, 24 nt, Human
aauugcgugaaccugggaggcaga

SEQ ID NO: 1228957 - RNA, 24 nt, Human
acaagagugagacucugucucaaa

SEQ ID NO: 1228958 - RNA, 18 nt, Human
accacacaugaacuagau

SEQ ID NO: 1228959 - RNA, 21 nt, Human
agaaaaaguaaaaaugaacaa

SEQ ID NO: 1228960 - RNA, 18 nt, Human
agagguugcagugagcca

SEQ ID NO: 1228961 - RNA, 20 nt, Human
agagguugcagugagccaag

SEQ ID NO: 1228962 - RNA, 22 nt, Human
agagguugcagugagccaagau

SEQ ID NO: 1228963 - RNA, 24 nt, Human
agagguugcagugagccaagaugg

SEQ ID NO: 1228964 - RNA, 23 nt, Human
agauggguggaucgcuugaggcc

SEQ ID NO: 1228965 - RNA, 24 nt, Human
agcacacuaaagguaucuucacac

SEQ ID NO: 1228966 - RNA, 24 nt, Human
agcacucugggaggccaagauggg

SEQ ID NO: 1228967 - RNA, 24 nt, Human
aggcagagguugcagugagccaag

SEQ ID NO: 1228968 - RNA, 24 nt, Human
aggcaugguggcacacaccuguaa

SEQ ID NO: 1228969 - RNA, 18 nt, Human
aggcuuuuuuucugaauu

SEQ ID NO: 1228970 - RNA, 22 nt, Human
agggagaaaauagcuuuuagga

SEQ ID NO: 1228971 - RNA, 23 nt, Human
auccugggcuaguuucuaauccu

SEQ ID NO: 1228972 - RNA, 22 nt, Human
aucugcagacaccauuuuccuu

SEQ ID NO: 1228973 - RNA, 18 nt, Human
auggcgccacuacacccc

SEQ ID NO: 1228974 - RNA, 23 nt, Human
auucaugaacauggaauguauuu

SEQ ID NO: 1228975 - RNA, 18 nt, Human
caaaagagacuaagacac

SEQ ID NO: 1228976 - RNA, 19 nt, Human
caaacaaaaacaaaaugca

SEQ ID NO: 1228977 - RNA, 21 nt, Human
caagaaaacugauucccacag

SEQ ID NO: 1228978 - RNA, 24 nt, Human
caagagugagacucugucucaaaa

SEQ ID NO: 1228979 - RNA, 19 nt, Human
caauacaguccuuaaagag

SEQ ID NO: 1228980 - RNA, 23 nt, Human
caauacaguccuuaaagaguuga

SEQ ID NO: 1228981 - RNA, 21 nt, Human
cacaauagcuaauacacauua

SEQ ID NO: 1228982 - RNA, 24 nt, Human
cacaccuguaaucccagcacucug

SEQ ID NO: 1228983 - RNA, 19 nt, Human
cacaccuguaaucccugcu

SEQ ID NO: 1228984 - RNA, 20 nt, Human
caccuguaaucccagcacuc

SEQ ID NO: 1228985 - RNA, 24 nt, Human
caccuguaaucccagcacucuggg

SEQ ID NO: 1228986 - RNA, 18 nt, Human
caccuguaaucccugcua

SEQ ID NO: 1228987 - RNA, 24 nt, Human
caccuguaaucccugcuacucagg

SEQ ID NO: 1228988 - RNA, 21 nt, Human
cacuacaccccagucucgaca

SEQ ID NO: 1228989 - RNA, 21 nt, Human
cagaagacaguugguucaaag

SEQ ID NO: 1228990 - RNA, 19 nt, Human
cagaggaucuuuuaaaacc

SEQ ID NO: 1228991 - RNA, 20 nt, Human
cagcaaagaaaccagcugga

SEQ ID NO: 1228992 - RNA, 20 nt, Human
cagcacucugggaggccaag

SEQ ID NO: 1228993 - RNA, 26 nt, Human
cagcacucugggaggccaagaugggu

SEQ ID NO: 1228994 - RNA, 24 nt, Human
caguuuguguauucucuuuuguug

SEQ ID NO: 1228995 - RNA, 20 nt, Human
caugaacuagauaccuuccc

SEQ ID NO: 1228996 - RNA, 18 nt, Human
cauuacuguaguucugua

SEQ ID NO: 1228997 - RNA, 20 nt, Human
ccaaaaguggaagagcacac

SEQ ID NO: 1228998 - RNA, 20 nt, Human
ccaauagauccagaagacag

SEQ ID NO: 1228999 - RNA, 25 nt, Human
ccugggaggcagagguugcagugag

SEQ ID NO: 1229000 - RNA, 19 nt, Human
ccuguaaucccugcuacuc

SEQ ID NO: 1229001 - RNA, 21 nt, Human
ccugugaacuucuggggauac

SEQ ID NO: 1229002 - RNA, 24 nt, Human
cgacaagagugagacucugucuca

SEQ ID NO: 1229003 - RNA, 24 nt, Human
cgccacuacaccccagucucgaca

SEQ ID NO: 1229004 - RNA, 18 nt, Human
cucaaaaaaaaacaaaca

SEQ ID NO: 1229005 - RNA, 18 nt, Human
cucugucucaaaaaaaaa

SEQ ID NO: 1229006 - RNA, 19 nt, Human
cucugucucaaaaaaaaac

SEQ ID NO: 1229007 - RNA, 22 nt, Human
cugaauucucaauucuaugcca

SEQ ID NO: 1229008 - RNA, 22 nt, Human
cugacaucuucucuccuuuucu

SEQ ID NO: 1229009 - RNA, 19 nt, Human
cugauucaugaacauggaa

SEQ ID NO: 1229010 - RNA, 19 nt, Human
cuucuuugcagaaaagccu

SEQ ID NO: 1229011 - RNA, 24 nt, Human
gaggcugaguauggugauucacac

SEQ ID NO: 1229012 - RNA, 18 nt, Human
gagguugcagugagccaa

SEQ ID NO: 1229013 - RNA, 18 nt, Human
gaucgcuugaggccagga

SEQ ID NO: 1229014 - RNA, 23 nt, Human
gcacacuaaagguaucuucacac

SEQ ID NO: 1229015 - RNA, 19 nt, Human
gccacuacaccccagucuc

SEQ ID NO: 1229016 - RNA, 19 nt, Human
gggagaggaauugcuggau

SEQ ID NO: 1229017 - RNA, 20 nt, Human
ggucuuguauucuacgaccu

SEQ ID NO: 1229018 - RNA, 24 nt, Human
ggugauucacaccuguaaucccag

SEQ ID NO: 1229019 - RNA, 24 nt, Human
gguugcagugagccaagauggcgc

SEQ ID NO: 1229020 - RNA, 23 nt, Human
gucauuuguauuucuucuuugca

SEQ ID NO: 1229021 - RNA, 23 nt, Human
uaaaaauacuaaaaauuagccag

SEQ ID NO: 1229022 - RNA, 25 nt, Human
uaaaaauacuaaaaauuagccaguc

SEQ ID NO: 1229023 - RNA, 26 nt, Human
uaaaauaguuaaguuauaccuaagug

SEQ ID NO: 1229024 - RNA, 21 nt, Human
uaagacaccaaaaguggaaga

SEQ ID NO: 1229025 - RNA, 18 nt, Human
uaaucccugcuacucagg

SEQ ID NO: 1229026 - RNA, 22 nt, Human
uacagaggaucuuuuaaaacca

SEQ ID NO: 1229027 - RNA, 18 nt, Human
uaccugugaacuucuggg

SEQ ID NO: 1229028 - RNA, 21 nt, Human
uacgaguucuuuauauaccac

SEQ ID NO: 1229029 - RNA, 21 nt, Human
uacuaaaaauuagccaggcau

SEQ ID NO: 1229030 - RNA, 20 nt, Human
uagaaucagcaaagaaaccc

SEQ ID NO: 1229031 - RNA, 23 nt, Human
uauagaaggaaaaaauagaaaaa

SEQ ID NO: 1229032 - RNA, 23 nt, Human
uaucagaaguuuucaauacagag

SEQ ID NO: 1229033 - RNA, 23 nt, Human
uaucguaacucuacauuuaacca

SEQ ID NO: 1229034 - RNA, 24 nt, Human
uauuucuucuuugcagaaaagccu

SEQ ID NO: 1229035 - RNA, 28 nt, Human
ucaaaaaaaaacaaacaaacaaaaacaa

SEQ ID NO: 1229036 - RNA, 24 nt, Human
ucaaaagagacuaagacaccaaaa

SEQ ID NO: 1229037 - RNA, 22 nt, Human
ucaauuucuccacauccucauc

SEQ ID NO: 1229038 - RNA, 22 nt, Human
ucacaccuguaaucccagcacu

SEQ ID NO: 1229039 - RNA, 24 nt, Human
uccaguuuguguauucucuuuugu

SEQ ID NO: 1229040 - RNA, 23 nt, Human
uccccuuccucauucuggaacug

SEQ ID NO: 1229041 - RNA, 22 nt, Human
uccugggcuaguuucuaauccu

SEQ ID NO: 1229042 - RNA, 22 nt, Human
ucucaaaaaaaaacaaacaaac

SEQ ID NO: 1229043 - RNA, 23 nt, Human
ucucaaaaaaaaacaaacaaaca

SEQ ID NO: 1229044 - RNA, 20 nt, Human
ucuccccuuccucauucugg

SEQ ID NO: 1229045 - RNA, 22 nt, Human
ucucuacuaaaaauacuaaaaa

SEQ ID NO: 1229046 - RNA, 19 nt, Human
ucucugcuauugcugauag

SEQ ID NO: 1229047 - RNA, 23 nt, Human
ucucuuuuguugccuaugcuuug

SEQ ID NO: 1229048 - RNA, 22 nt, Human
ucugaauauucaaaacauugca

SEQ ID NO: 1229049 - RNA, 24 nt, Human
ugaaccugggaggcagagguugca

SEQ ID NO: 1229050 - RNA, 19 nt, Human
ugaacuucuggggauacau

SEQ ID NO: 1229051 - RNA, 22 nt, Human
ugaagagaaguauaaagaauua

SEQ ID NO: 1229052 - RNA, 18 nt, Human
ugacuuaauauuuggugg

SEQ ID NO: 1229053 - RNA, 22 nt, Human
ugauucacaccuguaaucccag

SEQ ID NO: 1229054 - RNA, 24 nt, Human
ugauucacaccuguaaucccagca

SEQ ID NO: 1229055 - RNA, 19 nt, Human
ugauuugcaaauauuuucu

SEQ ID NO: 1229056 - RNA, 22 nt, Human
ugauuugcaaauauuuucuccc

SEQ ID NO: 1229057 - RNA, 22 nt, Human
ugcagaaaagccuguugagcua

SEQ ID NO: 1229058 - RNA, 21 nt, Human
uggaagaaaaaguaaaaauga

SEQ ID NO: 1229059 - RNA, 21 nt, Human
uggaagagcacacuaaaggua

SEQ ID NO: 1229060 - RNA, 21 nt, Human
uggaagagcacacuaaaggua

SEQ ID NO: 1229061 - RNA, 21 nt, Human
uggaucgcuugaggccaggag

SEQ ID NO: 1229062 - RNA, 24 nt, Human
uggaucgcuugaggccaggaguuc

SEQ ID NO: 1229063 - RNA, 24 nt, Human
ugggaggcagagguugcagugagc

SEQ ID NO: 1229064 - RNA, 23 nt, Human
ugggaggccaagauggguggauc

SEQ ID NO: 1229065 - RNA, 24 nt, Human
uggguggaucgcuugaggccagga

SEQ ID NO: 1229066 - RNA, 24 nt, Human
uggugauucacaccuguaauccca

SEQ ID NO: 1229067 - RNA, 23 nt, Human
ugguggcacacaccuguaauccc

SEQ ID NO: 1229068 - RNA, 21 nt, Human
uggugucauuucaaacaacag

SEQ ID NO: 1229069 - RNA, 24 nt, Human
uguaaucccugcuacucagguggc

SEQ ID NO: 1229070 - RNA, 19 nt, Human
ugugcacagguuuuuaugu

SEQ ID NO: 1229071 - RNA, 25 nt, Human
uguuaugagaauuucaauuucucca

SEQ ID NO: 1229072 - RNA, 23 nt, Human
uguugagcuauuuugcccauuuc

SEQ ID NO: 1229073 - RNA, 23 nt, Human
uuacgaguucuuuauauaccacc

SEQ ID NO: 1229074 - RNA, 20 nt, Human
uucaaaacaaaagggggaaa

SEQ ID NO: 1229075 - RNA, 21 nt, Human
uucaaaacaaaagggggaaaa

SEQ ID NO: 1229076 - RNA, 22 nt, Human
uugcagugagccaagauggcgc

SEQ ID NO: 1229077 - RNA, 24 nt, Human
uugcgugaaccugggaggcagagg

SEQ ID NO: 1229078 - RNA, 30 nt, Human
uugcuggaucauaucguaacucuacauugu

SEQ ID NO: 1229079 - RNA, 18 nt, Human
uuucaagauucuuccuaa

SEQ ID NO: 1229080 - RNA, 22 nt, Human
uuucuccccuuccucauucugg

SEQ ID NO: 1229081 - RNA, 21 nt, Human
acccuaaagcaauauuugagg

SEQ ID NO: 1229082 - RNA, 27 nt, Human
gaugacccuaaagcaauauuugagggg

SEQ ID NO: 1229083 - RNA, 23 nt, Human
ucacuguaggugcuguacucauc

SEQ ID NO: 1229084 - RNA, 18 nt, Human
ucacuguaguuaccgaag

SEQ ID NO: 1229085 - RNA, 23 nt, Human
ucucuguuuuuuuccugauucuu

SEQ ID NO: 1229086 - RNA, 20 nt, Human
ugauuggcaaaaucuuccuc

SEQ ID NO: 1229087 - RNA, 19 nt, Human
uggcaaaaucuuccucugu

SEQ ID NO: 1229088 - RNA, 28 nt, Human
uuuuuuguuauguugacccuucuuugau

SEQ ID NO: 1229089 - RNA, 26 nt, Human
aagaaaagaaucauccccugaaaugc

SEQ ID NO: 1229090 - RNA, 24 nt, Human
aagaagaaaagaaucauccccuga

SEQ ID NO: 1229091 - RNA, 18 nt, Human
aggaaaaagaagaaaaga

SEQ ID NO: 1229092 - RNA, 20 nt, Human
aggaaaaagaagaaaagaag

SEQ ID NO: 1229093 - RNA, 27 nt, Human
auacaagaguugcggaaaguuguucuu

SEQ ID NO: 1229094 - RNA, 19 nt, Human
caccaaaacagccuagacu

SEQ ID NO: 1229095 - RNA, 25 nt, Human
cuuucagccauugucaucagcugac

SEQ ID NO: 1229096 - RNA, 19 nt, Human
uaggaaaaagaagaaaaga

SEQ ID NO: 1229097 - RNA, 21 nt, Human
ucuugguuuccaugaccuggc

SEQ ID NO: 1229098 - RNA, 25 nt, Human
ugcaagacucaaacagaaccacaga

SEQ ID NO: 1229099 - RNA, 19 nt, Human
uuacaaguaaaugcacuac

SEQ ID NO: 1229100 - RNA, 23 nt, Human
aggaauuucuuggguuccuucag

SEQ ID NO: 1229101 - RNA, 19 nt, Human
caucuagcuuugccucauc

SEQ ID NO: 1229102 - RNA, 18 nt, Human
cuucaggaaugcaucuag

SEQ ID NO: 1229103 - RNA, 19 nt, Human
uagcuuugccucaucuuug

SEQ ID NO: 1229104 - RNA, 23 nt, Human
ucgucuagagaauucauuucauu

SEQ ID NO: 1229105 - RNA, 18 nt, Human
ucuagcuuugccucaucu

SEQ ID NO: 1229106 - RNA, 23 nt, Human
acacuugaaauuccaaagagaaa

SEQ ID NO: 1229107 - RNA, 21 nt, Human
accaaggugcaccugccuggg

SEQ ID NO: 1229108 - RNA, 23 nt, Human
uuaccaaggugcaccugccuggg

SEQ ID NO: 1229109 - RNA, 21 nt, Human
accccaauuuuucauccuuuu

SEQ ID NO: 1229110 - RNA, 20 nt, Human
accuggcuuguaaucaguga

SEQ ID NO: 1229111 - RNA, 18 nt, Human
agaagccagucaggcuca

SEQ ID NO: 1229112 - RNA, 22 nt, Human
aggaaggcaugggagaagagga

SEQ ID NO: 1229113 - RNA, 23 nt, Human
aggagggacucaauguccuguga

SEQ ID NO: 1229114 - RNA, 27 nt, Human
aggauccacucauccuccacggucagc

SEQ ID NO: 1229115 - RNA, 21 nt, Human
agggaggaaggcaugggagaa

SEQ ID NO: 1229116 - RNA, 19 nt, Human
auccuccacggucagcuau

SEQ ID NO: 1229117 - RNA, 22 nt, Human
cacauguaagucuggccccugu

SEQ ID NO: 1229118 - RNA, 20 nt, Human
caccuguacuucuaaucaaa

SEQ ID NO: 1229119 - RNA, 20 nt, Human
cagcagggaggaaggcaugg

SEQ ID NO: 1229120 - RNA, 19 nt, Human
cauuuugcaaaugugacac

SEQ ID NO: 1229121 - RNA, 27 nt, Human
ccaaaacugugaccacauguaagucug

SEQ ID NO: 1229122 - RNA, 21 nt, Human
ccacauguaagucuggccccu

SEQ ID NO: 1229123 - RNA, 22 nt, Human
cccacaaccuccagcaagcagc

SEQ ID NO: 1229124 - RNA, 24 nt, Human
ccuacagacugacuaaguaggggg

SEQ ID NO: 1229125 - RNA, 21 nt, Human
ccugaccacauuuguccaucc

SEQ ID NO: 1229126 - RNA, 21 nt, Human
ccugugauggaguguagaggc

SEQ ID NO: 1229127 - RNA, 23 nt, Human
cgcugucguggccaccacccggc

SEQ ID NO: 1229128 - RNA, 21 nt, Human
cuaugugcuuauuucuuuucc

SEQ ID NO: 1229129 - RNA, 23 nt, Human
cucauccuccacggucagcuauc

SEQ ID NO: 1229130 - RNA, 20 nt, Human
gaagaggaggagggacucaa

SEQ ID NO: 1229131 - RNA, 19 nt, Human
gacuauugucucuucugcu

SEQ ID NO: 1229132 - RNA, 18 nt, Human
gcacguggggcagauguu

SEQ ID NO: 1229133 - RNA, 22 nt, Human
ggaaaaaaccaggaacaaugaa

SEQ ID NO: 1229134 - RNA, 26 nt, Human
ggaggaaggcaugggagaagaggagg

SEQ ID NO: 1229135 - RNA, 21 nt, Human
uaaauggaaguucccacaacc

SEQ ID NO: 1229136 - RNA, 18 nt, Human
uauagaagccacucggau

SEQ ID NO: 1229137 - RNA, 23 nt, Human
ucagugaaaugauccuugaucug

SEQ ID NO: 1229138 - RNA, 21 nt, Human
ucaguuccuuuccaugcagca

SEQ ID NO: 1229139 - RNA, 19 nt, Human
uccauucccaccgcggccg

SEQ ID NO: 1229140 - RNA, 21 nt, Human
uccauucccaccgcggccgcg

SEQ ID NO: 1229141 - RNA, 24 nt, Human
ucccacaaccuccagcaagcagca

SEQ ID NO: 1229142 - RNA, 26 nt, Human
ucccacaaccuccagcaaggggcccu

SEQ ID NO: 1229143 - RNA, 22 nt, Human
ucccaccgcggccgcggaagag

SEQ ID NO: 1229144 - RNA, 18 nt, Human
ucugcugccaucaagcuc

SEQ ID NO: 1229145 - RNA, 23 nt, Human
ucuucugcugccaucaagcucau

SEQ ID NO: 1229146 - RNA, 21 nt, Human
ugccacagcagggaggaaggc

SEQ ID NO: 1229147 - RNA, 20 nt, Human
ugccaucaagcucauggugc

SEQ ID NO: 1229148 - RNA, 21 nt, Human
uggaaaaaaccaggaacaaug

SEQ ID NO: 1229149 - RNA, 24 nt, Human
uggaaaaaaccaggaacaaugaaa

SEQ ID NO: 1229150 - RNA, 21 nt, Human
ugggagaagaggaggagggac

SEQ ID NO: 1229151 - RNA, 22 nt, Human
ugucguggccaccacccggcuu

SEQ ID NO: 1229152 - RNA, 20 nt, Human
ugugauggaguguagaggcu

SEQ ID NO: 1229153 - RNA, 20 nt, Human
uucccaccgcggccgcggaa

SEQ ID NO: 1229154 - RNA, 24 nt, Human
uuccuuuccaugcagcacacaaua

SEQ ID NO: 1229155 - RNA, 20 nt, Human
uugaucugcccugaccacau

SEQ ID NO: 1229156 - RNA, 18 nt, Human
uuugcaaaugugacaccc

SEQ ID NO: 1229157 - RNA, 22 nt, Human
auuuuauucauggaccccuuca

SEQ ID NO: 1229158 - RNA, 19 nt, Human
caacauaacguuggaaaag

SEQ ID NO: 1229159 - RNA, 21 nt, Human
caaggacuccaauaagcaaca

SEQ ID NO: 1229160 - RNA, 22 nt, Human
caucuuucccaaguaucaagga

SEQ ID NO: 1229161 - RNA, 26 nt, Human
gccaaguuaacuccaucuuucccaag

SEQ ID NO: 1229162 - RNA, 24 nt, Human
ucaaggacuccaauaagcaacaga

SEQ ID NO: 1229163 - RNA, 24 nt, Human
uucaucaacauaacguuggaaaag

SEQ ID NO: 1229164 - RNA, 27 nt, Human
uugcugauguccacuugugggguacuc

SEQ ID NO: 1229165 - RNA, 19 nt, Human
aacacuuccaccuggaauc

SEQ ID NO: 1229166 - RNA, 21 nt, Human
aagaaaccuacccggaauuca

SEQ ID NO: 1229167 - RNA, 24 nt, Human
aagaaaucagagaagacacaaaca

SEQ ID NO: 1229168 - RNA, 22 nt, Human
aagaguucaagaccagccuggu

SEQ ID NO: 1229169 - RNA, 19 nt, Human
aaggcucuccuacccucca

SEQ ID NO: 1229170 - RNA, 22 nt, Human
aaggcucuccuacccuccauca

SEQ ID NO: 1229171 - RNA, 21 nt, Human
aaguuccucucccuggauccc

SEQ ID NO: 1229172 - RNA, 20 nt, Human
aaucagaauacaaaaacaaa

SEQ ID NO: 1229173 - RNA, 20 nt, Human
aauuuccauuugugcauccc

SEQ ID NO: 1229174 - RNA, 24 nt, Human
acaaaaacaaccaccaacaacaac

SEQ ID NO: 1229175 - RNA, 26 nt, Human
acaaaaacaaccaccaacaacaacau

SEQ ID NO: 1229176 - RNA, 18 nt, Human
acacagaaaaaauaagau

SEQ ID NO: 1229177 - RNA, 19 nt, Human
acagccaaaaaccaucaca

SEQ ID NO: 1229178 - RNA, 21 nt, Human
accaacaacaacaucagccca

SEQ ID NO: 1229179 - RNA, 19 nt, Human
accauacuacagggcuaca

SEQ ID NO: 1229180 - RNA, 22 nt, Human
acucauuuuguccuaccucucu

SEQ ID NO: 1229181 - RNA, 22 nt, Human
agaaaaaauaagauaccuagga

SEQ ID NO: 1229182 - RNA, 18 nt, Human
agaaagaggccuuaccuc

SEQ ID NO: 1229183 - RNA, 24 nt, Human
agaaaucagagaagacacaaacaa

SEQ ID NO: 1229184 - RNA, 21 nt, Human
agaauacaaaaacaaccacca

SEQ ID NO: 1229185 - RNA, 21 nt, Human
agaauaugacugggaauccau

SEQ ID NO: 1229186 - RNA, 23 nt, Human
agccaaaaaccaucacauagucc

SEQ ID NO: 1229187 - RNA, 21 nt, Human
agcccuaccccaguccucaga

SEQ ID NO: 1229188 - RNA, 19 nt, Human
agccuggucaacauaguga

SEQ ID NO: 1229189 - RNA, 24 nt, Human
agccuggucaacauagugagauuc

SEQ ID NO: 1229190 - RNA, 24 nt, Human
agugcccgguugcccaagucaaaa

SEQ ID NO: 1229191 - RNA, 22 nt, Human
aguuguuccuucucugucuucu

SEQ ID NO: 1229192 - RNA, 20 nt, Human
auaaaaaguaauuacaauga

SEQ ID NO: 1229193 - RNA, 24 nt, Human
auaaauuuuguauuuaaaacagag

SEQ ID NO: 1229194 - RNA, 21 nt, Human
aucagaauacaaaaacaacca

SEQ ID NO: 1229195 - RNA, 23 nt, Human
aucuugaaauguccucucccuca

SEQ ID NO: 1229196 - RNA, 22 nt, Human
auuuuguccuaccucucuguga

SEQ ID NO: 1229197 - RNA, 21 nt, Human
caaaaagaacgaagcuggagg

SEQ ID NO: 1229198 - RNA, 22 nt, Human
caaaaagaacgaagcuggaggc

SEQ ID NO: 1229199 - RNA, 23 nt, Human
caaaaagaacgaagcuggaggca

SEQ ID NO: 1229200 - RNA, 23 nt, Human
caaaccauacuacagggcuacag

SEQ ID NO: 1229201 - RNA, 21 nt, Human
caaacuuccuuagaaagaggc

SEQ ID NO: 1229202 - RNA, 22 nt, Human
caacaacaucagcccaacuuuc

SEQ ID NO: 1229203 - RNA, 22 nt, Human
caacauagugagauucuaucuc

SEQ ID NO: 1229204 - RNA, 24 nt, Human
caacauagugagauucuaucuccu

SEQ ID NO: 1229205 - RNA, 18 nt, Human
caagaaaccuacccggaa

SEQ ID NO: 1229206 - RNA, 24 nt, Human
caagaccagccuggucaacauagu

SEQ ID NO: 1229207 - RNA, 21 nt, Human
caagaugauguuggccucaua

SEQ ID NO: 1229208 - RNA, 20 nt, Human
cacaguuacucagcagcacu

SEQ ID NO: 1229209 - RNA, 21 nt, Human
cacaugguuuuuaucuuuagu

SEQ ID NO: 1229210 - RNA, 22 nt, Human
caccaacaacaacaucagccca

SEQ ID NO: 1229211 - RNA, 24 nt, Human
caccaacaacaacaucagcccaac

SEQ ID NO: 1229212 - RNA, 24 nt, Human
caccuggaauccccaaagaggccc

SEQ ID NO: 1229213 - RNA, 23 nt, Human
cacucaaaauacaguucuguaau

SEQ ID NO: 1229214 - RNA, 19 nt, Human
cagaauacaaaaacaacca

SEQ ID NO: 1229215 - RNA, 21 nt, Human
cagaauacaaaaacaaccacc

SEQ ID NO: 1229216 - RNA, 23 nt, Human
cagaauacaaaaacaaccaccaa

SEQ ID NO: 1229217 - RNA, 24 nt, Human
cagaauacaaaaacaaccaccaac

SEQ ID NO: 1229218 - RNA, 25 nt, Human
cagaauacaaaaacaaccaccaaca

SEQ ID NO: 1229219 - RNA, 26 nt, Human
cagcaaaaagaacgaagcuggaggca

SEQ ID NO: 1229220 - RNA, 23 nt, Human
cagcaaaucaauuucuuccuggc

SEQ ID NO: 1229221 - RNA, 20 nt, Human
caguaaccaaaacagcauga

SEQ ID NO: 1229222 - RNA, 24 nt, Human
caguaaccaaaacagcaugauacu

SEQ ID NO: 1229223 - RNA, 19 nt, Human
caucauguuacccaacuuc

SEQ ID NO: 1229224 - RNA, 24 nt, Human
caucccaugcccagcccacccucc

SEQ ID NO: 1229225 - RNA, 20 nt, Human
ccaaaacagcaugauacuga

SEQ ID NO: 1229226 - RNA, 22 nt, Human
ccaaaguaauuuacagaugcaa

SEQ ID NO: 1229227 - RNA, 22 nt, Human
ccagcccacccuccaccagccu

SEQ ID NO: 1229228 - RNA, 23 nt, Human
ccagcuagucuauccuucagcca

SEQ ID NO: 1229229 - RNA, 18 nt, Human
ccaugaauuuauccaucu

SEQ ID NO: 1229230 - RNA, 22 nt, Human
cccaacuucaaaccauacuaca

SEQ ID NO: 1229231 - RNA, 19 nt, Human
ccccaaagaggcccgcuuu

SEQ ID NO: 1229232 - RNA, 24 nt, Human
ccccacacagccagcaugugucca

SEQ ID NO: 1229233 - RNA, 19 nt, Human
ccccuuuuuccuucaugag

SEQ ID NO: 1229234 - RNA, 22 nt, Human
cccuggauccccuuuuuccuuc

SEQ ID NO: 1229235 - RNA, 23 nt, Human
cccuuuuuccuucaugagugccc

SEQ ID NO: 1229236 - RNA, 21 nt, Human
ccuauguguuaccacacacgc

SEQ ID NO: 1229237 - RNA, 18 nt, Human
ccuccaucauuccucccu

SEQ ID NO: 1229238 - RNA, 24 nt, Human
ccucccucuaccccacacagccag

SEQ ID NO: 1229239 - RNA, 24 nt, Human
ccucugcaguucacucugcugcuu

SEQ ID NO: 1229240 - RNA, 24 nt, Human
ccuggucaacauagugagauucua

SEQ ID NO: 1229241 - RNA, 19 nt, Human
ccuguugugacuuccuaug

SEQ ID NO: 1229242 - RNA, 20 nt, Human
ccuugcauccuggggaugaa

SEQ ID NO: 1229243 - RNA, 24 nt, Human
cuacucucugacucacuucuuaac

SEQ ID NO: 1229244 - RNA, 23 nt, Human
cucuuccacaacuuuaacuucag

SEQ ID NO: 1229245 - RNA, 23 nt, Human
cugaaaucagacaaugauuagaa

SEQ ID NO: 1229246 - RNA, 24 nt, Human
cugcuaaauauaucucaauuguau

SEQ ID NO: 1229247 - RNA, 20 nt, Human
cugcucaaagaaaucagaga

SEQ ID NO: 1229248 - RNA, 19 nt, Human
cuggguucugguuucuuuc

SEQ ID NO: 1229249 - RNA, 21 nt, Human
cuguuucuauuucuguggggu

SEQ ID NO: 1229250 - RNA, 21 nt, Human
cuucaugagugcccgguugcc

SEQ ID NO: 1229251 - RNA, 18 nt, Human
cuucucuauucuaagaga

SEQ ID NO: 1229252 - RNA, 29 nt, Human
cuuggcuucucccucuaguuguuccuucu

SEQ ID NO: 1229253 - RNA, 21 nt, Human
cuuuuagccuccacacugguu

SEQ ID NO: 1229254 - RNA, 21 nt, Human
gaagacacaaacaaauggaaa

SEQ ID NO: 1229255 - RNA, 19 nt, Human
gaaucacaguuacucagca

SEQ ID NO: 1229256 - RNA, 24 nt, Human
gaaugaguuggggaggaguuccuc

SEQ ID NO: 1229257 - RNA, 18 nt, Human
gacuuccuauggacacag

SEQ ID NO: 1229258 - RNA, 20 nt, Human
gcaauccucagcaaaaagaa

SEQ ID NO: 1229259 - RNA, 19 nt, Human
gcauagaaguguuugcagu

SEQ ID NO: 1229260 - RNA, 18 nt, Human
gcccacccuccaccagcc

SEQ ID NO: 1229261 - RNA, 22 nt, Human
gcccuaauagccaagcaauccu

SEQ ID NO: 1229262 - RNA, 22 nt, Human
ggggaaucacaguuacucagca

SEQ ID NO: 1229263 - RNA, 21 nt, Human
ggucaugccuaugugugagcu

SEQ ID NO: 1229264 - RNA, 18 nt, Human
guauuuaaaacagagcuc

SEQ ID NO: 1229265 - RNA, 24 nt, Human
guccaacacuuccaccuggaaucc

SEQ ID NO: 1229266 - RNA, 21 nt, Human
gugugugugugugugugugug

SEQ ID NO: 1229267 - RNA, 21 nt, Human
gugugugugugugugugugug

SEQ ID NO: 1229268 - RNA, 21 nt, Human
gugugugugugugugugugug

SEQ ID NO: 1229269 - RNA, 21 nt, Human
gugugugugugugugugugug

SEQ ID NO: 1229270 - RNA, 21 nt, Human
gugugugugugugugugugug

SEQ ID NO: 1229271 - RNA, 23 nt, Human
guuccuguaaaaaugguaccagc

SEQ ID NO: 1229272 - RNA, 24 nt, Human
guuccuguaaaaaugguaccagcu

SEQ ID NO: 1229273 - RNA, 19 nt, Human
uaaccaaaacagcaugaua

SEQ ID NO: 1229274 - RNA, 25 nt, Human
uaauuuacagaugcaaguuaucccu

SEQ ID NO: 1229275 - RNA, 21 nt, Human
uacaaaaacaaccaccaacaa

SEQ ID NO: 1229276 - RNA, 18 nt, Human
uacaucuucuucuucacu

SEQ ID NO: 1229277 - RNA, 23 nt, Human
uacaucuucuucuucacugcauu

SEQ ID NO: 1229278 - RNA, 21 nt, Human
uacccaucuacucucugacuc

SEQ ID NO: 1229279 - RNA, 21 nt, Human
uaccucacugucccuacccau

SEQ ID NO: 1229280 - RNA, 21 nt, Human
uagaaagaggccuuaccucac

SEQ ID NO: 1229281 - RNA, 26 nt, Human
uagaaguguuugcaguaguuucugau

SEQ ID NO: 1229282 - RNA, 23 nt, Human
uagaauaugacugggaauccauc

SEQ ID NO: 1229283 - RNA, 22 nt, Human
uagugucuguggagaaacuuuu

SEQ ID NO: 1229284 - RNA, 23 nt, Human
uagugucuguggagaaacuuuuu

SEQ ID NO: 1229285 - RNA, 18 nt, Human
uauacugcccaaaguaau

SEQ ID NO: 1229286 - RNA, 18 nt, Human
ucaauuucuuccuggcuc

SEQ ID NO: 1229287 - RNA, 18 nt, Human
ucacucugcugcuucaga

SEQ ID NO: 1229288 - RNA, 19 nt, Human
ucacugcauuuuugugggc

SEQ ID NO: 1229289 - RNA, 20 nt, Human
ucacugucccuacccaucua

SEQ ID NO: 1229290 - RNA, 20 nt, Human
ucagcccacucaaaauacag

SEQ ID NO: 1229291 - RNA, 24 nt, Human
ucaguguccucucaugggcuuccu

SEQ ID NO: 1229292 - RNA, 19 nt, Human
uccaacacuuccaccugga

SEQ ID NO: 1229293 - RNA, 22 nt, Human
ucccaugcccagcccacccucc

SEQ ID NO: 1229294 - RNA, 18 nt, Human
uccccaaagaggcccgcu

SEQ ID NO: 1229295 - RNA, 23 nt, Human
ucccucaguuccuauguguuacc

SEQ ID NO: 1229296 - RNA, 20 nt, Human
ucccuggauccccuuuuucc

SEQ ID NO: 1229297 - RNA, 20 nt, Human
uccuucaugagugcccgguu

SEQ ID NO: 1229298 - RNA, 20 nt, Human
ucgcuugggugccaagaguu

SEQ ID NO: 1229299 - RNA, 24 nt, Human
ucgcuugggugccaagaguucaag

SEQ ID NO: 1229300 - RNA, 24 nt, Human
ucugugaccgugaaagaccggggc

SEQ ID NO: 1229301 - RNA, 18 nt, Human
ugaaaauuuucaggucug

SEQ ID NO: 1229302 - RNA, 18 nt, Human
ugaaauguccucucccuc

SEQ ID NO: 1229303 - RNA, 27 nt, Human
ugaagagugugugugugugugugugug

SEQ ID NO: 1229304 - RNA, 18 nt, Human
ugagauaaccacaugguu

SEQ ID NO: 1229305 - RNA, 21 nt, Human
ugaugccaucaccuggggaau

SEQ ID NO: 1229306 - RNA, 21 nt, Human
ugcccagcccacccuccacca

SEQ ID NO: 1229307 - RNA, 23 nt, Human
ugcccagcccacccuccaccagc

SEQ ID NO: 1229308 - RNA, 22 nt, Human
ugccuuggcuucucccucuagu

SEQ ID NO: 1229309 - RNA, 19 nt, Human
uggacacagccaaaaacca

SEQ ID NO: 1229310 - RNA, 20 nt, Human
uggcaaaggucaucucucug

SEQ ID NO: 1229311 - RNA, 21 nt, Human
ugggaauccaucauguucugg

SEQ ID NO: 1229312 - RNA, 22 nt, Human
ugugaauaacaaaaugaagaau

SEQ ID NO: 1229313 - RNA, 21 nt, Human
ugugaccgugaaagacggcug

SEQ ID NO: 1229314 - RNA, 21 nt, Human
ugugaugaaucagauuaauug

SEQ ID NO: 1229315 - RNA, 20 nt, Human
ugugugugugugugugucug

SEQ ID NO: 1229316 - RNA, 18 nt, Human
ugugugugugugugugug

SEQ ID NO: 1229317 - RNA, 18 nt, Human
ugugugugugugugugug

SEQ ID NO: 1229318 - RNA, 18 nt, Human
ugugugugugugugugug

SEQ ID NO: 1229319 - RNA, 18 nt, Human
ugugugugugugugugug

SEQ ID NO: 1229320 - RNA, 18 nt, Human
ugugugugugugugugug

SEQ ID NO: 1229321 - RNA, 18 nt, Human
ugugugugugugugugug

SEQ ID NO: 1229322 - RNA, 18 nt, Human
ugugugugugugugugug

SEQ ID NO: 1229323 - RNA, 18 nt, Human
ugugugugugugugugug

SEQ ID NO: 1229324 - RNA, 18 nt, Human
ugugugugugugugugug

SEQ ID NO: 1229325 - RNA, 18 nt, Human
ugugugugugugugugug

SEQ ID NO: 1229326 - RNA, 18 nt, Human
ugugugugugugugugug

SEQ ID NO: 1229327 - RNA, 18 nt, Human
ugugugugugugugugug

SEQ ID NO: 1229328 - RNA, 18 nt, Human
ugugugugugugugugug

SEQ ID NO: 1229329 - RNA, 18 nt, Human
ugugugugugugugugug

SEQ ID NO: 1229330 - RNA, 18 nt, Human
ugugugugugugugugug

SEQ ID NO: 1229331 - RNA, 18 nt, Human
ugugugugugugugugug

SEQ ID NO: 1229332 - RNA, 18 nt, Human
ugugugugugugugugug

SEQ ID NO: 1229333 - RNA, 22 nt, Human
ugugugugugugugugugucug

SEQ ID NO: 1229334 - RNA, 21 nt, Human
ugugugugugugugugugugu

SEQ ID NO: 1229335 - RNA, 21 nt, Human
ugugugugugugugugugugu

SEQ ID NO: 1229336 - RNA, 21 nt, Human
ugugugugugugugugugugu

SEQ ID NO: 1229337 - RNA, 21 nt, Human
ugugugugugugugugugugu

SEQ ID NO: 1229338 - RNA, 21 nt, Human
ugugugugugugugugugugu

SEQ ID NO: 1229339 - RNA, 21 nt, Human
ugugugugugugugugugugu

SEQ ID NO: 1229340 - RNA, 21 nt, Human
ugugugugugugugugugugu

SEQ ID NO: 1229341 - RNA, 21 nt, Human
ugugugugugugugugugugu

SEQ ID NO: 1229342 - RNA, 21 nt, Human
ugugugugugugugugugugu

SEQ ID NO: 1229343 - RNA, 21 nt, Human
ugugugugugugugugugugu

SEQ ID NO: 1229344 - RNA, 21 nt, Human
ugugugugugugugugugugu

SEQ ID NO: 1229345 - RNA, 21 nt, Human
ugugugugugugugugugugu

SEQ ID NO: 1229346 - RNA, 21 nt, Human
ugugugugugugugugugugu

SEQ ID NO: 1229347 - RNA, 21 nt, Human
ugugugugugugugugugugu

SEQ ID NO: 1229348 - RNA, 21 nt, Human
ugugugugugugugugugugu

SEQ ID NO: 1229349 - RNA, 21 nt, Human
ugugugugugugugugugugu

SEQ ID NO: 1229350 - RNA, 21 nt, Human
ugugugugugugugugugugu

SEQ ID NO: 1229351 - RNA, 21 nt, Human
ugugugugugugugugugugu

SEQ ID NO: 1229352 - RNA, 21 nt, Human
ugugugugugugugugugugu

SEQ ID NO: 1229353 - RNA, 21 nt, Human
ugugugugugugugugugugu

SEQ ID NO: 1229354 - RNA, 21 nt, Human
ugugugugugugugugugugu

SEQ ID NO: 1229355 - RNA, 21 nt, Human
ugugugugugugugugugugu

SEQ ID NO: 1229356 - RNA, 21 nt, Human
ugugugugugugugugugugu

SEQ ID NO: 1229357 - RNA, 21 nt, Human
ugugugugugugugugugugu

SEQ ID NO: 1229358 - RNA, 21 nt, Human
ugugugugugugugugugugu

SEQ ID NO: 1229359 - RNA, 21 nt, Human
ugugugugugugugugugugu

SEQ ID NO: 1229360 - RNA, 21 nt, Human
ugugugugugugugugugugu

SEQ ID NO: 1229361 - RNA, 21 nt, Human
ugugugugugugugugugugu

SEQ ID NO: 1229362 - RNA, 21 nt, Human
ugugugugugugugugugugu

SEQ ID NO: 1229363 - RNA, 21 nt, Human
ugugugugugugugugugugu

SEQ ID NO: 1229364 - RNA, 21 nt, Human
ugugugugugugugugugugu

SEQ ID NO: 1229365 - RNA, 21 nt, Human
ugugugugugugugugugugu

SEQ ID NO: 1229366 - RNA, 22 nt, Human
ugugugugugugugugugugug

SEQ ID NO: 1229367 - RNA, 22 nt, Human
ugugugugugugugugugugug

SEQ ID NO: 1229368 - RNA, 22 nt, Human
ugugugugugugugugugugug

SEQ ID NO: 1229369 - RNA, 22 nt, Human
ugugugugugugugugugugug

SEQ ID NO: 1229370 - RNA, 22 nt, Human
ugugugugugugugugugugug

SEQ ID NO: 1229371 - RNA, 22 nt, Human
ugugugugugugugugugugug

SEQ ID NO: 1229372 - RNA, 22 nt, Human
ugugugugugugugugugugug

SEQ ID NO: 1229373 - RNA, 22 nt, Human
ugugugugugugugugugugug

SEQ ID NO: 1229374 - RNA, 22 nt, Human
ugugugugugugugugugugug

SEQ ID NO: 1229375 - RNA, 22 nt, Human
ugugugugugugugugugugug

SEQ ID NO: 1229376 - RNA, 18 nt, Human
uguuccuucucugucuuc

SEQ ID NO: 1229377 - RNA, 19 nt, Human
uguuucuauuucugugggg

SEQ ID NO: 1229378 - RNA, 18 nt, Human
uuaaaacagagcucuuga

SEQ ID NO: 1229379 - RNA, 23 nt, Human
uuacagcaaaucaauuucuuccc

SEQ ID NO: 1229380 - RNA, 19 nt, Human
uucaagaaaccuacccgga

SEQ ID NO: 1229381 - RNA, 28 nt, Human
uucaagaaaccuacccggaauucauaga

SEQ ID NO: 1229382 - RNA, 19 nt, Human
uucacucugcugcuucaga

SEQ ID NO: 1229383 - RNA, 23 nt, Human
uuccauuugugcaucccaugccc

SEQ ID NO: 1229384 - RNA, 24 nt, Human
uuccucccucuaccccacacagcc

SEQ ID NO: 1229385 - RNA, 23 nt, Human
uucuguggggucagugguaacau

SEQ ID NO: 1229386 - RNA, 18 nt, Human
uugucauuucuaauugug

SEQ ID NO: 1229387 - RNA, 23 nt, Human
uugugcaucccaugcccagccca

SEQ ID NO: 1229388 - RNA, 18 nt, Human
uugugggcugcacuuacc

SEQ ID NO: 1229389 - RNA, 24 nt, Human
uuuccauuugugcaucccaugccc

SEQ ID NO: 1229390 - RNA, 20 nt, Human
aacauggcaaaacccugucu

SEQ ID NO: 1229391 - RNA, 21 nt, Human
aacauggcaaaacccugucuc

SEQ ID NO: 1229392 - RNA, 24 nt, Human
acccugucucuacuaaaaauacaa

SEQ ID NO: 1229393 - RNA, 18 nt, Human
agccacaugcuccagcac

SEQ ID NO: 1229394 - RNA, 18 nt, Human
agccuggucaacauggca

SEQ ID NO: 1229395 - RNA, 20 nt, Human
aggaguuugagaccagccug

SEQ ID NO: 1229396 - RNA, 18 nt, Human
aggcagguggaucaccug

SEQ ID NO: 1229397 - RNA, 22 nt, Human
aggcagguggaucaccugaggu

SEQ ID NO: 1229398 - RNA, 26 nt, Human
aggcagguggaucaccugaggucagg

SEQ ID NO: 1229399 - RNA, 24 nt, Human
aggcaguucccaaauggcaguccu

SEQ ID NO: 1229400 - RNA, 21 nt, Human
aggccgaggcagguggaucac

SEQ ID NO: 1229401 - RNA, 24 nt, Human
aggcguggugguggacaccuguaa

SEQ ID NO: 1229402 - RNA, 19 nt, Human
aggucaggaguuugagacc

SEQ ID NO: 1229403 - RNA, 18 nt, Human
aguucccaaauggcaguc

SEQ ID NO: 1229404 - RNA, 20 nt, Human
caacauggcaaaacccuguc

SEQ ID NO: 1229405 - RNA, 22 nt, Human
caacauggcaaaacccugucuc

SEQ ID NO: 1229406 - RNA, 24 nt, Human
caacauggcaaaacccugucucua

SEQ ID NO: 1229407 - RNA, 23 nt, Human
caccugaggucaggaguuugaga

SEQ ID NO: 1229408 - RNA, 18 nt, Human
cagccaccacgggguccu

SEQ ID NO: 1229409 - RNA, 18 nt, Human
caucacugacgggcaggc

SEQ ID NO: 1229410 - RNA, 20 nt, Human
cauguagaagaaaggaaucu

SEQ ID NO: 1229411 - RNA, 22 nt, Human
ccaccacgggguccuuggcugu

SEQ ID NO: 1229412 - RNA, 22 nt, Human
ccugaggucaggaguuugagac

SEQ ID NO: 1229413 - RNA, 21 nt, Human
ccuggauuggaaggccgaggc

SEQ ID NO: 1229414 - RNA, 22 nt, Human
ccuggucaacauggcaaaaccc

SEQ ID NO: 1229415 - RNA, 24 nt, Human
ccuggucaacauggcaaaacccug

SEQ ID NO: 1229416 - RNA, 20 nt, Human
cgaggcagguggaucaccug

SEQ ID NO: 1229417 - RNA, 24 nt, Human
cgaggcagguggaucaccugaggu

SEQ ID NO: 1229418 - RNA, 26 nt, Human
cgaggcagguggaucaccugagguca

SEQ ID NO: 1229419 - RNA, 21 nt, Human
cuggcagcaucagcgaggccu

SEQ ID NO: 1229420 - RNA, 20 nt, Human
cuucugauucuggcagcauc

SEQ ID NO: 1229421 - RNA, 24 nt, Human
gaucaccugaggucaggaguuuga

SEQ ID NO: 1229422 - RNA, 21 nt, Human
ggaaagccugggaagcuuaga

SEQ ID NO: 1229423 - RNA, 22 nt, Human
ggaucaccugaggucaggaguu

SEQ ID NO: 1229424 - RNA, 18 nt, Human
ggauuggaaggccgaggc

SEQ ID NO: 1229425 - RNA, 22 nt, Human
ggcaggcaguucccaaauggca

SEQ ID NO: 1229426 - RNA, 19 nt, Human
ggucaggaguuugagacca

SEQ ID NO: 1229427 - RNA, 21 nt, Human
gguggacaccuguaaucccag

SEQ ID NO: 1229428 - RNA, 24 nt, Human
ggugguggacaccuguaaucccag

SEQ ID NO: 1229429 - RNA, 21 nt, Human
guggaucaccugaggucagga

SEQ ID NO: 1229430 - RNA, 21 nt, Human
uaaaaauacaaaaauuagcca

SEQ ID NO: 1229431 - RNA, 19 nt, Human
ucaccugaggucaggaguu

SEQ ID NO: 1229432 - RNA, 21 nt, Human
ucucuacuaaaaauacaaaaa

SEQ ID NO: 1229433 - RNA, 23 nt, Human
ugagaccagccuggucaacaugg

SEQ ID NO: 1229434 - RNA, 21 nt, Human
ugaggaaagccugggaagcuu

SEQ ID NO: 1229435 - RNA, 18 nt, Human
ugaggucaggaguuugag

SEQ ID NO: 1229436 - RNA, 21 nt, Human
ugcagaacuccccuucugauu

SEQ ID NO: 1229437 - RNA, 24 nt, Human
uggaaggccgaggcagguggauca

SEQ ID NO: 1229438 - RNA, 23 nt, Human
uggaucaccugaggucaggaguu

SEQ ID NO: 1229439 - RNA, 24 nt, Human
uggaucaccugaggucaggaguuu

SEQ ID NO: 1229440 - RNA, 27 nt, Human
uggaucaccugaggucaggaguuugag

SEQ ID NO: 1229441 - RNA, 21 nt, Human
uggauuggaaggccgaggcag

SEQ ID NO: 1229442 - RNA, 18 nt, Human
uggcagcaucagcgaggc

SEQ ID NO: 1229443 - RNA, 19 nt, Human
ugggaagcuuagaaaggua

SEQ ID NO: 1229444 - RNA, 23 nt, Human
uggguucugggagccacaugcuc

SEQ ID NO: 1229445 - RNA, 24 nt, Human
uggugguggacaccuguaauccca

SEQ ID NO: 1229446 - RNA, 18 nt, Human
uucaucagaucagccacc

SEQ ID NO: 1229447 - RNA, 25 nt, Human
uuggaaggccgaggcagguggauca

SEQ ID NO: 1229448 - RNA, 19 nt, Human
aaaauccccccacccgacu

SEQ ID NO: 1229449 - RNA, 23 nt, Human
agaaaauccccccacccgacuca

SEQ ID NO: 1229450 - RNA, 23 nt, Human
agcacauaacaagccuucggcca

SEQ ID NO: 1229451 - RNA, 21 nt, Human
caaaauacauaaaacauacaa

SEQ ID NO: 1229452 - RNA, 23 nt, Human
cacuguccucuuccaauuuagcc

SEQ ID NO: 1229453 - RNA, 21 nt, Human
cagcccccggaaagcccuguu

SEQ ID NO: 1229454 - RNA, 20 nt, Human
caggcacagcacauaacaaa

SEQ ID NO: 1229455 - RNA, 22 nt, Human
caucauuucaaacagaaacucu

SEQ ID NO: 1229456 - RNA, 20 nt, Human
cauuuucucuucauguuuuu

SEQ ID NO: 1229457 - RNA, 21 nt, Human
ccacccgacucaaggcacaga

SEQ ID NO: 1229458 - RNA, 24 nt, Human
ccagaaguuuuucaucauuucaag

SEQ ID NO: 1229459 - RNA, 22 nt, Human
ccaucagguguguccuccuggg

SEQ ID NO: 1229460 - RNA, 18 nt, Human
cccagaaaauccccccac

SEQ ID NO: 1229461 - RNA, 21 nt, Human
ccccaucagguguguccuccu

SEQ ID NO: 1229462 - RNA, 21 nt, Human
ccugagacaaucuccccuucc

SEQ ID NO: 1229463 - RNA, 21 nt, Human
ccuguucuacauucugucucu

SEQ ID NO: 1229464 - RNA, 21 nt, Human
ccuuccuuuuuuucccccuag

SEQ ID NO: 1229465 - RNA, 19 nt, Human
cucaaggcacagauuagaa

SEQ ID NO: 1229466 - RNA, 20 nt, Human
cuccagcccccggaaagccc

SEQ ID NO: 1229467 - RNA, 19 nt, Human
cuccuugucuucuccucca

SEQ ID NO: 1229468 - RNA, 22 nt, Human
cuuccuaacaaaguuauuccgg

SEQ ID NO: 1229469 - RNA, 23 nt, Human
gaaaauccccccacccgacucaa

SEQ ID NO: 1229470 - RNA, 20 nt, Human
gcacagauuagaaaaccuuc

SEQ ID NO: 1229471 - RNA, 19 nt, Human
uaacauguguacauucugc

SEQ ID NO: 1229472 - RNA, 21 nt, Human
uaacauguguacauucugcuu

SEQ ID NO: 1229473 - RNA, 24 nt, Human
uaacugucaaguucaccuuccuaa

SEQ ID NO: 1229474 - RNA, 23 nt, Human
uaacuuucuguccucaggauaac

SEQ ID NO: 1229475 - RNA, 19 nt, Human
uagaaaaccuucccaggcc

SEQ ID NO: 1229476 - RNA, 19 nt, Human
uauuuguccuacugugucu

SEQ ID NO: 1229477 - RNA, 19 nt, Human
ucaccacaaucuauuucca

SEQ ID NO: 1229478 - RNA, 22 nt, Human
uccaggcacagcacauaacaag

SEQ ID NO: 1229479 - RNA, 19 nt, Human
ucccagaaaauccccccac

SEQ ID NO: 1229480 - RNA, 18 nt, Human
ucccagagccccaucagg

SEQ ID NO: 1229481 - RNA, 20 nt, Human
uccuccugggcagcagccuc

SEQ ID NO: 1229482 - RNA, 22 nt, Human
uccuugucuucuccuccagccc

SEQ ID NO: 1229483 - RNA, 24 nt, Human
ucuauuuccagaaguuuuucauca

SEQ ID NO: 1229484 - RNA, 18 nt, Human
ucugaccaagaagucaca

SEQ ID NO: 1229485 - RNA, 24 nt, Human
uggcaaaauacauaaaacauacaa

SEQ ID NO: 1229486 - RNA, 28 nt, Human
uggcaaaauacauaaaacauacaacuaa

SEQ ID NO: 1229487 - RNA, 18 nt, Human
uguccuacugugucuggu

SEQ ID NO: 1229488 - RNA, 24 nt, Human
ugugcacaugugaagaugugcgua

SEQ ID NO: 1229489 - RNA, 18 nt, Human
uuaacauguguacauucu

SEQ ID NO: 1229490 - RNA, 20 nt, Human
uuagaaaaccuucccaggcc

SEQ ID NO: 1229491 - RNA, 22 nt, Human
uucauuuuuguuuuacaugugu

SEQ ID NO: 1229492 - RNA, 18 nt, Human
uuuaacguguacaguuca

SEQ ID NO: 1229493 - RNA, 18 nt, Human
uuucccagaaaauccccc

SEQ ID NO: 1229494 - RNA, 20 nt, Human
uuucccagaaaaucccccca

SEQ ID NO: 1229495 - RNA, 22 nt, Human
uuuuuuuuuuuuuuugcuucau

SEQ ID NO: 1229496 - RNA, 19 nt, Human
uuuuuuuuuuuuuuuugcu

SEQ ID NO: 1229497 - RNA, 21 nt, Human
uuuuuuuuuuuuuuuuugcuu

SEQ ID NO: 1229498 - RNA, 20 nt, Human
uuuuuuuuuuuuuuuuuugg

SEQ ID NO: 1229499 - RNA, 23 nt, Human
aaauaucuucuugacaggcuccc

SEQ ID NO: 1229500 - RNA, 22 nt, Human
aagauuuuaagguuaagugauc

SEQ ID NO: 1229501 - RNA, 23 nt, Human
aagucuggagacuagggucagcu

SEQ ID NO: 1229502 - RNA, 21 nt, Human
acagcagaagaccugguugag

SEQ ID NO: 1229503 - RNA, 21 nt, Human
accuucucuagucuugagacc

SEQ ID NO: 1229504 - RNA, 24 nt, Human
auuacuauuaaguuauucauagcu

SEQ ID NO: 1229505 - RNA, 27 nt, Human
cacaggauuugacagcagaggacauac

SEQ ID NO: 1229506 - RNA, 19 nt, Human
cagaagaccugguugaguc

SEQ ID NO: 1229507 - RNA, 19 nt, Human
cugaaagguuucugaucca

SEQ ID NO: 1229508 - RNA, 19 nt, Human
gacccuggcaacuugguga

SEQ ID NO: 1229509 - RNA, 21 nt, Human
gcuccgauucugaagcugaag

SEQ ID NO: 1229510 - RNA, 20 nt, Human
ggaggcucugcuggccaugg

SEQ ID NO: 1229511 - RNA, 18 nt, Human
gggaauugggcgacugga

SEQ ID NO: 1229512 - RNA, 21 nt, Human
gggaggcucugcuggccaugg

SEQ ID NO: 1229513 - RNA, 19 nt, Human
gggcacaggauuugacagc

SEQ ID NO: 1229514 - RNA, 20 nt, Human
guugagucuugcuucugcag

SEQ ID NO: 1229515 - RNA, 21 nt, Human
guugaucugcacgacccuggc

SEQ ID NO: 1229516 - RNA, 20 nt, Human
uaauuacuaugacuuucauu

SEQ ID NO: 1229517 - RNA, 20 nt, Human
uagaauguuuucuggauauu

SEQ ID NO: 1229518 - RNA, 19 nt, Human
ucgcucaaggucacaacag

SEQ ID NO: 1229519 - RNA, 25 nt, Human
ucucuagucuugagaccaaaggaau

SEQ ID NO: 1229520 - RNA, 23 nt, Human
ugaaagucuggagacuaggguca

SEQ ID NO: 1229521 - RNA, 22 nt, Human
ugcacgacccuggcaaccggcg

SEQ ID NO: 1229522 - RNA, 23 nt, Human
ugccagugacaagcugugugacc

SEQ ID NO: 1229523 - RNA, 20 nt, Human
uugaugauuaugguuauuuc

SEQ ID NO: 1229524 - RNA, 19 nt, Human
uuucagggccuugguuuca

SEQ ID NO: 1229525 - RNA, 23 nt, Human
uuucuggauauuggcaauuaugu

SEQ ID NO: 1229526 - RNA, 23 nt, Human
cacacgaggaugaugacaaacag

SEQ ID NO: 1229527 - RNA, 24 nt, Human
aaaguguugggauuacaggcguga

SEQ ID NO: 1229528 - RNA, 25 nt, Human
aagugauccucccgccucagccucc

SEQ ID NO: 1229529 - RNA, 21 nt, Human
aaguguugggauuacaggcgu

SEQ ID NO: 1229530 - RNA, 26 nt, Human
aaguguugggauuacaggcgugagcc

SEQ ID NO: 1229531 - RNA, 19 nt, Human
aaugacaagccacuucuca

SEQ ID NO: 1229532 - RNA, 22 nt, Human
acacagccaugggggugacuuc

SEQ ID NO: 1229533 - RNA, 22 nt, Human
acucagaaccgacaaaaacucc

SEQ ID NO: 1229534 - RNA, 19 nt, Human
acugcagccccaauuuccu

SEQ ID NO: 1229535 - RNA, 25 nt, Human
agaaacccaggcacguguacagcca

SEQ ID NO: 1229536 - RNA, 18 nt, Human
agccccugguggucccag

SEQ ID NO: 1229537 - RNA, 28 nt, Human
agcucggccaacccgccaccauccgcaa

SEQ ID NO: 1229538 - RNA, 19 nt, Human
agcuggaccugcaguccaa

SEQ ID NO: 1229539 - RNA, 19 nt, Human
aggaaacaaaaucaaacac

SEQ ID NO: 1229540 - RNA, 19 nt, Human
aggcguugagcaggccgcu

SEQ ID NO: 1229541 - RNA, 23 nt, Human
aggcugggaggauccugggggcu

SEQ ID NO: 1229542 - RNA, 20 nt, Human
aguccaagacuccuugggga

SEQ ID NO: 1229543 - RNA, 19 nt, Human
agugcaguggcgcaaucag

SEQ ID NO: 1229544 - RNA, 24 nt, Human
auccgcaauagaaggcaaaggcug

SEQ ID NO: 1229545 - RNA, 18 nt, Human
augacaagccacuucuca

SEQ ID NO: 1229546 - RNA, 18 nt, Human
auuccgcuuaauccugcu

SEQ ID NO: 1229547 - RNA, 22 nt, Human
caaaaacuccaggucuuccaag

SEQ ID NO: 1229548 - RNA, 22 nt, Human
caaagcucggccaacccgccac

SEQ ID NO: 1229549 - RNA, 24 nt, Human
caaaguguugggauuacaggcgug

SEQ ID NO: 1229550 - RNA, 20 nt, Human
caagcuccucaccucugagc

SEQ ID NO: 1229551 - RNA, 27 nt, Human
caagugauccucccgccucagccuccc

SEQ ID NO: 1229552 - RNA, 27 nt, Human
caagugauccucccgccucagccuccc

SEQ ID NO: 1229553 - RNA, 19 nt, Human
cacagcacuggcauccccu

SEQ ID NO: 1229554 - RNA, 25 nt, Human
cacagccaugggggugacuucccag

SEQ ID NO: 1229555 - RNA, 21 nt, Human
caccccucccgcaggagggcc

SEQ ID NO: 1229556 - RNA, 22 nt, Human
caccuccccucacagugcuguc

SEQ ID NO: 1229557 - RNA, 22 nt, Human
caccugccccuguccccagagc

SEQ ID NO: 1229558 - RNA, 20 nt, Human
cacuacaccuggucuuuggc

SEQ ID NO: 1229559 - RNA, 22 nt, Human
cacuggcccucccaggcugcac

SEQ ID NO: 1229560 - RNA, 20 nt, Human
cagaaccgacaaaaacucca

SEQ ID NO: 1229561 - RNA, 19 nt, Human
cagagccccggcaccccuc

SEQ ID NO: 1229562 - RNA, 20 nt, Human
cagccccaauuuccugggcu

SEQ ID NO: 1229563 - RNA, 23 nt, Human
cagccccaauuuccugggcucaa

SEQ ID NO: 1229564 - RNA, 24 nt, Human
cagccccaauuuccugggcucaag

SEQ ID NO: 1229565 - RNA, 20 nt, Human
cagccuagaccuuuccauca

SEQ ID NO: 1229566 - RNA, 24 nt, Human
cagcgccgcaggcugagaucccaa

SEQ ID NO: 1229567 - RNA, 22 nt, Human
caggcaagccucccugccucuc

SEQ ID NO: 1229568 - RNA, 18 nt, Human
caggcugcaccccgcgcc

SEQ ID NO: 1229569 - RNA, 19 nt, Human
cagggaggacuuggccaca

SEQ ID NO: 1229570 - RNA, 20 nt, Human
caguggcgcaaucagagcuc

SEQ ID NO: 1229571 - RNA, 22 nt, Human
ccaaaguguugggauuacaggc

SEQ ID NO: 1229572 - RNA, 22 nt, Human
ccaaaguguugggauuacaggc

SEQ ID NO: 1229573 - RNA, 24 nt, Human
ccaaaguguugggauuacaggcgu

SEQ ID NO: 1229574 - RNA, 23 nt, Human
ccacgcccagagccaccugcccc

SEQ ID NO: 1229575 - RNA, 20 nt, Human
cccaaagucacgcugcugcu

SEQ ID NO: 1229576 - RNA, 22 nt, Human
ccccaccgagccggucagggcu

SEQ ID NO: 1229577 - RNA, 21 nt, Human
ccccaugcugaguguggcccc

SEQ ID NO: 1229578 - RNA, 21 nt, Human
ccccgcgcccagagcucaucu

SEQ ID NO: 1229579 - RNA, 24 nt, Human
ccccguauggccaggcugggagga

SEQ ID NO: 1229580 - RNA, 26 nt, Human
ccccucgggggaagagcggacacccc

SEQ ID NO: 1229581 - RNA, 18 nt, Human
cccggcaccccucccgca

SEQ ID NO: 1229582 - RNA, 24 nt, Human
cccucugcagagcuggaccugcag

SEQ ID NO: 1229583 - RNA, 24 nt, Human
ccgccucagccucccaaaguguug

SEQ ID NO: 1229584 - RNA, 26 nt, Human
ccgcgcccagagcucaucuccagaca

SEQ ID NO: 1229585 - RNA, 21 nt, Human
ccucccgcaggagggccugac

SEQ ID NO: 1229586 - RNA, 23 nt, Human
ccucccgccucagccucccaaag

SEQ ID NO: 1229587 - RNA, 22 nt, Human
ccuccugcuuugcagccaggaa

SEQ ID NO: 1229588 - RNA, 18 nt, Human
ccucuccucucucuaucc

SEQ ID NO: 1229589 - RNA, 22 nt, Human
ccucugagcgucgcuccagcuc

SEQ ID NO: 1229590 - RNA, 19 nt, Human
ccuggcacagcacuggcau

SEQ ID NO: 1229591 - RNA, 18 nt, Human
ccuggcuggccaccuccc

SEQ ID NO: 1229592 - RNA, 22 nt, Human
ccugggcucaagugauccuccc

SEQ ID NO: 1229593 - RNA, 21 nt, Human
ccuggggccagccuagaccuu

SEQ ID NO: 1229594 - RNA, 22 nt, Human
ccugggggcugaggcucccucc

SEQ ID NO: 1229595 - RNA, 18 nt, Human
cgacaaaaacuccagguc

SEQ ID NO: 1229596 - RNA, 19 nt, Human
cgaccgccccuccuggcac

SEQ ID NO: 1229597 - RNA, 23 nt, Human
cgcaaucagagcucacugcagcc

SEQ ID NO: 1229598 - RNA, 25 nt, Human
cgcccagagccaccugccccugucc

SEQ ID NO: 1229599 - RNA, 23 nt, Human
cggcaggcguugagcaggccgcu

SEQ ID NO: 1229600 - RNA, 22 nt, Human
cggccaacccgccaccauccgc

SEQ ID NO: 1229601 - RNA, 24 nt, Human
cggcuguuugggucuggcgucugc

SEQ ID NO: 1229602 - RNA, 24 nt, Human
cucaagugauccucccgccucagc

SEQ ID NO: 1229603 - RNA, 24 nt, Human
cucacugcagccccaauuuccugg

SEQ ID NO: 1229604 - RNA, 20 nt, Human
cucagcaccgaccgccccuc

SEQ ID NO: 1229605 - RNA, 19 nt, Human
cucaggcugggugccuggc

SEQ ID NO: 1229606 - RNA, 19 nt, Human
cucccaggcugcaccccgc

SEQ ID NO: 1229607 - RNA, 23 nt, Human
cucccugcagccccucugcagag

SEQ ID NO: 1229608 - RNA, 18 nt, Human
cugcaccccgcgcccaga

SEQ ID NO: 1229609 - RNA, 23 nt, Human
cugcagccccaauuuccugggcu

SEQ ID NO: 1229610 - RNA, 23 nt, Human
cuggacaagugaggaggugcacu

SEQ ID NO: 1229611 - RNA, 20 nt, Human
cuggauggagugcaguggcg

SEQ ID NO: 1229612 - RNA, 23 nt, Human
gaaaucagagccuccuugcuacc

SEQ ID NO: 1229613 - RNA, 21 nt, Human
gacuccuuggggaugaggggu

SEQ ID NO: 1229614 - RNA, 19 nt, Human
gacuggggaggaaaugaca

SEQ ID NO: 1229615 - RNA, 21 nt, Human
gacuucccagggggccugugg

SEQ ID NO: 1229616 - RNA, 19 nt, Human
gagccuccuugcuacccag

SEQ ID NO: 1229617 - RNA, 21 nt, Human
gagcucacagaucagcaauuu

SEQ ID NO: 1229618 - RNA, 22 nt, Human
gaggggucuaggguuuaguccc

SEQ ID NO: 1229619 - RNA, 18 nt, Human
gauuacaggcgugagcca

SEQ ID NO: 1229620 - RNA, 21 nt, Human
gauuacaggcgugagccacua

SEQ ID NO: 1229621 - RNA, 22 nt, Human
gauuacaggcgugagccacuac

SEQ ID NO: 1229622 - RNA, 18 nt, Human
gcacagcacuggcauccc

SEQ ID NO: 1229623 - RNA, 24 nt, Human
gcacuggcauccccugguguucca

SEQ ID NO: 1229624 - RNA, 23 nt, Human
gccagccuagaccuuuccaucau

SEQ ID NO: 1229625 - RNA, 25 nt, Human
gccaggcugggaggauccugggggc

SEQ ID NO: 1229626 - RNA, 19 nt, Human
gcccagagccaccugcccc

SEQ ID NO: 1229627 - RNA, 23 nt, Human
gccucagccucccaaaguguugg

SEQ ID NO: 1229628 - RNA, 22 nt, Human
gccugacuggggaggaaaugac

SEQ ID NO: 1229629 - RNA, 21 nt, Human
gcgucugcuccagccuggcgu

SEQ ID NO: 1229630 - RNA, 19 nt, Human
gcucaagugauccucccgc

SEQ ID NO: 1229631 - RNA, 27 nt, Human
gcuccagcuccuuucaaagacgcuggg

SEQ ID NO: 1229632 - RNA, 25 nt, Human
ggacaagugaggaggugcacuuucc

SEQ ID NO: 1229633 - RNA, 21 nt, Human
ggaccucuggucacggcucag

SEQ ID NO: 1229634 - RNA, 20 nt, Human
ggcagcgccaucauuccucc

SEQ ID NO: 1229635 - RNA, 18 nt, Human
ggcgggaaaugauuaccu

SEQ ID NO: 1229636 - RNA, 25 nt, Human
gggaagcaggccucacucagcaccc

SEQ ID NO: 1229637 - RNA, 22 nt, Human
gggccauaguaacuuuggagga

SEQ ID NO: 1229638 - RNA, 22 nt, Human
gggcucaagugauccucccgcc

SEQ ID NO: 1229639 - RNA, 19 nt, Human
ggggcugaggcucccucca

SEQ ID NO: 1229640 - RNA, 21 nt, Human
ggugccuggcuggccaccucc

SEQ ID NO: 1229641 - RNA, 24 nt, Human
gugauccucccgccucagccuccc

SEQ ID NO: 1229642 - RNA, 24 nt, Human
uaaacacagagacugagagaugag

SEQ ID NO: 1229643 - RNA, 22 nt, Human
uacaccuggucuuuggcuacaa

SEQ ID NO: 1229644 - RNA, 22 nt, Human
uacaggcgugagccacuacacc

SEQ ID NO: 1229645 - RNA, 22 nt, Human
uacaggcgugagccacuacacc

SEQ ID NO: 1229646 - RNA, 23 nt, Human
uacaggcgugagccacuacaccu

SEQ ID NO: 1229647 - RNA, 21 nt, Human
uagcagacucccaggcaagcc

SEQ ID NO: 1229648 - RNA, 24 nt, Human
ucacugcagccccaauuuccuggg

SEQ ID NO: 1229649 - RNA, 21 nt, Human
uccaaggaaacaaaaucaaac

SEQ ID NO: 1229650 - RNA, 24 nt, Human
uccaaggaaacaaaaucaaacacc

SEQ ID NO: 1229651 - RNA, 22 nt, Human
uccacgcccagagccaccugcc

SEQ ID NO: 1229652 - RNA, 24 nt, Human
ucccaaaguguugggauuacaggc

SEQ ID NO: 1229653 - RNA, 19 nt, Human
ucccaggcaagccucccug

SEQ ID NO: 1229654 - RNA, 21 nt, Human
ucccaggcugcaccccgcgcc

SEQ ID NO: 1229655 - RNA, 20 nt, Human
uccucccgccucagccuccc

SEQ ID NO: 1229656 - RNA, 21 nt, Human
uccugggcucaagugauccuc

SEQ ID NO: 1229657 - RNA, 19 nt, Human
ucucaggucaccggcaggc

SEQ ID NO: 1229658 - RNA, 23 nt, Human
ucucauaagaaugugccugauuu

SEQ ID NO: 1229659 - RNA, 22 nt, Human
ucuccucucucuauccucuaca

SEQ ID NO: 1229660 - RNA, 24 nt, Human
ucucuggcucggaccucuggucac

SEQ ID NO: 1229661 - RNA, 21 nt, Human
ucugcagacgcugggcuccuu

SEQ ID NO: 1229662 - RNA, 22 nt, Human
ucugcucgcucguuagccaggg

SEQ ID NO: 1229663 - RNA, 21 nt, Human
ucuggucacggcucaggcugg

SEQ ID NO: 1229664 - RNA, 22 nt, Human
ugacuucccagggggccugugg

SEQ ID NO: 1229665 - RNA, 18 nt, Human
ugagcaggccgcucugca

SEQ ID NO: 1229666 - RNA, 23 nt, Human
ugcaaggugccuccccgagacag

SEQ ID NO: 1229667 - RNA, 21 nt, Human
ugcaguccaagacuccuuggg

SEQ ID NO: 1229668 - RNA, 18 nt, Human
ugccaaaguccccggggg

SEQ ID NO: 1229669 - RNA, 24 nt, Human
ugccugauuugggaagcaggccuc

SEQ ID NO: 1229670 - RNA, 21 nt, Human
ugccuggcuggccaccucccc

SEQ ID NO: 1229671 - RNA, 18 nt, Human
uggagugcaguggcgcaa

SEQ ID NO: 1229672 - RNA, 19 nt, Human
uggagugcaguggcgcaau

SEQ ID NO: 1229673 - RNA, 21 nt, Human
uggagugcaguggcgcaauca

SEQ ID NO: 1229674 - RNA, 19 nt, Human
uggcauccccugguguucc

SEQ ID NO: 1229675 - RNA, 20 nt, Human
uggccuuguuuguuuucugc

SEQ ID NO: 1229676 - RNA, 24 nt, Human
uggcgcaaucagagcucacugcag

SEQ ID NO: 1229677 - RNA, 20 nt, Human
ugggaggauccugggggcug

SEQ ID NO: 1229678 - RNA, 20 nt, Human
ugggaggauccugggggcug

SEQ ID NO: 1229679 - RNA, 18 nt, Human
ugggauuacaggcgugag

SEQ ID NO: 1229680 - RNA, 19 nt, Human
ugggauuacaggcgugagc

SEQ ID NO: 1229681 - RNA, 21 nt, Human
ugggauuacaggcgugagcca

SEQ ID NO: 1229682 - RNA, 22 nt, Human
ugggauuacaggcgugagccac

SEQ ID NO: 1229683 - RNA, 22 nt, Human
ugggauuacaggcgugagccac

SEQ ID NO: 1229684 - RNA, 23 nt, Human
ugggauuacaggcgugagccacu

SEQ ID NO: 1229685 - RNA, 24 nt, Human
ugggauuacaggcgugagccacua

SEQ ID NO: 1229686 - RNA, 24 nt, Human
ugggauuacaggcgugagccacua

SEQ ID NO: 1229687 - RNA, 18 nt, Human
ugggcccuggaugcuccc

SEQ ID NO: 1229688 - RNA, 20 nt, Human
ugggcccuggaugcucccug

SEQ ID NO: 1229689 - RNA, 24 nt, Human
ugggcucaagugauccucccgccu

SEQ ID NO: 1229690 - RNA, 24 nt, Human
uggucccagggccucugcucgcuc

SEQ ID NO: 1229691 - RNA, 23 nt, Human
uuccaugguuuugguagcagacu

SEQ ID NO: 1229692 - RNA, 25 nt, Human
uuccugggcucaagugauccucccg

SEQ ID NO: 1229693 - RNA, 24 nt, Human
uuuccugggcucaagugauccucc

SEQ ID NO: 1229694 - RNA, 19 nt, Human
uuugcacaaccgcagcggc

SEQ ID NO: 1229695 - RNA, 20 nt, Human
aaaacuauacaucaauagua

SEQ ID NO: 1229696 - RNA, 19 nt, Human
aaaauccagacacaaaacc

SEQ ID NO: 1229697 - RNA, 24 nt, Human
aaacaagacaagagcuucuuccac

SEQ ID NO: 1229698 - RNA, 21 nt, Human
aaacaccagaaaaucaaacag

SEQ ID NO: 1229699 - RNA, 23 nt, Human
aacaugcaugucauugaaaacac

SEQ ID NO: 1229700 - RNA, 22 nt, Human
aaccacacagggucagacgcaa

SEQ ID NO: 1229701 - RNA, 22 nt, Human
aacuuacucacaugcuuaaaga

SEQ ID NO: 1229702 - RNA, 20 nt, Human
aagcgcagccagcgugagcc

SEQ ID NO: 1229703 - RNA, 24 nt, Human
aauuucugacagccauggcagcuu

SEQ ID NO: 1229704 - RNA, 21 nt, Human
acaccagaaaaucaaacagac

SEQ ID NO: 1229705 - RNA, 20 nt, Human
accaugccgacacggagccc

SEQ ID NO: 1229706 - RNA, 21 nt, Human
acugcucugaaauaaggaaau

SEQ ID NO: 1229707 - RNA, 25 nt, Human
agaaauucaaagccaauuauuagcc

SEQ ID NO: 1229708 - RNA, 20 nt, Human
agaacagccaauccagaaag

SEQ ID NO: 1229709 - RNA, 19 nt, Human
agacgaacgcauguacugc

SEQ ID NO: 1229710 - RNA, 23 nt, Human
agacgcaaacacaggggaugauc

SEQ ID NO: 1229711 - RNA, 23 nt, Human
agccaguggcugaugccuacaca

SEQ ID NO: 1229712 - RNA, 18 nt, Human
agcugccugguggacagc

SEQ ID NO: 1229713 - RNA, 21 nt, Human
caaaaagccccaauuucugaa

SEQ ID NO: 1229714 - RNA, 24 nt, Human
caaagcacugagaaguccaacaug

SEQ ID NO: 1229715 - RNA, 26 nt, Human
caaccaccaagguugaaggaaacagc

SEQ ID NO: 1229716 - RNA, 23 nt, Human
caagagcuucuuccacuucugcu

SEQ ID NO: 1229717 - RNA, 24 nt, Human
cacaacaccuaggcagaacaugga

SEQ ID NO: 1229718 - RNA, 20 nt, Human
cacagagaaauucaaagcca

SEQ ID NO: 1229719 - RNA, 20 nt, Human
caccagaaaaucaaacagac

SEQ ID NO: 1229720 - RNA, 24 nt, Human
caccagaaaaucaaacagacgaau

SEQ ID NO: 1229721 - RNA, 20 nt, Human
caccaugccgacacggagcc

SEQ ID NO: 1229722 - RNA, 20 nt, Human
cacugcugaggacacuaccc

SEQ ID NO: 1229723 - RNA, 18 nt, Human
cagcagccagcagccugg

SEQ ID NO: 1229724 - RNA, 19 nt, Human
cagcagccagcagccuggc

SEQ ID NO: 1229725 - RNA, 21 nt, Human
cagcagccagcagccuggcag

SEQ ID NO: 1229726 - RNA, 20 nt, Human
cagccauggcagcuuucccu

SEQ ID NO: 1229727 - RNA, 20 nt, Human
cauacugcugcaacagcaug

SEQ ID NO: 1229728 - RNA, 26 nt, Human
cauagcacuaaaaugagagcuuccca

SEQ ID NO: 1229729 - RNA, 22 nt, Human
cauguaaagccccagaucacuc

SEQ ID NO: 1229730 - RNA, 18 nt, Human
ccagaaaguagccgccug

SEQ ID NO: 1229731 - RNA, 22 nt, Human
ccaugccgacacggagcccugc

SEQ ID NO: 1229732 - RNA, 19 nt, Human
cccacuccaucaagggaau

SEQ ID NO: 1229733 - RNA, 22 nt, Human
cccagaucacucgggcaccugc

SEQ ID NO: 1229734 - RNA, 19 nt, Human
cccgugcaaccaccaaggu

SEQ ID NO: 1229735 - RNA, 21 nt, Human
cccgugcaaccaccaagguug

SEQ ID NO: 1229736 - RNA, 25 nt, Human
cccuccaccccuauuuugccaaacc

SEQ ID NO: 1229737 - RNA, 21 nt, Human
cccugcaugguuggagagcuc

SEQ ID NO: 1229738 - RNA, 21 nt, Human
ccuccuucaagcaagcgcagc

SEQ ID NO: 1229739 - RNA, 24 nt, Human
ccuguaaacacaugccuguaugaa

SEQ ID NO: 1229740 - RNA, 19 nt, Human
cgacacggagcccugcaug

SEQ ID NO: 1229741 - RNA, 18 nt, Human
cguggggcuggugagcug

SEQ ID NO: 1229742 - RNA, 19 nt, Human
cuaaagcaaagccucaggc

SEQ ID NO: 1229743 - RNA, 27 nt, Human
cuccaccccuauuuugccaaaccccca

SEQ ID NO: 1229744 - RNA, 20 nt, Human
gaaaaucaaacagacgaaug

SEQ ID NO: 1229745 - RNA, 25 nt, Human
gaacgcauguacugcucugaaauaa

SEQ ID NO: 1229746 - RNA, 21 nt, Human
gaauaaaauccagacacaaaa

SEQ ID NO: 1229747 - RNA, 19 nt, Human
gagagcucugccccucaca

SEQ ID NO: 1229748 - RNA, 18 nt, Human
gcagccagcagccuggca

SEQ ID NO: 1229749 - RNA, 20 nt, Human
gcagcuuucccuccaccccu

SEQ ID NO: 1229750 - RNA, 20 nt, Human
ggacaaaugccaaacaagac

SEQ ID NO: 1229751 - RNA, 18 nt, Human
ggacaguguuuauucauc

SEQ ID NO: 1229752 - RNA, 21 nt, Human
gggcacagagaaauucaaagc

SEQ ID NO: 1229753 - RNA, 25 nt, Human
ggucagacgcaaacacaggggauga

SEQ ID NO: 1229754 - RNA, 20 nt, Human
gguccuaaguagcugcaugu

SEQ ID NO: 1229755 - RNA, 24 nt, Human
guaaacacaugccuguaugaauaa

SEQ ID NO: 1229756 - RNA, 19 nt, Human
gucagacgcaaacacaggg

SEQ ID NO: 1229757 - RNA, 20 nt, Human
gugagcugcugcugcuaucu

SEQ ID NO: 1229758 - RNA, 21 nt, Human
uaaaauccagacacaaaacca

SEQ ID NO: 1229759 - RNA, 26 nt, Human
uaaaauccagacacaaaaccauacug

SEQ ID NO: 1229760 - RNA, 23 nt, Human
uaaacacaugccuguaugaauaa

SEQ ID NO: 1229761 - RNA, 25 nt, Human
uaagaacagccaauccagaaagcua

SEQ ID NO: 1229762 - RNA, 18 nt, Human
uacauagcacuaaaauga

SEQ ID NO: 1229763 - RNA, 22 nt, Human
uagaacccuuaaaucagccucc

SEQ ID NO: 1229764 - RNA, 18 nt, Human
uagcagagaaaccaccac

SEQ ID NO: 1229765 - RNA, 24 nt, Human
ucaaagccaauuauuagccaaaaa

SEQ ID NO: 1229766 - RNA, 19 nt, Human
ucaagggaaugcaaccaca

SEQ ID NO: 1229767 - RNA, 21 nt, Human
ucaauaguaaaagcgaaugag

SEQ ID NO: 1229768 - RNA, 22 nt, Human
ucagacgcaaacacaggggaug

SEQ ID NO: 1229769 - RNA, 21 nt, Human
uccacauguaaagccccagau

SEQ ID NO: 1229770 - RNA, 18 nt, Human
ucccagaaaguagccgcc

SEQ ID NO: 1229771 - RNA, 22 nt, Human
ucccugcuguucuugccacaac

SEQ ID NO: 1229772 - RNA, 21 nt, Human
ucucugcugaacaugcauguc

SEQ ID NO: 1229773 - RNA, 19 nt, Human
ugaaaacaccagaaaauca

SEQ ID NO: 1229774 - RNA, 22 nt, Human
ugaaaacaccagaaaaucaaac

SEQ ID NO: 1229775 - RNA, 24 nt, Human
ugaauaaaauccagacacaaaacc

SEQ ID NO: 1229776 - RNA, 22 nt, Human
ugccacaacaccuaggcagaac

SEQ ID NO: 1229777 - RNA, 24 nt, Human
ugcccucucacugcugaggacacu

SEQ ID NO: 1229778 - RNA, 22 nt, Human
uggaacagaaagauacguuaga

SEQ ID NO: 1229779 - RNA, 19 nt, Human
uguaaacacaugccuguau

SEQ ID NO: 1229780 - RNA, 18 nt, Human
uguggagagaagaauugg

SEQ ID NO: 1229781 - RNA, 24 nt, Human
uguuuauucaucuuucucugcuga

SEQ ID NO: 1229782 - RNA, 21 nt, Human
uugcacugcuaagaacagcca

SEQ ID NO: 1229783 - RNA, 18 nt, Human
accaugggccgggcuggu

SEQ ID NO: 1229784 - RNA, 22 nt, Human
acgcagagccugacaaauggcu

SEQ ID NO: 1229785 - RNA, 19 nt, Human
acggccaucgggucugcaa

SEQ ID NO: 1229786 - RNA, 20 nt, Human
agagcaaggggcccucccuc

SEQ ID NO: 1229787 - RNA, 21 nt, Human
aggcaggcacccccccacccc

SEQ ID NO: 1229788 - RNA, 18 nt, Human
caaugcaggcaggcaccc

SEQ ID NO: 1229789 - RNA, 18 nt, Human
cacccccccaccccaugc

SEQ ID NO: 1229790 - RNA, 22 nt, Human
cacccccccaccccaugcuuua

SEQ ID NO: 1229791 - RNA, 19 nt, Human
cacgcugggggaccauggg

SEQ ID NO: 1229792 - RNA, 21 nt, Human
cagccacauuccccaugcucg

SEQ ID NO: 1229793 - RNA, 25 nt, Human
caggcacccccccaccccaugcuuu

SEQ ID NO: 1229794 - RNA, 21 nt, Human
caggcaggcacccccccaccc

SEQ ID NO: 1229795 - RNA, 22 nt, Human
ccaugcucagcagcggcucaca

SEQ ID NO: 1229796 - RNA, 23 nt, Human
cccccccaccccaugcuuuacgg

SEQ ID NO: 1229797 - RNA, 24 nt, Human
ccucauggcugagcacacagugcc

SEQ ID NO: 1229798 - RNA, 20 nt, Human
cggguccgcaguccacuccu

SEQ ID NO: 1229799 - RNA, 24 nt, Human
cgucuuuuggcgaugguuccuuuc

SEQ ID NO: 1229800 - RNA, 19 nt, Human
cuccuggugcuccuucugg

SEQ ID NO: 1229801 - RNA, 20 nt, Human
cugcaaugcaggcaggcacc

SEQ ID NO: 1229802 - RNA, 24 nt, Human
cugccggggggggacgugcuggag

SEQ ID NO: 1229803 - RNA, 18 nt, Human
gacagcaucugcugcuag

SEQ ID NO: 1229804 - RNA, 19 nt, Human
gaggaggacagggagaagg

SEQ ID NO: 1229805 - RNA, 18 nt, Human
gcugacccuuccuccauc

SEQ ID NO: 1229806 - RNA, 18 nt, Human
ggagaaggcagcauugcu

SEQ ID NO: 1229807 - RNA, 21 nt, Human
ggcagugcgguguagacacuu

SEQ ID NO: 1229808 - RNA, 20 nt, Human
ggcuuuuuccucaacaaucc

SEQ ID NO: 1229809 - RNA, 19 nt, Human
gggagaaggcagcauugcu

SEQ ID NO: 1229810 - RNA, 19 nt, Human
gggcccucccuccacuccu

SEQ ID NO: 1229811 - RNA, 23 nt, Human
gggcccucccuccacugccgggg

SEQ ID NO: 1229812 - RNA, 18 nt, Human
gguccuggcucugcacug

SEQ ID NO: 1229813 - RNA, 24 nt, Human
gguccuggcucugcacugucccug

SEQ ID NO: 1229814 - RNA, 21 nt, Human
uaaacaguacuguguucuaga

SEQ ID NO: 1229815 - RNA, 22 nt, Human
uaggaguugugaggacacguga

SEQ ID NO: 1229816 - RNA, 21 nt, Human
ucgcucagccagugacugugc

SEQ ID NO: 1229817 - RNA, 21 nt, Human
ucugacagcugcaaugcaggc

SEQ ID NO: 1229818 - RNA, 19 nt, Human
ucuggagugacaggcucuc

SEQ ID NO: 1229819 - RNA, 19 nt, Human
ugacaggcucucucuccac

SEQ ID NO: 1229820 - RNA, 20 nt, Human
ugacaguaauaacugauaaa

SEQ ID NO: 1229821 - RNA, 28 nt, Human
ugacaguaauaacugauaagaaaugaaa

SEQ ID NO: 1229822 - RNA, 18 nt, Human
ugagcacacagugccggg

SEQ ID NO: 1229823 - RNA, 21 nt, Human
ugauaagaaaugaaaucacag

SEQ ID NO: 1229824 - RNA, 22 nt, Human
ugcaggcaggcacccccccacc

SEQ ID NO: 1229825 - RNA, 19 nt, Human
ugccaagguguggaacagg

SEQ ID NO: 1229826 - RNA, 18 nt, Human
ugccgggccagguggugc

SEQ ID NO: 1229827 - RNA, 18 nt, Human
ugccggggggggacgugc

SEQ ID NO: 1229828 - RNA, 19 nt, Human
ugcuggagagcgacgggcc

SEQ ID NO: 1229829 - RNA, 20 nt, Human
ugggggaccaugggccgggc

SEQ ID NO: 1229830 - RNA, 24 nt, Human
ugggggaccaugggccgggcuggu

SEQ ID NO: 1229831 - RNA, 18 nt, Human
uggugcuuuugcuggaga

SEQ ID NO: 1229832 - RNA, 20 nt, Human
uguagacacuugagcugugg

SEQ ID NO: 1229833 - RNA, 26 nt, Human
uguagacacuugagcugugggcagga

SEQ ID NO: 1229834 - RNA, 19 nt, Human
uuccucagcgucuuuuggc

SEQ ID NO: 1229835 - RNA, 22 nt, Human
uuuacauucuuuuagaaguguu

SEQ ID NO: 1229836 - RNA, 23 nt, Human
uuuugcuggagagcaaggggccc

SEQ ID NO: 1229837 - RNA, 18 nt, Human
aaaacagcagagagagau

SEQ ID NO: 1229838 - RNA, 18 nt, Human
acagcagagagagaugaa

SEQ ID NO: 1229839 - RNA, 20 nt, Human
agaaaacagcagagagagau

SEQ ID NO: 1229840 - RNA, 19 nt, Human
agagagaaaacagcagaga

SEQ ID NO: 1229841 - RNA, 18 nt, Human
agggaaaccagagagaaa

SEQ ID NO: 1229842 - RNA, 19 nt, Human
caaggacccagaucagagg

SEQ ID NO: 1229843 - RNA, 18 nt, Human
gagaaaacagcagagaga

SEQ ID NO: 1229844 - RNA, 22 nt, Human
ggacccagaucagaggcuggca

SEQ ID NO: 1229845 - RNA, 24 nt, Human
gguaaaagggaaaccagagagaaa

SEQ ID NO: 1229846 - RNA, 24 nt, Human
aaaguucccucacgucugagcaau

SEQ ID NO: 1229847 - RNA, 18 nt, Human
aacagugacuucucaaag

SEQ ID NO: 1229848 - RNA, 25 nt, Human
aaccuguugauaauagaaaaacuuu

SEQ ID NO: 1229849 - RNA, 21 nt, Human
aaccuuuucugccauuuuccu

SEQ ID NO: 1229850 - RNA, 24 nt, Human
aaccuuuucugccauuuuccuuuu

SEQ ID NO: 1229851 - RNA, 22 nt, Human
aagcucaccuuuguaacaguuu

SEQ ID NO: 1229852 - RNA, 26 nt, Human
aagucauaaaagaccuauuuauugac

SEQ ID NO: 1229853 - RNA, 21 nt, Human
aagucauagccccuccuacag

SEQ ID NO: 1229854 - RNA, 23 nt, Human
acauugaucuaccaaacacauua

SEQ ID NO: 1229855 - RNA, 19 nt, Human
accuugcccuguccagccc

SEQ ID NO: 1229856 - RNA, 20 nt, Human
acugacuggcuccaaggcuc

SEQ ID NO: 1229857 - RNA, 18 nt, Human
agaaccccuucucuggcc

SEQ ID NO: 1229858 - RNA, 25 nt, Human
agaggcuaaaacgcauaaugacagu

SEQ ID NO: 1229859 - RNA, 19 nt, Human
agagucccugugggcggaa

SEQ ID NO: 1229860 - RNA, 23 nt, Human
agcagcuguuugauuucugaguu

SEQ ID NO: 1229861 - RNA, 21 nt, Human
agccuuuggcacaauagguuu

SEQ ID NO: 1229862 - RNA, 24 nt, Human
aggaggcuggcggcuguccugggc

SEQ ID NO: 1229863 - RNA, 24 nt, Human
aggcauggggaguuuugaagcuuc

SEQ ID NO: 1229864 - RNA, 21 nt, Human
aggcuggcggcuguccugggc

SEQ ID NO: 1229865 - RNA, 21 nt, Human
agggauggacuuucuggucgu

SEQ ID NO: 1229866 - RNA, 18 nt, Human
agugguauaugaaaguuc

SEQ ID NO: 1229867 - RNA, 30 nt, Human
auaagaacaacaucuuuauugaaaaacauu

SEQ ID NO: 1229868 - RNA, 20 nt, Human
aucaguucuucauuuucuuu

SEQ ID NO: 1229869 - RNA, 18 nt, Human
augcuucaaacaaaaacc

SEQ ID NO: 1229870 - RNA, 21 nt, Human
auggagugugcauaaagcucc

SEQ ID NO: 1229871 - RNA, 22 nt, Human
auguauccguugucaaaaccug

SEQ ID NO: 1229872 - RNA, 20 nt, Human
auuucagcauuccauuuuua

SEQ ID NO: 1229873 - RNA, 22 nt, Human
caaaaauaaagcccacagcuaa

SEQ ID NO: 1229874 - RNA, 20 nt, Human
caaacaaaaaccaauuuaga

SEQ ID NO: 1229875 - RNA, 21 nt, Human
caaauguggcaucuaaugaac

SEQ ID NO: 1229876 - RNA, 19 nt, Human
caagugaaucagacggcuu

SEQ ID NO: 1229877 - RNA, 19 nt, Human
caccagagucccugugggc

SEQ ID NO: 1229878 - RNA, 22 nt, Human
caccagagucccugugggcgga

SEQ ID NO: 1229879 - RNA, 19 nt, Human
cacugugugugcugcagac

SEQ ID NO: 1229880 - RNA, 23 nt, Human
cagacaccuucaccugcaguuuu

SEQ ID NO: 1229881 - RNA, 22 nt, Human
cagacucauuucugaaggugau

SEQ ID NO: 1229882 - RNA, 25 nt, Human
caggcaggauaaauuccugcacccc

SEQ ID NO: 1229883 - RNA, 21 nt, Human
cagggcugucagcccugcucu

SEQ ID NO: 1229884 - RNA, 19 nt, Human
caguaccuugcccugucca

SEQ ID NO: 1229885 - RNA, 23 nt, Human
caugcuucaaacaaaaaccaauu

SEQ ID NO: 1229886 - RNA, 21 nt, Human
cauuccuuauucuuaucccag

SEQ ID NO: 1229887 - RNA, 22 nt, Human
ccauggcccucuuuccuccugu

SEQ ID NO: 1229888 - RNA, 23 nt, Human
ccauugccgaaauccacauugau

SEQ ID NO: 1229889 - RNA, 20 nt, Human
ccccacgccagugacaccag

SEQ ID NO: 1229890 - RNA, 21 nt, Human
ccccuaaguaggucauuauug

SEQ ID NO: 1229891 - RNA, 20 nt, Human
ccccuucccgccaccucugc

SEQ ID NO: 1229892 - RNA, 21 nt, Human
cccucagucaagugaaucaga

SEQ ID NO: 1229893 - RNA, 24 nt, Human
cccuccuacaguucugucuuccuu

SEQ ID NO: 1229894 - RNA, 18 nt, Human
cccuguccagccccaccu

SEQ ID NO: 1229895 - RNA, 18 nt, Human
ccuaaaccucuccucgga

SEQ ID NO: 1229896 - RNA, 22 nt, Human
ccucccagugguauaugaaagu

SEQ ID NO: 1229897 - RNA, 24 nt, Human
ccugcucgccucccuauagccuaa

SEQ ID NO: 1229898 - RNA, 19 nt, Human
ccugugggcggaacccagg

SEQ ID NO: 1229899 - RNA, 18 nt, Human
cgggacuggcagagaaaa

SEQ ID NO: 1229900 - RNA, 24 nt, Human
cugaagaggcuaaaacgcauaaug

SEQ ID NO: 1229901 - RNA, 19 nt, Human
cugacuggcuccaaggcuc

SEQ ID NO: 1229902 - RNA, 22 nt, Human
cugcagcuccuuuccaggcacg

SEQ ID NO: 1229903 - RNA, 18 nt, Human
cugcaucauucucuuaca

SEQ ID NO: 1229904 - RNA, 22 nt, Human
cugcaucauucucuuacaguca

SEQ ID NO: 1229905 - RNA, 23 nt, Human
cuggcaaaaauaaagcccacagc

SEQ ID NO: 1229906 - RNA, 20 nt, Human
cuggcccucaccugcucgcc

SEQ ID NO: 1229907 - RNA, 26 nt, Human
cugucagcccugcucuggaaggguug

SEQ ID NO: 1229908 - RNA, 21 nt, Human
cuguuuuccaaaacaacugug

SEQ ID NO: 1229909 - RNA, 21 nt, Human
cuuccuuguuuucuuugaggg

SEQ ID NO: 1229910 - RNA, 20 nt, Human
cuucucaucuguggaagagu

SEQ ID NO: 1229911 - RNA, 19 nt, Human
cuuugcacugacuggcucc

SEQ ID NO: 1229912 - RNA, 18 nt, Human
gaacccaggcauggggag

SEQ ID NO: 1229913 - RNA, 20 nt, Human
gacaccuucaccugcaguuu

SEQ ID NO: 1229914 - RNA, 20 nt, Human
gagaaccccuucucuggccc

SEQ ID NO: 1229915 - RNA, 22 nt, Human
gagaaccccuucucuggcccuc

SEQ ID NO: 1229916 - RNA, 18 nt, Human
gagugugcauaaagcucc

SEQ ID NO: 1229917 - RNA, 20 nt, Human
gauaguaucuuuuauacagu

SEQ ID NO: 1229918 - RNA, 21 nt, Human
gauggagcccggcugugccau

SEQ ID NO: 1229919 - RNA, 19 nt, Human
gccuagucuuaauuuaauu

SEQ ID NO: 1229920 - RNA, 21 nt, Human
gcuacaacauguuauuuaucc

SEQ ID NO: 1229921 - RNA, 23 nt, Human
gcucugagcagaugggacacucu

SEQ ID NO: 1229922 - RNA, 26 nt, Human
ggcucccauggcccucuuuccuccuu

SEQ ID NO: 1229923 - RNA, 18 nt, Human
gggaaaauguaauccugg

SEQ ID NO: 1229924 - RNA, 20 nt, Human
gggaagcugugugugcagcc

SEQ ID NO: 1229925 - RNA, 21 nt, Human
gucuuccuuguuuucuuugag

SEQ ID NO: 1229926 - RNA, 21 nt, Human
gucuuucuccagcuuuccccu

SEQ ID NO: 1229927 - RNA, 21 nt, Human
gugaaccucugggcuccuuuu

SEQ ID NO: 1229928 - RNA, 23 nt, Human
gugaaucagacggcuuuuuggug

SEQ ID NO: 1229929 - RNA, 23 nt, Human
gugcugcagacaccuucaccugc

SEQ ID NO: 1229930 - RNA, 21 nt, Human
uaggaguuucuacuuucagac

SEQ ID NO: 1229931 - RNA, 24 nt, Human
uaggaguuucuacuuucagacugg

SEQ ID NO: 1229932 - RNA, 23 nt, Human
uaggggaaaauguaauccuggga

SEQ ID NO: 1229933 - RNA, 21 nt, Human
uaucuaaacuuguaugugaaa

SEQ ID NO: 1229934 - RNA, 21 nt, Human
uauuuucuugugauaguuuua

SEQ ID NO: 1229935 - RNA, 20 nt, Human
ucacagucaaauguggcauc

SEQ ID NO: 1229936 - RNA, 24 nt, Human
ucacucugcuucucaucuguggaa

SEQ ID NO: 1229937 - RNA, 19 nt, Human
ucagacuguuuuccaaaac

SEQ ID NO: 1229938 - RNA, 23 nt, Human
uccauuuuuacaaaaauaggagu

SEQ ID NO: 1229939 - RNA, 21 nt, Human
ucccauagaaucaccugcagg

SEQ ID NO: 1229940 - RNA, 21 nt, Human
uccucuggccuccagggaaag

SEQ ID NO: 1229941 - RNA, 24 nt, Human
uccugggcacacgcugugaaccuc

SEQ ID NO: 1229942 - RNA, 26 nt, Human
uccugggcacacgcugugaaccucug

SEQ ID NO: 1229943 - RNA, 21 nt, Human
uccuuguuuucuuugagggcc

SEQ ID NO: 1229944 - RNA, 24 nt, Human
uccuuuuggcucugagcagauggg

SEQ ID NO: 1229945 - RNA, 18 nt, Human
ucucuggcccucaccugc

SEQ ID NO: 1229946 - RNA, 21 nt, Human
ucugacuuccucuggccucca

SEQ ID NO: 1229947 - RNA, 23 nt, Human
ucugagugacugacaguugauuu

SEQ ID NO: 1229948 - RNA, 19 nt, Human
ucugucccgcagcauguua

SEQ ID NO: 1229949 - RNA, 24 nt, Human
ucuuaucccagaucugcuuugcag

SEQ ID NO: 1229950 - RNA, 19 nt, Human
ugaaaugaacagugacuuc

SEQ ID NO: 1229951 - RNA, 24 nt, Human
ugaagaaaccucauuucugaagag

SEQ ID NO: 1229952 - RNA, 24 nt, Human
ugaagucauagccccuccuacagu

SEQ ID NO: 1229953 - RNA, 18 nt, Human
ugacuuauuucagcauuc

SEQ ID NO: 1229954 - RNA, 19 nt, Human
ugagugacugacaguugau

SEQ ID NO: 1229955 - RNA, 23 nt, Human
ugccugugugauggagcccggcu

SEQ ID NO: 1229956 - RNA, 21 nt, Human
ugcuuaguguaaagaacaguu

SEQ ID NO: 1229957 - RNA, 20 nt, Human
uggaaggguugugggggacc

SEQ ID NO: 1229958 - RNA, 20 nt, Human
uggcaaaaauaaagcccaca

SEQ ID NO: 1229959 - RNA, 19 nt, Human
uggcagcauccaaauuaac

SEQ ID NO: 1229960 - RNA, 24 nt, Human
uggcauuuuguauuccucccagug

SEQ ID NO: 1229961 - RNA, 24 nt, Human
uggcccucuuuccuccugucuuuc

SEQ ID NO: 1229962 - RNA, 21 nt, Human
ugggauugagcuggcugucag

SEQ ID NO: 1229963 - RNA, 21 nt, Human
uggggaccccaguuugagaac

SEQ ID NO: 1229964 - RNA, 23 nt, Human
uguccucaccugcagcuccuuuc

SEQ ID NO: 1229965 - RNA, 21 nt, Human
ugugcauaaagcucccacaga

SEQ ID NO: 1229966 - RNA, 21 nt, Human
uguggaagaguuuucagacug

SEQ ID NO: 1229967 - RNA, 20 nt, Human
uuaaauuccgggacuggcag

SEQ ID NO: 1229968 - RNA, 24 nt, Human
uucccaggccauuccacuggggac

SEQ ID NO: 1229969 - RNA, 21 nt, Human
uugacauuuuuuucuggauua

SEQ ID NO: 1229970 - RNA, 22 nt, Human
uugggcaagauucauuuucugu

SEQ ID NO: 1229971 - RNA, 23 nt, Human
uuucugugugucaaauucagauu

SEQ ID NO: 1229972 - RNA, 24 nt, Human
uuuuauggcuacaacauguuauuu

SEQ ID NO: 1229973 - RNA, 24 nt, Human
uuuugacaacuucaacaguaguug

SEQ ID NO: 1229974 - RNA, 18 nt, Human
aagcaggagaaucgcuug

SEQ ID NO: 1229975 - RNA, 23 nt, Human
aagcaggagaaucgcuugaacca

SEQ ID NO: 1229976 - RNA, 24 nt, Human
aggcugaagcaggagaaucgcuug

SEQ ID NO: 1229977 - RNA, 22 nt, Human
aucggcuacccuccguccccag

SEQ ID NO: 1229978 - RNA, 20 nt, Human
caucuguaaucccaacuacu

SEQ ID NO: 1229979 - RNA, 24 nt, Human
caucuguaaucccaacuacucagg

SEQ ID NO: 1229980 - RNA, 22 nt, Human
ccugcacuaagaaccagcaaau

SEQ ID NO: 1229981 - RNA, 25 nt, Human
cgcuugaaccaugcuuggguucugu

SEQ ID NO: 1229982 - RNA, 21 nt, Human
cuaagaaccagcaaauuugcu

SEQ ID NO: 1229983 - RNA, 19 nt, Human
cuugaaccaugcuuggguu

SEQ ID NO: 1229984 - RNA, 23 nt, Human
gcucagggccccaucggcuaccc

SEQ ID NO: 1229985 - RNA, 23 nt, Human
gguggcgggcaucuguaauccca

SEQ ID NO: 1229986 - RNA, 21 nt, Human
uaagaaccagcaaauuugcua

SEQ ID NO: 1229987 - RNA, 19 nt, Human
uccugcacuaagaaccagc

SEQ ID NO: 1229988 - RNA, 24 nt, Human
ucuguggucaaguccagaagaggc

SEQ ID NO: 1229989 - RNA, 28 nt, Human
ugaaccaugcuuggguucuguggucaag

SEQ ID NO: 1229990 - RNA, 20 nt, Human
ugaagcaggagaaucgcuug

SEQ ID NO: 1229991 - RNA, 24 nt, Human
ugaagcaggagaaucgcuugaacc

SEQ ID NO: 1229992 - RNA, 22 nt, Human
aagaacaggaaggcaaaaacgc

SEQ ID NO: 1229993 - RNA, 31 nt, Human
acuuuaaauaaacacaauucuagagaagaag

SEQ ID NO: 1229994 - RNA, 25 nt, Human
aggaggagacaauguuuaugugcaa

SEQ ID NO: 1229995 - RNA, 21 nt, Human
augcccuccacacuggugccu

SEQ ID NO: 1229996 - RNA, 24 nt, Human
cacagccuguacuuccccucacgc

SEQ ID NO: 1229997 - RNA, 20 nt, Human
cagaaaagggucagaucuga

SEQ ID NO: 1229998 - RNA, 22 nt, Human
ccagagaaucagaaaaggguca

SEQ ID NO: 1229999 - RNA, 18 nt, Human
cccaggaggagacaaugu

SEQ ID NO: 1230000 - RNA, 20 nt, Human
ccuguacuuccccucacgca

SEQ ID NO: 1230001 - RNA, 20 nt, Human
cugagaauaguaauucuuuc

SEQ ID NO: 1230002 - RNA, 19 nt, Human
cuguacuuccccucacgca

SEQ ID NO: 1230003 - RNA, 20 nt, Human
gaccuggccacagacacacu

SEQ ID NO: 1230004 - RNA, 21 nt, Human
gagggggagcuccccauggag

SEQ ID NO: 1230005 - RNA, 22 nt, Human
gcugcagugugagcuccagucc

SEQ ID NO: 1230006 - RNA, 21 nt, Human
uaaacacaauucuagagaaga

SEQ ID NO: 1230007 - RNA, 24 nt, Human
uacuuccccucacgcagaacagcc

SEQ ID NO: 1230008 - RNA, 21 nt, Human
uccccucacgcagaacagccc

SEQ ID NO: 1230009 - RNA, 21 nt, Human
ugagaauaguaauucuuuccu

SEQ ID NO: 1230010 - RNA, 20 nt, Human
ugauugcgguggaaagaaca

SEQ ID NO: 1230011 - RNA, 19 nt, Human
ugcccuccacacuggugcc

SEQ ID NO: 1230012 - RNA, 19 nt, Human
ugcccuccacacuggugcc

SEQ ID NO: 1230013 - RNA, 20 nt, Human
ugcgaugcccuccacacugg

SEQ ID NO: 1230014 - RNA, 22 nt, Human
uggaaagaacaauggccagaga

SEQ ID NO: 1230015 - RNA, 21 nt, Human
uggccauggacacacuggacc

SEQ ID NO: 1230016 - RNA, 24 nt, Human
ugguacuacugagaauaguaauuc

SEQ ID NO: 1230017 - RNA, 23 nt, Human
ugugcaagcuuagaaugguggua

SEQ ID NO: 1230018 - RNA, 25 nt, Human
uuaaauaaacacaauucuagagaag

SEQ ID NO: 1230019 - RNA, 21 nt, Human
uuucauguuugauugcggugg

SEQ ID NO: 1230020 - RNA, 25 nt, Human
uaguuggggcauugggaaagaauuu

SEQ ID NO: 1230021 - RNA, 21 nt, Human
ugggagaggaaggugcuggag

SEQ ID NO: 1230022 - RNA, 21 nt, Human
uggggcauugggaaagaauuu

SEQ ID NO: 1230023 - RNA, 21 nt, Human
uuaguuggggcauugggaaag

SEQ ID NO: 1230024 - RNA, 20 nt, Human
acagacccuggcuguguggc

SEQ ID NO: 1230025 - RNA, 22 nt, Human
agaccagacagcaggacauggg

SEQ ID NO: 1230026 - RNA, 18 nt, Human
cacccaccggugagacca

SEQ ID NO: 1230027 - RNA, 22 nt, Human
cagacccuggcuguguggccuu

SEQ ID NO: 1230028 - RNA, 21 nt, Human
ccccacucgacauaccuuccc

SEQ ID NO: 1230029 - RNA, 27 nt, Human
ccuggagcacccaccggugagaccaga

SEQ ID NO: 1230030 - RNA, 23 nt, Human
cuggagcacccaccggugagacc

SEQ ID NO: 1230031 - RNA, 23 nt, Human
gacccuggcuguguggccuuggg

SEQ ID NO: 1230032 - RNA, 19 nt, Human
gcagcuggaggccaggggc

SEQ ID NO: 1230033 - RNA, 21 nt, Human
uccuaggaucacaccuggucc

SEQ ID NO: 1230034 - RNA, 23 nt, Human
ucugcaccgcauggucucaaggg

SEQ ID NO: 1230035 - RNA, 19 nt, Human
ugagaccagacagcaggac

SEQ ID NO: 1230036 - RNA, 23 nt, Human
ugagaccagacagcaggacaugg

SEQ ID NO: 1230037 - RNA, 19 nt, Human
ugccuggagcacccaccgg

SEQ ID NO: 1230038 - RNA, 18 nt, Human
uggagcacccaccgguga

SEQ ID NO: 1230039 - RNA, 22 nt, Human
ugggaagcugguaccacaggcu

SEQ ID NO: 1230040 - RNA, 24 nt, Human
gcucguggugggccagcagcuugg

SEQ ID NO: 1230041 - RNA, 19 nt, Human
ugggccagcagcuuggcug

SEQ ID NO: 1230042 - RNA, 24 nt, Human
aaacgacagacagcuucucuccua

SEQ ID NO: 1230043 - RNA, 18 nt, Human
aagguauuuucauccuuc

SEQ ID NO: 1230044 - RNA, 29 nt, Human
acagcuucucuccuagggcuggggaccaa

SEQ ID NO: 1230045 - RNA, 18 nt, Human
agggcuggggaccagcug

SEQ ID NO: 1230046 - RNA, 25 nt, Human
caaacgacagacagcuucucuccua

SEQ ID NO: 1230047 - RNA, 19 nt, Human
caccuccaggugcccuugc

SEQ ID NO: 1230048 - RNA, 21 nt, Human
cacgcagacagagccuaccgc

SEQ ID NO: 1230049 - RNA, 19 nt, Human
cccuugccacauggagagu

SEQ ID NO: 1230050 - RNA, 20 nt, Human
cuaccgcuucuucugccagg

SEQ ID NO: 1230051 - RNA, 20 nt, Human
cucccaccuccaggugcccu

SEQ ID NO: 1230052 - RNA, 18 nt, Human
cuccugcccucccaccuc

SEQ ID NO: 1230053 - RNA, 19 nt, Human
cugcccucccaccuccagg

SEQ ID NO: 1230054 - RNA, 22 nt, Human
gacgcuccugcccucccaccuc

SEQ ID NO: 1230055 - RNA, 21 nt, Human
gcuccugcccucccaccucca

SEQ ID NO: 1230056 - RNA, 18 nt, Human
ucucuccuagggcugggg

SEQ ID NO: 1230057 - RNA, 22 nt, Human
ugccagggcaagacgacgcucc

SEQ ID NO: 1230058 - RNA, 25 nt, Human
uuuucaguucuccucucugcacucc

SEQ ID NO: 1230059 - RNA, 27 nt, Human
aaacuacuaaucaaaguuaaucacuug

SEQ ID NO: 1230060 - RNA, 19 nt, Human
aaagcagcugaaacaggca

SEQ ID NO: 1230061 - RNA, 25 nt, Human
aagagcugccagcccuuggccagug

SEQ ID NO: 1230062 - RNA, 21 nt, Human
aaguagucagcaagggcagag

SEQ ID NO: 1230063 - RNA, 19 nt, Human
aaucacuugcacacacuua

SEQ ID NO: 1230064 - RNA, 22 nt, Human
acagcagugggaagagcagggc

SEQ ID NO: 1230065 - RNA, 20 nt, Human
acaugguguuuuguccaucc

SEQ ID NO: 1230066 - RNA, 23 nt, Human
accacagacacugcugaccucug

SEQ ID NO: 1230067 - RNA, 21 nt, Human
agaagagcacauuccagaaaa

SEQ ID NO: 1230068 - RNA, 19 nt, Human
agacacugcugaccucuga

SEQ ID NO: 1230069 - RNA, 18 nt, Human
agagcagggcgccuuagg

SEQ ID NO: 1230070 - RNA, 24 nt, Human
agcacugccuccuaucugccaucu

SEQ ID NO: 1230071 - RNA, 18 nt, Human
agcugccagcccuuggcc

SEQ ID NO: 1230072 - RNA, 25 nt, Human
agugacaguggugccuccugcagcu

SEQ ID NO: 1230073 - RNA, 21 nt, Human
auaguucuuggagcacaacag

SEQ ID NO: 1230074 - RNA, 21 nt, Human
auccuacaccacagacacugc

SEQ ID NO: 1230075 - RNA, 21 nt, Human
aucuuccccugaucucaacaa

SEQ ID NO: 1230076 - RNA, 22 nt, Human
augcagcucuguggagauggga

SEQ ID NO: 1230077 - RNA, 23 nt, Human
augguguuuuguccauccaugug

SEQ ID NO: 1230078 - RNA, 19 nt, Human
cacagacacugcugaccuc

SEQ ID NO: 1230079 - RNA, 21 nt, Human
cagggacagcagugggaagag

SEQ ID NO: 1230080 - RNA, 24 nt, Human
ccagaaaaguagucagcaagggca

SEQ ID NO: 1230081 - RNA, 22 nt, Human
ccagaagagcacauuccagaaa

SEQ ID NO: 1230082 - RNA, 20 nt, Human
ccagcccuuggccagugaca

SEQ ID NO: 1230083 - RNA, 27 nt, Human
ccagugacaguggugccuccugcagcu

SEQ ID NO: 1230084 - RNA, 24 nt, Human
ccgcaacggacucugcccuccucg

SEQ ID NO: 1230085 - RNA, 20 nt, Human
ccgcugcgggugggccuccg

SEQ ID NO: 1230086 - RNA, 27 nt, Human
ccuccuaucugccaucuuccccugauc

SEQ ID NO: 1230087 - RNA, 21 nt, Human
ccuccugcagcucccgccaca

SEQ ID NO: 1230088 - RNA, 22 nt, Human
ccucgugcaggccggaggcccc

SEQ ID NO: 1230089 - RNA, 23 nt, Human
ccugggcgcgcggcgcucggucc

SEQ ID NO: 1230090 - RNA, 19 nt, Human
cgcucgguccuucacguga

SEQ ID NO: 1230091 - RNA, 21 nt, Human
cggcagccgcaacggacucug

SEQ ID NO: 1230092 - RNA, 20 nt, Human
cgugcaggccggaggccccg

SEQ ID NO: 1230093 - RNA, 18 nt, Human
cuacacauuagcacugcc

SEQ ID NO: 1230094 - RNA, 18 nt, Human
cuccagcgcacccugggc

SEQ ID NO: 1230095 - RNA, 19 nt, Human
cucccgccacaggaauggg

SEQ ID NO: 1230096 - RNA, 20 nt, Human
cucuugagaaaggacaaaua

SEQ ID NO: 1230097 - RNA, 20 nt, Human
cugaccucugaccuacuauc

SEQ ID NO: 1230098 - RNA, 24 nt, Human
gaggauccugcuuagucccgaugc

SEQ ID NO: 1230099 - RNA, 19 nt, Human
gcgggcgcggcgagcgggg

SEQ ID NO: 1230100 - RNA, 24 nt, Human
ggaggcagaaugggguccuugggg

SEQ ID NO: 1230101 - RNA, 23 nt, Human
ggccccgccugggcgcgcggcgc

SEQ ID NO: 1230102 - RNA, 19 nt, Human
guccuuggggagucucugu

SEQ ID NO: 1230103 - RNA, 20 nt, Human
uacaccacagacacugcuga

SEQ ID NO: 1230104 - RNA, 25 nt, Human
uagaauagaaggaugccuuccuccc

SEQ ID NO: 1230105 - RNA, 24 nt, Human
uauguuccuaugauaguucuugga

SEQ ID NO: 1230106 - RNA, 20 nt, Human
ucagcaagggcagaggccca

SEQ ID NO: 1230107 - RNA, 19 nt, Human
ucauuguaaagaguugaaa

SEQ ID NO: 1230108 - RNA, 18 nt, Human
uccuaucugccaucuucc

SEQ ID NO: 1230109 - RNA, 21 nt, Human
ucucacuuccagaagagcaca

SEQ ID NO: 1230110 - RNA, 22 nt, Human
ucuucuuucaaaggauccguga

SEQ ID NO: 1230111 - RNA, 21 nt, Human
ugagaaaggacaaauauucua

SEQ ID NO: 1230112 - RNA, 23 nt, Human
ugagaaaggacaaauauucuagg

SEQ ID NO: 1230113 - RNA, 20 nt, Human
ugcacacacuuaaacacacu

SEQ ID NO: 1230114 - RNA, 20 nt, Human
ugccaaggagcguggcugcc

SEQ ID NO: 1230115 - RNA, 22 nt, Human
ugccaaggagcguggcugcccc

SEQ ID NO: 1230116 - RNA, 21 nt, Human
ugccaaggagcguggcugccg

SEQ ID NO: 1230117 - RNA, 23 nt, Human
ugcuccagcgcacccugggccag

SEQ ID NO: 1230118 - RNA, 19 nt, Human
ugggaagagcagggcgccu

SEQ ID NO: 1230119 - RNA, 20 nt, Human
uggugccccggacaggcaga

SEQ ID NO: 1230120 - RNA, 24 nt, Human
uggugcuccagcgcacccugggcc

SEQ ID NO: 1230121 - RNA, 18 nt, Human
uguggagaugggauuaca

SEQ ID NO: 1230122 - RNA, 27 nt, Human
uuaguccaggccaauccacacagggca

SEQ ID NO: 1230123 - RNA, 22 nt, Human
uucccacccaagaucccagacu

SEQ ID NO: 1230124 - RNA, 26 nt, Human
uuggccagugacaguggugccuccuu

SEQ ID NO: 1230125 - RNA, 20 nt, Human
aaacuaaggcaaaacuaaug

SEQ ID NO: 1230126 - RNA, 23 nt, Human
aaagaaaaggcaaggcaacaaaa

SEQ ID NO: 1230127 - RNA, 20 nt, Human
aaagcucuuccacaucuucc

SEQ ID NO: 1230128 - RNA, 23 nt, Human
aaagcucuuccacaucuuccuuc

SEQ ID NO: 1230129 - RNA, 25 nt, Human
aaagcucuuccacaucuuccuucuc

SEQ ID NO: 1230130 - RNA, 26 nt, Human
aagacagcacacugagaguuaaaaua

SEQ ID NO: 1230131 - RNA, 18 nt, Human
aaggcaaggcaacaaaaa

SEQ ID NO: 1230132 - RNA, 19 nt, Human
aaguaccuccuuaguucau

SEQ ID NO: 1230133 - RNA, 24 nt, Human
aaguaguaagugaaauugcaaagc

SEQ ID NO: 1230134 - RNA, 21 nt, Human
aaugccauuugagaaaguuau

SEQ ID NO: 1230135 - RNA, 20 nt, Human
accaauauacaaaguacaua

SEQ ID NO: 1230136 - RNA, 21 nt, Human
agaaaaggcaaggcaacaaaa

SEQ ID NO: 1230137 - RNA, 21 nt, Human
aguaacaaugaaaagaggccg

SEQ ID NO: 1230138 - RNA, 20 nt, Human
auaaagacagcacacugaga

SEQ ID NO: 1230139 - RNA, 21 nt, Human
cucaucaucuagaaagcuguc

SEQ ID NO: 1230140 - RNA, 24 nt, Human
cugaggucaaaaaaacuaaggcaa

SEQ ID NO: 1230141 - RNA, 22 nt, Human
gcaaagcucacaucuaagguac

SEQ ID NO: 1230142 - RNA, 18 nt, Human
gccauuugagaaaguuau

SEQ ID NO: 1230143 - RNA, 23 nt, Human
gcugcauuuuuuaaagccugguu

SEQ ID NO: 1230144 - RNA, 19 nt, Human
ggaaaaaaauuuaaaaaga

SEQ ID NO: 1230145 - RNA, 24 nt, Human
uaaaaagaccaaaguuuuaugcaa

SEQ ID NO: 1230146 - RNA, 19 nt, Human
uaaaauaaucagcuaggac

SEQ ID NO: 1230147 - RNA, 21 nt, Human
uaaggcagauaugacuacaga

SEQ ID NO: 1230148 - RNA, 23 nt, Human
uaucaaaagaaggaaaauaacug

SEQ ID NO: 1230149 - RNA, 21 nt, Human
uaugggaggccagaaucuuga

SEQ ID NO: 1230150 - RNA, 25 nt, Human
ucaucuaaaacauuucucauugauu

SEQ ID NO: 1230151 - RNA, 19 nt, Human
uccuucucuucaucuuccu

SEQ ID NO: 1230152 - RNA, 19 nt, Human
ucuaccuucucugucuucc

SEQ ID NO: 1230153 - RNA, 23 nt, Human
ucugaggucaaaaaaacuaaggc

SEQ ID NO: 1230154 - RNA, 21 nt, Human
ucuuccuucucuucaucuucc

SEQ ID NO: 1230155 - RNA, 23 nt, Human
ugaaauugcaaagcucacaucua

SEQ ID NO: 1230156 - RNA, 18 nt, Human
ugaacauuucucuucuac

SEQ ID NO: 1230157 - RNA, 23 nt, Human
ugaacauuucucuucuacagccu

SEQ ID NO: 1230158 - RNA, 26 nt, Human
ugaacuuucaacuggcaaacaacuuu

SEQ ID NO: 1230159 - RNA, 24 nt, Human
ugcuacuuucaucugaggucaaaa

SEQ ID NO: 1230160 - RNA, 23 nt, Human
ugcuucuuucaaaagcucuucca

SEQ ID NO: 1230161 - RNA, 20 nt, Human
uggaaaaaaauuuaaaaaga

SEQ ID NO: 1230162 - RNA, 22 nt, Human
uggaacacaaaauaacauuccc

SEQ ID NO: 1230163 - RNA, 20 nt, Human
uguaugcacauauaaaugca

SEQ ID NO: 1230164 - RNA, 20 nt, Human
uugaaggauaaaaguaguaa

SEQ ID NO: 1230165 - RNA, 18 nt, Human
uuuccugguucccaguca

SEQ ID NO: 1230166 - RNA, 21 nt, Human
uuuggaaccaaucuucccaag

SEQ ID NO: 1230167 - RNA, 24 nt, Human
uuuuuauuaccaauauacaaagua

SEQ ID NO: 1230168 - RNA, 22 nt, Human
aagggaauguggaggucugggc

SEQ ID NO: 1230169 - RNA, 23 nt, Human
aagggaauguggaggucugggcu

SEQ ID NO: 1230170 - RNA, 25 nt, Human
aauauuuaaggucagaacuguuuaa

SEQ ID NO: 1230171 - RNA, 24 nt, Human
acaaggaaaaauuuauucuuuuca

SEQ ID NO: 1230172 - RNA, 24 nt, Human
agaaaggaaaauaaaaauggagga

SEQ ID NO: 1230173 - RNA, 20 nt, Human
agaacuguuuaaaaagaagc

SEQ ID NO: 1230174 - RNA, 22 nt, Human
aggugguucaaggaguuuuagg

SEQ ID NO: 1230175 - RNA, 21 nt, Human
cacugcuaaaaaguuauagga

SEQ ID NO: 1230176 - RNA, 23 nt, Human
cauuuuuguucuguuucugaaaa

SEQ ID NO: 1230177 - RNA, 24 nt, Human
ccaaucuggaauucacugaacgca

SEQ ID NO: 1230178 - RNA, 20 nt, Human
cuguccacugacugaugcuu

SEQ ID NO: 1230179 - RNA, 21 nt, Human
cuguccacugacugaugcuuu

SEQ ID NO: 1230180 - RNA, 19 nt, Human
gaaacauaguauuuuugua

SEQ ID NO: 1230181 - RNA, 20 nt, Human
ggaagaagguauucuguuua

SEQ ID NO: 1230182 - RNA, 18 nt, Human
gggaauguggaggucugg

SEQ ID NO: 1230183 - RNA, 26 nt, Human
ggucugggcuucccccauauucucug

SEQ ID NO: 1230184 - RNA, 22 nt, Human
uauucuguuuauuuccugucca

SEQ ID NO: 1230185 - RNA, 24 nt, Human
uauuugaauuuccucccagaaauu

SEQ ID NO: 1230186 - RNA, 25 nt, Human
uauuuugcucuccugcagaacaagc

SEQ ID NO: 1230187 - RNA, 22 nt, Human
ucgcaaggaagaagguauucug

SEQ ID NO: 1230188 - RNA, 22 nt, Human
ucuccugcagaacaagcuuaau

SEQ ID NO: 1230189 - RNA, 23 nt, Human
ucucucuacauucucuuugguuc

SEQ ID NO: 1230190 - RNA, 24 nt, Human
ucuucaaauacuauucugaaagcc

SEQ ID NO: 1230191 - RNA, 21 nt, Human
uuagggcccucuuguccuucu

SEQ ID NO: 1230192 - RNA, 20 nt, Human
uucaagguaguuuuggaaga

SEQ ID NO: 1230193 - RNA, 19 nt, Human
uuccuguccacugacugau

SEQ ID NO: 1230194 - RNA, 19 nt, Human
uuggcaacugaaaacuuug

SEQ ID NO: 1230195 - RNA, 22 nt, Human
uuucaagguaguuuuggaagau

SEQ ID NO: 1230196 - RNA, 20 nt, Human
aauggggaguagaggaaaga

SEQ ID NO: 1230197 - RNA, 22 nt, Human
acaaaauaagauuguugaccuc

SEQ ID NO: 1230198 - RNA, 20 nt, Human
acagccagacacacguccac

SEQ ID NO: 1230199 - RNA, 21 nt, Human
agacgauuugacaaggucaag

SEQ ID NO: 1230200 - RNA, 22 nt, Human
agaggaaagaugaaguaacaag

SEQ ID NO: 1230201 - RNA, 18 nt, Human
agccgacucaggaaaccu

SEQ ID NO: 1230202 - RNA, 25 nt, Human
aucucauccuuacauagcaguucca

SEQ ID NO: 1230203 - RNA, 22 nt, Human
cagccagacacacguccacguu

SEQ ID NO: 1230204 - RNA, 20 nt, Human
cagccgacucaggaaaccua

SEQ ID NO: 1230205 - RNA, 21 nt, Human
caguuccagaaggccugggcu

SEQ ID NO: 1230206 - RNA, 24 nt, Human
cauagcaguuccagaaggccuggg

SEQ ID NO: 1230207 - RNA, 23 nt, Human
ccucaaacuccacuuugcaucuc

SEQ ID NO: 1230208 - RNA, 21 nt, Human
uaagacgauuugacaagguca

SEQ ID NO: 1230209 - RNA, 23 nt, Human
uaagacgauuugacaaggucaag

SEQ ID NO: 1230210 - RNA, 24 nt, Human
uaagacgauuugacaaggucaaga

SEQ ID NO: 1230211 - RNA, 22 nt, Human
ugaccucaaacuccacuuugca

SEQ ID NO: 1230212 - RNA, 21 nt, Human
ugaccuuuauucaagaaagca

SEQ ID NO: 1230213 - RNA, 20 nt, Human
ugacuguggccauuuuccuu

SEQ ID NO: 1230214 - RNA, 26 nt, Human
ugcaucucauccuuacauagcaguuc

SEQ ID NO: 1230215 - RNA, 21 nt, Human
uuccagaaggccugggcuucc

SEQ ID NO: 1230216 - RNA, 21 nt, Human
cacccagcagccgcuguccac

SEQ ID NO: 1230217 - RNA, 18 nt, Human
cccgaguaguugggcugc

SEQ ID NO: 1230218 - RNA, 19 nt, Human
cucauagagcacccagcag

SEQ ID NO: 1230219 - RNA, 25 nt, Human
gagcacccagcagccgcuguccacg

SEQ ID NO: 1230220 - RNA, 20 nt, Human
gcccuggaagccccgguccu

SEQ ID NO: 1230221 - RNA, 19 nt, Human
gcucaaguagggcugcagg

SEQ ID NO: 1230222 - RNA, 23 nt, Human
ggcgcaggaacuacuggaggccc

SEQ ID NO: 1230223 - RNA, 27 nt, Human
uacuggaggcccgaguaguugggcugc

SEQ ID NO: 1230224 - RNA, 25 nt, Human
uaguuuccagaugaagcaagggaua

SEQ ID NO: 1230225 - RNA, 19 nt, Human
ugggguggucgcugcugca

SEQ ID NO: 1230226 - RNA, 22 nt, Human
cagcccccggaagucggccccc

SEQ ID NO: 1230227 - RNA, 25 nt, Human
ccccccgccccagccuccgcuucaa

SEQ ID NO: 1230228 - RNA, 20 nt, Human
cccccgagagcggcgguggg

SEQ ID NO: 1230229 - RNA, 20 nt, Human
cccccggaagucggcccccg

SEQ ID NO: 1230230 - RNA, 24 nt, Human
ccccgccccagccuccgcuucaac

SEQ ID NO: 1230231 - RNA, 24 nt, Human
ccccggccgcgccggcugcccccc

SEQ ID NO: 1230232 - RNA, 21 nt, Human
cccggaagucggcccccgaga

SEQ ID NO: 1230233 - RNA, 23 nt, Human
ccgagagcggcggugggcuccuc

SEQ ID NO: 1230234 - RNA, 18 nt, Human
ccgcgccggcugcccccc

SEQ ID NO: 1230235 - RNA, 20 nt, Human
ccggcugccccccgccccag

SEQ ID NO: 1230236 - RNA, 26 nt, Human
cgccccagccuccgcuucaacggcuc

SEQ ID NO: 1230237 - RNA, 23 nt, Human
cggcugccccccgccccagccuc

SEQ ID NO: 1230238 - RNA, 24 nt, Human
cuccgcuucaacggcucagccccc

SEQ ID NO: 1230239 - RNA, 18 nt, Human
cugcgccuccugccccgg

SEQ ID NO: 1230240 - RNA, 20 nt, Human
gccccagccuccgcuucaac

SEQ ID NO: 1230241 - RNA, 18 nt, Human
gcgccuccugccccggcc

SEQ ID NO: 1230242 - RNA, 20 nt, Human
uaacuuuccucaaacagcag

SEQ ID NO: 1230243 - RNA, 20 nt, Human
ucggcccccgagagcggcgg

SEQ ID NO: 1230244 - RNA, 23 nt, Human
uggcagcuuuuucaucacugcug

SEQ ID NO: 1230245 - RNA, 19 nt, Human
uuuuucaucacugcugccu

SEQ ID NO: 1230246 - RNA, 26 nt, Human
uuuuucaucacugcugccuaccaagu

SEQ ID NO: 1230247 - RNA, 23 nt, Human
ccagaugcucagcaauucuagug

SEQ ID NO: 1230248 - RNA, 19 nt, Human
uauguggaauaguguaggg

SEQ ID NO: 1230249 - RNA, 20 nt, Human
aaaguuuuugaccuuggaca

SEQ ID NO: 1230250 - RNA, 19 nt, Human
aacauggaagcagucaaaa

SEQ ID NO: 1230251 - RNA, 23 nt, Human
aagaagcuggucucagaguggug

SEQ ID NO: 1230252 - RNA, 21 nt, Human
aauacguugcccacuccacuu

SEQ ID NO: 1230253 - RNA, 21 nt, Human
accuuggacaugaacagcaag

SEQ ID NO: 1230254 - RNA, 20 nt, Human
acuguguggacaugacuggu

SEQ ID NO: 1230255 - RNA, 20 nt, Human
agacccggauggugagggug

SEQ ID NO: 1230256 - RNA, 22 nt, Human
agaguagggugcguggcuugaa

SEQ ID NO: 1230257 - RNA, 25 nt, Human
agagucuuucacccaauaucugcuu

SEQ ID NO: 1230258 - RNA, 19 nt, Human
agccagucccuaaagaccc

SEQ ID NO: 1230259 - RNA, 22 nt, Human
agccucuuucacaugguaggcu

SEQ ID NO: 1230260 - RNA, 18 nt, Human
agcuccaauaacaugcca

SEQ ID NO: 1230261 - RNA, 23 nt, Human
aggucccccacauacagcgaggc

SEQ ID NO: 1230262 - RNA, 22 nt, Human
aucacacagugcuuucucaacg

SEQ ID NO: 1230263 - RNA, 22 nt, Human
caaaguguacagauccacagcc

SEQ ID NO: 1230264 - RNA, 21 nt, Human
cacauacagcgaggccaugug

SEQ ID NO: 1230265 - RNA, 21 nt, Human
cagcugcuuccugugucucaa

SEQ ID NO: 1230266 - RNA, 21 nt, Human
caguugguacaacaguagcac

SEQ ID NO: 1230267 - RNA, 19 nt, Human
cccccacauacagcgaggc

SEQ ID NO: 1230268 - RNA, 23 nt, Human
cgagcagcugagcggauagccaa

SEQ ID NO: 1230269 - RNA, 28 nt, Human
cuccaauaacaugccagugagguacccc

SEQ ID NO: 1230270 - RNA, 20 nt, Human
cuucugcugcugaagagggg

SEQ ID NO: 1230271 - RNA, 20 nt, Human
cuuguaguacaacuacagcu

SEQ ID NO: 1230272 - RNA, 22 nt, Human
gaaccugugaagaagcuggucu

SEQ ID NO: 1230273 - RNA, 25 nt, Human
gagaauuccugaagcauauuuguac

SEQ ID NO: 1230274 - RNA, 22 nt, Human
gagccagucccuaaagacccgg

SEQ ID NO: 1230275 - RNA, 21 nt, Human
gcgauagaucgcgcugagacc

SEQ ID NO: 1230276 - RNA, 20 nt, Human
ggacacguagcccacgaaga

SEQ ID NO: 1230277 - RNA, 22 nt, Human
gguggucccugaucaauuuuaa

SEQ ID NO: 1230278 - RNA, 18 nt, Human
guagcccacgaagaggug

SEQ ID NO: 1230279 - RNA, 23 nt, Human
gugacaggaggagagcgagugcc

SEQ ID NO: 1230280 - RNA, 21 nt, Human
guggagccagcagcagcagcu

SEQ ID NO: 1230281 - RNA, 23 nt, Human
uaacaucaaaguucaugguggcc

SEQ ID NO: 1230282 - RNA, 20 nt, Human
uagcaacauacuguguggac

SEQ ID NO: 1230283 - RNA, 25 nt, Human
ucaauagcuccuucagcugcuuccu

SEQ ID NO: 1230284 - RNA, 19 nt, Human
ucccccacauacagcgagg

SEQ ID NO: 1230285 - RNA, 19 nt, Human
ugaggaaugagaauuccug

SEQ ID NO: 1230286 - RNA, 21 nt, Human
ugcugcugaagaggggcagau

SEQ ID NO: 1230287 - RNA, 23 nt, Human
ugcuuucuggagccucuuucaca

SEQ ID NO: 1230288 - RNA, 23 nt, Human
uguacagauccacagcccuuaga

SEQ ID NO: 1230289 - RNA, 18 nt, Human
uguaguacaacuacagcu

SEQ ID NO: 1230290 - RNA, 24 nt, Human
ugugguagcugggggcgcuggggu

SEQ ID NO: 1230291 - RNA, 22 nt, Human
uguguggacaugacugguggaa

SEQ ID NO: 1230292 - RNA, 19 nt, Human
uuaagcaguugguacaaca

SEQ ID NO: 1230293 - RNA, 22 nt, Human
aagcuucguaaagacaaggaaa

SEQ ID NO: 1230294 - RNA, 21 nt, Human
ccuccaguuccuugaacaaac

SEQ ID NO: 1230295 - RNA, 24 nt, Human
cucagaaugaaagcuucguaaaga

SEQ ID NO: 1230296 - RNA, 20 nt, Human
gcucaucccugcuggguucc

SEQ ID NO: 1230297 - RNA, 22 nt, Human
uggcuccugauuuucuugcccu

SEQ ID NO: 1230298 - RNA, 19 nt, Human
ugucucucuccacucccuc

SEQ ID NO: 1230299 - RNA, 21 nt, Human
aaggugccgccaggcuagagg

SEQ ID NO: 1230300 - RNA, 21 nt, Human
acacagcucuugugcaccucu

SEQ ID NO: 1230301 - RNA, 25 nt, Human
acagggaaguuggguggcuuccggg

SEQ ID NO: 1230302 - RNA, 21 nt, Human
accccauucugggcccgucuu

SEQ ID NO: 1230303 - RNA, 18 nt, Human
acuagccagcugggaccg

SEQ ID NO: 1230304 - RNA, 19 nt, Human
acucccgaccccauucugg

SEQ ID NO: 1230305 - RNA, 19 nt, Human
agccuggggguccgagacu

SEQ ID NO: 1230306 - RNA, 20 nt, Human
agcgccggggcccugcccag

SEQ ID NO: 1230307 - RNA, 21 nt, Human
aggacagugccaccaggcucu

SEQ ID NO: 1230308 - RNA, 18 nt, Human
aggacaucaggcguguga

SEQ ID NO: 1230309 - RNA, 20 nt, Human
aggcuccgagguuugcuuca

SEQ ID NO: 1230310 - RNA, 18 nt, Human
aggcugcuuguuuugaag

SEQ ID NO: 1230311 - RNA, 20 nt, Human
agggaaguuggguggcuucc

SEQ ID NO: 1230312 - RNA, 23 nt, Human
agggaaguuggguggcuuccggg

SEQ ID NO: 1230313 - RNA, 19 nt, Human
aggugcuggccagggcugg

SEQ ID NO: 1230314 - RNA, 20 nt, Human
auggcacucaggagcugcug

SEQ ID NO: 1230315 - RNA, 24 nt, Human
caccucgaagaaggcggauccgaa

SEQ ID NO: 1230316 - RNA, 23 nt, Human
cacggcccaggcuccccagcgcc

SEQ ID NO: 1230317 - RNA, 23 nt, Human
cagcaggucauccaucuuauagc

SEQ ID NO: 1230318 - RNA, 19 nt, Human
cagcauggaaggcugcccg

SEQ ID NO: 1230319 - RNA, 18 nt, Human
cagggcaccucuccagcg

SEQ ID NO: 1230320 - RNA, 24 nt, Human
caguaaaucucaucccugaaagac

SEQ ID NO: 1230321 - RNA, 19 nt, Human
cagucagacaccucccuca

SEQ ID NO: 1230322 - RNA, 21 nt, Human
ccacagcccuguccucagcag

SEQ ID NO: 1230323 - RNA, 18 nt, Human
ccacugucuuguccuuau

SEQ ID NO: 1230324 - RNA, 21 nt, Human
ccagccccgggccaggcugcu

SEQ ID NO: 1230325 - RNA, 24 nt, Human
cccagucagacaccucccucaagg

SEQ ID NO: 1230326 - RNA, 22 nt, Human
cccgucuuuuggccucccuggg

SEQ ID NO: 1230327 - RNA, 22 nt, Human
cccugcccagccuccuccucuc

SEQ ID NO: 1230328 - RNA, 24 nt, Human
ccggggcccugcccagccuccucc

SEQ ID NO: 1230329 - RNA, 23 nt, Human
ccggucguuguugaacugggccu

SEQ ID NO: 1230330 - RNA, 18 nt, Human
ccucagcagccgcgcccu

SEQ ID NO: 1230331 - RNA, 23 nt, Human
ccucccgcgaacacuuguggaau

SEQ ID NO: 1230332 - RNA, 19 nt, Human
ccuccugagaaccugcugg

SEQ ID NO: 1230333 - RNA, 22 nt, Human
ccucugagaggucccauaugca

SEQ ID NO: 1230334 - RNA, 23 nt, Human
ccucugagaggucccauaugcag

SEQ ID NO: 1230335 - RNA, 19 nt, Human
ccugcuggguucuggucca

SEQ ID NO: 1230336 - RNA, 18 nt, Human
cgccaaggacaggcccug

SEQ ID NO: 1230337 - RNA, 19 nt, Human
cgcgcccuuugcacagccc

SEQ ID NO: 1230338 - RNA, 21 nt, Human
cggcccaggcuccccagcgcc

SEQ ID NO: 1230339 - RNA, 21 nt, Human
cucgcacagcaggcggcugcc

SEQ ID NO: 1230340 - RNA, 19 nt, Human
cugcgcuggagucggcugu

SEQ ID NO: 1230341 - RNA, 21 nt, Human
cugggcccgucuuuuggccuc

SEQ ID NO: 1230342 - RNA, 24 nt, Human
cugggggcuggaggaggagaggag

SEQ ID NO: 1230343 - RNA, 22 nt, Human
cuuggagccccgcugcuuguuc

SEQ ID NO: 1230344 - RNA, 18 nt, Human
gaaagacacagaccauua

SEQ ID NO: 1230345 - RNA, 18 nt, Human
gaagaaggcggauccgaa

SEQ ID NO: 1230346 - RNA, 18 nt, Human
gaaggugggccaccggca

SEQ ID NO: 1230347 - RNA, 20 nt, Human
gaaguacaccugguagggga

SEQ ID NO: 1230348 - RNA, 21 nt, Human
gaaguucuccgagagcugcuu

SEQ ID NO: 1230349 - RNA, 20 nt, Human
gaccuggggaaggggaaggu

SEQ ID NO: 1230350 - RNA, 27 nt, Human
gagaaccugcuggguucugguccagug

SEQ ID NO: 1230351 - RNA, 22 nt, Human
gagagggccugggaaggugccg

SEQ ID NO: 1230352 - RNA, 20 nt, Human
gagcuggcucugcuccagga

SEQ ID NO: 1230353 - RNA, 21 nt, Human
gccacagcccuguccucagca

SEQ ID NO: 1230354 - RNA, 18 nt, Human
gccccgggccaggcugcu

SEQ ID NO: 1230355 - RNA, 22 nt, Human
gcccgccaaggacaggcccugg

SEQ ID NO: 1230356 - RNA, 26 nt, Human
gcccugcccagccuccuccucucuca

SEQ ID NO: 1230357 - RNA, 24 nt, Human
gccgaggcagaggcugagcaggau

SEQ ID NO: 1230358 - RNA, 22 nt, Human
gcuccaggaguuuuuauugaac

SEQ ID NO: 1230359 - RNA, 18 nt, Human
gcuggaggaggagaggag

SEQ ID NO: 1230360 - RNA, 18 nt, Human
gcuucaggaagcagcagg

SEQ ID NO: 1230361 - RNA, 23 nt, Human
ggaggaggagaggagacaggggu

SEQ ID NO: 1230362 - RNA, 18 nt, Human
ggauccagccccgggcca

SEQ ID NO: 1230363 - RNA, 24 nt, Human
ggcccgucuuuuggccucccuggg

SEQ ID NO: 1230364 - RNA, 23 nt, Human
ggccugggugcugcgcuggaguc

SEQ ID NO: 1230365 - RNA, 23 nt, Human
ggcugagugggcuuuguaugggg

SEQ ID NO: 1230366 - RNA, 23 nt, Human
ggcugcccgccaaggacaggccc

SEQ ID NO: 1230367 - RNA, 30 nt, Human
ggcuggggccuuggagccccgcugcuuguu

SEQ ID NO: 1230368 - RNA, 18 nt, Human
ggcuucaggaagcagcag

SEQ ID NO: 1230369 - RNA, 18 nt, Human
gggaagggcgccugagca

SEQ ID NO: 1230370 - RNA, 21 nt, Human
gggcugagugggcuuuguaug

SEQ ID NO: 1230371 - RNA, 18 nt, Human
ggguggggugggguuggg

SEQ ID NO: 1230372 - RNA, 21 nt, Human
gguaggggagcgucacggggg

SEQ ID NO: 1230373 - RNA, 20 nt, Human
ggugcugccgcugcuccagc

SEQ ID NO: 1230374 - RNA, 21 nt, Human
guuggguggcuuccggggacu

SEQ ID NO: 1230375 - RNA, 20 nt, Human
uaggagaguaggcugggggc

SEQ ID NO: 1230376 - RNA, 22 nt, Human
uaggagaguaggcugggggcug

SEQ ID NO: 1230377 - RNA, 21 nt, Human
uagguggugagcagguccuug

SEQ ID NO: 1230378 - RNA, 18 nt, Human
ucagcaggucauccaucu

SEQ ID NO: 1230379 - RNA, 20 nt, Human
ucaggaagcagcagguucuc

SEQ ID NO: 1230380 - RNA, 19 nt, Human
ucaggcgugugagguucuc

SEQ ID NO: 1230381 - RNA, 22 nt, Human
ucauggcacucaggagcugcug

SEQ ID NO: 1230382 - RNA, 21 nt, Human
uccagcgccggggcccugccc

SEQ ID NO: 1230383 - RNA, 23 nt, Human
ucccuggagauauguugagccac

SEQ ID NO: 1230384 - RNA, 19 nt, Human
ucccugggcagcgcccagg

SEQ ID NO: 1230385 - RNA, 21 nt, Human
ucccugggcagcgcccaggac

SEQ ID NO: 1230386 - RNA, 22 nt, Human
uccgagacucccgaccccauuc

SEQ ID NO: 1230387 - RNA, 21 nt, Human
uccgcgcagguacuugggcag

SEQ ID NO: 1230388 - RNA, 22 nt, Human
uccucagcagccgcgcccuuug

SEQ ID NO: 1230389 - RNA, 23 nt, Human
uccuucuggcugaugaccugggg

SEQ ID NO: 1230390 - RNA, 18 nt, Human
ucucugagggugggaagc

SEQ ID NO: 1230391 - RNA, 19 nt, Human
ucugcauucacauccuucc

SEQ ID NO: 1230392 - RNA, 20 nt, Human
ucuuuuggccucccugggca

SEQ ID NO: 1230393 - RNA, 20 nt, Human
ugagagggccugggaaggug

SEQ ID NO: 1230394 - RNA, 23 nt, Human
ugcccagccuccuccucucucag

SEQ ID NO: 1230395 - RNA, 25 nt, Human
ugcggggcugagugggcuuuguaug

SEQ ID NO: 1230396 - RNA, 23 nt, Human
ugcuccagcuggagaucuuggug

SEQ ID NO: 1230397 - RNA, 18 nt, Human
ugcucuuuuuccacuccu

SEQ ID NO: 1230398 - RNA, 23 nt, Human
uggaaggcugcccgccaaggaca

SEQ ID NO: 1230399 - RNA, 19 nt, Human
uggaugagcagaaccccau

SEQ ID NO: 1230400 - RNA, 23 nt, Human
uggcguguggagcuggcucugcu

SEQ ID NO: 1230401 - RNA, 19 nt, Human
ugggaagcagccgaggcag

SEQ ID NO: 1230402 - RNA, 21 nt, Human
ugggcacacagcucuugugca

SEQ ID NO: 1230403 - RNA, 22 nt, Human
uggggugggguugggagguguc

SEQ ID NO: 1230404 - RNA, 18 nt, Human
uggugggguggggugggg

SEQ ID NO: 1230405 - RNA, 21 nt, Human
uguauggggggcagcauggaa

SEQ ID NO: 1230406 - RNA, 23 nt, Human
ugucagucagucauccaccaaua

SEQ ID NO: 1230407 - RNA, 26 nt, Human
ugucugcauucacauccuuggacgac

SEQ ID NO: 1230408 - RNA, 22 nt, Human
ugucuuguccuuaugcuuguca

SEQ ID NO: 1230409 - RNA, 18 nt, Human
uucuggugggguggggug

SEQ ID NO: 1230410 - RNA, 20 nt, Human
uuggucuugggguggaugag

SEQ ID NO: 1230411 - RNA, 21 nt, Human
uuggugaagggauagguggug

SEQ ID NO: 1230412 - RNA, 23 nt, Human
uuguggaauccgcgcagguacuu

SEQ ID NO: 1230413 - RNA, 20 nt, Human
uuucuggggcuuguucuucc

SEQ ID NO: 1230414 - RNA, 19 nt, Human
uuuggccucccugggcagc

SEQ ID NO: 1230415 - RNA, 22 nt, Human
uuuugaaguucuccgagagcug

SEQ ID NO: 1230416 - RNA, 21 nt, Human
aaaaaagaaaucaccaaagaa

SEQ ID NO: 1230417 - RNA, 27 nt, Human
aaaaaagauaaagaaggaaauagaaga

SEQ ID NO: 1230418 - RNA, 21 nt, Human
aaaaaguagacacgcuaagga

SEQ ID NO: 1230419 - RNA, 19 nt, Human
aaaacaacaacaacaacaa

SEQ ID NO: 1230420 - RNA, 22 nt, Human
aaaacaacaacaacaacaaaac

SEQ ID NO: 1230421 - RNA, 19 nt, Human
aaaauacaacauaacaaaa

SEQ ID NO: 1230422 - RNA, 18 nt, Human
aaaauacaauauaacaga

SEQ ID NO: 1230423 - RNA, 20 nt, Human
aaacaaaaauacaacauaac

SEQ ID NO: 1230424 - RNA, 22 nt, Human
aaacacacuuacuagaugaccc

SEQ ID NO: 1230425 - RNA, 22 nt, Human
aaacaggaauaaaaaugcucag

SEQ ID NO: 1230426 - RNA, 23 nt, Human
aaacaggauagaagugaaaugag

SEQ ID NO: 1230427 - RNA, 24 nt, Human
aaacuggaaucaaagugucccuca

SEQ ID NO: 1230428 - RNA, 24 nt, Human
aaacuggguauccacaugaaaaag

SEQ ID NO: 1230429 - RNA, 20 nt, Human
aaagaaacaaauugaacuuc

SEQ ID NO: 1230430 - RNA, 23 nt, Human
aaagaaacaaauugaacuucaug

SEQ ID NO: 1230431 - RNA, 19 nt, Human
aaagcauaugaagcaaaaa

SEQ ID NO: 1230432 - RNA, 21 nt, Human
aaauacaacauaacaaaacuu

SEQ ID NO: 1230433 - RNA, 21 nt, Human
aaauacuguauaacuccacuu

SEQ ID NO: 1230434 - RNA, 21 nt, Human
aacaaauaguaaacaauuauu

SEQ ID NO: 1230435 - RNA, 21 nt, Human
aacaacaacaacaacaacaaa

SEQ ID NO: 1230436 - RNA, 22 nt, Human
aacaacgccagaguugaauuaa

SEQ ID NO: 1230437 - RNA, 25 nt, Human
aacagaguaaaaacgcaaccaacag

SEQ ID NO: 1230438 - RNA, 20 nt, Human
aaccuggaagugcagaugag

SEQ ID NO: 1230439 - RNA, 18 nt, Human
aacuacaaaaaucuuaga

SEQ ID NO: 1230440 - RNA, 19 nt, Human
aacugaaacauggaagcaa

SEQ ID NO: 1230441 - RNA, 23 nt, Human
aacugacagaauugaaggaagaa

SEQ ID NO: 1230442 - RNA, 22 nt, Human
aacuucaaaagcacacucucaa

SEQ ID NO: 1230443 - RNA, 18 nt, Human
aagaaacaaauagauuuu

SEQ ID NO: 1230444 - RNA, 18 nt, Human
aagaaauauaccaucaag

SEQ ID NO: 1230445 - RNA, 22 nt, Human
aagaagacauaaguauauccau

SEQ ID NO: 1230446 - RNA, 26 nt, Human
aagaagccagaauugaaaggcuacag

SEQ ID NO: 1230447 - RNA, 21 nt, Human
aagacagagaagaaaguaaaa

SEQ ID NO: 1230448 - RNA, 21 nt, Human
aagagugagacaguuccuuaa

SEQ ID NO: 1230449 - RNA, 23 nt, Human
aagcaaaaacugacagaauugaa

SEQ ID NO: 1230450 - RNA, 18 nt, Human
aagcagaagaaucucaaa

SEQ ID NO: 1230451 - RNA, 18 nt, Human
aagcagaagaaucucaaa

SEQ ID NO: 1230452 - RNA, 21 nt, Human
aagucugucucccuaagacuc

SEQ ID NO: 1230453 - RNA, 23 nt, Human
aagugucaacaaggauguggaga

SEQ ID NO: 1230454 - RNA, 26 nt, Human
aauaauggauagaaugacaaaaaaga

SEQ ID NO: 1230455 - RNA, 25 nt, Human
aaucacauaacgacaaauacuguau

SEQ ID NO: 1230456 - RNA, 18 nt, Human
aaucagucacaaagucaa

SEQ ID NO: 1230457 - RNA, 20 nt, Human
aaucagucacaaagucaagg

SEQ ID NO: 1230458 - RNA, 18 nt, Human
aaugacaaaaaagauaaa

SEQ ID NO: 1230459 - RNA, 22 nt, Human
aaugacaaaaaagauaaagaag

SEQ ID NO: 1230460 - RNA, 24 nt, Human
aaugacaaaaaagauaaagaagga

SEQ ID NO: 1230461 - RNA, 18 nt, Human
aauggaaaucaaaacuac

SEQ ID NO: 1230462 - RNA, 18 nt, Human
aauguaagaccaaaacua

SEQ ID NO: 1230463 - RNA, 25 nt, Human
acaaaaauuagcucagaauggauca

SEQ ID NO: 1230464 - RNA, 21 nt, Human
acaaaauggaugaacaacaug

SEQ ID NO: 1230465 - RNA, 25 nt, Human
acaacaacaaaaaauaacaaguguc

SEQ ID NO: 1230466 - RNA, 21 nt, Human
acaacaacaacaacaacaaaa

SEQ ID NO: 1230467 - RNA, 28 nt, Human
acaacaacaacaacaacaaaaaauaaca

SEQ ID NO: 1230468 - RNA, 19 nt, Human
acacugacucuguguuuug

SEQ ID NO: 1230469 - RNA, 21 nt, Human
acagaaucaucuauucaacag

SEQ ID NO: 1230470 - RNA, 28 nt, Human
acagcaacagcauacacauucuucccaa

SEQ ID NO: 1230471 - RNA, 19 nt, Human
acaggcagcaaaaguaaaa

SEQ ID NO: 1230472 - RNA, 21 nt, Human
acccaaaagaauugaaagcag

SEQ ID NO: 1230473 - RNA, 19 nt, Human
accuguauugguuuucccu

SEQ ID NO: 1230474 - RNA, 18 nt, Human
acuagaaugaaaagucug

SEQ ID NO: 1230475 - RNA, 19 nt, Human
acucaccaauaaagaaaca

SEQ ID NO: 1230476 - RNA, 20 nt, Human
acucaccaauaaagaaacaa

SEQ ID NO: 1230477 - RNA, 25 nt, Human
acucauucuuuccucugcauucccu

SEQ ID NO: 1230478 - RNA, 26 nt, Human
agaaaaaaccauccuaaaaguuguau

SEQ ID NO: 1230479 - RNA, 20 nt, Human
agaagaaagcuggaagacuc

SEQ ID NO: 1230480 - RNA, 19 nt, Human
agaagaaaguaaaagcagg

SEQ ID NO: 1230481 - RNA, 21 nt, Human
agacaguuccuuaaaaauuaa

SEQ ID NO: 1230482 - RNA, 25 nt, Human
agauaaaaaagaaaucaccaaagaa

SEQ ID NO: 1230483 - RNA, 19 nt, Human
agcaaaaguaaaagaaaca

SEQ ID NO: 1230484 - RNA, 22 nt, Human
aggaaaaggcaaaaccauaagg

SEQ ID NO: 1230485 - RNA, 28 nt, Human
aggaaaaggcaaaaccauaaggacaaaa

SEQ ID NO: 1230486 - RNA, 21 nt, Human
aggaaguagaaaaaaccaucc

SEQ ID NO: 1230487 - RNA, 20 nt, Human
aggauagaagugaaaugaaa

SEQ ID NO: 1230488 - RNA, 22 nt, Human
aggcuacaaaucugauuccauu

SEQ ID NO: 1230489 - RNA, 21 nt, Human
agggaccuuuaauagccaaag

SEQ ID NO: 1230490 - RNA, 22 nt, Human
agguuaccaccucacacccauu

SEQ ID NO: 1230491 - RNA, 21 nt, Human
aguaacagaaguaaauuggaa

SEQ ID NO: 1230492 - RNA, 21 nt, Human
aguagaaaaaaccauccuaaa

SEQ ID NO: 1230493 - RNA, 21 nt, Human
auaacagauauagccagagga

SEQ ID NO: 1230494 - RNA, 24 nt, Human
auaauacucaaaacagugugguac

SEQ ID NO: 1230495 - RNA, 24 nt, Human
auacaacauaacaaaacuuaugca

SEQ ID NO: 1230496 - RNA, 18 nt, Human
auaugauauucaggaaaa

SEQ ID NO: 1230497 - RNA, 24 nt, Human
aucuugacccauagggaaugagag

SEQ ID NO: 1230498 - RNA, 21 nt, Human
augaagcaaaaacugacagaa

SEQ ID NO: 1230499 - RNA, 23 nt, Human
augaauucuugauacaagcagaa

SEQ ID NO: 1230500 - RNA, 25 nt, Human
augacaaaaaagauaaagaaggaaa

SEQ ID NO: 1230501 - RNA, 24 nt, Human
auggcaauagaaauacuccauauc

SEQ ID NO: 1230502 - RNA, 26 nt, Human
caaaacagaucagcaguugcuagccc

SEQ ID NO: 1230503 - RNA, 22 nt, Human
caaaagaaaucaccaaaggaua

SEQ ID NO: 1230504 - RNA, 20 nt, Human
caaaauggaugaacaacaug

SEQ ID NO: 1230505 - RNA, 23 nt, Human
caaaauggaugaacaacaugucc

SEQ ID NO: 1230506 - RNA, 20 nt, Human
caaaauuagacacagaaagu

SEQ ID NO: 1230507 - RNA, 19 nt, Human
caaagaaaucacaaaagaa

SEQ ID NO: 1230508 - RNA, 22 nt, Human
caaaggcacaggcagcaaaagu

SEQ ID NO: 1230509 - RNA, 19 nt, Human
caaaucaaccaaccaacca

SEQ ID NO: 1230510 - RNA, 21 nt, Human
caaaucaaccaaccaaccaag

SEQ ID NO: 1230511 - RNA, 22 nt, Human
caaaucaaccaaccaaccaaga

SEQ ID NO: 1230512 - RNA, 23 nt, Human
caaaugauuuuugacaaggguac

SEQ ID NO: 1230513 - RNA, 25 nt, Human
caacaaaaaauaacaagugucaaca

SEQ ID NO: 1230514 - RNA, 26 nt, Human
caacaacaacaacaaaaaauaacaag

SEQ ID NO: 1230515 - RNA, 20 nt, Human
caacaacaacaacaacaaaa

SEQ ID NO: 1230516 - RNA, 19 nt, Human
caacagaguaaaaacgcaa

SEQ ID NO: 1230517 - RNA, 22 nt, Human
caacagaguaaaaacgcaacca

SEQ ID NO: 1230518 - RNA, 22 nt, Human
caacagaguggaagaaaauaau

SEQ ID NO: 1230519 - RNA, 24 nt, Human
caaccaaccaagauaaaacauguc

SEQ ID NO: 1230520 - RNA, 27 nt, Human
caacuacuggcgugaagccauucaagu

SEQ ID NO: 1230521 - RNA, 23 nt, Human
caagaacuaugucaauccaacaa

SEQ ID NO: 1230522 - RNA, 21 nt, Human
caagaagauauaccugugaua

SEQ ID NO: 1230523 - RNA, 22 nt, Human
caauaacugaaacauggaagca

SEQ ID NO: 1230524 - RNA, 24 nt, Human
caaucuugaaaaagcagaagaaag

SEQ ID NO: 1230525 - RNA, 23 nt, Human
cacauaacgacaaauacuguaua

SEQ ID NO: 1230526 - RNA, 20 nt, Human
caccacacucuuaaacaaca

SEQ ID NO: 1230527 - RNA, 23 nt, Human
cacccugcucucuuuugauuacu

SEQ ID NO: 1230528 - RNA, 23 nt, Human
cacgcuaaggaaaaagaaaaaaa

SEQ ID NO: 1230529 - RNA, 24 nt, Human
cacuuuauaaauuaaaaagcaaag

SEQ ID NO: 1230530 - RNA, 18 nt, Human
cagaaaguagaauggcug

SEQ ID NO: 1230531 - RNA, 23 nt, Human
cagaacaaaaaauuaugcccucu

SEQ ID NO: 1230532 - RNA, 23 nt, Human
cagaagaaagcuggaagacucac

SEQ ID NO: 1230533 - RNA, 24 nt, Human
cagaauggaucaaagaccuaaaug

SEQ ID NO: 1230534 - RNA, 21 nt, Human
cagcagacaauccugaggccc

SEQ ID NO: 1230535 - RNA, 23 nt, Human
cagcaguaagcacauagaaagau

SEQ ID NO: 1230536 - RNA, 18 nt, Human
cagcugcuguggaaaaga

SEQ ID NO: 1230537 - RNA, 22 nt, Human
cagcuuugcuucaaccuggaag

SEQ ID NO: 1230538 - RNA, 23 nt, Human
cauggaagcaacccaagugucca

SEQ ID NO: 1230539 - RNA, 30 nt, Human
ccacagauuaaguauaaauaaauuuaaaaa

SEQ ID NO: 1230540 - RNA, 22 nt, Human
cccaagaaaugauaguccuuua

SEQ ID NO: 1230541 - RNA, 22 nt, Human
ccccuagauccuuccagaacaa

SEQ ID NO: 1230542 - RNA, 21 nt, Human
ccuucucuuacuauucucuuc

SEQ ID NO: 1230543 - RNA, 23 nt, Human
cuaaagcauaugaagcaaaaacu

SEQ ID NO: 1230544 - RNA, 22 nt, Human
cucacacccauuaggauggcua

SEQ ID NO: 1230545 - RNA, 21 nt, Human
cucacaguuccugguuucaaa

SEQ ID NO: 1230546 - RNA, 18 nt, Human
cucagaauggaucaaaga

SEQ ID NO: 1230547 - RNA, 18 nt, Human
cucuccacaaguaaccca

SEQ ID NO: 1230548 - RNA, 21 nt, Human
cugcauucccucccucuccac

SEQ ID NO: 1230549 - RNA, 27 nt, Human
cugcuaaguuaacuaagccaaucacau

SEQ ID NO: 1230550 - RNA, 19 nt, Human
cuggggauacacccaaaag

SEQ ID NO: 1230551 - RNA, 19 nt, Human
cuucccaagugcacacgga

SEQ ID NO: 1230552 - RNA, 21 nt, Human
cuugauuugagccucccuugg

SEQ ID NO: 1230553 - RNA, 24 nt, Human
cuuggauaugacaccaaaggcaca

SEQ ID NO: 1230554 - RNA, 24 nt, Human
cuuuucccuguuguugcauagaag

SEQ ID NO: 1230555 - RNA, 26 nt, Human
gaaaaaaccauccuaaaaguuguaug

SEQ ID NO: 1230556 - RNA, 20 nt, Human
gaaauagaagacuugaauaa

SEQ ID NO: 1230557 - RNA, 22 nt, Human
gaagcuauauaugggcugaaga

SEQ ID NO: 1230558 - RNA, 21 nt, Human
gaaguaaauuggaaaauucac

SEQ ID NO: 1230559 - RNA, 18 nt, Human
gaauggaucaaagaccua

SEQ ID NO: 1230560 - RNA, 22 nt, Human
gacagcccugaaauaaacccug

SEQ ID NO: 1230561 - RNA, 24 nt, Human
gagaagaaaguaaaagcagggggg

SEQ ID NO: 1230562 - RNA, 19 nt, Human
gaggagggggauuaugaca

SEQ ID NO: 1230563 - RNA, 19 nt, Human
gaggcccauucuaauggcu

SEQ ID NO: 1230564 - RNA, 19 nt, Human
gagguugguuuuggauacu

SEQ ID NO: 1230565 - RNA, 21 nt, Human
gauacacccaaaagaauugaa

SEQ ID NO: 1230566 - RNA, 18 nt, Human
gaucacaucucugaucua

SEQ ID NO: 1230567 - RNA, 27 nt, Human
gauggaagguggugaugauugcacagu

SEQ ID NO: 1230568 - RNA, 19 nt, Human
gcagacaauccugaggccc

SEQ ID NO: 1230569 - RNA, 18 nt, Human
gcuaagugcaagaagcca

SEQ ID NO: 1230570 - RNA, 23 nt, Human
gcuaccauuaaaacaacaacaac

SEQ ID NO: 1230571 - RNA, 24 nt, Human
ggaaaaggcaaaaccauaaggaca

SEQ ID NO: 1230572 - RNA, 19 nt, Human
ggaaauagaagacuugaau

SEQ ID NO: 1230573 - RNA, 23 nt, Human
gggaaugagagcugaugcauaau

SEQ ID NO: 1230574 - RNA, 23 nt, Human
ggggagaggggauugagcagaaa

SEQ ID NO: 1230575 - RNA, 19 nt, Human
gggugccuggcauucagcu

SEQ ID NO: 1230576 - RNA, 20 nt, Human
gguggugaugauugcacagu

SEQ ID NO: 1230577 - RNA, 21 nt, Human
guaaaaacgcaaccaacagag

SEQ ID NO: 1230578 - RNA, 23 nt, Human
guaaacugugggcagaacuucau

SEQ ID NO: 1230579 - RNA, 21 nt, Human
gugaaacuagugcuaagauaa

SEQ ID NO: 1230580 - RNA, 19 nt, Human
gugccauguggaacagaau

SEQ ID NO: 1230581 - RNA, 20 nt, Human
guggugguuagucaacugua

SEQ ID NO: 1230582 - RNA, 25 nt, Human
uaaaacaacaacaacaacaacaaaa

SEQ ID NO: 1230583 - RNA, 24 nt, Human
uaaaaugagcaaagggcuuaagua

SEQ ID NO: 1230584 - RNA, 24 nt, Human
uaaagacagagaagaaaguaaaag

SEQ ID NO: 1230585 - RNA, 19 nt, Human
uaagauguccauacuaccc

SEQ ID NO: 1230586 - RNA, 19 nt, Human
uaagggaaauggaaaucaa

SEQ ID NO: 1230587 - RNA, 21 nt, Human
uaagggaaauggaaaucaaaa

SEQ ID NO: 1230588 - RNA, 18 nt, Human
uaagugcaagaagccaga

SEQ ID NO: 1230589 - RNA, 27 nt, Human
uaauaguuggaaacuucaaaagcacac

SEQ ID NO: 1230590 - RNA, 22 nt, Human
uaauuaccauaugguuuagcug

SEQ ID NO: 1230591 - RNA, 21 nt, Human
uacaaaaaaagaguagugaug

SEQ ID NO: 1230592 - RNA, 22 nt, Human
uacaaaucaaccaaccaaccaa

SEQ ID NO: 1230593 - RNA, 24 nt, Human
uacacagaaucaucuauucaacag

SEQ ID NO: 1230594 - RNA, 20 nt, Human
uacacauuugucaaaacaca

SEQ ID NO: 1230595 - RNA, 23 nt, Human
uaccaagcuuggccaagaagaua

SEQ ID NO: 1230596 - RNA, 21 nt, Human
uaccacaaaaacaugaaaaag

SEQ ID NO: 1230597 - RNA, 26 nt, Human
uaccacaaaaacaugaaaaaguagac

SEQ ID NO: 1230598 - RNA, 24 nt, Human
uaccauuaaaacaacaacaacaac

SEQ ID NO: 1230599 - RNA, 19 nt, Human
uacuccauaucuugaccau

SEQ ID NO: 1230600 - RNA, 24 nt, Human
uacuggcauaaaaaccaauggaau

SEQ ID NO: 1230601 - RNA, 21 nt, Human
uagaaaaaaccauccuaaaag

SEQ ID NO: 1230602 - RNA, 22 nt, Human
uagaaugaaaagucugucuccc

SEQ ID NO: 1230603 - RNA, 24 nt, Human
uagaauggcuguuuucagggcuug

SEQ ID NO: 1230604 - RNA, 19 nt, Human
uagcagcauuauucacaau

SEQ ID NO: 1230605 - RNA, 20 nt, Human
uagccaaaaucccauagauu

SEQ ID NO: 1230606 - RNA, 21 nt, Human
uagugccauguggaacagaau

SEQ ID NO: 1230607 - RNA, 23 nt, Human
uaucaacagaguaaaaacgcaac

SEQ ID NO: 1230608 - RNA, 23 nt, Human
uaugacugaauacuggguaacaa

SEQ ID NO: 1230609 - RNA, 21 nt, Human
uaugcaauguagugaaacuag

SEQ ID NO: 1230610 - RNA, 21 nt, Human
uauuuccuuuagguagaaaaa

SEQ ID NO: 1230611 - RNA, 22 nt, Human
ucaaaagcacacucucaauaau

SEQ ID NO: 1230612 - RNA, 19 nt, Human
ucagucacaaagucaaggc

SEQ ID NO: 1230613 - RNA, 22 nt, Human
uccacaaguaacccauuucuga

SEQ ID NO: 1230614 - RNA, 22 nt, Human
uccacaugaaaaagaauaaagu

SEQ ID NO: 1230615 - RNA, 22 nt, Human
uccagaacaaaaaauuaugccc

SEQ ID NO: 1230616 - RNA, 23 nt, Human
uccccaggaggaaaucuugaccc

SEQ ID NO: 1230617 - RNA, 21 nt, Human
ucccuaagacucucauaccaa

SEQ ID NO: 1230618 - RNA, 18 nt, Human
ucccuaucaaaaucucaa

SEQ ID NO: 1230619 - RNA, 20 nt, Human
ucuaaaccaucauccaguag

SEQ ID NO: 1230620 - RNA, 21 nt, Human
ucuaaaccaucauccaguagg

SEQ ID NO: 1230621 - RNA, 22 nt, Human
ucuacaguaauaguuggaaacu

SEQ ID NO: 1230622 - RNA, 21 nt, Human
ucuaggaaacaaauaguaaac

SEQ ID NO: 1230623 - RNA, 21 nt, Human
ucuauggcaauagaaauacuc

SEQ ID NO: 1230624 - RNA, 21 nt, Human
ucuauuauugcuaccugggau

SEQ ID NO: 1230625 - RNA, 23 nt, Human
ucucagggaccuuuaauagccaa

SEQ ID NO: 1230626 - RNA, 22 nt, Human
ucugaaauucucuuuucccugu

SEQ ID NO: 1230627 - RNA, 18 nt, Human
ucugcauucccucccucu

SEQ ID NO: 1230628 - RNA, 21 nt, Human
ucugcauucccucccucucca

SEQ ID NO: 1230629 - RNA, 19 nt, Human
ucuuacuauucucuucugg

SEQ ID NO: 1230630 - RNA, 22 nt, Human
ucuuggauaugacaccaaaggc

SEQ ID NO: 1230631 - RNA, 23 nt, Human
ugaaacauggaagcaacccaagu

SEQ ID NO: 1230632 - RNA, 24 nt, Human
ugaaacauggaagcaacccaagug

SEQ ID NO: 1230633 - RNA, 21 nt, Human
ugaagcaaaaacugacagaau

SEQ ID NO: 1230634 - RNA, 19 nt, Human
ugaaggaagaaauagacag

SEQ ID NO: 1230635 - RNA, 20 nt, Human
ugaauaagcaaaauguagua

SEQ ID NO: 1230636 - RNA, 25 nt, Human
ugaauagacagcccugaaauaaacc

SEQ ID NO: 1230637 - RNA, 19 nt, Human
ugaaugaauaagcaaaaug

SEQ ID NO: 1230638 - RNA, 19 nt, Human
ugacaaggguaccaagaug

SEQ ID NO: 1230639 - RNA, 20 nt, Human
ugacaccaaaggcacaggca

SEQ ID NO: 1230640 - RNA, 24 nt, Human
ugacaccaaaggcacaggcagcaa

SEQ ID NO: 1230641 - RNA, 21 nt, Human
ugacguagccaaaaucccaua

SEQ ID NO: 1230642 - RNA, 22 nt, Human
ugacguuucugaggaaguagaa

SEQ ID NO: 1230643 - RNA, 20 nt, Human
ugagcaaagggcuuaaguag

SEQ ID NO: 1230644 - RNA, 22 nt, Human
ugagcaaagggcuuaaguagac

SEQ ID NO: 1230645 - RNA, 22 nt, Human
ugaugauggaagguggugauga

SEQ ID NO: 1230646 - RNA, 21 nt, Human
ugcauucccucccucuccaca

SEQ ID NO: 1230647 - RNA, 18 nt, Human
ugccauguggaacagaau

SEQ ID NO: 1230648 - RNA, 18 nt, Human
ugcccccuagauccuucc

SEQ ID NO: 1230649 - RNA, 22 nt, Human
ugcuacaaagcuauaauacuca

SEQ ID NO: 1230650 - RNA, 31 nt, Human
ugcucuacaaguguaaacaggaauaaaaauu

SEQ ID NO: 1230651 - RNA, 20 nt, Human
ugcuucaaccuggaagugca

SEQ ID NO: 1230652 - RNA, 25 nt, Human
uggaaaauucacaaauuugugaaaa

SEQ ID NO: 1230653 - RNA, 22 nt, Human
uggaagacucacaguuccuggu

SEQ ID NO: 1230654 - RNA, 21 nt, Human
uggaagguggugaugauugca

SEQ ID NO: 1230655 - RNA, 24 nt, Human
uggaaucaaagugucccucaacug

SEQ ID NO: 1230656 - RNA, 21 nt, Human
uggauagaaugacaaaaaaga

SEQ ID NO: 1230657 - RNA, 18 nt, Human
uggaugaacaacaugucc

SEQ ID NO: 1230658 - RNA, 20 nt, Human
uggcaaaaggaugaaguuag

SEQ ID NO: 1230659 - RNA, 24 nt, Human
uggcaaaaggaugaaguuagaaau

SEQ ID NO: 1230660 - RNA, 18 nt, Human
ugggcagaacuucauugc

SEQ ID NO: 1230661 - RNA, 19 nt, Human
uggggauggggagagggga

SEQ ID NO: 1230662 - RNA, 19 nt, Human
ugggugccuggcauucagc

SEQ ID NO: 1230663 - RNA, 24 nt, Human
uguaaacaggaauaaaaaugcuca

SEQ ID NO: 1230664 - RNA, 24 nt, Human
ugucaacaaggauguggagaaacu

SEQ ID NO: 1230665 - RNA, 25 nt, Human
ugugaauuucuucuuuagcaaguuu

SEQ ID NO: 1230666 - RNA, 21 nt, Human
ugugauauacauuuacauacu

SEQ ID NO: 1230667 - RNA, 22 nt, Human
uguggagaaacuggaacccuug

SEQ ID NO: 1230668 - RNA, 23 nt, Human
uguggugacauuuaaaauccacu

SEQ ID NO: 1230669 - RNA, 18 nt, Human
uguuuugguaaagaaaua

SEQ ID NO: 1230670 - RNA, 19 nt, Human
uuaaaacaacaacaacaac

SEQ ID NO: 1230671 - RNA, 24 nt, Human
uuaacaacgccagaguugaauuaa

SEQ ID NO: 1230672 - RNA, 24 nt, Human
uuaagugguaaaauguacaaaaaa

SEQ ID NO: 1230673 - RNA, 28 nt, Human
uuaguaaucucaccuguauugguuuucc

SEQ ID NO: 1230674 - RNA, 22 nt, Human
uucacaauaacugaaacaugga

SEQ ID NO: 1230675 - RNA, 22 nt, Human
uucagcagacaauccugaggcc

SEQ ID NO: 1230676 - RNA, 25 nt, Human
uucauagcagcauuauucacaauaa

SEQ ID NO: 1230677 - RNA, 19 nt, Human
uuccauccuccacuuucaa

SEQ ID NO: 1230678 - RNA, 23 nt, Human
uuccuuuagguagaaaaauacaa

SEQ ID NO: 1230679 - RNA, 22 nt, Human
uucuuuagcaaguuuauucuaa

SEQ ID NO: 1230680 - RNA, 25 nt, Human
uuggaaaacagcuuggcaacucuua

SEQ ID NO: 1230681 - RNA, 21 nt, Human
uuuccaacaaagcacagugac

SEQ ID NO: 1230682 - RNA, 20 nt, Human
uuuugagguucuaggaaaca

SEQ ID NO: 1230683 - RNA, 19 nt, Human
ugguaagugaggugccuuc

SEQ ID NO: 1230684 - RNA, 23 nt, Human
aaaacaaauauggacacaagaca

SEQ ID NO: 1230685 - RNA, 18 nt, Human
aagcccggggcugcgcgg

SEQ ID NO: 1230686 - RNA, 22 nt, Human
aagcccggggcugcgcgggaga

SEQ ID NO: 1230687 - RNA, 24 nt, Human
accacaaaacaaauauggacacaa

SEQ ID NO: 1230688 - RNA, 22 nt, Human
agaaaggacugacuagagcuca

SEQ ID NO: 1230689 - RNA, 27 nt, Human
agacaaaaaguaacugaaaggggaccc

SEQ ID NO: 1230690 - RNA, 25 nt, Human
aguuuucaacuuaacauaggucaca

SEQ ID NO: 1230691 - RNA, 23 nt, Human
auggacacaagacaaaaaguaac

SEQ ID NO: 1230692 - RNA, 24 nt, Human
caaaaaguaacugaaaggggagaa

SEQ ID NO: 1230693 - RNA, 27 nt, Human
cacaaaacaaauauggacacaagacaa

SEQ ID NO: 1230694 - RNA, 24 nt, Human
cagaaaggacugacuagagcucag

SEQ ID NO: 1230695 - RNA, 25 nt, Human
cagaaauuucccuucugaaggaagg

SEQ ID NO: 1230696 - RNA, 25 nt, Human
ccgggcaacggcggucaaggcuccu

SEQ ID NO: 1230697 - RNA, 20 nt, Human
cgggagagggccgggcaacg

SEQ ID NO: 1230698 - RNA, 23 nt, Human
gcggaagcccggggcugcgcggg

SEQ ID NO: 1230699 - RNA, 21 nt, Human
gcuccuggccucagacgguug

SEQ ID NO: 1230700 - RNA, 19 nt, Human
gggcaacggcggucaaggc

SEQ ID NO: 1230701 - RNA, 22 nt, Human
uacagauuccccuuccugaccc

SEQ ID NO: 1230702 - RNA, 19 nt, Human
ucagacgguugcucgucgg

SEQ ID NO: 1230703 - RNA, 21 nt, Human
ugacccucagaaauuucccuu

SEQ ID NO: 1230704 - RNA, 24 nt, Human
ugacuagagcucaguaaacaacau

SEQ ID NO: 1230705 - RNA, 19 nt, Human
ugagguacagauuccccuu

SEQ ID NO: 1230706 - RNA, 19 nt, Human
ugcgcgggagagggccggg

SEQ ID NO: 1230707 - RNA, 20 nt, Human
uguuggaguauauaaauuau

SEQ ID NO: 1230708 - RNA, 18 nt, Human
uuauuauguauccccgcc

SEQ ID NO: 1230709 - RNA, 21 nt, Human
uucugaaggaaggacugcgga

SEQ ID NO: 1230710 - RNA, 26 nt, Human
uuugguuucccaauauuccuuccuug

SEQ ID NO: 1230711 - RNA, 19 nt, Human
aaagcacgggggagggcag

SEQ ID NO: 1230712 - RNA, 23 nt, Human
aaagcagcauggcaagaccuaga

SEQ ID NO: 1230713 - RNA, 23 nt, Human
agagcacuuccuuguccccgcuc

SEQ ID NO: 1230714 - RNA, 19 nt, Human
agaggcggcucgcggcggg

SEQ ID NO: 1230715 - RNA, 20 nt, Human
ccaggucagaggggaaagca

SEQ ID NO: 1230716 - RNA, 20 nt, Human
cccgggccaccaccuucaag

SEQ ID NO: 1230717 - RNA, 21 nt, Human
cccgggccaccaccuucaagg

SEQ ID NO: 1230718 - RNA, 24 nt, Human
cuuagugggaaaaaaaacccuuua

SEQ ID NO: 1230719 - RNA, 21 nt, Human
gagaggcggcucgcggcgggu

SEQ ID NO: 1230720 - RNA, 31 nt, Human
ggaaaaaaaacccuuuaggacugagucucgg

SEQ ID NO: 1230721 - RNA, 20 nt, Human
ggaacagcaccugcuggaca

SEQ ID NO: 1230722 - RNA, 21 nt, Human
ggagaaccaacccaggucaga

SEQ ID NO: 1230723 - RNA, 20 nt, Human
gggagaggcggcucgcggcg

SEQ ID NO: 1230724 - RNA, 22 nt, Human
ggggagggcaggguugagucgg

SEQ ID NO: 1230725 - RNA, 23 nt, Human
ggggagggcaggguugagucggg

SEQ ID NO: 1230726 - RNA, 18 nt, Human
uaagagcacuuccuuguc

SEQ ID NO: 1230727 - RNA, 18 nt, Human
uccccgcucuuacccggg

SEQ ID NO: 1230728 - RNA, 22 nt, Human
ugagucgggcggggaggggaga

SEQ ID NO: 1230729 - RNA, 20 nt, Human
uggcaagaccuagacccagu

SEQ ID NO: 1230730 - RNA, 22 nt, Human
ugggaaaaaaaacccuuuagga

SEQ ID NO: 1230731 - RNA, 20 nt, Human
aaacaaaaucugucugcagc

SEQ ID NO: 1230732 - RNA, 23 nt, Human
aaccgacacugacaaguuaaacg

SEQ ID NO: 1230733 - RNA, 21 nt, Human
acggcaauaauagggcgcacc

SEQ ID NO: 1230734 - RNA, 19 nt, Human
agauggaggcauuugaacu

SEQ ID NO: 1230735 - RNA, 22 nt, Human
agauggaggcauuugaacuggg

SEQ ID NO: 1230736 - RNA, 24 nt, Human
agccuuguccccugcacuccaacu

SEQ ID NO: 1230737 - RNA, 24 nt, Human
agggauugaagaucggcgucugug

SEQ ID NO: 1230738 - RNA, 23 nt, Human
aggugcuguggggacaccgagau

SEQ ID NO: 1230739 - RNA, 20 nt, Human
auugaagaucggcgucugug

SEQ ID NO: 1230740 - RNA, 23 nt, Human
caaacauguaacagcaggaguuu

SEQ ID NO: 1230741 - RNA, 23 nt, Human
cacaguuugcagaguuaugugga

SEQ ID NO: 1230742 - RNA, 19 nt, Human
cacccucgcugccccgggg

SEQ ID NO: 1230743 - RNA, 21 nt, Human
caccgagauggugacacccuc

SEQ ID NO: 1230744 - RNA, 21 nt, Human
cagagggaaacaaaaucuguc

SEQ ID NO: 1230745 - RNA, 18 nt, Human
ccccggggagugugacau

SEQ ID NO: 1230746 - RNA, 19 nt, Human
ccgagauggugacacccuc

SEQ ID NO: 1230747 - RNA, 22 nt, Human
ccgagauggugacacccucgcu

SEQ ID NO: 1230748 - RNA, 22 nt, Human
ccuauccccaaccacgaacuga

SEQ ID NO: 1230749 - RNA, 22 nt, Human
cugcaggggugcagaaccgaca

SEQ ID NO: 1230750 - RNA, 24 nt, Human
cugcaggggugcagaaccgacacu

SEQ ID NO: 1230751 - RNA, 24 nt, Human
gcacuccaacuuuacagagggaaa

SEQ ID NO: 1230752 - RNA, 23 nt, Human
gccccuacagagccugcaggggu

SEQ ID NO: 1230753 - RNA, 21 nt, Human
uccaucggcagcuugcuacga

SEQ ID NO: 1230754 - RNA, 19 nt, Human
ugacggcagaaggcgaagg

SEQ ID NO: 1230755 - RNA, 21 nt, Human
ugacuagggcugucaccggug

SEQ ID NO: 1230756 - RNA, 23 nt, Human
ugggccuugaaggaugacuaggg

SEQ ID NO: 1230757 - RNA, 19 nt, Human
ugguauggagauggaggca

SEQ ID NO: 1230758 - RNA, 19 nt, Human
uguggagucacauaaucca

SEQ ID NO: 1230759 - RNA, 24 nt, Human
uugcagaguuauguggagucacau

SEQ ID NO: 1230760 - RNA, 19 nt, Human
aauuaagagcucaucuuca

SEQ ID NO: 1230761 - RNA, 22 nt, Human
aauucgcagcgccaucuuccuc

SEQ ID NO: 1230762 - RNA, 25 nt, Human
acagagccuuccccaguagaccgaa

SEQ ID NO: 1230763 - RNA, 21 nt, Human
cacugaaaacauuaaaugggu

SEQ ID NO: 1230764 - RNA, 26 nt, Human
cacugaaaacauuaaauggguuuugu

SEQ ID NO: 1230765 - RNA, 24 nt, Human
cagagccuuccccaguagaccgaa

SEQ ID NO: 1230766 - RNA, 22 nt, Human
cagcaaaaaagagcaagucaca

SEQ ID NO: 1230767 - RNA, 22 nt, Human
caggcauucacugaaaacauua

SEQ ID NO: 1230768 - RNA, 18 nt, Human
ccucccgggaccgggccg

SEQ ID NO: 1230769 - RNA, 21 nt, Human
gaaagaaccggaggcaaacac

SEQ ID NO: 1230770 - RNA, 21 nt, Human
gcuucccacgguggaaagaac

SEQ ID NO: 1230771 - RNA, 18 nt, Human
gguggggguggcguucgc

SEQ ID NO: 1230772 - RNA, 20 nt, Human
gugaaaaauuaagagcucau

SEQ ID NO: 1230773 - RNA, 23 nt, Human
uaaauaccccaggcauucacuga

SEQ ID NO: 1230774 - RNA, 21 nt, Human
uaacuggccacuacuagaacu

SEQ ID NO: 1230775 - RNA, 26 nt, Human
ugaauagacucuaauuuagcaccuac

SEQ ID NO: 1230776 - RNA, 18 nt, Human
uggaaagaaccggaggca

SEQ ID NO: 1230777 - RNA, 20 nt, Human
ugugaaaaauuaagagcuca

SEQ ID NO: 1230778 - RNA, 20 nt, Human
uguucuuccccaguuccucc

SEQ ID NO: 1230779 - RNA, 27 nt, Human
uuccccaguuccuccauugagugaaua

SEQ ID NO: 1230780 - RNA, 22 nt, Human
uucuuccccaguuccuccauug

SEQ ID NO: 1230781 - RNA, 25 nt, Human
uuuguucuuccccaguuccuccauu

SEQ ID NO: 1230782 - RNA, 22 nt, Human
aaaucugcacuuuuuauuucua

SEQ ID NO: 1230783 - RNA, 19 nt, Human
aagcaggaggagguggacg

SEQ ID NO: 1230784 - RNA, 20 nt, Human
aagcaggaggagguggacgg

SEQ ID NO: 1230785 - RNA, 18 nt, Human
aggcaaaaauacaggaac

SEQ ID NO: 1230786 - RNA, 24 nt, Human
aggcaaaaauacaggaacagagaa

SEQ ID NO: 1230787 - RNA, 20 nt, Human
aggcaggggugaggagagau

SEQ ID NO: 1230788 - RNA, 25 nt, Human
aggcaggggugaggagagaugaggg

SEQ ID NO: 1230789 - RNA, 21 nt, Human
cacuccagguagacccauccc

SEQ ID NO: 1230790 - RNA, 20 nt, Human
cauucuagaaaaggcaaaaa

SEQ ID NO: 1230791 - RNA, 23 nt, Human
cuagaaaaggcaaaaauacagga

SEQ ID NO: 1230792 - RNA, 24 nt, Human
ggguauuccucaagucacuccagg

SEQ ID NO: 1230793 - RNA, 25 nt, Human
uagaaaaggcaaaaauacaggaaca

SEQ ID NO: 1230794 - RNA, 21 nt, Human
ucuguggugguggcugugaga

SEQ ID NO: 1230795 - RNA, 23 nt, Human
ugagggcguucucuggaguauug

SEQ ID NO: 1230796 - RNA, 25 nt, Human
uguacugucuguggugguggcugug

SEQ ID NO: 1230797 - RNA, 24 nt, Human
uguggugguggcugugagaaucca

SEQ ID NO: 1230798 - RNA, 23 nt, Human
aacuaauuuuauuuuauuuuuua

SEQ ID NO: 1230799 - RNA, 21 nt, Human
aagcugagagaacacuccacg

SEQ ID NO: 1230800 - RNA, 18 nt, Human
ccagcagucccauagcua

SEQ ID NO: 1230801 - RNA, 23 nt, Human
cccacaggguuggagaggcaguc

SEQ ID NO: 1230802 - RNA, 20 nt, Human
cccgccaagucuccugucca

SEQ ID NO: 1230803 - RNA, 18 nt, Human
ccuggacuaggagccagc

SEQ ID NO: 1230804 - RNA, 20 nt, Human
cuggagcaucucccgccaag

SEQ ID NO: 1230805 - RNA, 23 nt, Human
cuuacagcccacaggguuggaga

SEQ ID NO: 1230806 - RNA, 27 nt, Human
gaccuaagcugagagaaccggggguuc

SEQ ID NO: 1230807 - RNA, 20 nt, Human
gagcuugcuuacagcccaca

SEQ ID NO: 1230808 - RNA, 20 nt, Human
gcccacggaaccgucccagg

SEQ ID NO: 1230809 - RNA, 21 nt, Human
gccugagcuugcuuacagccc

SEQ ID NO: 1230810 - RNA, 19 nt, Human
ggagaggcagucauacccc

SEQ ID NO: 1230811 - RNA, 22 nt, Human
ggagcaucucccgccaagucuc

SEQ ID NO: 1230812 - RNA, 21 nt, Human
gggauguuagcuuugucugca

SEQ ID NO: 1230813 - RNA, 23 nt, Human
uaagcugagagaacacuccacga

SEQ ID NO: 1230814 - RNA, 23 nt, Human
ucauacccccaugauuccuggac

SEQ ID NO: 1230815 - RNA, 20 nt, Human
ugagagaacacuccacgaug

SEQ ID NO: 1230816 - RNA, 22 nt, Human
ugggauguuagcuuugucugca

SEQ ID NO: 1230817 - RNA, 20 nt, Human
ugucugggauguuagcuuug

SEQ ID NO: 1230818 - RNA, 21 nt, Human
uuugucugcagggguucccag

SEQ ID NO: 1230819 - RNA, 24 nt, Human
aaauaaauaaauaauagaaggcag

SEQ ID NO: 1230820 - RNA, 26 nt, Human
aaggcagcuuuaaauuaguauacuga

SEQ ID NO: 1230821 - RNA, 25 nt, Human
aggcagcuuuaaauuaguauacuga

SEQ ID NO: 1230822 - RNA, 27 nt, Human
auaaauaauagaaggcagccgguaccc

SEQ ID NO: 1230823 - RNA, 22 nt, Human
uaagaaaaauguuauauauaug

SEQ ID NO: 1230824 - RNA, 19 nt, Human
uagaagaaacaugcuagca

SEQ ID NO: 1230825 - RNA, 19 nt, Human
aaacauggucauauguacc

SEQ ID NO: 1230826 - RNA, 24 nt, Human
aaagugcugggauuacaggcguga

SEQ ID NO: 1230827 - RNA, 24 nt, Human
aaccaccaauacauagauuucuac

SEQ ID NO: 1230828 - RNA, 19 nt, Human
aaccuggaagggaccggcg

SEQ ID NO: 1230829 - RNA, 23 nt, Human
aaccuggaagggaccggcgcgcu

SEQ ID NO: 1230830 - RNA, 19 nt, Human
aaguagcugggacuacagg

SEQ ID NO: 1230831 - RNA, 20 nt, Human
aaguagcugggacuacaggu

SEQ ID NO: 1230832 - RNA, 19 nt, Human
aagugcugggauuacaggc

SEQ ID NO: 1230833 - RNA, 19 nt, Human
aagugcugggauuacaggc

SEQ ID NO: 1230834 - RNA, 26 nt, Human
aagugcugggauuacaggcgugagcc

SEQ ID NO: 1230835 - RNA, 21 nt, Human
acaguggcuugaucucggcuc

SEQ ID NO: 1230836 - RNA, 23 nt, Human
accucggccucccaaagugcugg

SEQ ID NO: 1230837 - RNA, 18 nt, Human
acugcaagcucugccucc

SEQ ID NO: 1230838 - RNA, 21 nt, Human
agaaauguauacaucucuagu

SEQ ID NO: 1230839 - RNA, 23 nt, Human
agaaauuuggcaucagguggaca

SEQ ID NO: 1230840 - RNA, 19 nt, Human
agacaagacauggauaacc

SEQ ID NO: 1230841 - RNA, 18 nt, Human
agcucugccuccuggguu

SEQ ID NO: 1230842 - RNA, 24 nt, Human
aguacaguggcuugaucucggcuc

SEQ ID NO: 1230843 - RNA, 22 nt, Human
aguaucccucacccccucagac

SEQ ID NO: 1230844 - RNA, 20 nt, Human
agucugcgggcgcuccgagg

SEQ ID NO: 1230845 - RNA, 18 nt, Human
agugcugggauuacaggc

SEQ ID NO: 1230846 - RNA, 24 nt, Human
augaucugcccaccucggccuccc

SEQ ID NO: 1230847 - RNA, 24 nt, Human
caaagugcugggauuacaggcgug

SEQ ID NO: 1230848 - RNA, 25 nt, Human
caaauauagacaaauacauaggaac

SEQ ID NO: 1230849 - RNA, 22 nt, Human
cacaccauucuccugccucagc

SEQ ID NO: 1230850 - RNA, 18 nt, Human
cacacccagccggucucu

SEQ ID NO: 1230851 - RNA, 20 nt, Human
caccacacccagccggucuc

SEQ ID NO: 1230852 - RNA, 18 nt, Human
caccguguuagccaggau

SEQ ID NO: 1230853 - RNA, 24 nt, Human
caccguguuagccaggauggucuc

SEQ ID NO: 1230854 - RNA, 23 nt, Human
cacugcaagcucugccuccuggg

SEQ ID NO: 1230855 - RNA, 22 nt, Human
ccaaagugcugggauuacaggc

SEQ ID NO: 1230856 - RNA, 22 nt, Human
ccaaagugcugggauuacaggc

SEQ ID NO: 1230857 - RNA, 24 nt, Human
ccaaagugcugggauuacaggcgu

SEQ ID NO: 1230858 - RNA, 21 nt, Human
ccaccaauacauagauuucua

SEQ ID NO: 1230859 - RNA, 20 nt, Human
ccaggcccagggagccgcgc

SEQ ID NO: 1230860 - RNA, 23 nt, Human
cccaaguagcugggacuacaggu

SEQ ID NO: 1230861 - RNA, 24 nt, Human
cccaaguagcugggacuacaggug

SEQ ID NO: 1230862 - RNA, 19 nt, Human
ccccucagacacgggcuag

SEQ ID NO: 1230863 - RNA, 20 nt, Human
cccuuuucucagagcucuga

SEQ ID NO: 1230864 - RNA, 18 nt, Human
ccugaaaaagacaacaac

SEQ ID NO: 1230865 - RNA, 23 nt, Human
ccugccucagccucccaaguagc

SEQ ID NO: 1230866 - RNA, 25 nt, Human
cgcgcggggcugcccggcugggcug

SEQ ID NO: 1230867 - RNA, 19 nt, Human
cggggcugcccggcugggc

SEQ ID NO: 1230868 - RNA, 24 nt, Human
cucacugcaagcucugccuccugg

SEQ ID NO: 1230869 - RNA, 19 nt, Human
cucagagcucugauauuuu

SEQ ID NO: 1230870 - RNA, 24 nt, Human
cucagccucccaaguagcugggac

SEQ ID NO: 1230871 - RNA, 19 nt, Human
cuccugaaaaagacaacaa

SEQ ID NO: 1230872 - RNA, 25 nt, Human
cuccugccucagccucccaaguagc

SEQ ID NO: 1230873 - RNA, 21 nt, Human
cuccuggguucacaccauucu

SEQ ID NO: 1230874 - RNA, 18 nt, Human
cucugucacccaggaugg

SEQ ID NO: 1230875 - RNA, 19 nt, Human
cugcaagcucugccuccug

SEQ ID NO: 1230876 - RNA, 23 nt, Human
cugccucagccucccaaguagcu

SEQ ID NO: 1230877 - RNA, 19 nt, Human
cugcgggcgcuccgaggcu

SEQ ID NO: 1230878 - RNA, 24 nt, Human
cuggguuucaccguguuagccagg

SEQ ID NO: 1230879 - RNA, 20 nt, Human
cuucugaccucaugaucugc

SEQ ID NO: 1230880 - RNA, 24 nt, Human
cuuugucccuuuucucagagcucu

SEQ ID NO: 1230881 - RNA, 22 nt, Human
gaaaaagacaacaacaucaaaa

SEQ ID NO: 1230882 - RNA, 22 nt, Human
gaccucaugaucugcccaccuc

SEQ ID NO: 1230883 - RNA, 20 nt, Human
gagcgcgcggggcugcccgg

SEQ ID NO: 1230884 - RNA, 18 nt, Human
gauuacaggcgugagcca

SEQ ID NO: 1230885 - RNA, 21 nt, Human
gauuacaggcgugagccacca

SEQ ID NO: 1230886 - RNA, 22 nt, Human
gauuacaggcgugagccaccac

SEQ ID NO: 1230887 - RNA, 25 nt, Human
gccuccuggguucacaccauucucc

SEQ ID NO: 1230888 - RNA, 20 nt, Human
gcuggguuucaccguguuag

SEQ ID NO: 1230889 - RNA, 24 nt, Human
gcuggguuucaccguguuagccag

SEQ ID NO: 1230890 - RNA, 24 nt, Human
ggauggucucgaucuucugaccuc

SEQ ID NO: 1230891 - RNA, 19 nt, Human
ggauuacaggcgugagcca

SEQ ID NO: 1230892 - RNA, 18 nt, Human
ggggcugcccggcugggc

SEQ ID NO: 1230893 - RNA, 21 nt, Human
ggguuucaccguguuagccag

SEQ ID NO: 1230894 - RNA, 20 nt, Human
gugccugcaaccacgccuag

SEQ ID NO: 1230895 - RNA, 24 nt, Human
uaaagauucuaaccagaaaugcua

SEQ ID NO: 1230896 - RNA, 18 nt, Human
uaagaaauuuggcaucag

SEQ ID NO: 1230897 - RNA, 24 nt, Human
uacaaaguuucaucauugccccca

SEQ ID NO: 1230898 - RNA, 24 nt, Human
uacaggcgugagccaccacaccca

SEQ ID NO: 1230899 - RNA, 23 nt, Human
uacauagauuucuacacuccuga

SEQ ID NO: 1230900 - RNA, 21 nt, Human
uaguagaggcuggguuucacc

SEQ ID NO: 1230901 - RNA, 23 nt, Human
uaguagaggcuggguuucaccgu

SEQ ID NO: 1230902 - RNA, 24 nt, Human
uaguagaggcuggguuucaccgug

SEQ ID NO: 1230903 - RNA, 21 nt, Human
ucacaccauucuccugccuca

SEQ ID NO: 1230904 - RNA, 24 nt, Human
ucaccguguuagccaggauggucu

SEQ ID NO: 1230905 - RNA, 18 nt, Human
ucacugcaagcucugccu

SEQ ID NO: 1230906 - RNA, 23 nt, Human
ucacugcaagcucugccuccugg

SEQ ID NO: 1230907 - RNA, 24 nt, Human
ucacugcaagcucugccuccuggg

SEQ ID NO: 1230908 - RNA, 18 nt, Human
ucagccucccaaguagcu

SEQ ID NO: 1230909 - RNA, 20 nt, Human
ucagccucccaaguagcugg

SEQ ID NO: 1230910 - RNA, 21 nt, Human
ucagguggacaacaucuaggu

SEQ ID NO: 1230911 - RNA, 24 nt, Human
ucccaaagugcugggauuacaggc

SEQ ID NO: 1230912 - RNA, 24 nt, Human
ucccaaguagcugggacuacaggu

SEQ ID NO: 1230913 - RNA, 18 nt, Human
ucccucacccccucagac

SEQ ID NO: 1230914 - RNA, 20 nt, Human
uccggagcccgcgcaaccug

SEQ ID NO: 1230915 - RNA, 24 nt, Human
uccuggguucacaccauucuccug

SEQ ID NO: 1230916 - RNA, 18 nt, Human
ucggccucccaaagugcu

SEQ ID NO: 1230917 - RNA, 26 nt, Human
ucucagagcucugauauuuuccuaac

SEQ ID NO: 1230918 - RNA, 28 nt, Human
ucucuugguuuacaaauauagacaaaua

SEQ ID NO: 1230919 - RNA, 24 nt, Human
ucugucacccaggauggaguacag

SEQ ID NO: 1230920 - RNA, 20 nt, Human
ucuugcucugucacccagga

SEQ ID NO: 1230921 - RNA, 24 nt, Human
ucuugcucugucacccaggaugga

SEQ ID NO: 1230922 - RNA, 22 nt, Human
ugaaaaagacaacaacaucaaa

SEQ ID NO: 1230923 - RNA, 22 nt, Human
ugagauggagucuugcucuguc

SEQ ID NO: 1230924 - RNA, 24 nt, Human
ugaucugcccaccucggccuccca

SEQ ID NO: 1230925 - RNA, 21 nt, Human
ugcccccaaccuuggaauuuc

SEQ ID NO: 1230926 - RNA, 27 nt, Human
ugcccggcugggcugggucucguccgg

SEQ ID NO: 1230927 - RNA, 24 nt, Human
ugccucagccucccaaguagcugg

SEQ ID NO: 1230928 - RNA, 19 nt, Human
ugccuccuggguucacacc

SEQ ID NO: 1230929 - RNA, 21 nt, Human
ugcgggcgcuccgaggcuccg

SEQ ID NO: 1230930 - RNA, 24 nt, Human
ugcugggauuacaggcgugagcca

SEQ ID NO: 1230931 - RNA, 22 nt, Human
uggaauuucagagugagagcau

SEQ ID NO: 1230932 - RNA, 19 nt, Human
uggaguacaguggcuugau

SEQ ID NO: 1230933 - RNA, 24 nt, Human
uggaguacaguggcuugaucucgg

SEQ ID NO: 1230934 - RNA, 19 nt, Human
uggagucuugcucugucac

SEQ ID NO: 1230935 - RNA, 22 nt, Human
uggcaaaugacaaccaccaaua

SEQ ID NO: 1230936 - RNA, 19 nt, Human
ugggacuacaggugccugc

SEQ ID NO: 1230937 - RNA, 24 nt, Human
ugggacuacaggugccugcaacca

SEQ ID NO: 1230938 - RNA, 18 nt, Human
ugggauuacaggcgugag

SEQ ID NO: 1230939 - RNA, 19 nt, Human
ugggauuacaggcgugagc

SEQ ID NO: 1230940 - RNA, 22 nt, Human
ugggauuacaggcgugagccac

SEQ ID NO: 1230941 - RNA, 23 nt, Human
ugggauuacaggcgugagccacc

SEQ ID NO: 1230942 - RNA, 24 nt, Human
ugggauuacaggcgugagccacca

SEQ ID NO: 1230943 - RNA, 20 nt, Human
uggguucacaccauucuccu

SEQ ID NO: 1230944 - RNA, 23 nt, Human
uggguuucaccguguuagccagg

SEQ ID NO: 1230945 - RNA, 21 nt, Human
ugucccuuuucucagagcucu

SEQ ID NO: 1230946 - RNA, 22 nt, Human
uuaguagaggcuggguuucacc

SEQ ID NO: 1230947 - RNA, 24 nt, Human
uuaguagaggcuggguuucaccgu

SEQ ID NO: 1230948 - RNA, 21 nt, Human
uugagauggagucuugcucug

SEQ ID NO: 1230949 - RNA, 24 nt, Human
uugcuuugucccuuuucucagagc

SEQ ID NO: 1230950 - RNA, 19 nt, Human
uuucaccguguuagccagg

SEQ ID NO: 1230951 - RNA, 22 nt, Human
uuugucccuuuucucagagcuc

SEQ ID NO: 1230952 - RNA, 24 nt, Human
uuuuuaguagaggcuggguuucac

SEQ ID NO: 1230953 - RNA, 20 nt, Human
uuuuuguauuuuuaguagag

SEQ ID NO: 1230954 - RNA, 18 nt, Human
uuuuuuguauuuuuagua

SEQ ID NO: 1230955 - RNA, 22 nt, Human
uuuuuuguauuuuuaguagagg

SEQ ID NO: 1230956 - RNA, 29 nt, Human
uuuuuuuuuuuuuguauuuuuaguagagg

SEQ ID NO: 1230957 - RNA, 20 nt, Human
aaaaguacauagcgacacuc

SEQ ID NO: 1230958 - RNA, 24 nt, Human
aaauugcugggauuacagguguga

SEQ ID NO: 1230959 - RNA, 19 nt, Human
acccagcuggggcuggagu

SEQ ID NO: 1230960 - RNA, 19 nt, Human
acucacuugucuccauccu

SEQ ID NO: 1230961 - RNA, 24 nt, Human
acucugucacccagcuggggcugg

SEQ ID NO: 1230962 - RNA, 18 nt, Human
acucuguucuucagugcu

SEQ ID NO: 1230963 - RNA, 24 nt, Human
aucauguugguaaggcuguucuug

SEQ ID NO: 1230964 - RNA, 18 nt, Human
auugcugggauuacaggu

SEQ ID NO: 1230965 - RNA, 24 nt, Human
caaauugcugggauuacaggugug

SEQ ID NO: 1230966 - RNA, 23 nt, Human
caaccuccaccucccagguucaa

SEQ ID NO: 1230967 - RNA, 22 nt, Human
caagggauucuccugcuucagc

SEQ ID NO: 1230968 - RNA, 24 nt, Human
caagggauucuccugcuucagccu

SEQ ID NO: 1230969 - RNA, 18 nt, Human
cacccaccaccacgccug

SEQ ID NO: 1230970 - RNA, 22 nt, Human
cacucugucacccagcuggggc

SEQ ID NO: 1230971 - RNA, 29 nt, Human
cacucugucacccagcuggggcuggagug

SEQ ID NO: 1230972 - RNA, 20 nt, Human
cacugcaaccuccaccuccc

SEQ ID NO: 1230973 - RNA, 19 nt, Human
cagcagccugggaaccagc

SEQ ID NO: 1230974 - RNA, 19 nt, Human
cagguucaagggauucucc

SEQ ID NO: 1230975 - RNA, 24 nt, Human
cagguuguuuuguuuuuguuuuug

SEQ ID NO: 1230976 - RNA, 24 nt, Human
caucauguugguaaggcuguucuu

SEQ ID NO: 1230977 - RNA, 20 nt, Human
cauguugguaaggcuguucu

SEQ ID NO: 1230978 - RNA, 24 nt, Human
cauguugguaaggcuguucuugaa

SEQ ID NO: 1230979 - RNA, 21 nt, Human
ccaaauugcugggauuacagg

SEQ ID NO: 1230980 - RNA, 21 nt, Human
ccaaauugcugggauuacagg

SEQ ID NO: 1230981 - RNA, 24 nt, Human
ccaaauugcugggauuacaggugu

SEQ ID NO: 1230982 - RNA, 24 nt, Human
ccacugcaaccuccaccucccagg

SEQ ID NO: 1230983 - RNA, 27 nt, Human
ccacugcaaccuccaccucccagguuc

SEQ ID NO: 1230984 - RNA, 22 nt, Human
cccaaguaccugggauuagagu

SEQ ID NO: 1230985 - RNA, 24 nt, Human
cccacugcaaccuccaccucccag

SEQ ID NO: 1230986 - RNA, 24 nt, Human
ccucccagguucaagggauucucc

SEQ ID NO: 1230987 - RNA, 21 nt, Human
ccugaccucaguugauccacc

SEQ ID NO: 1230988 - RNA, 23 nt, Human
ccugaccucaguugauccaccug

SEQ ID NO: 1230989 - RNA, 21 nt, Human
ccugccuuggucucccaaauu

SEQ ID NO: 1230990 - RNA, 22 nt, Human
ccuuggucucccaaauugcugg

SEQ ID NO: 1230991 - RNA, 24 nt, Human
cgccuggguaauuuuuguauuuuu

SEQ ID NO: 1230992 - RNA, 23 nt, Human
cucacucugucacccagcugggg

SEQ ID NO: 1230993 - RNA, 24 nt, Human
cucaguugauccaccugccuuggu

SEQ ID NO: 1230994 - RNA, 25 nt, Human
cuccauccucagucaucuuuuaaaa

SEQ ID NO: 1230995 - RNA, 23 nt, Human
cugcaaccuccaccucccagguu

SEQ ID NO: 1230996 - RNA, 24 nt, Human
cugcaaccuccaccucccagguuc

SEQ ID NO: 1230997 - RNA, 24 nt, Human
gaccucaguugauccaccugccuu

SEQ ID NO: 1230998 - RNA, 22 nt, Human
gagaugguuucaucauguuggu

SEQ ID NO: 1230999 - RNA, 18 nt, Human
gauuacaggugugagcca

SEQ ID NO: 1231000 - RNA, 21 nt, Human
gauuacaggugugagccacca

SEQ ID NO: 1231001 - RNA, 22 nt, Human
gauuacaggugugagccaccac

SEQ ID NO: 1231002 - RNA, 22 nt, Human
gauucuccugcuucagccuccc

SEQ ID NO: 1231003 - RNA, 24 nt, Human
gccuuggucucccaaauugcuggg

SEQ ID NO: 1231004 - RNA, 22 nt, Human
ggauucuccugcuucagccucc

SEQ ID NO: 1231005 - RNA, 24 nt, Human
ggcuggagugcaguagcacgaucu

SEQ ID NO: 1231006 - RNA, 24 nt, Human
ggcuguucuugaacuccugaccuc

SEQ ID NO: 1231007 - RNA, 21 nt, Human
guuguuuuguuuuuguuuuug

SEQ ID NO: 1231008 - RNA, 24 nt, Human
uaauuuuuguauuuuuagaagaga

SEQ ID NO: 1231009 - RNA, 22 nt, Human
uacaggugugagccaccacacc

SEQ ID NO: 1231010 - RNA, 22 nt, Human
uacaggugugagccaccacacc

SEQ ID NO: 1231011 - RNA, 23 nt, Human
uacaggugugagccaccacaccu

SEQ ID NO: 1231012 - RNA, 22 nt, Human
uagaagagaugguuucaucaug

SEQ ID NO: 1231013 - RNA, 22 nt, Human
uagagucacccaccaccacgcc

SEQ ID NO: 1231014 - RNA, 23 nt, Human
ucacugaaaauugccuuggaguu

SEQ ID NO: 1231015 - RNA, 21 nt, Human
ucagucaucuuuuaaaaguac

SEQ ID NO: 1231016 - RNA, 23 nt, Human
ucccaaauugcugggauuacagg

SEQ ID NO: 1231017 - RNA, 24 nt, Human
ucccaaauugcugggauuacaggu

SEQ ID NO: 1231018 - RNA, 21 nt, Human
ucccagguucaagggauucuc

SEQ ID NO: 1231019 - RNA, 24 nt, Human
ucccagguucaagggauucuccug

SEQ ID NO: 1231020 - RNA, 23 nt, Human
ucucacucugucacccagcuggg

SEQ ID NO: 1231021 - RNA, 30 nt, Human
ucucacucugucacccagcuggggcuggaa

SEQ ID NO: 1231022 - RNA, 21 nt, Human
ucuccauccucagucaucuuu

SEQ ID NO: 1231023 - RNA, 23 nt, Human
ucuucagugcugcaauuucugau

SEQ ID NO: 1231024 - RNA, 20 nt, Human
ugaacuccugaccucaguug

SEQ ID NO: 1231025 - RNA, 24 nt, Human
ugaccucaguugauccaccugccu

SEQ ID NO: 1231026 - RNA, 20 nt, Human
ugcugggauuacagguguga

SEQ ID NO: 1231027 - RNA, 24 nt, Human
ugcugggauuacaggugugagcca

SEQ ID NO: 1231028 - RNA, 24 nt, Human
ugcuucagccucccaaguaccugg

SEQ ID NO: 1231029 - RNA, 23 nt, Human
uggagugcaguagcacgaucuug

SEQ ID NO: 1231030 - RNA, 24 nt, Human
uggagugcaguagcacgaucuugg

SEQ ID NO: 1231031 - RNA, 22 nt, Human
ugggacuuucggagcagcagcc

SEQ ID NO: 1231032 - RNA, 23 nt, Human
ugggacuuucggagcagcagccu

SEQ ID NO: 1231033 - RNA, 18 nt, Human
ugggauuacaggugugag

SEQ ID NO: 1231034 - RNA, 19 nt, Human
ugggauuacaggugugagc

SEQ ID NO: 1231035 - RNA, 22 nt, Human
ugggauuacaggugugagccac

SEQ ID NO: 1231036 - RNA, 23 nt, Human
ugggauuacaggugugagccacc

SEQ ID NO: 1231037 - RNA, 24 nt, Human
ugggauuacaggugugagccacca

SEQ ID NO: 1231038 - RNA, 24 nt, Human
ugguaaggcuguucuugaacuccu

SEQ ID NO: 1231039 - RNA, 26 nt, Human
ugucacccagcuggggcuggagugca

SEQ ID NO: 1231040 - RNA, 22 nt, Human
uuagaagagaugguuucaucau

SEQ ID NO: 1231041 - RNA, 18 nt, Human
uucaagggauucuccugc

SEQ ID NO: 1231042 - RNA, 24 nt, Human
uucuucagugcugcaauuucugau

SEQ ID NO: 1231043 - RNA, 25 nt, Human
uugagacagugucucacucugucac

SEQ ID NO: 1231044 - RNA, 24 nt, Human
uugauccaccugccuuggucuccc

SEQ ID NO: 1231045 - RNA, 19 nt, Human
uugcugggauuacaggugu

SEQ ID NO: 1231046 - RNA, 19 nt, Human
uuguuuuuguuuuguuuuu

SEQ ID NO: 1231047 - RNA, 21 nt, Human
uuucaucauguugguaaggcu

SEQ ID NO: 1231048 - RNA, 21 nt, Human
uuuuuagaagagaugguuuca

SEQ ID NO: 1231049 - RNA, 20 nt, Human
uuuuuguauuuuuagaagag

SEQ ID NO: 1231050 - RNA, 23 nt, Human
uuuuuguauuuuuagaagagaug

SEQ ID NO: 1231051 - RNA, 18 nt, Human
aaaaaagucccuuuccuu

SEQ ID NO: 1231052 - RNA, 21 nt, Human
aaaaaggcuuauuauaaaaaa

SEQ ID NO: 1231053 - RNA, 24 nt, Human
aaaacauaaacccaugaagaaaau

SEQ ID NO: 1231054 - RNA, 24 nt, Human
aaaauacucuuuuccagcuaauua

SEQ ID NO: 1231055 - RNA, 21 nt, Human
aaagaaggaguggggaaaggg

SEQ ID NO: 1231056 - RNA, 24 nt, Human
aaaguggcgagucuggguuuggag

SEQ ID NO: 1231057 - RNA, 18 nt, Human
aaccagaugcuugcuagc

SEQ ID NO: 1231058 - RNA, 19 nt, Human
aaggaguggggaaagggag

SEQ ID NO: 1231059 - RNA, 19 nt, Human
aaggaguggggaaagggag

SEQ ID NO: 1231060 - RNA, 23 nt, Human
acaaaacccaccgaaaaucagca

SEQ ID NO: 1231061 - RNA, 25 nt, Human
acaaacaaaaaacagcugggauaug

SEQ ID NO: 1231062 - RNA, 20 nt, Human
acauauuagaaaccauaaaa

SEQ ID NO: 1231063 - RNA, 18 nt, Human
accacagauacaaaaaua

SEQ ID NO: 1231064 - RNA, 20 nt, Human
accuccuauacauaauaacu

SEQ ID NO: 1231065 - RNA, 22 nt, Human
acugcagcuuacaugggaaauu

SEQ ID NO: 1231066 - RNA, 21 nt, Human
agaaggaguggggaaagggag

SEQ ID NO: 1231067 - RNA, 21 nt, Human
agaaggggaagcagggcgcgg

SEQ ID NO: 1231068 - RNA, 18 nt, Human
agaagugguggcaacaca

SEQ ID NO: 1231069 - RNA, 25 nt, Human
agccagggguuggggggaagaagcu

SEQ ID NO: 1231070 - RNA, 21 nt, Human
aggaaacgaacauuaguguug

SEQ ID NO: 1231071 - RNA, 27 nt, Human
auaaacccaugaagaaaaugcaaccca

SEQ ID NO: 1231072 - RNA, 21 nt, Human
auggagggagaagggagggaa

SEQ ID NO: 1231073 - RNA, 21 nt, Human
auuuaaaaauccccucucccc

SEQ ID NO: 1231074 - RNA, 23 nt, Human
caaacaaaaaacagcugggauau

SEQ ID NO: 1231075 - RNA, 20 nt, Human
cacaaaccaaaaaguauacg

SEQ ID NO: 1231076 - RNA, 21 nt, Human
cacugugcgagcgugugugua

SEQ ID NO: 1231077 - RNA, 23 nt, Human
cacuguucagcugcaguguggca

SEQ ID NO: 1231078 - RNA, 25 nt, Human
cacuugaacugaggucuaaggaaac

SEQ ID NO: 1231079 - RNA, 21 nt, Human
cagaaaaugaugaugggcuaa

SEQ ID NO: 1231080 - RNA, 23 nt, Human
cagaaccaguuggcugaccuaac

SEQ ID NO: 1231081 - RNA, 26 nt, Human
cagcgucccuggcuggaauggugccc

SEQ ID NO: 1231082 - RNA, 18 nt, Human
cagggcgcgggauagggu

SEQ ID NO: 1231083 - RNA, 19 nt, Human
ccaaaaugaaacgaaaaca

SEQ ID NO: 1231084 - RNA, 21 nt, Human
ccaggcauggaugagguucuc

SEQ ID NO: 1231085 - RNA, 19 nt, Human
cgaaaaucagcaguuccaa

SEQ ID NO: 1231086 - RNA, 22 nt, Human
cgagcuggaaacagccccauga

SEQ ID NO: 1231087 - RNA, 21 nt, Human
cgccccccuucuucacaucuc

SEQ ID NO: 1231088 - RNA, 20 nt, Human
cgccugucccgcggcgggca

SEQ ID NO: 1231089 - RNA, 21 nt, Human
cgcucgccccccuucuucaca

SEQ ID NO: 1231090 - RNA, 22 nt, Human
cgcuugcccuccucgcuccuug

SEQ ID NO: 1231091 - RNA, 23 nt, Human
cuaauccuugcaacguauuagaa

SEQ ID NO: 1231092 - RNA, 18 nt, Human
cugcugcagugugggcgg

SEQ ID NO: 1231093 - RNA, 22 nt, Human
cuggaggcuggcugaagguuuu

SEQ ID NO: 1231094 - RNA, 20 nt, Human
cuuggaguggaagggagcgg

SEQ ID NO: 1231095 - RNA, 23 nt, Human
gaaaaaucaacuacaaaacccac

SEQ ID NO: 1231096 - RNA, 19 nt, Human
gaaacgaaaacauaaaccc

SEQ ID NO: 1231097 - RNA, 26 nt, Human
gaagggagcgggggagaagaugagag

SEQ ID NO: 1231098 - RNA, 23 nt, Human
gaaggguuuuuacauauggccuu

SEQ ID NO: 1231099 - RNA, 23 nt, Human
gagacccuagagaaagaccccaa

SEQ ID NO: 1231100 - RNA, 19 nt, Human
gauagaaacugcagcuuac

SEQ ID NO: 1231101 - RNA, 21 nt, Human
gaugagcuuguggacgagcug

SEQ ID NO: 1231102 - RNA, 22 nt, Human
gcagggggaguggagagucuac

SEQ ID NO: 1231103 - RNA, 19 nt, Human
gccucgagguaccagggag

SEQ ID NO: 1231104 - RNA, 26 nt, Human
gccugauuuggggagggggggcggcu

SEQ ID NO: 1231105 - RNA, 20 nt, Human
gcgggcagcuuugcucccuu

SEQ ID NO: 1231106 - RNA, 23 nt, Human
ggaaaaaagucccuuuccuugaa

SEQ ID NO: 1231107 - RNA, 18 nt, Human
ggaaaauacuacacacug

SEQ ID NO: 1231108 - RNA, 18 nt, Human
ggaaacagccccaugaag

SEQ ID NO: 1231109 - RNA, 24 nt, Human
ggaagaacagccggcguccgcaag

SEQ ID NO: 1231110 - RNA, 21 nt, Human
ggaagguggucucucgacagc

SEQ ID NO: 1231111 - RNA, 18 nt, Human
ggagaagggagggaaacu

SEQ ID NO: 1231112 - RNA, 22 nt, Human
gggaggcuucuggacagaaaau

SEQ ID NO: 1231113 - RNA, 28 nt, Human
gggcgcgggauaggguuugggggaaggg

SEQ ID NO: 1231114 - RNA, 24 nt, Human
gggggaagguggucucucgacagc

SEQ ID NO: 1231115 - RNA, 18 nt, Human
gggggcagaaaaugauga

SEQ ID NO: 1231116 - RNA, 24 nt, Human
ggguuuggaguugcaggagaaaga

SEQ ID NO: 1231117 - RNA, 25 nt, Human
gguuggggggaagaagcucccuaug

SEQ ID NO: 1231118 - RNA, 19 nt, Human
gugaaccaagagaaagaga

SEQ ID NO: 1231119 - RNA, 27 nt, Human
uaaaaaggcuuauuauaaaaaaaucaa

SEQ ID NO: 1231120 - RNA, 18 nt, Human
uaaaaauccccucucccc

SEQ ID NO: 1231121 - RNA, 23 nt, Human
uaaaauagccagggguugggggg

SEQ ID NO: 1231122 - RNA, 21 nt, Human
uaaacccaugaagaaaaugca

SEQ ID NO: 1231123 - RNA, 22 nt, Human
uaaacccaugaagaaaaugcaa

SEQ ID NO: 1231124 - RNA, 24 nt, Human
uaaccgaugccuucacaaaccaaa

SEQ ID NO: 1231125 - RNA, 18 nt, Human
uaacuagcucaccuccua

SEQ ID NO: 1231126 - RNA, 19 nt, Human
uaauguuuuguuaccacag

SEQ ID NO: 1231127 - RNA, 22 nt, Human
uacaaaacccaccgaaaaucag

SEQ ID NO: 1231128 - RNA, 25 nt, Human
uauuagaaaaauacucuuuuccagc

SEQ ID NO: 1231129 - RNA, 22 nt, Human
ucacaaaccaaaaaguauacgu

SEQ ID NO: 1231130 - RNA, 18 nt, Human
ucaccuagacgccugucc

SEQ ID NO: 1231131 - RNA, 18 nt, Human
uccaagaggaugcaaugc

SEQ ID NO: 1231132 - RNA, 25 nt, Human
uccguggcaaggcgacaggcagaac

SEQ ID NO: 1231133 - RNA, 19 nt, Human
uccuuggaguggaagggag

SEQ ID NO: 1231134 - RNA, 20 nt, Human
ucgccugauuuggggagggg

SEQ ID NO: 1231135 - RNA, 21 nt, Human
ucucagucuauuacgggugaa

SEQ ID NO: 1231136 - RNA, 21 nt, Human
ucuccaggcauggaugagguu

SEQ ID NO: 1231137 - RNA, 21 nt, Human
ucuccggagaucgccugauuu

SEQ ID NO: 1231138 - RNA, 24 nt, Human
ucucugcuccuuuuccaaacugga

SEQ ID NO: 1231139 - RNA, 20 nt, Human
ugaaacgaaaacauaaaccc

SEQ ID NO: 1231140 - RNA, 21 nt, Human
ugaaagaagagagaaacaggu

SEQ ID NO: 1231141 - RNA, 22 nt, Human
ugaaccagaugcuugcuagcga

SEQ ID NO: 1231142 - RNA, 23 nt, Human
ugaaccagaugcuugcuagcgac

SEQ ID NO: 1231143 - RNA, 23 nt, Human
ugaagacugguguccugugugca

SEQ ID NO: 1231144 - RNA, 21 nt, Human
ugaaugaagacgucuacuaac

SEQ ID NO: 1231145 - RNA, 19 nt, Human
ugacaaacaaaaaacagcu

SEQ ID NO: 1231146 - RNA, 24 nt, Human
ugaccuaaccaccugugcacccaa

SEQ ID NO: 1231147 - RNA, 19 nt, Human
ugauuuggggagggggggc

SEQ ID NO: 1231148 - RNA, 21 nt, Human
ugcaucagugaaucauuucaa

SEQ ID NO: 1231149 - RNA, 18 nt, Human
ugcucccuucaucuuccu

SEQ ID NO: 1231150 - RNA, 21 nt, Human
ugcugcagugugggcggcagg

SEQ ID NO: 1231151 - RNA, 24 nt, Human
ugcugcagugugggcggcaggggg

SEQ ID NO: 1231152 - RNA, 22 nt, Human
uggaagaggcgggggaggagga

SEQ ID NO: 1231153 - RNA, 18 nt, Human
uggagggagaagggaggg

SEQ ID NO: 1231154 - RNA, 22 nt, Human
uggcagacuggaaaaaaguccc

SEQ ID NO: 1231155 - RNA, 21 nt, Human
uggcgaagguuccuuccucag

SEQ ID NO: 1231156 - RNA, 19 nt, Human
uggcgggaagaacagccgg

SEQ ID NO: 1231157 - RNA, 19 nt, Human
uggcugcggauggagggag

SEQ ID NO: 1231158 - RNA, 21 nt, Human
ugggggggcagaaaaugauga

SEQ ID NO: 1231159 - RNA, 24 nt, Human
ugggggggcagaaaaugaugaugg

SEQ ID NO: 1231160 - RNA, 21 nt, Human
uggguuuggaguugcaggaga

SEQ ID NO: 1231161 - RNA, 22 nt, Human
uguacaucauacacuuguauau

SEQ ID NO: 1231162 - RNA, 27 nt, Human
uguacaucauacacuuguauauauauu

SEQ ID NO: 1231163 - RNA, 22 nt, Human
uguauggauguggcugcugcag

SEQ ID NO: 1231164 - RNA, 18 nt, Human
uguccgcucgccccccuu

SEQ ID NO: 1231165 - RNA, 19 nt, Human
uguggacgagcuggaaaca

SEQ ID NO: 1231166 - RNA, 24 nt, Human
uuaaugugagcaaauagcuugggg

SEQ ID NO: 1231167 - RNA, 23 nt, Human
uuaguauacagguaaagaaugaa

SEQ ID NO: 1231168 - RNA, 25 nt, Human
uuaguauacagguaaagaaugaauu

SEQ ID NO: 1231169 - RNA, 19 nt, Human
uucaucuuccuguccgcuc

SEQ ID NO: 1231170 - RNA, 19 nt, Human
uuccugauucucacaaguu

SEQ ID NO: 1231171 - RNA, 19 nt, Human
uugcucccuucaucuuccc

SEQ ID NO: 1231172 - RNA, 20 nt, Human
uugcucccuucaucuuccug

SEQ ID NO: 1231173 - RNA, 19 nt, Human
uuggucauacauauuagaa

SEQ ID NO: 1231174 - RNA, 20 nt, Human
uuggugaugugaaauugagu

SEQ ID NO: 1231175 - RNA, 24 nt, Human
uuguguuugaggaaacuauuuggu

SEQ ID NO: 1231176 - RNA, 23 nt, Human
uuguuaauaguacaggagucugu

SEQ ID NO: 1231177 - RNA, 19 nt, Human
uuucuagauguucuccagg

SEQ ID NO: 1231178 - RNA, 21 nt, Human
aacaaaaaucacuuuauucac

SEQ ID NO: 1231179 - RNA, 19 nt, Human
aacaugauuuuguacccuc

SEQ ID NO: 1231180 - RNA, 21 nt, Human
aagauccagccuuucccccac

SEQ ID NO: 1231181 - RNA, 22 nt, Human
agauuugaauuuuuaaaaaauu

SEQ ID NO: 1231182 - RNA, 19 nt, Human
cagccuuucccccacgagu

SEQ ID NO: 1231183 - RNA, 19 nt, Human
ccagagcaggauuuuaaga

SEQ ID NO: 1231184 - RNA, 21 nt, Human
ggacgacgucaacauguccuc

SEQ ID NO: 1231185 - RNA, 22 nt, Human
ugcacaaagguaaaauaauauc

SEQ ID NO: 1231186 - RNA, 25 nt, Human
uuccccauuguuuuguuguuucaac

SEQ ID NO: 1231187 - RNA, 19 nt, Human
uugcacauggcucacuccu

SEQ ID NO: 1231188 - RNA, 18 nt, Human
uugcuuaauuccccauug

SEQ ID NO: 1231189 - RNA, 20 nt, Human
uuuaagacucucggacgacg

SEQ ID NO: 1231190 - RNA, 21 nt, Human
uuuauucacaugccagaacag

SEQ ID NO: 1231191 - RNA, 23 nt, Human
uuucccccacgagucuggaaucc

SEQ ID NO: 1231192 - RNA, 19 nt, Human
aagcugccgcuaccgagcc

SEQ ID NO: 1231193 - RNA, 27 nt, Human
aauguccaccucuucccagcgcugggc

SEQ ID NO: 1231194 - RNA, 18 nt, Human
acaccccgcccccgcccg

SEQ ID NO: 1231195 - RNA, 21 nt, Human
acuuguagaaggccagaauag

SEQ ID NO: 1231196 - RNA, 22 nt, Human
agaaggccagaauaguggagug

SEQ ID NO: 1231197 - RNA, 23 nt, Human
agcgccucuguuaccugcagugg

SEQ ID NO: 1231198 - RNA, 21 nt, Human
caaguuuuuugcuucaucaca

SEQ ID NO: 1231199 - RNA, 21 nt, Human
cacaccccgcccccgcccgcu

SEQ ID NO: 1231200 - RNA, 18 nt, Human
caccgcccgcgcucgcgc

SEQ ID NO: 1231201 - RNA, 20 nt, Human
ccauagauaaauauucagca

SEQ ID NO: 1231202 - RNA, 22 nt, Human
ccccgcccccgcccgcuugcag

SEQ ID NO: 1231203 - RNA, 21 nt, Human
cccgcgcucgcgcccugaagc

SEQ ID NO: 1231204 - RNA, 18 nt, Human
ccgcaaccccguccgcag

SEQ ID NO: 1231205 - RNA, 22 nt, Human
ccucgcagcgccucuguuaccu

SEQ ID NO: 1231206 - RNA, 19 nt, Human
cgccucuguuaccugcagu

SEQ ID NO: 1231207 - RNA, 24 nt, Human
cugaagcugccgcuaccgagcccg

SEQ ID NO: 1231208 - RNA, 22 nt, Human
gagcccgcaaccccguccgcag

SEQ ID NO: 1231209 - RNA, 19 nt, Human
gcaucgcaguucuacuacu

SEQ ID NO: 1231210 - RNA, 24 nt, Human
gccucacaccccgcccccgcccgc

SEQ ID NO: 1231211 - RNA, 21 nt, Human
guccgcagcgccucacacccc

SEQ ID NO: 1231212 - RNA, 24 nt, Human
uaaucucugugccucaauuuccuc

SEQ ID NO: 1231213 - RNA, 24 nt, Human
ucucugugccucaauuuccucauc

SEQ ID NO: 1231214 - RNA, 22 nt, Human
ugguucagauuaguuaaucucu

SEQ ID NO: 1231215 - RNA, 22 nt, Human
uguagaaggccagaauagugga

SEQ ID NO: 1231216 - RNA, 18 nt, Human
uguccaaguuugcaucgc

SEQ ID NO: 1231217 - RNA, 23 nt, Human
uguccaaguuugcaucgcaguuc

SEQ ID NO: 1231218 - RNA, 21 nt, Human
uugcaucgcaguucuacuacu

SEQ ID NO: 1231219 - RNA, 23 nt, Human
aagcagccaggccaccacgggca

SEQ ID NO: 1231220 - RNA, 24 nt, Human
agagaggaguuucccacaggauug

SEQ ID NO: 1231221 - RNA, 18 nt, Human
aggcuccaucagggcagu

SEQ ID NO: 1231222 - RNA, 22 nt, Human
agguccacucuucacagacagc

SEQ ID NO: 1231223 - RNA, 22 nt, Human
agguccuggcaugcagcagaug

SEQ ID NO: 1231224 - RNA, 18 nt, Human
caccacgggcaagagagu

SEQ ID NO: 1231225 - RNA, 20 nt, Human
cacucuucacagacagcaag

SEQ ID NO: 1231226 - RNA, 19 nt, Human
cagccaggccaccacgggc

SEQ ID NO: 1231227 - RNA, 22 nt, Human
ccugcuggcaaccccaguucca

SEQ ID NO: 1231228 - RNA, 23 nt, Human
gcagguccuggcaugcagcagau

SEQ ID NO: 1231229 - RNA, 20 nt, Human
gcaugcagcagaugcccagu

SEQ ID NO: 1231230 - RNA, 20 nt, Human
gcaugcagcagaugcccagu

SEQ ID NO: 1231231 - RNA, 21 nt, Human
ggcuccaucagggcaguccca

SEQ ID NO: 1231232 - RNA, 21 nt, Human
gggcaagagagugcagcucuu

SEQ ID NO: 1231233 - RNA, 25 nt, Human
uacacggccaccagggagacgcagc

SEQ ID NO: 1231234 - RNA, 19 nt, Human
ucacagacagcaagcagcc

SEQ ID NO: 1231235 - RNA, 22 nt, Human
ucacagacagcaagcagccagg

SEQ ID NO: 1231236 - RNA, 19 nt, Human
ucccaccgcuucugagccu

SEQ ID NO: 1231237 - RNA, 19 nt, Human
ucuagagaggaguuuccca

SEQ ID NO: 1231238 - RNA, 19 nt, Human
ugaaugugucucauuuguu

SEQ ID NO: 1231239 - RNA, 20 nt, Human
ugcagcagaugcccagugaa

SEQ ID NO: 1231240 - RNA, 19 nt, Human
ugcuggcaaccccaguucc

SEQ ID NO: 1231241 - RNA, 19 nt, Human
uucacagacagcaagcagc

SEQ ID NO: 1231242 - RNA, 24 nt, Human
uucacagacagcaagcagccaggc

SEQ ID NO: 1231243 - RNA, 18 nt, Human
aacacccuccuaauacaa

SEQ ID NO: 1231244 - RNA, 21 nt, Human
aacacccuccuaauacaaaag

SEQ ID NO: 1231245 - RNA, 20 nt, Human
aaggagaaacaacccgaggc

SEQ ID NO: 1231246 - RNA, 20 nt, Human
agaaacccccaggguuuaga

SEQ ID NO: 1231247 - RNA, 18 nt, Human
agacaguccccauccuga

SEQ ID NO: 1231248 - RNA, 24 nt, Human
agacaguccccauccugaaauuca

SEQ ID NO: 1231249 - RNA, 21 nt, Human
aggaacccacccugagucacc

SEQ ID NO: 1231250 - RNA, 18 nt, Human
auaaacucaggugugguc

SEQ ID NO: 1231251 - RNA, 25 nt, Human
auacaucuucuguuaugcaacaccc

SEQ ID NO: 1231252 - RNA, 20 nt, Human
auccaggacaaagaccugau

SEQ ID NO: 1231253 - RNA, 21 nt, Human
caacacccuccuaauacaaaa

SEQ ID NO: 1231254 - RNA, 22 nt, Human
cacccugagucaccucauuagc

SEQ ID NO: 1231255 - RNA, 18 nt, Human
cacuucugagaaaccccc

SEQ ID NO: 1231256 - RNA, 18 nt, Human
cagaacugggucuuccug

SEQ ID NO: 1231257 - RNA, 21 nt, Human
cagcagacaguccccauccug

SEQ ID NO: 1231258 - RNA, 21 nt, Human
caggacuaaugcagacgcucc

SEQ ID NO: 1231259 - RNA, 19 nt, Human
caggggcccgccaggacua

SEQ ID NO: 1231260 - RNA, 22 nt, Human
ccacgacugaggagcugaaggc

SEQ ID NO: 1231261 - RNA, 21 nt, Human
ccagcuguguaucugcagcuu

SEQ ID NO: 1231262 - RNA, 24 nt, Human
cgccaggacuaaugcagacgcucc

SEQ ID NO: 1231263 - RNA, 18 nt, Human
cggcaggaaaggacaccc

SEQ ID NO: 1231264 - RNA, 18 nt, Human
cggcuccugggcuuuccu

SEQ ID NO: 1231265 - RNA, 19 nt, Human
cggcuccugggcuuuccuc

SEQ ID NO: 1231266 - RNA, 18 nt, Human
cucaaagccccaacccuc

SEQ ID NO: 1231267 - RNA, 20 nt, Human
cuccacacuucugagaaacc

SEQ ID NO: 1231268 - RNA, 20 nt, Human
cugaaggcccuccaggccca

SEQ ID NO: 1231269 - RNA, 19 nt, Human
gacugcugggagguugggc

SEQ ID NO: 1231270 - RNA, 22 nt, Human
gcagcuuuguucuucuguuucu

SEQ ID NO: 1231271 - RNA, 21 nt, Human
gcaucuggguugccuccagcu

SEQ ID NO: 1231272 - RNA, 24 nt, Human
gcaugcugagcugccagaacuggg

SEQ ID NO: 1231273 - RNA, 18 nt, Human
ggccuuucccagcugugu

SEQ ID NO: 1231274 - RNA, 23 nt, Human
gggcaucuggguugccuccagcu

SEQ ID NO: 1231275 - RNA, 21 nt, Human
gggucuuucagcagacagucc

SEQ ID NO: 1231276 - RNA, 18 nt, Human
ggugcacacgugucucug

SEQ ID NO: 1231277 - RNA, 21 nt, Human
gguguggucccaggggcccgc

SEQ ID NO: 1231278 - RNA, 22 nt, Human
gucaccucauuagcauaaacuc

SEQ ID NO: 1231279 - RNA, 19 nt, Human
guggucccaggggcccgcc

SEQ ID NO: 1231280 - RNA, 22 nt, Human
uaaugcagacgcuccacacuuc

SEQ ID NO: 1231281 - RNA, 19 nt, Human
uacagcaaugucacagaca

SEQ ID NO: 1231282 - RNA, 20 nt, Human
uacagcaaugucacagacau

SEQ ID NO: 1231283 - RNA, 20 nt, Human
uagaagcuuccuccgaggau

SEQ ID NO: 1231284 - RNA, 20 nt, Human
uaggugauugaagcccacuu

SEQ ID NO: 1231285 - RNA, 23 nt, Human
ucagguguggucccaggggcccg

SEQ ID NO: 1231286 - RNA, 24 nt, Human
ucaguaggaacccacccugaguca

SEQ ID NO: 1231287 - RNA, 18 nt, Human
uccaaaggagaaacaacc

SEQ ID NO: 1231288 - RNA, 24 nt, Human
uccaaaggagaaacaacccgaggc

SEQ ID NO: 1231289 - RNA, 23 nt, Human
uccacacuucugagaaaccccca

SEQ ID NO: 1231290 - RNA, 21 nt, Human
uccuguggcuguucuuccuuc

SEQ ID NO: 1231291 - RNA, 21 nt, Human
ugaaggcccuccaggcccagu

SEQ ID NO: 1231292 - RNA, 22 nt, Human
ugcagacgcuccacacuucuga

SEQ ID NO: 1231293 - RNA, 23 nt, Human
ugggcccagagagauccuuccaa

SEQ ID NO: 1231294 - RNA, 22 nt, Human
uuccacgggcaucuggguugcc

SEQ ID NO: 1231295 - RNA, 21 nt, Human
uucccagcuguguaucugcag

SEQ ID NO: 1231296 - RNA, 22 nt, Human
uuccuguggcuguucuuccuuc

SEQ ID NO: 1231297 - RNA, 23 nt, Human
uuccuuccacgggcaucuggguu

SEQ ID NO: 1231298 - RNA, 23 nt, Human
uucucacuuaucaaagcaucucg

SEQ ID NO: 1231299 - RNA, 24 nt, Human
uuucccagcuguguaucugcagcu

SEQ ID NO: 1231300 - RNA, 18 nt, Human
aacaugugcccaaggugg

SEQ ID NO: 1231301 - RNA, 23 nt, Human
agaaagcccacaaccagcggaac

SEQ ID NO: 1231302 - RNA, 21 nt, Human
aggcaggacagcucaaagugg

SEQ ID NO: 1231303 - RNA, 22 nt, Human
agguaaauuuaaacauuuucua

SEQ ID NO: 1231304 - RNA, 24 nt, Human
cagcccucaggagguccugagaac

SEQ ID NO: 1231305 - RNA, 18 nt, Human
cauggcccgugacacagc

SEQ ID NO: 1231306 - RNA, 23 nt, Human
cauggcccgugacacagcccuca

SEQ ID NO: 1231307 - RNA, 21 nt, Human
ccagcggaacgcaggcgaugg

SEQ ID NO: 1231308 - RNA, 21 nt, Human
cccacaaccagcggaacgcag

SEQ ID NO: 1231309 - RNA, 21 nt, Human
gaaauacauugguuugguuca

SEQ ID NO: 1231310 - RNA, 19 nt, Human
gaacaugugcccaaggugg

SEQ ID NO: 1231311 - RNA, 24 nt, Human
gagaacaugugcccaagguggucg

SEQ ID NO: 1231312 - RNA, 18 nt, Human
ggccgcagaaagcccaca

SEQ ID NO: 1231313 - RNA, 19 nt, Human
ggccgcagaaagcccacaa

SEQ ID NO: 1231314 - RNA, 21 nt, Human
ggccgcagaaagcccacaacc

SEQ ID NO: 1231315 - RNA, 22 nt, Human
ggcggaggggagacgcgcccuc

SEQ ID NO: 1231316 - RNA, 23 nt, Human
uccaggcuauagguaaauuuaaa

SEQ ID NO: 1231317 - RNA, 21 nt, Human
ucggagccuaauaugagugac

SEQ ID NO: 1231318 - RNA, 20 nt, Human
uggggagaggagcgagcagg

SEQ ID NO: 1231319 - RNA, 21 nt, Human
uggggagaggagcgagcaggc

SEQ ID NO: 1231320 - RNA, 22 nt, Human
agcagaagcugaaaaaagcuuc

SEQ ID NO: 1231321 - RNA, 24 nt, Human
agcagaagcugaaaaaagcuucca

SEQ ID NO: 1231322 - RNA, 18 nt, Human
caccugaggggacagagc

SEQ ID NO: 1231323 - RNA, 19 nt, Human
cagcuccugucuuuccccc

SEQ ID NO: 1231324 - RNA, 23 nt, Human
cagggccaggugccugagagacc

SEQ ID NO: 1231325 - RNA, 21 nt, Human
caggggccagaauccccagau

SEQ ID NO: 1231326 - RNA, 21 nt, Human
ccagcagaagcugaaaaaagc

SEQ ID NO: 1231327 - RNA, 22 nt, Human
ccaggggccagaauccccagau

SEQ ID NO: 1231328 - RNA, 25 nt, Human
cccagcugcccuucugguaccucag

SEQ ID NO: 1231329 - RNA, 24 nt, Human
cccccgagaugcugugccugcagg

SEQ ID NO: 1231330 - RNA, 24 nt, Human
ccccugagaccuccccaguguaga

SEQ ID NO: 1231331 - RNA, 21 nt, Human
ccucugaagccaggggccaga

SEQ ID NO: 1231332 - RNA, 20 nt, Human
ccugagagacccccagcucc

SEQ ID NO: 1231333 - RNA, 22 nt, Human
cggccugggccccccgagaugc

SEQ ID NO: 1231334 - RNA, 22 nt, Human
cugaagccaggggccagaaucc

SEQ ID NO: 1231335 - RNA, 21 nt, Human
gcuccaccugggccucugaag

SEQ ID NO: 1231336 - RNA, 20 nt, Human
ggccaggugccugagagacc

SEQ ID NO: 1231337 - RNA, 23 nt, Human
ugaggcauugccccugagaccuc

SEQ ID NO: 1231338 - RNA, 19 nt, Human
ugggccucugaagccaggg

SEQ ID NO: 1231339 - RNA, 21 nt, Human
uguagagccagcagaagcuga

SEQ ID NO: 1231340 - RNA, 18 nt, Human
acccaagggcgcacacug

SEQ ID NO: 1231341 - RNA, 22 nt, Human
agggagguaggggcaggccaga

SEQ ID NO: 1231342 - RNA, 22 nt, Human
cagagucccagcuguccuggac

SEQ ID NO: 1231343 - RNA, 24 nt, Human
cagcagcuccgucucacaccugcc

SEQ ID NO: 1231344 - RNA, 18 nt, Human
cagggagguaggggcagg

SEQ ID NO: 1231345 - RNA, 18 nt, Human
ccagagucccagcugucc

SEQ ID NO: 1231346 - RNA, 18 nt, Human
ccagguggugggacgugu

SEQ ID NO: 1231347 - RNA, 22 nt, Human
ccagguggugggacguguggcu

SEQ ID NO: 1231348 - RNA, 24 nt, Human
cccagguggugggacguguggcug

SEQ ID NO: 1231349 - RNA, 22 nt, Human
cucacaccugccuccagagcuc

SEQ ID NO: 1231350 - RNA, 22 nt, Human
cuggacucugggcgcucaccag

SEQ ID NO: 1231351 - RNA, 24 nt, Human
cuuccuggacccacugaguaaccc

SEQ ID NO: 1231352 - RNA, 24 nt, Human
gcacacuggggacugggccccucc

SEQ ID NO: 1231353 - RNA, 25 nt, Human
ggacugggugggugggcucacaggg

SEQ ID NO: 1231354 - RNA, 19 nt, Human
ggccccuccggguucuucc

SEQ ID NO: 1231355 - RNA, 25 nt, Human
gugggcucacagggagguaggggca

SEQ ID NO: 1231356 - RNA, 19 nt, Human
uccagagcucaggacuggg

SEQ ID NO: 1231357 - RNA, 22 nt, Human
uccuggacccacugaguaaccc

SEQ ID NO: 1231358 - RNA, 23 nt, Human
ugaguaacccagguggugggacg

SEQ ID NO: 1231359 - RNA, 24 nt, Human
uggacccacugaguaacccaggug

SEQ ID NO: 1231360 - RNA, 27 nt, Human
uggacucugggcgcucaccagcagcuc

SEQ ID NO: 1231361 - RNA, 22 nt, Human
uggugggacguguggcugugag

SEQ ID NO: 1231362 - RNA, 18 nt, Human
ugugaguccuggacucug

SEQ ID NO: 1231363 - RNA, 24 nt, Human
aaacagacauaaucacaauuccaa

SEQ ID NO: 1231364 - RNA, 25 nt, Human
aaacagacauaaucacaauuccaac

SEQ ID NO: 1231365 - RNA, 24 nt, Human
aaaguggugggauuacaggcauga

SEQ ID NO: 1231366 - RNA, 26 nt, Human
aagcgauucucaugccucagccuccu

SEQ ID NO: 1231367 - RNA, 22 nt, Human
aagugauccuccugcaucaccc

SEQ ID NO: 1231368 - RNA, 21 nt, Human
aaguggugggauuacaggcau

SEQ ID NO: 1231369 - RNA, 21 nt, Human
aaugugucuacauccuuggau

SEQ ID NO: 1231370 - RNA, 21 nt, Human
acaaucucagcucauagcaac

SEQ ID NO: 1231371 - RNA, 18 nt, Human
acaggguuucaccauguu

SEQ ID NO: 1231372 - RNA, 23 nt, Human
acaggguuucaccauguuggcca

SEQ ID NO: 1231373 - RNA, 24 nt, Human
acaggguuucaccauguuggccag

SEQ ID NO: 1231374 - RNA, 18 nt, Human
accauauaauaggaaaau

SEQ ID NO: 1231375 - RNA, 18 nt, Human
accauguuggccaggcug

SEQ ID NO: 1231376 - RNA, 24 nt, Human
acccuguugcccaggguggaauga

SEQ ID NO: 1231377 - RNA, 18 nt, Human
agccuccugaguagcuag

SEQ ID NO: 1231378 - RNA, 24 nt, Human
agcgauucucaugccucagccucc

SEQ ID NO: 1231379 - RNA, 21 nt, Human
aggcuggucuccaacuccugg

SEQ ID NO: 1231380 - RNA, 21 nt, Human
aguagcuaggauuacaggcau

SEQ ID NO: 1231381 - RNA, 24 nt, Human
agugauccuccugcaucacccucc

SEQ ID NO: 1231382 - RNA, 22 nt, Human
augccucagccuccugaguagc

SEQ ID NO: 1231383 - RNA, 21 nt, Human
auuuuuuuaaaguuucaaauu

SEQ ID NO: 1231384 - RNA, 20 nt, Human
caaagaccaauccgcucuuc

SEQ ID NO: 1231385 - RNA, 24 nt, Human
caaaguggugggauuacaggcaug

SEQ ID NO: 1231386 - RNA, 24 nt, Human
caacuccuggccucaagugauccu

SEQ ID NO: 1231387 - RNA, 21 nt, Human
caccagguccagcuaauuuuu

SEQ ID NO: 1231388 - RNA, 21 nt, Human
caccauguuggccaggcuggu

SEQ ID NO: 1231389 - RNA, 24 nt, Human
caccauguuggccaggcuggucuc

SEQ ID NO: 1231390 - RNA, 27 nt, Human
caccauguuggccaggcuggucuccaa

SEQ ID NO: 1231391 - RNA, 19 nt, Human
cacccuguugcccagggug

SEQ ID NO: 1231392 - RNA, 24 nt, Human
cagagucucacccuguugcccagg

SEQ ID NO: 1231393 - RNA, 19 nt, Human
cagccuccugaguagcuag

SEQ ID NO: 1231394 - RNA, 24 nt, Human
caggguuucaccauguuggccagg

SEQ ID NO: 1231395 - RNA, 25 nt, Human
cauacaaagguacagcuuugucaag

SEQ ID NO: 1231396 - RNA, 24 nt, Human
caugccucagccuccugaguagcu

SEQ ID NO: 1231397 - RNA, 24 nt, Human
cauguuggccaggcuggucuccaa

SEQ ID NO: 1231398 - RNA, 19 nt, Human
ccaaaguggugggauuaca

SEQ ID NO: 1231399 - RNA, 24 nt, Human
ccaaaguggugggauuacaggcau

SEQ ID NO: 1231400 - RNA, 20 nt, Human
ccaggcuggucuccaacucc

SEQ ID NO: 1231401 - RNA, 24 nt, Human
cccaaaguggugggauuacaggca

SEQ ID NO: 1231402 - RNA, 19 nt, Human
ccuccugcaucacccuccc

SEQ ID NO: 1231403 - RNA, 22 nt, Human
ccuccugcaucacccucccaaa

SEQ ID NO: 1231404 - RNA, 23 nt, Human
ccugaguagcuaggauuacaggc

SEQ ID NO: 1231405 - RNA, 24 nt, Human
ccugaguagcuaggauuacaggca

SEQ ID NO: 1231406 - RNA, 18 nt, Human
ccuggccucaagugaucc

SEQ ID NO: 1231407 - RNA, 21 nt, Human
ccuggccucaagugauccucc

SEQ ID NO: 1231408 - RNA, 22 nt, Human
ccuggccucaagugauccuccu

SEQ ID NO: 1231409 - RNA, 23 nt, Human
ccuggccucaagugauccuccug

SEQ ID NO: 1231410 - RNA, 24 nt, Human
cuaaugugucuacauccuuggaua

SEQ ID NO: 1231411 - RNA, 22 nt, Human
cucauagcaaccuccacuugcu

SEQ ID NO: 1231412 - RNA, 24 nt, Human
cucauagcaaccuccacuugcuga

SEQ ID NO: 1231413 - RNA, 25 nt, Human
cucaugccucagccuccugaguagc

SEQ ID NO: 1231414 - RNA, 24 nt, Human
cuccugaguagcuaggauuacagg

SEQ ID NO: 1231415 - RNA, 21 nt, Human
cuccugcaucacccucccaaa

SEQ ID NO: 1231416 - RNA, 24 nt, Human
cugaguagcuaggauuacaggcau

SEQ ID NO: 1231417 - RNA, 21 nt, Human
cugcaucacccucccaaagug

SEQ ID NO: 1231418 - RNA, 19 nt, Human
gaacaaagaccaauccgcu

SEQ ID NO: 1231419 - RNA, 22 nt, Human
gaguagcuaggauuacaggcau

SEQ ID NO: 1231420 - RNA, 24 nt, Human
gaguagcuaggauuacaggcaugc

SEQ ID NO: 1231421 - RNA, 18 nt, Human
gauuacaggcaugagcca

SEQ ID NO: 1231422 - RNA, 21 nt, Human
gauuacaggcaugagccacca

SEQ ID NO: 1231423 - RNA, 22 nt, Human
gauuacaggcaugagccaccau

SEQ ID NO: 1231424 - RNA, 18 nt, Human
gauuacaggcaugcgcca

SEQ ID NO: 1231425 - RNA, 24 nt, Human
gcgauucucaugccucagccuccu

SEQ ID NO: 1231426 - RNA, 20 nt, Human
gcucuuguugaacaaagacu

SEQ ID NO: 1231427 - RNA, 23 nt, Human
gcuggucuccaacuccuggccuc

SEQ ID NO: 1231428 - RNA, 24 nt, Human
ggauuacaggcaugagccaccaug

SEQ ID NO: 1231429 - RNA, 19 nt, Human
ggauuacaggcaugcgcca

SEQ ID NO: 1231430 - RNA, 22 nt, Human
ggauuacaggcaugcgccacca

SEQ ID NO: 1231431 - RNA, 24 nt, Human
ggcuggucuccaacuccuggccuc

SEQ ID NO: 1231432 - RNA, 22 nt, Human
ggguuucaccauguuggccagg

SEQ ID NO: 1231433 - RNA, 20 nt, Human
guagcuaggauuacaggcau

SEQ ID NO: 1231434 - RNA, 25 nt, Human
uaaaacagacauaaucacaauucca

SEQ ID NO: 1231435 - RNA, 25 nt, Human
uaaacaacuaaaacagacauaauca

SEQ ID NO: 1231436 - RNA, 18 nt, Human
uaaagaacagcuaaguuc

SEQ ID NO: 1231437 - RNA, 20 nt, Human
uaagguacauuugcaaagaa

SEQ ID NO: 1231438 - RNA, 28 nt, Human
uaauuuuuuuuuguauuuuuaguagaga

SEQ ID NO: 1231439 - RNA, 22 nt, Human
uacaggcaugagccaccaugcc

SEQ ID NO: 1231440 - RNA, 22 nt, Human
uagagacaggguuucaccaugu

SEQ ID NO: 1231441 - RNA, 24 nt, Human
uaggaaaauucuuuuaaacaacua

SEQ ID NO: 1231442 - RNA, 21 nt, Human
uaggauuacaggcaugcgcca

SEQ ID NO: 1231443 - RNA, 22 nt, Human
uaggauuacaggcaugcgccac

SEQ ID NO: 1231444 - RNA, 24 nt, Human
uaggauuacaggcaugcgccacca

SEQ ID NO: 1231445 - RNA, 24 nt, Human
uaguagagacaggguuucaccaug

SEQ ID NO: 1231446 - RNA, 26 nt, Human
uaguagagacaggguuucaccauguu

SEQ ID NO: 1231447 - RNA, 21 nt, Human
ucaagugauccuccugcauca

SEQ ID NO: 1231448 - RNA, 26 nt, Human
ucauagcaaccuccacuuggggcccu

SEQ ID NO: 1231449 - RNA, 26 nt, Human
ucauagcaaccuccacuugggguccu

SEQ ID NO: 1231450 - RNA, 18 nt, Human
ucaugauuugcuccucau

SEQ ID NO: 1231451 - RNA, 24 nt, Human
ucccaaaguggugggauuacaggc

SEQ ID NO: 1231452 - RNA, 23 nt, Human
uccuccugcaucacccucccaaa

SEQ ID NO: 1231453 - RNA, 19 nt, Human
uccugaguagcuaggauua

SEQ ID NO: 1231454 - RNA, 24 nt, Human
uccugaguagcuaggauuacaggc

SEQ ID NO: 1231455 - RNA, 20 nt, Human
ucucacccuguugcccaggg

SEQ ID NO: 1231456 - RNA, 24 nt, Human
ucucacccuguugcccagggugga

SEQ ID NO: 1231457 - RNA, 26 nt, Human
ucucacccuguugcccaggguggaau

SEQ ID NO: 1231458 - RNA, 27 nt, Human
ucucacccuguugcccaggguggaaug

SEQ ID NO: 1231459 - RNA, 18 nt, Human
ugagacagagucucaccc

SEQ ID NO: 1231460 - RNA, 22 nt, Human
ugagacagagucucacccuguu

SEQ ID NO: 1231461 - RNA, 23 nt, Human
ugccucagccuccugaguagcua

SEQ ID NO: 1231462 - RNA, 24 nt, Human
ugccucagccuccugaguagcuag

SEQ ID NO: 1231463 - RNA, 22 nt, Human
uggaauuuuugaacuccuuguc

SEQ ID NO: 1231464 - RNA, 24 nt, Human
uggcacaaucucagcucauagcaa

SEQ ID NO: 1231465 - RNA, 24 nt, Human
uggccaggcuggucuccaacuccu

SEQ ID NO: 1231466 - RNA, 18 nt, Human
uggccucaagugauccuc

SEQ ID NO: 1231467 - RNA, 20 nt, Human
uggccucaagugauccuccu

SEQ ID NO: 1231468 - RNA, 24 nt, Human
uggccucaagugauccuccugcau

SEQ ID NO: 1231469 - RNA, 18 nt, Human
ugggauuacaggcaugag

SEQ ID NO: 1231470 - RNA, 22 nt, Human
ugggauuacaggcaugagccac

SEQ ID NO: 1231471 - RNA, 23 nt, Human
ugggauuacaggcaugagccacc

SEQ ID NO: 1231472 - RNA, 24 nt, Human
ugggauuacaggcaugagccacca

SEQ ID NO: 1231473 - RNA, 25 nt, Human
ugggauuacaggcaugagccaccau

SEQ ID NO: 1231474 - RNA, 24 nt, Human
uuaguagagacaggguuucaccau

SEQ ID NO: 1231475 - RNA, 23 nt, Human
uucaagcgauucucaugccucag

SEQ ID NO: 1231476 - RNA, 24 nt, Human
uuucaccauguuggccaggcuggu

SEQ ID NO: 1231477 - RNA, 22 nt, Human
uuuuguauuuuuaguagagaca

SEQ ID NO: 1231478 - RNA, 24 nt, Human
uuuuuaguagagacaggguuucac

SEQ ID NO: 1231479 - RNA, 21 nt, Human
uuuuuguauuuuuaguagaga

SEQ ID NO: 1231480 - RNA, 21 nt, Human
uuuuuuguauuuuuaguagag

SEQ ID NO: 1231481 - RNA, 20 nt, Human
uuuuuuuuuuugagacagag

SEQ ID NO: 1231482 - RNA, 26 nt, Human
uuuuuuuuuuuugagacagagucuca

SEQ ID NO: 1231483 - RNA, 20 nt, Human
uuuuuuuuuuuuuuuuuugg

SEQ ID NO: 1231484 - RNA, 24 nt, Human
aaccaauucauucaccaggcggca

SEQ ID NO: 1231485 - RNA, 22 nt, Human
acggagucucacugauugcuag

SEQ ID NO: 1231486 - RNA, 20 nt, Human
aggugucucuuuaaagaaag

SEQ ID NO: 1231487 - RNA, 25 nt, Human
cauuucagcuucuggccacugggag

SEQ ID NO: 1231488 - RNA, 18 nt, Human
cuacgcccacggagucuc

SEQ ID NO: 1231489 - RNA, 19 nt, Human
cucacugauugcuagcaca

SEQ ID NO: 1231490 - RNA, 22 nt, Human
cuuaaaaaacggcgcaccacaa

SEQ ID NO: 1231491 - RNA, 22 nt, Human
uaaaaaacggcgcaccacaaga

SEQ ID NO: 1231492 - RNA, 22 nt, Human
uccuacgcccacggagucucac

SEQ ID NO: 1231493 - RNA, 18 nt, Human
ugccgucauuucagcuuc

SEQ ID NO: 1231494 - RNA, 27 nt, Human
aaaaauggcaaagagagaccgguaccc

SEQ ID NO: 1231495 - RNA, 22 nt, Human
aaggaccagcugccguucugga

SEQ ID NO: 1231496 - RNA, 19 nt, Human
acagguuggagaggaagaa

SEQ ID NO: 1231497 - RNA, 18 nt, Human
agaggaagaaguacaugg

SEQ ID NO: 1231498 - RNA, 23 nt, Human
agaggaagaaguacaugggggug

SEQ ID NO: 1231499 - RNA, 20 nt, Human
agcauacuggaugggcugcc

SEQ ID NO: 1231500 - RNA, 25 nt, Human
agccugcauagaagaugacucugcc

SEQ ID NO: 1231501 - RNA, 19 nt, Human
agcucacccacgccggccu

SEQ ID NO: 1231502 - RNA, 19 nt, Human
aggacaccugccccaaggc

SEQ ID NO: 1231503 - RNA, 23 nt, Human
agguguaggugccaugguccucc

SEQ ID NO: 1231504 - RNA, 21 nt, Human
augaucagguuccccagcacc

SEQ ID NO: 1231505 - RNA, 19 nt, Human
caaaaauggcaaagagaga

SEQ ID NO: 1231506 - RNA, 21 nt, Human
caaggacagguuggagaggaa

SEQ ID NO: 1231507 - RNA, 18 nt, Human
cacauggacaggaacagc

SEQ ID NO: 1231508 - RNA, 20 nt, Human
cagcaugggggugaccaccg

SEQ ID NO: 1231509 - RNA, 19 nt, Human
cagccugcauagaagauga

SEQ ID NO: 1231510 - RNA, 24 nt, Human
cagcugccguucuggauccucuga

SEQ ID NO: 1231511 - RNA, 18 nt, Human
caggacaccugccccaag

SEQ ID NO: 1231512 - RNA, 22 nt, Human
cagggcauccuggauguggagc

SEQ ID NO: 1231513 - RNA, 21 nt, Human
ccagcugccguucuggauccu

SEQ ID NO: 1231514 - RNA, 23 nt, Human
ccaggaugaugaucagguucccc

SEQ ID NO: 1231515 - RNA, 22 nt, Human
ccaggcagguguaggugccaug

SEQ ID NO: 1231516 - RNA, 22 nt, Human
ccggccucgcagguggagcgag

SEQ ID NO: 1231517 - RNA, 23 nt, Human
ccuccaaaaauggcaaagagaga

SEQ ID NO: 1231518 - RNA, 18 nt, Human
cucugagcacggacggug

SEQ ID NO: 1231519 - RNA, 21 nt, Human
cuggauccucugagcacggac

SEQ ID NO: 1231520 - RNA, 19 nt, Human
cuuccaugccuccaaaaau

SEQ ID NO: 1231521 - RNA, 23 nt, Human
gcucacccacgccggccucgcag

SEQ ID NO: 1231522 - RNA, 21 nt, Human
ggagcucacccacgccggccu

SEQ ID NO: 1231523 - RNA, 23 nt, Human
ggcagggcauccuggauguggag

SEQ ID NO: 1231524 - RNA, 19 nt, Human
ggggaggugggagucaggg

SEQ ID NO: 1231525 - RNA, 18 nt, Human
ggggguggggagguggga

SEQ ID NO: 1231526 - RNA, 19 nt, Human
ggggguggggaggugggag

SEQ ID NO: 1231527 - RNA, 23 nt, Human
ggggguggggaggugggagucag

SEQ ID NO: 1231528 - RNA, 23 nt, Human
ggguggggaggugggagucaggg

SEQ ID NO: 1231529 - RNA, 21 nt, Human
uacauggggguggggaggugg

SEQ ID NO: 1231530 - RNA, 23 nt, Human
uccaaaaauggcaaagagagaca

SEQ ID NO: 1231531 - RNA, 21 nt, Human
uccuccggcagggcauccugg

SEQ ID NO: 1231532 - RNA, 20 nt, Human
ugaagggguucagcaugggg

SEQ ID NO: 1231533 - RNA, 18 nt, Human
ugagcacggacggugacc

SEQ ID NO: 1231534 - RNA, 23 nt, Human
ugaugaucagguuccccagcacc

SEQ ID NO: 1231535 - RNA, 20 nt, Human
ugccccaaggcauucucagc

SEQ ID NO: 1231536 - RNA, 23 nt, Human
uggagcucacccacgccggccuc

SEQ ID NO: 1231537 - RNA, 18 nt, Human
uggauguccacaaucauc

SEQ ID NO: 1231538 - RNA, 18 nt, Human
uggggaggugggagucag

SEQ ID NO: 1231539 - RNA, 19 nt, Human
uggggaggugggagucagg

SEQ ID NO: 1231540 - RNA, 21 nt, Human
uggggaggugggagucagggc

SEQ ID NO: 1231541 - RNA, 18 nt, Human
uggggguggggagguggg

SEQ ID NO: 1231542 - RNA, 19 nt, Human
uggggguggggagguggga

SEQ ID NO: 1231543 - RNA, 20 nt, Human
uggggguggggaggugggag

SEQ ID NO: 1231544 - RNA, 23 nt, Human
uggggguggggaggugggaguca

SEQ ID NO: 1231545 - RNA, 24 nt, Human
uuucucaggcuguagaugaagggg

SEQ ID NO: 1231546 - RNA, 21 nt, Human
auggcccucaggcuccaggag

SEQ ID NO: 1231547 - RNA, 19 nt, Human
caccaggguuccccaaguc

SEQ ID NO: 1231548 - RNA, 19 nt, Human
cacccucaugugcacacac

SEQ ID NO: 1231549 - RNA, 18 nt, Human
caggguuccccaaguccc

SEQ ID NO: 1231550 - RNA, 20 nt, Human
cauggcccucaggcuccagg

SEQ ID NO: 1231551 - RNA, 25 nt, Human
cucaugugcacacacacaccuccca

SEQ ID NO: 1231552 - RNA, 19 nt, Human
guaguucuuccaccacugg

SEQ ID NO: 1231553 - RNA, 22 nt, Human
guaguucuuccaccacuggagg

SEQ ID NO: 1231554 - RNA, 24 nt, Human
uagacaugggcaccuccaagcacc

SEQ ID NO: 1231555 - RNA, 18 nt, Human
ucccaccuagacaugggc

SEQ ID NO: 1231556 - RNA, 19 nt, Human
uccccaagucccaccuaga

SEQ ID NO: 1231557 - RNA, 22 nt, Human
uaagauucuaacuuugcagaau

SEQ ID NO: 1231558 - RNA, 21 nt, Human
uugcagaauaggaaauggagg

SEQ ID NO: 1231559 - RNA, 24 nt, Human
aaacuaccagacauauuuucuagu

SEQ ID NO: 1231560 - RNA, 26 nt, Human
aaccccaaacgaacuuuugcuccacc

SEQ ID NO: 1231561 - RNA, 19 nt, Human
aagaaaccacccccaaaac

SEQ ID NO: 1231562 - RNA, 20 nt, Human
aagaacagcauaggggaaac

SEQ ID NO: 1231563 - RNA, 20 nt, Human
aagaacucaaguacaaauaa

SEQ ID NO: 1231564 - RNA, 21 nt, Human
aagaggacaaacaugacuagg

SEQ ID NO: 1231565 - RNA, 23 nt, Human
aagcauuacccaucagaaguugc

SEQ ID NO: 1231566 - RNA, 22 nt, Human
aaggcaaaaugccaaaauugga

SEQ ID NO: 1231567 - RNA, 22 nt, Human
aaguggaacaaccccaaacgaa

SEQ ID NO: 1231568 - RNA, 18 nt, Human
aaucauuuauucucauac

SEQ ID NO: 1231569 - RNA, 18 nt, Human
aaucuaguaacauuccau

SEQ ID NO: 1231570 - RNA, 19 nt, Human
aauuacaauucaacaugag

SEQ ID NO: 1231571 - RNA, 22 nt, Human
acaagaacucaaguacaaauaa

SEQ ID NO: 1231572 - RNA, 21 nt, Human
acacagacccaaaccauauca

SEQ ID NO: 1231573 - RNA, 18 nt, Human
acccaccagaaggaaaca

SEQ ID NO: 1231574 - RNA, 18 nt, Human
acccuaguagguguuugg

SEQ ID NO: 1231575 - RNA, 25 nt, Human
accucccuccaugucccuuccccaa

SEQ ID NO: 1231576 - RNA, 22 nt, Human
acuaacccacucaagacaacac

SEQ ID NO: 1231577 - RNA, 25 nt, Human
agaaaccacccccaaaacucagugg

SEQ ID NO: 1231578 - RNA, 23 nt, Human
agaaggaaacaacuccagacaca

SEQ ID NO: 1231579 - RNA, 25 nt, Human
agaaggacaagaacucaaguacaaa

SEQ ID NO: 1231580 - RNA, 21 nt, Human
agacaaagaugaaaauacucu

SEQ ID NO: 1231581 - RNA, 23 nt, Human
agcaccuucuuuacaugguggca

SEQ ID NO: 1231582 - RNA, 21 nt, Human
agccaaacacuuauaaaaccg

SEQ ID NO: 1231583 - RNA, 18 nt, Human
aggcuguagaagguuuau

SEQ ID NO: 1231584 - RNA, 22 nt, Human
agguguuuggggaaagaggguu

SEQ ID NO: 1231585 - RNA, 18 nt, Human
agugaugaugguagaagg

SEQ ID NO: 1231586 - RNA, 20 nt, Human
auccugaguccaguuugggg

SEQ ID NO: 1231587 - RNA, 19 nt, Human
auuuggguggggacacaga

SEQ ID NO: 1231588 - RNA, 22 nt, Human
caaaauaaagucuugaccaaua

SEQ ID NO: 1231589 - RNA, 19 nt, Human
caagaacagcauaggggaa

SEQ ID NO: 1231590 - RNA, 23 nt, Human
caaucaccucccuccaugucccu

SEQ ID NO: 1231591 - RNA, 20 nt, Human
caccagaaggaaacaacucc

SEQ ID NO: 1231592 - RNA, 21 nt, Human
caccagaaggaaacaacucca

SEQ ID NO: 1231593 - RNA, 24 nt, Human
cacccccaaaacucaguggcuuaa

SEQ ID NO: 1231594 - RNA, 19 nt, Human
caccucaagccaccuuccc

SEQ ID NO: 1231595 - RNA, 24 nt, Human
cacuccuccaccucaagccaccuu

SEQ ID NO: 1231596 - RNA, 21 nt, Human
cagaagacgaagggaaagcaa

SEQ ID NO: 1231597 - RNA, 21 nt, Human
cagcagccagaacccacucag

SEQ ID NO: 1231598 - RNA, 19 nt, Human
caucaggaauuacaauuca

SEQ ID NO: 1231599 - RNA, 21 nt, Human
caucaggaauuacaauucaac

SEQ ID NO: 1231600 - RNA, 25 nt, Human
cauucccccaugauccaaucaccuc

SEQ ID NO: 1231601 - RNA, 24 nt, Human
ccaaaccauaucacuccuccaccu

SEQ ID NO: 1231602 - RNA, 23 nt, Human
ccaaauccauaaacacaggaaaa

SEQ ID NO: 1231603 - RNA, 20 nt, Human
ccaccacaaauuuaccuaga

SEQ ID NO: 1231604 - RNA, 22 nt, Human
ccacucaagacaacacuagcag

SEQ ID NO: 1231605 - RNA, 24 nt, Human
ccagaaggaaacaacuccagacac

SEQ ID NO: 1231606 - RNA, 21 nt, Human
ccagacauauuuucuaguucu

SEQ ID NO: 1231607 - RNA, 25 nt, Human
ccagugaugaugguagaaggacaag

SEQ ID NO: 1231608 - RNA, 18 nt, Human
cccaaaccauaucacucc

SEQ ID NO: 1231609 - RNA, 24 nt, Human
cccauuagcauuauucugguccaa

SEQ ID NO: 1231610 - RNA, 23 nt, Human
ccccaugauccaaucaccucccu

SEQ ID NO: 1231611 - RNA, 23 nt, Human
cccccaugauccaaucaccuccc

SEQ ID NO: 1231612 - RNA, 22 nt, Human
ccucuccaaagccuuaaaaauc

SEQ ID NO: 1231613 - RNA, 24 nt, Human
cgauagggguacaucuacuaucau

SEQ ID NO: 1231614 - RNA, 21 nt, Human
cuaacccacucaagacaacac

SEQ ID NO: 1231615 - RNA, 24 nt, Human
cucaagacaacacuagcagaaaaa

SEQ ID NO: 1231616 - RNA, 22 nt, Human
cucacuuacuaucacaagaaca

SEQ ID NO: 1231617 - RNA, 19 nt, Human
cucuucacaauaaaucuug

SEQ ID NO: 1231618 - RNA, 22 nt, Human
gaaagaaaagaggacaaacaug

SEQ ID NO: 1231619 - RNA, 23 nt, Human
gaccaugaacccaccagaaggaa

SEQ ID NO: 1231620 - RNA, 21 nt, Human
gagauuuggguggggacacag

SEQ ID NO: 1231621 - RNA, 21 nt, Human
gaguccaguuuggggaggcag

SEQ ID NO: 1231622 - RNA, 18 nt, Human
gcagugacuacccagaga

SEQ ID NO: 1231623 - RNA, 24 nt, Human
gcauaagaaaccacccccaaaacu

SEQ ID NO: 1231624 - RNA, 21 nt, Human
ggaggcagugacuacccagag

SEQ ID NO: 1231625 - RNA, 28 nt, Human
ggcagaagacgaagggaaaggggacccc

SEQ ID NO: 1231626 - RNA, 23 nt, Human
gggcaaagaguaagggguaagug

SEQ ID NO: 1231627 - RNA, 23 nt, Human
guuuggggaggcagugacuaccc

SEQ ID NO: 1231628 - RNA, 19 nt, Human
uaaaagaaucgauaggggu

SEQ ID NO: 1231629 - RNA, 19 nt, Human
uaacaggaagcaugacugg

SEQ ID NO: 1231630 - RNA, 24 nt, Human
uaacuaacccacucaagacaacac

SEQ ID NO: 1231631 - RNA, 19 nt, Human
uaagaaaccacccccaaaa

SEQ ID NO: 1231632 - RNA, 20 nt, Human
uacaugguggcagaaugggg

SEQ ID NO: 1231633 - RNA, 24 nt, Human
uacaugguggcagaaugggguggg

SEQ ID NO: 1231634 - RNA, 22 nt, Human
uagaaggacaagaacucaagua

SEQ ID NO: 1231635 - RNA, 25 nt, Human
uauaaagaaagaaaagaggacaaac

SEQ ID NO: 1231636 - RNA, 18 nt, Human
uauaaguucuauuuacca

SEQ ID NO: 1231637 - RNA, 21 nt, Human
uaucacaagaacagcauaggg

SEQ ID NO: 1231638 - RNA, 19 nt, Human
uaucuuguccuuuguugag

SEQ ID NO: 1231639 - RNA, 22 nt, Human
uaugaagaaaagaaguuuaauu

SEQ ID NO: 1231640 - RNA, 18 nt, Human
ucaccucccuccaugucc

SEQ ID NO: 1231641 - RNA, 24 nt, Human
uccaccucaagccaccuuccagag

SEQ ID NO: 1231642 - RNA, 19 nt, Human
ucccagacaaagaugaaaa

SEQ ID NO: 1231643 - RNA, 20 nt, Human
ucccagacaaagaugaaaau

SEQ ID NO: 1231644 - RNA, 22 nt, Human
ucccuccaugucccuuccccaa

SEQ ID NO: 1231645 - RNA, 21 nt, Human
ucuacaaacaaaauaaagucu

SEQ ID NO: 1231646 - RNA, 21 nt, Human
ucuaguaacauuccaugggga

SEQ ID NO: 1231647 - RNA, 23 nt, Human
ucuccaaagccuuaaaaaucugc

SEQ ID NO: 1231648 - RNA, 22 nt, Human
ucucuggaggaagaaaauaauu

SEQ ID NO: 1231649 - RNA, 23 nt, Human
ugaacccaccagaaggaaacaac

SEQ ID NO: 1231650 - RNA, 21 nt, Human
ugaauaucucccaauaguuuu

SEQ ID NO: 1231651 - RNA, 22 nt, Human
ugaugaugguagaaggacaaga

SEQ ID NO: 1231652 - RNA, 22 nt, Human
ugcauaagaaaccacccccaaa

SEQ ID NO: 1231653 - RNA, 28 nt, Human
uggaacaaccccaaacgaaaggucaucc

SEQ ID NO: 1231654 - RNA, 18 nt, Human
uggcuccauucuugaagu

SEQ ID NO: 1231655 - RNA, 18 nt, Human
ugggaauaaaagcuggcc

SEQ ID NO: 1231656 - RNA, 18 nt, Human
uggggugggggaggagcc

SEQ ID NO: 1231657 - RNA, 21 nt, Human
uggggugggggaggagccaaa

SEQ ID NO: 1231658 - RNA, 18 nt, Human
uguagaaauaauguaugg

SEQ ID NO: 1231659 - RNA, 19 nt, Human
ugugaagguccauggcucc

SEQ ID NO: 1231660 - RNA, 22 nt, Human
uguguagaaauaauguaugggg

SEQ ID NO: 1231661 - RNA, 25 nt, Human
uuaaaaccaguaaaaccuguaaugu

SEQ ID NO: 1231662 - RNA, 24 nt, Human
uuacaugguggcagaauggggugg

SEQ ID NO: 1231663 - RNA, 24 nt, Human
uucaacaugagauuugggugggga

SEQ ID NO: 1231664 - RNA, 20 nt, Human
uuccagaguacuauuaaaac

SEQ ID NO: 1231665 - RNA, 20 nt, Human
uucccagacaaagaugaaaa

SEQ ID NO: 1231666 - RNA, 25 nt, Human
uucuauaaucagagcaagcauuacc

SEQ ID NO: 1231667 - RNA, 25 nt, Human
uugaagucagcgagaccaugaaccc

SEQ ID NO: 1231668 - RNA, 19 nt, Human
uugagacaaagaaugccac

SEQ ID NO: 1231669 - RNA, 18 nt, Human
uuggcuucuacaaacaaa

SEQ ID NO: 1231670 - RNA, 21 nt, Human
uuguaguugucuguccacagg

SEQ ID NO: 1231671 - RNA, 23 nt, Human
uuuccagugaugaugguagaagg

SEQ ID NO: 1231672 - RNA, 19 nt, Human
uuuggcuucuacaaacaaa

SEQ ID NO: 1231673 - RNA, 20 nt, Human
uuuguaguugucuguccaca

SEQ ID NO: 1231674 - RNA, 23 nt, Human
uuuguaguugucuguccacagga

SEQ ID NO: 1231675 - RNA, 25 nt, Human
uuuguaguugucuguccacaggauc

SEQ ID NO: 1231676 - RNA, 20 nt, Human
aaacugcuaccacacacuca

SEQ ID NO: 1231677 - RNA, 22 nt, Human
aaauaaacauuugaucuagaac

SEQ ID NO: 1231678 - RNA, 21 nt, Human
aaaucggcuggcgggaaccca

SEQ ID NO: 1231679 - RNA, 24 nt, Human
accacacacucauacuaucccaaa

SEQ ID NO: 1231680 - RNA, 24 nt, Human
auaaacauuugaucuagaacaaag

SEQ ID NO: 1231681 - RNA, 20 nt, Human
cagcaccauugcggcuccag

SEQ ID NO: 1231682 - RNA, 22 nt, Human
cagcgaguggcgugacccugac

SEQ ID NO: 1231683 - RNA, 23 nt, Human
ccccuccggccccuggucagcuc

SEQ ID NO: 1231684 - RNA, 20 nt, Human
cccgacgggugggaaagggc

SEQ ID NO: 1231685 - RNA, 26 nt, Human
cccgcagggggcccagggcuuggggg

SEQ ID NO: 1231686 - RNA, 18 nt, Human
cccgcccuccaucagcac

SEQ ID NO: 1231687 - RNA, 22 nt, Human
ccuggacggacuccgggccguc

SEQ ID NO: 1231688 - RNA, 18 nt, Human
cggacuccgggccguccc

SEQ ID NO: 1231689 - RNA, 20 nt, Human
cgggaacccaggagcccgac

SEQ ID NO: 1231690 - RNA, 21 nt, Human
cgugacggggcgcccagucgc

SEQ ID NO: 1231691 - RNA, 25 nt, Human
cuccagccuccgcggugcccggguc

SEQ ID NO: 1231692 - RNA, 18 nt, Human
cuccaucucccgcccucc

SEQ ID NO: 1231693 - RNA, 21 nt, Human
cucccgcccuccaucagcacc

SEQ ID NO: 1231694 - RNA, 19 nt, Human
cucccgcugccgccccacc

SEQ ID NO: 1231695 - RNA, 19 nt, Human
gaacccaggagcccgacgg

SEQ ID NO: 1231696 - RNA, 23 nt, Human
gacauucagcuauaguaaaaaua

SEQ ID NO: 1231697 - RNA, 19 nt, Human
gccgccccaccccagaauc

SEQ ID NO: 1231698 - RNA, 18 nt, Human
gcggagccacagacaacc

SEQ ID NO: 1231699 - RNA, 21 nt, Human
gcuccaucucccgcccuccau

SEQ ID NO: 1231700 - RNA, 23 nt, Human
ggccccuggucagcuccaucucc

SEQ ID NO: 1231701 - RNA, 19 nt, Human
ggcuuggggggcacagagu

SEQ ID NO: 1231702 - RNA, 21 nt, Human
ggcuuggggggcacagaguuc

SEQ ID NO: 1231703 - RNA, 26 nt, Human
uaccacacacucauacuaucccaaag

SEQ ID NO: 1231704 - RNA, 19 nt, Human
uagcagacauaacaucaaa

SEQ ID NO: 1231705 - RNA, 22 nt, Human
ucagcuccaucucccgcccucc

SEQ ID NO: 1231706 - RNA, 19 nt, Human
ugcccgggucuggggaggg

SEQ ID NO: 1231707 - RNA, 20 nt, Human
ugccuggacggacuccgggc

SEQ ID NO: 1231708 - RNA, 25 nt, Human
uggcgggaacccaggagcccgacgg

SEQ ID NO: 1231709 - RNA, 19 nt, Human
uggcgugacccugacggcu

SEQ ID NO: 1231710 - RNA, 20 nt, Human
uggggggcacagaguucagg

SEQ ID NO: 1231711 - RNA, 21 nt, Human
uucaggguuuccagcgagugg

SEQ ID NO: 1231712 - RNA, 25 nt, Human
aaaaaaaaaaaaaaaaagaaaagaa

SEQ ID NO: 1231713 - RNA, 23 nt, Human
aaaaaaaaaagaaaagaaaagaa

SEQ ID NO: 1231714 - RNA, 20 nt, Human
aaacagacauaugauagcau

SEQ ID NO: 1231715 - RNA, 23 nt, Human
aaagaaaagaaaagaaaaaggga

SEQ ID NO: 1231716 - RNA, 18 nt, Human
aaagcucuguuaagggua

SEQ ID NO: 1231717 - RNA, 19 nt, Human
aacaaaacauggaggaguc

SEQ ID NO: 1231718 - RNA, 20 nt, Human
aacagugcgagacuccaucu

SEQ ID NO: 1231719 - RNA, 19 nt, Human
aacauagugaaaccccauc

SEQ ID NO: 1231720 - RNA, 20 nt, Human
aacauagugaaaccccaucu

SEQ ID NO: 1231721 - RNA, 20 nt, Human
aacauagugaaaccccaucu

SEQ ID NO: 1231722 - RNA, 21 nt, Human
aacauagugaaaccccaucuc

SEQ ID NO: 1231723 - RNA, 22 nt, Human
aacuuccuucugguccucacug

SEQ ID NO: 1231724 - RNA, 24 nt, Human
aagaaaagaaaaagggagaaggga

SEQ ID NO: 1231725 - RNA, 22 nt, Human
aagaaagcauuccccuagggcc

SEQ ID NO: 1231726 - RNA, 21 nt, Human
aagucuuuuuccacccaacag

SEQ ID NO: 1231727 - RNA, 24 nt, Human
acaggcugggcgcaguggcucaug

SEQ ID NO: 1231728 - RNA, 24 nt, Human
acagugcgagacuccaucucaaaa

SEQ ID NO: 1231729 - RNA, 20 nt, Human
accagccccugcaacagugc

SEQ ID NO: 1231730 - RNA, 24 nt, Human
accccaucucuacuaaaaauacaa

SEQ ID NO: 1231731 - RNA, 21 nt, Human
agaaaagaaaaagggagaagg

SEQ ID NO: 1231732 - RNA, 18 nt, Human
agaaaagaaaagaaaaag

SEQ ID NO: 1231733 - RNA, 19 nt, Human
agaaaagaaaagaaaaagg

SEQ ID NO: 1231734 - RNA, 26 nt, Human
agaaaucauuuuagcacuguaauaag

SEQ ID NO: 1231735 - RNA, 22 nt, Human
agaagaaagucuuuuuccaccc

SEQ ID NO: 1231736 - RNA, 21 nt, Human
agacugugccacugcacacca

SEQ ID NO: 1231737 - RNA, 24 nt, Human
agcacuuugggaggcugaggcagg

SEQ ID NO: 1231738 - RNA, 21 nt, Human
agcaucacuugaacccgagag

SEQ ID NO: 1231739 - RNA, 21 nt, Human
agccgagacugugccacugca

SEQ ID NO: 1231740 - RNA, 20 nt, Human
agcugggcgugguggugggc

SEQ ID NO: 1231741 - RNA, 24 nt, Human
aggaggaucaccaggucaggaguu

SEQ ID NO: 1231742 - RNA, 22 nt, Human
aggaguucaagaccagacugcc

SEQ ID NO: 1231743 - RNA, 22 nt, Human
aggaucaccaggucaggaguuc

SEQ ID NO: 1231744 - RNA, 18 nt, Human
aggcaggagcaucacuug

SEQ ID NO: 1231745 - RNA, 24 nt, Human
aggcaggagcaucacuugaacccg

SEQ ID NO: 1231746 - RNA, 20 nt, Human
aggcaggaggaucaccaggu

SEQ ID NO: 1231747 - RNA, 24 nt, Human
aggcaggaggaucaccaggucagg

SEQ ID NO: 1231748 - RNA, 21 nt, Human
aggcggagguugcagugagcc

SEQ ID NO: 1231749 - RNA, 24 nt, Human
aggcggagguugcagugagccgag

SEQ ID NO: 1231750 - RNA, 24 nt, Human
aggcugaggcaggagcaucacuug

SEQ ID NO: 1231751 - RNA, 19 nt, Human
aggcugaggcaggaggauc

SEQ ID NO: 1231752 - RNA, 24 nt, Human
aguggcucaugccuauaaucccag

SEQ ID NO: 1231753 - RNA, 28 nt, Human
auaccagcaucccuuuccaaccggaggg

SEQ ID NO: 1231754 - RNA, 21 nt, Human
auacuguacuuaagagaagga

SEQ ID NO: 1231755 - RNA, 21 nt, Human
aucauaaaccucccaggauac

SEQ ID NO: 1231756 - RNA, 19 nt, Human
augccuauaaucccagcac

SEQ ID NO: 1231757 - RNA, 21 nt, Human
auuucagcuauacaagccaau

SEQ ID NO: 1231758 - RNA, 22 nt, Human
caagccaaucaccugaguaaaa

SEQ ID NO: 1231759 - RNA, 18 nt, Human
cacaaaacuuccuucugg

SEQ ID NO: 1231760 - RNA, 21 nt, Human
caccuguaauccuagcuauuc

SEQ ID NO: 1231761 - RNA, 24 nt, Human
caccuguaauccuagcuauucagg

SEQ ID NO: 1231762 - RNA, 20 nt, Human
cacugcacaccagccccugc

SEQ ID NO: 1231763 - RNA, 24 nt, Human
cacugcacaccagccccugcaaca

SEQ ID NO: 1231764 - RNA, 24 nt, Human
cagcacuuugggaggcugaggcag

SEQ ID NO: 1231765 - RNA, 25 nt, Human
cagcacuuugggaggcugaggcagg

SEQ ID NO: 1231766 - RNA, 18 nt, Human
cagcugaaaccuacuaca

SEQ ID NO: 1231767 - RNA, 19 nt, Human
caggaaccuguggcagggu

SEQ ID NO: 1231768 - RNA, 24 nt, Human
caggaggcugaggcaggagcauca

SEQ ID NO: 1231769 - RNA, 21 nt, Human
caucaugaguacucugcuuau

SEQ ID NO: 1231770 - RNA, 19 nt, Human
caucuggaacuaagagacu

SEQ ID NO: 1231771 - RNA, 20 nt, Human
caugccuauaaucccagcac

SEQ ID NO: 1231772 - RNA, 24 nt, Human
caugccuauaaucccagcacuuug

SEQ ID NO: 1231773 - RNA, 24 nt, Human
ccaacagaggaggccaaacaccag

SEQ ID NO: 1231774 - RNA, 21 nt, Human
ccacugcacaccagccccugc

SEQ ID NO: 1231775 - RNA, 18 nt, Human
ccagacugcccaacauag

SEQ ID NO: 1231776 - RNA, 22 nt, Human
ccccugcaacagugcgagacuc

SEQ ID NO: 1231777 - RNA, 19 nt, Human
ccuacaugauguuuugauu

SEQ ID NO: 1231778 - RNA, 20 nt, Human
ccuacuacagggcaaagauu

SEQ ID NO: 1231779 - RNA, 22 nt, Human
ccuauaaucccagcacuuuggg

SEQ ID NO: 1231780 - RNA, 23 nt, Human
cgagacuccaucucaaaaaaaaa

SEQ ID NO: 1231781 - RNA, 24 nt, Human
cgagaggcggagguugcagugagc

SEQ ID NO: 1231782 - RNA, 18 nt, Human
cucaaaaaaaaaaaaaaa

SEQ ID NO: 1231783 - RNA, 26 nt, Human
cucaaaaaaaaaaaaaaaaagaaaag

SEQ ID NO: 1231784 - RNA, 23 nt, Human
cucaugccuauaaucccagcacu

SEQ ID NO: 1231785 - RNA, 24 nt, Human
cucaugccuauaaucccagcacuu

SEQ ID NO: 1231786 - RNA, 19 nt, Human
cuccaucucaaaaaaaaaa

SEQ ID NO: 1231787 - RNA, 21 nt, Human
cuguaauccuagcuauucagg

SEQ ID NO: 1231788 - RNA, 20 nt, Human
gacaggcugggcgcaguggc

SEQ ID NO: 1231789 - RNA, 21 nt, Human
gacaggcugggcgcaguggcu

SEQ ID NO: 1231790 - RNA, 26 nt, Human
gacaggcugggcgcaguggcucaugc

SEQ ID NO: 1231791 - RNA, 19 nt, Human
gagaaagaacuauacugua

SEQ ID NO: 1231792 - RNA, 23 nt, Human
gagguugcagugagccgagacug

SEQ ID NO: 1231793 - RNA, 22 nt, Human
gaucaccaggucaggaguucaa

SEQ ID NO: 1231794 - RNA, 24 nt, Human
gaucaccaggucaggaguucaaga

SEQ ID NO: 1231795 - RNA, 24 nt, Human
gccaaagcacaaaacuuccuucug

SEQ ID NO: 1231796 - RNA, 21 nt, Human
gcucagcugaaaccuacuaca

SEQ ID NO: 1231797 - RNA, 19 nt, Human
ggacaggcugggcgcagug

SEQ ID NO: 1231798 - RNA, 21 nt, Human
ggacaggcugggcgcaguggc

SEQ ID NO: 1231799 - RNA, 22 nt, Human
ggagaaaaacagacauaugaua

SEQ ID NO: 1231800 - RNA, 18 nt, Human
ggagguugcagugagccg

SEQ ID NO: 1231801 - RNA, 20 nt, Human
ggagguugcagugagccgag

SEQ ID NO: 1231802 - RNA, 22 nt, Human
ggagguugcagugagccgagac

SEQ ID NO: 1231803 - RNA, 23 nt, Human
ggcgcaguggcucaugccuauaa

SEQ ID NO: 1231804 - RNA, 23 nt, Human
ggcugggcgcaguggcucaugcc

SEQ ID NO: 1231805 - RNA, 24 nt, Human
gggcgugguggugggcaccuguaa

SEQ ID NO: 1231806 - RNA, 24 nt, Human
gguggugggcaccuguaauccuag

SEQ ID NO: 1231807 - RNA, 30 nt, Human
uaaaaacaucaaaaaucauaaaccucccag

SEQ ID NO: 1231808 - RNA, 22 nt, Human
uaaaagaaaaaaaauaucucac

SEQ ID NO: 1231809 - RNA, 20 nt, Human
uaaaccucccaggauaccag

SEQ ID NO: 1231810 - RNA, 23 nt, Human
uaaaccucccaggauaccagcau

SEQ ID NO: 1231811 - RNA, 19 nt, Human
uaauauuacaauacuacuu

SEQ ID NO: 1231812 - RNA, 23 nt, Human
uaccagcaucccuuuccaagaga

SEQ ID NO: 1231813 - RNA, 22 nt, Human
uagagaacccaucuggaacuaa

SEQ ID NO: 1231814 - RNA, 24 nt, Human
uagcacuguaauaagaaaagcucu

SEQ ID NO: 1231815 - RNA, 24 nt, Human
uagcuauucaggaggcugaggcag

SEQ ID NO: 1231816 - RNA, 25 nt, Human
uaggaaguaacccagucauucaaau

SEQ ID NO: 1231817 - RNA, 22 nt, Human
uauaacuaggaaaauagagaag

SEQ ID NO: 1231818 - RNA, 21 nt, Human
uaugcauagaaagaaacaguu

SEQ ID NO: 1231819 - RNA, 24 nt, Human
ucaccaggucaggaguucaagacc

SEQ ID NO: 1231820 - RNA, 26 nt, Human
ucagcugaaaccuacuacagggcaaa

SEQ ID NO: 1231821 - RNA, 18 nt, Human
ucaugaguacucugcuua

SEQ ID NO: 1231822 - RNA, 20 nt, Human
ucauucaaauucuaccucuc

SEQ ID NO: 1231823 - RNA, 23 nt, Human
uccaucucaaaaaaaaaaaaaaa

SEQ ID NO: 1231824 - RNA, 22 nt, Human
ucucuacuaaaaauacaaaaaa

SEQ ID NO: 1231825 - RNA, 19 nt, Human
ugaaaccccaucucuacua

SEQ ID NO: 1231826 - RNA, 18 nt, Human
ugaaaccuacuacagggc

SEQ ID NO: 1231827 - RNA, 22 nt, Human
ugaacaggcacaugcauacuca

SEQ ID NO: 1231828 - RNA, 22 nt, Human
ugagccgagacugugccacugc

SEQ ID NO: 1231829 - RNA, 24 nt, Human
ugaggcaggagcaucacuugaacc

SEQ ID NO: 1231830 - RNA, 25 nt, Human
ugaggcaggagcaucacuugaaccc

SEQ ID NO: 1231831 - RNA, 20 nt, Human
ugaggcaggaggaucaccag

SEQ ID NO: 1231832 - RNA, 23 nt, Human
ugaggcaggaggaucaccagguc

SEQ ID NO: 1231833 - RNA, 24 nt, Human
ugaggcaggaggaucaccagguca

SEQ ID NO: 1231834 - RNA, 20 nt, Human
ugauuggaacaguuuuccuu

SEQ ID NO: 1231835 - RNA, 23 nt, Human
ugccuauaaucccagcacuuugg

SEQ ID NO: 1231836 - RNA, 22 nt, Human
uggaacaguuuuccuuuaauau

SEQ ID NO: 1231837 - RNA, 21 nt, Human
uggcucaugccuauaauccca

SEQ ID NO: 1231838 - RNA, 24 nt, Human
uggcucaugccuauaaucccagca

SEQ ID NO: 1231839 - RNA, 20 nt, Human
ugggaggcugaggcaggagg

SEQ ID NO: 1231840 - RNA, 24 nt, Human
ugggaggcugaggcaggaggauca

SEQ ID NO: 1231841 - RNA, 24 nt, Human
ugguagacaguacacuugggaauu

SEQ ID NO: 1231842 - RNA, 19 nt, Human
uggugggcaccuguaaucc

SEQ ID NO: 1231843 - RNA, 22 nt, Human
ugguggugggcaccuguaaucc

SEQ ID NO: 1231844 - RNA, 22 nt, Human
uguccuguauucuuaccauaga

SEQ ID NO: 1231845 - RNA, 18 nt, Human
uuagcugggcgugguggu

SEQ ID NO: 1231846 - RNA, 24 nt, Human
uuagcugggcgugguggugggcac

SEQ ID NO: 1231847 - RNA, 20 nt, Human
uucaagaggagaaaaacaga

SEQ ID NO: 1231848 - RNA, 19 nt, Human
uucaagaggagaaaaacga

SEQ ID NO: 1231849 - RNA, 24 nt, Human
uugaacccgagaggcggagguugc

SEQ ID NO: 1231850 - RNA, 19 nt, Human
uugcagugagccgagacug

SEQ ID NO: 1231851 - RNA, 22 nt, Human
uugcagugagccgagacugugc

SEQ ID NO: 1231852 - RNA, 23 nt, Human
uugcagugagccgagacugugcc

SEQ ID NO: 1231853 - RNA, 25 nt, Human
uugggaggcugaggcaggaggauca

SEQ ID NO: 1231854 - RNA, 19 nt, Human
uuuaagaaaaagggacagg

SEQ ID NO: 1231855 - RNA, 20 nt, Human
uuugauuuuucucaaaggca

SEQ ID NO: 1231856 - RNA, 25 nt, Human
uuuuuuauuaguuuuguuuuuuuuu

SEQ ID NO: 1231857 - RNA, 25 nt, Human
aaacuaaacuuaaaaucuaaaaauu

SEQ ID NO: 1231858 - RNA, 21 nt, Human
aaaucaggcuucaaaucgcag

SEQ ID NO: 1231859 - RNA, 26 nt, Human
aacaaaagcgacuccauugggaccac

SEQ ID NO: 1231860 - RNA, 22 nt, Human
aacagaaaaccuaaaacuaaac

SEQ ID NO: 1231861 - RNA, 24 nt, Human
aaccacucaaaauaaacgucucug

SEQ ID NO: 1231862 - RNA, 21 nt, Human
aagaagcucagagcccaaagc

SEQ ID NO: 1231863 - RNA, 23 nt, Human
aagaauaguaguaguguauuagc

SEQ ID NO: 1231864 - RNA, 20 nt, Human
aagacagugagacuccaucu

SEQ ID NO: 1231865 - RNA, 19 nt, Human
aagcacaaauuuaacugaa

SEQ ID NO: 1231866 - RNA, 20 nt, Human
aagcucagagcccaaagcaa

SEQ ID NO: 1231867 - RNA, 24 nt, Human
aaguagcuagaacuacaggcgugc

SEQ ID NO: 1231868 - RNA, 24 nt, Human
acaacagaaacacgguguacuaaa

SEQ ID NO: 1231869 - RNA, 25 nt, Human
acaauacaagcacucagaagcaccg

SEQ ID NO: 1231870 - RNA, 22 nt, Human
accacagaacacaacagaaaca

SEQ ID NO: 1231871 - RNA, 22 nt, Human
accaucaucaccaucaucaggu

SEQ ID NO: 1231872 - RNA, 21 nt, Human
acguuuacuuuuuguagaaac

SEQ ID NO: 1231873 - RNA, 22 nt, Human
acucacagcugacaauuacuga

SEQ ID NO: 1231874 - RNA, 19 nt, Human
agaaaagaaaaaugcugcg

SEQ ID NO: 1231875 - RNA, 23 nt, Human
agaagaagcucagagcccaaagc

SEQ ID NO: 1231876 - RNA, 20 nt, Human
agagaugaaaggcagaggaa

SEQ ID NO: 1231877 - RNA, 21 nt, Human
agaggaagcucagagcccaag

SEQ ID NO: 1231878 - RNA, 19 nt, Human
agcaggaggugucuccccc

SEQ ID NO: 1231879 - RNA, 24 nt, Human
agccugggcaagacagugagacuc

SEQ ID NO: 1231880 - RNA, 24 nt, Human
agcggguggggcuucauccugcag

SEQ ID NO: 1231881 - RNA, 19 nt, Human
agcuacuacuaauacucac

SEQ ID NO: 1231882 - RNA, 23 nt, Human
agcuauauacacuuugaggacca

SEQ ID NO: 1231883 - RNA, 19 nt, Human
agcugacaauuacugagca

SEQ ID NO: 1231884 - RNA, 20 nt, Human
aggaguuugagaccagccug

SEQ ID NO: 1231885 - RNA, 23 nt, Human
aggcagaagaagcucagagccca

SEQ ID NO: 1231886 - RNA, 23 nt, Human
aggcagaggaagcucagagccca

SEQ ID NO: 1231887 - RNA, 22 nt, Human
aggcaggccccaaggcacucca

SEQ ID NO: 1231888 - RNA, 23 nt, Human
aggcgggaggaucgcuugagccu

SEQ ID NO: 1231889 - RNA, 18 nt, Human
aguaacggcgaggacaca

SEQ ID NO: 1231890 - RNA, 28 nt, Human
auccaggcaggccccaaggcacuccagu

SEQ ID NO: 1231891 - RNA, 21 nt, Human
augagauggaccagaaaccug

SEQ ID NO: 1231892 - RNA, 24 nt, Human
augggguuucgcucugucucccag

SEQ ID NO: 1231893 - RNA, 22 nt, Human
auuuccucaauacucccuccca

SEQ ID NO: 1231894 - RNA, 19 nt, Human
caaaaacaugagcccccac

SEQ ID NO: 1231895 - RNA, 21 nt, Human
caaaaagaagggcagagaaca

SEQ ID NO: 1231896 - RNA, 22 nt, Human
caaaauaaaguaaaugugaauc

SEQ ID NO: 1231897 - RNA, 19 nt, Human
caaacaauaacgcugaccu

SEQ ID NO: 1231898 - RNA, 21 nt, Human
caaaucgcagcccugcaacuu

SEQ ID NO: 1231899 - RNA, 21 nt, Human
caacacaacuaugaaccuucc

SEQ ID NO: 1231900 - RNA, 22 nt, Human
caaccucccaggcugaagugau

SEQ ID NO: 1231901 - RNA, 22 nt, Human
caaugcagccucaaccucccag

SEQ ID NO: 1231902 - RNA, 21 nt, Human
cacaaauuuaacugaagugag

SEQ ID NO: 1231903 - RNA, 19 nt, Human
cacagggccacagggugaa

SEQ ID NO: 1231904 - RNA, 24 nt, Human
cacagggccacagggugaaugcuc

SEQ ID NO: 1231905 - RNA, 19 nt, Human
caccaggcagagguguggu

SEQ ID NO: 1231906 - RNA, 26 nt, Human
cagagcccaaagcaaagggguggagg

SEQ ID NO: 1231907 - RNA, 24 nt, Human
cagccucaaccucccaggcugaag

SEQ ID NO: 1231908 - RNA, 19 nt, Human
cagcucaaugcagccucaa

SEQ ID NO: 1231909 - RNA, 24 nt, Human
caucucagccucccaaguagcuag

SEQ ID NO: 1231910 - RNA, 22 nt, Human
ccacagaacacaacagaaacac

SEQ ID NO: 1231911 - RNA, 26 nt, Human
ccacccccaaacaauaacgcugaccu

SEQ ID NO: 1231912 - RNA, 23 nt, Human
ccauuugcauccacuguggucaa

SEQ ID NO: 1231913 - RNA, 23 nt, Human
cccaaguagcuagaacuacaggc

SEQ ID NO: 1231914 - RNA, 26 nt, Human
cccacccccaaacaauaacgcugacc

SEQ ID NO: 1231915 - RNA, 19 nt, Human
cccaggcuggagugccgug

SEQ ID NO: 1231916 - RNA, 23 nt, Human
cccccaaacaauaacgcugaccu

SEQ ID NO: 1231917 - RNA, 19 nt, Human
ccucaaccucccaggcuga

SEQ ID NO: 1231918 - RNA, 22 nt, Human
ccucuggugaaaauacgggaac

SEQ ID NO: 1231919 - RNA, 19 nt, Human
ccugcaacuucagagcuac

SEQ ID NO: 1231920 - RNA, 21 nt, Human
ccugcagagaugaaaggcaga

SEQ ID NO: 1231921 - RNA, 19 nt, Human
ccuguacagcggguggggc

SEQ ID NO: 1231922 - RNA, 25 nt, Human
cgaggacacaaaacugguagagcca

SEQ ID NO: 1231923 - RNA, 24 nt, Human
cgcaugcauuuccucaauacuccc

SEQ ID NO: 1231924 - RNA, 20 nt, Human
cgggccacaaauaccuucuc

SEQ ID NO: 1231925 - RNA, 20 nt, Human
cuaaacuuaaaaucuaaaaa

SEQ ID NO: 1231926 - RNA, 19 nt, Human
cucacaauguugccaaggc

SEQ ID NO: 1231927 - RNA, 22 nt, Human
cuccugugcaaagaagucucau

SEQ ID NO: 1231928 - RNA, 20 nt, Human
cucugucucccaggcuggag

SEQ ID NO: 1231929 - RNA, 20 nt, Human
cugaagugaucuucccaucu

SEQ ID NO: 1231930 - RNA, 24 nt, Human
cugaccauauugaacagacgaugc

SEQ ID NO: 1231931 - RNA, 20 nt, Human
cugagcacuugcucugugcc

SEQ ID NO: 1231932 - RNA, 21 nt, Human
cugcaacuucagagcuaccac

SEQ ID NO: 1231933 - RNA, 18 nt, Human
cugccaaggagggcaggc

SEQ ID NO: 1231934 - RNA, 26 nt, Human
cuucccaucucagccucccaaguagc

SEQ ID NO: 1231935 - RNA, 28 nt, Human
cuuugaggaccagcugaacuugggcagg

SEQ ID NO: 1231936 - RNA, 22 nt, Human
gaaaaccuaaaacuaaacuuaa

SEQ ID NO: 1231937 - RNA, 20 nt, Human
gaacuugggcagaacuaaca

SEQ ID NO: 1231938 - RNA, 20 nt, Human
gaagaagcucagagcccaaa

SEQ ID NO: 1231939 - RNA, 22 nt, Human
gagcuggcuuguuagccaagaa

SEQ ID NO: 1231940 - RNA, 24 nt, Human
gaucgcuugagccuaggaguuuga

SEQ ID NO: 1231941 - RNA, 20 nt, Human
gcagagaacagucuucuuca

SEQ ID NO: 1231942 - RNA, 21 nt, Human
gccguggcuugaucucagcuc

SEQ ID NO: 1231943 - RNA, 20 nt, Human
gccucaaccucccaggcuga

SEQ ID NO: 1231944 - RNA, 23 nt, Human
gcugaaaucaagauuauguucug

SEQ ID NO: 1231945 - RNA, 20 nt, Human
gcuggaaaaccacucaaaau

SEQ ID NO: 1231946 - RNA, 22 nt, Human
gcuuugcauccuguacagcggg

SEQ ID NO: 1231947 - RNA, 21 nt, Human
ggaaaaacacagggccacagg

SEQ ID NO: 1231948 - RNA, 19 nt, Human
ggaugccaccaggcagagg

SEQ ID NO: 1231949 - RNA, 24 nt, Human
ggcaggccccaaggcacuccagug

SEQ ID NO: 1231950 - RNA, 22 nt, Human
gggaacccaaacacacgaguca

SEQ ID NO: 1231951 - RNA, 23 nt, Human
gggaacccaaacacacgagucag

SEQ ID NO: 1231952 - RNA, 22 nt, Human
gggcagaacuaacacccucugg

SEQ ID NO: 1231953 - RNA, 19 nt, Human
gggcuucauccuacagaga

SEQ ID NO: 1231954 - RNA, 24 nt, Human
gugaucuucccaucucagccuccc

SEQ ID NO: 1231955 - RNA, 18 nt, Human
gugccuagcccaggggug

SEQ ID NO: 1231956 - RNA, 22 nt, Human
uaaaguaaaugugaaucaacug

SEQ ID NO: 1231957 - RNA, 25 nt, Human
uaaaguaaaugugaaucauguuggc

SEQ ID NO: 1231958 - RNA, 22 nt, Human
uaacaaccugccuuauuccaga

SEQ ID NO: 1231959 - RNA, 25 nt, Human
uaagucagacacugauuucaaagug

SEQ ID NO: 1231960 - RNA, 19 nt, Human
uacaaaaacaugagccccc

SEQ ID NO: 1231961 - RNA, 22 nt, Human
uacaauacaagcacucagaagc

SEQ ID NO: 1231962 - RNA, 21 nt, Human
uacauacaacacaacuaugaa

SEQ ID NO: 1231963 - RNA, 25 nt, Human
uacauacaacacaacuaugaaccuu

SEQ ID NO: 1231964 - RNA, 21 nt, Human
uaccaugcuaaugagguccag

SEQ ID NO: 1231965 - RNA, 25 nt, Human
uaccaugcuaaugagguccaguauu

SEQ ID NO: 1231966 - RNA, 18 nt, Human
uaccucuacucuaaacuc

SEQ ID NO: 1231967 - RNA, 22 nt, Human
uagaaacagggucucacaaugu

SEQ ID NO: 1231968 - RNA, 21 nt, Human
uagaacuacaggcgugcacca

SEQ ID NO: 1231969 - RNA, 24 nt, Human
uagaacuacaggcgugcaccacua

SEQ ID NO: 1231970 - RNA, 19 nt, Human
uagcagcugaaaucaagau

SEQ ID NO: 1231971 - RNA, 19 nt, Human
uagcccaggggugugagug

SEQ ID NO: 1231972 - RNA, 20 nt, Human
uaggaugccaccaggcagag

SEQ ID NO: 1231973 - RNA, 24 nt, Human
uaguagaggcgggaggaucgcuug

SEQ ID NO: 1231974 - RNA, 21 nt, Human
ucaaagcuuugagcuggcuug

SEQ ID NO: 1231975 - RNA, 23 nt, Human
ucaaugcagccucaaccucccag

SEQ ID NO: 1231976 - RNA, 24 nt, Human
ucaaugcagccucaaccucccagg

SEQ ID NO: 1231977 - RNA, 18 nt, Human
ucagccucccaaguagcu

SEQ ID NO: 1231978 - RNA, 20 nt, Human
ucagccucccaaguagcuag

SEQ ID NO: 1231979 - RNA, 20 nt, Human
uccagaaggaauucaggaaa

SEQ ID NO: 1231980 - RNA, 24 nt, Human
ucccaaguagcuagaacuacaggc

SEQ ID NO: 1231981 - RNA, 23 nt, Human
ucccucccaguaacggcgaggac

SEQ ID NO: 1231982 - RNA, 21 nt, Human
uccguguggcucgugucaccc

SEQ ID NO: 1231983 - RNA, 21 nt, Human
uccugaagggcggguggggcu

SEQ ID NO: 1231984 - RNA, 21 nt, Human
uccuguacagcggguggggcu

SEQ ID NO: 1231985 - RNA, 20 nt, Human
ucgcucugucucccaggcug

SEQ ID NO: 1231986 - RNA, 21 nt, Human
ucgcucugucucccaggcugg

SEQ ID NO: 1231987 - RNA, 22 nt, Human
ucgcucugucucccaggcugga

SEQ ID NO: 1231988 - RNA, 21 nt, Human
ucgcuugagccuaggaguuug

SEQ ID NO: 1231989 - RNA, 18 nt, Human
ucucccaggcuggagugc

SEQ ID NO: 1231990 - RNA, 23 nt, Human
ucucucucaagcaggcuccuggu

SEQ ID NO: 1231991 - RNA, 18 nt, Human
ucuggugaaaauacggga

SEQ ID NO: 1231992 - RNA, 19 nt, Human
ucugucucccaggcuggag

SEQ ID NO: 1231993 - RNA, 20 nt, Human
ugaacagacgaugcacagag

SEQ ID NO: 1231994 - RNA, 23 nt, Human
ugagccuaggaguuugagaccag

SEQ ID NO: 1231995 - RNA, 25 nt, Human
ugcaaaaagaagggcagagaacagu

SEQ ID NO: 1231996 - RNA, 18 nt, Human
ugcagccucaaccuccca

SEQ ID NO: 1231997 - RNA, 18 nt, Human
ugccaaggcuggcauccu

SEQ ID NO: 1231998 - RNA, 25 nt, Human
ugccaggaaucacggaagcaccucg

SEQ ID NO: 1231999 - RNA, 18 nt, Human
ugccuguacauacaacac

SEQ ID NO: 1232000 - RNA, 18 nt, Human
uggaaaaacacagggccc

SEQ ID NO: 1232001 - RNA, 21 nt, Human
uggaaaaccacucaaaauaaa

SEQ ID NO: 1232002 - RNA, 21 nt, Human
uggaaaccaucaucaccauca

SEQ ID NO: 1232003 - RNA, 20 nt, Human
uggaccagaaaccugugcuu

SEQ ID NO: 1232004 - RNA, 20 nt, Human
uggcaggagcagcgugcauc

SEQ ID NO: 1232005 - RNA, 24 nt, Human
uggcuugaucucagcucaaugcag

SEQ ID NO: 1232006 - RNA, 20 nt, Human
ugggaccacggugagagggu

SEQ ID NO: 1232007 - RNA, 18 nt, Human
uggguuaagucagacacu

SEQ ID NO: 1232008 - RNA, 18 nt, Human
ugugaggagcaaaccacc

SEQ ID NO: 1232009 - RNA, 18 nt, Human
ugugaguguucaggaagu

SEQ ID NO: 1232010 - RNA, 22 nt, Human
ugugccaggaaucacggaagca

SEQ ID NO: 1232011 - RNA, 20 nt, Human
ugugguggaaaaacacaggg

SEQ ID NO: 1232012 - RNA, 18 nt, Human
ugugugccuguacauaca

SEQ ID NO: 1232013 - RNA, 22 nt, Human
uuaguagcagcugaaaucaaga

SEQ ID NO: 1232014 - RNA, 22 nt, Human
uuaguucuacuaucaaaacaga

SEQ ID NO: 1232015 - RNA, 19 nt, Human
uucaaagugucucaggaau

SEQ ID NO: 1232016 - RNA, 19 nt, Human
uucaggaaacacaaagaca

SEQ ID NO: 1232017 - RNA, 20 nt, Human
uugcauccuguacagcgggu

SEQ ID NO: 1232018 - RNA, 24 nt, Human
uuguagaaacagggucucacaaug

SEQ ID NO: 1232019 - RNA, 22 nt, Human
uuucgcucugucucccaggcug

SEQ ID NO: 1232020 - RNA, 23 nt, Human
uuucgcucugucucccaggcugg

SEQ ID NO: 1232021 - RNA, 24 nt, Human
uuucgcucugucucccaggcugga

SEQ ID NO: 1232022 - RNA, 19 nt, Human
aaaggugcacuuuuuuaca

SEQ ID NO: 1232023 - RNA, 19 nt, Human
aaauagccuuuaaauuggg

SEQ ID NO: 1232024 - RNA, 23 nt, Human
aaggaacugauccaggacaggac

SEQ ID NO: 1232025 - RNA, 21 nt, Human
acagacuuucuuuuuugccuc

SEQ ID NO: 1232026 - RNA, 22 nt, Human
acaucagauuccuccauuucau

SEQ ID NO: 1232027 - RNA, 27 nt, Human
acccuaaaaagucauuucuuggagaag

SEQ ID NO: 1232028 - RNA, 21 nt, Human
acgcgcugccggguaccacgg

SEQ ID NO: 1232029 - RNA, 20 nt, Human
acugaaucuguuucuccagu

SEQ ID NO: 1232030 - RNA, 19 nt, Human
acuguguguaaaauacugc

SEQ ID NO: 1232031 - RNA, 19 nt, Human
agauuaaucugagaguuac

SEQ ID NO: 1232032 - RNA, 19 nt, Human
agcucauggauguuccuuc

SEQ ID NO: 1232033 - RNA, 23 nt, Human
aggcccuugaucacaagcguauc

SEQ ID NO: 1232034 - RNA, 18 nt, Human
aggguugggaggaccucu

SEQ ID NO: 1232035 - RNA, 24 nt, Human
aucaucuaucacuuucuccaguuu

SEQ ID NO: 1232036 - RNA, 21 nt, Human
aucccuucuucuuccucuuca

SEQ ID NO: 1232037 - RNA, 24 nt, Human
augcagcaggugucacagaaggac

SEQ ID NO: 1232038 - RNA, 20 nt, Human
caaaaucuuccagcgccucc

SEQ ID NO: 1232039 - RNA, 22 nt, Human
cacacccuccagcacgcaggcc

SEQ ID NO: 1232040 - RNA, 20 nt, Human
cacagaaggacccuguccca

SEQ ID NO: 1232041 - RNA, 21 nt, Human
cacccagccuggugaugcagc

SEQ ID NO: 1232042 - RNA, 24 nt, Human
cacccuaaaaagucauuucuugga

SEQ ID NO: 1232043 - RNA, 20 nt, Human
cagagucccucacagccucc

SEQ ID NO: 1232044 - RNA, 21 nt, Human
caggacaggacagacuuucuu

SEQ ID NO: 1232045 - RNA, 23 nt, Human
caggagcugaaguucugaaauca

SEQ ID NO: 1232046 - RNA, 20 nt, Human
caggugucacagaaggaccc

SEQ ID NO: 1232047 - RNA, 23 nt, Human
caucagauucuuuuucuugguuu

SEQ ID NO: 1232048 - RNA, 21 nt, Human
ccaccccccgacauccuccca

SEQ ID NO: 1232049 - RNA, 21 nt, Human
ccagagucccucacagccucc

SEQ ID NO: 1232050 - RNA, 24 nt, Human
ccagccuggugaugcagcaggugu

SEQ ID NO: 1232051 - RNA, 18 nt, Human
ccagcgccuccuggagcc

SEQ ID NO: 1232052 - RNA, 22 nt, Human
cccaccccccgacauccuccca

SEQ ID NO: 1232053 - RNA, 24 nt, Human
ccccaagccgcuaccaccagcccu

SEQ ID NO: 1232054 - RNA, 25 nt, Human
cccgacauccucccacucccucgca

SEQ ID NO: 1232055 - RNA, 19 nt, Human
cccuccagcacgcaggcca

SEQ ID NO: 1232056 - RNA, 20 nt, Human
cccugucccagcugguccug

SEQ ID NO: 1232057 - RNA, 25 nt, Human
ccuccuggagccugucgacgucccc

SEQ ID NO: 1232058 - RNA, 18 nt, Human
cgacauccucccacuccc

SEQ ID NO: 1232059 - RNA, 21 nt, Human
cgcgcugccggguaccacggc

SEQ ID NO: 1232060 - RNA, 19 nt, Human
cgcugccggguaccacggc

SEQ ID NO: 1232061 - RNA, 21 nt, Human
cggaacgccuccccccacccc

SEQ ID NO: 1232062 - RNA, 22 nt, Human
cggaacgccuccccccaccccc

SEQ ID NO: 1232063 - RNA, 23 nt, Human
cggaacgccuccccccacccccc

SEQ ID NO: 1232064 - RNA, 20 nt, Human
cggcagucagaagaaccacu

SEQ ID NO: 1232065 - RNA, 22 nt, Human
cuccccccaccccccgacaucc

SEQ ID NO: 1232066 - RNA, 18 nt, Human
cucuccaguuuuacugga

SEQ ID NO: 1232067 - RNA, 24 nt, Human
cugccggguaccacggcuuucuuu

SEQ ID NO: 1232068 - RNA, 20 nt, Human
cugucccagcugguccugcu

SEQ ID NO: 1232069 - RNA, 22 nt, Human
cugugaguucuggcaauugugu

SEQ ID NO: 1232070 - RNA, 19 nt, Human
gaacugauccaggacagga

SEQ ID NO: 1232071 - RNA, 18 nt, Human
gaccggaacgccuccccc

SEQ ID NO: 1232072 - RNA, 24 nt, Human
gaccggaacgccuccccccacccc

SEQ ID NO: 1232073 - RNA, 23 nt, Human
gagcaccuccccaagccgcuacc

SEQ ID NO: 1232074 - RNA, 21 nt, Human
gaggaccucuuggcgcaggag

SEQ ID NO: 1232075 - RNA, 21 nt, Human
gcaggccaagugggguggggg

SEQ ID NO: 1232076 - RNA, 21 nt, Human
gcaggugucacagaaggaccc

SEQ ID NO: 1232077 - RNA, 23 nt, Human
gugaugcagcaggugucacagaa

SEQ ID NO: 1232078 - RNA, 22 nt, Human
uaaaaccagaacuguguguaaa

SEQ ID NO: 1232079 - RNA, 18 nt, Human
uaaaacuaaaggugcacu

SEQ ID NO: 1232080 - RNA, 26 nt, Human
uaaaagacucaaucccuucuucuucc

SEQ ID NO: 1232081 - RNA, 23 nt, Human
uaaaauagccuuuaaauugggac

SEQ ID NO: 1232082 - RNA, 25 nt, Human
uaaauccagugacaguuuucaguau

SEQ ID NO: 1232083 - RNA, 24 nt, Human
uaaauugggaccacugaaucuguu

SEQ ID NO: 1232084 - RNA, 21 nt, Human
uaaucugagaguuacuauuaa

SEQ ID NO: 1232085 - RNA, 21 nt, Human
uaggaugguguggccucugau

SEQ ID NO: 1232086 - RNA, 23 nt, Human
uauaguuucuccuuggaucuguu

SEQ ID NO: 1232087 - RNA, 25 nt, Human
ucccacucccucgcacacccuccag

SEQ ID NO: 1232088 - RNA, 19 nt, Human
ucccagcugguccugcucc

SEQ ID NO: 1232089 - RNA, 24 nt, Human
uccccaagccgcuaccaccagccc

SEQ ID NO: 1232090 - RNA, 24 nt, Human
uccucuucaucuucaucuucuucu

SEQ ID NO: 1232091 - RNA, 24 nt, Human
uccuuggaucuguuaacaauucac

SEQ ID NO: 1232092 - RNA, 24 nt, Human
ucucaaaaucuuccagcgccuccu

SEQ ID NO: 1232093 - RNA, 19 nt, Human
ucucccuccgcgggucucu

SEQ ID NO: 1232094 - RNA, 21 nt, Human
ucuucaucuucaucuucuucu

SEQ ID NO: 1232095 - RNA, 20 nt, Human
ucuugguuuuuucuuucugg

SEQ ID NO: 1232096 - RNA, 24 nt, Human
ugaacgcgcugccggguaccacgg

SEQ ID NO: 1232097 - RNA, 20 nt, Human
ugacaaaggaacugauccag

SEQ ID NO: 1232098 - RNA, 23 nt, Human
ugaguucuggcaauuguguccgu

SEQ ID NO: 1232099 - RNA, 21 nt, Human
ugccucuucucaaaaucuucc

SEQ ID NO: 1232100 - RNA, 18 nt, Human
uggcuucccagagucccu

SEQ ID NO: 1232101 - RNA, 18 nt, Human
ugggaggaccucuuggcg

SEQ ID NO: 1232102 - RNA, 25 nt, Human
uggggaccggaacgccuccccccac

SEQ ID NO: 1232103 - RNA, 25 nt, Human
uggggugggggggaacgaagggagc

SEQ ID NO: 1232104 - RNA, 20 nt, Human
ugguguggccucugaucugu

SEQ ID NO: 1232105 - RNA, 23 nt, Human
uguauaguuucuccuuggaucug

SEQ ID NO: 1232106 - RNA, 18 nt, Human
uuacuggaauuggauccu

SEQ ID NO: 1232107 - RNA, 22 nt, Human
uucgucaucauuauccauggau

SEQ ID NO: 1232108 - RNA, 24 nt, Human
uugaaugcaucuuguuuauaacug

SEQ ID NO: 1232109 - RNA, 18 nt, Human
uuggagaagcgauggaug

SEQ ID NO: 1232110 - RNA, 24 nt, Human
uugggaggaccucuuggcgcagga

SEQ ID NO: 1232111 - RNA, 22 nt, Human
uuggggaccggaacgccucccc

SEQ ID NO: 1232112 - RNA, 20 nt, Human
uuuccugugagguuucggug

SEQ ID NO: 1232113 - RNA, 24 nt, Human
uuucucagcuugagacacaucaga

SEQ ID NO: 1232114 - RNA, 18 nt, Human
aacaagagcgaaaccccg

SEQ ID NO: 1232115 - RNA, 20 nt, Human
aacauggagaaaccccgucu

SEQ ID NO: 1232116 - RNA, 21 nt, Human
aacauggagaaaccccgucuc

SEQ ID NO: 1232117 - RNA, 19 nt, Human
aaccccgucucaaaaaaaa

SEQ ID NO: 1232118 - RNA, 20 nt, Human
aagaaaaaaaaagaauguag

SEQ ID NO: 1232119 - RNA, 24 nt, Human
aaucacuugaaccugggaggugga

SEQ ID NO: 1232120 - RNA, 19 nt, Human
aaugagugaaucaaccacc

SEQ ID NO: 1232121 - RNA, 20 nt, Human
acaagagcgaaaccccgucu

SEQ ID NO: 1232122 - RNA, 21 nt, Human
acaagagcgaaaccccgucuc

SEQ ID NO: 1232123 - RNA, 24 nt, Human
acagagcaagacacuaucucaaaa

SEQ ID NO: 1232124 - RNA, 22 nt, Human
acauggccuccaccugccucuc

SEQ ID NO: 1232125 - RNA, 19 nt, Human
accacugcacuccagccug

SEQ ID NO: 1232126 - RNA, 24 nt, Human
accccgucucuacuaaaaauacaa

SEQ ID NO: 1232127 - RNA, 19 nt, Human
acccgggugugguggcgca

SEQ ID NO: 1232128 - RNA, 23 nt, Human
acccgggugugguggcgcaugcc

SEQ ID NO: 1232129 - RNA, 24 nt, Human
acugcacuccagccugggugacag

SEQ ID NO: 1232130 - RNA, 26 nt, Human
acugcacuccagccugggugacagag

SEQ ID NO: 1232131 - RNA, 22 nt, Human
agaaucacuugaaccugggagg

SEQ ID NO: 1232132 - RNA, 24 nt, Human
agagagacccaccaacuccaugcc

SEQ ID NO: 1232133 - RNA, 20 nt, Human
agcagaaaaaucccccaaag

SEQ ID NO: 1232134 - RNA, 19 nt, Human
agcccugacccucguccug

SEQ ID NO: 1232135 - RNA, 22 nt, Human
aggcaggagaaucacuugaacc

SEQ ID NO: 1232136 - RNA, 24 nt, Human
aggcaggagaaucacuugaaccug

SEQ ID NO: 1232137 - RNA, 24 nt, Human
aggcugaggcaggagaaucacuug

SEQ ID NO: 1232138 - RNA, 21 nt, Human
aggcugaggcgggaggauugc

SEQ ID NO: 1232139 - RNA, 24 nt, Human
aggcugaggcgggaggauugcuug

SEQ ID NO: 1232140 - RNA, 23 nt, Human
agggauuagaagccacuucaacu

SEQ ID NO: 1232141 - RNA, 22 nt, Human
agguaggcggaucaccugaggg

SEQ ID NO: 1232142 - RNA, 19 nt, Human
agguggagguugcagugaa

SEQ ID NO: 1232143 - RNA, 24 nt, Human
agguggagguugcagugaaccaag

SEQ ID NO: 1232144 - RNA, 22 nt, Human
aggugggagcagacgcugaggg

SEQ ID NO: 1232145 - RNA, 21 nt, Human
aguggccugagcagcggcuag

SEQ ID NO: 1232146 - RNA, 22 nt, Human
aucccagcacuuugggaggcca

SEQ ID NO: 1232147 - RNA, 19 nt, Human
auggggcacaggaucugaa

SEQ ID NO: 1232148 - RNA, 24 nt, Human
auugcaccacugcacuccagccug

SEQ ID NO: 1232149 - RNA, 18 nt, Human
auugcacuccagccugga

SEQ ID NO: 1232150 - RNA, 25 nt, Human
auugcacuccagccuggacaacaag

SEQ ID NO: 1232151 - RNA, 24 nt, Human
auugcgccauugcacuccagccug

SEQ ID NO: 1232152 - RNA, 22 nt, Human
auuugccuuccacaucacaaaa

SEQ ID NO: 1232153 - RNA, 18 nt, Human
caacugcugcagcugcug

SEQ ID NO: 1232154 - RNA, 19 nt, Human
caagagcgaaaccccgucu

SEQ ID NO: 1232155 - RNA, 24 nt, Human
caagauugcgccauugcacuccag

SEQ ID NO: 1232156 - RNA, 24 nt, Human
caagguaggcggaucaccugaggu

SEQ ID NO: 1232157 - RNA, 20 nt, Human
caccacugcacuccagccug

SEQ ID NO: 1232158 - RNA, 23 nt, Human
caccuguggucccagcuacucgg

SEQ ID NO: 1232159 - RNA, 24 nt, Human
caccuguggucccagcuacucggg

SEQ ID NO: 1232160 - RNA, 21 nt, Human
cacgcacccucaacucauccc

SEQ ID NO: 1232161 - RNA, 24 nt, Human
cacgccuguaaucccagcacuuug

SEQ ID NO: 1232162 - RNA, 24 nt, Human
cacuccagccuggacaacaagagc

SEQ ID NO: 1232163 - RNA, 25 nt, Human
cacuccagccuggacaacaagagcg

SEQ ID NO: 1232164 - RNA, 22 nt, Human
cacuccagccugggugacagag

SEQ ID NO: 1232165 - RNA, 23 nt, Human
cacuccagccugggugacagagc

SEQ ID NO: 1232166 - RNA, 19 nt, Human
cacuccgccuugagagaga

SEQ ID NO: 1232167 - RNA, 19 nt, Human
cacugcacuccagccuggg

SEQ ID NO: 1232168 - RNA, 19 nt, Human
cacugcacuccagccuggg

SEQ ID NO: 1232169 - RNA, 22 nt, Human
cacugcacuccagccuggguga

SEQ ID NO: 1232170 - RNA, 23 nt, Human
cacugcacuccagccugggugac

SEQ ID NO: 1232171 - RNA, 24 nt, Human
cacugcacuccagccugggugaca

SEQ ID NO: 1232172 - RNA, 24 nt, Human
cacugcacuccagccugggugaca

SEQ ID NO: 1232173 - RNA, 21 nt, Human
cacuucaacugcugcagcugc

SEQ ID NO: 1232174 - RNA, 21 nt, Human
cacuugaaccugggaggugga

SEQ ID NO: 1232175 - RNA, 21 nt, Human
cagcacuuugggaggccaagg

SEQ ID NO: 1232176 - RNA, 24 nt, Human
cagcacuuugggaggccaagguag

SEQ ID NO: 1232177 - RNA, 20 nt, Human
cagcagaaaaaucccccaaa

SEQ ID NO: 1232178 - RNA, 24 nt, Human
cagcccuccccucuguccuguggu

SEQ ID NO: 1232179 - RNA, 24 nt, Human
cagccugacuaacauggagaaacc

SEQ ID NO: 1232180 - RNA, 24 nt, Human
cagccuuggcuggcccgauggcuc

SEQ ID NO: 1232181 - RNA, 24 nt, Human
cagcuacucgggaggcugaggcgg

SEQ ID NO: 1232182 - RNA, 19 nt, Human
caggaccuucaugaaugag

SEQ ID NO: 1232183 - RNA, 21 nt, Human
caggucgggcgugguggcuca

SEQ ID NO: 1232184 - RNA, 22 nt, Human
cagugcccucccccacccccuc

SEQ ID NO: 1232185 - RNA, 22 nt, Human
caguugugaaggaggcugggga

SEQ ID NO: 1232186 - RNA, 18 nt, Human
cauugcacuccagccugg

SEQ ID NO: 1232187 - RNA, 19 nt, Human
cauugcacuccagccugga

SEQ ID NO: 1232188 - RNA, 20 nt, Human
cauugcacuccagccuggac

SEQ ID NO: 1232189 - RNA, 21 nt, Human
cauugcacuccagccuggaca

SEQ ID NO: 1232190 - RNA, 24 nt, Human
cauugcacuccagccuggacaaca

SEQ ID NO: 1232191 - RNA, 24 nt, Human
cauugccuuucaacagcucccacc

SEQ ID NO: 1232192 - RNA, 19 nt, Human
ccacaugguucuucccggg

SEQ ID NO: 1232193 - RNA, 22 nt, Human
ccacaugguucuucccggguca

SEQ ID NO: 1232194 - RNA, 20 nt, Human
ccacugcacuccagccuggg

SEQ ID NO: 1232195 - RNA, 20 nt, Human
ccacugcacuccagccuggg

SEQ ID NO: 1232196 - RNA, 20 nt, Human
ccacugcacuccagccuggg

SEQ ID NO: 1232197 - RNA, 21 nt, Human
ccacugcacuccagccugggu

SEQ ID NO: 1232198 - RNA, 21 nt, Human
ccacugcacuccagccugggu

SEQ ID NO: 1232199 - RNA, 23 nt, Human
ccacugcacuccagccuggguga

SEQ ID NO: 1232200 - RNA, 23 nt, Human
ccacugcacuccagccuggguga

SEQ ID NO: 1232201 - RNA, 24 nt, Human
ccacugcacuccagccugggugac

SEQ ID NO: 1232202 - RNA, 25 nt, Human
ccacugcacuccagccugggugaca

SEQ ID NO: 1232203 - RNA, 19 nt, Human
ccacuggaggggagagcuc

SEQ ID NO: 1232204 - RNA, 22 nt, Human
ccagugcccucccccacccccu

SEQ ID NO: 1232205 - RNA, 19 nt, Human
ccauugcacuccagccugg

SEQ ID NO: 1232206 - RNA, 21 nt, Human
ccauugcacuccagccuggac

SEQ ID NO: 1232207 - RNA, 21 nt, Human
cccacgcacccucaacucauc

SEQ ID NO: 1232208 - RNA, 23 nt, Human
cccacgcacccucaacucauccc

SEQ ID NO: 1232209 - RNA, 18 nt, Human
cccauacaccuguggucc

SEQ ID NO: 1232210 - RNA, 26 nt, Human
ccccacccccuccgcggcuugccccg

SEQ ID NO: 1232211 - RNA, 19 nt, Human
ccccgucucaaaaaaaaaa

SEQ ID NO: 1232212 - RNA, 23 nt, Human
cccgagaagcugaagccaggacc

SEQ ID NO: 1232213 - RNA, 24 nt, Human
ccgucucaaaaaaaaaaaacaaaa

SEQ ID NO: 1232214 - RNA, 25 nt, Human
ccgucucaaaaaaaaaaaacaaaaa

SEQ ID NO: 1232215 - RNA, 19 nt, Human
ccuccgcggcuugccccgc

SEQ ID NO: 1232216 - RNA, 23 nt, Human
ccugacuaacauggagaaacccc

SEQ ID NO: 1232217 - RNA, 24 nt, Human
ccugacuaacauggagaaaccccg

SEQ ID NO: 1232218 - RNA, 18 nt, Human
ccuggaggcuuucugccu

SEQ ID NO: 1232219 - RNA, 21 nt, Human
ccugggagguggagguugcag

SEQ ID NO: 1232220 - RNA, 20 nt, Human
ccugggugacagagcaagac

SEQ ID NO: 1232221 - RNA, 22 nt, Human
ccuguaaucccagcacuuuggg

SEQ ID NO: 1232222 - RNA, 19 nt, Human
ccuguaaucucagcuuuag

SEQ ID NO: 1232223 - RNA, 21 nt, Human
ccuguggucccagcuacucgg

SEQ ID NO: 1232224 - RNA, 18 nt, Human
ccugugguguuugcugcc

SEQ ID NO: 1232225 - RNA, 23 nt, Human
ccuucucacucacccgguccugg

SEQ ID NO: 1232226 - RNA, 22 nt, Human
ccuugcagagagacccaccaac

SEQ ID NO: 1232227 - RNA, 18 nt, Human
cgagaagcugaagccagg

SEQ ID NO: 1232228 - RNA, 23 nt, Human
cgaguggaugaaugagugaauca

SEQ ID NO: 1232229 - RNA, 24 nt, Human
cgccauugcacuccagccuggaca

SEQ ID NO: 1232230 - RNA, 23 nt, Human
cgccuguaaucccagcacuuugg

SEQ ID NO: 1232231 - RNA, 20 nt, Human
cggcuugccccgcucuccuu

SEQ ID NO: 1232232 - RNA, 22 nt, Human
cgggaggcugaggcgggaggau

SEQ ID NO: 1232233 - RNA, 19 nt, Human
cucaaaaaagaaaagaaaa

SEQ ID NO: 1232234 - RNA, 22 nt, Human
cucacgccuguaaucccagcac

SEQ ID NO: 1232235 - RNA, 24 nt, Human
cucacgccuguaaucccagcacuu

SEQ ID NO: 1232236 - RNA, 22 nt, Human
cucccccacccccuccgcggcu

SEQ ID NO: 1232237 - RNA, 22 nt, Human
cuccuucucacucacccggucc

SEQ ID NO: 1232238 - RNA, 20 nt, Human
cucugugcccacgcacccuc

SEQ ID NO: 1232239 - RNA, 20 nt, Human
cugaagguggcaggaccuuc

SEQ ID NO: 1232240 - RNA, 18 nt, Human
cugcauugccuuucaaca

SEQ ID NO: 1232241 - RNA, 23 nt, Human
cuggaggcuuucugccucggcag

SEQ ID NO: 1232242 - RNA, 19 nt, Human
cugugggauggggcacagg

SEQ ID NO: 1232243 - RNA, 23 nt, Human
cuuccacaucacaaaagugcaca

SEQ ID NO: 1232244 - RNA, 21 nt, Human
cuugaaccugggagguggagg

SEQ ID NO: 1232245 - RNA, 21 nt, Human
cuuuuggccugaggucgagga

SEQ ID NO: 1232246 - RNA, 26 nt, Human
gacccaccaacuccaugccucacuua

SEQ ID NO: 1232247 - RNA, 19 nt, Human
gacuuuuaucccuggucuc

SEQ ID NO: 1232248 - RNA, 21 nt, Human
gagaaaccccgucucuacuaa

SEQ ID NO: 1232249 - RNA, 18 nt, Human
gagaagcugaagccagga

SEQ ID NO: 1232250 - RNA, 23 nt, Human
gagaccagccugacuaacaugga

SEQ ID NO: 1232251 - RNA, 22 nt, Human
gagaggucaaagcuacagugag

SEQ ID NO: 1232252 - RNA, 24 nt, Human
gaggcgggaggauugcuugagccu

SEQ ID NO: 1232253 - RNA, 23 nt, Human
gagguugcagugaaccaagauug

SEQ ID NO: 1232254 - RNA, 18 nt, Human
gaucaccugagguggaga

SEQ ID NO: 1232255 - RNA, 18 nt, Human
gauugcuugagccugaga

SEQ ID NO: 1232256 - RNA, 22 nt, Human
gcaagacacuaucucaaaaaag

SEQ ID NO: 1232257 - RNA, 24 nt, Human
gcacuccagccugggugacagagc

SEQ ID NO: 1232258 - RNA, 24 nt, Human
gcagcaguuguccuuucuccugac

SEQ ID NO: 1232259 - RNA, 23 nt, Human
gcaggagaaucacuugaaccugg

SEQ ID NO: 1232260 - RNA, 19 nt, Human
gccccgcucuccuucucac

SEQ ID NO: 1232261 - RNA, 18 nt, Human
gcccucccccacccccuc

SEQ ID NO: 1232262 - RNA, 21 nt, Human
gcccucccccacccccuccgc

SEQ ID NO: 1232263 - RNA, 21 nt, Human
gccuuucaacagcucccacag

SEQ ID NO: 1232264 - RNA, 21 nt, Human
gcuagagcagcaaggacccug

SEQ ID NO: 1232265 - RNA, 18 nt, Human
gcugaagccaggacccug

SEQ ID NO: 1232266 - RNA, 23 nt, Human
ggaaggaggauguccacuggagg

SEQ ID NO: 1232267 - RNA, 22 nt, Human
ggagguugcagugaaccaagau

SEQ ID NO: 1232268 - RNA, 24 nt, Human
ggagguugcagugaaccaagauug

SEQ ID NO: 1232269 - RNA, 23 nt, Human
ggcgugguggcucacgccuguaa

SEQ ID NO: 1232270 - RNA, 21 nt, Human
ggcucacgccuguaaucccag

SEQ ID NO: 1232271 - RNA, 19 nt, Human
ggcuuaaacuccagggagg

SEQ ID NO: 1232272 - RNA, 27 nt, Human
gggaaggaggauguccacuggagggga

SEQ ID NO: 1232273 - RNA, 23 nt, Human
gggaggcugaggcaggagaauca

SEQ ID NO: 1232274 - RNA, 24 nt, Human
gggugugguggcgcaugccuguaa

SEQ ID NO: 1232275 - RNA, 18 nt, Human
ggucgggcgugguggcuc

SEQ ID NO: 1232276 - RNA, 19 nt, Human
ggugugguggcgcaugccu

SEQ ID NO: 1232277 - RNA, 18 nt, Human
gucacugugggauggggc

SEQ ID NO: 1232278 - RNA, 20 nt, Human
guccugcagguccagccagg

SEQ ID NO: 1232279 - RNA, 20 nt, Human
gugcccucccccacccccuc

SEQ ID NO: 1232280 - RNA, 23 nt, Human
guggcgcaugccuguaaucucag

SEQ ID NO: 1232281 - RNA, 23 nt, Human
guggcucacgccuguaaucccag

SEQ ID NO: 1232282 - RNA, 24 nt, Human
uaacauggagaaaccccgucucua

SEQ ID NO: 1232283 - RNA, 20 nt, Human
uaaggaagagcuuuuaaaaa

SEQ ID NO: 1232284 - RNA, 31 nt, Human
uaaguccauccuacacagauuuuuaaggaaa

SEQ ID NO: 1232285 - RNA, 18 nt, Human
uacagugagcugcgauug

SEQ ID NO: 1232286 - RNA, 21 nt, Human
uaccagcagaaaaauccccca

SEQ ID NO: 1232287 - RNA, 18 nt, Human
uacccuaggccagucacu

SEQ ID NO: 1232288 - RNA, 19 nt, Human
uagagcagcaaggacccug

SEQ ID NO: 1232289 - RNA, 22 nt, Human
uagccagguguggugacccaua

SEQ ID NO: 1232290 - RNA, 24 nt, Human
uagcuacucgggaggcugaggcag

SEQ ID NO: 1232291 - RNA, 20 nt, Human
uagcuucucagcuaugaucc

SEQ ID NO: 1232292 - RNA, 18 nt, Human
uaggcggaucaccugagg

SEQ ID NO: 1232293 - RNA, 23 nt, Human
ucaaaaaaaaaaaacaaaaacua

SEQ ID NO: 1232294 - RNA, 19 nt, Human
ucaaaaaagaaaagaaaaa

SEQ ID NO: 1232295 - RNA, 18 nt, Human
ucaagcccacacuacugc

SEQ ID NO: 1232296 - RNA, 19 nt, Human
ucacuugaaccugggaggu

SEQ ID NO: 1232297 - RNA, 24 nt, Human
ucacuugaaccugggagguggagg

SEQ ID NO: 1232298 - RNA, 24 nt, Human
ucaggucgggcgugguggcucacg

SEQ ID NO: 1232299 - RNA, 21 nt, Human
uccacaucacaaaagugcaca

SEQ ID NO: 1232300 - RNA, 24 nt, Human
uccagccugggugacagagcaaga

SEQ ID NO: 1232301 - RNA, 23 nt, Human
uccaugccucacuuaccagcaga

SEQ ID NO: 1232302 - RNA, 22 nt, Human
ucccagccucugccuuaggguc

SEQ ID NO: 1232303 - RNA, 22 nt, Human
ucccagccucugccuuaggguc

SEQ ID NO: 1232304 - RNA, 22 nt, Human
ucccccaaagucacguggagau

SEQ ID NO: 1232305 - RNA, 24 nt, Human
uccccugugcugggagggacccac

SEQ ID NO: 1232306 - RNA, 19 nt, Human
uccgcggcuugccccgcuc

SEQ ID NO: 1232307 - RNA, 19 nt, Human
uccugguggugcucugugc

SEQ ID NO: 1232308 - RNA, 22 nt, Human
uccuugcagagagacccaccaa

SEQ ID NO: 1232309 - RNA, 25 nt, Human
ucgggaggcugaggcaggagaauca

SEQ ID NO: 1232310 - RNA, 20 nt, Human
ucgggaggcugaggcgggag

SEQ ID NO: 1232311 - RNA, 22 nt, Human
ucuaacagauggaucuuuuggc

SEQ ID NO: 1232312 - RNA, 21 nt, Human
ucucacucacccgguccuggu

SEQ ID NO: 1232313 - RNA, 24 nt, Human
ucucuacuaaaaauacaaaaaauu

SEQ ID NO: 1232314 - RNA, 24 nt, Human
ucucugagcagccuuggcuggccc

SEQ ID NO: 1232315 - RNA, 24 nt, Human
ugaaccugggagguggagguugca

SEQ ID NO: 1232316 - RNA, 20 nt, Human
ugaaggaggcuggggaaugu

SEQ ID NO: 1232317 - RNA, 19 nt, Human
ugaaugagugaaucaacca

SEQ ID NO: 1232318 - RNA, 23 nt, Human
ugacauggccuccaccugccucu

SEQ ID NO: 1232319 - RNA, 24 nt, Human
ugacccauacaccuguggucccag

SEQ ID NO: 1232320 - RNA, 21 nt, Human
ugagaggucaaagcuacagug

SEQ ID NO: 1232321 - RNA, 19 nt, Human
ugagauggaggaaggggcu

SEQ ID NO: 1232322 - RNA, 20 nt, Human
ugagcagccuuggcuggccc

SEQ ID NO: 1232323 - RNA, 22 nt, Human
ugagccccgucuucuccacaga

SEQ ID NO: 1232324 - RNA, 23 nt, Human
ugaggagggagacuucuuagggc

SEQ ID NO: 1232325 - RNA, 23 nt, Human
ugaggagugggcagccuggagcu

SEQ ID NO: 1232326 - RNA, 20 nt, Human
ugaggcaggagaaucacuug

SEQ ID NO: 1232327 - RNA, 24 nt, Human
ugaggcaggagaaucacuugaacc

SEQ ID NO: 1232328 - RNA, 25 nt, Human
ugaggcaggagaaucacuugaaccu

SEQ ID NO: 1232329 - RNA, 23 nt, Human
ugaggcgggaggauugcuugagc

SEQ ID NO: 1232330 - RNA, 24 nt, Human
ugaggcgggaggauugcuugagcc

SEQ ID NO: 1232331 - RNA, 18 nt, Human
ugaggcugggaaggagga

SEQ ID NO: 1232332 - RNA, 19 nt, Human
ugagguggagaccagccug

SEQ ID NO: 1232333 - RNA, 21 nt, Human
ugcaccacugcacuccagccu

SEQ ID NO: 1232334 - RNA, 22 nt, Human
ugcacuccagccuggacaacaa

SEQ ID NO: 1232335 - RNA, 25 nt, Human
ugcacuccagccuggacaacaagag

SEQ ID NO: 1232336 - RNA, 23 nt, Human
ugcagagagacccaccaacucca

SEQ ID NO: 1232337 - RNA, 19 nt, Human
ugcauugccuuucaacagc

SEQ ID NO: 1232338 - RNA, 23 nt, Human
ugccccgcucuccuucucacuca

SEQ ID NO: 1232339 - RNA, 31 nt, Human
ugccuguaaucucagcuuuagcuacucgggg

SEQ ID NO: 1232340 - RNA, 20 nt, Human
ugccuuagggucugggacac

SEQ ID NO: 1232341 - RNA, 19 nt, Human
ugcuguuguacacccgaga

SEQ ID NO: 1232342 - RNA, 19 nt, Human
uggaggcugccccugcagu

SEQ ID NO: 1232343 - RNA, 20 nt, Human
uggccaccuggcugagcccu

SEQ ID NO: 1232344 - RNA, 21 nt, Human
uggccaccuggcugagcccug

SEQ ID NO: 1232345 - RNA, 20 nt, Human
uggcccgauggcucuaacag

SEQ ID NO: 1232346 - RNA, 21 nt, Human
uggcgcaugccuguaaucuca

SEQ ID NO: 1232347 - RNA, 22 nt, Human
uggcgcaugccuguaaucucag

SEQ ID NO: 1232348 - RNA, 19 nt, Human
uggcgguaggguggaggcc

SEQ ID NO: 1232349 - RNA, 20 nt, Human
uggcgguaggguggaggcug

SEQ ID NO: 1232350 - RNA, 22 nt, Human
uggcucacgccuguaaucccag

SEQ ID NO: 1232351 - RNA, 24 nt, Human
uggcucacgccuguaaucccagca

SEQ ID NO: 1232352 - RNA, 22 nt, Human
uggcugagcccugacccucguc

SEQ ID NO: 1232353 - RNA, 21 nt, Human
ugggaaggaggauguccacug

SEQ ID NO: 1232354 - RNA, 24 nt, Human
ugggaggccaagguaggcggauca

SEQ ID NO: 1232355 - RNA, 18 nt, Human
ugggagguggagguugca

SEQ ID NO: 1232356 - RNA, 24 nt, Human
ugggagguggagguugcagugaac

SEQ ID NO: 1232357 - RNA, 29 nt, Human
ugggagguggagguugcagugacaacggu

SEQ ID NO: 1232358 - RNA, 19 nt, Human
ugggauggggcacaggauc

SEQ ID NO: 1232359 - RNA, 24 nt, Human
ugguggcgcaugccuguaaucuca

SEQ ID NO: 1232360 - RNA, 24 nt, Human
ugguggcucacgccuguaauccca

SEQ ID NO: 1232361 - RNA, 23 nt, Human
uguccuggaggcuuucugccucg

SEQ ID NO: 1232362 - RNA, 27 nt, Human
uguccugugguguuugcugccguguac

SEQ ID NO: 1232363 - RNA, 21 nt, Human
uguccuugcagagagacccac

SEQ ID NO: 1232364 - RNA, 22 nt, Human
ugugcugggagggacccacagg

SEQ ID NO: 1232365 - RNA, 23 nt, Human
ugugggauggggcacaggaucug

SEQ ID NO: 1232366 - RNA, 24 nt, Human
ugugguguuugcugccugcauugc

SEQ ID NO: 1232367 - RNA, 22 nt, Human
uguuugcugccugcauugccuu

SEQ ID NO: 1232368 - RNA, 21 nt, Human
uuagaaaugacauggccucca

SEQ ID NO: 1232369 - RNA, 23 nt, Human
uuccauuugccuuccacaucaca

SEQ ID NO: 1232370 - RNA, 23 nt, Human
uuccuguuccccugugcugggag

SEQ ID NO: 1232371 - RNA, 24 nt, Human
uugaaccugggagguggagguugc

SEQ ID NO: 1232372 - RNA, 20 nt, Human
uugaaucuuucaugaggcug

SEQ ID NO: 1232373 - RNA, 22 nt, Human
uugcagugaaccaagauugcgc

SEQ ID NO: 1232374 - RNA, 23 nt, Human
uugccuuucaacagcucccacag

SEQ ID NO: 1232375 - RNA, 23 nt, Human
uugcgccauugcacuccagccug

SEQ ID NO: 1232376 - RNA, 18 nt, Human
uugcuugagccugagagg

SEQ ID NO: 1232377 - RNA, 25 nt, Human
uuggguccuggugagauggaggaag

SEQ ID NO: 1232378 - RNA, 21 nt, Human
agaccccacucauguacccag

SEQ ID NO: 1232379 - RNA, 23 nt, Human
agcagcggcggcggcggcggcgg

SEQ ID NO: 1232380 - RNA, 20 nt, Human
agggagcccgggagcggugc

SEQ ID NO: 1232381 - RNA, 22 nt, Human
aucuaagcucccauuugaucuu

SEQ ID NO: 1232382 - RNA, 19 nt, Human
caagagcagaggcuaauag

SEQ ID NO: 1232383 - RNA, 21 nt, Human
cagaguccuacaaggauucac

SEQ ID NO: 1232384 - RNA, 21 nt, Human
cagcgcaaguccacaaacugu

SEQ ID NO: 1232385 - RNA, 26 nt, Human
cagcggcggcggcggcggcggcuccc

SEQ ID NO: 1232386 - RNA, 22 nt, Human
cagcuaacuucuuacaagagca

SEQ ID NO: 1232387 - RNA, 24 nt, Human
caucuaagcucccauuugaucuuc

SEQ ID NO: 1232388 - RNA, 18 nt, Human
ccccccacaccccggccg

SEQ ID NO: 1232389 - RNA, 18 nt, Human
ccccggccggcgcgcugg

SEQ ID NO: 1232390 - RNA, 22 nt, Human
ccccgugugcgcccccuggccc

SEQ ID NO: 1232391 - RNA, 20 nt, Human
cccgccgccccccacacccc

SEQ ID NO: 1232392 - RNA, 25 nt, Human
ccgugugcgcccccuggcccgcccu

SEQ ID NO: 1232393 - RNA, 24 nt, Human
cgcaaguccacaaacuguucccuu

SEQ ID NO: 1232394 - RNA, 18 nt, Human
cgccccccacaccccggc

SEQ ID NO: 1232395 - RNA, 19 nt, Human
cgcccucgccccuccggcc

SEQ ID NO: 1232396 - RNA, 20 nt, Human
cucacaaaauuccugaaaau

SEQ ID NO: 1232397 - RNA, 25 nt, Human
cucauguacccagaucuauguuggg

SEQ ID NO: 1232398 - RNA, 21 nt, Human
cucccauuugaucuucuccag

SEQ ID NO: 1232399 - RNA, 19 nt, Human
cuccggcccgccgcccccc

SEQ ID NO: 1232400 - RNA, 21 nt, Human
cuggcccgcccucgccccucc

SEQ ID NO: 1232401 - RNA, 24 nt, Human
cuuccacaucuaagcucccauuug

SEQ ID NO: 1232402 - RNA, 19 nt, Human
cuucuuacaagagcagagg

SEQ ID NO: 1232403 - RNA, 18 nt, Human
gaaugagauggaagaggg

SEQ ID NO: 1232404 - RNA, 22 nt, Human
gcagaggcuaauagaugugccc

SEQ ID NO: 1232405 - RNA, 23 nt, Human
gcagcagcggcggcggcggcggc

SEQ ID NO: 1232406 - RNA, 23 nt, Human
gcagcagcggcggcggcggcggc

SEQ ID NO: 1232407 - RNA, 19 nt, Human
gcggcggcggcggcggcuc

SEQ ID NO: 1232408 - RNA, 20 nt, Human
gcggcggcggcggcucgggc

SEQ ID NO: 1232409 - RNA, 22 nt, Human
gcggcggcggcucgggcucggc

SEQ ID NO: 1232410 - RNA, 21 nt, Human
ggcggcggcggcggcggcucg

SEQ ID NO: 1232411 - RNA, 21 nt, Human
ggcggcggcggcggcucgggc

SEQ ID NO: 1232412 - RNA, 20 nt, Human
ggcggcggcucgggcucggc

SEQ ID NO: 1232413 - RNA, 20 nt, Human
gggaaugagauggaagaggg

SEQ ID NO: 1232414 - RNA, 21 nt, Human
gggaaugagauggaagaggga

SEQ ID NO: 1232415 - RNA, 24 nt, Human
gggagguagagaaucuaagaaaga

SEQ ID NO: 1232416 - RNA, 28 nt, Human
gggagguagagaaucuaagaaagacugu

SEQ ID NO: 1232417 - RNA, 22 nt, Human
gguagugcaugauccaagggug

SEQ ID NO: 1232418 - RNA, 18 nt, Human
uaauaagaccccacucau

SEQ ID NO: 1232419 - RNA, 18 nt, Human
uauaacaaugucacucga

SEQ ID NO: 1232420 - RNA, 21 nt, Human
ucacaagauuauaauaagacc

SEQ ID NO: 1232421 - RNA, 19 nt, Human
ucacucgaaguguggucca

SEQ ID NO: 1232422 - RNA, 21 nt, Human
ucaucuauaacaaugucacuc

SEQ ID NO: 1232423 - RNA, 19 nt, Human
uccacaucuaagcucccau

SEQ ID NO: 1232424 - RNA, 24 nt, Human
ucuaagaaagacugugcauuuucc

SEQ ID NO: 1232425 - RNA, 18 nt, Human
ugccuggucaccuagggg

SEQ ID NO: 1232426 - RNA, 23 nt, Human
ugggagggagcccgggagcggug

SEQ ID NO: 1232427 - RNA, 20 nt, Human
uucagaguguuucuugguuu

SEQ ID NO: 1232428 - RNA, 19 nt, Human
aaggcauuccaauugugga

SEQ ID NO: 1232429 - RNA, 21 nt, Human
cagcuuggcucuccccuuugu

SEQ ID NO: 1232430 - RNA, 21 nt, Human
ccucucaggaagggccaggga

SEQ ID NO: 1232431 - RNA, 22 nt, Human
cuuuauacagucacugccaaau

SEQ ID NO: 1232432 - RNA, 19 nt, Human
gaaaggcucagcuuggcuc

SEQ ID NO: 1232433 - RNA, 20 nt, Human
gaauuuguuuuuaacuucuu

SEQ ID NO: 1232434 - RNA, 21 nt, Human
ggaagggccagggauucaggc

SEQ ID NO: 1232435 - RNA, 21 nt, Human
ucacaucuuccuggaucugaa

SEQ ID NO: 1232436 - RNA, 19 nt, Human
ugaguggauccucucagga

SEQ ID NO: 1232437 - RNA, 19 nt, Human
uggugggaucugaguggau

SEQ ID NO: 1232438 - RNA, 26 nt, Human
uuuaacuucuuuauacagucacugcc

SEQ ID NO: 1232439 - RNA, 22 nt, Human
aaaagccugacaaugucaagga

SEQ ID NO: 1232440 - RNA, 19 nt, Human
aaauauauucauuuuccca

SEQ ID NO: 1232441 - RNA, 23 nt, Human
aaguagcgaaagucgcuuuggcc

SEQ ID NO: 1232442 - RNA, 22 nt, Human
acuaccaacauuagaaaagccu

SEQ ID NO: 1232443 - RNA, 19 nt, Human
auggguguggaauggcagc

SEQ ID NO: 1232444 - RNA, 25 nt, Human
caaaaaaggcugcaacauuugucua

SEQ ID NO: 1232445 - RNA, 20 nt, Human
caagagugccacaugugaug

SEQ ID NO: 1232446 - RNA, 20 nt, Human
cagaagcaggggccgcacag

SEQ ID NO: 1232447 - RNA, 18 nt, Human
caggugcuggggacucag

SEQ ID NO: 1232448 - RNA, 23 nt, Human
ccaaagcuacgccgaccaaucca

SEQ ID NO: 1232449 - RNA, 22 nt, Human
ccaacauuagaaaagccugaca

SEQ ID NO: 1232450 - RNA, 22 nt, Human
ccacaugugauggguguggaau

SEQ ID NO: 1232451 - RNA, 25 nt, Human
ccucagcauccgcagaagcaggggc

SEQ ID NO: 1232452 - RNA, 19 nt, Human
cgccaggaagccaggccaa

SEQ ID NO: 1232453 - RNA, 20 nt, Human
cucagcauccgcagaagcag

SEQ ID NO: 1232454 - RNA, 22 nt, Human
gucaaggaguggcaagagugcc

SEQ ID NO: 1232455 - RNA, 23 nt, Human
uaagguccggccgcccaaagcua

SEQ ID NO: 1232456 - RNA, 18 nt, Human
uagaaaagccugacaaug

SEQ ID NO: 1232457 - RNA, 21 nt, Human
uagcgaaagucgcuuuggccc

SEQ ID NO: 1232458 - RNA, 23 nt, Human
uauauucauuuucccaucacugg

SEQ ID NO: 1232459 - RNA, 21 nt, Human
ucuacaaaccucuggauauac

SEQ ID NO: 1232460 - RNA, 22 nt, Human
ugaaggguaugugcaucuucau

SEQ ID NO: 1232461 - RNA, 19 nt, Human
uggaauggcagcucacugu

SEQ ID NO: 1232462 - RNA, 20 nt, Human
uggaauggcagcucacugua

SEQ ID NO: 1232463 - RNA, 19 nt, Human
ugugugacuuucuaagguc

SEQ ID NO: 1232464 - RNA, 22 nt, Human
uuaaaccagaaaacaccuucau

SEQ ID NO: 1232465 - RNA, 20 nt, Human
uuggaaucugcuuuggguuc

SEQ ID NO: 1232466 - RNA, 20 nt, Human
uuggagagacaguuauagca

SEQ ID NO: 1232467 - RNA, 20 nt, Human
aaccuccaccuccugggcuc

SEQ ID NO: 1232468 - RNA, 24 nt, Human
aaggugcugagaucacagguguga

SEQ ID NO: 1232469 - RNA, 18 nt, Human
aauuuuguauuuuuagua

SEQ ID NO: 1232470 - RNA, 19 nt, Human
acaaugccugacuaauuuu

SEQ ID NO: 1232471 - RNA, 18 nt, Human
accacguuggucaggcug

SEQ ID NO: 1232472 - RNA, 22 nt, Human
accauagggaaaugucuucuca

SEQ ID NO: 1232473 - RNA, 24 nt, Human
accuauucagguacuggaggugaa

SEQ ID NO: 1232474 - RNA, 25 nt, Human
acucuguugcccaggcuagaaugca

SEQ ID NO: 1232475 - RNA, 18 nt, Human
agaacucaagggacagga

SEQ ID NO: 1232476 - RNA, 25 nt, Human
agacaagauggggguuuugcucuaa

SEQ ID NO: 1232477 - RNA, 19 nt, Human
agaucacaggugugagcca

SEQ ID NO: 1232478 - RNA, 18 nt, Human
agccuccagaguagcugg

SEQ ID NO: 1232479 - RNA, 20 nt, Human
agcuaugacagagagaggca

SEQ ID NO: 1232480 - RNA, 21 nt, Human
aggaaggcagguuugggcugg

SEQ ID NO: 1232481 - RNA, 24 nt, Human
agggauucuccugccucagccucc

SEQ ID NO: 1232482 - RNA, 24 nt, Human
aggugaucugccugccucggccuc

SEQ ID NO: 1232483 - RNA, 26 nt, Human
aggugcugagaucacaggugugagcc

SEQ ID NO: 1232484 - RNA, 18 nt, Human
aguagcugggauuacagg

SEQ ID NO: 1232485 - RNA, 24 nt, Human
aguggcaugaucuccgcucagugc

SEQ ID NO: 1232486 - RNA, 22 nt, Human
augacagagagaggcaggguac

SEQ ID NO: 1232487 - RNA, 21 nt, Human
augggguuucaccacguuggu

SEQ ID NO: 1232488 - RNA, 24 nt, Human
augggguuucaccacguuggucag

SEQ ID NO: 1232489 - RNA, 24 nt, Human
auuuuuguauuuuuaguagagaug

SEQ ID NO: 1232490 - RNA, 23 nt, Human
caaccuccaccuccugggcucag

SEQ ID NO: 1232491 - RNA, 24 nt, Human
caagauggggguuuugcucuaagc

SEQ ID NO: 1232492 - RNA, 22 nt, Human
caagccccugcagagaagcaag

SEQ ID NO: 1232493 - RNA, 22 nt, Human
caagggauucuccugccucagc

SEQ ID NO: 1232494 - RNA, 24 nt, Human
caaggugcugagaucacaggugug

SEQ ID NO: 1232495 - RNA, 23 nt, Human
caaugugugccaggacagauggg

SEQ ID NO: 1232496 - RNA, 24 nt, Human
cacacuggacauuucaagccccug

SEQ ID NO: 1232497 - RNA, 19 nt, Human
cacagaacucaagggacag

SEQ ID NO: 1232498 - RNA, 18 nt, Human
cacaggugugagccacca

SEQ ID NO: 1232499 - RNA, 24 nt, Human
caccacacccggcuaauuuuugua

SEQ ID NO: 1232500 - RNA, 21 nt, Human
caccacguuggucaggcuggu

SEQ ID NO: 1232501 - RNA, 24 nt, Human
caccacguuggucaggcuggucuc

SEQ ID NO: 1232502 - RNA, 18 nt, Human
caccaugcugggcuaggc

SEQ ID NO: 1232503 - RNA, 20 nt, Human
cacuggacauuucaagcccc

SEQ ID NO: 1232504 - RNA, 21 nt, Human
caggugcccaacaccacaccc

SEQ ID NO: 1232505 - RNA, 22 nt, Human
cagguguuucuccugccucagc

SEQ ID NO: 1232506 - RNA, 19 nt, Human
cagguucaagggauucucc

SEQ ID NO: 1232507 - RNA, 20 nt, Human
cauuguaacacagacaaagc

SEQ ID NO: 1232508 - RNA, 24 nt, Human
ccaaagcacugauagaccuauuca

SEQ ID NO: 1232509 - RNA, 19 nt, Human
ccaacaccacacccggcua

SEQ ID NO: 1232510 - RNA, 21 nt, Human
ccaaggugcugagaucacagg

SEQ ID NO: 1232511 - RNA, 24 nt, Human
ccaaggugcugagaucacaggugu

SEQ ID NO: 1232512 - RNA, 19 nt, Human
ccagaguagcugggauuac

SEQ ID NO: 1232513 - RNA, 22 nt, Human
ccagaguagcugggauuacagg

SEQ ID NO: 1232514 - RNA, 23 nt, Human
ccagaguagcugggauuacaggu

SEQ ID NO: 1232515 - RNA, 24 nt, Human
ccagaguagcugggauuacaggug

SEQ ID NO: 1232516 - RNA, 22 nt, Human
cccaacaccacacccggcuaau

SEQ ID NO: 1232517 - RNA, 23 nt, Human
cccaggcuagaaugcaguggcau

SEQ ID NO: 1232518 - RNA, 22 nt, Human
ccuccaccuccugggcucaggu

SEQ ID NO: 1232519 - RNA, 24 nt, Human
ccucccagguucaagggauucucc

SEQ ID NO: 1232520 - RNA, 21 nt, Human
ccugaccuaaggugaucugcc

SEQ ID NO: 1232521 - RNA, 23 nt, Human
ccugaccuaaggugaucugccug

SEQ ID NO: 1232522 - RNA, 24 nt, Human
ccugccucagccuccagaguagcu

SEQ ID NO: 1232523 - RNA, 23 nt, Human
ccugccucagccucccaaguagc

SEQ ID NO: 1232524 - RNA, 23 nt, Human
cuaauuuuuguauuuuuaguaga

SEQ ID NO: 1232525 - RNA, 23 nt, Human
cucagccuccagaguagcuggga

SEQ ID NO: 1232526 - RNA, 21 nt, Human
cucccaaggugcugagaucac

SEQ ID NO: 1232527 - RNA, 26 nt, Human
cuccugaccuaaggugaucugccugc

SEQ ID NO: 1232528 - RNA, 22 nt, Human
cuccugccucagccuccagagu

SEQ ID NO: 1232529 - RNA, 23 nt, Human
cugccucagccucccaaguagcu

SEQ ID NO: 1232530 - RNA, 23 nt, Human
cugccucggccucccaaggugcu

SEQ ID NO: 1232531 - RNA, 21 nt, Human
cuggaucuugauauguguuuc

SEQ ID NO: 1232532 - RNA, 24 nt, Human
cuggggaacccaccucccagguuc

SEQ ID NO: 1232533 - RNA, 26 nt, Human
cuuacugugcugggaguacuugugga

SEQ ID NO: 1232534 - RNA, 19 nt, Human
cuuguggagugggggcugu

SEQ ID NO: 1232535 - RNA, 21 nt, Human
cuuguggagugggggcugugu

SEQ ID NO: 1232536 - RNA, 19 nt, Human
gaauuggaggcugggacag

SEQ ID NO: 1232537 - RNA, 19 nt, Human
gacacagaacucaagggac

SEQ ID NO: 1232538 - RNA, 21 nt, Human
gacaggaaggagaugaauugg

SEQ ID NO: 1232539 - RNA, 24 nt, Human
gaccuaaggugaucugccugccuc

SEQ ID NO: 1232540 - RNA, 20 nt, Human
gagaugaauuggaggcuggg

SEQ ID NO: 1232541 - RNA, 24 nt, Human
gagaugggguuucaccacguuggu

SEQ ID NO: 1232542 - RNA, 20 nt, Human
gaggcugggacagggguccc

SEQ ID NO: 1232543 - RNA, 25 nt, Human
gaguagcugggauuacaggugccca

SEQ ID NO: 1232544 - RNA, 18 nt, Human
gaucacaggugugagcca

SEQ ID NO: 1232545 - RNA, 22 nt, Human
gaucacaggugugagccaccau

SEQ ID NO: 1232546 - RNA, 20 nt, Human
gccugguuuggggaauguuu

SEQ ID NO: 1232547 - RNA, 25 nt, Human
gcuagaaugcaguggcaugaucucc

SEQ ID NO: 1232548 - RNA, 25 nt, Human
ggacaggggucccugccagggaugc

SEQ ID NO: 1232549 - RNA, 20 nt, Human
ggagacagacaagauggggg

SEQ ID NO: 1232550 - RNA, 23 nt, Human
ggagucuuacucuguugcccagg

SEQ ID NO: 1232551 - RNA, 24 nt, Human
gggauucuccugccucagccuccc

SEQ ID NO: 1232552 - RNA, 26 nt, Human
gggcaaugugugccaggacagauggg

SEQ ID NO: 1232553 - RNA, 19 nt, Human
gggcuaggaaggcagguuu

SEQ ID NO: 1232554 - RNA, 18 nt, Human
gggguuucaccacguugg

SEQ ID NO: 1232555 - RNA, 22 nt, Human
gggguuucaccacguuggucag

SEQ ID NO: 1232556 - RNA, 22 nt, Human
ggguuucaccacguuggucagg

SEQ ID NO: 1232557 - RNA, 19 nt, Human
gugaucugccugccucggc

SEQ ID NO: 1232558 - RNA, 20 nt, Human
gugcaaccuccaccuccugg

SEQ ID NO: 1232559 - RNA, 21 nt, Human
gugcugagaucacagguguga

SEQ ID NO: 1232560 - RNA, 22 nt, Human
uaagacggagucuuacucuguu

SEQ ID NO: 1232561 - RNA, 18 nt, Human
uaaggugaucugccugcc

SEQ ID NO: 1232562 - RNA, 21 nt, Human
uaauuuuguauuuuuaguaga

SEQ ID NO: 1232563 - RNA, 24 nt, Human
uaauuuuuguauuuuuaguagaga

SEQ ID NO: 1232564 - RNA, 23 nt, Human
uacaggugcccaacaccacaccc

SEQ ID NO: 1232565 - RNA, 23 nt, Human
uacaggugcccaacaccacaccc

SEQ ID NO: 1232566 - RNA, 24 nt, Human
uacucuguugcccaggcuagaaug

SEQ ID NO: 1232567 - RNA, 24 nt, Human
uagaaugcaguggcaugaucuccg

SEQ ID NO: 1232568 - RNA, 22 nt, Human
uagagaugggguuucaccacgu

SEQ ID NO: 1232569 - RNA, 18 nt, Human
uagcauuguaacacagac

SEQ ID NO: 1232570 - RNA, 23 nt, Human
uagcuaugacagagagaggcagg

SEQ ID NO: 1232571 - RNA, 25 nt, Human
uaggaaggcagguuugggcuggaga

SEQ ID NO: 1232572 - RNA, 19 nt, Human
uaguagagaugggguuuca

SEQ ID NO: 1232573 - RNA, 24 nt, Human
uaguagagaugggguuucaccacg

SEQ ID NO: 1232574 - RNA, 26 nt, Human
uaguagagaugggguuucaccacguu

SEQ ID NO: 1232575 - RNA, 19 nt, Human
uauguguuucucaguugga

SEQ ID NO: 1232576 - RNA, 24 nt, Human
uauuuauuuuuuaagacggagucu

SEQ ID NO: 1232577 - RNA, 20 nt, Human
ucagccucccaaguagcugg

SEQ ID NO: 1232578 - RNA, 24 nt, Human
ucagugcaaccuccaccuccuggg

SEQ ID NO: 1232579 - RNA, 27 nt, Human
ucagugcaaccuccaccuccugggcuc

SEQ ID NO: 1232580 - RNA, 24 nt, Human
uccagaguagcugggauuacaggu

SEQ ID NO: 1232581 - RNA, 23 nt, Human
ucccaaggugcugagaucacagg

SEQ ID NO: 1232582 - RNA, 24 nt, Human
ucccaaguagcugggaacgcaggu

SEQ ID NO: 1232583 - RNA, 24 nt, Human
ucccagguagacagugguugaggc

SEQ ID NO: 1232584 - RNA, 21 nt, Human
ucccagguucaagggauucuc

SEQ ID NO: 1232585 - RNA, 24 nt, Human
ucccagguucaagggauucuccug

SEQ ID NO: 1232586 - RNA, 24 nt, Human
uccugggcucagguguuucuccug

SEQ ID NO: 1232587 - RNA, 18 nt, Human
ucggccucccaaggugcu

SEQ ID NO: 1232588 - RNA, 22 nt, Human
ucuagacuccauccuccauccc

SEQ ID NO: 1232589 - RNA, 26 nt, Human
ucuccugccucagccucccaaguagc

SEQ ID NO: 1232590 - RNA, 18 nt, Human
ucuguugcccaggcuaga

SEQ ID NO: 1232591 - RNA, 24 nt, Human
ucuguugcccaggcuagaaugcag

SEQ ID NO: 1232592 - RNA, 19 nt, Human
ucuuacucuguugcccagg

SEQ ID NO: 1232593 - RNA, 23 nt, Human
ucuuacucuguugcccaggcuag

SEQ ID NO: 1232594 - RNA, 24 nt, Human
ucuuacucuguugcccaggcuaga

SEQ ID NO: 1232595 - RNA, 19 nt, Human
ugacacagaacucaaggga

SEQ ID NO: 1232596 - RNA, 18 nt, Human
ugacagagagaggcaggg

SEQ ID NO: 1232597 - RNA, 24 nt, Human
ugaccuaaggugaucugccugccu

SEQ ID NO: 1232598 - RNA, 22 nt, Human
ugagaucacaggugugagccac

SEQ ID NO: 1232599 - RNA, 24 nt, Human
ugagaucacaggugugagccacca

SEQ ID NO: 1232600 - RNA, 23 nt, Human
ugaucuccgcucagugcaaccuc

SEQ ID NO: 1232601 - RNA, 24 nt, Human
ugcccaggcuagaaugcaguggca

SEQ ID NO: 1232602 - RNA, 24 nt, Human
ugccucagccuccagaguagcugg

SEQ ID NO: 1232603 - RNA, 24 nt, Human
ugccucagccucccaaguagcugg

SEQ ID NO: 1232604 - RNA, 21 nt, Human
ugccucggccucccaaggugc

SEQ ID NO: 1232605 - RNA, 24 nt, Human
ugccucggccucccaaggugcuga

SEQ ID NO: 1232606 - RNA, 22 nt, Human
ugccugggaugagaguggagac

SEQ ID NO: 1232607 - RNA, 24 nt, Human
ugcugagaucacaggugugagcca

SEQ ID NO: 1232608 - RNA, 27 nt, Human
uggagacucgggcuugggaggcauccc

SEQ ID NO: 1232609 - RNA, 20 nt, Human
uggcagugucaggcaaggac

SEQ ID NO: 1232610 - RNA, 23 nt, Human
ugggaacgcaggugcgugccaca

SEQ ID NO: 1232611 - RNA, 20 nt, Human
ugggaugagaguggagacag

SEQ ID NO: 1232612 - RNA, 19 nt, Human
ugggauuacaggugcccaa

SEQ ID NO: 1232613 - RNA, 22 nt, Human
ugggauuacaggugcccaacac

SEQ ID NO: 1232614 - RNA, 24 nt, Human
ugggauuacaggugcccaacacca

SEQ ID NO: 1232615 - RNA, 26 nt, Human
ugggcucagguguuucuccugccccg

SEQ ID NO: 1232616 - RNA, 24 nt, Human
ugggcucagguguuucuccugccu

SEQ ID NO: 1232617 - RNA, 20 nt, Human
ugggcuggagacucgggcuu

SEQ ID NO: 1232618 - RNA, 24 nt, Human
ugggguuucaccacguuggucagg

SEQ ID NO: 1232619 - RNA, 25 nt, Human
uggucaagucugaucucagggcugg

SEQ ID NO: 1232620 - RNA, 24 nt, Human
uggucaggcuggucucaaacuccu

SEQ ID NO: 1232621 - RNA, 21 nt, Human
uguauuuuuaguagagauggg

SEQ ID NO: 1232622 - RNA, 22 nt, Human
ugugacacagaacucaagggac

SEQ ID NO: 1232623 - RNA, 20 nt, Human
uuacaggugcccaacaccac

SEQ ID NO: 1232624 - RNA, 18 nt, Human
uuaguagagaugggguuu

SEQ ID NO: 1232625 - RNA, 22 nt, Human
uuaguagagaugggguuucacc

SEQ ID NO: 1232626 - RNA, 25 nt, Human
uuaguagagaugggguuucaccacg

SEQ ID NO: 1232627 - RNA, 23 nt, Human
uucaagggauucuccugccucag

SEQ ID NO: 1232628 - RNA, 18 nt, Human
uucuucuuguggccucug

SEQ ID NO: 1232629 - RNA, 19 nt, Human
uugauauguguuucucagu

SEQ ID NO: 1232630 - RNA, 19 nt, Human
uugcuugggacccaggggg

SEQ ID NO: 1232631 - RNA, 20 nt, Human
uuggaggcugggacaggggu

SEQ ID NO: 1232632 - RNA, 21 nt, Human
uugggaggcaucccagguaga

SEQ ID NO: 1232633 - RNA, 21 nt, Human
uuucaccacguuggucaggcu

SEQ ID NO: 1232634 - RNA, 18 nt, Human
uuuuguauuuuuaguaga

SEQ ID NO: 1232635 - RNA, 19 nt, Human
uuuuguauuuuuaguagag

SEQ ID NO: 1232636 - RNA, 24 nt, Human
uuuuuaguagagaugggguuucac

SEQ ID NO: 1232637 - RNA, 21 nt, Human
uuuuucuucuuguggccucug

SEQ ID NO: 1232638 - RNA, 20 nt, Human
uuuuuguauuuuuaguagag

SEQ ID NO: 1232639 - RNA, 21 nt, Human
ccaauuucuugguauuucuca

SEQ ID NO: 1232640 - RNA, 19 nt, Human
cucggguuuccgcuccugg

SEQ ID NO: 1232641 - RNA, 22 nt, Human
cucuacaguuaccuaguggcug

SEQ ID NO: 1232642 - RNA, 24 nt, Human
cucuacaguuaccuaguggcugcu

SEQ ID NO: 1232643 - RNA, 19 nt, Human
uggccucuacaguuaccuu

SEQ ID NO: 1232644 - RNA, 20 nt, Human
uugcaguggccucuacaguu

SEQ ID NO: 1232645 - RNA, 18 nt, Human
aaacuaaaccucuguuga

SEQ ID NO: 1232646 - RNA, 20 nt, Human
aagaagggaugauuggagca

SEQ ID NO: 1232647 - RNA, 19 nt, Human
aaguagcugggauuacaga

SEQ ID NO: 1232648 - RNA, 25 nt, Human
aaguagcugggauuacagacaccca

SEQ ID NO: 1232649 - RNA, 24 nt, Human
accauguuggccaggcuggucucg

SEQ ID NO: 1232650 - RNA, 18 nt, Human
acccaccaccacacccaa

SEQ ID NO: 1232651 - RNA, 21 nt, Human
accuggaugaugugcagcacu

SEQ ID NO: 1232652 - RNA, 18 nt, Human
acgggguuucaccauguu

SEQ ID NO: 1232653 - RNA, 23 nt, Human
acgggguuucaccauguuggcca

SEQ ID NO: 1232654 - RNA, 24 nt, Human
acgggguuucaccauguuggccag

SEQ ID NO: 1232655 - RNA, 24 nt, Human
acucuugucgcccaggcuggagcg

SEQ ID NO: 1232656 - RNA, 22 nt, Human
acugcaaugcagagguacccag

SEQ ID NO: 1232657 - RNA, 24 nt, Human
agagugcugggauuacagcugugg

SEQ ID NO: 1232658 - RNA, 25 nt, Human
agagugcugggauuacagcuguggg

SEQ ID NO: 1232659 - RNA, 21 nt, Human
agcacuguuugcaggagguga

SEQ ID NO: 1232660 - RNA, 21 nt, Human
agcaggugugugugugugugu

SEQ ID NO: 1232661 - RNA, 24 nt, Human
agccugucacccccucacgacucc

SEQ ID NO: 1232662 - RNA, 19 nt, Human
aggaaucacgucuucaagu

SEQ ID NO: 1232663 - RNA, 22 nt, Human
aggugugugugugugugugugu

SEQ ID NO: 1232664 - RNA, 24 nt, Human
aggugugugugugugugugugugg

SEQ ID NO: 1232665 - RNA, 21 nt, Human
agguucaagugauucuccugc

SEQ ID NO: 1232666 - RNA, 22 nt, Human
aguagagacgggguuucaccau

SEQ ID NO: 1232667 - RNA, 22 nt, Human
agugcugggauuacagcugugg

SEQ ID NO: 1232668 - RNA, 24 nt, Human
aucucagcuuauuagaaaaaacaa

SEQ ID NO: 1232669 - RNA, 18 nt, Human
caaaguguuaagugggaa

SEQ ID NO: 1232670 - RNA, 19 nt, Human
caagaaaaguugagaguca

SEQ ID NO: 1232671 - RNA, 19 nt, Human
caaguccagccacuagagc

SEQ ID NO: 1232672 - RNA, 22 nt, Human
caagugauucuccugccucagc

SEQ ID NO: 1232673 - RNA, 22 nt, Human
caaguucaugcuaaucaaagug

SEQ ID NO: 1232674 - RNA, 21 nt, Human
caccauguuggccaggcuggu

SEQ ID NO: 1232675 - RNA, 24 nt, Human
caccauguuggccaggcuggucuc

SEQ ID NO: 1232676 - RNA, 27 nt, Human
caccauguuggccaggcuggucucgaa

SEQ ID NO: 1232677 - RNA, 21 nt, Human
cacugcaacguccgccuccua

SEQ ID NO: 1232678 - RNA, 22 nt, Human
cagaagauucuucccaggucaa

SEQ ID NO: 1232679 - RNA, 21 nt, Human
cagacacccaccaccacaccc

SEQ ID NO: 1232680 - RNA, 23 nt, Human
cagacacccaccaccacacccaa

SEQ ID NO: 1232681 - RNA, 24 nt, Human
cagacacccaccaccacacccaac

SEQ ID NO: 1232682 - RNA, 24 nt, Human
cagagugcugggauuacagcugug

SEQ ID NO: 1232683 - RNA, 24 nt, Human
cauccagaaaggaagcagaugaua

SEQ ID NO: 1232684 - RNA, 24 nt, Human
cauguuggccaggcuggucucgaa

SEQ ID NO: 1232685 - RNA, 21 nt, Human
ccacuagagccucucucucca

SEQ ID NO: 1232686 - RNA, 20 nt, Human
ccagagugcugggauuacag

SEQ ID NO: 1232687 - RNA, 24 nt, Human
ccagagugcugggauuacagcugu

SEQ ID NO: 1232688 - RNA, 20 nt, Human
ccauccaagaauacacacuc

SEQ ID NO: 1232689 - RNA, 25 nt, Human
ccauccaagaauacacacucugcaa

SEQ ID NO: 1232690 - RNA, 21 nt, Human
cccaccaccacacccaacuaa

SEQ ID NO: 1232691 - RNA, 22 nt, Human
ccccagagugcugggauuacag

SEQ ID NO: 1232692 - RNA, 20 nt, Human
cccccucacgacuccucgaa

SEQ ID NO: 1232693 - RNA, 24 nt, Human
ccgccuccuagguucaagugauuc

SEQ ID NO: 1232694 - RNA, 23 nt, Human
ccuagguucaagugauucuccuc

SEQ ID NO: 1232695 - RNA, 23 nt, Human
ccuagguucaagugauucuccug

SEQ ID NO: 1232696 - RNA, 22 nt, Human
ccucaggugauccagccugccu

SEQ ID NO: 1232697 - RNA, 22 nt, Human
ccucaggugauccagccugccu

SEQ ID NO: 1232698 - RNA, 24 nt, Human
ccuccuagguucaagugauucucc

SEQ ID NO: 1232699 - RNA, 25 nt, Human
ccugcccucaggugauccagccugc

SEQ ID NO: 1232700 - RNA, 18 nt, Human
ccugggacaggcauggaa

SEQ ID NO: 1232701 - RNA, 18 nt, Human
ccuuuccaucacugaccc

SEQ ID NO: 1232702 - RNA, 24 nt, Human
cgggguuucaccauguuggccagg

SEQ ID NO: 1232703 - RNA, 23 nt, Human
cuaauuuuuguauuuuuaguaga

SEQ ID NO: 1232704 - RNA, 22 nt, Human
cucagagacuguaaacuaaacc

SEQ ID NO: 1232705 - RNA, 24 nt, Human
cucagccuucuaaguagcugggau

SEQ ID NO: 1232706 - RNA, 19 nt, Human
cuccuagguucaagugauu

SEQ ID NO: 1232707 - RNA, 22 nt, Human
cuccugccucagccuucuaagu

SEQ ID NO: 1232708 - RNA, 19 nt, Human
cucuugucgcccaggcugg

SEQ ID NO: 1232709 - RNA, 23 nt, Human
cugcaacguccgccuccuagguu

SEQ ID NO: 1232710 - RNA, 23 nt, Human
cugccucagccuucuaaguagcu

SEQ ID NO: 1232711 - RNA, 24 nt, Human
cugugggccacugcgcccggccuu

SEQ ID NO: 1232712 - RNA, 23 nt, Human
cuuuuuuuuuuuuuuuuugagau

SEQ ID NO: 1232713 - RNA, 24 nt, Human
gaaugcaagucaaugagucagcca

SEQ ID NO: 1232714 - RNA, 21 nt, Human
gagaaggaaaagacaucucau

SEQ ID NO: 1232715 - RNA, 24 nt, Human
gagaaugguuuuacuuaaaaauau

SEQ ID NO: 1232716 - RNA, 24 nt, Human
gagacgggguuucaccauguuggc

SEQ ID NO: 1232717 - RNA, 20 nt, Human
gaugauggagaaggaaaaga

SEQ ID NO: 1232718 - RNA, 18 nt, Human
gauuacagcugugggcca

SEQ ID NO: 1232719 - RNA, 22 nt, Human
gauuacagcugugggccacugc

SEQ ID NO: 1232720 - RNA, 22 nt, Human
gauuacagcugugggccacugc

SEQ ID NO: 1232721 - RNA, 19 nt, Human
gauucuccugccucagccu

SEQ ID NO: 1232722 - RNA, 22 nt, Human
gccacuagagccucucucucca

SEQ ID NO: 1232723 - RNA, 20 nt, Human
gcccaggcuggagcgcaaug

SEQ ID NO: 1232724 - RNA, 21 nt, Human
gcuggagcgcaauggugccag

SEQ ID NO: 1232725 - RNA, 19 nt, Human
ggaagcagaugauaaaguc

SEQ ID NO: 1232726 - RNA, 23 nt, Human
gggguuucaccauguuggccagg

SEQ ID NO: 1232727 - RNA, 21 nt, Human
gguagcuuaugaccaccugga

SEQ ID NO: 1232728 - RNA, 23 nt, Human
guagagacgggguuucaccaugu

SEQ ID NO: 1232729 - RNA, 22 nt, Human
gugauccagccugccuuggccc

SEQ ID NO: 1232730 - RNA, 21 nt, Human
gugauucuccugccucagccu

SEQ ID NO: 1232731 - RNA, 18 nt, Human
gugccaucuuggcucacu

SEQ ID NO: 1232732 - RNA, 21 nt, Human
gugugugugugugugugugug

SEQ ID NO: 1232733 - RNA, 22 nt, Human
gugugugugugugugugugugu

SEQ ID NO: 1232734 - RNA, 19 nt, Human
uaacuuggcucuaagauga

SEQ ID NO: 1232735 - RNA, 21 nt, Human
uaagaacauauaacuuggcuc

SEQ ID NO: 1232736 - RNA, 24 nt, Human
uaauuuuuguauuuuuaguagaga

SEQ ID NO: 1232737 - RNA, 23 nt, Human
uacgugcacaaagaggagcaaga

SEQ ID NO: 1232738 - RNA, 22 nt, Human
uagagacgggguuucaccaugu

SEQ ID NO: 1232739 - RNA, 19 nt, Human
uagcaaaagcugacuugug

SEQ ID NO: 1232740 - RNA, 23 nt, Human
uagguucaagugauucuccugcc

SEQ ID NO: 1232741 - RNA, 24 nt, Human
uagguucaagugauucuccugccu

SEQ ID NO: 1232742 - RNA, 24 nt, Human
uaguagagacgggguuucaccaug

SEQ ID NO: 1232743 - RNA, 26 nt, Human
uaguagagacgggguuucaccauguu

SEQ ID NO: 1232744 - RNA, 18 nt, Human
uauuucuauuuucucaaa

SEQ ID NO: 1232745 - RNA, 19 nt, Human
ucaagugauucuccugccu

SEQ ID NO: 1232746 - RNA, 20 nt, Human
ucaaugaacaaaaagcuaca

SEQ ID NO: 1232747 - RNA, 23 nt, Human
ucacucuugucgcccaggcugga

SEQ ID NO: 1232748 - RNA, 24 nt, Human
ucacugcaacguccgccuccuagg

SEQ ID NO: 1232749 - RNA, 25 nt, Human
ucacugcaacguccgccuccuaggu

SEQ ID NO: 1232750 - RNA, 27 nt, Human
ucacugcaacguccgccuccuagguuc

SEQ ID NO: 1232751 - RNA, 21 nt, Human
ucagcaucugcugcccaacag

SEQ ID NO: 1232752 - RNA, 20 nt, Human
ucccacucauugaauccaaa

SEQ ID NO: 1232753 - RNA, 22 nt, Human
ucccaggucaaguccagccacc

SEQ ID NO: 1232754 - RNA, 21 nt, Human
uccuagguucaagugauucuc

SEQ ID NO: 1232755 - RNA, 24 nt, Human
uccuagguucaagugauucuccug

SEQ ID NO: 1232756 - RNA, 20 nt, Human
uccucgaauggccccuccac

SEQ ID NO: 1232757 - RNA, 18 nt, Human
ucgcccaggcuggagcgc

SEQ ID NO: 1232758 - RNA, 19 nt, Human
ucuaaguagcugggauuac

SEQ ID NO: 1232759 - RNA, 24 nt, Human
ucuccaaaucuuagccugucaccc

SEQ ID NO: 1232760 - RNA, 21 nt, Human
ucuccuuaagagaaaugggaa

SEQ ID NO: 1232761 - RNA, 22 nt, Human
ucuccuuaagagaaaugggaau

SEQ ID NO: 1232762 - RNA, 18 nt, Human
ucuuuuuuuuuuuuuuuu

SEQ ID NO: 1232763 - RNA, 20 nt, Human
ugaacaaaaagcuacaugga

SEQ ID NO: 1232764 - RNA, 20 nt, Human
ugauucuccugccucagccu

SEQ ID NO: 1232765 - RNA, 22 nt, Human
ugccaucaauccuggcugaagu

SEQ ID NO: 1232766 - RNA, 24 nt, Human
ugccucagccuucuaaguagcugg

SEQ ID NO: 1232767 - RNA, 21 nt, Human
ugccuuggccccccagagugc

SEQ ID NO: 1232768 - RNA, 21 nt, Human
ugccuuggccccccagagugc

SEQ ID NO: 1232769 - RNA, 24 nt, Human
ugcgcccggccuuggaccuuguuu

SEQ ID NO: 1232770 - RNA, 19 nt, Human
uggaccuuguuuucuaaug

SEQ ID NO: 1232771 - RNA, 24 nt, Human
uggccaggcuggucucgaacuccu

SEQ ID NO: 1232772 - RNA, 18 nt, Human
uggcucacugcaacgucc

SEQ ID NO: 1232773 - RNA, 19 nt, Human
ugggauuacagacacccac

SEQ ID NO: 1232774 - RNA, 21 nt, Human
ugggauuacagacacccacca

SEQ ID NO: 1232775 - RNA, 24 nt, Human
ugggauuacagacacccaccacca

SEQ ID NO: 1232776 - RNA, 19 nt, Human
ugggauuacagcugugggc

SEQ ID NO: 1232777 - RNA, 22 nt, Human
ugggauuacagcugugggccac

SEQ ID NO: 1232778 - RNA, 22 nt, Human
ugggauuacagcugugggccac

SEQ ID NO: 1232779 - RNA, 24 nt, Human
ugggauuacagcugugggccacug

SEQ ID NO: 1232780 - RNA, 23 nt, Human
ugucuacauaaggaugguuccau

SEQ ID NO: 1232781 - RNA, 21 nt, Human
uguguguguguguguacgugc

SEQ ID NO: 1232782 - RNA, 21 nt, Human
uguguguguguguguguacgu

SEQ ID NO: 1232783 - RNA, 22 nt, Human
uguguguguguguguguacgug

SEQ ID NO: 1232784 - RNA, 18 nt, Human
ugugugugugugugugug

SEQ ID NO: 1232785 - RNA, 18 nt, Human
ugugugugugugugugug

SEQ ID NO: 1232786 - RNA, 18 nt, Human
ugugugugugugugugug

SEQ ID NO: 1232787 - RNA, 18 nt, Human
ugugugugugugugugug

SEQ ID NO: 1232788 - RNA, 18 nt, Human
ugugugugugugugugug

SEQ ID NO: 1232789 - RNA, 18 nt, Human
ugugugugugugugugug

SEQ ID NO: 1232790 - RNA, 18 nt, Human
ugugugugugugugugug

SEQ ID NO: 1232791 - RNA, 18 nt, Human
ugugugugugugugugug

SEQ ID NO: 1232792 - RNA, 20 nt, Human
ugugugugugugugugugua

SEQ ID NO: 1232793 - RNA, 21 nt, Human
ugugugugugugugugugugu

SEQ ID NO: 1232794 - RNA, 21 nt, Human
ugugugugugugugugugugu

SEQ ID NO: 1232795 - RNA, 21 nt, Human
ugugugugugugugugugugu

SEQ ID NO: 1232796 - RNA, 21 nt, Human
ugugugugugugugugugugu

SEQ ID NO: 1232797 - RNA, 21 nt, Human
ugugugugugugugugugugu

SEQ ID NO: 1232798 - RNA, 21 nt, Human
ugugugugugugugugugugu

SEQ ID NO: 1232799 - RNA, 21 nt, Human
ugugugugugugugugugugu

SEQ ID NO: 1232800 - RNA, 21 nt, Human
ugugugugugugugugugugu

SEQ ID NO: 1232801 - RNA, 21 nt, Human
ugugugugugugugugugugu

SEQ ID NO: 1232802 - RNA, 21 nt, Human
ugugugugugugugugugugu

SEQ ID NO: 1232803 - RNA, 21 nt, Human
ugugugugugugugugugugu

SEQ ID NO: 1232804 - RNA, 21 nt, Human
ugugugugugugugugugugu

SEQ ID NO: 1232805 - RNA, 22 nt, Human
ugugugugugugugugugugua

SEQ ID NO: 1232806 - RNA, 22 nt, Human
ugugugugugugugugugugug

SEQ ID NO: 1232807 - RNA, 22 nt, Human
ugugugugugugugugugugug

SEQ ID NO: 1232808 - RNA, 22 nt, Human
ugugugugugugugugugugug

SEQ ID NO: 1232809 - RNA, 22 nt, Human
ugugugugugugugugugugug

SEQ ID NO: 1232810 - RNA, 22 nt, Human
ugugugugugugugugugugug

SEQ ID NO: 1232811 - RNA, 23 nt, Human
ugugugugugugugugugugugu

SEQ ID NO: 1232812 - RNA, 19 nt, Human
uuaagugggaaugcaaguc

SEQ ID NO: 1232813 - RNA, 18 nt, Human
uuaguagagacgggguuu

SEQ ID NO: 1232814 - RNA, 22 nt, Human
uuaguagagacgggguuucacc

SEQ ID NO: 1232815 - RNA, 24 nt, Human
uuaguagagacgggguuucaccau

SEQ ID NO: 1232816 - RNA, 23 nt, Human
uucaaaccgccccucugcacacu

SEQ ID NO: 1232817 - RNA, 21 nt, Human
uucaagugauucuccugccuc

SEQ ID NO: 1232818 - RNA, 23 nt, Human
uucaagugauucuccugccucag

SEQ ID NO: 1232819 - RNA, 24 nt, Human
uucaagugauucuccugccucagc

SEQ ID NO: 1232820 - RNA, 24 nt, Human
uucacucuugucgcccaggcugga

SEQ ID NO: 1232821 - RNA, 23 nt, Human
uuguauuuuuaguagagacgggg

SEQ ID NO: 1232822 - RNA, 24 nt, Human
uuucaccauguuggccaggcuggu

SEQ ID NO: 1232823 - RNA, 20 nt, Human
uuugggaguuuacugcuuua

SEQ ID NO: 1232824 - RNA, 21 nt, Human
uuuuguauuuuuaguagagac

SEQ ID NO: 1232825 - RNA, 24 nt, Human
uuuuuaguagagacgggguuucac

SEQ ID NO: 1232826 - RNA, 20 nt, Human
uuuuuguauuuuuaguagag

SEQ ID NO: 1232827 - RNA, 19 nt, Human
uuuuuuuuugagauggagc

SEQ ID NO: 1232828 - RNA, 22 nt, Human
uuuuuuuuuuuuuugagaugga

SEQ ID NO: 1232829 - RNA, 18 nt, Human
uuuuuuuuuuuuuuuuug

SEQ ID NO: 1232830 - RNA, 22 nt, Human
caauugcccaggcuuuccugaa

SEQ ID NO: 1232831 - RNA, 25 nt, Human
cauuccaauugcccaggcuuuccug

SEQ ID NO: 1232832 - RNA, 20 nt, Human
ccaauggggaucauuccuuc

SEQ ID NO: 1232833 - RNA, 18 nt, Human
ccagcugggggcgcaauu

SEQ ID NO: 1232834 - RNA, 19 nt, Human
cccaggcuuuccugaaaca

SEQ ID NO: 1232835 - RNA, 27 nt, Human
ugaaacacaggcacccuagucucaccu

SEQ ID NO: 1232836 - RNA, 19 nt, Human
aaagcacacggcauaaaac

SEQ ID NO: 1232837 - RNA, 24 nt, Human
acaaaacuuaaaacaccuuccagg

SEQ ID NO: 1232838 - RNA, 25 nt, Human
acagacaccaccgugggugccgagc

SEQ ID NO: 1232839 - RNA, 25 nt, Human
acagcacagacaccaccgugggugc

SEQ ID NO: 1232840 - RNA, 27 nt, Human
agagaccaaagcagcacagcacagaca

SEQ ID NO: 1232841 - RNA, 18 nt, Human
agcaccagggaacgaggg

SEQ ID NO: 1232842 - RNA, 23 nt, Human
aggcaagauccaaagcaauuuua

SEQ ID NO: 1232843 - RNA, 19 nt, Human
agggcaaguuccacagggc

SEQ ID NO: 1232844 - RNA, 21 nt, Human
auggcaauggagcccagcgcc

SEQ ID NO: 1232845 - RNA, 20 nt, Human
caaagcagcacagcacagac

SEQ ID NO: 1232846 - RNA, 23 nt, Human
caaagcagcacagcacagacacc

SEQ ID NO: 1232847 - RNA, 20 nt, Human
cacacggcauaaaacgaggu

SEQ ID NO: 1232848 - RNA, 24 nt, Human
caccuuccaggcaagauccaaagc

SEQ ID NO: 1232849 - RNA, 18 nt, Human
cagagaccaaagcagcac

SEQ ID NO: 1232850 - RNA, 19 nt, Human
cagagcagaguccgccucu

SEQ ID NO: 1232851 - RNA, 21 nt, Human
cauuuccaccagcaccaggga

SEQ ID NO: 1232852 - RNA, 18 nt, Human
ccaaagcagcacagcaca

SEQ ID NO: 1232853 - RNA, 21 nt, Human
ccagagcagaguccgccucuu

SEQ ID NO: 1232854 - RNA, 19 nt, Human
cucuuccagagcagagucc

SEQ ID NO: 1232855 - RNA, 25 nt, Human
cuuaaaacaccuuccaggcaagauc

SEQ ID NO: 1232856 - RNA, 19 nt, Human
gcacagcacagacaccacc

SEQ ID NO: 1232857 - RNA, 23 nt, Human
ggauccagagaccaaagcagcac

SEQ ID NO: 1232858 - RNA, 18 nt, Human
guugacaagggggaaugc

SEQ ID NO: 1232859 - RNA, 22 nt, Human
uaaaagcacacggcauaaaacg

SEQ ID NO: 1232860 - RNA, 25 nt, Human
uacaaaacuuaaaacaccuuccagg

SEQ ID NO: 1232861 - RNA, 19 nt, Human
uagagucaaauguaucugc

SEQ ID NO: 1232862 - RNA, 23 nt, Human
uauuacaaaacuuaaaacaccuu

SEQ ID NO: 1232863 - RNA, 21 nt, Human
ucagcagguaaaagcacacgg

SEQ ID NO: 1232864 - RNA, 21 nt, Human
uccaccagcaccagggaacga

SEQ ID NO: 1232865 - RNA, 20 nt, Human
uccagagcagaguccgccuc

SEQ ID NO: 1232866 - RNA, 19 nt, Human
uccaggcaagauccaaagc

SEQ ID NO: 1232867 - RNA, 20 nt, Human
uggcaauggagcccagcgcc

SEQ ID NO: 1232868 - RNA, 22 nt, Human
uucauuguccaagccauccacc

SEQ ID NO: 1232869 - RNA, 25 nt, Human
aaacaaaacauacauacagcaagaa

SEQ ID NO: 1232870 - RNA, 21 nt, Human
aaacaaaccagacucuaacag

SEQ ID NO: 1232871 - RNA, 22 nt, Human
aaaccaaacucucaacaaaauu

SEQ ID NO: 1232872 - RNA, 20 nt, Human
aaaccagguaauuaaaacag

SEQ ID NO: 1232873 - RNA, 20 nt, Human
aaagagacaauuauaaacca

SEQ ID NO: 1232874 - RNA, 19 nt, Human
aaaguguauacagccaaca

SEQ ID NO: 1232875 - RNA, 23 nt, Human
aacaaaacaaccuguuuguccuu

SEQ ID NO: 1232876 - RNA, 18 nt, Human
aacaucagaaucuuggca

SEQ ID NO: 1232877 - RNA, 23 nt, Human
aaccaaacucucaacaaaauucg

SEQ ID NO: 1232878 - RNA, 21 nt, Human
aaccaaagaaagugcuccagg

SEQ ID NO: 1232879 - RNA, 21 nt, Human
aacccaagcaucgaugugucu

SEQ ID NO: 1232880 - RNA, 21 nt, Human
aacgaaaccuucaaauauugc

SEQ ID NO: 1232881 - RNA, 18 nt, Human
aaggacuugaucacuucc

SEQ ID NO: 1232882 - RNA, 21 nt, Human
acaaaagaaaaacucucagcu

SEQ ID NO: 1232883 - RNA, 24 nt, Human
acaaaaugagucaauacaacacau

SEQ ID NO: 1232884 - RNA, 21 nt, Human
acaccaacuccagcacccggc

SEQ ID NO: 1232885 - RNA, 20 nt, Human
accaucagugcucugagcaa

SEQ ID NO: 1232886 - RNA, 21 nt, Human
acgaaaccuucaaauauugcc

SEQ ID NO: 1232887 - RNA, 24 nt, Human
agaaagaacaggcaguuguaaaaa

SEQ ID NO: 1232888 - RNA, 18 nt, Human
agacaaaagagacaauua

SEQ ID NO: 1232889 - RNA, 21 nt, Human
agcaauccaagaaucccggcc

SEQ ID NO: 1232890 - RNA, 18 nt, Human
agccggcccccggccccc

SEQ ID NO: 1232891 - RNA, 21 nt, Human
agcgguaccagugcuugcaca

SEQ ID NO: 1232892 - RNA, 18 nt, Human
agcucauguggguuggau

SEQ ID NO: 1232893 - RNA, 18 nt, Human
agcugggcagguugcaca

SEQ ID NO: 1232894 - RNA, 19 nt, Human
aguaacgucugcuuccaca

SEQ ID NO: 1232895 - RNA, 19 nt, Human
agugaagggagggagcaag

SEQ ID NO: 1232896 - RNA, 19 nt, Human
aguuuucagcacaaggugu

SEQ ID NO: 1232897 - RNA, 23 nt, Human
auacuaugaauugaaacagaaca

SEQ ID NO: 1232898 - RNA, 19 nt, Human
augcuucucaauauauuaa

SEQ ID NO: 1232899 - RNA, 18 nt, Human
auguaucuaaaaccauac

SEQ ID NO: 1232900 - RNA, 25 nt, Human
caaaacauacauacagcaagaacuc

SEQ ID NO: 1232901 - RNA, 19 nt, Human
caaaagaaaaacucucagc

SEQ ID NO: 1232902 - RNA, 23 nt, Human
caaaauaaaaggaccauuaauca

SEQ ID NO: 1232903 - RNA, 26 nt, Human
caagacaaaagagacaauuauaaacc

SEQ ID NO: 1232904 - RNA, 19 nt, Human
caagcaauguaucaaauac

SEQ ID NO: 1232905 - RNA, 23 nt, Human
caaggagcaauccaagaaucccg

SEQ ID NO: 1232906 - RNA, 19 nt, Human
caauucuuauguaucuaaa

SEQ ID NO: 1232907 - RNA, 22 nt, Human
cacaaccugaaaaagaaacaag

SEQ ID NO: 1232908 - RNA, 20 nt, Human
cacggcacaagcacuuuccc

SEQ ID NO: 1232909 - RNA, 18 nt, Human
cagaucucuccuccauuc

SEQ ID NO: 1232910 - RNA, 21 nt, Human
cagcaccaaugacaaagauau

SEQ ID NO: 1232911 - RNA, 18 nt, Human
cagcuccgcagcucggac

SEQ ID NO: 1232912 - RNA, 18 nt, Human
cagcucggacagcuccag

SEQ ID NO: 1232913 - RNA, 20 nt, Human
caguagaaagaggaaacacg

SEQ ID NO: 1232914 - RNA, 27 nt, Human
caucgaaaagaaucuuuaacagauuuc

SEQ ID NO: 1232915 - RNA, 19 nt, Human
caucgccgugcaggcagcg

SEQ ID NO: 1232916 - RNA, 26 nt, Human
cauucgggaauuuaaaucuuugaaac

SEQ ID NO: 1232917 - RNA, 18 nt, Human
ccaaccugaaguuuucag

SEQ ID NO: 1232918 - RNA, 20 nt, Human
ccaccacacuucccaugcau

SEQ ID NO: 1232919 - RNA, 20 nt, Human
cccaaauguuauuccaauuu

SEQ ID NO: 1232920 - RNA, 23 nt, Human
cccaauaacgaguuugaggcuua

SEQ ID NO: 1232921 - RNA, 22 nt, Human
cccacucaaccaacugcaaccc

SEQ ID NO: 1232922 - RNA, 19 nt, Human
cccagagggcccucccacc

SEQ ID NO: 1232923 - RNA, 24 nt, Human
ccccaaauguuauuccaauuuugu

SEQ ID NO: 1232924 - RNA, 18 nt, Human
ccccagagcccgagcccg

SEQ ID NO: 1232925 - RNA, 19 nt, Human
cccucccaccacacuuccc

SEQ ID NO: 1232926 - RNA, 19 nt, Human
ccucacugaaaccaaucuu

SEQ ID NO: 1232927 - RNA, 18 nt, Human
ccugaaccacuucucuug

SEQ ID NO: 1232928 - RNA, 18 nt, Human
ccugaggauuuuucuggc

SEQ ID NO: 1232929 - RNA, 20 nt, Human
cggccccagagcccgagccc

SEQ ID NO: 1232930 - RNA, 23 nt, Human
cggcccccgcggccccagagccc

SEQ ID NO: 1232931 - RNA, 22 nt, Human
cggcccccggcccccgcggccc

SEQ ID NO: 1232932 - RNA, 23 nt, Human
cggcccccggcccccgcggcccc

SEQ ID NO: 1232933 - RNA, 19 nt, Human
cgggugcaacaugcauaug

SEQ ID NO: 1232934 - RNA, 20 nt, Human
cucacuuuuagagaagugca

SEQ ID NO: 1232935 - RNA, 23 nt, Human
cuccagcacccggcugggcagcc

SEQ ID NO: 1232936 - RNA, 21 nt, Human
cucuucuacaacgaaaccuuc

SEQ ID NO: 1232937 - RNA, 22 nt, Human
cucuucuacaacgaaaccuuca

SEQ ID NO: 1232938 - RNA, 26 nt, Human
cuggacaucgaaaagaaucuuuaaca

SEQ ID NO: 1232939 - RNA, 22 nt, Human
cuggagcagucauuagugcuga

SEQ ID NO: 1232940 - RNA, 19 nt, Human
cugggcagccggcccccgg

SEQ ID NO: 1232941 - RNA, 24 nt, Human
cuuuaagccuuaauauuucuucuu

SEQ ID NO: 1232942 - RNA, 21 nt, Human
gaacaccaacuccagcacccg

SEQ ID NO: 1232943 - RNA, 18 nt, Human
gagaaccacugguuugaa

SEQ ID NO: 1232944 - RNA, 22 nt, Human
gaucacuuccuaacaaguccau

SEQ ID NO: 1232945 - RNA, 21 nt, Human
gcaauguaucaaauacacaau

SEQ ID NO: 1232946 - RNA, 22 nt, Human
gcagcauauugaaaugaccaga

SEQ ID NO: 1232947 - RNA, 20 nt, Human
gcaguccaggcagaccaugc

SEQ ID NO: 1232948 - RNA, 21 nt, Human
gcaugauguaaacaauaugaa

SEQ ID NO: 1232949 - RNA, 23 nt, Human
gcccucaugacccagaugcuccu

SEQ ID NO: 1232950 - RNA, 19 nt, Human
gcuaacuuagagacaacau

SEQ ID NO: 1232951 - RNA, 25 nt, Human
ggaaaaaaaaggacuggagaaagga

SEQ ID NO: 1232952 - RNA, 28 nt, Human
ggacagcuccagguaagaggggaacgcc

SEQ ID NO: 1232953 - RNA, 20 nt, Human
ggagcagucauuagugcuga

SEQ ID NO: 1232954 - RNA, 24 nt, Human
ggcccccggcccccgcggccccag

SEQ ID NO: 1232955 - RNA, 19 nt, Human
gugcuccagguuucccaag

SEQ ID NO: 1232956 - RNA, 20 nt, Human
guuacaaaauaaaaggacca

SEQ ID NO: 1232957 - RNA, 18 nt, Human
uaaaacaaaacauacaua

SEQ ID NO: 1232958 - RNA, 20 nt, Human
uaagagaacaccaacuccag

SEQ ID NO: 1232959 - RNA, 24 nt, Human
uaagccaaaaauaauacaaaauga

SEQ ID NO: 1232960 - RNA, 24 nt, Human
uacaccaagaaaaaucaauuucua

SEQ ID NO: 1232961 - RNA, 24 nt, Human
uacaccaagaaaaaucaauuucua

SEQ ID NO: 1232962 - RNA, 19 nt, Human
uacagcaagaacucagaag

SEQ ID NO: 1232963 - RNA, 18 nt, Human
uacagcauuuauaagguu

SEQ ID NO: 1232964 - RNA, 21 nt, Human
uaccagugcuugcacaccagg

SEQ ID NO: 1232965 - RNA, 23 nt, Human
uagaaagaggaaacacgaagaua

SEQ ID NO: 1232966 - RNA, 20 nt, Human
uagaacaaaacaaccuguuu

SEQ ID NO: 1232967 - RNA, 20 nt, Human
uagaacuagaacaaaacaac

SEQ ID NO: 1232968 - RNA, 21 nt, Human
uaguaacgucugcuuccacau

SEQ ID NO: 1232969 - RNA, 28 nt, Human
uauagccccaauaacgaguuugagggga

SEQ ID NO: 1232970 - RNA, 18 nt, Human
uaugacuaauagcuuuca

SEQ ID NO: 1232971 - RNA, 24 nt, Human
ucaacaaaauucggaauggccaca

SEQ ID NO: 1232972 - RNA, 22 nt, Human
ucagcaccaaugacaaagauau

SEQ ID NO: 1232973 - RNA, 23 nt, Human
ucagucuucacaaacacacuacu

SEQ ID NO: 1232974 - RNA, 23 nt, Human
uccacaucugcaugcuucguuaa

SEQ ID NO: 1232975 - RNA, 19 nt, Human
ucccauaagcagaucucuc

SEQ ID NO: 1232976 - RNA, 22 nt, Human
uccuaacaaguccaucuucaac

SEQ ID NO: 1232977 - RNA, 21 nt, Human
ucuacaaucucaccuuuaaag

SEQ ID NO: 1232978 - RNA, 22 nt, Human
ucuaccgaaaugcucuccucag

SEQ ID NO: 1232979 - RNA, 20 nt, Human
ucucaucgccgugcaggcag

SEQ ID NO: 1232980 - RNA, 23 nt, Human
ucucaucgccgugcaggcagcgg

SEQ ID NO: 1232981 - RNA, 18 nt, Human
ucuccaguuuacgacuuc

SEQ ID NO: 1232982 - RNA, 23 nt, Human
ucugucaucacaagaaagccacu

SEQ ID NO: 1232983 - RNA, 24 nt, Human
ugaaaagcacguaucuuggccuug

SEQ ID NO: 1232984 - RNA, 18 nt, Human
ugaaacagaacacuccuu

SEQ ID NO: 1232985 - RNA, 18 nt, Human
ugaaggcccucaugaccc

SEQ ID NO: 1232986 - RNA, 22 nt, Human
ugacaaagauauuccaucuccu

SEQ ID NO: 1232987 - RNA, 22 nt, Human
ugacccagaugcucaugcugcu

SEQ ID NO: 1232988 - RNA, 18 nt, Human
ugacuacaaaguguauac

SEQ ID NO: 1232989 - RNA, 23 nt, Human
ugagaguaaaaacaaaaacaaac

SEQ ID NO: 1232990 - RNA, 19 nt, Human
ugagcaaugggguuucgau

SEQ ID NO: 1232991 - RNA, 23 nt, Human
ugagguagugaagggagggagca

SEQ ID NO: 1232992 - RNA, 22 nt, Human
ugccacagugcccagagggccc

SEQ ID NO: 1232993 - RNA, 20 nt, Human
ugcgggcgcacaggcuccgg

SEQ ID NO: 1232994 - RNA, 23 nt, Human
ugcuaacuuagagacaacaucgg

SEQ ID NO: 1232995 - RNA, 21 nt, Human
uggaaaaaaaaggacuggaga

SEQ ID NO: 1232996 - RNA, 20 nt, Human
uggcagcauauugaaaugac

SEQ ID NO: 1232997 - RNA, 24 nt, Human
uguaaaguaaagccauucuucuua

SEQ ID NO: 1232998 - RNA, 19 nt, Human
uguaagccaaaaauaauac

SEQ ID NO: 1232999 - RNA, 21 nt, Human
uguucuguguuaugagacacu

SEQ ID NO: 1233000 - RNA, 18 nt, Human
uuaaagcuggaaauaaca

SEQ ID NO: 1233001 - RNA, 19 nt, Human
uuccacucagcaccuucaa

SEQ ID NO: 1233002 - RNA, 22 nt, Human
uucccaugcauggcggcccuca

SEQ ID NO: 1233003 - RNA, 18 nt, Human
uucgcucgcuuuugucaa

SEQ ID NO: 1233004 - RNA, 19 nt, Human
uucuaccgaaaugcucucc

SEQ ID NO: 1233005 - RNA, 22 nt, Human
uugaaacagaacacuccuuuga

SEQ ID NO: 1233006 - RNA, 21 nt, Human
uugcaccaucagugcucugag

SEQ ID NO: 1233007 - RNA, 19 nt, Human
uugccgaacugaguuguuc

SEQ ID NO: 1233008 - RNA, 24 nt, Human
uuuguaguuaacccaguugucccc

SEQ ID NO: 1233009 - RNA, 25 nt, Human
aacacccagaaacuuguuagaaaug

SEQ ID NO: 1233010 - RNA, 19 nt, Human
aacugggaccacaagugcu

SEQ ID NO: 1233011 - RNA, 20 nt, Human
aagcagggcaagggcaaugu

SEQ ID NO: 1233012 - RNA, 21 nt, Human
acagaugaggaagaggaaguu

SEQ ID NO: 1233013 - RNA, 23 nt, Human
agaaaugcaaauccucaggucuc

SEQ ID NO: 1233014 - RNA, 19 nt, Human
agacuggcuccagguccca

SEQ ID NO: 1233015 - RNA, 24 nt, Human
agcggcggaggcaacacccagaaa

SEQ ID NO: 1233016 - RNA, 20 nt, Human
aggaagaggaaguucaggga

SEQ ID NO: 1233017 - RNA, 18 nt, Human
auccucaggucucaccca

SEQ ID NO: 1233018 - RNA, 24 nt, Human
caacacccagaaacuuguuagaaa

SEQ ID NO: 1233019 - RNA, 21 nt, Human
cagccagcagcuaccucccuc

SEQ ID NO: 1233020 - RNA, 21 nt, Human
ccaagccacaucccuccagga

SEQ ID NO: 1233021 - RNA, 20 nt, Human
ccagaucagcggcggaggca

SEQ ID NO: 1233022 - RNA, 23 nt, Human
ccucaggucucacccagacugga

SEQ ID NO: 1233023 - RNA, 18 nt, Human
cggaggcaacacccagaa

SEQ ID NO: 1233024 - RNA, 23 nt, Human
cucccagcuucacuguguauucc

SEQ ID NO: 1233025 - RNA, 18 nt, Human
cucugcuuccacaccuuc

SEQ ID NO: 1233026 - RNA, 21 nt, Human
gcggcggaggcaacacccaga

SEQ ID NO: 1233027 - RNA, 18 nt, Human
gcuaccucccucucucca

SEQ ID NO: 1233028 - RNA, 18 nt, Human
ggacagacuggcuccagg

SEQ ID NO: 1233029 - RNA, 18 nt, Human
ggcggaggcaacacccag

SEQ ID NO: 1233030 - RNA, 21 nt, Human
ggcugcaggaagauccuccag

SEQ ID NO: 1233031 - RNA, 19 nt, Human
gguaccaucuuccuaugcc

SEQ ID NO: 1233032 - RNA, 19 nt, Human
uccccagaucagcggcgga

SEQ ID NO: 1233033 - RNA, 20 nt, Human
ucccgccugguaccaucuuc

SEQ ID NO: 1233034 - RNA, 22 nt, Human
ucccgccugguaccaucuuccu

SEQ ID NO: 1233035 - RNA, 19 nt, Human
uccucaggucucacccaga

SEQ ID NO: 1233036 - RNA, 24 nt, Human
uccucaggucucacccagacugga

SEQ ID NO: 1233037 - RNA, 20 nt, Human
ucucccagcuucacugugua

SEQ ID NO: 1233038 - RNA, 19 nt, Human
ugaccacuuuagccaguag

SEQ ID NO: 1233039 - RNA, 23 nt, Human
ugaggaagaggaaguucagggag

SEQ ID NO: 1233040 - RNA, 27 nt, Human
ugaggaagaggaaguucagggaggggg

SEQ ID NO: 1233041 - RNA, 19 nt, Human
uggcuccaggucccacagc

SEQ ID NO: 1233042 - RNA, 21 nt, Human
uggcuccaggucccacagccu

SEQ ID NO: 1233043 - RNA, 24 nt, Human
uggcugcaggaagauccuccaggg

SEQ ID NO: 1233044 - RNA, 22 nt, Human
uuccuaugccagccagcagcua

SEQ ID NO: 1233045 - RNA, 21 nt, Human
aacaaggaggcccuggucccc

SEQ ID NO: 1233046 - RNA, 22 nt, Human
aaguagcugggauuacaggcau

SEQ ID NO: 1233047 - RNA, 24 nt, Human
aaguagcugggauuacaggcaugc

SEQ ID NO: 1233048 - RNA, 18 nt, Human
accggcccgccucaaaca

SEQ ID NO: 1233049 - RNA, 22 nt, Human
accuccgccucccagguucuag

SEQ ID NO: 1233050 - RNA, 20 nt, Human
acggguuuucgcuauguugg

SEQ ID NO: 1233051 - RNA, 24 nt, Human
acggguuuucgcuauguuggccag

SEQ ID NO: 1233052 - RNA, 25 nt, Human
acucugucgcccaggcuggagugca

SEQ ID NO: 1233053 - RNA, 19 nt, Human
acuucaggcccccuguggc

SEQ ID NO: 1233054 - RNA, 22 nt, Human
agaaaucuucugagguuucugg

SEQ ID NO: 1233055 - RNA, 22 nt, Human
aggagauccgccugccucagcc

SEQ ID NO: 1233056 - RNA, 24 nt, Human
aggagauccgccugccucagccuc

SEQ ID NO: 1233057 - RNA, 25 nt, Human
aggcuggagugcaguggcgcgaucu

SEQ ID NO: 1233058 - RNA, 20 nt, Human
agugauucuccugccucagc

SEQ ID NO: 1233059 - RNA, 21 nt, Human
agugcaguggcgcgaucucag

SEQ ID NO: 1233060 - RNA, 23 nt, Human
agugcaguggcgcgaucucagcu

SEQ ID NO: 1233061 - RNA, 24 nt, Human
agugcaguggcgcgaucucagcuc

SEQ ID NO: 1233062 - RNA, 20 nt, Human
auguuggccaggcuggucuc

SEQ ID NO: 1233063 - RNA, 24 nt, Human
auuuuuguauuuuuaguagagacg

SEQ ID NO: 1233064 - RNA, 19 nt, Human
caagaaaucuucugagguu

SEQ ID NO: 1233065 - RNA, 21 nt, Human
cacacccccacacucacgccg

SEQ ID NO: 1233066 - RNA, 24 nt, Human
caccacgcccugcuaauuuuugua

SEQ ID NO: 1233067 - RNA, 19 nt, Human
caccuccgccucccagguu

SEQ ID NO: 1233068 - RNA, 22 nt, Human
cacucugucgcccaggcuggag

SEQ ID NO: 1233069 - RNA, 23 nt, Human
cagcucacugccaccuccgccuc

SEQ ID NO: 1233070 - RNA, 22 nt, Human
caggaauggcaaggcgccaccu

SEQ ID NO: 1233071 - RNA, 21 nt, Human
caggagauccgccugccucag

SEQ ID NO: 1233072 - RNA, 18 nt, Human
caggugccccucccguuc

SEQ ID NO: 1233073 - RNA, 19 nt, Human
cagguucuagugauucucc

SEQ ID NO: 1233074 - RNA, 23 nt, Human
ccaaguagcugggauuacaggca

SEQ ID NO: 1233075 - RNA, 24 nt, Human
ccaaguagcugggauuacaggcau

SEQ ID NO: 1233076 - RNA, 20 nt, Human
ccaccacgcccugcuaauuu

SEQ ID NO: 1233077 - RNA, 18 nt, Human
ccaccuccgccucccagg

SEQ ID NO: 1233078 - RNA, 23 nt, Human
ccaccuggagacacgcucugagc

SEQ ID NO: 1233079 - RNA, 21 nt, Human
ccaggaauggcaaggcgccac

SEQ ID NO: 1233080 - RNA, 20 nt, Human
ccaggugccccucccguucc

SEQ ID NO: 1233081 - RNA, 23 nt, Human
cccaaguagcugggauuacaggc

SEQ ID NO: 1233082 - RNA, 24 nt, Human
cccaaguagcugggauuacaggca

SEQ ID NO: 1233083 - RNA, 23 nt, Human
cccaggaauggcaaggcgccacc

SEQ ID NO: 1233084 - RNA, 22 nt, Human
cccaggcuggagugcaguggcg

SEQ ID NO: 1233085 - RNA, 24 nt, Human
ccccaggaauggcaaggcgccacc

SEQ ID NO: 1233086 - RNA, 23 nt, Human
ccccuguggccaccggcccgccu

SEQ ID NO: 1233087 - RNA, 20 nt, Human
cccugguccccaggaauggc

SEQ ID NO: 1233088 - RNA, 19 nt, Human
ccgccugccucagccuccc

SEQ ID NO: 1233089 - RNA, 22 nt, Human
ccuacugcgagauucuugaggc

SEQ ID NO: 1233090 - RNA, 21 nt, Human
ccuccaggugccccucccguu

SEQ ID NO: 1233091 - RNA, 24 nt, Human
ccucccagguucuagugauucucc

SEQ ID NO: 1233092 - RNA, 19 nt, Human
ccucccguuccuccacugc

SEQ ID NO: 1233093 - RNA, 22 nt, Human
ccucccguuccuccacugcaga

SEQ ID NO: 1233094 - RNA, 23 nt, Human
ccugaccucaggagauccgccug

SEQ ID NO: 1233095 - RNA, 23 nt, Human
ccugccucagccucccaaguagc

SEQ ID NO: 1233096 - RNA, 24 nt, Human
ccugccucagccucccaaguagcu

SEQ ID NO: 1233097 - RNA, 21 nt, Human
cgccggaauggccacccucgg

SEQ ID NO: 1233098 - RNA, 21 nt, Human
cgcgaucucagcucacugcca

SEQ ID NO: 1233099 - RNA, 24 nt, Human
cgcuauguuggccaggcuggucuc

SEQ ID NO: 1233100 - RNA, 21 nt, Human
cggagcagcuggcacgagagg

SEQ ID NO: 1233101 - RNA, 18 nt, Human
cggcccgccucaaacacu

SEQ ID NO: 1233102 - RNA, 24 nt, Human
cggguuuucgcuauguuggccagg

SEQ ID NO: 1233103 - RNA, 22 nt, Human
cuaauggccggccgccucucuc

SEQ ID NO: 1233104 - RNA, 22 nt, Human
cuagugauucuccugccucagc

SEQ ID NO: 1233105 - RNA, 27 nt, Human
cuagugauucuccugccucagccuccc

SEQ ID NO: 1233106 - RNA, 24 nt, Human
cucacucugucgcccaggcuggag

SEQ ID NO: 1233107 - RNA, 23 nt, Human
cucagccucccaaguagcuggga

SEQ ID NO: 1233108 - RNA, 22 nt, Human
cucagcucacugccaccuccgc

SEQ ID NO: 1233109 - RNA, 24 nt, Human
cucauuuuccgccucuucuccacc

SEQ ID NO: 1233110 - RNA, 26 nt, Human
cuccugaccucaggagauccgccugc

SEQ ID NO: 1233111 - RNA, 25 nt, Human
cuccugccucagccucccaaguagc

SEQ ID NO: 1233112 - RNA, 20 nt, Human
cucggcccaccuggcaugca

SEQ ID NO: 1233113 - RNA, 21 nt, Human
cuguggccaccggcccgccuc

SEQ ID NO: 1233114 - RNA, 19 nt, Human
gaaagagaaaggaggcaag

SEQ ID NO: 1233115 - RNA, 19 nt, Human
gaauggcaaggcgccaccu

SEQ ID NO: 1233116 - RNA, 24 nt, Human
gaccucaggagauccgccugccuc

SEQ ID NO: 1233117 - RNA, 24 nt, Human
gagauccgccugccucagccuccc

SEQ ID NO: 1233118 - RNA, 24 nt, Human
gagcacagaugauacuuggguggu

SEQ ID NO: 1233119 - RNA, 18 nt, Human
gagcagcuggcacgagag

SEQ ID NO: 1233120 - RNA, 20 nt, Human
gagcagcuggcacgagaggc

SEQ ID NO: 1233121 - RNA, 18 nt, Human
gauuacaggcaugcgcca

SEQ ID NO: 1233122 - RNA, 21 nt, Human
gauucuccugccucagccucc

SEQ ID NO: 1233123 - RNA, 22 nt, Human
gccaccuccgccucccagguuc

SEQ ID NO: 1233124 - RNA, 19 nt, Human
gcccaggcuggagugcagu

SEQ ID NO: 1233125 - RNA, 20 nt, Human
gcccaggcuggagugcagug

SEQ ID NO: 1233126 - RNA, 22 nt, Human
gcccugcuaauuuuuguauuuu

SEQ ID NO: 1233127 - RNA, 24 nt, Human
gcuauguuggccaggcuggucucg

SEQ ID NO: 1233128 - RNA, 23 nt, Human
gcuggucucgagcuccugaccuc

SEQ ID NO: 1233129 - RNA, 24 nt, Human
ggagauccgccugccucagccucc

SEQ ID NO: 1233130 - RNA, 20 nt, Human
ggagcagcuggcacgagagg

SEQ ID NO: 1233131 - RNA, 19 nt, Human
ggauuacaggcaugcgcca

SEQ ID NO: 1233132 - RNA, 24 nt, Human
ggcuggucucgagcuccugaccuc

SEQ ID NO: 1233133 - RNA, 23 nt, Human
ggguuuucgcuauguuggccagg

SEQ ID NO: 1233134 - RNA, 19 nt, Human
ggucucgagcuccugaccu

SEQ ID NO: 1233135 - RNA, 19 nt, Human
gguggaacugguggccagg

SEQ ID NO: 1233136 - RNA, 18 nt, Human
guagcugggauuacaggc

SEQ ID NO: 1233137 - RNA, 24 nt, Human
gugauucuccugccucagccuccc

SEQ ID NO: 1233138 - RNA, 22 nt, Human
guucccucacacccccacacuc

SEQ ID NO: 1233139 - RNA, 24 nt, Human
uaauuuuuguauuuuuaguagaga

SEQ ID NO: 1233140 - RNA, 22 nt, Human
uagagacggguuuucgcuaugu

SEQ ID NO: 1233141 - RNA, 21 nt, Human
uagcagaaaaaaucaggucuc

SEQ ID NO: 1233142 - RNA, 24 nt, Human
uaguagagacggguuuucgcuaug

SEQ ID NO: 1233143 - RNA, 20 nt, Human
uaugaccagaacaaggaggc

SEQ ID NO: 1233144 - RNA, 23 nt, Human
uauguuggccaggcuggucucga

SEQ ID NO: 1233145 - RNA, 24 nt, Human
uauguuggccaggcuggucucgag

SEQ ID NO: 1233146 - RNA, 18 nt, Human
ucaaagagaaaucccagc

SEQ ID NO: 1233147 - RNA, 24 nt, Human
ucacucugucgcccaggcuggagu

SEQ ID NO: 1233148 - RNA, 18 nt, Human
ucacugccaccuccgccu

SEQ ID NO: 1233149 - RNA, 19 nt, Human
ucacugccaccuccgccuc

SEQ ID NO: 1233150 - RNA, 24 nt, Human
ucacugccaccuccgccucccagg

SEQ ID NO: 1233151 - RNA, 18 nt, Human
ucagccucccaaguagcu

SEQ ID NO: 1233152 - RNA, 20 nt, Human
ucagccucccaaguagcugg

SEQ ID NO: 1233153 - RNA, 21 nt, Human
ucaggagauccgccugccuca

SEQ ID NO: 1233154 - RNA, 24 nt, Human
ucaggcccccuguggccaccggcc

SEQ ID NO: 1233155 - RNA, 21 nt, Human
uccacugcagaaaguucuagc

SEQ ID NO: 1233156 - RNA, 24 nt, Human
ucccaaguagcugggauuacaggc

SEQ ID NO: 1233157 - RNA, 21 nt, Human
ucccagguucuagugauucuc

SEQ ID NO: 1233158 - RNA, 24 nt, Human
ucccagguucuagugauucuccug

SEQ ID NO: 1233159 - RNA, 22 nt, Human
ucccguuccuccacugcagaaa

SEQ ID NO: 1233160 - RNA, 21 nt, Human
uccgccugccucagccuccca

SEQ ID NO: 1233161 - RNA, 22 nt, Human
ucgcccaggcuggagugcagug

SEQ ID NO: 1233162 - RNA, 22 nt, Human
ucgcuauguuggccaggcuggu

SEQ ID NO: 1233163 - RNA, 23 nt, Human
ucucacucugucgcccaggcugg

SEQ ID NO: 1233164 - RNA, 24 nt, Human
ucucacucugucgcccaggcugga

SEQ ID NO: 1233165 - RNA, 26 nt, Human
ucucacucugucgcccaggcuggagu

SEQ ID NO: 1233166 - RNA, 25 nt, Human
ucucugggucuccgcuccucgggag

SEQ ID NO: 1233167 - RNA, 24 nt, Human
ucugucgcccaggcuggagugcag

SEQ ID NO: 1233168 - RNA, 19 nt, Human
ucuuuccagaggccucaca

SEQ ID NO: 1233169 - RNA, 18 nt, Human
ugaccucaggagauccgc

SEQ ID NO: 1233170 - RNA, 24 nt, Human
ugaccucaggagauccgccugccu

SEQ ID NO: 1233171 - RNA, 28 nt, Human
ugagguuucuggccugcugaccacaggg

SEQ ID NO: 1233172 - RNA, 20 nt, Human
ugauucuccugccucagccu

SEQ ID NO: 1233173 - RNA, 22 nt, Human
ugcaguggcgcgaucucagcuc

SEQ ID NO: 1233174 - RNA, 23 nt, Human
ugccucagccucccaaagugugg

SEQ ID NO: 1233175 - RNA, 24 nt, Human
ugccucagccucccaaguagcugg

SEQ ID NO: 1233176 - RNA, 18 nt, Human
uggaggaaagagaaagga

SEQ ID NO: 1233177 - RNA, 19 nt, Human
uggaggaaagagaaaggag

SEQ ID NO: 1233178 - RNA, 23 nt, Human
uggagugcaguggcgcgaucuca

SEQ ID NO: 1233179 - RNA, 24 nt, Human
uggagugcaguggcgcgaucucag

SEQ ID NO: 1233180 - RNA, 23 nt, Human
uggcaaggcgccaccugugagga

SEQ ID NO: 1233181 - RNA, 24 nt, Human
uggccaggcuggucucgagcuccu

SEQ ID NO: 1233182 - RNA, 24 nt, Human
uggccaggggccagagcacagaug

SEQ ID NO: 1233183 - RNA, 24 nt, Human
uggcgcgaucucagcucacugcca

SEQ ID NO: 1233184 - RNA, 19 nt, Human
uggcucccggggcguaccc

SEQ ID NO: 1233185 - RNA, 18 nt, Human
ugggauuacaggcaugcg

SEQ ID NO: 1233186 - RNA, 21 nt, Human
ugggauuacaggcaugcgcca

SEQ ID NO: 1233187 - RNA, 22 nt, Human
ugggauuacaggcaugcgccac

SEQ ID NO: 1233188 - RNA, 24 nt, Human
ugggauuacaggcaugcgccacca

SEQ ID NO: 1233189 - RNA, 23 nt, Human
uggguggucugagcaagggcagg

SEQ ID NO: 1233190 - RNA, 18 nt, Human
uguggccaccggcccgcc

SEQ ID NO: 1233191 - RNA, 19 nt, Human
uuaguagagacggguuuuc

SEQ ID NO: 1233192 - RNA, 24 nt, Human
uuaguagagacggguuuucgcuau

SEQ ID NO: 1233193 - RNA, 18 nt, Human
uucuagugauucuccugc

SEQ ID NO: 1233194 - RNA, 23 nt, Human
uucuagugauucuccugccucag

SEQ ID NO: 1233195 - RNA, 23 nt, Human
uuucgcuauguuggccaggcugg

SEQ ID NO: 1233196 - RNA, 24 nt, Human
uuucgcuauguuggccaggcuggu

SEQ ID NO: 1233197 - RNA, 24 nt, Human
uuuuuaguagagacggguuuucgc

SEQ ID NO: 1233198 - RNA, 20 nt, Human
uuuuuguauuuuuaguagag

SEQ ID NO: 1233199 - RNA, 22 nt, Human
aaaggcuccccuaacccaaggc

SEQ ID NO: 1233200 - RNA, 20 nt, Human
aacccaaggccccaaggcag

SEQ ID NO: 1233201 - RNA, 24 nt, Human
acccugaagagcaugaggccagcu

SEQ ID NO: 1233202 - RNA, 24 nt, Human
acuaaagacaaaggcuccccuaac

SEQ ID NO: 1233203 - RNA, 18 nt, Human
agagggcucaaagccagc

SEQ ID NO: 1233204 - RNA, 22 nt, Human
agcaguguagagggcucaaagc

SEQ ID NO: 1233205 - RNA, 24 nt, Human
aggcagccuggcagcugagauuuu

SEQ ID NO: 1233206 - RNA, 22 nt, Human
caaacucccuggguccucacaa

SEQ ID NO: 1233207 - RNA, 25 nt, Human
caaaggcuccccuaacccaaggccc

SEQ ID NO: 1233208 - RNA, 20 nt, Human
caaccagcaguguagagggc

SEQ ID NO: 1233209 - RNA, 25 nt, Human
caaggccccaaggcaguguuucaag

SEQ ID NO: 1233210 - RNA, 21 nt, Human
cacccucucaacucuccuggg

SEQ ID NO: 1233211 - RNA, 25 nt, Human
cacuaaagacaaaggcuccccuaac

SEQ ID NO: 1233212 - RNA, 19 nt, Human
cagacuguaggccucacug

SEQ ID NO: 1233213 - RNA, 20 nt, Human
cauccaaacucccugggucc

SEQ ID NO: 1233214 - RNA, 21 nt, Human
ccacagugaguguccucagca

SEQ ID NO: 1233215 - RNA, 22 nt, Human
cccccaugccucucucauccca

SEQ ID NO: 1233216 - RNA, 22 nt, Human
cccuggguccucacaacagccc

SEQ ID NO: 1233217 - RNA, 23 nt, Human
ccucucuauucucucuguguccc

SEQ ID NO: 1233218 - RNA, 25 nt, Human
cgcuccggcccucuggcaguuccca

SEQ ID NO: 1233219 - RNA, 24 nt, Human
cucaaagccagcauuccuccacuu

SEQ ID NO: 1233220 - RNA, 21 nt, Human
cucaacucuccugggucugca

SEQ ID NO: 1233221 - RNA, 21 nt, Human
cucacccccaugccucucuca

SEQ ID NO: 1233222 - RNA, 26 nt, Human
cuccagauaggaacugacccugaaga

SEQ ID NO: 1233223 - RNA, 22 nt, Human
cucccuggguccucacaacagc

SEQ ID NO: 1233224 - RNA, 24 nt, Human
cucucuauucucucuguguccccc

SEQ ID NO: 1233225 - RNA, 21 nt, Human
cugcacuaaagacaaaggcuc

SEQ ID NO: 1233226 - RNA, 21 nt, Human
cugcucagacuguaggccuca

SEQ ID NO: 1233227 - RNA, 24 nt, Human
gaccuugccuucacccgccggugc

SEQ ID NO: 1233228 - RNA, 18 nt, Human
gaggaugcugaggcacag

SEQ ID NO: 1233229 - RNA, 21 nt, Human
gcaaaaggagccauagaaaua

SEQ ID NO: 1233230 - RNA, 19 nt, Human
gcagcaaaaggagccauag

SEQ ID NO: 1233231 - RNA, 21 nt, Human
gccaguggcaggccaugcugu

SEQ ID NO: 1233232 - RNA, 24 nt, Human
gccucuggcaaugagcugcuccag

SEQ ID NO: 1233233 - RNA, 23 nt, Human
ggcagccuggcagcugagauuuu

SEQ ID NO: 1233234 - RNA, 22 nt, Human
gucaacuccagauaggaacuga

SEQ ID NO: 1233235 - RNA, 21 nt, Human
uaacccaaggccccaaggcag

SEQ ID NO: 1233236 - RNA, 23 nt, Human
uaggucccagggcaaggauggag

SEQ ID NO: 1233237 - RNA, 22 nt, Human
uccacauccaaacucccugggu

SEQ ID NO: 1233238 - RNA, 21 nt, Human
uccccauuuauagaugaggau

SEQ ID NO: 1233239 - RNA, 19 nt, Human
ucccccacccucucaacuc

SEQ ID NO: 1233240 - RNA, 21 nt, Human
ucuccugggucugcagggacu

SEQ ID NO: 1233241 - RNA, 22 nt, Human
ucucugugucccccacccucuc

SEQ ID NO: 1233242 - RNA, 19 nt, Human
ugaagugacuuguccaagg

SEQ ID NO: 1233243 - RNA, 22 nt, Human
ugaagugacuuguccaagguca

SEQ ID NO: 1233244 - RNA, 20 nt, Human
ugcacuaaagacaaaggcuc

SEQ ID NO: 1233245 - RNA, 18 nt, Human
ugccagggccacaagagg

SEQ ID NO: 1233246 - RNA, 18 nt, Human
ugcugcagggguacgggg

SEQ ID NO: 1233247 - RNA, 19 nt, Human
uguagagggcucaaagcca

SEQ ID NO: 1233248 - RNA, 19 nt, Human
uguccugcacuaaagacaa

SEQ ID NO: 1233249 - RNA, 23 nt, Human
uguccugcacuaaagacaaaggc

SEQ ID NO: 1233250 - RNA, 22 nt, Human
uucagagauccccauuuauaga

SEQ ID NO: 1233251 - RNA, 18 nt, Human
uuccuccacuugaacucc

SEQ ID NO: 1233252 - RNA, 24 nt, Human
uuccuccacuugaacuccugcgcu

SEQ ID NO: 1233253 - RNA, 18 nt, Human
uugcuucuccccauuucc

SEQ ID NO: 1233254 - RNA, 20 nt, Human
uuugcuucuccccauuuccc

SEQ ID NO: 1233255 - RNA, 24 nt, Human
aaacagccugagcuggagccccag

SEQ ID NO: 1233256 - RNA, 19 nt, Human
acaaagccuccugagauug

SEQ ID NO: 1233257 - RNA, 22 nt, Human
acccacccagccagcuuccccc

SEQ ID NO: 1233258 - RNA, 24 nt, Human
accccagagcaaacugagacagca

SEQ ID NO: 1233259 - RNA, 18 nt, Human
accugggucagucugucc

SEQ ID NO: 1233260 - RNA, 18 nt, Human
acgccauggugggucggc

SEQ ID NO: 1233261 - RNA, 21 nt, Human
acucccauccccaccaagccc

SEQ ID NO: 1233262 - RNA, 23 nt, Human
acucccauccccaccaagcccac

SEQ ID NO: 1233263 - RNA, 18 nt, Human
agaguuccuccuauuccc

SEQ ID NO: 1233264 - RNA, 22 nt, Human
agcaaccaacacagagggaccu

SEQ ID NO: 1233265 - RNA, 21 nt, Human
agcccagcccucagggaagcc

SEQ ID NO: 1233266 - RNA, 18 nt, Human
aggccugggacuggagcc

SEQ ID NO: 1233267 - RNA, 23 nt, Human
agggcccucugaggccucugccc

SEQ ID NO: 1233268 - RNA, 24 nt, Human
agggccucugccccagccuccucc

SEQ ID NO: 1233269 - RNA, 23 nt, Human
aguuccuccuauucccaaacagc

SEQ ID NO: 1233270 - RNA, 31 nt, Human
auccccaccaagcccacccaccuccugccag

SEQ ID NO: 1233271 - RNA, 19 nt, Human
caaacaaagccuccugaga

SEQ ID NO: 1233272 - RNA, 24 nt, Human
caaagcccccacgauauucacucc

SEQ ID NO: 1233273 - RNA, 20 nt, Human
caaagcuucaaccuggacac

SEQ ID NO: 1233274 - RNA, 19 nt, Human
cacacacagccacacacgg

SEQ ID NO: 1233275 - RNA, 19 nt, Human
cacacagccacacacggcu

SEQ ID NO: 1233276 - RNA, 24 nt, Human
cacacagccacacacggcucugcc

SEQ ID NO: 1233277 - RNA, 19 nt, Human
caccaagcccacccaccuc

SEQ ID NO: 1233278 - RNA, 21 nt, Human
caccaagcccacccaccuccu

SEQ ID NO: 1233279 - RNA, 18 nt, Human
cacccaccuccugccagg

SEQ ID NO: 1233280 - RNA, 22 nt, Human
cacccagccagcuucccccacc

SEQ ID NO: 1233281 - RNA, 21 nt, Human
cacccccagucugagcugcuc

SEQ ID NO: 1233282 - RNA, 23 nt, Human
caccuccugccagggccucugcc

SEQ ID NO: 1233283 - RNA, 22 nt, Human
cagagcagcaaccaacacagag

SEQ ID NO: 1233284 - RNA, 18 nt, Human
cagcacagguccacuccu

SEQ ID NO: 1233285 - RNA, 19 nt, Human
cagcacagguccacuccuu

SEQ ID NO: 1233286 - RNA, 27 nt, Human
cagccuccuccugaccugguccugccu

SEQ ID NO: 1233287 - RNA, 19 nt, Human
caggaauagcaaacucaaa

SEQ ID NO: 1233288 - RNA, 22 nt, Human
cagggccucugccccagccucc

SEQ ID NO: 1233289 - RNA, 22 nt, Human
caggggcuacagccgcugacca

SEQ ID NO: 1233290 - RNA, 19 nt, Human
ccaaagcuucaaccuggac

SEQ ID NO: 1233291 - RNA, 23 nt, Human
ccacaggacugcccagaccccag

SEQ ID NO: 1233292 - RNA, 21 nt, Human
ccacccagccagcuuccccca

SEQ ID NO: 1233293 - RNA, 25 nt, Human
ccacccagccagcuucccccacccc

SEQ ID NO: 1233294 - RNA, 19 nt, Human
ccacccaggcaggagcgag

SEQ ID NO: 1233295 - RNA, 21 nt, Human
ccacccccagcuguuuccagg

SEQ ID NO: 1233296 - RNA, 19 nt, Human
ccacucucccgacuuggcc

SEQ ID NO: 1233297 - RNA, 21 nt, Human
ccagagcagcaaccaacacag

SEQ ID NO: 1233298 - RNA, 20 nt, Human
ccagggccucugccccagcc

SEQ ID NO: 1233299 - RNA, 19 nt, Human
cccaccaagcccacccacc

SEQ ID NO: 1233300 - RNA, 18 nt, Human
cccaccuccugccagggc

SEQ ID NO: 1233301 - RNA, 21 nt, Human
cccacgauauucacuccugag

SEQ ID NO: 1233302 - RNA, 23 nt, Human
cccacuggagagcuaagccccag

SEQ ID NO: 1233303 - RNA, 20 nt, Human
cccagcacuggccacucucc

SEQ ID NO: 1233304 - RNA, 21 nt, Human
cccagccagcuucccccaccc

SEQ ID NO: 1233305 - RNA, 22 nt, Human
cccagcuguuuccaggccuggg

SEQ ID NO: 1233306 - RNA, 24 nt, Human
cccauccccaccaagcccacccac

SEQ ID NO: 1233307 - RNA, 24 nt, Human
ccccaccaagcccacccaccuccu

SEQ ID NO: 1233308 - RNA, 21 nt, Human
ccccacccccagcuguuucca

SEQ ID NO: 1233309 - RNA, 23 nt, Human
ccccagagcaaacugagacagca

SEQ ID NO: 1233310 - RNA, 24 nt, Human
ccccaggaacagccaucuggcccu

SEQ ID NO: 1233311 - RNA, 24 nt, Human
ccccaggccccaggaacagccauc

SEQ ID NO: 1233312 - RNA, 24 nt, Human
cccgcagaccaaccaucccaggcc

SEQ ID NO: 1233313 - RNA, 20 nt, Human
cccugaguucccagacacuc

SEQ ID NO: 1233314 - RNA, 18 nt, Human
cccugcugagaccuuguc

SEQ ID NO: 1233315 - RNA, 20 nt, Human
ccucagagccguuggcccag

SEQ ID NO: 1233316 - RNA, 25 nt, Human
ccuccuauucccaaacagccugagc

SEQ ID NO: 1233317 - RNA, 18 nt, Human
ccuccugaccugguccug

SEQ ID NO: 1233318 - RNA, 20 nt, Human
ccuccugaccugguccugcc

SEQ ID NO: 1233319 - RNA, 19 nt, Human
ccucuccucccugcacaca

SEQ ID NO: 1233320 - RNA, 24 nt, Human
ccucugccccagccuccuccugac

SEQ ID NO: 1233321 - RNA, 22 nt, Human
ccugacccugaguucccagaca

SEQ ID NO: 1233322 - RNA, 19 nt, Human
ccugagcuggagccccagg

SEQ ID NO: 1233323 - RNA, 25 nt, Human
ccugcaggcccaagcugggugcugg

SEQ ID NO: 1233324 - RNA, 21 nt, Human
ccugccagggccucugcccca

SEQ ID NO: 1233325 - RNA, 22 nt, Human
ccugcugagaccuugucccaca

SEQ ID NO: 1233326 - RNA, 25 nt, Human
ccugggacuggagcccugcugagac

SEQ ID NO: 1233327 - RNA, 24 nt, Human
ccugggucagucugucccuagggc

SEQ ID NO: 1233328 - RNA, 20 nt, Human
cuacucccauccccaccaag

SEQ ID NO: 1233329 - RNA, 27 nt, Human
cucacucccaccuagacuccugggauc

SEQ ID NO: 1233330 - RNA, 22 nt, Human
cuccgggcuugacugagggcug

SEQ ID NO: 1233331 - RNA, 18 nt, Human
cuccugaccugguccugc

SEQ ID NO: 1233332 - RNA, 18 nt, Human
cuccugggaucugguccu

SEQ ID NO: 1233333 - RNA, 21 nt, Human
cuccugggaucugguccuguc

SEQ ID NO: 1233334 - RNA, 23 nt, Human
cucugccccagccuccuccugac

SEQ ID NO: 1233335 - RNA, 23 nt, Human
cugaccugguccugccugggccu

SEQ ID NO: 1233336 - RNA, 19 nt, Human
cugagacagcacaggucca

SEQ ID NO: 1233337 - RNA, 22 nt, Human
cugaguccccaccugcaggccc

SEQ ID NO: 1233338 - RNA, 18 nt, Human
cugcugagaccuuguccc

SEQ ID NO: 1233339 - RNA, 19 nt, Human
cugggcccagagggucuug

SEQ ID NO: 1233340 - RNA, 19 nt, Human
cugucccuagggcccucug

SEQ ID NO: 1233341 - RNA, 20 nt, Human
cuuagccacuagcucccgac

SEQ ID NO: 1233342 - RNA, 23 nt, Human
cuuagugacuggucacauccuaa

SEQ ID NO: 1233343 - RNA, 21 nt, Human
cuugcugccuccaagggcucc

SEQ ID NO: 1233344 - RNA, 21 nt, Human
gaacaagcugaagacauggag

SEQ ID NO: 1233345 - RNA, 21 nt, Human
gaagccaggcaccaucuugcc

SEQ ID NO: 1233346 - RNA, 20 nt, Human
gaccugguccugccugggcc

SEQ ID NO: 1233347 - RNA, 19 nt, Human
gagcaaacugagacagcac

SEQ ID NO: 1233348 - RNA, 21 nt, Human
gagcagcaaccaacacagagg

SEQ ID NO: 1233349 - RNA, 18 nt, Human
gaggcaggggggccccuu

SEQ ID NO: 1233350 - RNA, 20 nt, Human
gcccaggggcuacagccgcu

SEQ ID NO: 1233351 - RNA, 22 nt, Human
gccccaggccccaggaacagcc

SEQ ID NO: 1233352 - RNA, 20 nt, Human
gccccaguucagaggaagcu

SEQ ID NO: 1233353 - RNA, 20 nt, Human
gcccugacccugaguuccca

SEQ ID NO: 1233354 - RNA, 24 nt, Human
gccugagcuggagccccaggcccc

SEQ ID NO: 1233355 - RNA, 22 nt, Human
gcucaaagcccccacgauauuc

SEQ ID NO: 1233356 - RNA, 18 nt, Human
ggagccccaggccccagg

SEQ ID NO: 1233357 - RNA, 22 nt, Human
ggagcguccucaagcaaguccc

SEQ ID NO: 1233358 - RNA, 24 nt, Human
ggcuggggcuucagggacuccccu

SEQ ID NO: 1233359 - RNA, 21 nt, Human
ggggcuaacggagagcccaga

SEQ ID NO: 1233360 - RNA, 28 nt, Human
gguccugucuuugccacacuuggggcug

SEQ ID NO: 1233361 - RNA, 18 nt, Human
ggugcugggucccagagg

SEQ ID NO: 1233362 - RNA, 24 nt, Human
guagauuuuauuaaccaaacaaag

SEQ ID NO: 1233363 - RNA, 18 nt, Human
guccuuguggcccucggg

SEQ ID NO: 1233364 - RNA, 18 nt, Human
gugcugggucccagaggc

SEQ ID NO: 1233365 - RNA, 21 nt, Human
uaaccaaacaaagccuccuga

SEQ ID NO: 1233366 - RNA, 21 nt, Human
uaaccacacccacccagccag

SEQ ID NO: 1233367 - RNA, 26 nt, Human
uaaccacacccacccagccagcuucc

SEQ ID NO: 1233368 - RNA, 23 nt, Human
uaauaaaaauagguuucugcaga

SEQ ID NO: 1233369 - RNA, 22 nt, Human
uagagagggcccagcacuggcc

SEQ ID NO: 1233370 - RNA, 25 nt, Human
uauaaaacaggaauagcaaacucaa

SEQ ID NO: 1233371 - RNA, 20 nt, Human
ucacuccugaguccccaccu

SEQ ID NO: 1233372 - RNA, 21 nt, Human
ucagcaggccacggugcagcc

SEQ ID NO: 1233373 - RNA, 19 nt, Human
ucccaaagcuucaaccugg

SEQ ID NO: 1233374 - RNA, 20 nt, Human
ucccaaagcuucaaccugga

SEQ ID NO: 1233375 - RNA, 22 nt, Human
ucccagacacucccaugacccu

SEQ ID NO: 1233376 - RNA, 22 nt, Human
ucccaugacccugcagagggca

SEQ ID NO: 1233377 - RNA, 18 nt, Human
ucccccacccccagcugu

SEQ ID NO: 1233378 - RNA, 25 nt, Human
ucccuagggcccucugaggccucug

SEQ ID NO: 1233379 - RNA, 22 nt, Human
ucccugcacacauuugccuccg

SEQ ID NO: 1233380 - RNA, 21 nt, Human
ucccuuagccacuagcucccg

SEQ ID NO: 1233381 - RNA, 24 nt, Human
uccugaguccccaccugcaggccc

SEQ ID NO: 1233382 - RNA, 23 nt, Human
uccuuguggcccucgggcuccuu

SEQ ID NO: 1233383 - RNA, 21 nt, Human
ucuacagcuguggccacggac

SEQ ID NO: 1233384 - RNA, 21 nt, Human
ucuacagcuguggccacggac

SEQ ID NO: 1233385 - RNA, 29 nt, Human
ucuggcccugacccugaguuccgguuccg

SEQ ID NO: 1233386 - RNA, 25 nt, Human
ugacccugaguucccagacacuccc

SEQ ID NO: 1233387 - RNA, 18 nt, Human
ugaccugguccugccugg

SEQ ID NO: 1233388 - RNA, 21 nt, Human
ugaggcugggcccagaggguc

SEQ ID NO: 1233389 - RNA, 26 nt, Human
ugaggcugggcccagagggucuugcu

SEQ ID NO: 1233390 - RNA, 19 nt, Human
ugagggcugggauuggcca

SEQ ID NO: 1233391 - RNA, 20 nt, Human
ugcaaggagcccugucuaca

SEQ ID NO: 1233392 - RNA, 22 nt, Human
ugcagaacagguuauaaaacag

SEQ ID NO: 1233393 - RNA, 19 nt, Human
ugcaggaaggcagugcccc

SEQ ID NO: 1233394 - RNA, 19 nt, Human
ugccacccccagucugagc

SEQ ID NO: 1233395 - RNA, 19 nt, Human
ugcccagaccccagagcaa

SEQ ID NO: 1233396 - RNA, 18 nt, Human
ugccccagccuccuccug

SEQ ID NO: 1233397 - RNA, 26 nt, Human
ugccuugcugccuccaagggcuccca

SEQ ID NO: 1233398 - RNA, 19 nt, Human
uggagcccugcugagaccu

SEQ ID NO: 1233399 - RNA, 24 nt, Human
ugucuacagcuguggccacggacg

SEQ ID NO: 1233400 - RNA, 22 nt, Human
uucacuccugaguccccaccug

SEQ ID NO: 1233401 - RNA, 26 nt, Human
aacgcagcugcagucugaccccuugg

SEQ ID NO: 1233402 - RNA, 21 nt, Human
acauacacuccgguggaugug

SEQ ID NO: 1233403 - RNA, 25 nt, Human
acugaaacacagaacaugugccagu

SEQ ID NO: 1233404 - RNA, 21 nt, Human
caaggugaguccaaggacacc

SEQ ID NO: 1233405 - RNA, 23 nt, Human
cacagaacaugugccaaggugag

SEQ ID NO: 1233406 - RNA, 19 nt, Human
caccgcugcuccacagaac

SEQ ID NO: 1233407 - RNA, 18 nt, Human
cagcugcagucugucggg

SEQ ID NO: 1233408 - RNA, 18 nt, Human
cagcugcagucugucggu

SEQ ID NO: 1233409 - RNA, 19 nt, Human
ccccuccccauacauacac

SEQ ID NO: 1233410 - RNA, 25 nt, Human
cuccacagaacugcuggcugucucu

SEQ ID NO: 1233411 - RNA, 18 nt, Human
cuccgguggaugugagcg

SEQ ID NO: 1233412 - RNA, 24 nt, Human
cugggaacaggugaagccccuccc

SEQ ID NO: 1233413 - RNA, 22 nt, Human
gaacaggugaagccccucccca

SEQ ID NO: 1233414 - RNA, 22 nt, Human
gaacaggugaagccccucccca

SEQ ID NO: 1233415 - RNA, 28 nt, Human
gaagccccuccccauacauacacucuuc

SEQ ID NO: 1233416 - RNA, 24 nt, Human
gccaaggugaguccaaggacaccu

SEQ ID NO: 1233417 - RNA, 19 nt, Human
ggcagcacccucuuuuggc

SEQ ID NO: 1233418 - RNA, 22 nt, Human
ggccaccgcugcuccacagaac

SEQ ID NO: 1233419 - RNA, 18 nt, Human
uagccggccaccgcugcu

SEQ ID NO: 1233420 - RNA, 23 nt, Human
ugaguccaaggacaccucuggga

SEQ ID NO: 1233421 - RNA, 20 nt, Human
ugggggcccaggcuaggggc

SEQ ID NO: 1233422 - RNA, 21 nt, Human
ugggggcccaggcuaggggca

SEQ ID NO: 1233423 - RNA, 21 nt, Human
ugggguuaggggcuuggacau

SEQ ID NO: 1233424 - RNA, 19 nt, Human
ugggugaucaggucucucu

SEQ ID NO: 1233425 - RNA, 27 nt, Human
aaaaaaaaaaaaaaaugagauucagag

SEQ ID NO: 1233426 - RNA, 24 nt, Human
aaaagaccagagauaaguaagaua

SEQ ID NO: 1233427 - RNA, 24 nt, Human
aaagaacuguccccccacacacca

SEQ ID NO: 1233428 - RNA, 18 nt, Human
aaagagccauggccaacu

SEQ ID NO: 1233429 - RNA, 21 nt, Human
aaaggaacguggaaaagagcc

SEQ ID NO: 1233430 - RNA, 21 nt, Human
aaaggggaauuacaggcauga

SEQ ID NO: 1233431 - RNA, 21 nt, Human
aacagagguggcagaaacugc

SEQ ID NO: 1233432 - RNA, 18 nt, Human
aagagcugucuggacaaa

SEQ ID NO: 1233433 - RNA, 23 nt, Human
aagcagccugagaggaaucugaa

SEQ ID NO: 1233434 - RNA, 21 nt, Human
aauuacaggcaugagccacug

SEQ ID NO: 1233435 - RNA, 24 nt, Human
aauuacaggcaugagccacugugc

SEQ ID NO: 1233436 - RNA, 24 nt, Human
acagcucccuugccacugcaggga

SEQ ID NO: 1233437 - RNA, 21 nt, Human
acaggaaaggcaggggacagc

SEQ ID NO: 1233438 - RNA, 22 nt, Human
acaggucccucagccaggagug

SEQ ID NO: 1233439 - RNA, 18 nt, Human
accugcuccacugggucc

SEQ ID NO: 1233440 - RNA, 24 nt, Human
acuucaaaacagcagcuuuagaag

SEQ ID NO: 1233441 - RNA, 21 nt, Human
agaaacagugacagaaagccg

SEQ ID NO: 1233442 - RNA, 21 nt, Human
agaagugggcagaggguagug

SEQ ID NO: 1233443 - RNA, 23 nt, Human
agaggaaaagguuccucccaagg

SEQ ID NO: 1233444 - RNA, 19 nt, Human
agccgggccuacccucuga

SEQ ID NO: 1233445 - RNA, 25 nt, Human
agcggcaguaacagagguggcagaa

SEQ ID NO: 1233446 - RNA, 18 nt, Human
aggaaacacagggguuga

SEQ ID NO: 1233447 - RNA, 24 nt, Human
aggaacguggaaaagagccauggc

SEQ ID NO: 1233448 - RNA, 20 nt, Human
aucuccucuucaccuggcua

SEQ ID NO: 1233449 - RNA, 20 nt, Human
augcacuucaaaacagcagc

SEQ ID NO: 1233450 - RNA, 24 nt, Human
augccacacagaggaagggcaggc

SEQ ID NO: 1233451 - RNA, 21 nt, Human
caaaacagcagcuuuagaagc

SEQ ID NO: 1233452 - RNA, 22 nt, Human
caaguccccaucaaaaaagacc

SEQ ID NO: 1233453 - RNA, 21 nt, Human
cacaaagaacuguccccccac

SEQ ID NO: 1233454 - RNA, 23 nt, Human
cacaagcagccugagaggaaucu

SEQ ID NO: 1233455 - RNA, 24 nt, Human
cacaaggaaaggugaaagcggcag

SEQ ID NO: 1233456 - RNA, 18 nt, Human
cacacaccauucaagucc

SEQ ID NO: 1233457 - RNA, 21 nt, Human
cacaccaagccauccuucccc

SEQ ID NO: 1233458 - RNA, 18 nt, Human
cacagaggaagggcaggc

SEQ ID NO: 1233459 - RNA, 22 nt, Human
caccaagccauccuucccccau

SEQ ID NO: 1233460 - RNA, 23 nt, Human
cacccugaacuugauaauggccu

SEQ ID NO: 1233461 - RNA, 24 nt, Human
caccgcguggcuggccaucuccuu

SEQ ID NO: 1233462 - RNA, 23 nt, Human
cacuucaaaacagcagcuuuaga

SEQ ID NO: 1233463 - RNA, 20 nt, Human
cagacuuucuuauguugagu

SEQ ID NO: 1233464 - RNA, 24 nt, Human
cagcucccuugccacugcagggaa

SEQ ID NO: 1233465 - RNA, 22 nt, Human
caggccccacaggaaaggcagg

SEQ ID NO: 1233466 - RNA, 19 nt, Human
caucgcccuuuccuucugc

SEQ ID NO: 1233467 - RNA, 21 nt, Human
ccaaaggggaauuacaggcau

SEQ ID NO: 1233468 - RNA, 21 nt, Human
ccacacaaagaacuguccccc

SEQ ID NO: 1233469 - RNA, 23 nt, Human
ccacacaccauucaaguccccau

SEQ ID NO: 1233470 - RNA, 20 nt, Human
cccacacaggacaccagagc

SEQ ID NO: 1233471 - RNA, 23 nt, Human
cccauagggacauggagaaauac

SEQ ID NO: 1233472 - RNA, 21 nt, Human
cccauccugcggcagcagagg

SEQ ID NO: 1233473 - RNA, 24 nt, Human
ccccacacaccauucaagucccca

SEQ ID NO: 1233474 - RNA, 21 nt, Human
ccccagcaucuccucuucacc

SEQ ID NO: 1233475 - RNA, 26 nt, Human
ccccagcaucuccucuucaccugguc

SEQ ID NO: 1233476 - RNA, 20 nt, Human
cccucccacccugaacuuga

SEQ ID NO: 1233477 - RNA, 19 nt, Human
ccuucccccauccccacug

SEQ ID NO: 1233478 - RNA, 20 nt, Human
cgaggaggagaauguggagc

SEQ ID NO: 1233479 - RNA, 22 nt, Human
cguggaaaagagccauggccaa

SEQ ID NO: 1233480 - RNA, 24 nt, Human
cuaaaacccagcuuuucuggcugc

SEQ ID NO: 1233481 - RNA, 21 nt, Human
cucaaaagccuccaauggcuc

SEQ ID NO: 1233482 - RNA, 23 nt, Human
cucaaaagccuccaauggcucgc

SEQ ID NO: 1233483 - RNA, 18 nt, Human
cuccccagcaucuccucu

SEQ ID NO: 1233484 - RNA, 18 nt, Human
cuccuucccugaccuucc

SEQ ID NO: 1233485 - RNA, 18 nt, Human
cuccuucccugaccuucc

SEQ ID NO: 1233486 - RNA, 25 nt, Human
gaaaagguuccucccaaggcuuaag

SEQ ID NO: 1233487 - RNA, 20 nt, Human
gaaaccccuuccuuccucaa

SEQ ID NO: 1233488 - RNA, 24 nt, Human
gaauuacaggcaugagccacugug

SEQ ID NO: 1233489 - RNA, 20 nt, Human
gacagccgggccuacccucu

SEQ ID NO: 1233490 - RNA, 18 nt, Human
gagcuggggcuaaaaccc

SEQ ID NO: 1233491 - RNA, 22 nt, Human
gaugaaaggaacguggaaaaga

SEQ ID NO: 1233492 - RNA, 19 nt, Human
gauucagagaagucaagca

SEQ ID NO: 1233493 - RNA, 21 nt, Human
gcagccugagaggaaucugaa

SEQ ID NO: 1233494 - RNA, 23 nt, Human
gcucagggcagcugugacugcuc

SEQ ID NO: 1233495 - RNA, 21 nt, Human
gcuggccaucuccuucccuga

SEQ ID NO: 1233496 - RNA, 22 nt, Human
ggaauguccugcucaggggugc

SEQ ID NO: 1233497 - RNA, 23 nt, Human
ggaauuacaggcaugagccacug

SEQ ID NO: 1233498 - RNA, 25 nt, Human
ggaauuacaggcaugagccacugug

SEQ ID NO: 1233499 - RNA, 24 nt, Human
ggacagacacaccaagccauccuu

SEQ ID NO: 1233500 - RNA, 19 nt, Human
ggagaauguggagcucagg

SEQ ID NO: 1233501 - RNA, 21 nt, Human
ggccuggggcucucacugggg

SEQ ID NO: 1233502 - RNA, 24 nt, Human
gggaauuacaggcaugagccacug

SEQ ID NO: 1233503 - RNA, 18 nt, Human
ggguggggauaacuggca

SEQ ID NO: 1233504 - RNA, 19 nt, Human
gucaagcauucugcccaca

SEQ ID NO: 1233505 - RNA, 23 nt, Human
uaacugcuacaugauguucaaac

SEQ ID NO: 1233506 - RNA, 24 nt, Human
uacaggcaugagccacugugccca

SEQ ID NO: 1233507 - RNA, 21 nt, Human
uacccacucaaaagccuccaa

SEQ ID NO: 1233508 - RNA, 24 nt, Human
uagcauggcccaggcccuggguuu

SEQ ID NO: 1233509 - RNA, 21 nt, Human
uauggaggucaagaagcuucu

SEQ ID NO: 1233510 - RNA, 18 nt, Human
uccaauggcucgcaguua

SEQ ID NO: 1233511 - RNA, 19 nt, Human
uccacccacacaggacacc

SEQ ID NO: 1233512 - RNA, 19 nt, Human
uccaccgcguggcuggcca

SEQ ID NO: 1233513 - RNA, 23 nt, Human
uccacuggguccucacuuuucca

SEQ ID NO: 1233514 - RNA, 21 nt, Human
ucccaaaggggaauuacaggc

SEQ ID NO: 1233515 - RNA, 20 nt, Human
ucccaaggcuuaagagcugu

SEQ ID NO: 1233516 - RNA, 24 nt, Human
ucccacacaaagaacugucccccc

SEQ ID NO: 1233517 - RNA, 19 nt, Human
ucccagagaauggcagguc

SEQ ID NO: 1233518 - RNA, 23 nt, Human
uccccagcaucuccucuucaccu

SEQ ID NO: 1233519 - RNA, 24 nt, Human
ucccccauccccacuggucacaaa

SEQ ID NO: 1233520 - RNA, 18 nt, Human
ucccucacacacagaaac

SEQ ID NO: 1233521 - RNA, 19 nt, Human
ucccucacacacagaaaca

SEQ ID NO: 1233522 - RNA, 24 nt, Human
ucccucacacacagaaacagugac

SEQ ID NO: 1233523 - RNA, 19 nt, Human
ucccugaccuuccugguug

SEQ ID NO: 1233524 - RNA, 24 nt, Human
ucccugugagagaauuaaucaccc

SEQ ID NO: 1233525 - RNA, 20 nt, Human
uccuucagccggaguccugg

SEQ ID NO: 1233526 - RNA, 21 nt, Human
ucuaagggaugcagcaaggcc

SEQ ID NO: 1233527 - RNA, 23 nt, Human
ugaacagcucccuugccacugca

SEQ ID NO: 1233528 - RNA, 19 nt, Human
ugacaaaaaaaaaaaaaaa

SEQ ID NO: 1233529 - RNA, 21 nt, Human
ugacauuuggguuguaacaau

SEQ ID NO: 1233530 - RNA, 20 nt, Human
ugagaggaaucugaaucacg

SEQ ID NO: 1233531 - RNA, 22 nt, Human
ugagaggaaucugaaucacgaa

SEQ ID NO: 1233532 - RNA, 20 nt, Human
ugcaaacuagauuaugucau

SEQ ID NO: 1233533 - RNA, 23 nt, Human
ugccacacagaggaagggcaggc

SEQ ID NO: 1233534 - RNA, 24 nt, Human
uggaaaagagccauggccaacuca

SEQ ID NO: 1233535 - RNA, 18 nt, Human
uggaagugucgggccugg

SEQ ID NO: 1233536 - RNA, 25 nt, Human
uggaaucaagauccagguagagacu

SEQ ID NO: 1233537 - RNA, 21 nt, Human
uggcuaacugcuacaugaugu

SEQ ID NO: 1233538 - RNA, 21 nt, Human
uggcuggccaucuccuucccu

SEQ ID NO: 1233539 - RNA, 23 nt, Human
ugggaugaaaggaacguggaaaa

SEQ ID NO: 1233540 - RNA, 24 nt, Human
uggggagaggggguacgugcaguc

SEQ ID NO: 1233541 - RNA, 20 nt, Human
ugguggggggugacauuugg

SEQ ID NO: 1233542 - RNA, 19 nt, Human
uguggagcucagggcagcu

SEQ ID NO: 1233543 - RNA, 23 nt, Human
uguugcuugcaccuaacugauuu

SEQ ID NO: 1233544 - RNA, 20 nt, Human
uucaaaacagcagcuuuagg

SEQ ID NO: 1233545 - RNA, 25 nt, Human
uucaccuggcuaacugcuacaugau

SEQ ID NO: 1233546 - RNA, 19 nt, Human
uucccugaccuuccugguu

SEQ ID NO: 1233547 - RNA, 19 nt, Human
uugcuugcaccuaacugau

SEQ ID NO: 1233548 - RNA, 19 nt, Human
uuuguuagaaaccccuucc

SEQ ID NO: 1233549 - RNA, 26 nt, Human
aaaagacccaggcagcuuagugggca

SEQ ID NO: 1233550 - RNA, 23 nt, Human
aaacuccuggguucuccaggccu

SEQ ID NO: 1233551 - RNA, 23 nt, Human
acaggccaccacagccaggugga

SEQ ID NO: 1233552 - RNA, 19 nt, Human
agaaaaaaaaauaaggaaa

SEQ ID NO: 1233553 - RNA, 19 nt, Human
agaaaaaaaaauaaggaaa

SEQ ID NO: 1233554 - RNA, 21 nt, Human
agaaaaaaaaauaaggaaaag

SEQ ID NO: 1233555 - RNA, 18 nt, Human
agucuuuuuuuuuuuucc

SEQ ID NO: 1233556 - RNA, 23 nt, Human
caagacaccuaauugacuugcaa

SEQ ID NO: 1233557 - RNA, 24 nt, Human
caagacaccuaauugacuugcaac

SEQ ID NO: 1233558 - RNA, 20 nt, Human
ccacaggccaccacagccag

SEQ ID NO: 1233559 - RNA, 19 nt, Human
cuccuggguucuccaggcc

SEQ ID NO: 1233560 - RNA, 21 nt, Human
gaaacuccuggguucuccagg

SEQ ID NO: 1233561 - RNA, 22 nt, Human
gagcaccauuaaauauucacac

SEQ ID NO: 1233562 - RNA, 24 nt, Human
guuaaaugaguaauagucuuuuuu

SEQ ID NO: 1233563 - RNA, 24 nt, Human
uaaaugaguaauagucuuuuuuuu

SEQ ID NO: 1233564 - RNA, 22 nt, Human
uaauagucuuuuuuuuuuuucc

SEQ ID NO: 1233565 - RNA, 24 nt, Human
uagcucaaccugcuuaaacaaugu

SEQ ID NO: 1233566 - RNA, 26 nt, Human
uagucuuuuuuuuuuuuccuuagaga

SEQ ID NO: 1233567 - RNA, 23 nt, Human
uggcagcacagcuuggaaacucc

SEQ ID NO: 1233568 - RNA, 18 nt, Human
uuaaaacucaacagucau

SEQ ID NO: 1233569 - RNA, 19 nt, Human
uucccuuuugggggcaacu

SEQ ID NO: 1233570 - RNA, 20 nt, Human
acuccagagcccucccucuu

SEQ ID NO: 1233571 - RNA, 25 nt, Human
acuccagagcccucccucuuuaacu

SEQ ID NO: 1233572 - RNA, 19 nt, Human
agagcugggugaccuugag

SEQ ID NO: 1233573 - RNA, 19 nt, Human
agcagguugcuuaaccuuc

SEQ ID NO: 1233574 - RNA, 21 nt, Human
auggagccucugugcugggca

SEQ ID NO: 1233575 - RNA, 18 nt, Human
ccuugagcagguugcuua

SEQ ID NO: 1233576 - RNA, 18 nt, Human
cucgcuaguauccuucca

SEQ ID NO: 1233577 - RNA, 22 nt, Human
cucuuuaacugcugcuuuuaac

SEQ ID NO: 1233578 - RNA, 19 nt, Human
cugggcaccggggcuaggc

SEQ ID NO: 1233579 - RNA, 26 nt, Human
gcagcuuuugcccagagucuggguuc

SEQ ID NO: 1233580 - RNA, 20 nt, Human
ggugacacauauggagccuc

SEQ ID NO: 1233581 - RNA, 24 nt, Human
uaggcccuuccuaugcacucucau

SEQ ID NO: 1233582 - RNA, 20 nt, Human
ucaaacgcaaacaguccaac

SEQ ID NO: 1233583 - RNA, 23 nt, Human
uccagagcccucccucuuuaacu

SEQ ID NO: 1233584 - RNA, 19 nt, Human
uggagccucugugcugggc

SEQ ID NO: 1233585 - RNA, 23 nt, Human
aaaagcacaagaagacagaaacc

SEQ ID NO: 1233586 - RNA, 21 nt, Human
aaaugccacaggaaacaaacu

SEQ ID NO: 1233587 - RNA, 25 nt, Human
aacagccuuccaauugccccuccac

SEQ ID NO: 1233588 - RNA, 19 nt, Human
aagacagaaaccuguaagc

SEQ ID NO: 1233589 - RNA, 18 nt, Human
aagugcaggguggaggug

SEQ ID NO: 1233590 - RNA, 21 nt, Human
acagagagguuaaaaucugga

SEQ ID NO: 1233591 - RNA, 21 nt, Human
accccacccccaccccuugag

SEQ ID NO: 1233592 - RNA, 23 nt, Human
acccucaccggggaacccucacu

SEQ ID NO: 1233593 - RNA, 20 nt, Human
accugcaucaccuccuccuc

SEQ ID NO: 1233594 - RNA, 24 nt, Human
agcacaagaagacagaaaccugua

SEQ ID NO: 1233595 - RNA, 18 nt, Human
agccuguaguucuuuggg

SEQ ID NO: 1233596 - RNA, 20 nt, Human
agcucugaccccacccccac

SEQ ID NO: 1233597 - RNA, 20 nt, Human
aggaaaaaccaaauauacau

SEQ ID NO: 1233598 - RNA, 22 nt, Human
aggcccggucaccuggucagga

SEQ ID NO: 1233599 - RNA, 24 nt, Human
agggugccucucaucucuggguuu

SEQ ID NO: 1233600 - RNA, 18 nt, Human
aggucucagcucuuggag

SEQ ID NO: 1233601 - RNA, 22 nt, Human
aggucucagcucuuggaggagg

SEQ ID NO: 1233602 - RNA, 21 nt, Human
agguuaaaaucuggagcagga

SEQ ID NO: 1233603 - RNA, 26 nt, Human
augaaucugaacugcccucuccugug

SEQ ID NO: 1233604 - RNA, 19 nt, Human
cacaagcacagaucccaga

SEQ ID NO: 1233605 - RNA, 19 nt, Human
caccuggucaggacagagc

SEQ ID NO: 1233606 - RNA, 21 nt, Human
caccuuguccugugucugagg

SEQ ID NO: 1233607 - RNA, 19 nt, Human
cacucccgccugccccaga

SEQ ID NO: 1233608 - RNA, 26 nt, Human
cacucccgccugccccagacuggaga

SEQ ID NO: 1233609 - RNA, 22 nt, Human
cagagcaacugcaucuaaaagc

SEQ ID NO: 1233610 - RNA, 23 nt, Human
cagaucccagacuuugccagagg

SEQ ID NO: 1233611 - RNA, 20 nt, Human
caucagcaaacauugaacca

SEQ ID NO: 1233612 - RNA, 22 nt, Human
ccaauugccccuccacccccag

SEQ ID NO: 1233613 - RNA, 18 nt, Human
ccauacagaaugaaucug

SEQ ID NO: 1233614 - RNA, 23 nt, Human
ccaucuuggcugcuguccugccu

SEQ ID NO: 1233615 - RNA, 21 nt, Human
cccacccccaccccuugagag

SEQ ID NO: 1233616 - RNA, 24 nt, Human
cccacguuguugaauguccagaaa

SEQ ID NO: 1233617 - RNA, 22 nt, Human
ccccaccaaccuuacccucacc

SEQ ID NO: 1233618 - RNA, 21 nt, Human
cccccgccgggucaccucccc

SEQ ID NO: 1233619 - RNA, 23 nt, Human
cccccgccgggucaccuccccgc

SEQ ID NO: 1233620 - RNA, 19 nt, Human
ccccgcccccucggucccc

SEQ ID NO: 1233621 - RNA, 20 nt, Human
ccccgccgggucaccucccc

SEQ ID NO: 1233622 - RNA, 22 nt, Human
ccccggcccgccaggccccgga

SEQ ID NO: 1233623 - RNA, 20 nt, Human
cccgcccccucgguccccgg

SEQ ID NO: 1233624 - RNA, 22 nt, Human
cccgcccgcuggcuccgccccc

SEQ ID NO: 1233625 - RNA, 21 nt, Human
cccggcccgccaggccccgga

SEQ ID NO: 1233626 - RNA, 23 nt, Human
cccggcccgccaggccccggaag

SEQ ID NO: 1233627 - RNA, 23 nt, Human
ccgcuggcuccgcccccgccggg

SEQ ID NO: 1233628 - RNA, 22 nt, Human
ccuccacccccagcugaggccc

SEQ ID NO: 1233629 - RNA, 19 nt, Human
ccucccgcgccgcgcccgc

SEQ ID NO: 1233630 - RNA, 20 nt, Human
ccuguaagcucugaccccac

SEQ ID NO: 1233631 - RNA, 19 nt, Human
ccuguggcuggacagcagc

SEQ ID NO: 1233632 - RNA, 19 nt, Human
ccuguggcuggucaggugc

SEQ ID NO: 1233633 - RNA, 23 nt, Human
ccuuucccacagaagggggugcc

SEQ ID NO: 1233634 - RNA, 21 nt, Human
cgccaggccccggaagacgcc

SEQ ID NO: 1233635 - RNA, 18 nt, Human
cgccgggucaccuccccg

SEQ ID NO: 1233636 - RNA, 26 nt, Human
cgccucccgcgccgcgcccgcccgcu

SEQ ID NO: 1233637 - RNA, 18 nt, Human
cgcugcacccccaccaac

SEQ ID NO: 1233638 - RNA, 19 nt, Human
cuccccguuucucucccca

SEQ ID NO: 1233639 - RNA, 22 nt, Human
cucugaccaguggccgcccccc

SEQ ID NO: 1233640 - RNA, 23 nt, Human
cugcaccauccucgcuguuuccc

SEQ ID NO: 1233641 - RNA, 24 nt, Human
cugcaucaccuccuccucuugcag

SEQ ID NO: 1233642 - RNA, 20 nt, Human
cuggucaggugcccccagcc

SEQ ID NO: 1233643 - RNA, 21 nt, Human
cuuuauguguguguguaugug

SEQ ID NO: 1233644 - RNA, 19 nt, Human
gaaacuuugugcaaagaau

SEQ ID NO: 1233645 - RNA, 21 nt, Human
gaccccacccccaccccuuga

SEQ ID NO: 1233646 - RNA, 20 nt, Human
gcacgugggccucauagcag

SEQ ID NO: 1233647 - RNA, 23 nt, Human
gccacaggaaacaaacuuuaugu

SEQ ID NO: 1233648 - RNA, 19 nt, Human
gccagaggcaaacagccuu

SEQ ID NO: 1233649 - RNA, 21 nt, Human
gcugcacccccaccaaccuua

SEQ ID NO: 1233650 - RNA, 24 nt, Human
ggaaaaaccaaauauacauacuua

SEQ ID NO: 1233651 - RNA, 18 nt, Human
ggagcccccugaugggcu

SEQ ID NO: 1233652 - RNA, 22 nt, Human
ggccccggaagacgccgcggcg

SEQ ID NO: 1233653 - RNA, 18 nt, Human
ggccccuucagacccaaa

SEQ ID NO: 1233654 - RNA, 19 nt, Human
gggaacccucacuagcagg

SEQ ID NO: 1233655 - RNA, 18 nt, Human
gggccccuucagacccaa

SEQ ID NO: 1233656 - RNA, 18 nt, Human
gguggagucucaccuggg

SEQ ID NO: 1233657 - RNA, 22 nt, Human
gguugggcaggcuuguuuuugc

SEQ ID NO: 1233658 - RNA, 22 nt, Human
guaccagagucucuugggcuca

SEQ ID NO: 1233659 - RNA, 22 nt, Human
gugaagcgcugcacccccacca

SEQ ID NO: 1233660 - RNA, 18 nt, Human
uaaaagcacaagaagaca

SEQ ID NO: 1233661 - RNA, 23 nt, Human
uaaaagcacaagaagacagaaac

SEQ ID NO: 1233662 - RNA, 18 nt, Human
uaaccucacacaagcaca

SEQ ID NO: 1233663 - RNA, 21 nt, Human
uaaccucacacaagcacagau

SEQ ID NO: 1233664 - RNA, 20 nt, Human
uaaggaauaauucuuccuuc

SEQ ID NO: 1233665 - RNA, 23 nt, Human
uacccucaccggggaacccucac

SEQ ID NO: 1233666 - RNA, 20 nt, Human
uauguguguguguaugugug

SEQ ID NO: 1233667 - RNA, 22 nt, Human
ucagacccaaagcuuuaggcau

SEQ ID NO: 1233668 - RNA, 22 nt, Human
ucagcaccuguuuccuuuccca

SEQ ID NO: 1233669 - RNA, 23 nt, Human
ucagcaccuguuuccuuucccac

SEQ ID NO: 1233670 - RNA, 21 nt, Human
uccugugucugagguccugug

SEQ ID NO: 1233671 - RNA, 21 nt, Human
ucucuggguuuagccuggcuu

SEQ ID NO: 1233672 - RNA, 20 nt, Human
ucuguaucucuuggcuuugu

SEQ ID NO: 1233673 - RNA, 20 nt, Human
ucuuggaggagggcuaaggc

SEQ ID NO: 1233674 - RNA, 23 nt, Human
ucuugggcucagcaccuguuucc

SEQ ID NO: 1233675 - RNA, 23 nt, Human
ucuuugggguggagggaagaagg

SEQ ID NO: 1233676 - RNA, 22 nt, Human
ugaaccagggcccacucccgcc

SEQ ID NO: 1233677 - RNA, 21 nt, Human
ugaagcgcugcacccccacca

SEQ ID NO: 1233678 - RNA, 21 nt, Human
ugaaucugaacugcccucucc

SEQ ID NO: 1233679 - RNA, 21 nt, Human
ugaccaguggccgccccccuc

SEQ ID NO: 1233680 - RNA, 18 nt, Human
ugaccccacccccacccc

SEQ ID NO: 1233681 - RNA, 20 nt, Human
ugaccccacccccaccccuu

SEQ ID NO: 1233682 - RNA, 18 nt, Human
ugagaggucucagcucuu

SEQ ID NO: 1233683 - RNA, 27 nt, Human
ugcccccagcccacagagagguuaaaa

SEQ ID NO: 1233684 - RNA, 23 nt, Human
ugcccucuccuguggcuggucag

SEQ ID NO: 1233685 - RNA, 18 nt, Human
ugccucugaccaguggcc

SEQ ID NO: 1233686 - RNA, 22 nt, Human
ugccucuuuuuuuuuuuuuccu

SEQ ID NO: 1233687 - RNA, 19 nt, Human
ugccuggagaugaacugga

SEQ ID NO: 1233688 - RNA, 24 nt, Human
uggagcaggaggcagcacgugggc

SEQ ID NO: 1233689 - RNA, 19 nt, Human
uggagggaagaagggaagg

SEQ ID NO: 1233690 - RNA, 19 nt, Human
uggagucucaauaaagcuc

SEQ ID NO: 1233691 - RNA, 23 nt, Human
uggagucucaccuggggccuaga

SEQ ID NO: 1233692 - RNA, 18 nt, Human
uggcuggacagcagcagc

SEQ ID NO: 1233693 - RNA, 19 nt, Human
ugggcaggcuuguuuuugc

SEQ ID NO: 1233694 - RNA, 21 nt, Human
uggguaccagagucucuuggg

SEQ ID NO: 1233695 - RNA, 18 nt, Human
uggucaggugcccccagc

SEQ ID NO: 1233696 - RNA, 22 nt, Human
ugguggagucucaccuggggcc

SEQ ID NO: 1233697 - RNA, 25 nt, Human
uggugguggagucucaccuggggcc

SEQ ID NO: 1233698 - RNA, 26 nt, Human
ugucagaggccuggagccaaggccac

SEQ ID NO: 1233699 - RNA, 23 nt, Human
uguucauuuuuuuuggggggggu

SEQ ID NO: 1233700 - RNA, 18 nt, Human
uguugggggccccuucag

SEQ ID NO: 1233701 - RNA, 25 nt, Human
uuaggcaugauuccaacuggcugca

SEQ ID NO: 1233702 - RNA, 21 nt, Human
uucagacccaaagcuuuaggc

SEQ ID NO: 1233703 - RNA, 25 nt, Human
uucccacagaagggggugccuguca

SEQ ID NO: 1233704 - RNA, 24 nt, Human
uugcccugggacaucuguaucucu

SEQ ID NO: 1233705 - RNA, 19 nt, Human
uugugaagcgcugcacccc

SEQ ID NO: 1233706 - RNA, 23 nt, Human
uuugggguggagggaagaaggga

SEQ ID NO: 1233707 - RNA, 19 nt, Human
uuuuuuuuggggggggucu

SEQ ID NO: 1233708 - RNA, 21 nt, Human
acgcaguugcgacaggaggcc

SEQ ID NO: 1233709 - RNA, 24 nt, Human
cugggcuccugggcugaacaugga

SEQ ID NO: 1233710 - RNA, 20 nt, Human
gcgacaggaggccaggggaa

SEQ ID NO: 1233711 - RNA, 22 nt, Human
gcuccugggcugaacauggacc

SEQ ID NO: 1233712 - RNA, 18 nt, Human
aaaaucccagaaccaaga

SEQ ID NO: 1233713 - RNA, 21 nt, Human
aagcaggcugagcgcccggcu

SEQ ID NO: 1233714 - RNA, 22 nt, Human
aagcaggcugagcgcccggcug

SEQ ID NO: 1233715 - RNA, 21 nt, Human
accugccugcuccccagcccu

SEQ ID NO: 1233716 - RNA, 19 nt, Human
agcgaagcaggcugagcgc

SEQ ID NO: 1233717 - RNA, 25 nt, Human
agucacaaagccccugcuacugggg

SEQ ID NO: 1233718 - RNA, 19 nt, Human
caccuccagggcugggguc

SEQ ID NO: 1233719 - RNA, 21 nt, Human
caccugccugcuccccagccc

SEQ ID NO: 1233720 - RNA, 20 nt, Human
cacugguugucaccugccug

SEQ ID NO: 1233721 - RNA, 22 nt, Human
cagcgaagcaggcugagcgccc

SEQ ID NO: 1233722 - RNA, 19 nt, Human
cauauugcccaggccuggc

SEQ ID NO: 1233723 - RNA, 18 nt, Human
cccucagguccccucuuc

SEQ ID NO: 1233724 - RNA, 20 nt, Human
ccugcuacuggggaaagaga

SEQ ID NO: 1233725 - RNA, 20 nt, Human
cuccagggcuggggucucuc

SEQ ID NO: 1233726 - RNA, 23 nt, Human
cugauagucacaaagccccugcu

SEQ ID NO: 1233727 - RNA, 18 nt, Human
gaaaaucccagaaccaag

SEQ ID NO: 1233728 - RNA, 23 nt, Human
gacacugguugucaccugccugc

SEQ ID NO: 1233729 - RNA, 20 nt, Human
gccauauugcccaggccugg

SEQ ID NO: 1233730 - RNA, 20 nt, Human
gcgaagcaggcugagcgccc

SEQ ID NO: 1233731 - RNA, 19 nt, Human
ggaaaguaggacacugguu

SEQ ID NO: 1233732 - RNA, 18 nt, Human
gggaaagagaaaggaagg

SEQ ID NO: 1233733 - RNA, 21 nt, Human
ggggaaagagaaaggaaggcc

SEQ ID NO: 1233734 - RNA, 20 nt, Human
guggugccgucccgaccucg

SEQ ID NO: 1233735 - RNA, 24 nt, Human
uaagacccaauuaagaaaauccca

SEQ ID NO: 1233736 - RNA, 21 nt, Human
uauuccaacguccaccccagg

SEQ ID NO: 1233737 - RNA, 20 nt, Human
ucccgaccucgacaagcauc

SEQ ID NO: 1233738 - RNA, 18 nt, Human
uccugggccccgcagggc

SEQ ID NO: 1233739 - RNA, 25 nt, Human
ucucgccauauugcccaggccuggc

SEQ ID NO: 1233740 - RNA, 25 nt, Human
ucucucaucguguuguccccacuuu

SEQ ID NO: 1233741 - RNA, 24 nt, Human
ugaggucucgccauauugcccagg

SEQ ID NO: 1233742 - RNA, 22 nt, Human
ugcuacuggggaaagagaaagg

SEQ ID NO: 1233743 - RNA, 24 nt, Human
ugcuguccagccacgaaucuccca

SEQ ID NO: 1233744 - RNA, 19 nt, Human
uggccgagggcaccuccag

SEQ ID NO: 1233745 - RNA, 24 nt, Human
uggggucucucaucguguuguccc

SEQ ID NO: 1233746 - RNA, 21 nt, Human
uguccagccacgaaucuccca

SEQ ID NO: 1233747 - RNA, 21 nt, Human
uuccaacguccaccccaggcc

SEQ ID NO: 1233748 - RNA, 21 nt, Human
uugcccaggccuggcaggugu

SEQ ID NO: 1233749 - RNA, 20 nt, Human
acagugcagagcaggcccac

SEQ ID NO: 1233750 - RNA, 19 nt, Human
acccuggucagcugccugg

SEQ ID NO: 1233751 - RNA, 21 nt, Human
agaucgggagcaggaagugga

SEQ ID NO: 1233752 - RNA, 20 nt, Human
aggcccacgagcagcagccc

SEQ ID NO: 1233753 - RNA, 22 nt, Human
agggaagccccaugcaaggggc

SEQ ID NO: 1233754 - RNA, 24 nt, Human
caacuuuauugaggggaaauauau

SEQ ID NO: 1233755 - RNA, 23 nt, Human
cagagguucugcuugcccccucc

SEQ ID NO: 1233756 - RNA, 25 nt, Human
caggauccuggacaaaggggucaag

SEQ ID NO: 1233757 - RNA, 27 nt, Human
caugcaaggggcaaagucaugccaccc

SEQ ID NO: 1233758 - RNA, 22 nt, Human
ccaagagugagcagccucuucc

SEQ ID NO: 1233759 - RNA, 23 nt, Human
ccacccggaggcugagcuuccag

SEQ ID NO: 1233760 - RNA, 20 nt, Human
ccacccuggucagcugccug

SEQ ID NO: 1233761 - RNA, 19 nt, Human
cccaaccagggaagcccca

SEQ ID NO: 1233762 - RNA, 19 nt, Human
cccccuuagcacugcucac

SEQ ID NO: 1233763 - RNA, 21 nt, Human
cccugagccaacaccugccac

SEQ ID NO: 1233764 - RNA, 22 nt, Human
cugcuugcccccuccgagggug

SEQ ID NO: 1233765 - RNA, 19 nt, Human
cuucccugagccaacaccu

SEQ ID NO: 1233766 - RNA, 24 nt, Human
gagcaggaaguggauguugcagag

SEQ ID NO: 1233767 - RNA, 22 nt, Human
gcacagugcagagcaggcccac

SEQ ID NO: 1233768 - RNA, 20 nt, Human
ggaaauauauacaccuuuga

SEQ ID NO: 1233769 - RNA, 18 nt, Human
ggaggccagagguucugc

SEQ ID NO: 1233770 - RNA, 19 nt, Human
ggauguccuuucuuuuauc

SEQ ID NO: 1233771 - RNA, 22 nt, Human
gucaugccacccggaggcugag

SEQ ID NO: 1233772 - RNA, 23 nt, Human
uacaccuuugaaaauuagaaaaa

SEQ ID NO: 1233773 - RNA, 24 nt, Human
ucagcugccugguccccaaccagg

SEQ ID NO: 1233774 - RNA, 19 nt, Human
ucagggagaucgggagcag

SEQ ID NO: 1233775 - RNA, 19 nt, Human
ucaugccacccggaggcug

SEQ ID NO: 1233776 - RNA, 24 nt, Human
ucccugagccaacaccugccaccc

SEQ ID NO: 1233777 - RNA, 26 nt, Human
ucccugagccaacaccugccacccug

SEQ ID NO: 1233778 - RNA, 24 nt, Human
uccuuucuuuuaucugcuccugau

SEQ ID NO: 1233779 - RNA, 20 nt, Human
ugagaugcagaugccuccaa

SEQ ID NO: 1233780 - RNA, 24 nt, Human
ugaggggaaauauauacaccuuug

SEQ ID NO: 1233781 - RNA, 20 nt, Human
ugccaagagugagcagccuc

SEQ ID NO: 1233782 - RNA, 20 nt, Human
ugcccccuccgaggguguug

SEQ ID NO: 1233783 - RNA, 18 nt, Human
uuagcacugcucacuugc

SEQ ID NO: 1233784 - RNA, 20 nt, Human
uuccaguggccuucccacag

SEQ ID NO: 1233785 - RNA, 18 nt, Human
cacccgcagaaccacauc

SEQ ID NO: 1233786 - RNA, 21 nt, Human
cagcaccgccucgcucugguu

SEQ ID NO: 1233787 - RNA, 18 nt, Human
cagcagcaggcggugggc

SEQ ID NO: 1233788 - RNA, 19 nt, Human
cagcaggcggugggcgugg

SEQ ID NO: 1233789 - RNA, 20 nt, Human
cagcggcgcaguccuguggc

SEQ ID NO: 1233790 - RNA, 19 nt, Human
cagcucacugugcaguccc

SEQ ID NO: 1233791 - RNA, 19 nt, Human
caggaacagcucacugugc

SEQ ID NO: 1233792 - RNA, 23 nt, Human
ccacucgggcccagcugcgucug

SEQ ID NO: 1233793 - RNA, 20 nt, Human
ccugcagcuggaacagcugu

SEQ ID NO: 1233794 - RNA, 22 nt, Human
ccugcagcuggaacagcugugc

SEQ ID NO: 1233795 - RNA, 24 nt, Human
cgcaguacagguaccugaugaacu

SEQ ID NO: 1233796 - RNA, 30 nt, Human
cgccucgcucugguuacuuagcagcuccaa

SEQ ID NO: 1233797 - RNA, 21 nt, Human
cugugcagggggauggccugg

SEQ ID NO: 1233798 - RNA, 23 nt, Human
gcagcuccaggaacaggggaacc

SEQ ID NO: 1233799 - RNA, 21 nt, Human
gcccgcagccugcacccgcag

SEQ ID NO: 1233800 - RNA, 23 nt, Human
gcgggcgcgagguaguugcgggg

SEQ ID NO: 1233801 - RNA, 20 nt, Human
ggauggccugggucagcagc

SEQ ID NO: 1233802 - RNA, 24 nt, Human
ggcccagcugcgucuggaagcugg

SEQ ID NO: 1233803 - RNA, 19 nt, Human
ggcggugggcguggaauac

SEQ ID NO: 1233804 - RNA, 20 nt, Human
gggauggccugggucagcag

SEQ ID NO: 1233805 - RNA, 21 nt, Human
gucuggaagcuggugcugcgg

SEQ ID NO: 1233806 - RNA, 22 nt, Human
guggcuccugcagcaccgccuc

SEQ ID NO: 1233807 - RNA, 24 nt, Human
uacagguaccugaugaacuugucg

SEQ ID NO: 1233808 - RNA, 22 nt, Human
ucagcagcacggucagcucccc

SEQ ID NO: 1233809 - RNA, 23 nt, Human
ucagcuccccgcaguacaggacu

SEQ ID NO: 1233810 - RNA, 20 nt, Human
ucgaagaacuuggcguagug

SEQ ID NO: 1233811 - RNA, 18 nt, Human
ugacccggcggcccgcgu

SEQ ID NO: 1233812 - RNA, 18 nt, Human
ugacgucgaagaacuugg

SEQ ID NO: 1233813 - RNA, 21 nt, Human
ugcggggcaggaaggcgcugc

SEQ ID NO: 1233814 - RNA, 19 nt, Human
uggaauacccggaccucau

SEQ ID NO: 1233815 - RNA, 21 nt, Human
ugggcguggaauacccggacc

SEQ ID NO: 1233816 - RNA, 23 nt, Human
ugugcagucccagcagcaggcgg

SEQ ID NO: 1233817 - RNA, 23 nt, Human
uugacgucgaagaacuuggcgua

SEQ ID NO: 1233818 - RNA, 18 nt, Human
caucccagcccccacacc

SEQ ID NO: 1233819 - RNA, 21 nt, Human
cccaucccagcccccacacca

SEQ ID NO: 1233820 - RNA, 23 nt, Human
cccccacaccaccgaugagagcc

SEQ ID NO: 1233821 - RNA, 23 nt, Human
gcccccacaccaccgaugagagc

SEQ ID NO: 1233822 - RNA, 19 nt, Human
guggccucaagcagcgcaa

SEQ ID NO: 1233823 - RNA, 19 nt, Human
ugagucccaucccagcccc

SEQ ID NO: 1233824 - RNA, 19 nt, Human
ugagucccaucccagcccc

SEQ ID NO: 1233825 - RNA, 22 nt, Human
ugccuggaagagaaguggccuc

SEQ ID NO: 1233826 - RNA, 18 nt, Human
uggaagagaaguggccuc

SEQ ID NO: 1233827 - RNA, 21 nt, Human
uggccucaagcagcgcaacag

SEQ ID NO: 1233828 - RNA, 21 nt, Human
uucugagucccaucccagccc

SEQ ID NO: 1233829 - RNA, 23 nt, Human
agcgagcgagcaguuggcugaaa

SEQ ID NO: 1233830 - RNA, 19 nt, Human
agggccagcucgugcucuc

SEQ ID NO: 1233831 - RNA, 21 nt, Human
aguuggcugaaaaaagggaag

SEQ ID NO: 1233832 - RNA, 18 nt, Human
aucugcaucuccagguca

SEQ ID NO: 1233833 - RNA, 22 nt, Human
cacgcaccuugucuagguagga

SEQ ID NO: 1233834 - RNA, 20 nt, Human
cacuugguccugaagucauc

SEQ ID NO: 1233835 - RNA, 19 nt, Human
cagcugccagccuggcauu

SEQ ID NO: 1233836 - RNA, 23 nt, Human
cagggucagcucguccaacaccc

SEQ ID NO: 1233837 - RNA, 21 nt, Human
ccacgccaggugcggcauccg

SEQ ID NO: 1233838 - RNA, 22 nt, Human
ccggucugaccucgcagagcaa

SEQ ID NO: 1233839 - RNA, 21 nt, Human
ccuucaggccuucuaucugca

SEQ ID NO: 1233840 - RNA, 25 nt, Human
cgagcaguuggcugaaaaaagggaa

SEQ ID NO: 1233841 - RNA, 21 nt, Human
cgugccaaggagggaggugag

SEQ ID NO: 1233842 - RNA, 21 nt, Human
cucgugcucucacuugguccu

SEQ ID NO: 1233843 - RNA, 19 nt, Human
cucugugguugugcuuugc

SEQ ID NO: 1233844 - RNA, 19 nt, Human
gugguugugcuuugccauc

SEQ ID NO: 1233845 - RNA, 19 nt, Human
uaggaggccaggcggucac

SEQ ID NO: 1233846 - RNA, 24 nt, Human
ucaaugguggccgcaaugaucuuu

SEQ ID NO: 1233847 - RNA, 22 nt, Human
ucacuuccaggucggcguuggc

SEQ ID NO: 1233848 - RNA, 19 nt, Human
ucagguccacgccaggugc

SEQ ID NO: 1233849 - RNA, 18 nt, Human
ucaguccuggccaggguc

SEQ ID NO: 1233850 - RNA, 21 nt, Human
ucaguccuggccagggucagc

SEQ ID NO: 1233851 - RNA, 19 nt, Human
uccacagucagccgcaggg

SEQ ID NO: 1233852 - RNA, 22 nt, Human
uccugaagucaucagcugccag

SEQ ID NO: 1233853 - RNA, 20 nt, Human
uccuucaggccuucuaucug

SEQ ID NO: 1233854 - RNA, 22 nt, Human
ucgugcucucacuugguccuga

SEQ ID NO: 1233855 - RNA, 23 nt, Human
ucuagguaggaggccaggcgguc

SEQ ID NO: 1233856 - RNA, 18 nt, Human
ucucacuugguccugaag

SEQ ID NO: 1233857 - RNA, 25 nt, Human
ugcaaaaugggcugcgcauucucaa

SEQ ID NO: 1233858 - RNA, 25 nt, Human
ugucaaucugcaaaaugggcugcgc

SEQ ID NO: 1233859 - RNA, 20 nt, Human
uugguccugaagucaucagc

SEQ ID NO: 1233860 - RNA, 23 nt, Human
aagggguggcccauuuggccucc

SEQ ID NO: 1233861 - RNA, 19 nt, Human
caggccccuucaccuucac

SEQ ID NO: 1233862 - RNA, 20 nt, Human
ccccuucaccuucacacugg

SEQ ID NO: 1233863 - RNA, 21 nt, Human
gggcaggccccuucaccuuca

SEQ ID NO: 1233864 - RNA, 20 nt, Human
ugccagaaaaaccuuuauuu

SEQ ID NO: 1233865 - RNA, 23 nt, Human
aagagggugauugaaaaaaacac

SEQ ID NO: 1233866 - RNA, 18 nt, Human
acacauuaguccccgccc

SEQ ID NO: 1233867 - RNA, 19 nt, Human
acagggacuggcuggccca

SEQ ID NO: 1233868 - RNA, 23 nt, Human
acagggacuggcuggcccagagc

SEQ ID NO: 1233869 - RNA, 24 nt, Human
agauaaaagaugaaauuuaauggg

SEQ ID NO: 1233870 - RNA, 18 nt, Human
agcaggcgugcugggggc

SEQ ID NO: 1233871 - RNA, 18 nt, Human
agccacacgcagagaagg

SEQ ID NO: 1233872 - RNA, 19 nt, Human
aggagggaccguggugcca

SEQ ID NO: 1233873 - RNA, 21 nt, Human
agggacuggcuggcccagagc

SEQ ID NO: 1233874 - RNA, 25 nt, Human
aguaaaacagggacuggcuggccca

SEQ ID NO: 1233875 - RNA, 23 nt, Human
auggggggugggggggcacaaga

SEQ ID NO: 1233876 - RNA, 21 nt, Human
caaagcaggcgugcugggggc

SEQ ID NO: 1233877 - RNA, 20 nt, Human
caccccuucccucuucgucc

SEQ ID NO: 1233878 - RNA, 19 nt, Human
cacgcugcugccucucuuc

SEQ ID NO: 1233879 - RNA, 22 nt, Human
cagcgcagcagcguacgggucc

SEQ ID NO: 1233880 - RNA, 21 nt, Human
caggagccacgucagcgcagc

SEQ ID NO: 1233881 - RNA, 21 nt, Human
ccaccccuucccucuucgucc

SEQ ID NO: 1233882 - RNA, 18 nt, Human
ccagcccugcuuccagga

SEQ ID NO: 1233883 - RNA, 21 nt, Human
ccagcccugcuuccaggagcc

SEQ ID NO: 1233884 - RNA, 21 nt, Human
cccuacgccagcccugcuucc

SEQ ID NO: 1233885 - RNA, 23 nt, Human
cccuguucguucguucuuucucu

SEQ ID NO: 1233886 - RNA, 20 nt, Human
ccucucuccucucuccucuc

SEQ ID NO: 1233887 - RNA, 22 nt, Human
ccucuucguccucgccuaggag

SEQ ID NO: 1233888 - RNA, 21 nt, Human
ccuucuccgucacucucuucc

SEQ ID NO: 1233889 - RNA, 21 nt, Human
cgacccgucaccaagggccag

SEQ ID NO: 1233890 - RNA, 23 nt, Human
cgcauccuuccucggggccgcag

SEQ ID NO: 1233891 - RNA, 18 nt, Human
cucaccgcauccuuccuc

SEQ ID NO: 1233892 - RNA, 20 nt, Human
cuccucucucucucuuucuc

SEQ ID NO: 1233893 - RNA, 23 nt, Human
cuccuucuccgucacucucuucc

SEQ ID NO: 1233894 - RNA, 21 nt, Human
cucuccugcgaggagcuucag

SEQ ID NO: 1233895 - RNA, 18 nt, Human
cucucuccucucucucuc

SEQ ID NO: 1233896 - RNA, 23 nt, Human
cucucucucucucucuccugcga

SEQ ID NO: 1233897 - RNA, 18 nt, Human
cucucucucucucucucu

SEQ ID NO: 1233898 - RNA, 18 nt, Human
cucucucucucucucucu

SEQ ID NO: 1233899 - RNA, 18 nt, Human
cucucucucucucucucu

SEQ ID NO: 1233900 - RNA, 21 nt, Human
cucuucguccucgccuaggag

SEQ ID NO: 1233901 - RNA, 18 nt, Human
cugcugccucucuucugc

SEQ ID NO: 1233902 - RNA, 22 nt, Human
cuggcuggcccagagccuuggg

SEQ ID NO: 1233903 - RNA, 20 nt, Human
cuuucucucuccucucuccc

SEQ ID NO: 1233904 - RNA, 19 nt, Human
gcuugcagggaccacgcug

SEQ ID NO: 1233905 - RNA, 21 nt, Human
ggauccccuccuuugucugga

SEQ ID NO: 1233906 - RNA, 20 nt, Human
gucauucuguaaagggacgc

SEQ ID NO: 1233907 - RNA, 20 nt, Human
gucucuuucucuccuucucc

SEQ ID NO: 1233908 - RNA, 22 nt, Human
gugcugggggcugcuuggccag

SEQ ID NO: 1233909 - RNA, 21 nt, Human
guucuuucucucucuccgggc

SEQ ID NO: 1233910 - RNA, 21 nt, Human
uaaaagaugaaauuuaauggg

SEQ ID NO: 1233911 - RNA, 19 nt, Human
uacgccagcccugcuucca

SEQ ID NO: 1233912 - RNA, 19 nt, Human
ucaccgcauccuuccucgg

SEQ ID NO: 1233913 - RNA, 19 nt, Human
ucacucucuucccucccuc

SEQ ID NO: 1233914 - RNA, 23 nt, Human
ucagcgcagcagcguacgggucc

SEQ ID NO: 1233915 - RNA, 19 nt, Human
uccaggagccacgucagcg

SEQ ID NO: 1233916 - RNA, 20 nt, Human
uccccgcccucggaaguaag

SEQ ID NO: 1233917 - RNA, 23 nt, Human
uccccgcccucggaaguaagggc

SEQ ID NO: 1233918 - RNA, 24 nt, Human
ucccucccucucuccucucuccuc

SEQ ID NO: 1233919 - RNA, 18 nt, Human
ucucccgucucuuucucu

SEQ ID NO: 1233920 - RNA, 22 nt, Human
ucuccugcgaggagcuucagau

SEQ ID NO: 1233921 - RNA, 22 nt, Human
ucucuccuucuccgucacucuc

SEQ ID NO: 1233922 - RNA, 29 nt, Human
ucucucuccucucucccgucucuuucucu

SEQ ID NO: 1233923 - RNA, 26 nt, Human
ucucucucuccucucucucucuuucu

SEQ ID NO: 1233924 - RNA, 18 nt, Human
ucucucucuuucucucuc

SEQ ID NO: 1233925 - RNA, 27 nt, Human
ucuucugcccuuuuccccuuaguuuua

SEQ ID NO: 1233926 - RNA, 18 nt, Human
ucuuucucucuccucucu

SEQ ID NO: 1233927 - RNA, 19 nt, Human
ucuuucucucucuccucuc

SEQ ID NO: 1233928 - RNA, 19 nt, Human
uggaacccucuggcucacc

SEQ ID NO: 1233929 - RNA, 23 nt, Human
uggaacccucuggcucaccgcau

SEQ ID NO: 1233930 - RNA, 23 nt, Human
uggccaggaaagcggacgcuugc

SEQ ID NO: 1233931 - RNA, 19 nt, Human
uucccucuucguccucgcc

SEQ ID NO: 1233932 - RNA, 19 nt, Human
aaccagcagcccaggucag

SEQ ID NO: 1233933 - RNA, 23 nt, Human
agacuacaucaaaaucugggcag

SEQ ID NO: 1233934 - RNA, 21 nt, Human
caaagagcugccuaaagaaac

SEQ ID NO: 1233935 - RNA, 19 nt, Human
cagggggcgcugcgcccgg

SEQ ID NO: 1233936 - RNA, 18 nt, Human
ccccaaucauuccuccuu

SEQ ID NO: 1233937 - RNA, 20 nt, Human
cccggcccgcccggccgcug

SEQ ID NO: 1233938 - RNA, 22 nt, Human
ccgcagcgcggcgccugcccgg

SEQ ID NO: 1233939 - RNA, 26 nt, Human
ccuccuuuucagggcaggagaggcag

SEQ ID NO: 1233940 - RNA, 22 nt, Human
ccugcgcgcgcccccgccgccc

SEQ ID NO: 1233941 - RNA, 19 nt, Human
cggcagggagagcaaaguu

SEQ ID NO: 1233942 - RNA, 21 nt, Human
cugcgcgcgcccccgccgccc

SEQ ID NO: 1233943 - RNA, 24 nt, Human
cugcgcgcgcccccgccgcccgcc

SEQ ID NO: 1233944 - RNA, 21 nt, Human
gcagagggaggacaaagagcu

SEQ ID NO: 1233945 - RNA, 20 nt, Human
gcaggagggagacccggccc

SEQ ID NO: 1233946 - RNA, 21 nt, Human
gccagccgcgccccgcagcgc

SEQ ID NO: 1233947 - RNA, 18 nt, Human
gcgcgcgcccccgccgcc

SEQ ID NO: 1233948 - RNA, 22 nt, Human
gcgcgcgcccccgccgcccgcc

SEQ ID NO: 1233949 - RNA, 18 nt, Human
ggcgcugcgcccggcugc

SEQ ID NO: 1233950 - RNA, 18 nt, Human
uaaaagaucacacaaaag

SEQ ID NO: 1233951 - RNA, 19 nt, Human
uagcuggagcaaacugcag

SEQ ID NO: 1233952 - RNA, 23 nt, Human
ucaggagcaccaccgaggcacgg

SEQ ID NO: 1233953 - RNA, 18 nt, Human
ucuucaggcccagggggc

SEQ ID NO: 1233954 - RNA, 24 nt, Human
uggagcaaacugcagagaucaaga

SEQ ID NO: 1233955 - RNA, 20 nt, Human
uucagggcaggagaggcaga

SEQ ID NO: 1233956 - RNA, 19 nt, Human
aaaaacacacagcacugaa

SEQ ID NO: 1233957 - RNA, 23 nt, Human
aaaauaaaaaaaguuaaaagccc

SEQ ID NO: 1233958 - RNA, 21 nt, Human
aaauaaccuggaacauuucac

SEQ ID NO: 1233959 - RNA, 20 nt, Human
aacauggugaaacccugucu

SEQ ID NO: 1233960 - RNA, 21 nt, Human
aacauggugaaacccugucuc

SEQ ID NO: 1233961 - RNA, 21 nt, Human
aagcaggagggacuuuucuag

SEQ ID NO: 1233962 - RNA, 25 nt, Human
aaggaaaaacacacagcacugaagg

SEQ ID NO: 1233963 - RNA, 18 nt, Human
aaguaacccuaaaaagga

SEQ ID NO: 1233964 - RNA, 30 nt, Human
aauaaauaaauaaaauaaaaaaaguuaaaa

SEQ ID NO: 1233965 - RNA, 24 nt, Human
aaucguuugaacccaggaggcaga

SEQ ID NO: 1233966 - RNA, 24 nt, Human
acagagugagacuccaucucaaaa

SEQ ID NO: 1233967 - RNA, 24 nt, Human
accaacauggugaaacccugucuc

SEQ ID NO: 1233968 - RNA, 19 nt, Human
accacagcacuuacuaccc

SEQ ID NO: 1233969 - RNA, 18 nt, Human
acccugucucuacuaaaa

SEQ ID NO: 1233970 - RNA, 23 nt, Human
acuaaaaauaccaaaaaaaaaau

SEQ ID NO: 1233971 - RNA, 19 nt, Human
acuccagccugggccacag

SEQ ID NO: 1233972 - RNA, 24 nt, Human
acuccagccugggccacagaguga

SEQ ID NO: 1233973 - RNA, 18 nt, Human
acugcacuccagccuggg

SEQ ID NO: 1233974 - RNA, 24 nt, Human
acugcacuccagccugggccacag

SEQ ID NO: 1233975 - RNA, 24 nt, Human
acuugaggucaggaguuugagacc

SEQ ID NO: 1233976 - RNA, 26 nt, Human
agaacauguuuauucagaugugccag

SEQ ID NO: 1233977 - RNA, 22 nt, Human
agaacgcacagcagcccgcagg

SEQ ID NO: 1233978 - RNA, 18 nt, Human
agacaccacggccugaag

SEQ ID NO: 1233979 - RNA, 20 nt, Human
agaggaugcagugagccgag

SEQ ID NO: 1233980 - RNA, 24 nt, Human
agaggaugcagugagccgagguug

SEQ ID NO: 1233981 - RNA, 23 nt, Human
agcaagaaaaaggucuggcccga

SEQ ID NO: 1233982 - RNA, 23 nt, Human
agcacuuugggaggcggaagugg

SEQ ID NO: 1233983 - RNA, 24 nt, Human
agccuaaccaacauggugaaaccc

SEQ ID NO: 1233984 - RNA, 24 nt, Human
agccugggccacagagugagacuc

SEQ ID NO: 1233985 - RNA, 22 nt, Human
aggaaaaacacacagcacugaa

SEQ ID NO: 1233986 - RNA, 22 nt, Human
aggacauuaaaaguuaaaagcc

SEQ ID NO: 1233987 - RNA, 21 nt, Human
aggcagaggaugcagugagcc

SEQ ID NO: 1233988 - RNA, 24 nt, Human
aggcagaggaugcagugagccgag

SEQ ID NO: 1233989 - RNA, 23 nt, Human
aggcaggacaaucguuugaaccc

SEQ ID NO: 1233990 - RNA, 24 nt, Human
aggcaggacaaucguuugaaccca

SEQ ID NO: 1233991 - RNA, 20 nt, Human
aggcugaggcaggacaaucg

SEQ ID NO: 1233992 - RNA, 24 nt, Human
aggcugaggcaggacaaucguuug

SEQ ID NO: 1233993 - RNA, 21 nt, Human
agggagaugcugaaagggccc

SEQ ID NO: 1233994 - RNA, 23 nt, Human
agguguuaaagguaaggucacuu

SEQ ID NO: 1233995 - RNA, 24 nt, Human
agguguuguggcaggcaccuguaa

SEQ ID NO: 1233996 - RNA, 24 nt, Human
auagaaacagcugcuggccaucag

SEQ ID NO: 1233997 - RNA, 24 nt, Human
aucacuugaggucaggaguuugag

SEQ ID NO: 1233998 - RNA, 22 nt, Human
augcagugagccgagguugugc

SEQ ID NO: 1233999 - RNA, 21 nt, Human
caaaaaaaaaaucagccaggu

SEQ ID NO: 1234000 - RNA, 20 nt, Human
caaaaguaacccuaaaaagg

SEQ ID NO: 1234001 - RNA, 24 nt, Human
caacauggugaaacccugucucua

SEQ ID NO: 1234002 - RNA, 19 nt, Human
caagggaacagccagccuu

SEQ ID NO: 1234003 - RNA, 24 nt, Human
cacaccuguaaucccagcacuuug

SEQ ID NO: 1234004 - RNA, 24 nt, Human
cacagagugagacuccaucucaaa

SEQ ID NO: 1234005 - RNA, 23 nt, Human
caccuguaaucccagcacuuugg

SEQ ID NO: 1234006 - RNA, 24 nt, Human
caccuguaaucccagcacuuuggg

SEQ ID NO: 1234007 - RNA, 23 nt, Human
caccuguaaucccagcuacucgg

SEQ ID NO: 1234008 - RNA, 24 nt, Human
caccuguaaucccagcuacucggg

SEQ ID NO: 1234009 - RNA, 19 nt, Human
cacucacaucuucccuucc

SEQ ID NO: 1234010 - RNA, 19 nt, Human
cacucaugaaagcaccccg

SEQ ID NO: 1234011 - RNA, 22 nt, Human
cacuccagccugggccacagag

SEQ ID NO: 1234012 - RNA, 23 nt, Human
cacuccagccugggccacagagu

SEQ ID NO: 1234013 - RNA, 24 nt, Human
cacuccagccugggccacagagug

SEQ ID NO: 1234014 - RNA, 18 nt, Human
cacugcacuccagccugg

SEQ ID NO: 1234015 - RNA, 19 nt, Human
cacugcacuccagccuggg

SEQ ID NO: 1234016 - RNA, 20 nt, Human
cacugcacuccagccugggc

SEQ ID NO: 1234017 - RNA, 24 nt, Human
cacugcacuccagccugggccaca

SEQ ID NO: 1234018 - RNA, 23 nt, Human
cacuugaggucaggaguuugaga

SEQ ID NO: 1234019 - RNA, 18 nt, Human
cagcacuuugggaggcgg

SEQ ID NO: 1234020 - RNA, 24 nt, Human
cagcuacucgggaggcugaggcag

SEQ ID NO: 1234021 - RNA, 21 nt, Human
caggaggcagaggaugcagug

SEQ ID NO: 1234022 - RNA, 18 nt, Human
caggaugggcccuggggc

SEQ ID NO: 1234023 - RNA, 18 nt, Human
cauggcuagcagaccuca

SEQ ID NO: 1234024 - RNA, 19 nt, Human
cauuaaaaguuaaaagccc

SEQ ID NO: 1234025 - RNA, 28 nt, Human
ccaaaccaagauacggaccacacucaug

SEQ ID NO: 1234026 - RNA, 22 nt, Human
ccaaccaaccccagucgugcca

SEQ ID NO: 1234027 - RNA, 22 nt, Human
ccacagagugagacuccaucuc

SEQ ID NO: 1234028 - RNA, 18 nt, Human
ccacagcacuuacuaccc

SEQ ID NO: 1234029 - RNA, 20 nt, Human
ccacugcacuccagccuggg

SEQ ID NO: 1234030 - RNA, 20 nt, Human
ccacugcacuccagccuggg

SEQ ID NO: 1234031 - RNA, 21 nt, Human
ccacugcacuccagccugggc

SEQ ID NO: 1234032 - RNA, 24 nt, Human
ccacugcacuccagccugggccac

SEQ ID NO: 1234033 - RNA, 22 nt, Human
cccaaccaaccccagucgugcu

SEQ ID NO: 1234034 - RNA, 22 nt, Human
cccgcagggagggcucagcccc

SEQ ID NO: 1234035 - RNA, 24 nt, Human
cccggccgggcauggcggcucaca

SEQ ID NO: 1234036 - RNA, 21 nt, Human
cccugagcugcaaauaagaac

SEQ ID NO: 1234037 - RNA, 22 nt, Human
ccuaaccaacauggugaaaccc

SEQ ID NO: 1234038 - RNA, 18 nt, Human
ccucuuccccgcucuccu

SEQ ID NO: 1234039 - RNA, 21 nt, Human
ccuguaaucccagcuacucgg

SEQ ID NO: 1234040 - RNA, 24 nt, Human
cgagguugugccacugcacuccag

SEQ ID NO: 1234041 - RNA, 26 nt, Human
cgcuaauccgggacccacagccacgc

SEQ ID NO: 1234042 - RNA, 24 nt, Human
cggaagugguggaucacuugaggu

SEQ ID NO: 1234043 - RNA, 22 nt, Human
cggcucacaccuguaaucccag

SEQ ID NO: 1234044 - RNA, 22 nt, Human
cucacaccuguaaucccagcac

SEQ ID NO: 1234045 - RNA, 24 nt, Human
cucacaccuguaaucccagcacuu

SEQ ID NO: 1234046 - RNA, 23 nt, Human
cucaucauacagaaauaugacaa

SEQ ID NO: 1234047 - RNA, 20 nt, Human
cuccucuuccccgcucuccu

SEQ ID NO: 1234048 - RNA, 28 nt, Human
cucuacuaaaaauaccaaaaaaaaaauc

SEQ ID NO: 1234049 - RNA, 19 nt, Human
cucuccucuccuccggucc

SEQ ID NO: 1234050 - RNA, 18 nt, Human
cugaagcugcucuccucu

SEQ ID NO: 1234051 - RNA, 21 nt, Human
cuguaaucccagcuacucggg

SEQ ID NO: 1234052 - RNA, 20 nt, Human
cugugcuguagcagaaguuu

SEQ ID NO: 1234053 - RNA, 24 nt, Human
cuuacuacccaaggacaggcugcu

SEQ ID NO: 1234054 - RNA, 21 nt, Human
cuuccaagcuggcuugccuaa

SEQ ID NO: 1234055 - RNA, 24 nt, Human
cuuccaaucuauauauuauacuuu

SEQ ID NO: 1234056 - RNA, 19 nt, Human
cuuggcacuggcgugcaua

SEQ ID NO: 1234057 - RNA, 19 nt, Human
gaaacccugucucuacuaa

SEQ ID NO: 1234058 - RNA, 18 nt, Human
gaacauguuuauucagau

SEQ ID NO: 1234059 - RNA, 18 nt, Human
gaacccaggaggcagagg

SEQ ID NO: 1234060 - RNA, 22 nt, Human
gaagugguggaucacuugaggu

SEQ ID NO: 1234061 - RNA, 24 nt, Human
gaucacuugaggucaggaguuuga

SEQ ID NO: 1234062 - RNA, 18 nt, Human
gcaagaaaaaggucuggc

SEQ ID NO: 1234063 - RNA, 22 nt, Human
gcacauggcuagcagaccucag

SEQ ID NO: 1234064 - RNA, 24 nt, Human
gcacuccagccugggccacagagu

SEQ ID NO: 1234065 - RNA, 23 nt, Human
gcacugaagggucucuggguggu

SEQ ID NO: 1234066 - RNA, 22 nt, Human
gcacugugccuuuucugugcug

SEQ ID NO: 1234067 - RNA, 19 nt, Human
gccacugcacuccagccug

SEQ ID NO: 1234068 - RNA, 22 nt, Human
gccacugcacuccagccugggc

SEQ ID NO: 1234069 - RNA, 18 nt, Human
ggagacaccacggccuga

SEQ ID NO: 1234070 - RNA, 22 nt, Human
ggaucacuugaggucaggaguu

SEQ ID NO: 1234071 - RNA, 20 nt, Human
ggaucgaccuggaagaggca

SEQ ID NO: 1234072 - RNA, 19 nt, Human
ggcaccuguaaucccagcu

SEQ ID NO: 1234073 - RNA, 23 nt, Human
ggcauggcggcucacaccuguaa

SEQ ID NO: 1234074 - RNA, 24 nt, Human
ggcggcucacaccuguaaucccag

SEQ ID NO: 1234075 - RNA, 23 nt, Human
ggcucacaccuguaaucccagca

SEQ ID NO: 1234076 - RNA, 18 nt, Human
gggcuggggaggugagac

SEQ ID NO: 1234077 - RNA, 19 nt, Human
ggucaggaguuugagacca

SEQ ID NO: 1234078 - RNA, 22 nt, Human
guggcaggcaccuguaauccca

SEQ ID NO: 1234079 - RNA, 24 nt, Human
uaaaaauaccaaaaaaaaaaucag

SEQ ID NO: 1234080 - RNA, 22 nt, Human
uaaaacaauuucuggugacuuc

SEQ ID NO: 1234081 - RNA, 24 nt, Human
uaaccaacauggugaaacccuguc

SEQ ID NO: 1234082 - RNA, 23 nt, Human
uaacugacccgaaguaacagaaa

SEQ ID NO: 1234083 - RNA, 21 nt, Human
uaacuuccaagcuggcuugcc

SEQ ID NO: 1234084 - RNA, 23 nt, Human
uaagaacacagacgugggagaca

SEQ ID NO: 1234085 - RNA, 26 nt, Human
uaagaacacagacgugggagacacca

SEQ ID NO: 1234086 - RNA, 18 nt, Human
uaagaacauguuuauucc

SEQ ID NO: 1234087 - RNA, 18 nt, Human
uaccugggaaugcaaacc

SEQ ID NO: 1234088 - RNA, 18 nt, Human
uaggccccaaccaacccc

SEQ ID NO: 1234089 - RNA, 20 nt, Human
uauaugacacacacauuaua

SEQ ID NO: 1234090 - RNA, 19 nt, Human
uaucuguauaugacacaca

SEQ ID NO: 1234091 - RNA, 25 nt, Human
ucagccagguguuguggcaggcacc

SEQ ID NO: 1234092 - RNA, 19 nt, Human
ucaggaugggcccuggggc

SEQ ID NO: 1234093 - RNA, 23 nt, Human
uccagccugggccacagagugag

SEQ ID NO: 1234094 - RNA, 24 nt, Human
uccagccugggccacagagugaga

SEQ ID NO: 1234095 - RNA, 21 nt, Human
uccuccugacuuccauuuccu

SEQ ID NO: 1234096 - RNA, 24 nt, Human
ucgggaggcugaggcaggacaauc

SEQ ID NO: 1234097 - RNA, 18 nt, Human
ucuaaacacacaacaaaa

SEQ ID NO: 1234098 - RNA, 22 nt, Human
ucuccucuccuccggucccgug

SEQ ID NO: 1234099 - RNA, 21 nt, Human
ugaaagcaccccguggcaggu

SEQ ID NO: 1234100 - RNA, 22 nt, Human
ugacaagaugaugaagucacaa

SEQ ID NO: 1234101 - RNA, 23 nt, Human
ugacaggggcagacugugaggga

SEQ ID NO: 1234102 - RNA, 18 nt, Human
ugacccgaaguaacagaa

SEQ ID NO: 1234103 - RNA, 23 nt, Human
ugagaccagccuaaccaacaugg

SEQ ID NO: 1234104 - RNA, 24 nt, Human
ugagaccagccuaaccaacauggu

SEQ ID NO: 1234105 - RNA, 22 nt, Human
ugagccgagguugugccacugc

SEQ ID NO: 1234106 - RNA, 24 nt, Human
ugaggcaggacaaucguuugaacc

SEQ ID NO: 1234107 - RNA, 25 nt, Human
ugaggcaggacaaucguuugaaccc

SEQ ID NO: 1234108 - RNA, 28 nt, Human
ugaggcaggacaaucguuugaacccccu

SEQ ID NO: 1234109 - RNA, 18 nt, Human
ugaggucaggaguuugag

SEQ ID NO: 1234110 - RNA, 18 nt, Human
ugcaaacccugagcugca

SEQ ID NO: 1234111 - RNA, 21 nt, Human
ugccgaggucucccucccuca

SEQ ID NO: 1234112 - RNA, 24 nt, Human
uggaacauuucacaguguacgaca

SEQ ID NO: 1234113 - RNA, 23 nt, Human
uggaucacuugaggucaggaguu

SEQ ID NO: 1234114 - RNA, 24 nt, Human
uggaucacuugaggucaggaguuu

SEQ ID NO: 1234115 - RNA, 26 nt, Human
uggaucacuugaggucaggaguuuga

SEQ ID NO: 1234116 - RNA, 19 nt, Human
uggcaaaggagcaagaaaa

SEQ ID NO: 1234117 - RNA, 26 nt, Human
uggcacuggcgugcauacugguuuua

SEQ ID NO: 1234118 - RNA, 24 nt, Human
uggcggcucacaccuguaauccca

SEQ ID NO: 1234119 - RNA, 18 nt, Human
ugggaggcggaaguggug

SEQ ID NO: 1234120 - RNA, 23 nt, Human
ugguggaucacuugaggucagga

SEQ ID NO: 1234121 - RNA, 24 nt, Human
uguggcaggcaccuguaaucccag

SEQ ID NO: 1234122 - RNA, 22 nt, Human
uuaaaagcccaacauagaaaca

SEQ ID NO: 1234123 - RNA, 23 nt, Human
uugugccacugcacuccagccug

SEQ ID NO: 1234124 - RNA, 18 nt, Human
uuugggaggcggaagugg

SEQ ID NO: 1234125 - RNA, 25 nt, Human
ucccggaaggucucuauuucuuucc

SEQ ID NO: 1234126 - RNA, 24 nt, Human
aaagugcugggauuacaggcguga

SEQ ID NO: 1234127 - RNA, 22 nt, Human
aacagccaacucuccuacauau

SEQ ID NO: 1234128 - RNA, 20 nt, Human
aacauggugaaacuccgucu

SEQ ID NO: 1234129 - RNA, 21 nt, Human
aacauggugaaacuccgucuc

SEQ ID NO: 1234130 - RNA, 22 nt, Human
aacuagaacccagcugacuucc

SEQ ID NO: 1234131 - RNA, 19 nt, Human
aagagaaugaggagaaggg

SEQ ID NO: 1234132 - RNA, 19 nt, Human
aagcaaaggugaaagcaga

SEQ ID NO: 1234133 - RNA, 21 nt, Human
aagcaaaggugaaagcagaaa

SEQ ID NO: 1234134 - RNA, 22 nt, Human
aagcaggagaaucacuugaacc

SEQ ID NO: 1234135 - RNA, 24 nt, Human
aagcaggagaaucacuugaaccug

SEQ ID NO: 1234136 - RNA, 25 nt, Human
aagcaggagaaucacuugaaccugg

SEQ ID NO: 1234137 - RNA, 21 nt, Human
aaggcccaggaaggccuccag

SEQ ID NO: 1234138 - RNA, 19 nt, Human
aagugcugggauuacaggc

SEQ ID NO: 1234139 - RNA, 19 nt, Human
aagugcugggauuacaggc

SEQ ID NO: 1234140 - RNA, 26 nt, Human
aagugcugggauuacaggcgugagcc

SEQ ID NO: 1234141 - RNA, 21 nt, Human
aauacuaaaggcaacugucac

SEQ ID NO: 1234142 - RNA, 24 nt, Human
aaucacuugaaccugggaggcaga

SEQ ID NO: 1234143 - RNA, 21 nt, Human
acagcacuucuagggucaccu

SEQ ID NO: 1234144 - RNA, 19 nt, Human
acauggugaaacuccgucu

SEQ ID NO: 1234145 - RNA, 21 nt, Human
acauugcacuucagccugggc

SEQ ID NO: 1234146 - RNA, 23 nt, Human
acauugcacuucagccugggcaa

SEQ ID NO: 1234147 - RNA, 24 nt, Human
acauugcacuucagccugggcaac

SEQ ID NO: 1234148 - RNA, 24 nt, Human
accaacauggugaaacuccgucuc

SEQ ID NO: 1234149 - RNA, 23 nt, Human
accagaguaaaaggaaaagacug

SEQ ID NO: 1234150 - RNA, 24 nt, Human
acuagaacccagcugacuuccccc

SEQ ID NO: 1234151 - RNA, 18 nt, Human
acucaacacagccauucc

SEQ ID NO: 1234152 - RNA, 18 nt, Human
acuccagcgccugcugug

SEQ ID NO: 1234153 - RNA, 18 nt, Human
acuccagcgccugcugug

SEQ ID NO: 1234154 - RNA, 24 nt, Human
acuccgucucuacuaaaaauacaa

SEQ ID NO: 1234155 - RNA, 21 nt, Human
acugcaagcucugccucccag

SEQ ID NO: 1234156 - RNA, 23 nt, Human
agaaacaaucucuauuuaagagc

SEQ ID NO: 1234157 - RNA, 18 nt, Human
agaaacuccaucucaaaa

SEQ ID NO: 1234158 - RNA, 21 nt, Human
agaacccagcugacuuccccc

SEQ ID NO: 1234159 - RNA, 24 nt, Human
agaacuuugggaggccgagguggg

SEQ ID NO: 1234160 - RNA, 22 nt, Human
agaaucacuugaaccugggagg

SEQ ID NO: 1234161 - RNA, 19 nt, Human
agacaguagcauacuuggc

SEQ ID NO: 1234162 - RNA, 24 nt, Human
agagguugcagugagccgagaucg

SEQ ID NO: 1234163 - RNA, 19 nt, Human
agcacgccuucccauccug

SEQ ID NO: 1234164 - RNA, 18 nt, Human
agccaggugugguggugc

SEQ ID NO: 1234165 - RNA, 22 nt, Human
agccugaccaacauggugaaac

SEQ ID NO: 1234166 - RNA, 20 nt, Human
aggaaggauuugggccucag

SEQ ID NO: 1234167 - RNA, 25 nt, Human
aggaaggccuccaggaaaaggcugc

SEQ ID NO: 1234168 - RNA, 22 nt, Human
aggagaagggagaguugacaag

SEQ ID NO: 1234169 - RNA, 21 nt, Human
aggcagagguugcagugagcc

SEQ ID NO: 1234170 - RNA, 24 nt, Human
aggcagagguugcagugagccgag

SEQ ID NO: 1234171 - RNA, 18 nt, Human
aggcaggacacagaggac

SEQ ID NO: 1234172 - RNA, 21 nt, Human
aggccgagguggggggaucac

SEQ ID NO: 1234173 - RNA, 22 nt, Human
aggccgagguggggggaucacu

SEQ ID NO: 1234174 - RNA, 25 nt, Human
aggcuggagugcaguggugcaaucu

SEQ ID NO: 1234175 - RNA, 24 nt, Human
aggggggccgggugugguggcuca

SEQ ID NO: 1234176 - RNA, 21 nt, Human
agguggggggaucacugaggu

SEQ ID NO: 1234177 - RNA, 21 nt, Human
aggugguguagccaccauacc

SEQ ID NO: 1234178 - RNA, 20 nt, Human
aguaaaaggaaaagacugga

SEQ ID NO: 1234179 - RNA, 20 nt, Human
agugcaguggugcaaucucg

SEQ ID NO: 1234180 - RNA, 24 nt, Human
agugcaguggugcaaucucggcuc

SEQ ID NO: 1234181 - RNA, 18 nt, Human
agugcugggauuacaggc

SEQ ID NO: 1234182 - RNA, 18 nt, Human
auaaaacacuguagcccc

SEQ ID NO: 1234183 - RNA, 18 nt, Human
auaaaacacuguagcccc

SEQ ID NO: 1234184 - RNA, 24 nt, Human
aucgcaacauugcacuucagccug

SEQ ID NO: 1234185 - RNA, 24 nt, Human
augauccgcccgccucggccuccc

SEQ ID NO: 1234186 - RNA, 18 nt, Human
augggguuucaccauguu

SEQ ID NO: 1234187 - RNA, 24 nt, Human
augggguuucaccauguuagccag

SEQ ID NO: 1234188 - RNA, 24 nt, Human
auugcacuucagccugggcaacaa

SEQ ID NO: 1234189 - RNA, 25 nt, Human
auugcacuucagccugggcaacaag

SEQ ID NO: 1234190 - RNA, 20 nt, Human
caaagcaggagaaucacuug

SEQ ID NO: 1234191 - RNA, 24 nt, Human
caaagcaggagaaucacuugaacc

SEQ ID NO: 1234192 - RNA, 24 nt, Human
caaagugcugggauuacaggcgug

SEQ ID NO: 1234193 - RNA, 24 nt, Human
caacauggugaaacuccgucucua

SEQ ID NO: 1234194 - RNA, 19 nt, Human
caagaaggugcuucaucuu

SEQ ID NO: 1234195 - RNA, 24 nt, Human
caagcacgccuucccauccugccc

SEQ ID NO: 1234196 - RNA, 19 nt, Human
caccacacccagccucuuc

SEQ ID NO: 1234197 - RNA, 18 nt, Human
caccauguuagccaggau

SEQ ID NO: 1234198 - RNA, 22 nt, Human
caccauguuagccaggaugguc

SEQ ID NO: 1234199 - RNA, 23 nt, Human
caccauguuagccaggauggucu

SEQ ID NO: 1234200 - RNA, 24 nt, Human
caccauguuagccaggauggucuu

SEQ ID NO: 1234201 - RNA, 18 nt, Human
cacccaccaccaugccug

SEQ ID NO: 1234202 - RNA, 18 nt, Human
caccccucuccuccccuu

SEQ ID NO: 1234203 - RNA, 18 nt, Human
caccccucuccuccccuu

SEQ ID NO: 1234204 - RNA, 22 nt, Human
cacgccauucuccugccucagc

SEQ ID NO: 1234205 - RNA, 24 nt, Human
cagaacuuugggaggccgaggugg

SEQ ID NO: 1234206 - RNA, 18 nt, Human
cagccugggcaacaagag

SEQ ID NO: 1234207 - RNA, 20 nt, Human
caggacuccagcgccugcug

SEQ ID NO: 1234208 - RNA, 24 nt, Human
caggaggccaaagcaggagaauca

SEQ ID NO: 1234209 - RNA, 19 nt, Human
caggauauucagaagugcu

SEQ ID NO: 1234210 - RNA, 21 nt, Human
caguagcauacuuggcccugg

SEQ ID NO: 1234211 - RNA, 19 nt, Human
cauaccugcaaucccagcu

SEQ ID NO: 1234212 - RNA, 21 nt, Human
caucaucauugagaucgggag

SEQ ID NO: 1234213 - RNA, 18 nt, Human
cauguuaaaucauuuccu

SEQ ID NO: 1234214 - RNA, 19 nt, Human
cauugcacuucagccuggg

SEQ ID NO: 1234215 - RNA, 19 nt, Human
cauugcacuucagccuggg

SEQ ID NO: 1234216 - RNA, 20 nt, Human
cauugcacuucagccugggc

SEQ ID NO: 1234217 - RNA, 21 nt, Human
cauugcacuucagccugggca

SEQ ID NO: 1234218 - RNA, 22 nt, Human
cauugcacuucagccugggcaa

SEQ ID NO: 1234219 - RNA, 24 nt, Human
cauugcacuucagccugggcaaca

SEQ ID NO: 1234220 - RNA, 22 nt, Human
ccaaagugcugggauuacaggc

SEQ ID NO: 1234221 - RNA, 22 nt, Human
ccaaagugcugggauuacaggc

SEQ ID NO: 1234222 - RNA, 24 nt, Human
ccaaagugcugggauuacaggcgu

SEQ ID NO: 1234223 - RNA, 22 nt, Human
ccagcgccugcugugguggggu

SEQ ID NO: 1234224 - RNA, 21 nt, Human
ccaggcacccaccaccaugcc

SEQ ID NO: 1234225 - RNA, 20 nt, Human
cccagguucacgccauucuc

SEQ ID NO: 1234226 - RNA, 21 nt, Human
cccauccugcccugccggaac

SEQ ID NO: 1234227 - RNA, 21 nt, Human
ccccacagccguucuuaccua

SEQ ID NO: 1234228 - RNA, 21 nt, Human
cccccacagccguucuuaccu

SEQ ID NO: 1234229 - RNA, 23 nt, Human
ccucagacccugguggucccagg

SEQ ID NO: 1234230 - RNA, 18 nt, Human
ccucaggauauucagaag

SEQ ID NO: 1234231 - RNA, 23 nt, Human
ccugaccaacauggugaaacucc

SEQ ID NO: 1234232 - RNA, 24 nt, Human
ccugaccaacauggugaaacuccg

SEQ ID NO: 1234233 - RNA, 21 nt, Human
ccugcaaucccagcuacucag

SEQ ID NO: 1234234 - RNA, 22 nt, Human
ccugccggaacaccccucuccu

SEQ ID NO: 1234235 - RNA, 23 nt, Human
ccugccucagccucccgaguagc

SEQ ID NO: 1234236 - RNA, 25 nt, Human
ccugggaggcagagguugcagugag

SEQ ID NO: 1234237 - RNA, 24 nt, Human
cgagaccagccugaccaacauggu

SEQ ID NO: 1234238 - RNA, 21 nt, Human
cgaggacuccaaauuuucugu

SEQ ID NO: 1234239 - RNA, 23 nt, Human
cgagguggggggaucacugaggu

SEQ ID NO: 1234240 - RNA, 25 nt, Human
cgagguggggggaucacugagguca

SEQ ID NO: 1234241 - RNA, 24 nt, Human
cgcccaggcuggagugcaguggug

SEQ ID NO: 1234242 - RNA, 21 nt, Human
cgcccugucuuuaugacaccu

SEQ ID NO: 1234243 - RNA, 24 nt, Human
cgccucggccucccaaagugcugg

SEQ ID NO: 1234244 - RNA, 25 nt, Human
cuagaacccagcugacuucccccac

SEQ ID NO: 1234245 - RNA, 20 nt, Human
cuaggcuacaaaccuguacu

SEQ ID NO: 1234246 - RNA, 22 nt, Human
cucacacccauaaucccagaac

SEQ ID NO: 1234247 - RNA, 22 nt, Human
cucaccuaaauuucacaacaau

SEQ ID NO: 1234248 - RNA, 24 nt, Human
cucagccucccgaguagcugggac

SEQ ID NO: 1234249 - RNA, 24 nt, Human
cuccugaccucaugauccgcccgc

SEQ ID NO: 1234250 - RNA, 23 nt, Human
cucuccuccccuuagugaggaag

SEQ ID NO: 1234251 - RNA, 20 nt, Human
cucugucgcccaggcuggag

SEQ ID NO: 1234252 - RNA, 24 nt, Human
cugcaagcucugccucccagguuc

SEQ ID NO: 1234253 - RNA, 23 nt, Human
cugccucagccucccgaguagcu

SEQ ID NO: 1234254 - RNA, 22 nt, Human
cuguauuuuuaguagagauggg

SEQ ID NO: 1234255 - RNA, 23 nt, Human
cuguauuuuuaguagagaugggg

SEQ ID NO: 1234256 - RNA, 18 nt, Human
cuucaucuuauuuuagug

SEQ ID NO: 1234257 - RNA, 20 nt, Human
cuugaagucuccuugguggg

SEQ ID NO: 1234258 - RNA, 21 nt, Human
cuugcucugucgcccaggcug

SEQ ID NO: 1234259 - RNA, 21 nt, Human
cuuugggaggccgaggugggg

SEQ ID NO: 1234260 - RNA, 24 nt, Human
gaaaaauuucaaaacacuuugcaa

SEQ ID NO: 1234261 - RNA, 20 nt, Human
gaaauccgagaacacucuuc

SEQ ID NO: 1234262 - RNA, 21 nt, Human
gaaggggggccggguguggug

SEQ ID NO: 1234263 - RNA, 22 nt, Human
gaccucaugauccgcccgccuc

SEQ ID NO: 1234264 - RNA, 26 nt, Human
gacuccagcgccugcugugguggggu

SEQ ID NO: 1234265 - RNA, 22 nt, Human
gacuccaggcacccaccaccau

SEQ ID NO: 1234266 - RNA, 21 nt, Human
gagauggagucuugcucuguc

SEQ ID NO: 1234267 - RNA, 18 nt, Human
gagaugggguuucaccau

SEQ ID NO: 1234268 - RNA, 24 nt, Human
gagaugggguuucaccauguuagc

SEQ ID NO: 1234269 - RNA, 19 nt, Human
gaggacuccaaauuuucug

SEQ ID NO: 1234270 - RNA, 20 nt, Human
gaguaaaaggaaaagacugg

SEQ ID NO: 1234271 - RNA, 20 nt, Human
gaguagcugggacuccaggc

SEQ ID NO: 1234272 - RNA, 18 nt, Human
gagugcugacuuccucuc

SEQ ID NO: 1234273 - RNA, 23 nt, Human
gaucacugaggucagaaguucga

SEQ ID NO: 1234274 - RNA, 18 nt, Human
gauuacaggcgugagcca

SEQ ID NO: 1234275 - RNA, 21 nt, Human
gauuacaggcgugagccacca

SEQ ID NO: 1234276 - RNA, 22 nt, Human
gauuacaggcgugagccaccac

SEQ ID NO: 1234277 - RNA, 19 nt, Human
gcccaggcuggagugcagu

SEQ ID NO: 1234278 - RNA, 20 nt, Human
gcccaggcuggagugcagug

SEQ ID NO: 1234279 - RNA, 23 nt, Human
gcccaggcuggagugcaguggug

SEQ ID NO: 1234280 - RNA, 22 nt, Human
gcccuggguuugacauaaaacu

SEQ ID NO: 1234281 - RNA, 25 nt, Human
gccucccagguucacgccauucucc

SEQ ID NO: 1234282 - RNA, 25 nt, Human
gcucugucgcccaggcuggagugca

SEQ ID NO: 1234283 - RNA, 21 nt, Human
gcuuggggagauaaagaaggc

SEQ ID NO: 1234284 - RNA, 21 nt, Human
ggacuccuaggcuacaaaccu

SEQ ID NO: 1234285 - RNA, 24 nt, Human
ggauggucuugaucuccugaccuc

SEQ ID NO: 1234286 - RNA, 19 nt, Human
ggauuacaggcgugagcca

SEQ ID NO: 1234287 - RNA, 21 nt, Human
ggccgggugugguggcucaca

SEQ ID NO: 1234288 - RNA, 22 nt, Human
gggggccgggugugguggcuca

SEQ ID NO: 1234289 - RNA, 18 nt, Human
gggguuucaccauguuag

SEQ ID NO: 1234290 - RNA, 22 nt, Human
gggguuucaccauguuagccag

SEQ ID NO: 1234291 - RNA, 24 nt, Human
gguggcucacacccauaaucccag

SEQ ID NO: 1234292 - RNA, 19 nt, Human
ggugggggcgcggcagagc

SEQ ID NO: 1234293 - RNA, 23 nt, Human
ggugugguggcucacacccauaa

SEQ ID NO: 1234294 - RNA, 24 nt, Human
gguuucaccauguuagccaggaug

SEQ ID NO: 1234295 - RNA, 23 nt, Human
guagagaugggguuucaccaugu

SEQ ID NO: 1234296 - RNA, 20 nt, Human
gucaguuguccauauggcuc

SEQ ID NO: 1234297 - RNA, 21 nt, Human
gugaaacuccgucucuacuaa

SEQ ID NO: 1234298 - RNA, 24 nt, Human
gugagccaccacacccagccucuu

SEQ ID NO: 1234299 - RNA, 18 nt, Human
guggugggguaggguggg

SEQ ID NO: 1234300 - RNA, 19 nt, Human
guugcagugagccgagauc

SEQ ID NO: 1234301 - RNA, 20 nt, Human
uaaaaauacaaaauuagcca

SEQ ID NO: 1234302 - RNA, 22 nt, Human
uaaaaauacaaaauuagccagg

SEQ ID NO: 1234303 - RNA, 23 nt, Human
uaaaaauacaaaauuagccaggu

SEQ ID NO: 1234304 - RNA, 22 nt, Human
uaaagagggugaagcgaaaaug

SEQ ID NO: 1234305 - RNA, 19 nt, Human
uaaggugaaauccgagaac

SEQ ID NO: 1234306 - RNA, 24 nt, Human
uaauuuagaaacaaucucuauuua

SEQ ID NO: 1234307 - RNA, 28 nt, Human
uaauuuuuuucuguauuuuuaguagaga

SEQ ID NO: 1234308 - RNA, 23 nt, Human
uacacaaaccuaggugguguagc

SEQ ID NO: 1234309 - RNA, 24 nt, Human
uacaggcgugagccaccacaccca

SEQ ID NO: 1234310 - RNA, 24 nt, Human
uaccugcaaucccagcuacucagg

SEQ ID NO: 1234311 - RNA, 22 nt, Human
uagagaugggguuucaccaugu

SEQ ID NO: 1234312 - RNA, 20 nt, Human
uagcaugauccccaguuuaa

SEQ ID NO: 1234313 - RNA, 22 nt, Human
uagccccaaguuaaguucccuc

SEQ ID NO: 1234314 - RNA, 24 nt, Human
uaguagagaugggguuucaccaug

SEQ ID NO: 1234315 - RNA, 26 nt, Human
uaguagagaugggguuucaccauguu

SEQ ID NO: 1234316 - RNA, 23 nt, Human
uauucacucaccuaaauuucaca

SEQ ID NO: 1234317 - RNA, 23 nt, Human
ucaacacagccauuccccuagaa

SEQ ID NO: 1234318 - RNA, 24 nt, Human
ucaccauguuagccaggauggucu

SEQ ID NO: 1234319 - RNA, 21 nt, Human
ucaccuguguucagagaucua

SEQ ID NO: 1234320 - RNA, 25 nt, Human
ucacuaggugauuucaccauugugc

SEQ ID NO: 1234321 - RNA, 18 nt, Human
ucacugcaagcucugccu

SEQ ID NO: 1234322 - RNA, 18 nt, Human
ucacugcaagcucugccu

SEQ ID NO: 1234323 - RNA, 19 nt, Human
ucacugcaagcucugccuc

SEQ ID NO: 1234324 - RNA, 24 nt, Human
ucacugcaagcucugccucccagg

SEQ ID NO: 1234325 - RNA, 25 nt, Human
ucacuugaaccugggaggcagaggu

SEQ ID NO: 1234326 - RNA, 23 nt, Human
ucagccucccgaguagcugggac

SEQ ID NO: 1234327 - RNA, 21 nt, Human
ucaggcaggacacagaggaca

SEQ ID NO: 1234328 - RNA, 23 nt, Human
ucauauauucacucaccuaaaag

SEQ ID NO: 1234329 - RNA, 24 nt, Human
ucccaaagugcugggauuacaggc

SEQ ID NO: 1234330 - RNA, 21 nt, Human
ucccaaggaagucaccggacc

SEQ ID NO: 1234331 - RNA, 22 nt, Human
ucccaaggaagucaccggaccu

SEQ ID NO: 1234332 - RNA, 18 nt, Human
ucccaggacuccagcgcc

SEQ ID NO: 1234333 - RNA, 19 nt, Human
ucccagguucacgccauuc

SEQ ID NO: 1234334 - RNA, 21 nt, Human
ucccagguucacgccauucuc

SEQ ID NO: 1234335 - RNA, 24 nt, Human
ucccagguucacgccauucuccug

SEQ ID NO: 1234336 - RNA, 19 nt, Human
ucccauccugcccugccgg

SEQ ID NO: 1234337 - RNA, 23 nt, Human
uccccaguuuaaaggugaggaaa

SEQ ID NO: 1234338 - RNA, 19 nt, Human
uccccuagaaguuacagca

SEQ ID NO: 1234339 - RNA, 24 nt, Human
ucccgaguagcugggacuccaggc

SEQ ID NO: 1234340 - RNA, 20 nt, Human
ucgcaacauugcacuucagc

SEQ ID NO: 1234341 - RNA, 24 nt, Human
ucgcccaggcuggagugcaguggu

SEQ ID NO: 1234342 - RNA, 18 nt, Human
ucggccucccaaagugcu

SEQ ID NO: 1234343 - RNA, 23 nt, Human
ucuacauauagaaagcuagggac

SEQ ID NO: 1234344 - RNA, 24 nt, Human
ucuccugccucagccucccgagua

SEQ ID NO: 1234345 - RNA, 22 nt, Human
ucucuacuaaaaauacaaaauu

SEQ ID NO: 1234346 - RNA, 24 nt, Human
ucugucgcccaggcuggagugcag

SEQ ID NO: 1234347 - RNA, 23 nt, Human
ucuugcucugucgcccaggcugg

SEQ ID NO: 1234348 - RNA, 24 nt, Human
ucuugcucugucgcccaggcugga

SEQ ID NO: 1234349 - RNA, 20 nt, Human
ugaaaugcuaacuagcauga

SEQ ID NO: 1234350 - RNA, 24 nt, Human
ugaaccugggaggcagagguugca

SEQ ID NO: 1234351 - RNA, 24 nt, Human
ugaccaacauggugaaacuccguc

SEQ ID NO: 1234352 - RNA, 20 nt, Human
ugagaaaugugucacuaggg

SEQ ID NO: 1234353 - RNA, 20 nt, Human
ugaggaaauugagucacagg

SEQ ID NO: 1234354 - RNA, 20 nt, Human
ugaggagaagggagaguuga

SEQ ID NO: 1234355 - RNA, 20 nt, Human
ugcacacauggagaagaggc

SEQ ID NO: 1234356 - RNA, 19 nt, Human
ugcacuucagccugggcaa

SEQ ID NO: 1234357 - RNA, 22 nt, Human
ugcaguggugcaaucucggcuc

SEQ ID NO: 1234358 - RNA, 24 nt, Human
ugccucagccucccgaguagcugg

SEQ ID NO: 1234359 - RNA, 19 nt, Human
ugccucccagguucacgcc

SEQ ID NO: 1234360 - RNA, 24 nt, Human
ugcugggauuacaggcgugagcca

SEQ ID NO: 1234361 - RNA, 23 nt, Human
uggaagagaguccaagauucacc

SEQ ID NO: 1234362 - RNA, 23 nt, Human
uggagucuugcucugucgcccag

SEQ ID NO: 1234363 - RNA, 24 nt, Human
uggagucuugcucugucgcccagg

SEQ ID NO: 1234364 - RNA, 23 nt, Human
uggagugcaguggugcaaucucg

SEQ ID NO: 1234365 - RNA, 24 nt, Human
uggagugcaguggugcaaucucgg

SEQ ID NO: 1234366 - RNA, 18 nt, Human
ugggaggaggcugaacug

SEQ ID NO: 1234367 - RNA, 24 nt, Human
ugggaggcagagguugcagugagc

SEQ ID NO: 1234368 - RNA, 24 nt, Human
ugggaggccgagguggggggauca

SEQ ID NO: 1234369 - RNA, 18 nt, Human
ugggauuacaggcgugag

SEQ ID NO: 1234370 - RNA, 19 nt, Human
ugggauuacaggcgugagc

SEQ ID NO: 1234371 - RNA, 22 nt, Human
ugggauuacaggcgugagccac

SEQ ID NO: 1234372 - RNA, 23 nt, Human
ugggauuacaggcgugagccacc

SEQ ID NO: 1234373 - RNA, 24 nt, Human
ugggauuacaggcgugagccacca

SEQ ID NO: 1234374 - RNA, 27 nt, Human
ugggccucagacccugguggucccagg

SEQ ID NO: 1234375 - RNA, 23 nt, Human
uggggugggggcgcggcagagcu

SEQ ID NO: 1234376 - RNA, 24 nt, Human
ugggguuucaccauguuagccagg

SEQ ID NO: 1234377 - RNA, 22 nt, Human
uggugcauaccugcaaucccag

SEQ ID NO: 1234378 - RNA, 21 nt, Human
uguaacuagaacccagcugac

SEQ ID NO: 1234379 - RNA, 24 nt, Human
uguucagagaucuacccugugugc

SEQ ID NO: 1234380 - RNA, 18 nt, Human
uuaguagagaugggguuu

SEQ ID NO: 1234381 - RNA, 22 nt, Human
uuaguagagaugggguuucacc

SEQ ID NO: 1234382 - RNA, 24 nt, Human
uuaguagagaugggguuucaccau

SEQ ID NO: 1234383 - RNA, 23 nt, Human
uucaucuuauuuuagugcuuggc

SEQ ID NO: 1234384 - RNA, 24 nt, Human
uugaaccugggaggcagagguugc

SEQ ID NO: 1234385 - RNA, 22 nt, Human
uugagucacaggcagaauaacu

SEQ ID NO: 1234386 - RNA, 18 nt, Human
uugcagugagccgagauc

SEQ ID NO: 1234387 - RNA, 19 nt, Human
uugcagugagccgagaucg

SEQ ID NO: 1234388 - RNA, 20 nt, Human
uugcagugagccgagaucgc

SEQ ID NO: 1234389 - RNA, 24 nt, Human
uugcucugucgcccaggcuggagu

SEQ ID NO: 1234390 - RNA, 25 nt, Human
uugggaggccgagguggggggauca

SEQ ID NO: 1234391 - RNA, 25 nt, Human
uugggguaaaaguuaaauaaaacac

SEQ ID NO: 1234392 - RNA, 19 nt, Human
uuucaccauguuagccagg

SEQ ID NO: 1234393 - RNA, 20 nt, Human
uuucaccauguuagccagga

SEQ ID NO: 1234394 - RNA, 24 nt, Human
uuucauaugcagucaugcauugcu

SEQ ID NO: 1234395 - RNA, 21 nt, Human
uuucuguauuuuuaguagaga

SEQ ID NO: 1234396 - RNA, 21 nt, Human
uuuucuguauuuuuaguagag

SEQ ID NO: 1234397 - RNA, 24 nt, Human
uuuucuguauuuuuaguagagaug

SEQ ID NO: 1234398 - RNA, 24 nt, Human
uuuuuaguagagaugggguuucac

SEQ ID NO: 1234399 - RNA, 19 nt, Human
aaaaacuccgagcgggauu

SEQ ID NO: 1234400 - RNA, 20 nt, Human
aaucuggccacccagauuca

SEQ ID NO: 1234401 - RNA, 24 nt, Human
agagcgccgggcagaacuuccucc

SEQ ID NO: 1234402 - RNA, 22 nt, Human
agccccagcacacccccugccc

SEQ ID NO: 1234403 - RNA, 23 nt, Human
aggaacucccuuaccucuauauc

SEQ ID NO: 1234404 - RNA, 23 nt, Human
aggaacucccuuaccucuauauc

SEQ ID NO: 1234405 - RNA, 23 nt, Human
aggaacucccuuaccucuauauc

SEQ ID NO: 1234406 - RNA, 24 nt, Human
aggccauggccucucuugacacca

SEQ ID NO: 1234407 - RNA, 20 nt, Human
caacaauauaaccagggagg

SEQ ID NO: 1234408 - RNA, 21 nt, Human
cacagccccagcacacccccu

SEQ ID NO: 1234409 - RNA, 18 nt, Human
caccaucccccacccccu

SEQ ID NO: 1234410 - RNA, 26 nt, Human
cacccccugcccucaggggccccaag

SEQ ID NO: 1234411 - RNA, 18 nt, Human
cagcacacccccugcccu

SEQ ID NO: 1234412 - RNA, 18 nt, Human
cagccccagggcccuccg

SEQ ID NO: 1234413 - RNA, 20 nt, Human
cagggcccuccgccuugggg

SEQ ID NO: 1234414 - RNA, 22 nt, Human
cagguuaggccccuaccaucga

SEQ ID NO: 1234415 - RNA, 22 nt, Human
caguguucugggaggaagaagg

SEQ ID NO: 1234416 - RNA, 20 nt, Human
cauuacaagccacagcccca

SEQ ID NO: 1234417 - RNA, 23 nt, Human
cauuacaagccacagccccagca

SEQ ID NO: 1234418 - RNA, 20 nt, Human
ccacacuuccucugagaauc

SEQ ID NO: 1234419 - RNA, 18 nt, Human
ccaccaucccccaccccc

SEQ ID NO: 1234420 - RNA, 21 nt, Human
ccagcgccugaggagcgaaga

SEQ ID NO: 1234421 - RNA, 22 nt, Human
ccaggaguccagccccagggcc

SEQ ID NO: 1234422 - RNA, 18 nt, Human
ccagggaggcaccggcgg

SEQ ID NO: 1234423 - RNA, 26 nt, Human
ccauggccucucuugacaccaccucc

SEQ ID NO: 1234424 - RNA, 23 nt, Human
cccaccaucccccacccccucuu

SEQ ID NO: 1234425 - RNA, 18 nt, Human
cccagcacacccccugcc

SEQ ID NO: 1234426 - RNA, 18 nt, Human
ccccagcacacccccugc

SEQ ID NO: 1234427 - RNA, 22 nt, Human
ccccagggcccuccgccuuggg

SEQ ID NO: 1234428 - RNA, 20 nt, Human
cccccacccccucuugaucc

SEQ ID NO: 1234429 - RNA, 19 nt, Human
ccccuccccugccuuuccc

SEQ ID NO: 1234430 - RNA, 19 nt, Human
cccugggcgggguuuccag

SEQ ID NO: 1234431 - RNA, 20 nt, Human
ccgcgcucccuccucgacug

SEQ ID NO: 1234432 - RNA, 19 nt, Human
ccggagaggcugcgcggaa

SEQ ID NO: 1234433 - RNA, 19 nt, Human
ccucccaccaucccccacc

SEQ ID NO: 1234434 - RNA, 20 nt, Human
ccucgcccugaucugagccu

SEQ ID NO: 1234435 - RNA, 18 nt, Human
ccucucuggacaagcagc

SEQ ID NO: 1234436 - RNA, 22 nt, Human
ccucugagaaucugugugucug

SEQ ID NO: 1234437 - RNA, 25 nt, Human
ccucugggcuuccagggagcuuugg

SEQ ID NO: 1234438 - RNA, 19 nt, Human
ccuggcuuccuguccccuc

SEQ ID NO: 1234439 - RNA, 20 nt, Human
ccuuccccgacccucggggc

SEQ ID NO: 1234440 - RNA, 24 nt, Human
cgccgggcagaacuuccucccgga

SEQ ID NO: 1234441 - RNA, 20 nt, Human
cgcgguuggggagagggagc

SEQ ID NO: 1234442 - RNA, 18 nt, Human
cggcugggcgggccucag

SEQ ID NO: 1234443 - RNA, 19 nt, Human
cgguguccuggcuuccugu

SEQ ID NO: 1234444 - RNA, 21 nt, Human
cgguuccuuccccgacccucg

SEQ ID NO: 1234445 - RNA, 25 nt, Human
cucagaacaaccuccaggaguccag

SEQ ID NO: 1234446 - RNA, 30 nt, Human
cuccucgacugugcggcucccgcgcugccu

SEQ ID NO: 1234447 - RNA, 18 nt, Human
cucugcuaggcauugccc

SEQ ID NO: 1234448 - RNA, 21 nt, Human
cucugggcuuccagggagcuu

SEQ ID NO: 1234449 - RNA, 21 nt, Human
cucuugacaccaccuccuggg

SEQ ID NO: 1234450 - RNA, 18 nt, Human
cugagccuugguggcacc

SEQ ID NO: 1234451 - RNA, 18 nt, Human
cuugacaccaccuccugg

SEQ ID NO: 1234452 - RNA, 22 nt, Human
gaaaaacuccgagcgggauucc

SEQ ID NO: 1234453 - RNA, 20 nt, Human
gaagacgccacccccucccc

SEQ ID NO: 1234454 - RNA, 20 nt, Human
gagccggcgguggcugcagg

SEQ ID NO: 1234455 - RNA, 19 nt, Human
gagccugcacucacuccag

SEQ ID NO: 1234456 - RNA, 20 nt, Human
gaggaagaagggcccgcauc

SEQ ID NO: 1234457 - RNA, 24 nt, Human
gauugcccucccaccaucccccac

SEQ ID NO: 1234458 - RNA, 19 nt, Human
gcaccuggcugucuccagg

SEQ ID NO: 1234459 - RNA, 23 nt, Human
gcccugggcgggguuuccagggg

SEQ ID NO: 1234460 - RNA, 22 nt, Human
gccucucuggacaagcagccuc

SEQ ID NO: 1234461 - RNA, 20 nt, Human
gccuuucccggagcagcccg

SEQ ID NO: 1234462 - RNA, 19 nt, Human
gcgggccucagggagccca

SEQ ID NO: 1234463 - RNA, 23 nt, Human
gcggggcugagauggugggacug

SEQ ID NO: 1234464 - RNA, 19 nt, Human
gcucgaugucucgggcugg

SEQ ID NO: 1234465 - RNA, 19 nt, Human
gcugggugggcggagccgg

SEQ ID NO: 1234466 - RNA, 19 nt, Human
ggacuggggagggcgggag

SEQ ID NO: 1234467 - RNA, 25 nt, Human
ggacuggggcugggcugcgguugcg

SEQ ID NO: 1234468 - RNA, 20 nt, Human
ggcauugcccaccugugagu

SEQ ID NO: 1234469 - RNA, 21 nt, Human
ggccgggccagcgccugagga

SEQ ID NO: 1234470 - RNA, 20 nt, Human
ggcggagccggcgguggcug

SEQ ID NO: 1234471 - RNA, 18 nt, Human
gggauccugggccgcacc

SEQ ID NO: 1234472 - RNA, 28 nt, Human
gggcagaacuuccucccggacuggggcu

SEQ ID NO: 1234473 - RNA, 22 nt, Human
gggccgggccagcgccugagga

SEQ ID NO: 1234474 - RNA, 22 nt, Human
gguggcugcagguuaggccccu

SEQ ID NO: 1234475 - RNA, 23 nt, Human
guccuggcuuccuguccccucug

SEQ ID NO: 1234476 - RNA, 24 nt, Human
uacaagccacagccccagcacacc

SEQ ID NO: 1234477 - RNA, 20 nt, Human
uaguaaguaaggaacucccu

SEQ ID NO: 1234478 - RNA, 20 nt, Human
uaguaaguaaggaacucccu

SEQ ID NO: 1234479 - RNA, 24 nt, Human
uccacacuuccucugagaaucugu

SEQ ID NO: 1234480 - RNA, 19 nt, Human
uccagggagcuuuggagcu

SEQ ID NO: 1234481 - RNA, 22 nt, Human
ucccaccaucccccacccccuc

SEQ ID NO: 1234482 - RNA, 21 nt, Human
uccgccuugggggucuucugu

SEQ ID NO: 1234483 - RNA, 19 nt, Human
uccucccggacuggggcug

SEQ ID NO: 1234484 - RNA, 21 nt, Human
ucucuugacaccaccuccugg

SEQ ID NO: 1234485 - RNA, 19 nt, Human
ucuugacaccaccuccugg

SEQ ID NO: 1234486 - RNA, 21 nt, Human
ugagauggugggacuggggag

SEQ ID NO: 1234487 - RNA, 18 nt, Human
ugaucugagccugcacuc

SEQ ID NO: 1234488 - RNA, 22 nt, Human
ugcggggcugagauggugggac

SEQ ID NO: 1234489 - RNA, 24 nt, Human
uggcugucuccagggagaaagagg

SEQ ID NO: 1234490 - RNA, 25 nt, Human
ugggaagcugaaucuggccacccag

SEQ ID NO: 1234491 - RNA, 27 nt, Human
ugggacuggggagggcgggagccuccc

SEQ ID NO: 1234492 - RNA, 19 nt, Human
ugggaggaagaagggcccg

SEQ ID NO: 1234493 - RNA, 23 nt, Human
ugggccgcaccuggcugucucca

SEQ ID NO: 1234494 - RNA, 23 nt, Human
ugggcggagccggcgguggcugc

SEQ ID NO: 1234495 - RNA, 21 nt, Human
ugucugagccuugguggcacc

SEQ ID NO: 1234496 - RNA, 18 nt, Human
ugugccuguggaccuggc

SEQ ID NO: 1234497 - RNA, 20 nt, Human
ugugcggcucccgcgcugcc

SEQ ID NO: 1234498 - RNA, 21 nt, Human
ugugugccaagagcuggcuga

SEQ ID NO: 1234499 - RNA, 21 nt, Human
uucugggaggaagaagggccc

SEQ ID NO: 1234500 - RNA, 21 nt, Human
aaagccccaggucauuuccag

SEQ ID NO: 1234501 - RNA, 21 nt, Human
agagcucccugagccugagca

SEQ ID NO: 1234502 - RNA, 19 nt, Human
agaguauuuauuuggccuu

SEQ ID NO: 1234503 - RNA, 23 nt, Human
agccaaaagcuucacucaauguu

SEQ ID NO: 1234504 - RNA, 21 nt, Human
agcccugggaagguuuugggg

SEQ ID NO: 1234505 - RNA, 21 nt, Human
aggcaguuucuucagccgccu

SEQ ID NO: 1234506 - RNA, 23 nt, Human
aucaccucucuggcucuggauuc

SEQ ID NO: 1234507 - RNA, 24 nt, Human
aucaccucucuggcucuggauucc

SEQ ID NO: 1234508 - RNA, 27 nt, Human
aucaccucucuggcucuggauuccuac

SEQ ID NO: 1234509 - RNA, 24 nt, Human
caccaauaucaccucucuggcucu

SEQ ID NO: 1234510 - RNA, 25 nt, Human
caccuggagagucuuccugcagggg

SEQ ID NO: 1234511 - RNA, 22 nt, Human
cagggccaaccccagggcugga

SEQ ID NO: 1234512 - RNA, 23 nt, Human
cccugagccugagcagagggccc

SEQ ID NO: 1234513 - RNA, 23 nt, Human
ccugcagggccaaccccagggcu

SEQ ID NO: 1234514 - RNA, 21 nt, Human
cucauaauggccacccccucc

SEQ ID NO: 1234515 - RNA, 19 nt, Human
cugagccugagcagagggc

SEQ ID NO: 1234516 - RNA, 21 nt, Human
cugcagggccaaccccagggc

SEQ ID NO: 1234517 - RNA, 20 nt, Human
cuggcucuggauuccuaccu

SEQ ID NO: 1234518 - RNA, 19 nt, Human
cuguggccggagcacugcc

SEQ ID NO: 1234519 - RNA, 24 nt, Human
gggacagagcccugggaagguuuu

SEQ ID NO: 1234520 - RNA, 18 nt, Human
uacagccaaaagcuucac

SEQ ID NO: 1234521 - RNA, 26 nt, Human
uacccugccauccuagccauuagugg

SEQ ID NO: 1234522 - RNA, 23 nt, Human
ucaaaaagccccaggucauuucc

SEQ ID NO: 1234523 - RNA, 18 nt, Human
ucccugagccugagcaga

SEQ ID NO: 1234524 - RNA, 20 nt, Human
ucucuggcucuggauuccua

SEQ ID NO: 1234525 - RNA, 23 nt, Human
ucuuccugcagggccaaccccag

SEQ ID NO: 1234526 - RNA, 18 nt, Human
ugaaaugggaacuuccuu

SEQ ID NO: 1234527 - RNA, 20 nt, Human
ugaaaugggaacuuccuuua

SEQ ID NO: 1234528 - RNA, 19 nt, Human
ugcaauugguguuuucagc

SEQ ID NO: 1234529 - RNA, 26 nt, Human
ugcaccaauaucaccucucuggcucu

SEQ ID NO: 1234530 - RNA, 18 nt, Human
ugcagggccaaccccagg

SEQ ID NO: 1234531 - RNA, 23 nt, Human
uggccacccccuccccacugccc

SEQ ID NO: 1234532 - RNA, 21 nt, Human
uggccggagcacugccaacaa

SEQ ID NO: 1234533 - RNA, 23 nt, Human
uggcucauagggaauuaaggguc

SEQ ID NO: 1234534 - RNA, 19 nt, Human
uggcucuggauuccuaccu

SEQ ID NO: 1234535 - RNA, 30 nt, Human
ugggaagguuuuggggguagagcccagggg

SEQ ID NO: 1234536 - RNA, 22 nt, Human
ugucagagggccccuguccuag

SEQ ID NO: 1234537 - RNA, 18 nt, Human
uuagaaugugcccuaccc

SEQ ID NO: 1234538 - RNA, 19 nt, Human
uucagccgccuacccugcc

SEQ ID NO: 1234539 - RNA, 18 nt, Human
uuuauuuggccuucugcc

SEQ ID NO: 1234540 - RNA, 20 nt, Human
aacccccuccccuggcucca

SEQ ID NO: 1234541 - RNA, 18 nt, Human
aaggaccccaagaccauc

SEQ ID NO: 1234542 - RNA, 19 nt, Human
acccccuccccuggcucca

SEQ ID NO: 1234543 - RNA, 18 nt, Human
cacagccucacuucuccc

SEQ ID NO: 1234544 - RNA, 23 nt, Human
cacagcucauacauccaaagcac

SEQ ID NO: 1234545 - RNA, 18 nt, Human
cacaguggaaggcagggc

SEQ ID NO: 1234546 - RNA, 22 nt, Human
cagccucacuucucccaccugc

SEQ ID NO: 1234547 - RNA, 23 nt, Human
cagucacagccucacuucuccca

SEQ ID NO: 1234548 - RNA, 18 nt, Human
caguggaaggcagggcug

SEQ ID NO: 1234549 - RNA, 21 nt, Human
cccaacccccuccccuggcuc

SEQ ID NO: 1234550 - RNA, 26 nt, Human
cccaacccccuccccuggcuccaacc

SEQ ID NO: 1234551 - RNA, 21 nt, Human
cccaagaccaucauccucgac

SEQ ID NO: 1234552 - RNA, 19 nt, Human
ccccaacccccuccccugg

SEQ ID NO: 1234553 - RNA, 18 nt, Human
ccccccaacccccucccc

SEQ ID NO: 1234554 - RNA, 24 nt, Human
ccccccaacccccuccccuggcuc

SEQ ID NO: 1234555 - RNA, 22 nt, Human
cccccuccccuggcuccaaccc

SEQ ID NO: 1234556 - RNA, 21 nt, Human
ccccuggcuccaaccccaguc

SEQ ID NO: 1234557 - RNA, 23 nt, Human
cccuccccuggcuccaaccccag

SEQ ID NO: 1234558 - RNA, 21 nt, Human
cccucugcugcccugcccccc

SEQ ID NO: 1234559 - RNA, 23 nt, Human
cccugccccccaacccccucccc

SEQ ID NO: 1234560 - RNA, 27 nt, Human
ccucccucugcugcccugccccccaac

SEQ ID NO: 1234561 - RNA, 20 nt, Human
ccucgacucuuccccuuccu

SEQ ID NO: 1234562 - RNA, 19 nt, Human
ccugccugcucucuucagg

SEQ ID NO: 1234563 - RNA, 24 nt, Human
ccuggcuccaaccccagucacagc

SEQ ID NO: 1234564 - RNA, 22 nt, Human
cuaauggacagacagacagacu

SEQ ID NO: 1234565 - RNA, 20 nt, Human
cuccaaccccagucacagcc

SEQ ID NO: 1234566 - RNA, 19 nt, Human
cuccccuggcuccaacccc

SEQ ID NO: 1234567 - RNA, 21 nt, Human
cuccccuggcuccaaccccag

SEQ ID NO: 1234568 - RNA, 18 nt, Human
cucccucugcugcccugc

SEQ ID NO: 1234569 - RNA, 19 nt, Human
cucuucagggucccucccu

SEQ ID NO: 1234570 - RNA, 23 nt, Human
cugcugcccugccccccaacccc

SEQ ID NO: 1234571 - RNA, 26 nt, Human
cugugcccugccugcucucuucaggg

SEQ ID NO: 1234572 - RNA, 23 nt, Human
cuuggccuuugcccuuaauuggc

SEQ ID NO: 1234573 - RNA, 19 nt, Human
gaacaagaugacaaagccc

SEQ ID NO: 1234574 - RNA, 20 nt, Human
gacaaagcccaaggacccca

SEQ ID NO: 1234575 - RNA, 20 nt, Human
gacugggaacaagaugacaa

SEQ ID NO: 1234576 - RNA, 21 nt, Human
gagcacaguggaaggcagggc

SEQ ID NO: 1234577 - RNA, 22 nt, Human
gaggugagucuuggccuuugcc

SEQ ID NO: 1234578 - RNA, 22 nt, Human
gcuaauggacagacagacagac

SEQ ID NO: 1234579 - RNA, 24 nt, Human
ggguaggcccugggaaggggaggu

SEQ ID NO: 1234580 - RNA, 20 nt, Human
guaggcccugggaaggggag

SEQ ID NO: 1234581 - RNA, 20 nt, Human
ucauccucgacucuuccccu

SEQ ID NO: 1234582 - RNA, 21 nt, Human
ucuccagccugcucugcugug

SEQ ID NO: 1234583 - RNA, 18 nt, Human
ugcccugccccccaaccc

SEQ ID NO: 1234584 - RNA, 19 nt, Human
ugcccugccccccaacccc

SEQ ID NO: 1234585 - RNA, 24 nt, Human
ugcccugccccccaacccccuccc

SEQ ID NO: 1234586 - RNA, 22 nt, Human
uggaaggcagggcugggccccu

SEQ ID NO: 1234587 - RNA, 24 nt, Human
uggacagacagacagacugggaac

SEQ ID NO: 1234588 - RNA, 21 nt, Human
uggcuccaaccccagucacag

SEQ ID NO: 1234589 - RNA, 24 nt, Human
uggcuccaaccccagucacagccu

SEQ ID NO: 1234590 - RNA, 25 nt, Human
ugggaacaagaugacaaagcccaag

SEQ ID NO: 1234591 - RNA, 22 nt, Human
ugggaaggggaggugagucuug

SEQ ID NO: 1234592 - RNA, 20 nt, Human
aaagugcugggauuacaggg

SEQ ID NO: 1234593 - RNA, 24 nt, Human
aaagugcugggauuacagggguga

SEQ ID NO: 1234594 - RNA, 20 nt, Human
aaccacaggcaggauaaaga

SEQ ID NO: 1234595 - RNA, 24 nt, Human
aaguaaucgacccgccuuggccuc

SEQ ID NO: 1234596 - RNA, 18 nt, Human
aagugcugggauuacagg

SEQ ID NO: 1234597 - RNA, 21 nt, Human
aagugcugggauuacaggggu

SEQ ID NO: 1234598 - RNA, 26 nt, Human
aagugcugggauuacaggggugagcc

SEQ ID NO: 1234599 - RNA, 24 nt, Human
aauguuggccaggcuggucgugaa

SEQ ID NO: 1234600 - RNA, 25 nt, Human
acccgccuuggccucccaaagugcu

SEQ ID NO: 1234601 - RNA, 21 nt, Human
acugagcggccacucugguga

SEQ ID NO: 1234602 - RNA, 18 nt, Human
agccacugagcccagcca

SEQ ID NO: 1234603 - RNA, 25 nt, Human
aggcaggauaaagagcagccuccaa

SEQ ID NO: 1234604 - RNA, 25 nt, Human
aggcuggagugcaguggcacgaucu

SEQ ID NO: 1234605 - RNA, 20 nt, Human
agugcaguggcacgaucucg

SEQ ID NO: 1234606 - RNA, 23 nt, Human
agugcaguggcacgaucucggcu

SEQ ID NO: 1234607 - RNA, 24 nt, Human
agugcaguggcacgaucucggcuc

SEQ ID NO: 1234608 - RNA, 25 nt, Human
aucucaaccagugaggcccaucugc

SEQ ID NO: 1234609 - RNA, 18 nt, Human
augggguuucacaauguu

SEQ ID NO: 1234610 - RNA, 24 nt, Human
augggguuucacaauguuggccag

SEQ ID NO: 1234611 - RNA, 21 nt, Human
auucuccugccucagccuccc

SEQ ID NO: 1234612 - RNA, 24 nt, Human
caaagugcugggauuacaggggug

SEQ ID NO: 1234613 - RNA, 22 nt, Human
caagcaauucuccugccucagc

SEQ ID NO: 1234614 - RNA, 21 nt, Human
cacaauguuggccaggcuggu

SEQ ID NO: 1234615 - RNA, 22 nt, Human
cacaauguuggccaggcugguc

SEQ ID NO: 1234616 - RNA, 26 nt, Human
cacuccugcccccugguggcuggagg

SEQ ID NO: 1234617 - RNA, 23 nt, Human
caggcaggauaaagagcagccuc

SEQ ID NO: 1234618 - RNA, 19 nt, Human
ccaaagugcugggauuaca

SEQ ID NO: 1234619 - RNA, 21 nt, Human
ccaaagugcugggauuacagg

SEQ ID NO: 1234620 - RNA, 24 nt, Human
ccaaagugcugggauuacaggggu

SEQ ID NO: 1234621 - RNA, 24 nt, Human
ccccggguagcugggauuacaggc

SEQ ID NO: 1234622 - RNA, 23 nt, Human
cccggguagcugggauuacaggc

SEQ ID NO: 1234623 - RNA, 24 nt, Human
cccggguagcugggauuacaggca

SEQ ID NO: 1234624 - RNA, 27 nt, Human
ccgccuucugaguucaagcaauucuuu

SEQ ID NO: 1234625 - RNA, 24 nt, Human
ccggguagcugggauuacaggcau

SEQ ID NO: 1234626 - RNA, 20 nt, Human
ccugaccucaaguaaucgac

SEQ ID NO: 1234627 - RNA, 24 nt, Human
ccuucugaguucaagcaauucucc

SEQ ID NO: 1234628 - RNA, 22 nt, Human
cgagauggagucuugcucuguu

SEQ ID NO: 1234629 - RNA, 23 nt, Human
cugcagccuccgccuucugaguu

SEQ ID NO: 1234630 - RNA, 24 nt, Human
cugccucagccuccccggguagcu

SEQ ID NO: 1234631 - RNA, 24 nt, Human
gaccucaaguaaucgacccgccuu

SEQ ID NO: 1234632 - RNA, 22 nt, Human
gagcugaaaaccacaggcagga

SEQ ID NO: 1234633 - RNA, 20 nt, Human
gaguucaagcaauucuccug

SEQ ID NO: 1234634 - RNA, 18 nt, Human
gauuacaggcaugugcca

SEQ ID NO: 1234635 - RNA, 22 nt, Human
gauuacaggcaugugccacuac

SEQ ID NO: 1234636 - RNA, 18 nt, Human
gauuacaggggugagcca

SEQ ID NO: 1234637 - RNA, 18 nt, Human
gcagagaugggguuucac

SEQ ID NO: 1234638 - RNA, 22 nt, Human
gccuuggccucccaaagugcug

SEQ ID NO: 1234639 - RNA, 19 nt, Human
gcuggagugcaguggcacg

SEQ ID NO: 1234640 - RNA, 23 nt, Human
gcuggucgugaacuccugaccuc

SEQ ID NO: 1234641 - RNA, 19 nt, Human
ggauuacaggcaugugcca

SEQ ID NO: 1234642 - RNA, 19 nt, Human
ggccaggcuggucgugaac

SEQ ID NO: 1234643 - RNA, 24 nt, Human
ggcuggucgugaacuccugaccuc

SEQ ID NO: 1234644 - RNA, 20 nt, Human
gggaauuuuuuuuuuuuuuu

SEQ ID NO: 1234645 - RNA, 29 nt, Human
gggguggggaauuuuuuuuuuuuuucuuc

SEQ ID NO: 1234646 - RNA, 18 nt, Human
gggguuucacaauguugg

SEQ ID NO: 1234647 - RNA, 22 nt, Human
gggguuucacaauguuggccag

SEQ ID NO: 1234648 - RNA, 22 nt, Human
ggguuucacaauguuggccagg

SEQ ID NO: 1234649 - RNA, 24 nt, Human
guaaucgacccgccuuggccuccc

SEQ ID NO: 1234650 - RNA, 18 nt, Human
guagcugggauuacaggc

SEQ ID NO: 1234651 - RNA, 19 nt, Human
guagcugggauuacaggca

SEQ ID NO: 1234652 - RNA, 22 nt, Human
guagcugggauuacaggcaugu

SEQ ID NO: 1234653 - RNA, 19 nt, Human
gugagccacugagcccagc

SEQ ID NO: 1234654 - RNA, 19 nt, Human
guugaccaggcuggagugc

SEQ ID NO: 1234655 - RNA, 21 nt, Human
uaaagagcagccuccaagagc

SEQ ID NO: 1234656 - RNA, 20 nt, Human
uaacuuauaaauagaagucc

SEQ ID NO: 1234657 - RNA, 24 nt, Human
uaacuuuuguauuuuuggcagaga

SEQ ID NO: 1234658 - RNA, 23 nt, Human
uacaggcaugugccacuacgccc

SEQ ID NO: 1234659 - RNA, 18 nt, Human
uacaggggugagccacug

SEQ ID NO: 1234660 - RNA, 19 nt, Human
uacaggggugagccacuga

SEQ ID NO: 1234661 - RNA, 24 nt, Human
uacaggggugagccacugagccca

SEQ ID NO: 1234662 - RNA, 18 nt, Human
ucacugcagccuccgccu

SEQ ID NO: 1234663 - RNA, 18 nt, Human
ucacugcagccuccgccu

SEQ ID NO: 1234664 - RNA, 19 nt, Human
ucacugcagccuccgccuu

SEQ ID NO: 1234665 - RNA, 22 nt, Human
ucacugcagccuccgccuucug

SEQ ID NO: 1234666 - RNA, 24 nt, Human
ucacugcagccuccgccuucugag

SEQ ID NO: 1234667 - RNA, 25 nt, Human
ucacugcagccuccgccuucugagu

SEQ ID NO: 1234668 - RNA, 22 nt, Human
ucaucuaagcaacucuggucau

SEQ ID NO: 1234669 - RNA, 23 nt, Human
ucccaaagugcugggauuacagg

SEQ ID NO: 1234670 - RNA, 22 nt, Human
uccgccuucugaguucaagccg

SEQ ID NO: 1234671 - RNA, 26 nt, Human
ucuccugccucagccuccccggguag

SEQ ID NO: 1234672 - RNA, 20 nt, Human
ucugaguucaagcaauucuc

SEQ ID NO: 1234673 - RNA, 23 nt, Human
ucugaguucaagcaauucuccug

SEQ ID NO: 1234674 - RNA, 19 nt, Human
ucuguugaccaggcuggag

SEQ ID NO: 1234675 - RNA, 24 nt, Human
ucuguugaccaggcuggagugcag

SEQ ID NO: 1234676 - RNA, 23 nt, Human
ucuugcucuguugaccaggcugg

SEQ ID NO: 1234677 - RNA, 24 nt, Human
ucuugcucuguugaccaggcugga

SEQ ID NO: 1234678 - RNA, 24 nt, Human
ugaccaggcuggagugcaguggca

SEQ ID NO: 1234679 - RNA, 20 nt, Human
ugaccucaaguaaucgaccc

SEQ ID NO: 1234680 - RNA, 21 nt, Human
ugaccucaaguaaucgacccg

SEQ ID NO: 1234681 - RNA, 25 nt, Human
ugaccucaaguaaucgacccgccuu

SEQ ID NO: 1234682 - RNA, 21 nt, Human
ugaguucaagcaauucuccug

SEQ ID NO: 1234683 - RNA, 24 nt, Human
ugaguucaagcaauucuccugccu

SEQ ID NO: 1234684 - RNA, 22 nt, Human
ugcaguggcacgaucucggcuc

SEQ ID NO: 1234685 - RNA, 25 nt, Human
ugccucagccuccccggguagcugg

SEQ ID NO: 1234686 - RNA, 23 nt, Human
uggagugcaguggcacgaucucg

SEQ ID NO: 1234687 - RNA, 24 nt, Human
uggagugcaguggcacgaucucgg

SEQ ID NO: 1234688 - RNA, 24 nt, Human
uggcagagaugggguuucacaaug

SEQ ID NO: 1234689 - RNA, 24 nt, Human
uggccaggcuggucgugaacuccu

SEQ ID NO: 1234690 - RNA, 22 nt, Human
uggcgggcugggcacugagcgg

SEQ ID NO: 1234691 - RNA, 19 nt, Human
uggcuggagggagcggcag

SEQ ID NO: 1234692 - RNA, 18 nt, Human
ugggauuacaggcaugug

SEQ ID NO: 1234693 - RNA, 21 nt, Human
ugggauuacaggcaugugcca

SEQ ID NO: 1234694 - RNA, 22 nt, Human
ugggauuacaggcaugugccac

SEQ ID NO: 1234695 - RNA, 22 nt, Human
ugggauuacaggcaugugccac

SEQ ID NO: 1234696 - RNA, 24 nt, Human
ugggauuacaggcaugugccacua

SEQ ID NO: 1234697 - RNA, 24 nt, Human
ugggauuacaggcaugugccacua

SEQ ID NO: 1234698 - RNA, 19 nt, Human
ugggauuacaggggugagc

SEQ ID NO: 1234699 - RNA, 22 nt, Human
ugggauuacaggggugagccac

SEQ ID NO: 1234700 - RNA, 22 nt, Human
ugggauuacaggggugagccac

SEQ ID NO: 1234701 - RNA, 24 nt, Human
ugggauuacaggggugagccacug

SEQ ID NO: 1234702 - RNA, 24 nt, Human
ugggguuucacaauguuggccagg

SEQ ID NO: 1234703 - RNA, 21 nt, Human
uucaagcaauucuccugccuc

SEQ ID NO: 1234704 - RNA, 24 nt, Human
uucaagcaauucuccugccucagc

SEQ ID NO: 1234705 - RNA, 25 nt, Human
uucacaauguuggccaggcuggucg

SEQ ID NO: 1234706 - RNA, 18 nt, Human
uuggccucccaaagugcu

SEQ ID NO: 1234707 - RNA, 21 nt, Human
uuggcuuuacgaaaucaagag

SEQ ID NO: 1234708 - RNA, 23 nt, Human
uuguauuuuuggcagagaugggg

SEQ ID NO: 1234709 - RNA, 21 nt, Human
uuucacaauguuggccaggcu

SEQ ID NO: 1234710 - RNA, 22 nt, Human
uuucacaauguuggccaggcug

SEQ ID NO: 1234711 - RNA, 24 nt, Human
uuuuuggcagagaugggguuucac

SEQ ID NO: 1234712 - RNA, 18 nt, Human
uuuuuuuuuucuucgaga

SEQ ID NO: 1234713 - RNA, 23 nt, Human
uuuuuuuuuuuuuucuucgagau

SEQ ID NO: 1234714 - RNA, 20 nt, Human
uuuuuuuuuuuuuucuucgg

SEQ ID NO: 1234715 - RNA, 25 nt, Human
caguaaagucuuuucucucuggcuu

SEQ ID NO: 1234716 - RNA, 26 nt, Human
ccagcaucaucaucugacccuuccuc

SEQ ID NO: 1234717 - RNA, 21 nt, Human
ccagugguaggcacuuucucu

SEQ ID NO: 1234718 - RNA, 25 nt, Human
cccccauucuuccucagaggguucc

SEQ ID NO: 1234719 - RNA, 19 nt, Human
ccucccagugguaggcacu

SEQ ID NO: 1234720 - RNA, 29 nt, Human
ccucccagugguaggcacuuucucucccc

SEQ ID NO: 1234721 - RNA, 24 nt, Human
ccuuaaucucuccucucuccaucu

SEQ ID NO: 1234722 - RNA, 18 nt, Human
cucugcucaucucucccc

SEQ ID NO: 1234723 - RNA, 21 nt, Human
cucugcucaucucuccccacu

SEQ ID NO: 1234724 - RNA, 20 nt, Human
gcacuuucucuccugggucc

SEQ ID NO: 1234725 - RNA, 20 nt, Human
ucagcaguaaagucuuuucu

SEQ ID NO: 1234726 - RNA, 22 nt, Human
ucaucaucugacccuuccucug

SEQ ID NO: 1234727 - RNA, 23 nt, Human
ucaucucuccccacuuaggucuc

SEQ ID NO: 1234728 - RNA, 24 nt, Human
ucccaccuuagcuuugagucucaa

SEQ ID NO: 1234729 - RNA, 22 nt, Human
ucccccauucuuccucagaggg

SEQ ID NO: 1234730 - RNA, 18 nt, Human
ugggccccauggacaauu

SEQ ID NO: 1234731 - RNA, 20 nt, Human
ugguaggcacuuucucuccu

SEQ ID NO: 1234732 - RNA, 26 nt, Human
uucucucuggcuucuuucccccauuc

SEQ ID NO: 1234733 - RNA, 19 nt, Human
aagugacaggguaagagag

SEQ ID NO: 1234734 - RNA, 19 nt, Human
acagcccccuggaagagug

SEQ ID NO: 1234735 - RNA, 18 nt, Human
acaggacagaggagggga

SEQ ID NO: 1234736 - RNA, 19 nt, Human
accaggucuugaaugggcc

SEQ ID NO: 1234737 - RNA, 21 nt, Human
accccagccccacgauggccu

SEQ ID NO: 1234738 - RNA, 27 nt, Human
agagcucucccaccacacagcccuucg

SEQ ID NO: 1234739 - RNA, 26 nt, Human
agaggaggggagagggagaaggggau

SEQ ID NO: 1234740 - RNA, 21 nt, Human
agagggagaaggggauguuca

SEQ ID NO: 1234741 - RNA, 20 nt, Human
agcagaggggggauaagggc

SEQ ID NO: 1234742 - RNA, 22 nt, Human
aggacagaggaggggagaggga

SEQ ID NO: 1234743 - RNA, 22 nt, Human
aggagcuggagggguuuccaag

SEQ ID NO: 1234744 - RNA, 24 nt, Human
aggcaagcaggcaggcaggccucc

SEQ ID NO: 1234745 - RNA, 22 nt, Human
aggcaggcaggccuccuagcuc

SEQ ID NO: 1234746 - RNA, 25 nt, Human
agggaagcagagcuugcaccgccug

SEQ ID NO: 1234747 - RNA, 18 nt, Human
auggugccaguguccuca

SEQ ID NO: 1234748 - RNA, 19 nt, Human
caagcgggagcccccaggc

SEQ ID NO: 1234749 - RNA, 24 nt, Human
caccacacagcccccuggaagagu

SEQ ID NO: 1234750 - RNA, 22 nt, Human
caccccagccccacgauggccu

SEQ ID NO: 1234751 - RNA, 19 nt, Human
cagagcucucccaccacac

SEQ ID NO: 1234752 - RNA, 26 nt, Human
cagccccacgauggccugagggcaau

SEQ ID NO: 1234753 - RNA, 23 nt, Human
cagcccuggccucucugcccucu

SEQ ID NO: 1234754 - RNA, 22 nt, Human
cagcgcccagguccagccuccc

SEQ ID NO: 1234755 - RNA, 26 nt, Human
caggcaggcaggccuccuagcucccc

SEQ ID NO: 1234756 - RNA, 20 nt, Human
cagggugacccccaggucca

SEQ ID NO: 1234757 - RNA, 23 nt, Human
caguucugagcccacugauuccc

SEQ ID NO: 1234758 - RNA, 22 nt, Human
caucucgcccccugggacccac

SEQ ID NO: 1234759 - RNA, 19 nt, Human
ccacuggccucuuggggga

SEQ ID NO: 1234760 - RNA, 21 nt, Human
ccaggcugcuuucucugcgcu

SEQ ID NO: 1234761 - RNA, 24 nt, Human
ccaguguccucauaucuguuuccc

SEQ ID NO: 1234762 - RNA, 21 nt, Human
cccaccacacagcccccugga

SEQ ID NO: 1234763 - RNA, 23 nt, Human
cccagacuugccucagcccuggc

SEQ ID NO: 1234764 - RNA, 19 nt, Human
cccagccucccagacuugc

SEQ ID NO: 1234765 - RNA, 20 nt, Human
cccagguacagggugcuggc

SEQ ID NO: 1234766 - RNA, 22 nt, Human
cccagguccaggaacuuucggc

SEQ ID NO: 1234767 - RNA, 24 nt, Human
ccccaggaacucugugccaaacaa

SEQ ID NO: 1234768 - RNA, 22 nt, Human
ccccaggccucaucgguaacuc

SEQ ID NO: 1234769 - RNA, 18 nt, Human
ccccagguccaggaacuu

SEQ ID NO: 1234770 - RNA, 19 nt, Human
cccccagguuuugccucuc

SEQ ID NO: 1234771 - RNA, 18 nt, Human
ccccuccaccccagcccc

SEQ ID NO: 1234772 - RNA, 24 nt, Human
ccccucuugaguccuggcaaagac

SEQ ID NO: 1234773 - RNA, 19 nt, Human
ccccugggacccacaggac

SEQ ID NO: 1234774 - RNA, 19 nt, Human
cccuccgaagccccucucc

SEQ ID NO: 1234775 - RNA, 22 nt, Human
cccuccgaagccccucucccag

SEQ ID NO: 1234776 - RNA, 18 nt, Human
ccucagggccucuggcag

SEQ ID NO: 1234777 - RNA, 22 nt, Human
ccucagggccucuggcaggcaa

SEQ ID NO: 1234778 - RNA, 24 nt, Human
ccuccaccccagccccacgauggc

SEQ ID NO: 1234779 - RNA, 21 nt, Human
ccucccagacuugccucagcc

SEQ ID NO: 1234780 - RNA, 18 nt, Human
ccuccuagcuccccucca

SEQ ID NO: 1234781 - RNA, 19 nt, Human
ccucugaggaagcagcagg

SEQ ID NO: 1234782 - RNA, 20 nt, Human
ccucuugggggagcaggaca

SEQ ID NO: 1234783 - RNA, 19 nt, Human
ccugacccagccucccaga

SEQ ID NO: 1234784 - RNA, 19 nt, Human
ccugccaguucugagccca

SEQ ID NO: 1234785 - RNA, 20 nt, Human
ccugcugaaaugcccagccc

SEQ ID NO: 1234786 - RNA, 21 nt, Human
ccugcugaaaugcccagccca

SEQ ID NO: 1234787 - RNA, 21 nt, Human
ccuucaucugcuccuccccca

SEQ ID NO: 1234788 - RNA, 23 nt, Human
cuagcuccccuccaccccagccc

SEQ ID NO: 1234789 - RNA, 18 nt, Human
cuaggcccucucccuggg

SEQ ID NO: 1234790 - RNA, 23 nt, Human
cuccaccccagccccacgauggc

SEQ ID NO: 1234791 - RNA, 24 nt, Human
cuccaccccagccccacgauggcc

SEQ ID NO: 1234792 - RNA, 18 nt, Human
cuccccuccaccccagcc

SEQ ID NO: 1234793 - RNA, 23 nt, Human
cucugagcccuggggcccggccu

SEQ ID NO: 1234794 - RNA, 21 nt, Human
cucugugccaaacaaguccuc

SEQ ID NO: 1234795 - RNA, 18 nt, Human
cugagcccuggggcccgg

SEQ ID NO: 1234796 - RNA, 20 nt, Human
cugauucccugacaaugccu

SEQ ID NO: 1234797 - RNA, 21 nt, Human
cugccuggcuggggugagggc

SEQ ID NO: 1234798 - RNA, 24 nt, Human
cugggcagaugggaggagcuggag

SEQ ID NO: 1234799 - RNA, 19 nt, Human
cuggggucucccuuucugg

SEQ ID NO: 1234800 - RNA, 21 nt, Human
cuucacaugcaggugggcacc

SEQ ID NO: 1234801 - RNA, 25 nt, Human
cuuccuccaaggacauuuccuaaaa

SEQ ID NO: 1234802 - RNA, 24 nt, Human
cuugccucagcccuggccucucug

SEQ ID NO: 1234803 - RNA, 20 nt, Human
gaacacuuccuccaaggaca

SEQ ID NO: 1234804 - RNA, 18 nt, Human
gagcccuggggcccggcc

SEQ ID NO: 1234805 - RNA, 23 nt, Human
gaggagcuggagggguuuccaag

SEQ ID NO: 1234806 - RNA, 20 nt, Human
gaggccugugcccgcggagc

SEQ ID NO: 1234807 - RNA, 18 nt, Human
gauaagggcugaguccca

SEQ ID NO: 1234808 - RNA, 19 nt, Human
gcagaugggaggagcugga

SEQ ID NO: 1234809 - RNA, 24 nt, Human
gcaggacagagcucucccaccaca

SEQ ID NO: 1234810 - RNA, 18 nt, Human
gccucucugccuggcugg

SEQ ID NO: 1234811 - RNA, 22 nt, Human
gcugcagcgcccacuggccucu

SEQ ID NO: 1234812 - RNA, 20 nt, Human
gcugcuuucucugcgcuccu

SEQ ID NO: 1234813 - RNA, 24 nt, Human
gcuggccccagcccucaguguggc

SEQ ID NO: 1234814 - RNA, 18 nt, Human
ggagcuggccccagcccu

SEQ ID NO: 1234815 - RNA, 23 nt, Human
ggaggagcuggagggguuuccaa

SEQ ID NO: 1234816 - RNA, 18 nt, Human
ggcaaugggacagccuga

SEQ ID NO: 1234817 - RNA, 18 nt, Human
ggcccucucccugggguc

SEQ ID NO: 1234818 - RNA, 18 nt, Human
ggcucaggaggacuggcg

SEQ ID NO: 1234819 - RNA, 23 nt, Human
ggcugcugguaaacuccaccccc

SEQ ID NO: 1234820 - RNA, 22 nt, Human
gggcagaugggaggagcuggag

SEQ ID NO: 1234821 - RNA, 21 nt, Human
gggucucccuuucuggggucu

SEQ ID NO: 1234822 - RNA, 23 nt, Human
ggucagcagcuccuaggccuugg

SEQ ID NO: 1234823 - RNA, 23 nt, Human
guccucugucccuaucaguuccu

SEQ ID NO: 1234824 - RNA, 22 nt, Human
guggaagugguguccucugucc

SEQ ID NO: 1234825 - RNA, 22 nt, Human
guggagaggagccgcucccaca

SEQ ID NO: 1234826 - RNA, 18 nt, Human
uaacucugaccagugucc

SEQ ID NO: 1234827 - RNA, 18 nt, Human
uagcccaagugcagcgcc

SEQ ID NO: 1234828 - RNA, 25 nt, Human
uagcuccccuccaccccagccccac

SEQ ID NO: 1234829 - RNA, 19 nt, Human
uagcugccggggaccccca

SEQ ID NO: 1234830 - RNA, 23 nt, Human
uaucuguuucccuccgaagcccc

SEQ ID NO: 1234831 - RNA, 18 nt, Human
uccacccccauccaggga

SEQ ID NO: 1234832 - RNA, 21 nt, Human
ucccagacuugccucagcccu

SEQ ID NO: 1234833 - RNA, 21 nt, Human
ucccauggcccugccaccagg

SEQ ID NO: 1234834 - RNA, 20 nt, Human
ucccuggugaggccugugcc

SEQ ID NO: 1234835 - RNA, 21 nt, Human
uccgaagccccucucccagca

SEQ ID NO: 1234836 - RNA, 23 nt, Human
uccuaggccuuggcugguggaag

SEQ ID NO: 1234837 - RNA, 18 nt, Human
uccuggaagcgggacuag

SEQ ID NO: 1234838 - RNA, 20 nt, Human
ucugucccuaucaguuccug

SEQ ID NO: 1234839 - RNA, 18 nt, Human
ugaccaguguccuggaag

SEQ ID NO: 1234840 - RNA, 18 nt, Human
ugaggaguuuggcuggga

SEQ ID NO: 1234841 - RNA, 19 nt, Human
ugccaguucugagcccacu

SEQ ID NO: 1234842 - RNA, 24 nt, Human
ugccuggggcagaugggggagggc

SEQ ID NO: 1234843 - RNA, 20 nt, Human
uggaagaguggagaggagcc

SEQ ID NO: 1234844 - RNA, 18 nt, Human
uggcccagggaagcagag

SEQ ID NO: 1234845 - RNA, 24 nt, Human
uggccccagcccucaguguggccc

SEQ ID NO: 1234846 - RNA, 21 nt, Human
uggcgggcucaggaggacugg

SEQ ID NO: 1234847 - RNA, 24 nt, Human
uggcugguggaagugguguccucu

SEQ ID NO: 1234848 - RNA, 21 nt, Human
ugggaccaggcuagcccaagu

SEQ ID NO: 1234849 - RNA, 20 nt, Human
uggggucucccuuucugggg

SEQ ID NO: 1234850 - RNA, 22 nt, Human
uggugaggccugugcccgcgga

SEQ ID NO: 1234851 - RNA, 23 nt, Human
ugguggggcuggcgggcucagga

SEQ ID NO: 1234852 - RNA, 20 nt, Human
ugugccaaacaaguccucaa

SEQ ID NO: 1234853 - RNA, 22 nt, Human
uguggcccagggaagcagagcu

SEQ ID NO: 1234854 - RNA, 26 nt, Human
uguuucccuccgaagccccucuccca

SEQ ID NO: 1234855 - RNA, 23 nt, Human
uuccaagcgggagcccccaggcc

SEQ ID NO: 1234856 - RNA, 23 nt, Human
uuccuccaaggacauuuccuaaa

SEQ ID NO: 1234857 - RNA, 19 nt, Human
uugcugcagcgcccacugg

SEQ ID NO: 1234858 - RNA, 25 nt, Human
uugcugcagcgcccacuggccucuu

SEQ ID NO: 1234859 - RNA, 18 nt, Human
uuugccucucugccuggc

SEQ ID NO: 1234860 - RNA, 21 nt, Human
uuugccucucugccuggcugg

SEQ ID NO: 1234861 - RNA, 19 nt, Human
agcacacacacacacauau

SEQ ID NO: 1234862 - RNA, 25 nt, Human
cacacacacacacauauauaucuua

SEQ ID NO: 1234863 - RNA, 23 nt, Human
cacacacacacauauauaucuua

SEQ ID NO: 1234864 - RNA, 20 nt, Human
cauuuugguuauguguuuca

SEQ ID NO: 1234865 - RNA, 19 nt, Human
guagcacacacacacacau

SEQ ID NO: 1234866 - RNA, 27 nt, Human
uagcacacacacacacauauauaucuu

SEQ ID NO: 1234867 - RNA, 23 nt, Human
uauguagcacacacacacacagu

SEQ ID NO: 1234868 - RNA, 26 nt, Human
uauguagcacacacacacacauauag

SEQ ID NO: 1234869 - RNA, 26 nt, Human
uguagcacacacacacacauauauag

SEQ ID NO: 1234870 - RNA, 21 nt, Human
aggggcugcggagcccagugg

SEQ ID NO: 1234871 - RNA, 20 nt, Human
ugcccuuaguucuuggaucc

SEQ ID NO: 1234872 - RNA, 20 nt, Human
aaaaaaauggacaugguaga

SEQ ID NO: 1234873 - RNA, 24 nt, Human
aacacaaaaauaugacuauuugga

SEQ ID NO: 1234874 - RNA, 21 nt, Human
aacuuuauuucaguuuaaaca

SEQ ID NO: 1234875 - RNA, 18 nt, Human
acgacggcggcggcggcg

SEQ ID NO: 1234876 - RNA, 25 nt, Human
acgacggcggcggcggcggcugcuc

SEQ ID NO: 1234877 - RNA, 18 nt, Human
aguuuuaaagaucaggaa

SEQ ID NO: 1234878 - RNA, 23 nt, Human
caccuccgggcccucugaacucu

SEQ ID NO: 1234879 - RNA, 18 nt, Human
caccugaaaaaggucuca

SEQ ID NO: 1234880 - RNA, 18 nt, Human
cagggacagauaggagag

SEQ ID NO: 1234881 - RNA, 19 nt, Human
cauucuucauagcaguuuc

SEQ ID NO: 1234882 - RNA, 19 nt, Human
ccaaauaacuacacaucac

SEQ ID NO: 1234883 - RNA, 18 nt, Human
ccaccuccgggcccucug

SEQ ID NO: 1234884 - RNA, 19 nt, Human
ccucugaacuccgcugcgg

SEQ ID NO: 1234885 - RNA, 18 nt, Human
cuacacaucacugauuuc

SEQ ID NO: 1234886 - RNA, 21 nt, Human
cuucauagcaguuucauugcc

SEQ ID NO: 1234887 - RNA, 22 nt, Human
gaagucaccucagauaaacuga

SEQ ID NO: 1234888 - RNA, 19 nt, Human
gcggcggcggcggcugcuc

SEQ ID NO: 1234889 - RNA, 21 nt, Human
ggcggcggcggcugcucgagg

SEQ ID NO: 1234890 - RNA, 18 nt, Human
guagaauugcuacacacc

SEQ ID NO: 1234891 - RNA, 24 nt, Human
guagcaacgacggcggcggcggcg

SEQ ID NO: 1234892 - RNA, 22 nt, Human
uaaacaacaaagcaaaugauau

SEQ ID NO: 1234893 - RNA, 23 nt, Human
uaaacugagaaagugaugucuaa

SEQ ID NO: 1234894 - RNA, 25 nt, Human
uaaauguuaggaacaaugauaugca

SEQ ID NO: 1234895 - RNA, 22 nt, Human
uaacuacacaucacugauuucc

SEQ ID NO: 1234896 - RNA, 22 nt, Human
uaagguacaccuagaaauaaca

SEQ ID NO: 1234897 - RNA, 21 nt, Human
uaggagaguacagucauucuu

SEQ ID NO: 1234898 - RNA, 22 nt, Human
uauuaggauucaagaugguauu

SEQ ID NO: 1234899 - RNA, 19 nt, Human
ucaggaacaucuuuauggg

SEQ ID NO: 1234900 - RNA, 20 nt, Human
ucaguuagucagugccaaaa

SEQ ID NO: 1234901 - RNA, 25 nt, Human
ucugaacuccgcugcggcaguagca

SEQ ID NO: 1234902 - RNA, 22 nt, Human
ugagaaagugaugucuaaugcu

SEQ ID NO: 1234903 - RNA, 23 nt, Human
uggaaaauucuguuucuacuuaa

SEQ ID NO: 1234904 - RNA, 23 nt, Human
ugguaaguuccuuuuuaaugcuu

SEQ ID NO: 1234905 - RNA, 21 nt, Human
uucaagaugguauuuaaaauc

SEQ ID NO: 1234906 - RNA, 19 nt, Human
uugagccuggcugcugcug

SEQ ID NO: 1234907 - RNA, 21 nt, Human
uugcuacacaccugaaaaagg

SEQ ID NO: 1234908 - RNA, 19 nt, Human
uuuagaggaaacacaaaaa

SEQ ID NO: 1234909 - RNA, 18 nt, Human
uuuuuccucuuuaacuaa

SEQ ID NO: 1234910 - RNA, 20 nt, Human
aucuuggucucggucucauu

SEQ ID NO: 1234911 - RNA, 19 nt, Human
uaaaacugcaggaagaucu

SEQ ID NO: 1234912 - RNA, 20 nt, Human
aaaaaaguuuccauaaauag

SEQ ID NO: 1234913 - RNA, 24 nt, Human
aaaaauacaaaaauuagccaugug

SEQ ID NO: 1234914 - RNA, 23 nt, Human
aaagcaggagaaucgcuugaacc

SEQ ID NO: 1234915 - RNA, 20 nt, Human
aaaggagaaugaggagaagg

SEQ ID NO: 1234916 - RNA, 24 nt, Human
aaagugcugggauuacaggcguga

SEQ ID NO: 1234917 - RNA, 22 nt, Human
aacagccaacucuccuacauau

SEQ ID NO: 1234918 - RNA, 19 nt, Human
aacauggugaaacuccauc

SEQ ID NO: 1234919 - RNA, 20 nt, Human
aacauggugaaacuccaucu

SEQ ID NO: 1234920 - RNA, 21 nt, Human
aacauggugaaacuccaucuc

SEQ ID NO: 1234921 - RNA, 22 nt, Human
aacuagaacccagcugacuucc

SEQ ID NO: 1234922 - RNA, 18 nt, Human
aagaaggugcuucaucuu

SEQ ID NO: 1234923 - RNA, 19 nt, Human
aagaugaguucuggacaaa

SEQ ID NO: 1234924 - RNA, 19 nt, Human
aagcaaaaaugggaggaga

SEQ ID NO: 1234925 - RNA, 19 nt, Human
aagcaaaggugaaagcaga

SEQ ID NO: 1234926 - RNA, 21 nt, Human
aagcaaaggugaaagcagaaa

SEQ ID NO: 1234927 - RNA, 22 nt, Human
aagcaggagaaucgcuugaacc

SEQ ID NO: 1234928 - RNA, 24 nt, Human
aagcaggagaaucgcuugaaccug

SEQ ID NO: 1234929 - RNA, 25 nt, Human
aagcaggagaaucgcuugaaccugg

SEQ ID NO: 1234930 - RNA, 19 nt, Human
aagugcugggauuacaggc

SEQ ID NO: 1234931 - RNA, 19 nt, Human
aagugcugggauuacaggc

SEQ ID NO: 1234932 - RNA, 26 nt, Human
aagugcugggauuacaggcgugagcc

SEQ ID NO: 1234933 - RNA, 18 nt, Human
aaucgcuugaaccuggga

SEQ ID NO: 1234934 - RNA, 24 nt, Human
aaucgcuugaaccugggaggcaga

SEQ ID NO: 1234935 - RNA, 20 nt, Human
acaccccucuccuccccuua

SEQ ID NO: 1234936 - RNA, 21 nt, Human
acagcacuucuagggucaccu

SEQ ID NO: 1234937 - RNA, 26 nt, Human
acauuaaaggagaaugaggagaaggg

SEQ ID NO: 1234938 - RNA, 21 nt, Human
acauugcacuucagccugggc

SEQ ID NO: 1234939 - RNA, 23 nt, Human
acauugcacuucagccugggcaa

SEQ ID NO: 1234940 - RNA, 24 nt, Human
acauugcacuucagccugggcaac

SEQ ID NO: 1234941 - RNA, 24 nt, Human
accaacauggugaaacuccaucuc

SEQ ID NO: 1234942 - RNA, 23 nt, Human
accagaguaaaaggaaaagacug

SEQ ID NO: 1234943 - RNA, 19 nt, Human
acccaggcuggagugcagu

SEQ ID NO: 1234944 - RNA, 23 nt, Human
acccaggcuggagugcaguggug

SEQ ID NO: 1234945 - RNA, 19 nt, Human
accccucuccuccccuuag

SEQ ID NO: 1234946 - RNA, 23 nt, Human
accucggccucccaaagugcugg

SEQ ID NO: 1234947 - RNA, 20 nt, Human
accugcaaucccagcuacuc

SEQ ID NO: 1234948 - RNA, 23 nt, Human
accugcaaucccagcuacucagg

SEQ ID NO: 1234949 - RNA, 24 nt, Human
acuagaacccagcugacuuccccc

SEQ ID NO: 1234950 - RNA, 18 nt, Human
acucaacacagccauucc

SEQ ID NO: 1234951 - RNA, 18 nt, Human
acuccagcgccugcugug

SEQ ID NO: 1234952 - RNA, 18 nt, Human
acuccagcgccugcugug

SEQ ID NO: 1234953 - RNA, 24 nt, Human
acuccaucucuacuaaaaauacaa

SEQ ID NO: 1234954 - RNA, 21 nt, Human
acugcaagcucugccucccag

SEQ ID NO: 1234955 - RNA, 22 nt, Human
acuuugggaggccgaggugggg

SEQ ID NO: 1234956 - RNA, 23 nt, Human
agaaacaaucccuauuuaagagc

SEQ ID NO: 1234957 - RNA, 18 nt, Human
agaaacuccaucucaaaa

SEQ ID NO: 1234958 - RNA, 21 nt, Human
agaacccagcugacuuccccc

SEQ ID NO: 1234959 - RNA, 24 nt, Human
agaacuuugggaggccgagguggg

SEQ ID NO: 1234960 - RNA, 22 nt, Human
agaaucgcuugaaccugggagg

SEQ ID NO: 1234961 - RNA, 19 nt, Human
agacaguagcauacuuggc

SEQ ID NO: 1234962 - RNA, 24 nt, Human
agagguugcagugagccgagaucg

SEQ ID NO: 1234963 - RNA, 19 nt, Human
agcacgccuucccauccug

SEQ ID NO: 1234964 - RNA, 22 nt, Human
agccugaccaacauggugaaac

SEQ ID NO: 1234965 - RNA, 20 nt, Human
aggaaggauuugggccucag

SEQ ID NO: 1234966 - RNA, 22 nt, Human
aggagaagggagaguugacaag

SEQ ID NO: 1234967 - RNA, 21 nt, Human
aggcagagguugcagugagcc

SEQ ID NO: 1234968 - RNA, 24 nt, Human
aggcagagguugcagugagccgag

SEQ ID NO: 1234969 - RNA, 21 nt, Human
aggccgagguggggggaucac

SEQ ID NO: 1234970 - RNA, 23 nt, Human
aggccgagguggggggaucacug

SEQ ID NO: 1234971 - RNA, 25 nt, Human
aggcuggagugcaguggugcaaucu

SEQ ID NO: 1234972 - RNA, 21 nt, Human
agguggggggaucacugaggu

SEQ ID NO: 1234973 - RNA, 21 nt, Human
aggugguguagccaccauacc

SEQ ID NO: 1234974 - RNA, 20 nt, Human
aguaaaaggaaaagacugga

SEQ ID NO: 1234975 - RNA, 22 nt, Human
aguagagaugggguuucaccau

SEQ ID NO: 1234976 - RNA, 19 nt, Human
aguagcugggacuccaggc

SEQ ID NO: 1234977 - RNA, 23 nt, Human
agugcaguggugcaaucuuggcu

SEQ ID NO: 1234978 - RNA, 24 nt, Human
agugcaguggugcaaucuuggcuc

SEQ ID NO: 1234979 - RNA, 18 nt, Human
agugcugggauuacaggc

SEQ ID NO: 1234980 - RNA, 18 nt, Human
auaaaacacuguagcccc

SEQ ID NO: 1234981 - RNA, 18 nt, Human
auaaaacacuguagcccc

SEQ ID NO: 1234982 - RNA, 23 nt, Human
auacgaaaacgaguaaaagacca

SEQ ID NO: 1234983 - RNA, 24 nt, Human
aucgcaacauugcacuucagccug

SEQ ID NO: 1234984 - RNA, 18 nt, Human
augggguuucaccauguu

SEQ ID NO: 1234985 - RNA, 19 nt, Human
augggguuucaccauguua

SEQ ID NO: 1234986 - RNA, 20 nt, Human
augggguuucaccauguuag

SEQ ID NO: 1234987 - RNA, 24 nt, Human
augggguuucaccauguuagccag

SEQ ID NO: 1234988 - RNA, 24 nt, Human
auugcacuucagccugggcaacaa

SEQ ID NO: 1234989 - RNA, 25 nt, Human
auugcacuucagccugggcaacaag

SEQ ID NO: 1234990 - RNA, 24 nt, Human
caaagugcugggauuacaggcgug

SEQ ID NO: 1234991 - RNA, 24 nt, Human
caacauggugaaacuccaucucua

SEQ ID NO: 1234992 - RNA, 18 nt, Human
cacacauggagaagaggc

SEQ ID NO: 1234993 - RNA, 19 nt, Human
caccacacccagccucuuc

SEQ ID NO: 1234994 - RNA, 18 nt, Human
caccauguuagccaggau

SEQ ID NO: 1234995 - RNA, 22 nt, Human
caccauguuagccaggaugguc

SEQ ID NO: 1234996 - RNA, 24 nt, Human
caccauguuagccaggauggucuu

SEQ ID NO: 1234997 - RNA, 18 nt, Human
cacccaccaccaugccug

SEQ ID NO: 1234998 - RNA, 24 nt, Human
cacccaggcuggagugcaguggug

SEQ ID NO: 1234999 - RNA, 18 nt, Human
caccccucuccuccccuu

SEQ ID NO: 1235000 - RNA, 22 nt, Human
cacgccauucuccugccucagc

SEQ ID NO: 1235001 - RNA, 20 nt, Human
cacgccuucccauccugccc

SEQ ID NO: 1235002 - RNA, 24 nt, Human
cagaacuuugggaggccgaggugg

SEQ ID NO: 1235003 - RNA, 22 nt, Human
cagaguaaaaggaaaagacugg

SEQ ID NO: 1235004 - RNA, 18 nt, Human
cagccugggcaacaagag

SEQ ID NO: 1235005 - RNA, 20 nt, Human
caggacuccagcgccugcug

SEQ ID NO: 1235006 - RNA, 19 nt, Human
caggauauucagaagugcu

SEQ ID NO: 1235007 - RNA, 21 nt, Human
caguagcauacuuggcccugg

SEQ ID NO: 1235008 - RNA, 19 nt, Human
cauaccugcaaucccagcu

SEQ ID NO: 1235009 - RNA, 18 nt, Human
cauguuaaaucauuuccu

SEQ ID NO: 1235010 - RNA, 18 nt, Human
cauugcacuucagccugg

SEQ ID NO: 1235011 - RNA, 19 nt, Human
cauugcacuucagccuggg

SEQ ID NO: 1235012 - RNA, 20 nt, Human
cauugcacuucagccugggc

SEQ ID NO: 1235013 - RNA, 21 nt, Human
cauugcacuucagccugggca

SEQ ID NO: 1235014 - RNA, 24 nt, Human
cauugcacuucagccugggcaaca

SEQ ID NO: 1235015 - RNA, 20 nt, Human
ccaaagugcugggauuacag

SEQ ID NO: 1235016 - RNA, 22 nt, Human
ccaaagugcugggauuacaggc

SEQ ID NO: 1235017 - RNA, 22 nt, Human
ccaaagugcugggauuacaggc

SEQ ID NO: 1235018 - RNA, 24 nt, Human
ccaaagugcugggauuacaggcgu

SEQ ID NO: 1235019 - RNA, 18 nt, Human
ccaacucuccuacauaug

SEQ ID NO: 1235020 - RNA, 19 nt, Human
ccaacucuccuacauaugc

SEQ ID NO: 1235021 - RNA, 22 nt, Human
ccagcgccugcugugguggggu

SEQ ID NO: 1235022 - RNA, 21 nt, Human
ccaggcacccaccaccaugcc

SEQ ID NO: 1235023 - RNA, 20 nt, Human
cccagguucacgccauucuc

SEQ ID NO: 1235024 - RNA, 21 nt, Human
cccauccugcccugccggaac

SEQ ID NO: 1235025 - RNA, 21 nt, Human
ccccacagccguucuuaccua

SEQ ID NO: 1235026 - RNA, 21 nt, Human
cccccacagccguucuuaccu

SEQ ID NO: 1235027 - RNA, 18 nt, Human
cccugucuuuaugacacc

SEQ ID NO: 1235028 - RNA, 24 nt, Human
ccuaacauuaaaggagaaugagga

SEQ ID NO: 1235029 - RNA, 21 nt, Human
ccuaggcuacaaaccuguacu

SEQ ID NO: 1235030 - RNA, 23 nt, Human
ccucagacccugguggucccagg

SEQ ID NO: 1235031 - RNA, 18 nt, Human
ccucaggauauucagaag

SEQ ID NO: 1235032 - RNA, 24 nt, Human
ccugaccaacauggugaaacucca

SEQ ID NO: 1235033 - RNA, 21 nt, Human
ccugcaaucccagcuacucag

SEQ ID NO: 1235034 - RNA, 22 nt, Human
ccugccggaacaccccucuccu

SEQ ID NO: 1235035 - RNA, 25 nt, Human
ccugggaggcagagguugcagugag

SEQ ID NO: 1235036 - RNA, 24 nt, Human
cgagaccagccugaccaacauggu

SEQ ID NO: 1235037 - RNA, 21 nt, Human
cgaggacuccaaauuuucugu

SEQ ID NO: 1235038 - RNA, 23 nt, Human
cgagguggggggaucacugaggu

SEQ ID NO: 1235039 - RNA, 25 nt, Human
cuagaacccagcugacuucccccac

SEQ ID NO: 1235040 - RNA, 22 nt, Human
cucacacccauaaucccagaac

SEQ ID NO: 1235041 - RNA, 22 nt, Human
cucaccuaaauuucacaacaau

SEQ ID NO: 1235042 - RNA, 24 nt, Human
cucagccucccgaguagcugggac

SEQ ID NO: 1235043 - RNA, 22 nt, Human
cuccugaccucgugauccgccc

SEQ ID NO: 1235044 - RNA, 23 nt, Human
cucuccuccccuuagugaggaag

SEQ ID NO: 1235045 - RNA, 23 nt, Human
cugccucagccucccgaguagcu

SEQ ID NO: 1235046 - RNA, 22 nt, Human
cuguauuuuuaguagagauggg

SEQ ID NO: 1235047 - RNA, 23 nt, Human
cuguauuuuuaguagagaugggg

SEQ ID NO: 1235048 - RNA, 18 nt, Human
cugucacccaggcuggag

SEQ ID NO: 1235049 - RNA, 22 nt, Human
cuuaggacuccuaggcuacaaa

SEQ ID NO: 1235050 - RNA, 20 nt, Human
cuugaagucuccuugguggg

SEQ ID NO: 1235051 - RNA, 21 nt, Human
cuugcucugucacccaggcug

SEQ ID NO: 1235052 - RNA, 20 nt, Human
cuuguaagcgugagucccgc

SEQ ID NO: 1235053 - RNA, 24 nt, Human
gaaaaauuucaaaacacuuugcaa

SEQ ID NO: 1235054 - RNA, 20 nt, Human
gaaauccgagaacacucuuc

SEQ ID NO: 1235055 - RNA, 21 nt, Human
gaaggggggccggguguggug

SEQ ID NO: 1235056 - RNA, 24 nt, Human
gaauacuaaaggcaacugucacac

SEQ ID NO: 1235057 - RNA, 22 nt, Human
gaccucgugauccgcccaccuc

SEQ ID NO: 1235058 - RNA, 22 nt, Human
gaccucgugauccgcccaccuc

SEQ ID NO: 1235059 - RNA, 24 nt, Human
gaccucgugauccgcccaccucgg

SEQ ID NO: 1235060 - RNA, 26 nt, Human
gacuccagcgccugcugugguggggu

SEQ ID NO: 1235061 - RNA, 21 nt, Human
gagauggagucuugcucuguc

SEQ ID NO: 1235062 - RNA, 18 nt, Human
gagaugggguuucaccau

SEQ ID NO: 1235063 - RNA, 24 nt, Human
gagaugggguuucaccauguuagc

SEQ ID NO: 1235064 - RNA, 19 nt, Human
gaggacuccaaauuuucug

SEQ ID NO: 1235065 - RNA, 24 nt, Human
gagguggggggaucacugagguca

SEQ ID NO: 1235066 - RNA, 18 nt, Human
gagugcugacuuccucuc

SEQ ID NO: 1235067 - RNA, 23 nt, Human
gaucacugaggucagaaguucga

SEQ ID NO: 1235068 - RNA, 18 nt, Human
gauuacaggcgugagcca

SEQ ID NO: 1235069 - RNA, 21 nt, Human
gauuacaggcgugagccacca

SEQ ID NO: 1235070 - RNA, 22 nt, Human
gauuacaggcgugagccaccac

SEQ ID NO: 1235071 - RNA, 22 nt, Human
gcaagcucugccucccagguuc

SEQ ID NO: 1235072 - RNA, 20 nt, Human
gccucagccucccgaguagc

SEQ ID NO: 1235073 - RNA, 25 nt, Human
gccucccagguucacgccauucucc

SEQ ID NO: 1235074 - RNA, 21 nt, Human
gcucacugcaagcucugccuc

SEQ ID NO: 1235075 - RNA, 25 nt, Human
gcucugucacccaggcuggagugca

SEQ ID NO: 1235076 - RNA, 21 nt, Human
ggacuccuaggcuacaaaccu

SEQ ID NO: 1235077 - RNA, 19 nt, Human
ggauuacaggcgugagcca

SEQ ID NO: 1235078 - RNA, 20 nt, Human
gggccgggugugguggcuca

SEQ ID NO: 1235079 - RNA, 22 nt, Human
gggggccgggugugguggcuca

SEQ ID NO: 1235080 - RNA, 24 nt, Human
gggggccgggugugguggcucaca

SEQ ID NO: 1235081 - RNA, 22 nt, Human
gggguuucaccauguuagccag

SEQ ID NO: 1235082 - RNA, 20 nt, Human
ggucuugaucuccugaccuc

SEQ ID NO: 1235083 - RNA, 24 nt, Human
gguggcucacacccauaaucccag

SEQ ID NO: 1235084 - RNA, 23 nt, Human
ggugugguggcucacacccauaa

SEQ ID NO: 1235085 - RNA, 24 nt, Human
gguuucaccauguuagccaggaug

SEQ ID NO: 1235086 - RNA, 23 nt, Human
guagagaugggguuucaccaugu

SEQ ID NO: 1235087 - RNA, 24 nt, Human
gucuugcucugucacccaggcugg

SEQ ID NO: 1235088 - RNA, 24 nt, Human
gugagccaccacacccagccucuu

SEQ ID NO: 1235089 - RNA, 24 nt, Human
gugauccgcccaccucggccuccc

SEQ ID NO: 1235090 - RNA, 18 nt, Human
guggugggguaggguggg

SEQ ID NO: 1235091 - RNA, 19 nt, Human
guugcagugagccgagauc

SEQ ID NO: 1235092 - RNA, 21 nt, Human
guugcagugagccgagaucgc

SEQ ID NO: 1235093 - RNA, 21 nt, Human
uaaaaauacaaaaauuagcca

SEQ ID NO: 1235094 - RNA, 22 nt, Human
uaaagagggugaagcaaaaaug

SEQ ID NO: 1235095 - RNA, 23 nt, Human
uaaagagggugaagcaaaaaugg

SEQ ID NO: 1235096 - RNA, 22 nt, Human
uaaggugaaauccgagaacacu

SEQ ID NO: 1235097 - RNA, 24 nt, Human
uaauuuagaaacaaucccuauuua

SEQ ID NO: 1235098 - RNA, 28 nt, Human
uaauuuuuuucuguauuuuuaguagaga

SEQ ID NO: 1235099 - RNA, 23 nt, Human
uacacaaaccuaggugguguagc

SEQ ID NO: 1235100 - RNA, 24 nt, Human
uacaggcgugagccaccacaccca

SEQ ID NO: 1235101 - RNA, 24 nt, Human
uaccugcaaucccagcuacucagg

SEQ ID NO: 1235102 - RNA, 22 nt, Human
uagagaugggguuucaccaugu

SEQ ID NO: 1235103 - RNA, 20 nt, Human
uagcaugauccccaguuuaa

SEQ ID NO: 1235104 - RNA, 22 nt, Human
uagccccaaguuaaguucccuc

SEQ ID NO: 1235105 - RNA, 24 nt, Human
uaguagagaugggguuucaccaug

SEQ ID NO: 1235106 - RNA, 25 nt, Human
uaguagagaugggguuucaccaugu

SEQ ID NO: 1235107 - RNA, 18 nt, Human
uaugaaaugcaaacuagc

SEQ ID NO: 1235108 - RNA, 23 nt, Human
uauucacucaccuaaauuucaca

SEQ ID NO: 1235109 - RNA, 23 nt, Human
ucaacacagccauuccccuagaa

SEQ ID NO: 1235110 - RNA, 24 nt, Human
ucaccauguuagccaggauggucu

SEQ ID NO: 1235111 - RNA, 22 nt, Human
ucacccaggcuggagugcagug

SEQ ID NO: 1235112 - RNA, 21 nt, Human
ucaccuguguucagagaucua

SEQ ID NO: 1235113 - RNA, 25 nt, Human
ucacuaggugauuucaccauugugc

SEQ ID NO: 1235114 - RNA, 18 nt, Human
ucacugcaagcucugccu

SEQ ID NO: 1235115 - RNA, 18 nt, Human
ucacugcaagcucugccu

SEQ ID NO: 1235116 - RNA, 19 nt, Human
ucacugcaagcucugccuc

SEQ ID NO: 1235117 - RNA, 24 nt, Human
ucacugcaagcucugccucccagg

SEQ ID NO: 1235118 - RNA, 23 nt, Human
ucagccucccgaguagcugggac

SEQ ID NO: 1235119 - RNA, 23 nt, Human
ucauauauucacucaccuaaaag

SEQ ID NO: 1235120 - RNA, 19 nt, Human
uccaggcacccaccaccau

SEQ ID NO: 1235121 - RNA, 24 nt, Human
ucccaaagugcugggauuacaggc

SEQ ID NO: 1235122 - RNA, 21 nt, Human
ucccaaggaagucaccggacc

SEQ ID NO: 1235123 - RNA, 22 nt, Human
ucccaaggaagucaccggaccu

SEQ ID NO: 1235124 - RNA, 18 nt, Human
ucccaggacuccagcgcc

SEQ ID NO: 1235125 - RNA, 19 nt, Human
ucccagguucacgccauuc

SEQ ID NO: 1235126 - RNA, 20 nt, Human
ucccagguucacgccauucu

SEQ ID NO: 1235127 - RNA, 21 nt, Human
ucccagguucacgccauucuc

SEQ ID NO: 1235128 - RNA, 24 nt, Human
ucccagguucacgccauucuccug

SEQ ID NO: 1235129 - RNA, 19 nt, Human
ucccauccugcccugccgg

SEQ ID NO: 1235130 - RNA, 23 nt, Human
uccccaguuuaaaggugaggaaa

SEQ ID NO: 1235131 - RNA, 19 nt, Human
uccccuagaaguuacagca

SEQ ID NO: 1235132 - RNA, 24 nt, Human
ucccgaguagcugggacuccaggc

SEQ ID NO: 1235133 - RNA, 20 nt, Human
ucgcaacauugcacuucagc

SEQ ID NO: 1235134 - RNA, 18 nt, Human
ucgcuugaaccugggagg

SEQ ID NO: 1235135 - RNA, 18 nt, Human
ucggccucccaaagugcu

SEQ ID NO: 1235136 - RNA, 23 nt, Human
ucuacauauagaaagcuagggac

SEQ ID NO: 1235137 - RNA, 24 nt, Human
ucuccugccucagccucccgagua

SEQ ID NO: 1235138 - RNA, 21 nt, Human
ucucuacuaaaaauacaaaaa

SEQ ID NO: 1235139 - RNA, 24 nt, Human
ucugucacccaggcuggagugcag

SEQ ID NO: 1235140 - RNA, 23 nt, Human
ucuugcucugucacccaggcugg

SEQ ID NO: 1235141 - RNA, 24 nt, Human
ucuugcucugucacccaggcugga

SEQ ID NO: 1235142 - RNA, 20 nt, Human
ugaaaugcaaacuagcauga

SEQ ID NO: 1235143 - RNA, 24 nt, Human
ugaaccugggaggcagagguugca

SEQ ID NO: 1235144 - RNA, 24 nt, Human
ugaccaacauggugaaacuccauc

SEQ ID NO: 1235145 - RNA, 21 nt, Human
ugagaaaugcgucacuaggug

SEQ ID NO: 1235146 - RNA, 20 nt, Human
ugaggaaauugagucacagg

SEQ ID NO: 1235147 - RNA, 20 nt, Human
ugaggagaagggagaguuga

SEQ ID NO: 1235148 - RNA, 24 nt, Human
ugauccgcccaccucggccuccca

SEQ ID NO: 1235149 - RNA, 19 nt, Human
ugcacuucagccugggcaa

SEQ ID NO: 1235150 - RNA, 22 nt, Human
ugcaguggugcaaucuuggcuc

SEQ ID NO: 1235151 - RNA, 24 nt, Human
ugccucagccucccgaguagcugg

SEQ ID NO: 1235152 - RNA, 19 nt, Human
ugccucccagguucacgcc

SEQ ID NO: 1235153 - RNA, 20 nt, Human
ugccuggcauaggcauaggg

SEQ ID NO: 1235154 - RNA, 24 nt, Human
ugcucugucacccaggcuggagug

SEQ ID NO: 1235155 - RNA, 24 nt, Human
ugcugggauuacaggcgugagcca

SEQ ID NO: 1235156 - RNA, 18 nt, Human
uggaaucaacucuuaacc

SEQ ID NO: 1235157 - RNA, 19 nt, Human
uggagucuugcucugucac

SEQ ID NO: 1235158 - RNA, 23 nt, Human
uggagugcaguggugcaaucuug

SEQ ID NO: 1235159 - RNA, 24 nt, Human
uggagugcaguggugcaaucuugg

SEQ ID NO: 1235160 - RNA, 19 nt, Human
uggcucacugcaagcucug

SEQ ID NO: 1235161 - RNA, 18 nt, Human
ugggaggaggcugaacug

SEQ ID NO: 1235162 - RNA, 24 nt, Human
ugggaggcagagguugcagugagc

SEQ ID NO: 1235163 - RNA, 24 nt, Human
ugggaggccgagguggggggauca

SEQ ID NO: 1235164 - RNA, 18 nt, Human
ugggauuacaggcgugag

SEQ ID NO: 1235165 - RNA, 19 nt, Human
ugggauuacaggcgugagc

SEQ ID NO: 1235166 - RNA, 22 nt, Human
ugggauuacaggcgugagccac

SEQ ID NO: 1235167 - RNA, 23 nt, Human
ugggauuacaggcgugagccacc

SEQ ID NO: 1235168 - RNA, 24 nt, Human
ugggauuacaggcgugagccacca

SEQ ID NO: 1235169 - RNA, 27 nt, Human
ugggccucagacccugguggucccagg

SEQ ID NO: 1235170 - RNA, 24 nt, Human
ugggguuucaccauguuagccagg

SEQ ID NO: 1235171 - RNA, 22 nt, Human
uggugcauaccugcaaucccag

SEQ ID NO: 1235172 - RNA, 21 nt, Human
uguaacuagaacccagcugac

SEQ ID NO: 1235173 - RNA, 21 nt, Human
ugucacccaggcuggagugca

SEQ ID NO: 1235174 - RNA, 24 nt, Human
uguucagagaucuacccugugugc

SEQ ID NO: 1235175 - RNA, 18 nt, Human
uuaguagagaugggguuu

SEQ ID NO: 1235176 - RNA, 22 nt, Human
uuaguagagaugggguuucacc

SEQ ID NO: 1235177 - RNA, 24 nt, Human
uuaguagagaugggguuucaccau

SEQ ID NO: 1235178 - RNA, 23 nt, Human
uucaucuuauuccagugccuggc

SEQ ID NO: 1235179 - RNA, 20 nt, Human
uucuguauuuuuaguagaga

SEQ ID NO: 1235180 - RNA, 24 nt, Human
uugaaccugggaggcagagguugc

SEQ ID NO: 1235181 - RNA, 22 nt, Human
uugagucacaggcagaauaacu

SEQ ID NO: 1235182 - RNA, 19 nt, Human
uugcagugagccgagaucg

SEQ ID NO: 1235183 - RNA, 20 nt, Human
uugcagugagccgagaucgc

SEQ ID NO: 1235184 - RNA, 24 nt, Human
uugcucugucacccaggcuggagu

SEQ ID NO: 1235185 - RNA, 25 nt, Human
uugggaggccgagguggggggauca

SEQ ID NO: 1235186 - RNA, 25 nt, Human
uugggguaaaaguuaaauaaaacac

SEQ ID NO: 1235187 - RNA, 19 nt, Human
uuucaccauguuagccagg

SEQ ID NO: 1235188 - RNA, 20 nt, Human
uuucaccauguuagccagga

SEQ ID NO: 1235189 - RNA, 24 nt, Human
uuucauaugcagucaugcauugcu

SEQ ID NO: 1235190 - RNA, 21 nt, Human
uuucuguauuuuuaguagaga

SEQ ID NO: 1235191 - RNA, 21 nt, Human
uuuucuguauuuuuaguagag

SEQ ID NO: 1235192 - RNA, 24 nt, Human
uuuuuaguagagaugggguuucac

SEQ ID NO: 1235193 - RNA, 25 nt, Human
aaggagccaccucuccgggugucuc

SEQ ID NO: 1235194 - RNA, 21 nt, Human
agacggcccgcaugggccuca

SEQ ID NO: 1235195 - RNA, 19 nt, Human
aucugggacccgggugucc

SEQ ID NO: 1235196 - RNA, 23 nt, Human
cacaggcccagcucucgcuggcu

SEQ ID NO: 1235197 - RNA, 24 nt, Human
ccacaggcccagcucucgcuggcu

SEQ ID NO: 1235198 - RNA, 20 nt, Human
ccaccacuuggccuuuucug

SEQ ID NO: 1235199 - RNA, 18 nt, Human
ccccucgugggccgcaaa

SEQ ID NO: 1235200 - RNA, 22 nt, Human
ccgcaaaccucuccgccaccac

SEQ ID NO: 1235201 - RNA, 22 nt, Human
cgccaccacuuggccuuuucug

SEQ ID NO: 1235202 - RNA, 20 nt, Human
cgucugggugcauaucaucc

SEQ ID NO: 1235203 - RNA, 23 nt, Human
gcccuggcgcgugaagacggccc

SEQ ID NO: 1235204 - RNA, 18 nt, Human
gcugcggggcgcucacgc

SEQ ID NO: 1235205 - RNA, 21 nt, Human
ggcccagcucucgcuggcuca

SEQ ID NO: 1235206 - RNA, 21 nt, Human
ggcccuggcgcgugaagacgg

SEQ ID NO: 1235207 - RNA, 21 nt, Human
uccaggcucagcagcaccucc

SEQ ID NO: 1235208 - RNA, 22 nt, Human
ucucgcuggcucaugcggguga

SEQ ID NO: 1235209 - RNA, 24 nt, Human
ugcaggugguggcuagcaggcuac

SEQ ID NO: 1235210 - RNA, 22 nt, Human
ugcagugccacuggcuccucga

SEQ ID NO: 1235211 - RNA, 19 nt, Human
ugccacuggcuccucgaag

SEQ ID NO: 1235212 - RNA, 18 nt, Human
uggcuagcaggcuaccgu

SEQ ID NO: 1235213 - RNA, 20 nt, Human
ugguccugagcgggcugcgg

SEQ ID NO: 1235214 - RNA, 27 nt, Human
uuucuggggucaaugaugcgcaagguc

SEQ ID NO: 1235215 - RNA, 19 nt, Human
aaacaaaaaacugagaccc

SEQ ID NO: 1235216 - RNA, 21 nt, Human
aaacaaaaaacugagacccga

SEQ ID NO: 1235217 - RNA, 24 nt, Human
aaauguagucuugggccccacccc

SEQ ID NO: 1235218 - RNA, 23 nt, Human
aacaaaaaacugagacccgaugc

SEQ ID NO: 1235219 - RNA, 22 nt, Human
aacugcaaggauacaaacaaac

SEQ ID NO: 1235220 - RNA, 18 nt, Human
aagcaggaagacccugag

SEQ ID NO: 1235221 - RNA, 20 nt, Human
aagugccaguggaaagagac

SEQ ID NO: 1235222 - RNA, 26 nt, Human
aagugugcuccugaaccagcaaaacc

SEQ ID NO: 1235223 - RNA, 21 nt, Human
acagaggggagaaugccuaca

SEQ ID NO: 1235224 - RNA, 20 nt, Human
acccaccuucucccccuccc

SEQ ID NO: 1235225 - RNA, 24 nt, Human
acccaccuucucccccucccuucc

SEQ ID NO: 1235226 - RNA, 24 nt, Human
acccugaggggcaaucacuaggaa

SEQ ID NO: 1235227 - RNA, 26 nt, Human
acccugaggggcaaucacuaggaaac

SEQ ID NO: 1235228 - RNA, 19 nt, Human
acuucaaggacacugucaa

SEQ ID NO: 1235229 - RNA, 26 nt, Human
agaaaagcaggaagacccugaggggc

SEQ ID NO: 1235230 - RNA, 20 nt, Human
agcugcuuuggcgucucucc

SEQ ID NO: 1235231 - RNA, 20 nt, Human
aggccagaguccauggcagc

SEQ ID NO: 1235232 - RNA, 24 nt, Human
agggcgcugcaggagcagaggagg

SEQ ID NO: 1235233 - RNA, 20 nt, Human
caaaaaacugagacccgaug

SEQ ID NO: 1235234 - RNA, 24 nt, Human
caaaaaacugagacccgaugcggu

SEQ ID NO: 1235235 - RNA, 21 nt, Human
caaacaaaaaacugagacccg

SEQ ID NO: 1235236 - RNA, 24 nt, Human
caaacaaaaaacugagacccgaug

SEQ ID NO: 1235237 - RNA, 21 nt, Human
caaagacccaccagaucaaac

SEQ ID NO: 1235238 - RNA, 20 nt, Human
caagaggagccucuggagca

SEQ ID NO: 1235239 - RNA, 19 nt, Human
caccccaaagacccaccag

SEQ ID NO: 1235240 - RNA, 24 nt, Human
caccccaaagacccaccagaucaa

SEQ ID NO: 1235241 - RNA, 27 nt, Human
caccccaaagacccaccagaucaaacc

SEQ ID NO: 1235242 - RNA, 24 nt, Human
cacccucggagcucucaguuuugu

SEQ ID NO: 1235243 - RNA, 19 nt, Human
cagcucugacaucagccau

SEQ ID NO: 1235244 - RNA, 21 nt, Human
cagcugcugcugcugagcucc

SEQ ID NO: 1235245 - RNA, 18 nt, Human
caguggccuccgaaccag

SEQ ID NO: 1235246 - RNA, 23 nt, Human
caguggggcuucucucugcaucu

SEQ ID NO: 1235247 - RNA, 23 nt, Human
cauaacugcaaggauacaaacaa

SEQ ID NO: 1235248 - RNA, 20 nt, Human
ccacgaugguagcaaagcag

SEQ ID NO: 1235249 - RNA, 19 nt, Human
ccagcucugacaucagcca

SEQ ID NO: 1235250 - RNA, 21 nt, Human
ccaguggaaagagacugcagg

SEQ ID NO: 1235251 - RNA, 23 nt, Human
ccccaaagacccaccagaucaaa

SEQ ID NO: 1235252 - RNA, 19 nt, Human
ccccaccccaaagacccac

SEQ ID NO: 1235253 - RNA, 22 nt, Human
cccccucccuuccauucuucca

SEQ ID NO: 1235254 - RNA, 20 nt, Human
ccccucccuuccauucuucc

SEQ ID NO: 1235255 - RNA, 20 nt, Human
cccugaaggcaaggcccagg

SEQ ID NO: 1235256 - RNA, 19 nt, Human
ccgaaccaguucugcuccu

SEQ ID NO: 1235257 - RNA, 21 nt, Human
ccucuggagcaaggucagcuu

SEQ ID NO: 1235258 - RNA, 22 nt, Human
ccuuggucggcagcugcuggca

SEQ ID NO: 1235259 - RNA, 23 nt, Human
cgggagcucaucacaaauguagu

SEQ ID NO: 1235260 - RNA, 23 nt, Human
cgguagagcugcaguggccuccg

SEQ ID NO: 1235261 - RNA, 21 nt, Human
cucccugaaggcaaggcccag

SEQ ID NO: 1235262 - RNA, 19 nt, Human
cuccuuggcagacugcugg

SEQ ID NO: 1235263 - RNA, 23 nt, Human
cucgcaaacaaaaaacugagacc

SEQ ID NO: 1235264 - RNA, 21 nt, Human
cugcaguggccuccgaaccag

SEQ ID NO: 1235265 - RNA, 18 nt, Human
cugucaugugccacaucc

SEQ ID NO: 1235266 - RNA, 24 nt, Human
cuucaaggacacugucaacucccu

SEQ ID NO: 1235267 - RNA, 18 nt, Human
cuugggccccaccccaaa

SEQ ID NO: 1235268 - RNA, 21 nt, Human
cuugggccccaccccaaagac

SEQ ID NO: 1235269 - RNA, 19 nt, Human
gagcccacccaccuucucc

SEQ ID NO: 1235270 - RNA, 19 nt, Human
gaguccauggcagcugcuu

SEQ ID NO: 1235271 - RNA, 18 nt, Human
gcagcugcuggcaacagc

SEQ ID NO: 1235272 - RNA, 18 nt, Human
gcuuucagccaacaaggc

SEQ ID NO: 1235273 - RNA, 22 nt, Human
ggagaaugccuacaggccugag

SEQ ID NO: 1235274 - RNA, 22 nt, Human
ggagcagaggagggggcggggc

SEQ ID NO: 1235275 - RNA, 21 nt, Human
ggcccagggcuuugacuuccc

SEQ ID NO: 1235276 - RNA, 19 nt, Human
ggccgcggcaagaggagcc

SEQ ID NO: 1235277 - RNA, 23 nt, Human
ggcuuucagccaacaaggccaau

SEQ ID NO: 1235278 - RNA, 19 nt, Human
gggccccaccccaaagacc

SEQ ID NO: 1235279 - RNA, 23 nt, Human
gggcggggcaggacggcuuccuu

SEQ ID NO: 1235280 - RNA, 18 nt, Human
ggucggcagcugcuggca

SEQ ID NO: 1235281 - RNA, 20 nt, Human
guagagcugcaguggccucc

SEQ ID NO: 1235282 - RNA, 18 nt, Human
guagucuugggccccacc

SEQ ID NO: 1235283 - RNA, 21 nt, Human
uaacugcaaggauacaaacaa

SEQ ID NO: 1235284 - RNA, 22 nt, Human
uaacugcaaggauacaaacaaa

SEQ ID NO: 1235285 - RNA, 19 nt, Human
uacaagcagggacagggca

SEQ ID NO: 1235286 - RNA, 19 nt, Human
uagagcugcaguggccucc

SEQ ID NO: 1235287 - RNA, 24 nt, Human
uagauaucucugagucacuuuuuu

SEQ ID NO: 1235288 - RNA, 22 nt, Human
ucaauggcucuuuuaauaaucu

SEQ ID NO: 1235289 - RNA, 19 nt, Human
ucaggcacugucaugugcc

SEQ ID NO: 1235290 - RNA, 19 nt, Human
uccacgaugguagcaaagc

SEQ ID NO: 1235291 - RNA, 20 nt, Human
uccagaggccaggaaggcuc

SEQ ID NO: 1235292 - RNA, 22 nt, Human
uccagucagcaucuucaauggc

SEQ ID NO: 1235293 - RNA, 20 nt, Human
uccccugauuucuggcuuuc

SEQ ID NO: 1235294 - RNA, 19 nt, Human
ucccuaggcauggagagac

SEQ ID NO: 1235295 - RNA, 22 nt, Human
ucccucaccggcaggguagggu

SEQ ID NO: 1235296 - RNA, 22 nt, Human
ucccugaaggcaaggcccaggg

SEQ ID NO: 1235297 - RNA, 20 nt, Human
ucccugagcccacccaccuu

SEQ ID NO: 1235298 - RNA, 19 nt, Human
uccgugagacccucugucc

SEQ ID NO: 1235299 - RNA, 20 nt, Human
uccgugagacccucugucca

SEQ ID NO: 1235300 - RNA, 19 nt, Human
uccugaaccagcaaaaccc

SEQ ID NO: 1235301 - RNA, 21 nt, Human
ucugaaugaacccgaaaacuc

SEQ ID NO: 1235302 - RNA, 21 nt, Human
ucuggaacucaacuucaagug

SEQ ID NO: 1235303 - RNA, 24 nt, Human
ucuuccaaaccagcugcugcugcc

SEQ ID NO: 1235304 - RNA, 21 nt, Human
ucuucuggccacucuggccgu

SEQ ID NO: 1235305 - RNA, 18 nt, Human
ucuugggccccaccccaa

SEQ ID NO: 1235306 - RNA, 24 nt, Human
ucuugggccccaccccaaagaccc

SEQ ID NO: 1235307 - RNA, 22 nt, Human
ugagaagacacacgagcuucca

SEQ ID NO: 1235308 - RNA, 18 nt, Human
ugagacccucuguccagc

SEQ ID NO: 1235309 - RNA, 18 nt, Human
ugcaaggauacaaacaaa

SEQ ID NO: 1235310 - RNA, 21 nt, Human
ugcaggcacauuuuaaagucu

SEQ ID NO: 1235311 - RNA, 19 nt, Human
uggaaagagacugcaggug

SEQ ID NO: 1235312 - RNA, 19 nt, Human
uggcagacugcugggugug

SEQ ID NO: 1235313 - RNA, 24 nt, Human
uggcucuuccaaaccagcugcugc

SEQ ID NO: 1235314 - RNA, 18 nt, Human
ugugagggcucaggggcu

SEQ ID NO: 1235315 - RNA, 18 nt, Human
ugugccacauccugugug

SEQ ID NO: 1235316 - RNA, 18 nt, Human
uguggugggcacuucacc

SEQ ID NO: 1235317 - RNA, 25 nt, Human
uucaaagugugcuccugaaccagca

SEQ ID NO: 1235318 - RNA, 18 nt, Human
uuccagaggccaggaagg

SEQ ID NO: 1235319 - RNA, 19 nt, Human
uugaagggagcccuucagg

SEQ ID NO: 1235320 - RNA, 19 nt, Human
aagccugcuaggagcgccu

SEQ ID NO: 1235321 - RNA, 18 nt, Human
caaugggcucccgccucc

SEQ ID NO: 1235322 - RNA, 30 nt, Human
caaugggcucccgccuccuccgccgguccu

SEQ ID NO: 1235323 - RNA, 19 nt, Human
cagcagaacaggcagcgaa

SEQ ID NO: 1235324 - RNA, 23 nt, Human
ccugcuaggagcgccugucucca

SEQ ID NO: 1235325 - RNA, 19 nt, Human
cgcgucuuaaacccgaagc

SEQ ID NO: 1235326 - RNA, 22 nt, Human
cuuaaacccgaagccggaaaag

SEQ ID NO: 1235327 - RNA, 21 nt, Human
gaucagcagaacaggcagcga

SEQ ID NO: 1235328 - RNA, 26 nt, Human
gccacaggcucucgggacaaugggcu

SEQ ID NO: 1235329 - RNA, 18 nt, Human
gccgguccagccaucacg

SEQ ID NO: 1235330 - RNA, 22 nt, Human
gggcucccgccuccuccgccgg

SEQ ID NO: 1235331 - RNA, 21 nt, Human
uccuccgccgguccagccauc

SEQ ID NO: 1235332 - RNA, 20 nt, Human
ugcuuguacucaccugcccu

SEQ ID NO: 1235333 - RNA, 21 nt, Human
ugggcucacucguguguaggu

SEQ ID NO: 1235334 - RNA, 20 nt, Human
uggggccgaucagcagaaca

SEQ ID NO: 1235335 - RNA, 21 nt, Human
uuguacucaccugcccugggc

SEQ ID NO: 1235336 - RNA, 19 nt, Human
aaaaagcaaaaggcugcug

SEQ ID NO: 1235337 - RNA, 24 nt, Human
aagcaaccaggaggagguaagagc

SEQ ID NO: 1235338 - RNA, 21 nt, Human
aaggggagggaagaaaaaaga

SEQ ID NO: 1235339 - RNA, 19 nt, Human
aaggugaaaagcugguguu

SEQ ID NO: 1235340 - RNA, 21 nt, Human
acccuugauaaggggagggaa

SEQ ID NO: 1235341 - RNA, 21 nt, Human
agaaaaaagaaaaagcaaaag

SEQ ID NO: 1235342 - RNA, 18 nt, Human
agcuggcugguuccuucu

SEQ ID NO: 1235343 - RNA, 20 nt, Human
aggaaaaggugaaaagcugg

SEQ ID NO: 1235344 - RNA, 20 nt, Human
auaaacuuggggugggggca

SEQ ID NO: 1235345 - RNA, 25 nt, Human
aucuuccuuggugucauuccuguug

SEQ ID NO: 1235346 - RNA, 19 nt, Human
caagaaaagcaaccaggag

SEQ ID NO: 1235347 - RNA, 18 nt, Human
cagaaacuuccugggguu

SEQ ID NO: 1235348 - RNA, 19 nt, Human
cagcggggcccgaggcggc

SEQ ID NO: 1235349 - RNA, 21 nt, Human
cagguggcacaugacagauca

SEQ ID NO: 1235350 - RNA, 19 nt, Human
cauuuggaaaaacuggcag

SEQ ID NO: 1235351 - RNA, 19 nt, Human
ccgggggggcggggguucc

SEQ ID NO: 1235352 - RNA, 26 nt, Human
cgcccuucucuccuuccacgacauca

SEQ ID NO: 1235353 - RNA, 22 nt, Human
cggcugcccuucacggguacuc

SEQ ID NO: 1235354 - RNA, 25 nt, Human
cugaacaguaaggauggcucccuuc

SEQ ID NO: 1235355 - RNA, 19 nt, Human
cugcgcagaaacuuccugg

SEQ ID NO: 1235356 - RNA, 24 nt, Human
cuggugaacaaagacaucuuccuu

SEQ ID NO: 1235357 - RNA, 20 nt, Human
gcagauaccagauggcagcu

SEQ ID NO: 1235358 - RNA, 21 nt, Human
gcugguuccuucucagccuga

SEQ ID NO: 1235359 - RNA, 23 nt, Human
ggcaagaaaagcaaccaggagga

SEQ ID NO: 1235360 - RNA, 27 nt, Human
ggcaagaaaagcaaccaggaggaggua

SEQ ID NO: 1235361 - RNA, 24 nt, Human
ggcagcucuggguguccuuugagu

SEQ ID NO: 1235362 - RNA, 22 nt, Human
gggaagaaaaaagaaaaagcaa

SEQ ID NO: 1235363 - RNA, 22 nt, Human
ggggucccagcagcggggcccg

SEQ ID NO: 1235364 - RNA, 21 nt, Human
ggugguggggcaacugaggga

SEQ ID NO: 1235365 - RNA, 28 nt, Human
guugcugucucugaacaguaaggauggc

SEQ ID NO: 1235366 - RNA, 18 nt, Human
uccgggccgggggggcgg

SEQ ID NO: 1235367 - RNA, 19 nt, Human
uccgggccgggggggcggg

SEQ ID NO: 1235368 - RNA, 22 nt, Human
uccugagucucaaggaaaaggu

SEQ ID NO: 1235369 - RNA, 21 nt, Human
ucgccggauugccaggggugc

SEQ ID NO: 1235370 - RNA, 20 nt, Human
ugaacaaagacaucuuccuu

SEQ ID NO: 1235371 - RNA, 21 nt, Human
ugcgcagaaacuuccuggggu

SEQ ID NO: 1235372 - RNA, 21 nt, Human
ugcgcccuucucuccuuccac

SEQ ID NO: 1235373 - RNA, 23 nt, Human
uggcuucugcgcccuucucuccu

SEQ ID NO: 1235374 - RNA, 19 nt, Human
uggguaggguacaggucau

SEQ ID NO: 1235375 - RNA, 22 nt, Human
uuaguggcuucugcgcccuucu

SEQ ID NO: 1235376 - RNA, 19 nt, Human
uuccuuggugucauuccug

SEQ ID NO: 1235377 - RNA, 24 nt, Human
uuccuuggugucauuccuguugau

SEQ ID NO: 1235378 - RNA, 19 nt, Human
uucuuuuaauagcugucug

SEQ ID NO: 1235379 - RNA, 23 nt, Human
aacggcgguggcggcggcggcgg

SEQ ID NO: 1235380 - RNA, 26 nt, Human
aacggcgguggcggcggcggcggcga

SEQ ID NO: 1235381 - RNA, 28 nt, Human
acccugguggccccacagccccacauug

SEQ ID NO: 1235382 - RNA, 18 nt, Human
accugggccaccccccuc

SEQ ID NO: 1235383 - RNA, 19 nt, Human
accugggccaccccccucu

SEQ ID NO: 1235384 - RNA, 21 nt, Human
auggaggggggguccuagggc

SEQ ID NO: 1235385 - RNA, 24 nt, Human
cacagccccacauuggagggcagg

SEQ ID NO: 1235386 - RNA, 21 nt, Human
caccccccucugccccccacc

SEQ ID NO: 1235387 - RNA, 18 nt, Human
caccugcacaggguccag

SEQ ID NO: 1235388 - RNA, 18 nt, Human
cagcagcaggaguaagag

SEQ ID NO: 1235389 - RNA, 21 nt, Human
cagcagcgacggcgacaacgg

SEQ ID NO: 1235390 - RNA, 18 nt, Human
cagcgacggcgacaacgg

SEQ ID NO: 1235391 - RNA, 27 nt, Human
caggagaaagaggaguacugcgugggu

SEQ ID NO: 1235392 - RNA, 22 nt, Human
caggaugcaguggauguggaca

SEQ ID NO: 1235393 - RNA, 21 nt, Human
cauaguugccacguugaugcc

SEQ ID NO: 1235394 - RNA, 22 nt, Human
ccacauuggagggcaggcccgc

SEQ ID NO: 1235395 - RNA, 19 nt, Human
cccacccccggccccaacc

SEQ ID NO: 1235396 - RNA, 22 nt, Human
cccacccccggccccaacccac

SEQ ID NO: 1235397 - RNA, 18 nt, Human
ccccacccccggccccaa

SEQ ID NO: 1235398 - RNA, 18 nt, Human
ccccccacccccggcccc

SEQ ID NO: 1235399 - RNA, 23 nt, Human
ccccccacccccggccccaaccc

SEQ ID NO: 1235400 - RNA, 18 nt, Human
ccccccucugccccccac

SEQ ID NO: 1235401 - RNA, 18 nt, Human
cccccggccccaacccac

SEQ ID NO: 1235402 - RNA, 18 nt, Human
ccuccuccagguaggaau

SEQ ID NO: 1235403 - RNA, 18 nt, Human
ccucugccccccaccccc

SEQ ID NO: 1235404 - RNA, 19 nt, Human
ccugaucaaagaaaggcac

SEQ ID NO: 1235405 - RNA, 19 nt, Human
ccugggccaccccccucug

SEQ ID NO: 1235406 - RNA, 24 nt, Human
ccugggccaccccccucugccccc

SEQ ID NO: 1235407 - RNA, 24 nt, Human
cggcgacgaacacagcgaagaaga

SEQ ID NO: 1235408 - RNA, 21 nt, Human
cuaaggcguucuggaguccau

SEQ ID NO: 1235409 - RNA, 19 nt, Human
cugcggccacugcuggugg

SEQ ID NO: 1235410 - RNA, 23 nt, Human
gacaacggcgguggcggcggcgg

SEQ ID NO: 1235411 - RNA, 20 nt, Human
gacaagaacgaugaggccca

SEQ ID NO: 1235412 - RNA, 20 nt, Human
gagaaagaggaguacugcgu

SEQ ID NO: 1235413 - RNA, 23 nt, Human
gcagcgacggcgacaacggcggu

SEQ ID NO: 1235414 - RNA, 21 nt, Human
gcaucgugggggcuuucuugg

SEQ ID NO: 1235415 - RNA, 22 nt, Human
gcgacgaacacagcgaagaaga

SEQ ID NO: 1235416 - RNA, 23 nt, Human
gcggcggcggcggcgacgaacac

SEQ ID NO: 1235417 - RNA, 22 nt, Human
ggacaucuucaccugcacaggg

SEQ ID NO: 1235418 - RNA, 20 nt, Human
ggacugcagccucagcucaa

SEQ ID NO: 1235419 - RNA, 19 nt, Human
ggcaggagaaagaggagua

SEQ ID NO: 1235420 - RNA, 30 nt, Human; identical to SEQ ID NO: 1097729

SEQ ID NO: 1235421 - RNA, 21 nt, Human
ggcgacgaacacagcgaagaa

SEQ ID NO: 1235422 - RNA, 23 nt, Human
ggcgacgaacacagcgaagaaga

SEQ ID NO: 1235423 - RNA, 29 nt, Human
ggcggcggcggcgacgaacacagcgaagg

SEQ ID NO: 1235424 - RNA, 20 nt, Human
gggccaccccccucugcccc

SEQ ID NO: 1235425 - RNA, 24 nt, Human
ggggguccuagggccaccugggcc

SEQ ID NO: 1235426 - RNA, 23 nt, Human
gggguccuagggccaccugggcc

SEQ ID NO: 1235427 - RNA, 20 nt, Human
gucugggggaccacuugggg

SEQ ID NO: 1235428 - RNA, 22 nt, Human
uaccacccugguggccccacag

SEQ ID NO: 1235429 - RNA, 21 nt, Human
uacgggaagggcagguugucc

SEQ ID NO: 1235430 - RNA, 20 nt, Human
uagagagagggugguggcag

SEQ ID NO: 1235431 - RNA, 23 nt, Human
uagcugguuuuccauggaggggg

SEQ ID NO: 1235432 - RNA, 26 nt, Human
uagcugguuuuccauggagggggggu

SEQ ID NO: 1235433 - RNA, 18 nt, Human
uaguucugcggccacugc

SEQ ID NO: 1235434 - RNA, 24 nt, Human
uauugauugcaacaucucacggug

SEQ ID NO: 1235435 - RNA, 19 nt, Human
ucugaguagcccaaucaau

SEQ ID NO: 1235436 - RNA, 20 nt, Human
ugacaagaacgaugaggccc

SEQ ID NO: 1235437 - RNA, 21 nt, Human
ugacaagaacgaugaggccca

SEQ ID NO: 1235438 - RNA, 24 nt, Human
ugacagguagagagaggguggugg

SEQ ID NO: 1235439 - RNA, 21 nt, Human
ugcaguggauguggacauccu

SEQ ID NO: 1235440 - RNA, 21 nt, Human
uggauguggacauccugagcc

SEQ ID NO: 1235441 - RNA, 19 nt, Human
uggcggcggcggcggcgac

SEQ ID NO: 1235442 - RNA, 20 nt, Human
ugggauacgggaagggcagg

SEQ ID NO: 1235443 - RNA, 20 nt, Human
uguccuccuccuccagguaa

SEQ ID NO: 1235444 - RNA, 18 nt, Human
uuggagaaaugguggcag

SEQ ID NO: 1235445 - RNA, 25 nt, Human
aagaggcagagcagggccacgagca

SEQ ID NO: 1235446 - RNA, 21 nt, Human
aaggaguuccuaaggaugaug

SEQ ID NO: 1235447 - RNA, 18 nt, Human
acaaagucgaagugcucu

SEQ ID NO: 1235448 - RNA, 19 nt, Human
acagcccucggugcaccac

SEQ ID NO: 1235449 - RNA, 21 nt, Human
acccucugggaucagacacuu

SEQ ID NO: 1235450 - RNA, 22 nt, Human
accgaagcagccugaacccagc

SEQ ID NO: 1235451 - RNA, 26 nt, Human
agaccaggucuccagcuccaccuggu

SEQ ID NO: 1235452 - RNA, 23 nt, Human
agcacgugugggugcuccaaguu

SEQ ID NO: 1235453 - RNA, 20 nt, Human
agcagcucuuuuccuccaag

SEQ ID NO: 1235454 - RNA, 20 nt, Human
agcccgcgggcccccaggua

SEQ ID NO: 1235455 - RNA, 23 nt, Human
agccugaacccagcagcuccccu

SEQ ID NO: 1235456 - RNA, 18 nt, Human
aggaagaggcagagcagg

SEQ ID NO: 1235457 - RNA, 18 nt, Human
aggcccuagagagaccag

SEQ ID NO: 1235458 - RNA, 18 nt, Human
agguggaacgucuacccc

SEQ ID NO: 1235459 - RNA, 19 nt, Human
aucgggccuucgggaccua

SEQ ID NO: 1235460 - RNA, 19 nt, Human
caacuggaugucccggagc

SEQ ID NO: 1235461 - RNA, 22 nt, Human
cacaugguccaguguggccccu

SEQ ID NO: 1235462 - RNA, 18 nt, Human
caccagcccgcgggcccc

SEQ ID NO: 1235463 - RNA, 21 nt, Human
caccagcccgcgggcccccag

SEQ ID NO: 1235464 - RNA, 22 nt, Human
cacccacgauggcccuggacca

SEQ ID NO: 1235465 - RNA, 22 nt, Human
cacccacgauggcccuggaccc

SEQ ID NO: 1235466 - RNA, 18 nt, Human
cacccucugggaucagac

SEQ ID NO: 1235467 - RNA, 20 nt, Human
caccgaagcagccugaaccc

SEQ ID NO: 1235468 - RNA, 21 nt, Human
cagaagccaaggagcauggga

SEQ ID NO: 1235469 - RNA, 18 nt, Human
cagccuucagaagccaag

SEQ ID NO: 1235470 - RNA, 23 nt, Human
caucaaauguccuugagugcaag

SEQ ID NO: 1235471 - RNA, 21 nt, Human
ccaaugccguccagguccuca

SEQ ID NO: 1235472 - RNA, 22 nt, Human
ccaaugccguccagguccucag

SEQ ID NO: 1235473 - RNA, 25 nt, Human
ccaguguggccccuugauccucucu

SEQ ID NO: 1235474 - RNA, 24 nt, Human
cccccagguacgccauggcucccg

SEQ ID NO: 1235475 - RNA, 22 nt, Human
cccccagguacgccauggcucu

SEQ ID NO: 1235476 - RNA, 18 nt, Human
cccccaguucugugccca

SEQ ID NO: 1235477 - RNA, 23 nt, Human
cccggagcagcuucaguagccac

SEQ ID NO: 1235478 - RNA, 20 nt, Human
cccgggcaccgcccagaggc

SEQ ID NO: 1235479 - RNA, 19 nt, Human
cccucugggaucagacacu

SEQ ID NO: 1235480 - RNA, 18 nt, Human
cccuggaccaaacgaagg

SEQ ID NO: 1235481 - RNA, 24 nt, Human
ccgauaccucucgcaggaaguccc

SEQ ID NO: 1235482 - RNA, 18 nt, Human
ccuggucaaggcggaagc

SEQ ID NO: 1235483 - RNA, 18 nt, Human
cgagaaggcuccguggcg

SEQ ID NO: 1235484 - RNA, 21 nt, Human
cgcugggcaggccggcccaug

SEQ ID NO: 1235485 - RNA, 21 nt, Human
cgugcagacgcagcacgugug

SEQ ID NO: 1235486 - RNA, 23 nt, Human
cgugcagacgcagcacguguggg

SEQ ID NO: 1235487 - RNA, 22 nt, Human
cuagcgcauagaagcuuccucu

SEQ ID NO: 1235488 - RNA, 24 nt, Human
cucauaauccauacuaccagcauc

SEQ ID NO: 1235489 - RNA, 19 nt, Human
cuccagcuccaccugguca

SEQ ID NO: 1235490 - RNA, 25 nt, Human
cugugcccaucgggccuucgggacc

SEQ ID NO: 1235491 - RNA, 21 nt, Human
cuugaggccccccucuggcuc

SEQ ID NO: 1235492 - RNA, 19 nt, Human
gaacccagcagcuccccuc

SEQ ID NO: 1235493 - RNA, 20 nt, Human
gacccaguucuuagacuuag

SEQ ID NO: 1235494 - RNA, 22 nt, Human
gagcagcgggggugucggggcc

SEQ ID NO: 1235495 - RNA, 19 nt, Human
gagcaugggagggaggaga

SEQ ID NO: 1235496 - RNA, 19 nt, Human
gcagggccacgagcagcgg

SEQ ID NO: 1235497 - RNA, 18 nt, Human
gcaguucaggauggcugu

SEQ ID NO: 1235498 - RNA, 19 nt, Human
gcccagaggccgcaccagc

SEQ ID NO: 1235499 - RNA, 23 nt, Human
gcccuagagagaccaggucucca

SEQ ID NO: 1235500 - RNA, 19 nt, Human
gcccucaggggccuaggcu

SEQ ID NO: 1235501 - RNA, 22 nt, Human
gccggggccguuaggcgcgcgu

SEQ ID NO: 1235502 - RNA, 18 nt, Human
gccugaacccagcagcuc

SEQ ID NO: 1235503 - RNA, 20 nt, Human
gcuuggucccauguggccag

SEQ ID NO: 1235504 - RNA, 26 nt, Human
ggcccagaacguagccuuuucagagc

SEQ ID NO: 1235505 - RNA, 23 nt, Human
ggcccagccaaaggagcuucagc

SEQ ID NO: 1235506 - RNA, 20 nt, Human
ggcgcaggcucucugggggc

SEQ ID NO: 1235507 - RNA, 23 nt, Human
gggaggagacauuugccagugcc

SEQ ID NO: 1235508 - RNA, 25 nt, Human
gggcccccagguacgccauggcucc

SEQ ID NO: 1235509 - RNA, 19 nt, Human
gggggugucggggccgggg

SEQ ID NO: 1235510 - RNA, 21 nt, Human
guauagcagcucuuuuccucc

SEQ ID NO: 1235511 - RNA, 18 nt, Human
gugcuccaaguucaucau

SEQ ID NO: 1235512 - RNA, 21 nt, Human
guggcgcaggcucucuggggg

SEQ ID NO: 1235513 - RNA, 22 nt, Human
guugguaugggaaaaaacaaag

SEQ ID NO: 1235514 - RNA, 24 nt, Human
uagcagcucuuuuccuccaagucc

SEQ ID NO: 1235515 - RNA, 23 nt, Human
uagggcggggcccgcccaugacg

SEQ ID NO: 1235516 - RNA, 24 nt, Human
uaggggaggguagaagcaguuggu

SEQ ID NO: 1235517 - RNA, 20 nt, Human
uaugauguauagcagcucuu

SEQ ID NO: 1235518 - RNA, 23 nt, Human
uaugauguauagcagcucuuuuc

SEQ ID NO: 1235519 - RNA, 23 nt, Human
ucagccuucagaagccaaggagc

SEQ ID NO: 1235520 - RNA, 22 nt, Human
uccaccuggucaaggcggaagc

SEQ ID NO: 1235521 - RNA, 20 nt, Human
uccauacuaccagcaucaaa

SEQ ID NO: 1235522 - RNA, 22 nt, Human
uccaucauccaggauggcugcc

SEQ ID NO: 1235523 - RNA, 20 nt, Human
ucggacagucugcgcugggc

SEQ ID NO: 1235524 - RNA, 24 nt, Human
ugacagccacugggacacucuugc

SEQ ID NO: 1235525 - RNA, 21 nt, Human
ugcaccacaccgaagcagccu

SEQ ID NO: 1235526 - RNA, 23 nt, Human
ugcaccacaccgaagcagccuga

SEQ ID NO: 1235527 - RNA, 21 nt, Human
ugccaaugccguccagguccu

SEQ ID NO: 1235528 - RNA, 23 nt, Human
ugccgcaggaagaggcagagcag

SEQ ID NO: 1235529 - RNA, 18 nt, Human
uggccaggcccucagggg

SEQ ID NO: 1235530 - RNA, 23 nt, Human
uggcccaguacaaggccgugcag

SEQ ID NO: 1235531 - RNA, 21 nt, Human
uggcucagggaggugccgugg

SEQ ID NO: 1235532 - RNA, 21 nt, Human
ugggaucagacacuugaggcc

SEQ ID NO: 1235533 - RNA, 23 nt, Human
ugggaucuccccagguggaacgu

SEQ ID NO: 1235534 - RNA, 21 nt, Human
uggucaaggcggaagcggcga

SEQ ID NO: 1235535 - RNA, 21 nt, Human
uguagugggcagacuagaucc

SEQ ID NO: 1235536 - RNA, 19 nt, Human
ugucccggagcagcuucag

SEQ ID NO: 1235537 - RNA, 24 nt, Human
ugucggggccggggccguuaggcg

SEQ ID NO: 1235538 - RNA, 25 nt, Human
ugugagagcugggcuggggcagggg

SEQ ID NO: 1235539 - RNA, 22 nt, Human
uguggccaggcccucaggggcc

SEQ ID NO: 1235540 - RNA, 21 nt, Human
uuuacaaagucgaagugcucu

SEQ ID NO: 1235541 - RNA, 27 nt, Human
uuuccuccaaguccucuuguuugagaa

SEQ ID NO: 1235542 - RNA, 21 nt, Human
uuugccagugcccaacucugg

SEQ ID NO: 1235543 - RNA, 24 nt, Human
aaaaugccaaaggcauuuucacac

SEQ ID NO: 1235544 - RNA, 18 nt, Human
aaacacaucucccagugu

SEQ ID NO: 1235545 - RNA, 18 nt, Human
aagcaggcaaauacauug

SEQ ID NO: 1235546 - RNA, 22 nt, Human
aagcaggcaaauacauugagca

SEQ ID NO: 1235547 - RNA, 22 nt, Human
aaugccaaaggcauuuucacac

SEQ ID NO: 1235548 - RNA, 20 nt, Human
agauuacacccccaagucug

SEQ ID NO: 1235549 - RNA, 19 nt, Human
agcuugaccgccaccacua

SEQ ID NO: 1235550 - RNA, 21 nt, Human
aguugccggagauuacacccc

SEQ ID NO: 1235551 - RNA, 23 nt, Human
cacacaauaucaauugcaggaac

SEQ ID NO: 1235552 - RNA, 18 nt, Human
cacagugucugucucugg

SEQ ID NO: 1235553 - RNA, 22 nt, Human
ccugcacagugucugucucugg

SEQ ID NO: 1235554 - RNA, 19 nt, Human
cuggugcucuugugaugag

SEQ ID NO: 1235555 - RNA, 27 nt, Human
ucucccaguguuguaagcaggcaaaua

SEQ ID NO: 1235556 - RNA, 24 nt, Human
ucucuggcuguuaacuuacucauu

SEQ ID NO: 1235557 - RNA, 21 nt, Human
ucuugugaugagcaacuuacu

SEQ ID NO: 1235558 - RNA, 28 nt, Human
ugaccgccaccacuaggguauaagagcc

SEQ ID NO: 1235559 - RNA, 19 nt, Human
ugaugagcaacuuacuggc

SEQ ID NO: 1235560 - RNA, 24 nt, Human
ugauugcacuuuuuuaaaaaugcc

SEQ ID NO: 1235561 - RNA, 18 nt, Human
uggcaaacacaucuccca

SEQ ID NO: 1235562 - RNA, 24 nt, Human
uggugcucuugugaugagcaacuu

SEQ ID NO: 1235563 - RNA, 27 nt, Human
ugugaugagcaacuuacuggcaaacac

SEQ ID NO: 1235564 - RNA, 23 nt, Human
uuagcuugaccgccaccacuagg

SEQ ID NO: 1235565 - RNA, 20 nt, Human
uuucacacaauaucaauugc

SEQ ID NO: 1235566 - RNA, 24 nt, Human
uuugcaaugccugcacagugucug

SEQ ID NO: 1235567 - RNA, 24 nt, Human
aaaguucugggauuacaggcguga

SEQ ID NO: 1235568 - RNA, 21 nt, Human
accuugccugucucccuucca

SEQ ID NO: 1235569 - RNA, 23 nt, Human
accuugccugucucccuuccaac

SEQ ID NO: 1235570 - RNA, 18 nt, Human
acgggguuuuaccaaguu

SEQ ID NO: 1235571 - RNA, 19 nt, Human
acgggguuuuaccaaguug

SEQ ID NO: 1235572 - RNA, 24 nt, Human
acgggguuuuaccaaguugaccag

SEQ ID NO: 1235573 - RNA, 24 nt, Human
agccugggguggcuuuggggaccu

SEQ ID NO: 1235574 - RNA, 21 nt, Human
aggaacauuaaagucuggucc

SEQ ID NO: 1235575 - RNA, 21 nt, Human
aggcagaaggccagggcccca

SEQ ID NO: 1235576 - RNA, 24 nt, Human
aggcagaaggccagggccccaggg

SEQ ID NO: 1235577 - RNA, 22 nt, Human
agggugcuggggagccuggggu

SEQ ID NO: 1235578 - RNA, 20 nt, Human
aggucuggaaguuguucacc

SEQ ID NO: 1235579 - RNA, 24 nt, Human
aggugaucugcccaccucggcuuc

SEQ ID NO: 1235580 - RNA, 19 nt, Human
aggugauuuacaggucacc

SEQ ID NO: 1235581 - RNA, 21 nt, Human
aguaguugggauuacaggcau

SEQ ID NO: 1235582 - RNA, 23 nt, Human
aguaguugggauuacaggcaugc

SEQ ID NO: 1235583 - RNA, 19 nt, Human
agugaaggcggggggcugg

SEQ ID NO: 1235584 - RNA, 24 nt, Human
agugauucucaugccucagccucc

SEQ ID NO: 1235585 - RNA, 20 nt, Human
agugcaguggcgcgaucucg

SEQ ID NO: 1235586 - RNA, 23 nt, Human
agugcaguggcgcgaucucggcu

SEQ ID NO: 1235587 - RNA, 24 nt, Human
agugcaguggcgcgaucucggcuc

SEQ ID NO: 1235588 - RNA, 18 nt, Human
augcuccucagggugcug

SEQ ID NO: 1235589 - RNA, 24 nt, Human
auuuuuguauuuuuaguagagacg

SEQ ID NO: 1235590 - RNA, 24 nt, Human
caaaguucugggauuacaggcgug

SEQ ID NO: 1235591 - RNA, 20 nt, Human
caagaaaagagcuaacagac

SEQ ID NO: 1235592 - RNA, 22 nt, Human
caagaaaagagcuaacagacau

SEQ ID NO: 1235593 - RNA, 22 nt, Human
caagugauucucaugccucagc

SEQ ID NO: 1235594 - RNA, 28 nt, Human
caagugauucucaugccucagccuccug

SEQ ID NO: 1235595 - RNA, 18 nt, Human
caccguguggaugcugug

SEQ ID NO: 1235596 - RNA, 24 nt, Human
caccucggcuucccaaaguucugg

SEQ ID NO: 1235597 - RNA, 18 nt, Human
caccugacuaauuuuugu

SEQ ID NO: 1235598 - RNA, 18 nt, Human
cacugcaaccucugcuuc

SEQ ID NO: 1235599 - RNA, 23 nt, Human
cagcaucagcccuguucccacgg

SEQ ID NO: 1235600 - RNA, 20 nt, Human
cagccuccugaguaguuggg

SEQ ID NO: 1235601 - RNA, 20 nt, Human
cagggugcuggggagccugg

SEQ ID NO: 1235602 - RNA, 19 nt, Human
cagucucagcuccguaagg

SEQ ID NO: 1235603 - RNA, 23 nt, Human
caugcaccaccacaccugacuaa

SEQ ID NO: 1235604 - RNA, 24 nt, Human
caugccucagccuccugaguaguu

SEQ ID NO: 1235605 - RNA, 20 nt, Human
caugcuccuuucuccucuuu

SEQ ID NO: 1235606 - RNA, 22 nt, Human
cauucagggcaccccagugcuc

SEQ ID NO: 1235607 - RNA, 22 nt, Human
ccaaaguucugggauuacaggc

SEQ ID NO: 1235608 - RNA, 24 nt, Human
ccaaaguucugggauuacaggcgu

SEQ ID NO: 1235609 - RNA, 23 nt, Human
cccagguucaagugauucucaug

SEQ ID NO: 1235610 - RNA, 18 nt, Human
cccuggcuggagcuucag

SEQ ID NO: 1235611 - RNA, 20 nt, Human
ccggcagcccagaaacggcc

SEQ ID NO: 1235612 - RNA, 18 nt, Human
ccuagugcagucucagcu

SEQ ID NO: 1235613 - RNA, 22 nt, Human
ccucaggugaucugcccaccuc

SEQ ID NO: 1235614 - RNA, 23 nt, Human
ccugaguaguugggauuacaggc

SEQ ID NO: 1235615 - RNA, 24 nt, Human
ccugaguaguugggauuacaggca

SEQ ID NO: 1235616 - RNA, 24 nt, Human
ccuggccucaggugaucugcccac

SEQ ID NO: 1235617 - RNA, 21 nt, Human
ccugucucccuuccaacaagg

SEQ ID NO: 1235618 - RNA, 21 nt, Human
ccugugcagauuucuggagcu

SEQ ID NO: 1235619 - RNA, 20 nt, Human
ccugugccggcagcccagaa

SEQ ID NO: 1235620 - RNA, 22 nt, Human
ccuugcgggauucugcccugaa

SEQ ID NO: 1235621 - RNA, 19 nt, Human
cggccuucaggcagaaggc

SEQ ID NO: 1235622 - RNA, 24 nt, Human
cgggguuuuaccaaguugaccagg

SEQ ID NO: 1235623 - RNA, 25 nt, Human
cgucacuacaauuucaagaaaagag

SEQ ID NO: 1235624 - RNA, 23 nt, Human
cuaauuuuuguauuuuuaguaga

SEQ ID NO: 1235625 - RNA, 19 nt, Human
cuagugcagucucagcucc

SEQ ID NO: 1235626 - RNA, 24 nt, Human
cucacugcaaccucugcuucccag

SEQ ID NO: 1235627 - RNA, 24 nt, Human
cucacugcaaccucugcuucccag

SEQ ID NO: 1235628 - RNA, 23 nt, Human
cucagaaaguuccaagacugccc

SEQ ID NO: 1235629 - RNA, 19 nt, Human
cugaauguccacagugauc

SEQ ID NO: 1235630 - RNA, 24 nt, Human
cugaguaguugggauuacaggcau

SEQ ID NO: 1235631 - RNA, 23 nt, Human
cugcaaccucugcuucccagguu

SEQ ID NO: 1235632 - RNA, 24 nt, Human
cugcaaccucugcuucccagguuc

SEQ ID NO: 1235633 - RNA, 25 nt, Human
cugcccuguccuuucagaagccaca

SEQ ID NO: 1235634 - RNA, 22 nt, Human
cugcucugucacucaggcuaga

SEQ ID NO: 1235635 - RNA, 18 nt, Human
cugcuucccagguucaag

SEQ ID NO: 1235636 - RNA, 25 nt, Human
cugcuucccucccugugccggcagc

SEQ ID NO: 1235637 - RNA, 23 nt, Human
cugguucuuggauuccuguagcu

SEQ ID NO: 1235638 - RNA, 21 nt, Human
cuguggggcugugcauccagc

SEQ ID NO: 1235639 - RNA, 18 nt, Human
gaccaguuguccaauguc

SEQ ID NO: 1235640 - RNA, 20 nt, Human
gagacgggguuuuaccaagu

SEQ ID NO: 1235641 - RNA, 23 nt, Human
gaggaggagcugugggauuggcg

SEQ ID NO: 1235642 - RNA, 22 nt, Human
gaguaguugggauuacaggcau

SEQ ID NO: 1235643 - RNA, 18 nt, Human
gauuacaggcgugagccg

SEQ ID NO: 1235644 - RNA, 21 nt, Human
gauuacaggcgugagccgcca

SEQ ID NO: 1235645 - RNA, 24 nt, Human
gauuacaggcgugagccgccaugc

SEQ ID NO: 1235646 - RNA, 19 nt, Human
gcuagagugcaguggcgcg

SEQ ID NO: 1235647 - RNA, 19 nt, Human
gcuccuccugagucuccac

SEQ ID NO: 1235648 - RNA, 22 nt, Human
gcugguugugaacuccuggccu

SEQ ID NO: 1235649 - RNA, 23 nt, Human
gcugguugugaacuccuggccuc

SEQ ID NO: 1235650 - RNA, 22 nt, Human
ggagcugugggauuggcgacca

SEQ ID NO: 1235651 - RNA, 21 nt, Human
ggccagagcacugguucuugg

SEQ ID NO: 1235652 - RNA, 24 nt, Human
ggcugguugugaacuccuggccuc

SEQ ID NO: 1235653 - RNA, 22 nt, Human
ggugcuggggagccuggggugg

SEQ ID NO: 1235654 - RNA, 20 nt, Human
guaguugggauuacaggcau

SEQ ID NO: 1235655 - RNA, 24 nt, Human
gugaucugcccaccucggcuuccc

SEQ ID NO: 1235656 - RNA, 24 nt, Human
gugauucucaugccucagccuccu

SEQ ID NO: 1235657 - RNA, 24 nt, Human
uaauuuuuguauuuuuaguagaga

SEQ ID NO: 1235658 - RNA, 22 nt, Human
uacaggcaugcaccaccacacc

SEQ ID NO: 1235659 - RNA, 20 nt, Human
uacaugcuccuuucuccucu

SEQ ID NO: 1235660 - RNA, 21 nt, Human
uacggccuggccagaagcaga

SEQ ID NO: 1235661 - RNA, 22 nt, Human
uagagugcaguggcgcgaucuc

SEQ ID NO: 1235662 - RNA, 24 nt, Human
uagagugcaguggcgcgaucucgg

SEQ ID NO: 1235663 - RNA, 22 nt, Human
uaguagagacgggguuuuacca

SEQ ID NO: 1235664 - RNA, 24 nt, Human
uaguagagacgggguuuuaccaag

SEQ ID NO: 1235665 - RNA, 26 nt, Human
uaguagagacgggguuuuaccaaguu

SEQ ID NO: 1235666 - RNA, 18 nt, Human
uaguugggauuacaggca

SEQ ID NO: 1235667 - RNA, 20 nt, Human
uauuucaacacaaguuacuu

SEQ ID NO: 1235668 - RNA, 18 nt, Human
ucaagaaaagagcuaaca

SEQ ID NO: 1235669 - RNA, 19 nt, Human
ucacugcaaccucugcuuc

SEQ ID NO: 1235670 - RNA, 24 nt, Human
ucacugcaaccucugcuucccagg

SEQ ID NO: 1235671 - RNA, 20 nt, Human
ucagccuccugaguaguugg

SEQ ID NO: 1235672 - RNA, 19 nt, Human
ucaguacagacucaagaga

SEQ ID NO: 1235673 - RNA, 23 nt, Human
ucagugaaggcggggggcugggg

SEQ ID NO: 1235674 - RNA, 24 nt, Human
ucccaaaguucugggauuacaggc

SEQ ID NO: 1235675 - RNA, 20 nt, Human
ucccagguucaagugauucu

SEQ ID NO: 1235676 - RNA, 21 nt, Human
ucccagguucaagugauucuc

SEQ ID NO: 1235677 - RNA, 24 nt, Human
ucccagguucaagugauucucaug

SEQ ID NO: 1235678 - RNA, 19 nt, Human
uccguaagggugcucagcu

SEQ ID NO: 1235679 - RNA, 24 nt, Human
uccugaguaguugggauuacaggc

SEQ ID NO: 1235680 - RNA, 26 nt, Human
ucucaggcagguucuagacgagccuu

SEQ ID NO: 1235681 - RNA, 18 nt, Human
ucugcucugucacucagg

SEQ ID NO: 1235682 - RNA, 23 nt, Human
ucugcucugucacucaggcuaga

SEQ ID NO: 1235683 - RNA, 19 nt, Human
ucugcuucccagguucaag

SEQ ID NO: 1235684 - RNA, 24 nt, Human
ucugucacucaggcuagagugcag

SEQ ID NO: 1235685 - RNA, 24 nt, Human
ugaccaggcugguugugaacuccu

SEQ ID NO: 1235686 - RNA, 22 nt, Human
ugagacaggagucugcucuguc

SEQ ID NO: 1235687 - RNA, 23 nt, Human
ugaucugcccaccucggcuuccc

SEQ ID NO: 1235688 - RNA, 24 nt, Human
ugaucugcccaccucggcuuccca

SEQ ID NO: 1235689 - RNA, 21 nt, Human
ugcagucucagcuccguaagg

SEQ ID NO: 1235690 - RNA, 22 nt, Human
ugcaguggcgcgaucucggcuc

SEQ ID NO: 1235691 - RNA, 27 nt, Human
ugcccuguccuuucagaagccacaggu

SEQ ID NO: 1235692 - RNA, 23 nt, Human
ugccggcagcccagaaacggccu

SEQ ID NO: 1235693 - RNA, 24 nt, Human
ugccggcagcccagaaacggccuu

SEQ ID NO: 1235694 - RNA, 24 nt, Human
ugccucagccuccugaguaguugg

SEQ ID NO: 1235695 - RNA, 24 nt, Human
ugcucugucacucaggcuagagug

SEQ ID NO: 1235696 - RNA, 20 nt, Human
ugcuggggagccuggggugg

SEQ ID NO: 1235697 - RNA, 21 nt, Human
uggaaguuguucaccuuacau

SEQ ID NO: 1235698 - RNA, 22 nt, Human
uggauuucuguagcugcaguuu

SEQ ID NO: 1235699 - RNA, 20 nt, Human
uggcaaaggaggaggagcug

SEQ ID NO: 1235700 - RNA, 18 nt, Human
uggccagaagcagaagug

SEQ ID NO: 1235701 - RNA, 28 nt, Human
uggccagagcacugguucuuggauuccu

SEQ ID NO: 1235702 - RNA, 20 nt, Human
uggccucaggugaucugccc

SEQ ID NO: 1235703 - RNA, 24 nt, Human
uggccucaggugaucugcccaccu

SEQ ID NO: 1235704 - RNA, 21 nt, Human
uggcuuuggggaccugucuuc

SEQ ID NO: 1235705 - RNA, 21 nt, Human
ugggauuacaggcaugcacca

SEQ ID NO: 1235706 - RNA, 24 nt, Human
ugggauuacaggcaugcaccacca

SEQ ID NO: 1235707 - RNA, 18 nt, Human
ugggauuacaggcgugag

SEQ ID NO: 1235708 - RNA, 21 nt, Human
ugggauuacaggcgugagccg

SEQ ID NO: 1235709 - RNA, 22 nt, Human
ugggauuacaggcgugagccgc

SEQ ID NO: 1235710 - RNA, 23 nt, Human
ugggauuacaggcgugagccgcc

SEQ ID NO: 1235711 - RNA, 24 nt, Human
ugggauuacaggcgugagccgcca

SEQ ID NO: 1235712 - RNA, 25 nt, Human
ugggauuacaggcgugagccgccau

SEQ ID NO: 1235713 - RNA, 26 nt, Human
ugggauuacaggcgugagccgccaug

SEQ ID NO: 1235714 - RNA, 27 nt, Human
ugggauuacaggcgugagccgccaugc

SEQ ID NO: 1235715 - RNA, 21 nt, Human
uguauuuuuaguagagacggg

SEQ ID NO: 1235716 - RNA, 20 nt, Human
uguccccagacccuagugca

SEQ ID NO: 1235717 - RNA, 20 nt, Human
uguggggcugugcauccagc

SEQ ID NO: 1235718 - RNA, 19 nt, Human
uuacaggcgugagccgcca

SEQ ID NO: 1235719 - RNA, 18 nt, Human
uuaguagagacgggguuu

SEQ ID NO: 1235720 - RNA, 22 nt, Human
uuaguagagacgggguuuuacc

SEQ ID NO: 1235721 - RNA, 23 nt, Human
uuaguagagacgggguuuuacca

SEQ ID NO: 1235722 - RNA, 23 nt, Human
uucaagugauucucaugccucag

SEQ ID NO: 1235723 - RNA, 19 nt, Human
uucccagguucaagugauu

SEQ ID NO: 1235724 - RNA, 19 nt, Human
uucuucuauacauguacag

SEQ ID NO: 1235725 - RNA, 18 nt, Human
uugccuggcuuuguggag

SEQ ID NO: 1235726 - RNA, 23 nt, Human
uuguauuuuuaguagagacgggg

SEQ ID NO: 1235727 - RNA, 24 nt, Human
uuuuuaguagagacgggguuuuac

SEQ ID NO: 1235728 - RNA, 20 nt, Human
uuuuuguauuuuuaguagag

SEQ ID NO: 1235729 - RNA, 19 nt, Human
agacaugaaggguuaucua

SEQ ID NO: 1235730 - RNA, 19 nt, Human
agccaaguuaauuaccaca

SEQ ID NO: 1235731 - RNA, 23 nt, Human
cuguauauguguacugagaaacu

SEQ ID NO: 1235732 - RNA, 21 nt, Human
gagacagaaucuggcucuguc

SEQ ID NO: 1235733 - RNA, 21 nt, Human
gucgcccagugagacuccuau

SEQ ID NO: 1235734 - RNA, 23 nt, Human
uaaaaaauucaccugaccaugac

SEQ ID NO: 1235735 - RNA, 25 nt, Human
uaauuaccacaguuuaaauaagaac

SEQ ID NO: 1235736 - RNA, 23 nt, Human
uacaaguaaaaaauucaccugac

SEQ ID NO: 1235737 - RNA, 19 nt, Human
uauacugguagacaugaag

SEQ ID NO: 1235738 - RNA, 19 nt, Human
uccaguuacaaguaaaaaa

SEQ ID NO: 1235739 - RNA, 21 nt, Human
ucuggcucugucgcccaguga

SEQ ID NO: 1235740 - RNA, 21 nt, Human
ucuggcucugucgcccaguga

SEQ ID NO: 1235741 - RNA, 23 nt, Human
ucuggcucugucgcccagugaga

SEQ ID NO: 1235742 - RNA, 20 nt, Human
ccugcccgcuggacuucccu

SEQ ID NO: 1235743 - RNA, 19 nt, Human
ucaaucucugaagaugcau

SEQ ID NO: 1235744 - RNA, 22 nt, Human
ucccugacauuuucaaucucug

SEQ ID NO: 1235745 - RNA, 23 nt, Human
ccagcaugcuacugccacgcccc

SEQ ID NO: 1235746 - RNA, 22 nt, Human
cucccagcaugcuacugccacg

SEQ ID NO: 1235747 - RNA, 18 nt, Human
cuuccugcugugcugaac

SEQ ID NO: 1235748 - RNA, 19 nt, Human
gcauggccuguugucuuuc

SEQ ID NO: 1235749 - RNA, 18 nt, Human
uaauuucugugcauuccc

SEQ ID NO: 1235750 - RNA, 22 nt, Human
uccugcugugcugaaccccugc

SEQ ID NO: 1235751 - RNA, 19 nt, Human
ugcugaaccccugcccuuu

SEQ ID NO: 1235752 - RNA, 19 nt, Human
ugcugugcugaaccccugc

SEQ ID NO: 1235753 - RNA, 22 nt, Human
ugcugugcugaaccccugcccu

SEQ ID NO: 1235754 - RNA, 21 nt, Human
aaaagaaaaaaaaugagcuaa

SEQ ID NO: 1235755 - RNA, 22 nt, Human
aaacaaaaucacccccuggaaa

SEQ ID NO: 1235756 - RNA, 19 nt, Human
aaacaggaauaaggugaca

SEQ ID NO: 1235757 - RNA, 24 nt, Human
aaacaggaauaaggugacaaccag

SEQ ID NO: 1235758 - RNA, 19 nt, Human
aagcugaacccuaagaaau

SEQ ID NO: 1235759 - RNA, 20 nt, Human
aagguccuuauuuuuggaga

SEQ ID NO: 1235760 - RNA, 25 nt, Human
aagguccuuauuuuuggagaacagu

SEQ ID NO: 1235761 - RNA, 24 nt, Human
acagaauccauaaaacaccaugcu

SEQ ID NO: 1235762 - RNA, 21 nt, Human
acugaaauaaaccugaaagcu

SEQ ID NO: 1235763 - RNA, 18 nt, Human
acuguaauuucuggauuu

SEQ ID NO: 1235764 - RNA, 21 nt, Human
acuugcaaauauuccugagag

SEQ ID NO: 1235765 - RNA, 21 nt, Human
agagaguaaggaaggcucacg

SEQ ID NO: 1235766 - RNA, 18 nt, Human
agauaggaaagugggaaa

SEQ ID NO: 1235767 - RNA, 25 nt, Human
agcaucuacuuucucauacugugac

SEQ ID NO: 1235768 - RNA, 18 nt, Human
aggaaggaaggcucccau

SEQ ID NO: 1235769 - RNA, 19 nt, Human
aggcagugagaaaagucag

SEQ ID NO: 1235770 - RNA, 22 nt, Human
aguuugugagaaaggcugaccu

SEQ ID NO: 1235771 - RNA, 22 nt, Human
auaaaaccagauguaccuucca

SEQ ID NO: 1235772 - RNA, 19 nt, Human
auaaaaugugccuuacauc

SEQ ID NO: 1235773 - RNA, 20 nt, Human
aucucugucuggaucaucuc

SEQ ID NO: 1235774 - RNA, 18 nt, Human
augacagcuauuuuuagu

SEQ ID NO: 1235775 - RNA, 18 nt, Human
caaaauuccacaagucuc

SEQ ID NO: 1235776 - RNA, 25 nt, Human
caaaugucucuguacucaaagcucu

SEQ ID NO: 1235777 - RNA, 18 nt, Human
caccccuguagcaauggg

SEQ ID NO: 1235778 - RNA, 21 nt, Human
caccucaccagugccaucugu

SEQ ID NO: 1235779 - RNA, 18 nt, Human
caccuuguuguagaaaca

SEQ ID NO: 1235780 - RNA, 23 nt, Human
cagcucuucuaaaaacaaaauca

SEQ ID NO: 1235781 - RNA, 18 nt, Human
caggaggccuccccuugc

SEQ ID NO: 1235782 - RNA, 28 nt, Human
cagguuucuuccauucacaucguguucc

SEQ ID NO: 1235783 - RNA, 22 nt, Human
caucagucucuuuuugcuaaca

SEQ ID NO: 1235784 - RNA, 22 nt, Human
ccaaagacaaaauuccacaagu

SEQ ID NO: 1235785 - RNA, 19 nt, Human
ccuccccuugccucccaag

SEQ ID NO: 1235786 - RNA, 21 nt, Human
ccuguccaaagacaaaauucc

SEQ ID NO: 1235787 - RNA, 19 nt, Human
ccuugauuaggaaggaagg

SEQ ID NO: 1235788 - RNA, 24 nt, Human
cgaauggacaauaauuuuuaaagc

SEQ ID NO: 1235789 - RNA, 26 nt, Human
cgacagauaaccccauuaaacucucu

SEQ ID NO: 1235790 - RNA, 21 nt, Human
cuacaggacaaaauauaaaac

SEQ ID NO: 1235791 - RNA, 18 nt, Human
cuagaguuuuuauuauuc

SEQ ID NO: 1235792 - RNA, 20 nt, Human
cucacaaauauaaauaccau

SEQ ID NO: 1235793 - RNA, 22 nt, Human
cucacaaggacagacaugucug

SEQ ID NO: 1235794 - RNA, 18 nt, Human
cuccaggugugccagaag

SEQ ID NO: 1235795 - RNA, 19 nt, Human
cucccauggaagcuuuuau

SEQ ID NO: 1235796 - RNA, 21 nt, Human
cugaccuacaggacuaaaacc

SEQ ID NO: 1235797 - RNA, 22 nt, Human
cugcaacggaacucccaccacc

SEQ ID NO: 1235798 - RNA, 21 nt, Human
cuguccaaagacaaaauucca

SEQ ID NO: 1235799 - RNA, 20 nt, Human
cuguguucuggaguugcucc

SEQ ID NO: 1235800 - RNA, 18 nt, Human
cuuccucuugaaaagggc

SEQ ID NO: 1235801 - RNA, 22 nt, Human
cuucuaaaaacaaaaucacccc

SEQ ID NO: 1235802 - RNA, 24 nt, Human
cuuuuugcuaacagaaugaccaag

SEQ ID NO: 1235803 - RNA, 18 nt, Human
gaaaacuuaagcuaaugu

SEQ ID NO: 1235804 - RNA, 22 nt, Human
gacuguguucuggaguugcucc

SEQ ID NO: 1235805 - RNA, 18 nt, Human
gagaaugaauccaaggga

SEQ ID NO: 1235806 - RNA, 21 nt, Human
ggaaaaaccugaacaucucug

SEQ ID NO: 1235807 - RNA, 18 nt, Human
gguaguguaaggaccauu

SEQ ID NO: 1235808 - RNA, 24 nt, Human
gguccuuauuuuuggagaacaguc

SEQ ID NO: 1235809 - RNA, 20 nt, Human
guccacggacguccaaaaau

SEQ ID NO: 1235810 - RNA, 24 nt, Human
guuugucuggagaggguaucuuuc

SEQ ID NO: 1235811 - RNA, 20 nt, Human
uaaaacaggaauaaggugac

SEQ ID NO: 1235812 - RNA, 24 nt, Human
uaacacucacaaauauaaauacca

SEQ ID NO: 1235813 - RNA, 22 nt, Human
uaacgaaggcagugagaaaagu

SEQ ID NO: 1235814 - RNA, 27 nt, Human
uaagaaauuguccaaaaauauguacaa

SEQ ID NO: 1235815 - RNA, 23 nt, Human
uaagcugcuaaaaacuaaaacag

SEQ ID NO: 1235816 - RNA, 24 nt, Human
uacacaaggaaaaaccugaacauc

SEQ ID NO: 1235817 - RNA, 19 nt, Human
uagcagaggugguuuguca

SEQ ID NO: 1235818 - RNA, 20 nt, Human
uaggaaggaaggcucccaug

SEQ ID NO: 1235819 - RNA, 22 nt, Human
uagugcagaguauucacaaaug

SEQ ID NO: 1235820 - RNA, 24 nt, Human
uauagcugagaccugcaacggaac

SEQ ID NO: 1235821 - RNA, 20 nt, Human
uauuuggggaauggaaauaa

SEQ ID NO: 1235822 - RNA, 26 nt, Human
ucaaucaaguaggagaaugaauccaa

SEQ ID NO: 1235823 - RNA, 22 nt, Human
ucaccuaggcaaaucuuaguuc

SEQ ID NO: 1235824 - RNA, 23 nt, Human
ucagggugggaggugauccaauc

SEQ ID NO: 1235825 - RNA, 23 nt, Human
uccagacaaccgucauccccaau

SEQ ID NO: 1235826 - RNA, 21 nt, Human
uccauaaaacaccaugcucca

SEQ ID NO: 1235827 - RNA, 20 nt, Human
ucccauuauccucacgacug

SEQ ID NO: 1235828 - RNA, 22 nt, Human
uccuuccacggguuucaguaaa

SEQ ID NO: 1235829 - RNA, 18 nt, Human
uccuuggggcaucuacag

SEQ ID NO: 1235830 - RNA, 20 nt, Human
uccuuggggcaucuacaguu

SEQ ID NO: 1235831 - RNA, 20 nt, Human
ucuacaguucuuuuucaagu

SEQ ID NO: 1235832 - RNA, 27 nt, Human
ucuccagacaaccgucauccccaauuu

SEQ ID NO: 1235833 - RNA, 23 nt, Human
ucugucaaagaggccuguccaaa

SEQ ID NO: 1235834 - RNA, 21 nt, Human
ugacuagggguauaaaaugug

SEQ ID NO: 1235835 - RNA, 21 nt, Human
ugagaccugcaacggaacucc

SEQ ID NO: 1235836 - RNA, 24 nt, Human
ugauugaaccucugaauucugggg

SEQ ID NO: 1235837 - RNA, 24 nt, Human
ugcaacggaacucccaccaccaaa

SEQ ID NO: 1235838 - RNA, 23 nt, Human
ugcagaguauucacaaauggacc

SEQ ID NO: 1235839 - RNA, 18 nt, Human
ugcucauuaccgccaguc

SEQ ID NO: 1235840 - RNA, 26 nt, Human
uggccagaaggaaguuggucgacacg

SEQ ID NO: 1235841 - RNA, 21 nt, Human
ugggaaaugcugucugcucac

SEQ ID NO: 1235842 - RNA, 23 nt, Human
ugggaaaugcugucugcucacug

SEQ ID NO: 1235843 - RNA, 22 nt, Human
ugguugguuccuuggggcaucu

SEQ ID NO: 1235844 - RNA, 20 nt, Human
uguaaucgaauggacaauaa

SEQ ID NO: 1235845 - RNA, 23 nt, Human
uguccaaagacaaaauuccacaa

SEQ ID NO: 1235846 - RNA, 22 nt, Human
ugugacacaagcacuggauucu

SEQ ID NO: 1235847 - RNA, 24 nt, Human
ugugacacaagcacuggauucuuu

SEQ ID NO: 1235848 - RNA, 18 nt, Human
ugugguaguguaaggacc

SEQ ID NO: 1235849 - RNA, 19 nt, Human
uguuauagcugagaccugc

SEQ ID NO: 1235850 - RNA, 19 nt, Human
uuacucucaagcgauagaa

SEQ ID NO: 1235851 - RNA, 21 nt, Human
uuagcaagagugaacgauuuc

SEQ ID NO: 1235852 - RNA, 21 nt, Human
uuccccagcaucuacuuucuc

SEQ ID NO: 1235853 - RNA, 19 nt, Human
uuccuuggggcaucuacag

SEQ ID NO: 1235854 - RNA, 20 nt, Human
uucuucacugauaauucugg

SEQ ID NO: 1235855 - RNA, 19 nt, Human
uugaauuacacaaggaaaa

SEQ ID NO: 1235856 - RNA, 20 nt, Human
uugcuccaggugugccagaa

SEQ ID NO: 1235857 - RNA, 22 nt, Human
uugcugaauaaaugcaucauau

SEQ ID NO: 1235858 - RNA, 22 nt, Human
uuggguaaagaucaaucauugu

SEQ ID NO: 1235859 - RNA, 20 nt, Human
uuuuguguguucucauugac

SEQ ID NO: 1235860 - RNA, 19 nt, Human
acccugguaaauauuaugg

SEQ ID NO: 1235861 - RNA, 26 nt, Human
caguguaagauaacaccuucagauua

SEQ ID NO: 1235862 - RNA, 24 nt, Human
cauacucuuuuguuacuuccaaaa

SEQ ID NO: 1235863 - RNA, 21 nt, Human
cauuugcaaaauccacuuaaa

SEQ ID NO: 1235864 - RNA, 21 nt, Human
cauuuugcaacuucugcugca

SEQ ID NO: 1235865 - RNA, 22 nt, Human
ccugguaaauauuauggaaaag

SEQ ID NO: 1235866 - RNA, 27 nt, Human
cuggcucuucccaugugggggacgauc

SEQ ID NO: 1235867 - RNA, 18 nt, Human
gacuaggcuaagcugucu

SEQ ID NO: 1235868 - RNA, 18 nt, Human
uaaaagaaguuacuguuu

SEQ ID NO: 1235869 - RNA, 22 nt, Human
uacauaaauuuucaucagacau

SEQ ID NO: 1235870 - RNA, 23 nt, Human
uaccccauccuuuuuauguuucu

SEQ ID NO: 1235871 - RNA, 21 nt, Human
uagcugaagaggccaagaaac

SEQ ID NO: 1235872 - RNA, 20 nt, Human
uaguagcagcugcuacuucu

SEQ ID NO: 1235873 - RNA, 22 nt, Human
uauaacuguuaccccauccuuu

SEQ ID NO: 1235874 - RNA, 22 nt, Human
ucacuagaaaugcauuuucauc

SEQ ID NO: 1235875 - RNA, 18 nt, Human
ucaguaauacugguuuuc

SEQ ID NO: 1235876 - RNA, 20 nt, Human
ucucacuuugaucucuucca

SEQ ID NO: 1235877 - RNA, 23 nt, Human
ucugugaucuggcucuucccaug

SEQ ID NO: 1235878 - RNA, 23 nt, Human
ugauuuacaguguaagauaacac

SEQ ID NO: 1235879 - RNA, 19 nt, Human
ugccuuaucuuucagagua

SEQ ID NO: 1235880 - RNA, 25 nt, Human
ugcucuuguuuccuuucuaguucuc

SEQ ID NO: 1235881 - RNA, 24 nt, Human
uuugagagguagugaggaaagaaa

SEQ ID NO: 1235882 - RNA, 22 nt, Human
uuuuaaggcaagucugcaguua

SEQ ID NO: 1235883 - RNA, 23 nt, Human
aaagcacucagagcuaggcagca

SEQ ID NO: 1235884 - RNA, 21 nt, Human
aacacaccucucaaccucagu

SEQ ID NO: 1235885 - RNA, 20 nt, Human
aacagagcaagacuccaucu

SEQ ID NO: 1235886 - RNA, 19 nt, Human
aacauggugaaaccccguc

SEQ ID NO: 1235887 - RNA, 20 nt, Human
aacauggugaaaccccgucu

SEQ ID NO: 1235888 - RNA, 21 nt, Human
aacauggugaaaccccgucuc

SEQ ID NO: 1235889 - RNA, 18 nt, Human
aaccucccccuccgccuc

SEQ ID NO: 1235890 - RNA, 22 nt, Human
aaccucccccuccgccucccac

SEQ ID NO: 1235891 - RNA, 24 nt, Human
aagaaauaaaaacggccgggcucc

SEQ ID NO: 1235892 - RNA, 18 nt, Human
aagccggagucugaaccc

SEQ ID NO: 1235893 - RNA, 21 nt, Human
aaggaagaacucaaagcacuc

SEQ ID NO: 1235894 - RNA, 23 nt, Human
aaucacuugaacccggaggcgga

SEQ ID NO: 1235895 - RNA, 24 nt, Human
aaucgcuugaacccaggaggcgga

SEQ ID NO: 1235896 - RNA, 24 nt, Human
aauggcaugcaccuguagucccag

SEQ ID NO: 1235897 - RNA, 24 nt, Human
acagagcaagacuccaucucaaaa

SEQ ID NO: 1235898 - RNA, 20 nt, Human
acagagcgagacuccgucuc

SEQ ID NO: 1235899 - RNA, 24 nt, Human
acagagcgagacuccgucucaaaa

SEQ ID NO: 1235900 - RNA, 24 nt, Human
acagggaggaggccaggcccccag

SEQ ID NO: 1235901 - RNA, 19 nt, Human
acccaggugguccagagcc

SEQ ID NO: 1235902 - RNA, 23 nt, Human
accccagcuccucccacccccaa

SEQ ID NO: 1235903 - RNA, 24 nt, Human
accccgucucuacuaaaaauacaa

SEQ ID NO: 1235904 - RNA, 21 nt, Human
accgcuaauagucacugacca

SEQ ID NO: 1235905 - RNA, 24 nt, Human
accucagugaggaacccuccccag

SEQ ID NO: 1235906 - RNA, 24 nt, Human
acugcacuccagccugggcgacag

SEQ ID NO: 1235907 - RNA, 26 nt, Human
acugcacuccagccugggcgacagag

SEQ ID NO: 1235908 - RNA, 23 nt, Human
acugcacucuggccuggcaacag

SEQ ID NO: 1235909 - RNA, 23 nt, Human
acugcacucuggccuggcaacag

SEQ ID NO: 1235910 - RNA, 22 nt, Human
agaaucgcuugaacccaggagg

SEQ ID NO: 1235911 - RNA, 18 nt, Human
agacagggaggaggccag

SEQ ID NO: 1235912 - RNA, 23 nt, Human
agcacugugagugugugggucca

SEQ ID NO: 1235913 - RNA, 24 nt, Human
agcacuuugggaggucgagguggg

SEQ ID NO: 1235914 - RNA, 19 nt, Human
agcagagccuguugcaccc

SEQ ID NO: 1235915 - RNA, 20 nt, Human
agcagggucaggaggcuggg

SEQ ID NO: 1235916 - RNA, 24 nt, Human
agcagggucaggaggcuggggcgg

SEQ ID NO: 1235917 - RNA, 24 nt, Human
agccugggcgacagagcgagacuc

SEQ ID NO: 1235918 - RNA, 27 nt, Human
agcuccucccacccccaaccucccccu

SEQ ID NO: 1235919 - RNA, 21 nt, Human
aggaccagcaaggggcaggug

SEQ ID NO: 1235920 - RNA, 26 nt, Human
aggaggucaagagauugagaccaucc

SEQ ID NO: 1235921 - RNA, 24 nt, Human
aggcagcaggaaauggggaggccu

SEQ ID NO: 1235922 - RNA, 23 nt, Human
aggcaggagaaucgcuugaaccc

SEQ ID NO: 1235923 - RNA, 24 nt, Human
aggcaggagaaucgcuugaaccca

SEQ ID NO: 1235924 - RNA, 23 nt, Human
aggcagggaaucacuugaacccg

SEQ ID NO: 1235925 - RNA, 24 nt, Human
aggcauaauggcaugcaccuguag

SEQ ID NO: 1235926 - RNA, 24 nt, Human
aggcggagguugcagugagccaag

SEQ ID NO: 1235927 - RNA, 24 nt, Human
aggcggagguugcagugagcugag

SEQ ID NO: 1235928 - RNA, 20 nt, Human
aggcugaggcaggagaaucg

SEQ ID NO: 1235929 - RNA, 24 nt, Human
aggcugaggcaggagaaucgcuug

SEQ ID NO: 1235930 - RNA, 19 nt, Human
aggcugaggcagggaauca

SEQ ID NO: 1235931 - RNA, 21 nt, Human
aggcuggggcggggccggagg

SEQ ID NO: 1235932 - RNA, 22 nt, Human
aggcuggggcggggccggaggg

SEQ ID NO: 1235933 - RNA, 21 nt, Human
agggaggguggcugggaggga

SEQ ID NO: 1235934 - RNA, 24 nt, Human
agggaggguggcugggagggacgg

SEQ ID NO: 1235935 - RNA, 24 nt, Human
agguggguggaucaggaggucaag

SEQ ID NO: 1235936 - RNA, 20 nt, Human
agugacccagccccaccccu

SEQ ID NO: 1235937 - RNA, 21 nt, Human
auccuggccaacauggugaaa

SEQ ID NO: 1235938 - RNA, 24 nt, Human
aucgcgccacugcacuccagccug

SEQ ID NO: 1235939 - RNA, 24 nt, Human
auugcaccacugcacucuggccug

SEQ ID NO: 1235940 - RNA, 24 nt, Human
caacauggugaaaccccgucucua

SEQ ID NO: 1235941 - RNA, 21 nt, Human
caagacuccaucucaaaaaaa

SEQ ID NO: 1235942 - RNA, 18 nt, Human
cacaaacaaggcuggaga

SEQ ID NO: 1235943 - RNA, 26 nt, Human
cacacuaacggaaugcacaaacaagg

SEQ ID NO: 1235944 - RNA, 18 nt, Human
caccacugcacucuggcc

SEQ ID NO: 1235945 - RNA, 23 nt, Human
cacccccaaccucccccuccgcc

SEQ ID NO: 1235946 - RNA, 21 nt, Human
caccgcuucggagaggcaguc

SEQ ID NO: 1235947 - RNA, 22 nt, Human
caccgcuucggagaggcagucu

SEQ ID NO: 1235948 - RNA, 19 nt, Human
caccuguagucccaguuac

SEQ ID NO: 1235949 - RNA, 22 nt, Human
caccuguagucccaguuacuca

SEQ ID NO: 1235950 - RNA, 24 nt, Human
cacgccuguaaucccagcacuuug

SEQ ID NO: 1235951 - RNA, 20 nt, Human
cacucagagcuaggcagcag

SEQ ID NO: 1235952 - RNA, 24 nt, Human
cacuccagccugggcgacagagcg

SEQ ID NO: 1235953 - RNA, 22 nt, Human
cacucuggccuggcaacagagc

SEQ ID NO: 1235954 - RNA, 19 nt, Human
cacugcacuccagccuggg

SEQ ID NO: 1235955 - RNA, 20 nt, Human
cacugcacuccagccugggc

SEQ ID NO: 1235956 - RNA, 22 nt, Human
cacugcacuccagccugggcga

SEQ ID NO: 1235957 - RNA, 23 nt, Human
cacugcacuccagccugggcgac

SEQ ID NO: 1235958 - RNA, 24 nt, Human
cacugcacuccagccugggcgaca

SEQ ID NO: 1235959 - RNA, 18 nt, Human
cacugcacucuggccugg

SEQ ID NO: 1235960 - RNA, 20 nt, Human
cacugcacucuggccuggca

SEQ ID NO: 1235961 - RNA, 23 nt, Human
cacugcacucuggccuggcaaca

SEQ ID NO: 1235962 - RNA, 23 nt, Human
cacugcacucuggccuggcaaca

SEQ ID NO: 1235963 - RNA, 21 nt, Human
cagagccuguugcacccauaa

SEQ ID NO: 1235964 - RNA, 21 nt, Human
cagcacuuugggaggucgagg

SEQ ID NO: 1235965 - RNA, 24 nt, Human
cagcacuuugggaggucgaggugg

SEQ ID NO: 1235966 - RNA, 23 nt, Human
cagcaggcugaggcagggaauca

SEQ ID NO: 1235967 - RNA, 23 nt, Human
cagccccaccccagcuccuccca

SEQ ID NO: 1235968 - RNA, 18 nt, Human
cagcgaagccacaggauu

SEQ ID NO: 1235969 - RNA, 24 nt, Human
cagcuacuugggaggcugaggcag

SEQ ID NO: 1235970 - RNA, 19 nt, Human
caggaccagcaaggggcag

SEQ ID NO: 1235971 - RNA, 22 nt, Human
caggcccccagugacaaccaug

SEQ ID NO: 1235972 - RNA, 21 nt, Human
caggccgggcgugguggcuca

SEQ ID NO: 1235973 - RNA, 24 nt, Human
caggcugaggcagggaaucacuug

SEQ ID NO: 1235974 - RNA, 22 nt, Human
cagggaccaccuguaaccuaau

SEQ ID NO: 1235975 - RNA, 19 nt, Human
caggugggaucaguccuau

SEQ ID NO: 1235976 - RNA, 25 nt, Human
caucucaaaaaaacaauuagccagg

SEQ ID NO: 1235977 - RNA, 20 nt, Human
ccaaggcugcuaagcaguga

SEQ ID NO: 1235978 - RNA, 22 nt, Human
ccaccuguaaccuaaugggggc

SEQ ID NO: 1235979 - RNA, 23 nt, Human
ccaccuguaaccuaaugggggca

SEQ ID NO: 1235980 - RNA, 20 nt, Human
ccacugcacuccagccuggg

SEQ ID NO: 1235981 - RNA, 20 nt, Human
ccacugcacuccagccuggg

SEQ ID NO: 1235982 - RNA, 21 nt, Human
ccacugcacuccagccugggc

SEQ ID NO: 1235983 - RNA, 21 nt, Human
ccacugcacuccagccugggc

SEQ ID NO: 1235984 - RNA, 24 nt, Human
ccacugcacuccagccugggcgac

SEQ ID NO: 1235985 - RNA, 19 nt, Human
ccacugcacucuggccugg

SEQ ID NO: 1235986 - RNA, 19 nt, Human
ccacugcacucuggccugg

SEQ ID NO: 1235987 - RNA, 20 nt, Human
ccacugcacucuggccuggc

SEQ ID NO: 1235988 - RNA, 23 nt, Human
ccacugcacucuggccuggcaac

SEQ ID NO: 1235989 - RNA, 23 nt, Human
ccagcuccucccacccccaaccu

SEQ ID NO: 1235990 - RNA, 24 nt, Human
ccagcuccucccacccccaaccuc

SEQ ID NO: 1235991 - RNA, 22 nt, Human
ccaggaggcggagguugcagug

SEQ ID NO: 1235992 - RNA, 21 nt, Human
ccaggcauuguggcacgugcc

SEQ ID NO: 1235993 - RNA, 26 nt, Human
ccaggccgggcgugguggcucacgcc

SEQ ID NO: 1235994 - RNA, 25 nt, Human
ccaggccgggcgugguggcucacgg

SEQ ID NO: 1235995 - RNA, 22 nt, Human
cccacccccaaccucccccucc

SEQ ID NO: 1235996 - RNA, 21 nt, Human
cccagcuccucccacccccaa

SEQ ID NO: 1235997 - RNA, 18 nt, Human
ccccaaccucccccuccg

SEQ ID NO: 1235998 - RNA, 20 nt, Human
ccccaaccucccccuccgcc

SEQ ID NO: 1235999 - RNA, 20 nt, Human
ccccaaccucccccuccgcc

SEQ ID NO: 1236000 - RNA, 24 nt, Human
ccccaaccucccccuccgccuccc

SEQ ID NO: 1236001 - RNA, 30 nt, Human
ccccaaccucccccuccgccucccaccccc

SEQ ID NO: 1236002 - RNA, 19 nt, Human
ccccaccccagcuccuccc

SEQ ID NO: 1236003 - RNA, 19 nt, Human
ccccaccccagcuccuccc

SEQ ID NO: 1236004 - RNA, 22 nt, Human
ccccaccccagcuccucccacc

SEQ ID NO: 1236005 - RNA, 18 nt, Human
ccccagcuccucccaccc

SEQ ID NO: 1236006 - RNA, 19 nt, Human
cccccaaccucccccuccg

SEQ ID NO: 1236007 - RNA, 22 nt, Human
cccccaaccucccccuccgccu

SEQ ID NO: 1236008 - RNA, 24 nt, Human
cccgucccugcagcgagccuuagc

SEQ ID NO: 1236009 - RNA, 18 nt, Human
cccuccgccucccacccc

SEQ ID NO: 1236010 - RNA, 24 nt, Human
ccgugggcagggaccaccuguaac

SEQ ID NO: 1236011 - RNA, 18 nt, Human
ccucagugacccagcccc

SEQ ID NO: 1236012 - RNA, 27 nt, Human
ccucccacccccaaccucccccuccgc

SEQ ID NO: 1236013 - RNA, 19 nt, Human
ccugcaccuuccccagcug

SEQ ID NO: 1236014 - RNA, 18 nt, Human
ccugcagcgagccuuagc

SEQ ID NO: 1236015 - RNA, 21 nt, Human
ccuggcaacagagcaagacuc

SEQ ID NO: 1236016 - RNA, 20 nt, Human
ccuggcaugcugggucccug

SEQ ID NO: 1236017 - RNA, 22 nt, Human
ccuggccaacauggugaaaccc

SEQ ID NO: 1236018 - RNA, 23 nt, Human
ccuggccaacauggugaaacccc

SEQ ID NO: 1236019 - RNA, 24 nt, Human
ccuggccaacauggugaaaccccg

SEQ ID NO: 1236020 - RNA, 22 nt, Human
ccugggcgacagagcgagacuc

SEQ ID NO: 1236021 - RNA, 22 nt, Human
ccuguaaucccagcacuuuggg

SEQ ID NO: 1236022 - RNA, 18 nt, Human
ccuguagucccagcuacu

SEQ ID NO: 1236023 - RNA, 21 nt, Human
ccuguagucccagcuacuugg

SEQ ID NO: 1236024 - RNA, 22 nt, Human
ccuguagucccagcuacuuggg

SEQ ID NO: 1236025 - RNA, 24 nt, Human
ccuguagucccaguuacucagcag

SEQ ID NO: 1236026 - RNA, 22 nt, Human
cgagguggguggaucaggaggu

SEQ ID NO: 1236027 - RNA, 24 nt, Human
cgagguggguggaucaggagguca

SEQ ID NO: 1236028 - RNA, 26 nt, Human
cgccacugcacuccagccugggcgac

SEQ ID NO: 1236029 - RNA, 25 nt, Human
cgcuucggagaggcagucucccagg

SEQ ID NO: 1236030 - RNA, 21 nt, Human
cggcagggcgguggcggagga

SEQ ID NO: 1236031 - RNA, 26 nt, Human
cggccgggcuccgaggggcccuggcu

SEQ ID NO: 1236032 - RNA, 19 nt, Human
cgggaacuugcccaaggcu

SEQ ID NO: 1236033 - RNA, 22 nt, Human
cucacgccuguaaucccagcac

SEQ ID NO: 1236034 - RNA, 24 nt, Human
cucacgccuguaaucccagcacuu

SEQ ID NO: 1236035 - RNA, 23 nt, Human
cucagagcuaggcagcaggaaau

SEQ ID NO: 1236036 - RNA, 22 nt, Human
cucccacccccaaccucccccu

SEQ ID NO: 1236037 - RNA, 19 nt, Human
cuccgccucccaccccagg

SEQ ID NO: 1236038 - RNA, 21 nt, Human
cuccucccacccccaaccuuc

SEQ ID NO: 1236039 - RNA, 20 nt, Human
cugcggccucuucagggccc

SEQ ID NO: 1236040 - RNA, 19 nt, Human
cuucagggcccagauucca

SEQ ID NO: 1236041 - RNA, 24 nt, Human
cuugaacccggaggcggagguugc

SEQ ID NO: 1236042 - RNA, 21 nt, Human
cuuuguacugacaccacgcuc

SEQ ID NO: 1236043 - RNA, 18 nt, Human
gaagacagcgaagccaca

SEQ ID NO: 1236044 - RNA, 24 nt, Human
gaaugcacaaacaaggcuggagaa

SEQ ID NO: 1236045 - RNA, 24 nt, Human
gacagagcgagacuccgucucaaa

SEQ ID NO: 1236046 - RNA, 23 nt, Human
gagaucgcgccacugcacuccag

SEQ ID NO: 1236047 - RNA, 23 nt, Human
gaggaacccuccccagcacacua

SEQ ID NO: 1236048 - RNA, 22 nt, Human
gagggaugcggacacagcacgg

SEQ ID NO: 1236049 - RNA, 21 nt, Human
gagguggguggaucaggaggu

SEQ ID NO: 1236050 - RNA, 18 nt, Human
gagguugcagugagccaa

SEQ ID NO: 1236051 - RNA, 21 nt, Human
gagguugcagugagccaagau

SEQ ID NO: 1236052 - RNA, 23 nt, Human
gagguugcagugagccaagauug

SEQ ID NO: 1236053 - RNA, 23 nt, Human
gagguugcagugagcugagaucg

SEQ ID NO: 1236054 - RNA, 24 nt, Human
gcacuccagccugggcgacagagc

SEQ ID NO: 1236055 - RNA, 23 nt, Human
gcacucuggccuggcaacagagc

SEQ ID NO: 1236056 - RNA, 22 nt, Human
gcaggagaaucgcuugaaccca

SEQ ID NO: 1236057 - RNA, 24 nt, Human
gccaacauggugaaaccccgucuc

SEQ ID NO: 1236058 - RNA, 22 nt, Human
gccacugcacuccagccugggc

SEQ ID NO: 1236059 - RNA, 24 nt, Human
gccacugcacuccagccugggcga

SEQ ID NO: 1236060 - RNA, 22 nt, Human
gccuggcaacagagcaagacuc

SEQ ID NO: 1236061 - RNA, 21 nt, Human
gccugggacuaaaggagaaag

SEQ ID NO: 1236062 - RNA, 24 nt, Human
gcgaagccacaggauuaugcaaag

SEQ ID NO: 1236063 - RNA, 20 nt, Human
gcgguggcggaggaggaagc

SEQ ID NO: 1236064 - RNA, 23 nt, Human
gcuaggcagcaggaaauggggag

SEQ ID NO: 1236065 - RNA, 20 nt, Human
gcugagaucgcgccacugca

SEQ ID NO: 1236066 - RNA, 19 nt, Human
ggaacccuccccagcacac

SEQ ID NO: 1236067 - RNA, 25 nt, Human
ggaaugcacaaacaaggcuggagac

SEQ ID NO: 1236068 - RNA, 18 nt, Human
ggagacagggaggaggcc

SEQ ID NO: 1236069 - RNA, 18 nt, Human
ggagcaggcagggaggcc

SEQ ID NO: 1236070 - RNA, 22 nt, Human
ggaggcggagguugcagugagc

SEQ ID NO: 1236071 - RNA, 22 nt, Human
ggaggcggagguugcagugagc

SEQ ID NO: 1236072 - RNA, 22 nt, Human
ggagguugcagugagccaagau

SEQ ID NO: 1236073 - RNA, 24 nt, Human
ggagguugcagugagccaagauug

SEQ ID NO: 1236074 - RNA, 22 nt, Human
ggagguugcagugagcugagau

SEQ ID NO: 1236075 - RNA, 24 nt, Human
ggagguugcagugagcugagaucg

SEQ ID NO: 1236076 - RNA, 23 nt, Human
ggcgugguggcucacgccuguaa

SEQ ID NO: 1236077 - RNA, 20 nt, Human
gggaggguggcugggaggga

SEQ ID NO: 1236078 - RNA, 22 nt, Human
ggggcaggugggaucaguccua

SEQ ID NO: 1236079 - RNA, 24 nt, Human
gguggcucacgccuguaaucccag

SEQ ID NO: 1236080 - RNA, 23 nt, Human
guacaggaccagcaaggggcagg

SEQ ID NO: 1236081 - RNA, 18 nt, Human
guccagagcccaugugcu

SEQ ID NO: 1236082 - RNA, 22 nt, Human
guggcacgugccuguaguccca

SEQ ID NO: 1236083 - RNA, 23 nt, Human
guggcucacgccuguaaucccag

SEQ ID NO: 1236084 - RNA, 24 nt, Human
gugguccagagcccaugugcugga

SEQ ID NO: 1236085 - RNA, 19 nt, Human
guugcagugagcugagauc

SEQ ID NO: 1236086 - RNA, 21 nt, Human
uaaaaauacaaaaauuagcca

SEQ ID NO: 1236087 - RNA, 19 nt, Human
uaaccuaaugggggcagag

SEQ ID NO: 1236088 - RNA, 18 nt, Human
uaagaaauaaaaacggcc

SEQ ID NO: 1236089 - RNA, 19 nt, Human
uaagacacccuagcuagaa

SEQ ID NO: 1236090 - RNA, 19 nt, Human
uaaggaagaacucaaagca

SEQ ID NO: 1236091 - RNA, 19 nt, Human
uaauccucaacagaagcca

SEQ ID NO: 1236092 - RNA, 24 nt, Human
uacaggaccagcaaggggcaggug

SEQ ID NO: 1236093 - RNA, 21 nt, Human
uacugacaccacgcucagcac

SEQ ID NO: 1236094 - RNA, 23 nt, Human
uauacaugguuuaagaaauaaaa

SEQ ID NO: 1236095 - RNA, 28 nt, Human
ucaacagaagccagaacuaaucaacggg

SEQ ID NO: 1236096 - RNA, 24 nt, Human
ucaggaggucaagagauugagacc

SEQ ID NO: 1236097 - RNA, 22 nt, Human
ucagggcccagauuccacaggg

SEQ ID NO: 1236098 - RNA, 23 nt, Human
ucagggcccagauuccacaggga

SEQ ID NO: 1236099 - RNA, 25 nt, Human
uccaacacaccucucaaccucagug

SEQ ID NO: 1236100 - RNA, 23 nt, Human
uccagccugggcgacagagcgag

SEQ ID NO: 1236101 - RNA, 24 nt, Human
uccagccugggcgacagagcgaga

SEQ ID NO: 1236102 - RNA, 20 nt, Human
ucccacccccaaccuccccc

SEQ ID NO: 1236103 - RNA, 23 nt, Human
ucccacccccaaccucccccucc

SEQ ID NO: 1236104 - RNA, 18 nt, Human
ucccugcaccgugggcag

SEQ ID NO: 1236105 - RNA, 25 nt, Human
ucccugcuauaagacacccuaggac

SEQ ID NO: 1236106 - RNA, 23 nt, Human
ucgcgccacugcacuccagccug

SEQ ID NO: 1236107 - RNA, 24 nt, Human
ucgcuugaacccaggaggcggagg

SEQ ID NO: 1236108 - RNA, 22 nt, Human
ucggagaggcagucucccaggc

SEQ ID NO: 1236109 - RNA, 22 nt, Human
ucucccaggcccccugcaccuu

SEQ ID NO: 1236110 - RNA, 27 nt, Human
ucucccugcaccgugggcagggacugg

SEQ ID NO: 1236111 - RNA, 23 nt, Human
ucucuacuaaaaauacaaaaauu

SEQ ID NO: 1236112 - RNA, 20 nt, Human
ugaagacagcgaagccacag

SEQ ID NO: 1236113 - RNA, 24 nt, Human
ugacaaccaugauuuaagacagaa

SEQ ID NO: 1236114 - RNA, 24 nt, Human
ugagaccauccuggccaacauggu

SEQ ID NO: 1236115 - RNA, 22 nt, Human
ugagcugagaucgcgccacugc

SEQ ID NO: 1236116 - RNA, 20 nt, Human
ugaggcaggagaaucgcuug

SEQ ID NO: 1236117 - RNA, 24 nt, Human
ugaggcaggagaaucgcuugaacc

SEQ ID NO: 1236118 - RNA, 25 nt, Human
ugaggcaggagaaucgcuugaaccc

SEQ ID NO: 1236119 - RNA, 19 nt, Human
ugaggcagggaaucacuug

SEQ ID NO: 1236120 - RNA, 23 nt, Human
ugaggcagggaaucacuugaacc

SEQ ID NO: 1236121 - RNA, 24 nt, Human
ugaggcagggaaucacuugaaccc

SEQ ID NO: 1236122 - RNA, 19 nt, Human
ugaggcuggggagaggguc

SEQ ID NO: 1236123 - RNA, 24 nt, Human
ugccuguagucccagcuacuuggg

SEQ ID NO: 1236124 - RNA, 23 nt, Human
ugcugggucccugcuauaagaca

SEQ ID NO: 1236125 - RNA, 19 nt, Human
uggcaagcuccccgucccu

SEQ ID NO: 1236126 - RNA, 22 nt, Human
uggcaagcuccccgucccugca

SEQ ID NO: 1236127 - RNA, 24 nt, Human
uggcaagcuccccgucccugcagc

SEQ ID NO: 1236128 - RNA, 24 nt, Human
uggccaacauggugaaaccccguc

SEQ ID NO: 1236129 - RNA, 24 nt, Human
uggcucacgccuguaaucccagca

SEQ ID NO: 1236130 - RNA, 19 nt, Human
ugggaggcugaggcaggag

SEQ ID NO: 1236131 - RNA, 23 nt, Human
ugggaggcugaggcaggagaauc

SEQ ID NO: 1236132 - RNA, 19 nt, Human
ugggagggacggaagggug

SEQ ID NO: 1236133 - RNA, 23 nt, Human
ugggagggacggaagggugaggg

SEQ ID NO: 1236134 - RNA, 23 nt, Human
ugggaggucgagguggguggauc

SEQ ID NO: 1236135 - RNA, 27 nt, Human
ugggggcagaggagcagaaccacgagg

SEQ ID NO: 1236136 - RNA, 22 nt, Human
uggguggaucaggaggucaaga

SEQ ID NO: 1236137 - RNA, 24 nt, Human
ugguggcucacgccuguaauccca

SEQ ID NO: 1236138 - RNA, 23 nt, Human
uuaauccucaacagaagccagaa

SEQ ID NO: 1236139 - RNA, 23 nt, Human
uucccuguccgcuggugcugggu

SEQ ID NO: 1236140 - RNA, 24 nt, Human
uugaacccaggaggcggagguugc

SEQ ID NO: 1236141 - RNA, 22 nt, Human
uugcagugagccaagauugcac

SEQ ID NO: 1236142 - RNA, 18 nt, Human
uugcagugagcugagauc

SEQ ID NO: 1236143 - RNA, 20 nt, Human
uugcagugagcugagaucgc

SEQ ID NO: 1236144 - RNA, 22 nt, Human
uugcagugagcugagaucgcgc

SEQ ID NO: 1236145 - RNA, 21 nt, Human
uugcccaaggcugcuaagcag

SEQ ID NO: 1236146 - RNA, 24 nt, Human
uugggaggcugaggcaggagaauc

SEQ ID NO: 1236147 - RNA, 23 nt, Human
augaaguguuugaggaagugggu

SEQ ID NO: 1236148 - RNA, 24 nt, Human
auggcacaggugauggucucccuc

SEQ ID NO: 1236149 - RNA, 20 nt, Human
cagcucuggguccaucuccc

SEQ ID NO: 1236150 - RNA, 23 nt, Human
caggagcacccugcuggagaggc

SEQ ID NO: 1236151 - RNA, 26 nt, Human
caggagcacccugcuggagaggccaa

SEQ ID NO: 1236152 - RNA, 22 nt, Human
cgggaaggcuggggcagcagca

SEQ ID NO: 1236153 - RNA, 21 nt, Human
cuccccacccuacauguuccc

SEQ ID NO: 1236154 - RNA, 24 nt, Human
cuuuuauuauuauugcuuuuauua

SEQ ID NO: 1236155 - RNA, 23 nt, Human
gagcacccugcuggagaggccaa

SEQ ID NO: 1236156 - RNA, 20 nt, Human
ggaaggcuggggcagcagca

SEQ ID NO: 1236157 - RNA, 20 nt, Human
gguguuucuggagugcagag

SEQ ID NO: 1236158 - RNA, 21 nt, Human
uacauguucccagguucuguc

SEQ ID NO: 1236159 - RNA, 22 nt, Human
ucaggguguuucuggagugcag

SEQ ID NO: 1236160 - RNA, 20 nt, Human
uccaucuccucucugagccu

SEQ ID NO: 1236161 - RNA, 22 nt, Human
uccaugcccaccauuugccccu

SEQ ID NO: 1236162 - RNA, 22 nt, Human
ucccauggcacaggugaugguc

SEQ ID NO: 1236163 - RNA, 21 nt, Human
uccccacccuacauguuccca

SEQ ID NO: 1236164 - RNA, 20 nt, Human
ucccucucagcucugggucc

SEQ ID NO: 1236165 - RNA, 21 nt, Human
ucuaguucuuguuuugucucu

SEQ ID NO: 1236166 - RNA, 24 nt, Human
ucucccucucagcucuggguccau

SEQ ID NO: 1236167 - RNA, 25 nt, Human
uggcacaggugauggucucccucuc

SEQ ID NO: 1236168 - RNA, 23 nt, Human
ugggaauucucaccaagaguuuc

SEQ ID NO: 1236169 - RNA, 22 nt, Human
uugccccuuuguccuaggguac

SEQ ID NO: 1236170 - RNA, 23 nt, Human
uuucauuaggccaagucugcggg

SEQ ID NO: 1236171 - RNA, 18 nt, Human
uuuccaucuccucucuga

SEQ ID NO: 1236172 - RNA, 24 nt, Human
aaaauaacgcucugagacaggaug

SEQ ID NO: 1236173 - RNA, 20 nt, Human
agcagcagccaggcugggga

SEQ ID NO: 1236174 - RNA, 22 nt, Human
agccaaagaggaaccgaggcac

SEQ ID NO: 1236175 - RNA, 22 nt, Human
agccaggcuggggaccccaggc

SEQ ID NO: 1236176 - RNA, 18 nt, Human
agccggaguccccgagga

SEQ ID NO: 1236177 - RNA, 26 nt, Human
aggcacaggcccaggccucccacgca

SEQ ID NO: 1236178 - RNA, 18 nt, Human
aggcaggacgaguguagg

SEQ ID NO: 1236179 - RNA, 19 nt, Human
auucagggcccagcagcag

SEQ ID NO: 1236180 - RNA, 19 nt, Human
caaaauaacgcucugagac

SEQ ID NO: 1236181 - RNA, 19 nt, Human
cagaguucagguaccugcc

SEQ ID NO: 1236182 - RNA, 21 nt, Human
cagcccagccacaggguccug

SEQ ID NO: 1236183 - RNA, 21 nt, Human
caggaugcuccaggcccuuga

SEQ ID NO: 1236184 - RNA, 19 nt, Human
caggcaggacgaguguagg

SEQ ID NO: 1236185 - RNA, 22 nt, Human
caggcaggacgaguguaggcag

SEQ ID NO: 1236186 - RNA, 19 nt, Human
caggcuggggaccccaggc

SEQ ID NO: 1236187 - RNA, 23 nt, Human
cccaggcuggggcagccuugagc

SEQ ID NO: 1236188 - RNA, 23 nt, Human
ccccgaggacagccaaagaggaa

SEQ ID NO: 1236189 - RNA, 24 nt, Human
cgaggacagccaaagaggaaccga

SEQ ID NO: 1236190 - RNA, 18 nt, Human
cuuuguacuggccucucu

SEQ ID NO: 1236191 - RNA, 24 nt, Human
gaccaaaauaacgcucugagacag

SEQ ID NO: 1236192 - RNA, 19 nt, Human
gccacaggguccugccagc

SEQ ID NO: 1236193 - RNA, 19 nt, Human
gcccagcagcagccaggcu

SEQ ID NO: 1236194 - RNA, 25 nt, Human
ggaugcuccaggcccuugaacucag

SEQ ID NO: 1236195 - RNA, 22 nt, Human
gggcuuuguacuggccucucuu

SEQ ID NO: 1236196 - RNA, 22 nt, Human
ucagggcccagcagcagccagg

SEQ ID NO: 1236197 - RNA, 21 nt, Human
ucccagcccagccacaggguc

SEQ ID NO: 1236198 - RNA, 23 nt, Human
uccucugugaagcccucucagag

SEQ ID NO: 1236199 - RNA, 22 nt, Human
ugacagcuccauucccagccca

SEQ ID NO: 1236200 - RNA, 22 nt, Human
ugagacaggaugcuccaggccc

SEQ ID NO: 1236201 - RNA, 23 nt, Human
ugcuccaggcccuugaacucagc

SEQ ID NO: 1236202 - RNA, 20 nt, Human
uggcgugccuuccacucucu

SEQ ID NO: 1236203 - RNA, 20 nt, Human
aagggcagaaggugcugggg

SEQ ID NO: 1236204 - RNA, 26 nt, Human
aaggugcuggggccagcccgcugggg

SEQ ID NO: 1236205 - RNA, 18 nt, Human
agaaagaaucugaauaug

SEQ ID NO: 1236206 - RNA, 22 nt, Human
agaaggugcuggggccagcccg

SEQ ID NO: 1236207 - RNA, 20 nt, Human
agaggcugucucagcaucua

SEQ ID NO: 1236208 - RNA, 20 nt, Human
agggagaggcugucucagca

SEQ ID NO: 1236209 - RNA, 24 nt, Human
cagcccgcuggggguggcgguccg

SEQ ID NO: 1236210 - RNA, 22 nt, Human
cgucccggccucugugcccugg

SEQ ID NO: 1236211 - RNA, 23 nt, Human
cuggggccagcccgcugggggug

SEQ ID NO: 1236212 - RNA, 23 nt, Human
cuugccuggcguacccucccuuu

SEQ ID NO: 1236213 - RNA, 22 nt, Human
gcuguggggcaggccgucuguc

SEQ ID NO: 1236214 - RNA, 24 nt, Human
ggagaggcugucucagcaucuaug

SEQ ID NO: 1236215 - RNA, 19 nt, Human
gggaagggcagaaggugcu

SEQ ID NO: 1236216 - RNA, 22 nt, Human
gucccggccucugugcccuggg

SEQ ID NO: 1236217 - RNA, 18 nt, Human
guggacacgggccuccgu

SEQ ID NO: 1236218 - RNA, 20 nt, Human
uaaagcgaggguaucuucag

SEQ ID NO: 1236219 - RNA, 26 nt, Human
uaacaucaaagaaagaaucugaauau

SEQ ID NO: 1236220 - RNA, 23 nt, Human
ucccggccucugugcccugggcu

SEQ ID NO: 1236221 - RNA, 21 nt, Human
ucugagugggagcugcagcug

SEQ ID NO: 1236222 - RNA, 21 nt, Human
ugagugggagcugcagcugau

SEQ ID NO: 1236223 - RNA, 22 nt, Human
ugcagcugauguggacacgggc

SEQ ID NO: 1236224 - RNA, 20 nt, Human
ugcccugggcuugccuggcg

SEQ ID NO: 1236225 - RNA, 20 nt, Human
ugcccugggcuugccuggcg

SEQ ID NO: 1236226 - RNA, 23 nt, Human
uggcaaacccugcguucacuggc

SEQ ID NO: 1236227 - RNA, 18 nt, Human
ugggaagggcagaaggug

SEQ ID NO: 1236228 - RNA, 19 nt, Human
ugggaagggcagaaggugc

SEQ ID NO: 1236229 - RNA, 19 nt, Human
uggggcaggccgucugucu

SEQ ID NO: 1236230 - RNA, 21 nt, Human
ugguagcaauggcaaacccug

SEQ ID NO: 1236231 - RNA, 24 nt, Human
uuguggugcuugcuugguagcaau

SEQ ID NO: 1236232 - RNA, 23 nt, Human
acagaucuuuccaagacccaaag

SEQ ID NO: 1236233 - RNA, 20 nt, Human
agacccaaagaucagggcga

SEQ ID NO: 1236234 - RNA, 23 nt, Human
caaagucuacagaucuuuccaag

SEQ ID NO: 1236235 - RNA, 22 nt, Human
cagaucuuuccaagacccaaag

SEQ ID NO: 1236236 - RNA, 19 nt, Human
ccaccaacguucagaucca

SEQ ID NO: 1236237 - RNA, 19 nt, Human
cccgcagguggcgguggcc

SEQ ID NO: 1236238 - RNA, 18 nt, Human
cgaccaacuugcaguaga

SEQ ID NO: 1236239 - RNA, 18 nt, Human
cgggugaaggcugagccc

SEQ ID NO: 1236240 - RNA, 22 nt, Human
cucgccggguccccucuccccg

SEQ ID NO: 1236241 - RNA, 22 nt, Human
cugaggacaggggagggcuuug

SEQ ID NO: 1236242 - RNA, 19 nt, Human
gacaggggagggcuuugcc

SEQ ID NO: 1236243 - RNA, 21 nt, Human
gcaguagagcucgggcugggg

SEQ ID NO: 1236244 - RNA, 21 nt, Human
gggcccccgaccaacuugcag

SEQ ID NO: 1236245 - RNA, 18 nt, Human
gugcuuccaaagucuaca

SEQ ID NO: 1236246 - RNA, 23 nt, Human
uacagaucuuuccaagacccaaa

SEQ ID NO: 1236247 - RNA, 20 nt, Human
uagagcucgggcuggggccu

SEQ ID NO: 1236248 - RNA, 22 nt, Human
ugaguaggugcuuccaaagucu

SEQ ID NO: 1236249 - RNA, 21 nt, Human
ugauugcauuuuauuuaaucu

SEQ ID NO: 1236250 - RNA, 23 nt, Human
ugccuggggcgguggggcccccg

SEQ ID NO: 1236251 - RNA, 20 nt, Human
ugguguggccgcugccuggg

SEQ ID NO: 1236252 - RNA, 22 nt, Human
uuccuggggucuucagaauugc

SEQ ID NO: 1236253 - RNA, 19 nt, Human
uugcaguagagcucgggcu

SEQ ID NO: 1236254 - RNA, 24 nt, Human
uugccucccgcccaaauucuuuua

SEQ ID NO: 1236255 - RNA, 23 nt, Human
uuggugacaggaugugcuuuccu

SEQ ID NO: 1236256 - RNA, 24 nt, Human
aacagcuuuacuaaaaagccaacc

SEQ ID NO: 1236257 - RNA, 20 nt, Human
aacauggugaaacccugucu

SEQ ID NO: 1236258 - RNA, 21 nt, Human
aacauggugaaacccugucuc

SEQ ID NO: 1236259 - RNA, 24 nt, Human
aaucacuugaaccugggaggcaga

SEQ ID NO: 1236260 - RNA, 20 nt, Human
aaucuccucuccaaaggagc

SEQ ID NO: 1236261 - RNA, 24 nt, Human
accaacauggugaaacccugucuc

SEQ ID NO: 1236262 - RNA, 24 nt, Human
acccugucucuacuaaaaauacaa

SEQ ID NO: 1236263 - RNA, 24 nt, Human
acgaaacuccaucucaaaaaaaua

SEQ ID NO: 1236264 - RNA, 19 nt, Human
acgagaacgaaacuccauc

SEQ ID NO: 1236265 - RNA, 22 nt, Human
agaaucacuugaaccugggagg

SEQ ID NO: 1236266 - RNA, 22 nt, Human
agagguugcagugagcugagau

SEQ ID NO: 1236267 - RNA, 24 nt, Human
agagguugcagugagcugagauug

SEQ ID NO: 1236268 - RNA, 24 nt, Human
agcacuuugggaggcugagguggg

SEQ ID NO: 1236269 - RNA, 24 nt, Human
agccugaccaacauggugaaaccc

SEQ ID NO: 1236270 - RNA, 24 nt, Human
aggcacaguggcucacgccuguaa

SEQ ID NO: 1236271 - RNA, 20 nt, Human
aggcagagguugcagugagc

SEQ ID NO: 1236272 - RNA, 24 nt, Human
aggcagagguugcagugagcugag

SEQ ID NO: 1236273 - RNA, 22 nt, Human
aggcaggagaaucacuugaacc

SEQ ID NO: 1236274 - RNA, 24 nt, Human
aggcaggagaaucacuugaaccug

SEQ ID NO: 1236275 - RNA, 24 nt, Human
aggcugaggcaggagaaucacuug

SEQ ID NO: 1236276 - RNA, 24 nt, Human
aggcuuuagcauaauuuucaauuc

SEQ ID NO: 1236277 - RNA, 22 nt, Human
agguggguagaucaccugaggu

SEQ ID NO: 1236278 - RNA, 24 nt, Human
aguggcucacgccuguaaucccag

SEQ ID NO: 1236279 - RNA, 19 nt, Human
auagaucuaucaugugauu

SEQ ID NO: 1236280 - RNA, 23 nt, Human
auugcacuccagguugggcaacg

SEQ ID NO: 1236281 - RNA, 24 nt, Human
caacauggugaaacccugucucua

SEQ ID NO: 1236282 - RNA, 24 nt, Human
cacaccuguaaucucagcuacuug

SEQ ID NO: 1236283 - RNA, 21 nt, Human
cacaucauaaucuccucucca

SEQ ID NO: 1236284 - RNA, 22 nt, Human
caccugaggucuggaguucgag

SEQ ID NO: 1236285 - RNA, 23 nt, Human
caccuguaaucucagcuacuugg

SEQ ID NO: 1236286 - RNA, 24 nt, Human
caccuguaaucucagcuacuuggg

SEQ ID NO: 1236287 - RNA, 24 nt, Human
cacgccuguaaucccagcacuuug

SEQ ID NO: 1236288 - RNA, 24 nt, Human
cagcacuuugggaggcugaggugg

SEQ ID NO: 1236289 - RNA, 24 nt, Human
cagcuacuugggaggcugaggcag

SEQ ID NO: 1236290 - RNA, 20 nt, Human
cagcuuuacuaaaaagccau

SEQ ID NO: 1236291 - RNA, 20 nt, Human
caucauaaucuccucuccaa

SEQ ID NO: 1236292 - RNA, 19 nt, Human
cauugcacuccagguuggg

SEQ ID NO: 1236293 - RNA, 22 nt, Human
cauugcacuccagguugggcaa

SEQ ID NO: 1236294 - RNA, 23 nt, Human
cauugcacuccagguugggcaac

SEQ ID NO: 1236295 - RNA, 18 nt, Human
ccauugcacuccagguug

SEQ ID NO: 1236296 - RNA, 20 nt, Human
ccauugcacuccagguuggg

SEQ ID NO: 1236297 - RNA, 21 nt, Human
ccauugcacuccagguugggc

SEQ ID NO: 1236298 - RNA, 24 nt, Human
ccauugcacuccagguugggcaac

SEQ ID NO: 1236299 - RNA, 22 nt, Human
ccugaccaacauggugaaaccc

SEQ ID NO: 1236300 - RNA, 24 nt, Human
ccugaccaacauggugaaacccug

SEQ ID NO: 1236301 - RNA, 25 nt, Human
ccugggaggcagagguugcagugag

SEQ ID NO: 1236302 - RNA, 21 nt, Human
ccuguaaucucagcuacuugg

SEQ ID NO: 1236303 - RNA, 24 nt, Human
cgagaccagccugaccaacauggu

SEQ ID NO: 1236304 - RNA, 23 nt, Human
cgccuguaaucccagcacuuugg

SEQ ID NO: 1236305 - RNA, 24 nt, Human
cgccuguaaucccagcacuuuggg

SEQ ID NO: 1236306 - RNA, 22 nt, Human
cucacgccuguaaucccagcac

SEQ ID NO: 1236307 - RNA, 24 nt, Human
cucacgccuguaaucccagcacuu

SEQ ID NO: 1236308 - RNA, 24 nt, Human
cugaccaacauggugaaacccugu

SEQ ID NO: 1236309 - RNA, 23 nt, Human
cugaguaaaagacaaggguuuau

SEQ ID NO: 1236310 - RNA, 21 nt, Human
cuguaaucucagcuacuuggg

SEQ ID NO: 1236311 - RNA, 23 nt, Human
gagauugugccauugcacuccag

SEQ ID NO: 1236312 - RNA, 23 nt, Human
gagguggguagaucaccugaggu

SEQ ID NO: 1236313 - RNA, 18 nt, Human
gaucaccugaggucugga

SEQ ID NO: 1236314 - RNA, 24 nt, Human
gaucaccugaggucuggaguucga

SEQ ID NO: 1236315 - RNA, 23 nt, Human
gcaggagaaucacuugaaccugg

SEQ ID NO: 1236316 - RNA, 19 nt, Human
gcauaaucuuucacaucau

SEQ ID NO: 1236317 - RNA, 24 nt, Human
gccauugcacuccagguugggcaa

SEQ ID NO: 1236318 - RNA, 24 nt, Human
gggcaugguggcgcacaccuguaa

SEQ ID NO: 1236319 - RNA, 21 nt, Human
gugaaacccugucucuacuaa

SEQ ID NO: 1236320 - RNA, 24 nt, Human
guugcagugagcugagauugugcc

SEQ ID NO: 1236321 - RNA, 21 nt, Human
uaaacagcuuuacuaaaaagc

SEQ ID NO: 1236322 - RNA, 24 nt, Human
uagaucaccugaggucuggaguuc

SEQ ID NO: 1236323 - RNA, 18 nt, Human
uaguuacaucuuuuucuc

SEQ ID NO: 1236324 - RNA, 25 nt, Human
ucacuugaaccugggaggcagaggu

SEQ ID NO: 1236325 - RNA, 25 nt, Human
ucaggccaggcacaguggcucacgc

SEQ ID NO: 1236326 - RNA, 22 nt, Human
ucucuacuaaaaauacaaaaaa

SEQ ID NO: 1236327 - RNA, 24 nt, Human
ugaaccugggaggcagagguugca

SEQ ID NO: 1236328 - RNA, 24 nt, Human
ugaccaacauggugaaacccuguc

SEQ ID NO: 1236329 - RNA, 20 nt, Human
ugaggcaggagaaucacuug

SEQ ID NO: 1236330 - RNA, 24 nt, Human
ugaggcaggagaaucacuugaacc

SEQ ID NO: 1236331 - RNA, 25 nt, Human
ugaggcaggagaaucacuugaaccu

SEQ ID NO: 1236332 - RNA, 20 nt, Human
ugagguggguagaucaccug

SEQ ID NO: 1236333 - RNA, 21 nt, Human
ugagguggguagaucaccuga

SEQ ID NO: 1236334 - RNA, 24 nt, Human
ugagguggguagaucaccugaggu

SEQ ID NO: 1236335 - RNA, 24 nt, Human
ugaguaaaagacaaggguuuauag

SEQ ID NO: 1236336 - RNA, 23 nt, Human
ugcacuccagguugggcaacgag

SEQ ID NO: 1236337 - RNA, 23 nt, Human
ugccucgcuuacagaggguugcu

SEQ ID NO: 1236338 - RNA, 19 nt, Human
uggagaaaccaugugaaaa

SEQ ID NO: 1236339 - RNA, 22 nt, Human
uggcgcacaccuguaaucucag

SEQ ID NO: 1236340 - RNA, 22 nt, Human
uggcucacgccuguaaucccag

SEQ ID NO: 1236341 - RNA, 24 nt, Human
uggcucacgccuguaaucccagca

SEQ ID NO: 1236342 - RNA, 19 nt, Human
ugggaauguuuguuccaua

SEQ ID NO: 1236343 - RNA, 22 nt, Human
ugggaauguuuguuccauauag

SEQ ID NO: 1236344 - RNA, 24 nt, Human
ugggaggcagagguugcagugagc

SEQ ID NO: 1236345 - RNA, 19 nt, Human
ugggaggcugaggcaggag

SEQ ID NO: 1236346 - RNA, 24 nt, Human
ugggaggcugaggcaggagaauca

SEQ ID NO: 1236347 - RNA, 20 nt, Human
ugggaggcugagguggguag

SEQ ID NO: 1236348 - RNA, 24 nt, Human
ugggaggcugagguggguagauca

SEQ ID NO: 1236349 - RNA, 24 nt, Human
uggguagaucaccugaggucugga

SEQ ID NO: 1236350 - RNA, 24 nt, Human
ugguggcgcacaccuguaaucuca

SEQ ID NO: 1236351 - RNA, 18 nt, Human
uuagcugggcaugguggc

SEQ ID NO: 1236352 - RNA, 20 nt, Human
uuagcugggcaugguggcgc

SEQ ID NO: 1236353 - RNA, 25 nt, Human
uucuaaauuucauaaagaaugucag

SEQ ID NO: 1236354 - RNA, 21 nt, Human
uugaacccuacugaaguguua

SEQ ID NO: 1236355 - RNA, 24 nt, Human
uugaaccugggaggcagagguugc

SEQ ID NO: 1236356 - RNA, 22 nt, Human
uugcagugagcugagauugugc

SEQ ID NO: 1236357 - RNA, 25 nt, Human
uugggaggcugaggcaggagaauca

SEQ ID NO: 1236358 - RNA, 25 nt, Human
uugggaggcugagguggguagauca

SEQ ID NO: 1236359 - RNA, 23 nt, Human
aagaaagaagggaagaagucugg

SEQ ID NO: 1236360 - RNA, 23 nt, Human
aagagacucgguccagugaggac

SEQ ID NO: 1236361 - RNA, 22 nt, Human
aauaaggaagcaucaguagaga

SEQ ID NO: 1236362 - RNA, 21 nt, Human
acccccagaagguggcauuga

SEQ ID NO: 1236363 - RNA, 22 nt, Human
acuuugcaauuaaagaaugcca

SEQ ID NO: 1236364 - RNA, 24 nt, Human
caaauuuaccacauuccuuuaaga

SEQ ID NO: 1236365 - RNA, 21 nt, Human
cauccuggagcggcacgggcc

SEQ ID NO: 1236366 - RNA, 18 nt, Human
cguagaggagaaaggcug

SEQ ID NO: 1236367 - RNA, 20 nt, Human
cugaagagacucgguccagu

SEQ ID NO: 1236368 - RNA, 21 nt, Human
gaaaaauaauaaggaagcauc

SEQ ID NO: 1236369 - RNA, 24 nt, Human
gagacagagccaguucugaagaga

SEQ ID NO: 1236370 - RNA, 25 nt, Human
gcccugggaugacacacggguccca

SEQ ID NO: 1236371 - RNA, 23 nt, Human
ggucugggaggauacuggugcca

SEQ ID NO: 1236372 - RNA, 25 nt, Human
guucccucaccucaaccuuuaauuu

SEQ ID NO: 1236373 - RNA, 21 nt, Human
uagaggagaaaggcugguuuc

SEQ ID NO: 1236374 - RNA, 21 nt, Human
uccuggagcggcacgggcccu

SEQ ID NO: 1236375 - RNA, 19 nt, Human
ugagggcaauucuuaacuc

SEQ ID NO: 1236376 - RNA, 19 nt, Human
ugaguaggggcuaccccca

SEQ ID NO: 1236377 - RNA, 26 nt, Human
ugcaguacguagaggagaaaggcugg

SEQ ID NO: 1236378 - RNA, 22 nt, Human
ugccaaaagauuauaaagugac

SEQ ID NO: 1236379 - RNA, 22 nt, Human
uggagcggcacgggcccugcug

SEQ ID NO: 1236380 - RNA, 20 nt, Human
uggcaaacagugaugcagua

SEQ ID NO: 1236381 - RNA, 19 nt, Human
uggcauugagagugauggu

SEQ ID NO: 1236382 - RNA, 21 nt, Human
uucacaagcccugggaugaca

SEQ ID NO: 1236383 - RNA, 20 nt, Human
uucugaagagacucggucca

SEQ ID NO: 1236384 - RNA, 23 nt, Human
uucuuaacucggacaucaaaauu

SEQ ID NO: 1236385 - RNA, 19 nt, Human
aaaaaaaaaaaaaaaaaga

SEQ ID NO: 1236386 - RNA, 23 nt, Human
aaaaaaaaaaaaaaaaagaacac

SEQ ID NO: 1236387 - RNA, 22 nt, Human
aaaaaaaaaaaaaagaacacag

SEQ ID NO: 1236388 - RNA, 19 nt, Human
aaaaaaaaaaaaagaacac

SEQ ID NO: 1236389 - RNA, 25 nt, Human
aaaaaaaaaaaagaacacagucuag

SEQ ID NO: 1236390 - RNA, 22 nt, Human
aaaaaaaagaacacagucuagg

SEQ ID NO: 1236391 - RNA, 22 nt, Human
aaaagaacgagaguaaccccua

SEQ ID NO: 1236392 - RNA, 25 nt, Human
aacacacacuugauacacaugcaug

SEQ ID NO: 1236393 - RNA, 19 nt, Human
aacuaugacauagaaaaua

SEQ ID NO: 1236394 - RNA, 20 nt, Human
aacuuuuucccucaagacag

SEQ ID NO: 1236395 - RNA, 23 nt, Human
aagcagccaaagucaguucccaa

SEQ ID NO: 1236396 - RNA, 24 nt, Human
aagucaguucccaaauaaugccca

SEQ ID NO: 1236397 - RNA, 22 nt, Human
aauaacuuuuucccucaagaca

SEQ ID NO: 1236398 - RNA, 23 nt, Human
accaagaucaacauacucuccug

SEQ ID NO: 1236399 - RNA, 19 nt, Human
accacacuuaaagaaagua

SEQ ID NO: 1236400 - RNA, 23 nt, Human
acccacuccccgcucacacacac

SEQ ID NO: 1236401 - RNA, 25 nt, Human
agaauagaacguuuuuuccccuuuc

SEQ ID NO: 1236402 - RNA, 22 nt, Human
agacagaaaaucagcaacagga

SEQ ID NO: 1236403 - RNA, 18 nt, Human
agagugcugggggcaggc

SEQ ID NO: 1236404 - RNA, 19 nt, Human
agagugcugggggcaggcg

SEQ ID NO: 1236405 - RNA, 21 nt, Human
agagugcugggggcaggcgug

SEQ ID NO: 1236406 - RNA, 19 nt, Human
aggaaucauuuccacuuug

SEQ ID NO: 1236407 - RNA, 22 nt, Human
aggcaaauacacguauguucuu

SEQ ID NO: 1236408 - RNA, 19 nt, Human
agugcugggggcaggcgug

SEQ ID NO: 1236409 - RNA, 19 nt, Human
agugcugggggcaggcgug

SEQ ID NO: 1236410 - RNA, 23 nt, Human
augccacacaagaaacacacacu

SEQ ID NO: 1236411 - RNA, 20 nt, Human
augucuccuucuuagugaua

SEQ ID NO: 1236412 - RNA, 19 nt, Human
auuuacaaguuaguguaua

SEQ ID NO: 1236413 - RNA, 19 nt, Human
caaagaauucauuucucag

SEQ ID NO: 1236414 - RNA, 23 nt, Human
caaauaaugcccaaagugagcac

SEQ ID NO: 1236415 - RNA, 19 nt, Human
caacauacucuccugaaua

SEQ ID NO: 1236416 - RNA, 19 nt, Human
caaucccuaagaauucaca

SEQ ID NO: 1236417 - RNA, 21 nt, Human
caaugccacacaagaaacaca

SEQ ID NO: 1236418 - RNA, 18 nt, Human
caccuagagugcuggggg

SEQ ID NO: 1236419 - RNA, 19 nt, Human
cagaauaucuucuguccuc

SEQ ID NO: 1236420 - RNA, 20 nt, Human
caguucccaaauaaugcccu

SEQ ID NO: 1236421 - RNA, 24 nt, Human
ccaaauaaugcccaaagugagcac

SEQ ID NO: 1236422 - RNA, 24 nt, Human
ccaagagcaacaaugccacacaag

SEQ ID NO: 1236423 - RNA, 23 nt, Human
ccacaaagaauucauuucucaga

SEQ ID NO: 1236424 - RNA, 20 nt, Human
cccaagagcaacaaugccac

SEQ ID NO: 1236425 - RNA, 23 nt, Human
cccacuccccgcucacacacaca

SEQ ID NO: 1236426 - RNA, 22 nt, Human
ccccuuggcacuucuguaauaa

SEQ ID NO: 1236427 - RNA, 21 nt, Human
cccuuggcacuucuguaauaa

SEQ ID NO: 1236428 - RNA, 21 nt, Human
ccuagagugcugggggcaggc

SEQ ID NO: 1236429 - RNA, 24 nt, Human
ccugaccugcugugucccuaagaa

SEQ ID NO: 1236430 - RNA, 21 nt, Human
cuagagugcugggggcaggcg

SEQ ID NO: 1236431 - RNA, 22 nt, Human
cuagagugcugggggcaggcgu

SEQ ID NO: 1236432 - RNA, 21 nt, Human
cucaagacagaaaaucagcaa

SEQ ID NO: 1236433 - RNA, 24 nt, Human
cucaagacagaaaaucagcaacag

SEQ ID NO: 1236434 - RNA, 24 nt, Human
cucagagcucacuaaccaccaccu

SEQ ID NO: 1236435 - RNA, 22 nt, Human
cuccaauacuucagaugcuacc

SEQ ID NO: 1236436 - RNA, 22 nt, Human
cuuaaucagaauaagcuucacc

SEQ ID NO: 1236437 - RNA, 25 nt, Human
gagaguaaccccuauuucccuuuga

SEQ ID NO: 1236438 - RNA, 21 nt, Human
gagcucacuaaccaccaccua

SEQ ID NO: 1236439 - RNA, 21 nt, Human
ggcaaauacacguauguucuu

SEQ ID NO: 1236440 - RNA, 18 nt, Human
ggcaaaucaucaaauguc

SEQ ID NO: 1236441 - RNA, 21 nt, Human
guauguacacuagacacuggg

SEQ ID NO: 1236442 - RNA, 23 nt, Human
guguauguacacuagacacuggg

SEQ ID NO: 1236443 - RNA, 19 nt, Human
uaaaacgguaagcaaagca

SEQ ID NO: 1236444 - RNA, 19 nt, Human
uaaaaucuuuuucuauagu

SEQ ID NO: 1236445 - RNA, 24 nt, Human
uaaauaaccuuccaugacggccau

SEQ ID NO: 1236446 - RNA, 19 nt, Human
uaaccaaaacuuacccagg

SEQ ID NO: 1236447 - RNA, 23 nt, Human
uaagaaaaagcagccaaagucag

SEQ ID NO: 1236448 - RNA, 27 nt, Human
uaagaaaaagcagccaaagucaguucc

SEQ ID NO: 1236449 - RNA, 22 nt, Human
uacagaguguuuaggcaaauac

SEQ ID NO: 1236450 - RNA, 22 nt, Human
uacccaagagcaacaaugccac

SEQ ID NO: 1236451 - RNA, 20 nt, Human
uagagugcugggggcaggcg

SEQ ID NO: 1236452 - RNA, 19 nt, Human
uaggaccaagucaaaucca

SEQ ID NO: 1236453 - RNA, 23 nt, Human
uaggaccaagucaaauccaaccc

SEQ ID NO: 1236454 - RNA, 22 nt, Human
uagugauaucauauacuaauau

SEQ ID NO: 1236455 - RNA, 19 nt, Human
uauaaccaaaacuuaccca

SEQ ID NO: 1236456 - RNA, 23 nt, Human
uaugauccccuuggcacuucugu

SEQ ID NO: 1236457 - RNA, 18 nt, Human
uauugaaucuuuguaguu

SEQ ID NO: 1236458 - RNA, 21 nt, Human
uauugaaucuuuguaguucuu

SEQ ID NO: 1236459 - RNA, 21 nt, Human
ucagagcucacuaaccaccac

SEQ ID NO: 1236460 - RNA, 24 nt, Human
ucagagcucacuaaccaccaccua

SEQ ID NO: 1236461 - RNA, 22 nt, Human
uccaaacaaucaaucccuaaga

SEQ ID NO: 1236462 - RNA, 18 nt, Human
uccaaugcaaacauagau

SEQ ID NO: 1236463 - RNA, 18 nt, Human
ucccaaauaaugcccaaa

SEQ ID NO: 1236464 - RNA, 19 nt, Human
ucccuaagaaaaagcagcc

SEQ ID NO: 1236465 - RNA, 21 nt, Human
ucccuaagaaaaagcagccaa

SEQ ID NO: 1236466 - RNA, 21 nt, Human
ucccucaagacagaaaaucag

SEQ ID NO: 1236467 - RNA, 24 nt, Human
uccuaggauugugaaaaugaaugc

SEQ ID NO: 1236468 - RNA, 21 nt, Human
ucuccugaauaacuuuuuccc

SEQ ID NO: 1236469 - RNA, 25 nt, Human
ugaaccaagaucaacauacucuccu

SEQ ID NO: 1236470 - RNA, 23 nt, Human
ugaaugaaauauaauaauuugga

SEQ ID NO: 1236471 - RNA, 24 nt, Human
ugaccugaugaccacacuuaaaga

SEQ ID NO: 1236472 - RNA, 20 nt, Human
ugagagagauucuguggccu

SEQ ID NO: 1236473 - RNA, 21 nt, Human
ugagagagauucuguggccuu

SEQ ID NO: 1236474 - RNA, 18 nt, Human
ugauauaguaaaaugcau

SEQ ID NO: 1236475 - RNA, 24 nt, Human
ugcaaacauagauuauaugcugca

SEQ ID NO: 1236476 - RNA, 18 nt, Human
ugccacacaagaaacaca

SEQ ID NO: 1236477 - RNA, 20 nt, Human
ugcugggggcaggcgugggg

SEQ ID NO: 1236478 - RNA, 21 nt, Human
ugggggcaggcguggggcaca

SEQ ID NO: 1236479 - RNA, 26 nt, Human
uguaauaagcugagguaaugcuguug

SEQ ID NO: 1236480 - RNA, 24 nt, Human
ugucuccuucuuagugauaucauu

SEQ ID NO: 1236481 - RNA, 19 nt, Human
ugugaaaaugaaugcccuc

SEQ ID NO: 1236482 - RNA, 23 nt, Human
uuaauggagauggauuaugaacc

SEQ ID NO: 1236483 - RNA, 21 nt, Human
uuauaugcugcaguuuuucug

SEQ ID NO: 1236484 - RNA, 25 nt, Human
uucaaaaagucuuuaguuuuacaaa

SEQ ID NO: 1236485 - RNA, 19 nt, Human
uuccaaugcaaacauaggg

SEQ ID NO: 1236486 - RNA, 24 nt, Human
uuccuaaaauaaaaugggggaaaa

SEQ ID NO: 1236487 - RNA, 19 nt, Human
uuuguaguucuuaaaagca

SEQ ID NO: 1236488 - RNA, 21 nt, Human
uuuuccuaaaauaaaaugggg

SEQ ID NO: 1236489 - RNA, 24 nt, Human
uuuucugcgaaaaaagaacgagag

SEQ ID NO: 1236490 - RNA, 21 nt, Human
aagagacauagcuucugagac

SEQ ID NO: 1236491 - RNA, 19 nt, Human
aagaguggauuagcagccu

SEQ ID NO: 1236492 - RNA, 20 nt, Human
aaggcacauuuuuccauaag

SEQ ID NO: 1236493 - RNA, 25 nt, Human
agacagguaggagacaggaggcugg

SEQ ID NO: 1236494 - RNA, 18 nt, Human
aggagccucuaacugugg

SEQ ID NO: 1236495 - RNA, 18 nt, Human
caaucguugccauuguag

SEQ ID NO: 1236496 - RNA, 21 nt, Human
caggagccucuaacuguggag

SEQ ID NO: 1236497 - RNA, 24 nt, Human
caggagccucuaacuguggaggag

SEQ ID NO: 1236498 - RNA, 23 nt, Human
caggaggcugggagaaggucaaa

SEQ ID NO: 1236499 - RNA, 23 nt, Human
caucuuuuccuuuuucagagugu

SEQ ID NO: 1236500 - RNA, 18 nt, Human
cccaggacagaugcggcc

SEQ ID NO: 1236501 - RNA, 21 nt, Human
ccucaucuccugagaacuggg

SEQ ID NO: 1236502 - RNA, 18 nt, Human
ccugguagccucaucucc

SEQ ID NO: 1236503 - RNA, 18 nt, Human
cuuuucuucucuguucuc

SEQ ID NO: 1236504 - RNA, 24 nt, Human
gcguggacuuuucaacaacaguuu

SEQ ID NO: 1236505 - RNA, 20 nt, Human
guaguauuguaauuuuuccc

SEQ ID NO: 1236506 - RNA, 22 nt, Human
uacagaaagagaaaaaaucuuc

SEQ ID NO: 1236507 - RNA, 21 nt, Human
uacuaguugugcccugugggc

SEQ ID NO: 1236508 - RNA, 21 nt, Human
uagcuucugagacauuuccuc

SEQ ID NO: 1236509 - RNA, 23 nt, Human
uccuuuuucagagugucuuuucu

SEQ ID NO: 1236510 - RNA, 19 nt, Human
ucuuuucuucucuguucuc

SEQ ID NO: 1236511 - RNA, 22 nt, Human
ucuuuucuucucuguucucucc

SEQ ID NO: 1236512 - RNA, 23 nt, Human
ugaagaaggacaaaugagcccca

SEQ ID NO: 1236513 - RNA, 21 nt, Human
ugagccccaggacagaugcgg

SEQ ID NO: 1236514 - RNA, 20 nt, Human
ugggagaaggucaaagagac

SEQ ID NO: 1236515 - RNA, 21 nt, Human
ugucuuuucuucucuguucuc

SEQ ID NO: 1236516 - RNA, 22 nt, Human
uucagagugucuuuucuucucu

SEQ ID NO: 1236517 - RNA, 26 nt, Human
uucucuguucucuccugguagccuca

SEQ ID NO: 1236518 - RNA, 22 nt, Human
uugucuucagugacauaccgag

SEQ ID NO: 1236519 - RNA, 24 nt, Human
auuuaaagccccuggauccugcuc

SEQ ID NO: 1236520 - RNA, 18 nt, Human
cagguuaaaauuuaaagc

SEQ ID NO: 1236521 - RNA, 23 nt, Human
ccccuggauccugcuccagucgc

SEQ ID NO: 1236522 - RNA, 24 nt, Human
ccccuggauccugcuccagucgcc

SEQ ID NO: 1236523 - RNA, 23 nt, Human
ggaaaaccagucugaaaaaauaa

SEQ ID NO: 1236524 - RNA, 19 nt, Human
guggaacguaauaaaagug

SEQ ID NO: 1236525 - RNA, 25 nt, Human
guuaaaauuuaaagccccuggaucc

SEQ ID NO: 1236526 - RNA, 20 nt, Human
uaaaagugacuaaauuggau

SEQ ID NO: 1236527 - RNA, 22 nt, Human
uaaauacaaucugugaccauga

SEQ ID NO: 1236528 - RNA, 23 nt, Human
uaaauacaaucugugaccaugaa

SEQ ID NO: 1236529 - RNA, 21 nt, Human
uagaagcaauuuacaacgaag

SEQ ID NO: 1236530 - RNA, 19 nt, Human
ugauugggggaggcaaagu

SEQ ID NO: 1236531 - RNA, 22 nt, Human
uggaccuucucgguagcaauuu

SEQ ID NO: 1236532 - RNA, 19 nt, Human
uuuaaagccccuggauccu

SEQ ID NO: 1236533 - RNA, 18 nt, Human
aaacaaaagccccaacac

SEQ ID NO: 1236534 - RNA, 20 nt, Human
aaacaaaagccccaacacca

SEQ ID NO: 1236535 - RNA, 21 nt, Human
aaaccaaagcaaacuuggcaa

SEQ ID NO: 1236536 - RNA, 25 nt, Human
aaaccaaagcaaacuuggcaagaaa

SEQ ID NO: 1236537 - RNA, 22 nt, Human
aagaagucaucaccuuuacaaa

SEQ ID NO: 1236538 - RNA, 23 nt, Human
aagccccaacaccacuggauucc

SEQ ID NO: 1236539 - RNA, 21 nt, Human
acaaaauaaaaacaaaagccc

SEQ ID NO: 1236540 - RNA, 20 nt, Human
accuuuacaaaauaaaaaca

SEQ ID NO: 1236541 - RNA, 18 nt, Human
agaaaagagaggggaggg

SEQ ID NO: 1236542 - RNA, 21 nt, Human
agaaaccaaagcaaacuuggc

SEQ ID NO: 1236543 - RNA, 19 nt, Human
caaaagccccaacaccacu

SEQ ID NO: 1236544 - RNA, 23 nt, Human
caaaauaaaaacaaaagccccaa

SEQ ID NO: 1236545 - RNA, 23 nt, Human
cagaaaccaaagcaaacuuggca

SEQ ID NO: 1236546 - RNA, 19 nt, Human
cccaacaccacuggauucc

SEQ ID NO: 1236547 - RNA, 20 nt, Human
ccccaacaccacuggauucc

SEQ ID NO: 1236548 - RNA, 21 nt, Human
cccugggcucucccuggggac

SEQ ID NO: 1236549 - RNA, 28 nt, Human
ccuuuuuuuuuuuuuuuccucucuuuua

SEQ ID NO: 1236550 - RNA, 26 nt, Human
cuuuuuuuuuuuuuuuccucucuuuu

SEQ ID NO: 1236551 - RNA, 23 nt, Human
ggcaagaaaagagaggggaggga

SEQ ID NO: 1236552 - RNA, 18 nt, Human
uaaaaacaaaagccccaa

SEQ ID NO: 1236553 - RNA, 18 nt, Human
uaagaagucaucaccuuu

SEQ ID NO: 1236554 - RNA, 24 nt, Human
ucccuggggacgaacccuccuccu

SEQ ID NO: 1236555 - RNA, 18 nt, Human
uccuuuuuuuuuuuuuuu

SEQ ID NO: 1236556 - RNA, 26 nt, Human
uccuuuuuuuuuuuuuuuccucucuu

SEQ ID NO: 1236557 - RNA, 20 nt, Human
uggcaagaaaagagagggga

SEQ ID NO: 1236558 - RNA, 24 nt, Human
uguuuccuuuuuuuuuuuuuuuuu

SEQ ID NO: 1236559 - RNA, 24 nt, Human
uuuacaaaauaaaaacaaaagccc

SEQ ID NO: 1236560 - RNA, 22 nt, Human
caaacuagccacacugccgagc

SEQ ID NO: 1236561 - RNA, 20 nt, Human
cacaaacuagccacacugcc

SEQ ID NO: 1236562 - RNA, 21 nt, Human
cacagguaggaggucaccagg

SEQ ID NO: 1236563 - RNA, 21 nt, Human
caccagguaggacaccaccgg

SEQ ID NO: 1236564 - RNA, 23 nt, Human
cagcaucaagucgcuggcguccc

SEQ ID NO: 1236565 - RNA, 26 nt, Human
ccacacaaacuagccacacugccgag

SEQ ID NO: 1236566 - RNA, 18 nt, Human
gcugggcaccaggggcag

SEQ ID NO: 1236567 - RNA, 19 nt, Human
ggauguccgccucgcugcg

SEQ ID NO: 1236568 - RNA, 22 nt, Human
ggcccggggugcgcucggaguc

SEQ ID NO: 1236569 - RNA, 19 nt, Human
uaacugaaaagagcgucag

SEQ ID NO: 1236570 - RNA, 23 nt, Human
uaggacaccaccggacuugggug

SEQ ID NO: 1236571 - RNA, 19 nt, Human
ucgcugcgcccugcggagu

SEQ ID NO: 1236572 - RNA, 22 nt, Human
uguccgccucgcugcgcccugc

SEQ ID NO: 1236573 - RNA, 24 nt, Human
accuccaaagaaacgaggagcggg

SEQ ID NO: 1236574 - RNA, 20 nt, Human
accugggcagaacuggagcu

SEQ ID NO: 1236575 - RNA, 18 nt, Human
caggcggggccgaccgcg

SEQ ID NO: 1236576 - RNA, 22 nt, Human
ccagcccccggcggcccuugcc

SEQ ID NO: 1236577 - RNA, 20 nt, Human
cccgggcgcgucggaucccg

SEQ ID NO: 1236578 - RNA, 21 nt, Human
cgucgccuccucguccagccc

SEQ ID NO: 1236579 - RNA, 18 nt, Human
cuggaagggccaaccucc

SEQ ID NO: 1236580 - RNA, 19 nt, Human
gaacuggagcuggaagggc

SEQ ID NO: 1236581 - RNA, 26 nt, Human
gaacuggagcuggaagggccaaccuc

SEQ ID NO: 1236582 - RNA, 18 nt, Human
uagaagguggggacgguc

SEQ ID NO: 1236583 - RNA, 21 nt, Human
ucacagugucauuuacaggca

SEQ ID NO: 1236584 - RNA, 22 nt, Human
uggaagggccaaccuccaaaga

SEQ ID NO: 1236585 - RNA, 22 nt, Human
ugggcagaacuggagcuggaag

SEQ ID NO: 1236586 - RNA, 27 nt, Human
agagagcucccaaacagaaacucaaag

SEQ ID NO: 1236587 - RNA, 25 nt, Human
agagcucccaaacagaaacucaaag

SEQ ID NO: 1236588 - RNA, 22 nt, Human
agaggaaggaggaucacuugag

SEQ ID NO: 1236589 - RNA, 18 nt, Human
aggaaggaggaucacuug

SEQ ID NO: 1236590 - RNA, 24 nt, Human
aggaucacuugagaccaggaguuu

SEQ ID NO: 1236591 - RNA, 23 nt, Human
aguggcucaugcuuguaauccca

SEQ ID NO: 1236592 - RNA, 24 nt, Human
aucacuugagaccaggaguuugag

SEQ ID NO: 1236593 - RNA, 18 nt, Human
caggaguuugaggcuaug

SEQ ID NO: 1236594 - RNA, 20 nt, Human
ccaccacuuucggaagcaga

SEQ ID NO: 1236595 - RNA, 19 nt, Human
cccaaacagaaacucaaag

SEQ ID NO: 1236596 - RNA, 24 nt, Human
cucaugcuuguaaucccaccacuu

SEQ ID NO: 1236597 - RNA, 24 nt, Human
gaucacuugagaccaggaguuuga

SEQ ID NO: 1236598 - RNA, 20 nt, Human
gcaggguacaguggcucaug

SEQ ID NO: 1236599 - RNA, 22 nt, Human
ggaucacuugagaccaggaguu

SEQ ID NO: 1236600 - RNA, 24 nt, Human
ggguacaguggcucaugcuuguaa

SEQ ID NO: 1236601 - RNA, 20 nt, Human
uaagccacgauugccacuga

SEQ ID NO: 1236602 - RNA, 22 nt, Human
ucaugcuuguaaucccaccacu

SEQ ID NO: 1236603 - RNA, 21 nt, Human
uggcucaugcuuguaauccca

SEQ ID NO: 1236604 - RNA, 24 nt, Human
uggcucaugcuuguaaucccacca

SEQ ID NO: 1236605 - RNA, 19 nt, Human
uguaaucccaccacuuucg

SEQ ID NO: 1236606 - RNA, 23 nt, Human
aagcccccagcagauaccagcuc

SEQ ID NO: 1236607 - RNA, 18 nt, Human
acgauucucuacuguuua

SEQ ID NO: 1236608 - RNA, 24 nt, Human
acggaggcccgggagacccacggc

SEQ ID NO: 1236609 - RNA, 23 nt, Human
agagugcaauguggcucccgaaa

SEQ ID NO: 1236610 - RNA, 18 nt, Human
agauaccagcucagcucc

SEQ ID NO: 1236611 - RNA, 22 nt, Human
augaaaaugguaaaccuuccca

SEQ ID NO: 1236612 - RNA, 19 nt, Human
auguccacagcuaaaccag

SEQ ID NO: 1236613 - RNA, 21 nt, Human
cagagugcaauguggcucccg

SEQ ID NO: 1236614 - RNA, 21 nt, Human
cagccgaaacgcgucccgggc

SEQ ID NO: 1236615 - RNA, 19 nt, Human
ccaggcaagucagagugca

SEQ ID NO: 1236616 - RNA, 23 nt, Human
ccauguguaaugucaaccauuuc

SEQ ID NO: 1236617 - RNA, 25 nt, Human
cccaggaagcccccagcagauaccc

SEQ ID NO: 1236618 - RNA, 18 nt, Human
ccccagcagauaccagcu

SEQ ID NO: 1236619 - RNA, 20 nt, Human
ccccucgcucggcgccccuc

SEQ ID NO: 1236620 - RNA, 22 nt, Human
cccucggccgccguggaaccuu

SEQ ID NO: 1236621 - RNA, 22 nt, Human
ccggaacucccguggcccgcgc

SEQ ID NO: 1236622 - RNA, 18 nt, Human
ccuccggccagagguggg

SEQ ID NO: 1236623 - RNA, 22 nt, Human
ccuucccgggaagcucuccccg

SEQ ID NO: 1236624 - RNA, 18 nt, Human
ccuuuauuaccacauagu

SEQ ID NO: 1236625 - RNA, 20 nt, Human
cgaaagcgucccacacaccg

SEQ ID NO: 1236626 - RNA, 23 nt, Human
cgccgggacagccuucccgccga

SEQ ID NO: 1236627 - RNA, 21 nt, Human
cgccguggaaccuucccggga

SEQ ID NO: 1236628 - RNA, 18 nt, Human
cgcgagcgauaagucuga

SEQ ID NO: 1236629 - RNA, 19 nt, Human
cucacggccacucuccuua

SEQ ID NO: 1236630 - RNA, 19 nt, Human
cucagugaugugacacugc

SEQ ID NO: 1236631 - RNA, 22 nt, Human
cucccguggcccgcgccucccc

SEQ ID NO: 1236632 - RNA, 20 nt, Human
cuggaauaagaccuuuccug

SEQ ID NO: 1236633 - RNA, 20 nt, Human
cuucccgggaagcucucccc

SEQ ID NO: 1236634 - RNA, 21 nt, Human
gagcaguaugagacaguccau

SEQ ID NO: 1236635 - RNA, 22 nt, Human
gcgaggaagucaccccggccca

SEQ ID NO: 1236636 - RNA, 18 nt, Human
gggaaggaggacgguacg

SEQ ID NO: 1236637 - RNA, 20 nt, Human
gggcgcggaaacccucggcc

SEQ ID NO: 1236638 - RNA, 21 nt, Human
gucaaccauuuccaugaaaau

SEQ ID NO: 1236639 - RNA, 24 nt, Human
guccgcgagcgauaagucugagga

SEQ ID NO: 1236640 - RNA, 19 nt, Human
gugcaagguuuagcuucuu

SEQ ID NO: 1236641 - RNA, 23 nt, Human
uaguccagagcaguaugagacag

SEQ ID NO: 1236642 - RNA, 21 nt, Human
uccaugcuagggcaugacaaa

SEQ ID NO: 1236643 - RNA, 24 nt, Human
uccaugcuagggcaugaccggggc

SEQ ID NO: 1236644 - RNA, 22 nt, Human
ucccgaaagcgucccacacacc

SEQ ID NO: 1236645 - RNA, 18 nt, Human
ucccgggcgcggaaaccc

SEQ ID NO: 1236646 - RNA, 18 nt, Human
ucccgggcgcggaaaccc

SEQ ID NO: 1236647 - RNA, 19 nt, Human
ucucacggccacucuccuu

SEQ ID NO: 1236648 - RNA, 20 nt, Human
uggaauaagaccuuuccuga

SEQ ID NO: 1236649 - RNA, 19 nt, Human
uggcucccgaaagcguccc

SEQ ID NO: 1236650 - RNA, 22 nt, Human
uuucggauggcacucucacggc

SEQ ID NO: 1236651 - RNA, 24 nt, Human
aagaaacaccucccucuucaggcc

SEQ ID NO: 1236652 - RNA, 21 nt, Human
aagcaagacaauaaauugaaa

SEQ ID NO: 1236653 - RNA, 22 nt, Human
aauauacauacuugcauacaua

SEQ ID NO: 1236654 - RNA, 19 nt, Human
agaagaaacaccucccucu

SEQ ID NO: 1236655 - RNA, 18 nt, Human
agccuuacauuuuaauga

SEQ ID NO: 1236656 - RNA, 21 nt, Human
auacuuuagugaacaaaacug

SEQ ID NO: 1236657 - RNA, 20 nt, Human
cauacauauuuauacacauu

SEQ ID NO: 1236658 - RNA, 27 nt, Human
cuagcagugacuagcucugcucuuuuu

SEQ ID NO: 1236659 - RNA, 19 nt, Human
uaaauugaaagcauaauca

SEQ ID NO: 1236660 - RNA, 26 nt, Human
uacauacuugcauacauauuuauaca

SEQ ID NO: 1236661 - RNA, 22 nt, Human
uauacacauuaucagaccagca

SEQ ID NO: 1236662 - RNA, 23 nt, Human
uauccuuguccuguuucuaagga

SEQ ID NO: 1236663 - RNA, 18 nt, Human
ucgaagaacuguuccagc

SEQ ID NO: 1236664 - RNA, 22 nt, Human
ugaacaaaacugacaaauucca

SEQ ID NO: 1236665 - RNA, 21 nt, Human
ugaugauuagggaaacuauuu

SEQ ID NO: 1236666 - RNA, 18 nt, Human
uggaaauguuccacuuuc

SEQ ID NO: 1236667 - RNA, 19 nt, Human
uguuccagccaucuuguuc

SEQ ID NO: 1236668 - RNA, 22 nt, Human
uuauggacccuuccugagaucu

SEQ ID NO: 1236669 - RNA, 23 nt, Human
uuggaaauguuccacuuucccaa

SEQ ID NO: 1236670 - RNA, 24 nt, Human
aaggagauguugagguggguggcc

SEQ ID NO: 1236671 - RNA, 23 nt, Human
acuccuguccccagggcccaggg

SEQ ID NO: 1236672 - RNA, 19 nt, Human
agauacugcaggcagcucg

SEQ ID NO: 1236673 - RNA, 18 nt, Human
agcagguuacccagcugg

SEQ ID NO: 1236674 - RNA, 22 nt, Human
agcugguuguuccacagcacca

SEQ ID NO: 1236675 - RNA, 22 nt, Human
agcuguggcggcugcuccuucu

SEQ ID NO: 1236676 - RNA, 25 nt, Human
aggcacccucgaaggggcccgggag

SEQ ID NO: 1236677 - RNA, 18 nt, Human
agggaguccguggggggc

SEQ ID NO: 1236678 - RNA, 22 nt, Human
agguggguggccgacucguagu

SEQ ID NO: 1236679 - RNA, 21 nt, Human
caagugcagcacugccaggcu

SEQ ID NO: 1236680 - RNA, 22 nt, Human
cacccgggucaccacaaacacc

SEQ ID NO: 1236681 - RNA, 23 nt, Human
cagcagcgccuucugcgucucga

SEQ ID NO: 1236682 - RNA, 23 nt, Human
cagccccuuccucugcuccuuga

SEQ ID NO: 1236683 - RNA, 26 nt, Human
cagcccgaggcgcagcacgcugcggg

SEQ ID NO: 1236684 - RNA, 28 nt, Human
cagggcaggacagggggucucgucccuc

SEQ ID NO: 1236685 - RNA, 25 nt, Human
caugaagagagaaacaaagggcagg

SEQ ID NO: 1236686 - RNA, 23 nt, Human
ccaccgcgcccucgcacgugagc

SEQ ID NO: 1236687 - RNA, 25 nt, Human
ccaccgcgcccucgcacgugagcuu

SEQ ID NO: 1236688 - RNA, 23 nt, Human
ccagccccgggugccgaugugcu

SEQ ID NO: 1236689 - RNA, 23 nt, Human
ccagguucagcgucuccaggcuc

SEQ ID NO: 1236690 - RNA, 24 nt, Human
cccagguucagcgucuccaggcuc

SEQ ID NO: 1236691 - RNA, 19 nt, Human
ccccagggcccagggaguc

SEQ ID NO: 1236692 - RNA, 19 nt, Human
cccgcgcgcgccugcccgu

SEQ ID NO: 1236693 - RNA, 20 nt, Human
cccgcgcgcgccugcccguu

SEQ ID NO: 1236694 - RNA, 18 nt, Human
cccgcgggugacaugaag

SEQ ID NO: 1236695 - RNA, 18 nt, Human
cccuuccucuuccuccuc

SEQ ID NO: 1236696 - RNA, 22 nt, Human
ccgccaccgccaccgcgcccuc

SEQ ID NO: 1236697 - RNA, 19 nt, Human
ccgccgccgcuucaggcgc

SEQ ID NO: 1236698 - RNA, 23 nt, Human
ccgccgccgcuucaggcgccgcc

SEQ ID NO: 1236699 - RNA, 24 nt, Human
ccgccgccgcuucaggcgccgccu

SEQ ID NO: 1236700 - RNA, 20 nt, Human
ccgcgccagcaccaaguugc

SEQ ID NO: 1236701 - RNA, 26 nt, Human
ccuccgccgagccccgcgcgcgccug

SEQ ID NO: 1236702 - RNA, 24 nt, Human
ccuccucacgggggccccggggac

SEQ ID NO: 1236703 - RNA, 21 nt, Human
ccuuccucuuccuccucuucc

SEQ ID NO: 1236704 - RNA, 18 nt, Human
ccuucuccucccucuccc

SEQ ID NO: 1236705 - RNA, 22 nt, Human
cgccgagugguccagcaggggc

SEQ ID NO: 1236706 - RNA, 19 nt, Human
cggcccgggcuggacacgg

SEQ ID NO: 1236707 - RNA, 24 nt, Human
cggcccgggcuggacacggaaauc

SEQ ID NO: 1236708 - RNA, 19 nt, Human
cggccgccugccagccccg

SEQ ID NO: 1236709 - RNA, 23 nt, Human
cgggcuggacacggaaauccgcu

SEQ ID NO: 1236710 - RNA, 18 nt, Human
cgggucaccacaaacacc

SEQ ID NO: 1236711 - RNA, 23 nt, Human
cguccgcucuccuaguggucgua

SEQ ID NO: 1236712 - RNA, 19 nt, Human
cucgcagauguaggccaga

SEQ ID NO: 1236713 - RNA, 21 nt, Human
cucguaguacucgaucauguc

SEQ ID NO: 1236714 - RNA, 19 nt, Human
cucuuccuccccauccgag

SEQ ID NO: 1236715 - RNA, 20 nt, Human
cuuccucuuccuccucuucc

SEQ ID NO: 1236716 - RNA, 19 nt, Human
cuuggguucacggucgagg

SEQ ID NO: 1236717 - RNA, 19 nt, Human
cuuggguucacggucgagg

SEQ ID NO: 1236718 - RNA, 20 nt, Human
gacuccuguccccagggccc

SEQ ID NO: 1236719 - RNA, 19 nt, Human
gagcuugguggaggccagc

SEQ ID NO: 1236720 - RNA, 30 nt, Human
gaucucguucucccgaagguccagucucaa

SEQ ID NO: 1236721 - RNA, 23 nt, Human
gccccgggccccggauuugucuc

SEQ ID NO: 1236722 - RNA, 19 nt, Human
gccccuuccucugcuccuu

SEQ ID NO: 1236723 - RNA, 22 nt, Human
gccugcccguucgcagucacac

SEQ ID NO: 1236724 - RNA, 18 nt, Human
gcgcuugcagccguucug

SEQ ID NO: 1236725 - RNA, 19 nt, Human
gcgcuugcagccguucugg

SEQ ID NO: 1236726 - RNA, 20 nt, Human
gcuguggcggcugcuccuuc

SEQ ID NO: 1236727 - RNA, 19 nt, Human
ggcuggggcucgguggcgg

SEQ ID NO: 1236728 - RNA, 20 nt, Human
gggcgggcucuccacccggg

SEQ ID NO: 1236729 - RNA, 22 nt, Human
gggcugccugggggacuccugu

SEQ ID NO: 1236730 - RNA, 21 nt, Human
ggggacgcagggggcucugcc

SEQ ID NO: 1236731 - RNA, 19 nt, Human
gggggacgcagggggcucu

SEQ ID NO: 1236732 - RNA, 20 nt, Human
gggugggggacgcagggggc

SEQ ID NO: 1236733 - RNA, 19 nt, Human
gguucacggucgaggucca

SEQ ID NO: 1236734 - RNA, 19 nt, Human
guccgggcugggugcgggg

SEQ ID NO: 1236735 - RNA, 22 nt, Human
gugcuuguugaaggagauguug

SEQ ID NO: 1236736 - RNA, 24 nt, Human
guggggggcaccagggcaggacag

SEQ ID NO: 1236737 - RNA, 21 nt, Human
guucucccgaagguccagucu

SEQ ID NO: 1236738 - RNA, 24 nt, Human
uacccagcugggccgaggaggucc

SEQ ID NO: 1236739 - RNA, 22 nt, Human
ucaccacaaacaccuuguggcc

SEQ ID NO: 1236740 - RNA, 24 nt, Human
ucaccagccccuuccucugcuccu

SEQ ID NO: 1236741 - RNA, 21 nt, Human
ucaugcccaggaaggccaugc

SEQ ID NO: 1236742 - RNA, 23 nt, Human
uccccagggcccagggaguccgu

SEQ ID NO: 1236743 - RNA, 19 nt, Human
ucccgaagguccagucuca

SEQ ID NO: 1236744 - RNA, 21 nt, Human
uccugcaggccguugagcuug

SEQ ID NO: 1236745 - RNA, 20 nt, Human
ucuccccuuccucuuccucc

SEQ ID NO: 1236746 - RNA, 30 nt, Human
ucucgucccucuccccuuccucuuccuccc

SEQ ID NO: 1236747 - RNA, 18 nt, Human
ucuuccuccucuuccucc

SEQ ID NO: 1236748 - RNA, 21 nt, Human
ugaagagagaaacaaagggca

SEQ ID NO: 1236749 - RNA, 27 nt, Human
ugaaggagauguugagguggguggccg

SEQ ID NO: 1236750 - RNA, 25 nt, Human
ugaggugccgcacacccucguuccc

SEQ ID NO: 1236751 - RNA, 24 nt, Human
ugagguggguggccgacucguagu

SEQ ID NO: 1236752 - RNA, 23 nt, Human
ugagugguucaccuugagggcca

SEQ ID NO: 1236753 - RNA, 23 nt, Human
ugccccgggccccggauuugucu

SEQ ID NO: 1236754 - RNA, 18 nt, Human
ugcucgguggguguggag

SEQ ID NO: 1236755 - RNA, 21 nt, Human
uggucucaggcauggaggccg

SEQ ID NO: 1236756 - RNA, 19 nt, Human
ugucucuccggguccgccc

SEQ ID NO: 1236757 - RNA, 20 nt, Human
uuccacagcaccagggucac

SEQ ID NO: 1236758 - RNA, 22 nt, Human
uucuugaggugccgcacacccu

SEQ ID NO: 1236759 - RNA, 21 nt, Human
uuguggccccggcccgggcug

SEQ ID NO: 1236760 - RNA, 20 nt, Human
uuucuuggguucacggucga

SEQ ID NO: 1236761 - RNA, 18 nt, Human
aaacagaugacuggaccc

SEQ ID NO: 1236762 - RNA, 20 nt, Human
cagcgagccaccgcauaagc

SEQ ID NO: 1236763 - RNA, 22 nt, Human
caucccuguucugagcagcgag

SEQ ID NO: 1236764 - RNA, 19 nt, Human
caucucugccaucccuguu

SEQ ID NO: 1236765 - RNA, 20 nt, Human
ccuugaguuuuugauggugg

SEQ ID NO: 1236766 - RNA, 22 nt, Human
cuggacccacagcacugguccu

SEQ ID NO: 1236767 - RNA, 23 nt, Human
cuggacccacagcacugguccuu

SEQ ID NO: 1236768 - RNA, 20 nt, Human
gccaucccuguucugagcag

SEQ ID NO: 1236769 - RNA, 21 nt, Human
guucugagcagcgagccaccg

SEQ ID NO: 1236770 - RNA, 20 nt, Human
ugaaacagaugacuggaccc

SEQ ID NO: 1236771 - RNA, 21 nt, Human
uugaugguggugcucaucucu

SEQ ID NO: 1236772 - RNA, 24 nt, Human
agaaucacauguggcagccaaguu

SEQ ID NO: 1236773 - RNA, 22 nt, Human
aggaagcguguucuagugucca

SEQ ID NO: 1236774 - RNA, 19 nt, Human
auucacagccacgggcugc

SEQ ID NO: 1236775 - RNA, 18 nt, Human
cacauguggcagccaagu

SEQ ID NO: 1236776 - RNA, 19 nt, Human
uaggaaaggucacggggua

SEQ ID NO: 1236777 - RNA, 22 nt, Human
ucacgggguaaugaaagacagg

SEQ ID NO: 1236778 - RNA, 19 nt, Human
ucccagggauaaagaauuc

SEQ ID NO: 1236779 - RNA, 20 nt, Human
aauagcugcuagguaggcac

SEQ ID NO: 1236780 - RNA, 18 nt, Human
acaccuccgccccaugac

SEQ ID NO: 1236781 - RNA, 19 nt, Human
accuccgccccaugacccu

SEQ ID NO: 1236782 - RNA, 26 nt, Human
aggcaccagugaaaaccuggauugug

SEQ ID NO: 1236783 - RNA, 21 nt, Human
cacaccuccgccccaugaccu

SEQ ID NO: 1236784 - RNA, 21 nt, Human
cagauagagaagccuccaaca

SEQ ID NO: 1236785 - RNA, 18 nt, Human
cagcacacagugccgacu

SEQ ID NO: 1236786 - RNA, 23 nt, Human
caggaugcucccagaugcccuga

SEQ ID NO: 1236787 - RNA, 24 nt, Human
ccacggugacgccacaccuccgcc

SEQ ID NO: 1236788 - RNA, 20 nt, Human
ccagaagagccccgacggug

SEQ ID NO: 1236789 - RNA, 19 nt, Human
ccaugcacccacggugacg

SEQ ID NO: 1236790 - RNA, 25 nt, Human
cccacggugacgccacaccuccgcc

SEQ ID NO: 1236791 - RNA, 25 nt, Human
cccaugacccucucaggaugcuccc

SEQ ID NO: 1236792 - RNA, 19 nt, Human
ccggagcggggcgggcggc

SEQ ID NO: 1236793 - RNA, 25 nt, Human
ccggagcggggcgggcggcugggcu

SEQ ID NO: 1236794 - RNA, 20 nt, Human
cgcucuucaggaaaagcuga

SEQ ID NO: 1236795 - RNA, 21 nt, Human
cuccgccccaugacccucuca

SEQ ID NO: 1236796 - RNA, 24 nt, Human
cuccuugcugucauacacacuaac

SEQ ID NO: 1236797 - RNA, 20 nt, Human
cuggguuucugugcacaucu

SEQ ID NO: 1236798 - RNA, 21 nt, Human
gagcggggcgggcggcugggc

SEQ ID NO: 1236799 - RNA, 18 nt, Human
gcacggcgucccuuccug

SEQ ID NO: 1236800 - RNA, 19 nt, Human
gccacaccuccgccccaug

SEQ ID NO: 1236801 - RNA, 21 nt, Human
gcggggcgggcggcugggcuc

SEQ ID NO: 1236802 - RNA, 18 nt, Human
ggccggagcggggcgggc

SEQ ID NO: 1236803 - RNA, 19 nt, Human
guaggcaccagugaaaacc

SEQ ID NO: 1236804 - RNA, 23 nt, Human
gugcacaucucagauagagaagc

SEQ ID NO: 1236805 - RNA, 20 nt, Human
ucaggaggcagcacgcagca

SEQ ID NO: 1236806 - RNA, 22 nt, Human
uccaugcacccacggugacgcc

SEQ ID NO: 1236807 - RNA, 23 nt, Human
uccaugcacccacggugacgcca

SEQ ID NO: 1236808 - RNA, 23 nt, Human
uccaugcacccacggugacgcca

SEQ ID NO: 1236809 - RNA, 20 nt, Human
ugacgccacaccuccgcccc

SEQ ID NO: 1236810 - RNA, 24 nt, Human
ugacgccacaccuccgccccauga

SEQ ID NO: 1236811 - RNA, 22 nt, Human
aaaaaaggcuccaugaagaaga

SEQ ID NO: 1236812 - RNA, 21 nt, Human
aaaaaggcuccaugaagaaga

SEQ ID NO: 1236813 - RNA, 21 nt, Human
aaaaguauccaaacagaagag

SEQ ID NO: 1236814 - RNA, 29 nt, Human
aaacagaagagugaaugaaaagggacccc

SEQ ID NO: 1236815 - RNA, 22 nt, Human
aaggcagcugcaggggaugggg

SEQ ID NO: 1236816 - RNA, 25 nt, Human
aaguuuccagcaugcagucaagcac

SEQ ID NO: 1236817 - RNA, 21 nt, Human
aauggugcugugaaaaggacu

SEQ ID NO: 1236818 - RNA, 23 nt, Human
acagaguuugccgcuucaaaaga

SEQ ID NO: 1236819 - RNA, 18 nt, Human
acaggcacuaccccgaag

SEQ ID NO: 1236820 - RNA, 22 nt, Human
accccgaagcuucauagacaua

SEQ ID NO: 1236821 - RNA, 22 nt, Human
acccugcccccaaaaaaaggca

SEQ ID NO: 1236822 - RNA, 18 nt, Human
acucaaaaaaucugcagc

SEQ ID NO: 1236823 - RNA, 21 nt, Human
agacaaugucgguaguaccaa

SEQ ID NO: 1236824 - RNA, 21 nt, Human
agcaaaaguauccaaacagaa

SEQ ID NO: 1236825 - RNA, 22 nt, Human
aggaaaaaaggcuccaugaagg

SEQ ID NO: 1236826 - RNA, 25 nt, Human
aggcagcugcaggggaugggggagg

SEQ ID NO: 1236827 - RNA, 20 nt, Human
aguaccaaacuauuucuugg

SEQ ID NO: 1236828 - RNA, 24 nt, Human
caacccccacccugcccccaaaag

SEQ ID NO: 1236829 - RNA, 19 nt, Human
caauccuuucuugaggagu

SEQ ID NO: 1236830 - RNA, 19 nt, Human
cagaguuugccgcuucaaa

SEQ ID NO: 1236831 - RNA, 22 nt, Human
caucaacccccacccugccccc

SEQ ID NO: 1236832 - RNA, 20 nt, Human
caugaaggacacagaaggac

SEQ ID NO: 1236833 - RNA, 26 nt, Human
ccacccugcccccaaaaaaaggcagc

SEQ ID NO: 1236834 - RNA, 21 nt, Human
ccccaaaaaaaggcagcugca

SEQ ID NO: 1236835 - RNA, 18 nt, Human
ccccacccugcccccaaa

SEQ ID NO: 1236836 - RNA, 22 nt, Human
ccccacccugcccccaaaaaaa

SEQ ID NO: 1236837 - RNA, 20 nt, Human
cccccacccugcccccaaaa

SEQ ID NO: 1236838 - RNA, 23 nt, Human
cccccacccugcccccaaaaaaa

SEQ ID NO: 1236839 - RNA, 25 nt, Human
cgcuucaaaaauacaaaguuuccag

SEQ ID NO: 1236840 - RNA, 24 nt, Human
cuaccccgaagcuucauagacaua

SEQ ID NO: 1236841 - RNA, 19 nt, Human
cugcccccaaaaaaaggca

SEQ ID NO: 1236842 - RNA, 20 nt, Human
gcccccaaaaaaaggcagcc

SEQ ID NO: 1236843 - RNA, 20 nt, Human
gcuaaacacacugcagacug

SEQ ID NO: 1236844 - RNA, 24 nt, Human
gcugcuccaacaugcggagaugac

SEQ ID NO: 1236845 - RNA, 26 nt, Human
guaccaaacuauuucuuggcugcucc

SEQ ID NO: 1236846 - RNA, 24 nt, Human
guugcaguaccaauccuuucuuga

SEQ ID NO: 1236847 - RNA, 19 nt, Human
uaaaauaaaaucucaggcc

SEQ ID NO: 1236848 - RNA, 20 nt, Human
uaaaauaaaaucucaggccu

SEQ ID NO: 1236849 - RNA, 18 nt, Human
uaacuucagagcauucca

SEQ ID NO: 1236850 - RNA, 20 nt, Human
uaccccgaagcuucauagac

SEQ ID NO: 1236851 - RNA, 21 nt, Human
uacucagagguguucugagaa

SEQ ID NO: 1236852 - RNA, 20 nt, Human
uaguaccaaacuauuucuug

SEQ ID NO: 1236853 - RNA, 20 nt, Human
uauccaaacagaagagugaa

SEQ ID NO: 1236854 - RNA, 21 nt, Human
ucaacccccacccugccccca

SEQ ID NO: 1236855 - RNA, 24 nt, Human
ucaacccccacccugcccccaaaa

SEQ ID NO: 1236856 - RNA, 24 nt, Human
ucagagguguucugagaauggugc

SEQ ID NO: 1236857 - RNA, 21 nt, Human
ucagauacaugaaggacacag

SEQ ID NO: 1236858 - RNA, 18 nt, Human
ucagugcaucagugagaa

SEQ ID NO: 1236859 - RNA, 27 nt, Human
ucauugaaaaguuuguuuuggugggag

SEQ ID NO: 1236860 - RNA, 23 nt, Human
uccaaacagaagagugaaugaaa

SEQ ID NO: 1236861 - RNA, 24 nt, Human
uccaugugcuuucacuaacacagc

SEQ ID NO: 1236862 - RNA, 20 nt, Human
ucccccuuucugagaccugu

SEQ ID NO: 1236863 - RNA, 22 nt, Human
ucuaaaauaaaaucucaggccc

SEQ ID NO: 1236864 - RNA, 20 nt, Human
ucuaaagcaacaccuuccaa

SEQ ID NO: 1236865 - RNA, 19 nt, Human
ucuaugaaacguauuggga

SEQ ID NO: 1236866 - RNA, 23 nt, Human
ucucaaguacuuaguguuacagg

SEQ ID NO: 1236867 - RNA, 21 nt, Human
ugaaacauaacuauacugcaa

SEQ ID NO: 1236868 - RNA, 21 nt, Human
ugaaaugaacuggccagggug

SEQ ID NO: 1236869 - RNA, 20 nt, Human
ugagcuauugagcucccccu

SEQ ID NO: 1236870 - RNA, 18 nt, Human
ugcaggggaugggggagg

SEQ ID NO: 1236871 - RNA, 25 nt, Human
ugcccgaagcccgcucuccuagcgc

SEQ ID NO: 1236872 - RNA, 22 nt, Human
ugcuuuuagcucaugacagccc

SEQ ID NO: 1236873 - RNA, 18 nt, Human
ugggcuuucacauuuuca

SEQ ID NO: 1236874 - RNA, 24 nt, Human
uguuacaggucuucauugaucaga

SEQ ID NO: 1236875 - RNA, 22 nt, Human
uuaaugcacaucuaaacuuggg

SEQ ID NO: 1236876 - RNA, 18 nt, Human
uuacaggcacuaccccga

SEQ ID NO: 1236877 - RNA, 19 nt, Human
uucagggccaucagugcau

SEQ ID NO: 1236878 - RNA, 19 nt, Human
uucuuggcugcuccaacau

SEQ ID NO: 1236879 - RNA, 20 nt, Human
uuuaauacuuaaugcacauc

SEQ ID NO: 1236880 - RNA, 24 nt, Human
aaagugcugggauuacaggcaaga

SEQ ID NO: 1236881 - RNA, 18 nt, Human
aaauagcaaaauagaaag

SEQ ID NO: 1236882 - RNA, 20 nt, Human
aagagccaccgcgcccagca

SEQ ID NO: 1236883 - RNA, 27 nt, Human
aagcaauucuccugccucggccuccca

SEQ ID NO: 1236884 - RNA, 22 nt, Human
aaguagcugggauuacaggcau

SEQ ID NO: 1236885 - RNA, 24 nt, Human
aaguagcugggauuacaggcaugc

SEQ ID NO: 1236886 - RNA, 18 nt, Human
aagugcugggauuacagg

SEQ ID NO: 1236887 - RNA, 19 nt, Human
aagugcugggauuacaggc

SEQ ID NO: 1236888 - RNA, 26 nt, Human
aagugcugggauuacaggcaagagcc

SEQ ID NO: 1236889 - RNA, 24 nt, Human
aauuuuguauucuuaguagagaca

SEQ ID NO: 1236890 - RNA, 24 nt, Human
acacacacacacacacacacacgg

SEQ ID NO: 1236891 - RNA, 23 nt, Human
accucagccucccaaagugcugg

SEQ ID NO: 1236892 - RNA, 18 nt, Human
acuaaaagaacaagacua

SEQ ID NO: 1236893 - RNA, 21 nt, Human
agaaggcauuccccacuccca

SEQ ID NO: 1236894 - RNA, 18 nt, Human
agacaggguuucuccaua

SEQ ID NO: 1236895 - RNA, 18 nt, Human
agccaccgcgcccagcac

SEQ ID NO: 1236896 - RNA, 23 nt, Human
aggauuucauugcuacuaaaaga

SEQ ID NO: 1236897 - RNA, 20 nt, Human
aggcaugcaccaccaugccc

SEQ ID NO: 1236898 - RNA, 24 nt, Human
aggugaucugcccaccucagccuc

SEQ ID NO: 1236899 - RNA, 22 nt, Human
aguagagacaggguuucuccau

SEQ ID NO: 1236900 - RNA, 18 nt, Human
agugcugggauuacaggc

SEQ ID NO: 1236901 - RNA, 24 nt, Human
auuucauugcuacuaaaagaacaa

SEQ ID NO: 1236902 - RNA, 27 nt, Human
caaagugcugggauuacaggcaagagc

SEQ ID NO: 1236903 - RNA, 21 nt, Human
caaauagcaaaauagaaagaa

SEQ ID NO: 1236904 - RNA, 22 nt, Human
caagcaauucuccugccucggc

SEQ ID NO: 1236905 - RNA, 20 nt, Human
cacacacacacacacacaca

SEQ ID NO: 1236906 - RNA, 22 nt, Human
caccaccaugcccagcuaauuu

SEQ ID NO: 1236907 - RNA, 23 nt, Human
cacucccacuccaggaguuuggg

SEQ ID NO: 1236908 - RNA, 21 nt, Human
cacugcaaccucugccucccg

SEQ ID NO: 1236909 - RNA, 23 nt, Human
cacugcaaccucugccucccggg

SEQ ID NO: 1236910 - RNA, 25 nt, Human
cagagcuccaucauuuuuuuuuuuu

SEQ ID NO: 1236911 - RNA, 24 nt, Human
caggguuucuccauauuggucagg

SEQ ID NO: 1236912 - RNA, 18 nt, Human
cauucaaacacacacaca

SEQ ID NO: 1236913 - RNA, 19 nt, Human
ccaaagugcugggauuaca

SEQ ID NO: 1236914 - RNA, 23 nt, Human
ccaaagugcugggauuacaggca

SEQ ID NO: 1236915 - RNA, 23 nt, Human
ccaaguagcugggauuacaggca

SEQ ID NO: 1236916 - RNA, 24 nt, Human
ccaaguagcugggauuacaggcau

SEQ ID NO: 1236917 - RNA, 24 nt, Human
cccaaagugcugggauuacaggca

SEQ ID NO: 1236918 - RNA, 23 nt, Human
cccaaguagcugggauuacaggc

SEQ ID NO: 1236919 - RNA, 24 nt, Human
cccaaguagcugggauuacaggca

SEQ ID NO: 1236920 - RNA, 18 nt, Human
cccacucccacuccagga

SEQ ID NO: 1236921 - RNA, 22 nt, Human
cccaggcuggagugcaauggcg

SEQ ID NO: 1236922 - RNA, 22 nt, Human
ccccuuauaaggaagacagaaa

SEQ ID NO: 1236923 - RNA, 24 nt, Human
cccgaucucaggugaucugcccac

SEQ ID NO: 1236924 - RNA, 23 nt, Human
cccggguucaagcaauucuccug

SEQ ID NO: 1236925 - RNA, 24 nt, Human
ccucccggguucaagcaauucucc

SEQ ID NO: 1236926 - RNA, 24 nt, Human
cucacugcaaccucugccucccgg

SEQ ID NO: 1236927 - RNA, 24 nt, Human
cucggccucccaaguagcugggau

SEQ ID NO: 1236928 - RNA, 20 nt, Human
cugaugcugucucagaugag

SEQ ID NO: 1236929 - RNA, 19 nt, Human
cugcaaccucugccucccg

SEQ ID NO: 1236930 - RNA, 23 nt, Human
cugcaaccucugccucccggguu

SEQ ID NO: 1236931 - RNA, 24 nt, Human
cugcaaccucugccucccggguuc

SEQ ID NO: 1236932 - RNA, 23 nt, Human
cugccucggccucccaaguagcu

SEQ ID NO: 1236933 - RNA, 23 nt, Human
gagacaggguuucuccauauugg

SEQ ID NO: 1236934 - RNA, 28 nt, Human
gagcuccaucauuuuuuuuuuuuuuuuu

SEQ ID NO: 1236935 - RNA, 24 nt, Human
gaucucaggugaucugcccaccuc

SEQ ID NO: 1236936 - RNA, 18 nt, Human
gauuacaggcaagagcca

SEQ ID NO: 1236937 - RNA, 24 nt, Human
gauuacaggcaugcaccaccaugc

SEQ ID NO: 1236938 - RNA, 22 nt, Human
gcaaccucugccucccggguuc

SEQ ID NO: 1236939 - RNA, 20 nt, Human
gcaccaccaugcccagcuaa

SEQ ID NO: 1236940 - RNA, 19 nt, Human
gcccaggcuggagugcaau

SEQ ID NO: 1236941 - RNA, 20 nt, Human
gccucggccucccaaguagc

SEQ ID NO: 1236942 - RNA, 21 nt, Human
gccucggccucccaaguagcu

SEQ ID NO: 1236943 - RNA, 21 nt, Human
gcucuuguugcccaggcugga

SEQ ID NO: 1236944 - RNA, 24 nt, Human
gcucuuguugcccaggcuggagug

SEQ ID NO: 1236945 - RNA, 21 nt, Human
gcuggagugcaauggcgcuag

SEQ ID NO: 1236946 - RNA, 22 nt, Human
ggauuacaggcaagagccaccg

SEQ ID NO: 1236947 - RNA, 24 nt, Human
ggauuacaggcaugcaccaccaug

SEQ ID NO: 1236948 - RNA, 21 nt, Human
gggugaguccuaggaaacauu

SEQ ID NO: 1236949 - RNA, 18 nt, Human
guagcugggauuacaggc

SEQ ID NO: 1236950 - RNA, 24 nt, Human
gugaucugcccaccucagccuccc

SEQ ID NO: 1236951 - RNA, 24 nt, Human
uaaaaaacaaccauauuucauaga

SEQ ID NO: 1236952 - RNA, 25 nt, Human
uaaaaaacaaccauauuucauagau

SEQ ID NO: 1236953 - RNA, 20 nt, Human
uaagcauuuuucauucaaac

SEQ ID NO: 1236954 - RNA, 24 nt, Human
uacaggcaagagccaccgcgccca

SEQ ID NO: 1236955 - RNA, 24 nt, Human
uacaggcaugcaccaccaugccca

SEQ ID NO: 1236956 - RNA, 21 nt, Human
uagaaagaaauaaaugguuuc

SEQ ID NO: 1236957 - RNA, 26 nt, Human
uagauaucuuuccacuuaagcacauu

SEQ ID NO: 1236958 - RNA, 18 nt, Human
uagcaaaauagaaagaaa

SEQ ID NO: 1236959 - RNA, 18 nt, Human
uagcaaaauagaaagaaa

SEQ ID NO: 1236960 - RNA, 18 nt, Human
uaguagagacaggguuuc

SEQ ID NO: 1236961 - RNA, 24 nt, Human
uaguagagacaggguuucuccaua

SEQ ID NO: 1236962 - RNA, 25 nt, Human
ucaaaauaguccaaaauaaaucuga

SEQ ID NO: 1236963 - RNA, 24 nt, Human
ucacugcaaccucugccucccggg

SEQ ID NO: 1236964 - RNA, 25 nt, Human
ucacugcaaccucugccucccgggu

SEQ ID NO: 1236965 - RNA, 22 nt, Human
ucagaugaguaacugcaaauca

SEQ ID NO: 1236966 - RNA, 18 nt, Human
ucagccucccaaagugcu

SEQ ID NO: 1236967 - RNA, 24 nt, Human
ucagguuggcaggugaauggccuc

SEQ ID NO: 1236968 - RNA, 33 nt, Human
ucauucaaacacacacacacacacacacacggu

SEQ ID NO: 1236969 - RNA, 22 nt, Human
ucauugacuagaagugaccaaa

SEQ ID NO: 1236970 - RNA, 24 nt, Human
ucccaaagugcugggauuacaggc

SEQ ID NO: 1236971 - RNA, 24 nt, Human
ucccaaguagcugggauuacaggc

SEQ ID NO: 1236972 - RNA, 21 nt, Human
ucccggguucaagcaauucuc

SEQ ID NO: 1236973 - RNA, 24 nt, Human
ucccggguucaagcaauucuccug

SEQ ID NO: 1236974 - RNA, 21 nt, Human
ucugcccaccucagccuccca

SEQ ID NO: 1236975 - RNA, 24 nt, Human
ucugccucccggguucaagcaauu

SEQ ID NO: 1236976 - RNA, 22 nt, Human
ucuuguugcccaggcuggagug

SEQ ID NO: 1236977 - RNA, 19 nt, Human
ugaaaaagguuacugccac

SEQ ID NO: 1236978 - RNA, 20 nt, Human
ugaccaaaauagauucuacu

SEQ ID NO: 1236979 - RNA, 21 nt, Human
ugagaaaagacuuuugaaagc

SEQ ID NO: 1236980 - RNA, 23 nt, Human
ugagacagaguuuugcucuuguu

SEQ ID NO: 1236981 - RNA, 24 nt, Human
ugaucugcccaccucagccuccca

SEQ ID NO: 1236982 - RNA, 18 nt, Human
ugcccaggcuggagugca

SEQ ID NO: 1236983 - RNA, 21 nt, Human
ugcccaggcuggagugcaaug

SEQ ID NO: 1236984 - RNA, 21 nt, Human
ugcccaggcuggagugcaaug

SEQ ID NO: 1236985 - RNA, 21 nt, Human
ugccucggccucccaaguagc

SEQ ID NO: 1236986 - RNA, 24 nt, Human
ugccucggccucccaaguagcugg

SEQ ID NO: 1236987 - RNA, 26 nt, Human
ugcuacuaaaagaacaagacuauuca

SEQ ID NO: 1236988 - RNA, 24 nt, Human
ugcucuuguugcccaggcuggagu

SEQ ID NO: 1236989 - RNA, 22 nt, Human
ugcugggauuacaggcaagagc

SEQ ID NO: 1236990 - RNA, 23 nt, Human
uggagugcaauggcgcuaucuca

SEQ ID NO: 1236991 - RNA, 24 nt, Human
uggcgcuaucucagcucacugcaa

SEQ ID NO: 1236992 - RNA, 22 nt, Human
ugggauuacaggcaagagccac

SEQ ID NO: 1236993 - RNA, 23 nt, Human
ugggauuacaggcaagagccacc

SEQ ID NO: 1236994 - RNA, 24 nt, Human
ugggauuacaggcaagagccaccg

SEQ ID NO: 1236995 - RNA, 21 nt, Human
ugggauuacaggcaugcacca

SEQ ID NO: 1236996 - RNA, 24 nt, Human
ugggauuacaggcaugcaccacca

SEQ ID NO: 1236997 - RNA, 20 nt, Human
uguugcccaggcuggagugc

SEQ ID NO: 1236998 - RNA, 22 nt, Human
uguugcccaggcuggagugcaa

SEQ ID NO: 1236999 - RNA, 25 nt, Human
uuaaaaaacaaccauauuucauaga

SEQ ID NO: 1237000 - RNA, 24 nt, Human
uuaguagagacaggguuucuccau

SEQ ID NO: 1237001 - RNA, 21 nt, Human
uuauauccagacugcauuacu

SEQ ID NO: 1237002 - RNA, 21 nt, Human
uucaagcaauucuccugccuc

SEQ ID NO: 1237003 - RNA, 24 nt, Human
uucaagcaauucuccugccucggc

SEQ ID NO: 1237004 - RNA, 31 nt, Human
uucauucaaacacacacacacacacacacag

SEQ ID NO: 1237005 - RNA, 19 nt, Human
uuccacuuaagcacauuca

SEQ ID NO: 1237006 - RNA, 18 nt, Human
uugcccaggcuggagugc

SEQ ID NO: 1237007 - RNA, 23 nt, Human
uugcucuuguugcccaggcugga

SEQ ID NO: 1237008 - RNA, 24 nt, Human
uuugcucuuguugcccaggcugga

SEQ ID NO: 1237009 - RNA, 24 nt, Human
uuuugcucuuguugcccaggcugg

SEQ ID NO: 1237010 - RNA, 20 nt, Human
uuuuguauucuuaguagaga

SEQ ID NO: 1237011 - RNA, 18 nt, Human
uuuuuuuuuuuuuuuuug

SEQ ID NO: 1237012 - RNA, 22 nt, Human
aaacagcuguucucaacaagcc

SEQ ID NO: 1237013 - RNA, 24 nt, Human
aaagguacauacuauucugcacuu

SEQ ID NO: 1237014 - RNA, 20 nt, Human
aacaaaaucauugugaaugg

SEQ ID NO: 1237015 - RNA, 20 nt, Human
aacccuuucucuuucacuuu

SEQ ID NO: 1237016 - RNA, 18 nt, Human
aagcaacagaaaauauac

SEQ ID NO: 1237017 - RNA, 18 nt, Human
aaguaugcaugugccagg

SEQ ID NO: 1237018 - RNA, 18 nt, Human
acagcaguaauaaugugu

SEQ ID NO: 1237019 - RNA, 19 nt, Human
aggaaccagaacagugcau

SEQ ID NO: 1237020 - RNA, 22 nt, Human
aguaagcaacagaaaauauaca

SEQ ID NO: 1237021 - RNA, 18 nt, Human
agucacagaaaaugaacu

SEQ ID NO: 1237022 - RNA, 22 nt, Human
augagucacagaaaaugaacuu

SEQ ID NO: 1237023 - RNA, 21 nt, Human
caccuuggaaaagaaaaucag

SEQ ID NO: 1237024 - RNA, 23 nt, Human
cacuuuuacuaaacaacuggaga

SEQ ID NO: 1237025 - RNA, 26 nt, Human
cagcaguaauaaugugucaacauaaa

SEQ ID NO: 1237026 - RNA, 19 nt, Human
cagcagugcucugucuugc

SEQ ID NO: 1237027 - RNA, 20 nt, Human
caguacuaagauaccaaaac

SEQ ID NO: 1237028 - RNA, 18 nt, Human
cagugguguguuaugcuu

SEQ ID NO: 1237029 - RNA, 22 nt, Human
cauuagaaaucgaaaacagcug

SEQ ID NO: 1237030 - RNA, 18 nt, Human
ccaggcaaaguuguuaca

SEQ ID NO: 1237031 - RNA, 20 nt, Human
cccucagcgccgcgaggccg

SEQ ID NO: 1237032 - RNA, 24 nt, Human
ccggcggcgggucuagcucuccuc

SEQ ID NO: 1237033 - RNA, 18 nt, Human
ccuccgccgccgccgccu

SEQ ID NO: 1237034 - RNA, 18 nt, Human
cgggucuagcucuccucc

SEQ ID NO: 1237035 - RNA, 22 nt, Human
cuacaccuuggaaaagaaaauc

SEQ ID NO: 1237036 - RNA, 21 nt, Human
cuagacauuuacagcagugcu

SEQ ID NO: 1237037 - RNA, 22 nt, Human
cucaucacauuuugucacuugu

SEQ ID NO: 1237038 - RNA, 19 nt, Human
cuccuccgccgccgccgcc

SEQ ID NO: 1237039 - RNA, 23 nt, Human
cuccuccgccgccgccgccuggu

SEQ ID NO: 1237040 - RNA, 18 nt, Human
cugcacuuuuccaccaaa

SEQ ID NO: 1237041 - RNA, 21 nt, Human
cugggcggggacccggaggag

SEQ ID NO: 1237042 - RNA, 24 nt, Human
gaaaacagcuguucucaacaagcc

SEQ ID NO: 1237043 - RNA, 23 nt, Human
gaaaucgaaaacagcuguucuca

SEQ ID NO: 1237044 - RNA, 28 nt, Human
gaagcucucaucacauuuugucacuuuu

SEQ ID NO: 1237045 - RNA, 28 nt, Human
gaggaggaggaagaaaaaggaggaggga

SEQ ID NO: 1237046 - RNA, 19 nt, Human
gcuguucucaacaagccaa

SEQ ID NO: 1237047 - RNA, 22 nt, Human
ggaagaaaaaggaggagggaag

SEQ ID NO: 1237048 - RNA, 22 nt, Human
ggacuggggguggaggaagcgg

SEQ ID NO: 1237049 - RNA, 20 nt, Human
gugucaacauaaaaaaacua

SEQ ID NO: 1237050 - RNA, 20 nt, Human
uaaaagguacauacuauucu

SEQ ID NO: 1237051 - RNA, 26 nt, Human
uaagaaaaugcauauagcacuaaaga

SEQ ID NO: 1237052 - RNA, 25 nt, Human
uaagcaacauccuguguaguugcca

SEQ ID NO: 1237053 - RNA, 20 nt, Human
uauggagcagagaacaaaau

SEQ ID NO: 1237054 - RNA, 23 nt, Human
uauuuuuuuaaucaggcauugcc

SEQ ID NO: 1237055 - RNA, 23 nt, Human
ucacagaaaaugaacuuuggaua

SEQ ID NO: 1237056 - RNA, 20 nt, Human
uccuguggcaggaaaaaccc

SEQ ID NO: 1237057 - RNA, 21 nt, Human
ucucagagcaaacaguaagca

SEQ ID NO: 1237058 - RNA, 19 nt, Human
ucuguaaguaccuggugaa

SEQ ID NO: 1237059 - RNA, 22 nt, Human
ugaaaaaaguccaggcaaaguu

SEQ ID NO: 1237060 - RNA, 22 nt, Human
ugaaugauguaugaaaucugcu

SEQ ID NO: 1237061 - RNA, 23 nt, Human
ugccaugauuuccaaaaaauaua

SEQ ID NO: 1237062 - RNA, 27 nt, Human
uggauaccuguccacuuuaaggguuuu

SEQ ID NO: 1237063 - RNA, 21 nt, Human
uguaccaauaaaaaaaaaauc

SEQ ID NO: 1237064 - RNA, 21 nt, Human
uguguuaugcuuguuauauaa

SEQ ID NO: 1237065 - RNA, 19 nt, Human
uguuguaaaaugaaaaaag

SEQ ID NO: 1237066 - RNA, 25 nt, Human
uucacuuuuacuaaacaaccccuag

SEQ ID NO: 1237067 - RNA, 20 nt, Human
uucagccauuuuauuguucu

SEQ ID NO: 1237068 - RNA, 18 nt, Human
uugacaacugucacauuu

SEQ ID NO: 1237069 - RNA, 18 nt, Human
uugaugaaacauucuuug

SEQ ID NO: 1237070 - RNA, 21 nt, Human
uuuccaccaaaagcaguggug

SEQ ID NO: 1237071 - RNA, 18 nt, Human
uuuggugcaguuagucca

SEQ ID NO: 1237072 - RNA, 21 nt, Human
aaacccuaggcagaugagagu

SEQ ID NO: 1237073 - RNA, 23 nt, Human
cagaaugaaaggcuuucugaaca

SEQ ID NO: 1237074 - RNA, 19 nt, Human
cccuccaugcaaugguuca

SEQ ID NO: 1237075 - RNA, 23 nt, Human
ggagguuguaaaucacccuccau

SEQ ID NO: 1237076 - RNA, 19 nt, Human
uaaaucacccuccaugcaa

SEQ ID NO: 1237077 - RNA, 20 nt, Human
ugagaguggagguuguaaau

SEQ ID NO: 1237078 - RNA, 22 nt, Human
aaagacagagagagggggaagc

SEQ ID NO: 1237079 - RNA, 18 nt, Human
aacaaaagccuuaacaac

SEQ ID NO: 1237080 - RNA, 20 nt, Human
aaccaagccaucuugacucc

SEQ ID NO: 1237081 - RNA, 21 nt, Human
aaccgugggucaggcugaccu

SEQ ID NO: 1237082 - RNA, 18 nt, Human
aagagggcaggaacuggg

SEQ ID NO: 1237083 - RNA, 21 nt, Human
aagcaaggcucuugcuuuggg

SEQ ID NO: 1237084 - RNA, 23 nt, Human
aagcaaggcucuugcuuugggau

SEQ ID NO: 1237085 - RNA, 20 nt, Human
aagccaguuuguugaaacca

SEQ ID NO: 1237086 - RNA, 21 nt, Human
aaggccaggaccagggugaaa

SEQ ID NO: 1237087 - RNA, 23 nt, Human
aauauccaccuacaagguacagc

SEQ ID NO: 1237088 - RNA, 19 nt, Human
acaaccgugggucaggcug

SEQ ID NO: 1237089 - RNA, 21 nt, Human
acacaggcacagacguccucc

SEQ ID NO: 1237090 - RNA, 24 nt, Human
acacuggaaggcaaggccaggacc

SEQ ID NO: 1237091 - RNA, 25 nt, Human
acagagcagagcagcuaaagggcaa

SEQ ID NO: 1237092 - RNA, 20 nt, Human
acagaggugaaggcacagcc

SEQ ID NO: 1237093 - RNA, 19 nt, Human
agagagagaaagacagaga

SEQ ID NO: 1237094 - RNA, 23 nt, Human
agagagagaaagacagagagagg

SEQ ID NO: 1237095 - RNA, 18 nt, Human
agagagagaggaguugga

SEQ ID NO: 1237096 - RNA, 21 nt, Human
agagagagaggaguuggagag

SEQ ID NO: 1237097 - RNA, 20 nt, Human
agagagagggggaagcaguc

SEQ ID NO: 1237098 - RNA, 21 nt, Human
agagagagggggaagcaguca

SEQ ID NO: 1237099 - RNA, 21 nt, Human
agagcuuuccuaccccugccu

SEQ ID NO: 1237100 - RNA, 18 nt, Human
agcaaggcucuugcuuug

SEQ ID NO: 1237101 - RNA, 18 nt, Human
agcccagcacagagcaga

SEQ ID NO: 1237102 - RNA, 23 nt, Human
agccugaccagugagaacaaugc

SEQ ID NO: 1237103 - RNA, 20 nt, Human
aggaaaugucaaaaagcuca

SEQ ID NO: 1237104 - RNA, 22 nt, Human
aggcaaggccaggaccagggug

SEQ ID NO: 1237105 - RNA, 26 nt, Human
auaacacauccuucaagcccaggaua

SEQ ID NO: 1237106 - RNA, 23 nt, Human
augaugaacaaggucaggaucug

SEQ ID NO: 1237107 - RNA, 22 nt, Human
augcaugguagcauuucagagu

SEQ ID NO: 1237108 - RNA, 19 nt, Human
auuucagaguuucugucuc

SEQ ID NO: 1237109 - RNA, 20 nt, Human
caaaaauuccaugaugaaca

SEQ ID NO: 1237110 - RNA, 23 nt, Human
caaccacagcuaacauuagagcc

SEQ ID NO: 1237111 - RNA, 18 nt, Human
caacugagacguugucuu

SEQ ID NO: 1237112 - RNA, 19 nt, Human
caagagcuuuccuaccccu

SEQ ID NO: 1237113 - RNA, 19 nt, Human
caagcuggcugauucucaa

SEQ ID NO: 1237114 - RNA, 18 nt, Human
cacaagcccagcacagag

SEQ ID NO: 1237115 - RNA, 23 nt, Human
cacagcucagccucacucacuuc

SEQ ID NO: 1237116 - RNA, 18 nt, Human
cacauccccaaaggaggg

SEQ ID NO: 1237117 - RNA, 23 nt, Human
caccccacaagcccagcacagag

SEQ ID NO: 1237118 - RNA, 22 nt, Human
cacggccaagagcuuuccuacc

SEQ ID NO: 1237119 - RNA, 20 nt, Human
cagaaaugcagagcuggcag

SEQ ID NO: 1237120 - RNA, 19 nt, Human
cagagcagcuaaagggcaa

SEQ ID NO: 1237121 - RNA, 21 nt, Human
cagcauagagaauauccaaua

SEQ ID NO: 1237122 - RNA, 19 nt, Human
cagccucacucacuucauc

SEQ ID NO: 1237123 - RNA, 18 nt, Human
cagccuccccucuccucc

SEQ ID NO: 1237124 - RNA, 24 nt, Human
cagccuccccucuccuccuucucc

SEQ ID NO: 1237125 - RNA, 24 nt, Human
cagcuaaagggcaaggacuggcac

SEQ ID NO: 1237126 - RNA, 24 nt, Human
caggaacugggucucucugugcac

SEQ ID NO: 1237127 - RNA, 23 nt, Human
caggaccagggugaaacaagcaa

SEQ ID NO: 1237128 - RNA, 19 nt, Human
caggcacagacguccuccc

SEQ ID NO: 1237129 - RNA, 22 nt, Human
cauacacaggcacagacguccu

SEQ ID NO: 1237130 - RNA, 21 nt, Human
caugaaccaauuacuccuccc

SEQ ID NO: 1237131 - RNA, 19 nt, Human
cauguuaacacugaaaaau

SEQ ID NO: 1237132 - RNA, 18 nt, Human
ccaacauacacaggcaca

SEQ ID NO: 1237133 - RNA, 18 nt, Human
ccaaccucuugcuagugc

SEQ ID NO: 1237134 - RNA, 22 nt, Human
ccaagagcuuuccuaccccugc

SEQ ID NO: 1237135 - RNA, 21 nt, Human
cccacaagcccagcacagagc

SEQ ID NO: 1237136 - RNA, 22 nt, Human
cccacaagcccagcacagagca

SEQ ID NO: 1237137 - RNA, 18 nt, Human
cccagcacagagcagagc

SEQ ID NO: 1237138 - RNA, 22 nt, Human
ccuaaucccagcccuguuggau

SEQ ID NO: 1237139 - RNA, 23 nt, Human
ccuaccccugccuccucugggag

SEQ ID NO: 1237140 - RNA, 27 nt, Human
ccuccagggcaacacuccuggacucac

SEQ ID NO: 1237141 - RNA, 19 nt, Human
ccuccgucugguagcuucc

SEQ ID NO: 1237142 - RNA, 18 nt, Human
ccuccuucucccuauucu

SEQ ID NO: 1237143 - RNA, 20 nt, Human
cggccaagagcuuuccuacc

SEQ ID NO: 1237144 - RNA, 22 nt, Human
cuaccccugccuccucugggag

SEQ ID NO: 1237145 - RNA, 23 nt, Human
cuccuggacucaccuuguuaacc

SEQ ID NO: 1237146 - RNA, 23 nt, Human
cucuccuccuucucccuauucug

SEQ ID NO: 1237147 - RNA, 21 nt, Human
cugaccagugagaacaaugcu

SEQ ID NO: 1237148 - RNA, 23 nt, Human
cuuaaaauauccaccuacaaggu

SEQ ID NO: 1237149 - RNA, 21 nt, Human
cuucccaagcuggcugauucu

SEQ ID NO: 1237150 - RNA, 22 nt, Human
cuugacucccgucucccagaca

SEQ ID NO: 1237151 - RNA, 19 nt, Human
cuugcuagugccucccuug

SEQ ID NO: 1237152 - RNA, 23 nt, Human
gaacaaggucaggaucugaccuc

SEQ ID NO: 1237153 - RNA, 22 nt, Human
gaccauuuggauugccuauuuu

SEQ ID NO: 1237154 - RNA, 27 nt, Human
gagaaagacagagagagggggaaggaa

SEQ ID NO: 1237155 - RNA, 21 nt, Human
gagcacagagccaaacgccaa

SEQ ID NO: 1237156 - RNA, 19 nt, Human
gcccuugccaggcauaaag

SEQ ID NO: 1237157 - RNA, 21 nt, Human
gcuaaagggcaaggacuggca

SEQ ID NO: 1237158 - RNA, 21 nt, Human
ggauggaucuagaacugauuu

SEQ ID NO: 1237159 - RNA, 19 nt, Human
ggcaguggaguuuggcugg

SEQ ID NO: 1237160 - RNA, 21 nt, Human
ggccaggaccagggugaaaca

SEQ ID NO: 1237161 - RNA, 18 nt, Human
gggcauggacagauccug

SEQ ID NO: 1237162 - RNA, 19 nt, Human
ggucaggcugaccuggcca

SEQ ID NO: 1237163 - RNA, 21 nt, Human
gucaauuccaaccacagcuaa

SEQ ID NO: 1237164 - RNA, 24 nt, Human
guccucuggggugacaaccguggg

SEQ ID NO: 1237165 - RNA, 22 nt, Human
gugcguuccauaaacgaguccc

SEQ ID NO: 1237166 - RNA, 23 nt, Human
guugaaaccaagccaucuugacu

SEQ ID NO: 1237167 - RNA, 24 nt, Human
uaaucagggaucaggaccugguuu

SEQ ID NO: 1237168 - RNA, 21 nt, Human
uacaauaauuugcaggcaaaa

SEQ ID NO: 1237169 - RNA, 19 nt, Human
uacacaggcacagacgucc

SEQ ID NO: 1237170 - RNA, 18 nt, Human
uacacuugcuucuugucu

SEQ ID NO: 1237171 - RNA, 26 nt, Human
uaccccugccuccucugggagucugc

SEQ ID NO: 1237172 - RNA, 18 nt, Human
uacuaugugucacucauu

SEQ ID NO: 1237173 - RNA, 22 nt, Human
uagaacuagagaguccugaggc

SEQ ID NO: 1237174 - RNA, 24 nt, Human
uauaaacuccaagagggcaggaac

SEQ ID NO: 1237175 - RNA, 23 nt, Human
uaugccuccagggcaacacuccu

SEQ ID NO: 1237176 - RNA, 22 nt, Human
uauggagcuuagggauucugug

SEQ ID NO: 1237177 - RNA, 19 nt, Human
uauucugucuccucucuca

SEQ ID NO: 1237178 - RNA, 24 nt, Human
uauucugucuccucucucacccca

SEQ ID NO: 1237179 - RNA, 24 nt, Human
ucaccccacaagcccagcacagag

SEQ ID NO: 1237180 - RNA, 18 nt, Human
ucacuugggaugaaaaag

SEQ ID NO: 1237181 - RNA, 21 nt, Human
ucagccucacucacuucaucc

SEQ ID NO: 1237182 - RNA, 19 nt, Human
uccaaaggcugggccccug

SEQ ID NO: 1237183 - RNA, 18 nt, Human
ucccauaaacaacucaaa

SEQ ID NO: 1237184 - RNA, 22 nt, Human
uccugcuuucauuacagcugca

SEQ ID NO: 1237185 - RNA, 23 nt, Human
ucguauuugcacagcucagccuc

SEQ ID NO: 1237186 - RNA, 21 nt, Human
ucuccuccuucucccuauucu

SEQ ID NO: 1237187 - RNA, 19 nt, Human
ucuccucucucaccccaca

SEQ ID NO: 1237188 - RNA, 22 nt, Human
ucuccugcugccauuuaggacc

SEQ ID NO: 1237189 - RNA, 21 nt, Human
ucucugugcguaaaugugucc

SEQ ID NO: 1237190 - RNA, 20 nt, Human
ucugggaugcacacagcaag

SEQ ID NO: 1237191 - RNA, 20 nt, Human
ucugucuccucucucacccc

SEQ ID NO: 1237192 - RNA, 21 nt, Human
ucugucuccucucucaccccc

SEQ ID NO: 1237193 - RNA, 22 nt, Human
ucugugaagucauacuuggccu

SEQ ID NO: 1237194 - RNA, 24 nt, Human
ucuucuccugcugccauuuaggac

SEQ ID NO: 1237195 - RNA, 26 nt, Human
ucuucuguuacccuugcuuuguaugg

SEQ ID NO: 1237196 - RNA, 23 nt, Human
ugaaaccaagccaucuugacucc

SEQ ID NO: 1237197 - RNA, 25 nt, Human
ugaaagcagcauagagaauauccaa

SEQ ID NO: 1237198 - RNA, 22 nt, Human
ugaaaugauaggcagcauggca

SEQ ID NO: 1237199 - RNA, 23 nt, Human
ugaaccaauuacuccucccuuua

SEQ ID NO: 1237200 - RNA, 23 nt, Human
ugacucccgucucccagacaauc

SEQ ID NO: 1237201 - RNA, 21 nt, Human
ugcuuccuccgucugguagcu

SEQ ID NO: 1237202 - RNA, 21 nt, Human
uggaaggcaaggccaggacca

SEQ ID NO: 1237203 - RNA, 24 nt, Human
uggauucugucuccuuaaaauuuu

SEQ ID NO: 1237204 - RNA, 22 nt, Human
uggcagaggcucagagcaugaa

SEQ ID NO: 1237205 - RNA, 24 nt, Human
ugggauaaagucuaaggaaauguc

SEQ ID NO: 1237206 - RNA, 18 nt, Human
ugggaugaaaaagcuccu

SEQ ID NO: 1237207 - RNA, 21 nt, Human
ugggucaggcugaccuggcca

SEQ ID NO: 1237208 - RNA, 24 nt, Human
uggugaacauguuaacacugaaaa

SEQ ID NO: 1237209 - RNA, 21 nt, Human
uguuuuaugccuccagggcaa

SEQ ID NO: 1237210 - RNA, 25 nt, Human
uugcaggcaaaaagaaucgcuuccu

SEQ ID NO: 1237211 - RNA, 19 nt, Human
uuggauugccuauuuuucu

SEQ ID NO: 1237212 - RNA, 20 nt, Human
uuuauuaaaauccugcuuuc

SEQ ID NO: 1237213 - RNA, 24 nt, Human
auauauuuuaaguaggacagguuu

SEQ ID NO: 1237214 - RNA, 25 nt, Human
gguuuuuuuuuuuuuaaacuuuugg

SEQ ID NO: 1237215 - RNA, 26 nt, Human
uaggacagguuuuuuuuuuuuuaaaa

SEQ ID NO: 1237216 - RNA, 24 nt, Human
uuuuuuuuuuuuuaaacuuuugga

SEQ ID NO: 1237217 - RNA, 24 nt, Human
aaaaacaaaaacaaaaacaaaaac

SEQ ID NO: 1237218 - RNA, 25 nt, Human
aaaaagaaguuuuuuauuucagaga

SEQ ID NO: 1237219 - RNA, 22 nt, Human
aaaacaaaaacaaaaacaaaaa

SEQ ID NO: 1237220 - RNA, 27 nt, Human
aaaacaaaaacaaaaacaaacaaacaa

SEQ ID NO: 1237221 - RNA, 19 nt, Human
aaaacaaacaaacaaaaaa

SEQ ID NO: 1237222 - RNA, 23 nt, Human
aaaaccccuucauuuucaaacuu

SEQ ID NO: 1237223 - RNA, 26 nt, Human
aaacaaaaacaaaaacaaaaacaaac

SEQ ID NO: 1237224 - RNA, 22 nt, Human
aaaguacagauguuaucaaaag

SEQ ID NO: 1237225 - RNA, 24 nt, Human
aacacuuugggaggccgagguggg

SEQ ID NO: 1237226 - RNA, 23 nt, Human
aaccuccugcaaacagaugacau

SEQ ID NO: 1237227 - RNA, 21 nt, Human
aacguggcgaaaccccauuuc

SEQ ID NO: 1237228 - RNA, 21 nt, Human
aacguggcgaaaccccauuuc

SEQ ID NO: 1237229 - RNA, 24 nt, Human
aagggccgggugcgguggcucacg

SEQ ID NO: 1237230 - RNA, 27 nt, Human
acaaaaacaaaaacaaacaaacaaaaa

SEQ ID NO: 1237231 - RNA, 22 nt, Human
acaaacaaacaaaaaacacgcu

SEQ ID NO: 1237232 - RNA, 19 nt, Human
acaagagugaaacuccauc

SEQ ID NO: 1237233 - RNA, 20 nt, Human
acaagagugaaacuccaucu

SEQ ID NO: 1237234 - RNA, 21 nt, Human
acaagagugaaacuccaucuc

SEQ ID NO: 1237235 - RNA, 22 nt, Human
acauauccuuuuagaagagucc

SEQ ID NO: 1237236 - RNA, 24 nt, Human
accccauuucuacuaaaaauacaa

SEQ ID NO: 1237237 - RNA, 24 nt, Human
accugaggucaggaguucaagacc

SEQ ID NO: 1237238 - RNA, 25 nt, Human
acuccagccugggcaacaagaguga

SEQ ID NO: 1237239 - RNA, 20 nt, Human
acuggggaaaaucaaagcuu

SEQ ID NO: 1237240 - RNA, 19 nt, Human
agagacagugcggaugaga

SEQ ID NO: 1237241 - RNA, 21 nt, Human
agagauuaaagaauuugaaac

SEQ ID NO: 1237242 - RNA, 23 nt, Human
agccagacauguuggcgcacgcc

SEQ ID NO: 1237243 - RNA, 24 nt, Human
agccuggccaacguggcgaaaccc

SEQ ID NO: 1237244 - RNA, 18 nt, Human
agcuaauacagcuaaugc

SEQ ID NO: 1237245 - RNA, 23 nt, Human
aggcaggagaaucgcuuaaaccc

SEQ ID NO: 1237246 - RNA, 24 nt, Human
aggcaggagaaucgcuuaaaccca

SEQ ID NO: 1237247 - RNA, 21 nt, Human
aggccgagguggguggaucac

SEQ ID NO: 1237248 - RNA, 22 nt, Human
agguggguggaucaccugaggu

SEQ ID NO: 1237249 - RNA, 19 nt, Human
auaacgaagacaucaggaa

SEQ ID NO: 1237250 - RNA, 20 nt, Human
augaacauuuuucaugggca

SEQ ID NO: 1237251 - RNA, 24 nt, Human
auugcacuccagccugggcaacaa

SEQ ID NO: 1237252 - RNA, 25 nt, Human
auugcacuccagccugggcaacaag

SEQ ID NO: 1237253 - RNA, 24 nt, Human
caaaaacaaacaaacaaaaaacac

SEQ ID NO: 1237254 - RNA, 18 nt, Human
caaaagaggaaauucuua

SEQ ID NO: 1237255 - RNA, 26 nt, Human
caaacaaacaaaaaacacgcuaauuc

SEQ ID NO: 1237256 - RNA, 24 nt, Human
caacacuuugggaggccgaggugg

SEQ ID NO: 1237257 - RNA, 21 nt, Human
caagauccgaagaaacuucca

SEQ ID NO: 1237258 - RNA, 19 nt, Human
caagcugucagaaaacacu

SEQ ID NO: 1237259 - RNA, 19 nt, Human
cacaguauggguacagaac

SEQ ID NO: 1237260 - RNA, 20 nt, Human
cacccuuaacuuaaauacau

SEQ ID NO: 1237261 - RNA, 23 nt, Human
caccugaggucaggaguucaaga

SEQ ID NO: 1237262 - RNA, 24 nt, Human
cacgccuguaaucccaacacuuug

SEQ ID NO: 1237263 - RNA, 18 nt, Human
cacgccuguaaucccagc

SEQ ID NO: 1237264 - RNA, 19 nt, Human
cacgccuguaaucccagcu

SEQ ID NO: 1237265 - RNA, 23 nt, Human
cacuccagccugggcaacaagag

SEQ ID NO: 1237266 - RNA, 24 nt, Human
cacuccagccugggcaacaagagu

SEQ ID NO: 1237267 - RNA, 25 nt, Human
cacuccagccugggcaacaagagug

SEQ ID NO: 1237268 - RNA, 21 nt, Human
cagaaaacacugcgcggucaa

SEQ ID NO: 1237269 - RNA, 18 nt, Human
cagagaugcuuaaaaguc

SEQ ID NO: 1237270 - RNA, 24 nt, Human
cagcuaaugcauuauaaauaaugu

SEQ ID NO: 1237271 - RNA, 27 nt, Human
caguaaagauggguauuagcaacacag

SEQ ID NO: 1237272 - RNA, 21 nt, Human
caucaaaaaagcaacagcuaa

SEQ ID NO: 1237273 - RNA, 22 nt, Human
caucaaaaaagcaacagcuaau

SEQ ID NO: 1237274 - RNA, 26 nt, Human
caucucaaaaaaacaaaaacaaaaac

SEQ ID NO: 1237275 - RNA, 28 nt, Human
caucucaaaaaaacaaaaacaaaaacaa

SEQ ID NO: 1237276 - RNA, 18 nt, Human
cauugcacuccagccugg

SEQ ID NO: 1237277 - RNA, 19 nt, Human
cauugcacuccagccuggg

SEQ ID NO: 1237278 - RNA, 21 nt, Human
cauugcacuccagccugggca

SEQ ID NO: 1237279 - RNA, 24 nt, Human
cauugcacuccagccugggcaaca

SEQ ID NO: 1237280 - RNA, 22 nt, Human
ccacuacucaaccuuuuuccug

SEQ ID NO: 1237281 - RNA, 22 nt, Human
ccaucucaaaaaaacaaaaacc

SEQ ID NO: 1237282 - RNA, 20 nt, Human
ccauugcacuccagccuggg

SEQ ID NO: 1237283 - RNA, 21 nt, Human
ccauugcacuccagccugggc

SEQ ID NO: 1237284 - RNA, 23 nt, Human
ccauugcacuccagccugggcaa

SEQ ID NO: 1237285 - RNA, 24 nt, Human
ccauugcacuccagccugggcaac

SEQ ID NO: 1237286 - RNA, 23 nt, Human
ccccucgagcccgaaggccucua

SEQ ID NO: 1237287 - RNA, 25 nt, Human
ccuccugcaaacagaugacaucggc

SEQ ID NO: 1237288 - RNA, 18 nt, Human
ccucgagcccgaaggccu

SEQ ID NO: 1237289 - RNA, 24 nt, Human
ccuggccaacguggcgaaacccca

SEQ ID NO: 1237290 - RNA, 22 nt, Human
ccuguaaucccaacacuuuggg

SEQ ID NO: 1237291 - RNA, 21 nt, Human
ccuguaaucccagcuacucgg

SEQ ID NO: 1237292 - RNA, 25 nt, Human
cgaaacacccccucgagcccgaagg

SEQ ID NO: 1237293 - RNA, 24 nt, Human
cgagguggguggaucaccugaggu

SEQ ID NO: 1237294 - RNA, 26 nt, Human
cgagguggguggaucaccugagguca

SEQ ID NO: 1237295 - RNA, 23 nt, Human
cgccuguaaucccagcuacucgg

SEQ ID NO: 1237296 - RNA, 24 nt, Human
cgccuguaaucccagcuacucggg

SEQ ID NO: 1237297 - RNA, 26 nt, Human
cggugaguuccuucuggauaagguuc

SEQ ID NO: 1237298 - RNA, 22 nt, Human
cucacgccuguaaucccaacac

SEQ ID NO: 1237299 - RNA, 24 nt, Human
cucacgccuguaaucccaacacuu

SEQ ID NO: 1237300 - RNA, 24 nt, Human
cuccagcaguucuuugugaagugg

SEQ ID NO: 1237301 - RNA, 23 nt, Human
cugaaaccugaagaacagaagau

SEQ ID NO: 1237302 - RNA, 19 nt, Human
cugcgcguacgugucugcc

SEQ ID NO: 1237303 - RNA, 25 nt, Human
cuuccacuuuaauuuuccccuugga

SEQ ID NO: 1237304 - RNA, 24 nt, Human
gaaaacacugcgcggucaaccucc

SEQ ID NO: 1237305 - RNA, 23 nt, Human
gagauugugccauugcacuccag

SEQ ID NO: 1237306 - RNA, 21 nt, Human
gagguugcagugagccgagau

SEQ ID NO: 1237307 - RNA, 23 nt, Human
gagguugcagugagccgagauug

SEQ ID NO: 1237308 - RNA, 21 nt, Human
gaucaccugaggucaggaguu

SEQ ID NO: 1237309 - RNA, 23 nt, Human
gaucaccugaggucaggaguuca

SEQ ID NO: 1237310 - RNA, 24 nt, Human
gaucaccugaggucaggaguucaa

SEQ ID NO: 1237311 - RNA, 18 nt, Human
gaugcaaacaucaacagu

SEQ ID NO: 1237312 - RNA, 22 nt, Human
gcaggagaaucgcuuaaaccca

SEQ ID NO: 1237313 - RNA, 21 nt, Human
gccaacguggcgaaaccccau

SEQ ID NO: 1237314 - RNA, 19 nt, Human
gccauugcacuccagccug

SEQ ID NO: 1237315 - RNA, 22 nt, Human
gccauugcacuccagccugggc

SEQ ID NO: 1237316 - RNA, 24 nt, Human
gccauugcacuccagccugggcaa

SEQ ID NO: 1237317 - RNA, 23 nt, Human
gccuguaaucccagcuacucggg

SEQ ID NO: 1237318 - RNA, 21 nt, Human
ggaaagagaagauguaugaug

SEQ ID NO: 1237319 - RNA, 22 nt, Human
ggagguugcagugagccgagau

SEQ ID NO: 1237320 - RNA, 24 nt, Human
ggagguugcagugagccgagauug

SEQ ID NO: 1237321 - RNA, 18 nt, Human
ggccgggugcgguggcuc

SEQ ID NO: 1237322 - RNA, 21 nt, Human
ggcgcacgccuguaaucccag

SEQ ID NO: 1237323 - RNA, 19 nt, Human
ggcggagguugcagugagc

SEQ ID NO: 1237324 - RNA, 20 nt, Human
ggcggagguugcagugagcc

SEQ ID NO: 1237325 - RNA, 23 nt, Human
ggcggagguugcagugagccgag

SEQ ID NO: 1237326 - RNA, 20 nt, Human
ggcucacgccuguaauccca

SEQ ID NO: 1237327 - RNA, 24 nt, Human
gggugcgguggcucacgccuguaa

SEQ ID NO: 1237328 - RNA, 21 nt, Human
gguggaucaccugaggucagg

SEQ ID NO: 1237329 - RNA, 23 nt, Human
gguggcucacgccuguaauccca

SEQ ID NO: 1237330 - RNA, 22 nt, Human
guggcucacgccuguaauccca

SEQ ID NO: 1237331 - RNA, 24 nt, Human
guuggcgcacgccuguaaucccag

SEQ ID NO: 1237332 - RNA, 18 nt, Human
uaaaaauaagaaugaaaa

SEQ ID NO: 1237333 - RNA, 21 nt, Human
uaaaaauacaaaaauuagcca

SEQ ID NO: 1237334 - RNA, 22 nt, Human
uaaaaccccuucauuuucaaac

SEQ ID NO: 1237335 - RNA, 23 nt, Human
uaaagauggguauuagcaacaca

SEQ ID NO: 1237336 - RNA, 21 nt, Human
uaacuuaaauacauuuucccu

SEQ ID NO: 1237337 - RNA, 23 nt, Human
uacucaaccuuuuuccuguuuau

SEQ ID NO: 1237338 - RNA, 18 nt, Human
uagaaaguggccaggccu

SEQ ID NO: 1237339 - RNA, 19 nt, Human
uagaggaaaacaaggaaag

SEQ ID NO: 1237340 - RNA, 23 nt, Human
uagcuaaaaaaauucucuuauaa

SEQ ID NO: 1237341 - RNA, 20 nt, Human
uaggagggcugaacauuuua

SEQ ID NO: 1237342 - RNA, 22 nt, Human
uaggaugccaguaaagaugggu

SEQ ID NO: 1237343 - RNA, 23 nt, Human
uaguuucuccagcaguucuuugu

SEQ ID NO: 1237344 - RNA, 22 nt, Human
uauaguuuuuucuaaacaagau

SEQ ID NO: 1237345 - RNA, 22 nt, Human
uauauacacacuguugucugua

SEQ ID NO: 1237346 - RNA, 23 nt, Human
uauauauauuacauauauacaca

SEQ ID NO: 1237347 - RNA, 24 nt, Human
uauauauauuacauauauacacac

SEQ ID NO: 1237348 - RNA, 18 nt, Human
uaucaaaagaggaaauuc

SEQ ID NO: 1237349 - RNA, 23 nt, Human
ucaaaaaaacaaaaacaaaaaca

SEQ ID NO: 1237350 - RNA, 31 nt, Human
ucaaaaaaacaaaaacaaaaacaaaaacaaa

SEQ ID NO: 1237351 - RNA, 22 nt, Human
ucaaugauucauccaaaauuuc

SEQ ID NO: 1237352 - RNA, 23 nt, Human
ucaccugaggucaggaguucaag

SEQ ID NO: 1237353 - RNA, 22 nt, Human
ucauccaaaauuucaagcccau

SEQ ID NO: 1237354 - RNA, 21 nt, Human
uccuaaaaauaagaaugaaaa

SEQ ID NO: 1237355 - RNA, 24 nt, Human
ugaaaauaccuuacuuguucauug

SEQ ID NO: 1237356 - RNA, 21 nt, Human
ugaaagaaaaauuaagaucau

SEQ ID NO: 1237357 - RNA, 19 nt, Human
ugaagaacagaagaucucu

SEQ ID NO: 1237358 - RNA, 24 nt, Human
ugaagaacugaaaccugaagaaca

SEQ ID NO: 1237359 - RNA, 21 nt, Human
ugagagcguccucagucaccu

SEQ ID NO: 1237360 - RNA, 22 nt, Human
ugagccgagauugugccauugc

SEQ ID NO: 1237361 - RNA, 19 nt, Human
ugaggcaggagaaucgcuu

SEQ ID NO: 1237362 - RNA, 24 nt, Human
ugaggcaggagaaucgcuuaaacc

SEQ ID NO: 1237363 - RNA, 21 nt, Human
ugauagugagcagaauaugaa

SEQ ID NO: 1237364 - RNA, 22 nt, Human
ugaugcaaacaucaacaguuuc

SEQ ID NO: 1237365 - RNA, 20 nt, Human
ugauucgaaacacccccucg

SEQ ID NO: 1237366 - RNA, 19 nt, Human
ugcacuccagccugggcaa

SEQ ID NO: 1237367 - RNA, 24 nt, Human
ugccauugcacuccagccugggca

SEQ ID NO: 1237368 - RNA, 19 nt, Human
ugcgcugauggguacaaaa

SEQ ID NO: 1237369 - RNA, 23 nt, Human
ugcuuaaaagucccacuacucaa

SEQ ID NO: 1237370 - RNA, 20 nt, Human
uggaauguguugucaugaaa

SEQ ID NO: 1237371 - RNA, 24 nt, Human
uggaucaccugaggucaggaguuc

SEQ ID NO: 1237372 - RNA, 27 nt, Human
uggaucaccugaggucaggaguucaag

SEQ ID NO: 1237373 - RNA, 24 nt, Human
uggccaacguggcgaaaccccauu

SEQ ID NO: 1237374 - RNA, 18 nt, Human
uggccaggccuucgugcu

SEQ ID NO: 1237375 - RNA, 20 nt, Human
uggccaggccuucgugcugc

SEQ ID NO: 1237376 - RNA, 21 nt, Human
uggcgcacgccuguaauccca

SEQ ID NO: 1237377 - RNA, 18 nt, Human
uggcuaagaaggcugaac

SEQ ID NO: 1237378 - RNA, 24 nt, Human
uggcucacgccuguaaucccaaca

SEQ ID NO: 1237379 - RNA, 23 nt, Human
ugggaggccgagguggguggauc

SEQ ID NO: 1237380 - RNA, 24 nt, Human
ugggaggccgagguggguggauca

SEQ ID NO: 1237381 - RNA, 24 nt, Human
uggguacaaaacuaguuucuccag

SEQ ID NO: 1237382 - RNA, 24 nt, Human
uggguggaucaccugaggucagga

SEQ ID NO: 1237383 - RNA, 18 nt, Human
ugucugccaggauguugu

SEQ ID NO: 1237384 - RNA, 24 nt, Human
uguuggcgcacgccuguaauccca

SEQ ID NO: 1237385 - RNA, 21 nt, Human
uguuucuccuccaauuguaga

SEQ ID NO: 1237386 - RNA, 20 nt, Human
uuaaaagucccacuacucaa

SEQ ID NO: 1237387 - RNA, 24 nt, Human
uuaaacccagggggcggagguugc

SEQ ID NO: 1237388 - RNA, 23 nt, Human
uuaaagaauuugaaacaagggcu

SEQ ID NO: 1237389 - RNA, 23 nt, Human
uuaaagcucugaaauuguaguaa

SEQ ID NO: 1237390 - RNA, 21 nt, Human
uuacuccuuccaugugucaag

SEQ ID NO: 1237391 - RNA, 21 nt, Human
uuaguaaagcaugguuaccac

SEQ ID NO: 1237392 - RNA, 21 nt, Human
uucauccaaaauuucaagccc

SEQ ID NO: 1237393 - RNA, 21 nt, Human
uucaugggcaagaguaacuga

SEQ ID NO: 1237394 - RNA, 21 nt, Human
uucauuuuacuauauauauau

SEQ ID NO: 1237395 - RNA, 18 nt, Human
uuccccuuggaguacuua

SEQ ID NO: 1237396 - RNA, 22 nt, Human
uuccccuuggaguacuuaaagu

SEQ ID NO: 1237397 - RNA, 18 nt, Human
uucgaaacacccccucga

SEQ ID NO: 1237398 - RNA, 20 nt, Human
uucuaauuuuaaaaaguuug

SEQ ID NO: 1237399 - RNA, 18 nt, Human
uugcagugagccgagauu

SEQ ID NO: 1237400 - RNA, 19 nt, Human
uugcagugagccgagauug

SEQ ID NO: 1237401 - RNA, 22 nt, Human
uugcagugagccgagauugugc

SEQ ID NO: 1237402 - RNA, 23 nt, Human
uugcagugagccgagauugugcc

SEQ ID NO: 1237403 - RNA, 21 nt, Human
uuggcgcacgccuguaauccc

SEQ ID NO: 1237404 - RNA, 25 nt, Human
uugggaggccgagguggguggauca

SEQ ID NO: 1237405 - RNA, 23 nt, Human
uugugccauugcacuccagccug

SEQ ID NO: 1237406 - RNA, 22 nt, Human
uuucauuuuacuauauauauau

SEQ ID NO: 1237407 - RNA, 21 nt, Human
uuucuacuaaaaauacaaaaa

SEQ ID NO: 1237408 - RNA, 25 nt, Human
aaaaaaaaaaaaaguggcuucugua

SEQ ID NO: 1237409 - RNA, 22 nt, Human
aaaaaaaagacaaaucuaaaaa

SEQ ID NO: 1237410 - RNA, 25 nt, Human
aaaaaaagacaaaucuaaaaaucac

SEQ ID NO: 1237411 - RNA, 25 nt, Human
aaaacagaaacaaaaacaacaacaa

SEQ ID NO: 1237412 - RNA, 23 nt, Human
aaaauaacucauaugauccaagg

SEQ ID NO: 1237413 - RNA, 25 nt, Human
aaaauaacucauaugauccaaggca

SEQ ID NO: 1237414 - RNA, 21 nt, Human
aaacaaaaacaacaacaacaa

SEQ ID NO: 1237415 - RNA, 24 nt, Human
aaacaacaacaacaaaagcuaacc

SEQ ID NO: 1237416 - RNA, 22 nt, Human
aaacaacccuacucuaccaaau

SEQ ID NO: 1237417 - RNA, 25 nt, Human
aaacagaaacaaaaacaacaacaac

SEQ ID NO: 1237418 - RNA, 26 nt, Human
aaacagaaacaaaaacaacaacaaca

SEQ ID NO: 1237419 - RNA, 19 nt, Human
aaagugcuaggauuacagg

SEQ ID NO: 1237420 - RNA, 24 nt, Human
aaagugcuaggauuacaggcguga

SEQ ID NO: 1237421 - RNA, 22 nt, Human
aaaugccauauucucucuauga

SEQ ID NO: 1237422 - RNA, 21 nt, Human
aaaugccuucacaaaaccucu

SEQ ID NO: 1237423 - RNA, 18 nt, Human
aacaaaacagaaacaaaa

SEQ ID NO: 1237424 - RNA, 22 nt, Human
aacaaaacagaaacaaaaacaa

SEQ ID NO: 1237425 - RNA, 19 nt, Human
aacauggagaaaccccauc

SEQ ID NO: 1237426 - RNA, 20 nt, Human
aacauggagaaaccccaucu

SEQ ID NO: 1237427 - RNA, 21 nt, Human
aacauggagaaaccccaucuc

SEQ ID NO: 1237428 - RNA, 22 nt, Human
aaccaaacaacccuacucuacc

SEQ ID NO: 1237429 - RNA, 18 nt, Human
aagacaccauuaucaugc

SEQ ID NO: 1237430 - RNA, 19 nt, Human
aagcuggaguccaggggug

SEQ ID NO: 1237431 - RNA, 24 nt, Human
aaguagcugggauuacaggcgcgu

SEQ ID NO: 1237432 - RNA, 26 nt, Human
aaguagcugggauuacaggcgcgugc

SEQ ID NO: 1237433 - RNA, 26 nt, Human
aagugcuaggauuacaggcgugagcc

SEQ ID NO: 1237434 - RNA, 24 nt, Human
aaugaccauaaaugccuucacaaa

SEQ ID NO: 1237435 - RNA, 20 nt, Human
acaaaaacaacaacaacaaa

SEQ ID NO: 1237436 - RNA, 24 nt, Human
acaaaacagaaacaaaaacaacaa

SEQ ID NO: 1237437 - RNA, 30 nt, Human
acaaaccaaacaacccuacucuaccaaauu

SEQ ID NO: 1237438 - RNA, 28 nt, Human
acaacaacaacaaaagcuaaccaugaca

SEQ ID NO: 1237439 - RNA, 22 nt, Human
acaacagaaggcacuacauaag

SEQ ID NO: 1237440 - RNA, 25 nt, Human
acaacccuacucuaccaaaucacau

SEQ ID NO: 1237441 - RNA, 20 nt, Human
acaagagcaaaacuccaucu

SEQ ID NO: 1237442 - RNA, 24 nt, Human
accauguuggccaggcuggucuug

SEQ ID NO: 1237443 - RNA, 24 nt, Human
accccaucucuacuaaaaauacaa

SEQ ID NO: 1237444 - RNA, 25 nt, Human
accuuuuugaaaaauaauaagauga

SEQ ID NO: 1237445 - RNA, 18 nt, Human
acgggguuucaccauguu

SEQ ID NO: 1237446 - RNA, 23 nt, Human
acgggguuucaccauguuggcca

SEQ ID NO: 1237447 - RNA, 24 nt, Human
acgggguuucaccauguuggccag

SEQ ID NO: 1237448 - RNA, 20 nt, Human
acucuuucccagguucccag

SEQ ID NO: 1237449 - RNA, 25 nt, Human
acugugucacccaagcuggagucca

SEQ ID NO: 1237450 - RNA, 19 nt, Human
acuugcacccgggaggugg

SEQ ID NO: 1237451 - RNA, 21 nt, Human
acuugcacccgggagguggag

SEQ ID NO: 1237452 - RNA, 19 nt, Human
agaaggcacuaggcauuac

SEQ ID NO: 1237453 - RNA, 24 nt, Human
agcacuuugggaggccgaggcggg

SEQ ID NO: 1237454 - RNA, 19 nt, Human
agccaccacacccagccua

SEQ ID NO: 1237455 - RNA, 20 nt, Human
agccgagauugcgccauugc

SEQ ID NO: 1237456 - RNA, 18 nt, Human
agcggaccgcgccgcaga

SEQ ID NO: 1237457 - RNA, 18 nt, Human
aggcaggacaaucacuug

SEQ ID NO: 1237458 - RNA, 24 nt, Human
aggcaggacaaucacuugcacccg

SEQ ID NO: 1237459 - RNA, 21 nt, Human
aggccgaggcgggcggaucac

SEQ ID NO: 1237460 - RNA, 22 nt, Human
aggcgggcggaucaccugaggg

SEQ ID NO: 1237461 - RNA, 22 nt, Human
aggcgggcggaucaccugaggu

SEQ ID NO: 1237462 - RNA, 24 nt, Human
aggcgugguggcacauaccuguaa

SEQ ID NO: 1237463 - RNA, 21 nt, Human
aggcugaggcaggacaaucac

SEQ ID NO: 1237464 - RNA, 20 nt, Human
agggguguaaucucagcuca

SEQ ID NO: 1237465 - RNA, 22 nt, Human
agguaguauuguuuaaacaaaa

SEQ ID NO: 1237466 - RNA, 21 nt, Human
agguaugcuucaagagacugu

SEQ ID NO: 1237467 - RNA, 24 nt, Human
aggugcgguggcucacaccuguaa

SEQ ID NO: 1237468 - RNA, 24 nt, Human
agguggagguugcagucagccgag

SEQ ID NO: 1237469 - RNA, 24 nt, Human
aguccagggguguaaucucagcuc

SEQ ID NO: 1237470 - RNA, 23 nt, Human
agucuuucuugggucaggaaugc

SEQ ID NO: 1237471 - RNA, 24 nt, Human
agugauucucacaucucagccucc

SEQ ID NO: 1237472 - RNA, 22 nt, Human
auagaaggcacuaggcauuaca

SEQ ID NO: 1237473 - RNA, 18 nt, Human
aucagucacucuuuccca

SEQ ID NO: 1237474 - RNA, 19 nt, Human
aucucaaaaaaaaaaaaag

SEQ ID NO: 1237475 - RNA, 22 nt, Human
augaaaaucuauaugacaacug

SEQ ID NO: 1237476 - RNA, 22 nt, Human
auguaggacaacagaaggcacu

SEQ ID NO: 1237477 - RNA, 24 nt, Human
auugcacuccagccugggcaacaa

SEQ ID NO: 1237478 - RNA, 25 nt, Human
auugcacuccagccugggcaacaag

SEQ ID NO: 1237479 - RNA, 21 nt, Human
auugggcaaagcagcaccaau

SEQ ID NO: 1237480 - RNA, 26 nt, Human
caaaacagaaacaaaaacaacaacaa

SEQ ID NO: 1237481 - RNA, 25 nt, Human
caaaauaacucauaugauccaaggc

SEQ ID NO: 1237482 - RNA, 23 nt, Human
caaacacaaaccaaacaacccua

SEQ ID NO: 1237483 - RNA, 25 nt, Human
caaacacaaaccaaacaacccuacu

SEQ ID NO: 1237484 - RNA, 22 nt, Human
caaacgcaaggagucuuucuug

SEQ ID NO: 1237485 - RNA, 24 nt, Human
caaagugcuaggauuacaggcgug

SEQ ID NO: 1237486 - RNA, 18 nt, Human
caacaacaaaagcuaacc

SEQ ID NO: 1237487 - RNA, 21 nt, Human
caacaacaaaagcuaaccaug

SEQ ID NO: 1237488 - RNA, 22 nt, Human
caacaacaacaaaagcuaacca

SEQ ID NO: 1237489 - RNA, 21 nt, Human
caacaagagcaaaacuccauc

SEQ ID NO: 1237490 - RNA, 24 nt, Human
caagagcaaaacuccaucucaaaa

SEQ ID NO: 1237491 - RNA, 22 nt, Human
caagugauucucacaucucagc

SEQ ID NO: 1237492 - RNA, 23 nt, Human
caaugccagcacugcaguaugaa

SEQ ID NO: 1237493 - RNA, 19 nt, Human
cacacccagccuaauguuu

SEQ ID NO: 1237494 - RNA, 24 nt, Human
cacaccuguaaucccagcacuuug

SEQ ID NO: 1237495 - RNA, 21 nt, Human
cacauaaaaaacucaugaaug

SEQ ID NO: 1237496 - RNA, 23 nt, Human
caccacacccagccuaauguuua

SEQ ID NO: 1237497 - RNA, 24 nt, Human
caccaugccuggcuaauuuuugua

SEQ ID NO: 1237498 - RNA, 21 nt, Human
caccauguuggccaggcuggu

SEQ ID NO: 1237499 - RNA, 23 nt, Human
caccauguuggccaggcuggucu

SEQ ID NO: 1237500 - RNA, 24 nt, Human
caccauguuggccaggcuggucuu

SEQ ID NO: 1237501 - RNA, 31 nt, Human; identical to SEQ ID NO: 952325

SEQ ID NO: 1237502 - RNA, 20 nt, Human
cacccgggagguggagguug

SEQ ID NO: 1237503 - RNA, 23 nt, Human
caccuguaaucccagcacuuugg

SEQ ID NO: 1237504 - RNA, 24 nt, Human
caccuguaaucccagcacuuuggg

SEQ ID NO: 1237505 - RNA, 21 nt, Human
cacuaauacugauggcccaca

SEQ ID NO: 1237506 - RNA, 24 nt, Human
cacuccagccugggcaacaagagc

SEQ ID NO: 1237507 - RNA, 21 nt, Human
cacugcaaccuccgccuccca

SEQ ID NO: 1237508 - RNA, 24 nt, Human
cacuuuaaaaaguaaugcacuaaa

SEQ ID NO: 1237509 - RNA, 24 nt, Human
cagagaacaaaagauagcuucuga

SEQ ID NO: 1237510 - RNA, 24 nt, Human
cagcacuuugggaggccgaggcgg

SEQ ID NO: 1237511 - RNA, 24 nt, Human
cagccugaccaacauggagaaacc

SEQ ID NO: 1237512 - RNA, 24 nt, Human
cagcuacucaggaggcugaggcag

SEQ ID NO: 1237513 - RNA, 24 nt, Human
caggaggcugaggcaggacaauca

SEQ ID NO: 1237514 - RNA, 20 nt, Human
caguaaaaaugaagacacca

SEQ ID NO: 1237515 - RNA, 26 nt, Human
caguuuaaaaaaauagcugauuauga

SEQ ID NO: 1237516 - RNA, 19 nt, Human
cauaccuguaaucccagcu

SEQ ID NO: 1237517 - RNA, 23 nt, Human
cauguuggccaggcuggucuugg

SEQ ID NO: 1237518 - RNA, 24 nt, Human
cauguuggccaggcuggucuugga

SEQ ID NO: 1237519 - RNA, 18 nt, Human
cauugcacuccagccugg

SEQ ID NO: 1237520 - RNA, 19 nt, Human
cauugcacuccagccuggg

SEQ ID NO: 1237521 - RNA, 21 nt, Human
cauugcacuccagccugggca

SEQ ID NO: 1237522 - RNA, 24 nt, Human
cauugcacuccagccugggcaaca

SEQ ID NO: 1237523 - RNA, 24 nt, Human
ccaaacaacccuacucuaccaaau

SEQ ID NO: 1237524 - RNA, 20 nt, Human
ccaaagugcuaggauuacag

SEQ ID NO: 1237525 - RNA, 22 nt, Human
ccaaagugcuaggauuacaggc

SEQ ID NO: 1237526 - RNA, 24 nt, Human
ccaaagugcuaggauuacaggcgu

SEQ ID NO: 1237527 - RNA, 22 nt, Human
ccaaguagcugggauuacaggc

SEQ ID NO: 1237528 - RNA, 20 nt, Human
ccauugcacuccagccuggg

SEQ ID NO: 1237529 - RNA, 21 nt, Human
ccauugcacuccagccugggc

SEQ ID NO: 1237530 - RNA, 23 nt, Human
ccauugcacuccagccugggcaa

SEQ ID NO: 1237531 - RNA, 24 nt, Human
ccauugcacuccagccugggcaac

SEQ ID NO: 1237532 - RNA, 23 nt, Human
cccaaguagcugggauuacaggc

SEQ ID NO: 1237533 - RNA, 24 nt, Human
cccaaguagcugggauuacaggcg

SEQ ID NO: 1237534 - RNA, 20 nt, Human
cccagguucaagugauucuc

SEQ ID NO: 1237535 - RNA, 22 nt, Human
cccccugaccguucgcgccgcc

SEQ ID NO: 1237536 - RNA, 21 nt, Human
cccgggagguggagguugcag

SEQ ID NO: 1237537 - RNA, 24 nt, Human
ccgccucccagguucaagugauuc

SEQ ID NO: 1237538 - RNA, 22 nt, Human
ccucccagguucaagugauucu

SEQ ID NO: 1237539 - RNA, 24 nt, Human
ccugaccaacauggagaaacccca

SEQ ID NO: 1237540 - RNA, 22 nt, Human
ccugaggucgggaguuugagac

SEQ ID NO: 1237541 - RNA, 21 nt, Human
ccuguaaucccagcuacucag

SEQ ID NO: 1237542 - RNA, 24 nt, Human
cgagauugcgccauugcacuccag

SEQ ID NO: 1237543 - RNA, 20 nt, Human
cgaggcgggcggaucaccug

SEQ ID NO: 1237544 - RNA, 24 nt, Human
cgaggcgggcggaucaccugaggu

SEQ ID NO: 1237545 - RNA, 20 nt, Human
cgccauugcacuccagccug

SEQ ID NO: 1237546 - RNA, 24 nt, Human
cgccauugcacuccagccugggca

SEQ ID NO: 1237547 - RNA, 22 nt, Human
cgccucccagguucaagugauu

SEQ ID NO: 1237548 - RNA, 24 nt, Human
cggaucaccugaggucgggaguuu

SEQ ID NO: 1237549 - RNA, 24 nt, Human
cgggagguggagguugcagucagc

SEQ ID NO: 1237550 - RNA, 18 nt, Human
cgggcggaucaccugagg

SEQ ID NO: 1237551 - RNA, 24 nt, Human
cgggcggaucaccugaggucggga

SEQ ID NO: 1237552 - RNA, 24 nt, Human
cgggguuucaccauguuggccagg

SEQ ID NO: 1237553 - RNA, 21 nt, Human
cuaaccauaggacaguucagu

SEQ ID NO: 1237554 - RNA, 19 nt, Human
cuaggcauuacauaauacc

SEQ ID NO: 1237555 - RNA, 22 nt, Human
cucacaccuguaaucccagcac

SEQ ID NO: 1237556 - RNA, 24 nt, Human
cucacaccuguaaucccagcacuu

SEQ ID NO: 1237557 - RNA, 24 nt, Human
cucacugcaaccuccgccucccag

SEQ ID NO: 1237558 - RNA, 21 nt, Human
cucagccucccaaguagcugg

SEQ ID NO: 1237559 - RNA, 23 nt, Human
cucagccucccaaguagcuggga

SEQ ID NO: 1237560 - RNA, 19 nt, Human
cuccacagcggaccgcgcc

SEQ ID NO: 1237561 - RNA, 19 nt, Human
cuccaucucaaaaaaaaaa

SEQ ID NO: 1237562 - RNA, 19 nt, Human
cucccagguucaagugauu

SEQ ID NO: 1237563 - RNA, 19 nt, Human
cugaggcaggacaaucacu

SEQ ID NO: 1237564 - RNA, 23 nt, Human
cugcaaccuccgccucccagguu

SEQ ID NO: 1237565 - RNA, 24 nt, Human
cugggcaacaagagcaaaacucca

SEQ ID NO: 1237566 - RNA, 21 nt, Human
cuugcacccgggagguggagg

SEQ ID NO: 1237567 - RNA, 25 nt, Human
gaaaagcuucaagacuagcagcuga

SEQ ID NO: 1237568 - RNA, 24 nt, Human
gaccuuaagugaccuguccaccuu

SEQ ID NO: 1237569 - RNA, 24 nt, Human
gagacgggguuucaccauguuggc

SEQ ID NO: 1237570 - RNA, 23 nt, Human
gagguugcagucagccgagauug

SEQ ID NO: 1237571 - RNA, 24 nt, Human
gaucaccugaggucgggaguuuga

SEQ ID NO: 1237572 - RNA, 18 nt, Human
gauuacaggcgcgugcca

SEQ ID NO: 1237573 - RNA, 18 nt, Human
gauuacaggcgugagcca

SEQ ID NO: 1237574 - RNA, 21 nt, Human
gauuacaggcgugagccacca

SEQ ID NO: 1237575 - RNA, 22 nt, Human
gauuacaggcgugagccaccac

SEQ ID NO: 1237576 - RNA, 22 nt, Human
gcaaccuccgccucccagguuc

SEQ ID NO: 1237577 - RNA, 18 nt, Human
gcaguaugaaaucacuaa

SEQ ID NO: 1237578 - RNA, 22 nt, Human
gccauugcacuccagccugggc

SEQ ID NO: 1237579 - RNA, 24 nt, Human
gccauugcacuccagccugggcaa

SEQ ID NO: 1237580 - RNA, 19 nt, Human
gcuaccaaacaaauaaugc

SEQ ID NO: 1237581 - RNA, 22 nt, Human
ggagguugcagucagccgagau

SEQ ID NO: 1237582 - RNA, 24 nt, Human
ggagguugcagucagccgagauug

SEQ ID NO: 1237583 - RNA, 19 nt, Human
ggaguuugagaccagccug

SEQ ID NO: 1237584 - RNA, 22 nt, Human
ggaucaccugaggucgggaguu

SEQ ID NO: 1237585 - RNA, 19 nt, Human
ggauuacaggcgugagcca

SEQ ID NO: 1237586 - RNA, 22 nt, Human
ggauuacaggcgugagccacca

SEQ ID NO: 1237587 - RNA, 23 nt, Human
gggguuucaccauguuggccagg

SEQ ID NO: 1237588 - RNA, 19 nt, Human
ggucgggaguuugagacca

SEQ ID NO: 1237589 - RNA, 24 nt, Human
gguggcacauaccuguaaucccag

SEQ ID NO: 1237590 - RNA, 23 nt, Human
gguggcucacaccuguaauccca

SEQ ID NO: 1237591 - RNA, 24 nt, Human
gguggcucacaccuguaaucccag

SEQ ID NO: 1237592 - RNA, 23 nt, Human
gguguaaucucagcucacugcaa

SEQ ID NO: 1237593 - RNA, 18 nt, Human
guagcugggauuacaggc

SEQ ID NO: 1237594 - RNA, 26 nt, Human
guaggaaaaguguuuuaagaaacauu

SEQ ID NO: 1237595 - RNA, 27 nt, Human
guaggacaacagaaggcacuacauaag

SEQ ID NO: 1237596 - RNA, 20 nt, Human
gugauucucacaucucagcc

SEQ ID NO: 1237597 - RNA, 24 nt, Human
gugauucucacaucucagccuccc

SEQ ID NO: 1237598 - RNA, 23 nt, Human
guggcucacaccuguaaucccag

SEQ ID NO: 1237599 - RNA, 19 nt, Human
uaaaaaaauagcugauuau

SEQ ID NO: 1237600 - RNA, 20 nt, Human
uaaaaauacaaaauuagcca

SEQ ID NO: 1237601 - RNA, 22 nt, Human
uaaaaauacaaaauuagccagg

SEQ ID NO: 1237602 - RNA, 23 nt, Human
uaaaaauacaaaauuagccaggc

SEQ ID NO: 1237603 - RNA, 20 nt, Human
uaaaauauagaaugccuuuc

SEQ ID NO: 1237604 - RNA, 24 nt, Human
uaaacaaaacagaaacaaaaacaa

SEQ ID NO: 1237605 - RNA, 20 nt, Human
uaaaguggaaccaccacaga

SEQ ID NO: 1237606 - RNA, 21 nt, Human
uaagagcacuuuagacaugau

SEQ ID NO: 1237607 - RNA, 23 nt, Human
uaagagcacuuuagacaugauua

SEQ ID NO: 1237608 - RNA, 24 nt, Human
uaauuuuuguauuuuuacuagaga

SEQ ID NO: 1237609 - RNA, 24 nt, Human
uacaggcgugagccaccacaccca

SEQ ID NO: 1237610 - RNA, 22 nt, Human
uacaguaaaaaugaagacacca

SEQ ID NO: 1237611 - RNA, 22 nt, Human
uaccaaacaaauaaugccagaa

SEQ ID NO: 1237612 - RNA, 24 nt, Human
uaccuguaaucccagcuacucagg

SEQ ID NO: 1237613 - RNA, 24 nt, Human
uacuagagacgggguuucaccaug

SEQ ID NO: 1237614 - RNA, 20 nt, Human
uagagacgggguuucaccau

SEQ ID NO: 1237615 - RNA, 21 nt, Human
uagagacgggguuucaccaug

SEQ ID NO: 1237616 - RNA, 22 nt, Human
uagagacgggguuucaccaugu

SEQ ID NO: 1237617 - RNA, 21 nt, Human
uagcuucugaagccauauccu

SEQ ID NO: 1237618 - RNA, 18 nt, Human
uaggauuacaggcgugag

SEQ ID NO: 1237619 - RNA, 19 nt, Human
uaggauuacaggcgugagc

SEQ ID NO: 1237620 - RNA, 22 nt, Human
uaggauuacaggcgugagccac

SEQ ID NO: 1237621 - RNA, 24 nt, Human
uaggauuacaggcgugagccacca

SEQ ID NO: 1237622 - RNA, 19 nt, Human
uaucaucacucaaauaagu

SEQ ID NO: 1237623 - RNA, 20 nt, Human
uaugacaccaacaacuuaca

SEQ ID NO: 1237624 - RNA, 21 nt, Human
uaugacaccaacaacuuacaa

SEQ ID NO: 1237625 - RNA, 21 nt, Human
ucaaaugccauauucucucua

SEQ ID NO: 1237626 - RNA, 20 nt, Human
ucacgcaccaaaaauuauca

SEQ ID NO: 1237627 - RNA, 19 nt, Human
ucacugcaaccuccgccuc

SEQ ID NO: 1237628 - RNA, 24 nt, Human
ucacugcaaccuccgccucccagg

SEQ ID NO: 1237629 - RNA, 25 nt, Human
ucacugcaaccuccgccucccaggu

SEQ ID NO: 1237630 - RNA, 27 nt, Human
ucacugcaaccuccgccucccagguuc

SEQ ID NO: 1237631 - RNA, 20 nt, Human
ucagccucccaaguagcugg

SEQ ID NO: 1237632 - RNA, 27 nt, Human
ucagcucacugcaaccuccgccuccca

SEQ ID NO: 1237633 - RNA, 19 nt, Human
uccacuccgcugccacuga

SEQ ID NO: 1237634 - RNA, 24 nt, Human
ucccaaagugcuaggauuacaggc

SEQ ID NO: 1237635 - RNA, 24 nt, Human
ucccaaguagcugggauuacaggc

SEQ ID NO: 1237636 - RNA, 23 nt, Human
ucccagaaaguuaugaaauacuu

SEQ ID NO: 1237637 - RNA, 19 nt, Human
ucccagguucaagugauuc

SEQ ID NO: 1237638 - RNA, 21 nt, Human
ucccagguucaagugauucuc

SEQ ID NO: 1237639 - RNA, 25 nt, Human
ucucaaaaaaaaaaaaaguggcuuc

SEQ ID NO: 1237640 - RNA, 24 nt, Human
ucucacugugucacccaagcugga

SEQ ID NO: 1237641 - RNA, 26 nt, Human
ucucacugugucacccaagcuggagu

SEQ ID NO: 1237642 - RNA, 20 nt, Human
ucucuacuaaaaauacaaaa

SEQ ID NO: 1237643 - RNA, 24 nt, Human
ucuggccaggugcgguggcucaca

SEQ ID NO: 1237644 - RNA, 20 nt, Human
ucuguuuauacaauacaguc

SEQ ID NO: 1237645 - RNA, 18 nt, Human
ucuuucccagguucccag

SEQ ID NO: 1237646 - RNA, 23 nt, Human
ucuuuugcuacuguuuagcugug

SEQ ID NO: 1237647 - RNA, 22 nt, Human
ugaaaaauaauaagaugaccau

SEQ ID NO: 1237648 - RNA, 22 nt, Human
ugaaauuaagagauaaacuagg

SEQ ID NO: 1237649 - RNA, 24 nt, Human
ugaagacaccauuaucaugcuaau

SEQ ID NO: 1237650 - RNA, 24 nt, Human
ugaccuguccaccuuggccuccca

SEQ ID NO: 1237651 - RNA, 24 nt, Human
ugagaccagccugaccaacaugga

SEQ ID NO: 1237652 - RNA, 19 nt, Human
ugagagaucuccuuugugc

SEQ ID NO: 1237653 - RNA, 20 nt, Human
ugaggcaggacaaucacuug

SEQ ID NO: 1237654 - RNA, 24 nt, Human
ugaggcaggacaaucacuugcacc

SEQ ID NO: 1237655 - RNA, 18 nt, Human
ugaggucgggaguuugag

SEQ ID NO: 1237656 - RNA, 24 nt, Human
ugaugcugguagagauaaaacauu

SEQ ID NO: 1237657 - RNA, 19 nt, Human
ugcacuccagccugggcaa

SEQ ID NO: 1237658 - RNA, 18 nt, Human
ugccacugagagaucucc

SEQ ID NO: 1237659 - RNA, 24 nt, Human
ugcuaggauuacaggcgugagcca

SEQ ID NO: 1237660 - RNA, 24 nt, Human
uggaagggaaaauaaugaaaaucu

SEQ ID NO: 1237661 - RNA, 23 nt, Human
uggccaggcuggucuuggacucu

SEQ ID NO: 1237662 - RNA, 24 nt, Human
uggccaggugcgguggcucacacc

SEQ ID NO: 1237663 - RNA, 21 nt, Human
uggcucacaccuguaauccca

SEQ ID NO: 1237664 - RNA, 22 nt, Human
uggcucacaccuguaaucccag

SEQ ID NO: 1237665 - RNA, 24 nt, Human
uggcucacaccuguaaucccagca

SEQ ID NO: 1237666 - RNA, 24 nt, Human
ugggaaaaauaaaacgcuaccaaa

SEQ ID NO: 1237667 - RNA, 19 nt, Human
ugggaggccgaggcgggcg

SEQ ID NO: 1237668 - RNA, 24 nt, Human
ugggaggccgaggcgggcggauca

SEQ ID NO: 1237669 - RNA, 21 nt, Human
ugggauuacaggcgcgugcca

SEQ ID NO: 1237670 - RNA, 22 nt, Human
ugggauuacaggcgcgugccac

SEQ ID NO: 1237671 - RNA, 24 nt, Human
ugggauuacaggcgcgugccacca

SEQ ID NO: 1237672 - RNA, 25 nt, Human
ugggauuacaggcgcgugccaccau

SEQ ID NO: 1237673 - RNA, 23 nt, Human
ugguggcacauaccuguaauccc

SEQ ID NO: 1237674 - RNA, 24 nt, Human
ugguggcacauaccuguaauccca

SEQ ID NO: 1237675 - RNA, 24 nt, Human
uuaaaaaaauaucugcaaugccag

SEQ ID NO: 1237676 - RNA, 24 nt, Human
uuacuagagacgggguuucaccau

SEQ ID NO: 1237677 - RNA, 19 nt, Human
uucaagugauucucacauc

SEQ ID NO: 1237678 - RNA, 23 nt, Human
uucaagugauucucacaucucag

SEQ ID NO: 1237679 - RNA, 19 nt, Human
uucuggccaggugcggugg

SEQ ID NO: 1237680 - RNA, 24 nt, Human
uugcacccgggagguggagguugc

SEQ ID NO: 1237681 - RNA, 20 nt, Human
uugcagucagccgagauugc

SEQ ID NO: 1237682 - RNA, 22 nt, Human
uugcagucagccgagauugcgc

SEQ ID NO: 1237683 - RNA, 23 nt, Human
uugcgccauugcacuccagccug

SEQ ID NO: 1237684 - RNA, 20 nt, Human
uuggagaaacugguaacauu

SEQ ID NO: 1237685 - RNA, 18 nt, Human
uuggccucccaaagugcu

SEQ ID NO: 1237686 - RNA, 25 nt, Human
uugggaggccgaggcgggcggauca

SEQ ID NO: 1237687 - RNA, 24 nt, Human
uuucaccauguuggccaggcuggu

SEQ ID NO: 1237688 - RNA, 23 nt, Human
uuugaaaaauaauaagaugacca

SEQ ID NO: 1237689 - RNA, 22 nt, Human
uuuggguauuagaccacaguua

SEQ ID NO: 1237690 - RNA, 23 nt, Human
uuuucugaaaagucagcuguugu

SEQ ID NO: 1237691 - RNA, 24 nt, Human
uuuuuacuagagacgggguuucac

SEQ ID NO: 1237692 - RNA, 20 nt, Human
uuuuuguauuuuuacuagag

SEQ ID NO: 1237693 - RNA, 23 nt, Human
uuuuuguauuuuuacuagagacg

SEQ ID NO: 1237694 - RNA, 22 nt, Human
gcguggugguagauuccagcca

SEQ ID NO: 1237695 - RNA, 19 nt, Human
uagcguggugguagauucc

SEQ ID NO: 1237696 - RNA, 25 nt, Human
uccuggagcagagaaguagcguggu

SEQ ID NO: 1237697 - RNA, 21 nt, Human
uguuuucagcauucuuuucag

SEQ ID NO: 1237698 - RNA, 21 nt, Human
uucagcauucuuuucaggccu

SEQ ID NO: 1237699 - RNA, 24 nt, Human
uuuucagcauucuuuucaggccuu

SEQ ID NO: 1237700 - RNA, 22 nt, Human
aaccuggcaccgugcucagcca

SEQ ID NO: 1237701 - RNA, 23 nt, Human
acacacacacauacacacacaca

SEQ ID NO: 1237702 - RNA, 23 nt, Human
acacacacauacacacacacaca

SEQ ID NO: 1237703 - RNA, 23 nt, Human
acacacauacacacacacacaca

SEQ ID NO: 1237704 - RNA, 23 nt, Human
acauacacacacacacacacacg

SEQ ID NO: 1237705 - RNA, 23 nt, Human
agacaaaaguguaucuuccagaa

SEQ ID NO: 1237706 - RNA, 22 nt, Human
auagcaaagacaaaaguguauc

SEQ ID NO: 1237707 - RNA, 22 nt, Human
cacacacacacacacacgcagc

SEQ ID NO: 1237708 - RNA, 25 nt, Human
cacacacacacacacacgcagcacu

SEQ ID NO: 1237709 - RNA, 22 nt, Human
cacacacacacauacacacaca

SEQ ID NO: 1237710 - RNA, 24 nt, Human
cacacacacacauacacacacaca

SEQ ID NO: 1237711 - RNA, 28 nt, Human
cacacacacacauacacacacacacaca

SEQ ID NO: 1237712 - RNA, 25 nt, Human
cacauacacacacacacacacacgc

SEQ ID NO: 1237713 - RNA, 33 nt, Human
cacucaacugaacacacacacacauacacagug

SEQ ID NO: 1237714 - RNA, 19 nt, Human
cacugauggagaguacagc

SEQ ID NO: 1237715 - RNA, 27 nt, Human
cauacacacacacacacacacgcagca

SEQ ID NO: 1237716 - RNA, 21 nt, Human
ccaagcaauggaaucuggaac

SEQ ID NO: 1237717 - RNA, 19 nt, Human
cuauaauagcaaagacaaa

SEQ ID NO: 1237718 - RNA, 20 nt, Human
ggaaccuggcaccgugcuca

SEQ ID NO: 1237719 - RNA, 26 nt, Human
ucaucuauaauagcaaagacaaaagu

SEQ ID NO: 1237720 - RNA, 21 nt, Human
ucuuccagaagaugccucugg

SEQ ID NO: 1237721 - RNA, 26 nt, Human
ugaacacacacacacauacacacaca

SEQ ID NO: 1237722 - RNA, 25 nt, Human
ugaacacacacacacauacacacag

SEQ ID NO: 1237723 - RNA, 24 nt, Human
augagauuuaaaauaguucuuuua

SEQ ID NO: 1237724 - RNA, 22 nt, Human
ccccaaggaccccugcaaucag

SEQ ID NO: 1237725 - RNA, 21 nt, Human
ccccugcaaucagaaacaaaa

SEQ ID NO: 1237726 - RNA, 23 nt, Human
cuauccacaccagucaccagagu

SEQ ID NO: 1237727 - RNA, 20 nt, Human
gaguauaaacauaauaugcc

SEQ ID NO: 1237728 - RNA, 21 nt, Human
ggaccccugcaaucagaaaca

SEQ ID NO: 1237729 - RNA, 22 nt, Human
uauaaacauaauaugccccaag

SEQ ID NO: 1237730 - RNA, 22 nt, Human
ugaaguguuuuguuaucuaaca

SEQ ID NO: 1237731 - RNA, 26 nt, Human
ugaaguguuuuguuaucuaacauguu

SEQ ID NO: 1237732 - RNA, 24 nt, Human
ugagagaggaguauaaacauaaua

SEQ ID NO: 1237733 - RNA, 22 nt, Human
ugcaaucagaaacaaaauaguc

SEQ ID NO: 1237734 - RNA, 23 nt, Human
aaaaagugagcucauuugaauaa

SEQ ID NO: 1237735 - RNA, 24 nt, Human
aagugagcucauuugaauaaagau

SEQ ID NO: 1237736 - RNA, 19 nt, Human
agguguucugaucuccagg

SEQ ID NO: 1237737 - RNA, 22 nt, Human
ggagggaaagaaacaacuggag

SEQ ID NO: 1237738 - RNA, 19 nt, Human
gguguggagggagggaaag

SEQ ID NO: 1237739 - RNA, 19 nt, Human
uaccccacagagccaguca

SEQ ID NO: 1237740 - RNA, 20 nt, Human
uagugagaacccaagguuau

SEQ ID NO: 1237741 - RNA, 20 nt, Human
ucugaucuccagguguggag

SEQ ID NO: 1237742 - RNA, 23 nt, Human
uggagggagggaaagaaacaacu

SEQ ID NO: 1237743 - RNA, 19 nt, Human
ugguugaaaaaaagugagc

SEQ ID NO: 1237744 - RNA, 20 nt, Human
uugaaaaaaagugagcucau

SEQ ID NO: 1237745 - RNA, 21 nt, Human
aaacagaccucacugggcucu

SEQ ID NO: 1237746 - RNA, 24 nt, Human
aaagugcugggauuacagguguga

SEQ ID NO: 1237747 - RNA, 19 nt, Human
aaaugaucagcacaggaag

SEQ ID NO: 1237748 - RNA, 23 nt, Human
aagcaaaugauaaaaugcaaacc

SEQ ID NO: 1237749 - RNA, 26 nt, Human
aagcaaaugauaaaaugcaaaccaga

SEQ ID NO: 1237750 - RNA, 27 nt, Human
aagcaaaugauaaaaugcaaaccagaa

SEQ ID NO: 1237751 - RNA, 18 nt, Human
aagugcugggauuacagg

SEQ ID NO: 1237752 - RNA, 19 nt, Human
aagugcugggauuacaggu

SEQ ID NO: 1237753 - RNA, 26 nt, Human
aagugcugggauuacaggugugagcc

SEQ ID NO: 1237754 - RNA, 18 nt, Human
aauagcugggauuacagg

SEQ ID NO: 1237755 - RNA, 23 nt, Human
aaugauaaaaugcaaaccagaaa

SEQ ID NO: 1237756 - RNA, 24 nt, Human
accagguuggccaugcuggucuug

SEQ ID NO: 1237757 - RNA, 19 nt, Human
acccugcugcccugucugc

SEQ ID NO: 1237758 - RNA, 26 nt, Human
acgcacacauaguagaugcucacaca

SEQ ID NO: 1237759 - RNA, 24 nt, Human
acuauguuucccaggcuggucuug

SEQ ID NO: 1237760 - RNA, 24 nt, Human
acugccuuggccuccugaguagcu

SEQ ID NO: 1237761 - RNA, 19 nt, Human
acugcucugagauauaagc

SEQ ID NO: 1237762 - RNA, 18 nt, Human
agaaaacagaccucacug

SEQ ID NO: 1237763 - RNA, 19 nt, Human
agaaagacacagguucaga

SEQ ID NO: 1237764 - RNA, 19 nt, Human
agaugaacagcuggacuug

SEQ ID NO: 1237765 - RNA, 19 nt, Human
agcaaaugauaaaaugcaa

SEQ ID NO: 1237766 - RNA, 20 nt, Human
agccauucuccugccucagc

SEQ ID NO: 1237767 - RNA, 20 nt, Human
agcugacugcaaccucuucc

SEQ ID NO: 1237768 - RNA, 24 nt, Human
aggugauccgccugccucggccuc

SEQ ID NO: 1237769 - RNA, 21 nt, Human
aguaacacacuggaaaaaucc

SEQ ID NO: 1237770 - RNA, 23 nt, Human
agugacugugggaugaggucuug

SEQ ID NO: 1237771 - RNA, 23 nt, Human
agugcaguggcauaaucuuagcu

SEQ ID NO: 1237772 - RNA, 24 nt, Human
agugcaguggcauaaucuuagcug

SEQ ID NO: 1237773 - RNA, 22 nt, Human
aguuagccagaguuaaaacaga

SEQ ID NO: 1237774 - RNA, 24 nt, Human
aucugagaacaggaguggggaucu

SEQ ID NO: 1237775 - RNA, 19 nt, Human
aucuuucuuuucuuuuucu

SEQ ID NO: 1237776 - RNA, 18 nt, Human
augggguuucaccagguu

SEQ ID NO: 1237777 - RNA, 20 nt, Human
augggguuucaccagguugg

SEQ ID NO: 1237778 - RNA, 21 nt, Human
caaaaagaauggauuucaagu

SEQ ID NO: 1237779 - RNA, 24 nt, Human
caaagugcugggauuacaggugug

SEQ ID NO: 1237780 - RNA, 24 nt, Human
caccagguuggccaugcuggucuu

SEQ ID NO: 1237781 - RNA, 24 nt, Human
cacuauguuucccaggcuggucuu

SEQ ID NO: 1237782 - RNA, 19 nt, Human
cagaaaacagaccucacug

SEQ ID NO: 1237783 - RNA, 24 nt, Human
cagaacucauagaguuuacaacau

SEQ ID NO: 1237784 - RNA, 24 nt, Human
cagaccagcuugcucucagagcuc

SEQ ID NO: 1237785 - RNA, 19 nt, Human
cagcuugaaauaccuugug

SEQ ID NO: 1237786 - RNA, 20 nt, Human
cagcuugcucucagagcucc

SEQ ID NO: 1237787 - RNA, 24 nt, Human
caggaagcaaaugauaaaaugcaa

SEQ ID NO: 1237788 - RNA, 22 nt, Human
caggugauccgccugccucggc

SEQ ID NO: 1237789 - RNA, 21 nt, Human
cauccauggauucaaccaacc

SEQ ID NO: 1237790 - RNA, 24 nt, Human
caucuuguccuucaauugcaguca

SEQ ID NO: 1237791 - RNA, 21 nt, Human
ccaaagugcugggauuacagg

SEQ ID NO: 1237792 - RNA, 21 nt, Human
ccaaagugcugggauuacagg

SEQ ID NO: 1237793 - RNA, 24 nt, Human
ccaaagugcugggauuacaggugu

SEQ ID NO: 1237794 - RNA, 18 nt, Human
ccagaaaacagaccucac

SEQ ID NO: 1237795 - RNA, 24 nt, Human
ccaggcuggucuugaacuccuggg

SEQ ID NO: 1237796 - RNA, 22 nt, Human
ccauccucuuuuaauuccuagc

SEQ ID NO: 1237797 - RNA, 20 nt, Human
ccaugcuggucuugaacucc

SEQ ID NO: 1237798 - RNA, 23 nt, Human
cccaaaagucuaacccacccauu

SEQ ID NO: 1237799 - RNA, 24 nt, Human
ccccugaauagcugggauuacagg

SEQ ID NO: 1237800 - RNA, 24 nt, Human
cccugaauagcugggauuacaggc

SEQ ID NO: 1237801 - RNA, 23 nt, Human
ccuagcccaaaagucuaacccac

SEQ ID NO: 1237802 - RNA, 19 nt, Human
ccugaaggaagccagacca

SEQ ID NO: 1237803 - RNA, 23 nt, Human
ccugaauagcugggauuacaggc

SEQ ID NO: 1237804 - RNA, 24 nt, Human
ccugaauagcugggauuacaggca

SEQ ID NO: 1237805 - RNA, 18 nt, Human
ccugaccucaggugaucc

SEQ ID NO: 1237806 - RNA, 21 nt, Human
ccugaccucaggugauccgcc

SEQ ID NO: 1237807 - RNA, 23 nt, Human
ccugaccucaggugauccgccug

SEQ ID NO: 1237808 - RNA, 24 nt, Human
ccugggcucaaguaauacugccuu

SEQ ID NO: 1237809 - RNA, 19 nt, Human
ccugguauguaaaugagcc

SEQ ID NO: 1237810 - RNA, 20 nt, Human
ccuuggguccccugcggccc

SEQ ID NO: 1237811 - RNA, 22 nt, Human
cucauaugauccuuauaacugc

SEQ ID NO: 1237812 - RNA, 26 nt, Human
cuccugaccucaggugauccgccugc

SEQ ID NO: 1237813 - RNA, 23 nt, Human
cuccugccucagcccccugaaua

SEQ ID NO: 1237814 - RNA, 22 nt, Human
cucuugcccuguuguccaggcu

SEQ ID NO: 1237815 - RNA, 20 nt, Human
cugagaacaggaguggggau

SEQ ID NO: 1237816 - RNA, 19 nt, Human
cugagguucagaauaaagu

SEQ ID NO: 1237817 - RNA, 20 nt, Human
cugcccugucugcuggcugc

SEQ ID NO: 1237818 - RNA, 20 nt, Human
cugcccugucugcuggcugc

SEQ ID NO: 1237819 - RNA, 23 nt, Human
cugccucggccucccaaagugcu

SEQ ID NO: 1237820 - RNA, 25 nt, Human
cugcuccauccucuuuuaauuccua

SEQ ID NO: 1237821 - RNA, 22 nt, Human
cugcugcccugucugcuggcug

SEQ ID NO: 1237822 - RNA, 19 nt, Human
cuggaaaaauccaaaaaga

SEQ ID NO: 1237823 - RNA, 18 nt, Human
cuggagucuccuaaacca

SEQ ID NO: 1237824 - RNA, 19 nt, Human
cuggucuugaacuccuggg

SEQ ID NO: 1237825 - RNA, 20 nt, Human
cuguauguuuauuuccccac

SEQ ID NO: 1237826 - RNA, 23 nt, Human
cuugaaauaccuugugcccuuga

SEQ ID NO: 1237827 - RNA, 24 nt, Human
cuuggccuccugaguagcugggac

SEQ ID NO: 1237828 - RNA, 23 nt, Human
cuugggagcauccucagugcucu

SEQ ID NO: 1237829 - RNA, 24 nt, Human
cuuggguccccugcggcccccagg

SEQ ID NO: 1237830 - RNA, 23 nt, Human
cuuucuuuucuuuuucuucuuuu

SEQ ID NO: 1237831 - RNA, 18 nt, Human
cuuuuuuuuuuuuuucuu

SEQ ID NO: 1237832 - RNA, 22 nt, Human
gaagggauucaaugagacuggg

SEQ ID NO: 1237833 - RNA, 24 nt, Human
gaauagcugggauuacaggcacac

SEQ ID NO: 1237834 - RNA, 18 nt, Human
gacccucuuuuccuacag

SEQ ID NO: 1237835 - RNA, 21 nt, Human
gacccucuuuuccuacagagc

SEQ ID NO: 1237836 - RNA, 24 nt, Human
gaccucaggugauccgccugccuc

SEQ ID NO: 1237837 - RNA, 19 nt, Human
gagaacaaccagagugacc

SEQ ID NO: 1237838 - RNA, 20 nt, Human
gagacaguuuuaggucuggg

SEQ ID NO: 1237839 - RNA, 20 nt, Human
gagaugggguuucaccaggu

SEQ ID NO: 1237840 - RNA, 19 nt, Human
gagccaccgugcuccaccc

SEQ ID NO: 1237841 - RNA, 18 nt, Human
gagcuccuuggguccccu

SEQ ID NO: 1237842 - RNA, 22 nt, Human
gagucuacagaauuggaacugg

SEQ ID NO: 1237843 - RNA, 22 nt, Human
gagugcaguggcauaaucuuag

SEQ ID NO: 1237844 - RNA, 18 nt, Human
gauuacaggugugagcca

SEQ ID NO: 1237845 - RNA, 21 nt, Human
gauuacaggugugagccaccg

SEQ ID NO: 1237846 - RNA, 24 nt, Human
gauuacaggugugagccaccgugc

SEQ ID NO: 1237847 - RNA, 22 nt, Human
gcaaccucuuccugccggguuc

SEQ ID NO: 1237848 - RNA, 20 nt, Human
gccuccugaguagcugggac

SEQ ID NO: 1237849 - RNA, 19 nt, Human
gcuagaauuccaggguaag

SEQ ID NO: 1237850 - RNA, 19 nt, Human
gcuccauccucuuuuaauu

SEQ ID NO: 1237851 - RNA, 23 nt, Human
gcuggucuugaacuccugaccuc

SEQ ID NO: 1237852 - RNA, 22 nt, Human
ggccuugacggcgaacagugcc

SEQ ID NO: 1237853 - RNA, 18 nt, Human
ggcuggucuugaacuccu

SEQ ID NO: 1237854 - RNA, 18 nt, Human
gggguuucaccagguugg

SEQ ID NO: 1237855 - RNA, 18 nt, Human
gguaucugcagcuugaaa

SEQ ID NO: 1237856 - RNA, 19 nt, Human
ggucuugaacuccugaccu

SEQ ID NO: 1237857 - RNA, 19 nt, Human
gguuuaguggguuggagau

SEQ ID NO: 1237858 - RNA, 20 nt, Human
guaauacugccuuggccucc

SEQ ID NO: 1237859 - RNA, 19 nt, Human
gugugagccaccgugcucc

SEQ ID NO: 1237860 - RNA, 24 nt, Human
guuuuuguauuuuuaguagagaug

SEQ ID NO: 1237861 - RNA, 20 nt, Human
uacacuuuuauaaugccuua

SEQ ID NO: 1237862 - RNA, 27 nt, Human
uacagaauuggaacuggagucuccuaa

SEQ ID NO: 1237863 - RNA, 22 nt, Human
uacaggugugagccaccgugcu

SEQ ID NO: 1237864 - RNA, 25 nt, Human
uacaggugugagccaccgugcucca

SEQ ID NO: 1237865 - RNA, 24 nt, Human
uaccuugugcccuugauuaauuca

SEQ ID NO: 1237866 - RNA, 22 nt, Human
uagcaaauugacccugcugccc

SEQ ID NO: 1237867 - RNA, 19 nt, Human
uagcagaauuggaaaggga

SEQ ID NO: 1237868 - RNA, 25 nt, Human
uagccuuguguccuggagacaguuu

SEQ ID NO: 1237869 - RNA, 19 nt, Human
uaguagagaugggguuuca

SEQ ID NO: 1237870 - RNA, 20 nt, Human
uaguagagaugggguuucac

SEQ ID NO: 1237871 - RNA, 22 nt, Human
uaguagagaugggguuucacca

SEQ ID NO: 1237872 - RNA, 23 nt, Human
uaguagagaugggguuucaccag

SEQ ID NO: 1237873 - RNA, 24 nt, Human
uaguagagaugggguuucaccagg

SEQ ID NO: 1237874 - RNA, 26 nt, Human
uaguagagaugggguuucaccagguu

SEQ ID NO: 1237875 - RNA, 24 nt, Human
uaguuuuuguauuuuuaguagaga

SEQ ID NO: 1237876 - RNA, 19 nt, Human
uaugccacugugucuggcu

SEQ ID NO: 1237877 - RNA, 23 nt, Human
uauguuucccaggcuggucuuga

SEQ ID NO: 1237878 - RNA, 24 nt, Human
uauguuucccaggcuggucuugaa

SEQ ID NO: 1237879 - RNA, 21 nt, Human
ucaauaaaguagacaagucca

SEQ ID NO: 1237880 - RNA, 18 nt, Human
ucagaauaaaguuagcca

SEQ ID NO: 1237881 - RNA, 18 nt, Human
ucagcccccugaauagcu

SEQ ID NO: 1237882 - RNA, 24 nt, Human
ucagcccucuguauccaugguuuc

SEQ ID NO: 1237883 - RNA, 21 nt, Human
ucaggugauccgccugccucg

SEQ ID NO: 1237884 - RNA, 21 nt, Human
ucauaucuucucagucauugc

SEQ ID NO: 1237885 - RNA, 22 nt, Human
ucauaugauccuuauaacugcu

SEQ ID NO: 1237886 - RNA, 19 nt, Human
uccaaaaagaauggauuuc

SEQ ID NO: 1237887 - RNA, 23 nt, Human
ucccaaagugcugggauuacagg

SEQ ID NO: 1237888 - RNA, 23 nt, Human
uccuaaaccaguguuucuuuugc

SEQ ID NO: 1237889 - RNA, 24 nt, Human
uccucagugcucucuggaaaauag

SEQ ID NO: 1237890 - RNA, 18 nt, Human
uccugaguagcugggacc

SEQ ID NO: 1237891 - RNA, 21 nt, Human
uccugggcucaaguaauacug

SEQ ID NO: 1237892 - RNA, 18 nt, Human
ucggccucccaaagugcu

SEQ ID NO: 1237893 - RNA, 24 nt, Human
ucucacuauguuucccaggcuggu

SEQ ID NO: 1237894 - RNA, 24 nt, Human
ucuccugccucagcccccugaaua

SEQ ID NO: 1237895 - RNA, 18 nt, Human
ucuggaaaauagcuccuu

SEQ ID NO: 1237896 - RNA, 23 nt, Human
ucuugaacuccugaccucaggug

SEQ ID NO: 1237897 - RNA, 22 nt, Human
ucuugaacuccugggcucaagu

SEQ ID NO: 1237898 - RNA, 23 nt, Human
ucuugaacuccugggcucaagua

SEQ ID NO: 1237899 - RNA, 19 nt, Human
ucuugcccuguuguccagg

SEQ ID NO: 1237900 - RNA, 24 nt, Human
ucuugcccuguuguccaggcuuga

SEQ ID NO: 1237901 - RNA, 25 nt, Human
ucuugcccuguuguccaggcuugag

SEQ ID NO: 1237902 - RNA, 23 nt, Human
ucuugcgaaugaccucacugcuu

SEQ ID NO: 1237903 - RNA, 20 nt, Human
ucuuucuuuucuuuuucuuc

SEQ ID NO: 1237904 - RNA, 18 nt, Human
ucuuuuuuuuuuuuuuuu

SEQ ID NO: 1237905 - RNA, 19 nt, Human
ugaaauaccuugugcccuu

SEQ ID NO: 1237906 - RNA, 22 nt, Human
ugaaauaccuugugcccuugau

SEQ ID NO: 1237907 - RNA, 18 nt, Human
ugaccucaggugauccgc

SEQ ID NO: 1237908 - RNA, 24 nt, Human
ugaccucaggugauccgccugccu

SEQ ID NO: 1237909 - RNA, 18 nt, Human
ugacuuggcucuuuucag

SEQ ID NO: 1237910 - RNA, 23 nt, Human
ugagaacaggaguggggaucuug

SEQ ID NO: 1237911 - RNA, 22 nt, Human
ugagguggacucuugcccuguu

SEQ ID NO: 1237912 - RNA, 23 nt, Human
ugagguggacucuugcccuguug

SEQ ID NO: 1237913 - RNA, 23 nt, Human
ugaucuucagcaagaccugguau

SEQ ID NO: 1237914 - RNA, 22 nt, Human
ugcaaaccagaaaacagaccuc

SEQ ID NO: 1237915 - RNA, 21 nt, Human
ugcaucccugagcuucaucca

SEQ ID NO: 1237916 - RNA, 25 nt, Human
ugcccugucugcuggcugcuuucuu

SEQ ID NO: 1237917 - RNA, 24 nt, Human
ugccggguucgagccauucuccug

SEQ ID NO: 1237918 - RNA, 21 nt, Human
ugccucagcccccugaauagc

SEQ ID NO: 1237919 - RNA, 27 nt, Human
ugccucagcccccugaauagcugggau

SEQ ID NO: 1237920 - RNA, 21 nt, Human
ugccucggccucccaaagugc

SEQ ID NO: 1237921 - RNA, 24 nt, Human
ugccucggccucccaaagugcugg

SEQ ID NO: 1237922 - RNA, 20 nt, Human
ugccuuggccuccugaguaa

SEQ ID NO: 1237923 - RNA, 21 nt, Human
ugccuuggccuccugaguagc

SEQ ID NO: 1237924 - RNA, 24 nt, Human
ugcgaaugaccucacugcuuuuug

SEQ ID NO: 1237925 - RNA, 24 nt, Human
ugcugggauuacaggugugagcca

SEQ ID NO: 1237926 - RNA, 21 nt, Human
ugcuggucuuugucauaucuu

SEQ ID NO: 1237927 - RNA, 18 nt, Human
uggaagggauucaaugag

SEQ ID NO: 1237928 - RNA, 24 nt, Human
uggccaugcuggucuugaacuccu

SEQ ID NO: 1237929 - RNA, 20 nt, Human
uggccuccugaguagcuggg

SEQ ID NO: 1237930 - RNA, 23 nt, Human
uggcuugggcugugggguggagg

SEQ ID NO: 1237931 - RNA, 22 nt, Human
ugggaaaggccugaaggaagcc

SEQ ID NO: 1237932 - RNA, 24 nt, Human
ugggaaaggccugaaggaagccag

SEQ ID NO: 1237933 - RNA, 24 nt, Human
ugggaauguggcuugggcuguggg

SEQ ID NO: 1237934 - RNA, 21 nt, Human
ugggaccauagacauaugcca

SEQ ID NO: 1237935 - RNA, 24 nt, Human
ugggaccauagacauaugccacug

SEQ ID NO: 1237936 - RNA, 21 nt, Human
ugggauuacaggcacacacca

SEQ ID NO: 1237937 - RNA, 22 nt, Human
ugggauuacaggcacacaccac

SEQ ID NO: 1237938 - RNA, 24 nt, Human
ugggauuacaggcacacaccacca

SEQ ID NO: 1237939 - RNA, 18 nt, Human
ugggauuacaggugugag

SEQ ID NO: 1237940 - RNA, 21 nt, Human
ugggauuacaggugugagcca

SEQ ID NO: 1237941 - RNA, 22 nt, Human
ugggauuacaggugugagccac

SEQ ID NO: 1237942 - RNA, 23 nt, Human
ugggauuacaggugugagccacc

SEQ ID NO: 1237943 - RNA, 23 nt, Human
ugggauuacaggugugagccacc

SEQ ID NO: 1237944 - RNA, 24 nt, Human
ugggauuacaggugugagccaccg

SEQ ID NO: 1237945 - RNA, 22 nt, Human
ugggguggagguagaugaacag

SEQ ID NO: 1237946 - RNA, 19 nt, Human
ugggguuucaccagguugg

SEQ ID NO: 1237947 - RNA, 18 nt, Human
ugguauguaaaugagccu

SEQ ID NO: 1237948 - RNA, 21 nt, Human
uguauuuuuaguagagauggg

SEQ ID NO: 1237949 - RNA, 19 nt, Human
ugucagggaucacaagcuc

SEQ ID NO: 1237950 - RNA, 20 nt, Human
uguuggaagggauucaauga

SEQ ID NO: 1237951 - RNA, 28 nt, Human
uuaaccucucugaaccucagucuuccua

SEQ ID NO: 1237952 - RNA, 23 nt, Human
uuaauuccuagcccaaaagucua

SEQ ID NO: 1237953 - RNA, 22 nt, Human
uuacaacaucuuguccuucaau

SEQ ID NO: 1237954 - RNA, 18 nt, Human
uuaguagagaugggguuu

SEQ ID NO: 1237955 - RNA, 22 nt, Human
uuaguagagaugggguuucacc

SEQ ID NO: 1237956 - RNA, 23 nt, Human
uuaguagagaugggguuucacca

SEQ ID NO: 1237957 - RNA, 24 nt, Human
uucccaggcuggucuugaacuccu

SEQ ID NO: 1237958 - RNA, 21 nt, Human
uucgagccauucuccugccuc

SEQ ID NO: 1237959 - RNA, 23 nt, Human
uugcucucagagcuccuuggguc

SEQ ID NO: 1237960 - RNA, 18 nt, Human
uugcugggguucaaaucu

SEQ ID NO: 1237961 - RNA, 23 nt, Human
uuguauuuuuaguagagaugggg

SEQ ID NO: 1237962 - RNA, 24 nt, Human
uuguccaggcuugagugcaguggc

SEQ ID NO: 1237963 - RNA, 20 nt, Human
uuuaaucuccaauuuucagg

SEQ ID NO: 1237964 - RNA, 20 nt, Human
uuuaaucuccaauuuucagg

SEQ ID NO: 1237965 - RNA, 24 nt, Human
uuuuuaguagagaugggguuucac

SEQ ID NO: 1237966 - RNA, 20 nt, Human
uuuuuguauuuuuaguagag

SEQ ID NO: 1237967 - RNA, 21 nt, Human
uuuuuguauuuuuaguagaga

SEQ ID NO: 1237968 - RNA, 24 nt, Human
uuuuuuuuuucuugagguggacuc

SEQ ID NO: 1237969 - RNA, 23 nt, Human
uuuuuuuuuuuucuuuucuuuuu

SEQ ID NO: 1237970 - RNA, 20 nt, Human
uuuuuuuuuuuuuaaagaug

SEQ ID NO: 1237971 - RNA, 18 nt, Human
uuuuuuuuuuuuuucuug

SEQ ID NO: 1237972 - RNA, 21 nt, Human
uuuuuuuuuuuuuucuugagg

SEQ ID NO: 1237973 - RNA, 19 nt, Human
uuuuuuuuuuuuuuuuuaa

SEQ ID NO: 1237974 - RNA, 21 nt, Human
aaacaggaaccccacaaaggc

SEQ ID NO: 1237975 - RNA, 22 nt, Human
aaagaggcaggcccaggaaugg

SEQ ID NO: 1237976 - RNA, 18 nt, Human
aaagccauccucccgccu

SEQ ID NO: 1237977 - RNA, 24 nt, Human
aaagugcugggauuacagguguga

SEQ ID NO: 1237978 - RNA, 21 nt, Human
aaauggcccacagggaaaggc

SEQ ID NO: 1237979 - RNA, 23 nt, Human
aagaacacagaggaagcagugac

SEQ ID NO: 1237980 - RNA, 20 nt, Human
aaguagcugggacuacaggu

SEQ ID NO: 1237981 - RNA, 24 nt, Human
aaguagcugggacuacaggugugu

SEQ ID NO: 1237982 - RNA, 25 nt, Human
aaguagcugggacuacaggugugua

SEQ ID NO: 1237983 - RNA, 18 nt, Human
aagugcugggauuacagg

SEQ ID NO: 1237984 - RNA, 19 nt, Human
aagugcugggauuacaggu

SEQ ID NO: 1237985 - RNA, 26 nt, Human
aagugcugggauuacaggugugagcc

SEQ ID NO: 1237986 - RNA, 18 nt, Human
aaucagggaucugacuua

SEQ ID NO: 1237987 - RNA, 18 nt, Human
acaagaaaaaggaugcgg

SEQ ID NO: 1237988 - RNA, 19 nt, Human
acacagaggaagcagugac

SEQ ID NO: 1237989 - RNA, 18 nt, Human
acagcccacccagaggcc

SEQ ID NO: 1237990 - RNA, 22 nt, Human
acagugaccucugucaacccug

SEQ ID NO: 1237991 - RNA, 24 nt, Human
acaguggggcugugagcacccugc

SEQ ID NO: 1237992 - RNA, 19 nt, Human
acccaggcuggagugcagu

SEQ ID NO: 1237993 - RNA, 23 nt, Human
acccaggcuggagugcaguggug

SEQ ID NO: 1237994 - RNA, 21 nt, Human
acccugcagccacugcugggc

SEQ ID NO: 1237995 - RNA, 18 nt, Human
acccugucacccaggcug

SEQ ID NO: 1237996 - RNA, 25 nt, Human
acccugucacccaggcuggagugca

SEQ ID NO: 1237997 - RNA, 21 nt, Human
accuagaagaacacagaggaa

SEQ ID NO: 1237998 - RNA, 20 nt, Human
accucaaggaaucacucuuu

SEQ ID NO: 1237999 - RNA, 19 nt, Human
acuacagguguguaccacc

SEQ ID NO: 1238000 - RNA, 24 nt, Human
acuauguugcccaggcuggucuug

SEQ ID NO: 1238001 - RNA, 25 nt, Human
acuauguugcccaggcuggucuuga

SEQ ID NO: 1238002 - RNA, 24 nt, Human
acugcugggcaaaaccugcccagu

SEQ ID NO: 1238003 - RNA, 25 nt, Human
agaggcaggcccaggaauggaauuu

SEQ ID NO: 1238004 - RNA, 21 nt, Human
agcagugacggucccuccaua

SEQ ID NO: 1238005 - RNA, 22 nt, Human
agccacugaguaggguaccacc

SEQ ID NO: 1238006 - RNA, 18 nt, Human
agccauccucccgccuca

SEQ ID NO: 1238007 - RNA, 21 nt, Human
agccucaaccuccugggcuaa

SEQ ID NO: 1238008 - RNA, 23 nt, Human
agccucaaccuccugggcuaaag

SEQ ID NO: 1238009 - RNA, 19 nt, Human
agcuggauucacugcccag

SEQ ID NO: 1238010 - RNA, 19 nt, Human
agggacacuggggacuuau

SEQ ID NO: 1238011 - RNA, 18 nt, Human
agggggcuucccugguca

SEQ ID NO: 1238012 - RNA, 22 nt, Human
aggucucacuauguugcccagg

SEQ ID NO: 1238013 - RNA, 20 nt, Human
agugauuacagaccaccuca

SEQ ID NO: 1238014 - RNA, 24 nt, Human
aguuuuucaaccagcaggcaacuu

SEQ ID NO: 1238015 - RNA, 22 nt, Human
aucccagagccaagucagcccc

SEQ ID NO: 1238016 - RNA, 21 nt, Human
auccucccgccucagccuccc

SEQ ID NO: 1238017 - RNA, 21 nt, Human
aucuccccuacugucuaaacc

SEQ ID NO: 1238018 - RNA, 24 nt, Human
caaagugcugggauuacaggugug

SEQ ID NO: 1238019 - RNA, 21 nt, Human
caacaggaaaaaugcucuacc

SEQ ID NO: 1238020 - RNA, 24 nt, Human
caaggucucacuauguugcccagg

SEQ ID NO: 1238021 - RNA, 20 nt, Human
cacagcccacccagaggccc

SEQ ID NO: 1238022 - RNA, 19 nt, Human
cacaggagccucaaccucc

SEQ ID NO: 1238023 - RNA, 24 nt, Human
cacccaggcuggagugcaguggug

SEQ ID NO: 1238024 - RNA, 22 nt, Human
cacccugcagccacugcugggc

SEQ ID NO: 1238025 - RNA, 22 nt, Human
cacccugucacccaggcuggag

SEQ ID NO: 1238026 - RNA, 23 nt, Human
cacccugucacccaggcuggagu

SEQ ID NO: 1238027 - RNA, 25 nt, Human
cacccugucacccaggcuggagugc

SEQ ID NO: 1238028 - RNA, 19 nt, Human
caccuccacgagugauuac

SEQ ID NO: 1238029 - RNA, 22 nt, Human
cacgcagacugacacgcugggc

SEQ ID NO: 1238030 - RNA, 24 nt, Human
cacggacacagcccacccagaggc

SEQ ID NO: 1238031 - RNA, 19 nt, Human
cacuauguugcccaggcug

SEQ ID NO: 1238032 - RNA, 24 nt, Human
cacuauguugcccaggcuggucuu

SEQ ID NO: 1238033 - RNA, 27 nt, Human
cacuauguugcccaggcuggucuugaa

SEQ ID NO: 1238034 - RNA, 20 nt, Human
cagaccaccucaaggaauca

SEQ ID NO: 1238035 - RNA, 19 nt, Human
cagaccuggcaccugcaug

SEQ ID NO: 1238036 - RNA, 18 nt, Human
caggagccugggagcaag

SEQ ID NO: 1238037 - RNA, 19 nt, Human
caggagccugggagcaagg

SEQ ID NO: 1238038 - RNA, 22 nt, Human
caggagccugggagcaagggcu

SEQ ID NO: 1238039 - RNA, 18 nt, Human
caggcaggagccugggag

SEQ ID NO: 1238040 - RNA, 18 nt, Human
cagggggcuucccugguc

SEQ ID NO: 1238041 - RNA, 24 nt, Human
cagugaccucugucaacccugguu

SEQ ID NO: 1238042 - RNA, 20 nt, Human
cauggcguggucucccugca

SEQ ID NO: 1238043 - RNA, 21 nt, Human
ccaaagugcugggauuacagg

SEQ ID NO: 1238044 - RNA, 21 nt, Human
ccaaagugcugggauuacagg

SEQ ID NO: 1238045 - RNA, 24 nt, Human
ccaaagugcugggauuacaggugu

SEQ ID NO: 1238046 - RNA, 20 nt, Human
ccaaauggcccacagggaaa

SEQ ID NO: 1238047 - RNA, 22 nt, Human
ccacagggaaaggcuggggaaa

SEQ ID NO: 1238048 - RNA, 23 nt, Human
cccaaguagcugggacuacaggu

SEQ ID NO: 1238049 - RNA, 24 nt, Human
cccaaguagcugggacuacaggug

SEQ ID NO: 1238050 - RNA, 26 nt, Human
ccccgcaugggccccacauguaccua

SEQ ID NO: 1238051 - RNA, 23 nt, Human
cccgccucagccucccaaguagc

SEQ ID NO: 1238052 - RNA, 21 nt, Human
cccucuuggcuuaucaggggg

SEQ ID NO: 1238053 - RNA, 19 nt, Human
ccucaaggaaucacucuuu

SEQ ID NO: 1238054 - RNA, 20 nt, Human
ccugagcucaagugaccuuc

SEQ ID NO: 1238055 - RNA, 23 nt, Human
ccugcacaucauggcagauuguu

SEQ ID NO: 1238056 - RNA, 19 nt, Human
ccugcuacaguggggcugu

SEQ ID NO: 1238057 - RNA, 18 nt, Human
ccugggagcaagggcugu

SEQ ID NO: 1238058 - RNA, 19 nt, Human
ccuguagggugggccucug

SEQ ID NO: 1238059 - RNA, 20 nt, Human
ccuguagggugggccucugc

SEQ ID NO: 1238060 - RNA, 24 nt, Human
ccugucacccaggcuggagugcag

SEQ ID NO: 1238061 - RNA, 24 nt, Human
cgccucagccucccaaguagcugg

SEQ ID NO: 1238062 - RNA, 18 nt, Human
cucaagugaccuucccaa

SEQ ID NO: 1238063 - RNA, 23 nt, Human
cucaagugaccuucccaaagugc

SEQ ID NO: 1238064 - RNA, 24 nt, Human
cucacccugucacccaggcuggag

SEQ ID NO: 1238065 - RNA, 21 nt, Human
cucagagugacaacaggaaaa

SEQ ID NO: 1238066 - RNA, 24 nt, Human
cucagccucccaaguagcugggac

SEQ ID NO: 1238067 - RNA, 19 nt, Human
cucaugugucccaggacac

SEQ ID NO: 1238068 - RNA, 18 nt, Human
cucgugccccgcaugggc

SEQ ID NO: 1238069 - RNA, 23 nt, Human
cucuaccuacagaccuggcaccu

SEQ ID NO: 1238070 - RNA, 21 nt, Human
cucugucaacccugguuuacc

SEQ ID NO: 1238071 - RNA, 25 nt, Human
cugaaaaucuccccuacugucuaag

SEQ ID NO: 1238072 - RNA, 19 nt, Human
cugcucagagugacaacag

SEQ ID NO: 1238073 - RNA, 20 nt, Human
cuugcagcucaagaaggagg

SEQ ID NO: 1238074 - RNA, 20 nt, Human
gaacagaugcauguuagcau

SEQ ID NO: 1238075 - RNA, 24 nt, Human
gacuacagguguguaccaccaugc

SEQ ID NO: 1238076 - RNA, 19 nt, Human
gagccagcccacacucgug

SEQ ID NO: 1238077 - RNA, 20 nt, Human
gagcccugcaccuggcccug

SEQ ID NO: 1238078 - RNA, 23 nt, Human
gaguaggguaccaccuggguccu

SEQ ID NO: 1238079 - RNA, 21 nt, Human
gauuacaggugugagcccugc

SEQ ID NO: 1238080 - RNA, 22 nt, Human
gauuacaggugugagcccugca

SEQ ID NO: 1238081 - RNA, 19 nt, Human
gcucaagugaccuucccaa

SEQ ID NO: 1238082 - RNA, 23 nt, Human
gcugaaaaucuccccuacugucu

SEQ ID NO: 1238083 - RNA, 21 nt, Human
gcuggagugcaguggugccag

SEQ ID NO: 1238084 - RNA, 20 nt, Human
ggaaaaaugcucuaccuaca

SEQ ID NO: 1238085 - RNA, 22 nt, Human
ggaaaaaugcucuaccuacaga

SEQ ID NO: 1238086 - RNA, 18 nt, Human
ggaaaggcuggggaaaag

SEQ ID NO: 1238087 - RNA, 26 nt, Human
ggacacagcccacccagaggcccagc

SEQ ID NO: 1238088 - RNA, 24 nt, Human
ggacuacagguguguaccaccaug

SEQ ID NO: 1238089 - RNA, 23 nt, Human
ggagccugggagcaagggcugug

SEQ ID NO: 1238090 - RNA, 22 nt, Human
ggauaaacaggaaccccacaaa

SEQ ID NO: 1238091 - RNA, 25 nt, Human
ggauaaguacacacacccugccccu

SEQ ID NO: 1238092 - RNA, 21 nt, Human
ggauuacaggugugagcccug

SEQ ID NO: 1238093 - RNA, 19 nt, Human
ggcaaaaccugcccagugg

SEQ ID NO: 1238094 - RNA, 19 nt, Human
ggcaacuuuccccucucaa

SEQ ID NO: 1238095 - RNA, 23 nt, Human
ggcccucuuggcuuaucaggggg

SEQ ID NO: 1238096 - RNA, 24 nt, Human
ggcuggucuugaacuccugagcuc

SEQ ID NO: 1238097 - RNA, 19 nt, Human
gggauaaacaggaacccca

SEQ ID NO: 1238098 - RNA, 24 nt, Human
gggauaaacaggaaccccacaaag

SEQ ID NO: 1238099 - RNA, 22 nt, Human
gggauaaguacacacacccugc

SEQ ID NO: 1238100 - RNA, 24 nt, Human
ggggacgacagagggucacuugug

SEQ ID NO: 1238101 - RNA, 18 nt, Human
ggucuggcaggcacccag

SEQ ID NO: 1238102 - RNA, 20 nt, Human
ggucuggcaggcacccagcc

SEQ ID NO: 1238103 - RNA, 18 nt, Human
gugugacuuacugccuca

SEQ ID NO: 1238104 - RNA, 21 nt, Human
guguguaccaccaugcccagc

SEQ ID NO: 1238105 - RNA, 23 nt, Human
uaaacaggaaccccacaaaggca

SEQ ID NO: 1238106 - RNA, 26 nt, Human
uaaccauccuccccuucugucccucc

SEQ ID NO: 1238107 - RNA, 23 nt, Human
uaaguacacacacccugccccug

SEQ ID NO: 1238108 - RNA, 20 nt, Human
uacagccuaaagugacacgg

SEQ ID NO: 1238109 - RNA, 22 nt, Human
uacaggugugagcccugcaccu

SEQ ID NO: 1238110 - RNA, 18 nt, Human
uaccuacagaccuggcac

SEQ ID NO: 1238111 - RNA, 21 nt, Human
uaccugccucacucugagagu

SEQ ID NO: 1238112 - RNA, 18 nt, Human
uacugugugacuuacugc

SEQ ID NO: 1238113 - RNA, 20 nt, Human
uagaagaacacagaggaagc

SEQ ID NO: 1238114 - RNA, 21 nt, Human
uagaagaacacagaggaagca

SEQ ID NO: 1238115 - RNA, 20 nt, Human
uagacauccacagugaccuc

SEQ ID NO: 1238116 - RNA, 20 nt, Human
uagacauccacagugaccuc

SEQ ID NO: 1238117 - RNA, 25 nt, Human
uaggcagcgagaaaggaaaagccag

SEQ ID NO: 1238118 - RNA, 24 nt, Human
uagggugggccucugcuuccagaa

SEQ ID NO: 1238119 - RNA, 19 nt, Human
uauguugcccaggcugguc

SEQ ID NO: 1238120 - RNA, 24 nt, Human
uauguugcccaggcuggucuugaa

SEQ ID NO: 1238121 - RNA, 24 nt, Human
ucacccaggcuggagugcaguggu

SEQ ID NO: 1238122 - RNA, 24 nt, Human
ucacccugucacccaggcuggagu

SEQ ID NO: 1238123 - RNA, 20 nt, Human
ucagccucccaaguagcugg

SEQ ID NO: 1238124 - RNA, 23 nt, Human
uccacagugaccucugucaaccc

SEQ ID NO: 1238125 - RNA, 18 nt, Human
uccagagacaaggucuca

SEQ ID NO: 1238126 - RNA, 23 nt, Human
ucccaaagugcugggauuacagg

SEQ ID NO: 1238127 - RNA, 23 nt, Human
ucccaaguagcugggacuacagg

SEQ ID NO: 1238128 - RNA, 22 nt, Human
ucccuccaggaggcagggagga

SEQ ID NO: 1238129 - RNA, 19 nt, Human
ucccuccauagacauccac

SEQ ID NO: 1238130 - RNA, 21 nt, Human
ucccuccauagacauccacag

SEQ ID NO: 1238131 - RNA, 22 nt, Human
ucccuggucauccuccagcagc

SEQ ID NO: 1238132 - RNA, 27 nt, Human
uccucccgccucagccucccaaguagc

SEQ ID NO: 1238133 - RNA, 21 nt, Human
ucgcgaacccuccgugggucu

SEQ ID NO: 1238134 - RNA, 24 nt, Human
ucucacccugucacccaggcugga

SEQ ID NO: 1238135 - RNA, 26 nt, Human
ucucacccugucacccaggcuggagu

SEQ ID NO: 1238136 - RNA, 27 nt, Human
ucucacccugucacccaggcuggagug

SEQ ID NO: 1238137 - RNA, 19 nt, Human
ucucacuauguugcccagg

SEQ ID NO: 1238138 - RNA, 23 nt, Human
ucucacuauguugcccaggcugg

SEQ ID NO: 1238139 - RNA, 24 nt, Human
ucucacuauguugcccaggcuggu

SEQ ID NO: 1238140 - RNA, 26 nt, Human
ucucacuauguugcccaggcuggucu

SEQ ID NO: 1238141 - RNA, 27 nt, Human
ucucacuauguugcccaggcuggucuu

SEQ ID NO: 1238142 - RNA, 23 nt, Human
ucuugaacuccugagcucaagug

SEQ ID NO: 1238143 - RNA, 21 nt, Human
ugaacacaagaaaaaggaugc

SEQ ID NO: 1238144 - RNA, 24 nt, Human
ugaacuccugagcucaagugaccu

SEQ ID NO: 1238145 - RNA, 18 nt, Human
ugagccagcccacacucg

SEQ ID NO: 1238146 - RNA, 18 nt, Human
ugaguaggguaccaccug

SEQ ID NO: 1238147 - RNA, 19 nt, Human
ugcaaagaggcaggcccag

SEQ ID NO: 1238148 - RNA, 21 nt, Human
ugcagccacugcugggcaaaa

SEQ ID NO: 1238149 - RNA, 22 nt, Human
ugcauggcguggucucccugca

SEQ ID NO: 1238150 - RNA, 20 nt, Human
ugccagcccaggcugaacua

SEQ ID NO: 1238151 - RNA, 24 nt, Human
ugcccaggcuggucuugaacuccu

SEQ ID NO: 1238152 - RNA, 28 nt, Human
ugcccaggcuggucuugaacuccugagc

SEQ ID NO: 1238153 - RNA, 19 nt, Human
ugccccugcuacagugggg

SEQ ID NO: 1238154 - RNA, 19 nt, Human
ugccucagcuaaagcuugc

SEQ ID NO: 1238155 - RNA, 23 nt, Human
ugcuacaguggggcugugagcac

SEQ ID NO: 1238156 - RNA, 20 nt, Human
ugcugggauuacagguguga

SEQ ID NO: 1238157 - RNA, 21 nt, Human
uggagugcaguggugccauca

SEQ ID NO: 1238158 - RNA, 22 nt, Human
uggagugcaguggugccaucag

SEQ ID NO: 1238159 - RNA, 23 nt, Human
uggagugcaguggugccaucagg

SEQ ID NO: 1238160 - RNA, 28 nt, Human
uggagugcaguggugccauccuagcacg

SEQ ID NO: 1238161 - RNA, 19 nt, Human
uggauucacugcccaguac

SEQ ID NO: 1238162 - RNA, 21 nt, Human
uggcagauuguucugaaagcu

SEQ ID NO: 1238163 - RNA, 20 nt, Human
uggcaggcacccagccucug

SEQ ID NO: 1238164 - RNA, 21 nt, Human
uggcccacagggaaaggcugg

SEQ ID NO: 1238165 - RNA, 21 nt, Human
ugggacuacagguguguacca

SEQ ID NO: 1238166 - RNA, 24 nt, Human
ugggacuacagguguguaccacca

SEQ ID NO: 1238167 - RNA, 25 nt, Human
ugggacuacagguguguaccaccau

SEQ ID NO: 1238168 - RNA, 18 nt, Human
ugggagcaagggcugugc

SEQ ID NO: 1238169 - RNA, 18 nt, Human
ugggauuacaggugugag

SEQ ID NO: 1238170 - RNA, 19 nt, Human
ugggauuacaggugugagc

SEQ ID NO: 1238171 - RNA, 20 nt, Human
ugggauuacaggugugagcc

SEQ ID NO: 1238172 - RNA, 20 nt, Human
ugggauuacaggugugagcc

SEQ ID NO: 1238173 - RNA, 21 nt, Human
ugggauuacaggugugagccc

SEQ ID NO: 1238174 - RNA, 23 nt, Human
ugggauuacaggugugagcccug

SEQ ID NO: 1238175 - RNA, 23 nt, Human
ugggauuacaggugugagcccug

SEQ ID NO: 1238176 - RNA, 20 nt, Human
ugguuuaccuguaggguggg

SEQ ID NO: 1238177 - RNA, 19 nt, Human
uguagggcagggauaagua

SEQ ID NO: 1238178 - RNA, 21 nt, Human
ugucacccaggcuggagugca

SEQ ID NO: 1238179 - RNA, 18 nt, Human
ugucccaggacacuacgg

SEQ ID NO: 1238180 - RNA, 18 nt, Human
ugugacuuacugccucag

SEQ ID NO: 1238181 - RNA, 22 nt, Human
uuaugugccagcccaggcugaa

SEQ ID NO: 1238182 - RNA, 24 nt, Human
uucacaggagccucaaccuccugg

SEQ ID NO: 1238183 - RNA, 23 nt, Human
uucacugcccaguacuugucuug

SEQ ID NO: 1238184 - RNA, 20 nt, Human
uucagggauaaacaggaacc

SEQ ID NO: 1238185 - RNA, 18 nt, Human
acagugcccuucuugcca

SEQ ID NO: 1238186 - RNA, 20 nt, Human
acugguaacagugguuuccu

SEQ ID NO: 1238187 - RNA, 21 nt, Human
ggaaagggcaggagaugaggu

SEQ ID NO: 1238188 - RNA, 21 nt, Human
guacuguauucccccauuugu

SEQ ID NO: 1238189 - RNA, 20 nt, Human
uacuguauucccccauuugu

SEQ ID NO: 1238190 - RNA, 24 nt, Human
uccagauaugugaaguguguacug

SEQ ID NO: 1238191 - RNA, 23 nt, Human
uccaucaucaccaggggagggaa

SEQ ID NO: 1238192 - RNA, 21 nt, Human
aaaaaaaaaaaaaaaggcaca

SEQ ID NO: 1238193 - RNA, 19 nt, Human
aaaaaaauccaaaaccucu

SEQ ID NO: 1238194 - RNA, 19 nt, Human
aaaaacaaaccacaagaga

SEQ ID NO: 1238195 - RNA, 18 nt, Human
aaacaaacaaggcaacau

SEQ ID NO: 1238196 - RNA, 20 nt, Human
aaagaccaaugaguagacac

SEQ ID NO: 1238197 - RNA, 21 nt, Human
aaccacaagagaaaaaaaucc

SEQ ID NO: 1238198 - RNA, 25 nt, Human
aacugaacucuugacaucauuucca

SEQ ID NO: 1238199 - RNA, 20 nt, Human
aacuguggcccccuagccuc

SEQ ID NO: 1238200 - RNA, 21 nt, Human
aagaagccagaaggaaaaaac

SEQ ID NO: 1238201 - RNA, 23 nt, Human
aagaagccagaaggaaaaaacaa

SEQ ID NO: 1238202 - RNA, 25 nt, Human
aagaagccagaaggaaaaaacaaac

SEQ ID NO: 1238203 - RNA, 23 nt, Human
aaugaagagacuguaauagaaga

SEQ ID NO: 1238204 - RNA, 24 nt, Human
aaugaagagacuguaauagaagaa

SEQ ID NO: 1238205 - RNA, 24 nt, Human
aauuuuuaaaacuucaccauucaa

SEQ ID NO: 1238206 - RNA, 19 nt, Human
acaagagugaaacuccauc

SEQ ID NO: 1238207 - RNA, 20 nt, Human
acaagagugaaacuccaucu

SEQ ID NO: 1238208 - RNA, 21 nt, Human
acaagagugaaacuccaucuc

SEQ ID NO: 1238209 - RNA, 24 nt, Human
accacagccacaucacagcuccug

SEQ ID NO: 1238210 - RNA, 24 nt, Human
accucgucucuacuaaaaauacaa

SEQ ID NO: 1238211 - RNA, 24 nt, Human
accugggaggcaguggcugcagug

SEQ ID NO: 1238212 - RNA, 25 nt, Human
acuccagccugggcaacaagaguga

SEQ ID NO: 1238213 - RNA, 22 nt, Human
acugaauggauuauuauucuuc

SEQ ID NO: 1238214 - RNA, 21 nt, Human
acuggagaacaaaagcgaaua

SEQ ID NO: 1238215 - RNA, 20 nt, Human
acuuaaaaaacaaaccacaa

SEQ ID NO: 1238216 - RNA, 24 nt, Human
agaacaaagaccaaugaguagaca

SEQ ID NO: 1238217 - RNA, 22 nt, Human
agaaucacuugaaccugggagg

SEQ ID NO: 1238218 - RNA, 21 nt, Human
agagaaaaaaauccaaaaccu

SEQ ID NO: 1238219 - RNA, 19 nt, Human
agaggaaacugaacucuug

SEQ ID NO: 1238220 - RNA, 20 nt, Human
agaugccaguggccugccua

SEQ ID NO: 1238221 - RNA, 22 nt, Human
agcaccuauuuuacuaccuggc

SEQ ID NO: 1238222 - RNA, 24 nt, Human
agcaguuugggaggcugagguggg

SEQ ID NO: 1238223 - RNA, 20 nt, Human
agccacaucacagcuccugg

SEQ ID NO: 1238224 - RNA, 21 nt, Human
agcgcaugccuguaaucccag

SEQ ID NO: 1238225 - RNA, 23 nt, Human
agcuggguguguuagcgcaugcc

SEQ ID NO: 1238226 - RNA, 22 nt, Human
aggcaggagaaucacuugaacc

SEQ ID NO: 1238227 - RNA, 24 nt, Human
aggcaggagaaucacuugaaccug

SEQ ID NO: 1238228 - RNA, 20 nt, Human
aggcaguggcugcagugagc

SEQ ID NO: 1238229 - RNA, 21 nt, Human
aggcaguggcugcagugagcu

SEQ ID NO: 1238230 - RNA, 24 nt, Human
aggcaguggcugcagugagcugag

SEQ ID NO: 1238231 - RNA, 24 nt, Human
aggcugaggcaggagaaucacuug

SEQ ID NO: 1238232 - RNA, 22 nt, Human
auaaaacacauccaguacuuga

SEQ ID NO: 1238233 - RNA, 24 nt, Human
aucgcgccauugcacuccagccug

SEQ ID NO: 1238234 - RNA, 22 nt, Human
augaagcagcaacuguggcccc

SEQ ID NO: 1238235 - RNA, 24 nt, Human
auugcacuccagccugggcaacaa

SEQ ID NO: 1238236 - RNA, 20 nt, Human
caaaacagaggaaacugaac

SEQ ID NO: 1238237 - RNA, 18 nt, Human
caaagaaugauccuugga

SEQ ID NO: 1238238 - RNA, 21 nt, Human
caaagaccaaugaguagacac

SEQ ID NO: 1238239 - RNA, 23 nt, Human
caaauggaugaguaauuuuuuuu

SEQ ID NO: 1238240 - RNA, 22 nt, Human
caagagaaaaaaauccaaaacc

SEQ ID NO: 1238241 - RNA, 21 nt, Human
caaugaagagacuguaauaga

SEQ ID NO: 1238242 - RNA, 24 nt, Human
cacaagagaaaaaaauccaaaacc

SEQ ID NO: 1238243 - RNA, 24 nt, Human
cacaccuguaaucccagcaguuug

SEQ ID NO: 1238244 - RNA, 22 nt, Human
caccucaaaaauccaccuccgg

SEQ ID NO: 1238245 - RNA, 23 nt, Human
caccuguaaucccagcaguuugg

SEQ ID NO: 1238246 - RNA, 24 nt, Human
caccuguaaucccagcaguuuggg

SEQ ID NO: 1238247 - RNA, 23 nt, Human
cacuauggcauccugacaugggg

SEQ ID NO: 1238248 - RNA, 23 nt, Human
cacuccagccugggcaacaagag

SEQ ID NO: 1238249 - RNA, 24 nt, Human
cacuccagccugggcaacaagagu

SEQ ID NO: 1238250 - RNA, 25 nt, Human
cacuccagccugggcaacaagagug

SEQ ID NO: 1238251 - RNA, 21 nt, Human
cagagauaauucugaccucac

SEQ ID NO: 1238252 - RNA, 21 nt, Human
cagagcccuggccagagcugu

SEQ ID NO: 1238253 - RNA, 23 nt, Human
cagagcccuggccagagcugucc

SEQ ID NO: 1238254 - RNA, 18 nt, Human
cagcaggucucucuuuuu

SEQ ID NO: 1238255 - RNA, 24 nt, Human
cagcaguuugggaggcugaggugg

SEQ ID NO: 1238256 - RNA, 24 nt, Human
cagcuacucgggaggcugaggcag

SEQ ID NO: 1238257 - RNA, 20 nt, Human
caggcacagaccucaucuca

SEQ ID NO: 1238258 - RNA, 24 nt, Human
caguggccugccuagaaagccacu

SEQ ID NO: 1238259 - RNA, 20 nt, Human
caugucacuggcuaguuugu

SEQ ID NO: 1238260 - RNA, 19 nt, Human
cauugcacuccagccuggg

SEQ ID NO: 1238261 - RNA, 21 nt, Human
cauugcacuccagccugggca

SEQ ID NO: 1238262 - RNA, 22 nt, Human
cauugcacuccagccugggcaa

SEQ ID NO: 1238263 - RNA, 24 nt, Human
cauugcacuccagccugggcaaca

SEQ ID NO: 1238264 - RNA, 18 nt, Human
ccacagauuugaugucca

SEQ ID NO: 1238265 - RNA, 18 nt, Human
ccacuggguaauacugug

SEQ ID NO: 1238266 - RNA, 23 nt, Human
ccacuuaaaaaacaaaccacaag

SEQ ID NO: 1238267 - RNA, 23 nt, Human
ccagagcugucccacaugucacu

SEQ ID NO: 1238268 - RNA, 24 nt, Human
ccaucucaaaaaaaaaaaaaaaaa

SEQ ID NO: 1238269 - RNA, 20 nt, Human
ccauugcacuccagccuggg

SEQ ID NO: 1238270 - RNA, 21 nt, Human
ccauugcacuccagccugggc

SEQ ID NO: 1238271 - RNA, 23 nt, Human
ccauugcacuccagccugggcaa

SEQ ID NO: 1238272 - RNA, 24 nt, Human
ccauugcacuccagccugggcaac

SEQ ID NO: 1238273 - RNA, 22 nt, Human
ccuagaccacagccacaucaca

SEQ ID NO: 1238274 - RNA, 19 nt, Human
ccugacauggggccugucu

SEQ ID NO: 1238275 - RNA, 19 nt, Human
ccuguaaucccagcuacuc

SEQ ID NO: 1238276 - RNA, 21 nt, Human
ccuguaaucccagcuacucgg

SEQ ID NO: 1238277 - RNA, 22 nt, Human
ccuguaaucccagcuacucggg

SEQ ID NO: 1238278 - RNA, 19 nt, Human
ccugucccaauggcuggga

SEQ ID NO: 1238279 - RNA, 24 nt, Human
cgccauugcacuccagccugggca

SEQ ID NO: 1238280 - RNA, 19 nt, Human
cggagguguuccugaaucg

SEQ ID NO: 1238281 - RNA, 24 nt, Human
cggagguguuccugaaucgguggc

SEQ ID NO: 1238282 - RNA, 24 nt, Human
cgggaggcugaggcaggagaauca

SEQ ID NO: 1238283 - RNA, 27 nt, Human
cucaaaaaaaaaaaaaaaaaggcacaa

SEQ ID NO: 1238284 - RNA, 21 nt, Human
cucacaccuguaaucccagca

SEQ ID NO: 1238285 - RNA, 21 nt, Human
cucacaccuguaaucccagca

SEQ ID NO: 1238286 - RNA, 19 nt, Human
cuccaucucaaaaaaaaaa

SEQ ID NO: 1238287 - RNA, 25 nt, Human
cugaacucuugacaucauuuccacc

SEQ ID NO: 1238288 - RNA, 19 nt, Human
cugcagugagcugagaucg

SEQ ID NO: 1238289 - RNA, 20 nt, Human
cugcagugagcugagaucgc

SEQ ID NO: 1238290 - RNA, 22 nt, Human
cugcagugagcugagaucgcgc

SEQ ID NO: 1238291 - RNA, 18 nt, Human
cugggaggcaaauggaug

SEQ ID NO: 1238292 - RNA, 19 nt, Human
cuguggcccccuagccucc

SEQ ID NO: 1238293 - RNA, 21 nt, Human
cuuaaacuuaccuggggaaau

SEQ ID NO: 1238294 - RNA, 21 nt, Human
cuugcaccucaaaaauccacc

SEQ ID NO: 1238295 - RNA, 24 nt, Human
gaacauggagaaaccucgucucua

SEQ ID NO: 1238296 - RNA, 21 nt, Human
gagaaaccucgucucuacuaa

SEQ ID NO: 1238297 - RNA, 23 nt, Human
gagaccagccugucgaacaugga

SEQ ID NO: 1238298 - RNA, 20 nt, Human
gagucugccaauccacuuag

SEQ ID NO: 1238299 - RNA, 19 nt, Human
gauaacaacuuuaacuuuu

SEQ ID NO: 1238300 - RNA, 23 nt, Human
gcaacuguggcccccuagccucc

SEQ ID NO: 1238301 - RNA, 23 nt, Human
gcaggagaaucacuugaaccugg

SEQ ID NO: 1238302 - RNA, 22 nt, Human
gccauugcacuccagccugggc

SEQ ID NO: 1238303 - RNA, 24 nt, Human
gccauugcacuccagccugggcaa

SEQ ID NO: 1238304 - RNA, 25 nt, Human
gcgcaacuccauggggcaggcagga

SEQ ID NO: 1238305 - RNA, 20 nt, Human
gcgcaaguacacugcagucc

SEQ ID NO: 1238306 - RNA, 19 nt, Human
ggcccccuagccuccucca

SEQ ID NO: 1238307 - RNA, 20 nt, Human
ggcugcagugagcugagauc

SEQ ID NO: 1238308 - RNA, 21 nt, Human
ggcugcagugagcugagaucg

SEQ ID NO: 1238309 - RNA, 19 nt, Human
gggaagcugaagaaagacu

SEQ ID NO: 1238310 - RNA, 24 nt, Human
ggguguguuagcgcaugccuguaa

SEQ ID NO: 1238311 - RNA, 24 nt, Human
ggucacgguggcucacaccuguaa

SEQ ID NO: 1238312 - RNA, 23 nt, Human
gguggcucacaccuguaauccca

SEQ ID NO: 1238313 - RNA, 24 nt, Human
gguggcucacaccuguaaucccag

SEQ ID NO: 1238314 - RNA, 26 nt, Human
gucggagguguuccugaaucgguggc

SEQ ID NO: 1238315 - RNA, 23 nt, Human
guggcucacaccuguaaucccag

SEQ ID NO: 1238316 - RNA, 26 nt, Human
guugcaacugcauuaucucauuuaaa

SEQ ID NO: 1238317 - RNA, 19 nt, Human
uaaaaaacaaaccacaaga

SEQ ID NO: 1238318 - RNA, 18 nt, Human
uaaaaauacaaaauuagc

SEQ ID NO: 1238319 - RNA, 19 nt, Human
uaaaaauacaaaauuagcu

SEQ ID NO: 1238320 - RNA, 24 nt, Human
uaaaaucaucaaacgcuaggcugu

SEQ ID NO: 1238321 - RNA, 23 nt, Human
uaagacuguuauucucuccuucc

SEQ ID NO: 1238322 - RNA, 23 nt, Human
uaagaggaauuaaaaaaaaaagc

SEQ ID NO: 1238323 - RNA, 22 nt, Human
uacaacuagauauguacaaaug

SEQ ID NO: 1238324 - RNA, 20 nt, Human
uaccuggcacacaauguagg

SEQ ID NO: 1238325 - RNA, 22 nt, Human
uacuuguggacacacaguugca

SEQ ID NO: 1238326 - RNA, 21 nt, Human
uagaagaagccagaaggaaaa

SEQ ID NO: 1238327 - RNA, 19 nt, Human
uagaggccauguucugcag

SEQ ID NO: 1238328 - RNA, 22 nt, Human
uagcgcaugccuguaaucccag

SEQ ID NO: 1238329 - RNA, 23 nt, Human
uagcugugcccucugucuauaag

SEQ ID NO: 1238330 - RNA, 22 nt, Human
uaugaaagggaagcugaagaaa

SEQ ID NO: 1238331 - RNA, 21 nt, Human
uaugacugcuuacuuccuuug

SEQ ID NO: 1238332 - RNA, 24 nt, Human
uauggcauccugacauggggccug

SEQ ID NO: 1238333 - RNA, 27 nt, Human
uauggcauccugacauggggccugucu

SEQ ID NO: 1238334 - RNA, 22 nt, Human
ucacuugaaccugggaggcagu

SEQ ID NO: 1238335 - RNA, 24 nt, Human
ucagcacaggggaaggguuucaca

SEQ ID NO: 1238336 - RNA, 23 nt, Human
uccaucucaaaaaaaaaaaaaaa

SEQ ID NO: 1238337 - RNA, 21 nt, Human
uccauggggcaggcaggauuc

SEQ ID NO: 1238338 - RNA, 18 nt, Human
ucccagagcccuggccag

SEQ ID NO: 1238339 - RNA, 19 nt, Human
ucccagagcccuggccaga

SEQ ID NO: 1238340 - RNA, 23 nt, Human
ucgcgccauugcacuccagccug

SEQ ID NO: 1238341 - RNA, 21 nt, Human
ucggagguguuccugaaucgg

SEQ ID NO: 1238342 - RNA, 25 nt, Human
ucgggaggcugaggcaggagaauca

SEQ ID NO: 1238343 - RNA, 18 nt, Human
ucucaagauaauaaguuc

SEQ ID NO: 1238344 - RNA, 20 nt, Human
ucucuacuaaaaauacaaaa

SEQ ID NO: 1238345 - RNA, 22 nt, Human
ucugcagugggagagcaauggg

SEQ ID NO: 1238346 - RNA, 22 nt, Human
ucuggacaaagucuucaauggc

SEQ ID NO: 1238347 - RNA, 23 nt, Human
ucuucagugcgauacacucugau

SEQ ID NO: 1238348 - RNA, 18 nt, Human
ucuugacaucauuuccac

SEQ ID NO: 1238349 - RNA, 25 nt, Human
ugaaaaguagcaaaaugacaguuga

SEQ ID NO: 1238350 - RNA, 19 nt, Human
ugaaccugggaggcagugg

SEQ ID NO: 1238351 - RNA, 24 nt, Human
ugaaccugggaggcaguggcugca

SEQ ID NO: 1238352 - RNA, 18 nt, Human
ugacauggggccugucuc

SEQ ID NO: 1238353 - RNA, 21 nt, Human
ugagacaauguguaugaaagc

SEQ ID NO: 1238354 - RNA, 24 nt, Human
ugagaucgcgccauugcacuccag

SEQ ID NO: 1238355 - RNA, 22 nt, Human
ugagcugagaucgcgccauugc

SEQ ID NO: 1238356 - RNA, 20 nt, Human
ugaggcaggagaaucacuug

SEQ ID NO: 1238357 - RNA, 24 nt, Human
ugaggcaggagaaucacuugaacc

SEQ ID NO: 1238358 - RNA, 25 nt, Human
ugaggcaggagaaucacuugaaccu

SEQ ID NO: 1238359 - RNA, 20 nt, Human
ugagguaaagugauagugag

SEQ ID NO: 1238360 - RNA, 21 nt, Human
ugaggugggaguucgagacca

SEQ ID NO: 1238361 - RNA, 24 nt, Human
ugaguuaaucaaaucacuggagaa

SEQ ID NO: 1238362 - RNA, 19 nt, Human
ugcacuccagccugggcaa

SEQ ID NO: 1238363 - RNA, 22 nt, Human
ugcacuccagccugggcaacaa

SEQ ID NO: 1238364 - RNA, 24 nt, Human
ugccuguaaucccagcuacucggg

SEQ ID NO: 1238365 - RNA, 18 nt, Human
uggaccgugcagagcgca

SEQ ID NO: 1238366 - RNA, 21 nt, Human
uggcaauuggagccaggguug

SEQ ID NO: 1238367 - RNA, 22 nt, Human
uggcaauuggagccaggguugu

SEQ ID NO: 1238368 - RNA, 18 nt, Human
uggcauaaaacacaucca

SEQ ID NO: 1238369 - RNA, 20 nt, Human
uggcauuaaucuagaggcca

SEQ ID NO: 1238370 - RNA, 21 nt, Human
uggcucacaccuguaauccca

SEQ ID NO: 1238371 - RNA, 22 nt, Human
uggcucacaccuguaaucccag

SEQ ID NO: 1238372 - RNA, 24 nt, Human
uggcucacaccuguaaucccagca

SEQ ID NO: 1238373 - RNA, 19 nt, Human
ugggaggcaguggcugcag

SEQ ID NO: 1238374 - RNA, 19 nt, Human
ugggaggcugaggugggag

SEQ ID NO: 1238375 - RNA, 23 nt, Human
ugggaggcugaggugggaguucg

SEQ ID NO: 1238376 - RNA, 18 nt, Human
uggguaauacugugcucc

SEQ ID NO: 1238377 - RNA, 19 nt, Human
uguaauagaagaagccaga

SEQ ID NO: 1238378 - RNA, 24 nt, Human
uguaauagaagaagccagaaggaa

SEQ ID NO: 1238379 - RNA, 24 nt, Human
ugucaaugaugaauucagaugcca

SEQ ID NO: 1238380 - RNA, 18 nt, Human
ugucgaacauggagaaac

SEQ ID NO: 1238381 - RNA, 24 nt, Human
ugugaagaaugaaguuccgucaug

SEQ ID NO: 1238382 - RNA, 24 nt, Human
uguuagcgcaugccuguaauccca

SEQ ID NO: 1238383 - RNA, 21 nt, Human
uuagcgcaugccuguaauccc

SEQ ID NO: 1238384 - RNA, 24 nt, Human
uuagcuggguguguuagcgcaugc

SEQ ID NO: 1238385 - RNA, 24 nt, Human
uuauauaaucauuuuugcgcugcu

SEQ ID NO: 1238386 - RNA, 18 nt, Human
uucagccuugcccugagu

SEQ ID NO: 1238387 - RNA, 20 nt, Human
uuccugaaucgguggcauua

SEQ ID NO: 1238388 - RNA, 22 nt, Human
uugagacaauguguaugaaagc

SEQ ID NO: 1238389 - RNA, 21 nt, Human
uuggauauuagaaaaaucugu

SEQ ID NO: 1238390 - RNA, 22 nt, Human
uuggauauuagaaaaaucuguu

SEQ ID NO: 1238391 - RNA, 19 nt, Human
uugugaagaaugaaguucc

SEQ ID NO: 1238392 - RNA, 22 nt, Human
uuugucaaacauuuauggagua

SEQ ID NO: 1238393 - RNA, 23 nt, Human
uuuugugggaaggauaccaaagu

SEQ ID NO: 1238394 - RNA, 18 nt, Human
gagcggcuuuauuuauaa

SEQ ID NO: 1238395 - RNA, 20 nt, Human
aaaaguccugugaccggaca

SEQ ID NO: 1238396 - RNA, 25 nt, Human
acuccagccugggugacaagaguga

SEQ ID NO: 1238397 - RNA, 24 nt, Human
agacugaggcaggagaauaucuug

SEQ ID NO: 1238398 - RNA, 22 nt, Human
agagguugcagugagcugagau

SEQ ID NO: 1238399 - RNA, 24 nt, Human
agagguugcagugagcugagaucg

SEQ ID NO: 1238400 - RNA, 24 nt, Human
aggagucagagguugcagugagcu

SEQ ID NO: 1238401 - RNA, 21 nt, Human
aggauguugacagcugggaau

SEQ ID NO: 1238402 - RNA, 22 nt, Human
aggcagagggagggagcgcggg

SEQ ID NO: 1238403 - RNA, 24 nt, Human
aggcagagggagggagcgcggggc

SEQ ID NO: 1238404 - RNA, 18 nt, Human
aggcaggagaauaucuug

SEQ ID NO: 1238405 - RNA, 24 nt, Human
aggcaggagaauaucuugaaccca

SEQ ID NO: 1238406 - RNA, 24 nt, Human
agucagagguugcagugagcugag

SEQ ID NO: 1238407 - RNA, 24 nt, Human
aucgagccauugcacuccagccug

SEQ ID NO: 1238408 - RNA, 21 nt, Human
auugcacuccagccuggguga

SEQ ID NO: 1238409 - RNA, 20 nt, Human
caagguccacuucucacucu

SEQ ID NO: 1238410 - RNA, 23 nt, Human
cacuccagccugggugacaagag

SEQ ID NO: 1238411 - RNA, 23 nt, Human
cacuccagccugggugacaagag

SEQ ID NO: 1238412 - RNA, 25 nt, Human
cacuccagccugggugacaagagug

SEQ ID NO: 1238413 - RNA, 20 nt, Human
cacucuuuacagacuguucu

SEQ ID NO: 1238414 - RNA, 23 nt, Human
cagagggcaaaaaguccugugac

SEQ ID NO: 1238415 - RNA, 28 nt, Human
caguggauuucucuucuuuccugagcuu

SEQ ID NO: 1238416 - RNA, 19 nt, Human
cauugcacuccagccuggg

SEQ ID NO: 1238417 - RNA, 19 nt, Human
cauugcacuccagccuggg

SEQ ID NO: 1238418 - RNA, 21 nt, Human
cauugcacuccagccugggug

SEQ ID NO: 1238419 - RNA, 22 nt, Human
cauugcacuccagccuggguga

SEQ ID NO: 1238420 - RNA, 24 nt, Human
cauugcacuccagccugggugaca

SEQ ID NO: 1238421 - RNA, 25 nt, Human
cauugcacuccagccugggugacaa

SEQ ID NO: 1238422 - RNA, 19 nt, Human
ccaggagucagagguugca

SEQ ID NO: 1238423 - RNA, 18 nt, Human
ccauugcacuccagccug

SEQ ID NO: 1238424 - RNA, 20 nt, Human
ccauugcacuccagccuggg

SEQ ID NO: 1238425 - RNA, 21 nt, Human
ccauugcacuccagccugggu

SEQ ID NO: 1238426 - RNA, 21 nt, Human
ccauugcacuccagccugggu

SEQ ID NO: 1238427 - RNA, 22 nt, Human
ccauugcacuccagccugggug

SEQ ID NO: 1238428 - RNA, 23 nt, Human
ccauugcacuccagccuggguga

SEQ ID NO: 1238429 - RNA, 24 nt, Human
ccauugcacuccagccugggugac

SEQ ID NO: 1238430 - RNA, 24 nt, Human
ccgccugagggacccgggaacaga

SEQ ID NO: 1238431 - RNA, 23 nt, Human
ccugugaccggacagagcagagc

SEQ ID NO: 1238432 - RNA, 24 nt, Human
cugggaaugaaaggcagagggagg

SEQ ID NO: 1238433 - RNA, 18 nt, Human
gacccgggaacagagggc

SEQ ID NO: 1238434 - RNA, 23 nt, Human
gagaucgagccauugcacuccag

SEQ ID NO: 1238435 - RNA, 22 nt, Human
gcaggagaauaucuugaaccca

SEQ ID NO: 1238436 - RNA, 19 nt, Human
gccauugcacuccagccug

SEQ ID NO: 1238437 - RNA, 24 nt, Human
gccauugcacuccagccuggguga

SEQ ID NO: 1238438 - RNA, 23 nt, Human
gccuguaauaccagcuacucggg

SEQ ID NO: 1238439 - RNA, 22 nt, Human
ggagucagagguugcagugagc

SEQ ID NO: 1238440 - RNA, 21 nt, Human
gggaaugaaaggcagagggag

SEQ ID NO: 1238441 - RNA, 24 nt, Human
gggaaugaaaggcagagggaggga

SEQ ID NO: 1238442 - RNA, 22 nt, Human
guccaagguccacuucucacuc

SEQ ID NO: 1238443 - RNA, 19 nt, Human
guugcagugagcugagauc

SEQ ID NO: 1238444 - RNA, 22 nt, Human
uacagacuguucucaguggauu

SEQ ID NO: 1238445 - RNA, 18 nt, Human
ucaguggauuucucuucu

SEQ ID NO: 1238446 - RNA, 24 nt, Human
uccagccugggugacaagagugag

SEQ ID NO: 1238447 - RNA, 25 nt, Human
uccagccugggugacaagagugaga

SEQ ID NO: 1238448 - RNA, 18 nt, Human
uccaggauguugacagcu

SEQ ID NO: 1238449 - RNA, 23 nt, Human
ucucacucuuuacagacuguucu

SEQ ID NO: 1238450 - RNA, 21 nt, Human
ugaaaggcagagggagggagc

SEQ ID NO: 1238451 - RNA, 24 nt, Human
ugacagcugggaaugaaaggcaga

SEQ ID NO: 1238452 - RNA, 24 nt, Human
ugaggcaggagaauaucuugaacc

SEQ ID NO: 1238453 - RNA, 25 nt, Human
ugaggcaggagaauaucuugaaccc

SEQ ID NO: 1238454 - RNA, 22 nt, Human
ugcacuccagccugggugacaa

SEQ ID NO: 1238455 - RNA, 23 nt, Human
ugcacuccagccugggugacaag

SEQ ID NO: 1238456 - RNA, 23 nt, Human
uucaaagcuuccaggauguugac

SEQ ID NO: 1238457 - RNA, 22 nt, Human
uuccugagcuucaaagcuucca

SEQ ID NO: 1238458 - RNA, 18 nt, Human
uugaacccaggagucaga

SEQ ID NO: 1238459 - RNA, 19 nt, Human
uugcagugagcugagaucg

SEQ ID NO: 1238460 - RNA, 22 nt, Human
uugcagugagcugagaucgagc

SEQ ID NO: 1238461 - RNA, 21 nt, Human
uuucucuucuuuccugagcuu

SEQ ID NO: 1238462 - RNA, 20 nt, Human
aacccagcccaucacuuugg

SEQ ID NO: 1238463 - RNA, 21 nt, Human
acccaggcuggagugcagugu

SEQ ID NO: 1238464 - RNA, 18 nt, Human
accugcugggggcacagg

SEQ ID NO: 1238465 - RNA, 18 nt, Human
acucugucacccaggcug

SEQ ID NO: 1238466 - RNA, 21 nt, Human
acucugucacccaggcuggag

SEQ ID NO: 1238467 - RNA, 25 nt, Human
acucugucacccaggcuggagugca

SEQ ID NO: 1238468 - RNA, 19 nt, Human
acugcagccucgacuuccu

SEQ ID NO: 1238469 - RNA, 19 nt, Human
aggcgcugggugggaguuc

SEQ ID NO: 1238470 - RNA, 22 nt, Human
aggcugcagccacccauccccu

SEQ ID NO: 1238471 - RNA, 25 nt, Human
aggcuggagugcaguguugcgaucu

SEQ ID NO: 1238472 - RNA, 21 nt, Human
agugcaguguugcgaucucag

SEQ ID NO: 1238473 - RNA, 30 nt, Human
auccuccaaccucagccuccugaguagcuu

SEQ ID NO: 1238474 - RNA, 23 nt, Human
auguggcuggacgcgguggcuca

SEQ ID NO: 1238475 - RNA, 24 nt, Human
caaaaaaagucaaauguggcugga

SEQ ID NO: 1238476 - RNA, 18 nt, Human
caaccucagccuccugag

SEQ ID NO: 1238477 - RNA, 25 nt, Human
caaccucagccuccugaguagcugg

SEQ ID NO: 1238478 - RNA, 20 nt, Human
caccuccaucugggagcagg

SEQ ID NO: 1238479 - RNA, 23 nt, Human
caccuccaucugggagcaggaug

SEQ ID NO: 1238480 - RNA, 24 nt, Human
cacgccuguaaucccagcacuuug

SEQ ID NO: 1238481 - RNA, 19 nt, Human
cacugcagccucgacuucc

SEQ ID NO: 1238482 - RNA, 24 nt, Human
cagaaaagacugacaccaccaagu

SEQ ID NO: 1238483 - RNA, 20 nt, Human
cagccuccugaguagcuggg

SEQ ID NO: 1238484 - RNA, 24 nt, Human
cagccucgacuuccuaggcucaag

SEQ ID NO: 1238485 - RNA, 19 nt, Human
caguccugggacucguggg

SEQ ID NO: 1238486 - RNA, 20 nt, Human
caucugggagcaggaugagg

SEQ ID NO: 1238487 - RNA, 22 nt, Human
ccacugccugcaccuccaucug

SEQ ID NO: 1238488 - RNA, 20 nt, Human
ccagcagcacuggccuccuc

SEQ ID NO: 1238489 - RNA, 22 nt, Human
cccacuugaaaggcugagacag

SEQ ID NO: 1238490 - RNA, 19 nt, Human
ccccagggcugccgccuuc

SEQ ID NO: 1238491 - RNA, 22 nt, Human
cccccuuccccaucugucuucc

SEQ ID NO: 1238492 - RNA, 20 nt, Human
ccuaggcucaagccauccuc

SEQ ID NO: 1238493 - RNA, 19 nt, Human
ccucagccuccugaguagc

SEQ ID NO: 1238494 - RNA, 24 nt, Human
ccuccaaccucagccuccugagua

SEQ ID NO: 1238495 - RNA, 19 nt, Human
ccucgacuuccuaggcuca

SEQ ID NO: 1238496 - RNA, 20 nt, Human
ccucgacuuccuaggcucaa

SEQ ID NO: 1238497 - RNA, 19 nt, Human
ccugcaccuccaucuggga

SEQ ID NO: 1238498 - RNA, 22 nt, Human
ccugcaccuccaucugggagca

SEQ ID NO: 1238499 - RNA, 20 nt, Human
ccugcucaguccugggacuc

SEQ ID NO: 1238500 - RNA, 22 nt, Human
ccuguaaucccagcacuuuggg

SEQ ID NO: 1238501 - RNA, 22 nt, Human
cucacgccuguaaucccagcac

SEQ ID NO: 1238502 - RNA, 24 nt, Human
cucacgccuguaaucccagcacuu

SEQ ID NO: 1238503 - RNA, 24 nt, Human
cucagccuccugaguagcugggac

SEQ ID NO: 1238504 - RNA, 24 nt, Human
cuccaaccucagccuccugaguag

SEQ ID NO: 1238505 - RNA, 25 nt, Human
cuccaaccucagccuccugaguagc

SEQ ID NO: 1238506 - RNA, 20 nt, Human
cuccucacugagcuuggucc

SEQ ID NO: 1238507 - RNA, 23 nt, Human
cugcagccucgacuuccuaggcu

SEQ ID NO: 1238508 - RNA, 23 nt, Human
gaagggcaggaaaccacugggag

SEQ ID NO: 1238509 - RNA, 21 nt, Human
gaccacugccugcaccuccau

SEQ ID NO: 1238510 - RNA, 19 nt, Human
gccucgacuuccuaggcuc

SEQ ID NO: 1238511 - RNA, 24 nt, Human
gcuaguuucuucaaaaaaagucaa

SEQ ID NO: 1238512 - RNA, 24 nt, Human
ggacgcgguggcucacgccuguaa

SEQ ID NO: 1238513 - RNA, 20 nt, Human
ggagcaggaugagggaaggg

SEQ ID NO: 1238514 - RNA, 23 nt, Human
gguggcucacgccuguaauccca

SEQ ID NO: 1238515 - RNA, 24 nt, Human
gguggcucacgccuguaaucccag

SEQ ID NO: 1238516 - RNA, 23 nt, Human
gugaggauguggagccacagggg

SEQ ID NO: 1238517 - RNA, 23 nt, Human
guggcuggacgcgguggcucacg

SEQ ID NO: 1238518 - RNA, 19 nt, Human
guucaccgcccccuucccc

SEQ ID NO: 1238519 - RNA, 24 nt, Human
ucacccaggcuggagugcaguguu

SEQ ID NO: 1238520 - RNA, 22 nt, Human
ucaccgcccccuuccccaucug

SEQ ID NO: 1238521 - RNA, 19 nt, Human
ucacugcagccucgacuuc

SEQ ID NO: 1238522 - RNA, 23 nt, Human
ucacugcagccucgacuuccuag

SEQ ID NO: 1238523 - RNA, 24 nt, Human
ucacugcagccucgacuuccuagg

SEQ ID NO: 1238524 - RNA, 23 nt, Human
ucagccuccugaguagcugggac

SEQ ID NO: 1238525 - RNA, 20 nt, Human
ucaguccugggacucguggg

SEQ ID NO: 1238526 - RNA, 22 nt, Human
ucccugcuccagugucugagga

SEQ ID NO: 1238527 - RNA, 18 nt, Human
uccuaggcucaagccauc

SEQ ID NO: 1238528 - RNA, 19 nt, Human
uccuccaaccucagccucc

SEQ ID NO: 1238529 - RNA, 24 nt, Human
uccugaguagcugggaccccuggc

SEQ ID NO: 1238530 - RNA, 21 nt, Human
ucgugggguggagcauucacc

SEQ ID NO: 1238531 - RNA, 19 nt, Human
ucuccccagggcugccgcc

SEQ ID NO: 1238532 - RNA, 24 nt, Human
ucugacucugucacccaggcugga

SEQ ID NO: 1238533 - RNA, 22 nt, Human
ucugaggaggacuugagcauag

SEQ ID NO: 1238534 - RNA, 21 nt, Human
ucugccagugccucccugcuc

SEQ ID NO: 1238535 - RNA, 24 nt, Human
ucugucacccaggcuggagugcag

SEQ ID NO: 1238536 - RNA, 26 nt, Human
ugaaaggcugagacagaaaagacuga

SEQ ID NO: 1238537 - RNA, 24 nt, Human
ugacucugucacccaggcuggagu

SEQ ID NO: 1238538 - RNA, 22 nt, Human
ugaggauguggagccacagggg

SEQ ID NO: 1238539 - RNA, 22 nt, Human
ugagggaagggcaggaaaccac

SEQ ID NO: 1238540 - RNA, 22 nt, Human
ugcaguguugcgaucucagcuc

SEQ ID NO: 1238541 - RNA, 19 nt, Human
ugccagugccucccugcuc

SEQ ID NO: 1238542 - RNA, 23 nt, Human
ugccugcaccuccaucugggagc

SEQ ID NO: 1238543 - RNA, 19 nt, Human
uggagugcaguguugcgau

SEQ ID NO: 1238544 - RNA, 19 nt, Human
uggagugcaguguugcgau

SEQ ID NO: 1238545 - RNA, 23 nt, Human
uggagugcaguguugcgaucuca

SEQ ID NO: 1238546 - RNA, 21 nt, Human
uggcagaggcaccaucgaggc

SEQ ID NO: 1238547 - RNA, 20 nt, Human
uggccuccucacugagcuug

SEQ ID NO: 1238548 - RNA, 22 nt, Human
uggcucacgccuguaaucccag

SEQ ID NO: 1238549 - RNA, 24 nt, Human
uggcucacgccuguaaucccagca

SEQ ID NO: 1238550 - RNA, 20 nt, Human
uggcucuccgcuccagcagc

SEQ ID NO: 1238551 - RNA, 20 nt, Human
ugggaggcgcugggugggag

SEQ ID NO: 1238552 - RNA, 24 nt, Human
ugggaggcgcugggugggaguucg

SEQ ID NO: 1238553 - RNA, 24 nt, Human
uguugcgaucucagcucacugcag

SEQ ID NO: 1238554 - RNA, 25 nt, Human
uuccagugauuccuccagaggcugc

SEQ ID NO: 1238555 - RNA, 24 nt, Human
uuccuaggcucaagccauccucca

SEQ ID NO: 1238556 - RNA, 23 nt, Human
aagaucaagguuagucaguuuuu

SEQ ID NO: 1238557 - RNA, 21 nt, Human
acaccaaaaggcagacguccu

SEQ ID NO: 1238558 - RNA, 25 nt, Human
acaccaaaaggcagacguccugaac

SEQ ID NO: 1238559 - RNA, 19 nt, Human
caccaaaaggcagacgucc

SEQ ID NO: 1238560 - RNA, 21 nt, Human
caccagugccacccuguggca

SEQ ID NO: 1238561 - RNA, 20 nt, Human
gucccagccagaaguggggc

SEQ ID NO: 1238562 - RNA, 24 nt, Human
uaagccucgugucugggaaacaau

SEQ ID NO: 1238563 - RNA, 19 nt, Human
uccgacaccaaaaggcaga

SEQ ID NO: 1238564 - RNA, 20 nt, Human
uccugaacuucuaguaagcc

SEQ ID NO: 1238565 - RNA, 22 nt, Human
uccugaacuucuaguaagccuc

SEQ ID NO: 1238566 - RNA, 19 nt, Human
ugaccauugauaagugaua

SEQ ID NO: 1238567 - RNA, 18 nt, Human
aaacaugcuuuauuuguu

SEQ ID NO: 1238568 - RNA, 22 nt, Human
aaaguuuacuuaguuuucuaaa

SEQ ID NO: 1238569 - RNA, 25 nt, Human
accccgguuccuucagaaccucagg

SEQ ID NO: 1238570 - RNA, 18 nt, Human
auaaagcgucuugagccc

SEQ ID NO: 1238571 - RNA, 23 nt, Human
auuucaaccaugcaguauguugc

SEQ ID NO: 1238572 - RNA, 21 nt, Human
cagcggccucgaggucccggu

SEQ ID NO: 1238573 - RNA, 22 nt, Human
ccccagcagcggccucgagguc

SEQ ID NO: 1238574 - RNA, 25 nt, Human
cccgcagaguccgcagaaggaggcg

SEQ ID NO: 1238575 - RNA, 19 nt, Human
ccggucgccagcaccccgg

SEQ ID NO: 1238576 - RNA, 18 nt, Human
ccuccccagcagcggccu

SEQ ID NO: 1238577 - RNA, 20 nt, Human
ccucgggagccgagggugag

SEQ ID NO: 1238578 - RNA, 22 nt, Human
cgaggucccggucgccagcacc

SEQ ID NO: 1238579 - RNA, 23 nt, Human
cgccuccgcccccugcacgcugg

SEQ ID NO: 1238580 - RNA, 19 nt, Human
cguguggcgggaaccccgg

SEQ ID NO: 1238581 - RNA, 21 nt, Human
cugccggggagggucccgcag

SEQ ID NO: 1238582 - RNA, 19 nt, Human
cuggccagcguccucccca

SEQ ID NO: 1238583 - RNA, 24 nt, Human
gcaguauguugcuucuggggucug

SEQ ID NO: 1238584 - RNA, 19 nt, Human
gccagcguccuccccagca

SEQ ID NO: 1238585 - RNA, 18 nt, Human
gccccgccuccgcccccu

SEQ ID NO: 1238586 - RNA, 20 nt, Human
gcggcggcggagcggcggcc

SEQ ID NO: 1238587 - RNA, 19 nt, Human
gcggcggcggcggagcggc

SEQ ID NO: 1238588 - RNA, 23 nt, Human
ggcgggagaugggagccucccgg

SEQ ID NO: 1238589 - RNA, 20 nt, Human
ggguugugcggggcgggaga

SEQ ID NO: 1238590 - RNA, 22 nt, Human
gguuuuguuaccgggcggcagg

SEQ ID NO: 1238591 - RNA, 18 nt, Human
gugcggggcgggagaugg

SEQ ID NO: 1238592 - RNA, 22 nt, Human
uaaagcgucuugagcccuaccg

SEQ ID NO: 1238593 - RNA, 20 nt, Human
uccgcccccugcacgcuggc

SEQ ID NO: 1238594 - RNA, 24 nt, Human
ucgccgauaaagcgucuugagccc

SEQ ID NO: 1238595 - RNA, 18 nt, Human
ugcccggguugugcgggg

SEQ ID NO: 1238596 - RNA, 18 nt, Human
uggccagcguccucccca

SEQ ID NO: 1238597 - RNA, 23 nt, Human
uugugcggggcgggagaugggag

SEQ ID NO: 1238598 - RNA, 25 nt, Human
aaacauauacaaauaucaaauacaa

SEQ ID NO: 1238599 - RNA, 22 nt, Human
aagucaaaaaaguucagauuca

SEQ ID NO: 1238600 - RNA, 20 nt, Human
acaaaaaccaagaaaaccaa

SEQ ID NO: 1238601 - RNA, 25 nt, Human
agaaauaaauagggaaaaaauaugc

SEQ ID NO: 1238602 - RNA, 18 nt, Human
agaauaaagacacaauca

SEQ ID NO: 1238603 - RNA, 21 nt, Human
agaggucauccuauaugugug

SEQ ID NO: 1238604 - RNA, 19 nt, Human
aggaagaaaaaaagcuuuc

SEQ ID NO: 1238605 - RNA, 21 nt, Human
aguucagauucauacauuucc

SEQ ID NO: 1238606 - RNA, 24 nt, Human
auagcaaucaaacauauacaaaua

SEQ ID NO: 1238607 - RNA, 20 nt, Human
auguuuguuaacucuuuuau

SEQ ID NO: 1238608 - RNA, 27 nt, Human
cacaaaaaccaagaaaaccaagaaaaa

SEQ ID NO: 1238609 - RNA, 21 nt, Human
caccacuggcaaccuuaaagu

SEQ ID NO: 1238610 - RNA, 22 nt, Human
cacucgcgcccaaagccgaaag

SEQ ID NO: 1238611 - RNA, 22 nt, Human
cccgagaagccgaaccgacacc

SEQ ID NO: 1238612 - RNA, 21 nt, Human
ccuuaaaguuaccucccuugg

SEQ ID NO: 1238613 - RNA, 24 nt, Human
cucaaaaaguaauagcacagagcc

SEQ ID NO: 1238614 - RNA, 20 nt, Human
gaagccgaaccgacaccaac

SEQ ID NO: 1238615 - RNA, 22 nt, Human
gaagccgaaccgacaccaacug

SEQ ID NO: 1238616 - RNA, 19 nt, Human
gaccgcggaauccgacccg

SEQ ID NO: 1238617 - RNA, 18 nt, Human
gagaagccgaaccgacac

SEQ ID NO: 1238618 - RNA, 18 nt, Human
guacauguacaaaauaug

SEQ ID NO: 1238619 - RNA, 23 nt, Human
guagacaacuuagccuaacggag

SEQ ID NO: 1238620 - RNA, 23 nt, Human
uaaaaaaaaaaucaaacaaguac

SEQ ID NO: 1238621 - RNA, 22 nt, Human
uaauagcacagagccauaaauc

SEQ ID NO: 1238622 - RNA, 25 nt, Human
uacaaauaucaaauacaaacacugu

SEQ ID NO: 1238623 - RNA, 25 nt, Human
uacauguacaaaauaugacauaaga

SEQ ID NO: 1238624 - RNA, 19 nt, Human
ucaaaaaaguucagauuca

SEQ ID NO: 1238625 - RNA, 19 nt, Human
ucaaacaaguacaaaaaau

SEQ ID NO: 1238626 - RNA, 22 nt, Human
ucacaaaaaccaagaaaaccaa

SEQ ID NO: 1238627 - RNA, 24 nt, Human
uccuagagaaacaaugacagucuu

SEQ ID NO: 1238628 - RNA, 21 nt, Human
ugauaaggcacuuuaaagaua

SEQ ID NO: 1238629 - RNA, 25 nt, Human
ugcaaaagcaguaaccacagaaaua

SEQ ID NO: 1238630 - RNA, 18 nt, Human
ugcaaagcucaaaaagua

SEQ ID NO: 1238631 - RNA, 21 nt, Human
ugcuggggauauagaauaaag

SEQ ID NO: 1238632 - RNA, 24 nt, Human
ugugacccuguuuuaggugcuggg

SEQ ID NO: 1238633 - RNA, 23 nt, Human
uuagugaauguugugugacccug

SEQ ID NO: 1238634 - RNA, 26 nt, Human
uucacaaaaaccaagaaaaccaagaa

SEQ ID NO: 1238635 - RNA, 23 nt, Human
uucauacauuuccuagagaaaca

SEQ ID NO: 1238636 - RNA, 21 nt, Human
uucauucugaguauauacaga

SEQ ID NO: 1238637 - RNA, 20 nt, Human
uugcaaagcucaaaaaguaa

SEQ ID NO: 1238638 - RNA, 24 nt, Human
uuuagugaauguugugugacccug

SEQ ID NO: 1238639 - RNA, 20 nt, Human
acugagcagcuguauucuuu

SEQ ID NO: 1238640 - RNA, 18 nt, Human
aaaacucucccauucucc

SEQ ID NO: 1238641 - RNA, 23 nt, Human
agcccuggacuaaaacucuccca

SEQ ID NO: 1238642 - RNA, 19 nt, Human
cacuaggcacauacccaac

SEQ ID NO: 1238643 - RNA, 22 nt, Human
uaaaacucucccauucuccaga

SEQ ID NO: 1238644 - RNA, 21 nt, Human
uaccagauauuuaauucucau

SEQ ID NO: 1238645 - RNA, 21 nt, Human
uaggauauccugguaggugaa

SEQ ID NO: 1238646 - RNA, 22 nt, Human
uaggcacauacccaaccagccc

SEQ ID NO: 1238647 - RNA, 19 nt, Human
ucaaaacaaagagugcaca

SEQ ID NO: 1238648 - RNA, 23 nt, Human
uugccauagacuaccagauauuu

SEQ ID NO: 1238649 - RNA, 18 nt, Human
cacuggucuugaaggcac

SEQ ID NO: 1238650 - RNA, 21 nt, Human
cuggggugucagcacucugca

SEQ ID NO: 1238651 - RNA, 21 nt, Human
gggagcuggacagccuggacc

SEQ ID NO: 1238652 - RNA, 23 nt, Human
aaaaagcaggguggcuaaggaua

SEQ ID NO: 1238653 - RNA, 20 nt, Human
aaaacaggagagcagcgagc

SEQ ID NO: 1238654 - RNA, 18 nt, Human
aaccaugauuacaaauuc

SEQ ID NO: 1238655 - RNA, 24 nt, Human
aagaaagaggacuugagaaaaugu

SEQ ID NO: 1238656 - RNA, 21 nt, Human
aggaggaaaaaagcagggugg

SEQ ID NO: 1238657 - RNA, 25 nt, Human
aggauaaagaaagaggacuugagaa

SEQ ID NO: 1238658 - RNA, 19 nt, Human
agugcugaagaggggaggg

SEQ ID NO: 1238659 - RNA, 19 nt, Human
caaagugcagaaucauuca

SEQ ID NO: 1238660 - RNA, 19 nt, Human
cccccuugggguccuacgc

SEQ ID NO: 1238661 - RNA, 22 nt, Human
cccccuugggguccuacgccuu

SEQ ID NO: 1238662 - RNA, 25 nt, Human
ccggugccgcugucccgagcggcuc

SEQ ID NO: 1238663 - RNA, 18 nt, Human
ccucucgccucccccuuu

SEQ ID NO: 1238664 - RNA, 24 nt, Human
ccuucuggcacgcggcuccuccaa

SEQ ID NO: 1238665 - RNA, 18 nt, Human
cgagaggguccugggucc

SEQ ID NO: 1238666 - RNA, 19 nt, Human
cgcagagcggcgaagggag

SEQ ID NO: 1238667 - RNA, 23 nt, Human
cgccucccccuuuggugggguua

SEQ ID NO: 1238668 - RNA, 19 nt, Human
cggccucgcagagcggcga

SEQ ID NO: 1238669 - RNA, 21 nt, Human
cuccgauuuuuuaaaaaagga

SEQ ID NO: 1238670 - RNA, 25 nt, Human
cuccuuguccccccuugggguccua

SEQ ID NO: 1238671 - RNA, 21 nt, Human
gcagcgagcaaaagcaaagau

SEQ ID NO: 1238672 - RNA, 21 nt, Human
gcggcgaagggagacucggga

SEQ ID NO: 1238673 - RNA, 18 nt, Human
ggagagcagcgagcaaaa

SEQ ID NO: 1238674 - RNA, 21 nt, Human
guccuccuuguccccccuugg

SEQ ID NO: 1238675 - RNA, 18 nt, Human
uaaaaaaggaggaaaaaa

SEQ ID NO: 1238676 - RNA, 23 nt, Human
uacaaauucuguggcugaggcaa

SEQ ID NO: 1238677 - RNA, 24 nt, Human
uacaaauucuguggcugaggcaaa

SEQ ID NO: 1238678 - RNA, 18 nt, Human
uacgccuucuggcacgcg

SEQ ID NO: 1238679 - RNA, 26 nt, Human
uagaaaucacuguuuucccuuuuccc

SEQ ID NO: 1238680 - RNA, 19 nt, Human
ucaguccaccgcuucggcc

SEQ ID NO: 1238681 - RNA, 22 nt, Human
ucagugcuguuuacaaagugca

SEQ ID NO: 1238682 - RNA, 23 nt, Human
ucaguguugaaauggacgaaggu

SEQ ID NO: 1238683 - RNA, 23 nt, Human
uccaaauguaggaaccacggauc

SEQ ID NO: 1238684 - RNA, 23 nt, Human
uccuccggugccgcugucccgag

SEQ ID NO: 1238685 - RNA, 21 nt, Human
ucuggcacgcggcuccuccaa

SEQ ID NO: 1238686 - RNA, 23 nt, Human
ucuguggcugaggcaaauguuuu

SEQ ID NO: 1238687 - RNA, 19 nt, Human
ugaaaaacaggagagcagc

SEQ ID NO: 1238688 - RNA, 20 nt, Human
ugaaauggacgaagguagug

SEQ ID NO: 1238689 - RNA, 20 nt, Human
uggcuccucucgccuccccc

SEQ ID NO: 1238690 - RNA, 20 nt, Human
uggcugaggcaaauguuuuc

SEQ ID NO: 1238691 - RNA, 19 nt, Human
ugucgagaggguccugggu

SEQ ID NO: 1238692 - RNA, 18 nt, Human
uguggagaaugaaaaaca

SEQ ID NO: 1238693 - RNA, 21 nt, Human
uguuuacaaagugcagaauca

SEQ ID NO: 1238694 - RNA, 26 nt, Human
uuaaaaaaggaggaaaaaagcagggu

SEQ ID NO: 1238695 - RNA, 21 nt, Human
uucaaaaagacuuuuuacgga

SEQ ID NO: 1238696 - RNA, 20 nt, Human
uucccuuuucccccuuuuuc

SEQ ID NO: 1238697 - RNA, 22 nt, Human
uugagaauuuuuaaauaccacu

SEQ ID NO: 1238698 - RNA, 20 nt, Human
uugccuuucaaaaagacuuu

SEQ ID NO: 1238699 - RNA, 20 nt, Human
uuucccuuuucccccuuuuu

SEQ ID NO: 1238700 - RNA, 19 nt, Human
uuuucccuuuucccccuuu

SEQ ID NO: 1238701 - RNA, 18 nt, Human
accuuaaaaagaucagaa

SEQ ID NO: 1238702 - RNA, 20 nt, Human
aggucugcagccgcccgcag

SEQ ID NO: 1238703 - RNA, 23 nt, Human
aggucugcagccgcccgcagccu

SEQ ID NO: 1238704 - RNA, 19 nt, Human
auuccgguccccucccgcc

SEQ ID NO: 1238705 - RNA, 21 nt, Human
cacaggcuauaaauaugaagc

SEQ ID NO: 1238706 - RNA, 25 nt, Human
ccagugaaccuuaaaaagaucagaa

SEQ ID NO: 1238707 - RNA, 23 nt, Human
ccgccgcgugccucucgccgucc

SEQ ID NO: 1238708 - RNA, 24 nt, Human
ccgccgcgugccucucgccguccc

SEQ ID NO: 1238709 - RNA, 22 nt, Human
cggcgggccggucuccgcuccc

SEQ ID NO: 1238710 - RNA, 19 nt, Human
cggcgucgggggcggcggg

SEQ ID NO: 1238711 - RNA, 22 nt, Human
cgggccggucuccgcucccagg

SEQ ID NO: 1238712 - RNA, 18 nt, Human
cuccgagccccggcugcg

SEQ ID NO: 1238713 - RNA, 21 nt, Human
cugcggauuccgguccccucc

SEQ ID NO: 1238714 - RNA, 22 nt, Human
gcggcgucgggggcggcgggcc

SEQ ID NO: 1238715 - RNA, 22 nt, Human
ggcggcgggccggucuccgcuc

SEQ ID NO: 1238716 - RNA, 22 nt, Human
gugaaccuuaaaaagaucagaa

SEQ ID NO: 1238717 - RNA, 25 nt, Human
uaccacaggcuauaaauaugaagca

SEQ ID NO: 1238718 - RNA, 20 nt, Human
ucgccgcccgucguucugcc

SEQ ID NO: 1238719 - RNA, 23 nt, Human
ucgggggcggcgggccggucucc

SEQ ID NO: 1238720 - RNA, 21 nt, Human
ugaagcaauauuucagcaaga

SEQ ID NO: 1238721 - RNA, 21 nt, Human
ugaugguaaaaacuaaaaacc

SEQ ID NO: 1238722 - RNA, 20 nt, Human
ugguuaauacaccagugaac

SEQ ID NO: 1238723 - RNA, 26 nt, Human
aaaaauagacaaguuaugauucagaa

SEQ ID NO: 1238724 - RNA, 18 nt, Human
aaacauagaaggcugaca

SEQ ID NO: 1238725 - RNA, 19 nt, Human
aaggaaaacacaaagccuc

SEQ ID NO: 1238726 - RNA, 25 nt, Human
aauaaaaagacacaagguacaagaa

SEQ ID NO: 1238727 - RNA, 25 nt, Human
aauacuuguuaaagggaucccaaaa

SEQ ID NO: 1238728 - RNA, 24 nt, Human
aauguaaaggcccagguguucaaa

SEQ ID NO: 1238729 - RNA, 20 nt, Human
acaaacugaaaguagcacac

SEQ ID NO: 1238730 - RNA, 19 nt, Human
acaaagccucauucagaug

SEQ ID NO: 1238731 - RNA, 21 nt, Human
acaagacacaaaauugagcag

SEQ ID NO: 1238732 - RNA, 22 nt, Human
acaauucuugaaacugucauaa

SEQ ID NO: 1238733 - RNA, 22 nt, Human
accuacaugucacauccaaggg

SEQ ID NO: 1238734 - RNA, 25 nt, Human
acgccaccucaucaggacuguggac

SEQ ID NO: 1238735 - RNA, 26 nt, Human
agaagugagcacaucacccgccuccu

SEQ ID NO: 1238736 - RNA, 21 nt, Human
agacucccucaggggcugcuu

SEQ ID NO: 1238737 - RNA, 21 nt, Human
agagagaaaggggcaaaugga

SEQ ID NO: 1238738 - RNA, 19 nt, Human
agcaaggauugcaaaagag

SEQ ID NO: 1238739 - RNA, 18 nt, Human
agcuagaaguuggcugag

SEQ ID NO: 1238740 - RNA, 19 nt, Human
aggaccccagaugccucuc

SEQ ID NO: 1238741 - RNA, 24 nt, Human
aggagaacauuaguucuccuuaaa

SEQ ID NO: 1238742 - RNA, 18 nt, Human
aggagagcugaggauucu

SEQ ID NO: 1238743 - RNA, 27 nt, Human
aggcagaaaaauagacaaguuaugagg

SEQ ID NO: 1238744 - RNA, 23 nt, Human
aggguuuuuuugguuuuuguuuu

SEQ ID NO: 1238745 - RNA, 19 nt, Human
aguucagaaggcaaauacu

SEQ ID NO: 1238746 - RNA, 20 nt, Human
augaagaacaauuuuacugg

SEQ ID NO: 1238747 - RNA, 26 nt, Human
augaccagagugaguucagugagcua

SEQ ID NO: 1238748 - RNA, 21 nt, Human
augacucccaccugcacauac

SEQ ID NO: 1238749 - RNA, 21 nt, Human
caacaugaaguuccaggaccc

SEQ ID NO: 1238750 - RNA, 19 nt, Human
cacaaaauugagcagcaaa

SEQ ID NO: 1238751 - RNA, 18 nt, Human
cacaagguacaagaauug

SEQ ID NO: 1238752 - RNA, 18 nt, Human
cacauagaaugucaucuc

SEQ ID NO: 1238753 - RNA, 21 nt, Human
cagagaccuccuguugugcug

SEQ ID NO: 1238754 - RNA, 22 nt, Human
cagcaaggauugcaaaagagaa

SEQ ID NO: 1238755 - RNA, 21 nt, Human
cagcuuccugauuuaggcccu

SEQ ID NO: 1238756 - RNA, 18 nt, Human
caggaugcugcgccgggc

SEQ ID NO: 1238757 - RNA, 18 nt, Human
ccaaacgccaccucauca

SEQ ID NO: 1238758 - RNA, 23 nt, Human
ccuaaagagagaaaggggcaaau

SEQ ID NO: 1238759 - RNA, 22 nt, Human
ccucaucaggacuguggacccc

SEQ ID NO: 1238760 - RNA, 23 nt, Human
cuaccuacaugucacauccaagg

SEQ ID NO: 1238761 - RNA, 21 nt, Human
cucaaugacaugucgcugaaa

SEQ ID NO: 1238762 - RNA, 22 nt, Human
cugcugaauguaguuuaccugu

SEQ ID NO: 1238763 - RNA, 24 nt, Human
cuuccuaccuacaugucacaucca

SEQ ID NO: 1238764 - RNA, 22 nt, Human
gagagcaaggaaaacacaaagc

SEQ ID NO: 1238765 - RNA, 25 nt, Human
gccaccucaucaggacuguggaccc

SEQ ID NO: 1238766 - RNA, 21 nt, Human
ggaucucugaaacauagaagg

SEQ ID NO: 1238767 - RNA, 21 nt, Human
gggaucccaaaagguaggaga

SEQ ID NO: 1238768 - RNA, 21 nt, Human
gguuuuuguuuuguuuuuuua

SEQ ID NO: 1238769 - RNA, 22 nt, Human
gugggcguuggaagaaacagca

SEQ ID NO: 1238770 - RNA, 23 nt, Human
uaaacuaucuuuuuaaaaagugc

SEQ ID NO: 1238771 - RNA, 23 nt, Human
uaacacuccucgagaaaaguucc

SEQ ID NO: 1238772 - RNA, 21 nt, Human
uaaggaauaaaugaagaacaa

SEQ ID NO: 1238773 - RNA, 24 nt, Human
uaaucagaggaaauuauccaaagc

SEQ ID NO: 1238774 - RNA, 23 nt, Human
uagaaaauuaaggaauaaaugaa

SEQ ID NO: 1238775 - RNA, 18 nt, Human
uagaaugucaucucugau

SEQ ID NO: 1238776 - RNA, 20 nt, Human
uagaaugucaucucugaugg

SEQ ID NO: 1238777 - RNA, 23 nt, Human
uaggcccuaaggaaugaagcaga

SEQ ID NO: 1238778 - RNA, 22 nt, Human
uauccaaagcugguuacugacc

SEQ ID NO: 1238779 - RNA, 23 nt, Human
uaucuuuuuaaaaagugcuuugu

SEQ ID NO: 1238780 - RNA, 20 nt, Human
ucacugugucuucuuggcag

SEQ ID NO: 1238781 - RNA, 18 nt, Human
ucagaagugagcacauca

SEQ ID NO: 1238782 - RNA, 21 nt, Human
ucagcagacucccucaggggc

SEQ ID NO: 1238783 - RNA, 18 nt, Human
ucaggacuguggaccccu

SEQ ID NO: 1238784 - RNA, 21 nt, Human
ucaggggcugcuucucuugga

SEQ ID NO: 1238785 - RNA, 21 nt, Human
ucccucaggggcugcuucucu

SEQ ID NO: 1238786 - RNA, 18 nt, Human
uccucgagaaaaguuccu

SEQ ID NO: 1238787 - RNA, 20 nt, Human
ucugaaacauaaaauuaagu

SEQ ID NO: 1238788 - RNA, 21 nt, Human
ucuuggcaggcagagcuuacu

SEQ ID NO: 1238789 - RNA, 24 nt, Human
ugaaaaggaacaugcaagagagca

SEQ ID NO: 1238790 - RNA, 24 nt, Human
ugacaagcaagggaauuucagcug

SEQ ID NO: 1238791 - RNA, 20 nt, Human
ugaccagaccuggccaugcu

SEQ ID NO: 1238792 - RNA, 22 nt, Human
ugacccaaaaggaaaccaucga

SEQ ID NO: 1238793 - RNA, 23 nt, Human
ugacgaacauuuaucaugaccag

SEQ ID NO: 1238794 - RNA, 18 nt, Human
ugagaaacaaacugaaag

SEQ ID NO: 1238795 - RNA, 20 nt, Human
ugagaggaggcaacacaugu

SEQ ID NO: 1238796 - RNA, 21 nt, Human
ugagcacaucacccgccuccu

SEQ ID NO: 1238797 - RNA, 23 nt, Human
ugaggagaacauuaguucuuuca

SEQ ID NO: 1238798 - RNA, 21 nt, Human
ugaguucagugagcuagaagu

SEQ ID NO: 1238799 - RNA, 19 nt, Human
ugcaagagagcaaggaaaa

SEQ ID NO: 1238800 - RNA, 19 nt, Human
ugcaugagaauauuuuuau

SEQ ID NO: 1238801 - RNA, 18 nt, Human
ugccuuugaaauuaucca

SEQ ID NO: 1238802 - RNA, 19 nt, Human
ugcuaagcaugaugaguga

SEQ ID NO: 1238803 - RNA, 22 nt, Human
uggaccccucucacugugucuu

SEQ ID NO: 1238804 - RNA, 22 nt, Human
uggcagccaggccuuuuccuag

SEQ ID NO: 1238805 - RNA, 26 nt, Human
uggcaggcagagcuuacugacccccu

SEQ ID NO: 1238806 - RNA, 19 nt, Human
uggucaauaggcccuuuuc

SEQ ID NO: 1238807 - RNA, 19 nt, Human
uguugaaguuguguaccau

SEQ ID NO: 1238808 - RNA, 18 nt, Human
uuaaaaacaauucuugaa

SEQ ID NO: 1238809 - RNA, 22 nt, Human
uucaucaacaugaaguuccagg

SEQ ID NO: 1238810 - RNA, 23 nt, Human
uucuuggcaggcagagcuuacug

SEQ ID NO: 1238811 - RNA, 18 nt, Human
uugaaguuguguaccaug

SEQ ID NO: 1238812 - RNA, 23 nt, Human
uuuguauccucuucauccucugu

SEQ ID NO: 1238813 - RNA, 19 nt, Human
uuuuuuaacaauagucuga

SEQ ID NO: 1238814 - RNA, 18 nt, Human
uuuuuugguuuuuguuuu

SEQ ID NO: 1238815 - RNA, 19 nt, Human
aaagugcuaggauuacagg

SEQ ID NO: 1238816 - RNA, 24 nt, Human
aaagugcuaggauuacaggcauga

SEQ ID NO: 1238817 - RNA, 20 nt, Human
aaccccugaccucgugaucc

SEQ ID NO: 1238818 - RNA, 26 nt, Human
aagugcuaggauuacaggcaugagcc

SEQ ID NO: 1238819 - RNA, 21 nt, Human
acaccaggcuaauuuuuguau

SEQ ID NO: 1238820 - RNA, 22 nt, Human
accauguuggucaggcuggucu

SEQ ID NO: 1238821 - RNA, 21 nt, Human
acgggguuucaccauguuggu

SEQ ID NO: 1238822 - RNA, 23 nt, Human
acgggguuucaccauguugguca

SEQ ID NO: 1238823 - RNA, 24 nt, Human
acgggguuucaccauguuggucag

SEQ ID NO: 1238824 - RNA, 24 nt, Human
auuuuuguauuuuuaguagagacg

SEQ ID NO: 1238825 - RNA, 24 nt, Human
caaagugcuaggauuacaggcaug

SEQ ID NO: 1238826 - RNA, 19 nt, Human
caagaaugcugcaggaacc

SEQ ID NO: 1238827 - RNA, 20 nt, Human
caagaaugcugcaggaaccc

SEQ ID NO: 1238828 - RNA, 23 nt, Human
caagaaugcugcaggaacccauu

SEQ ID NO: 1238829 - RNA, 24 nt, Human
caccacaccaggcuaauuuuugua

SEQ ID NO: 1238830 - RNA, 21 nt, Human
caccauguuggucaggcuggu

SEQ ID NO: 1238831 - RNA, 23 nt, Human
caccauguuggucaggcuggucu

SEQ ID NO: 1238832 - RNA, 24 nt, Human
caccauguuggucaggcuggucuu

SEQ ID NO: 1238833 - RNA, 24 nt, Human
cauguuggucaggcuggucuugaa

SEQ ID NO: 1238834 - RNA, 19 nt, Human
ccaaagugcuaggauuaca

SEQ ID NO: 1238835 - RNA, 24 nt, Human
ccaaagugcuaggauuacaggcau

SEQ ID NO: 1238836 - RNA, 24 nt, Human
ccccugaccucgugauccaucugc

SEQ ID NO: 1238837 - RNA, 21 nt, Human
ccugaccucgugauccaucug

SEQ ID NO: 1238838 - RNA, 23 nt, Human
cugccucggccucccaaagugcu

SEQ ID NO: 1238839 - RNA, 22 nt, Human
gaccucgugauccaucugccuc

SEQ ID NO: 1238840 - RNA, 22 nt, Human
gaccucgugauccaucugccuc

SEQ ID NO: 1238841 - RNA, 24 nt, Human
gaccucgugauccaucugccucgg

SEQ ID NO: 1238842 - RNA, 23 nt, Human
gagacgggguuucaccauguugg

SEQ ID NO: 1238843 - RNA, 24 nt, Human
gagacgggguuucaccauguuggu

SEQ ID NO: 1238844 - RNA, 18 nt, Human
gauuacaggcaugagcca

SEQ ID NO: 1238845 - RNA, 21 nt, Human
gauuacaggcaugagccacug

SEQ ID NO: 1238846 - RNA, 24 nt, Human
gauuacaggcaugagccacugugc

SEQ ID NO: 1238847 - RNA, 23 nt, Human
gcuggucuugaaccccugaccuc

SEQ ID NO: 1238848 - RNA, 22 nt, Human
ggauuacaggcaugagccacug

SEQ ID NO: 1238849 - RNA, 24 nt, Human
ggauuacaggcaugagccacugug

SEQ ID NO: 1238850 - RNA, 24 nt, Human
ggcuggucuugaaccccugaccuc

SEQ ID NO: 1238851 - RNA, 23 nt, Human
gggguuucaccauguuggucagg

SEQ ID NO: 1238852 - RNA, 22 nt, Human
ggguuucaccauguuggucagg

SEQ ID NO: 1238853 - RNA, 19 nt, Human
ggucuugaaccccugaccu

SEQ ID NO: 1238854 - RNA, 23 nt, Human
guagagacgggguuucaccaugu

SEQ ID NO: 1238855 - RNA, 24 nt, Human
gugauccaucugccucggccuccc

SEQ ID NO: 1238856 - RNA, 18 nt, Human
uaaagaaacugcagcaca

SEQ ID NO: 1238857 - RNA, 19 nt, Human
uaaagaaacugcagcacag

SEQ ID NO: 1238858 - RNA, 24 nt, Human
uaauuuuuguauuuuuaguagaga

SEQ ID NO: 1238859 - RNA, 22 nt, Human
uacaggcaugagccacugugcc

SEQ ID NO: 1238860 - RNA, 22 nt, Human
uagagacgggguuucaccaugu

SEQ ID NO: 1238861 - RNA, 22 nt, Human
uaggauuacaggcaugagccac

SEQ ID NO: 1238862 - RNA, 22 nt, Human
uaggauuacaggcaugagccac

SEQ ID NO: 1238863 - RNA, 23 nt, Human
uaggauuacaggcaugagccacu

SEQ ID NO: 1238864 - RNA, 24 nt, Human
uaggauuacaggcaugagccacug

SEQ ID NO: 1238865 - RNA, 24 nt, Human
uaguagagacgggguuucaccaug

SEQ ID NO: 1238866 - RNA, 26 nt, Human
uaguagagacgggguuucaccauguu

SEQ ID NO: 1238867 - RNA, 24 nt, Human
ucccaaagugcuaggauuacaggc

SEQ ID NO: 1238868 - RNA, 18 nt, Human
ucggccucccaaagugcu

SEQ ID NO: 1238869 - RNA, 21 nt, Human
ugccucggccucccaaagugc

SEQ ID NO: 1238870 - RNA, 23 nt, Human
ugccucggccucccaaagugcua

SEQ ID NO: 1238871 - RNA, 24 nt, Human
ugccucggccucccaaagugcuag

SEQ ID NO: 1238872 - RNA, 24 nt, Human
uggucaggcuggucuugaaccccu

SEQ ID NO: 1238873 - RNA, 21 nt, Human
uguauuuuuaguagagacggg

SEQ ID NO: 1238874 - RNA, 24 nt, Human
uguguaccaccacaccaggcuaau

SEQ ID NO: 1238875 - RNA, 18 nt, Human
uuaguagagacgggguuu

SEQ ID NO: 1238876 - RNA, 22 nt, Human
uuaguagagacgggguuucacc

SEQ ID NO: 1238877 - RNA, 24 nt, Human
uuaguagagacgggguuucaccau

SEQ ID NO: 1238878 - RNA, 23 nt, Human
uuguauuuuuaguagagacgggg

SEQ ID NO: 1238879 - RNA, 24 nt, Human
uuucaccauguuggucaggcuggu

SEQ ID NO: 1238880 - RNA, 24 nt, Human
uuuuuaguagagacgggguuucac

SEQ ID NO: 1238881 - RNA, 20 nt, Human
uuuuuguauuuuuaguagag

SEQ ID NO: 1238882 - RNA, 23 nt, Human
aacaaaagcgccuucuuaacacc

SEQ ID NO: 1238883 - RNA, 18 nt, Human
auagacauauuugcagag

SEQ ID NO: 1238884 - RNA, 23 nt, Human
caccauuaauggccucugaaauc

SEQ ID NO: 1238885 - RNA, 21 nt, Human
caugggccugugacaugaaac

SEQ ID NO: 1238886 - RNA, 18 nt, Human
cuuuaccauuccauuaaa

SEQ ID NO: 1238887 - RNA, 27 nt, Human
gaaaccaaugaaauaaaaaccagacaa

SEQ ID NO: 1238888 - RNA, 25 nt, Human
gaacugaacuagaacugaaaaguaa

SEQ ID NO: 1238889 - RNA, 22 nt, Human
gccucugaaaucaacaucagug

SEQ ID NO: 1238890 - RNA, 19 nt, Human
uauguaaagaaaauggcuu

SEQ ID NO: 1238891 - RNA, 22 nt, Human
ucaagaacugaacuagaacuga

SEQ ID NO: 1238892 - RNA, 20 nt, Human
ucaauagacauauuugcaga

SEQ ID NO: 1238893 - RNA, 27 nt, Human
ucuuucauuuuugucauuuuuaugugg

SEQ ID NO: 1238894 - RNA, 22 nt, Human
ugaaaccaaugaaauaaaaacc

SEQ ID NO: 1238895 - RNA, 24 nt, Human
ugaaauaaaaaccagacaauuuua

SEQ ID NO: 1238896 - RNA, 22 nt, Human
ugggccugugacaugaaaccag

SEQ ID NO: 1238897 - RNA, 21 nt, Human
agaaauccuuguuauagaacu

SEQ ID NO: 1238898 - RNA, 22 nt, Human
caaacugauaggguuuaaagca

SEQ ID NO: 1238899 - RNA, 21 nt, Human
ccuacacauaaacaagaggaa

SEQ ID NO: 1238900 - RNA, 18 nt, Human
ccuugagggaaggaaaag

SEQ ID NO: 1238901 - RNA, 20 nt, Human
ccuugagggaaggaaaagaa

SEQ ID NO: 1238902 - RNA, 19 nt, Human
cugccuacacauaaacaag

SEQ ID NO: 1238903 - RNA, 19 nt, Human
gcuggaggcaggaacucca

SEQ ID NO: 1238904 - RNA, 18 nt, Human
gggaaggaaaagaacaaa

SEQ ID NO: 1238905 - RNA, 22 nt, Human
guccaaauggaauccaaaucaa

SEQ ID NO: 1238906 - RNA, 21 nt, Human
uaaaaaaacagcuucugugca

SEQ ID NO: 1238907 - RNA, 24 nt, Human
uaagaacuuuccacagccuauaac

SEQ ID NO: 1238908 - RNA, 21 nt, Human
uccuugagggaaggaaaagaa

SEQ ID NO: 1238909 - RNA, 21 nt, Human
uggauagaagagaccacaguu

SEQ ID NO: 1238910 - RNA, 26 nt, Human
agaguucccauuggauuccuccacuc

SEQ ID NO: 1238911 - RNA, 19 nt, Human
caaaaaaccagccccugga

SEQ ID NO: 1238912 - RNA, 20 nt, Human
cagaguucccauuggauucc

SEQ ID NO: 1238913 - RNA, 19 nt, Human
cagccuccaggguuaauca

SEQ ID NO: 1238914 - RNA, 19 nt, Human
ccuagaccaaggcagccuc

SEQ ID NO: 1238915 - RNA, 23 nt, Human
ggguaguagagucuuggccagag

SEQ ID NO: 1238916 - RNA, 21 nt, Human
uaggagagauuaucuucacuc

SEQ ID NO: 1238917 - RNA, 26 nt, Human
uaggagagauuaucuucacucuuguu

SEQ ID NO: 1238918 - RNA, 23 nt, Human
uccacuccuggauuucucagaua

SEQ ID NO: 1238919 - RNA, 24 nt, Human
uggauuccuccacuccuggauuuc

SEQ ID NO: 1238920 - RNA, 25 nt, Human
uggccagaguucccauuggauuccu

SEQ ID NO: 1238921 - RNA, 21 nt, Human
uucaaaaaaccagccccugga

SEQ ID NO: 1238922 - RNA, 20 nt, Human
uucuucuuuuggugucuggg

SEQ ID NO: 1238923 - RNA, 20 nt, Human
uucuucuuuuggugucuggg

SEQ ID NO: 1238924 - RNA, 22 nt, Human
uucuucuuuuggugucugggua

SEQ ID NO: 1238925 - RNA, 26 nt, Human
uuuggugucuggguaguagagucuug

SEQ ID NO: 1238926 - RNA, 24 nt, Human
aaaauucugggauuacaggcguga

SEQ ID NO: 1238927 - RNA, 23 nt, Human
aaacaccacaaaucuaccaucuu

SEQ ID NO: 1238928 - RNA, 24 nt, Human
aaagugcugggauuacaggcguga

SEQ ID NO: 1238929 - RNA, 21 nt, Human
aacaccacaaaucuaccaucu

SEQ ID NO: 1238930 - RNA, 19 nt, Human
aagaguuagagaucagccu

SEQ ID NO: 1238931 - RNA, 25 nt, Human
aagcgauccucccaccucagccucc

SEQ ID NO: 1238932 - RNA, 19 nt, Human
aagugcugggauuacaggc

SEQ ID NO: 1238933 - RNA, 19 nt, Human
aagugcugggauuacaggc

SEQ ID NO: 1238934 - RNA, 26 nt, Human
aagugcugggauuacaggcgugagcc

SEQ ID NO: 1238935 - RNA, 22 nt, Human
acaaccuccaccucccggguuc

SEQ ID NO: 1238936 - RNA, 21 nt, Human
acagaaugugcuccuuugccu

SEQ ID NO: 1238937 - RNA, 21 nt, Human
acaggcacccaccaccacacc

SEQ ID NO: 1238938 - RNA, 24 nt, Human
acaggcgugagcaacuguaacaug

SEQ ID NO: 1238939 - RNA, 24 nt, Human
accaucuuggcuaggcuggucuug

SEQ ID NO: 1238940 - RNA, 23 nt, Human
accauguuggucaggcuggucuc

SEQ ID NO: 1238941 - RNA, 23 nt, Human
accucagccuccuaaaauucugg

SEQ ID NO: 1238942 - RNA, 26 nt, Human
accucgugacucgauauucaaggcca

SEQ ID NO: 1238943 - RNA, 18 nt, Human
acucuccuaccuccuucu

SEQ ID NO: 1238944 - RNA, 22 nt, Human
agaggaaggauugcuugaggcc

SEQ ID NO: 1238945 - RNA, 21 nt, Human
agcugccagagaaagcaacca

SEQ ID NO: 1238946 - RNA, 22 nt, Human
agcugccagagaaagcaaccac

SEQ ID NO: 1238947 - RNA, 23 nt, Human
agcuggacauggugaugcacgcc

SEQ ID NO: 1238948 - RNA, 20 nt, Human
aggaaggauugcuugaggcc

SEQ ID NO: 1238949 - RNA, 21 nt, Human
aggagcugcauuccuucuggg

SEQ ID NO: 1238950 - RNA, 19 nt, Human
aggaggagggcuagcugcc

SEQ ID NO: 1238951 - RNA, 20 nt, Human
aggcuaaggugggaggauug

SEQ ID NO: 1238952 - RNA, 22 nt, Human
aggucuuauuauguugcccagg

SEQ ID NO: 1238953 - RNA, 22 nt, Human
aguagaaaugggguuucaccau

SEQ ID NO: 1238954 - RNA, 23 nt, Human
aguagcuggaauuauagggaugu

SEQ ID NO: 1238955 - RNA, 18 nt, Human
aguagcugggauuacagg

SEQ ID NO: 1238956 - RNA, 18 nt, Human
agugcugggauuacaggc

SEQ ID NO: 1238957 - RNA, 24 nt, Human
augauccacccuccucggccuccc

SEQ ID NO: 1238958 - RNA, 20 nt, Human
augggguuucaccaucuugg

SEQ ID NO: 1238959 - RNA, 22 nt, Human
augggguuucaccaucuuggcu

SEQ ID NO: 1238960 - RNA, 24 nt, Human
augggguuucaccaucuuggcuag

SEQ ID NO: 1238961 - RNA, 21 nt, Human
augggguuucaccauguuggu

SEQ ID NO: 1238962 - RNA, 24 nt, Human
augggguuucaccauguuggucag

SEQ ID NO: 1238963 - RNA, 19 nt, Human
auguugcccaggcuggucu

SEQ ID NO: 1238964 - RNA, 24 nt, Human
auguuuguauuuuuaguagagaug

SEQ ID NO: 1238965 - RNA, 22 nt, Human
auucucugccuccugaguagcu

SEQ ID NO: 1238966 - RNA, 21 nt, Human
auuuuuuguuguugcuacaac

SEQ ID NO: 1238967 - RNA, 26 nt, Human
caaacuccugaccucaagugguccaa

SEQ ID NO: 1238968 - RNA, 24 nt, Human
caaacugcuaggauuacaggagug

SEQ ID NO: 1238969 - RNA, 24 nt, Human
caaagugcugggauuacaggcgug

SEQ ID NO: 1238970 - RNA, 19 nt, Human
caacaaguugggaggccaa

SEQ ID NO: 1238971 - RNA, 23 nt, Human
caaccuccaccucccggguucaa

SEQ ID NO: 1238972 - RNA, 23 nt, Human
caacuaggucuauuaaggcuaaa

SEQ ID NO: 1238973 - RNA, 22 nt, Human
caagcaauucuccugccucggc

SEQ ID NO: 1238974 - RNA, 19 nt, Human
caagugauucucugccucc

SEQ ID NO: 1238975 - RNA, 20 nt, Human
caagugguccaugugccuca

SEQ ID NO: 1238976 - RNA, 22 nt, Human
caagugguccaugugccucagc

SEQ ID NO: 1238977 - RNA, 21 nt, Human
caccaucuuggcuaggcuggu

SEQ ID NO: 1238978 - RNA, 24 nt, Human
caccaucuuggcuaggcuggucuu

SEQ ID NO: 1238979 - RNA, 21 nt, Human
caccauguuggucaggcuggu

SEQ ID NO: 1238980 - RNA, 24 nt, Human
caccauguuggucaggcuggucuc

SEQ ID NO: 1238981 - RNA, 18 nt, Human
cacccaccaccacaccug

SEQ ID NO: 1238982 - RNA, 18 nt, Human
cacgccuguaguuccagc

SEQ ID NO: 1238983 - RNA, 21 nt, Human
cacuacaaccuccaccucccg

SEQ ID NO: 1238984 - RNA, 23 nt, Human
cacugcaaugucugccuuuuggg

SEQ ID NO: 1238985 - RNA, 21 nt, Human
cagcuucuagaagccaccccu

SEQ ID NO: 1238986 - RNA, 22 nt, Human
caguucugggggccagaagccc

SEQ ID NO: 1238987 - RNA, 24 nt, Human
caucuguaaucccaacaaguuggg

SEQ ID NO: 1238988 - RNA, 20 nt, Human
ccaaagugcugggauuacag

SEQ ID NO: 1238989 - RNA, 22 nt, Human
ccaaagugcugggauuacaggc

SEQ ID NO: 1238990 - RNA, 22 nt, Human
ccaaagugcugggauuacaggc

SEQ ID NO: 1238991 - RNA, 24 nt, Human
ccaaagugcugggauuacaggcgu

SEQ ID NO: 1238992 - RNA, 19 nt, Human
ccaccccuauuccuugacu

SEQ ID NO: 1238993 - RNA, 26 nt, Human
ccaccucccggguucaagcaauucuu

SEQ ID NO: 1238994 - RNA, 19 nt, Human
ccacugcaccuggccccaa

SEQ ID NO: 1238995 - RNA, 24 nt, Human
cccaucuguaaucccaacaaguug

SEQ ID NO: 1238996 - RNA, 19 nt, Human
cccgaguagcuggaauuau

SEQ ID NO: 1238997 - RNA, 23 nt, Human
cccggguucaagcaauucuccug

SEQ ID NO: 1238998 - RNA, 25 nt, Human
ccuaaaauucugggauuacaggcgu

SEQ ID NO: 1238999 - RNA, 25 nt, Human
ccucaccugcugaacuccaggaggc

SEQ ID NO: 1239000 - RNA, 21 nt, Human
ccucaugauccacccuccucg

SEQ ID NO: 1239001 - RNA, 23 nt, Human
ccucccaccucagccuccuaaaa

SEQ ID NO: 1239002 - RNA, 24 nt, Human
ccucccggguucaagcaauucucc

SEQ ID NO: 1239003 - RNA, 25 nt, Human
ccuccuaaaauucugggauuacagg

SEQ ID NO: 1239004 - RNA, 18 nt, Human
ccucucugaccucuucuu

SEQ ID NO: 1239005 - RNA, 21 nt, Human
ccugaccucaagugguccaug

SEQ ID NO: 1239006 - RNA, 23 nt, Human
ccugaguagcugggauuacaggc

SEQ ID NO: 1239007 - RNA, 24 nt, Human
ccugaguagcugggauuacaggca

SEQ ID NO: 1239008 - RNA, 23 nt, Human
ccugccucggccucccgaguagc

SEQ ID NO: 1239009 - RNA, 18 nt, Human
ccugggcuuaagcgaucc

SEQ ID NO: 1239010 - RNA, 22 nt, Human
ccuguaguuccagcuacugggg

SEQ ID NO: 1239011 - RNA, 21 nt, Human
ccuuuuggguucaagugauuc

SEQ ID NO: 1239012 - RNA, 22 nt, Human
cgccuguaguuccagcuacugg

SEQ ID NO: 1239013 - RNA, 23 nt, Human
cgccuguaguuccagcuacuggg

SEQ ID NO: 1239014 - RNA, 24 nt, Human
cuaaaauucugggauuacaggcgu

SEQ ID NO: 1239015 - RNA, 18 nt, Human
cuacaaccuccaccuccc

SEQ ID NO: 1239016 - RNA, 23 nt, Human
cuacaaccuccaccucccggguu

SEQ ID NO: 1239017 - RNA, 23 nt, Human
cucaagugguccaugugccucag

SEQ ID NO: 1239018 - RNA, 19 nt, Human
cucaccugcugaacuccag

SEQ ID NO: 1239019 - RNA, 24 nt, Human
cucacuacaaccuccaccucccgg

SEQ ID NO: 1239020 - RNA, 25 nt, Human
cucacuacaaccuccaccucccggg

SEQ ID NO: 1239021 - RNA, 19 nt, Human
cucacugcaaugucugccu

SEQ ID NO: 1239022 - RNA, 25 nt, Human
cucagccuccuaaaauucugggauu

SEQ ID NO: 1239023 - RNA, 23 nt, Human
cuccugggcuuaagcgauccucc

SEQ ID NO: 1239024 - RNA, 18 nt, Human
cucuuguagcccaggcug

SEQ ID NO: 1239025 - RNA, 19 nt, Human
cucuuguagcccaggcugg

SEQ ID NO: 1239026 - RNA, 22 nt, Human
cucuuguagcccaggcuggagu

SEQ ID NO: 1239027 - RNA, 23 nt, Human
cugaguagcugggauuacaggca

SEQ ID NO: 1239028 - RNA, 23 nt, Human
cugccucggccucccgaguagcu

SEQ ID NO: 1239029 - RNA, 23 nt, Human
cugccuuuuggguucaagugauu

SEQ ID NO: 1239030 - RNA, 23 nt, Human
cugggggccagaagcccaacuag

SEQ ID NO: 1239031 - RNA, 24 nt, Human
cuuaagcgauccucccaccucagc

SEQ ID NO: 1239032 - RNA, 21 nt, Human
cuuccaaacugcuaggauuac

SEQ ID NO: 1239033 - RNA, 19 nt, Human
cuuguagcccaggcuggag

SEQ ID NO: 1239034 - RNA, 24 nt, Human
cuuguagcccaggcuggagugcaa

SEQ ID NO: 1239035 - RNA, 25 nt, Human
cuuucagccucaccugcugaacucc

SEQ ID NO: 1239036 - RNA, 24 nt, Human
gaaaugggguuucaccauguuggu

SEQ ID NO: 1239037 - RNA, 24 nt, Human
gaccucaagugguccaugugccuc

SEQ ID NO: 1239038 - RNA, 22 nt, Human
gaccucaugauccacccuccuc

SEQ ID NO: 1239039 - RNA, 21 nt, Human
gaccucuucuuccauuaccac

SEQ ID NO: 1239040 - RNA, 18 nt, Human
gagaugggguuucaccau

SEQ ID NO: 1239041 - RNA, 24 nt, Human
gagaugggguuucaccaucuuggc

SEQ ID NO: 1239042 - RNA, 25 nt, Human
gaguagcugggauuacaggcaccca

SEQ ID NO: 1239043 - RNA, 21 nt, Human
gagugcaauggcacaaucuca

SEQ ID NO: 1239044 - RNA, 18 nt, Human
gauuacaggagugagcca

SEQ ID NO: 1239045 - RNA, 22 nt, Human
gauuacaggagugagccacugc

SEQ ID NO: 1239046 - RNA, 23 nt, Human
gauuacaggagugagccacugca

SEQ ID NO: 1239047 - RNA, 21 nt, Human
gauuacaggcgugagcaacug

SEQ ID NO: 1239048 - RNA, 22 nt, Human
gauuacaggcgugagcaacugu

SEQ ID NO: 1239049 - RNA, 18 nt, Human
gauuacaggcgugagcca

SEQ ID NO: 1239050 - RNA, 22 nt, Human
gauuacaggcgugagccacugc

SEQ ID NO: 1239051 - RNA, 22 nt, Human
gauuacaggcgugagccacugc

SEQ ID NO: 1239052 - RNA, 23 nt, Human
gauugcuugaggccaagaguuag

SEQ ID NO: 1239053 - RNA, 19 nt, Human
gcaucaaacaccacaaauc

SEQ ID NO: 1239054 - RNA, 19 nt, Human
gcccaggcuggagugcaau

SEQ ID NO: 1239055 - RNA, 23 nt, Human
gcccaggcuggagugcaauggca

SEQ ID NO: 1239056 - RNA, 21 nt, Human
gccucggccucccgaguagcu

SEQ ID NO: 1239057 - RNA, 23 nt, Human
gcuacaacaaaguacccuacauu

SEQ ID NO: 1239058 - RNA, 20 nt, Human
gcucacugcaaugucugccu

SEQ ID NO: 1239059 - RNA, 24 nt, Human
gcucuuguagcccaggcuggagug

SEQ ID NO: 1239060 - RNA, 19 nt, Human
gcuggagugcaauggcaca

SEQ ID NO: 1239061 - RNA, 23 nt, Human
gcuggucucaaacuccugaccuc

SEQ ID NO: 1239062 - RNA, 24 nt, Human
ggacauggugaugcacgccuguag

SEQ ID NO: 1239063 - RNA, 22 nt, Human
ggaugcuguugagcuaacaggg

SEQ ID NO: 1239064 - RNA, 22 nt, Human
ggauuacaggagugagccacug

SEQ ID NO: 1239065 - RNA, 21 nt, Human
ggccaaagaggaaggauugcu

SEQ ID NO: 1239066 - RNA, 24 nt, Human
ggcuggucucaaacuccugaccuc

SEQ ID NO: 1239067 - RNA, 24 nt, Human
ggcuggucuugaacuucugaccuc

SEQ ID NO: 1239068 - RNA, 20 nt, Human
gggaaaauaggaagacccug

SEQ ID NO: 1239069 - RNA, 21 nt, Human
ggggaggcucuagacagaaug

SEQ ID NO: 1239070 - RNA, 19 nt, Human
gggguuucaccaucuuggc

SEQ ID NO: 1239071 - RNA, 22 nt, Human
gggguuucaccauguuggucag

SEQ ID NO: 1239072 - RNA, 19 nt, Human
ggguucaagugauucucug

SEQ ID NO: 1239073 - RNA, 19 nt, Human
gguccaugugccucagccu

SEQ ID NO: 1239074 - RNA, 22 nt, Human
ggucuugaacuucugaccucau

SEQ ID NO: 1239075 - RNA, 24 nt, Human
ggugaugcacgccuguaguuccag

SEQ ID NO: 1239076 - RNA, 19 nt, Human
gugccucagccuuccaaac

SEQ ID NO: 1239077 - RNA, 24 nt, Human
gugguccaugugccucagccuucc

SEQ ID NO: 1239078 - RNA, 22 nt, Human
guugcuacaacaaaguacccua

SEQ ID NO: 1239079 - RNA, 20 nt, Human
uaagcgauccucccaccuca

SEQ ID NO: 1239080 - RNA, 27 nt, Human
uaagcgauccucccaccucagccuccu

SEQ ID NO: 1239081 - RNA, 21 nt, Human
uaagcuccugggcuuaagcga

SEQ ID NO: 1239082 - RNA, 18 nt, Human
uaaggugggaggauugcu

SEQ ID NO: 1239083 - RNA, 24 nt, Human
uaauguuuguauuuuuaguagaga

SEQ ID NO: 1239084 - RNA, 22 nt, Human
uacaggagugagccacugcacc

SEQ ID NO: 1239085 - RNA, 22 nt, Human
uacaggagugagccacugcacc

SEQ ID NO: 1239086 - RNA, 23 nt, Human
uacaggagugagccacugcaccu

SEQ ID NO: 1239087 - RNA, 23 nt, Human
uacaggagugagccacugcaccu

SEQ ID NO: 1239088 - RNA, 23 nt, Human
uacaggcgugagccacugcgucu

SEQ ID NO: 1239089 - RNA, 22 nt, Human
uagaaaugggguuucaccaugu

SEQ ID NO: 1239090 - RNA, 18 nt, Human
uagcccaggcuggagugc

SEQ ID NO: 1239091 - RNA, 22 nt, Human
uaggauuacaggagugagccac

SEQ ID NO: 1239092 - RNA, 22 nt, Human
uaggauuacaggagugagccac

SEQ ID NO: 1239093 - RNA, 24 nt, Human
uaggauuacaggagugagccacug

SEQ ID NO: 1239094 - RNA, 24 nt, Human
uaguagaaaugggguuucaccaug

SEQ ID NO: 1239095 - RNA, 26 nt, Human
uaguagaaaugggguuucaccauguu

SEQ ID NO: 1239096 - RNA, 19 nt, Human
uaguagagaugggguuuca

SEQ ID NO: 1239097 - RNA, 23 nt, Human
uaguagagaugggguuucaccau

SEQ ID NO: 1239098 - RNA, 26 nt, Human
uaguagagaugggguuucaccaucuu

SEQ ID NO: 1239099 - RNA, 23 nt, Human
uauguugcccaggcuggucuuaa

SEQ ID NO: 1239100 - RNA, 24 nt, Human
uauguugcccaggcuggucuuaag

SEQ ID NO: 1239101 - RNA, 22 nt, Human
uauuauguugcccaggcugguc

SEQ ID NO: 1239102 - RNA, 24 nt, Human
ucacuacaaccuccaccucccggg

SEQ ID NO: 1239103 - RNA, 25 nt, Human
ucacuacaaccuccaccucccgggu

SEQ ID NO: 1239104 - RNA, 27 nt, Human
ucacuacaaccuccaccucccggguuc

SEQ ID NO: 1239105 - RNA, 24 nt, Human
ucacugcaaugucugccuuuuggg

SEQ ID NO: 1239106 - RNA, 27 nt, Human
ucacuuucucuaauucugacucuccua

SEQ ID NO: 1239107 - RNA, 21 nt, Human
uccacccuccucggccuccca

SEQ ID NO: 1239108 - RNA, 24 nt, Human
ucccaaagugcugggauuacaggc

SEQ ID NO: 1239109 - RNA, 24 nt, Human
ucccagcuucuagaagccaccccc

SEQ ID NO: 1239110 - RNA, 21 nt, Human
ucccggguucaagcaauucuc

SEQ ID NO: 1239111 - RNA, 24 nt, Human
ucccggguucaagcaauucuccug

SEQ ID NO: 1239112 - RNA, 25 nt, Human
ucccucucugaccucuucuuccauu

SEQ ID NO: 1239113 - RNA, 24 nt, Human
uccuaaaauucugggauuacaggc

SEQ ID NO: 1239114 - RNA, 25 nt, Human
uccuaaaauucugggauuacaggcg

SEQ ID NO: 1239115 - RNA, 20 nt, Human
uccucccaccucagccuccc

SEQ ID NO: 1239116 - RNA, 21 nt, Human
uccucggccucccaaagugcu

SEQ ID NO: 1239117 - RNA, 24 nt, Human
uccugaguagcugggauuacaggc

SEQ ID NO: 1239118 - RNA, 21 nt, Human
uccugggcuuaagcgauccuc

SEQ ID NO: 1239119 - RNA, 24 nt, Human
uccugggcuuaagcgauccuccca

SEQ ID NO: 1239120 - RNA, 23 nt, Human
ucggccucccgaguagcuggaau

SEQ ID NO: 1239121 - RNA, 21 nt, Human
ucuagaagccaccccuauucc

SEQ ID NO: 1239122 - RNA, 24 nt, Human
ucucaaacuccugaccucaagugg

SEQ ID NO: 1239123 - RNA, 23 nt, Human
ucuccuaccuccuucucuuauaa

SEQ ID NO: 1239124 - RNA, 19 nt, Human
ucucggucgcccaggcuaa

SEQ ID NO: 1239125 - RNA, 21 nt, Human
ucucuaauucugacucuccua

SEQ ID NO: 1239126 - RNA, 18 nt, Human
ucucugaccucuucuucc

SEQ ID NO: 1239127 - RNA, 19 nt, Human
ucucuuauaaagauccuug

SEQ ID NO: 1239128 - RNA, 23 nt, Human
ucuuauuauguugcccaggcugg

SEQ ID NO: 1239129 - RNA, 24 nt, Human
ucuuauuauguugcccaggcuggu

SEQ ID NO: 1239130 - RNA, 18 nt, Human
ucuuguagcccaggcugg

SEQ ID NO: 1239131 - RNA, 24 nt, Human
ugaccucaagugguccaugugccu

SEQ ID NO: 1239132 - RNA, 24 nt, Human
ugaggucuuauuauguugcccagg

SEQ ID NO: 1239133 - RNA, 18 nt, Human
ugaugcacgccuguaguu

SEQ ID NO: 1239134 - RNA, 20 nt, Human
ugaugcacgccuguaguucc

SEQ ID NO: 1239135 - RNA, 24 nt, Human
ugcccaggcuggucuuaagcuccu

SEQ ID NO: 1239136 - RNA, 28 nt, Human
ugcccaggcuggucuuaagcuccugggc

SEQ ID NO: 1239137 - RNA, 24 nt, Human
ugccucagccuuccaaacugcuag

SEQ ID NO: 1239138 - RNA, 20 nt, Human
ugccucggccucccgaguaa

SEQ ID NO: 1239139 - RNA, 21 nt, Human
ugccucggccucccgaguagc

SEQ ID NO: 1239140 - RNA, 24 nt, Human
ugccucggccucccgaguagcugg

SEQ ID NO: 1239141 - RNA, 22 nt, Human
ugccuuuuggguucaagugauu

SEQ ID NO: 1239142 - RNA, 24 nt, Human
ugcugggauuacaggcgugagcca

SEQ ID NO: 1239143 - RNA, 24 nt, Human
uggagugcaauggcacaaucucag

SEQ ID NO: 1239144 - RNA, 24 nt, Human
uggcacaaucucagcucacuacaa

SEQ ID NO: 1239145 - RNA, 24 nt, Human
uggcuaggcuggucuugaacuucu

SEQ ID NO: 1239146 - RNA, 22 nt, Human
ugggaggccaaagaggaaggau

SEQ ID NO: 1239147 - RNA, 19 nt, Human
ugggauuacaggcacccac

SEQ ID NO: 1239148 - RNA, 21 nt, Human
ugggauuacaggcacccacca

SEQ ID NO: 1239149 - RNA, 24 nt, Human
ugggauuacaggcacccaccacca

SEQ ID NO: 1239150 - RNA, 18 nt, Human
ugggauuacaggcgugag

SEQ ID NO: 1239151 - RNA, 18 nt, Human
ugggauuacaggcgugag

SEQ ID NO: 1239152 - RNA, 19 nt, Human
ugggauuacaggcgugagc

SEQ ID NO: 1239153 - RNA, 19 nt, Human
ugggauuacaggcgugagc

SEQ ID NO: 1239154 - RNA, 19 nt, Human
ugggauuacaggcgugagc

SEQ ID NO: 1239155 - RNA, 20 nt, Human
ugggauuacaggcgugagca

SEQ ID NO: 1239156 - RNA, 22 nt, Human
ugggauuacaggcgugagcaac

SEQ ID NO: 1239157 - RNA, 23 nt, Human
ugggauuacaggcgugagcaacu

SEQ ID NO: 1239158 - RNA, 24 nt, Human
ugggauuacaggcgugagcaacug

SEQ ID NO: 1239159 - RNA, 27 nt, Human
ugggauuacaggcgugagcaacuguaa

SEQ ID NO: 1239160 - RNA, 21 nt, Human
ugggauuacaggcgugagcca

SEQ ID NO: 1239161 - RNA, 22 nt, Human
ugggauuacaggcgugagccac

SEQ ID NO: 1239162 - RNA, 22 nt, Human
ugggauuacaggcgugagccac

SEQ ID NO: 1239163 - RNA, 24 nt, Human
ugggauuacaggcgugagccacug

SEQ ID NO: 1239164 - RNA, 24 nt, Human
ugggauuacaggcgugagccacug

SEQ ID NO: 1239165 - RNA, 25 nt, Human
ugggggaggcucuagacagaaugug

SEQ ID NO: 1239166 - RNA, 24 nt, Human
ugggggcucccaucuguaauccca

SEQ ID NO: 1239167 - RNA, 24 nt, Human
ugggguuucaccaucuuggcuagg

SEQ ID NO: 1239168 - RNA, 24 nt, Human
ugggguuucaccauguuggucagg

SEQ ID NO: 1239169 - RNA, 18 nt, Human
uggguucaagugauucuc

SEQ ID NO: 1239170 - RNA, 20 nt, Human
uggguucaagugauucucuu

SEQ ID NO: 1239171 - RNA, 24 nt, Human
uggucaggcuggucucaaacuccu

SEQ ID NO: 1239172 - RNA, 20 nt, Human
ugguccaugugccucagccu

SEQ ID NO: 1239173 - RNA, 24 nt, Human
uggugaugcacgccuguaguucca

SEQ ID NO: 1239174 - RNA, 21 nt, Human
ugugauugguggguauggggg

SEQ ID NO: 1239175 - RNA, 21 nt, Human
ugugcuccuuugccuuuccca

SEQ ID NO: 1239176 - RNA, 21 nt, Human
uguuuguauuuuuaguagaga

SEQ ID NO: 1239177 - RNA, 18 nt, Human
uuaaggcuaaagucaagg

SEQ ID NO: 1239178 - RNA, 18 nt, Human
uuaguagaaaugggguuu

SEQ ID NO: 1239179 - RNA, 22 nt, Human
uuaguagaaaugggguuucacc

SEQ ID NO: 1239180 - RNA, 24 nt, Human
uuaguagaaaugggguuucaccau

SEQ ID NO: 1239181 - RNA, 18 nt, Human
uuaguagagaugggguuu

SEQ ID NO: 1239182 - RNA, 22 nt, Human
uuaguagagaugggguuucacc

SEQ ID NO: 1239183 - RNA, 24 nt, Human
uuaguagagaugggguuucaccau

SEQ ID NO: 1239184 - RNA, 23 nt, Human
uuauagggaugucucacaacgcc

SEQ ID NO: 1239185 - RNA, 21 nt, Human
uucaagcaauucuccugccuc

SEQ ID NO: 1239186 - RNA, 24 nt, Human
uucaagcaauucuccugccucggc

SEQ ID NO: 1239187 - RNA, 22 nt, Human
uucaggaggagggcuagcugcc

SEQ ID NO: 1239188 - RNA, 20 nt, Human
uugaggccaagaguuagaga

SEQ ID NO: 1239189 - RNA, 23 nt, Human
uuguauuuuuaguagagaugggg

SEQ ID NO: 1239190 - RNA, 24 nt, Human
uuucaccaucuuggcuaggcuggu

SEQ ID NO: 1239191 - RNA, 24 nt, Human
uuucaccauguuggucaggcuggu

SEQ ID NO: 1239192 - RNA, 22 nt, Human
uuugccuuucccagcuucuaga

SEQ ID NO: 1239193 - RNA, 24 nt, Human
uuuggcucuuguagcccaggcugg

SEQ ID NO: 1239194 - RNA, 18 nt, Human
uuuguauuuuuaguagag

SEQ ID NO: 1239195 - RNA, 18 nt, Human
uuuuguuguugcuacaac

SEQ ID NO: 1239196 - RNA, 24 nt, Human
uuuuuaguagaaaugggguuucac

SEQ ID NO: 1239197 - RNA, 24 nt, Human
uuuuuaguagagaugggguuucac

SEQ ID NO: 1239198 - RNA, 24 nt, Human
uuuuugaggcuuggaacuuucagc

SEQ ID NO: 1239199 - RNA, 24 nt, Human
uuuuuuuuuuuaaacggaguuugg

SEQ ID NO: 1239200 - RNA, 23 nt, Human
aaacaauaccaucccauauugca

SEQ ID NO: 1239201 - RNA, 23 nt, Human
aaacugccauccacaaauaaacu

SEQ ID NO: 1239202 - RNA, 24 nt, Human
aaagugcugggauuacagguguga

SEQ ID NO: 1239203 - RNA, 24 nt, Human
aagcaauucuccugcuuuggccuc

SEQ ID NO: 1239204 - RNA, 18 nt, Human
aagugcugggauuacagg

SEQ ID NO: 1239205 - RNA, 19 nt, Human
aagugcugggauuacaggu

SEQ ID NO: 1239206 - RNA, 26 nt, Human
aagugcugggauuacaggugugagcc

SEQ ID NO: 1239207 - RNA, 20 nt, Human
aaugcaguggugcgaucuug

SEQ ID NO: 1239208 - RNA, 24 nt, Human
aaugcaguggugcgaucuugguuc

SEQ ID NO: 1239209 - RNA, 21 nt, Human
acacaaucccagacaacccca

SEQ ID NO: 1239210 - RNA, 20 nt, Human
acagaaaacugccauccaca

SEQ ID NO: 1239211 - RNA, 18 nt, Human
acaggguuucaccauguu

SEQ ID NO: 1239212 - RNA, 21 nt, Human
acaggguuucaccauguuggc

SEQ ID NO: 1239213 - RNA, 24 nt, Human
acaggguuucaccauguuggccag

SEQ ID NO: 1239214 - RNA, 24 nt, Human
accauguuggccaggcuggucucg

SEQ ID NO: 1239215 - RNA, 19 nt, Human
agaaaagaagcuucccaag

SEQ ID NO: 1239216 - RNA, 23 nt, Human
agaacagaaaagaagcuucccaa

SEQ ID NO: 1239217 - RNA, 20 nt, Human
agaagcuucccaagaggcac

SEQ ID NO: 1239218 - RNA, 24 nt, Human
agagggagucucgcucuauugcuu

SEQ ID NO: 1239219 - RNA, 18 nt, Human
agcaauucuccugcuuug

SEQ ID NO: 1239220 - RNA, 24 nt, Human
aggaagcaaaaauaaacuugcaag

SEQ ID NO: 1239221 - RNA, 20 nt, Human
aggcacucauuuuaaaaaua

SEQ ID NO: 1239222 - RNA, 23 nt, Human
aguagcugggauuacaggcacau

SEQ ID NO: 1239223 - RNA, 23 nt, Human
aguagcugggauuacaggcacau

SEQ ID NO: 1239224 - RNA, 19 nt, Human
agugauccacccaccucag

SEQ ID NO: 1239225 - RNA, 18 nt, Human
caaaaauaaacuugcaag

SEQ ID NO: 1239226 - RNA, 21 nt, Human
caaaacaauccaagagcuacc

SEQ ID NO: 1239227 - RNA, 24 nt, Human
caaagugcugggauuacaggugug

SEQ ID NO: 1239228 - RNA, 23 nt, Human
caaccuccaccucccggguucaa

SEQ ID NO: 1239229 - RNA, 22 nt, Human
caagcaauucuccugcuuuggc

SEQ ID NO: 1239230 - RNA, 19 nt, Human
caagugauccacccaccuc

SEQ ID NO: 1239231 - RNA, 20 nt, Human
cacacaaucccagacaaccc

SEQ ID NO: 1239232 - RNA, 21 nt, Human
caccauguuggccaggcuggu

SEQ ID NO: 1239233 - RNA, 24 nt, Human
caccauguuggccaggcuggucuc

SEQ ID NO: 1239234 - RNA, 27 nt, Human
caccauguuggccaggcuggucucgaa

SEQ ID NO: 1239235 - RNA, 22 nt, Human
cacccaccucagccucccaaag

SEQ ID NO: 1239236 - RNA, 23 nt, Human
cacccaccucagccucccaaagu

SEQ ID NO: 1239237 - RNA, 24 nt, Human
caccucagccucccaaagugcugg

SEQ ID NO: 1239238 - RNA, 21 nt, Human
cacugcaaccuccaccucccg

SEQ ID NO: 1239239 - RNA, 23 nt, Human
cacugcaaccuccaccucccggg

SEQ ID NO: 1239240 - RNA, 19 nt, Human
cacugcacuggccuaagau

SEQ ID NO: 1239241 - RNA, 23 nt, Human
cagacaaccccaaauaacuuuau

SEQ ID NO: 1239242 - RNA, 21 nt, Human
caggcacaugcaccaacccug

SEQ ID NO: 1239243 - RNA, 24 nt, Human
cagggaacuguuagaacagaaaag

SEQ ID NO: 1239244 - RNA, 24 nt, Human
caggguuucaccauguuggccagg

SEQ ID NO: 1239245 - RNA, 24 nt, Human
cauguuggccaggcuggucucgaa

SEQ ID NO: 1239246 - RNA, 21 nt, Human
ccaaagugcugggauuacagg

SEQ ID NO: 1239247 - RNA, 21 nt, Human
ccaaagugcugggauuacagg

SEQ ID NO: 1239248 - RNA, 24 nt, Human
ccaaagugcugggauuacaggugu

SEQ ID NO: 1239249 - RNA, 26 nt, Human
ccacccaccucagccucccaaagugc

SEQ ID NO: 1239250 - RNA, 27 nt, Human
ccaccucccggguucaagcaauucuuu

SEQ ID NO: 1239251 - RNA, 21 nt, Human
ccauccacaaauaaacuacca

SEQ ID NO: 1239252 - RNA, 24 nt, Human
ccauccacaaauaaacuaccaagg

SEQ ID NO: 1239253 - RNA, 21 nt, Human
cccaaaacuacagaaaacugc

SEQ ID NO: 1239254 - RNA, 23 nt, Human
cccggguucaagcaauucuccug

SEQ ID NO: 1239255 - RNA, 24 nt, Human
ccucccggguucaagcaauucucc

SEQ ID NO: 1239256 - RNA, 24 nt, Human
ccugaccucaagugauccacccac

SEQ ID NO: 1239257 - RNA, 23 nt, Human
ccugaguagcugggauuacaggc

SEQ ID NO: 1239258 - RNA, 24 nt, Human
ccugaguagcugggauuacaggca

SEQ ID NO: 1239259 - RNA, 24 nt, Human
cucaagugauccacccaccucagc

SEQ ID NO: 1239260 - RNA, 21 nt, Human
cucgcucuauugcuuaggcug

SEQ ID NO: 1239261 - RNA, 23 nt, Human
cugaguagcugggauuacaggca

SEQ ID NO: 1239262 - RNA, 18 nt, Human
cugcaaccuccaccuccc

SEQ ID NO: 1239263 - RNA, 23 nt, Human
cugcaaccuccaccucccggguu

SEQ ID NO: 1239264 - RNA, 22 nt, Human
cugccauauugaucaaucaugu

SEQ ID NO: 1239265 - RNA, 23 nt, Human
cugcuuuggccuccugaguagcu

SEQ ID NO: 1239266 - RNA, 21 nt, Human
gaaaaaaagcaauuuaaaaac

SEQ ID NO: 1239267 - RNA, 24 nt, Human
gaccucaagugauccacccaccuc

SEQ ID NO: 1239268 - RNA, 23 nt, Human
gagggagucucgcucuauugcuu

SEQ ID NO: 1239269 - RNA, 18 nt, Human
gauuacaggugugagcca

SEQ ID NO: 1239270 - RNA, 22 nt, Human
gauuacaggugugagccacugc

SEQ ID NO: 1239271 - RNA, 23 nt, Human
gauuacaggugugagccacugca

SEQ ID NO: 1239272 - RNA, 22 nt, Human
gcaaccuccaccucccggguuc

SEQ ID NO: 1239273 - RNA, 23 nt, Human
gcuggucucgaacuccugaccuc

SEQ ID NO: 1239274 - RNA, 20 nt, Human
gcuuaggcuggaaugcagug

SEQ ID NO: 1239275 - RNA, 19 nt, Human
ggaaaaacaguucuaaugg

SEQ ID NO: 1239276 - RNA, 24 nt, Human
ggcuggucucgaacuccugaccuc

SEQ ID NO: 1239277 - RNA, 22 nt, Human
ggguuucaccauguuggccagg

SEQ ID NO: 1239278 - RNA, 19 nt, Human
ggucucgaacuccugaccu

SEQ ID NO: 1239279 - RNA, 24 nt, Human
gugauccacccaccucagccuccc

SEQ ID NO: 1239280 - RNA, 18 nt, Human
guuuauuuaagguuuucu

SEQ ID NO: 1239281 - RNA, 22 nt, Human
uaaacaaccauuucauuuuuuc

SEQ ID NO: 1239282 - RNA, 22 nt, Human
uaaauaggaauggcaguaacac

SEQ ID NO: 1239283 - RNA, 19 nt, Human
uaaaugcagaccucucaaa

SEQ ID NO: 1239284 - RNA, 26 nt, Human
uaauuuuucuguauuuuuaguagaga

SEQ ID NO: 1239285 - RNA, 21 nt, Human
uacaggugugagccacugcac

SEQ ID NO: 1239286 - RNA, 21 nt, Human
uacaggugugagccacugcac

SEQ ID NO: 1239287 - RNA, 22 nt, Human
uacaggugugagccacugcacu

SEQ ID NO: 1239288 - RNA, 21 nt, Human
uaccuuaugaaaaaaagcaau

SEQ ID NO: 1239289 - RNA, 22 nt, Human
uagagacaggguuucaccaugu

SEQ ID NO: 1239290 - RNA, 24 nt, Human
uaguagagacaggguuucaccaug

SEQ ID NO: 1239291 - RNA, 25 nt, Human
uaguagagacaggguuucaccaugu

SEQ ID NO: 1239292 - RNA, 18 nt, Human
uauaaaauuaguaaacaa

SEQ ID NO: 1239293 - RNA, 23 nt, Human
uauaucagcaaaggcagaaagaa

SEQ ID NO: 1239294 - RNA, 25 nt, Human
ucaaucaggccagaaauuaucacaa

SEQ ID NO: 1239295 - RNA, 23 nt, Human
ucacugcaaccuccaccucccgg

SEQ ID NO: 1239296 - RNA, 23 nt, Human
ucacugcaaccuccaccucccgg

SEQ ID NO: 1239297 - RNA, 23 nt, Human
ucacugcaaccuccaccucccgg

SEQ ID NO: 1239298 - RNA, 24 nt, Human
ucacugcaaccuccaccucccggg

SEQ ID NO: 1239299 - RNA, 26 nt, Human
ucacugcaaccuccaccucccggguu

SEQ ID NO: 1239300 - RNA, 18 nt, Human
ucagccucccaaagugcu

SEQ ID NO: 1239301 - RNA, 22 nt, Human
ucaucugccauauugaucaauc

SEQ ID NO: 1239302 - RNA, 22 nt, Human
uccaagagcuaccacagucccc

SEQ ID NO: 1239303 - RNA, 21 nt, Human
uccacccaccucagccuccca

SEQ ID NO: 1239304 - RNA, 23 nt, Human
ucccaaagugcugggauuacagg

SEQ ID NO: 1239305 - RNA, 19 nt, Human
uccccaaaacuacagaaaa

SEQ ID NO: 1239306 - RNA, 21 nt, Human
ucccggguucaagcaauucuc

SEQ ID NO: 1239307 - RNA, 24 nt, Human
ucccggguucaagcaauucuccug

SEQ ID NO: 1239308 - RNA, 24 nt, Human
uccugaguagcugggauuacaggc

SEQ ID NO: 1239309 - RNA, 21 nt, Human
ucucgaacuccugaccucaag

SEQ ID NO: 1239310 - RNA, 19 nt, Human
ucucgcucuauugcuuagg

SEQ ID NO: 1239311 - RNA, 23 nt, Human
ucucgcucuauugcuuaggcugg

SEQ ID NO: 1239312 - RNA, 24 nt, Human
ucucgcucuauugcuuaggcugga

SEQ ID NO: 1239313 - RNA, 22 nt, Human
ucuuucacacaaucccagacaa

SEQ ID NO: 1239314 - RNA, 19 nt, Human
ugaaauuucuagaagcuca

SEQ ID NO: 1239315 - RNA, 24 nt, Human
ugauccacccaccucagccuccca

SEQ ID NO: 1239316 - RNA, 24 nt, Human
ugcugggauuacaggugugagcca

SEQ ID NO: 1239317 - RNA, 24 nt, Human
ugcuuaggcuggaaugcaguggug

SEQ ID NO: 1239318 - RNA, 20 nt, Human
ugcuuuggccuccugaguaa

SEQ ID NO: 1239319 - RNA, 24 nt, Human
uggaaugcaguggugcgaucuugg

SEQ ID NO: 1239320 - RNA, 24 nt, Human
uggccaggcuggucucgaacuccu

SEQ ID NO: 1239321 - RNA, 20 nt, Human
uggccuccugaguagcuggg

SEQ ID NO: 1239322 - RNA, 19 nt, Human
ugggauuacaggcacauca

SEQ ID NO: 1239323 - RNA, 23 nt, Human
ugggauuacaggcacaugcacca

SEQ ID NO: 1239324 - RNA, 18 nt, Human
ugggauuacaggugugag

SEQ ID NO: 1239325 - RNA, 19 nt, Human
ugggauuacaggugugagc

SEQ ID NO: 1239326 - RNA, 21 nt, Human
ugggauuacaggugugagcca

SEQ ID NO: 1239327 - RNA, 22 nt, Human
ugggauuacaggugugagccac

SEQ ID NO: 1239328 - RNA, 22 nt, Human
ugggauuacaggugugagccac

SEQ ID NO: 1239329 - RNA, 24 nt, Human
ugggauuacaggugugagccacug

SEQ ID NO: 1239330 - RNA, 18 nt, Human
ugguagauggugccuucu

SEQ ID NO: 1239331 - RNA, 24 nt, Human
uuacaggugugagccacugcacug

SEQ ID NO: 1239332 - RNA, 24 nt, Human
uuaguagagacaggguuucaccau

SEQ ID NO: 1239333 - RNA, 24 nt, Human
uucagcuguaauuugcaaaacaau

SEQ ID NO: 1239334 - RNA, 23 nt, Human
uucagugucugcugaggacccac

SEQ ID NO: 1239335 - RNA, 20 nt, Human
uugguagauggugccuucuc

SEQ ID NO: 1239336 - RNA, 22 nt, Human
uuucacacaaucccagacaacc

SEQ ID NO: 1239337 - RNA, 24 nt, Human
uuucaccauguuggccaggcuggu

SEQ ID NO: 1239338 - RNA, 21 nt, Human
uuucuguauuuuuaguagaga

SEQ ID NO: 1239339 - RNA, 28 nt, Human
uuugcaaaacaauccaagagcuaccacu

SEQ ID NO: 1239340 - RNA, 24 nt, Human
uuuggccuccugaguagcugggau

SEQ ID NO: 1239341 - RNA, 21 nt, Human
uuuucuguauuuuuaguagag

SEQ ID NO: 1239342 - RNA, 24 nt, Human
uuuucuguauuuuuaguagagaca

SEQ ID NO: 1239343 - RNA, 24 nt, Human
uuuuuaguagagacaggguuucac

SEQ ID NO: 1239344 - RNA, 21 nt, Human
aaacaggggccaaaauugaac

SEQ ID NO: 1239345 - RNA, 26 nt, Human
aagccaaggcacaguuugucgaagaa

SEQ ID NO: 1239346 - RNA, 23 nt, Human
aaucauauccaccaaauguugug

SEQ ID NO: 1239347 - RNA, 21 nt, Human
accaggcguccgccgcccccc

SEQ ID NO: 1239348 - RNA, 20 nt, Human
accuagaauggugccugaua

SEQ ID NO: 1239349 - RNA, 22 nt, Human
agcaaaugacaggaaaagucaa

SEQ ID NO: 1239350 - RNA, 19 nt, Human
aguuugucgaagaagucgg

SEQ ID NO: 1239351 - RNA, 20 nt, Human
auaauggaagcaaucauauc

SEQ ID NO: 1239352 - RNA, 23 nt, Human
auggugccugauacagaaagguu

SEQ ID NO: 1239353 - RNA, 22 nt, Human
auugaaaauuucuuaauuacuu

SEQ ID NO: 1239354 - RNA, 24 nt, Human
caaaccccuaagcuuuacuuuccu

SEQ ID NO: 1239355 - RNA, 18 nt, Human
caaauuuuccacagcagc

SEQ ID NO: 1239356 - RNA, 24 nt, Human
cagcaaaugacaggaaaagucaag

SEQ ID NO: 1239357 - RNA, 19 nt, Human
cagcagacgccgauaccac

SEQ ID NO: 1239358 - RNA, 20 nt, Human
cagccccacaacaacggccc

SEQ ID NO: 1239359 - RNA, 19 nt, Human
cagcgccagcgcgcagccc

SEQ ID NO: 1239360 - RNA, 22 nt, Human
caggcguccgccgccccccgga

SEQ ID NO: 1239361 - RNA, 23 nt, Human
cauaacugacucccacuuuacag

SEQ ID NO: 1239362 - RNA, 19 nt, Human
caucaaauuuccuguugcu

SEQ ID NO: 1239363 - RNA, 23 nt, Human
cauuggguggccaacugccauuc

SEQ ID NO: 1239364 - RNA, 23 nt, Human
ccacagcagcuuucaaaaccugu

SEQ ID NO: 1239365 - RNA, 30 nt, Human
ccaccaucugagcacuaauuucuugacuuu

SEQ ID NO: 1239366 - RNA, 23 nt, Human
ccagaggcgguccagcuucuucc

SEQ ID NO: 1239367 - RNA, 20 nt, Human
ccccccggaccaugcuuucc

SEQ ID NO: 1239368 - RNA, 20 nt, Human
cccccggaccaugcuuuccg

SEQ ID NO: 1239369 - RNA, 21 nt, Human
cccccggaccaugcuuuccgc

SEQ ID NO: 1239370 - RNA, 18 nt, Human
ccgccgccccccggacca

SEQ ID NO: 1239371 - RNA, 18 nt, Human
ccgccgccccccggacca

SEQ ID NO: 1239372 - RNA, 21 nt, Human
ccgccgccccccggaccaugc

SEQ ID NO: 1239373 - RNA, 19 nt, Human
cgcgcagccccacaacaac

SEQ ID NO: 1239374 - RNA, 23 nt, Human
cucaaccaccuauuggcuacaca

SEQ ID NO: 1239375 - RNA, 23 nt, Human
cuccagaggcgguccagcuucuu

SEQ ID NO: 1239376 - RNA, 20 nt, Human
cuguugccccuugcuuucaa

SEQ ID NO: 1239377 - RNA, 18 nt, Human
cuuuccucugaagauagg

SEQ ID NO: 1239378 - RNA, 18 nt, Human
gcagccccacaacaacgg

SEQ ID NO: 1239379 - RNA, 18 nt, Human
ggcgguccagcuucuucc

SEQ ID NO: 1239380 - RNA, 18 nt, Human
gguucuauauaaauguau

SEQ ID NO: 1239381 - RNA, 22 nt, Human
guagaagacaaugcauggacaa

SEQ ID NO: 1239382 - RNA, 22 nt, Human
guuccaguuuugaauucucacu

SEQ ID NO: 1239383 - RNA, 23 nt, Human
uaaauccaaugccuccuuccaaa

SEQ ID NO: 1239384 - RNA, 22 nt, Human
uaauaauauugucuuuuggcac

SEQ ID NO: 1239385 - RNA, 21 nt, Human
uacagcaucccgcccugcagc

SEQ ID NO: 1239386 - RNA, 19 nt, Human
uacuccuagaagccaaggc

SEQ ID NO: 1239387 - RNA, 19 nt, Human
uagaagacaaugcauggac

SEQ ID NO: 1239388 - RNA, 19 nt, Human
uaggugcuagaccuuuggc

SEQ ID NO: 1239389 - RNA, 24 nt, Human
ucaaccaccuauuggcuacacaac

SEQ ID NO: 1239390 - RNA, 22 nt, Human
ucagucauuaaauccaaugccu

SEQ ID NO: 1239391 - RNA, 23 nt, Human
ucagucauuaaauccaaugccuc

SEQ ID NO: 1239392 - RNA, 21 nt, Human
ucccgcgacggccucucucuu

SEQ ID NO: 1239393 - RNA, 24 nt, Human
uccgcucccgcgacggccucucuc

SEQ ID NO: 1239394 - RNA, 22 nt, Human
uccuugacuauuuugucuucuu

SEQ ID NO: 1239395 - RNA, 27 nt, Human
ucugugguaccuagaauggugccugau

SEQ ID NO: 1239396 - RNA, 21 nt, Human
ugaagaaacuacuagagccaa

SEQ ID NO: 1239397 - RNA, 18 nt, Human
uggaucaagcaaaucugu

SEQ ID NO: 1239398 - RNA, 25 nt, Human
uuaaacuaguggguucacaaacccc

SEQ ID NO: 1239399 - RNA, 22 nt, Human
uucacaaaccccuaagcuuuac

SEQ ID NO: 1239400 - RNA, 21 nt, Human
uuccucugauauuuuacaaau

SEQ ID NO: 1239401 - RNA, 19 nt, Human
uucucacucaaccaccuau

SEQ ID NO: 1239402 - RNA, 20 nt, Human
uugauuugaagaaacuacua

SEQ ID NO: 1239403 - RNA, 21 nt, Human
uugauuugaagaaacuacuag

SEQ ID NO: 1239404 - RNA, 22 nt, Human
uugucuucuuucaacaaagucu

SEQ ID NO: 1239405 - RNA, 22 nt, Human
uuuccaucaaggagucuacaca

SEQ ID NO: 1239406 - RNA, 20 nt, Human
uuuggcaaacaauggcagca

SEQ ID NO: 1239407 - RNA, 21 nt, Human
uuuucauuuauuccauuaacu

SEQ ID NO: 1239408 - RNA, 24 nt, Human
aaagugcugggauuacaggcguga

SEQ ID NO: 1239409 - RNA, 18 nt, Human
aacagcuccagagaccaa

SEQ ID NO: 1239410 - RNA, 18 nt, Human
aaggauggggugcgaugg

SEQ ID NO: 1239411 - RNA, 25 nt, Human
aagucugggcagaaaccggagccgg

SEQ ID NO: 1239412 - RNA, 19 nt, Human
aagugcugggauuacaggc

SEQ ID NO: 1239413 - RNA, 19 nt, Human
aagugcugggauuacaggc

SEQ ID NO: 1239414 - RNA, 26 nt, Human
aagugcugggauuacaggcgugagcc

SEQ ID NO: 1239415 - RNA, 23 nt, Human
agaacagcuccagagaccagccc

SEQ ID NO: 1239416 - RNA, 22 nt, Human
agagauaggacccaaccaaauc

SEQ ID NO: 1239417 - RNA, 19 nt, Human
agaucccagggugccucuc

SEQ ID NO: 1239418 - RNA, 24 nt, Human
agauggcaagccccggacugaaca

SEQ ID NO: 1239419 - RNA, 23 nt, Human
agcacaagcuccgagcuggcacc

SEQ ID NO: 1239420 - RNA, 24 nt, Human
agcgcagugucgcgaucucggcuc

SEQ ID NO: 1239421 - RNA, 18 nt, Human
aggaagaaggagcccggc

SEQ ID NO: 1239422 - RNA, 20 nt, Human
agggaaggaggaucgcuccc

SEQ ID NO: 1239423 - RNA, 21 nt, Human
agggaggaagaaggagcccgg

SEQ ID NO: 1239424 - RNA, 22 nt, Human
aguagagauuggguuucuccau

SEQ ID NO: 1239425 - RNA, 18 nt, Human
aguagcugggauuauagg

SEQ ID NO: 1239426 - RNA, 19 nt, Human
aucuggggccgagccgcuc

SEQ ID NO: 1239427 - RNA, 24 nt, Human
auuggguuucuccauguuggucag

SEQ ID NO: 1239428 - RNA, 24 nt, Human
auugugugugugugugugugugug

SEQ ID NO: 1239429 - RNA, 24 nt, Human
caaagugcugggauuacaggcgug

SEQ ID NO: 1239430 - RNA, 19 nt, Human
caaauccuuggccucgcca

SEQ ID NO: 1239431 - RNA, 22 nt, Human
caagccccggacugaacauuuu

SEQ ID NO: 1239432 - RNA, 21 nt, Human
caagcgcccccaucacucuuu

SEQ ID NO: 1239433 - RNA, 19 nt, Human
caagcuccgagcuggcacc

SEQ ID NO: 1239434 - RNA, 21 nt, Human
caagugucccucuucuagucc

SEQ ID NO: 1239435 - RNA, 26 nt, Human
cacagcacaagcuccgagcuggcacc

SEQ ID NO: 1239436 - RNA, 21 nt, Human
caccccuccccagucggcucg

SEQ ID NO: 1239437 - RNA, 18 nt, Human
caccgggaaaacugccga

SEQ ID NO: 1239438 - RNA, 23 nt, Human
cacgcccaggcauccacuuggcc

SEQ ID NO: 1239439 - RNA, 24 nt, Human
cacuacgcccggcuaauuuuugua

SEQ ID NO: 1239440 - RNA, 18 nt, Human
cagaacagcuccagagaa

SEQ ID NO: 1239441 - RNA, 18 nt, Human
cagaacagcuccagagac

SEQ ID NO: 1239442 - RNA, 24 nt, Human
cagagauaggacccaaccaaaucc

SEQ ID NO: 1239443 - RNA, 24 nt, Human
cagcccuggguccccaucuguccu

SEQ ID NO: 1239444 - RNA, 19 nt, Human
caggaccugccgcgagccc

SEQ ID NO: 1239445 - RNA, 22 nt, Human
cauaaaaggaccuagacgucca

SEQ ID NO: 1239446 - RNA, 24 nt, Human
cauguuggucaggcuggucuugaa

SEQ ID NO: 1239447 - RNA, 20 nt, Human
ccaaagugcugggauuacag

SEQ ID NO: 1239448 - RNA, 22 nt, Human
ccaaagugcugggauuacaggc

SEQ ID NO: 1239449 - RNA, 22 nt, Human
ccaaagugcugggauuacaggc

SEQ ID NO: 1239450 - RNA, 24 nt, Human
ccaaagugcugggauuacaggcgu

SEQ ID NO: 1239451 - RNA, 22 nt, Human
ccaacccugcggcucccucugu

SEQ ID NO: 1239452 - RNA, 22 nt, Human
ccacaccccuccccagucggcu

SEQ ID NO: 1239453 - RNA, 21 nt, Human
ccagacagccugcuuugcggg

SEQ ID NO: 1239454 - RNA, 19 nt, Human
ccauguuggucaggcuggu

SEQ ID NO: 1239455 - RNA, 21 nt, Human
ccauguuggucaggcuggucu

SEQ ID NO: 1239456 - RNA, 21 nt, Human
cccaaccaaauccuuggccuc

SEQ ID NO: 1239457 - RNA, 20 nt, Human
ccccaucuguccuccccucc

SEQ ID NO: 1239458 - RNA, 25 nt, Human
ccccgcgcccaagccccggugccuc

SEQ ID NO: 1239459 - RNA, 22 nt, Human
ccccuccaagcugguagcuccc

SEQ ID NO: 1239460 - RNA, 23 nt, Human
cccgaguagcugggauuauaggc

SEQ ID NO: 1239461 - RNA, 24 nt, Human
cccgaguagcugggauuauaggcg

SEQ ID NO: 1239462 - RNA, 23 nt, Human
cccggguucaagcuauuuuccug

SEQ ID NO: 1239463 - RNA, 21 nt, Human
cccguaggcggcucgcggcuu

SEQ ID NO: 1239464 - RNA, 20 nt, Human
cccuccaagcugguagcucc

SEQ ID NO: 1239465 - RNA, 18 nt, Human
ccgcgcccucuuggucug

SEQ ID NO: 1239466 - RNA, 19 nt, Human
ccgcgcccucuuggucugu

SEQ ID NO: 1239467 - RNA, 20 nt, Human
ccgcucaggaccugccgcga

SEQ ID NO: 1239468 - RNA, 20 nt, Human
ccggugccucugcccuagcc

SEQ ID NO: 1239469 - RNA, 20 nt, Human
ccucccugcgcccgccgcuc

SEQ ID NO: 1239470 - RNA, 21 nt, Human
ccucggcguccacaccccucc

SEQ ID NO: 1239471 - RNA, 22 nt, Human
ccucguuccucugcugcucccc

SEQ ID NO: 1239472 - RNA, 18 nt, Human
ccucugcccuagccgagg

SEQ ID NO: 1239473 - RNA, 19 nt, Human
ccucugcggucuucccggg

SEQ ID NO: 1239474 - RNA, 22 nt, Human
ccucuucggcggccgcgagagc

SEQ ID NO: 1239475 - RNA, 21 nt, Human
ccugcgcccgccgcucagaaa

SEQ ID NO: 1239476 - RNA, 22 nt, Human
cgaggccucugcggucuucccg

SEQ ID NO: 1239477 - RNA, 21 nt, Human
cgcccaggcauccacuuggcc

SEQ ID NO: 1239478 - RNA, 23 nt, Human
cgccgcgaagugacccacccucc

SEQ ID NO: 1239479 - RNA, 24 nt, Human
cgccucggccucccaaagugcugg

SEQ ID NO: 1239480 - RNA, 24 nt, Human
cgcgaagugacccacccucccccg

SEQ ID NO: 1239481 - RNA, 19 nt, Human
cgcgcccaagccccggugc

SEQ ID NO: 1239482 - RNA, 20 nt, Human
cgcucccucccucccuugcu

SEQ ID NO: 1239483 - RNA, 21 nt, Human
cggcguccacaccccucccca

SEQ ID NO: 1239484 - RNA, 23 nt, Human
cggcucgcggcuuccccuuuccu

SEQ ID NO: 1239485 - RNA, 24 nt, Human
cgggacagcgggaucccucccagg

SEQ ID NO: 1239486 - RNA, 19 nt, Human
cgggagagggagggaggga

SEQ ID NO: 1239487 - RNA, 28 nt, Human
cggggcauugugugugugugugugugug

SEQ ID NO: 1239488 - RNA, 24 nt, Human
cggguucaagcuauuuuccugucu

SEQ ID NO: 1239489 - RNA, 24 nt, Human
cucagccucccgaguagcugggau

SEQ ID NO: 1239490 - RNA, 23 nt, Human
cuccagagaccagcccuggccag

SEQ ID NO: 1239491 - RNA, 22 nt, Human
cuccagguuccagacagccugc

SEQ ID NO: 1239492 - RNA, 24 nt, Human
cuccauguuggucaggcuggucuu

SEQ ID NO: 1239493 - RNA, 19 nt, Human
cucccaggagccaagccgc

SEQ ID NO: 1239494 - RNA, 26 nt, Human
cucccgaccucaguugauccgcccgc

SEQ ID NO: 1239495 - RNA, 21 nt, Human
cuccugcuucccgaacuacag

SEQ ID NO: 1239496 - RNA, 21 nt, Human
cucgaaacuccugaucucgag

SEQ ID NO: 1239497 - RNA, 19 nt, Human
cucggcguccacaccccuc

SEQ ID NO: 1239498 - RNA, 23 nt, Human
cucggcguccacaccccucccca

SEQ ID NO: 1239499 - RNA, 20 nt, Human
cucuuguugcccaggcugga

SEQ ID NO: 1239500 - RNA, 23 nt, Human
cucuuguugcccaggcuggagcg

SEQ ID NO: 1239501 - RNA, 18 nt, Human
cugaucucgagcacagca

SEQ ID NO: 1239502 - RNA, 18 nt, Human
cugcgcccgccgcucaga

SEQ ID NO: 1239503 - RNA, 22 nt, Human
cugcggcucccucugugacccg

SEQ ID NO: 1239504 - RNA, 18 nt, Human
cuggcgggcucgggacag

SEQ ID NO: 1239505 - RNA, 23 nt, Human
cugucucagccucccgaguagcu

SEQ ID NO: 1239506 - RNA, 22 nt, Human
cuguucgccccauaaaaggacc

SEQ ID NO: 1239507 - RNA, 26 nt, Human
cuuccugcuuuauuccugcaucugau

SEQ ID NO: 1239508 - RNA, 19 nt, Human
cuuggccccuaccccuggc

SEQ ID NO: 1239509 - RNA, 20 nt, Human
gaaaacccucgaaacuccug

SEQ ID NO: 1239510 - RNA, 25 nt, Human
gaacagcuccagagaccagcccugg

SEQ ID NO: 1239511 - RNA, 18 nt, Human
gaaggggaggaggagagg

SEQ ID NO: 1239512 - RNA, 19 nt, Human
gaaggggaggaggagaggg

SEQ ID NO: 1239513 - RNA, 20 nt, Human
gacagggugccuugcacucc

SEQ ID NO: 1239514 - RNA, 24 nt, Human
gaccucaguugauccgcccgccuc

SEQ ID NO: 1239515 - RNA, 18 nt, Human
gacucgcgcucccucccu

SEQ ID NO: 1239516 - RNA, 19 nt, Human
gacucgcgcucccucccuc

SEQ ID NO: 1239517 - RNA, 18 nt, Human
gauuacaggcgugagcca

SEQ ID NO: 1239518 - RNA, 22 nt, Human
gauuacaggcgugagccaccgc

SEQ ID NO: 1239519 - RNA, 22 nt, Human
gauuacaggcgugagccaccgc

SEQ ID NO: 1239520 - RNA, 21 nt, Human
gcauccacuuggccggacaac

SEQ ID NO: 1239521 - RNA, 23 nt, Human
gccaagcgcccccaucacucugg

SEQ ID NO: 1239522 - RNA, 22 nt, Human
gcccaggcuggagcgcaguguc

SEQ ID NO: 1239523 - RNA, 22 nt, Human
gcccggcuaauuuuuguauuuu

SEQ ID NO: 1239524 - RNA, 19 nt, Human
gccgggagagggagggagg

SEQ ID NO: 1239525 - RNA, 22 nt, Human
gcgcucccucccucccuugcuc

SEQ ID NO: 1239526 - RNA, 21 nt, Human
gcucuuguugcccaggcugga

SEQ ID NO: 1239527 - RNA, 23 nt, Human
gcuggucuugaacucccgaccuc

SEQ ID NO: 1239528 - RNA, 18 nt, Human
ggacaacuuucuuccucc

SEQ ID NO: 1239529 - RNA, 23 nt, Human
ggcagaaaccggagccgggccug

SEQ ID NO: 1239530 - RNA, 20 nt, Human
ggcauugugugugugugugu

SEQ ID NO: 1239531 - RNA, 18 nt, Human
ggccucugcggucuuccc

SEQ ID NO: 1239532 - RNA, 20 nt, Human
ggcugaugugugcuaaagcu

SEQ ID NO: 1239533 - RNA, 24 nt, Human
ggcuggucuugaacucccgaccuc

SEQ ID NO: 1239534 - RNA, 23 nt, Human
gggcgggugggcgggcgagcggg

SEQ ID NO: 1239535 - RNA, 21 nt, Human
ggguuucuccauguuggucag

SEQ ID NO: 1239536 - RNA, 18 nt, Human
guagcugggauuauaggc

SEQ ID NO: 1239537 - RNA, 24 nt, Human
gucuguuucggaaagcgcucuggg

SEQ ID NO: 1239538 - RNA, 18 nt, Human
gugaaguggucugcuccg

SEQ ID NO: 1239539 - RNA, 18 nt, Human
gugggaaggggaggagga

SEQ ID NO: 1239540 - RNA, 24 nt, Human
gugggaaggggaggaggagaggga

SEQ ID NO: 1239541 - RNA, 21 nt, Human
gugugugugugugugugugug

SEQ ID NO: 1239542 - RNA, 21 nt, Human
gugugugugugugugugugug

SEQ ID NO: 1239543 - RNA, 24 nt, Human
uaauuuuuguauuuuuaguagaga

SEQ ID NO: 1239544 - RNA, 23 nt, Human
uacaggcgugagccaccgcgccc

SEQ ID NO: 1239545 - RNA, 18 nt, Human
uaccccuggcgggcucgg

SEQ ID NO: 1239546 - RNA, 21 nt, Human
uaggaaggauggggugcgaug

SEQ ID NO: 1239547 - RNA, 24 nt, Human
uaguagagacaagcauaucgaacg

SEQ ID NO: 1239548 - RNA, 24 nt, Human
uaguagagauuggguuucuccaug

SEQ ID NO: 1239549 - RNA, 24 nt, Human
ucaccgcaaucuccgccucccggg

SEQ ID NO: 1239550 - RNA, 25 nt, Human
ucaccgcaaucuccgccucccgggu

SEQ ID NO: 1239551 - RNA, 20 nt, Human
ucagccucccgaguagcugg

SEQ ID NO: 1239552 - RNA, 24 nt, Human
uccacaccccuccccagucggcuc

SEQ ID NO: 1239553 - RNA, 24 nt, Human
uccauguuggucaggcuggucuug

SEQ ID NO: 1239554 - RNA, 24 nt, Human
ucccaaagugcugggauuacaggc

SEQ ID NO: 1239555 - RNA, 19 nt, Human
ucccaggagccaagccgcc

SEQ ID NO: 1239556 - RNA, 19 nt, Human
uccccaucuguccuccccu

SEQ ID NO: 1239557 - RNA, 20 nt, Human
uccccgcgcccaagccccgg

SEQ ID NO: 1239558 - RNA, 24 nt, Human
ucccgaguagcugggauuauaggc

SEQ ID NO: 1239559 - RNA, 21 nt, Human
ucccggguucaagcuauuuuc

SEQ ID NO: 1239560 - RNA, 24 nt, Human
ucccggguucaagcuauuuuccug

SEQ ID NO: 1239561 - RNA, 18 nt, Human
ucccuucguccgucuccu

SEQ ID NO: 1239562 - RNA, 24 nt, Human
ucccuucguccgucuccucccccg

SEQ ID NO: 1239563 - RNA, 19 nt, Human
uccgggcgcaucgaaaccg

SEQ ID NO: 1239564 - RNA, 27 nt, Human
uccuuggccucgccaagcgcccccauc

SEQ ID NO: 1239565 - RNA, 18 nt, Human
ucggccucccaaagugcu

SEQ ID NO: 1239566 - RNA, 21 nt, Human
ucuucggcggccgcgagagcg

SEQ ID NO: 1239567 - RNA, 20 nt, Human
ugaacucccgaccucaguug

SEQ ID NO: 1239568 - RNA, 19 nt, Human
ugacccgggaccagccccg

SEQ ID NO: 1239569 - RNA, 19 nt, Human
ugaccugcgaccucccugc

SEQ ID NO: 1239570 - RNA, 20 nt, Human
ugagcagcgcugugucuguu

SEQ ID NO: 1239571 - RNA, 19 nt, Human
ugaggaguugguaguagag

SEQ ID NO: 1239572 - RNA, 23 nt, Human
ugauccgcccgccucggccuccc

SEQ ID NO: 1239573 - RNA, 18 nt, Human
ugcaucugauuauugggc

SEQ ID NO: 1239574 - RNA, 21 nt, Human
ugcccuagccgaggccucugc

SEQ ID NO: 1239575 - RNA, 19 nt, Human
ugccgcgagccccggggug

SEQ ID NO: 1239576 - RNA, 23 nt, Human
ugccucugcccuagccgaggccu

SEQ ID NO: 1239577 - RNA, 23 nt, Human
ugccuugcacucccucacgccca

SEQ ID NO: 1239578 - RNA, 24 nt, Human
ugcgggaagcgggcuguggagaaa

SEQ ID NO: 1239579 - RNA, 24 nt, Human
ugcugggauuacaggcgugagcca

SEQ ID NO: 1239580 - RNA, 24 nt, Human
ugcuuuauuccugcaucugauuaa

SEQ ID NO: 1239581 - RNA, 21 nt, Human
ugcuuuuuuucuuccuuagga

SEQ ID NO: 1239582 - RNA, 19 nt, Human
uggaagcacuccggcggag

SEQ ID NO: 1239583 - RNA, 20 nt, Human
uggaauaggcaacaaaugga

SEQ ID NO: 1239584 - RNA, 19 nt, Human
uggagcgcagugucgcgau

SEQ ID NO: 1239585 - RNA, 24 nt, Human
uggagcgcagugucgcgaucucgg

SEQ ID NO: 1239586 - RNA, 19 nt, Human
uggcaccgggcugagucaa

SEQ ID NO: 1239587 - RNA, 22 nt, Human
ugggaaggggaggaggagaggg

SEQ ID NO: 1239588 - RNA, 18 nt, Human
ugggauuacaggcgugag

SEQ ID NO: 1239589 - RNA, 19 nt, Human
ugggauuacaggcgugagc

SEQ ID NO: 1239590 - RNA, 21 nt, Human
ugggauuacaggcgugagcca

SEQ ID NO: 1239591 - RNA, 22 nt, Human
ugggauuacaggcgugagccac

SEQ ID NO: 1239592 - RNA, 23 nt, Human
ugggauuacaggcgugagccacc

SEQ ID NO: 1239593 - RNA, 24 nt, Human
ugggauuacaggcgugagccaccg

SEQ ID NO: 1239594 - RNA, 18 nt, Human
ugggauuauaggcgcgcg

SEQ ID NO: 1239595 - RNA, 22 nt, Human
ugggauuauaggcgcgcgccac

SEQ ID NO: 1239596 - RNA, 22 nt, Human
ugggauuauaggcgcgcgccac

SEQ ID NO: 1239597 - RNA, 24 nt, Human
ugggauuauaggcgcgcgccacua

SEQ ID NO: 1239598 - RNA, 19 nt, Human
ugggcgggcgagcgggcac

SEQ ID NO: 1239599 - RNA, 21 nt, Human
ugggggaggcggcgggggagg

SEQ ID NO: 1239600 - RNA, 23 nt, Human
uggguuucuccauguuggucagg

SEQ ID NO: 1239601 - RNA, 18 nt, Human
ugguagcucccgcgcccu

SEQ ID NO: 1239602 - RNA, 23 nt, Human
uggucaggcuggucuugaacucc

SEQ ID NO: 1239603 - RNA, 20 nt, Human
uggucugcuccggauggcuc

SEQ ID NO: 1239604 - RNA, 21 nt, Human
uggugggcgcucccucuccuc

SEQ ID NO: 1239605 - RNA, 24 nt, Human
uguccuccccuccaagcugguaau

SEQ ID NO: 1239606 - RNA, 24 nt, Human
ugucucagccucccgaguagcugg

SEQ ID NO: 1239607 - RNA, 18 nt, Human
ugugagcagcgcuguguc

SEQ ID NO: 1239608 - RNA, 22 nt, Human
ugugugugugugugagcagcgc

SEQ ID NO: 1239609 - RNA, 18 nt, Human
ugugugugugugugugug

SEQ ID NO: 1239610 - RNA, 18 nt, Human
ugugugugugugugugug

SEQ ID NO: 1239611 - RNA, 18 nt, Human
ugugugugugugugugug

SEQ ID NO: 1239612 - RNA, 18 nt, Human
ugugugugugugugugug

SEQ ID NO: 1239613 - RNA, 18 nt, Human
ugugugugugugugugug

SEQ ID NO: 1239614 - RNA, 18 nt, Human
ugugugugugugugugug

SEQ ID NO: 1239615 - RNA, 18 nt, Human
ugugugugugugugugug

SEQ ID NO: 1239616 - RNA, 21 nt, Human
ugugugugugugugugugugu

SEQ ID NO: 1239617 - RNA, 21 nt, Human
ugugugugugugugugugugu

SEQ ID NO: 1239618 - RNA, 21 nt, Human
ugugugugugugugugugugu

SEQ ID NO: 1239619 - RNA, 21 nt, Human
ugugugugugugugugugugu

SEQ ID NO: 1239620 - RNA, 21 nt, Human
ugugugugugugugugugugu

SEQ ID NO: 1239621 - RNA, 21 nt, Human
ugugugugugugugugugugu

SEQ ID NO: 1239622 - RNA, 21 nt, Human
ugugugugugugugugugugu

SEQ ID NO: 1239623 - RNA, 21 nt, Human
ugugugugugugugugugugu

SEQ ID NO: 1239624 - RNA, 21 nt, Human
ugugugugugugugugugugu

SEQ ID NO: 1239625 - RNA, 21 nt, Human
ugugugugugugugugugugu

SEQ ID NO: 1239626 - RNA, 21 nt, Human
ugugugugugugugugugugu

SEQ ID NO: 1239627 - RNA, 21 nt, Human
ugugugugugugugugugugu

SEQ ID NO: 1239628 - RNA, 22 nt, Human
ugugugugugugugugugugug

SEQ ID NO: 1239629 - RNA, 22 nt, Human
ugugugugugugugugugugug

SEQ ID NO: 1239630 - RNA, 22 nt, Human
ugugugugugugugugugugug

SEQ ID NO: 1239631 - RNA, 18 nt, Human
uuaguagagauuggguuu

SEQ ID NO: 1239632 - RNA, 24 nt, Human
uuaguagagauuggguuucuccau

SEQ ID NO: 1239633 - RNA, 21 nt, Human
uucaagcuauuuuccugucuc

SEQ ID NO: 1239634 - RNA, 19 nt, Human
uuccagacagccugcuuug

SEQ ID NO: 1239635 - RNA, 18 nt, Human
uuccuccagguuccagac

SEQ ID NO: 1239636 - RNA, 26 nt, Human
uuccucggcguucaccgagcgccgcg

SEQ ID NO: 1239637 - RNA, 19 nt, Human
uuccucugcugcuccccgc

SEQ ID NO: 1239638 - RNA, 23 nt, Human
uugcucuuguugcccaggcugga

SEQ ID NO: 1239639 - RNA, 24 nt, Human
uuggguuucuccauguuggucagg

SEQ ID NO: 1239640 - RNA, 20 nt, Human
uuucaaacaaauacaaaguu

SEQ ID NO: 1239641 - RNA, 19 nt, Human
uuucagagaaagucugggc

SEQ ID NO: 1239642 - RNA, 20 nt, Human
uuucagagaaagucugggca

SEQ ID NO: 1239643 - RNA, 21 nt, Human
uuucuccauguuggucaggcu

SEQ ID NO: 1239644 - RNA, 24 nt, Human
uuugcucuuguugcccaggcugga

SEQ ID NO: 1239645 - RNA, 24 nt, Human
uuuugcucuuguugcccaggcugg

SEQ ID NO: 1239646 - RNA, 19 nt, Human
uuuuuaguagagauugggu

SEQ ID NO: 1239647 - RNA, 20 nt, Human
uuuuuguauuuuuaguagag

SEQ ID NO: 1239648 - RNA, 25 nt, Human
acaggacuccccggcgggcggcggg

SEQ ID NO: 1239649 - RNA, 22 nt, Human
agcugggcaagcagcauuuggu

SEQ ID NO: 1239650 - RNA, 21 nt, Human
aggacuccccggcgggcggcg

SEQ ID NO: 1239651 - RNA, 25 nt, Human
aggcggcggcgaagucgggcggcgg

SEQ ID NO: 1239652 - RNA, 24 nt, Human
ccggcuccaggcggcggcgaaguc

SEQ ID NO: 1239653 - RNA, 24 nt, Human
gaggucgcggccagccggcuccag

SEQ ID NO: 1239654 - RNA, 22 nt, Human
gcgggcggcugaggucgcggcc

SEQ ID NO: 1239655 - RNA, 21 nt, Human
gcuccggcagacgagggcaaa

SEQ ID NO: 1239656 - RNA, 19 nt, Human
ggcggcggggcgcgcgggc

SEQ ID NO: 1239657 - RNA, 19 nt, Human
ggcggcggggcgcgcgggc

SEQ ID NO: 1239658 - RNA, 20 nt, Human
gggcggcggggcgcgcgggc

SEQ ID NO: 1239659 - RNA, 18 nt, Human
uaagagggggcauaggug

SEQ ID NO: 1239660 - RNA, 23 nt, Human
ucgcggccagccggcuccaggcg

SEQ ID NO: 1239661 - RNA, 21 nt, Human
uuaaugagcuugaugaagucc

SEQ ID NO: 1239662 - RNA, 24 nt, Human
uuugcucucuguacgccagcuggg

SEQ ID NO: 1239663 - RNA, 18 nt, Human
aaccccgagguggauggu

SEQ ID NO: 1239664 - RNA, 19 nt, Human
aaccccgagguggaugguc

SEQ ID NO: 1239665 - RNA, 23 nt, Human
aagcaagugaacacccugacagg

SEQ ID NO: 1239666 - RNA, 21 nt, Human
acaaggcagcaaaaguuggaa

SEQ ID NO: 1239667 - RNA, 20 nt, Human
acccccggaucccugcaagc

SEQ ID NO: 1239668 - RNA, 22 nt, Human
accccgagguggauggucugaa

SEQ ID NO: 1239669 - RNA, 22 nt, Human
agacaauaaaagcaagugaaca

SEQ ID NO: 1239670 - RNA, 23 nt, Human
agacaauaaaagcaagugaacac

SEQ ID NO: 1239671 - RNA, 23 nt, Human
agcaagugaacacccugacagga

SEQ ID NO: 1239672 - RNA, 19 nt, Human
aggauguuuuaggagaagc

SEQ ID NO: 1239673 - RNA, 21 nt, Human
aggcagcaaaaguuggaagcc

SEQ ID NO: 1239674 - RNA, 24 nt, Human
aucugccuuaggcgggaaaugcug

SEQ ID NO: 1239675 - RNA, 25 nt, Human
caaccccgagguggauggucugaag

SEQ ID NO: 1239676 - RNA, 21 nt, Human
caagugaacacccugacagga

SEQ ID NO: 1239677 - RNA, 21 nt, Human
caauaaaagcaagugaacacc

SEQ ID NO: 1239678 - RNA, 21 nt, Human
cacuacacaaggcagcaaaag

SEQ ID NO: 1239679 - RNA, 18 nt, Human
ccccggaucccugcaagc

SEQ ID NO: 1239680 - RNA, 20 nt, Human
cucaccucucugcacuucca

SEQ ID NO: 1239681 - RNA, 23 nt, Human
cuggagacaggggccucggucaa

SEQ ID NO: 1239682 - RNA, 18 nt, Human
gaccucaaccagcaggau

SEQ ID NO: 1239683 - RNA, 19 nt, Human
gcuggagacaggggccucg

SEQ ID NO: 1239684 - RNA, 20 nt, Human
gggaaaugcuguugcuggau

SEQ ID NO: 1239685 - RNA, 21 nt, Human
uaaaagcaagugaacacccug

SEQ ID NO: 1239686 - RNA, 23 nt, Human
uaagccugcuuguagccagugau

SEQ ID NO: 1239687 - RNA, 23 nt, Human
uagccgcaggaagcggccuugcu

SEQ ID NO: 1239688 - RNA, 20 nt, Human
uaugcagacaauaaaagcaa

SEQ ID NO: 1239689 - RNA, 19 nt, Human
ucccugcaagcagucgccu

SEQ ID NO: 1239690 - RNA, 21 nt, Human
ucuuacaacaauuaaauguau

SEQ ID NO: 1239691 - RNA, 26 nt, Human
ugcagacaauaaaagcaagugaacac

SEQ ID NO: 1239692 - RNA, 21 nt, Human
ugccuaagccugcuuguagcc

SEQ ID NO: 1239693 - RNA, 18 nt, Human
ugcggcgagugucucacc

SEQ ID NO: 1239694 - RNA, 19 nt, Human
uggaagccuggagugccua

SEQ ID NO: 1239695 - RNA, 19 nt, Human
uggucauguggauuuccag

SEQ ID NO: 1239696 - RNA, 23 nt, Human
ugucucaccucucugcacuucca

SEQ ID NO: 1239697 - RNA, 21 nt, Human
uuagccgcaggaagcggccuu

SEQ ID NO: 1239698 - RNA, 24 nt, Human
uugcaaccccgagguggauggucu

SEQ ID NO: 1239699 - RNA, 19 nt, Human
aaacagccacagaagucag

SEQ ID NO: 1239700 - RNA, 27 nt, Human
aaacagccacagaagucagaaccaaau

SEQ ID NO: 1239701 - RNA, 24 nt, Human
aaaguacuaagauuacaggcauga

SEQ ID NO: 1239702 - RNA, 23 nt, Human
aaagucuuucuaaggcagcauau

SEQ ID NO: 1239703 - RNA, 21 nt, Human
aagaugccuuuccuauaauug

SEQ ID NO: 1239704 - RNA, 22 nt, Human
aagucaaauagauguggccaaa

SEQ ID NO: 1239705 - RNA, 23 nt, Human
acaagaaauaaugacuucuuuca

SEQ ID NO: 1239706 - RNA, 18 nt, Human
acaggguuucaccguguu

SEQ ID NO: 1239707 - RNA, 19 nt, Human
acaggguuucaccguguua

SEQ ID NO: 1239708 - RNA, 20 nt, Human
acaggguuucaccguguuag

SEQ ID NO: 1239709 - RNA, 24 nt, Human
acaggguuucaccguguuagccag

SEQ ID NO: 1239710 - RNA, 18 nt, Human
acagugcuaacagcaaac

SEQ ID NO: 1239711 - RNA, 20 nt, Human
accugccaggccccucccca

SEQ ID NO: 1239712 - RNA, 20 nt, Human
acugcaagcuccgccuccug

SEQ ID NO: 1239713 - RNA, 21 nt, Human
agaaaaauucucuauaaaagc

SEQ ID NO: 1239714 - RNA, 18 nt, Human
agacaggguuucaccgug

SEQ ID NO: 1239715 - RNA, 20 nt, Human
agacugaaauauacagcaac

SEQ ID NO: 1239716 - RNA, 19 nt, Human
agagacaggguuucaccgu

SEQ ID NO: 1239717 - RNA, 22 nt, Human
agauuacaggcaugagcaacug

SEQ ID NO: 1239718 - RNA, 21 nt, Human
agccacagaagucagaaccaa

SEQ ID NO: 1239719 - RNA, 21 nt, Human
agcccuggccagcccggccuc

SEQ ID NO: 1239720 - RNA, 19 nt, Human
agcuauugcuaauggaagg

SEQ ID NO: 1239721 - RNA, 22 nt, Human
aggaaaaauggagaaauaaugc

SEQ ID NO: 1239722 - RNA, 25 nt, Human
aggcuggagugcaguggcgugaucu

SEQ ID NO: 1239723 - RNA, 20 nt, Human
aguagagacaggguuucacc

SEQ ID NO: 1239724 - RNA, 20 nt, Human
agugauccuccugccucagc

SEQ ID NO: 1239725 - RNA, 19 nt, Human
agugcaguggcgugaucuc

SEQ ID NO: 1239726 - RNA, 20 nt, Human
agugcaguggcgugaucucg

SEQ ID NO: 1239727 - RNA, 23 nt, Human
agugcaguggcgugaucucggcu

SEQ ID NO: 1239728 - RNA, 24 nt, Human
agugcaguggcgugaucucggcuc

SEQ ID NO: 1239729 - RNA, 24 nt, Human
caaaguacuaagauuacaggcaug

SEQ ID NO: 1239730 - RNA, 23 nt, Human
caacaaacacuguaaaaugcuau

SEQ ID NO: 1239731 - RNA, 20 nt, Human
cacaaucaucuuuaucuuag

SEQ ID NO: 1239732 - RNA, 22 nt, Human
cacaccauucuccugccucagc

SEQ ID NO: 1239733 - RNA, 19 nt, Human
cacccccuccugcguccgc

SEQ ID NO: 1239734 - RNA, 18 nt, Human
caccguguuagccaggau

SEQ ID NO: 1239735 - RNA, 24 nt, Human
caccguguuagccaggauggucuc

SEQ ID NO: 1239736 - RNA, 24 nt, Human
caggguuucaccguguuagccagg

SEQ ID NO: 1239737 - RNA, 19 nt, Human
caggugcccgccaccaugc

SEQ ID NO: 1239738 - RNA, 21 nt, Human
caggugcccgccaccaugcuc

SEQ ID NO: 1239739 - RNA, 22 nt, Human
cagugcuaacagcaaacugaca

SEQ ID NO: 1239740 - RNA, 22 nt, Human
cagugucucauuguugcccagg

SEQ ID NO: 1239741 - RNA, 24 nt, Human
caugauaaggcucuccaggaaaaa

SEQ ID NO: 1239742 - RNA, 19 nt, Human
cauuguugcccaggcuggu

SEQ ID NO: 1239743 - RNA, 22 nt, Human
cauuguugcccaggcuggucuc

SEQ ID NO: 1239744 - RNA, 24 nt, Human
ccaaaguacuaagauuacaggcau

SEQ ID NO: 1239745 - RNA, 19 nt, Human
ccaaguaaucaaucaucau

SEQ ID NO: 1239746 - RNA, 21 nt, Human
ccacaccauucuccugccuca

SEQ ID NO: 1239747 - RNA, 21 nt, Human
ccacagaagucagaaccaaau

SEQ ID NO: 1239748 - RNA, 23 nt, Human
ccaccuggaccuguaagccucug

SEQ ID NO: 1239749 - RNA, 19 nt, Human
ccagccauacacaaucauc

SEQ ID NO: 1239750 - RNA, 21 nt, Human
cccaggcuggagugcaguggc

SEQ ID NO: 1239751 - RNA, 22 nt, Human
cccaggcuggagugcaguggcg

SEQ ID NO: 1239752 - RNA, 23 nt, Human
cccagguggcugggacuacaggu

SEQ ID NO: 1239753 - RNA, 24 nt, Human
cccagguggcugggacuacaggug

SEQ ID NO: 1239754 - RNA, 19 nt, Human
ccccagacacacccccucc

SEQ ID NO: 1239755 - RNA, 18 nt, Human
cccuauauuuuaaacagc

SEQ ID NO: 1239756 - RNA, 23 nt, Human
cccucaaguuauccgggcuucua

SEQ ID NO: 1239757 - RNA, 23 nt, Human
cccuggccagcccggccucucca

SEQ ID NO: 1239758 - RNA, 19 nt, Human
ccgaagcccuggccagccc

SEQ ID NO: 1239759 - RNA, 24 nt, Human
ccucccagguggcugggacuacag

SEQ ID NO: 1239760 - RNA, 22 nt, Human
ccuccccagacacacccccucc

SEQ ID NO: 1239761 - RNA, 24 nt, Human
ccuccuggguccacaccauucucc

SEQ ID NO: 1239762 - RNA, 22 nt, Human
ccugccaggccccuccccagac

SEQ ID NO: 1239763 - RNA, 23 nt, Human
ccugccucagccucccagguggc

SEQ ID NO: 1239764 - RNA, 24 nt, Human
ccugccucagccucccagguggcu

SEQ ID NO: 1239765 - RNA, 21 nt, Human
ccuggccuugagugauccucc

SEQ ID NO: 1239766 - RNA, 22 nt, Human
ccuggccuugagugauccuccu

SEQ ID NO: 1239767 - RNA, 22 nt, Human
ccuugagugauccuccugccuc

SEQ ID NO: 1239768 - RNA, 19 nt, Human
cgccuccuggguccacacc

SEQ ID NO: 1239769 - RNA, 24 nt, Human
cgcucugucgcccaggcuggagug

SEQ ID NO: 1239770 - RNA, 25 nt, Human
cggaggccgaagcccuggccagccc

SEQ ID NO: 1239771 - RNA, 24 nt, Human
cucagccucccagguggcugggac

SEQ ID NO: 1239772 - RNA, 23 nt, Human
cuccaccuggaccuguaagccuc

SEQ ID NO: 1239773 - RNA, 21 nt, Human
cucccaaaguacuaagauuac

SEQ ID NO: 1239774 - RNA, 22 nt, Human
cucccagccauacacaaucauc

SEQ ID NO: 1239775 - RNA, 20 nt, Human
cuccugccucagccucccag

SEQ ID NO: 1239776 - RNA, 19 nt, Human
cuccugcguccgccccgcc

SEQ ID NO: 1239777 - RNA, 18 nt, Human
cuccuggguccacaccau

SEQ ID NO: 1239778 - RNA, 21 nt, Human
cuccuggguccacaccauucu

SEQ ID NO: 1239779 - RNA, 24 nt, Human
cucgcucugucgcccaggcuggag

SEQ ID NO: 1239780 - RNA, 22 nt, Human
cuggaccuguaagccucuggcc

SEQ ID NO: 1239781 - RNA, 19 nt, Human
cuggguuccucugcaauug

SEQ ID NO: 1239782 - RNA, 18 nt, Human
cuguaagccucuggccgc

SEQ ID NO: 1239783 - RNA, 25 nt, Human
cuguaagccucuggccgcgaaacuc

SEQ ID NO: 1239784 - RNA, 20 nt, Human
cuucugggaccugccaggcc

SEQ ID NO: 1239785 - RNA, 24 nt, Human
cuugagugauccuccugccucagc

SEQ ID NO: 1239786 - RNA, 21 nt, Human
gaagucagaaccaaauucagg

SEQ ID NO: 1239787 - RNA, 22 nt, Human
gaccucaugauccgccgugccc

SEQ ID NO: 1239788 - RNA, 22 nt, Human
gacuacaggugcccgccaccau

SEQ ID NO: 1239789 - RNA, 22 nt, Human
gauuacaggcaugagcaacugc

SEQ ID NO: 1239790 - RNA, 21 nt, Human
gccacagaagucagaaccaaa

SEQ ID NO: 1239791 - RNA, 20 nt, Human
gcccaggcuggagugcagug

SEQ ID NO: 1239792 - RNA, 24 nt, Human
gccucagccucccagguggcuggg

SEQ ID NO: 1239793 - RNA, 23 nt, Human
gccuccuggguccacaccauucu

SEQ ID NO: 1239794 - RNA, 25 nt, Human
gcucugucgcccaggcuggagugca

SEQ ID NO: 1239795 - RNA, 23 nt, Human
ggaccugccaggccccuccccag

SEQ ID NO: 1239796 - RNA, 22 nt, Human
ggccuugagugauccuccugcc

SEQ ID NO: 1239797 - RNA, 22 nt, Human
ggcuggagugcaguggcgugau

SEQ ID NO: 1239798 - RNA, 24 nt, Human
ggcuggucucaaacuccuggccuu

SEQ ID NO: 1239799 - RNA, 20 nt, Human
ggucucaauuuccugaccuc

SEQ ID NO: 1239800 - RNA, 24 nt, Human
gugauccuccugccucagccuccc

SEQ ID NO: 1239801 - RNA, 21 nt, Human
gugaucucggcucacugcaag

SEQ ID NO: 1239802 - RNA, 22 nt, Human
uaaaagugggaagaacuuauuu

SEQ ID NO: 1239803 - RNA, 22 nt, Human
uaaacagccacagaagucagaa

SEQ ID NO: 1239804 - RNA, 23 nt, Human
uaaacagccacagaagucagaac

SEQ ID NO: 1239805 - RNA, 19 nt, Human
uaagauuacaggcaugagc

SEQ ID NO: 1239806 - RNA, 23 nt, Human
uaagauuacaggcaugagcaacu

SEQ ID NO: 1239807 - RNA, 23 nt, Human
uaauaugcauuucuuccauuaca

SEQ ID NO: 1239808 - RNA, 23 nt, Human
uacuaagauuacaggcaugagca

SEQ ID NO: 1239809 - RNA, 22 nt, Human
uagagacaggguuucaccgugu

SEQ ID NO: 1239810 - RNA, 21 nt, Human
uaguagagacaggguuucacc

SEQ ID NO: 1239811 - RNA, 24 nt, Human
uaguagagacaggguuucaccgug

SEQ ID NO: 1239812 - RNA, 26 nt, Human
uaguagagacaggguuucaccguguu

SEQ ID NO: 1239813 - RNA, 20 nt, Human
uaguagaucaccuggugaga

SEQ ID NO: 1239814 - RNA, 24 nt, Human
ucaccguguuagccaggauggucu

SEQ ID NO: 1239815 - RNA, 18 nt, Human
ucacugcaagcuccgccu

SEQ ID NO: 1239816 - RNA, 23 nt, Human
ucacugcaagcuccgccuccugg

SEQ ID NO: 1239817 - RNA, 24 nt, Human
ucacugcaagcuccgccuccuggg

SEQ ID NO: 1239818 - RNA, 20 nt, Human
ucagguuuccaacaaacacu

SEQ ID NO: 1239819 - RNA, 25 nt, Human
uccaggaaaaaauauucacaagaaa

SEQ ID NO: 1239820 - RNA, 24 nt, Human
ucccaaaguacuaagauuacaggc

SEQ ID NO: 1239821 - RNA, 24 nt, Human
ucccagguggcugggacuacaggu

SEQ ID NO: 1239822 - RNA, 22 nt, Human
uccccagacacacccccuccug

SEQ ID NO: 1239823 - RNA, 24 nt, Human
uccccucauauucagccuucaacc

SEQ ID NO: 1239824 - RNA, 27 nt, Human
uccuccugccucagccucccaaaguac

SEQ ID NO: 1239825 - RNA, 19 nt, Human
uccugaccucaugauccgc

SEQ ID NO: 1239826 - RNA, 24 nt, Human
uccuggguccacaccauucuccug

SEQ ID NO: 1239827 - RNA, 22 nt, Human
ucgcccaggcuggagugcagug

SEQ ID NO: 1239828 - RNA, 24 nt, Human
ucgcucugucgcccaggcuggagu

SEQ ID NO: 1239829 - RNA, 21 nt, Human
ucucauuguugcccaggcugg

SEQ ID NO: 1239830 - RNA, 22 nt, Human
ucucauuguugcccaggcuggu

SEQ ID NO: 1239831 - RNA, 26 nt, Human
ucuccugccucagccucccagguggc

SEQ ID NO: 1239832 - RNA, 19 nt, Human
ucucgcucugucgcccagg

SEQ ID NO: 1239833 - RNA, 23 nt, Human
ucucgcucugucgcccaggcugg

SEQ ID NO: 1239834 - RNA, 24 nt, Human
ucucgcucugucgcccaggcugga

SEQ ID NO: 1239835 - RNA, 26 nt, Human
ucucgcucugucgcccaggcuggagu

SEQ ID NO: 1239836 - RNA, 27 nt, Human
ucucgcucugucgcccaggcuggagug

SEQ ID NO: 1239837 - RNA, 18 nt, Human
ucugcaauugcugucaug

SEQ ID NO: 1239838 - RNA, 25 nt, Human
ucugcauauaacuuaauaugcauuu

SEQ ID NO: 1239839 - RNA, 24 nt, Human
ucugucgcccaggcuggagugcag

SEQ ID NO: 1239840 - RNA, 22 nt, Human
ucuuauuucuuuucuuuuucuu

SEQ ID NO: 1239841 - RNA, 22 nt, Human
ugaaaaauacuucaguuuuauc

SEQ ID NO: 1239842 - RNA, 22 nt, Human
ugagacggagucucgcucuguc

SEQ ID NO: 1239843 - RNA, 27 nt, Human
ugagugauccuccugccucagccuccc

SEQ ID NO: 1239844 - RNA, 27 nt, Human
ugagugauccuccugccucagccuccc

SEQ ID NO: 1239845 - RNA, 24 nt, Human
ugcccaggcuggucucaaacuccu

SEQ ID NO: 1239846 - RNA, 24 nt, Human
ugccucagccucccaaaguacuaa

SEQ ID NO: 1239847 - RNA, 24 nt, Human
ugccucagccucccagguggcugg

SEQ ID NO: 1239848 - RNA, 19 nt, Human
uggagugcaguggcgugau

SEQ ID NO: 1239849 - RNA, 23 nt, Human
uggagugcaguggcgugaucucg

SEQ ID NO: 1239850 - RNA, 24 nt, Human
uggagugcaguggcgugaucucgg

SEQ ID NO: 1239851 - RNA, 23 nt, Human
uggccaaaucaauauaucccuug

SEQ ID NO: 1239852 - RNA, 20 nt, Human
uggccuugagugauccuccu

SEQ ID NO: 1239853 - RNA, 24 nt, Human
uggccuugagugauccuccugccu

SEQ ID NO: 1239854 - RNA, 20 nt, Human
uggcgugaucucggcucacu

SEQ ID NO: 1239855 - RNA, 20 nt, Human
uggcugggacuacaggugcc

SEQ ID NO: 1239856 - RNA, 21 nt, Human
ugggacuacaggugcccgcca

SEQ ID NO: 1239857 - RNA, 22 nt, Human
ugggacuacaggugcccgccac

SEQ ID NO: 1239858 - RNA, 24 nt, Human
ugggacuacaggugcccgccacca

SEQ ID NO: 1239859 - RNA, 25 nt, Human
ugggacuacaggugcccgccaccau

SEQ ID NO: 1239860 - RNA, 20 nt, Human
uggguccacaccauucuccu

SEQ ID NO: 1239861 - RNA, 22 nt, Human
ugucucauuguugcccaggcug

SEQ ID NO: 1239862 - RNA, 20 nt, Human
ugucuuguuagacuuccccu

SEQ ID NO: 1239863 - RNA, 22 nt, Human
uguugcccaggcuggucucaaa

SEQ ID NO: 1239864 - RNA, 22 nt, Human
uuaacacagucauaaauauccc

SEQ ID NO: 1239865 - RNA, 18 nt, Human
uuaauaucugcauauaac

SEQ ID NO: 1239866 - RNA, 22 nt, Human
uuaguagagacaggguuucacc

SEQ ID NO: 1239867 - RNA, 24 nt, Human
uuaguagagacaggguuucaccgu

SEQ ID NO: 1239868 - RNA, 25 nt, Human
uucccgacgccggaggccgaagccc

SEQ ID NO: 1239869 - RNA, 22 nt, Human
uucuccugccucagccucccag

SEQ ID NO: 1239870 - RNA, 22 nt, Human
uuguugcccaggcuggucucaa

SEQ ID NO: 1239871 - RNA, 23 nt, Human
uuguugcccaggcuggucucaaa

SEQ ID NO: 1239872 - RNA, 19 nt, Human
uuucaccguguuagccagg

SEQ ID NO: 1239873 - RNA, 19 nt, Human
uuuccaaaaguacaaacag

SEQ ID NO: 1239874 - RNA, 19 nt, Human
uuuccaaaaguacaaacag

SEQ ID NO: 1239875 - RNA, 25 nt, Human
uuuuguuuuuuugagacggagucuc

SEQ ID NO: 1239876 - RNA, 24 nt, Human
uuuuuaguagagacaggguuucac

SEQ ID NO: 1239877 - RNA, 21 nt, Human
uuuuuguauuuuuaguagaga

SEQ ID NO: 1239878 - RNA, 21 nt, Human
uuuuuuguauuuuuaguagag

SEQ ID NO: 1239879 - RNA, 24 nt, Human
uuuuuuguauuuuuaguagagaca

SEQ ID NO: 1239880 - RNA, 21 nt, Human
aaaggcucaauuccugccuuc

SEQ ID NO: 1239881 - RNA, 22 nt, Human
aacacaagaaaagaaugacuca

SEQ ID NO: 1239882 - RNA, 24 nt, Human
aacaggaacucaccaccaggucua

SEQ ID NO: 1239883 - RNA, 19 nt, Human
aagacaaggcagaaaagca

SEQ ID NO: 1239884 - RNA, 23 nt, Human
aagaggucaaaucagcugugccc

SEQ ID NO: 1239885 - RNA, 18 nt, Human
aaggauggggagucagcc

SEQ ID NO: 1239886 - RNA, 22 nt, Human
aaggugauuucauugcuacaga

SEQ ID NO: 1239887 - RNA, 22 nt, Human
aauggaggaauguuuuucugaa

SEQ ID NO: 1239888 - RNA, 23 nt, Human
acagggaaggaaaaaaauaccag

SEQ ID NO: 1239889 - RNA, 24 nt, Human
acccaacuccccauuccuugccuu

SEQ ID NO: 1239890 - RNA, 25 nt, Human
acccugaaaucgccuuugcaaaaau

SEQ ID NO: 1239891 - RNA, 23 nt, Human
acccugguguagaauauuaaucu

SEQ ID NO: 1239892 - RNA, 19 nt, Human
accuuccucuaggauuguu
